United States Patent 11,369,692 (MATERIALS AND METHODS FOR TREATMENT OF DUCHENNE MUSCULAR DYSTROPHY) - sequence listing, part 11

SEQ ID NO: 341725 - DNA, 20 bp, Artificial Sequence
  chemically synthesized
ttgcctgttcactctgatgg

SEQ ID NO: 341726 - DNA, 20 bp, Artificial Sequence
  chemically synthesized
aggttgcctgttcactctga

SEQ ID NO: 341727 - DNA, 20 bp, Artificial Sequence
  chemically synthesized
gaaactaccatcagagtgaa

SEQ ID NO: 341728 - DNA, 20 bp, Artificial Sequence
  chemically synthesized
aaactaccatcagagtgaac

SEQ ID NO: 341729 - DNA, 20 bp, Artificial Sequence
  chemically synthesized
tgaacaggcaacctacaaaa

SEQ ID NO: 341730 - DNA, 20 bp, Artificial Sequence
  chemically synthesized
gaacaggcaacctacaaaat

SEQ ID NO: 341731 - DNA, 20 bp, Artificial Sequence
  chemically synthesized
aaaattttctcccattttgt

SEQ ID NO: 341732 - DNA, 20 bp, Artificial Sequence
  chemically synthesized
aaaaattttctcccattttg

SEQ ID NO: 341733 - DNA, 20 bp, Artificial Sequence
  chemically synthesized
acaggcaacctacaaaatgg

SEQ ID NO: 341734 - DNA, 20 bp, Artificial Sequence
  chemically synthesized
tagccctttgtcagatgagt

SEQ ID NO: 341735 - DNA, 20 bp, Artificial Sequence
  chemically synthesized
ttagccctttgtcagatgag

SEQ ID NO: 341736 - DNA, 20 bp, Artificial Sequence
  chemically synthesized
atattagccctttgtcagat

SEQ ID NO: 341737 - DNA, 20 bp, Artificial Sequence
  chemically synthesized
tgcaacctactcatctgaca

SEQ ID NO: 341738 - DNA, 20 bp, Artificial Sequence
  chemically synthesized
gcaacctactcatctgacaa

SEQ ID NO: 341739 - DNA, 20 bp, Artificial Sequence
  chemically synthesized
caacctactcatctgacaaa

SEQ ID NO: 341740 - DNA, 20 bp, Artificial Sequence
  chemically synthesized
tctggatattagccctttgt

SEQ ID NO: 341741 - DNA, 20 bp, Artificial Sequence
  chemically synthesized
tctgacaaagggctaatatc

SEQ ID NO: 341742 - DNA, 20 bp, Artificial Sequence
  chemically synthesized
tcattgtagattctggatat

SEQ ID NO: 341743 - DNA, 20 bp, Artificial Sequence
  chemically synthesized
tttgagttcattgtagattc

SEQ ID NO: 341744 - DNA, 20 bp, Artificial Sequence
  chemically synthesized
aaatttgtttgagttcattg

SEQ ID NO: 341745 - DNA, 20 bp, Artificial Sequence
  chemically synthesized
tttttcttgtaaatttgttt

SEQ ID NO: 341746 - DNA, 20 bp, Artificial Sequence
  chemically synthesized
atgaactcaaacaaatttac

SEQ ID NO: 341747 - DNA, 20 bp, Artificial Sequence
  chemically synthesized
aaacaaacaaccccatcaaa

SEQ ID NO: 341748 - DNA, 20 bp, Artificial Sequence
  chemically synthesized
ccttcgcccactttttgatg

SEQ ID NO: 341749 - DNA, 20 bp, Artificial Sequence
  chemically synthesized
tccttcgcccactttttgat

SEQ ID NO: 341750 - DNA, 20 bp, Artificial Sequence
  chemically synthesized
gtccttcgcccactttttga

SEQ ID NO: 341751 - DNA, 20 bp, Artificial Sequence
  chemically synthesized
caaacaaccccatcaaaaag

SEQ ID NO: 341752 - DNA, 20 bp, Artificial Sequence
  chemically synthesized
aaacaaccccatcaaaaagt

SEQ ID NO: 341753 - DNA, 20 bp, Artificial Sequence
  chemically synthesized
accccatcaaaaagtgggcg

SEQ ID NO: 341754 - DNA, 20 bp, Artificial Sequence
  chemically synthesized
ccccatcaaaaagtgggcga

SEQ ID NO: 341755 - DNA, 20 bp, Artificial Sequence
  chemically synthesized
aagtgggcgaaggacatgaa

SEQ ID NO: 341756 - DNA, 20 bp, Artificial Sequence
  chemically synthesized
catgaacagacaattctcaa

SEQ ID NO: 341757 - DNA, 20 bp, Artificial Sequence
  chemically synthesized
gaacagacaattctcaaaag

SEQ ID NO: 341758 - DNA, 20 bp, Artificial Sequence
  chemically synthesized
ctgcataaatgtcttctttt

SEQ ID NO: 341759 - DNA, 20 bp, Artificial Sequence
  chemically synthesized
ctcaaaagaagacatttatg

SEQ ID NO: 341760 - DNA, 20 bp, Artificial Sequence
  chemically synthesized
gaagacatttatgcagccaa

SEQ ID NO: 341761 - DNA, 20 bp, Artificial Sequence
  chemically synthesized
gcattttttcatgtgtcttt

SEQ ID NO: 341762 - DNA, 20 bp, Artificial Sequence
  chemically synthesized
ctctgatgcccagtgatgat

SEQ ID NO: 341763 - DNA, 20 bp, Artificial Sequence
  chemically synthesized
gaaaaaatgctcatcatcac

SEQ ID NO: 341764 - DNA, 20 bp, Artificial Sequence
  chemically synthesized
aaaaaatgctcatcatcact

SEQ ID NO: 341765 - DNA, 20 bp, Artificial Sequence
  chemically synthesized
tgctcatcatcactgggcat

SEQ ID NO: 341766 - DNA, 20 bp, Artificial Sequence
  chemically synthesized
ctcatcatcactgggcatca

SEQ ID NO: 341767 - DNA, 20 bp, Artificial Sequence
  chemically synthesized
atttgcatttctctgatgcc

SEQ ID NO: 341768 - DNA, 20 bp, Artificial Sequence
  chemically synthesized
atgcaaatcaaaaccacaat

SEQ ID NO: 341769 - DNA, 20 bp, Artificial Sequence
  chemically synthesized
tgtgagatggtatctcattg

SEQ ID NO: 341770 - DNA, 20 bp, Artificial Sequence
  chemically synthesized
ccattctaactggtgtgaga

SEQ ID NO: 341771 - DNA, 20 bp, Artificial Sequence
  chemically synthesized
aatgagataccatctcacac

SEQ ID NO: 341772 - DNA, 20 bp, Artificial Sequence
  chemically synthesized
atcgccattctaactggtgt

SEQ ID NO: 341773 - DNA, 20 bp, Artificial Sequence
  chemically synthesized
agataccatctcacaccagt

SEQ ID NO: 341774 - DNA, 20 bp, Artificial Sequence
  chemically synthesized
ccatctcacaccagttagaa

SEQ ID NO: 341775 - DNA, 20 bp, Artificial Sequence
  chemically synthesized
ttaatgatcgccattctaac

SEQ ID NO: 341776 - DNA, 20 bp, Artificial Sequence
  chemically synthesized
ttagaatggcgatcattaaa

SEQ ID NO: 341777 - DNA, 20 bp, Artificial Sequence
  chemically synthesized
aatggcgatcattaaaaagt

SEQ ID NO: 341778 - DNA, 20 bp, Artificial Sequence
  chemically synthesized
atggcgatcattaaaaagtc

SEQ ID NO: 341779 - DNA, 20 bp, Artificial Sequence
  chemically synthesized
attaaaaagtcaggaaacaa

SEQ ID NO: 341780 - DNA, 20 bp, Artificial Sequence
  chemically synthesized
ttaaaaagtcaggaaacaac

SEQ ID NO: 341781 - DNA, 20 bp, Artificial Sequence
  chemically synthesized
agtcaggaaacaacaggtgc

SEQ ID NO: 341782 - DNA, 20 bp, Artificial Sequence
  chemically synthesized
tcaggaaacaacaggtgctg

SEQ ID NO: 341783 - DNA, 20 bp, Artificial Sequence
  chemically synthesized
aggaaacaacaggtgctgga

SEQ ID NO: 341784 - DNA, 20 bp, Artificial Sequence
  chemically synthesized
ggaaacaacaggtgctggag

SEQ ID NO: 341785 - DNA, 20 bp, Artificial Sequence
  chemically synthesized
ctatttctccacatcctctc

SEQ ID NO: 341786 - DNA, 20 bp, Artificial Sequence
  chemically synthesized
aacaggtgctggagaggatg

SEQ ID NO: 341787 - DNA, 20 bp, Artificial Sequence
  chemically synthesized
caggtgctggagaggatgtg

SEQ ID NO: 341788 - DNA, 20 bp, Artificial Sequence
  chemically synthesized
ctggagaggatgtggagaaa

SEQ ID NO: 341789 - DNA, 20 bp, Artificial Sequence
  chemically synthesized
tggagaggatgtggagaaat

SEQ ID NO: 341790 - DNA, 20 bp, Artificial Sequence
  chemically synthesized
cagtcccaccaacagtgaaa

SEQ ID NO: 341791 - DNA, 20 bp, Artificial Sequence
  chemically synthesized
taggaacactttttcactgt

SEQ ID NO: 341792 - DNA, 20 bp, Artificial Sequence
  chemically synthesized
gaacactttttcactgttgg

SEQ ID NO: 341793 - DNA, 20 bp, Artificial Sequence
  chemically synthesized
aacactttttcactgttggt

SEQ ID NO: 341794 - DNA, 20 bp, Artificial Sequence
  chemically synthesized
ctagtttacagtcccaccaa

SEQ ID NO: 341795 - DNA, 20 bp, Artificial Sequence
  chemically synthesized
ctgttggtgggactgtaaac

SEQ ID NO: 341796 - DNA, 20 bp, Artificial Sequence
  chemically synthesized
acaatggttgaactagttta

SEQ ID NO: 341797 - DNA, 20 bp, Artificial Sequence
  chemically synthesized
gacttccacaatggttgaac

SEQ ID NO: 341798 - DNA, 20 bp, Artificial Sequence
  chemically synthesized
gtaaactagttcaaccattg

SEQ ID NO: 341799 - DNA, 20 bp, Artificial Sequence
  chemically synthesized
aactagttcaaccattgtgg

SEQ ID NO: 341800 - DNA, 20 bp, Artificial Sequence
  chemically synthesized
ggccacactgacttccacaa

SEQ ID NO: 341801 - DNA, 20 bp, Artificial Sequence
  chemically synthesized
agttcaaccattgtggaagt

SEQ ID NO: 341802 - DNA, 20 bp, Artificial Sequence
  chemically synthesized
aaccattgtggaagtcagtg

SEQ ID NO: 341803 - DNA, 20 bp, Artificial Sequence
  chemically synthesized
aagtcagtgtggccattcct

SEQ ID NO: 341804 - DNA, 20 bp, Artificial Sequence
  chemically synthesized
agtcagtgtggccattcctc

SEQ ID NO: 341805 - DNA, 20 bp, Artificial Sequence
  chemically synthesized
gtcagtgtggccattcctca

SEQ ID NO: 341806 - DNA, 20 bp, Artificial Sequence
  chemically synthesized
agttctagatccctgaggaa

SEQ ID NO: 341807 - DNA, 20 bp, Artificial Sequence
  chemically synthesized
tttctagttctagatccctg

SEQ ID NO: 341808 - DNA, 20 bp, Artificial Sequence
  chemically synthesized
gtggccattcctcagggatc

SEQ ID NO: 341809 - DNA, 20 bp, Artificial Sequence
  chemically synthesized
atttctagttctagatccct

SEQ ID NO: 341810 - DNA, 20 bp, Artificial Sequence
  chemically synthesized
attcctcagggatctagaac

SEQ ID NO: 341811 - DNA, 20 bp, Artificial Sequence
  chemically synthesized
tcaaatgcgatttctagttc

SEQ ID NO: 341812 - DNA, 20 bp, Artificial Sequence
  chemically synthesized
gctgggtcaaatgcgatttc

SEQ ID NO: 341813 - DNA, 20 bp, Artificial Sequence
  chemically synthesized
actagaaatcgcatttgacc

SEQ ID NO: 341814 - DNA, 20 bp, Artificial Sequence
  chemically synthesized
tacccagtaacgggatggct

SEQ ID NO: 341815 - DNA, 20 bp, Artificial Sequence
  chemically synthesized
atacccagtaacgggatggc

SEQ ID NO: 341816 - DNA, 20 bp, Artificial Sequence
  chemically synthesized
gtatatacccagtaacggga

SEQ ID NO: 341817 - DNA, 20 bp, Artificial Sequence
  chemically synthesized
tgacccagccatcccgttac

SEQ ID NO: 341818 - DNA, 20 bp, Artificial Sequence
  chemically synthesized
gacccagccatcccgttact

SEQ ID NO: 341819 - DNA, 20 bp, Artificial Sequence
  chemically synthesized
atgggtatatacccagtaac

SEQ ID NO: 341820 - DNA, 20 bp, Artificial Sequence
  chemically synthesized
tatgggtatatacccagtaa

SEQ ID NO: 341821 - DNA, 20 bp, Artificial Sequence
  chemically synthesized
tagtcctatgggtatatacc

SEQ ID NO: 341822 - DNA, 20 bp, Artificial Sequence
  chemically synthesized
cgttactgggtatataccca

SEQ ID NO: 341823 - DNA, 20 bp, Artificial Sequence
  chemically synthesized
gttactgggtatatacccat

SEQ ID NO: 341824 - DNA, 20 bp, Artificial Sequence
  chemically synthesized
agcatgatttatagtcctat

SEQ ID NO: 341825 - DNA, 20 bp, Artificial Sequence
  chemically synthesized
cagcatgatttatagtccta

SEQ ID NO: 341826 - DNA, 20 bp, Artificial Sequence
  chemically synthesized
ctttatagcagcatgattta

SEQ ID NO: 341827 - DNA, 20 bp, Artificial Sequence
  chemically synthesized
ctataaatcatgctgctata

SEQ ID NO: 341828 - DNA, 20 bp, Artificial Sequence
  chemically synthesized
gtgtgcatgtgtctttatag

SEQ ID NO: 341829 - DNA, 20 bp, Artificial Sequence
  chemically synthesized
tacgtgtgcatgtgtcttta

SEQ ID NO: 341830 - DNA, 20 bp, Artificial Sequence
  chemically synthesized
atgcacacgtatgtttattg

SEQ ID NO: 341831 - DNA, 20 bp, Artificial Sequence
  chemically synthesized
tattgcggcattattcacga

SEQ ID NO: 341832 - DNA, 20 bp, Artificial Sequence
  chemically synthesized
cggcattattcacgatagca

SEQ ID NO: 341833 - DNA, 20 bp, Artificial Sequence
  chemically synthesized
tattcacgatagcaaagact

SEQ ID NO: 341834 - DNA, 20 bp, Artificial Sequence
  chemically synthesized
tggacatttgggttggttcc

SEQ ID NO: 341835 - DNA, 20 bp, Artificial Sequence
  chemically synthesized
tcattgttggacatttgggt

SEQ ID NO: 341836 - DNA, 20 bp, Artificial Sequence
  chemically synthesized
tctatcattgttggacattt

SEQ ID NO: 341837 - DNA, 20 bp, Artificial Sequence
  chemically synthesized
ctctatcattgttggacatt

SEQ ID NO: 341838 - DNA, 20 bp, Artificial Sequence
  chemically synthesized
acccaaatgtccaacaatga

SEQ ID NO: 341839 - DNA, 20 bp, Artificial Sequence
  chemically synthesized
ttaatccactctatcattgt

SEQ ID NO: 341840 - DNA, 20 bp, Artificial Sequence
  chemically synthesized
ccaaatgtccaacaatgata

SEQ ID NO: 341841 - DNA, 20 bp, Artificial Sequence
  chemically synthesized
aatgtccaacaatgatagag

SEQ ID NO: 341842 - DNA, 20 bp, Artificial Sequence
  chemically synthesized
caacaatgatagagtggatt

SEQ ID NO: 341843 - DNA, 20 bp, Artificial Sequence
  chemically synthesized
tagagtggattaagaaaatg

SEQ ID NO: 341844 - DNA, 20 bp, Artificial Sequence
  chemically synthesized
aatgtggcacatatacacca

SEQ ID NO: 341845 - DNA, 20 bp, Artificial Sequence
  chemically synthesized
tatggccgcatagcattcca

SEQ ID NO: 341846 - DNA, 20 bp, Artificial Sequence
  chemically synthesized
atacaccatggaatgctatg

SEQ ID NO: 341847 - DNA, 20 bp, Artificial Sequence
  chemically synthesized
catcattttttatggccgca

SEQ ID NO: 341848 - DNA, 20 bp, Artificial Sequence
  chemically synthesized
catgaactcatcatttttta

SEQ ID NO: 341849 - DNA, 20 bp, Artificial Sequence
  chemically synthesized
atgcggccataaaaaatgat

SEQ ID NO: 341850 - DNA, 20 bp, Artificial Sequence
  chemically synthesized
tgatgagttcatgtcctttg

SEQ ID NO: 341851 - DNA, 20 bp, Artificial Sequence
  chemically synthesized
gatgagttcatgtcctttgt

SEQ ID NO: 341852 - DNA, 20 bp, Artificial Sequence
  chemically synthesized
atgagttcatgtcctttgta

SEQ ID NO: 341853 - DNA, 20 bp, Artificial Sequence
  chemically synthesized
tttcatccatgtccctacaa

SEQ ID NO: 341854 - DNA, 20 bp, Artificial Sequence
  chemically synthesized
atttcatccatgtccctaca

SEQ ID NO: 341855 - DNA, 20 bp, Artificial Sequence
  chemically synthesized
tcatgtcctttgtagggaca

SEQ ID NO: 341856 - DNA, 20 bp, Artificial Sequence
  chemically synthesized
tgtagggacatggatgaaat

SEQ ID NO: 341857 - DNA, 20 bp, Artificial Sequence
  chemically synthesized
aaattggaaatcatcattct

SEQ ID NO: 341858 - DNA, 20 bp, Artificial Sequence
  chemically synthesized
tgttcttgcgatagtttact

SEQ ID NO: 341859 - DNA, 20 bp, Artificial Sequence
  chemically synthesized
cattctcagtaaactatcgc

SEQ ID NO: 341860 - DNA, 20 bp, Artificial Sequence
  chemically synthesized
ttggttttttgttcttgcga

SEQ ID NO: 341861 - DNA, 20 bp, Artificial Sequence
  chemically synthesized
gagtgagaatatgtggtgtt

SEQ ID NO: 341862 - DNA, 20 bp, Artificial Sequence
  chemically synthesized
cacctatgagtgagaatatg

SEQ ID NO: 341863 - DNA, 20 bp, Artificial Sequence
  chemically synthesized
acaccacatattctcactca

SEQ ID NO: 341864 - DNA, 20 bp, Artificial Sequence
  chemically synthesized
caccacatattctcactcat

SEQ ID NO: 341865 - DNA, 20 bp, Artificial Sequence
  chemically synthesized
ttcaattcccacctatgagt

SEQ ID NO: 341866 - DNA, 20 bp, Artificial Sequence
  chemically synthesized
cacatattctcactcatagg

SEQ ID NO: 341867 - DNA, 20 bp, Artificial Sequence
  chemically synthesized
acatattctcactcataggt

SEQ ID NO: 341868 - DNA, 20 bp, Artificial Sequence
  chemically synthesized
attgttcaattcccacctat

SEQ ID NO: 341869 - DNA, 20 bp, Artificial Sequence
  chemically synthesized
ataggtgggaattgaacaat

SEQ ID NO: 341870 - DNA, 20 bp, Artificial Sequence
  chemically synthesized
aattgaacaatgagaacaca

SEQ ID NO: 341871 - DNA, 20 bp, Artificial Sequence
  chemically synthesized
acaatgagaacacatggaca

SEQ ID NO: 341872 - DNA, 20 bp, Artificial Sequence
  chemically synthesized
caatgagaacacatggacac

SEQ ID NO: 341873 - DNA, 20 bp, Artificial Sequence
  chemically synthesized
tgagaacacatggacacagg

SEQ ID NO: 341874 - DNA, 20 bp, Artificial Sequence
  chemically synthesized
gagaacacatggacacagga

SEQ ID NO: 341875 - DNA, 20 bp, Artificial Sequence
  chemically synthesized
agaacacatggacacaggaa

SEQ ID NO: 341876 - DNA, 20 bp, Artificial Sequence
  chemically synthesized
gaacacatggacacaggaag

SEQ ID NO: 341877 - DNA, 20 bp, Artificial Sequence
  chemically synthesized
ggaaggggaacaccacactc

SEQ ID NO: 341878 - DNA, 20 bp, Artificial Sequence
  chemically synthesized
gaaggggaacaccacactct

SEQ ID NO: 341879 - DNA, 20 bp, Artificial Sequence
  chemically synthesized
aaggggaacaccacactctg

SEQ ID NO: 341880 - DNA, 20 bp, Artificial Sequence
  chemically synthesized
ccaccacagtccccagagtg

SEQ ID NO: 341881 - DNA, 20 bp, Artificial Sequence
  chemically synthesized
ccaccccaccacagtcccca

SEQ ID NO: 341882 - DNA, 20 bp, Artificial Sequence
  chemically synthesized
acaccacactctggggactg

SEQ ID NO: 341883 - DNA, 20 bp, Artificial Sequence
  chemically synthesized
ccccaccccaccacagtccc

SEQ ID NO: 341884 - DNA, 20 bp, Artificial Sequence
  chemically synthesized
ccacactctggggactgtgg

SEQ ID NO: 341885 - DNA, 20 bp, Artificial Sequence
  chemically synthesized
cacactctggggactgtggt

SEQ ID NO: 341886 - DNA, 20 bp, Artificial Sequence
  chemically synthesized
acactctggggactgtggtg

SEQ ID NO: 341887 - DNA, 20 bp, Artificial Sequence
  chemically synthesized
cccctccccccaccccacca

SEQ ID NO: 341888 - DNA, 20 bp, Artificial Sequence
  chemically synthesized
ctctggggactgtggtgggg

SEQ ID NO: 341889 - DNA, 20 bp, Artificial Sequence
  chemically synthesized
tctggggactgtggtggggt

SEQ ID NO: 341890 - DNA, 20 bp, Artificial Sequence
  chemically synthesized
ctggggactgtggtggggtg

SEQ ID NO: 341891 - DNA, 20 bp, Artificial Sequence
  chemically synthesized
tggggactgtggtggggtgg

SEQ ID NO: 341892 - DNA, 20 bp, Artificial Sequence
  chemically synthesized
ggggactgtggtggggtggg

SEQ ID NO: 341893 - DNA, 20 bp, Artificial Sequence
  chemically synthesized
ggactgtggtggggtggggg

SEQ ID NO: 341894 - DNA, 20 bp, Artificial Sequence
  chemically synthesized
gactgtggtggggtgggggg

SEQ ID NO: 341895 - DNA, 20 bp, Artificial Sequence
  chemically synthesized
actgtggtggggtgggggga

SEQ ID NO: 341896 - DNA, 20 bp, Artificial Sequence
  chemically synthesized
ctgtggtggggtggggggag

SEQ ID NO: 341897 - DNA, 20 bp, Artificial Sequence
  chemically synthesized
tgtggtggggtggggggagg

SEQ ID NO: 341898 - DNA, 20 bp, Artificial Sequence
  chemically synthesized
ggtggggtggggggaggggg

SEQ ID NO: 341899 - DNA, 20 bp, Artificial Sequence
  chemically synthesized
gtggggtggggggagggggt

SEQ ID NO: 341900 - DNA, 20 bp, Artificial Sequence
  chemically synthesized
tggggtggggggagggggta

SEQ ID NO: 341901 - DNA, 20 bp, Artificial Sequence
  chemically synthesized
gtggggggagggggtaggga

SEQ ID NO: 341902 - DNA, 20 bp, Artificial Sequence
  chemically synthesized
ggagggggtagggatagcac

SEQ ID NO: 341903 - DNA, 20 bp, Artificial Sequence
  chemically synthesized
gagggggtagggatagcact

SEQ ID NO: 341904 - DNA, 20 bp, Artificial Sequence
  chemically synthesized
gggggtagggatagcactgg

SEQ ID NO: 341905 - DNA, 20 bp, Artificial Sequence
  chemically synthesized
ctagcattagataaatctcc

SEQ ID NO: 341906 - DNA, 20 bp, Artificial Sequence
  chemically synthesized
ctgggagatttatctaatgc

SEQ ID NO: 341907 - DNA, 20 bp, Artificial Sequence
  chemically synthesized
actaactcgtcatctagcat

SEQ ID NO: 341908 - DNA, 20 bp, Artificial Sequence
  chemically synthesized
tttatctaatgctagatgac

SEQ ID NO: 341909 - DNA, 20 bp, Artificial Sequence
  chemically synthesized
gcacccactaactcgtcatc

SEQ ID NO: 341910 - DNA, 20 bp, Artificial Sequence
  chemically synthesized
tctaatgctagatgacgagt

SEQ ID NO: 341911 - DNA, 20 bp, Artificial Sequence
  chemically synthesized
aatgctagatgacgagttag

SEQ ID NO: 341912 - DNA, 20 bp, Artificial Sequence
  chemically synthesized
atgctagatgacgagttagt

SEQ ID NO: 341913 - DNA, 20 bp, Artificial Sequence
  chemically synthesized
agatgacgagttagtgggtg

SEQ ID NO: 341914 - DNA, 20 bp, Artificial Sequence
  chemically synthesized
agttagtgggtgcagcgcac

SEQ ID NO: 341915 - DNA, 20 bp, Artificial Sequence
  chemically synthesized
gtgggtgcagcgcaccagca

SEQ ID NO: 341916 - DNA, 20 bp, Artificial Sequence
  chemically synthesized
tacgtatacatgtgccatgc

SEQ ID NO: 341917 - DNA, 20 bp, Artificial Sequence
  chemically synthesized
catgtgcacattgtgcaggt

SEQ ID NO: 341918 - DNA, 20 bp, Artificial Sequence
  chemically synthesized
ggtacatgtgcacattgtgc

SEQ ID NO: 341919 - DNA, 20 bp, Artificial Sequence
  chemically synthesized
gggtacatgtgcacattgtg

SEQ ID NO: 341920 - DNA, 20 bp, Artificial Sequence
  chemically synthesized
caatgtgcacatgtacccta

SEQ ID NO: 341921 - DNA, 20 bp, Artificial Sequence
  chemically synthesized
ttattatactttaagcttta

SEQ ID NO: 341922 - DNA, 20 bp, Artificial Sequence
  chemically synthesized
attattatactttaagcttt

SEQ ID NO: 341923 - DNA, 20 bp, Artificial Sequence
  chemically synthesized
cacatgtaccctaaagctta

SEQ ID NO: 341924 - DNA, 20 bp, Artificial Sequence
  chemically synthesized
tattattatactttaagctt

SEQ ID NO: 341925 - DNA, 20 bp, Artificial Sequence
  chemically synthesized
ttcttttattattatacttt

SEQ ID NO: 341926 - DNA, 20 bp, Artificial Sequence
  chemically synthesized
agcttaaagtataataataa

SEQ ID NO: 341927 - DNA, 20 bp, Artificial Sequence
  chemically synthesized
tttggtttgctgaaattttt

SEQ ID NO: 341928 - DNA, 20 bp, Artificial Sequence
  chemically synthesized
aaaaaaaaacttaaaaattt

SEQ ID NO: 341929 - DNA, 20 bp, Artificial Sequence
  chemically synthesized
ggttattttaacaaacattt

SEQ ID NO: 341930 - DNA, 20 bp, Artificial Sequence
  chemically synthesized
ttggatatatatgtggttaa

SEQ ID NO: 341931 - DNA, 20 bp, Artificial Sequence
  chemically synthesized
tgaatatttggatatatatg

SEQ ID NO: 341932 - DNA, 20 bp, Artificial Sequence
  chemically synthesized
ttttatatataatgaatatt

SEQ ID NO: 341933 - DNA, 20 bp, Artificial Sequence
  chemically synthesized
tttatgagcatgatatttta

SEQ ID NO: 341934 - DNA, 20 bp, Artificial Sequence
  chemically synthesized
taaaatatcatgctcataaa

SEQ ID NO: 341935 - DNA, 20 bp, Artificial Sequence
  chemically synthesized
aaatatcatgctcataaata

SEQ ID NO: 341936 - DNA, 20 bp, Artificial Sequence
  chemically synthesized
ttaaaacttactctatttat

SEQ ID NO: 341937 - DNA, 20 bp, Artificial Sequence
  chemically synthesized
atcatgctcataaatagagt

SEQ ID NO: 341938 - DNA, 20 bp, Artificial Sequence
  chemically synthesized
atagagtaagttttaattaa

SEQ ID NO: 341939 - DNA, 20 bp, Artificial Sequence
  chemically synthesized
tagagtaagttttaattaac

SEQ ID NO: 341940 - DNA, 20 bp, Artificial Sequence
  chemically synthesized
gtgatttttattttttggta

SEQ ID NO: 341941 - DNA, 20 bp, Artificial Sequence
  chemically synthesized
tggtggtgatttttattttt

SEQ ID NO: 341942 - DNA, 20 bp, Artificial Sequence
  chemically synthesized
gttgctgttggtggtggtgg

SEQ ID NO: 341943 - DNA, 20 bp, Artificial Sequence
  chemically synthesized
gttgttgctgttggtggtgg

SEQ ID NO: 341944 - DNA, 20 bp, Artificial Sequence
  chemically synthesized
atcaccaccaccaccaccaa

SEQ ID NO: 341945 - DNA, 20 bp, Artificial Sequence
  chemically synthesized
tttgttgttgctgttggtgg

SEQ ID NO: 341946 - DNA, 20 bp, Artificial Sequence
  chemically synthesized
ccttttgttgttgctgttgg

SEQ ID NO: 341947 - DNA, 20 bp, Artificial Sequence
  chemically synthesized
cccccttttgttgttgctgt

SEQ ID NO: 341948 - DNA, 20 bp, Artificial Sequence
  chemically synthesized
accaccaacagcaacaacaa

SEQ ID NO: 341949 - DNA, 20 bp, Artificial Sequence
  chemically synthesized
ccaccaacagcaacaacaaa

SEQ ID NO: 341950 - DNA, 20 bp, Artificial Sequence
  chemically synthesized
caccaacagcaacaacaaaa

SEQ ID NO: 341951 - DNA, 20 bp, Artificial Sequence
  chemically synthesized
accaacagcaacaacaaaag

SEQ ID NO: 341952 - DNA, 20 bp, Artificial Sequence
  chemically synthesized
ccaacagcaacaacaaaagg

SEQ ID NO: 341953 - DNA, 20 bp, Artificial Sequence
  chemically synthesized
caacagcaacaacaaaaggg

SEQ ID NO: 341954 - DNA, 20 bp, Artificial Sequence
  chemically synthesized
aacagcaacaacaaaagggg

SEQ ID NO: 341955 - DNA, 20 bp, Artificial Sequence
  chemically synthesized
acagcaacaacaaaaggggg

SEQ ID NO: 341956 - DNA, 20 bp, Artificial Sequence
  chemically synthesized
tcaagaaaaaaaaaattata

SEQ ID NO: 341957 - DNA, 20 bp, Artificial Sequence
  chemically synthesized
ttttttttttcttgaaaact

SEQ ID NO: 341958 - DNA, 20 bp, Artificial Sequence
  chemically synthesized
gccatttgggctgagttttc

SEQ ID NO: 341959 - DNA, 20 bp, Artificial Sequence
  chemically synthesized
accaggtggccatttgggct

SEQ ID NO: 341960 - DNA, 20 bp, Artificial Sequence
  chemically synthesized
tcttgaaaactcagcccaaa

SEQ ID NO: 341961 - DNA, 20 bp, Artificial Sequence
  chemically synthesized
gaagcaccaggtggccattt

SEQ ID NO: 341962 - DNA, 20 bp, Artificial Sequence
  chemically synthesized
tgaagcaccaggtggccatt

SEQ ID NO: 341963 - DNA, 20 bp, Artificial Sequence
  chemically synthesized
actcagcccaaatggccacc

SEQ ID NO: 341964 - DNA, 20 bp, Artificial Sequence
  chemically synthesized
tcacgtcttgaagcaccagg

SEQ ID NO: 341965 - DNA, 20 bp, Artificial Sequence
  chemically synthesized
acttcacgtcttgaagcacc

SEQ ID NO: 341966 - DNA, 20 bp, Artificial Sequence
  chemically synthesized
aaatggccacctggtgcttc

SEQ ID NO: 341967 - DNA, 20 bp, Artificial Sequence
  chemically synthesized
cacttcacgtcttgaagcac

SEQ ID NO: 341968 - DNA, 20 bp, Artificial Sequence
  chemically synthesized
tattcacacttcacgtcttg

SEQ ID NO: 341969 - DNA, 20 bp, Artificial Sequence
  chemically synthesized
acctggtgcttcaagacgtg

SEQ ID NO: 341970 - DNA, 20 bp, Artificial Sequence
  chemically synthesized
gtgtgaatacatgtttcact

SEQ ID NO: 341971 - DNA, 20 bp, Artificial Sequence
  chemically synthesized
aaaagatattattttattcc

SEQ ID NO: 341972 - DNA, 20 bp, Artificial Sequence
  chemically synthesized
aatctggatgtaaataagaa

SEQ ID NO: 341973 - DNA, 20 bp, Artificial Sequence
  chemically synthesized
tttgaaatctggatgtaaat

SEQ ID NO: 341974 - DNA, 20 bp, Artificial Sequence
  chemically synthesized
tatcttttcttatttacatc

SEQ ID NO: 341975 - DNA, 20 bp, Artificial Sequence
  chemically synthesized
gtaaaatggagtttgaaatc

SEQ ID NO: 341976 - DNA, 20 bp, Artificial Sequence
  chemically synthesized
tttgtgttcaaggtaaaatg

SEQ ID NO: 341977 - DNA, 20 bp, Artificial Sequence
  chemically synthesized
actttgtgttcaaggtaaaa

SEQ ID NO: 341978 - DNA, 20 bp, Artificial Sequence
  chemically synthesized
atcacattactttgtgttca

SEQ ID NO: 341979 - DNA, 20 bp, Artificial Sequence
  chemically synthesized
tccattttaccttgaacaca

SEQ ID NO: 341980 - DNA, 20 bp, Artificial Sequence
  chemically synthesized
aatcacattactttgtgttc

SEQ ID NO: 341981 - DNA, 20 bp, Artificial Sequence
  chemically synthesized
gaacacaaagtaatgtgatt

SEQ ID NO: 341982 - DNA, 20 bp, Artificial Sequence
  chemically synthesized
aaagtaatgtgatttagtgt

SEQ ID NO: 341983 - DNA, 20 bp, Artificial Sequence
  chemically synthesized
aagtaatgtgatttagtgtg

SEQ ID NO: 341984 - DNA, 20 bp, Artificial Sequence
  chemically synthesized
aatgtgatttagtgtgagga

SEQ ID NO: 341985 - DNA, 20 bp, Artificial Sequence
  chemically synthesized
tgatttagtgtgaggaaaga

SEQ ID NO: 341986 - DNA, 20 bp, Artificial Sequence
  chemically synthesized
gatttagtgtgaggaaagaa

SEQ ID NO: 341987 - DNA, 20 bp, Artificial Sequence
  chemically synthesized
tagtgtgaggaaagaaagga

SEQ ID NO: 341988 - DNA, 20 bp, Artificial Sequence
  chemically synthesized
aatagtcattttcatagaaa

SEQ ID NO: 341989 - DNA, 20 bp, Artificial Sequence
  chemically synthesized
ccataaaatagtcattttca

SEQ ID NO: 341990 - DNA, 20 bp, Artificial Sequence
  chemically synthesized
ctatgaaaatgactatttta

SEQ ID NO: 341991 - DNA, 20 bp, Artificial Sequence
  chemically synthesized
tattagaaaataccataaaa

SEQ ID NO: 341992 - DNA, 20 bp, Artificial Sequence
  chemically synthesized
ttatggtattttctaataat

SEQ ID NO: 341993 - DNA, 20 bp, Artificial Sequence
  chemically synthesized
tatggtattttctaataatt

SEQ ID NO: 341994 - DNA, 20 bp, Artificial Sequence
  chemically synthesized
gttttataagacctaattat

SEQ ID NO: 341995 - DNA, 20 bp, Artificial Sequence
  chemically synthesized
aaacattggggaagttttat

SEQ ID NO: 341996 - DNA, 20 bp, Artificial Sequence
  chemically synthesized
ttgtagtaaaaacattgggg

SEQ ID NO: 341997 - DNA, 20 bp, Artificial Sequence
  chemically synthesized
gcattgtagtaaaaacattg

SEQ ID NO: 341998 - DNA, 20 bp, Artificial Sequence
  chemically synthesized
agcattgtagtaaaaacatt

SEQ ID NO: 341999 - DNA, 20 bp, Artificial Sequence
  chemically synthesized
cagcattgtagtaaaaacat

SEQ ID NO: 342000 - DNA, 20 bp, Artificial Sequence
  chemically synthesized
caatgtttttactacaatgc

SEQ ID NO: 342001 - DNA, 20 bp, Artificial Sequence
  chemically synthesized
gctgtggtctaccagcattg

SEQ ID NO: 342002 - DNA, 20 bp, Artificial Sequence
  chemically synthesized
tgtttttactacaatgctgg

SEQ ID NO: 342003 - DNA, 20 bp, Artificial Sequence
  chemically synthesized
acagactggctgtggtctac

SEQ ID NO: 342004 - DNA, 20 bp, Artificial Sequence
  chemically synthesized
actacaatgctggtagacca

SEQ ID NO: 342005 - DNA, 20 bp, Artificial Sequence
  chemically synthesized
caatgctggtagaccacagc

SEQ ID NO: 342006 - DNA, 20 bp, Artificial Sequence
  chemically synthesized
ggagcaagacagactggctg

SEQ ID NO: 342007 - DNA, 20 bp, Artificial Sequence
  chemically synthesized
aatcctggagcaagacagac

SEQ ID NO: 342008 - DNA, 20 bp, Artificial Sequence
  chemically synthesized
tcagaaatcctggagcaaga

SEQ ID NO: 342009 - DNA, 20 bp, Artificial Sequence
  chemically synthesized
acagccagtctgtcttgctc

SEQ ID NO: 342010 - DNA, 20 bp, Artificial Sequence
  chemically synthesized
cagccagtctgtcttgctcc

SEQ ID NO: 342011 - DNA, 20 bp, Artificial Sequence
  chemically synthesized
atcatcagaaatcctggagc

SEQ ID NO: 342012 - DNA, 20 bp, Artificial Sequence
  chemically synthesized
taagatcatcagaaatcctg

SEQ ID NO: 342013 - DNA, 20 bp, Artificial Sequence
  chemically synthesized
aataagatcatcagaaatcc

SEQ ID NO: 342014 - DNA, 20 bp, Artificial Sequence
  chemically synthesized
ttttaatggaataagatcat

SEQ ID NO: 342015 - DNA, 20 bp, Artificial Sequence
  chemically synthesized
gtctttttttttaatggaat

SEQ ID NO: 342016 - DNA, 20 bp, Artificial Sequence
  chemically synthesized
tgtggagtctttttttttaa

SEQ ID NO: 342017 - DNA, 20 bp, Artificial Sequence
  chemically synthesized
atcttattccattaaaaaaa

SEQ ID NO: 342018 - DNA, 20 bp, Artificial Sequence
  chemically synthesized
attaaaaaaaaagactccac

SEQ ID NO: 342019 - DNA, 20 bp, Artificial Sequence
  chemically synthesized
tttagttttcaagacttgtg

SEQ ID NO: 342020 - DNA, 20 bp, Artificial Sequence
  chemically synthesized
agtttagttttcaagacttg

SEQ ID NO: 342021 - DNA, 20 bp, Artificial Sequence
  chemically synthesized
gctaatatagtttagttttc

SEQ ID NO: 342022 - DNA, 20 bp, Artificial Sequence
  chemically synthesized
aactacatgctaatatagtt

SEQ ID NO: 342023 - DNA, 20 bp, Artificial Sequence
  chemically synthesized
tcttgaaaactaaactatat

SEQ ID NO: 342024 - DNA, 20 bp, Artificial Sequence
  chemically synthesized
cccaaaactacatgctaata

SEQ ID NO: 342025 - DNA, 20 bp, Artificial Sequence
  chemically synthesized
aactaaactatattagcatg

SEQ ID NO: 342026 - DNA, 20 bp, Artificial Sequence
  chemically synthesized
actatattagcatgtagttt

SEQ ID NO: 342027 - DNA, 20 bp, Artificial Sequence
  chemically synthesized
ctatattagcatgtagtttt

SEQ ID NO: 342028 - DNA, 20 bp, Artificial Sequence
  chemically synthesized
gggttgatacaaacttctct

SEQ ID NO: 342029 - DNA, 20 bp, Artificial Sequence
  chemically synthesized
aatgggaatgcagctgagag

SEQ ID NO: 342030 - DNA, 20 bp, Artificial Sequence
  chemically synthesized
tctaatgggaatgcagctga

SEQ ID NO: 342031 - DNA, 20 bp, Artificial Sequence
  chemically synthesized
tatctaatgggaatgcagct

SEQ ID NO: 342032 - DNA, 20 bp, Artificial Sequence
  chemically synthesized
agttttatctaatgggaatg

SEQ ID NO: 342033 - DNA, 20 bp, Artificial Sequence
  chemically synthesized
tctctcagctgcattcccat

SEQ ID NO: 342034 - DNA, 20 bp, Artificial Sequence
  chemically synthesized
atcattcagttttatctaat

SEQ ID NO: 342035 - DNA, 20 bp, Artificial Sequence
  chemically synthesized
catcattcagttttatctaa

SEQ ID NO: 342036 - DNA, 20 bp, Artificial Sequence
  chemically synthesized
caagtttccaatgcatcatt

SEQ ID NO: 342037 - DNA, 20 bp, Artificial Sequence
  chemically synthesized
gataaaactgaatgatgcat

SEQ ID NO: 342038 - DNA, 20 bp, Artificial Sequence
  chemically synthesized
tgaatgatgcattggaaact

SEQ ID NO: 342039 - DNA, 20 bp, Artificial Sequence
  chemically synthesized
gatacatgtttttaatttcc

SEQ ID NO: 342040 - DNA, 20 bp, Artificial Sequence
  chemically synthesized
aaattaaaaacatgtatctg

SEQ ID NO: 342041 - DNA, 20 bp, Artificial Sequence
  chemically synthesized
ttaaaaacatgtatctgtgg

SEQ ID NO: 342042 - DNA, 20 bp, Artificial Sequence
  chemically synthesized
aaacatgtatctgtggcaga

SEQ ID NO: 342043 - DNA, 20 bp, Artificial Sequence
  chemically synthesized
gcagtattatctttctgcca

SEQ ID NO: 342044 - DNA, 20 bp, Artificial Sequence
  chemically synthesized
aaaaagaaaaatggtgtgtg

SEQ ID NO: 342045 - DNA, 20 bp, Artificial Sequence
  chemically synthesized
tgaagcagcaaaaagaaaaa

SEQ ID NO: 342046 - DNA, 20 bp, Artificial Sequence
  chemically synthesized
tgatttagtgaagcagcaaa

SEQ ID NO: 342047 - DNA, 20 bp, Artificial Sequence
  chemically synthesized
catcaactgatttagtgaag

SEQ ID NO: 342048 - DNA, 20 bp, Artificial Sequence
  chemically synthesized
cagcatcaactgatttagtg

SEQ ID NO: 342049 - DNA, 20 bp, Artificial Sequence
  chemically synthesized
tttttgctgcttcactaaat

SEQ ID NO: 342050 - DNA, 20 bp, Artificial Sequence
  chemically synthesized
gtgttcagcatcaactgatt

SEQ ID NO: 342051 - DNA, 20 bp, Artificial Sequence
  chemically synthesized
tatacaccttattgcgtgtt

SEQ ID NO: 342052 - DNA, 20 bp, Artificial Sequence
  chemically synthesized
gttgatgctgaacacgcaat

SEQ ID NO: 342053 - DNA, 20 bp, Artificial Sequence
  chemically synthesized
ttgatgctgaacacgcaata

SEQ ID NO: 342054 - DNA, 20 bp, Artificial Sequence
  chemically synthesized
tgaacacgcaataaggtgta

SEQ ID NO: 342055 - DNA, 20 bp, Artificial Sequence
  chemically synthesized
gaacacgcaataaggtgtat

SEQ ID NO: 342056 - DNA, 20 bp, Artificial Sequence
  chemically synthesized
acgcaataaggtgtataggc

SEQ ID NO: 342057 - DNA, 20 bp, Artificial Sequence
  chemically synthesized
cgcaataaggtgtataggcc

SEQ ID NO: 342058 - DNA, 20 bp, Artificial Sequence
  chemically synthesized
aggtgtataggccaggccca

SEQ ID NO: 342059 - DNA, 20 bp, Artificial Sequence
  chemically synthesized
accaaaaggagctgtgggcc

SEQ ID NO: 342060 - DNA, 20 bp, Artificial Sequence
  chemically synthesized
acctgaccaaaaggagctgt

SEQ ID NO: 342061 - DNA, 20 bp, Artificial Sequence
  chemically synthesized
cacctgaccaaaaggagctg

SEQ ID NO: 342062 - DNA, 20 bp, Artificial Sequence
  chemically synthesized
gccaggcccacagctccttt

SEQ ID NO: 342063 - DNA, 20 bp, Artificial Sequence
  chemically synthesized
taattgcacctgaccaaaag

SEQ ID NO: 342064 - DNA, 20 bp, Artificial Sequence
  chemically synthesized
ggcccacagctccttttggt

SEQ ID NO: 342065 - DNA, 20 bp, Artificial Sequence
  chemically synthesized
gcccacagctccttttggtc

SEQ ID NO: 342066 - DNA, 20 bp, Artificial Sequence
  chemically synthesized
cctaattgcacctgaccaaa

SEQ ID NO: 342067 - DNA, 20 bp, Artificial Sequence
  chemically synthesized
tcctaattgcacctgaccaa

SEQ ID NO: 342068 - DNA, 20 bp, Artificial Sequence
  chemically synthesized
tccttttggtcaggtgcaat

SEQ ID NO: 342069 - DNA, 20 bp, Artificial Sequence
  chemically synthesized
ccttttggtcaggtgcaatt

SEQ ID NO: 342070 - DNA, 20 bp, Artificial Sequence
  chemically synthesized
cattagaagacagttaacat

SEQ ID NO: 342071 - DNA, 20 bp, Artificial Sequence
  chemically synthesized
tgatgtaacgcattagaaga

SEQ ID NO: 342072 - DNA, 20 bp, Artificial Sequence
  chemically synthesized
ctattgatgtaacgcattag

SEQ ID NO: 342073 - DNA, 20 bp, Artificial Sequence
  chemically synthesized
gtactattgatgtaacgcat

SEQ ID NO: 342074 - DNA, 20 bp, Artificial Sequence
  chemically synthesized
cttctaatgcgttacatcaa

SEQ ID NO: 342075 - DNA, 20 bp, Artificial Sequence
  chemically synthesized
tacatcaatagtacatgaat

SEQ ID NO: 342076 - DNA, 20 bp, Artificial Sequence
  chemically synthesized
atagtacatgaatgagtaat

SEQ ID NO: 342077 - DNA, 20 bp, Artificial Sequence
  chemically synthesized
cacatattttgcaaaagtta

SEQ ID NO: 342078 - DNA, 20 bp, Artificial Sequence
  chemically synthesized
ttcacatattttgcaaaagt

SEQ ID NO: 342079 - DNA, 20 bp, Artificial Sequence
  chemically synthesized
tttgttcacatattttgcaa

SEQ ID NO: 342080 - DNA, 20 bp, Artificial Sequence
  chemically synthesized
gataatgagtttgtgagtag

SEQ ID NO: 342081 - DNA, 20 bp, Artificial Sequence
  chemically synthesized
ttggataatgagtttgtgag

SEQ ID NO: 342082 - DNA, 20 bp, Artificial Sequence
  chemically synthesized
ttgttggataatgagtttgt

SEQ ID NO: 342083 - DNA, 20 bp, Artificial Sequence
  chemically synthesized
aaataaatttgttggataat

SEQ ID NO: 342084 - DNA, 20 bp, Artificial Sequence
  chemically synthesized
gagggcaaaaataaatttgt

SEQ ID NO: 342085 - DNA, 20 bp, Artificial Sequence
  chemically synthesized
tataagtttattttttgtga

SEQ ID NO: 342086 - DNA, 20 bp, Artificial Sequence
  chemically synthesized
ttataagtttattttttgtg

SEQ ID NO: 342087 - DNA, 20 bp, Artificial Sequence
  chemically synthesized
gttataagtttattttttgt

SEQ ID NO: 342088 - DNA, 20 bp, Artificial Sequence
  chemically synthesized
tttatttttttgtcagttat

SEQ ID NO: 342089 - DNA, 20 bp, Artificial Sequence
  chemically synthesized
tttcttttttatttttttgt

SEQ ID NO: 342090 - DNA, 20 bp, Artificial Sequence
  chemically synthesized
taactgacaaaaaaataaaa

SEQ ID NO: 342091 - DNA, 20 bp, Artificial Sequence
  chemically synthesized
aaattcctgttatatcaaat

SEQ ID NO: 342092 - DNA, 20 bp, Artificial Sequence
  chemically synthesized
agaaatctgatttgatataa

SEQ ID NO: 342093 - DNA, 20 bp, Artificial Sequence
  chemically synthesized
gaaatctgatttgatataac

SEQ ID NO: 342094 - DNA, 20 bp, Artificial Sequence
  chemically synthesized
atttgatataacaggaattt

SEQ ID NO: 342095 - DNA, 20 bp, Artificial Sequence
  chemically synthesized
tttgatataacaggaatttt

SEQ ID NO: 342096 - DNA, 20 bp, Artificial Sequence
  chemically synthesized
caggaattttaggaaaatta

SEQ ID NO: 342097 - DNA, 20 bp, Artificial Sequence
  chemically synthesized
taggaaaattaaagcattac

SEQ ID NO: 342098 - DNA, 20 bp, Artificial Sequence
  chemically synthesized
aggaaaattaaagcattact

SEQ ID NO: 342099 - DNA, 20 bp, Artificial Sequence
  chemically synthesized
gaaaattaaagcattactag

SEQ ID NO: 342100 - DNA, 20 bp, Artificial Sequence
  chemically synthesized
gaagccgtttttgaatctcc

SEQ ID NO: 342101 - DNA, 20 bp, Artificial Sequence
  chemically synthesized
attactaggagattcaaaaa

SEQ ID NO: 342102 - DNA, 20 bp, Artificial Sequence
  chemically synthesized
gattcaaaaacggcttcata

SEQ ID NO: 342103 - DNA, 20 bp, Artificial Sequence
  chemically synthesized
ttcaaaaacggcttcatata

SEQ ID NO: 342104 - DNA, 20 bp, Artificial Sequence
  chemically synthesized
tatggtatcaactctatatg

SEQ ID NO: 342105 - DNA, 20 bp, Artificial Sequence
  chemically synthesized
agagttgataccatataaat

SEQ ID NO: 342106 - DNA, 20 bp, Artificial Sequence
  chemically synthesized
ttctatagacccaatttata

SEQ ID NO: 342107 - DNA, 20 bp, Artificial Sequence
  chemically synthesized
gagttgataccatataaatt

SEQ ID NO: 342108 - DNA, 20 bp, Artificial Sequence
  chemically synthesized
taccatataaattgggtcta

SEQ ID NO: 342109 - DNA, 20 bp, Artificial Sequence
  chemically synthesized
catataaattgggtctatag

SEQ ID NO: 342110 - DNA, 20 bp, Artificial Sequence
  chemically synthesized
tctataggcttttgcttcta

SEQ ID NO: 342111 - DNA, 20 bp, Artificial Sequence
  chemically synthesized
aattgggtctatagaagcaa

SEQ ID NO: 342112 - DNA, 20 bp, Artificial Sequence
  chemically synthesized
tctatagaagcaaaagccta

SEQ ID NO: 342113 - DNA, 20 bp, Artificial Sequence
  chemically synthesized
acagcttcctgtatgtctat

SEQ ID NO: 342114 - DNA, 20 bp, Artificial Sequence
  chemically synthesized
tacagcttcctgtatgtcta

SEQ ID NO: 342115 - DNA, 20 bp, Artificial Sequence
  chemically synthesized
agcaaaagcctatagacata

SEQ ID NO: 342116 - DNA, 20 bp, Artificial Sequence
  chemically synthesized
gcaaaagcctatagacatac

SEQ ID NO: 342117 - DNA, 20 bp, Artificial Sequence
  chemically synthesized
aaagcctatagacatacagg

SEQ ID NO: 342118 - DNA, 20 bp, Artificial Sequence
  chemically synthesized
acatacaggaagctgtaatt

SEQ ID NO: 342119 - DNA, 20 bp, Artificial Sequence
  chemically synthesized
catacaggaagctgtaatta

SEQ ID NO: 342120 - DNA, 20 bp, Artificial Sequence
  chemically synthesized
tagtctcattaccttaatta

SEQ ID NO: 342121 - DNA, 20 bp, Artificial Sequence
  chemically synthesized
gaagctgtaattaaggtaat

SEQ ID NO: 342122 - DNA, 20 bp, Artificial Sequence
  chemically synthesized
tgtaattaaggtaatgagac

SEQ ID NO: 342123 - DNA, 20 bp, Artificial Sequence
  chemically synthesized
taattaaggtaatgagacta

SEQ ID NO: 342124 - DNA, 20 bp, Artificial Sequence
  chemically synthesized
aggtaatgagactagagctc

SEQ ID NO: 342125 - DNA, 20 bp, Artificial Sequence
  chemically synthesized
cccatatttcacttgagctc

SEQ ID NO: 342126 - DNA, 20 bp, Artificial Sequence
  chemically synthesized
gttttgcccatatttcactt

SEQ ID NO: 342127 - DNA, 20 bp, Artificial Sequence
  chemically synthesized
actagagctcaagtgaaata

SEQ ID NO: 342128 - DNA, 20 bp, Artificial Sequence
  chemically synthesized
ctagagctcaagtgaaatat

SEQ ID NO: 342129 - DNA, 20 bp, Artificial Sequence
  chemically synthesized
gcttaatcaggtttattcat

SEQ ID NO: 342130 - DNA, 20 bp, Artificial Sequence
  chemically synthesized
actgatgaataaacctgatt

SEQ ID NO: 342131 - DNA, 20 bp, Artificial Sequence
  chemically synthesized
tctgtgattttggcttaatc

SEQ ID NO: 342132 - DNA, 20 bp, Artificial Sequence
  chemically synthesized
ctctgtgattttggcttaat

SEQ ID NO: 342133 - DNA, 20 bp, Artificial Sequence
  chemically synthesized
acctgattaagccaaaatca

SEQ ID NO: 342134 - DNA, 20 bp, Artificial Sequence
  chemically synthesized
ctggtaaccctctgtgattt

SEQ ID NO: 342135 - DNA, 20 bp, Artificial Sequence
  chemically synthesized
ctgattaagccaaaatcaca

SEQ ID NO: 342136 - DNA, 20 bp, Artificial Sequence
  chemically synthesized
tgattaagccaaaatcacag

SEQ ID NO: 342137 - DNA, 20 bp, Artificial Sequence
  chemically synthesized
gattaagccaaaatcacaga

SEQ ID NO: 342138 - DNA, 20 bp, Artificial Sequence
  chemically synthesized
ccaaaatcacagagggttac

SEQ ID NO: 342139 - DNA, 20 bp, Artificial Sequence
  chemically synthesized
acagagggttaccagtgact

SEQ ID NO: 342140 - DNA, 20 bp, Artificial Sequence
  chemically synthesized
caaacttctaaccaagtcac

SEQ ID NO: 342141 - DNA, 20 bp, Artificial Sequence
  chemically synthesized
agggttaccagtgacttggt

SEQ ID NO: 342142 - DNA, 20 bp, Artificial Sequence
  chemically synthesized
gttaccagtgacttggttag

SEQ ID NO: 342143 - DNA, 20 bp, Artificial Sequence
  chemically synthesized
aaatgttcaaacttctaacc

SEQ ID NO: 342144 - DNA, 20 bp, Artificial Sequence
  chemically synthesized
ttagaagtttgaacattttc

SEQ ID NO: 342145 - DNA, 20 bp, Artificial Sequence
  chemically synthesized
tagaagtttgaacattttct

SEQ ID NO: 342146 - DNA, 20 bp, Artificial Sequence
  chemically synthesized
caaccacattattggatgcc

SEQ ID NO: 342147 - DNA, 20 bp, Artificial Sequence
  chemically synthesized
tttctaggcatccaataatg

SEQ ID NO: 342148 - DNA, 20 bp, Artificial Sequence
  chemically synthesized
tgcctacgcaaccacattat

SEQ ID NO: 342149 - DNA, 20 bp, Artificial Sequence
  chemically synthesized
catccaataatgtggttgcg

SEQ ID NO: 342150 - DNA, 20 bp, Artificial Sequence
  chemically synthesized
atccaataatgtggttgcgt

SEQ ID NO: 342151 - DNA, 20 bp, Artificial Sequence
  chemically synthesized
ataatgtggttgcgtaggca

SEQ ID NO: 342152 - DNA, 20 bp, Artificial Sequence
  chemically synthesized
taatgtggttgcgtaggcac

SEQ ID NO: 342153 - DNA, 20 bp, Artificial Sequence
  chemically synthesized
gtaggcacaggaataaaact

SEQ ID NO: 342154 - DNA, 20 bp, Artificial Sequence
  chemically synthesized
cacaggaataaaactgagtt

SEQ ID NO: 342155 - DNA, 20 bp, Artificial Sequence
  chemically synthesized
ccatcatccaaaaccaaact

SEQ ID NO: 342156 - DNA, 20 bp, Artificial Sequence
  chemically synthesized
aataaaactgagtttggttt

SEQ ID NO: 342157 - DNA, 20 bp, Artificial Sequence
  chemically synthesized
ctgagtttggttttggatga

SEQ ID NO: 342158 - DNA, 20 bp, Artificial Sequence
  chemically synthesized
ttggatgatggactttacct

SEQ ID NO: 342159 - DNA, 20 bp, Artificial Sequence
  chemically synthesized
tggatgatggactttaccta

SEQ ID NO: 342160 - DNA, 20 bp, Artificial Sequence
  chemically synthesized
aacaagacccaccttaggta

SEQ ID NO: 342161 - DNA, 20 bp, Artificial Sequence
  chemically synthesized
atgatggactttacctaagg

SEQ ID NO: 342162 - DNA, 20 bp, Artificial Sequence
  chemically synthesized
tgatggactttacctaaggt

SEQ ID NO: 342163 - DNA, 20 bp, Artificial Sequence
  chemically synthesized
aaagcaacaagacccacctt

SEQ ID NO: 342164 - DNA, 20 bp, Artificial Sequence
  chemically synthesized
aaaagcaacaagacccacct

SEQ ID NO: 342165 - DNA, 20 bp, Artificial Sequence
  chemically synthesized
gtgatgattttaaaagcaac

SEQ ID NO: 342166 - DNA, 20 bp, Artificial Sequence
  chemically synthesized
taagggagtgatgattttaa

SEQ ID NO: 342167 - DNA, 20 bp, Artificial Sequence
  chemically synthesized
aaaatcatcactcccttata

SEQ ID NO: 342168 - DNA, 20 bp, Artificial Sequence
  chemically synthesized
atttttttttctttataagg

SEQ ID NO: 342169 - DNA, 20 bp, Artificial Sequence
  chemically synthesized
agatttttttttctttataa

SEQ ID NO: 342170 - DNA, 20 bp, Artificial Sequence
  chemically synthesized
tagatttttttttctttata

SEQ ID NO: 342171 - DNA, 20 bp, Artificial Sequence
  chemically synthesized
atagatttttttttctttat

SEQ ID NO: 342172 - DNA, 20 bp, Artificial Sequence
  chemically synthesized
taaagaaaaaaaaatctatg

SEQ ID NO: 342173 - DNA, 20 bp, Artificial Sequence
  chemically synthesized
gttattttgggatgtctgca

SEQ ID NO: 342174 - DNA, 20 bp, Artificial Sequence
  chemically synthesized
cagtgtcttaatgttatttt

SEQ ID NO: 342175 - DNA, 20 bp, Artificial Sequence
  chemically synthesized
ccagtgtcttaatgttattt

SEQ ID NO: 342176 - DNA, 20 bp, Artificial Sequence
  chemically synthesized
agacatcccaaaataacatt

SEQ ID NO: 342177 - DNA, 20 bp, Artificial Sequence
  chemically synthesized
ccaaaataacattaagacac

SEQ ID NO: 342178 - DNA, 20 bp, Artificial Sequence
  chemically synthesized
caaaataacattaagacact

SEQ ID NO: 342179 - DNA, 20 bp, Artificial Sequence
  chemically synthesized
ccaggactgatgtcgaagcc

SEQ ID NO: 342180 - DNA, 20 bp, Artificial Sequence
  chemically synthesized
aagacactgggcttcgacat

SEQ ID NO: 342181 - DNA, 20 bp, Artificial Sequence
  chemically synthesized
tgaatccaggactgatgtcg

SEQ ID NO: 342182 - DNA, 20 bp, Artificial Sequence
  chemically synthesized
ctgggcttcgacatcagtcc

SEQ ID NO: 342183 - DNA, 20 bp, Artificial Sequence
  chemically synthesized
gattggatttgaatgaatcc

SEQ ID NO: 342184 - DNA, 20 bp, Artificial Sequence
  chemically synthesized
agattggatttgaatgaatc

SEQ ID NO: 342185 - DNA, 20 bp, Artificial Sequence
  chemically synthesized
aactaataggaagtagagat

SEQ ID NO: 342186 - DNA, 20 bp, Artificial Sequence
  chemically synthesized
cagataactaataggaagta

SEQ ID NO: 342187 - DNA, 20 bp, Artificial Sequence
  chemically synthesized
tacagataactaataggaag

SEQ ID NO: 342188 - DNA, 20 bp, Artificial Sequence
  chemically synthesized
atccaatctctacttcctat

SEQ ID NO: 342189 - DNA, 20 bp, Artificial Sequence
  chemically synthesized
ttatacagataactaatagg

SEQ ID NO: 342190 - DNA, 20 bp, Artificial Sequence
  chemically synthesized
atattatacagataactaat

SEQ ID NO: 342191 - DNA, 20 bp, Artificial Sequence
  chemically synthesized
catattatacagataactaa

SEQ ID NO: 342192 - DNA, 20 bp, Artificial Sequence
  chemically synthesized
tattagttatctgtataata

SEQ ID NO: 342193 - DNA, 20 bp, Artificial Sequence
  chemically synthesized
aggaatttacccatattata

SEQ ID NO: 342194 - DNA, 20 bp, Artificial Sequence
  chemically synthesized
attagttatctgtataatat

SEQ ID NO: 342195 - DNA, 20 bp, Artificial Sequence
  chemically synthesized
gcaaactgttgaggagagaa

SEQ ID NO: 342196 - DNA, 20 bp, Artificial Sequence
  chemically synthesized
agcaaactgttgaggagaga

SEQ ID NO: 342197 - DNA, 20 bp, Artificial Sequence
  chemically synthesized
aaattcctttctctcctcaa

SEQ ID NO: 342198 - DNA, 20 bp, Artificial Sequence
  chemically synthesized
tagaagcaaactgttgagga

SEQ ID NO: 342199 - DNA, 20 bp, Artificial Sequence
  chemically synthesized
tgtagaagcaaactgttgag

SEQ ID NO: 342200 - DNA, 20 bp, Artificial Sequence
  chemically synthesized
aatgtagaagcaaactgttg

SEQ ID NO: 342201 - DNA, 20 bp, Artificial Sequence
  chemically synthesized
aaatgtagaagcaaactgtt

SEQ ID NO: 342202 - DNA, 20 bp, Artificial Sequence
  chemically synthesized
acatgtacattaaaatgtag

SEQ ID NO: 342203 - DNA, 20 bp, Artificial Sequence
  chemically synthesized
ttcacatgtacattaaaatg

SEQ ID NO: 342204 - DNA, 20 bp, Artificial Sequence
  chemically synthesized
tacattttaatgtacatgtg

SEQ ID NO: 342205 - DNA, 20 bp, Artificial Sequence
  chemically synthesized
taatgtacatgtgaagttcc

SEQ ID NO: 342206 - DNA, 20 bp, Artificial Sequence
  chemically synthesized
caattgctttattaagggct

SEQ ID NO: 342207 - DNA, 20 bp, Artificial Sequence
  chemically synthesized
acaattgctttattaagggc

SEQ ID NO: 342208 - DNA, 20 bp, Artificial Sequence
  chemically synthesized
gaagttcctagcccttaata

SEQ ID NO: 342209 - DNA, 20 bp, Artificial Sequence
  chemically synthesized
ccttacaattgctttattaa

SEQ ID NO: 342210 - DNA, 20 bp, Artificial Sequence
  chemically synthesized
gccttacaattgctttatta

SEQ ID NO: 342211 - DNA, 20 bp, Artificial Sequence
  chemically synthesized
agccttacaattgctttatt

SEQ ID NO: 342212 - DNA, 20 bp, Artificial Sequence
  chemically synthesized
gcccttaataaagcaattgt

SEQ ID NO: 342213 - DNA, 20 bp, Artificial Sequence
  chemically synthesized
cccttaataaagcaattgta

SEQ ID NO: 342214 - DNA, 20 bp, Artificial Sequence
  chemically synthesized
agcaattgtaaggcttaaat

SEQ ID NO: 342215 - DNA, 20 bp, Artificial Sequence
  chemically synthesized
ttacctggagtttcttattt

SEQ ID NO: 342216 - DNA, 20 bp, Artificial Sequence
  chemically synthesized
aaggcttaaataagaaactc

SEQ ID NO: 342217 - DNA, 20 bp, Artificial Sequence
  chemically synthesized
aggcttaaataagaaactcc

SEQ ID NO: 342218 - DNA, 20 bp, Artificial Sequence
  chemically synthesized
taaataagaaactccaggta

SEQ ID NO: 342219 - DNA, 20 bp, Artificial Sequence
  chemically synthesized
tgtgccagctactttacctg

SEQ ID NO: 342220 - DNA, 20 bp, Artificial Sequence
  chemically synthesized
ataagaaactccaggtaaag

SEQ ID NO: 342221 - DNA, 20 bp, Artificial Sequence
  chemically synthesized
tatgtgccagctactttacc

SEQ ID NO: 342222 - DNA, 20 bp, Artificial Sequence
  chemically synthesized
gaaactccaggtaaagtagc

SEQ ID NO: 342223 - DNA, 20 bp, Artificial Sequence
  chemically synthesized
aatatgagcttattatgtgc

SEQ ID NO: 342224 - DNA, 20 bp, Artificial Sequence
  chemically synthesized
taaagtagctggcacataat

SEQ ID NO: 342225 - DNA, 20 bp, Artificial Sequence
  chemically synthesized
aaatagctaatatttaatat

SEQ ID NO: 342226 - DNA, 20 bp, Artificial Sequence
  chemically synthesized
aataagctcatattaaatat

SEQ ID NO: 342227 - DNA, 20 bp, Artificial Sequence
  chemically synthesized
acctgatcagtttgtgaaaa

SEQ ID NO: 342228 - DNA, 20 bp, Artificial Sequence
  chemically synthesized
agctattttcacaaactgat

SEQ ID NO: 342229 - DNA, 20 bp, Artificial Sequence
  chemically synthesized
gctattttcacaaactgatc

SEQ ID NO: 342230 - DNA, 20 bp, Artificial Sequence
  chemically synthesized
tccaagaaaagaaacctgat

SEQ ID NO: 342231 - DNA, 20 bp, Artificial Sequence
  chemically synthesized
actgatcaggtttcttttct

SEQ ID NO: 342232 - DNA, 20 bp, Artificial Sequence
  chemically synthesized
tgtcaccggcagtccaagaa

SEQ ID NO: 342233 - DNA, 20 bp, Artificial Sequence
  chemically synthesized
ggtttcttttcttggactgc

SEQ ID NO: 342234 - DNA, 20 bp, Artificial Sequence
  chemically synthesized
tgctgtgtcaccggcagtcc

SEQ ID NO: 342235 - DNA, 20 bp, Artificial Sequence
  chemically synthesized
tagttctgctgtgtcaccgg

SEQ ID NO: 342236 - DNA, 20 bp, Artificial Sequence
  chemically synthesized
ttcttggactgccggtgaca

SEQ ID NO: 342237 - DNA, 20 bp, Artificial Sequence
  chemically synthesized
tactagttctgctgtgtcac

SEQ ID NO: 342238 - DNA, 20 bp, Artificial Sequence
  chemically synthesized
ttggactgccggtgacacag

SEQ ID NO: 342239 - DNA, 20 bp, Artificial Sequence
  chemically synthesized
tgccggtgacacagcagaac

SEQ ID NO: 342240 - DNA, 20 bp, Artificial Sequence
  chemically synthesized
acacagcagaactagtaatg

SEQ ID NO: 342241 - DNA, 20 bp, Artificial Sequence
  chemically synthesized
aactttaaaatctacattac

SEQ ID NO: 342242 - DNA, 20 bp, Artificial Sequence
  chemically synthesized
aactagtaatgtagatttta

SEQ ID NO: 342243 - DNA, 20 bp, Artificial Sequence
  chemically synthesized
agattttaaagttaattgaa

SEQ ID NO: 342244 - DNA, 20 bp, Artificial Sequence
  chemically synthesized
attttaaagttaattgaatg

SEQ ID NO: 342245 - DNA, 20 bp, Artificial Sequence
  chemically synthesized
ttttaaagttaattgaatgg

SEQ ID NO: 342246 - DNA, 20 bp, Artificial Sequence
  chemically synthesized
taattgaatggaggtaaaac

SEQ ID NO: 342247 - DNA, 20 bp, Artificial Sequence
  chemically synthesized
aattgaatggaggtaaaact

SEQ ID NO: 342248 - DNA, 20 bp, Artificial Sequence
  chemically synthesized
ttgaatggaggtaaaactag

SEQ ID NO: 342249 - DNA, 20 bp, Artificial Sequence
  chemically synthesized
agaagaagttttcagtctcc

SEQ ID NO: 342250 - DNA, 20 bp, Artificial Sequence
  chemically synthesized
gaacatgtagaagaagtttt

SEQ ID NO: 342251 - DNA, 20 bp, Artificial Sequence
  chemically synthesized
gacaagtgaacatgtagaag

SEQ ID NO: 342252 - DNA, 20 bp, Artificial Sequence
  chemically synthesized
ggtgacaagtgaacatgtag

SEQ ID NO: 342253 - DNA, 20 bp, Artificial Sequence
  chemically synthesized
acgggtgacaagtgaacatg

SEQ ID NO: 342254 - DNA, 20 bp, Artificial Sequence
  chemically synthesized
ctgttctgcagacgggtgac

SEQ ID NO: 342255 - DNA, 20 bp, Artificial Sequence
  chemically synthesized
gttcacttgtcacccgtctg

SEQ ID NO: 342256 - DNA, 20 bp, Artificial Sequence
  chemically synthesized
tccaattctgttctgcagac

SEQ ID NO: 342257 - DNA, 20 bp, Artificial Sequence
  chemically synthesized
ctccaattctgttctgcaga

SEQ ID NO: 342258 - DNA, 20 bp, Artificial Sequence
  chemically synthesized
cttgtcacccgtctgcagaa

SEQ ID NO: 342259 - DNA, 20 bp, Artificial Sequence
  chemically synthesized
tgttctccaattctgttctg

SEQ ID NO: 342260 - DNA, 20 bp, Artificial Sequence
  chemically synthesized
acccgtctgcagaacagaat

SEQ ID NO: 342261 - DNA, 20 bp, Artificial Sequence
  chemically synthesized
ccgtctgcagaacagaattg

SEQ ID NO: 342262 - DNA, 20 bp, Artificial Sequence
  chemically synthesized
actctttccttgtgttatta

SEQ ID NO: 342263 - DNA, 20 bp, Artificial Sequence
  chemically synthesized
gagaacatccataataacac

SEQ ID NO: 342264 - DNA, 20 bp, Artificial Sequence
  chemically synthesized
agaacatccataataacaca

SEQ ID NO: 342265 - DNA, 20 bp, Artificial Sequence
  chemically synthesized
catccataataacacaagga

SEQ ID NO: 342266 - DNA, 20 bp, Artificial Sequence
  chemically synthesized
tccataataacacaaggaaa

SEQ ID NO: 342267 - DNA, 20 bp, Artificial Sequence
  chemically synthesized
taataacacaaggaaagagt

SEQ ID NO: 342268 - DNA, 20 bp, Artificial Sequence
  chemically synthesized
taacacaaggaaagagttag

SEQ ID NO: 342269 - DNA, 20 bp, Artificial Sequence
  chemically synthesized
acacaaggaaagagttagca

SEQ ID NO: 342270 - DNA, 20 bp, Artificial Sequence
  chemically synthesized
caaggaaagagttagcagag

SEQ ID NO: 342271 - DNA, 20 bp, Artificial Sequence
  chemically synthesized
aaagagttagcagagcagat

SEQ ID NO: 342272 - DNA, 20 bp, Artificial Sequence
  chemically synthesized
aagagttagcagagcagata

SEQ ID NO: 342273 - DNA, 20 bp, Artificial Sequence
  chemically synthesized
agcagataaggtatacgata

SEQ ID NO: 342274 - DNA, 20 bp, Artificial Sequence
  chemically synthesized
ggtatacgatatagatgata

SEQ ID NO: 342275 - DNA, 20 bp, Artificial Sequence
  chemically synthesized
agatgatatggatatactta

SEQ ID NO: 342276 - DNA, 20 bp, Artificial Sequence
  chemically synthesized
gatatggatatacttataga

SEQ ID NO: 342277 - DNA, 20 bp, Artificial Sequence
  chemically synthesized
tagtatgatattccatctat

SEQ ID NO: 342278 - DNA, 20 bp, Artificial Sequence
  chemically synthesized
ttatagatggaatatcatac

SEQ ID NO: 342279 - DNA, 20 bp, Artificial Sequence
  chemically synthesized
tatagatggaatatcatact

SEQ ID NO: 342280 - DNA, 20 bp, Artificial Sequence
  chemically synthesized
agatggaatatcatactagg

SEQ ID NO: 342281 - DNA, 20 bp, Artificial Sequence
  chemically synthesized
atgaatttgggacagcttcc

SEQ ID NO: 342282 - DNA, 20 bp, Artificial Sequence
  chemically synthesized
tcatttctatgaatttggga

SEQ ID NO: 342283 - DNA, 20 bp, Artificial Sequence
  chemically synthesized
aggaagctgtcccaaattca

SEQ ID NO: 342284 - DNA, 20 bp, Artificial Sequence
  chemically synthesized
agattcatttctatgaattt

SEQ ID NO: 342285 - DNA, 20 bp, Artificial Sequence
  chemically synthesized
aagattcatttctatgaatt

SEQ ID NO: 342286 - DNA, 20 bp, Artificial Sequence
  chemically synthesized
catagaaatgaatctttcaa

SEQ ID NO: 342287 - DNA, 20 bp, Artificial Sequence
  chemically synthesized
atagaaatgaatctttcaaa

SEQ ID NO: 342288 - DNA, 20 bp, Artificial Sequence
  chemically synthesized
agaaatgaatctttcaaaag

SEQ ID NO: 342289 - DNA, 20 bp, Artificial Sequence
  chemically synthesized
tttcacacctctccttttga

SEQ ID NO: 342290 - DNA, 20 bp, Artificial Sequence
  chemically synthesized
aaatgaatctttcaaaagga

SEQ ID NO: 342291 - DNA, 20 bp, Artificial Sequence
  chemically synthesized
aatgaatctttcaaaaggag

SEQ ID NO: 342292 - DNA, 20 bp, Artificial Sequence
  chemically synthesized
tatattctaattgaatttca

SEQ ID NO: 342293 - DNA, 20 bp, Artificial Sequence
  chemically synthesized
attatattctaattgaattt

SEQ ID NO: 342294 - DNA, 20 bp, Artificial Sequence
  chemically synthesized
aattcactctgaaattcaat

SEQ ID NO: 342295 - DNA, 20 bp, Artificial Sequence
  chemically synthesized
aaattcaattagaatataat

SEQ ID NO: 342296 - DNA, 20 bp, Artificial Sequence
  chemically synthesized
gaatataattagtgactgtt

SEQ ID NO: 342297 - DNA, 20 bp, Artificial Sequence
  chemically synthesized
tatcaaaactgtattctcaa

SEQ ID NO: 342298 - DNA, 20 bp, Artificial Sequence
  chemically synthesized
attagtgactgttgagaata

SEQ ID NO: 342299 - DNA, 20 bp, Artificial Sequence
  chemically synthesized
tgttgagaatacagttttga

SEQ ID NO: 342300 - DNA, 20 bp, Artificial Sequence
  chemically synthesized
acagttttgatagaataaat

SEQ ID NO: 342301 - DNA, 20 bp, Artificial Sequence
  chemically synthesized
cagttttgatagaataaatg

SEQ ID NO: 342302 - DNA, 20 bp, Artificial Sequence
  chemically synthesized
ttttgatagaataaatgagg

SEQ ID NO: 342303 - DNA, 20 bp, Artificial Sequence
  chemically synthesized
tgatagaataaatgaggcag

SEQ ID NO: 342304 - DNA, 20 bp, Artificial Sequence
  chemically synthesized
agaataaatgaggcagaaga

SEQ ID NO: 342305 - DNA, 20 bp, Artificial Sequence
  chemically synthesized
tgaggcagaagacagctttt

SEQ ID NO: 342306 - DNA, 20 bp, Artificial Sequence
  chemically synthesized
gaggcagaagacagctttta

SEQ ID NO: 342307 - DNA, 20 bp, Artificial Sequence
  chemically synthesized
aggcagaagacagcttttaa

SEQ ID NO: 342308 - DNA, 20 bp, Artificial Sequence
  chemically synthesized
ttttctccttaatcccttaa

SEQ ID NO: 342309 - DNA, 20 bp, Artificial Sequence
  chemically synthesized
aagacagcttttaagggatt

SEQ ID NO: 342310 - DNA, 20 bp, Artificial Sequence
  chemically synthesized
agacagcttttaagggatta

SEQ ID NO: 342311 - DNA, 20 bp, Artificial Sequence
  chemically synthesized
acagcttttaagggattaag

SEQ ID NO: 342312 - DNA, 20 bp, Artificial Sequence
  chemically synthesized
ttaagggattaaggagaaaa

SEQ ID NO: 342313 - DNA, 20 bp, Artificial Sequence
  chemically synthesized
ttaaggagaaaatggatatt

SEQ ID NO: 342314 - DNA, 20 bp, Artificial Sequence
  chemically synthesized
atattaagaaaatgtaactt

SEQ ID NO: 342315 - DNA, 20 bp, Artificial Sequence
  chemically synthesized
tattaagaaaatgtaacttc

SEQ ID NO: 342316 - DNA, 20 bp, Artificial Sequence
  chemically synthesized
agaaaatgtaacttcaggca

SEQ ID NO: 342317 - DNA, 20 bp, Artificial Sequence
  chemically synthesized
gaagttattctctatgcctg

SEQ ID NO: 342318 - DNA, 20 bp, Artificial Sequence
  chemically synthesized
aaaatgtaacttcaggcata

SEQ ID NO: 342319 - DNA, 20 bp, Artificial Sequence
  chemically synthesized
tcaggcatagagaataactt

SEQ ID NO: 342320 - DNA, 20 bp, Artificial Sequence
  chemically synthesized
caggcatagagaataacttc

SEQ ID NO: 342321 - DNA, 20 bp, Artificial Sequence
  chemically synthesized
tataattgcaaaacatcctg

SEQ ID NO: 342322 - DNA, 20 bp, Artificial Sequence
  chemically synthesized
aggatgttttgcaattataa

SEQ ID NO: 342323 - DNA, 20 bp, Artificial Sequence
  chemically synthesized
tgcaattataatggttataa

SEQ ID NO: 342324 - DNA, 20 bp, Artificial Sequence
  chemically synthesized
tgcaggacttggcaagtttt

SEQ ID NO: 342325 - DNA, 20 bp, Artificial Sequence
  chemically synthesized
ataatggctcaaaacttgcc

SEQ ID NO: 342326 - DNA, 20 bp, Artificial Sequence
  chemically synthesized
catttagtgcaggacttggc

SEQ ID NO: 342327 - DNA, 20 bp, Artificial Sequence
  chemically synthesized
gaaacatttagtgcaggact

SEQ ID NO: 342328 - DNA, 20 bp, Artificial Sequence
  chemically synthesized
tgatttgaaacatttagtgc

SEQ ID NO: 342329 - DNA, 20 bp, Artificial Sequence
  chemically synthesized
ttgatttgaaacatttagtg

SEQ ID NO: 342330 - DNA, 20 bp, Artificial Sequence
  chemically synthesized
attagttgatttgaaacatt

SEQ ID NO: 342331 - DNA, 20 bp, Artificial Sequence
  chemically synthesized
gttacaagaattaaatgaat

SEQ ID NO: 342332 - DNA, 20 bp, Artificial Sequence
  chemically synthesized
aattcatttaattcttgtaa

SEQ ID NO: 342333 - DNA, 20 bp, Artificial Sequence
  chemically synthesized
tcataccataggactgttac

SEQ ID NO: 342334 - DNA, 20 bp, Artificial Sequence
  chemically synthesized
taattcttgtaacagtccta

SEQ ID NO: 342335 - DNA, 20 bp, Artificial Sequence
  chemically synthesized
gagaattgtattcataccat

SEQ ID NO: 342336 - DNA, 20 bp, Artificial Sequence
  chemically synthesized
tgagaattgtattcatacca

SEQ ID NO: 342337 - DNA, 20 bp, Artificial Sequence
  chemically synthesized
ctcatctagaaaatgaaagt

SEQ ID NO: 342338 - DNA, 20 bp, Artificial Sequence
  chemically synthesized
tttcctcatctagaaaatga

SEQ ID NO: 342339 - DNA, 20 bp, Artificial Sequence
  chemically synthesized
caattctcactttcattttc

SEQ ID NO: 342340 - DNA, 20 bp, Artificial Sequence
  chemically synthesized
ctcactttcattttctagat

SEQ ID NO: 342341 - DNA, 20 bp, Artificial Sequence
  chemically synthesized
tcactttcattttctagatg

SEQ ID NO: 342342 - DNA, 20 bp, Artificial Sequence
  chemically synthesized
ccctgagccttttcctcatc

SEQ ID NO: 342343 - DNA, 20 bp, Artificial Sequence
  chemically synthesized
ttcattttctagatgaggaa

SEQ ID NO: 342344 - DNA, 20 bp, Artificial Sequence
  chemically synthesized
tcattttctagatgaggaaa

SEQ ID NO: 342345 - DNA, 20 bp, Artificial Sequence
  chemically synthesized
ttctagatgaggaaaaggct

SEQ ID NO: 342346 - DNA, 20 bp, Artificial Sequence
  chemically synthesized
tctagatgaggaaaaggctc

SEQ ID NO: 342347 - DNA, 20 bp, Artificial Sequence
  chemically synthesized
ctagatgaggaaaaggctca

SEQ ID NO: 342348 - DNA, 20 bp, Artificial Sequence
  chemically synthesized
gcaaatttcttaagatccct

SEQ ID NO: 342349 - DNA, 20 bp, Artificial Sequence
  chemically synthesized
ggaaaaggctcagggatctt

SEQ ID NO: 342350 - DNA, 20 bp, Artificial Sequence
  chemically synthesized
taaacttgtgcaaatttctt

SEQ ID NO: 342351 - DNA, 20 bp, Artificial Sequence
  chemically synthesized
ggatcttaagaaatttgcac

SEQ ID NO: 342352 - DNA, 20 bp, Artificial Sequence
  chemically synthesized
gaaatttgcacaagtttaca

SEQ ID NO: 342353 - DNA, 20 bp, Artificial Sequence
  chemically synthesized
cacaagtttacacagctaaa

SEQ ID NO: 342354 - DNA, 20 bp, Artificial Sequence
  chemically synthesized
aagtttacacagctaaaaag

SEQ ID NO: 342355 - DNA, 20 bp, Artificial Sequence
  chemically synthesized
aaactaaccttgccactttt

SEQ ID NO: 342356 - DNA, 20 bp, Artificial Sequence
  chemically synthesized
ttacacagctaaaaagtggc

SEQ ID NO: 342357 - DNA, 20 bp, Artificial Sequence
  chemically synthesized
tacacagctaaaaagtggca

SEQ ID NO: 342358 - DNA, 20 bp, Artificial Sequence
  chemically synthesized
cagctaaaaagtggcaaggt

SEQ ID NO: 342359 - DNA, 20 bp, Artificial Sequence
  chemically synthesized
tggcaaggttagttttgacc

SEQ ID NO: 342360 - DNA, 20 bp, Artificial Sequence
  chemically synthesized
ggcaaggttagttttgaccc

SEQ ID NO: 342361 - DNA, 20 bp, Artificial Sequence
  chemically synthesized
aaggttagttttgacccagg

SEQ ID NO: 342362 - DNA, 20 bp, Artificial Sequence
  chemically synthesized
gttctggagctggactgcct

SEQ ID NO: 342363 - DNA, 20 bp, Artificial Sequence
  chemically synthesized
tagttttgacccaggcagtc

SEQ ID NO: 342364 - DNA, 20 bp, Artificial Sequence
  chemically synthesized
ggttctggagctggactgcc

SEQ ID NO: 342365 - DNA, 20 bp, Artificial Sequence
  chemically synthesized
tgacccaggcagtccagctc

SEQ ID NO: 342366 - DNA, 20 bp, Artificial Sequence
  chemically synthesized
gacagcataggttctggagc

SEQ ID NO: 342367 - DNA, 20 bp, Artificial Sequence
  chemically synthesized
ggaggacagcataggttctg

SEQ ID NO: 342368 - DNA, 20 bp, Artificial Sequence
  chemically synthesized
agggaggacagcataggttc

SEQ ID NO: 342369 - DNA, 20 bp, Artificial Sequence
  chemically synthesized
aacagtagggaggacagcat

SEQ ID NO: 342370 - DNA, 20 bp, Artificial Sequence
  chemically synthesized
gaacagtagggaggacagca

SEQ ID NO: 342371 - DNA, 20 bp, Artificial Sequence
  chemically synthesized
catgtgaacagtagggagga

SEQ ID NO: 342372 - DNA, 20 bp, Artificial Sequence
  chemically synthesized
aagccatgtgaacagtaggg

SEQ ID NO: 342373 - DNA, 20 bp, Artificial Sequence
  chemically synthesized
gaagccatgtgaacagtagg

SEQ ID NO: 342374 - DNA, 20 bp, Artificial Sequence
  chemically synthesized
cagaagccatgtgaacagta

SEQ ID NO: 342375 - DNA, 20 bp, Artificial Sequence
  chemically synthesized
tcagaagccatgtgaacagt

SEQ ID NO: 342376 - DNA, 20 bp, Artificial Sequence
  chemically synthesized
ctcagaagccatgtgaacag

SEQ ID NO: 342377 - DNA, 20 bp, Artificial Sequence
  chemically synthesized
tgtcctccctactgttcaca

SEQ ID NO: 342378 - DNA, 20 bp, Artificial Sequence
  chemically synthesized
tgtctcagaagccatgtgaa

SEQ ID NO: 342379 - DNA, 20 bp, Artificial Sequence
  chemically synthesized
ctactgttcacatggcttct

SEQ ID NO: 342380 - DNA, 20 bp, Artificial Sequence
  chemically synthesized
gttcacatggcttctgagac

SEQ ID NO: 342381 - DNA, 20 bp, Artificial Sequence
  chemically synthesized
aatcactactcttgtctcag

SEQ ID NO: 342382 - DNA, 20 bp, Artificial Sequence
  chemically synthesized
tcacatggcttctgagacaa

SEQ ID NO: 342383 - DNA, 20 bp, Artificial Sequence
  chemically synthesized
ttaaatcactactcttgtct

SEQ ID NO: 342384 - DNA, 20 bp, Artificial Sequence
  chemically synthesized
catggcttctgagacaagag

SEQ ID NO: 342385 - DNA, 20 bp, Artificial Sequence
  chemically synthesized
caagagtagtgatttaaatt

SEQ ID NO: 342386 - DNA, 20 bp, Artificial Sequence
  chemically synthesized
tgatttaaatttagaacatg

SEQ ID NO: 342387 - DNA, 20 bp, Artificial Sequence
  chemically synthesized
taaatttagaacatgtggcc

SEQ ID NO: 342388 - DNA, 20 bp, Artificial Sequence
  chemically synthesized
ccacattagggtaaaagact

SEQ ID NO: 342389 - DNA, 20 bp, Artificial Sequence
  chemically synthesized
attttgccacattagggtaa

SEQ ID NO: 342390 - DNA, 20 bp, Artificial Sequence
  chemically synthesized
ccaagtcttttaccctaatg

SEQ ID NO: 342391 - DNA, 20 bp, Artificial Sequence
  chemically synthesized
ttcctgattttgccacatta

SEQ ID NO: 342392 - DNA, 20 bp, Artificial Sequence
  chemically synthesized
attcctgattttgccacatt

SEQ ID NO: 342393 - DNA, 20 bp, Artificial Sequence
  chemically synthesized
tattcctgattttgccacat

SEQ ID NO: 342394 - DNA, 20 bp, Artificial Sequence
  chemically synthesized
ttaccctaatgtggcaaaat

SEQ ID NO: 342395 - DNA, 20 bp, Artificial Sequence
  chemically synthesized
taccctaatgtggcaaaatc

SEQ ID NO: 342396 - DNA, 20 bp, Artificial Sequence
  chemically synthesized
aaaatcaggaataaaaaatt

SEQ ID NO: 342397 - DNA, 20 bp, Artificial Sequence
  chemically synthesized
gaataaaaaattaagtgttt

SEQ ID NO: 342398 - DNA, 20 bp, Artificial Sequence
  chemically synthesized
aagtgttttagtattcattt

SEQ ID NO: 342399 - DNA, 20 bp, Artificial Sequence
  chemically synthesized
agtgttttagtattcatttt

SEQ ID NO: 342400 - DNA, 20 bp, Artificial Sequence
  chemically synthesized
cattttgggtaaatttctat

SEQ ID NO: 342401 - DNA, 20 bp, Artificial Sequence
  chemically synthesized
actgttttcaagcgcactca

SEQ ID NO: 342402 - DNA, 20 bp, Artificial Sequence
  chemically synthesized
tctatgagtgcgcttgaaaa

SEQ ID NO: 342403 - DNA, 20 bp, Artificial Sequence
  chemically synthesized
cagtttcatgaactgttttc

SEQ ID NO: 342404 - DNA, 20 bp, Artificial Sequence
  chemically synthesized
tgaaaacagttcatgaaact

SEQ ID NO: 342405 - DNA, 20 bp, Artificial Sequence
  chemically synthesized
tcttacacttgtgtttttct

SEQ ID NO: 342406 - DNA, 20 bp, Artificial Sequence
  chemically synthesized
catgaaactgagaaaaacac

SEQ ID NO: 342407 - DNA, 20 bp, Artificial Sequence
  chemically synthesized
actgagaaaaacacaagtgt

SEQ ID NO: 342408 - DNA, 20 bp, Artificial Sequence
  chemically synthesized
tgtaagattaccataataca

SEQ ID NO: 342409 - DNA, 20 bp, Artificial Sequence
  chemically synthesized
tgatcacatgctttgtatta

SEQ ID NO: 342410 - DNA, 20 bp, Artificial Sequence
  chemically synthesized
tacaaagcatgtgatcactt

SEQ ID NO: 342411 - DNA, 20 bp, Artificial Sequence
  chemically synthesized
aagcatgtgatcactttgga

SEQ ID NO: 342412 - DNA, 20 bp, Artificial Sequence
  chemically synthesized
agcatgtgatcactttggaa

SEQ ID NO: 342413 - DNA, 20 bp, Artificial Sequence
  chemically synthesized
tagtagtatacacctttcca

SEQ ID NO: 342414 - DNA, 20 bp, Artificial Sequence
  chemically synthesized
tggaaaggtgtatactacta

SEQ ID NO: 342415 - DNA, 20 bp, Artificial Sequence
  chemically synthesized
tgcctataccttttccatag

SEQ ID NO: 342416 - DNA, 20 bp, Artificial Sequence
  chemically synthesized
aggtgtatactactatggaa

SEQ ID NO: 342417 - DNA, 20 bp, Artificial Sequence
  chemically synthesized
ggtgtatactactatggaaa

SEQ ID NO: 342418 - DNA, 20 bp, Artificial Sequence
  chemically synthesized
tattgcctataccttttcca

SEQ ID NO: 342419 - DNA, 20 bp, Artificial Sequence
  chemically synthesized
atactactatggaaaaggta

SEQ ID NO: 342420 - DNA, 20 bp, Artificial Sequence
  chemically synthesized
tactactatggaaaaggtat

SEQ ID NO: 342421 - DNA, 20 bp, Artificial Sequence
  chemically synthesized
aaaggtataggcaatacttc

SEQ ID NO: 342422 - DNA, 20 bp, Artificial Sequence
  chemically synthesized
gtataggcaatacttctagt

SEQ ID NO: 342423 - DNA, 20 bp, Artificial Sequence
  chemically synthesized
ttccaaatcattctaactag

SEQ ID NO: 342424 - DNA, 20 bp, Artificial Sequence
  chemically synthesized
cttttccaaatcattctaac

SEQ ID NO: 342425 - DNA, 20 bp, Artificial Sequence
  chemically synthesized
tacttctagttagaatgatt

SEQ ID NO: 342426 - DNA, 20 bp, Artificial Sequence
  chemically synthesized
ctagttagaatgatttggaa

SEQ ID NO: 342427 - DNA, 20 bp, Artificial Sequence
  chemically synthesized
tagttagaatgatttggaaa

SEQ ID NO: 342428 - DNA, 20 bp, Artificial Sequence
  chemically synthesized
aatgatttggaaaaggtttg

SEQ ID NO: 342429 - DNA, 20 bp, Artificial Sequence
  chemically synthesized
atgatttggaaaaggtttgt

SEQ ID NO: 342430 - DNA, 20 bp, Artificial Sequence
  chemically synthesized
tttggaaaaggtttgtagga

SEQ ID NO: 342431 - DNA, 20 bp, Artificial Sequence
  chemically synthesized
atattttaattaaattccac

SEQ ID NO: 342432 - DNA, 20 bp, Artificial Sequence
  chemically synthesized
attttaattaaattccacca

SEQ ID NO: 342433 - DNA, 20 bp, Artificial Sequence
  chemically synthesized
ttttaattaaattccaccag

SEQ ID NO: 342434 - DNA, 20 bp, Artificial Sequence
  chemically synthesized
tattatttcttttcctctgg

SEQ ID NO: 342435 - DNA, 20 bp, Artificial Sequence
  chemically synthesized
attaaattccaccagaggaa

SEQ ID NO: 342436 - DNA, 20 bp, Artificial Sequence
  chemically synthesized
ctgtattatttcttttcctc

SEQ ID NO: 342437 - DNA, 20 bp, Artificial Sequence
  chemically synthesized
ccagaggaaaagaaataata

SEQ ID NO: 342438 - DNA, 20 bp, Artificial Sequence
  chemically synthesized
aagaaataatacagcaattt

SEQ ID NO: 342439 - DNA, 20 bp, Artificial Sequence
  chemically synthesized
agaaataatacagcaatttt

SEQ ID NO: 342440 - DNA, 20 bp, Artificial Sequence
  chemically synthesized
caattttgggaaattattaa

SEQ ID NO: 342441 - DNA, 20 bp, Artificial Sequence
  chemically synthesized
ttgggaaattattaacagac

SEQ ID NO: 342442 - DNA, 20 bp, Artificial Sequence
  chemically synthesized
ggaaattattaacagaccag

SEQ ID NO: 342443 - DNA, 20 bp, Artificial Sequence
  chemically synthesized
attattaacagaccagtggt

SEQ ID NO: 342444 - DNA, 20 bp, Artificial Sequence
  chemically synthesized
tattaacagaccagtggttg

SEQ ID NO: 342445 - DNA, 20 bp, Artificial Sequence
  chemically synthesized
ttatctcaatctccaaccac

SEQ ID NO: 342446 - DNA, 20 bp, Artificial Sequence
  chemically synthesized
cagaccagtggttggagatt

SEQ ID NO: 342447 - DNA, 20 bp, Artificial Sequence
  chemically synthesized
gttggagattgagataaatt

SEQ ID NO: 342448 - DNA, 20 bp, Artificial Sequence
  chemically synthesized
tgagataaatttggaaactt

SEQ ID NO: 342449 - DNA, 20 bp, Artificial Sequence
  chemically synthesized
gataaatttggaaacttgag

SEQ ID NO: 342450 - DNA, 20 bp, Artificial Sequence
  chemically synthesized
atttcaaccacatacttctc

SEQ ID NO: 342451 - DNA, 20 bp, Artificial Sequence
  chemically synthesized
ttggaaacttgagaagtatg

SEQ ID NO: 342452 - DNA, 20 bp, Artificial Sequence
  chemically synthesized
atgtggttgaaatgtgacca

SEQ ID NO: 342453 - DNA, 20 bp, Artificial Sequence
  chemically synthesized
ggttgaaatgtgaccatgga

SEQ ID NO: 342454 - DNA, 20 bp, Artificial Sequence
  chemically synthesized
gtggtactttcgactgtcca

SEQ ID NO: 342455 - DNA, 20 bp, Artificial Sequence
  chemically synthesized
atgtgaccatggacagtcga

SEQ ID NO: 342456 - DNA, 20 bp, Artificial Sequence
  chemically synthesized
agtcgaaagtaccactgttg

SEQ ID NO: 342457 - DNA, 20 bp, Artificial Sequence
  chemically synthesized
aatggaaaacacttcaacag

SEQ ID NO: 342458 - DNA, 20 bp, Artificial Sequence
  chemically synthesized
cacaatggaaaacacttcaa

SEQ ID NO: 342459 - DNA, 20 bp, Artificial Sequence
  chemically synthesized
tgttgaagtgttttccattg

SEQ ID NO: 342460 - DNA, 20 bp, Artificial Sequence
  chemically synthesized
cttctcttaagattccacaa

SEQ ID NO: 342461 - DNA, 20 bp, Artificial Sequence
  chemically synthesized
gttttccattgtggaatctt

SEQ ID NO: 342462 - DNA, 20 bp, Artificial Sequence
  chemically synthesized
tttccattgtggaatcttaa

SEQ ID NO: 342463 - DNA, 20 bp, Artificial Sequence
  chemically synthesized
ccattgtggaatcttaagag

SEQ ID NO: 342464 - DNA, 20 bp, Artificial Sequence
  chemically synthesized
attgtggaatcttaagagaa

SEQ ID NO: 342465 - DNA, 20 bp, Artificial Sequence
  chemically synthesized
agtataaaagctcttctctt

SEQ ID NO: 342466 - DNA, 20 bp, Artificial Sequence
  chemically synthesized
actgctgccctaaagtataa

SEQ ID NO: 342467 - DNA, 20 bp, Artificial Sequence
  chemically synthesized
agagaagagcttttatactt

SEQ ID NO: 342468 - DNA, 20 bp, Artificial Sequence
  chemically synthesized
gagaagagcttttatacttt

SEQ ID NO: 342469 - DNA, 20 bp, Artificial Sequence
  chemically synthesized
agaagagcttttatacttta

SEQ ID NO: 342470 - DNA, 20 bp, Artificial Sequence
  chemically synthesized
agagcttttatactttaggg

SEQ ID NO: 342471 - DNA, 20 bp, Artificial Sequence
  chemically synthesized
ctatgagaactgctgcccta

SEQ ID NO: 342472 - DNA, 20 bp, Artificial Sequence
  chemically synthesized
gcttttatactttagggcag

SEQ ID NO: 342473 - DNA, 20 bp, Artificial Sequence
  chemically synthesized
ctttagggcagcagttctca

SEQ ID NO: 342474 - DNA, 20 bp, Artificial Sequence
  chemically synthesized
gggcagcagttctcatagtg

SEQ ID NO: 342475 - DNA, 20 bp, Artificial Sequence
  chemically synthesized
atgtctgagaaccacactat

SEQ ID NO: 342476 - DNA, 20 bp, Artificial Sequence
  chemically synthesized
agttctcatagtgtggttct

SEQ ID NO: 342477 - DNA, 20 bp, Artificial Sequence
  chemically synthesized
atagtgtggttctcagacat

SEQ ID NO: 342478 - DNA, 20 bp, Artificial Sequence
  chemically synthesized
tgctgttgattctgatgtct

SEQ ID NO: 342479 - DNA, 20 bp, Artificial Sequence
  chemically synthesized
ttctcagacatcagaatcaa

SEQ ID NO: 342480 - DNA, 20 bp, Artificial Sequence
  chemically synthesized
acatcagaatcaacagcaac

SEQ ID NO: 342481 - DNA, 20 bp, Artificial Sequence
  chemically synthesized
catcagaatcaacagcaact

SEQ ID NO: 342482 - DNA, 20 bp, Artificial Sequence
  chemically synthesized
ttgcacttctcacaaattcc

SEQ ID NO: 342483 - DNA, 20 bp, Artificial Sequence
  chemically synthesized
aacagcaactgggaatttgt

SEQ ID NO: 342484 - DNA, 20 bp, Artificial Sequence
  chemically synthesized
agcaactgggaatttgtgag

SEQ ID NO: 342485 - DNA, 20 bp, Artificial Sequence
  chemically synthesized
tgtgagaagtgcaaccgctc

SEQ ID NO: 342486 - DNA, 20 bp, Artificial Sequence
  chemically synthesized
ggtctagagtacagccagag

SEQ ID NO: 342487 - DNA, 20 bp, Artificial Sequence
  chemically synthesized
gtaggtctagagtacagcca

SEQ ID NO: 342488 - DNA, 20 bp, Artificial Sequence
  chemically synthesized
ctgtaggtctagagtacagc

SEQ ID NO: 342489 - DNA, 20 bp, Artificial Sequence
  chemically synthesized
caaccgctctggctgtactc

SEQ ID NO: 342490 - DNA, 20 bp, Artificial Sequence
  chemically synthesized
catcctgtaggtctagagta

SEQ ID NO: 342491 - DNA, 20 bp, Artificial Sequence
  chemically synthesized
tttctcatcctgtaggtcta

SEQ ID NO: 342492 - DNA, 20 bp, Artificial Sequence
  chemically synthesized
ctggctgtactctagaccta

SEQ ID NO: 342493 - DNA, 20 bp, Artificial Sequence
  chemically synthesized
tggctgtactctagacctac

SEQ ID NO: 342494 - DNA, 20 bp, Artificial Sequence
  chemically synthesized
agtttctcatcctgtaggtc

SEQ ID NO: 342495 - DNA, 20 bp, Artificial Sequence
  chemically synthesized
gtactctagacctacaggat

SEQ ID NO: 342496 - DNA, 20 bp, Artificial Sequence
  chemically synthesized
ccctgagtttctcatcctgt

SEQ ID NO: 342497 - DNA, 20 bp, Artificial Sequence
  chemically synthesized
cccctgagtttctcatcctg

SEQ ID NO: 342498 - DNA, 20 bp, Artificial Sequence
  chemically synthesized
gacctacaggatgagaaact

SEQ ID NO: 342499 - DNA, 20 bp, Artificial Sequence
  chemically synthesized
acctacaggatgagaaactc

SEQ ID NO: 342500 - DNA, 20 bp, Artificial Sequence
  chemically synthesized
cctacaggatgagaaactca

SEQ ID NO: 342501 - DNA, 20 bp, Artificial Sequence
  chemically synthesized
ctacaggatgagaaactcag

SEQ ID NO: 342502 - DNA, 20 bp, Artificial Sequence
  chemically synthesized
tacaggatgagaaactcagg

SEQ ID NO: 342503 - DNA, 20 bp, Artificial Sequence
  chemically synthesized
aggatgagaaactcaggggg

SEQ ID NO: 342504 - DNA, 20 bp, Artificial Sequence
  chemically synthesized
agtgttgggatccaccccct

SEQ ID NO: 342505 - DNA, 20 bp, Artificial Sequence
  chemically synthesized
ttgttaaaacagggagtgtt

SEQ ID NO: 342506 - DNA, 20 bp, Artificial Sequence
  chemically synthesized
tttgttaaaacagggagtgt

SEQ ID NO: 342507 - DNA, 20 bp, Artificial Sequence
  chemically synthesized
tagaggtttgttaaaacagg

SEQ ID NO: 342508 - DNA, 20 bp, Artificial Sequence
  chemically synthesized
cctagaggtttgttaaaaca

SEQ ID NO: 342509 - DNA, 20 bp, Artificial Sequence
  chemically synthesized
acctagaggtttgttaaaac

SEQ ID NO: 342510 - DNA, 20 bp, Artificial Sequence
  chemically synthesized
aacctagaggtttgttaaaa

SEQ ID NO: 342511 - DNA, 20 bp, Artificial Sequence
  chemically synthesized
tccctgttttaacaaacctc

SEQ ID NO: 342512 - DNA, 20 bp, Artificial Sequence
  chemically synthesized
ccctgttttaacaaacctct

SEQ ID NO: 342513 - DNA, 20 bp, Artificial Sequence
  chemically synthesized
catgcatcagaataacctag

SEQ ID NO: 342514 - DNA, 20 bp, Artificial Sequence
  chemically synthesized
acatgcatcagaataaccta

SEQ ID NO: 342515 - DNA, 20 bp, Artificial Sequence
  chemically synthesized
gaacatgcatcagaataacc

SEQ ID NO: 342516 - DNA, 20 bp, Artificial Sequence
  chemically synthesized
tctcaaacttgaacatgcat

SEQ ID NO: 342517 - DNA, 20 bp, Artificial Sequence
  chemically synthesized
ggttattctgatgcatgttc

SEQ ID NO: 342518 - DNA, 20 bp, Artificial Sequence
  chemically synthesized
tctgatgcatgttcaagttt

SEQ ID NO: 342519 - DNA, 20 bp, Artificial Sequence
  chemically synthesized
agtttgagaacccttgtttt

SEQ ID NO: 342520 - DNA, 20 bp, Artificial Sequence
  chemically synthesized
aaccacatcccttaaaacaa

SEQ ID NO: 342521 - DNA, 20 bp, Artificial Sequence
  chemically synthesized
gtttgagaacccttgtttta

SEQ ID NO: 342522 - DNA, 20 bp, Artificial Sequence
  chemically synthesized
caaccacatcccttaaaaca

SEQ ID NO: 342523 - DNA, 20 bp, Artificial Sequence
  chemically synthesized
tttgagaacccttgttttaa

SEQ ID NO: 342524 - DNA, 20 bp, Artificial Sequence
  chemically synthesized
gcaaccacatcccttaaaac

SEQ ID NO: 342525 - DNA, 20 bp, Artificial Sequence
  chemically synthesized
aacccttgttttaagggatg

SEQ ID NO: 342526 - DNA, 20 bp, Artificial Sequence
  chemically synthesized
taagggatgtggttgccatt

SEQ ID NO: 342527 - DNA, 20 bp, Artificial Sequence
  chemically synthesized
actttggtgaatagacttaa

SEQ ID NO: 342528 - DNA, 20 bp, Artificial Sequence
  chemically synthesized
gccattaagtctattcacca

SEQ ID NO: 342529 - DNA, 20 bp, Artificial Sequence
  chemically synthesized
aagaatggaactttggtgaa

SEQ ID NO: 342530 - DNA, 20 bp, Artificial Sequence
  chemically synthesized
ggaataaaagaatggaactt

SEQ ID NO: 342531 - DNA, 20 bp, Artificial Sequence
  chemically synthesized
aggagcctggaataaaagaa

SEQ ID NO: 342532 - DNA, 20 bp, Artificial Sequence
  chemically synthesized
aaagttccattcttttattc

SEQ ID NO: 342533 - DNA, 20 bp, Artificial Sequence
  chemically synthesized
aagttccattcttttattcc

SEQ ID NO: 342534 - DNA, 20 bp, Artificial Sequence
  chemically synthesized
ctatcaggagcctggaataa

SEQ ID NO: 342535 - DNA, 20 bp, Artificial Sequence
  chemically synthesized
aaaagatactatcaggagcc

SEQ ID NO: 342536 - DNA, 20 bp, Artificial Sequence
  chemically synthesized
cttttattccaggctcctga

SEQ ID NO: 342537 - DNA, 20 bp, Artificial Sequence
  chemically synthesized
agagtaaaagatactatcag

SEQ ID NO: 342538 - DNA, 20 bp, Artificial Sequence
  chemically synthesized
gcagagtaaaagatactatc

SEQ ID NO: 342539 - DNA, 20 bp, Artificial Sequence
  chemically synthesized
ggcagagtaaaagatactat

SEQ ID NO: 342540 - DNA, 20 bp, Artificial Sequence
  chemically synthesized
agtacaagtaggcagagtaa

SEQ ID NO: 342541 - DNA, 20 bp, Artificial Sequence
  chemically synthesized
tatcaaagtacaagtaggca

SEQ ID NO: 342542 - DNA, 20 bp, Artificial Sequence
  chemically synthesized
catatcaaagtacaagtagg

SEQ ID NO: 342543 - DNA, 20 bp, Artificial Sequence
  chemically synthesized
ggccatatcaaagtacaagt

SEQ ID NO: 342544 - DNA, 20 bp, Artificial Sequence
  chemically synthesized
tggccatatcaaagtacaag

SEQ ID NO: 342545 - DNA, 20 bp, Artificial Sequence
  chemically synthesized
acatggccatatcaaagtac

SEQ ID NO: 342546 - DNA, 20 bp, Artificial Sequence
  chemically synthesized
tgcctacttgtactttgata

SEQ ID NO: 342547 - DNA, 20 bp, Artificial Sequence
  chemically synthesized
taagtcacatggccatatca

SEQ ID NO: 342548 - DNA, 20 bp, Artificial Sequence
  chemically synthesized
atttgatgaagtaagtcaca

SEQ ID NO: 342549 - DNA, 20 bp, Artificial Sequence
  chemically synthesized
cacatttaatttgatgaagt

SEQ ID NO: 342550 - DNA, 20 bp, Artificial Sequence
  chemically synthesized
tgttcacatttaatttgatg

SEQ ID NO: 342551 - DNA, 20 bp, Artificial Sequence
  chemically synthesized
ttcatcaaattaaatgtgaa

SEQ ID NO: 342552 - DNA, 20 bp, Artificial Sequence
  chemically synthesized
atcaaattaaatgtgaacag

SEQ ID NO: 342553 - DNA, 20 bp, Artificial Sequence
  chemically synthesized
aagtgatgtgcgccatttcc

SEQ ID NO: 342554 - DNA, 20 bp, Artificial Sequence
  chemically synthesized
gtaaagcttctgcttggaaa

SEQ ID NO: 342555 - DNA, 20 bp, Artificial Sequence
  chemically synthesized
tgatgtgcgccatttccaag

SEQ ID NO: 342556 - DNA, 20 bp, Artificial Sequence
  chemically synthesized
tgtgcgccatttccaagcag

SEQ ID NO: 342557 - DNA, 20 bp, Artificial Sequence
  chemically synthesized
taacccgtaaagcttctgct

SEQ ID NO: 342558 - DNA, 20 bp, Artificial Sequence
  chemically synthesized
atttccaagcagaagcttta

SEQ ID NO: 342559 - DNA, 20 bp, Artificial Sequence
  chemically synthesized
tttccaagcagaagctttac

SEQ ID NO: 342560 - DNA, 20 bp, Artificial Sequence
  chemically synthesized
aaagcacacgataacccgta

SEQ ID NO: 342561 - DNA, 20 bp, Artificial Sequence
  chemically synthesized
gaacgcaagagaacatgtga

SEQ ID NO: 342562 - DNA, 20 bp, Artificial Sequence
  chemically synthesized
tataaactttaagaacgcaa

SEQ ID NO: 342563 - DNA, 20 bp, Artificial Sequence
  chemically synthesized
aatataaactttaagaacgc

SEQ ID NO: 342564 - DNA, 20 bp, Artificial Sequence
  chemically synthesized
catgttctcttgcgttctta

SEQ ID NO: 342565 - DNA, 20 bp, Artificial Sequence
  chemically synthesized
gtcatctcaatataaacttt

SEQ ID NO: 342566 - DNA, 20 bp, Artificial Sequence
  chemically synthesized
gcgttcttaaagtttatatt

SEQ ID NO: 342567 - DNA, 20 bp, Artificial Sequence
  chemically synthesized
tattgagatgacccttctct

SEQ ID NO: 342568 - DNA, 20 bp, Artificial Sequence
  chemically synthesized
aaggacctgggctgagagaa

SEQ ID NO: 342569 - DNA, 20 bp, Artificial Sequence
  chemically synthesized
gaaggacctgggctgagaga

SEQ ID NO: 342570 - DNA, 20 bp, Artificial Sequence
  chemically synthesized
tgaaggacctgggctgagag

SEQ ID NO: 342571 - DNA, 20 bp, Artificial Sequence
  chemically synthesized
agatgacccttctctcagcc

SEQ ID NO: 342572 - DNA, 20 bp, Artificial Sequence
  chemically synthesized
gatgacccttctctcagccc

SEQ ID NO: 342573 - DNA, 20 bp, Artificial Sequence
  chemically synthesized
agctgaaggacctgggctga

SEQ ID NO: 342574 - DNA, 20 bp, Artificial Sequence
  chemically synthesized
tcagctgaaggacctgggct

SEQ ID NO: 342575 - DNA, 20 bp, Artificial Sequence
  chemically synthesized
tgtactcagctgaaggacct

SEQ ID NO: 342576 - DNA, 20 bp, Artificial Sequence
  chemically synthesized
ttctctcagcccaggtcctt

SEQ ID NO: 342577 - DNA, 20 bp, Artificial Sequence
  chemically synthesized
ttgtactcagctgaaggacc

SEQ ID NO: 342578 - DNA, 20 bp, Artificial Sequence
  chemically synthesized
tcagcccaggtccttcagct

SEQ ID NO: 342579 - DNA, 20 bp, Artificial Sequence
  chemically synthesized
aactcattgtactcagctga

SEQ ID NO: 342580 - DNA, 20 bp, Artificial Sequence
  chemically synthesized
caactcattgtactcagctg

SEQ ID NO: 342581 - DNA, 20 bp, Artificial Sequence
  chemically synthesized
gcgtctcaactcattgtact

SEQ ID NO: 342582 - DNA, 20 bp, Artificial Sequence
  chemically synthesized
gtccttcagctgagtacaat

SEQ ID NO: 342583 - DNA, 20 bp, Artificial Sequence
  chemically synthesized
tcagctgagtacaatgagtt

SEQ ID NO: 342584 - DNA, 20 bp, Artificial Sequence
  chemically synthesized
tcatgtcactatagattggt

SEQ ID NO: 342585 - DNA, 20 bp, Artificial Sequence
  chemically synthesized
ttcatgtcactatagattgg

SEQ ID NO: 342586 - DNA, 20 bp, Artificial Sequence
  chemically synthesized
ttgagacgcctaccaatcta

SEQ ID NO: 342587 - DNA, 20 bp, Artificial Sequence
  chemically synthesized
aacttcatgtcactatagat

SEQ ID NO: 342588 - DNA, 20 bp, Artificial Sequence
  chemically synthesized
cgccaaacttcatgtcacta

SEQ ID NO: 342589 - DNA, 20 bp, Artificial Sequence
  chemically synthesized
taccaatctatagtgacatg

SEQ ID NO: 342590 - DNA, 20 bp, Artificial Sequence
  chemically synthesized
atctatagtgacatgaagtt

SEQ ID NO: 342591 - DNA, 20 bp, Artificial Sequence
  chemically synthesized
tatagtgacatgaagtttgg

SEQ ID NO: 342592 - DNA, 20 bp, Artificial Sequence
  chemically synthesized
atagtgacatgaagtttggc

SEQ ID NO: 342593 - DNA, 20 bp, Artificial Sequence
  chemically synthesized
gtgacatgaagtttggcggg

SEQ ID NO: 342594 - DNA, 20 bp, Artificial Sequence
  chemically synthesized
gaagaaaattctattctttt

SEQ ID NO: 342595 - DNA, 20 bp, Artificial Sequence
  chemically synthesized
atctcagcgactcaaaagaa

SEQ ID NO: 342596 - DNA, 20 bp, Artificial Sequence
  chemically synthesized
ctgatatctcagcgactcaa

SEQ ID NO: 342597 - DNA, 20 bp, Artificial Sequence
  chemically synthesized
ttctattcttttgagtcgct

SEQ ID NO: 342598 - DNA, 20 bp, Artificial Sequence
  chemically synthesized
cttttgagtcgctgagatat

SEQ ID NO: 342599 - DNA, 20 bp, Artificial Sequence
  chemically synthesized
taagaataattctgatatct

SEQ ID NO: 342600 - DNA, 20 bp, Artificial Sequence
  chemically synthesized
agatatcagaattattctta

SEQ ID NO: 342601 - DNA, 20 bp, Artificial Sequence
  chemically synthesized
acactacattatgcatctat

SEQ ID NO: 342602 - DNA, 20 bp, Artificial Sequence
  chemically synthesized
attcttatagatgcataatg

SEQ ID NO: 342603 - DNA, 20 bp, Artificial Sequence
  chemically synthesized
atgtagtgtatcctgattta

SEQ ID NO: 342604 - DNA, 20 bp, Artificial Sequence
  chemically synthesized
tgtagtgtatcctgatttat

SEQ ID NO: 342605 - DNA, 20 bp, Artificial Sequence
  chemically synthesized
taccatggcccctataaatc

SEQ ID NO: 342606 - DNA, 20 bp, Artificial Sequence
  chemically synthesized
gtagtgtatcctgatttata

SEQ ID NO: 342607 - DNA, 20 bp, Artificial Sequence
  chemically synthesized
gtaccatggcccctataaat

SEQ ID NO: 342608 - DNA, 20 bp, Artificial Sequence
  chemically synthesized
tagtgtatcctgatttatag

SEQ ID NO: 342609 - DNA, 20 bp, Artificial Sequence
  chemically synthesized
atcctgatttataggggcca

SEQ ID NO: 342610 - DNA, 20 bp, Artificial Sequence
  chemically synthesized
gatttataggggccatggta

SEQ ID NO: 342611 - DNA, 20 bp, Artificial Sequence
  chemically synthesized
tttataggggccatggtaca

SEQ ID NO: 342612 - DNA, 20 bp, Artificial Sequence
  chemically synthesized
tagatcccttctctgtacca

SEQ ID NO: 342613 - DNA, 20 bp, Artificial Sequence
  chemically synthesized
ataggggccatggtacagag

SEQ ID NO: 342614 - DNA, 20 bp, Artificial Sequence
  chemically synthesized
taggggccatggtacagaga

SEQ ID NO: 342615 - DNA, 20 bp, Artificial Sequence
  chemically synthesized
aggggccatggtacagagaa

SEQ ID NO: 342616 - DNA, 20 bp, Artificial Sequence
  chemically synthesized
cagagaagggatctatttca

SEQ ID NO: 342617 - DNA, 20 bp, Artificial Sequence
  chemically synthesized
atgttctctttaccatgaaa

SEQ ID NO: 342618 - DNA, 20 bp, Artificial Sequence
  chemically synthesized
aagggatctatttcatggta

SEQ ID NO: 342619 - DNA, 20 bp, Artificial Sequence
  chemically synthesized
gggatctatttcatggtaaa

SEQ ID NO: 342620 - DNA, 20 bp, Artificial Sequence
  chemically synthesized
aaagagaacatgtgtatcaa

SEQ ID NO: 342621 - DNA, 20 bp, Artificial Sequence
  chemically synthesized
catgtgtatcaacagattta

SEQ ID NO: 342622 - DNA, 20 bp, Artificial Sequence
  chemically synthesized
caacagatttatggtatcta

SEQ ID NO: 342623 - DNA, 20 bp, Artificial Sequence
  chemically synthesized
cagatttatggtatctatgg

SEQ ID NO: 342624 - DNA, 20 bp, Artificial Sequence
  chemically synthesized
gatttatggtatctatggaa

SEQ ID NO: 342625 - DNA, 20 bp, Artificial Sequence
  chemically synthesized
atttatggtatctatggaag

SEQ ID NO: 342626 - DNA, 20 bp, Artificial Sequence
  chemically synthesized
tcccatgttttcctcttcca

SEQ ID NO: 342627 - DNA, 20 bp, Artificial Sequence
  chemically synthesized
atctatggaagaggaaaaca

SEQ ID NO: 342628 - DNA, 20 bp, Artificial Sequence
  chemically synthesized
tctatggaagaggaaaacat

SEQ ID NO: 342629 - DNA, 20 bp, Artificial Sequence
  chemically synthesized
tccttttttctgaggtttaa

SEQ ID NO: 342630 - DNA, 20 bp, Artificial Sequence
  chemically synthesized
tgggaatcactattaaacct

SEQ ID NO: 342631 - DNA, 20 bp, Artificial Sequence
  chemically synthesized
cactattaaacctcagaaaa

SEQ ID NO: 342632 - DNA, 20 bp, Artificial Sequence
  chemically synthesized
atatatgatccttttttctg

SEQ ID NO: 342633 - DNA, 20 bp, Artificial Sequence
  chemically synthesized
actattaaacctcagaaaaa

SEQ ID NO: 342634 - DNA, 20 bp, Artificial Sequence
  chemically synthesized
aatatatgatccttttttct

SEQ ID NO: 342635 - DNA, 20 bp, Artificial Sequence
  chemically synthesized
tcatatattgtcacataaat

SEQ ID NO: 342636 - DNA, 20 bp, Artificial Sequence
  chemically synthesized
atatattgtcacataaataa

SEQ ID NO: 342637 - DNA, 20 bp, Artificial Sequence
  chemically synthesized
atattgtcacataaataaga

SEQ ID NO: 342638 - DNA, 20 bp, Artificial Sequence
  chemically synthesized
tattgtcacataaataagag

SEQ ID NO: 342639 - DNA, 20 bp, Artificial Sequence
  chemically synthesized
ttgtcacataaataagagag

SEQ ID NO: 342640 - DNA, 20 bp, Artificial Sequence
  chemically synthesized
cacataaataagagaggaga

SEQ ID NO: 342641 - DNA, 20 bp, Artificial Sequence
  chemically synthesized
aaataagagaggagaaagaa

SEQ ID NO: 342642 - DNA, 20 bp, Artificial Sequence
  chemically synthesized
ataagagaggagaaagaaca

SEQ ID NO: 342643 - DNA, 20 bp, Artificial Sequence
  chemically synthesized
aagagaggagaaagaacaga

SEQ ID NO: 342644 - DNA, 20 bp, Artificial Sequence
  chemically synthesized
agaggagaaagaacagagag

SEQ ID NO: 342645 - DNA, 20 bp, Artificial Sequence
  chemically synthesized
gaggagaaagaacagagaga

SEQ ID NO: 342646 - DNA, 20 bp, Artificial Sequence
  chemically synthesized
ggagaaagaacagagagaag

SEQ ID NO: 342647 - DNA, 20 bp, Artificial Sequence
  chemically synthesized
gaaagaacagagagaaggag

SEQ ID NO: 342648 - DNA, 20 bp, Artificial Sequence
  chemically synthesized
aaatattgttaatatgttgg

SEQ ID NO: 342649 - DNA, 20 bp, Artificial Sequence
  chemically synthesized
gataaatattgttaatatgt

SEQ ID NO: 342650 - DNA, 20 bp, Artificial Sequence
  chemically synthesized
tattaacaatatttatcttt

SEQ ID NO: 342651 - DNA, 20 bp, Artificial Sequence
  chemically synthesized
caatatttatctttcggtgt

SEQ ID NO: 342652 - DNA, 20 bp, Artificial Sequence
  chemically synthesized
atgtaaaattcttacaccga

SEQ ID NO: 342653 - DNA, 20 bp, Artificial Sequence
  chemically synthesized
ataatgcttaaataataata

SEQ ID NO: 342654 - DNA, 20 bp, Artificial Sequence
  chemically synthesized
tatttactatattattattt

SEQ ID NO: 342655 - DNA, 20 bp, Artificial Sequence
  chemically synthesized
agcattatataatcataaaa

SEQ ID NO: 342656 - DNA, 20 bp, Artificial Sequence
  chemically synthesized
aatagaaatgaatattataa

SEQ ID NO: 342657 - DNA, 20 bp, Artificial Sequence
  chemically synthesized
atgaatattataaaagcata

SEQ ID NO: 342658 - DNA, 20 bp, Artificial Sequence
  chemically synthesized
taaagtttatgacacaaaat

SEQ ID NO: 342659 - DNA, 20 bp, Artificial Sequence
  chemically synthesized
cctccaaaagatgagattcg

SEQ ID NO: 342660 - DNA, 20 bp, Artificial Sequence
  chemically synthesized
ccctccaaaagatgagattc

SEQ ID NO: 342661 - DNA, 20 bp, Artificial Sequence
  chemically synthesized
tggcctcgaatctcatcttt

SEQ ID NO: 342662 - DNA, 20 bp, Artificial Sequence
  chemically synthesized
gtttatgccctccaaaagat

SEQ ID NO: 342663 - DNA, 20 bp, Artificial Sequence
  chemically synthesized
gcctcgaatctcatcttttg

SEQ ID NO: 342664 - DNA, 20 bp, Artificial Sequence
  chemically synthesized
cctcgaatctcatcttttgg

SEQ ID NO: 342665 - DNA, 20 bp, Artificial Sequence
  chemically synthesized
ctcgaatctcatcttttgga

SEQ ID NO: 342666 - DNA, 20 bp, Artificial Sequence
  chemically synthesized
catgagtttatgccctccaa

SEQ ID NO: 342667 - DNA, 20 bp, Artificial Sequence
  chemically synthesized
ttttggagggcataaactca

SEQ ID NO: 342668 - DNA, 20 bp, Artificial Sequence
  chemically synthesized
tggagggcataaactcatgg

SEQ ID NO: 342669 - DNA, 20 bp, Artificial Sequence
  chemically synthesized
taattaagaaagtcttccat

SEQ ID NO: 342670 - DNA, 20 bp, Artificial Sequence
  chemically synthesized
tcatggaagactttcttaat

SEQ ID NO: 342671 - DNA, 20 bp, Artificial Sequence
  chemically synthesized
acaaaatggtctaattaaga

SEQ ID NO: 342672 - DNA, 20 bp, Artificial Sequence
  chemically synthesized
actcacaaaatggtctaatt

SEQ ID NO: 342673 - DNA, 20 bp, Artificial Sequence
  chemically synthesized
tcttaattagaccattttgt

SEQ ID NO: 342674 - DNA, 20 bp, Artificial Sequence
  chemically synthesized
tagtaaatacactcacaaaa

SEQ ID NO: 342675 - DNA, 20 bp, Artificial Sequence
  chemically synthesized
catggatacagatcaagagg

SEQ ID NO: 342676 - DNA, 20 bp, Artificial Sequence
  chemically synthesized
acacatggatacagatcaag

SEQ ID NO: 342677 - DNA, 20 bp, Artificial Sequence
  chemically synthesized
tacacatggatacagatcaa

SEQ ID NO: 342678 - DNA, 20 bp, Artificial Sequence
  chemically synthesized
cctacacatggatacagatc

SEQ ID NO: 342679 - DNA, 20 bp, Artificial Sequence
  chemically synthesized
cagtgtcctacacatggata

SEQ ID NO: 342680 - DNA, 20 bp, Artificial Sequence
  chemically synthesized
tcttgatctgtatccatgtg

SEQ ID NO: 342681 - DNA, 20 bp, Artificial Sequence
  chemically synthesized
cttgatctgtatccatgtgt

SEQ ID NO: 342682 - DNA, 20 bp, Artificial Sequence
  chemically synthesized
ttaaaacagtgtcctacaca

SEQ ID NO: 342683 - DNA, 20 bp, Artificial Sequence
  chemically synthesized
catgtgtaggacactgtttt

SEQ ID NO: 342684 - DNA, 20 bp, Artificial Sequence
  chemically synthesized
cgcatgggaagtacttaaaa

SEQ ID NO: 342685 - DNA, 20 bp, Artificial Sequence
  chemically synthesized
tcatagaaataacgcatggg

SEQ ID NO: 342686 - DNA, 20 bp, Artificial Sequence
  chemically synthesized
agatcatagaaataacgcat

SEQ ID NO: 342687 - DNA, 20 bp, Artificial Sequence
  chemically synthesized
aagatcatagaaataacgca

SEQ ID NO: 342688 - DNA, 20 bp, Artificial Sequence
  chemically synthesized
caagtctatgagaaagatca

SEQ ID NO: 342689 - DNA, 20 bp, Artificial Sequence
  chemically synthesized
tatttctatgatctttctca

SEQ ID NO: 342690 - DNA, 20 bp, Artificial Sequence
  chemically synthesized
tacccagcaagtctatgaga

SEQ ID NO: 342691 - DNA, 20 bp, Artificial Sequence
  chemically synthesized
attttacccagcaagtctat

SEQ ID NO: 342692 - DNA, 20 bp, Artificial Sequence
  chemically synthesized
gatctttctcatagacttgc

SEQ ID NO: 342693 - DNA, 20 bp, Artificial Sequence
  chemically synthesized
atctttctcatagacttgct

SEQ ID NO: 342694 - DNA, 20 bp, Artificial Sequence
  chemically synthesized
gataacaaattttacccagc

SEQ ID NO: 342695 - DNA, 20 bp, Artificial Sequence
  chemically synthesized
ttgggataacaaattttacc

SEQ ID NO: 342696 - DNA, 20 bp, Artificial Sequence
  chemically synthesized
tgggtaaaatttgttatccc

SEQ ID NO: 342697 - DNA, 20 bp, Artificial Sequence
  chemically synthesized
gggtaaaatttgttatccca

SEQ ID NO: 342698 - DNA, 20 bp, Artificial Sequence
  chemically synthesized
aaaatttgttatcccaaggt

SEQ ID NO: 342699 - DNA, 20 bp, Artificial Sequence
  chemically synthesized
gagaattcaatgccaacctt

SEQ ID NO: 342700 - DNA, 20 bp, Artificial Sequence
  chemically synthesized
tgagaattcaatgccaacct

SEQ ID NO: 342701 - DNA, 20 bp, Artificial Sequence
  chemically synthesized
aaggttggcattgaattctc

SEQ ID NO: 342702 - DNA, 20 bp, Artificial Sequence
  chemically synthesized
ggcatgttatgtaaacactt

SEQ ID NO: 342703 - DNA, 20 bp, Artificial Sequence
  chemically synthesized
agtgtttacataacatgccc

SEQ ID NO: 342704 - DNA, 20 bp, Artificial Sequence
  chemically synthesized
tttacttactgtataatcta

SEQ ID NO: 342705 - DNA, 20 bp, Artificial Sequence
  chemically synthesized
atttacttactgtataatct

SEQ ID NO: 342706 - DNA, 20 bp, Artificial Sequence
  chemically synthesized
ataacatgccctagattata

SEQ ID NO: 342707 - DNA, 20 bp, Artificial Sequence
  chemically synthesized
tatttacttactgtataatc

SEQ ID NO: 342708 - DNA, 20 bp, Artificial Sequence
  chemically synthesized
catgccctagattatacagt

SEQ ID NO: 342709 - DNA, 20 bp, Artificial Sequence
  chemically synthesized
agtaagtaaatatatactca

SEQ ID NO: 342710 - DNA, 20 bp, Artificial Sequence
  chemically synthesized
ataacttgatttgaatccat

SEQ ID NO: 342711 - DNA, 20 bp, Artificial Sequence
  chemically synthesized
tatactcatggattcaaatc

SEQ ID NO: 342712 - DNA, 20 bp, Artificial Sequence
  chemically synthesized
tgaaaagaacttaagtttta

SEQ ID NO: 342713 - DNA, 20 bp, Artificial Sequence
  chemically synthesized
tatttatgactctaaaactt

SEQ ID NO: 342714 - DNA, 20 bp, Artificial Sequence
  chemically synthesized
aatgaaaagaacttaagttt

SEQ ID NO: 342715 - DNA, 20 bp, Artificial Sequence
  chemically synthesized
tgctataatgaaaagaactt

SEQ ID NO: 342716 - DNA, 20 bp, Artificial Sequence
  chemically synthesized
aacttaagttcttttcatta

SEQ ID NO: 342717 - DNA, 20 bp, Artificial Sequence
  chemically synthesized
caacagcatgctataatgaa

SEQ ID NO: 342718 - DNA, 20 bp, Artificial Sequence
  chemically synthesized
ttatagcatgctgttgtatg

SEQ ID NO: 342719 - DNA, 20 bp, Artificial Sequence
  chemically synthesized
tcagataaatcttcatacaa

SEQ ID NO: 342720 - DNA, 20 bp, Artificial Sequence
  chemically synthesized
tgttgtatgaagatttatct

SEQ ID NO: 342721 - DNA, 20 bp, Artificial Sequence
  chemically synthesized
tatctgggtaggtacagact

SEQ ID NO: 342722 - DNA, 20 bp, Artificial Sequence
  chemically synthesized
ttcctatatctgggtaggta

SEQ ID NO: 342723 - DNA, 20 bp, Artificial Sequence
  chemically synthesized
tatctgagtctgtacctacc

SEQ ID NO: 342724 - DNA, 20 bp, Artificial Sequence
  chemically synthesized
acaccttcctatatctgggt

SEQ ID NO: 342725 - DNA, 20 bp, Artificial Sequence
  chemically synthesized
cacaccttcctatatctggg

SEQ ID NO: 342726 - DNA, 20 bp, Artificial Sequence
  chemically synthesized
agtctgtacctacccagata

SEQ ID NO: 342727 - DNA, 20 bp, Artificial Sequence
  chemically synthesized
gtctgtacctacccagatat

SEQ ID NO: 342728 - DNA, 20 bp, Artificial Sequence
  chemically synthesized
acacacaccttcctatatct

SEQ ID NO: 342729 - DNA, 20 bp, Artificial Sequence
  chemically synthesized
cacacacaccttcctatatc

SEQ ID NO: 342730 - DNA, 20 bp, Artificial Sequence
  chemically synthesized
tgtacctacccagatatagg

SEQ ID NO: 342731 - DNA, 20 bp, Artificial Sequence
  chemically synthesized
gtacctacccagatatagga

SEQ ID NO: 342732 - DNA, 20 bp, Artificial Sequence
  chemically synthesized
gtgtgtacgtttgtttaaac

SEQ ID NO: 342733 - DNA, 20 bp, Artificial Sequence
  chemically synthesized
gtacgtttgtttaaacaagt

SEQ ID NO: 342734 - DNA, 20 bp, Artificial Sequence
  chemically synthesized
tttaaacaagttagtatatt

SEQ ID NO: 342735 - DNA, 20 bp, Artificial Sequence
  chemically synthesized
ttagtatatttggtaacctt

SEQ ID NO: 342736 - DNA, 20 bp, Artificial Sequence
  chemically synthesized
aagagtcacttattttctaa

SEQ ID NO: 342737 - DNA, 20 bp, Artificial Sequence
  chemically synthesized
caagagtcacttattttcta

SEQ ID NO: 342738 - DNA, 20 bp, Artificial Sequence
  chemically synthesized
tttggtaacctttagaaaat

SEQ ID NO: 342739 - DNA, 20 bp, Artificial Sequence
  chemically synthesized
ctccttctcggcacatacaa

SEQ ID NO: 342740 - DNA, 20 bp, Artificial Sequence
  chemically synthesized
gcctccttctcggcacatac

SEQ ID NO: 342741 - DNA, 20 bp, Artificial Sequence
  chemically synthesized
aagtgactcttgtatgtgcc

SEQ ID NO: 342742 - DNA, 20 bp, Artificial Sequence
  chemically synthesized
tgactcttgtatgtgccgag

SEQ ID NO: 342743 - DNA, 20 bp, Artificial Sequence
  chemically synthesized
gactcttgtatgtgccgaga

SEQ ID NO: 342744 - DNA, 20 bp, Artificial Sequence
  chemically synthesized
ctcttgtatgtgccgagaag

SEQ ID NO: 342745 - DNA, 20 bp, Artificial Sequence
  chemically synthesized
tcttgtatgtgccgagaagg

SEQ ID NO: 342746 - DNA, 20 bp, Artificial Sequence
  chemically synthesized
taaatcaccagcctccttct

SEQ ID NO: 342747 - DNA, 20 bp, Artificial Sequence
  chemically synthesized
gtatgtgccgagaaggaggc

SEQ ID NO: 342748 - DNA, 20 bp, Artificial Sequence
  chemically synthesized
tgacattgagcataaatcac

SEQ ID NO: 342749 - DNA, 20 bp, Artificial Sequence
  chemically synthesized
gtgatttatgctcaatgtca

SEQ ID NO: 342750 - DNA, 20 bp, Artificial Sequence
  chemically synthesized
ttctattacactatgacatt

SEQ ID NO: 342751 - DNA, 20 bp, Artificial Sequence
  chemically synthesized
tgctcaatgtcatagtgtaa

SEQ ID NO: 342752 - DNA, 20 bp, Artificial Sequence
  chemically synthesized
ttgcgttattatgattatta

SEQ ID NO: 342753 - DNA, 20 bp, Artificial Sequence
  chemically synthesized
tgtaataatcataataacgc

SEQ ID NO: 342754 - DNA, 20 bp, Artificial Sequence
  chemically synthesized
cgcaagaaaaatctgatgac

SEQ ID NO: 342755 - DNA, 20 bp, Artificial Sequence
  chemically synthesized
gattagctatgtccagtcat

SEQ ID NO: 342756 - DNA, 20 bp, Artificial Sequence
  chemically synthesized
aaaaatctgatgactggaca

SEQ ID NO: 342757 - DNA, 20 bp, Artificial Sequence
  chemically synthesized
tccgtgtgattagctatgtc

SEQ ID NO: 342758 - DNA, 20 bp, Artificial Sequence
  chemically synthesized
actggacatagctaatcaca

SEQ ID NO: 342759 - DNA, 20 bp, Artificial Sequence
  chemically synthesized
agtggcaatatccgtgtgat

SEQ ID NO: 342760 - DNA, 20 bp, Artificial Sequence
  chemically synthesized
taaaatggaagtacatttag

SEQ ID NO: 342761 - DNA, 20 bp, Artificial Sequence
  chemically synthesized
ttgtaaaatggaagtacatt

SEQ ID NO: 342762 - DNA, 20 bp, Artificial Sequence
  chemically synthesized
atcgctttattgtaaaatgg

SEQ ID NO: 342763 - DNA, 20 bp, Artificial Sequence
  chemically synthesized
cacatcgctttattgtaaaa

SEQ ID NO: 342764 - DNA, 20 bp, Artificial Sequence
  chemically synthesized
tgtacttccattttacaata

SEQ ID NO: 342765 - DNA, 20 bp, Artificial Sequence
  chemically synthesized
tacaataaagcgatgtgata

SEQ ID NO: 342766 - DNA, 20 bp, Artificial Sequence
  chemically synthesized
ataaagaatcatgactcttt

SEQ ID NO: 342767 - DNA, 20 bp, Artificial Sequence
  chemically synthesized
aaagaatcatgactctttga

SEQ ID NO: 342768 - DNA, 20 bp, Artificial Sequence
  chemically synthesized
aagaatcatgactctttgag

SEQ ID NO: 342769 - DNA, 20 bp, Artificial Sequence
  chemically synthesized
agaatcatgactctttgaga

SEQ ID NO: 342770 - DNA, 20 bp, Artificial Sequence
  chemically synthesized
agcgctgttgccctctcaaa

SEQ ID NO: 342771 - DNA, 20 bp, Artificial Sequence
  chemically synthesized
tcagcgctgttgccctctca

SEQ ID NO: 342772 - DNA, 20 bp, Artificial Sequence
  chemically synthesized
atgactctttgagagggcaa

SEQ ID NO: 342773 - DNA, 20 bp, Artificial Sequence
  chemically synthesized
ggcaacagcgctgacatttc

SEQ ID NO: 342774 - DNA, 20 bp, Artificial Sequence
  chemically synthesized
aacttttgacctagaaatgt

SEQ ID NO: 342775 - DNA, 20 bp, Artificial Sequence
  chemically synthesized
gcaacagcgctgacatttct

SEQ ID NO: 342776 - DNA, 20 bp, Artificial Sequence
  chemically synthesized
cgctgacatttctaggtcaa

SEQ ID NO: 342777 - DNA, 20 bp, Artificial Sequence
  chemically synthesized
tctcatgaaaacttttgacc

SEQ ID NO: 342778 - DNA, 20 bp, Artificial Sequence
  chemically synthesized
tctaggtcaaaagttttcat

SEQ ID NO: 342779 - DNA, 20 bp, Artificial Sequence
  chemically synthesized
caaaagttttcatgagatta

SEQ ID NO: 342780 - DNA, 20 bp, Artificial Sequence
  chemically synthesized
aaagttttcatgagattatg

SEQ ID NO: 342781 - DNA, 20 bp, Artificial Sequence
  chemically synthesized
gaggctaattgtacatgttt

SEQ ID NO: 342782 - DNA, 20 bp, Artificial Sequence
  chemically synthesized
ggaggctaattgtacatgtt

SEQ ID NO: 342783 - DNA, 20 bp, Artificial Sequence
  chemically synthesized
agtacctaaacatgtacaat

SEQ ID NO: 342784 - DNA, 20 bp, Artificial Sequence
  chemically synthesized
aaacatgtacaattagcctc

SEQ ID NO: 342785 - DNA, 20 bp, Artificial Sequence
  chemically synthesized
gcagatgtgtgaacatctgg

SEQ ID NO: 342786 - DNA, 20 bp, Artificial Sequence
  chemically synthesized
tgcagatgtgtgaacatctg

SEQ ID NO: 342787 - DNA, 20 bp, Artificial Sequence
  chemically synthesized
attgcagatgtgtgaacatc

SEQ ID NO: 342788 - DNA, 20 bp, Artificial Sequence
  chemically synthesized
aggtttgaaaaaatatattg

SEQ ID NO: 342789 - DNA, 20 bp, Artificial Sequence
  chemically synthesized
taactgacagtgagtgacaa

SEQ ID NO: 342790 - DNA, 20 bp, Artificial Sequence
  chemically synthesized
ctaactgacagtgagtgaca

SEQ ID NO: 342791 - DNA, 20 bp, Artificial Sequence
  chemically synthesized
aaacctttgtcactcactgt

SEQ ID NO: 342792 - DNA, 20 bp, Artificial Sequence
  chemically synthesized
ttcgaatcctaactgacagt

SEQ ID NO: 342793 - DNA, 20 bp, Artificial Sequence
  chemically synthesized
ctttgtcactcactgtcagt

SEQ ID NO: 342794 - DNA, 20 bp, Artificial Sequence
  chemically synthesized
tttgtcactcactgtcagtt

SEQ ID NO: 342795 - DNA, 20 bp, Artificial Sequence
  chemically synthesized
atgtttcgaatcctaactga

SEQ ID NO: 342796 - DNA, 20 bp, Artificial Sequence
  chemically synthesized
ttaggattcgaaacatacta

SEQ ID NO: 342797 - DNA, 20 bp, Artificial Sequence
  chemically synthesized
aaaaagggggagaaaagctt

SEQ ID NO: 342798 - DNA, 20 bp, Artificial Sequence
  chemically synthesized
gtgtttaaaaagggggagaa

SEQ ID NO: 342799 - DNA, 20 bp, Artificial Sequence
  chemically synthesized
attttgtgtttaaaaagggg

SEQ ID NO: 342800 - DNA, 20 bp, Artificial Sequence
  chemically synthesized
ggattttgtgtttaaaaagg

SEQ ID NO: 342801 - DNA, 20 bp, Artificial Sequence
  chemically synthesized
aggattttgtgtttaaaaag

SEQ ID NO: 342802 - DNA, 20 bp, Artificial Sequence
  chemically synthesized
taggattttgtgtttaaaaa

SEQ ID NO: 342803 - DNA, 20 bp, Artificial Sequence
  chemically synthesized
ttaggattttgtgtttaaaa

SEQ ID NO: 342804 - DNA, 20 bp, Artificial Sequence
  chemically synthesized
tttaggattttgtgtttaaa

SEQ ID NO: 342805 - DNA, 20 bp, Artificial Sequence
  chemically synthesized
aacacaaaatcctaaaactt

SEQ ID NO: 342806 - DNA, 20 bp, Artificial Sequence
  chemically synthesized
agtctggctcctaaagtttt

SEQ ID NO: 342807 - DNA, 20 bp, Artificial Sequence
  chemically synthesized
acacaaaatcctaaaacttt

SEQ ID NO: 342808 - DNA, 20 bp, Artificial Sequence
  chemically synthesized
aagtctggctcctaaagttt

SEQ ID NO: 342809 - DNA, 20 bp, Artificial Sequence
  chemically synthesized
acaaaatcctaaaactttag

SEQ ID NO: 342810 - DNA, 20 bp, Artificial Sequence
  chemically synthesized
aatcctaaaactttaggagc

SEQ ID NO: 342811 - DNA, 20 bp, Artificial Sequence
  chemically synthesized
tgtgccaagtctggctccta

SEQ ID NO: 342812 - DNA, 20 bp, Artificial Sequence
  chemically synthesized
aaaactttaggagccagact

SEQ ID NO: 342813 - DNA, 20 bp, Artificial Sequence
  chemically synthesized
aacaatatatgtgccaagtc

SEQ ID NO: 342814 - DNA, 20 bp, Artificial Sequence
  chemically synthesized
acgacaacaatatatgtgcc

SEQ ID NO: 342815 - DNA, 20 bp, Artificial Sequence
  chemically synthesized
gcacatatattgttgtcgtt

SEQ ID NO: 342816 - DNA, 20 bp, Artificial Sequence
  chemically synthesized
cacatatattgttgtcgtta

SEQ ID NO: 342817 - DNA, 20 bp, Artificial Sequence
  chemically synthesized
gtcgttaaggtgatatccat

SEQ ID NO: 342818 - DNA, 20 bp, Artificial Sequence
  chemically synthesized
ttgatcgtcttatggactca

SEQ ID NO: 342819 - DNA, 20 bp, Artificial Sequence
  chemically synthesized
ggtgatatccatgagtccat

SEQ ID NO: 342820 - DNA, 20 bp, Artificial Sequence
  chemically synthesized
taaggttgttgatcgtctta

SEQ ID NO: 342821 - DNA, 20 bp, Artificial Sequence
  chemically synthesized
tacaatccagcagacagata

SEQ ID NO: 342822 - DNA, 20 bp, Artificial Sequence
  chemically synthesized
gtacaatccagcagacagat

SEQ ID NO: 342823 - DNA, 20 bp, Artificial Sequence
  chemically synthesized
caacaaccttatctgtctgc

SEQ ID NO: 342824 - DNA, 20 bp, Artificial Sequence
  chemically synthesized
tgtttgtacaatccagcaga

SEQ ID NO: 342825 - DNA, 20 bp, Artificial Sequence
  chemically synthesized
attctgtttgtacaatccag

SEQ ID NO: 342826 - DNA, 20 bp, Artificial Sequence
  chemically synthesized
ttaattctgtttgtacaatc

SEQ ID NO: 342827 - DNA, 20 bp, Artificial Sequence
  chemically synthesized
tgtctgctggattgtacaaa

SEQ ID NO: 342828 - DNA, 20 bp, Artificial Sequence
  chemically synthesized
gattgtacaaacagaattaa

SEQ ID NO: 342829 - DNA, 20 bp, Artificial Sequence
  chemically synthesized
acagaattaatagctgcctt

SEQ ID NO: 342830 - DNA, 20 bp, Artificial Sequence
  chemically synthesized
agccaaactctatcttaagg

SEQ ID NO: 342831 - DNA, 20 bp, Artificial Sequence
  chemically synthesized
aattaatagctgccttaaga

SEQ ID NO: 342832 - DNA, 20 bp, Artificial Sequence
  chemically synthesized
ttaatagctgccttaagata

SEQ ID NO: 342833 - DNA, 20 bp, Artificial Sequence
  chemically synthesized
ttcagccaaactctatctta

SEQ ID NO: 342834 - DNA, 20 bp, Artificial Sequence
  chemically synthesized
gttcagccaaactctatctt

SEQ ID NO: 342835 - DNA, 20 bp, Artificial Sequence
  chemically synthesized
agctgccttaagatagagtt

SEQ ID NO: 342836 - DNA, 20 bp, Artificial Sequence
  chemically synthesized
aagatagagtttggctgaac

SEQ ID NO: 342837 - DNA, 20 bp, Artificial Sequence
  chemically synthesized
atagagtttggctgaacgag

SEQ ID NO: 342838 - DNA, 20 bp, Artificial Sequence
  chemically synthesized
gcccagaagtactactcgtt

SEQ ID NO: 342839 - DNA, 20 bp, Artificial Sequence
  chemically synthesized
ggctgaacgagtagtacttc

SEQ ID NO: 342840 - DNA, 20 bp, Artificial Sequence
  chemically synthesized
gctgaacgagtagtacttct

SEQ ID NO: 342841 - DNA, 20 bp, Artificial Sequence
  chemically synthesized
aagtccatttatatgcccag

SEQ ID NO: 342842 - DNA, 20 bp, Artificial Sequence
  chemically synthesized
ctgaagtccatttatatgcc

SEQ ID NO: 342843 - DNA, 20 bp, Artificial Sequence
  chemically synthesized
agtacttctgggcatataaa

SEQ ID NO: 342844 - DNA, 20 bp, Artificial Sequence
  chemically synthesized
ctgggcatataaatggactt

SEQ ID NO: 342845 - DNA, 20 bp, Artificial Sequence
  chemically synthesized
gggcatataaatggacttca

SEQ ID NO: 342846 - DNA, 20 bp, Artificial Sequence
  chemically synthesized
catataaatggacttcagag

SEQ ID NO: 342847 - DNA, 20 bp, Artificial Sequence
  chemically synthesized
aaaattcatggacttctctg

SEQ ID NO: 342848 - DNA, 20 bp, Artificial Sequence
  chemically synthesized
atatgataccagaaaattca

SEQ ID NO: 342849 - DNA, 20 bp, Artificial Sequence
  chemically synthesized
agagaagtccatgaattttc

SEQ ID NO: 342850 - DNA, 20 bp, Artificial Sequence
  chemically synthesized
aaagaatttgcatatgatac

SEQ ID NO: 342851 - DNA, 20 bp, Artificial Sequence
  chemically synthesized
gcacatttgtacaaacacaa

SEQ ID NO: 342852 - DNA, 20 bp, Artificial Sequence
  chemically synthesized
gtgtttgtacaaatgtgcat

SEQ ID NO: 342853 - DNA, 20 bp, Artificial Sequence
  chemically synthesized
gtttgtacaaatgtgcatga

SEQ ID NO: 342854 - DNA, 20 bp, Artificial Sequence
  chemically synthesized
tttgtacaaatgtgcatgag

SEQ ID NO: 342855 - DNA, 20 bp, Artificial Sequence
  chemically synthesized
ttgtacaaatgtgcatgaga

SEQ ID NO: 342856 - DNA, 20 bp, Artificial Sequence
  chemically synthesized
aatgtgcatgagagggtcca

SEQ ID NO: 342857 - DNA, 20 bp, Artificial Sequence
  chemically synthesized
tagagatatgacaaaagctt

SEQ ID NO: 342858 - DNA, 20 bp, Artificial Sequence
  chemically synthesized
accaattagagatatgacaa

SEQ ID NO: 342859 - DNA, 20 bp, Artificial Sequence
  chemically synthesized
gcttttgtcatatctctaat

SEQ ID NO: 342860 - DNA, 20 bp, Artificial Sequence
  chemically synthesized
tgttggtattataccaatta

SEQ ID NO: 342861 - DNA, 20 bp, Artificial Sequence
  chemically synthesized
tgtgttggtattataccaat

SEQ ID NO: 342862 - DNA, 20 bp, Artificial Sequence
  chemically synthesized
tatgcaaccaaatattgtgt

SEQ ID NO: 342863 - DNA, 20 bp, Artificial Sequence
  chemically synthesized
tataataccaacacaatatt

SEQ ID NO: 342864 - DNA, 20 bp, Artificial Sequence
  chemically synthesized
caacacaatatttggttgca

SEQ ID NO: 342865 - DNA, 20 bp, Artificial Sequence
  chemically synthesized
aatgtttttagtatattcac

SEQ ID NO: 342866 - DNA, 20 bp, Artificial Sequence
  chemically synthesized
caatgtttttagtatattca

SEQ ID NO: 342867 - DNA, 20 bp, Artificial Sequence
  chemically synthesized
agtatacaactcaatgtttt

SEQ ID NO: 342868 - DNA, 20 bp, Artificial Sequence
  chemically synthesized
gtgaatatactaaaaacatt

SEQ ID NO: 342869 - DNA, 20 bp, Artificial Sequence
  chemically synthesized
attgagttgtatactttaaa

SEQ ID NO: 342870 - DNA, 20 bp, Artificial Sequence
  chemically synthesized
gccatacaatcatctgttta

SEQ ID NO: 342871 - DNA, 20 bp, Artificial Sequence
  chemically synthesized
actttaaacagatgattgta

SEQ ID NO: 342872 - DNA, 20 bp, Artificial Sequence
  chemically synthesized
atataaattatatctcaata

SEQ ID NO: 342873 - DNA, 20 bp, Artificial Sequence
  chemically synthesized
taaaatggaacagctttatt

SEQ ID NO: 342874 - DNA, 20 bp, Artificial Sequence
  chemically synthesized
tagtcatgtttaaaatggaa

SEQ ID NO: 342875 - DNA, 20 bp, Artificial Sequence
  chemically synthesized
taggctagtcatgtttaaaa

SEQ ID NO: 342876 - DNA, 20 bp, Artificial Sequence
  chemically synthesized
tgttccattttaaacatgac

SEQ ID NO: 342877 - DNA, 20 bp, Artificial Sequence
  chemically synthesized
cattttaaacatgactagcc

SEQ ID NO: 342878 - DNA, 20 bp, Artificial Sequence
  chemically synthesized
ttatttaaaaggttctaggc

SEQ ID NO: 342879 - DNA, 20 bp, Artificial Sequence
  chemically synthesized
aagtttatttaaaaggttct

SEQ ID NO: 342880 - DNA, 20 bp, Artificial Sequence
  chemically synthesized
caagtttatttaaaaggttc

SEQ ID NO: 342881 - DNA, 20 bp, Artificial Sequence
  chemically synthesized
gcctaacaagtttatttaaa

SEQ ID NO: 342882 - DNA, 20 bp, Artificial Sequence
  chemically synthesized
tgcctaacaagtttatttaa

SEQ ID NO: 342883 - DNA, 20 bp, Artificial Sequence
  chemically synthesized
aaccttttaaataaacttgt

SEQ ID NO: 342884 - DNA, 20 bp, Artificial Sequence
  chemically synthesized
accttttaaataaacttgtt

SEQ ID NO: 342885 - DNA, 20 bp, Artificial Sequence
  chemically synthesized
ggcttcaacttttgcctaac

SEQ ID NO: 342886 - DNA, 20 bp, Artificial Sequence
  chemically synthesized
taaataaacttgttaggcaa

SEQ ID NO: 342887 - DNA, 20 bp, Artificial Sequence
  chemically synthesized
aacttgttaggcaaaagttg

SEQ ID NO: 342888 - DNA, 20 bp, Artificial Sequence
  chemically synthesized
atagtaacataaacatcaag

SEQ ID NO: 342889 - DNA, 20 bp, Artificial Sequence
  chemically synthesized
ctaatagtaacataaacatc

SEQ ID NO: 342890 - DNA, 20 bp, Artificial Sequence
  chemically synthesized
cttgatgtttatgttactat

SEQ ID NO: 342891 - DNA, 20 bp, Artificial Sequence
  chemically synthesized
tgtttatgttactattagat

SEQ ID NO: 342892 - DNA, 20 bp, Artificial Sequence
  chemically synthesized
ttactgttgcaccaatctaa

SEQ ID NO: 342893 - DNA, 20 bp, Artificial Sequence
  chemically synthesized
ttactattagattggtgcaa

SEQ ID NO: 342894 - DNA, 20 bp, Artificial Sequence
  chemically synthesized
ttgccattactttcaatggc

SEQ ID NO: 342895 - DNA, 20 bp, Artificial Sequence
  chemically synthesized
ttgcattttcttgccattga

SEQ ID NO: 342896 - DNA, 20 bp, Artificial Sequence
  chemically synthesized
gtttttgccattactttcaa

SEQ ID NO: 342897 - DNA, 20 bp, Artificial Sequence
  chemically synthesized
tttcttgccattgaaagtaa

SEQ ID NO: 342898 - DNA, 20 bp, Artificial Sequence
  chemically synthesized
agttggtgcaaaagtaatca

SEQ ID NO: 342899 - DNA, 20 bp, Artificial Sequence
  chemically synthesized
aatatattaagttggtgcaa

SEQ ID NO: 342900 - DNA, 20 bp, Artificial Sequence
  chemically synthesized
attctaaaaatatattaagt

SEQ ID NO: 342901 - DNA, 20 bp, Artificial Sequence
  chemically synthesized
acacattctaaaaatatatt

SEQ ID NO: 342902 - DNA, 20 bp, Artificial Sequence
  chemically synthesized
gcaccaacttaatatatttt

SEQ ID NO: 342903 - DNA, 20 bp, Artificial Sequence
  chemically synthesized
aatgtgtgttccatgtcaaa

SEQ ID NO: 342904 - DNA, 20 bp, Artificial Sequence
  chemically synthesized
aagagttggaccatttgaca

SEQ ID NO: 342905 - DNA, 20 bp, Artificial Sequence
  chemically synthesized
gttgggattgagtcaagagt

SEQ ID NO: 342906 - DNA, 20 bp, Artificial Sequence
  chemically synthesized
attagttgggattgagtcaa

SEQ ID NO: 342907 - DNA, 20 bp, Artificial Sequence
  chemically synthesized
tcattagttgggattgagtc

SEQ ID NO: 342908 - DNA, 20 bp, Artificial Sequence
  chemically synthesized
acaggtcattagttgggatt

SEQ ID NO: 342909 - DNA, 20 bp, Artificial Sequence
  chemically synthesized
cactgaacaggtcattagtt

SEQ ID NO: 342910 - DNA, 20 bp, Artificial Sequence
  chemically synthesized
gcactgaacaggtcattagt

SEQ ID NO: 342911 - DNA, 20 bp, Artificial Sequence
  chemically synthesized
aagggcactgaacaggtcat

SEQ ID NO: 342912 - DNA, 20 bp, Artificial Sequence
  chemically synthesized
atcccaactaatgacctgtt

SEQ ID NO: 342913 - DNA, 20 bp, Artificial Sequence
  chemically synthesized
catagtcaagggcactgaac

SEQ ID NO: 342914 - DNA, 20 bp, Artificial Sequence
  chemically synthesized
ccatagtcaagggcactgaa

SEQ ID NO: 342915 - DNA, 20 bp, Artificial Sequence
  chemically synthesized
ctgttcagtgcccttgacta

SEQ ID NO: 342916 - DNA, 20 bp, Artificial Sequence
  chemically synthesized
gtgtacggcaccatagtcaa

SEQ ID NO: 342917 - DNA, 20 bp, Artificial Sequence
  chemically synthesized
agtgtacggcaccatagtca

SEQ ID NO: 342918 - DNA, 20 bp, Artificial Sequence
  chemically synthesized
aagtgtacggcaccatagtc

SEQ ID NO: 342919 - DNA, 20 bp, Artificial Sequence
  chemically synthesized
tagccaagtgtacggcacca

SEQ ID NO: 342920 - DNA, 20 bp, Artificial Sequence
  chemically synthesized
tgactatggtgccgtacact

SEQ ID NO: 342921 - DNA, 20 bp, Artificial Sequence
  chemically synthesized
catgaccatagccaagtgta

SEQ ID NO: 342922 - DNA, 20 bp, Artificial Sequence
  chemically synthesized
tggtgccgtacacttggcta

SEQ ID NO: 342923 - DNA, 20 bp, Artificial Sequence
  chemically synthesized
atagtggcatgaccatagcc

SEQ ID NO: 342924 - DNA, 20 bp, Artificial Sequence
  chemically synthesized
tcatcatagtggcatgacca

SEQ ID NO: 342925 - DNA, 20 bp, Artificial Sequence
  chemically synthesized
gtgtaaccaggtcatcatag

SEQ ID NO: 342926 - DNA, 20 bp, Artificial Sequence
  chemically synthesized
gctgtgtaaccaggtcatca

SEQ ID NO: 342927 - DNA, 20 bp, Artificial Sequence
  chemically synthesized
gtcatgccactatgatgacc

SEQ ID NO: 342928 - DNA, 20 bp, Artificial Sequence
  chemically synthesized
actatgatgacctggttaca

SEQ ID NO: 342929 - DNA, 20 bp, Artificial Sequence
  chemically synthesized
tgggtggtagctgtgtaacc

SEQ ID NO: 342930 - DNA, 20 bp, Artificial Sequence
  chemically synthesized
atgggtggtagctgtgtaac

SEQ ID NO: 342931 - DNA, 20 bp, Artificial Sequence
  chemically synthesized
ttaccaaagggaatgggtgg

SEQ ID NO: 342932 - DNA, 20 bp, Artificial Sequence
  chemically synthesized
ctgttaccaaagggaatggg

SEQ ID NO: 342933 - DNA, 20 bp, Artificial Sequence
  chemically synthesized
tatctgttaccaaagggaat

SEQ ID NO: 342934 - DNA, 20 bp, Artificial Sequence
  chemically synthesized
cagctaccacccattccctt

SEQ ID NO: 342935 - DNA, 20 bp, Artificial Sequence
  chemically synthesized
ttatctgttaccaaagggaa

SEQ ID NO: 342936 - DNA, 20 bp, Artificial Sequence
  chemically synthesized
gtgtgttatctgttaccaaa

SEQ ID NO: 342937 - DNA, 20 bp, Artificial Sequence
  chemically synthesized
ccacccattccctttggtaa

SEQ ID NO: 342938 - DNA, 20 bp, Artificial Sequence
  chemically synthesized
ggtgtgttatctgttaccaa

SEQ ID NO: 342939 - DNA, 20 bp, Artificial Sequence
  chemically synthesized
tggtgtgttatctgttacca

SEQ ID NO: 342940 - DNA, 20 bp, Artificial Sequence
  chemically synthesized
atgcagtgacaatatcagaa

SEQ ID NO: 342941 - DNA, 20 bp, Artificial Sequence
  chemically synthesized
agaagatgcagtgacaatat

SEQ ID NO: 342942 - DNA, 20 bp, Artificial Sequence
  chemically synthesized
gatattgtcactgcatcttc

SEQ ID NO: 342943 - DNA, 20 bp, Artificial Sequence
  chemically synthesized
gtgatacaagccagaagatg

SEQ ID NO: 342944 - DNA, 20 bp, Artificial Sequence
  chemically synthesized
tgtagagtgatacaagccag

SEQ ID NO: 342945 - DNA, 20 bp, Artificial Sequence
  chemically synthesized
tactgtagagtgatacaagc

SEQ ID NO: 342946 - DNA, 20 bp, Artificial Sequence
  chemically synthesized
tcattactgtagagtgatac

SEQ ID NO: 342947 - DNA, 20 bp, Artificial Sequence
  chemically synthesized
ttctggcttgtatcactcta

SEQ ID NO: 342948 - DNA, 20 bp, Artificial Sequence
  chemically synthesized
tggattgtgtcattactgta

SEQ ID NO: 342949 - DNA, 20 bp, Artificial Sequence
  chemically synthesized
gttggattgtgtcattactg

SEQ ID NO: 342950 - DNA, 20 bp, Artificial Sequence
  chemically synthesized
aaaataaaagacatattagt

SEQ ID NO: 342951 - DNA, 20 bp, Artificial Sequence
  chemically synthesized
cctaaaaataaaagacatat

SEQ ID NO: 342952 - DNA, 20 bp, Artificial Sequence
  chemically synthesized
actaatatgtcttttatttt

SEQ ID NO: 342953 - DNA, 20 bp, Artificial Sequence
  chemically synthesized
ttctttcctcctaaaaataa

SEQ ID NO: 342954 - DNA, 20 bp, Artificial Sequence
  chemically synthesized
ctaatatgtcttttattttt

SEQ ID NO: 342955 - DNA, 20 bp, Artificial Sequence
  chemically synthesized
aatatgtcttttatttttag

SEQ ID NO: 342956 - DNA, 20 bp, Artificial Sequence
  chemically synthesized
atatgtcttttatttttagg

SEQ ID NO: 342957 - DNA, 20 bp, Artificial Sequence
  chemically synthesized
gtcttttatttttaggagga

SEQ ID NO: 342958 - DNA, 20 bp, Artificial Sequence
  chemically synthesized
acattggctttattttagaa

SEQ ID NO: 342959 - DNA, 20 bp, Artificial Sequence
  chemically synthesized
gtttattccgttctaaaata

SEQ ID NO: 342960 - DNA, 20 bp, Artificial Sequence
  chemically synthesized
taaaaacattggctttattt

SEQ ID NO: 342961 - DNA, 20 bp, Artificial Sequence
  chemically synthesized
agaatatttaataaaaacat

SEQ ID NO: 342962 - DNA, 20 bp, Artificial Sequence
  chemically synthesized
ttcacatcccagtgggcacg

SEQ ID NO: 342963 - DNA, 20 bp, Artificial Sequence
  chemically synthesized
taaatattcttcgtgcccac

SEQ ID NO: 342964 - DNA, 20 bp, Artificial Sequence
  chemically synthesized
aaatattcttcgtgcccact

SEQ ID NO: 342965 - DNA, 20 bp, Artificial Sequence
  chemically synthesized
attggcattcacatcccagt

SEQ ID NO: 342966 - DNA, 20 bp, Artificial Sequence
  chemically synthesized
tattggcattcacatcccag

SEQ ID NO: 342967 - DNA, 20 bp, Artificial Sequence
  chemically synthesized
tcctattggcattcacatcc

SEQ ID NO: 342968 - DNA, 20 bp, Artificial Sequence
  chemically synthesized
cactgggatgtgaatgccaa

SEQ ID NO: 342969 - DNA, 20 bp, Artificial Sequence
  chemically synthesized
actgggatgtgaatgccaat

SEQ ID NO: 342970 - DNA, 20 bp, Artificial Sequence
  chemically synthesized
tctgatgtattttatcctat

SEQ ID NO: 342971 - DNA, 20 bp, Artificial Sequence
  chemically synthesized
gccaataggataaaatacat

SEQ ID NO: 342972 - DNA, 20 bp, Artificial Sequence
  chemically synthesized
caataggataaaatacatca

SEQ ID NO: 342973 - DNA, 20 bp, Artificial Sequence
  chemically synthesized
taggataaaatacatcagag

SEQ ID NO: 342974 - DNA, 20 bp, Artificial Sequence
  chemically synthesized
aaaatacatcagagaagcct

SEQ ID NO: 342975 - DNA, 20 bp, Artificial Sequence
  chemically synthesized
aaatacatcagagaagccta

SEQ ID NO: 342976 - DNA, 20 bp, Artificial Sequence
  chemically synthesized
cttgttctcatggaatcctt

SEQ ID NO: 342977 - DNA, 20 bp, Artificial Sequence
  chemically synthesized
ccttgttctcatggaatcct

SEQ ID NO: 342978 - DNA, 20 bp, Artificial Sequence
  chemically synthesized
gagaagcctaaggattccat

SEQ ID NO: 342979 - DNA, 20 bp, Artificial Sequence
  chemically synthesized
cctaaggattccatgagaac

SEQ ID NO: 342980 - DNA, 20 bp, Artificial Sequence
  chemically synthesized
tgtctgattccttgttctca

SEQ ID NO: 342981 - DNA, 20 bp, Artificial Sequence
  chemically synthesized
ctaaggattccatgagaaca

SEQ ID NO: 342982 - DNA, 20 bp, Artificial Sequence
  chemically synthesized
attccatgagaacaaggaat

SEQ ID NO: 342983 - DNA, 20 bp, Artificial Sequence
  chemically synthesized
atgagaacaaggaatcagac

SEQ ID NO: 342984 - DNA, 20 bp, Artificial Sequence
  chemically synthesized
agacaagtaatcatgtgcca

SEQ ID NO: 342985 - DNA, 20 bp, Artificial Sequence
  chemically synthesized
aagtaatcatgtgccacaga

SEQ ID NO: 342986 - DNA, 20 bp, Artificial Sequence
  chemically synthesized
ccaccagctgagtctatctg

SEQ ID NO: 342987 - DNA, 20 bp, Artificial Sequence
  chemically synthesized
tcatgtgccacagatagact

SEQ ID NO: 342988 - DNA, 20 bp, Artificial Sequence
  chemically synthesized
gtgccacagatagactcagc

SEQ ID NO: 342989 - DNA, 20 bp, Artificial Sequence
  chemically synthesized
ccacagatagactcagctgg

SEQ ID NO: 342990 - DNA, 20 bp, Artificial Sequence
  chemically synthesized
tattttcacttccaccagct

SEQ ID NO: 342991 - DNA, 20 bp, Artificial Sequence
  chemically synthesized
cagatagactcagctggtgg

SEQ ID NO: 342992 - DNA, 20 bp, Artificial Sequence
  chemically synthesized
tataatattttcacttccac

SEQ ID NO: 342993 - DNA, 20 bp, Artificial Sequence
  chemically synthesized
tggtggaagtgaaaatatta

SEQ ID NO: 342994 - DNA, 20 bp, Artificial Sequence
  chemically synthesized
ggtggaagtgaaaatattat

SEQ ID NO: 342995 - DNA, 20 bp, Artificial Sequence
  chemically synthesized
aagtgaaaatattataggtc

SEQ ID NO: 342996 - DNA, 20 bp, Artificial Sequence
  chemically synthesized
ttataggtcaagatgcctca

SEQ ID NO: 342997 - DNA, 20 bp, Artificial Sequence
  chemically synthesized
tataggtcaagatgcctcat

SEQ ID NO: 342998 - DNA, 20 bp, Artificial Sequence
  chemically synthesized
ggtcaagatgcctcataggt

SEQ ID NO: 342999 - DNA, 20 bp, Artificial Sequence
  chemically synthesized
catttttcctcttacctatg

SEQ ID NO: 343000 - DNA, 20 bp, Artificial Sequence
  chemically synthesized
gcatttttcctcttacctat

SEQ ID NO: 343001 - DNA, 20 bp, Artificial Sequence
  chemically synthesized
tcaagatgcctcataggtaa

SEQ ID NO: 343002 - DNA, 20 bp, Artificial Sequence
  chemically synthesized
caagatgcctcataggtaag

SEQ ID NO: 343003 - DNA, 20 bp, Artificial Sequence
  chemically synthesized
ataggtaagaggaaaaatgc

SEQ ID NO: 343004 - DNA, 20 bp, Artificial Sequence
  chemically synthesized
taggtaagaggaaaaatgcg

SEQ ID NO: 343005 - DNA, 20 bp, Artificial Sequence
  chemically synthesized
gtaagaggaaaaatgcgagg

SEQ ID NO: 343006 - DNA, 20 bp, Artificial Sequence
  chemically synthesized
aagaggaaaaatgcgaggta

SEQ ID NO: 343007 - DNA, 20 bp, Artificial Sequence
  chemically synthesized
aggaaaaatgcgaggtagag

SEQ ID NO: 343008 - DNA, 20 bp, Artificial Sequence
  chemically synthesized
aaatgcgaggtagagaagac

SEQ ID NO: 343009 - DNA, 20 bp, Artificial Sequence
  chemically synthesized
aatgcgaggtagagaagacc

SEQ ID NO: 343010 - DNA, 20 bp, Artificial Sequence
  chemically synthesized
tgcgaggtagagaagaccgg

SEQ ID NO: 343011 - DNA, 20 bp, Artificial Sequence
  chemically synthesized
aaacttacactattaactcc

SEQ ID NO: 343012 - DNA, 20 bp, Artificial Sequence
  chemically synthesized
tagagaagaccgggagttaa

SEQ ID NO: 343013 - DNA, 20 bp, Artificial Sequence
  chemically synthesized
agaccgggagttaatagtgt

SEQ ID NO: 343014 - DNA, 20 bp, Artificial Sequence
  chemically synthesized
ggagttaatagtgtaagttt

SEQ ID NO: 343015 - DNA, 20 bp, Artificial Sequence
  chemically synthesized
atagtgtaagtttaagctgc

SEQ ID NO: 343016 - DNA, 20 bp, Artificial Sequence
  chemically synthesized
tagtgtaagtttaagctgct

SEQ ID NO: 343017 - DNA, 20 bp, Artificial Sequence
  chemically synthesized
gtaagtttaagctgctgggc

SEQ ID NO: 343018 - DNA, 20 bp, Artificial Sequence
  chemically synthesized
taagtttaagctgctgggca

SEQ ID NO: 343019 - DNA, 20 bp, Artificial Sequence
  chemically synthesized
catgcttcggccttgcccag

SEQ ID NO: 343020 - DNA, 20 bp, Artificial Sequence
  chemically synthesized
tttcatgcttcggccttgcc

SEQ ID NO: 343021 - DNA, 20 bp, Artificial Sequence
  chemically synthesized
taagctgctgggcaaggccg

SEQ ID NO: 343022 - DNA, 20 bp, Artificial Sequence
  chemically synthesized
cttctgaatatttcatgctt

SEQ ID NO: 343023 - DNA, 20 bp, Artificial Sequence
  chemically synthesized
aggccgaagcatgaaatatt

SEQ ID NO: 343024 - DNA, 20 bp, Artificial Sequence
  chemically synthesized
ccgaagcatgaaatattcag

SEQ ID NO: 343025 - DNA, 20 bp, Artificial Sequence
  chemically synthesized
cgaagcatgaaatattcaga

SEQ ID NO: 343026 - DNA, 20 bp, Artificial Sequence
  chemically synthesized
gaagcatgaaatattcagaa

SEQ ID NO: 343027 - DNA, 20 bp, Artificial Sequence
  chemically synthesized
aaatattcagaagggataca

SEQ ID NO: 343028 - DNA, 20 bp, Artificial Sequence
  chemically synthesized
gaagggatacacagacaccc

SEQ ID NO: 343029 - DNA, 20 bp, Artificial Sequence
  chemically synthesized
atacacagacacccaagcta

SEQ ID NO: 343030 - DNA, 20 bp, Artificial Sequence
  chemically synthesized
gtccagatgagctttagctt

SEQ ID NO: 343031 - DNA, 20 bp, Artificial Sequence
  chemically synthesized
tgtccagatgagctttagct

SEQ ID NO: 343032 - DNA, 20 bp, Artificial Sequence
  chemically synthesized
gtgattgtccagatgagctt

SEQ ID NO: 343033 - DNA, 20 bp, Artificial Sequence
  chemically synthesized
cacccaagctaaagctcatc

SEQ ID NO: 343034 - DNA, 20 bp, Artificial Sequence
  chemically synthesized
acccttgtgattgtccagat

SEQ ID NO: 343035 - DNA, 20 bp, Artificial Sequence
  chemically synthesized
tctaaacccttgtgattgtc

SEQ ID NO: 343036 - DNA, 20 bp, Artificial Sequence
  chemically synthesized
aagctcatctggacaatcac

SEQ ID NO: 343037 - DNA, 20 bp, Artificial Sequence
  chemically synthesized
agctcatctggacaatcaca

SEQ ID NO: 343038 - DNA, 20 bp, Artificial Sequence
  chemically synthesized
gctcatctggacaatcacaa

SEQ ID NO: 343039 - DNA, 20 bp, Artificial Sequence
  chemically synthesized
tctggacaatcacaagggtt

SEQ ID NO: 343040 - DNA, 20 bp, Artificial Sequence
  chemically synthesized
tggacaatcacaagggttta

SEQ ID NO: 343041 - DNA, 20 bp, Artificial Sequence
  chemically synthesized
ggacaatcacaagggtttag

SEQ ID NO: 343042 - DNA, 20 bp, Artificial Sequence
  chemically synthesized
acaatcacaagggtttagag

SEQ ID NO: 343043 - DNA, 20 bp, Artificial Sequence
  chemically synthesized
aatcacaagggtttagagga

SEQ ID NO: 343044 - DNA, 20 bp, Artificial Sequence
  chemically synthesized
agggtttagaggagagtaaa

SEQ ID NO: 343045 - DNA, 20 bp, Artificial Sequence
  chemically synthesized
gggtttagaggagagtaaat

SEQ ID NO: 343046 - DNA, 20 bp, Artificial Sequence
  chemically synthesized
gaggagagtaaatgggacaa

SEQ ID NO: 343047 - DNA, 20 bp, Artificial Sequence
  chemically synthesized
agtaaatgggacaaaagaat

SEQ ID NO: 343048 - DNA, 20 bp, Artificial Sequence
  chemically synthesized
gtaaatgggacaaaagaatc

SEQ ID NO: 343049 - DNA, 20 bp, Artificial Sequence
  chemically synthesized
gggacaaaagaatcaggaat

SEQ ID NO: 343050 - DNA, 20 bp, Artificial Sequence
  chemically synthesized
aagaatcaggaatgagacct

SEQ ID NO: 343051 - DNA, 20 bp, Artificial Sequence
  chemically synthesized
aggaatgagacctaagcaat

SEQ ID NO: 343052 - DNA, 20 bp, Artificial Sequence
  chemically synthesized
ttcccattttctcattgctt

SEQ ID NO: 343053 - DNA, 20 bp, Artificial Sequence
  chemically synthesized
cttcccattttctcattgct

SEQ ID NO: 343054 - DNA, 20 bp, Artificial Sequence
  chemically synthesized
agacctaagcaatgagaaaa

SEQ ID NO: 343055 - DNA, 20 bp, Artificial Sequence
  chemically synthesized
gacctaagcaatgagaaaat

SEQ ID NO: 343056 - DNA, 20 bp, Artificial Sequence
  chemically synthesized
ctaagcaatgagaaaatggg

SEQ ID NO: 343057 - DNA, 20 bp, Artificial Sequence
  chemically synthesized
aaaatgggaagtaaattatg

SEQ ID NO: 343058 - DNA, 20 bp, Artificial Sequence
  chemically synthesized
gaagtaaattatgaagatac

SEQ ID NO: 343059 - DNA, 20 bp, Artificial Sequence
  chemically synthesized
aagtaaattatgaagataca

SEQ ID NO: 343060 - DNA, 20 bp, Artificial Sequence
  chemically synthesized
tatgaagatacaaggcaaca

SEQ ID NO: 343061 - DNA, 20 bp, Artificial Sequence
  chemically synthesized
atacaaggcaacacagacat

SEQ ID NO: 343062 - DNA, 20 bp, Artificial Sequence
  chemically synthesized
tacaaggcaacacagacatt

SEQ ID NO: 343063 - DNA, 20 bp, Artificial Sequence
  chemically synthesized
aaggcaacacagacattggg

SEQ ID NO: 343064 - DNA, 20 bp, Artificial Sequence
  chemically synthesized
gcaacacagacattgggcag

SEQ ID NO: 343065 - DNA, 20 bp, Artificial Sequence
  chemically synthesized
caacacagacattgggcagt

SEQ ID NO: 343066 - DNA, 20 bp, Artificial Sequence
  chemically synthesized
agacattgggcagtaggtat

SEQ ID NO: 343067 - DNA, 20 bp, Artificial Sequence
  chemically synthesized
gacattgggcagtaggtata

SEQ ID NO: 343068 - DNA, 20 bp, Artificial Sequence
  chemically synthesized
gggcagtaggtataaggaaa

SEQ ID NO: 343069 - DNA, 20 bp, Artificial Sequence
  chemically synthesized
ggcagtaggtataaggaaaa

SEQ ID NO: 343070 - DNA, 20 bp, Artificial Sequence
  chemically synthesized
gtaggtataaggaaaaaggc

SEQ ID NO: 343071 - DNA, 20 bp, Artificial Sequence
  chemically synthesized
taggtataaggaaaaaggct

SEQ ID NO: 343072 - DNA, 20 bp, Artificial Sequence
  chemically synthesized
aggtataaggaaaaaggctg

SEQ ID NO: 343073 - DNA, 20 bp, Artificial Sequence
  chemically synthesized
taaggaaaaaggctggggcc

SEQ ID NO: 343074 - DNA, 20 bp, Artificial Sequence
  chemically synthesized
aaagccttgattcttggccc

SEQ ID NO: 343075 - DNA, 20 bp, Artificial Sequence
  chemically synthesized
aaaggctggggccaagaatc

SEQ ID NO: 343076 - DNA, 20 bp, Artificial Sequence
  chemically synthesized
aaggctggggccaagaatca

SEQ ID NO: 343077 - DNA, 20 bp, Artificial Sequence
  chemically synthesized
caggccaaagccttgattct

SEQ ID NO: 343078 - DNA, 20 bp, Artificial Sequence
  chemically synthesized
ggggccaagaatcaaggctt

SEQ ID NO: 343079 - DNA, 20 bp, Artificial Sequence
  chemically synthesized
cacatatgggaagcaggcca

SEQ ID NO: 343080 - DNA, 20 bp, Artificial Sequence
  chemically synthesized
atatcacacatatgggaagc

SEQ ID NO: 343081 - DNA, 20 bp, Artificial Sequence
  chemically synthesized
aatatcacacatatgggaag

SEQ ID NO: 343082 - DNA, 20 bp, Artificial Sequence
  chemically synthesized
tcaaatatcacacatatggg

SEQ ID NO: 343083 - DNA, 20 bp, Artificial Sequence
  chemically synthesized
ttgtcaaatatcacacatat

SEQ ID NO: 343084 - DNA, 20 bp, Artificial Sequence
  chemically synthesized
cttgtcaaatatcacacata

SEQ ID NO: 343085 - DNA, 20 bp, Artificial Sequence
  chemically synthesized
ccatatgtgtgatatttgac

SEQ ID NO: 343086 - DNA, 20 bp, Artificial Sequence
  chemically synthesized
atgtgtgatatttgacaagt

SEQ ID NO: 343087 - DNA, 20 bp, Artificial Sequence
  chemically synthesized
gagaacatgaaaatttcgaa

SEQ ID NO: 343088 - DNA, 20 bp, Artificial Sequence
  chemically synthesized
catgtaacaattttacagaa

SEQ ID NO: 343089 - DNA, 20 bp, Artificial Sequence
  chemically synthesized
ttcatgtaacaattttacag

SEQ ID NO: 343090 - DNA, 20 bp, Artificial Sequence
  chemically synthesized
ttattcatgtaacaatttta

SEQ ID NO: 343091 - DNA, 20 bp, Artificial Sequence
  chemically synthesized
tacatcgtaggattgcagtg

SEQ ID NO: 343092 - DNA, 20 bp, Artificial Sequence
  chemically synthesized
ctacatcgtaggattgcagt

SEQ ID NO: 343093 - DNA, 20 bp, Artificial Sequence
  chemically synthesized
gtatctacatcgtaggattg

SEQ ID NO: 343094 - DNA, 20 bp, Artificial Sequence
  chemically synthesized
ctcactgcaatcctacgatg

SEQ ID NO: 343095 - DNA, 20 bp, Artificial Sequence
  chemically synthesized
cataatagtatctacatcgt

SEQ ID NO: 343096 - DNA, 20 bp, Artificial Sequence
  chemically synthesized
tcataatagtatctacatcg

SEQ ID NO: 343097 - DNA, 20 bp, Artificial Sequence
  chemically synthesized
ctgtaaaatggggatcataa

SEQ ID NO: 343098 - DNA, 20 bp, Artificial Sequence
  chemically synthesized
ctattatgatccccatttta

SEQ ID NO: 343099 - DNA, 20 bp, Artificial Sequence
  chemically synthesized
gtttcttcatctgtaaaatg

SEQ ID NO: 343100 - DNA, 20 bp, Artificial Sequence
  chemically synthesized
cgtttcttcatctgtaaaat

SEQ ID NO: 343101 - DNA, 20 bp, Artificial Sequence
  chemically synthesized
tcgtttcttcatctgtaaaa

SEQ ID NO: 343102 - DNA, 20 bp, Artificial Sequence
  chemically synthesized
tgatccccattttacagatg

SEQ ID NO: 343103 - DNA, 20 bp, Artificial Sequence
  chemically synthesized
attttacagatgaagaaacg

SEQ ID NO: 343104 - DNA, 20 bp, Artificial Sequence
  chemically synthesized
ttttacagatgaagaaacga

SEQ ID NO: 343105 - DNA, 20 bp, Artificial Sequence
  chemically synthesized
cagatgaagaaacgaaggcc

SEQ ID NO: 343106 - DNA, 20 bp, Artificial Sequence
  chemically synthesized
gatgaagaaacgaaggccaa

SEQ ID NO: 343107 - DNA, 20 bp, Artificial Sequence
  chemically synthesized
tgaagaaacgaaggccaaga

SEQ ID NO: 343108 - DNA, 20 bp, Artificial Sequence
  chemically synthesized
gaagaaacgaaggccaagag

SEQ ID NO: 343109 - DNA, 20 bp, Artificial Sequence
  chemically synthesized
gcaacttacttatcctctct

SEQ ID NO: 343110 - DNA, 20 bp, Artificial Sequence
  chemically synthesized
aacgaaggccaagagaggat

SEQ ID NO: 343111 - DNA, 20 bp, Artificial Sequence
  chemically synthesized
aaggccaagagaggataagt

SEQ ID NO: 343112 - DNA, 20 bp, Artificial Sequence
  chemically synthesized
agagaggataagtaagttgc

SEQ ID NO: 343113 - DNA, 20 bp, Artificial Sequence
  chemically synthesized
agaggataagtaagttgcca

SEQ ID NO: 343114 - DNA, 20 bp, Artificial Sequence
  chemically synthesized
tttactagcagtgtgatctc

SEQ ID NO: 343115 - DNA, 20 bp, Artificial Sequence
  chemically synthesized
gttgccagagatcacactgc

SEQ ID NO: 343116 - DNA, 20 bp, Artificial Sequence
  chemically synthesized
tccattttgccatttactag

SEQ ID NO: 343117 - DNA, 20 bp, Artificial Sequence
  chemically synthesized
gagatcacactgctagtaaa

SEQ ID NO: 343118 - DNA, 20 bp, Artificial Sequence
  chemically synthesized
atctccattttgccatttac

SEQ ID NO: 343119 - DNA, 20 bp, Artificial Sequence
  chemically synthesized
actgctagtaaatggcaaaa

SEQ ID NO: 343120 - DNA, 20 bp, Artificial Sequence
  chemically synthesized
tgctagtaaatggcaaaatg

SEQ ID NO: 343121 - DNA, 20 bp, Artificial Sequence
  chemically synthesized
aatggagattcaaaccccat

SEQ ID NO: 343122 - DNA, 20 bp, Artificial Sequence
  chemically synthesized
atggagattcaaaccccatt

SEQ ID NO: 343123 - DNA, 20 bp, Artificial Sequence
  chemically synthesized
tcatcagcaccagcctaatg

SEQ ID NO: 343124 - DNA, 20 bp, Artificial Sequence
  chemically synthesized
agattcaaaccccattaggc

SEQ ID NO: 343125 - DNA, 20 bp, Artificial Sequence
  chemically synthesized
atcatcagcaccagcctaat

SEQ ID NO: 343126 - DNA, 20 bp, Artificial Sequence
  chemically synthesized
tatcatcagcaccagcctaa

SEQ ID NO: 343127 - DNA, 20 bp, Artificial Sequence
  chemically synthesized
agacagggtatcatcagcac

SEQ ID NO: 343128 - DNA, 20 bp, Artificial Sequence
  chemically synthesized
aggaagagacagggtatcat

SEQ ID NO: 343129 - DNA, 20 bp, Artificial Sequence
  chemically synthesized
aggactcagaggaagagaca

SEQ ID NO: 343130 - DNA, 20 bp, Artificial Sequence
  chemically synthesized
aaggactcagaggaagagac

SEQ ID NO: 343131 - DNA, 20 bp, Artificial Sequence
  chemically synthesized
gaaggactcagaggaagaga

SEQ ID NO: 343132 - DNA, 20 bp, Artificial Sequence
  chemically synthesized
gataccctgtctcttcctct

SEQ ID NO: 343133 - DNA, 20 bp, Artificial Sequence
  chemically synthesized
atgcgaaggactcagaggaa

SEQ ID NO: 343134 - DNA, 20 bp, Artificial Sequence
  chemically synthesized
aaatgcgaaggactcagagg

SEQ ID NO: 343135 - DNA, 20 bp, Artificial Sequence
  chemically synthesized
ctgaaatgcgaaggactcag

SEQ ID NO: 343136 - DNA, 20 bp, Artificial Sequence
  chemically synthesized
actgaaatgcgaaggactca

SEQ ID NO: 343137 - DNA, 20 bp, Artificial Sequence
  chemically synthesized
ccactgaaatgcgaaggact

SEQ ID NO: 343138 - DNA, 20 bp, Artificial Sequence
  chemically synthesized
caatgtccactgaaatgcga

SEQ ID NO: 343139 - DNA, 20 bp, Artificial Sequence
  chemically synthesized
cctctgagtccttcgcattt

SEQ ID NO: 343140 - DNA, 20 bp, Artificial Sequence
  chemically synthesized
acaatgtccactgaaatgcg

SEQ ID NO: 343141 - DNA, 20 bp, Artificial Sequence
  chemically synthesized
ctgagtccttcgcatttcag

SEQ ID NO: 343142 - DNA, 20 bp, Artificial Sequence
  chemically synthesized
aggagctggcaggtggaagt

SEQ ID NO: 343143 - DNA, 20 bp, Artificial Sequence
  chemically synthesized
atgcaggagctggcaggtgg

SEQ ID NO: 343144 - DNA, 20 bp, Artificial Sequence
  chemically synthesized
ttgttccaacttccacctgc

SEQ ID NO: 343145 - DNA, 20 bp, Artificial Sequence
  chemically synthesized
gagatgcaggagctggcagg

SEQ ID NO: 343146 - DNA, 20 bp, Artificial Sequence
  chemically synthesized
aaagagatgcaggagctggc

SEQ ID NO: 343147 - DNA, 20 bp, Artificial Sequence
  chemically synthesized
caaagagatgcaggagctgg

SEQ ID NO: 343148 - DNA, 20 bp, Artificial Sequence
  chemically synthesized
aggcaaagagatgcaggagc

SEQ ID NO: 343149 - DNA, 20 bp, Artificial Sequence
  chemically synthesized
cagtaggcaaagagatgcag

SEQ ID NO: 343150 - DNA, 20 bp, Artificial Sequence
  chemically synthesized
tccagtaggcaaagagatgc

SEQ ID NO: 343151 - DNA, 20 bp, Artificial Sequence
  chemically synthesized
ctccagtaggcaaagagatg

SEQ ID NO: 343152 - DNA, 20 bp, Artificial Sequence
  chemically synthesized
aacagactccagtaggcaaa

SEQ ID NO: 343153 - DNA, 20 bp, Artificial Sequence
  chemically synthesized
tcctgcatctctttgcctac

SEQ ID NO: 343154 - DNA, 20 bp, Artificial Sequence
  chemically synthesized
agaacagactccagtaggca

SEQ ID NO: 343155 - DNA, 20 bp, Artificial Sequence
  chemically synthesized
ctgcatctctttgcctactg

SEQ ID NO: 343156 - DNA, 20 bp, Artificial Sequence
  chemically synthesized
ccggaagaacagactccagt

SEQ ID NO: 343157 - DNA, 20 bp, Artificial Sequence
  chemically synthesized
tccggaagaacagactccag

SEQ ID NO: 343158 - DNA, 20 bp, Artificial Sequence
  chemically synthesized
cactccggaagaacagactc

SEQ ID NO: 343159 - DNA, 20 bp, Artificial Sequence
  chemically synthesized
cctactggagtctgttcttc

SEQ ID NO: 343160 - DNA, 20 bp, Artificial Sequence
  chemically synthesized
ttgcatgcactccggaagaa

SEQ ID NO: 343161 - DNA, 20 bp, Artificial Sequence
  chemically synthesized
tactggagtctgttcttccg

SEQ ID NO: 343162 - DNA, 20 bp, Artificial Sequence
  chemically synthesized
atctattgcatgcactccgg

SEQ ID NO: 343163 - DNA, 20 bp, Artificial Sequence
  chemically synthesized
ttgatctattgcatgcactc

SEQ ID NO: 343164 - DNA, 20 bp, Artificial Sequence
  chemically synthesized
ttcttccggagtgcatgcaa

SEQ ID NO: 343165 - DNA, 20 bp, Artificial Sequence
  chemically synthesized
atgcaatagatcaaaaatgc

SEQ ID NO: 343166 - DNA, 20 bp, Artificial Sequence
  chemically synthesized
tgcaatagatcaaaaatgct

SEQ ID NO: 343167 - DNA, 20 bp, Artificial Sequence
  chemically synthesized
gcaatagatcaaaaatgcta

SEQ ID NO: 343168 - DNA, 20 bp, Artificial Sequence
  chemically synthesized
aatagatcaaaaatgctagg

SEQ ID NO: 343169 - DNA, 20 bp, Artificial Sequence
  chemically synthesized
ggggctgtgcattcactccc

SEQ ID NO: 343170 - DNA, 20 bp, Artificial Sequence
  chemically synthesized
aatgctagggagtgaatgca

SEQ ID NO: 343171 - DNA, 20 bp, Artificial Sequence
  chemically synthesized
agtgaatgcacagcccctcc

SEQ ID NO: 343172 - DNA, 20 bp, Artificial Sequence
  chemically synthesized
gtgaatgcacagcccctccc

SEQ ID NO: 343173 - DNA, 20 bp, Artificial Sequence
  chemically synthesized
ctgttggcagatcccgggag

SEQ ID NO: 343174 - DNA, 20 bp, Artificial Sequence
  chemically synthesized
tctgttggcagatcccggga

SEQ ID NO: 343175 - DNA, 20 bp, Artificial Sequence
  chemically synthesized
atctgttggcagatcccggg

SEQ ID NO: 343176 - DNA, 20 bp, Artificial Sequence
  chemically synthesized
catctgttggcagatcccgg

SEQ ID NO: 343177 - DNA, 20 bp, Artificial Sequence
  chemically synthesized
gtcatctgttggcagatccc

SEQ ID NO: 343178 - DNA, 20 bp, Artificial Sequence
  chemically synthesized
ggtcatctgttggcagatcc

SEQ ID NO: 343179 - DNA, 20 bp, Artificial Sequence
  chemically synthesized
cccctcccgggatctgccaa

SEQ ID NO: 343180 - DNA, 20 bp, Artificial Sequence
  chemically synthesized
tcctgctggtcatctgttgg

SEQ ID NO: 343181 - DNA, 20 bp, Artificial Sequence
  chemically synthesized
aactcctgctggtcatctgt

SEQ ID NO: 343182 - DNA, 20 bp, Artificial Sequence
  chemically synthesized
gggatctgccaacagatgac

SEQ ID NO: 343183 - DNA, 20 bp, Artificial Sequence
  chemically synthesized
atctgccaacagatgaccag

SEQ ID NO: 343184 - DNA, 20 bp, Artificial Sequence
  chemically synthesized
tctgccaacagatgaccagc

SEQ ID NO: 343185 - DNA, 20 bp, Artificial Sequence
  chemically synthesized
tgccaacagatgaccagcag

SEQ ID NO: 343186 - DNA, 20 bp, Artificial Sequence
  chemically synthesized
atttatacaccaactcctgc

SEQ ID NO: 343187 - DNA, 20 bp, Artificial Sequence
  chemically synthesized
aacagatgaccagcaggagt

SEQ ID NO: 343188 - DNA, 20 bp, Artificial Sequence
  chemically synthesized
gagttggtgtataaatacct

SEQ ID NO: 343189 - DNA, 20 bp, Artificial Sequence
  chemically synthesized
ttgaagagatgagaatgcta

SEQ ID NO: 343190 - DNA, 20 bp, Artificial Sequence
  chemically synthesized
tttgaagagatgagaatgct

SEQ ID NO: 343191 - DNA, 20 bp, Artificial Sequence
  chemically synthesized
gacttatcctttgaagagat

SEQ ID NO: 343192 - DNA, 20 bp, Artificial Sequence
  chemically synthesized
ttagcattctcatctcttca

SEQ ID NO: 343193 - DNA, 20 bp, Artificial Sequence
  chemically synthesized
tagcattctcatctcttcaa

SEQ ID NO: 343194 - DNA, 20 bp, Artificial Sequence
  chemically synthesized
cctcagacttatcctttgaa

SEQ ID NO: 343195 - DNA, 20 bp, Artificial Sequence
  chemically synthesized
cacctcagacttatcctttg

SEQ ID NO: 343196 - DNA, 20 bp, Artificial Sequence
  chemically synthesized
ttctcatctcttcaaaggat

SEQ ID NO: 343197 - DNA, 20 bp, Artificial Sequence
  chemically synthesized
tctcttcaaaggataagtct

SEQ ID NO: 343198 - DNA, 20 bp, Artificial Sequence
  chemically synthesized
ctcttcaaaggataagtctg

SEQ ID NO: 343199 - DNA, 20 bp, Artificial Sequence
  chemically synthesized
attatgtggaacacacacct

SEQ ID NO: 343200 - DNA, 20 bp, Artificial Sequence
  chemically synthesized
gggacttgaagaaaattatg

SEQ ID NO: 343201 - DNA, 20 bp, Artificial Sequence
  chemically synthesized
tgttccacataattttcttc

SEQ ID NO: 343202 - DNA, 20 bp, Artificial Sequence
  chemically synthesized
tcaatttgactggggacttg

SEQ ID NO: 343203 - DNA, 20 bp, Artificial Sequence
  chemically synthesized
cataattttcttcaagtccc

SEQ ID NO: 343204 - DNA, 20 bp, Artificial Sequence
  chemically synthesized
actggcgctcaatttgactg

SEQ ID NO: 343205 - DNA, 20 bp, Artificial Sequence
  chemically synthesized
aactggcgctcaatttgact

SEQ ID NO: 343206 - DNA, 20 bp, Artificial Sequence
  chemically synthesized
caactggcgctcaatttgac

SEQ ID NO: 343207 - DNA, 20 bp, Artificial Sequence
  chemically synthesized
ttcaagtccccagtcaaatt

SEQ ID NO: 343208 - DNA, 20 bp, Artificial Sequence
  chemically synthesized
tccccagtcaaattgagcgc

SEQ ID NO: 343209 - DNA, 20 bp, Artificial Sequence
  chemically synthesized
tttaaactgtggtggacaac

SEQ ID NO: 343210 - DNA, 20 bp, Artificial Sequence
  chemically synthesized
tgagcgccagttgtccacca

SEQ ID NO: 343211 - DNA, 20 bp, Artificial Sequence
  chemically synthesized
ttcaagagtttaaactgtgg

SEQ ID NO: 343212 - DNA, 20 bp, Artificial Sequence
  chemically synthesized
catttcaagagtttaaactg

SEQ ID NO: 343213 - DNA, 20 bp, Artificial Sequence
  chemically synthesized
caatgaagactacatttcaa

SEQ ID NO: 343214 - DNA, 20 bp, Artificial Sequence
  chemically synthesized
cagtttaaactcttgaaatg

SEQ ID NO: 343215 - DNA, 20 bp, Artificial Sequence
  chemically synthesized
gtcaatgaagactacatttc

SEQ ID NO: 343216 - DNA, 20 bp, Artificial Sequence
  chemically synthesized
agaaggaaggaaagtcaatg

SEQ ID NO: 343217 - DNA, 20 bp, Artificial Sequence
  chemically synthesized
gtgagacaaagaaggaagga

SEQ ID NO: 343218 - DNA, 20 bp, Artificial Sequence
  chemically synthesized
taaagtgagacaaagaagga

SEQ ID NO: 343219 - DNA, 20 bp, Artificial Sequence
  chemically synthesized
ataaagtgagacaaagaagg

SEQ ID NO: 343220 - DNA, 20 bp, Artificial Sequence
  chemically synthesized
atgataaagtgagacaaaga

SEQ ID NO: 343221 - DNA, 20 bp, Artificial Sequence
  chemically synthesized
aatgataaagtgagacaaag

SEQ ID NO: 343222 - DNA, 20 bp, Artificial Sequence
  chemically synthesized
gaaaatgataaagtgagaca

SEQ ID NO: 343223 - DNA, 20 bp, Artificial Sequence
  chemically synthesized
gagtaggaaaatgataaagt

SEQ ID NO: 343224 - DNA, 20 bp, Artificial Sequence
  chemically synthesized
atatgagtaggaaaatgata

SEQ ID NO: 343225 - DNA, 20 bp, Artificial Sequence
  chemically synthesized
agatgctagggaatatgagt

SEQ ID NO: 343226 - DNA, 20 bp, Artificial Sequence
  chemically synthesized
gagatgctagggaatatgag

SEQ ID NO: 343227 - DNA, 20 bp, Artificial Sequence
  chemically synthesized
gatgagatgctagggaatat

SEQ ID NO: 343228 - DNA, 20 bp, Artificial Sequence
  chemically synthesized
attttcctactcatattccc

SEQ ID NO: 343229 - DNA, 20 bp, Artificial Sequence
  chemically synthesized
ttatttgggatgagatgcta

SEQ ID NO: 343230 - DNA, 20 bp, Artificial Sequence
  chemically synthesized
tttatttgggatgagatgct

SEQ ID NO: 343231 - DNA, 20 bp, Artificial Sequence
  chemically synthesized
gtttatttgggatgagatgc

SEQ ID NO: 343232 - DNA, 20 bp, Artificial Sequence
  chemically synthesized
ccttctagtttatttgggat

SEQ ID NO: 343233 - DNA, 20 bp, Artificial Sequence
  chemically synthesized
ttcccccttctagtttattt

SEQ ID NO: 343234 - DNA, 20 bp, Artificial Sequence
  chemically synthesized
gcatctcatcccaaataaac

SEQ ID NO: 343235 - DNA, 20 bp, Artificial Sequence
  chemically synthesized
cttcccccttctagtttatt

SEQ ID NO: 343236 - DNA, 20 bp, Artificial Sequence
  chemically synthesized
tctcatcccaaataaactag

SEQ ID NO: 343237 - DNA, 20 bp, Artificial Sequence
  chemically synthesized
ctcatcccaaataaactaga

SEQ ID NO: 343238 - DNA, 20 bp, Artificial Sequence
  chemically synthesized
tcatcccaaataaactagaa

SEQ ID NO: 343239 - DNA, 20 bp, Artificial Sequence
  chemically synthesized
catcccaaataaactagaag

SEQ ID NO: 343240 - DNA, 20 bp, Artificial Sequence
  chemically synthesized
atcccaaataaactagaagg

SEQ ID NO: 343241 - DNA, 20 bp, Artificial Sequence
  chemically synthesized
ttcagaatacttcccccttc

SEQ ID NO: 343242 - DNA, 20 bp, Artificial Sequence
  chemically synthesized
ccaaataaactagaaggggg

SEQ ID NO: 343243 - DNA, 20 bp, Artificial Sequence
  chemically synthesized
taccctgtctttatgatttt

SEQ ID NO: 343244 - DNA, 20 bp, Artificial Sequence
  chemically synthesized
gaagtattctgaaaatcata

SEQ ID NO: 343245 - DNA, 20 bp, Artificial Sequence
  chemically synthesized
tattctgaaaatcataaaga

SEQ ID NO: 343246 - DNA, 20 bp, Artificial Sequence
  chemically synthesized
attctgaaaatcataaagac

SEQ ID NO: 343247 - DNA, 20 bp, Artificial Sequence
  chemically synthesized
ttctgaaaatcataaagaca

SEQ ID NO: 343248 - DNA, 20 bp, Artificial Sequence
  chemically synthesized
taataatgataataaaataa

SEQ ID NO: 343249 - DNA, 20 bp, Artificial Sequence
  chemically synthesized
tattattttattatcattat

SEQ ID NO: 343250 - DNA, 20 bp, Artificial Sequence
  chemically synthesized
tattagtaacatcgatatct

SEQ ID NO: 343251 - DNA, 20 bp, Artificial Sequence
  chemically synthesized
tttcttttttgattttggct

SEQ ID NO: 343252 - DNA, 20 bp, Artificial Sequence
  chemically synthesized
ggtcctttcttttttgattt

SEQ ID NO: 343253 - DNA, 20 bp, Artificial Sequence
  chemically synthesized
tatctgagccaaaatcaaaa

SEQ ID NO: 343254 - DNA, 20 bp, Artificial Sequence
  chemically synthesized
tgagccaaaatcaaaaaaga

SEQ ID NO: 343255 - DNA, 20 bp, Artificial Sequence
  chemically synthesized
gagccaaaatcaaaaaagaa

SEQ ID NO: 343256 - DNA, 20 bp, Artificial Sequence
  chemically synthesized
accagaaagagtacaaataa

SEQ ID NO: 343257 - DNA, 20 bp, Artificial Sequence
  chemically synthesized
aaccagaaagagtacaaata

SEQ ID NO: 343258 - DNA, 20 bp, Artificial Sequence
  chemically synthesized
taaccagaaagagtacaaat

SEQ ID NO: 343259 - DNA, 20 bp, Artificial Sequence
  chemically synthesized
acccttatttgtactctttc

SEQ ID NO: 343260 - DNA, 20 bp, Artificial Sequence
  chemically synthesized
gttagaatcctaaccagaaa

SEQ ID NO: 343261 - DNA, 20 bp, Artificial Sequence
  chemically synthesized
ttatttgtactctttctggt

SEQ ID NO: 343262 - DNA, 20 bp, Artificial Sequence
  chemically synthesized
tatttgtactctttctggtt

SEQ ID NO: 343263 - DNA, 20 bp, Artificial Sequence
  chemically synthesized
tggttagaatcctaaccaga

SEQ ID NO: 343264 - DNA, 20 bp, Artificial Sequence
  chemically synthesized
ctcatggttagaatcctaac

SEQ ID NO: 343265 - DNA, 20 bp, Artificial Sequence
  chemically synthesized
ctggttaggattctaaccat

SEQ ID NO: 343266 - DNA, 20 bp, Artificial Sequence
  chemically synthesized
aacattctaacactcatggt

SEQ ID NO: 343267 - DNA, 20 bp, Artificial Sequence
  chemically synthesized
aggattctaaccatgagtgt

SEQ ID NO: 343268 - DNA, 20 bp, Artificial Sequence
  chemically synthesized
caacaacattctaacactca

SEQ ID NO: 343269 - DNA, 20 bp, Artificial Sequence
  chemically synthesized
catgagtgttagaatgttgt

SEQ ID NO: 343270 - DNA, 20 bp, Artificial Sequence
  chemically synthesized
tgttgttggcactgaaccca

SEQ ID NO: 343271 - DNA, 20 bp, Artificial Sequence
  chemically synthesized
ggaaactgtaactatgggtt

SEQ ID NO: 343272 - DNA, 20 bp, Artificial Sequence
  chemically synthesized
tggcactgaacccatagtta

SEQ ID NO: 343273 - DNA, 20 bp, Artificial Sequence
  chemically synthesized
ttattggaaactgtaactat

SEQ ID NO: 343274 - DNA, 20 bp, Artificial Sequence
  chemically synthesized
attattggaaactgtaacta

SEQ ID NO: 343275 - DNA, 20 bp, Artificial Sequence
  chemically synthesized
tcttggcattcagaaattat

SEQ ID NO: 343276 - DNA, 20 bp, Artificial Sequence
  chemically synthesized
tccaataatttctgaatgcc

SEQ ID NO: 343277 - DNA, 20 bp, Artificial Sequence
  chemically synthesized
cggtcacttttcttggcatt

SEQ ID NO: 343278 - DNA, 20 bp, Artificial Sequence
  chemically synthesized
taatttctgaatgccaagaa

SEQ ID NO: 343279 - DNA, 20 bp, Artificial Sequence
  chemically synthesized
ccttccacggtcacttttct

SEQ ID NO: 343280 - DNA, 20 bp, Artificial Sequence
  chemically synthesized
aatgccaagaaaagtgaccg

SEQ ID NO: 343281 - DNA, 20 bp, Artificial Sequence
  chemically synthesized
gccaagaaaagtgaccgtgg

SEQ ID NO: 343282 - DNA, 20 bp, Artificial Sequence
  chemically synthesized
ccaagaaaagtgaccgtgga

SEQ ID NO: 343283 - DNA, 20 bp, Artificial Sequence
  chemically synthesized
aaaactctgctttccttcca

SEQ ID NO: 343284 - DNA, 20 bp, Artificial Sequence
  chemically synthesized
gaaaagtgaccgtggaagga

SEQ ID NO: 343285 - DNA, 20 bp, Artificial Sequence
  chemically synthesized
aagtgaccgtggaaggaaag

SEQ ID NO: 343286 - DNA, 20 bp, Artificial Sequence
  chemically synthesized
gtgaccgtggaaggaaagca

SEQ ID NO: 343287 - DNA, 20 bp, Artificial Sequence
  chemically synthesized
aagcagagtttttaactctg

SEQ ID NO: 343288 - DNA, 20 bp, Artificial Sequence
  chemically synthesized
cccactgaacacattccaca

SEQ ID NO: 343289 - DNA, 20 bp, Artificial Sequence
  chemically synthesized
cacccactgaacacattcca

SEQ ID NO: 343290 - DNA, 20 bp, Artificial Sequence
  chemically synthesized
ttaactctgtggaatgtgtt

SEQ ID NO: 343291 - DNA, 20 bp, Artificial Sequence
  chemically synthesized
actctgtggaatgtgttcag

SEQ ID NO: 343292 - DNA, 20 bp, Artificial Sequence
  chemically synthesized
ctctgtggaatgtgttcagt

SEQ ID NO: 343293 - DNA, 20 bp, Artificial Sequence
  chemically synthesized
gtggaatgtgttcagtgggt

SEQ ID NO: 343294 - DNA, 20 bp, Artificial Sequence
  chemically synthesized
tggaatgtgttcagtgggtg

SEQ ID NO: 343295 - DNA, 20 bp, Artificial Sequence
  chemically synthesized
tgtgttcagtgggtgaggaa

SEQ ID NO: 343296 - DNA, 20 bp, Artificial Sequence
  chemically synthesized
gtgttcagtgggtgaggaat

SEQ ID NO: 343297 - DNA, 20 bp, Artificial Sequence
  chemically synthesized
gttcagtgggtgaggaatgg

SEQ ID NO: 343298 - DNA, 20 bp, Artificial Sequence
  chemically synthesized
ttcagtgggtgaggaatggg

SEQ ID NO: 343299 - DNA, 20 bp, Artificial Sequence
  chemically synthesized
agtgggtgaggaatgggagg

SEQ ID NO: 343300 - DNA, 20 bp, Artificial Sequence
  chemically synthesized
atgttctactgagagcaaaa

SEQ ID NO: 343301 - DNA, 20 bp, Artificial Sequence
  chemically synthesized
aggaagttctattttgctct

SEQ ID NO: 343302 - DNA, 20 bp, Artificial Sequence
  chemically synthesized
aagttctattttgctctcag

SEQ ID NO: 343303 - DNA, 20 bp, Artificial Sequence
  chemically synthesized
catttttaatgttctactga

SEQ ID NO: 343304 - DNA, 20 bp, Artificial Sequence
  chemically synthesized
gccatttttaatgttctact

SEQ ID NO: 343305 - DNA, 20 bp, Artificial Sequence
  chemically synthesized
tctcagtagaacattaaaaa

SEQ ID NO: 343306 - DNA, 20 bp, Artificial Sequence
  chemically synthesized
cacagaatgctttacagagg

SEQ ID NO: 343307 - DNA, 20 bp, Artificial Sequence
  chemically synthesized
taaaaatggcttcctctgta

SEQ ID NO: 343308 - DNA, 20 bp, Artificial Sequence
  chemically synthesized
aaccacagaatgctttacag

SEQ ID NO: 343309 - DNA, 20 bp, Artificial Sequence
  chemically synthesized
gaaccacagaatgctttaca

SEQ ID NO: 343310 - DNA, 20 bp, Artificial Sequence
  chemically synthesized
gggaaccacagaatgcttta

SEQ ID NO: 343311 - DNA, 20 bp, Artificial Sequence
  chemically synthesized
ttcctctgtaaagcattctg

SEQ ID NO: 343312 - DNA, 20 bp, Artificial Sequence
  chemically synthesized
cccttatcttgggggaacca

SEQ ID NO: 343313 - DNA, 20 bp, Artificial Sequence
  chemically synthesized
aagcattctgtggttccccc

SEQ ID NO: 343314 - DNA, 20 bp, Artificial Sequence
  chemically synthesized
ttctgtggttcccccaagat

SEQ ID NO: 343315 - DNA, 20 bp, Artificial Sequence
  chemically synthesized
cagacctgcccttatcttgg

SEQ ID NO: 343316 - DNA, 20 bp, Artificial Sequence
  chemically synthesized
tctgtggttcccccaagata

SEQ ID NO: 343317 - DNA, 20 bp, Artificial Sequence
  chemically synthesized
acagacctgcccttatcttg

SEQ ID NO: 343318 - DNA, 20 bp, Artificial Sequence
  chemically synthesized
ctgtggttcccccaagataa

SEQ ID NO: 343319 - DNA, 20 bp, Artificial Sequence
  chemically synthesized
gacagacctgcccttatctt

SEQ ID NO: 343320 - DNA, 20 bp, Artificial Sequence
  chemically synthesized
agacagacctgcccttatct

SEQ ID NO: 343321 - DNA, 20 bp, Artificial Sequence
  chemically synthesized
tggttcccccaagataaggg

SEQ ID NO: 343322 - DNA, 20 bp, Artificial Sequence
  chemically synthesized
ggttcccccaagataagggc

SEQ ID NO: 343323 - DNA, 20 bp, Artificial Sequence
  chemically synthesized
ctatggcagtttatgacaga

SEQ ID NO: 343324 - DNA, 20 bp, Artificial Sequence
  chemically synthesized
ggtgctatggcagtttatga

SEQ ID NO: 343325 - DNA, 20 bp, Artificial Sequence
  chemically synthesized
ctgtctgtcataaactgcca

SEQ ID NO: 343326 - DNA, 20 bp, Artificial Sequence
  chemically synthesized
ataagtaatgggtgctatgg

SEQ ID NO: 343327 - DNA, 20 bp, Artificial Sequence
  chemically synthesized
tgtataagtaatgggtgcta

SEQ ID NO: 343328 - DNA, 20 bp, Artificial Sequence
  chemically synthesized
tatttagttgtataagtaat

SEQ ID NO: 343329 - DNA, 20 bp, Artificial Sequence
  chemically synthesized
ttatttagttgtataagtaa

SEQ ID NO: 343330 - DNA, 20 bp, Artificial Sequence
  chemically synthesized
actattttatttagttgtat

SEQ ID NO: 343331 - DNA, 20 bp, Artificial Sequence
  chemically synthesized
acttatacaactaaataaaa

SEQ ID NO: 343332 - DNA, 20 bp, Artificial Sequence
  chemically synthesized
tcactcaatactattttatt

SEQ ID NO: 343333 - DNA, 20 bp, Artificial Sequence
  chemically synthesized
caactaaataaaatagtatt

SEQ ID NO: 343334 - DNA, 20 bp, Artificial Sequence
  chemically synthesized
aataaaatagtattgagtga

SEQ ID NO: 343335 - DNA, 20 bp, Artificial Sequence
  chemically synthesized
ataaaatagtattgagtgat

SEQ ID NO: 343336 - DNA, 20 bp, Artificial Sequence
  chemically synthesized
aaatagtattgagtgatggg

SEQ ID NO: 343337 - DNA, 20 bp, Artificial Sequence
  chemically synthesized
agtattgagtgatgggtggt

SEQ ID NO: 343338 - DNA, 20 bp, Artificial Sequence
  chemically synthesized
ggtggttagtctctccaatg

SEQ ID NO: 343339 - DNA, 20 bp, Artificial Sequence
  chemically synthesized
tgaaaaagagctacattgga

SEQ ID NO: 343340 - DNA, 20 bp, Artificial Sequence
  chemically synthesized
attgaaaaagagctacattg

SEQ ID NO: 343341 - DNA, 20 bp, Artificial Sequence
  chemically synthesized
tcattgaaaaagagctacat

SEQ ID NO: 343342 - DNA, 20 bp, Artificial Sequence
  chemically synthesized
tgtctattttcattgaaaaa

SEQ ID NO: 343343 - DNA, 20 bp, Artificial Sequence
  chemically synthesized
aatgtctattttcattgaaa

SEQ ID NO: 343344 - DNA, 20 bp, Artificial Sequence
  chemically synthesized
tagctctttttcaatgaaaa

SEQ ID NO: 343345 - DNA, 20 bp, Artificial Sequence
  chemically synthesized
aatagacattgtgtttcttc

SEQ ID NO: 343346 - DNA, 20 bp, Artificial Sequence
  chemically synthesized
atagacattgtgtttcttcc

SEQ ID NO: 343347 - DNA, 20 bp, Artificial Sequence
  chemically synthesized
tagacattgtgtttcttcca

SEQ ID NO: 343348 - DNA, 20 bp, Artificial Sequence
  chemically synthesized
ggaactgtgtgaggccctgg

SEQ ID NO: 343349 - DNA, 20 bp, Artificial Sequence
  chemically synthesized
tagggaactgtgtgaggccc

SEQ ID NO: 343350 - DNA, 20 bp, Artificial Sequence
  chemically synthesized
gtttcttccagggcctcaca

SEQ ID NO: 343351 - DNA, 20 bp, Artificial Sequence
  chemically synthesized
aatatatagggaactgtgtg

SEQ ID NO: 343352 - DNA, 20 bp, Artificial Sequence
  chemically synthesized
aaatatatagggaactgtgt

SEQ ID NO: 343353 - DNA, 20 bp, Artificial Sequence
  chemically synthesized
ttttttatgtaaaatatata

SEQ ID NO: 343354 - DNA, 20 bp, Artificial Sequence
  chemically synthesized
tttttttatgtaaaatatat

SEQ ID NO: 343355 - DNA, 20 bp, Artificial Sequence
  chemically synthesized
atttttttatgtaaaatata

SEQ ID NO: 343356 - DNA, 20 bp, Artificial Sequence
  chemically synthesized
tattaggcaccaaatatttt

SEQ ID NO: 343357 - DNA, 20 bp, Artificial Sequence
  chemically synthesized
aaatatatacctaaaatatt

SEQ ID NO: 343358 - DNA, 20 bp, Artificial Sequence
  chemically synthesized
ttattaggcaccaaatattt

SEQ ID NO: 343359 - DNA, 20 bp, Artificial Sequence
  chemically synthesized
atagtttctatatatttatt

SEQ ID NO: 343360 - DNA, 20 bp, Artificial Sequence
  chemically synthesized
catagtttctatatatttat

SEQ ID NO: 343361 - DNA, 20 bp, Artificial Sequence
  chemically synthesized
tttggtgcctaataaatata

SEQ ID NO: 343362 - DNA, 20 bp, Artificial Sequence
  chemically synthesized
taaatatatagaaactatgc

SEQ ID NO: 343363 - DNA, 20 bp, Artificial Sequence
  chemically synthesized
aaatatatagaaactatgct

SEQ ID NO: 343364 - DNA, 20 bp, Artificial Sequence
  chemically synthesized
accctgccctgtgcctagca

SEQ ID NO: 343365 - DNA, 20 bp, Artificial Sequence
  chemically synthesized
tatagaaactatgctaggca

SEQ ID NO: 343366 - DNA, 20 bp, Artificial Sequence
  chemically synthesized
atagaaactatgctaggcac

SEQ ID NO: 343367 - DNA, 20 bp, Artificial Sequence
  chemically synthesized
tagaaactatgctaggcaca

SEQ ID NO: 343368 - DNA, 20 bp, Artificial Sequence
  chemically synthesized
accacaccctgccctgtgcc

SEQ ID NO: 343369 - DNA, 20 bp, Artificial Sequence
  chemically synthesized
aaactatgctaggcacaggg

SEQ ID NO: 343370 - DNA, 20 bp, Artificial Sequence
  chemically synthesized
aactatgctaggcacagggc

SEQ ID NO: 343371 - DNA, 20 bp, Artificial Sequence
  chemically synthesized
actatgctaggcacagggca

SEQ ID NO: 343372 - DNA, 20 bp, Artificial Sequence
  chemically synthesized
gctaggcacagggcagggtg

SEQ ID NO: 343373 - DNA, 20 bp, Artificial Sequence
  chemically synthesized
cagggcagggtgtggtgatt

SEQ ID NO: 343374 - DNA, 20 bp, Artificial Sequence
  chemically synthesized
gcagggtgtggtgatttagc

SEQ ID NO: 343375 - DNA, 20 bp, Artificial Sequence
  chemically synthesized
tgaggacagggtaaatagtc

SEQ ID NO: 343376 - DNA, 20 bp, Artificial Sequence
  chemically synthesized
gtttatgaggacagggtaaa

SEQ ID NO: 343377 - DNA, 20 bp, Artificial Sequence
  chemically synthesized
tttgtgtgtttatgaggaca

SEQ ID NO: 343378 - DNA, 20 bp, Artificial Sequence
  chemically synthesized
ttttgtgtgtttatgaggac

SEQ ID NO: 343379 - DNA, 20 bp, Artificial Sequence
  chemically synthesized
attttgtgtgtttatgagga

SEQ ID NO: 343380 - DNA, 20 bp, Artificial Sequence
  chemically synthesized
atccattttgtgtgtttatg

SEQ ID NO: 343381 - DNA, 20 bp, Artificial Sequence
  chemically synthesized
aatccattttgtgtgtttat

SEQ ID NO: 343382 - DNA, 20 bp, Artificial Sequence
  chemically synthesized
gtcctcataaacacacaaaa

SEQ ID NO: 343383 - DNA, 20 bp, Artificial Sequence
  chemically synthesized
taaacacacaaaatggattt

SEQ ID NO: 343384 - DNA, 20 bp, Artificial Sequence
  chemically synthesized
aaacacacaaaatggattta

SEQ ID NO: 343385 - DNA, 20 bp, Artificial Sequence
  chemically synthesized
agctggtgagagagggttta

SEQ ID NO: 343386 - DNA, 20 bp, Artificial Sequence
  chemically synthesized
gcttactagctggtgagaga

SEQ ID NO: 343387 - DNA, 20 bp, Artificial Sequence
  chemically synthesized
atctttaaaccctctctcac

SEQ ID NO: 343388 - DNA, 20 bp, Artificial Sequence
  chemically synthesized
tgcttactagctggtgagag

SEQ ID NO: 343389 - DNA, 20 bp, Artificial Sequence
  chemically synthesized
gtgcttactagctggtgaga

SEQ ID NO: 343390 - DNA, 20 bp, Artificial Sequence
  chemically synthesized
gtgtgcttactagctggtga

SEQ ID NO: 343391 - DNA, 20 bp, Artificial Sequence
  chemically synthesized
ttaaaccctctctcaccagc

SEQ ID NO: 343392 - DNA, 20 bp, Artificial Sequence
  chemically synthesized
gagtgtgcttactagctggt

SEQ ID NO: 343393 - DNA, 20 bp, Artificial Sequence
  chemically synthesized
accctctctcaccagctagt

SEQ ID NO: 343394 - DNA, 20 bp, Artificial Sequence
  chemically synthesized
ccctgagtgtgcttactagc

SEQ ID NO: 343395 - DNA, 20 bp, Artificial Sequence
  chemically synthesized
aaagccctgagtgtgcttac

SEQ ID NO: 343396 - DNA, 20 bp, Artificial Sequence
  chemically synthesized
caccagctagtaagcacact

SEQ ID NO: 343397 - DNA, 20 bp, Artificial Sequence
  chemically synthesized
accagctagtaagcacactc

SEQ ID NO: 343398 - DNA, 20 bp, Artificial Sequence
  chemically synthesized
ccagctagtaagcacactca

SEQ ID NO: 343399 - DNA, 20 bp, Artificial Sequence
  chemically synthesized
gagggtaactgaaaagccct

SEQ ID NO: 343400 - DNA, 20 bp, Artificial Sequence
  chemically synthesized
taagcacactcagggctttt

SEQ ID NO: 343401 - DNA, 20 bp, Artificial Sequence
  chemically synthesized
gtaagtagagggtaactgaa

SEQ ID NO: 343402 - DNA, 20 bp, Artificial Sequence
  chemically synthesized
agaaatagcttgtaagtaga

SEQ ID NO: 343403 - DNA, 20 bp, Artificial Sequence
  chemically synthesized
cagaaatagcttgtaagtag

SEQ ID NO: 343404 - DNA, 20 bp, Artificial Sequence
  chemically synthesized
ttcagttaccctctacttac

SEQ ID NO: 343405 - DNA, 20 bp, Artificial Sequence
  chemically synthesized
tcagaaatagcttgtaagta

SEQ ID NO: 343406 - DNA, 20 bp, Artificial Sequence
  chemically synthesized
attcagaaatagcttgtaag

SEQ ID NO: 343407 - DNA, 20 bp, Artificial Sequence
  chemically synthesized
atgattcagaaatagcttgt

SEQ ID NO: 343408 - DNA, 20 bp, Artificial Sequence
  chemically synthesized
ttgcagaaatgattcagaaa

SEQ ID NO: 343409 - DNA, 20 bp, Artificial Sequence
  chemically synthesized
agatggttgcagaaatgatt

SEQ ID NO: 343410 - DNA, 20 bp, Artificial Sequence
  chemically synthesized
tccttcctagaagatggttg

SEQ ID NO: 343411 - DNA, 20 bp, Artificial Sequence
  chemically synthesized
tcatttctgcaaccatcttc

SEQ ID NO: 343412 - DNA, 20 bp, Artificial Sequence
  chemically synthesized
catttctgcaaccatcttct

SEQ ID NO: 343413 - DNA, 20 bp, Artificial Sequence
  chemically synthesized
tggttatccttcctagaaga

SEQ ID NO: 343414 - DNA, 20 bp, Artificial Sequence
  chemically synthesized
ttctgcaaccatcttctagg

SEQ ID NO: 343415 - DNA, 20 bp, Artificial Sequence
  chemically synthesized
tctgcaaccatcttctagga

SEQ ID NO: 343416 - DNA, 20 bp, Artificial Sequence
  chemically synthesized
agaatggttatccttcctag

SEQ ID NO: 343417 - DNA, 20 bp, Artificial Sequence
  chemically synthesized
gtaagaatggttatccttcc

SEQ ID NO: 343418 - DNA, 20 bp, Artificial Sequence
  chemically synthesized
aaaaaaaaaaattgtaagaa

SEQ ID NO: 343419 - DNA, 20 bp, Artificial Sequence
  chemically synthesized
gcaaaaaaaaaaaaaattgt

SEQ ID NO: 343420 - DNA, 20 bp, Artificial Sequence
  chemically synthesized
aaagagcaactttggaggaa

SEQ ID NO: 343421 - DNA, 20 bp, Artificial Sequence
  chemically synthesized
ttttttttgccattcctcca

SEQ ID NO: 343422 - DNA, 20 bp, Artificial Sequence
  chemically synthesized
attcaaaagagcaactttgg

SEQ ID NO: 343423 - DNA, 20 bp, Artificial Sequence
  chemically synthesized
tattcaaaagagcaactttg

SEQ ID NO: 343424 - DNA, 20 bp, Artificial Sequence
  chemically synthesized
aatattcaaaagagcaactt

SEQ ID NO: 343425 - DNA, 20 bp, Artificial Sequence
  chemically synthesized
agttttgataatattcaaaa

SEQ ID NO: 343426 - DNA, 20 bp, Artificial Sequence
  chemically synthesized
gaagttttgataatattcaa

SEQ ID NO: 343427 - DNA, 20 bp, Artificial Sequence
  chemically synthesized
tattagatttggcaaattgg

SEQ ID NO: 343428 - DNA, 20 bp, Artificial Sequence
  chemically synthesized
gtttattagatttggcaaat

SEQ ID NO: 343429 - DNA, 20 bp, Artificial Sequence
  chemically synthesized
ttaaaatagtttattagatt

SEQ ID NO: 343430 - DNA, 20 bp, Artificial Sequence
  chemically synthesized
tgtgggttaaaatagtttat

SEQ ID NO: 343431 - DNA, 20 bp, Artificial Sequence
  chemically synthesized
aagtaagatgtgggttaaaa

SEQ ID NO: 343432 - DNA, 20 bp, Artificial Sequence
  chemically synthesized
gaaaacattaagtaagatgt

SEQ ID NO: 343433 - DNA, 20 bp, Artificial Sequence
  chemically synthesized
tgaaaacattaagtaagatg

SEQ ID NO: 343434 - DNA, 20 bp, Artificial Sequence
  chemically synthesized
ttccactgaaaacattaagt

SEQ ID NO: 343435 - DNA, 20 bp, Artificial Sequence
  chemically synthesized
taaattccactgaaaacatt

SEQ ID NO: 343436 - DNA, 20 bp, Artificial Sequence
  chemically synthesized
cacatcttacttaatgtttt

SEQ ID NO: 343437 - DNA, 20 bp, Artificial Sequence
  chemically synthesized
atcttacttaatgttttcag

SEQ ID NO: 343438 - DNA, 20 bp, Artificial Sequence
  chemically synthesized
ttaatgttttcagtggaatt

SEQ ID NO: 343439 - DNA, 20 bp, Artificial Sequence
  chemically synthesized
tgatcatgagaggaataatt

SEQ ID NO: 343440 - DNA, 20 bp, Artificial Sequence
  chemically synthesized
gtgggagggttgatcatgag

SEQ ID NO: 343441 - DNA, 20 bp, Artificial Sequence
  chemically synthesized
ggtgggagggttgatcatga

SEQ ID NO: 343442 - DNA, 20 bp, Artificial Sequence
  chemically synthesized
gaggtgggagggttgatcat

SEQ ID NO: 343443 - DNA, 20 bp, Artificial Sequence
  chemically synthesized
gttgtggcagagaggtggga

SEQ ID NO: 343444 - DNA, 20 bp, Artificial Sequence
  chemically synthesized
ggttgtggcagagaggtggg

SEQ ID NO: 343445 - DNA, 20 bp, Artificial Sequence
  chemically synthesized
aggttgtggcagagaggtgg

SEQ ID NO: 343446 - DNA, 20 bp, Artificial Sequence
  chemically synthesized
aaaggttgtggcagagaggt

SEQ ID NO: 343447 - DNA, 20 bp, Artificial Sequence
  chemically synthesized
aaaaggttgtggcagagagg

SEQ ID NO: 343448 - DNA, 20 bp, Artificial Sequence
  chemically synthesized
ccaaaaaggttgtggcagag

SEQ ID NO: 343449 - DNA, 20 bp, Artificial Sequence
  chemically synthesized
accaaaaaggttgtggcaga

SEQ ID NO: 343450 - DNA, 20 bp, Artificial Sequence
  chemically synthesized
agaccaaaaaggttgtggca

SEQ ID NO: 343451 - DNA, 20 bp, Artificial Sequence
  chemically synthesized
gaagaccaaaaaggttgtgg

SEQ ID NO: 343452 - DNA, 20 bp, Artificial Sequence
  chemically synthesized
taggaagaccaaaaaggttg

SEQ ID NO: 343453 - DNA, 20 bp, Artificial Sequence
  chemically synthesized
cctctctgccacaacctttt

SEQ ID NO: 343454 - DNA, 20 bp, Artificial Sequence
  chemically synthesized
caatgctaggaagaccaaaa

SEQ ID NO: 343455 - DNA, 20 bp, Artificial Sequence
  chemically synthesized
acaatgctaggaagaccaaa

SEQ ID NO: 343456 - DNA, 20 bp, Artificial Sequence
  chemically synthesized
cacaacctttttggtcttcc

SEQ ID NO: 343457 - DNA, 20 bp, Artificial Sequence
  chemically synthesized
caagatcacacaatgctagg

SEQ ID NO: 343458 - DNA, 20 bp, Artificial Sequence
  chemically synthesized
caccaagatcacacaatgct

SEQ ID NO: 343459 - DNA, 20 bp, Artificial Sequence
  chemically synthesized
acaccaagatcacacaatgc

SEQ ID NO: 343460 - DNA, 20 bp, Artificial Sequence
  chemically synthesized
ttcctagcattgtgtgatct

SEQ ID NO: 343461 - DNA, 20 bp, Artificial Sequence
  chemically synthesized
ccttatgagaagaagacacc

SEQ ID NO: 343462 - DNA, 20 bp, Artificial Sequence
  chemically synthesized
agaatatgccttatgagaag

SEQ ID NO: 343463 - DNA, 20 bp, Artificial Sequence
  chemically synthesized
tcttggtgtcttcttctcat

SEQ ID NO: 343464 - DNA, 20 bp, Artificial Sequence
  chemically synthesized
cttggtgtcttcttctcata

SEQ ID NO: 343465 - DNA, 20 bp, Artificial Sequence
  chemically synthesized
gagagaatatgccttatgag

SEQ ID NO: 343466 - DNA, 20 bp, Artificial Sequence
  chemically synthesized
catgagagaatatgccttat

SEQ ID NO: 343467 - DNA, 20 bp, Artificial Sequence
  chemically synthesized
tcataaggcatattctctca

SEQ ID NO: 343468 - DNA, 20 bp, Artificial Sequence
  chemically synthesized
tttaacagttgaaaccatga

SEQ ID NO: 343469 - DNA, 20 bp, Artificial Sequence
  chemically synthesized
tatttaacagttgaaaccat

SEQ ID NO: 343470 - DNA, 20 bp, Artificial Sequence
  chemically synthesized
ttaatcattagcatatttaa

SEQ ID NO: 343471 - DNA, 20 bp, Artificial Sequence
  chemically synthesized
ggtgcacagtttttaatcat

SEQ ID NO: 343472 - DNA, 20 bp, Artificial Sequence
  chemically synthesized
ggtttgagcagataggtgca

SEQ ID NO: 343473 - DNA, 20 bp, Artificial Sequence
  chemically synthesized
aaaaggaggtttgagcagat

SEQ ID NO: 343474 - DNA, 20 bp, Artificial Sequence
  chemically synthesized
aaaaaggaggtttgagcaga

SEQ ID NO: 343475 - DNA, 20 bp, Artificial Sequence
  chemically synthesized
ccttaaaaaggaggtttgag

SEQ ID NO: 343476 - DNA, 20 bp, Artificial Sequence
  chemically synthesized
gaaccttaaaaaggaggttt

SEQ ID NO: 343477 - DNA, 20 bp, Artificial Sequence
  chemically synthesized
tctgctcaaacctccttttt

SEQ ID NO: 343478 - DNA, 20 bp, Artificial Sequence
  chemically synthesized
gaatctgaaccttaaaaagg

SEQ ID NO: 343479 - DNA, 20 bp, Artificial Sequence
  chemically synthesized
ctgctcaaacctccttttta

SEQ ID NO: 343480 - DNA, 20 bp, Artificial Sequence
  chemically synthesized
tgaatctgaaccttaaaaag

SEQ ID NO: 343481 - DNA, 20 bp, Artificial Sequence
  chemically synthesized
tatgaatctgaaccttaaaa

SEQ ID NO: 343482 - DNA, 20 bp, Artificial Sequence
  chemically synthesized
atatgaatctgaaccttaaa

SEQ ID NO: 343483 - DNA, 20 bp, Artificial Sequence
  chemically synthesized
caaacctcctttttaaggtt

SEQ ID NO: 343484 - DNA, 20 bp, Artificial Sequence
  chemically synthesized
aaggttcagattcatataca

SEQ ID NO: 343485 - DNA, 20 bp, Artificial Sequence
  chemically synthesized
gttcagattcatatacatgg

SEQ ID NO: 343486 - DNA, 20 bp, Artificial Sequence
  chemically synthesized
gattcatatacatggtggcc

SEQ ID NO: 343487 - DNA, 20 bp, Artificial Sequence
  chemically synthesized
tcatatacatggtggcctag

SEQ ID NO: 343488 - DNA, 20 bp, Artificial Sequence
  chemically synthesized
cttttggtaaaatgtctact

SEQ ID NO: 343489 - DNA, 20 bp, Artificial Sequence
  chemically synthesized
gcttttggtaaaatgtctac

SEQ ID NO: 343490 - DNA, 20 bp, Artificial Sequence
  chemically synthesized
cctagtagacattttaccaa

SEQ ID NO: 343491 - DNA, 20 bp, Artificial Sequence
  chemically synthesized
ggtctaatttaatgtgcttt

SEQ ID NO: 343492 - DNA, 20 bp, Artificial Sequence
  chemically synthesized
ttaccaaaagcacattaaat

SEQ ID NO: 343493 - DNA, 20 bp, Artificial Sequence
  chemically synthesized
aagcacattaaattagacct

SEQ ID NO: 343494 - DNA, 20 bp, Artificial Sequence
  chemically synthesized
agatggatttcatttttctt

SEQ ID NO: 343495 - DNA, 20 bp, Artificial Sequence
  chemically synthesized
aagatggatttcatttttct

SEQ ID NO: 343496 - DNA, 20 bp, Artificial Sequence
  chemically synthesized
gagggagggagtaaagaaga

SEQ ID NO: 343497 - DNA, 20 bp, Artificial Sequence
  chemically synthesized
tttggagggagggagtaaag

SEQ ID NO: 343498 - DNA, 20 bp, Artificial Sequence
  chemically synthesized
aggtttggagggagggagta

SEQ ID NO: 343499 - DNA, 20 bp, Artificial Sequence
  chemically synthesized
taacgaggtttggagggagg

SEQ ID NO: 343500 - DNA, 20 bp, Artificial Sequence
  chemically synthesized
aataacgaggtttggaggga

SEQ ID NO: 343501 - DNA, 20 bp, Artificial Sequence
  chemically synthesized
aaataacgaggtttggaggg

SEQ ID NO: 343502 - DNA, 20 bp, Artificial Sequence
  chemically synthesized
taaataacgaggtttggagg

SEQ ID NO: 343503 - DNA, 20 bp, Artificial Sequence
  chemically synthesized
tttaaataacgaggtttgga

SEQ ID NO: 343504 - DNA, 20 bp, Artificial Sequence
  chemically synthesized
gtttaaataacgaggtttgg

SEQ ID NO: 343505 - DNA, 20 bp, Artificial Sequence
  chemically synthesized
agtttaaataacgaggtttg

SEQ ID NO: 343506 - DNA, 20 bp, Artificial Sequence
  chemically synthesized
ccagtttaaataacgaggtt

SEQ ID NO: 343507 - DNA, 20 bp, Artificial Sequence
  chemically synthesized
gaagtccagtttaaataacg

SEQ ID NO: 343508 - DNA, 20 bp, Artificial Sequence
  chemically synthesized
agaagtccagtttaaataac

SEQ ID NO: 343509 - DNA, 20 bp, Artificial Sequence
  chemically synthesized
ccaaacctcgttatttaaac

SEQ ID NO: 343510 - DNA, 20 bp, Artificial Sequence
  chemically synthesized
tacacaagtgaacagaagtc

SEQ ID NO: 343511 - DNA, 20 bp, Artificial Sequence
  chemically synthesized
tgtcttacacaagtgaacag

SEQ ID NO: 343512 - DNA, 20 bp, Artificial Sequence
  chemically synthesized
taatgtcttacacaagtgaa

SEQ ID NO: 343513 - DNA, 20 bp, Artificial Sequence
  chemically synthesized
ggacttctgttcacttgtgt

SEQ ID NO: 343514 - DNA, 20 bp, Artificial Sequence
  chemically synthesized
tgtatgataatgtcttacac

SEQ ID NO: 343515 - DNA, 20 bp, Artificial Sequence
  chemically synthesized
ttgtgtaagacattatcata

SEQ ID NO: 343516 - DNA, 20 bp, Artificial Sequence
  chemically synthesized
cattatcatacagatcatcc

SEQ ID NO: 343517 - DNA, 20 bp, Artificial Sequence
  chemically synthesized
atagggaggtgaagtatgct

SEQ ID NO: 343518 - DNA, 20 bp, Artificial Sequence
  chemically synthesized
gatagggaggtgaagtatgc

SEQ ID NO: 343519 - DNA, 20 bp, Artificial Sequence
  chemically synthesized
tatgacaggatagggaggtg

SEQ ID NO: 343520 - DNA, 20 bp, Artificial Sequence
  chemically synthesized
ctagatatgacaggataggg

SEQ ID NO: 343521 - DNA, 20 bp, Artificial Sequence
  chemically synthesized
actagatatgacaggatagg

SEQ ID NO: 343522 - DNA, 20 bp, Artificial Sequence
  chemically synthesized
tgactagatatgacaggata

SEQ ID NO: 343523 - DNA, 20 bp, Artificial Sequence
  chemically synthesized
atgactagatatgacaggat

SEQ ID NO: 343524 - DNA, 20 bp, Artificial Sequence
  chemically synthesized
aatgactagatatgacagga

SEQ ID NO: 343525 - DNA, 20 bp, Artificial Sequence
  chemically synthesized
aaggaatgactagatatgac

SEQ ID NO: 343526 - DNA, 20 bp, Artificial Sequence
  chemically synthesized
cctccctatcctgtcatatc

SEQ ID NO: 343527 - DNA, 20 bp, Artificial Sequence
  chemically synthesized
taaggaatgactagatatga

SEQ ID NO: 343528 - DNA, 20 bp, Artificial Sequence
  chemically synthesized
gatgggacttaaggaatgac

SEQ ID NO: 343529 - DNA, 20 bp, Artificial Sequence
  chemically synthesized
gtcatatctagtcattcctt

SEQ ID NO: 343530 - DNA, 20 bp, Artificial Sequence
  chemically synthesized
agattcattgatgggactta

SEQ ID NO: 343531 - DNA, 20 bp, Artificial Sequence
  chemically synthesized
aagattcattgatgggactt

SEQ ID NO: 343532 - DNA, 20 bp, Artificial Sequence
  chemically synthesized
gatggagaagattcattgat

SEQ ID NO: 343533 - DNA, 20 bp, Artificial Sequence
  chemically synthesized
ggatggagaagattcattga

SEQ ID NO: 343534 - DNA, 20 bp, Artificial Sequence
  chemically synthesized
gaggattgattgggatggag

SEQ ID NO: 343535 - DNA, 20 bp, Artificial Sequence
  chemically synthesized
gaagaggattgattgggatg

SEQ ID NO: 343536 - DNA, 20 bp, Artificial Sequence
  chemically synthesized
atgaagaggattgattggga

SEQ ID NO: 343537 - DNA, 20 bp, Artificial Sequence
  chemically synthesized
gcagatgaagaggattgatt

SEQ ID NO: 343538 - DNA, 20 bp, Artificial Sequence
  chemically synthesized
agcagatgaagaggattgat

SEQ ID NO: 343539 - DNA, 20 bp, Artificial Sequence
  chemically synthesized
tattgacaaagcagatgaag

SEQ ID NO: 343540 - DNA, 20 bp, Artificial Sequence
  chemically synthesized
gtattgacaaagcagatgaa

SEQ ID NO: 343541 - DNA, 20 bp, Artificial Sequence
  chemically synthesized
gagtattgacaaagcagatg

SEQ ID NO: 343542 - DNA, 20 bp, Artificial Sequence
  chemically synthesized
aacctagagtattgacaaag

SEQ ID NO: 343543 - DNA, 20 bp, Artificial Sequence
  chemically synthesized
ctgaacctagagtattgaca

SEQ ID NO: 343544 - DNA, 20 bp, Artificial Sequence
  chemically synthesized
catctgctttgtcaatactc

SEQ ID NO: 343545 - DNA, 20 bp, Artificial Sequence
  chemically synthesized
atctgctttgtcaatactct

SEQ ID NO: 343546 - DNA, 20 bp, Artificial Sequence
  chemically synthesized
ctttgtcaatactctaggtt

SEQ ID NO: 343547 - DNA, 20 bp, Artificial Sequence
  chemically synthesized
tttgtcaatactctaggttc

SEQ ID NO: 343548 - DNA, 20 bp, Artificial Sequence
  chemically synthesized
gtgtttatatcctgaaccta

SEQ ID NO: 343549 - DNA, 20 bp, Artificial Sequence
  chemically synthesized
aagtgtttatatcctgaacc

SEQ ID NO: 343550 - DNA, 20 bp, Artificial Sequence
  chemically synthesized
ggatataaacacttttcatc

SEQ ID NO: 343551 - DNA, 20 bp, Artificial Sequence
  chemically synthesized
ctggtaatagtccagatgaa

SEQ ID NO: 343552 - DNA, 20 bp, Artificial Sequence
  chemically synthesized
ttcggagactggtaatagtc

SEQ ID NO: 343553 - DNA, 20 bp, Artificial Sequence
  chemically synthesized
cttttcatctggactattac

SEQ ID NO: 343554 - DNA, 20 bp, Artificial Sequence
  chemically synthesized
atcttttcggagactggtaa

SEQ ID NO: 343555 - DNA, 20 bp, Artificial Sequence
  chemically synthesized
aattgtatcttttcggagac

SEQ ID NO: 343556 - DNA, 20 bp, Artificial Sequence
  chemically synthesized
gactattaccagtctccgaa

SEQ ID NO: 343557 - DNA, 20 bp, Artificial Sequence
  chemically synthesized
agaaaaattgtatcttttcg

SEQ ID NO: 343558 - DNA, 20 bp, Artificial Sequence
  chemically synthesized
tgagaaaaattgtatctttt

SEQ ID NO: 343559 - DNA, 20 bp, Artificial Sequence
  chemically synthesized
ttctaaaatcatacgtattt

SEQ ID NO: 343560 - DNA, 20 bp, Artificial Sequence
  chemically synthesized
ttctcaaatacgtatgattt

SEQ ID NO: 343561 - DNA, 20 bp, Artificial Sequence
  chemically synthesized
tcaaatacgtatgattttag

SEQ ID NO: 343562 - DNA, 20 bp, Artificial Sequence
  chemically synthesized
aaatacgtatgattttagaa

SEQ ID NO: 343563 - DNA, 20 bp, Artificial Sequence
  chemically synthesized
attttagaagagattaccat

SEQ ID NO: 343564 - DNA, 20 bp, Artificial Sequence
  chemically synthesized
ttttagaagagattaccatc

SEQ ID NO: 343565 - DNA, 20 bp, Artificial Sequence
  chemically synthesized
taatgagccaatgatcctga

SEQ ID NO: 343566 - DNA, 20 bp, Artificial Sequence
  chemically synthesized
gagattaccatcaggatcat

SEQ ID NO: 343567 - DNA, 20 bp, Artificial Sequence
  chemically synthesized
atcactgccctgaagataat

SEQ ID NO: 343568 - DNA, 20 bp, Artificial Sequence
  chemically synthesized
gatcattggctcattatctt

SEQ ID NO: 343569 - DNA, 20 bp, Artificial Sequence
  chemically synthesized
atcattggctcattatcttc

SEQ ID NO: 343570 - DNA, 20 bp, Artificial Sequence
  chemically synthesized
tcattggctcattatcttca

SEQ ID NO: 343571 - DNA, 20 bp, Artificial Sequence
  chemically synthesized
ttggctcattatcttcaggg

SEQ ID NO: 343572 - DNA, 20 bp, Artificial Sequence
  chemically synthesized
caccccgcatcactgccctg

SEQ ID NO: 343573 - DNA, 20 bp, Artificial Sequence
  chemically synthesized
ttatcttcagggcagtgatg

SEQ ID NO: 343574 - DNA, 20 bp, Artificial Sequence
  chemically synthesized
tatcttcagggcagtgatgc

SEQ ID NO: 343575 - DNA, 20 bp, Artificial Sequence
  chemically synthesized
atcttcagggcagtgatgcg

SEQ ID NO: 343576 - DNA, 20 bp, Artificial Sequence
  chemically synthesized
ttcagggcagtgatgcgggg

SEQ ID NO: 343577 - DNA, 20 bp, Artificial Sequence
  chemically synthesized
tcagggcagtgatgcggggt

SEQ ID NO: 343578 - DNA, 20 bp, Artificial Sequence
  chemically synthesized
agggcagtgatgcggggtgg

SEQ ID NO: 343579 - DNA, 20 bp, Artificial Sequence
  chemically synthesized
ggcagtgatgcggggtggga

SEQ ID NO: 343580 - DNA, 20 bp, Artificial Sequence
  chemically synthesized
gcggggtgggagagttctta

SEQ ID NO: 343581 - DNA, 20 bp, Artificial Sequence
  chemically synthesized
cggggtgggagagttcttaa

SEQ ID NO: 343582 - DNA, 20 bp, Artificial Sequence
  chemically synthesized
catgtagaatacagtccttt

SEQ ID NO: 343583 - DNA, 20 bp, Artificial Sequence
  chemically synthesized
tcataatcacatgtagaata

SEQ ID NO: 343584 - DNA, 20 bp, Artificial Sequence
  chemically synthesized
atttgactcataatcacatg

SEQ ID NO: 343585 - DNA, 20 bp, Artificial Sequence
  chemically synthesized
tgtattctacatgtgattat

SEQ ID NO: 343586 - DNA, 20 bp, Artificial Sequence
  chemically synthesized
tgattatgagtcaaattttc

SEQ ID NO: 343587 - DNA, 20 bp, Artificial Sequence
  chemically synthesized
agattgtgtctacagtggtc

SEQ ID NO: 343588 - DNA, 20 bp, Artificial Sequence
  chemically synthesized
tcaaattttccagaccactg

SEQ ID NO: 343589 - DNA, 20 bp, Artificial Sequence
  chemically synthesized
gtgtaagattgtgtctacag

SEQ ID NO: 343590 - DNA, 20 bp, Artificial Sequence
  chemically synthesized
gaagtgtaagattgtgtcta

SEQ ID NO: 343591 - DNA, 20 bp, Artificial Sequence
  chemically synthesized
tgcgtgaaacagtgaagtgt

SEQ ID NO: 343592 - DNA, 20 bp, Artificial Sequence
  chemically synthesized
catagctgcgtgaaacagtg

SEQ ID NO: 343593 - DNA, 20 bp, Artificial Sequence
  chemically synthesized
ttacacttcactgtttcacg

SEQ ID NO: 343594 - DNA, 20 bp, Artificial Sequence
  chemically synthesized
ggtatcatagctgcgtgaaa

SEQ ID NO: 343595 - DNA, 20 bp, Artificial Sequence
  chemically synthesized
cagttgttgtgtaggtatca

SEQ ID NO: 343596 - DNA, 20 bp, Artificial Sequence
  chemically synthesized
catccttacagttgttgtgt

SEQ ID NO: 343597 - DNA, 20 bp, Artificial Sequence
  chemically synthesized
acatccttacagttgttgtg

SEQ ID NO: 343598 - DNA, 20 bp, Artificial Sequence
  chemically synthesized
gatacctacacaacaactgt

SEQ ID NO: 343599 - DNA, 20 bp, Artificial Sequence
  chemically synthesized
atacctacacaacaactgta

SEQ ID NO: 343600 - DNA, 20 bp, Artificial Sequence
  chemically synthesized
atctcaaactcacatcctta

SEQ ID NO: 343601 - DNA, 20 bp, Artificial Sequence
  chemically synthesized
cacaacaactgtaaggatgt

SEQ ID NO: 343602 - DNA, 20 bp, Artificial Sequence
  chemically synthesized
aactgtaaggatgtgagttt

SEQ ID NO: 343603 - DNA, 20 bp, Artificial Sequence
  chemically synthesized
aaggatgtgagtttgagatg

SEQ ID NO: 343604 - DNA, 20 bp, Artificial Sequence
  chemically synthesized
tgagatgtagattgttattg

SEQ ID NO: 343605 - DNA, 20 bp, Artificial Sequence
  chemically synthesized
acttagcaaggagtggttgt

SEQ ID NO: 343606 - DNA, 20 bp, Artificial Sequence
  chemically synthesized
gaaacaaacttagcaaggag

SEQ ID NO: 343607 - DNA, 20 bp, Artificial Sequence
  chemically synthesized
actaacaaccactccttgct

SEQ ID NO: 343608 - DNA, 20 bp, Artificial Sequence
  chemically synthesized
tttgaaacaaacttagcaag

SEQ ID NO: 343609 - DNA, 20 bp, Artificial Sequence
  chemically synthesized
attttgaaacaaacttagca

SEQ ID NO: 343610 - DNA, 20 bp, Artificial Sequence
  chemically synthesized
cattttgaaacaaacttagc

SEQ ID NO: 343611 - DNA, 20 bp, Artificial Sequence
  chemically synthesized
agtccattttgaaacaaact

SEQ ID NO: 343612 - DNA, 20 bp, Artificial Sequence
  chemically synthesized
ttgctaagtttgtttcaaaa

SEQ ID NO: 343613 - DNA, 20 bp, Artificial Sequence
  chemically synthesized
gtttgtttcaaaatggactt

SEQ ID NO: 343614 - DNA, 20 bp, Artificial Sequence
  chemically synthesized
tttgtttcaaaatggactta

SEQ ID NO: 343615 - DNA, 20 bp, Artificial Sequence
  chemically synthesized
ttgtttcaaaatggacttaa

SEQ ID NO: 343616 - DNA, 20 bp, Artificial Sequence
  chemically synthesized
tgtttcaaaatggacttaag

SEQ ID NO: 343617 - DNA, 20 bp, Artificial Sequence
  chemically synthesized
gtttcaaaatggacttaagg

SEQ ID NO: 343618 - DNA, 20 bp, Artificial Sequence
  chemically synthesized
acaactgagatcaccccctt

SEQ ID NO: 343619 - DNA, 20 bp, Artificial Sequence
  chemically synthesized
tggacttaagggggtgatct

SEQ ID NO: 343620 - DNA, 20 bp, Artificial Sequence
  chemically synthesized
ttttcttgccaaaaacaact

SEQ ID NO: 343621 - DNA, 20 bp, Artificial Sequence
  chemically synthesized
ggggtgatctcagttgtttt

SEQ ID NO: 343622 - DNA, 20 bp, Artificial Sequence
  chemically synthesized
tgatctcagttgtttttggc

SEQ ID NO: 343623 - DNA, 20 bp, Artificial Sequence
  chemically synthesized
agttgtttttggcaagaaaa

SEQ ID NO: 343624 - DNA, 20 bp, Artificial Sequence
  chemically synthesized
tttggcaagaaaaaagtaat

SEQ ID NO: 343625 - DNA, 20 bp, Artificial Sequence
  chemically synthesized
gcaagaaaaaagtaattggc

SEQ ID NO: 343626 - DNA, 20 bp, Artificial Sequence
  chemically synthesized
aaaagtaattggcaagaaaa

SEQ ID NO: 343627 - DNA, 20 bp, Artificial Sequence
  chemically synthesized
attggcaagaaaaaagtaat

SEQ ID NO: 343628 - DNA, 20 bp, Artificial Sequence
  chemically synthesized
gcaagaaaaaagtaattggc

SEQ ID NO: 343629 - DNA, 20 bp, Artificial Sequence
  chemically synthesized
gaaaaaagtaattggcaaga

SEQ ID NO: 343630 - DNA, 20 bp, Artificial Sequence
  chemically synthesized
aaagtaattggcaagaaagc

SEQ ID NO: 343631 - DNA, 20 bp, Artificial Sequence
  chemically synthesized
agtaattggcaagaaagcca

SEQ ID NO: 343632 - DNA, 20 bp, Artificial Sequence
  chemically synthesized
attggcaagaaagccagaga

SEQ ID NO: 343633 - DNA, 20 bp, Artificial Sequence
  chemically synthesized
tggcaagaaagccagagaaa

SEQ ID NO: 343634 - DNA, 20 bp, Artificial Sequence
  chemically synthesized
atttcctctttctctttctc

SEQ ID NO: 343635 - DNA, 20 bp, Artificial Sequence
  chemically synthesized
aagaaagccagagaaagaga

SEQ ID NO: 343636 - DNA, 20 bp, Artificial Sequence
  chemically synthesized
gaaagccagagaaagagaaa

SEQ ID NO: 343637 - DNA, 20 bp, Artificial Sequence
  chemically synthesized
aaagccagagaaagagaaag

SEQ ID NO: 343638 - DNA, 20 bp, Artificial Sequence
  chemically synthesized
agaaagaggaaatgtttgtt

SEQ ID NO: 343639 - DNA, 20 bp, Artificial Sequence
  chemically synthesized
tgtttgttcagcccatgaat

SEQ ID NO: 343640 - DNA, 20 bp, Artificial Sequence
  chemically synthesized
ttgtaatgttactcattcat

SEQ ID NO: 343641 - DNA, 20 bp, Artificial Sequence
  chemically synthesized
attgtaatgttactcattca

SEQ ID NO: 343642 - DNA, 20 bp, Artificial Sequence
  chemically synthesized
tgaatgtttgaagttataaa

SEQ ID NO: 343643 - DNA, 20 bp, Artificial Sequence
  chemically synthesized
tgtatgggggtgaatgtttg

SEQ ID NO: 343644 - DNA, 20 bp, Artificial Sequence
  chemically synthesized
tttatagagcatttgtatgg

SEQ ID NO: 343645 - DNA, 20 bp, Artificial Sequence
  chemically synthesized
ttttatagagcatttgtatg

SEQ ID NO: 343646 - DNA, 20 bp, Artificial Sequence
  chemically synthesized
gttttatagagcatttgtat

SEQ ID NO: 343647 - DNA, 20 bp, Artificial Sequence
  chemically synthesized
agttttatagagcatttgta

SEQ ID NO: 343648 - DNA, 20 bp, Artificial Sequence
  chemically synthesized
atcatgacaatagttttata

SEQ ID NO: 343649 - DNA, 20 bp, Artificial Sequence
  chemically synthesized
tcatcatgacaatagtttta

SEQ ID NO: 343650 - DNA, 20 bp, Artificial Sequence
  chemically synthesized
ctgattgatcatcatgacaa

SEQ ID NO: 343651 - DNA, 20 bp, Artificial Sequence
  chemically synthesized
ctattgtcatgatgatcaat

SEQ ID NO: 343652 - DNA, 20 bp, Artificial Sequence
  chemically synthesized
tgatgatcaatcagcatttt

SEQ ID NO: 343653 - DNA, 20 bp, Artificial Sequence
  chemically synthesized
aagttgaaacatatatatcc

SEQ ID NO: 343654 - DNA, 20 bp, Artificial Sequence
  chemically synthesized
acagaacaagatcagaaact

SEQ ID NO: 343655 - DNA, 20 bp, Artificial Sequence
  chemically synthesized
gtgttgatacagaacaagat

SEQ ID NO: 343656 - DNA, 20 bp, Artificial Sequence
  chemically synthesized
gtgctgtgttgatacagaac

SEQ ID NO: 343657 - DNA, 20 bp, Artificial Sequence
  chemically synthesized
ctgtgagtgctgtgttgata

SEQ ID NO: 343658 - DNA, 20 bp, Artificial Sequence
  chemically synthesized
gatcttgttctgtatcaaca

SEQ ID NO: 343659 - DNA, 20 bp, Artificial Sequence
  chemically synthesized
ctgtatcaacacagcactca

SEQ ID NO: 343660 - DNA, 20 bp, Artificial Sequence
  chemically synthesized
agggatttcctgagttctgt

SEQ ID NO: 343661 - DNA, 20 bp, Artificial Sequence
  chemically synthesized
aacacagcactcacagaact

SEQ ID NO: 343662 - DNA, 20 bp, Artificial Sequence
  chemically synthesized
acacagcactcacagaactc

SEQ ID NO: 343663 - DNA, 20 bp, Artificial Sequence
  chemically synthesized
ggaggctatagggatttcct

SEQ ID NO: 343664 - DNA, 20 bp, Artificial Sequence
  chemically synthesized
cagaactcaggaaatcccta

SEQ ID NO: 343665 - DNA, 20 bp, Artificial Sequence
  chemically synthesized
tggaagctaaggaggctata

SEQ ID NO: 343666 - DNA, 20 bp, Artificial Sequence
  chemically synthesized
atggaagctaaggaggctat

SEQ ID NO: 343667 - DNA, 20 bp, Artificial Sequence
  chemically synthesized
gatggaagctaaggaggcta

SEQ ID NO: 343668 - DNA, 20 bp, Artificial Sequence
  chemically synthesized
ggaaatccctatagcctcct

SEQ ID NO: 343669 - DNA, 20 bp, Artificial Sequence
  chemically synthesized
gagaaagatggaagctaagg

SEQ ID NO: 343670 - DNA, 20 bp, Artificial Sequence
  chemically synthesized
agagaaagatggaagctaag

SEQ ID NO: 343671 - DNA, 20 bp, Artificial Sequence
  chemically synthesized
caagagaaagatggaagcta

SEQ ID NO: 343672 - DNA, 20 bp, Artificial Sequence
  chemically synthesized
acaagagaaagatggaagct

SEQ ID NO: 343673 - DNA, 20 bp, Artificial Sequence
  chemically synthesized
aaaagacaagagaaagatgg

SEQ ID NO: 343674 - DNA, 20 bp, Artificial Sequence
  chemically synthesized
ttcaaaagacaagagaaaga

SEQ ID NO: 343675 - DNA, 20 bp, Artificial Sequence
  chemically synthesized
gtatttcaaaagacaagaga

SEQ ID NO: 343676 - DNA, 20 bp, Artificial Sequence
  chemically synthesized
taaggtatttcaaaagacaa

SEQ ID NO: 343677 - DNA, 20 bp, Artificial Sequence
  chemically synthesized
tttaaggtatttcaaaagac

SEQ ID NO: 343678 - DNA, 20 bp, Artificial Sequence
  chemically synthesized
tgtgctttaaggtatttcaa

SEQ ID NO: 343679 - DNA, 20 bp, Artificial Sequence
  chemically synthesized
ttgtcttttgaaatacctta

SEQ ID NO: 343680 - DNA, 20 bp, Artificial Sequence
  chemically synthesized
aaatatgcttttgtgcttta

SEQ ID NO: 343681 - DNA, 20 bp, Artificial Sequence
  chemically synthesized
aaaatatgcttttgtgcttt

SEQ ID NO: 343682 - DNA, 20 bp, Artificial Sequence
  chemically synthesized
tgaaataccttaaagcacaa

SEQ ID NO: 343683 - DNA, 20 bp, Artificial Sequence
  chemically synthesized
aaagcacaaaagcatatttt

SEQ ID NO: 343684 - DNA, 20 bp, Artificial Sequence
  chemically synthesized
aagcacaaaagcatattttc

SEQ ID NO: 343685 - DNA, 20 bp, Artificial Sequence
  chemically synthesized
caaaagcatattttcaggca

SEQ ID NO: 343686 - DNA, 20 bp, Artificial Sequence
  chemically synthesized
aaaagcatattttcaggcaa

SEQ ID NO: 343687 - DNA, 20 bp, Artificial Sequence
  chemically synthesized
ggcaaaggtaaaaataattg

SEQ ID NO: 343688 - DNA, 20 bp, Artificial Sequence
  chemically synthesized
gcaaaggtaaaaataattgt

SEQ ID NO: 343689 - DNA, 20 bp, Artificial Sequence
  chemically synthesized
aaaaataattgtaggaatga

SEQ ID NO: 343690 - DNA, 20 bp, Artificial Sequence
  chemically synthesized
ttgtaggaatgatggtttca

SEQ ID NO: 343691 - DNA, 20 bp, Artificial Sequence
  chemically synthesized
aggaatgatggtttcacaga

SEQ ID NO: 343692 - DNA, 20 bp, Artificial Sequence
  chemically synthesized
ggaatgatggtttcacagac

SEQ ID NO: 343693 - DNA, 20 bp, Artificial Sequence
  chemically synthesized
gaatgatggtttcacagaca

SEQ ID NO: 343694 - DNA, 20 bp, Artificial Sequence
  chemically synthesized
tttcacagacagggtgtctt

SEQ ID NO: 343695 - DNA, 20 bp, Artificial Sequence
  chemically synthesized
agacagggtgtcttcagtga

SEQ ID NO: 343696 - DNA, 20 bp, Artificial Sequence
  chemically synthesized
taggaacttaactgtcactg

SEQ ID NO: 343697 - DNA, 20 bp, Artificial Sequence
  chemically synthesized
gggtgtcttcagtgacagtt

SEQ ID NO: 343698 - DNA, 20 bp, Artificial Sequence
  chemically synthesized
cagtgacagttaagttccta

SEQ ID NO: 343699 - DNA, 20 bp, Artificial Sequence
  chemically synthesized
gacagttaagttcctatggt

SEQ ID NO: 343700 - DNA, 20 bp, Artificial Sequence
  chemically synthesized
tcattacagtgtctcaccat

SEQ ID NO: 343701 - DNA, 20 bp, Artificial Sequence
  chemically synthesized
ctcattacagtgtctcacca

SEQ ID NO: 343702 - DNA, 20 bp, Artificial Sequence
  chemically synthesized
ctatggtgagacactgtaat

SEQ ID NO: 343703 - DNA, 20 bp, Artificial Sequence
  chemically synthesized
taaacactttgaactcatta

SEQ ID NO: 343704 - DNA, 20 bp, Artificial Sequence
  chemically synthesized
gagacactgtaatgagttca

SEQ ID NO: 343705 - DNA, 20 bp, Artificial Sequence
  chemically synthesized
taatgagttcaaagtgttta

SEQ ID NO: 343706 - DNA, 20 bp, Artificial Sequence
  chemically synthesized
gtgtttgacaagcagtattg

SEQ ID NO: 343707 - DNA, 20 bp, Artificial Sequence
  chemically synthesized
ttgaaggagtgtttgacaag

SEQ ID NO: 343708 - DNA, 20 bp, Artificial Sequence
  chemically synthesized
gcattgaaggagtgtttgac

SEQ ID NO: 343709 - DNA, 20 bp, Artificial Sequence
  chemically synthesized
aagaattcattgcattgaag

SEQ ID NO: 343710 - DNA, 20 bp, Artificial Sequence
  chemically synthesized
ccaagaattcattgcattga

SEQ ID NO: 343711 - DNA, 20 bp, Artificial Sequence
  chemically synthesized
gccaagaattcattgcattg

SEQ ID NO: 343712 - DNA, 20 bp, Artificial Sequence
  chemically synthesized
ccttcaatgcaatgaattct

SEQ ID NO: 343713 - DNA, 20 bp, Artificial Sequence
  chemically synthesized
tgcaatgaattcttggctac

SEQ ID NO: 343714 - DNA, 20 bp, Artificial Sequence
  chemically synthesized
cacatttgtggcttgtagcc

SEQ ID NO: 343715 - DNA, 20 bp, Artificial Sequence
  chemically synthesized
caaagcacatttgtggcttg

SEQ ID NO: 343716 - DNA, 20 bp, Artificial Sequence
  chemically synthesized
tatttctcaaagcacatttg

SEQ ID NO: 343717 - DNA, 20 bp, Artificial Sequence
  chemically synthesized
acaagccacaaatgtgcttt

SEQ ID NO: 343718 - DNA, 20 bp, Artificial Sequence
  chemically synthesized
cactcgctttttatttctca

SEQ ID NO: 343719 - DNA, 20 bp, Artificial Sequence
  chemically synthesized
aatgtgctttgagaaataaa

SEQ ID NO: 343720 - DNA, 20 bp, Artificial Sequence
  chemically synthesized
tgctttgagaaataaaaagc

SEQ ID NO: 343721 - DNA, 20 bp, Artificial Sequence
  chemically synthesized
taaaaagcgagtgaatatac

SEQ ID NO: 343722 - DNA, 20 bp, Artificial Sequence
  chemically synthesized
tggaccaataatagaaacac

SEQ ID NO: 343723 - DNA, 20 bp, Artificial Sequence
  chemically synthesized
tatactggtgtttctattat

SEQ ID NO: 343724 - DNA, 20 bp, Artificial Sequence
  chemically synthesized
tatctcagctggaccaataa

SEQ ID NO: 343725 - DNA, 20 bp, Artificial Sequence
  chemically synthesized
tggtgtttctattattggtc

SEQ ID NO: 343726 - DNA, 20 bp, Artificial Sequence
  chemically synthesized
tttctattattggtccagct

SEQ ID NO: 343727 - DNA, 20 bp, Artificial Sequence
  chemically synthesized
tattattggtccagctgaga

SEQ ID NO: 343728 - DNA, 20 bp, Artificial Sequence
  chemically synthesized
aaaaaagcaactatctcagc

SEQ ID NO: 343729 - DNA, 20 bp, Artificial Sequence
  chemically synthesized
gaataaaaaagcaactatct

SEQ ID NO: 343730 - DNA, 20 bp, Artificial Sequence
  chemically synthesized
aacttttattaagaataaaa

SEQ ID NO: 343731 - DNA, 20 bp, Artificial Sequence
  chemically synthesized
tgcttttttattcttaataa

SEQ ID NO: 343732 - DNA, 20 bp, Artificial Sequence
  chemically synthesized
acctcgagaaaacttttatt

SEQ ID NO: 343733 - DNA, 20 bp, Artificial Sequence
  chemically synthesized
ttcttaataaaagttttctc

SEQ ID NO: 343734 - DNA, 20 bp, Artificial Sequence
  chemically synthesized
tcttaataaaagttttctcg

SEQ ID NO: 343735 - DNA, 20 bp, Artificial Sequence
  chemically synthesized
taataaaagttttctcgagg

SEQ ID NO: 343736 - DNA, 20 bp, Artificial Sequence
  chemically synthesized
tttgaaattatgactacctc

SEQ ID NO: 343737 - DNA, 20 bp, Artificial Sequence
  chemically synthesized
taatttcaaaaccctgctta

SEQ ID NO: 343738 - DNA, 20 bp, Artificial Sequence
  chemically synthesized
atgattcattactataagca

SEQ ID NO: 343739 - DNA, 20 bp, Artificial Sequence
  chemically synthesized
catgattcattactataagc

SEQ ID NO: 343740 - DNA, 20 bp, Artificial Sequence
  chemically synthesized
ccatgattcattactataag

SEQ ID NO: 343741 - DNA, 20 bp, Artificial Sequence
  chemically synthesized
taaccatgattcattactat

SEQ ID NO: 343742 - DNA, 20 bp, Artificial Sequence
  chemically synthesized
ctgcttatagtaatgaatca

SEQ ID NO: 343743 - DNA, 20 bp, Artificial Sequence
  chemically synthesized
atgaatcatggttatttaca

SEQ ID NO: 343744 - DNA, 20 bp, Artificial Sequence
  chemically synthesized
tggttatttacaaagtaatt

SEQ ID NO: 343745 - DNA, 20 bp, Artificial Sequence
  chemically synthesized
acttatacaaatcgtgatca

SEQ ID NO: 343746 - DNA, 20 bp, Artificial Sequence
  chemically synthesized
actatgatcacgatttgtat

SEQ ID NO: 343747 - DNA, 20 bp, Artificial Sequence
  chemically synthesized
cacgatttgtataagtaatg

SEQ ID NO: 343748 - DNA, 20 bp, Artificial Sequence
  chemically synthesized
gtataagtaatgtagtcata

SEQ ID NO: 343749 - DNA, 20 bp, Artificial Sequence
  chemically synthesized
gtaatgtagtcatatagtcg

SEQ ID NO: 343750 - DNA, 20 bp, Artificial Sequence
  chemically synthesized
tcatatagtcgaagactttt

SEQ ID NO: 343751 - DNA, 20 bp, Artificial Sequence
  chemically synthesized
catatagtcgaagacttttc

SEQ ID NO: 343752 - DNA, 20 bp, Artificial Sequence
  chemically synthesized
atatagtcgaagacttttca

SEQ ID NO: 343753 - DNA, 20 bp, Artificial Sequence
  chemically synthesized
aaacagaaaacatccctgaa

SEQ ID NO: 343754 - DNA, 20 bp, Artificial Sequence
  chemically synthesized
ttgcagcttatcagtttaaa

SEQ ID NO: 343755 - DNA, 20 bp, Artificial Sequence
  chemically synthesized
tgttttctgtttaaactgat

SEQ ID NO: 343756 - DNA, 20 bp, Artificial Sequence
  chemically synthesized
tacagaattttgcagcttat

SEQ ID NO: 343757 - DNA, 20 bp, Artificial Sequence
  chemically synthesized
aaggaaaatacagaattttg

SEQ ID NO: 343758 - DNA, 20 bp, Artificial Sequence
  chemically synthesized
catttttattaaggaaaata

SEQ ID NO: 343759 - DNA, 20 bp, Artificial Sequence
  chemically synthesized
ttcctgaaacatttttatta

SEQ ID NO: 343760 - DNA, 20 bp, Artificial Sequence
  chemically synthesized
tttcctgaaacatttttatt

SEQ ID NO: 343761 - DNA, 20 bp, Artificial Sequence
  chemically synthesized
tttccttaataaaaatgttt

SEQ ID NO: 343762 - DNA, 20 bp, Artificial Sequence
  chemically synthesized
ttccttaataaaaatgtttc

SEQ ID NO: 343763 - DNA, 20 bp, Artificial Sequence
  chemically synthesized
aataaaaatgtttcaggaaa

SEQ ID NO: 343764 - DNA, 20 bp, Artificial Sequence
  chemically synthesized
aaaatgtttcaggaaaaaga

SEQ ID NO: 343765 - DNA, 20 bp, Artificial Sequence
  chemically synthesized
ttcaggaaaaagacagcgaa

SEQ ID NO: 343766 - DNA, 20 bp, Artificial Sequence
  chemically synthesized
ggaaaaagacagcgaacagc

SEQ ID NO: 343767 - DNA, 20 bp, Artificial Sequence
  chemically synthesized
acagcgaacagctagatttg

SEQ ID NO: 343768 - DNA, 20 bp, Artificial Sequence
  chemically synthesized
ttatttttactcttcaaatc

SEQ ID NO: 343769 - DNA, 20 bp, Artificial Sequence
  chemically synthesized
agcgaacagctagatttgaa

SEQ ID NO: 343770 - DNA, 20 bp, Artificial Sequence
  chemically synthesized
agatttgaagagtaaaaata

SEQ ID NO: 343771 - DNA, 20 bp, Artificial Sequence
  chemically synthesized
aagagtaaaaataaagaata

SEQ ID NO: 343772 - DNA, 20 bp, Artificial Sequence
  chemically synthesized
gtaaaaataaagaataaagc

SEQ ID NO: 343773 - DNA, 20 bp, Artificial Sequence
  chemically synthesized
aaaataaagaataaagccag

SEQ ID NO: 343774 - DNA, 20 bp, Artificial Sequence
  chemically synthesized
aaataaagaataaagccagt

SEQ ID NO: 343775 - DNA, 20 bp, Artificial Sequence
  chemically synthesized
tagaagtttgtgtttcctac

SEQ ID NO: 343776 - DNA, 20 bp, Artificial Sequence
  chemically synthesized
cagtaggaaacacaaacttc

SEQ ID NO: 343777 - DNA, 20 bp, Artificial Sequence
  chemically synthesized
taacaatttaaaagttctag

SEQ ID NO: 343778 - DNA, 20 bp, Artificial Sequence
  chemically synthesized
gtttaacaatttaaaagttc

SEQ ID NO: 343779 - DNA, 20 bp, Artificial Sequence
  chemically synthesized
aaagatgtttaacaatttaa

SEQ ID NO: 343780 - DNA, 20 bp, Artificial Sequence
  chemically synthesized
taaattgttaaacatctttg

SEQ ID NO: 343781 - DNA, 20 bp, Artificial Sequence
  chemically synthesized
attgttaaacatctttgtgg

SEQ ID NO: 343782 - DNA, 20 bp, Artificial Sequence
  chemically synthesized
aaatggtagttacttccaca

SEQ ID NO: 343783 - DNA, 20 bp, Artificial Sequence
  chemically synthesized
tgcagatttggtgaaaatgg

SEQ ID NO: 343784 - DNA, 20 bp, Artificial Sequence
  chemically synthesized
atttgcagatttggtgaaaa

SEQ ID NO: 343785 - DNA, 20 bp, Artificial Sequence
  chemically synthesized
tggaatatgatttgcagatt

SEQ ID NO: 343786 - DNA, 20 bp, Artificial Sequence
  chemically synthesized
acttgttggaatatgatttg

SEQ ID NO: 343787 - DNA, 20 bp, Artificial Sequence
  chemically synthesized
tctgcaaatcatattccaac

SEQ ID NO: 343788 - DNA, 20 bp, Artificial Sequence
  chemically synthesized
ggcttatttttacaacttgt

SEQ ID NO: 343789 - DNA, 20 bp, Artificial Sequence
  chemically synthesized
ttccaacaagttgtaaaaat

SEQ ID NO: 343790 - DNA, 20 bp, Artificial Sequence
  chemically synthesized
taaaaataagccataattct

SEQ ID NO: 343791 - DNA, 20 bp, Artificial Sequence
  chemically synthesized
actttcaattctaagaatta

SEQ ID NO: 343792 - DNA, 20 bp, Artificial Sequence
  chemically synthesized
gataagagactttcaattct

SEQ ID NO: 343793 - DNA, 20 bp, Artificial Sequence
  chemically synthesized
gccataattcttagaattga

SEQ ID NO: 343794 - DNA, 20 bp, Artificial Sequence
  chemically synthesized
tattacctgtagaatgataa

SEQ ID NO: 343795 - DNA, 20 bp, Artificial Sequence
  chemically synthesized
gttattacctgtagaatgat

SEQ ID NO: 343796 - DNA, 20 bp, Artificial Sequence
  chemically synthesized
gaaagtctcttatcattcta

SEQ ID NO: 343797 - DNA, 20 bp, Artificial Sequence
  chemically synthesized
aaagtctcttatcattctac

SEQ ID NO: 343798 - DNA, 20 bp, Artificial Sequence
  chemically synthesized
ccaagtcatgttattacctg

SEQ ID NO: 343799 - DNA, 20 bp, Artificial Sequence
  chemically synthesized
ctacaggtaataacatgact

SEQ ID NO: 343800 - DNA, 20 bp, Artificial Sequence
  chemically synthesized
attacccagagaacaggacc

SEQ ID NO: 343801 - DNA, 20 bp, Artificial Sequence
  chemically synthesized
catgacttggtcctgttctc

SEQ ID NO: 343802 - DNA, 20 bp, Artificial Sequence
  chemically synthesized
atgacttggtcctgttctct

SEQ ID NO: 343803 - DNA, 20 bp, Artificial Sequence
  chemically synthesized
tactccattacccagagaac

SEQ ID NO: 343804 - DNA, 20 bp, Artificial Sequence
  chemically synthesized
ttactccattacccagagaa

SEQ ID NO: 343805 - DNA, 20 bp, Artificial Sequence
  chemically synthesized
tggtcctgttctctgggtaa

SEQ ID NO: 343806 - DNA, 20 bp, Artificial Sequence
  chemically synthesized
acattttactccattaccca

SEQ ID NO: 343807 - DNA, 20 bp, Artificial Sequence
  chemically synthesized
gtcctgttctctgggtaatg

SEQ ID NO: 343808 - DNA, 20 bp, Artificial Sequence
  chemically synthesized
taacattttactccattacc

SEQ ID NO: 343809 - DNA, 20 bp, Artificial Sequence
  chemically synthesized
gtaatggagtaaaatgttac

SEQ ID NO: 343810 - DNA, 20 bp, Artificial Sequence
  chemically synthesized
gtctaaacatgggaatatgc

SEQ ID NO: 343811 - DNA, 20 bp, Artificial Sequence
  chemically synthesized
tactggcatattcccatgtt

SEQ ID NO: 343812 - DNA, 20 bp, Artificial Sequence
  chemically synthesized
ttgcaaatctgtctaaacat

SEQ ID NO: 343813 - DNA, 20 bp, Artificial Sequence
  chemically synthesized
tttgcaaatctgtctaaaca

SEQ ID NO: 343814 - DNA, 20 bp, Artificial Sequence
  chemically synthesized
ggcatattcccatgtttaga

SEQ ID NO: 343815 - DNA, 20 bp, Artificial Sequence
  chemically synthesized
tgtttagacagatttgcaaa

SEQ ID NO: 343816 - DNA, 20 bp, Artificial Sequence
  chemically synthesized
gacagatttgcaaatagccc

SEQ ID NO: 343817 - DNA, 20 bp, Artificial Sequence
  chemically synthesized
cagatttgcaaatagcccca

SEQ ID NO: 343818 - DNA, 20 bp, Artificial Sequence
  chemically synthesized
gttaggaatggaattctctg

SEQ ID NO: 343819 - DNA, 20 bp, Artificial Sequence
  chemically synthesized
ggttaggaatggaattctct

SEQ ID NO: 343820 - DNA, 20 bp, Artificial Sequence
  chemically synthesized
aggttaggaatggaattctc

SEQ ID NO: 343821 - DNA, 20 bp, Artificial Sequence
  chemically synthesized
aacatatcccaggttaggaa

SEQ ID NO: 343822 - DNA, 20 bp, Artificial Sequence
  chemically synthesized
agagaattccattcctaacc

SEQ ID NO: 343823 - DNA, 20 bp, Artificial Sequence
  chemically synthesized
gagaattccattcctaacct

SEQ ID NO: 343824 - DNA, 20 bp, Artificial Sequence
  chemically synthesized
tgagtaacatatcccaggtt

SEQ ID NO: 343825 - DNA, 20 bp, Artificial Sequence
  chemically synthesized
ttgagtaacatatcccaggt

SEQ ID NO: 343826 - DNA, 20 bp, Artificial Sequence
  chemically synthesized
gtctttgagtaacatatccc

SEQ ID NO: 343827 - DNA, 20 bp, Artificial Sequence
  chemically synthesized
cgtctttgagtaacatatcc

SEQ ID NO: 343828 - DNA, 20 bp, Artificial Sequence
  chemically synthesized
aacctgggatatgttactca

SEQ ID NO: 343829 - DNA, 20 bp, Artificial Sequence
  chemically synthesized
actccagatagaacgtcttt

SEQ ID NO: 343830 - DNA, 20 bp, Artificial Sequence
  chemically synthesized
ttactcaaagacgttctatc

SEQ ID NO: 343831 - DNA, 20 bp, Artificial Sequence
  chemically synthesized
actcaaagacgttctatctg

SEQ ID NO: 343832 - DNA, 20 bp, Artificial Sequence
  chemically synthesized
tatgaaagcttgactccaga

SEQ ID NO: 343833 - DNA, 20 bp, Artificial Sequence
  chemically synthesized
aagacgttctatctggagtc

SEQ ID NO: 343834 - DNA, 20 bp, Artificial Sequence
  chemically synthesized
cttgtatgaaagcttgactc

SEQ ID NO: 343835 - DNA, 20 bp, Artificial Sequence
  chemically synthesized
ctggagtcaagctttcatac

SEQ ID NO: 343836 - DNA, 20 bp, Artificial Sequence
  chemically synthesized
tgtctatgattcttgtatga

SEQ ID NO: 343837 - DNA, 20 bp, Artificial Sequence
  chemically synthesized
aagctttcatacaagaatca

SEQ ID NO: 343838 - DNA, 20 bp, Artificial Sequence
  chemically synthesized
aagaatcatagacatacttc

SEQ ID NO: 343839 - DNA, 20 bp, Artificial Sequence
  chemically synthesized
agaatcatagacatacttca

SEQ ID NO: 343840 - DNA, 20 bp, Artificial Sequence
  chemically synthesized
gaatcatagacatacttcaa

SEQ ID NO: 343841 - DNA, 20 bp, Artificial Sequence
  chemically synthesized
cagtgttcatggatcccttg

SEQ ID NO: 343842 - DNA, 20 bp, Artificial Sequence
  chemically synthesized
ttcaagggatccatgaacac

SEQ ID NO: 343843 - DNA, 20 bp, Artificial Sequence
  chemically synthesized
catatactttccagtgttca

SEQ ID NO: 343844 - DNA, 20 bp, Artificial Sequence
  chemically synthesized
agggatccatgaacactgga

SEQ ID NO: 343845 - DNA, 20 bp, Artificial Sequence
  chemically synthesized
catagtttccatatactttc

SEQ ID NO: 343846 - DNA, 20 bp, Artificial Sequence
  chemically synthesized
catgaacactggaaagtata

SEQ ID NO: 343847 - DNA, 20 bp, Artificial Sequence
  chemically synthesized
aaaaataaaaaacgtgaaca

SEQ ID NO: 343848 - DNA, 20 bp, Artificial Sequence
  chemically synthesized
gttcacgttttttatttttc

SEQ ID NO: 343849 - DNA, 20 bp, Artificial Sequence
  chemically synthesized
tcaagaaaatctacaccatc

SEQ ID NO: 343850 - DNA, 20 bp, Artificial Sequence
  chemically synthesized
tgagattctgctggatggtg

SEQ ID NO: 343851 - DNA, 20 bp, Artificial Sequence
  chemically synthesized
agaaaatctacaccatccag

SEQ ID NO: 343852 - DNA, 20 bp, Artificial Sequence
  chemically synthesized
ctgtgtgagattctgctgga

SEQ ID NO: 343853 - DNA, 20 bp, Artificial Sequence
  chemically synthesized
ggatctgtgtgagattctgc

SEQ ID NO: 343854 - DNA, 20 bp, Artificial Sequence
  chemically synthesized
ccatccagcagaatctcaca

SEQ ID NO: 343855 - DNA, 20 bp, Artificial Sequence
  chemically synthesized
ttaaaattaaggatctgtgt

SEQ ID NO: 343856 - DNA, 20 bp, Artificial Sequence
  chemically synthesized
cttaactcattttaaaatta

SEQ ID NO: 343857 - DNA, 20 bp, Artificial Sequence
  chemically synthesized
tcttaactcattttaaaatt

SEQ ID NO: 343858 - DNA, 20 bp, Artificial Sequence
  chemically synthesized
cagatccttaattttaaaat

SEQ ID NO: 343859 - DNA, 20 bp, Artificial Sequence
  chemically synthesized
ccttaattttaaaatgagtt

SEQ ID NO: 343860 - DNA, 20 bp, Artificial Sequence
  chemically synthesized
taattttaaaatgagttaag

SEQ ID NO: 343861 - DNA, 20 bp, Artificial Sequence
  chemically synthesized
ttttaaaatgagttaagaag

SEQ ID NO: 343862 - DNA, 20 bp, Artificial Sequence
  chemically synthesized
taaaatgagttaagaagcag

SEQ ID NO: 343863 - DNA, 20 bp, Artificial Sequence
  chemically synthesized
tgagttaagaagcagtggtc

SEQ ID NO: 343864 - DNA, 20 bp, Artificial Sequence
  chemically synthesized
gagttaagaagcagtggtct

SEQ ID NO: 343865 - DNA, 20 bp, Artificial Sequence
  chemically synthesized
agttaagaagcagtggtcta

SEQ ID NO: 343866 - DNA, 20 bp, Artificial Sequence
  chemically synthesized
taagaagcagtggtctaggg

SEQ ID NO: 343867 - DNA, 20 bp, Artificial Sequence
  chemically synthesized
aagaagcagtggtctagggc

SEQ ID NO: 343868 - DNA, 20 bp, Artificial Sequence
  chemically synthesized
ttgagaaccatagcctgccc

SEQ ID NO: 343869 - DNA, 20 bp, Artificial Sequence
  chemically synthesized
cagtggtctagggcaggcta

SEQ ID NO: 343870 - DNA, 20 bp, Artificial Sequence
  chemically synthesized
gatccacactttgagaacca

SEQ ID NO: 343871 - DNA, 20 bp, Artificial Sequence
  chemically synthesized
agggcaggctatggttctca

SEQ ID NO: 343872 - DNA, 20 bp, Artificial Sequence
  chemically synthesized
aggctatggttctcaaagtg

SEQ ID NO: 343873 - DNA, 20 bp, Artificial Sequence
  chemically synthesized
ctggtctggatccacacttt

SEQ ID NO: 343874 - DNA, 20 bp, Artificial Sequence
  chemically synthesized
tggttctcaaagtgtggatc

SEQ ID NO: 343875 - DNA, 20 bp, Artificial Sequence
  chemically synthesized
ctcaaagtgtggatccagac

SEQ ID NO: 343876 - DNA, 20 bp, Artificial Sequence
  chemically synthesized
aggtgacgctgatgctggtc

SEQ ID NO: 343877 - DNA, 20 bp, Artificial Sequence
  chemically synthesized
gtgtggatccagaccagcat

SEQ ID NO: 343878 - DNA, 20 bp, Artificial Sequence
  chemically synthesized
gtcccaggtgacgctgatgc

SEQ ID NO: 343879 - DNA, 20 bp, Artificial Sequence
  chemically synthesized
agaccagcatcagcgtcacc

SEQ ID NO: 343880 - DNA, 20 bp, Artificial Sequence
  chemically synthesized
gaccagcatcagcgtcacct

SEQ ID NO: 343881 - DNA, 20 bp, Artificial Sequence
  chemically synthesized
ggtatttctaaaaaggtccc

SEQ ID NO: 343882 - DNA, 20 bp, Artificial Sequence
  chemically synthesized
cggtatttctaaaaaggtcc

SEQ ID NO: 343883 - DNA, 20 bp, Artificial Sequence
  chemically synthesized
agcgtcacctgggacctttt

SEQ ID NO: 343884 - DNA, 20 bp, Artificial Sequence
  chemically synthesized
gaaattcggtatttctaaaa

SEQ ID NO: 343885 - DNA, 20 bp, Artificial Sequence
  chemically synthesized
tgaaattcggtatttctaaa

SEQ ID NO: 343886 - DNA, 20 bp, Artificial Sequence
  chemically synthesized
tttttagaaataccgaattt

SEQ ID NO: 343887 - DNA, 20 bp, Artificial Sequence
  chemically synthesized
ttttagaaataccgaatttc

SEQ ID NO: 343888 - DNA, 20 bp, Artificial Sequence
  chemically synthesized
tctgggagagtcctgaaatt

SEQ ID NO: 343889 - DNA, 20 bp, Artificial Sequence
  chemically synthesized
accgaatttcaggactctcc

SEQ ID NO: 343890 - DNA, 20 bp, Artificial Sequence
  chemically synthesized
ctaaccaagtaagtctggga

SEQ ID NO: 343891 - DNA, 20 bp, Artificial Sequence
  chemically synthesized
tactaaccaagtaagtctgg

SEQ ID NO: 343892 - DNA, 20 bp, Artificial Sequence
  chemically synthesized
gatactaaccaagtaagtct

SEQ ID NO: 343893 - DNA, 20 bp, Artificial Sequence
  chemically synthesized
agatactaaccaagtaagtc

SEQ ID NO: 343894 - DNA, 20 bp, Artificial Sequence
  chemically synthesized
aggactctcccagacttact

SEQ ID NO: 343895 - DNA, 20 bp, Artificial Sequence
  chemically synthesized
ctctcccagacttacttggt

SEQ ID NO: 343896 - DNA, 20 bp, Artificial Sequence
  chemically synthesized
ccctgagatactaaccaagt

SEQ ID NO: 343897 - DNA, 20 bp, Artificial Sequence
  chemically synthesized
cactccctgagatactaacc

SEQ ID NO: 343898 - DNA, 20 bp, Artificial Sequence
  chemically synthesized
gacttacttggttagtatct

SEQ ID NO: 343899 - DNA, 20 bp, Artificial Sequence
  chemically synthesized
acttacttggttagtatctc

SEQ ID NO: 343900 - DNA, 20 bp, Artificial Sequence
  chemically synthesized
cttacttggttagtatctca

SEQ ID NO: 343901 - DNA, 20 bp, Artificial Sequence
  chemically synthesized
tacttggttagtatctcagg

SEQ ID NO: 343902 - DNA, 20 bp, Artificial Sequence
  chemically synthesized
tggttagtatctcagggagt

SEQ ID NO: 343903 - DNA, 20 bp, Artificial Sequence
  chemically synthesized
atttctgggtctcactccct

SEQ ID NO: 343904 - DNA, 20 bp, Artificial Sequence
  chemically synthesized
gtatctcagggagtgagacc

SEQ ID NO: 343905 - DNA, 20 bp, Artificial Sequence
  chemically synthesized
aaaagaaaacacagatttct

SEQ ID NO: 343906 - DNA, 20 bp, Artificial Sequence
  chemically synthesized
aaaaagaaaacacagatttc

SEQ ID NO: 343907 - DNA, 20 bp, Artificial Sequence
  chemically synthesized
taaacattaaaaagaaaaca

SEQ ID NO: 343908 - DNA, 20 bp, Artificial Sequence
  chemically synthesized
tgtgtcgattaaacattaaa

SEQ ID NO: 343909 - DNA, 20 bp, Artificial Sequence
  chemically synthesized
gacacataattatgcatatt

SEQ ID NO: 343910 - DNA, 20 bp, Artificial Sequence
  chemically synthesized
acacataattatgcatattt

SEQ ID NO: 343911 - DNA, 20 bp, Artificial Sequence
  chemically synthesized
acataattatgcatatttag

SEQ ID NO: 343912 - DNA, 20 bp, Artificial Sequence
  chemically synthesized
cataattatgcatatttagg

SEQ ID NO: 343913 - DNA, 20 bp, Artificial Sequence
  chemically synthesized
ttatgcatatttaggaggta

SEQ ID NO: 343914 - DNA, 20 bp, Artificial Sequence
  chemically synthesized
atgcatatttaggaggtaca

SEQ ID NO: 343915 - DNA, 20 bp, Artificial Sequence
  chemically synthesized
attacatgttatattcatat

SEQ ID NO: 343916 - DNA, 20 bp, Artificial Sequence
  chemically synthesized
tattacatgttatattcata

SEQ ID NO: 343917 - DNA, 20 bp, Artificial Sequence
  chemically synthesized
ataacatgtaataatcaaat

SEQ ID NO: 343918 - DNA, 20 bp, Artificial Sequence
  chemically synthesized
taacatgtaataatcaaatc

SEQ ID NO: 343919 - DNA, 20 bp, Artificial Sequence
  chemically synthesized
gaggtaatggatatgataat

SEQ ID NO: 343920 - DNA, 20 bp, Artificial Sequence
  chemically synthesized
atgacaaatatttgaggtaa

SEQ ID NO: 343921 - DNA, 20 bp, Artificial Sequence
  chemically synthesized
aaagaaatgacaaatatttg

SEQ ID NO: 343922 - DNA, 20 bp, Artificial Sequence
  chemically synthesized
caaagaaatgacaaatattt

SEQ ID NO: 343923 - DNA, 20 bp, Artificial Sequence
  chemically synthesized
tatttgtcatttctttgtgt

SEQ ID NO: 343924 - DNA, 20 bp, Artificial Sequence
  chemically synthesized
atttgtcatttctttgtgtt

SEQ ID NO: 343925 - DNA, 20 bp, Artificial Sequence
  chemically synthesized
ttttgaaacttcccaacaca

SEQ ID NO: 343926 - DNA, 20 bp, Artificial Sequence
  chemically synthesized
tgtcatttctttgtgttggg

SEQ ID NO: 343927 - DNA, 20 bp, Artificial Sequence
  chemically synthesized
agtttcaaaatcctctcttc

SEQ ID NO: 343928 - DNA, 20 bp, Artificial Sequence
  chemically synthesized
tgtttaaatagctagaagag

SEQ ID NO: 343929 - DNA, 20 bp, Artificial Sequence
  chemically synthesized
atgtttaaatagctagaaga

SEQ ID NO: 343930 - DNA, 20 bp, Artificial Sequence
  chemically synthesized
gcatgtttaaatagctagaa

SEQ ID NO: 343931 - DNA, 20 bp, Artificial Sequence
  chemically synthesized
gtgcatgtttaaatagctag

SEQ ID NO: 343932 - DNA, 20 bp, Artificial Sequence
  chemically synthesized
attgtgcatgtttaaatagc

SEQ ID NO: 343933 - DNA, 20 bp, Artificial Sequence
  chemically synthesized
atttattgtgcatgtttaaa

SEQ ID NO: 343934 - DNA, 20 bp, Artificial Sequence
  chemically synthesized
caataaattactgttaactg

SEQ ID NO: 343935 - DNA, 20 bp, Artificial Sequence
  chemically synthesized
tgtaaggtaacttcagttaa

SEQ ID NO: 343936 - DNA, 20 bp, Artificial Sequence
  chemically synthesized
aaagcactgtaaggtaactt

SEQ ID NO: 343937 - DNA, 20 bp, Artificial Sequence
  chemically synthesized
tgttaactgaagttacctta

SEQ ID NO: 343938 - DNA, 20 bp, Artificial Sequence
  chemically synthesized
tagtgttctaaagcactgta

SEQ ID NO: 343939 - DNA, 20 bp, Artificial Sequence
  chemically synthesized
ctagtgttctaaagcactgt

SEQ ID NO: 343940 - DNA, 20 bp, Artificial Sequence
  chemically synthesized
gaagttaccttacagtgctt

SEQ ID NO: 343941 - DNA, 20 bp, Artificial Sequence
  chemically synthesized
ggatatgtactagtgttcta

SEQ ID NO: 343942 - DNA, 20 bp, Artificial Sequence
  chemically synthesized
cttacagtgctttagaacac

SEQ ID NO: 343943 - DNA, 20 bp, Artificial Sequence
  chemically synthesized
taaataggacggatatgtac

SEQ ID NO: 343944 - DNA, 20 bp, Artificial Sequence
  chemically synthesized
tagtacatatccgtcctatt

SEQ ID NO: 343945 - DNA, 20 bp, Artificial Sequence
  chemically synthesized
aaatgataagctaaatagga

SEQ ID NO: 343946 - DNA, 20 bp, Artificial Sequence
  chemically synthesized
tacaaaatgataagctaaat

SEQ ID NO: 343947 - DNA, 20 bp, Artificial Sequence
  chemically synthesized
atacaaaatgataagctaaa

SEQ ID NO: 343948 - DNA, 20 bp, Artificial Sequence
  chemically synthesized
gttaacagatacaaaatgat

SEQ ID NO: 343949 - DNA, 20 bp, Artificial Sequence
  chemically synthesized
atcattttgtatctgttaac

SEQ ID NO: 343950 - DNA, 20 bp, Artificial Sequence
  chemically synthesized
gaaagggacaagctagttaa

SEQ ID NO: 343951 - DNA, 20 bp, Artificial Sequence
  chemically synthesized
gagggaggaaagggacaagc

SEQ ID NO: 343952 - DNA, 20 bp, Artificial Sequence
  chemically synthesized
aggagagggaggaaagggac

SEQ ID NO: 343953 - DNA, 20 bp, Artificial Sequence
  chemically synthesized
gagggaggagagggaggaaa

SEQ ID NO: 343954 - DNA, 20 bp, Artificial Sequence
  chemically synthesized
agagggaggagagggaggaa

SEQ ID NO: 343955 - DNA, 20 bp, Artificial Sequence
  chemically synthesized
aagagggaggagagggagga

SEQ ID NO: 343956 - DNA, 20 bp, Artificial Sequence
  chemically synthesized
gggtaagagggaggagaggg

SEQ ID NO: 343957 - DNA, 20 bp, Artificial Sequence
  chemically synthesized
agggtaagagggaggagagg

SEQ ID NO: 343958 - DNA, 20 bp, Artificial Sequence
  chemically synthesized
ggagggtaagagggaggaga

SEQ ID NO: 343959 - DNA, 20 bp, Artificial Sequence
  chemically synthesized
gggagggtaagagggaggag

SEQ ID NO: 343960 - DNA, 20 bp, Artificial Sequence
  chemically synthesized
ggggagggtaagagggagga

SEQ ID NO: 343961 - DNA, 20 bp, Artificial Sequence
  chemically synthesized
ccggggagggtaagagggag

SEQ ID NO: 343962 - DNA, 20 bp, Artificial Sequence
  chemically synthesized
agccggggagggtaagaggg

SEQ ID NO: 343963 - DNA, 20 bp, Artificial Sequence
  chemically synthesized
aagccggggagggtaagagg

SEQ ID NO: 343964 - DNA, 20 bp, Artificial Sequence
  chemically synthesized
agaagccggggagggtaaga

SEQ ID NO: 343965 - DNA, 20 bp, Artificial Sequence
  chemically synthesized
cagaagccggggagggtaag

SEQ ID NO: 343966 - DNA, 20 bp, Artificial Sequence
  chemically synthesized
gcagaagccggggagggtaa

SEQ ID NO: 343967 - DNA, 20 bp, Artificial Sequence
  chemically synthesized
tagcagaagccggggagggt

SEQ ID NO: 343968 - DNA, 20 bp, Artificial Sequence
  chemically synthesized
ctcctccctcttaccctccc

SEQ ID NO: 343969 - DNA, 20 bp, Artificial Sequence
  chemically synthesized
tggttagcagaagccgggga

SEQ ID NO: 343970 - DNA, 20 bp, Artificial Sequence
  chemically synthesized
gtggttagcagaagccgggg

SEQ ID NO: 343971 - DNA, 20 bp, Artificial Sequence
  chemically synthesized
agtggttagcagaagccggg

SEQ ID NO: 343972 - DNA, 20 bp, Artificial Sequence
  chemically synthesized
atagtggttagcagaagccg

SEQ ID NO: 343973 - DNA, 20 bp, Artificial Sequence
  chemically synthesized
aatagtggttagcagaagcc

SEQ ID NO: 343974 - DNA, 20 bp, Artificial Sequence
  chemically synthesized
gaatagtggttagcagaagc

SEQ ID NO: 343975 - DNA, 20 bp, Artificial Sequence
  chemically synthesized
agtagaatagtggttagcag

SEQ ID NO: 343976 - DNA, 20 bp, Artificial Sequence
  chemically synthesized
ggcagtagaatagtggttag

SEQ ID NO: 343977 - DNA, 20 bp, Artificial Sequence
  chemically synthesized
gcaggcagtagaatagtggt

SEQ ID NO: 343978 - DNA, 20 bp, Artificial Sequence
  chemically synthesized
agaagcaggcagtagaatag

SEQ ID NO: 343979 - DNA, 20 bp, Artificial Sequence
  chemically synthesized
catagaagcaggcagtagaa

SEQ ID NO: 343980 - DNA, 20 bp, Artificial Sequence
  chemically synthesized
gatttcatagaagcaggcag

SEQ ID NO: 343981 - DNA, 20 bp, Artificial Sequence
  chemically synthesized
tttgatttcatagaagcagg

SEQ ID NO: 343982 - DNA, 20 bp, Artificial Sequence
  chemically synthesized
aagtttgatttcatagaagc

SEQ ID NO: 343983 - DNA, 20 bp, Artificial Sequence
  chemically synthesized
aaagtttgatttcatagaag

SEQ ID NO: 343984 - DNA, 20 bp, Artificial Sequence
  chemically synthesized
taaaaagtttgatttcatag

SEQ ID NO: 343985 - DNA, 20 bp, Artificial Sequence
  chemically synthesized
agctaaaaagtttgatttca

SEQ ID NO: 343986 - DNA, 20 bp, Artificial Sequence
  chemically synthesized
ttctatgaaatcaaactttt

SEQ ID NO: 343987 - DNA, 20 bp, Artificial Sequence
  chemically synthesized
tttcatatgttagagctaaa

SEQ ID NO: 343988 - DNA, 20 bp, Artificial Sequence
  chemically synthesized
tcacaagttttcatatgtta

SEQ ID NO: 343989 - DNA, 20 bp, Artificial Sequence
  chemically synthesized
tatcacaagttttcatatgt

SEQ ID NO: 343990 - DNA, 20 bp, Artificial Sequence
  chemically synthesized
cacgaagagataaatatcac

SEQ ID NO: 343991 - DNA, 20 bp, Artificial Sequence
  chemically synthesized
tgaaataagtcgggcacgaa

SEQ ID NO: 343992 - DNA, 20 bp, Artificial Sequence
  chemically synthesized
agtgaaataagtcgggcacg

SEQ ID NO: 343993 - DNA, 20 bp, Artificial Sequence
  chemically synthesized
actgttaagtgaaataagtc

SEQ ID NO: 343994 - DNA, 20 bp, Artificial Sequence
  chemically synthesized
tactgttaagtgaaataagt

SEQ ID NO: 343995 - DNA, 20 bp, Artificial Sequence
  chemically synthesized
tggatactgttaagtgaaat

SEQ ID NO: 343996 - DNA, 20 bp, Artificial Sequence
  chemically synthesized
gcccgacttatttcacttaa

SEQ ID NO: 343997 - DNA, 20 bp, Artificial Sequence
  chemically synthesized
ggatgagcctggatactgtt

SEQ ID NO: 343998 - DNA, 20 bp, Artificial Sequence
  chemically synthesized
ttatttcacttaacagtatc

SEQ ID NO: 343999 - DNA, 20 bp, Artificial Sequence
  chemically synthesized
tatttcacttaacagtatcc

SEQ ID NO: 344000 - DNA, 20 bp, Artificial Sequence
  chemically synthesized
ggtggtaacatggatgagcc

SEQ ID NO: 344001 - DNA, 20 bp, Artificial Sequence
  chemically synthesized
taattggtggtaacatggat

SEQ ID NO: 344002 - DNA, 20 bp, Artificial Sequence
  chemically synthesized
tcctgtaattggtggtaaca

SEQ ID NO: 344003 - DNA, 20 bp, Artificial Sequence
  chemically synthesized
atccatgttaccaccaatta

SEQ ID NO: 344004 - DNA, 20 bp, Artificial Sequence
  chemically synthesized
gaatgaaatcctgtaattgg

SEQ ID NO: 344005 - DNA, 20 bp, Artificial Sequence
  chemically synthesized
tccatgttaccaccaattac

SEQ ID NO: 344006 - DNA, 20 bp, Artificial Sequence
  chemically synthesized
aaagaatgaaatcctgtaat

SEQ ID NO: 344007 - DNA, 20 bp, Artificial Sequence
  chemically synthesized
acaggatttcattcttttta

SEQ ID NO: 344008 - DNA, 20 bp, Artificial Sequence
  chemically synthesized
gaatattattcagccataaa

SEQ ID NO: 344009 - DNA, 20 bp, Artificial Sequence
  chemically synthesized
aaacacaatggaatattatt

SEQ ID NO: 344010 - DNA, 20 bp, Artificial Sequence
  chemically synthesized
aatatggcatataaacacaa

SEQ ID NO: 344011 - DNA, 20 bp, Artificial Sequence
  chemically synthesized
gataaatgaatttaaaaata

SEQ ID NO: 344012 - DNA, 20 bp, Artificial Sequence
  chemically synthesized
taaattcatttatctgttaa

SEQ ID NO: 344013 - DNA, 20 bp, Artificial Sequence
  chemically synthesized
tcaacctaagtgtccattaa

SEQ ID NO: 344014 - DNA, 20 bp, Artificial Sequence
  chemically synthesized
tttatctgttaatggacact

SEQ ID NO: 344015 - DNA, 20 bp, Artificial Sequence
  chemically synthesized
ttatctgttaatggacactt

SEQ ID NO: 344016 - DNA, 20 bp, Artificial Sequence
  chemically synthesized
ttgagatacggaatcaacct

SEQ ID NO: 344017 - DNA, 20 bp, Artificial Sequence
  chemically synthesized
taaaacagattgttgagata

SEQ ID NO: 344018 - DNA, 20 bp, Artificial Sequence
  chemically synthesized
ccttgttaaaacagattgtt

SEQ ID NO: 344019 - DNA, 20 bp, Artificial Sequence
  chemically synthesized
tctcaacaatctgttttaac

SEQ ID NO: 344020 - DNA, 20 bp, Artificial Sequence
  chemically synthesized
ttctggaggccttgttaaaa

SEQ ID NO: 344021 - DNA, 20 bp, Artificial Sequence
  chemically synthesized
ctcaacaatctgttttaaca

SEQ ID NO: 344022 - DNA, 20 bp, Artificial Sequence
  chemically synthesized
atctgttttaacaaggcctc

SEQ ID NO: 344023 - DNA, 20 bp, Artificial Sequence
  chemically synthesized
tgcacatcagaattttctgg

SEQ ID NO: 344024 - DNA, 20 bp, Artificial Sequence
  chemically synthesized
gtgcacatcagaattttctg

SEQ ID NO: 344025 - DNA, 20 bp, Artificial Sequence
  chemically synthesized
gagtgcacatcagaattttc

SEQ ID NO: 344026 - DNA, 20 bp, Artificial Sequence
  chemically synthesized
tctcaaacttgagtgcacat

SEQ ID NO: 344027 - DNA, 20 bp, Artificial Sequence
  chemically synthesized
gaaaattctgatgtgcactc

SEQ ID NO: 344028 - DNA, 20 bp, Artificial Sequence
  chemically synthesized
tctgatgtgcactcaagttt

SEQ ID NO: 344029 - DNA, 20 bp, Artificial Sequence
  chemically synthesized
aattagaggttctcaaactt

SEQ ID NO: 344030 - DNA, 20 bp, Artificial Sequence
  chemically synthesized
aaaattgttgcgcaaattag

SEQ ID NO: 344031 - DNA, 20 bp, Artificial Sequence
  chemically synthesized
gaaaattgttgcgcaaatta

SEQ ID NO: 344032 - DNA, 20 bp, Artificial Sequence
  chemically synthesized
ttgaaaattgttgcgcaaat

SEQ ID NO: 344033 - DNA, 20 bp, Artificial Sequence
  chemically synthesized
tttgcgcaacaattttcaaa

SEQ ID NO: 344034 - DNA, 20 bp, Artificial Sequence
  chemically synthesized
taactgaatcaaaatttgag

SEQ ID NO: 344035 - DNA, 20 bp, Artificial Sequence
  chemically synthesized
cataactgaatcaaaatttg

SEQ ID NO: 344036 - DNA, 20 bp, Artificial Sequence
  chemically synthesized
acataactgaatcaaaattt

SEQ ID NO: 344037 - DNA, 20 bp, Artificial Sequence
  chemically synthesized
tgtctcctcaaattttgatt

SEQ ID NO: 344038 - DNA, 20 bp, Artificial Sequence
  chemically synthesized
aattttgattcagttatgtt

SEQ ID NO: 344039 - DNA, 20 bp, Artificial Sequence
  chemically synthesized
attttgattcagttatgttt

SEQ ID NO: 344040 - DNA, 20 bp, Artificial Sequence
  chemically synthesized
aaatatattttaaatcttcc

SEQ ID NO: 344041 - DNA, 20 bp, Artificial Sequence
  chemically synthesized
aatatattttaaatcttccc

SEQ ID NO: 344042 - DNA, 20 bp, Artificial Sequence
  chemically synthesized
aatcctcagaattgcctggg

SEQ ID NO: 344043 - DNA, 20 bp, Artificial Sequence
  chemically synthesized
gttaatcctcagaattgcct

SEQ ID NO: 344044 - DNA, 20 bp, Artificial Sequence
  chemically synthesized
ggttaatcctcagaattgcc

SEQ ID NO: 344045 - DNA, 20 bp, Artificial Sequence
  chemically synthesized
aaatcttcccaggcaattct

SEQ ID NO: 344046 - DNA, 20 bp, Artificial Sequence
  chemically synthesized
aatcttcccaggcaattctg

SEQ ID NO: 344047 - DNA, 20 bp, Artificial Sequence
  chemically synthesized
gtcccaaacaggttaatcct

SEQ ID NO: 344048 - DNA, 20 bp, Artificial Sequence
  chemically synthesized
attctgaggattaacctgtt

SEQ ID NO: 344049 - DNA, 20 bp, Artificial Sequence
  chemically synthesized
ttctgaggattaacctgttt

SEQ ID NO: 344050 - DNA, 20 bp, Artificial Sequence
  chemically synthesized
ctggagtagctgtcccaaac

SEQ ID NO: 344051 - DNA, 20 bp, Artificial Sequence
  chemically synthesized
gaggattaacctgtttggga

SEQ ID NO: 344052 - DNA, 20 bp, Artificial Sequence
  chemically synthesized
cctggagtagctgtcccaaa

SEQ ID NO: 344053 - DNA, 20 bp, Artificial Sequence
  chemically synthesized
cctgtttgggacagctactc

SEQ ID NO: 344054 - DNA, 20 bp, Artificial Sequence
  chemically synthesized
ctgtttgggacagctactcc

SEQ ID NO: 344055 - DNA, 20 bp, Artificial Sequence
  chemically synthesized
tgtttgggacagctactcca

SEQ ID NO: 344056 - DNA, 20 bp, Artificial Sequence
  chemically synthesized
tgagtagctttgccctggag

SEQ ID NO: 344057 - DNA, 20 bp, Artificial Sequence
  chemically synthesized
gggacagctactccagggca

SEQ ID NO: 344058 - DNA, 20 bp, Artificial Sequence
  chemically synthesized
gtttgagtagctttgccctg

SEQ ID NO: 344059 - DNA, 20 bp, Artificial Sequence
  chemically synthesized
aagtttgagtagctttgccc

SEQ ID NO: 344060 - DNA, 20 bp, Artificial Sequence
  chemically synthesized
ttctccaactaaagtttgag

SEQ ID NO: 344061 - DNA, 20 bp, Artificial Sequence
  chemically synthesized
gggcaaagctactcaaactt

SEQ ID NO: 344062 - DNA, 20 bp, Artificial Sequence
  chemically synthesized
tcgttctccaactaaagttt

SEQ ID NO: 344063 - DNA, 20 bp, Artificial Sequence
  chemically synthesized
aaagctactcaaactttagt

SEQ ID NO: 344064 - DNA, 20 bp, Artificial Sequence
  chemically synthesized
agctactcaaactttagttg

SEQ ID NO: 344065 - DNA, 20 bp, Artificial Sequence
  chemically synthesized
tggtactcgttctccaacta

SEQ ID NO: 344066 - DNA, 20 bp, Artificial Sequence
  chemically synthesized
tcaaactttagttggagaac

SEQ ID NO: 344067 - DNA, 20 bp, Artificial Sequence
  chemically synthesized
agttggagaacgagtaccat

SEQ ID NO: 344068 - DNA, 20 bp, Artificial Sequence
  chemically synthesized
tgtctcccaggtgaggctga

SEQ ID NO: 344069 - DNA, 20 bp, Artificial Sequence
  chemically synthesized
cgagtaccatcagcctcacc

SEQ ID NO: 344070 - DNA, 20 bp, Artificial Sequence
  chemically synthesized
gagtaccatcagcctcacct

SEQ ID NO: 344071 - DNA, 20 bp, Artificial Sequence
  chemically synthesized
gtaccatcagcctcacctgg

SEQ ID NO: 344072 - DNA, 20 bp, Artificial Sequence
  chemically synthesized
ccacaactgtctcccaggtg

SEQ ID NO: 344073 - DNA, 20 bp, Artificial Sequence
  chemically synthesized
gccacaactgtctcccaggt

SEQ ID NO: 344074 - DNA, 20 bp, Artificial Sequence
  chemically synthesized
catcagcctcacctgggaga

SEQ ID NO: 344075 - DNA, 20 bp, Artificial Sequence
  chemically synthesized
tgcagccacaactgtctccc

SEQ ID NO: 344076 - DNA, 20 bp, Artificial Sequence
  chemically synthesized
ctgcagccacaactgtctcc

SEQ ID NO: 344077 - DNA, 20 bp, Artificial Sequence
  chemically synthesized
cctcacctgggagacagttg

SEQ ID NO: 344078 - DNA, 20 bp, Artificial Sequence
  chemically synthesized
ctgggagacagttgtggctg

SEQ ID NO: 344079 - DNA, 20 bp, Artificial Sequence
  chemically synthesized
aggatgtgggcaagattctg

SEQ ID NO: 344080 - DNA, 20 bp, Artificial Sequence
  chemically synthesized
gtatgtctaaggatgtgggc

SEQ ID NO: 344081 - DNA, 20 bp, Artificial Sequence
  chemically synthesized
cagaatcttgcccacatcct

SEQ ID NO: 344082 - DNA, 20 bp, Artificial Sequence
  chemically synthesized
ttgagtatgtctaaggatgt

SEQ ID NO: 344083 - DNA, 20 bp, Artificial Sequence
  chemically synthesized
attgagtatgtctaaggatg

SEQ ID NO: 344084 - DNA, 20 bp, Artificial Sequence
  chemically synthesized
cgcttgattgagtatgtcta

SEQ ID NO: 344085 - DNA, 20 bp, Artificial Sequence
  chemically synthesized
acgcttgattgagtatgtct

SEQ ID NO: 344086 - DNA, 20 bp, Artificial Sequence
  chemically synthesized
atccttagacatactcaatc

SEQ ID NO: 344087 - DNA, 20 bp, Artificial Sequence
  chemically synthesized
tctcactctcacgcttgatt

SEQ ID NO: 344088 - DNA, 20 bp, Artificial Sequence
  chemically synthesized
agacatactcaatcaagcgt

SEQ ID NO: 344089 - DNA, 20 bp, Artificial Sequence
  chemically synthesized
acatactcaatcaagcgtga

SEQ ID NO: 344090 - DNA, 20 bp, Artificial Sequence
  chemically synthesized
actcaatcaagcgtgagagt

SEQ ID NO: 344091 - DNA, 20 bp, Artificial Sequence
  chemically synthesized
tcaagcgtgagagtgagacc

SEQ ID NO: 344092 - DNA, 20 bp, Artificial Sequence
  chemically synthesized
caagcgtgagagtgagacct

SEQ ID NO: 344093 - DNA, 20 bp, Artificial Sequence
  chemically synthesized
aagcgtgagagtgagaccta

SEQ ID NO: 344094 - DNA, 20 bp, Artificial Sequence
  chemically synthesized
ccagcaaaacacagatccct

SEQ ID NO: 344095 - DNA, 20 bp, Artificial Sequence
  chemically synthesized
cccagcaaaacacagatccc

SEQ ID NO: 344096 - DNA, 20 bp, Artificial Sequence
  chemically synthesized
taaataaacccagcaaaaca

SEQ ID NO: 344097 - DNA, 20 bp, Artificial Sequence
  chemically synthesized
cctagggatctgtgttttgc

SEQ ID NO: 344098 - DNA, 20 bp, Artificial Sequence
  chemically synthesized
ctagggatctgtgttttgct

SEQ ID NO: 344099 - DNA, 20 bp, Artificial Sequence
  chemically synthesized
agtaagtaaataaataaacc

SEQ ID NO: 344100 - DNA, 20 bp, Artificial Sequence
  chemically synthesized
ttgtttcaaatacagtaagt

SEQ ID NO: 344101 - DNA, 20 bp, Artificial Sequence
  chemically synthesized
gatcttgtttcaaatacagt

SEQ ID NO: 344102 - DNA, 20 bp, Artificial Sequence
  chemically synthesized
gtgagatcttgtttcaaata

SEQ ID NO: 344103 - DNA, 20 bp, Artificial Sequence
  chemically synthesized
ttacttactgtatttgaaac

SEQ ID NO: 344104 - DNA, 20 bp, Artificial Sequence
  chemically synthesized
tcgagcctggacaacagagt

SEQ ID NO: 344105 - DNA, 20 bp, Artificial Sequence
  chemically synthesized
caagatctcactctgttgtc

SEQ ID NO: 344106 - DNA, 20 bp, Artificial Sequence
  chemically synthesized
gcactcgagcctggacaaca

SEQ ID NO: 344107 - DNA, 20 bp, Artificial Sequence
  chemically synthesized
aagatctcactctgttgtcc

SEQ ID NO: 344108 - DNA, 20 bp, Artificial Sequence
  chemically synthesized
ctgcactcgagcctggacaa

SEQ ID NO: 344109 - DNA, 20 bp, Artificial Sequence
  chemically synthesized
tcactctgttgtccaggctc

SEQ ID NO: 344110 - DNA, 20 bp, Artificial Sequence
  chemically synthesized
catgccactgcactcgagcc

SEQ ID NO: 344111 - DNA, 20 bp, Artificial Sequence
  chemically synthesized
ctgttgtccaggctcgagtg

SEQ ID NO: 344112 - DNA, 20 bp, Artificial Sequence
  chemically synthesized
atgatcatgccactgcactc

SEQ ID NO: 344113 - DNA, 20 bp, Artificial Sequence
  chemically synthesized
ttgtccaggctcgagtgcag

SEQ ID NO: 344114 - DNA, 20 bp, Artificial Sequence
  chemically synthesized
gcatgatcatgcactcactg

SEQ ID NO: 344115 - DNA, 20 bp, Artificial Sequence
  chemically synthesized
caggagtttgatgctacagt

SEQ ID NO: 344116 - DNA, 20 bp, Artificial Sequence
  chemically synthesized
aacacaggagtttgatgcta

SEQ ID NO: 344117 - DNA, 20 bp, Artificial Sequence
  chemically synthesized
tcaggattgcttaaacacag

SEQ ID NO: 344118 - DNA, 20 bp, Artificial Sequence
  chemically synthesized
agcatcaaactcctgtgttt

SEQ ID NO: 344119 - DNA, 20 bp, Artificial Sequence
  chemically synthesized
gatcaggattgcttaaacac

SEQ ID NO: 344120 - DNA, 20 bp, Artificial Sequence
  chemically synthesized
ggatcaggattgcttaaaca

SEQ ID NO: 344121 - DNA, 20 bp, Artificial Sequence
  chemically synthesized
gacgctgaggcgggaggatc

SEQ ID NO: 344122 - DNA, 20 bp, Artificial Sequence
  chemically synthesized
ggacgctgaggcgggaggat

SEQ ID NO: 344123 - DNA, 20 bp, Artificial Sequence
  chemically synthesized
caatcctgatcctcccgcct

SEQ ID NO: 344124 - DNA, 20 bp, Artificial Sequence
  chemically synthesized
attcgggacgctgaggcggg

SEQ ID NO: 344125 - DNA, 20 bp, Artificial Sequence
  chemically synthesized
tattcgggacgctgaggcgg

SEQ ID NO: 344126 - DNA, 20 bp, Artificial Sequence
  chemically synthesized
actattcgggacgctgaggc

SEQ ID NO: 344127 - DNA, 20 bp, Artificial Sequence
  chemically synthesized
aactattcgggacgctgagg

SEQ ID NO: 344128 - DNA, 20 bp, Artificial Sequence
  chemically synthesized
cctaactattcgggacgctg

SEQ ID NO: 344129 - DNA, 20 bp, Artificial Sequence
  chemically synthesized
tcctaactattcgggacgct

SEQ ID NO: 344130 - DNA, 20 bp, Artificial Sequence
  chemically synthesized
tcccgcctcagcgtcccgaa

SEQ ID NO: 344131 - DNA, 20 bp, Artificial Sequence
  chemically synthesized
gcctcagcgtcccgaatagt

SEQ ID NO: 344132 - DNA, 20 bp, Artificial Sequence
  chemically synthesized
acctgtagtcctaactattc

SEQ ID NO: 344133 - DNA, 20 bp, Artificial Sequence
  chemically synthesized
cctcagcgtcccgaatagtt

SEQ ID NO: 344134 - DNA, 20 bp, Artificial Sequence
  chemically synthesized
aacctgtagtcctaactatt

SEQ ID NO: 344135 - DNA, 20 bp, Artificial Sequence
  chemically synthesized
gtcccgaatagttaggacta

SEQ ID NO: 344136 - DNA, 20 bp, Artificial Sequence
  chemically synthesized
tcccgaatagttaggactac

SEQ ID NO: 344137 - DNA, 20 bp, Artificial Sequence
  chemically synthesized
ggtgtggtagtgcaaacctg

SEQ ID NO: 344138 - DNA, 20 bp, Artificial Sequence
  chemically synthesized
aaaaaattagcgaggtgtgg

SEQ ID NO: 344139 - DNA, 20 bp, Artificial Sequence
  chemically synthesized
aaaaaaaaattagcgaggtg

SEQ ID NO: 344140 - DNA, 20 bp, Artificial Sequence
  chemically synthesized
acttaaaaaaaaaattagcg

SEQ ID NO: 344141 - DNA, 20 bp, Artificial Sequence
  chemically synthesized
tacttaaaaaaaaaattagc

SEQ ID NO: 344142 - DNA, 20 bp, Artificial Sequence
  chemically synthesized
aaaatacttaaaaaaaaaat

SEQ ID NO: 344143 - DNA, 20 bp, Artificial Sequence
  chemically synthesized
acctcgctaatttttttttt

SEQ ID NO: 344144 - DNA, 20 bp, Artificial Sequence
  chemically synthesized
gtattttttgctgtgtttct

SEQ ID NO: 344145 - DNA, 20 bp, Artificial Sequence
  chemically synthesized
ccagacaagactgagaaaca

SEQ ID NO: 344146 - DNA, 20 bp, Artificial Sequence
  chemically synthesized
caggagttccagacaagact

SEQ ID NO: 344147 - DNA, 20 bp, Artificial Sequence
  chemically synthesized
ctgtgtttctcagtcttgtc

SEQ ID NO: 344148 - DNA, 20 bp, Artificial Sequence
  chemically synthesized
tcagcccaggagttccagac

SEQ ID NO: 344149 - DNA, 20 bp, Artificial Sequence
  chemically synthesized
tcagtcttgtctggaactcc

SEQ ID NO: 344150 - DNA, 20 bp, Artificial Sequence
  chemically synthesized
tcccttcagcccaggagttc

SEQ ID NO: 344151 - DNA, 20 bp, Artificial Sequence
  chemically synthesized
cagtcttgtctggaactcct

SEQ ID NO: 344152 - DNA, 20 bp, Artificial Sequence
  chemically synthesized
ggcagatcccttcagcccag

SEQ ID NO: 344153 - DNA, 20 bp, Artificial Sequence
  chemically synthesized
tgtctggaactcctgggctg

SEQ ID NO: 344154 - DNA, 20 bp, Artificial Sequence
  chemically synthesized
gtctggaactcctgggctga

SEQ ID NO: 344155 - DNA, 20 bp, Artificial Sequence
  chemically synthesized
caggcagatcccttcagccc

SEQ ID NO: 344156 - DNA, 20 bp, Artificial Sequence
  chemically synthesized
tctggaactcctgggctgaa

SEQ ID NO: 344157 - DNA, 20 bp, Artificial Sequence
  chemically synthesized
gcaggcagatcccttcagcc

SEQ ID NO: 344158 - DNA, 20 bp, Artificial Sequence
  chemically synthesized
ccaaggcaggcagatccctt

SEQ ID NO: 344159 - DNA, 20 bp, Artificial Sequence
  chemically synthesized
ctgaagggatctgcctgcct

SEQ ID NO: 344160 - DNA, 20 bp, Artificial Sequence
  chemically synthesized
ctttgggaggccaaggcagg

SEQ ID NO: 344161 - DNA, 20 bp, Artificial Sequence
  chemically synthesized
gcactttgggaggccaaggc

SEQ ID NO: 344162 - DNA, 20 bp, Artificial Sequence
  chemically synthesized
agcactttgggaggccaagg

SEQ ID NO: 344163 - DNA, 20 bp, Artificial Sequence
  chemically synthesized
cccagcactttgggaggcca

SEQ ID NO: 344164 - DNA, 20 bp, Artificial Sequence
  chemically synthesized
tcccagcactttgggaggcc

SEQ ID NO: 344165 - DNA, 20 bp, Artificial Sequence
  chemically synthesized
ctgcctgccttggcctccca

SEQ ID NO: 344166 - DNA, 20 bp, Artificial Sequence
  chemically synthesized
tgtagtcccagcactttggg

SEQ ID NO: 344167 - DNA, 20 bp, Artificial Sequence
  chemically synthesized
ctgtagtcccagcactttgg

SEQ ID NO: 344168 - DNA, 20 bp, Artificial Sequence
  chemically synthesized
gccttggcctcccaaagtgc

SEQ ID NO: 344169 - DNA, 20 bp, Artificial Sequence
  chemically synthesized
acctgtagtcccagcacttt

SEQ ID NO: 344170 - DNA, 20 bp, Artificial Sequence
  chemically synthesized
ccttggcctcccaaagtgct

SEQ ID NO: 344171 - DNA, 20 bp, Artificial Sequence
  chemically synthesized
cacctgtagtcccagcactt

SEQ ID NO: 344172 - DNA, 20 bp, Artificial Sequence
  chemically synthesized
ctcccaaagtgctgggacta

SEQ ID NO: 344173 - DNA, 20 bp, Artificial Sequence
  chemically synthesized
tcccaaagtgctgggactac

SEQ ID NO: 344174 - DNA, 20 bp, Artificial Sequence
  chemically synthesized
ttggctcacacctgtagtcc

SEQ ID NO: 344175 - DNA, 20 bp, Artificial Sequence
  chemically synthesized
agtgctgggactacaggtgt

SEQ ID NO: 344176 - DNA, 20 bp, Artificial Sequence
  chemically synthesized
ggcatgttggctcacacctg

SEQ ID NO: 344177 - DNA, 20 bp, Artificial Sequence
  chemically synthesized
acaggtgtgagccaacatgc

SEQ ID NO: 344178 - DNA, 20 bp, Artificial Sequence
  chemically synthesized
caggtgtgagccaacatgcc

SEQ ID NO: 344179 - DNA, 20 bp, Artificial Sequence
  chemically synthesized
cggattcctccccggcatgt

SEQ ID NO: 344180 - DNA, 20 bp, Artificial Sequence
  chemically synthesized
aggtgtgagccaacatgccg

SEQ ID NO: 344181 - DNA, 20 bp, Artificial Sequence
  chemically synthesized
gtgtgagccaacatgccggg

SEQ ID NO: 344182 - DNA, 20 bp, Artificial Sequence
  chemically synthesized
tgtgagccaacatgccgggg

SEQ ID NO: 344183 - DNA, 20 bp, Artificial Sequence
  chemically synthesized
ggttaaaacggattcctccc

SEQ ID NO: 344184 - DNA, 20 bp, Artificial Sequence
  chemically synthesized
agggaaggtggtggttaaaa

SEQ ID NO: 344185 - DNA, 20 bp, Artificial Sequence
  chemically synthesized
agagtcatcagggaaggtgg

SEQ ID NO: 344186 - DNA, 20 bp, Artificial Sequence
  chemically synthesized
atcagagtcatcagggaagg

SEQ ID NO: 344187 - DNA, 20 bp, Artificial Sequence
  chemically synthesized
tgcatcagagtcatcaggga

SEQ ID NO: 344188 - DNA, 20 bp, Artificial Sequence
  chemically synthesized
ctgcatcagagtcatcaggg

SEQ ID NO: 344189 - DNA, 20 bp, Artificial Sequence
  chemically synthesized
ggcctgcatcagagtcatca

SEQ ID NO: 344190 - DNA, 20 bp, Artificial Sequence
  chemically synthesized
tggcctgcatcagagtcatc

SEQ ID NO: 344191 - DNA, 20 bp, Artificial Sequence
  chemically synthesized
gtggcctgcatcagagtcat

SEQ ID NO: 344192 - DNA, 20 bp, Artificial Sequence
  chemically synthesized
cttccctgatgactctgatg

SEQ ID NO: 344193 - DNA, 20 bp, Artificial Sequence
  chemically synthesized
ttccctgatgactctgatgc

SEQ ID NO: 344194 - DNA, 20 bp, Artificial Sequence
  chemically synthesized
tcaaagtgtggcctgcatca

SEQ ID NO: 344195 - DNA, 20 bp, Artificial Sequence
  chemically synthesized
tctcaaagtgtggcctgcat

SEQ ID NO: 344196 - DNA, 20 bp, Artificial Sequence
  chemically synthesized
tctgatgcaggccacacttt

SEQ ID NO: 344197 - DNA, 20 bp, Artificial Sequence
  chemically synthesized
tgtgctttgctctcaaagtg

SEQ ID NO: 344198 - DNA, 20 bp, Artificial Sequence
  chemically synthesized
tgatgcaggccacactttga

SEQ ID NO: 344199 - DNA, 20 bp, Artificial Sequence
  chemically synthesized
gtggctgtgctttgctctca

SEQ ID NO: 344200 - DNA, 20 bp, Artificial Sequence
  chemically synthesized
caggccacactttgagagca

SEQ ID NO: 344201 - DNA, 20 bp, Artificial Sequence
  chemically synthesized
cacactttgagagcaaagca

SEQ ID NO: 344202 - DNA, 20 bp, Artificial Sequence
  chemically synthesized
ttgagagcaaagcacagcca

SEQ ID NO: 344203 - DNA, 20 bp, Artificial Sequence
  chemically synthesized
aacttttctaattttttctg

SEQ ID NO: 344204 - DNA, 20 bp, Artificial Sequence
  chemically synthesized
agcacagccacagaaaaaat

SEQ ID NO: 344205 - DNA, 20 bp, Artificial Sequence
  chemically synthesized
agccacagaaaaaattagaa

SEQ ID NO: 344206 - DNA, 20 bp, Artificial Sequence
  chemically synthesized
atgcctttgtgtcacatgaa

SEQ ID NO: 344207 - DNA, 20 bp, Artificial Sequence
  chemically synthesized
ttgactattcatgtgacaca

SEQ ID NO: 344208 - DNA, 20 bp, Artificial Sequence
  chemically synthesized
tgactattcatgtgacacaa

SEQ ID NO: 344209 - DNA, 20 bp, Artificial Sequence
  chemically synthesized
tcatgtgacacaaaggcata

SEQ ID NO: 344210 - DNA, 20 bp, Artificial Sequence
  chemically synthesized
aagcctacatatagaaggca

SEQ ID NO: 344211 - DNA, 20 bp, Artificial Sequence
  chemically synthesized
attcaaagcctacatataga

SEQ ID NO: 344212 - DNA, 20 bp, Artificial Sequence
  chemically synthesized
atagctatgccttctatatg

SEQ ID NO: 344213 - DNA, 20 bp, Artificial Sequence
  chemically synthesized
tattcaaagcctacatatag

SEQ ID NO: 344214 - DNA, 20 bp, Artificial Sequence
  chemically synthesized
tagctatgccttctatatgt

SEQ ID NO: 344215 - DNA, 20 bp, Artificial Sequence
  chemically synthesized
agttattcaaagcctacata

SEQ ID NO: 344216 - DNA, 20 bp, Artificial Sequence
  chemically synthesized
ctattattaaaagttattca

SEQ ID NO: 344217 - DNA, 20 bp, Artificial Sequence
  chemically synthesized
ctttgaataacttttaataa

SEQ ID NO: 344218 - DNA, 20 bp, Artificial Sequence
  chemically synthesized
ggcttttttactattattaa

SEQ ID NO: 344219 - DNA, 20 bp, Artificial Sequence
  chemically synthesized
aacttttaataatagtaaaa

SEQ ID NO: 344220 - DNA, 20 bp, Artificial Sequence
  chemically synthesized
tttaataatagtaaaaaagc

SEQ ID NO: 344221 - DNA, 20 bp, Artificial Sequence
  chemically synthesized
ttaataatagtaaaaaagcc

SEQ ID NO: 344222 - DNA, 20 bp, Artificial Sequence
  chemically synthesized
taatagtaaaaaagccagga

SEQ ID NO: 344223 - DNA, 20 bp, Artificial Sequence
  chemically synthesized
accattattaaaagctatcc

SEQ ID NO: 344224 - DNA, 20 bp, Artificial Sequence
  chemically synthesized
gccaggatagcttttaataa

SEQ ID NO: 344225 - DNA, 20 bp, Artificial Sequence
  chemically synthesized
gtagcttctaccattattaa

SEQ ID NO: 344226 - DNA, 20 bp, Artificial Sequence
  chemically synthesized
aggatagcttttaataatgg

SEQ ID NO: 344227 - DNA, 20 bp, Artificial Sequence
  chemically synthesized
atagcttttaataatggtag

SEQ ID NO: 344228 - DNA, 20 bp, Artificial Sequence
  chemically synthesized
agtaagtaccaaataaagag

SEQ ID NO: 344229 - DNA, 20 bp, Artificial Sequence
  chemically synthesized
ggtagaagctactctttatt

SEQ ID NO: 344230 - DNA, 20 bp, Artificial Sequence
  chemically synthesized
tatagtaagtaccaaataaa

SEQ ID NO: 344231 - DNA, 20 bp, Artificial Sequence
  chemically synthesized
catatagtaagtaccaaata

SEQ ID NO: 344232 - DNA, 20 bp, Artificial Sequence
  chemically synthesized
cattgtgcttgtcatatagt

SEQ ID NO: 344233 - DNA, 20 bp, Artificial Sequence
  chemically synthesized
tttggtacttactatatgac

SEQ ID NO: 344234 - DNA, 20 bp, Artificial Sequence
  chemically synthesized
ttaccattgtgcttgtcata

SEQ ID NO: 344235 - DNA, 20 bp, Artificial Sequence
  chemically synthesized
ttactatatgacaagcacaa

SEQ ID NO: 344236 - DNA, 20 bp, Artificial Sequence
  chemically synthesized
ctttttctttaaggataaaa

SEQ ID NO: 344237 - DNA, 20 bp, Artificial Sequence
  chemically synthesized
actttttctttaaggataaa

SEQ ID NO: 344238 - DNA, 20 bp, Artificial Sequence
  chemically synthesized
cactttttctttaaggataa

SEQ ID NO: 344239 - DNA, 20 bp, Artificial Sequence
  chemically synthesized
gtatttcccttttatcctta

SEQ ID NO: 344240 - DNA, 20 bp, Artificial Sequence
  chemically synthesized
tggcctacactttttcttta

SEQ ID NO: 344241 - DNA, 20 bp, Artificial Sequence
  chemically synthesized
cccttttatccttaaagaaa

SEQ ID NO: 344242 - DNA, 20 bp, Artificial Sequence
  chemically synthesized
ctggcctacactttttcttt

SEQ ID NO: 344243 - DNA, 20 bp, Artificial Sequence
  chemically synthesized
ttatccttaaagaaaaagtg

SEQ ID NO: 344244 - DNA, 20 bp, Artificial Sequence
  chemically synthesized
tatccttaaagaaaaagtgt

SEQ ID NO: 344245 - DNA, 20 bp, Artificial Sequence
  chemically synthesized
cttaaagaaaaagtgtaggc

SEQ ID NO: 344246 - DNA, 20 bp, Artificial Sequence
  chemically synthesized
ttaaagaaaaagtgtaggcc

SEQ ID NO: 344247 - DNA, 20 bp, Artificial Sequence
  chemically synthesized
gaaaaagtgtaggccaggtg

SEQ ID NO: 344248 - DNA, 20 bp, Artificial Sequence
  chemically synthesized
aaagtgtaggccaggtgtgg

SEQ ID NO: 344249 - DNA, 20 bp, Artificial Sequence
  chemically synthesized
caggtgtaagccaccacacc

SEQ ID NO: 344250 - DNA, 20 bp, Artificial Sequence
  chemically synthesized
agtgctgggattacaggtgt

SEQ ID NO: 344251 - DNA, 20 bp, Artificial Sequence
  chemically synthesized
gtggcttacacctgtaatcc

SEQ ID NO: 344252 - DNA, 20 bp, Artificial Sequence
  chemically synthesized
tcccaaagtgctgggattac

SEQ ID NO: 344253 - DNA, 20 bp, Artificial Sequence
  chemically synthesized
ctcccaaagtgctgggatta

SEQ ID NO: 344254 - DNA, 20 bp, Artificial Sequence
  chemically synthesized
cacctgtaatcccagcactt

SEQ ID NO: 344255 - DNA, 20 bp, Artificial Sequence
  chemically synthesized
cctcagcctcccaaagtgct

SEQ ID NO: 344256 - DNA, 20 bp, Artificial Sequence
  chemically synthesized
acctgtaatcccagcacttt

SEQ ID NO: 344257 - DNA, 20 bp, Artificial Sequence
  chemically synthesized
gcctcagcctcccaaagtgc

SEQ ID NO: 344258 - DNA, 20 bp, Artificial Sequence
  chemically synthesized
ctgtaatcccagcactttgg

SEQ ID NO: 344259 - DNA, 20 bp, Artificial Sequence
  chemically synthesized
tgtaatcccagcactttggg

SEQ ID NO: 344260 - DNA, 20 bp, Artificial Sequence
  chemically synthesized
ctgcctgcctcagcctccca

SEQ ID NO: 344261 - DNA, 20 bp, Artificial Sequence
  chemically synthesized
tcccagcactttgggaggct

SEQ ID NO: 344262 - DNA, 20 bp, Artificial Sequence
  chemically synthesized
cccagcactttgggaggctg

SEQ ID NO: 344263 - DNA, 20 bp, Artificial Sequence
  chemically synthesized
agcactttgggaggctgagg

SEQ ID NO: 344264 - DNA, 20 bp, Artificial Sequence
  chemically synthesized
gcactttgggaggctgaggc

SEQ ID NO: 344265 - DNA, 20 bp, Artificial Sequence
  chemically synthesized
ctttgggaggctgaggcagg

SEQ ID NO: 344266 - DNA, 20 bp, Artificial Sequence
  chemically synthesized
ctcaggtgatctgcctgcct

SEQ ID NO: 344267 - DNA, 20 bp, Artificial Sequence
  chemically synthesized
ctgaggcaggcagatcacct

SEQ ID NO: 344268 - DNA, 20 bp, Artificial Sequence
  chemically synthesized
tgaggcaggcagatcacctg

SEQ ID NO: 344269 - DNA, 20 bp, Artificial Sequence
  chemically synthesized
gcaggcagatcacctgagga

SEQ ID NO: 344270 - DNA, 20 bp, Artificial Sequence
  chemically synthesized
ggtctcgtacttctgtcctc

SEQ ID NO: 344271 - DNA, 20 bp, Artificial Sequence
  chemically synthesized
ggcagatcacctgaggacag

SEQ ID NO: 344272 - DNA, 20 bp, Artificial Sequence
  chemically synthesized
tggtctcgtacttctgtcct

SEQ ID NO: 344273 - DNA, 20 bp, Artificial Sequence
  chemically synthesized
tcacctgaggacagaagtac

SEQ ID NO: 344274 - DNA, 20 bp, Artificial Sequence
  chemically synthesized
tgaggacagaagtacgagac

SEQ ID NO: 344275 - DNA, 20 bp, Artificial Sequence
  chemically synthesized
acagaagtacgagaccagcc

SEQ ID NO: 344276 - DNA, 20 bp, Artificial Sequence
  chemically synthesized
ttttgccatgttggccaggc

SEQ ID NO: 344277 - DNA, 20 bp, Artificial Sequence
  chemically synthesized
ggggttttgccatgttggcc

SEQ ID NO: 344278 - DNA, 20 bp, Artificial Sequence
  chemically synthesized
cgagaccagcctggccaaca

SEQ ID NO: 344279 - DNA, 20 bp, Artificial Sequence
  chemically synthesized
cggggttttgccatgttggc

SEQ ID NO: 344280 - DNA, 20 bp, Artificial Sequence
  chemically synthesized
gaaacggggttttgccatgt

SEQ ID NO: 344281 - DNA, 20 bp, Artificial Sequence
  chemically synthesized
gtgtatttttagtagaaacg

SEQ ID NO: 344282 - DNA, 20 bp, Artificial Sequence
  chemically synthesized
cgtgtatttttagtagaaac

SEQ ID NO: 344283 - DNA, 20 bp, Artificial Sequence
  chemically synthesized
tcgtgtatttttagtagaaa

SEQ ID NO: 344284 - DNA, 20 bp, Artificial Sequence
  chemically synthesized
gctaattcgtgtatttttag

SEQ ID NO: 344285 - DNA, 20 bp, Artificial Sequence
  chemically synthesized
ctggctaattcgtgtatttt

SEQ ID NO: 344286 - DNA, 20 bp, Artificial Sequence
  chemically synthesized
tctactaaaaatacacgaat

SEQ ID NO: 344287 - DNA, 20 bp, Artificial Sequence
  chemically synthesized
ctaaaaatacacgaattagc

SEQ ID NO: 344288 - DNA, 20 bp, Artificial Sequence
  chemically synthesized
taaaaatacacgaattagcc

SEQ ID NO: 344289 - DNA, 20 bp, Artificial Sequence
  chemically synthesized
atacacgaattagccaggtg

SEQ ID NO: 344290 - DNA, 20 bp, Artificial Sequence
  chemically synthesized
caggcatccgcaaccacacc

SEQ ID NO: 344291 - DNA, 20 bp, Artificial Sequence
  chemically synthesized
gaattagccaggtgtggttg

SEQ ID NO: 344292 - DNA, 20 bp, Artificial Sequence
  chemically synthesized
ggtgtggttgcggatgcctg

SEQ ID NO: 344293 - DNA, 20 bp, Artificial Sequence
  chemically synthesized
gttgcggatgcctgtagtcc

SEQ ID NO: 344294 - DNA, 20 bp, Artificial Sequence
  chemically synthesized
ccccgagtagctgggactac

SEQ ID NO: 344295 - DNA, 20 bp, Artificial Sequence
  chemically synthesized
tccccgagtagctgggacta

SEQ ID NO: 344296 - DNA, 20 bp, Artificial Sequence
  chemically synthesized
tgcctgtagtcccagctact

SEQ ID NO: 344297 - DNA, 20 bp, Artificial Sequence
  chemically synthesized
ctcagcctccccgagtagct

SEQ ID NO: 344298 - DNA, 20 bp, Artificial Sequence
  chemically synthesized
gcctgtagtcccagctactc

SEQ ID NO: 344299 - DNA, 20 bp, Artificial Sequence
  chemically synthesized
cctcagcctccccgagtagc

SEQ ID NO: 344300 - DNA, 20 bp, Artificial Sequence
  chemically synthesized
cctgtagtcccagctactcg

SEQ ID NO: 344301 - DNA, 20 bp, Artificial Sequence
  chemically synthesized
tgtagtcccagctactcggg

SEQ ID NO: 344302 - DNA, 20 bp, Artificial Sequence
  chemically synthesized
gtagtcccagctactcgggg

SEQ ID NO: 344303 - DNA, 20 bp, Artificial Sequence
  chemically synthesized
cctgcctcagcctccccgag

SEQ ID NO: 344304 - DNA, 20 bp, Artificial Sequence
  chemically synthesized
tctcctgcctcagcctcccc

SEQ ID NO: 344305 - DNA, 20 bp, Artificial Sequence
  chemically synthesized
cccagctactcggggaggct

SEQ ID NO: 344306 - DNA, 20 bp, Artificial Sequence
  chemically synthesized
ccagctactcggggaggctg

SEQ ID NO: 344307 - DNA, 20 bp, Artificial Sequence
  chemically synthesized
gctactcggggaggctgagg

SEQ ID NO: 344308 - DNA, 20 bp, Artificial Sequence
  chemically synthesized
ctactcggggaggctgaggc

SEQ ID NO: 344309 - DNA, 20 bp, Artificial Sequence
  chemically synthesized
actcggggaggctgaggcag

SEQ ID NO: 344310 - DNA, 20 bp, Artificial Sequence
  chemically synthesized
ttcaagcaattctcctgcct

SEQ ID NO: 344311 - DNA, 20 bp, Artificial Sequence
  chemically synthesized
gcaggagaattgcttgaacc

SEQ ID NO: 344312 - DNA, 20 bp, Artificial Sequence
  chemically synthesized
caggagaattgcttgaaccc

SEQ ID NO: 344313 - DNA, 20 bp, Artificial Sequence
  chemically synthesized
taccgctgcctcccgggttc

SEQ ID NO: 344314 - DNA, 20 bp, Artificial Sequence
  chemically synthesized
ggagaattgcttgaacccgg

SEQ ID NO: 344315 - DNA, 20 bp, Artificial Sequence
  chemically synthesized
gagaattgcttgaacccggg

SEQ ID NO: 344316 - DNA, 20 bp, Artificial Sequence
  chemically synthesized
aattgcttgaacccgggagg

SEQ ID NO: 344317 - DNA, 20 bp, Artificial Sequence
  chemically synthesized
cactgctaccgctgcctccc

SEQ ID NO: 344318 - DNA, 20 bp, Artificial Sequence
  chemically synthesized
tcactgctaccgctgcctcc

SEQ ID NO: 344319 - DNA, 20 bp, Artificial Sequence
  chemically synthesized
tgcttgaacccgggaggcag

SEQ ID NO: 344320 - DNA, 20 bp, Artificial Sequence
  chemically synthesized
ttgaacccgggaggcagcgg

SEQ ID NO: 344321 - DNA, 20 bp, Artificial Sequence
  chemically synthesized
aacccgggaggcagcggtag

SEQ ID NO: 344322 - DNA, 20 bp, Artificial Sequence
  chemically synthesized
cgggaggcagcggtagcagt

SEQ ID NO: 344323 - DNA, 20 bp, Artificial Sequence
  chemically synthesized
ggcagcggtagcagtgagcc

SEQ ID NO: 344324 - DNA, 20 bp, Artificial Sequence
  chemically synthesized
agagtgcagtggcatgatct

SEQ ID NO: 344325 - DNA, 20 bp, Artificial Sequence
  chemically synthesized
acccagtctggagagtgcag

SEQ ID NO: 344326 - DNA, 20 bp, Artificial Sequence
  chemically synthesized
gatcatgccactgcactctc

SEQ ID NO: 344327 - DNA, 20 bp, Artificial Sequence
  chemically synthesized
gtcacccagtctggagagtg

SEQ ID NO: 344328 - DNA, 20 bp, Artificial Sequence
  chemically synthesized
tgccactgcactctccagac

SEQ ID NO: 344329 - DNA, 20 bp, Artificial Sequence
  chemically synthesized
gttctgtcacccagtctgga

SEQ ID NO: 344330 - DNA, 20 bp, Artificial Sequence
  chemically synthesized
gccactgcactctccagact

SEQ ID NO: 344331 - DNA, 20 bp, Artificial Sequence
  chemically synthesized
ttgttctgtcacccagtctg

SEQ ID NO: 344332 - DNA, 20 bp, Artificial Sequence
  chemically synthesized
tcttgttctgtcacccagtc

SEQ ID NO: 344333 - DNA, 20 bp, Artificial Sequence
  chemically synthesized
gcactctccagactgggtga

SEQ ID NO: 344334 - DNA, 20 bp, Artificial Sequence
  chemically synthesized
cggagtcttgttctgtcacc

SEQ ID NO: 344335 - DNA, 20 bp, Artificial Sequence
  chemically synthesized
tccagactgggtgacagaac

SEQ ID NO: 344336 - DNA, 20 bp, Artificial Sequence
  chemically synthesized
ttttttttttttttgagacg

SEQ ID NO: 344337 - DNA, 20 bp, Artificial Sequence
  chemically synthesized
tcttttttttttttttgaga

SEQ ID NO: 344338 - DNA, 20 bp, Artificial Sequence
  chemically synthesized
cttttctttttttttttttt

SEQ ID NO: 344339 - DNA, 20 bp, Artificial Sequence
  chemically synthesized
tccgtctcaaaaaaaaaaaa

SEQ ID NO: 344340 - DNA, 20 bp, Artificial Sequence
  chemically synthesized
ctcaaaaaaaaaaaaaagaa

SEQ ID NO: 344341 - DNA, 20 bp, Artificial Sequence
  chemically synthesized
aaaaaaaaaaaagaaaagaa

SEQ ID NO: 344342 - DNA, 20 bp, Artificial Sequence
  chemically synthesized
aaaaaaagaaaagaaaagaa

SEQ ID NO: 344343 - DNA, 20 bp, Artificial Sequence
  chemically synthesized
agaaaagaaaagaaaagaaa

SEQ ID NO: 344344 - DNA, 20 bp, Artificial Sequence
  chemically synthesized
aaaagaaaagaaaaagaaaa

SEQ ID NO: 344345 - DNA, 20 bp, Artificial Sequence
  chemically synthesized
aaagaaaagaaaaagaaaaa

SEQ ID NO: 344346 - DNA, 20 bp, Artificial Sequence
  chemically synthesized
aaagaaaaaaggaaaactgc

SEQ ID NO: 344347 - DNA, 20 bp, Artificial Sequence
  chemically synthesized
aagaaaaaaggaaaactgcg

SEQ ID NO: 344348 - DNA, 20 bp, Artificial Sequence
  chemically synthesized
agaaaaaaggaaaactgcga

SEQ ID NO: 344349 - DNA, 20 bp, Artificial Sequence
  chemically synthesized
aaaaaggaaaactgcgaggg

SEQ ID NO: 344350 - DNA, 20 bp, Artificial Sequence
  chemically synthesized
aaaaggaaaactgcgagggt

SEQ ID NO: 344351 - DNA, 20 bp, Artificial Sequence
  chemically synthesized
gattaaatgccccaccctcg

SEQ ID NO: 344352 - DNA, 20 bp, Artificial Sequence
  chemically synthesized
aaaggaaaactgcgagggtg

SEQ ID NO: 344353 - DNA, 20 bp, Artificial Sequence
  chemically synthesized
gggcatttaatcctgttata

SEQ ID NO: 344354 - DNA, 20 bp, Artificial Sequence
  chemically synthesized
agttttcttatctgtataac

SEQ ID NO: 344355 - DNA, 20 bp, Artificial Sequence
  chemically synthesized
cagttttcttatctgtataa

SEQ ID NO: 344356 - DNA, 20 bp, Artificial Sequence
  chemically synthesized
tttaatcctgttatacagat

SEQ ID NO: 344357 - DNA, 20 bp, Artificial Sequence
  chemically synthesized
gttatacagataagaaaact

SEQ ID NO: 344358 - DNA, 20 bp, Artificial Sequence
  chemically synthesized
ttatacagataagaaaactg

SEQ ID NO: 344359 - DNA, 20 bp, Artificial Sequence
  chemically synthesized
atacagataagaaaactgag

SEQ ID NO: 344360 - DNA, 20 bp, Artificial Sequence
  chemically synthesized
aaattaaactttttgctcct

SEQ ID NO: 344361 - DNA, 20 bp, Artificial Sequence
  chemically synthesized
taagaaaactgaggagcaaa

SEQ ID NO: 344362 - DNA, 20 bp, Artificial Sequence
  chemically synthesized
caaaaagtttaattttcatt

SEQ ID NO: 344363 - DNA, 20 bp, Artificial Sequence
  chemically synthesized
ttaattttcattaagtacca

SEQ ID NO: 344364 - DNA, 20 bp, Artificial Sequence
  chemically synthesized
ttttcattaagtaccatagc

SEQ ID NO: 344365 - DNA, 20 bp, Artificial Sequence
  chemically synthesized
actcataccccagctggcta

SEQ ID NO: 344366 - DNA, 20 bp, Artificial Sequence
  chemically synthesized
cattaagtaccatagccagc

SEQ ID NO: 344367 - DNA, 20 bp, Artificial Sequence
  chemically synthesized
attaagtaccatagccagct

SEQ ID NO: 344368 - DNA, 20 bp, Artificial Sequence
  chemically synthesized
ttaagtaccatagccagctg

SEQ ID NO: 344369 - DNA, 20 bp, Artificial Sequence
  chemically synthesized
aactggactcataccccagc

SEQ ID NO: 344370 - DNA, 20 bp, Artificial Sequence
  chemically synthesized
accatagccagctggggtat

SEQ ID NO: 344371 - DNA, 20 bp, Artificial Sequence
  chemically synthesized
ttcaaactggactcataccc

SEQ ID NO: 344372 - DNA, 20 bp, Artificial Sequence
  chemically synthesized
agccagctggggtatgagtc

SEQ ID NO: 344373 - DNA, 20 bp, Artificial Sequence
  chemically synthesized
ggggtatgagtccagtttga

SEQ ID NO: 344374 - DNA, 20 bp, Artificial Sequence
  chemically synthesized
aaaatcacaaactttcaaac

SEQ ID NO: 344375 - DNA, 20 bp, Artificial Sequence
  chemically synthesized
gattttaataattacatcta

SEQ ID NO: 344376 - DNA, 20 bp, Artificial Sequence
  chemically synthesized
atatattttctgaagttctg

SEQ ID NO: 344377 - DNA, 20 bp, Artificial Sequence
  chemically synthesized
taattacatctacagaactt

SEQ ID NO: 344378 - DNA, 20 bp, Artificial Sequence
  chemically synthesized
atttcaaaatatattttctg

SEQ ID NO: 344379 - DNA, 20 bp, Artificial Sequence
  chemically synthesized
cagaaaatatattttgaaat

SEQ ID NO: 344380 - DNA, 20 bp, Artificial Sequence
  chemically synthesized
atatattttgaaatgagtct

SEQ ID NO: 344381 - DNA, 20 bp, Artificial Sequence
  chemically synthesized
tatattttgaaatgagtctt

SEQ ID NO: 344382 - DNA, 20 bp, Artificial Sequence
  chemically synthesized
atattttgaaatgagtctta

SEQ ID NO: 344383 - DNA, 20 bp, Artificial Sequence
  chemically synthesized
tttgaaatgagtcttagggc

SEQ ID NO: 344384 - DNA, 20 bp, Artificial Sequence
  chemically synthesized
ttgaaatgagtcttagggct

SEQ ID NO: 344385 - DNA, 20 bp, Artificial Sequence
  chemically synthesized
gcatgggtttacctagccct

SEQ ID NO: 344386 - DNA, 20 bp, Artificial Sequence
  chemically synthesized
atgtaatgcatgggtttacc

SEQ ID NO: 344387 - DNA, 20 bp, Artificial Sequence
  chemically synthesized
taataatacatgtaatgcat

SEQ ID NO: 344388 - DNA, 20 bp, Artificial Sequence
  chemically synthesized
ttaataatacatgtaatgca

SEQ ID NO: 344389 - DNA, 20 bp, Artificial Sequence
  chemically synthesized
atgcattacatgtattatta

SEQ ID NO: 344390 - DNA, 20 bp, Artificial Sequence
  chemically synthesized
tgcattacatgtattattaa

SEQ ID NO: 344391 - DNA, 20 bp, Artificial Sequence
  chemically synthesized
gcattacatgtattattaaa

SEQ ID NO: 344392 - DNA, 20 bp, Artificial Sequence
  chemically synthesized
tgtattattaaagggaaatt

SEQ ID NO: 344393 - DNA, 20 bp, Artificial Sequence
  chemically synthesized
aataccatcatttatggttt

SEQ ID NO: 344394 - DNA, 20 bp, Artificial Sequence
  chemically synthesized
atatctcaaaccataaatga

SEQ ID NO: 344395 - DNA, 20 bp, Artificial Sequence
  chemically synthesized
ttacctaataccatcattta

SEQ ID NO: 344396 - DNA, 20 bp, Artificial Sequence
  chemically synthesized
caaaccataaatgatggtat

SEQ ID NO: 344397 - DNA, 20 bp, Artificial Sequence
  chemically synthesized
aaaccataaatgatggtatt

SEQ ID NO: 344398 - DNA, 20 bp, Artificial Sequence
  chemically synthesized
cataaatgatggtattaggt

SEQ ID NO: 344399 - DNA, 20 bp, Artificial Sequence
  chemically synthesized
aatgatggtattaggtaagt

SEQ ID NO: 344400 - DNA, 20 bp, Artificial Sequence
  chemically synthesized
atggtattaggtaagtcagt

SEQ ID NO: 344401 - DNA, 20 bp, Artificial Sequence
  chemically synthesized
tatcaacatgcaaattaaaa

SEQ ID NO: 344402 - DNA, 20 bp, Artificial Sequence
  chemically synthesized
taaaacagattatcaataca

SEQ ID NO: 344403 - DNA, 20 bp, Artificial Sequence
  chemically synthesized
aaaacagattatcaatacat

SEQ ID NO: 344404 - DNA, 20 bp, Artificial Sequence
  chemically synthesized
aaacagattatcaatacata

SEQ ID NO: 344405 - DNA, 20 bp, Artificial Sequence
  chemically synthesized
tcaatacatagggattgact

SEQ ID NO: 344406 - DNA, 20 bp, Artificial Sequence
  chemically synthesized
tttggttgccatattatact

SEQ ID NO: 344407 - DNA, 20 bp, Artificial Sequence
  chemically synthesized
gggattgactaagtataata

SEQ ID NO: 344408 - DNA, 20 bp, Artificial Sequence
  chemically synthesized
agggcaattctgggataatt

SEQ ID NO: 344409 - DNA, 20 bp, Artificial Sequence
  chemically synthesized
atatggcaaccaaattatcc

SEQ ID NO: 344410 - DNA, 20 bp, Artificial Sequence
  chemically synthesized
tactttgagagggcaattct

SEQ ID NO: 344411 - DNA, 20 bp, Artificial Sequence
  chemically synthesized
ttactttgagagggcaattc

SEQ ID NO: 344412 - DNA, 20 bp, Artificial Sequence
  chemically synthesized
atcccagaattgccctctca

SEQ ID NO: 344413 - DNA, 20 bp, Artificial Sequence
  chemically synthesized
aagctcttgttactttgaga

SEQ ID NO: 344414 - DNA, 20 bp, Artificial Sequence
  chemically synthesized
taagctcttgttactttgag

SEQ ID NO: 344415 - DNA, 20 bp, Artificial Sequence
  chemically synthesized
ataagctcttgttactttga

SEQ ID NO: 344416 - DNA, 20 bp, Artificial Sequence
  chemically synthesized
gtataagctcttgttacttt

SEQ ID NO: 344417 - DNA, 20 bp, Artificial Sequence
  chemically synthesized
aattgccctctcaaagtaac

SEQ ID NO: 344418 - DNA, 20 bp, Artificial Sequence
  chemically synthesized
ttgccctctcaaagtaacaa

SEQ ID NO: 344419 - DNA, 20 bp, Artificial Sequence
  chemically synthesized
taaaatttgttcacatgtat

SEQ ID NO: 344420 - DNA, 20 bp, Artificial Sequence
  chemically synthesized
gacacagtctttttacatca

SEQ ID NO: 344421 - DNA, 20 bp, Artificial Sequence
  chemically synthesized
tacacattctgtgatgtaaa

SEQ ID NO: 344422 - DNA, 20 bp, Artificial Sequence
  chemically synthesized
atgtaaaaagactgtgtcat

SEQ ID NO: 344423 - DNA, 20 bp, Artificial Sequence
  chemically synthesized
ctctgcaatgactgatgaca

SEQ ID NO: 344424 - DNA, 20 bp, Artificial Sequence
  chemically synthesized
gactgtgtcatcagtcattg

SEQ ID NO: 344425 - DNA, 20 bp, Artificial Sequence
  chemically synthesized
ctgtgtcatcagtcattgca

SEQ ID NO: 344426 - DNA, 20 bp, Artificial Sequence
  chemically synthesized
catcagtcattgcagagaac

SEQ ID NO: 344427 - DNA, 20 bp, Artificial Sequence
  chemically synthesized
atcagtcattgcagagaacc

SEQ ID NO: 344428 - DNA, 20 bp, Artificial Sequence
  chemically synthesized
agtcattgcagagaaccagg

SEQ ID NO: 344429 - DNA, 20 bp, Artificial Sequence
  chemically synthesized
attgcagagaaccaggcagc

SEQ ID NO: 344430 - DNA, 20 bp, Artificial Sequence
  chemically synthesized
taaggaagtgacttgctgcc

SEQ ID NO: 344431 - DNA, 20 bp, Artificial Sequence
  chemically synthesized
agctgtgaacaattgtaagg

SEQ ID NO: 344432 - DNA, 20 bp, Artificial Sequence
  chemically synthesized
gagagctgtgaacaattgta

SEQ ID NO: 344433 - DNA, 20 bp, Artificial Sequence
  chemically synthesized
agagagctgtgaacaattgt

SEQ ID NO: 344434 - DNA, 20 bp, Artificial Sequence
  chemically synthesized
cacttccttacaattgttca

SEQ ID NO: 344435 - DNA, 20 bp, Artificial Sequence
  chemically synthesized
attgttcacagctctctgat

SEQ ID NO: 344436 - DNA, 20 bp, Artificial Sequence
  chemically synthesized
aggcaaagtagctaatcaga

SEQ ID NO: 344437 - DNA, 20 bp, Artificial Sequence
  chemically synthesized
tcaggcaaagtagctaatca

SEQ ID NO: 344438 - DNA, 20 bp, Artificial Sequence
  chemically synthesized
cttcaggcaaagtagctaat

SEQ ID NO: 344439 - DNA, 20 bp, Artificial Sequence
  chemically synthesized
gttttatgcttcaggcaaag

SEQ ID NO: 344440 - DNA, 20 bp, Artificial Sequence
  chemically synthesized
ctgattagctactttgcctg

SEQ ID NO: 344441 - DNA, 20 bp, Artificial Sequence
  chemically synthesized
tatgttttatgcttcaggca

SEQ ID NO: 344442 - DNA, 20 bp, Artificial Sequence
  chemically synthesized
gtgcttatgttttatgcttc

SEQ ID NO: 344443 - DNA, 20 bp, Artificial Sequence
  chemically synthesized
tgtgcttatgttttatgctt

SEQ ID NO: 344444 - DNA, 20 bp, Artificial Sequence
  chemically synthesized
ttgcctgaagcataaaacat

SEQ ID NO: 344445 - DNA, 20 bp, Artificial Sequence
  chemically synthesized
tagtacccatagaggtgagg

SEQ ID NO: 344446 - DNA, 20 bp, Artificial Sequence
  chemically synthesized
agttagtacccatagaggtg

SEQ ID NO: 344447 - DNA, 20 bp, Artificial Sequence
  chemically synthesized
cacattcttcctcacctcta

SEQ ID NO: 344448 - DNA, 20 bp, Artificial Sequence
  chemically synthesized
cagttagtacccatagaggt

SEQ ID NO: 344449 - DNA, 20 bp, Artificial Sequence
  chemically synthesized
acattcttcctcacctctat

SEQ ID NO: 344450 - DNA, 20 bp, Artificial Sequence
  chemically synthesized
agtccagttagtacccatag

SEQ ID NO: 344451 - DNA, 20 bp, Artificial Sequence
  chemically synthesized
cagtccagttagtacccata

SEQ ID NO: 344452 - DNA, 20 bp, Artificial Sequence
  chemically synthesized
aacagtccagttagtaccca

SEQ ID NO: 344453 - DNA, 20 bp, Artificial Sequence
  chemically synthesized
tcacctctatgggtactaac

SEQ ID NO: 344454 - DNA, 20 bp, Artificial Sequence
  chemically synthesized
atcacattaaacagtccagt

SEQ ID NO: 344455 - DNA, 20 bp, Artificial Sequence
  chemically synthesized
ctccatcacattaaacagtc

SEQ ID NO: 344456 - DNA, 20 bp, Artificial Sequence
  chemically synthesized
aattactccatcacattaaa

SEQ ID NO: 344457 - DNA, 20 bp, Artificial Sequence
  chemically synthesized
aactggactgtttaatgtga

SEQ ID NO: 344458 - DNA, 20 bp, Artificial Sequence
  chemically synthesized
ctggactgtttaatgtgatg

SEQ ID NO: 344459 - DNA, 20 bp, Artificial Sequence
  chemically synthesized
taatgtgatggagtaattaa

SEQ ID NO: 344460 - DNA, 20 bp, Artificial Sequence
  chemically synthesized
taggtccccaatgggagaaa

SEQ ID NO: 344461 - DNA, 20 bp, Artificial Sequence
  chemically synthesized
gtaggtccccaatgggagaa

SEQ ID NO: 344462 - DNA, 20 bp, Artificial Sequence
  chemically synthesized
aacagaaccttttctcccat

SEQ ID NO: 344463 - DNA, 20 bp, Artificial Sequence
  chemically synthesized
acagaaccttttctcccatt

SEQ ID NO: 344464 - DNA, 20 bp, Artificial Sequence
  chemically synthesized
cagaaccttttctcccattg

SEQ ID NO: 344465 - DNA, 20 bp, Artificial Sequence
  chemically synthesized
gccacgtaggtccccaatgg

SEQ ID NO: 344466 - DNA, 20 bp, Artificial Sequence
  chemically synthesized
ttgccacgtaggtccccaat

SEQ ID NO: 344467 - DNA, 20 bp, Artificial Sequence
  chemically synthesized
cttgccacgtaggtccccaa

SEQ ID NO: 344468 - DNA, 20 bp, Artificial Sequence
  chemically synthesized
tctcccattggggacctacg

SEQ ID NO: 344469 - DNA, 20 bp, Artificial Sequence
  chemically synthesized
ccattggggacctacgtggc

SEQ ID NO: 344470 - DNA, 20 bp, Artificial Sequence
  chemically synthesized
taatggggcacttgccacgt

SEQ ID NO: 344471 - DNA, 20 bp, Artificial Sequence
  chemically synthesized
ctaatggggcacttgccacg

SEQ ID NO: 344472 - DNA, 20 bp, Artificial Sequence
  chemically synthesized
ctacgtggcaagtgccccat

SEQ ID NO: 344473 - DNA, 20 bp, Artificial Sequence
  chemically synthesized
tacgtggcaagtgccccatt

SEQ ID NO: 344474 - DNA, 20 bp, Artificial Sequence
  chemically synthesized
tatgtacctaggacctaatg

SEQ ID NO: 344475 - DNA, 20 bp, Artificial Sequence
  chemically synthesized
gtatgtacctaggacctaat

SEQ ID NO: 344476 - DNA, 20 bp, Artificial Sequence
  chemically synthesized
tgtatgtacctaggacctaa

SEQ ID NO: 344477 - DNA, 20 bp, Artificial Sequence
  chemically synthesized
gcaagtgccccattaggtcc

SEQ ID NO: 344478 - DNA, 20 bp, Artificial Sequence
  chemically synthesized
caagtgccccattaggtcct

SEQ ID NO: 344479 - DNA, 20 bp, Artificial Sequence
  chemically synthesized
tttgggttctgtatgtacct

SEQ ID NO: 344480 - DNA, 20 bp, Artificial Sequence
  chemically synthesized
ttttgggttctgtatgtacc

SEQ ID NO: 344481 - DNA, 20 bp, Artificial Sequence
  chemically synthesized
cattaggtcctaggtacata

SEQ ID NO: 344482 - DNA, 20 bp, Artificial Sequence
  chemically synthesized
tacatacagaacccaaaaaa

SEQ ID NO: 344483 - DNA, 20 bp, Artificial Sequence
  chemically synthesized
cacattggcttctatttttt

SEQ ID NO: 344484 - DNA, 20 bp, Artificial Sequence
  chemically synthesized
ccacattggcttctattttt

SEQ ID NO: 344485 - DNA, 20 bp, Artificial Sequence
  chemically synthesized
atacagaacccaaaaaatag

SEQ ID NO: 344486 - DNA, 20 bp, Artificial Sequence
  chemically synthesized
ccaaaaaatagaagccaatg

SEQ ID NO: 344487 - DNA, 20 bp, Artificial Sequence
  chemically synthesized
caaaaaatagaagccaatgt

SEQ ID NO: 344488 - DNA, 20 bp, Artificial Sequence
  chemically synthesized
aaaaaatagaagccaatgtg

SEQ ID NO: 344489 - DNA, 20 bp, Artificial Sequence
  chemically synthesized
aaaatagaagccaatgtggg

SEQ ID NO: 344490 - DNA, 20 bp, Artificial Sequence
  chemically synthesized
gttccatttcctccccacat

SEQ ID NO: 344491 - DNA, 20 bp, Artificial Sequence
  chemically synthesized
aaatagaagccaatgtgggg

SEQ ID NO: 344492 - DNA, 20 bp, Artificial Sequence
  chemically synthesized
aagccaatgtggggaggaaa

SEQ ID NO: 344493 - DNA, 20 bp, Artificial Sequence
  chemically synthesized
gccatagcatataaaataat

SEQ ID NO: 344494 - DNA, 20 bp, Artificial Sequence
  chemically synthesized
actcattattttatatgcta

SEQ ID NO: 344495 - DNA, 20 bp, Artificial Sequence
  chemically synthesized
gtaggggggaaatcgtgcca

SEQ ID NO: 344496 - DNA, 20 bp, Artificial Sequence
  chemically synthesized
gtctagtaaatttggtaggg

SEQ ID NO: 344497 - DNA, 20 bp, Artificial Sequence
  chemically synthesized
agtctagtaaatttggtagg

SEQ ID NO: 344498 - DNA, 20 bp, Artificial Sequence
  chemically synthesized
cagtctagtaaatttggtag

SEQ ID NO: 344499 - DNA, 20 bp, Artificial Sequence
  chemically synthesized
tcagtctagtaaatttggta

SEQ ID NO: 344500 - DNA, 20 bp, Artificial Sequence
  chemically synthesized
atcagtctagtaaatttggt

SEQ ID NO: 344501 - DNA, 20 bp, Artificial Sequence
  chemically synthesized
aatcagtctagtaaatttgg

SEQ ID NO: 344502 - DNA, 20 bp, Artificial Sequence
  chemically synthesized
ttcccccctaccaaatttac

SEQ ID NO: 344503 - DNA, 20 bp, Artificial Sequence
  chemically synthesized
actaatcagtctagtaaatt

SEQ ID NO: 344504 - DNA, 20 bp, Artificial Sequence
  chemically synthesized
accaaatttactagactgat

SEQ ID NO: 344505 - DNA, 20 bp, Artificial Sequence
  chemically synthesized
cttacatttactaatcagtc

SEQ ID NO: 344506 - DNA, 20 bp, Artificial Sequence
  chemically synthesized
tttggcttacatttactaat

SEQ ID NO: 344507 - DNA, 20 bp, Artificial Sequence
  chemically synthesized
ctagactgattagtaaatgt

SEQ ID NO: 344508 - DNA, 20 bp, Artificial Sequence
  chemically synthesized
gtaaatgtaagccaaaatct

SEQ ID NO: 344509 - DNA, 20 bp, Artificial Sequence
  chemically synthesized
taaatgtaagccaaaatcta

SEQ ID NO: 344510 - DNA, 20 bp, Artificial Sequence
  chemically synthesized
ttcaatcacaccttagattt

SEQ ID NO: 344511 - DNA, 20 bp, Artificial Sequence
  chemically synthesized
atagtgattcaatcacacct

SEQ ID NO: 344512 - DNA, 20 bp, Artificial Sequence
  chemically synthesized
ttctcaagggatggatatta

SEQ ID NO: 344513 - DNA, 20 bp, Artificial Sequence
  chemically synthesized
cactataatatccatccctt

SEQ ID NO: 344514 - DNA, 20 bp, Artificial Sequence
  chemically synthesized
gagtcacagttctcaaggga

SEQ ID NO: 344515 - DNA, 20 bp, Artificial Sequence
  chemically synthesized
tgctgagtcacagttctcaa

SEQ ID NO: 344516 - DNA, 20 bp, Artificial Sequence
  chemically synthesized
ctgctgagtcacagttctca

SEQ ID NO: 344517 - DNA, 20 bp, Artificial Sequence
  chemically synthesized
tctgctgagtcacagttctc

SEQ ID NO: 344518 - DNA, 20 bp, Artificial Sequence
  chemically synthesized
atcccttgagaactgtgact

SEQ ID NO: 344519 - DNA, 20 bp, Artificial Sequence
  chemically synthesized
ttttcctatctgctgagtca

SEQ ID NO: 344520 - DNA, 20 bp, Artificial Sequence
  chemically synthesized
ccttgagaactgtgactcag

SEQ ID NO: 344521 - DNA, 20 bp, Artificial Sequence
  chemically synthesized
gagaactgtgactcagcaga

SEQ ID NO: 344522 - DNA, 20 bp, Artificial Sequence
  chemically synthesized
agaactgtgactcagcagat

SEQ ID NO: 344523 - DNA, 20 bp, Artificial Sequence
  chemically synthesized
tttctcttttcctatctgct

SEQ ID NO: 344524 - DNA, 20 bp, Artificial Sequence
  chemically synthesized
tgtgactcagcagataggaa

SEQ ID NO: 344525 - DNA, 20 bp, Artificial Sequence
  chemically synthesized
tgactcagcagataggaaaa

SEQ ID NO: 344526 - DNA, 20 bp, Artificial Sequence
  chemically synthesized
agtgacaagatgttggacat

SEQ ID NO: 344527 - DNA, 20 bp, Artificial Sequence
  chemically synthesized
aagtgtcagtgacaagatgt

SEQ ID NO: 344528 - DNA, 20 bp, Artificial Sequence
  chemically synthesized
atttcacaagtgtcagtgac

SEQ ID NO: 344529 - DNA, 20 bp, Artificial Sequence
  chemically synthesized
aatgataatttcacaagtgt

SEQ ID NO: 344530 - DNA, 20 bp, Artificial Sequence
  chemically synthesized
ttgtcaaatgataatttcac

SEQ ID NO: 344531 - DNA, 20 bp, Artificial Sequence
  chemically synthesized
attcctgccaaattatttca

SEQ ID NO: 344532 - DNA, 20 bp, Artificial Sequence
  chemically synthesized
tgacaaaccatgaaataatt

SEQ ID NO: 344533 - DNA, 20 bp, Artificial Sequence
  chemically synthesized
caaaccatgaaataatttgg

SEQ ID NO: 344534 - DNA, 20 bp, Artificial Sequence
  chemically synthesized
aaaccatgaaataatttggc

SEQ ID NO: 344535 - DNA, 20 bp, Artificial Sequence
  chemically synthesized
aaatgactcatttgttgtat

SEQ ID NO: 344536 - DNA, 20 bp, Artificial Sequence
  chemically synthesized
aggaatccaatacaacaaat

SEQ ID NO: 344537 - DNA, 20 bp, Artificial Sequence
  chemically synthesized
taaatacaattctgtctccc

SEQ ID NO: 344538 - DNA, 20 bp, Artificial Sequence
  chemically synthesized
ataccatttagctggggaga

SEQ ID NO: 344539 - DNA, 20 bp, Artificial Sequence
  chemically synthesized
ttgcataccatttagctggg

SEQ ID NO: 344540 - DNA, 20 bp, Artificial Sequence
  chemically synthesized
cattgcataccatttagctg

SEQ ID NO: 344541 - DNA, 20 bp, Artificial Sequence
  chemically synthesized
attctgtctccccagctaaa

SEQ ID NO: 344542 - DNA, 20 bp, Artificial Sequence
  chemically synthesized
tcattgcataccatttagct

SEQ ID NO: 344543 - DNA, 20 bp, Artificial Sequence
  chemically synthesized
atcattgcataccatttagc

SEQ ID NO: 344544 - DNA, 20 bp, Artificial Sequence
  chemically synthesized
tcttatcattgcataccatt

SEQ ID NO: 344545 - DNA, 20 bp, Artificial Sequence
  chemically synthesized
gctaaatggtatgcaatgat

SEQ ID NO: 344546 - DNA, 20 bp, Artificial Sequence
  chemically synthesized
tgataagatcaccattttaa

SEQ ID NO: 344547 - DNA, 20 bp, Artificial Sequence
  chemically synthesized
tttctagataactattaaaa

SEQ ID NO: 344548 - DNA, 20 bp, Artificial Sequence
  chemically synthesized
tcaccattttaatagttatc

SEQ ID NO: 344549 - DNA, 20 bp, Artificial Sequence
  chemically synthesized
ttttaatagttatctagaaa

SEQ ID NO: 344550 - DNA, 20 bp, Artificial Sequence
  chemically synthesized
gaattttaggcatctatttc

SEQ ID NO: 344551 - DNA, 20 bp, Artificial Sequence
  chemically synthesized
gtcataaaggaaagaatttt

SEQ ID NO: 344552 - DNA, 20 bp, Artificial Sequence
  chemically synthesized
agtcataaaggaaagaattt

SEQ ID NO: 344553 - DNA, 20 bp, Artificial Sequence
  chemically synthesized
tgttaaaaagtcataaagga

SEQ ID NO: 344554 - DNA, 20 bp, Artificial Sequence
  chemically synthesized
tggctgttaaaaagtcataa

SEQ ID NO: 344555 - DNA, 20 bp, Artificial Sequence
  chemically synthesized
ttggctgttaaaaagtcata

SEQ ID NO: 344556 - DNA, 20 bp, Artificial Sequence
  chemically synthesized
tttcctttatgactttttaa

SEQ ID NO: 344557 - DNA, 20 bp, Artificial Sequence
  chemically synthesized
tactcaggttggctgttaaa

SEQ ID NO: 344558 - DNA, 20 bp, Artificial Sequence
  chemically synthesized
gactttttaacagccaacct

SEQ ID NO: 344559 - DNA, 20 bp, Artificial Sequence
  chemically synthesized
tatcattattgtactcaggt

SEQ ID NO: 344560 - DNA, 20 bp, Artificial Sequence
  chemically synthesized
ataatatcattattgtactc

SEQ ID NO: 344561 - DNA, 20 bp, Artificial Sequence
  chemically synthesized
gataatatcattattgtact

SEQ ID NO: 344562 - DNA, 20 bp, Artificial Sequence
  chemically synthesized
agtacaataatgatattatc

SEQ ID NO: 344563 - DNA, 20 bp, Artificial Sequence
  chemically synthesized
aatgttgaccatataaattc

SEQ ID NO: 344564 - DNA, 20 bp, Artificial Sequence
  chemically synthesized
gatattatccagaatttata

SEQ ID NO: 344565 - DNA, 20 bp, Artificial Sequence
  chemically synthesized
gtcaacattcaattgctcac

SEQ ID NO: 344566 - DNA, 20 bp, Artificial Sequence
  chemically synthesized
tcaacattcaattgctcaca

SEQ ID NO: 344567 - DNA, 20 bp, Artificial Sequence
  chemically synthesized
aaactgtttaataaccttgt

SEQ ID NO: 344568 - DNA, 20 bp, Artificial Sequence
  chemically synthesized
ttgctcacaaggttattaaa

SEQ ID NO: 344569 - DNA, 20 bp, Artificial Sequence
  chemically synthesized
agagagcaggggaagaaaac

SEQ ID NO: 344570 - DNA, 20 bp, Artificial Sequence
  chemically synthesized
cagagagcaggggaagaaaa

SEQ ID NO: 344571 - DNA, 20 bp, Artificial Sequence
  chemically synthesized
ttaggagcagagagcagggg

SEQ ID NO: 344572 - DNA, 20 bp, Artificial Sequence
  chemically synthesized
ttcttaggagcagagagcag

SEQ ID NO: 344573 - DNA, 20 bp, Artificial Sequence
  chemically synthesized
attcttaggagcagagagca

SEQ ID NO: 344574 - DNA, 20 bp, Artificial Sequence
  chemically synthesized
aattcttaggagcagagagc

SEQ ID NO: 344575 - DNA, 20 bp, Artificial Sequence
  chemically synthesized
taattcttaggagcagagag

SEQ ID NO: 344576 - DNA, 20 bp, Artificial Sequence
  chemically synthesized
atgtaattcttaggagcaga

SEQ ID NO: 344577 - DNA, 20 bp, Artificial Sequence
  chemically synthesized
ttcccctgctctctgctcct

SEQ ID NO: 344578 - DNA, 20 bp, Artificial Sequence
  chemically synthesized
aaatgtaattcttaggagca

SEQ ID NO: 344579 - DNA, 20 bp, Artificial Sequence
  chemically synthesized
agaaatgtaattcttaggag

SEQ ID NO: 344580 - DNA, 20 bp, Artificial Sequence
  chemically synthesized
ataagaaatgtaattcttag

SEQ ID NO: 344581 - DNA, 20 bp, Artificial Sequence
  chemically synthesized
taataagaaatgtaattctt

SEQ ID NO: 344582 - DNA, 20 bp, Artificial Sequence
  chemically synthesized
ctaataagaaatgtaattct

SEQ ID NO: 344583 - DNA, 20 bp, Artificial Sequence
  chemically synthesized
ctaagaattacatttcttat

SEQ ID NO: 344584 - DNA, 20 bp, Artificial Sequence
  chemically synthesized
ttccttaggaaaattctaat

SEQ ID NO: 344585 - DNA, 20 bp, Artificial Sequence
  chemically synthesized
tttcttattagaattttcct

SEQ ID NO: 344586 - DNA, 20 bp, Artificial Sequence
  chemically synthesized
ttcttattagaattttccta

SEQ ID NO: 344587 - DNA, 20 bp, Artificial Sequence
  chemically synthesized
ttagaattttcctaaggaaa

SEQ ID NO: 344588 - DNA, 20 bp, Artificial Sequence
  chemically synthesized
ttcattctttccatttcctt

SEQ ID NO: 344589 - DNA, 20 bp, Artificial Sequence
  chemically synthesized
attcattctttccatttcct

SEQ ID NO: 344590 - DNA, 20 bp, Artificial Sequence
  chemically synthesized
aattttcctaaggaaatgga

SEQ ID NO: 344591 - DNA, 20 bp, Artificial Sequence
  chemically synthesized
aaggaaatggaaagaatgaa

SEQ ID NO: 344592 - DNA, 20 bp, Artificial Sequence
  chemically synthesized
ggaaagaatgaatggaaatg

SEQ ID NO: 344593 - DNA, 20 bp, Artificial Sequence
  chemically synthesized
aagaatgaatggaaatgaag

SEQ ID NO: 344594 - DNA, 20 bp, Artificial Sequence
  chemically synthesized
gtggaaatgttcaatatttc

SEQ ID NO: 344595 - DNA, 20 bp, Artificial Sequence
  chemically synthesized
aaataatgtccaaacgtgtt

SEQ ID NO: 344596 - DNA, 20 bp, Artificial Sequence
  chemically synthesized
tttcaagttcttaacacgtt

SEQ ID NO: 344597 - DNA, 20 bp, Artificial Sequence
  chemically synthesized
aacacgtttggacattattt

SEQ ID NO: 344598 - DNA, 20 bp, Artificial Sequence
  chemically synthesized
acacgtttggacattatttg

SEQ ID NO: 344599 - DNA, 20 bp, Artificial Sequence
  chemically synthesized
tggacattatttgaggatcc

SEQ ID NO: 344600 - DNA, 20 bp, Artificial Sequence
  chemically synthesized
ttatttgaggatcctggcta

SEQ ID NO: 344601 - DNA, 20 bp, Artificial Sequence
  chemically synthesized
agcaaatcttggctttagcc

SEQ ID NO: 344602 - DNA, 20 bp, Artificial Sequence
  chemically synthesized
cagcaaatcttggctttagc

SEQ ID NO: 344603 - DNA, 20 bp, Artificial Sequence
  chemically synthesized
tgaggatcctggctaaagcc

SEQ ID NO: 344604 - DNA, 20 bp, Artificial Sequence
  chemically synthesized
ccttcagcaaatcttggctt

SEQ ID NO: 344605 - DNA, 20 bp, Artificial Sequence
  chemically synthesized
taaaagccttcagcaaatct

SEQ ID NO: 344606 - DNA, 20 bp, Artificial Sequence
  chemically synthesized
gctaaagccaagatttgctg

SEQ ID NO: 344607 - DNA, 20 bp, Artificial Sequence
  chemically synthesized
ctaaagccaagatttgctga

SEQ ID NO: 344608 - DNA, 20 bp, Artificial Sequence
  chemically synthesized
ctgggaaccctaaaagcctt

SEQ ID NO: 344609 - DNA, 20 bp, Artificial Sequence
  chemically synthesized
caagatttgctgaaggcttt

SEQ ID NO: 344610 - DNA, 20 bp, Artificial Sequence
  chemically synthesized
aagatttgctgaaggctttt

SEQ ID NO: 344611 - DNA, 20 bp, Artificial Sequence
  chemically synthesized
agatttgctgaaggctttta

SEQ ID NO: 344612 - DNA, 20 bp, Artificial Sequence
  chemically synthesized
atagcaactgggaaccctaa

SEQ ID NO: 344613 - DNA, 20 bp, Artificial Sequence
  chemically synthesized
ctgaaggcttttagggttcc

SEQ ID NO: 344614 - DNA, 20 bp, Artificial Sequence
  chemically synthesized
ttaaagagattatagcaact

SEQ ID NO: 344615 - DNA, 20 bp, Artificial Sequence
  chemically synthesized
cttaaagagattatagcaac

SEQ ID NO: 344616 - DNA, 20 bp, Artificial Sequence
  chemically synthesized
tcagagtcttaaagagatta

SEQ ID NO: 344617 - DNA, 20 bp, Artificial Sequence
  chemically synthesized
ccagttgctataatctcttt

SEQ ID NO: 344618 - DNA, 20 bp, Artificial Sequence
  chemically synthesized
tcaattatcagagtcttaaa

SEQ ID NO: 344619 - DNA, 20 bp, Artificial Sequence
  chemically synthesized
cctcaattatcagagtctta

SEQ ID NO: 344620 - DNA, 20 bp, Artificial Sequence
  chemically synthesized
ggtgtctacctcaattatca

SEQ ID NO: 344621 - DNA, 20 bp, Artificial Sequence
  chemically synthesized
tctttaagactctgataatt

SEQ ID NO: 344622 - DNA, 20 bp, Artificial Sequence
  chemically synthesized
ctttaagactctgataattg

SEQ ID NO: 344623 - DNA, 20 bp, Artificial Sequence
  chemically synthesized
ttggtgtctacctcaattat

SEQ ID NO: 344624 - DNA, 20 bp, Artificial Sequence
  chemically synthesized
taagactctgataattgagg

SEQ ID NO: 344625 - DNA, 20 bp, Artificial Sequence
  chemically synthesized
tgataattgaggtagacacc

SEQ ID NO: 344626 - DNA, 20 bp, Artificial Sequence
  chemically synthesized
gataattgaggtagacacca

SEQ ID NO: 344627 - DNA, 20 bp, Artificial Sequence
  chemically synthesized
aattgaggtagacaccaagg

SEQ ID NO: 344628 - DNA, 20 bp, Artificial Sequence
  chemically synthesized
aattttacgtagttctgcct

SEQ ID NO: 344629 - DNA, 20 bp, Artificial Sequence
  chemically synthesized
acagacatgataattttacg

SEQ ID NO: 344630 - DNA, 20 bp, Artificial Sequence
  chemically synthesized
tgtcatttttttgttgttta

SEQ ID NO: 344631 - DNA, 20 bp, Artificial Sequence
  chemically synthesized
aaaaaatgacacacaattaa

SEQ ID NO: 344632 - DNA, 20 bp, Artificial Sequence
  chemically synthesized
tgattcaataatgagttttt

SEQ ID NO: 344633 - DNA, 20 bp, Artificial Sequence
  chemically synthesized
ctcactattgattcaataat

SEQ ID NO: 344634 - DNA, 20 bp, Artificial Sequence
  chemically synthesized
aaaactcattattgaatcaa

SEQ ID NO: 344635 - DNA, 20 bp, Artificial Sequence
  chemically synthesized
ctcattattgaatcaatagt

SEQ ID NO: 344636 - DNA, 20 bp, Artificial Sequence
  chemically synthesized
atcaatagtgagaatttatg

SEQ ID NO: 344637 - DNA, 20 bp, Artificial Sequence
  chemically synthesized
ttttttgctatgtgtggtgt

SEQ ID NO: 344638 - DNA, 20 bp, Artificial Sequence
  chemically synthesized
tatgtggctaacaccacaca

SEQ ID NO: 344639 - DNA, 20 bp, Artificial Sequence
  chemically synthesized
caaatcttttttgctatgtg

SEQ ID NO: 344640 - DNA, 20 bp, Artificial Sequence
  chemically synthesized
taacaccacacatagcaaaa

SEQ ID NO: 344641 - DNA, 20 bp, Artificial Sequence
  chemically synthesized
tagcaaaaaagatttgatgt

SEQ ID NO: 344642 - DNA, 20 bp, Artificial Sequence
  chemically synthesized
agcaaaaaagatttgatgtt

SEQ ID NO: 344643 - DNA, 20 bp, Artificial Sequence
  chemically synthesized
aaagatttgatgttaggtat

SEQ ID NO: 344644 - DNA, 20 bp, Artificial Sequence
  chemically synthesized
aagatttgatgttaggtatt

SEQ ID NO: 344645 - DNA, 20 bp, Artificial Sequence
  chemically synthesized
atgttaggtattaggaattg

SEQ ID NO: 344646 - DNA, 20 bp, Artificial Sequence
  chemically synthesized
tgattcattggttcatataa

SEQ ID NO: 344647 - DNA, 20 bp, Artificial Sequence
  chemically synthesized
atgaacaaattgtgattcat

SEQ ID NO: 344648 - DNA, 20 bp, Artificial Sequence
  chemically synthesized
aatcacaatttgttcatatt

SEQ ID NO: 344649 - DNA, 20 bp, Artificial Sequence
  chemically synthesized
aatttgttcatattaagaca

SEQ ID NO: 344650 - DNA, 20 bp, Artificial Sequence
  chemically synthesized
atttgttcatattaagacat

SEQ ID NO: 344651 - DNA, 20 bp, Artificial Sequence
  chemically synthesized
tgttcatattaagacatagg

SEQ ID NO: 344652 - DNA, 20 bp, Artificial Sequence
  chemically synthesized
aagacataggtagttatata

SEQ ID NO: 344653 - DNA, 20 bp, Artificial Sequence
  chemically synthesized
aatcacatttcaaaaaagat

SEQ ID NO: 344654 - DNA, 20 bp, Artificial Sequence
  chemically synthesized
ctcacaatcacatttcaaaa

SEQ ID NO: 344655 - DNA, 20 bp, Artificial Sequence
  chemically synthesized
cttttttgaaatgtgattgt

SEQ ID NO: 344656 - DNA, 20 bp, Artificial Sequence
  chemically synthesized
tgattgtgagccatttccat

SEQ ID NO: 344657 - DNA, 20 bp, Artificial Sequence
  chemically synthesized
gttttttcatccaatggaaa

SEQ ID NO: 344658 - DNA, 20 bp, Artificial Sequence
  chemically synthesized
gcgtctgttttttcatccaa

SEQ ID NO: 344659 - DNA, 20 bp, Artificial Sequence
  chemically synthesized
atttccattggatgaaaaaa

SEQ ID NO: 344660 - DNA, 20 bp, Artificial Sequence
  chemically synthesized
taaaagtgacaaataaggca

SEQ ID NO: 344661 - DNA, 20 bp, Artificial Sequence
  chemically synthesized
gtaaaagtgacaaataaggc

SEQ ID NO: 344662 - DNA, 20 bp, Artificial Sequence
  chemically synthesized
atgggtaaaagtgacaaata

SEQ ID NO: 344663 - DNA, 20 bp, Artificial Sequence
  chemically synthesized
catgggtaaaagtgacaaat

SEQ ID NO: 344664 - DNA, 20 bp, Artificial Sequence
  chemically synthesized
gtactaggtttcatgggtaa

SEQ ID NO: 344665 - DNA, 20 bp, Artificial Sequence
  chemically synthesized
agaaatgtactaggtttcat

SEQ ID NO: 344666 - DNA, 20 bp, Artificial Sequence
  chemically synthesized
tcacttttacccatgaaacc

SEQ ID NO: 344667 - DNA, 20 bp, Artificial Sequence
  chemically synthesized
tagaaatgtactaggtttca

SEQ ID NO: 344668 - DNA, 20 bp, Artificial Sequence
  chemically synthesized
tatatatgtagaaatgtact

SEQ ID NO: 344669 - DNA, 20 bp, Artificial Sequence
  chemically synthesized
ctatatatgtagaaatgtac

SEQ ID NO: 344670 - DNA, 20 bp, Artificial Sequence
  chemically synthesized
ctagtacatttctacatata

SEQ ID NO: 344671 - DNA, 20 bp, Artificial Sequence
  chemically synthesized
atgagtgtcttctatatatg

SEQ ID NO: 344672 - DNA, 20 bp, Artificial Sequence
  chemically synthesized
gtacatttctacatatatag

SEQ ID NO: 344673 - DNA, 20 bp, Artificial Sequence
  chemically synthesized
catatatagaagacactcat

SEQ ID NO: 344674 - DNA, 20 bp, Artificial Sequence
  chemically synthesized
acaagtcaataaacacttat

SEQ ID NO: 344675 - DNA, 20 bp, Artificial Sequence
  chemically synthesized
ttcttaatgttgtaaatcac

SEQ ID NO: 344676 - DNA, 20 bp, Artificial Sequence
  chemically synthesized
gacttgtgatttacaacatt

SEQ ID NO: 344677 - DNA, 20 bp, Artificial Sequence
  chemically synthesized
tttacaacattaagaataaa

SEQ ID NO: 344678 - DNA, 20 bp, Artificial Sequence
  chemically synthesized
tacaacattaagaataaaca

SEQ ID NO: 344679 - DNA, 20 bp, Artificial Sequence
  chemically synthesized
aaacagagatttttccctaa

SEQ ID NO: 344680 - DNA, 20 bp, Artificial Sequence
  chemically synthesized
atatacatgattttccgtta

SEQ ID NO: 344681 - DNA, 20 bp, Artificial Sequence
  chemically synthesized
aatatacatgattttccgtt

SEQ ID NO: 344682 - DNA, 20 bp, Artificial Sequence
  chemically synthesized
caatatacatgattttccgt

SEQ ID NO: 344683 - DNA, 20 bp, Artificial Sequence
  chemically synthesized
gtttatgattaacataaatg

SEQ ID NO: 344684 - DNA, 20 bp, Artificial Sequence
  chemically synthesized
atgctatgctagttttcata

SEQ ID NO: 344685 - DNA, 20 bp, Artificial Sequence
  chemically synthesized
atcataaactctatgaaaac

SEQ ID NO: 344686 - DNA, 20 bp, Artificial Sequence
  chemically synthesized
taatgctatgctagttttca

SEQ ID NO: 344687 - DNA, 20 bp, Artificial Sequence
  chemically synthesized
aaactctatgaaaactagca

SEQ ID NO: 344688 - DNA, 20 bp, Artificial Sequence
  chemically synthesized
ttctaactctaatgctatgc

SEQ ID NO: 344689 - DNA, 20 bp, Artificial Sequence
  chemically synthesized
tatgaaaactagcatagcat

SEQ ID NO: 344690 - DNA, 20 bp, Artificial Sequence
  chemically synthesized
tgaaaactagcatagcatta

SEQ ID NO: 344691 - DNA, 20 bp, Artificial Sequence
  chemically synthesized
aactagcatagcattagagt

SEQ ID NO: 344692 - DNA, 20 bp, Artificial Sequence
  chemically synthesized
tgaaaatgatagacatgatt

SEQ ID NO: 344693 - DNA, 20 bp, Artificial Sequence
  chemically synthesized
tggatagagtttgaaaatga

SEQ ID NO: 344694 - DNA, 20 bp, Artificial Sequence
  chemically synthesized
agctttctcaaggatggata

SEQ ID NO: 344695 - DNA, 20 bp, Artificial Sequence
  chemically synthesized
ctagctttctcaaggatgga

SEQ ID NO: 344696 - DNA, 20 bp, Artificial Sequence
  chemically synthesized
ttcaaactctatccatcctt

SEQ ID NO: 344697 - DNA, 20 bp, Artificial Sequence
  chemically synthesized
gaaactagctttctcaagga

SEQ ID NO: 344698 - DNA, 20 bp, Artificial Sequence
  chemically synthesized
aactctatccatccttgaga

SEQ ID NO: 344699 - DNA, 20 bp, Artificial Sequence
  chemically synthesized
tgaagaaactagctttctca

SEQ ID NO: 344700 - DNA, 20 bp, Artificial Sequence
  chemically synthesized
ctgaagaaactagctttctc

SEQ ID NO: 344701 - DNA, 20 bp, Artificial Sequence
  chemically synthesized
ctatccatccttgagaaagc

SEQ ID NO: 344702 - DNA, 20 bp, Artificial Sequence
  chemically synthesized
cttgagaaagctagtttctt

SEQ ID NO: 344703 - DNA, 20 bp, Artificial Sequence
  chemically synthesized
atattttaatctgaagaaac

SEQ ID NO: 344704 - DNA, 20 bp, Artificial Sequence
  chemically synthesized
tgtatttatattttaatctg

SEQ ID NO: 344705 - DNA, 20 bp, Artificial Sequence
  chemically synthesized
acatttaaaaattctgacaa

SEQ ID NO: 344706 - DNA, 20 bp, Artificial Sequence
  chemically synthesized
catttaaaaattctgacaaa

SEQ ID NO: 344707 - DNA, 20 bp, Artificial Sequence
  chemically synthesized
atttaaaaattctgacaaaa

SEQ ID NO: 344708 - DNA, 20 bp, Artificial Sequence
  chemically synthesized
gaagtttttctcccttttgt

SEQ ID NO: 344709 - DNA, 20 bp, Artificial Sequence
  chemically synthesized
ttaaaaattctgacaaaagg

SEQ ID NO: 344710 - DNA, 20 bp, Artificial Sequence
  chemically synthesized
aacttcatatgaaacacggg

SEQ ID NO: 344711 - DNA, 20 bp, Artificial Sequence
  chemically synthesized
cctaacttcatatgaaacac

SEQ ID NO: 344712 - DNA, 20 bp, Artificial Sequence
  chemically synthesized
gcctaacttcatatgaaaca

SEQ ID NO: 344713 - DNA, 20 bp, Artificial Sequence
  chemically synthesized
aacttcccgtgtttcatatg

SEQ ID NO: 344714 - DNA, 20 bp, Artificial Sequence
  chemically synthesized
tcccgtgtttcatatgaagt

SEQ ID NO: 344715 - DNA, 20 bp, Artificial Sequence
  chemically synthesized
cccgtgtttcatatgaagtt

SEQ ID NO: 344716 - DNA, 20 bp, Artificial Sequence
  chemically synthesized
ggcgaaatttgatttacatt

SEQ ID NO: 344717 - DNA, 20 bp, Artificial Sequence
  chemically synthesized
aaatttgatttacatttgga

SEQ ID NO: 344718 - DNA, 20 bp, Artificial Sequence
  chemically synthesized
tttgatttacatttggaaag

SEQ ID NO: 344719 - DNA, 20 bp, Artificial Sequence
  chemically synthesized
tgatttacatttggaaagaa

SEQ ID NO: 344720 - DNA, 20 bp, Artificial Sequence
  chemically synthesized
gaagagaaatccacttattt

SEQ ID NO: 344721 - DNA, 20 bp, Artificial Sequence
  chemically synthesized
tgatttacttctaaaataag

SEQ ID NO: 344722 - DNA, 20 bp, Artificial Sequence
  chemically synthesized
gagaaatccacttattttag

SEQ ID NO: 344723 - DNA, 20 bp, Artificial Sequence
  chemically synthesized
tcttgatttacttctaaaat

SEQ ID NO: 344724 - DNA, 20 bp, Artificial Sequence
  chemically synthesized
acttattttagaagtaaatc

SEQ ID NO: 344725 - DNA, 20 bp, Artificial Sequence
  chemically synthesized
gaaatgtgcaaaatatctat

SEQ ID NO: 344726 - DNA, 20 bp, Artificial Sequence
  chemically synthesized
aaatgtgcaaaatatctatc

SEQ ID NO: 344727 - DNA, 20 bp, Artificial Sequence
  chemically synthesized
tattttaaattcatacctga

SEQ ID NO: 344728 - DNA, 20 bp, Artificial Sequence
  chemically synthesized
attcattcaataatttataa

SEQ ID NO: 344729 - DNA, 20 bp, Artificial Sequence
  chemically synthesized
tataacagattgctataaat

SEQ ID NO: 344730 - DNA, 20 bp, Artificial Sequence
  chemically synthesized
caatacaggtatctgattta

SEQ ID NO: 344731 - DNA, 20 bp, Artificial Sequence
  chemically synthesized
acagggaagaaatacaatac

SEQ ID NO: 344732 - DNA, 20 bp, Artificial Sequence
  chemically synthesized
cacagggaagaaatacaata

SEQ ID NO: 344733 - DNA, 20 bp, Artificial Sequence
  chemically synthesized
ttccaaaacctgacacaggg

SEQ ID NO: 344734 - DNA, 20 bp, Artificial Sequence
  chemically synthesized
attgtatttcttccctgtgt

SEQ ID NO: 344735 - DNA, 20 bp, Artificial Sequence
  chemically synthesized
ttgtatttcttccctgtgtc

SEQ ID NO: 344736 - DNA, 20 bp, Artificial Sequence
  chemically synthesized
ggtttccaaaacctgacaca

SEQ ID NO: 344737 - DNA, 20 bp, Artificial Sequence
  chemically synthesized
tggtttccaaaacctgacac

SEQ ID NO: 344738 - DNA, 20 bp, Artificial Sequence
  chemically synthesized
gtggtttccaaaacctgaca

SEQ ID NO: 344739 - DNA, 20 bp, Artificial Sequence
  chemically synthesized
ttcttccctgtgtcaggttt

SEQ ID NO: 344740 - DNA, 20 bp, Artificial Sequence
  chemically synthesized
gtgtcaggttttggaaacca

SEQ ID NO: 344741 - DNA, 20 bp, Artificial Sequence
  chemically synthesized
gtcaggttttggaaaccaca

SEQ ID NO: 344742 - DNA, 20 bp, Artificial Sequence
  chemically synthesized
aggttttggaaaccacagag

SEQ ID NO: 344743 - DNA, 20 bp, Artificial Sequence
  chemically synthesized
ctgtcatatgcacttctctg

SEQ ID NO: 344744 - DNA, 20 bp, Artificial Sequence
  chemically synthesized
ccacagagaagtgcatatga

SEQ ID NO: 344745 - DNA, 20 bp, Artificial Sequence
  chemically synthesized
agaagtgcatatgacagtga

SEQ ID NO: 344746 - DNA, 20 bp, Artificial Sequence
  chemically synthesized
gaagtgcatatgacagtgac

SEQ ID NO: 344747 - DNA, 20 bp, Artificial Sequence
  chemically synthesized
gtgcatatgacagtgacagg

SEQ ID NO: 344748 - DNA, 20 bp, Artificial Sequence
  chemically synthesized
catatgacagtgacaggaag

SEQ ID NO: 344749 - DNA, 20 bp, Artificial Sequence
  chemically synthesized
tatgacagtgacaggaagca

SEQ ID NO: 344750 - DNA, 20 bp, Artificial Sequence
  chemically synthesized
aggaagcagagccaaactcc

SEQ ID NO: 344751 - DNA, 20 bp, Artificial Sequence
  chemically synthesized
ggaagcagagccaaactcct

SEQ ID NO: 344752 - DNA, 20 bp, Artificial Sequence
  chemically synthesized
cccctatctgcctaggagtt

SEQ ID NO: 344753 - DNA, 20 bp, Artificial Sequence
  chemically synthesized
agcagagccaaactcctagg

SEQ ID NO: 344754 - DNA, 20 bp, Artificial Sequence
  chemically synthesized
acccacccctatctgcctag

SEQ ID NO: 344755 - DNA, 20 bp, Artificial Sequence
  chemically synthesized
gagccaaactcctaggcaga

SEQ ID NO: 344756 - DNA, 20 bp, Artificial Sequence
  chemically synthesized
gtacccacccctatctgcct

SEQ ID NO: 344757 - DNA, 20 bp, Artificial Sequence
  chemically synthesized
agccaaactcctaggcagat

SEQ ID NO: 344758 - DNA, 20 bp, Artificial Sequence
  chemically synthesized
ggtacccacccctatctgcc

SEQ ID NO: 344759 - DNA, 20 bp, Artificial Sequence
  chemically synthesized
gccaaactcctaggcagata

SEQ ID NO: 344760 - DNA, 20 bp, Artificial Sequence
  chemically synthesized
ccaaactcctaggcagatag

SEQ ID NO: 344761 - DNA, 20 bp, Artificial Sequence
  chemically synthesized
aactcctaggcagatagggg

SEQ ID NO: 344762 - DNA, 20 bp, Artificial Sequence
  chemically synthesized
actcctaggcagataggggt

SEQ ID NO: 344763 - DNA, 20 bp, Artificial Sequence
  chemically synthesized
ggcagataggggtgggtacc

SEQ ID NO: 344764 - DNA, 20 bp, Artificial Sequence
  chemically synthesized
cttggaagtggggtttcact

SEQ ID NO: 344765 - DNA, 20 bp, Artificial Sequence
  chemically synthesized
gcttggaagtggggtttcac

SEQ ID NO: 344766 - DNA, 20 bp, Artificial Sequence
  chemically synthesized
cccagtgaaaccccacttcc

SEQ ID NO: 344767 - DNA, 20 bp, Artificial Sequence
  chemically synthesized
ctgtcttcagcttggaagtg

SEQ ID NO: 344768 - DNA, 20 bp, Artificial Sequence
  chemically synthesized
actgtcttcagcttggaagt

SEQ ID NO: 344769 - DNA, 20 bp, Artificial Sequence
  chemically synthesized
aactgtcttcagcttggaag

SEQ ID NO: 344770 - DNA, 20 bp, Artificial Sequence
  chemically synthesized
tttaactgtcttcagcttgg

SEQ ID NO: 344771 - DNA, 20 bp, Artificial Sequence
  chemically synthesized
gaaaccccacttccaagctg

SEQ ID NO: 344772 - DNA, 20 bp, Artificial Sequence
  chemically synthesized
gcctttaactgtcttcagct

SEQ ID NO: 344773 - DNA, 20 bp, Artificial Sequence
  chemically synthesized
ccccacttccaagctgaaga

SEQ ID NO: 344774 - DNA, 20 bp, Artificial Sequence
  chemically synthesized
ttcaggcctttaactgtctt

SEQ ID NO: 344775 - DNA, 20 bp, Artificial Sequence
  chemically synthesized
ttccaagctgaagacagtta

SEQ ID NO: 344776 - DNA, 20 bp, Artificial Sequence
  chemically synthesized
tccaagctgaagacagttaa

SEQ ID NO: 344777 - DNA, 20 bp, Artificial Sequence
  chemically synthesized
gaagacagttaaaggcctga

SEQ ID NO: 344778 - DNA, 20 bp, Artificial Sequence
  chemically synthesized
tgatttgtagtttggctttc

SEQ ID NO: 344779 - DNA, 20 bp, Artificial Sequence
  chemically synthesized
ttgatttgtagtttggcttt

SEQ ID NO: 344780 - DNA, 20 bp, Artificial Sequence
  chemically synthesized
caaggatttgatttgtagtt

SEQ ID NO: 344781 - DNA, 20 bp, Artificial Sequence
  chemically synthesized
cactgcaaggatttgatttg

SEQ ID NO: 344782 - DNA, 20 bp, Artificial Sequence
  chemically synthesized
aactacaaatcaaatccttg

SEQ ID NO: 344783 - DNA, 20 bp, Artificial Sequence
  chemically synthesized
tacaaatcaaatccttgcag

SEQ ID NO: 344784 - DNA, 20 bp, Artificial Sequence
  chemically synthesized
caagttctcaatccactgca

SEQ ID NO: 344785 - DNA, 20 bp, Artificial Sequence
  chemically synthesized
acaagttctcaatccactgc

SEQ ID NO: 344786 - DNA, 20 bp, Artificial Sequence
  chemically synthesized
tcaaatccttgcagtggatt

SEQ ID NO: 344787 - DNA, 20 bp, Artificial Sequence
  chemically synthesized
agcacaccaaataggaggac

SEQ ID NO: 344788 - DNA, 20 bp, Artificial Sequence
  chemically synthesized
tgagaacttgtcctcctatt

SEQ ID NO: 344789 - DNA, 20 bp, Artificial Sequence
  chemically synthesized
aggaaagcacaccaaatagg

SEQ ID NO: 344790 - DNA, 20 bp, Artificial Sequence
  chemically synthesized
gaggaaagcacaccaaatag

SEQ ID NO: 344791 - DNA, 20 bp, Artificial Sequence
  chemically synthesized
cagaggaaagcacaccaaat

SEQ ID NO: 344792 - DNA, 20 bp, Artificial Sequence
  chemically synthesized
tcagaggaaagcacaccaaa

SEQ ID NO: 344793 - DNA, 20 bp, Artificial Sequence
  chemically synthesized
ggtggagatcaatcagagga

SEQ ID NO: 344794 - DNA, 20 bp, Artificial Sequence
  chemically synthesized
gaagggtggagatcaatcag

SEQ ID NO: 344795 - DNA, 20 bp, Artificial Sequence
  chemically synthesized
tgaagggtggagatcaatca

SEQ ID NO: 344796 - DNA, 20 bp, Artificial Sequence
  chemically synthesized
ggtgaagggtggagatcaat

SEQ ID NO: 344797 - DNA, 20 bp, Artificial Sequence
  chemically synthesized
agtaaaataggtgaagggtg

SEQ ID NO: 344798 - DNA, 20 bp, Artificial Sequence
  chemically synthesized
taagtaaaataggtgaaggg

SEQ ID NO: 344799 - DNA, 20 bp, Artificial Sequence
  chemically synthesized
gtataagtaaaataggtgaa

SEQ ID NO: 344800 - DNA, 20 bp, Artificial Sequence
  chemically synthesized
ggtataagtaaaataggtga

SEQ ID NO: 344801 - DNA, 20 bp, Artificial Sequence
  chemically synthesized
aggtataagtaaaataggtg

SEQ ID NO: 344802 - DNA, 20 bp, Artificial Sequence
  chemically synthesized
tcagtaggtataagtaaaat

SEQ ID NO: 344803 - DNA, 20 bp, Artificial Sequence
  chemically synthesized
atcagtaggtataagtaaaa

SEQ ID NO: 344804 - DNA, 20 bp, Artificial Sequence
  chemically synthesized
caaaccatatcagtaggtat

SEQ ID NO: 344805 - DNA, 20 bp, Artificial Sequence
  chemically synthesized
tttacttatacctactgata

SEQ ID NO: 344806 - DNA, 20 bp, Artificial Sequence
  chemically synthesized
cacagccaaaccatatcagt

SEQ ID NO: 344807 - DNA, 20 bp, Artificial Sequence
  chemically synthesized
gcacagccaaaccatatcag

SEQ ID NO: 344808 - DNA, 20 bp, Artificial Sequence
  chemically synthesized
agggcacagccaaaccatat

SEQ ID NO: 344809 - DNA, 20 bp, Artificial Sequence
  chemically synthesized
ttatacctactgatatggtt

SEQ ID NO: 344810 - DNA, 20 bp, Artificial Sequence
  chemically synthesized
atgatatttgggtgagggca

SEQ ID NO: 344811 - DNA, 20 bp, Artificial Sequence
  chemically synthesized
tcatgatgatatttgggtga

SEQ ID NO: 344812 - DNA, 20 bp, Artificial Sequence
  chemically synthesized
ttcatgatgatatttgggtg

SEQ ID NO: 344813 - DNA, 20 bp, Artificial Sequence
  chemically synthesized
attcatgatgatatttgggt

SEQ ID NO: 344814 - DNA, 20 bp, Artificial Sequence
  chemically synthesized
gggaattcatgatgatattt

SEQ ID NO: 344815 - DNA, 20 bp, Artificial Sequence
  chemically synthesized
tgggaattcatgatgatatt

SEQ ID NO: 344816 - DNA, 20 bp, Artificial Sequence
  chemically synthesized
gggtccttcctacaacatgt

SEQ ID NO: 344817 - DNA, 20 bp, Artificial Sequence
  chemically synthesized
tcatgaattcccacatgttg

SEQ ID NO: 344818 - DNA, 20 bp, Artificial Sequence
  chemically synthesized
tgggtccttcctacaacatg

SEQ ID NO: 344819 - DNA, 20 bp, Artificial Sequence
  chemically synthesized
catgaattcccacatgttgt

SEQ ID NO: 344820 - DNA, 20 bp, Artificial Sequence
  chemically synthesized
gaattcccacatgttgtagg

SEQ ID NO: 344821 - DNA, 20 bp, Artificial Sequence
  chemically synthesized
aattcccacatgttgtagga

SEQ ID NO: 344822 - DNA, 20 bp, Artificial Sequence
  chemically synthesized
cacatgttgtaggaaggacc

SEQ ID NO: 344823 - DNA, 20 bp, Artificial Sequence
  chemically synthesized
atgttgtaggaaggacccag

SEQ ID NO: 344824 - DNA, 20 bp, Artificial Sequence
  chemically synthesized
tgttgtaggaaggacccagt

SEQ ID NO: 344825 - DNA, 20 bp, Artificial Sequence
  chemically synthesized
ttgtaggaaggacccagtgg

SEQ ID NO: 344826 - DNA, 20 bp, Artificial Sequence
  chemically synthesized
tgtaggaaggacccagtggg

SEQ ID NO: 344827 - DNA, 20 bp, Artificial Sequence
  chemically synthesized
tgatccagttacctcccact

SEQ ID NO: 344828 - DNA, 20 bp, Artificial Sequence
  chemically synthesized
atgatccagttacctcccac

SEQ ID NO: 344829 - DNA, 20 bp, Artificial Sequence
  chemically synthesized
aggacccagtgggaggtaac

SEQ ID NO: 344830 - DNA, 20 bp, Artificial Sequence
  chemically synthesized
agtgggaggtaactggatca

SEQ ID NO: 344831 - DNA, 20 bp, Artificial Sequence
  chemically synthesized
gtgggaggtaactggatcat

SEQ ID NO: 344832 - DNA, 20 bp, Artificial Sequence
  chemically synthesized
tgggaggtaactggatcatg

SEQ ID NO: 344833 - DNA, 20 bp, Artificial Sequence
  chemically synthesized
aaatacctgaccccatgatc

SEQ ID NO: 344834 - DNA, 20 bp, Artificial Sequence
  chemically synthesized
aggtaactggatcatggggt

SEQ ID NO: 344835 - DNA, 20 bp, Artificial Sequence
  chemically synthesized
ggtaactggatcatggggtc

SEQ ID NO: 344836 - DNA, 20 bp, Artificial Sequence
  chemically synthesized
cactatcatgagaacagcac

SEQ ID NO: 344837 - DNA, 20 bp, Artificial Sequence
  chemically synthesized
tcactatcatgagaacagca

SEQ ID NO: 344838 - DNA, 20 bp, Artificial Sequence
  chemically synthesized
cttattcactatcatgagaa

SEQ ID NO: 344839 - DNA, 20 bp, Artificial Sequence
  chemically synthesized
ttcccgtgctgttctcatga

SEQ ID NO: 344840 - DNA, 20 bp, Artificial Sequence
  chemically synthesized
tgaaacttattcactatcat

SEQ ID NO: 344841 - DNA, 20 bp, Artificial Sequence
  chemically synthesized
ctgttctcatgatagtgaat

SEQ ID NO: 344842 - DNA, 20 bp, Artificial Sequence
  chemically synthesized
ataagtttcacaaaatctga

SEQ ID NO: 344843 - DNA, 20 bp, Artificial Sequence
  chemically synthesized
actcccccttacaaagccat

SEQ ID NO: 344844 - DNA, 20 bp, Artificial Sequence
  chemically synthesized
acaaaatctgatggctttgt

SEQ ID NO: 344845 - DNA, 20 bp, Artificial Sequence
  chemically synthesized
caaaatctgatggctttgta

SEQ ID NO: 344846 - DNA, 20 bp, Artificial Sequence
  chemically synthesized
aaaatctgatggctttgtaa

SEQ ID NO: 344847 - DNA, 20 bp, Artificial Sequence
  chemically synthesized
aaatctgatggctttgtaag

SEQ ID NO: 344848 - DNA, 20 bp, Artificial Sequence
  chemically synthesized
aatctgatggctttgtaagg

SEQ ID NO: 344849 - DNA, 20 bp, Artificial Sequence
  chemically synthesized
tggggaaactcccccttaca

SEQ ID NO: 344850 - DNA, 20 bp, Artificial Sequence
  chemically synthesized
tctgatggctttgtaagggg

SEQ ID NO: 344851 - DNA, 20 bp, Artificial Sequence
  chemically synthesized
aagggggagtttccccacac

SEQ ID NO: 344852 - DNA, 20 bp, Artificial Sequence
  chemically synthesized
gcagacagagagcttgtgtg

SEQ ID NO: 344853 - DNA, 20 bp, Artificial Sequence
  chemically synthesized
agcagacagagagcttgtgt

SEQ ID NO: 344854 - DNA, 20 bp, Artificial Sequence
  chemically synthesized
cagcagacagagagcttgtg

SEQ ID NO: 344855 - DNA, 20 bp, Artificial Sequence
  chemically synthesized
catggatggcagcagacaga

SEQ ID NO: 344856 - DNA, 20 bp, Artificial Sequence
  chemically synthesized
tacatggatggcagcagaca

SEQ ID NO: 344857 - DNA, 20 bp, Artificial Sequence
  chemically synthesized
cttacatggatggcagcaga

SEQ ID NO: 344858 - DNA, 20 bp, Artificial Sequence
  chemically synthesized
acgtcttacatggatggcag

SEQ ID NO: 344859 - DNA, 20 bp, Artificial Sequence
  chemically synthesized
gtcacgtcttacatggatgg

SEQ ID NO: 344860 - DNA, 20 bp, Artificial Sequence
  chemically synthesized
ctgtctgctgccatccatgt

SEQ ID NO: 344861 - DNA, 20 bp, Artificial Sequence
  chemically synthesized
caagtcacgtcttacatgga

SEQ ID NO: 344862 - DNA, 20 bp, Artificial Sequence
  chemically synthesized
agagcaagtcacgtcttaca

SEQ ID NO: 344863 - DNA, 20 bp, Artificial Sequence
  chemically synthesized
gctggaaggcaaggaagagc

SEQ ID NO: 344864 - DNA, 20 bp, Artificial Sequence
  chemically synthesized
tcatgctggaaggcaaggaa

SEQ ID NO: 344865 - DNA, 20 bp, Artificial Sequence
  chemically synthesized
aatcatgctggaaggcaagg

SEQ ID NO: 344866 - DNA, 20 bp, Artificial Sequence
  chemically synthesized
acttgctcttccttgccttc

SEQ ID NO: 344867 - DNA, 20 bp, Artificial Sequence
  chemically synthesized
cacaatcatgctggaaggca

SEQ ID NO: 344868 - DNA, 20 bp, Artificial Sequence
  chemically synthesized
tcacaatcatgctggaaggc

SEQ ID NO: 344869 - DNA, 20 bp, Artificial Sequence
  chemically synthesized
agcttcacaatcatgctgga

SEQ ID NO: 344870 - DNA, 20 bp, Artificial Sequence
  chemically synthesized
aagcttcacaatcatgctgg

SEQ ID NO: 344871 - DNA, 20 bp, Artificial Sequence
  chemically synthesized
gggaagcttcacaatcatgc

SEQ ID NO: 344872 - DNA, 20 bp, Artificial Sequence
  chemically synthesized
tgccttccagcatgattgtg

SEQ ID NO: 344873 - DNA, 20 bp, Artificial Sequence
  chemically synthesized
gcatgattgtgaagcttccc

SEQ ID NO: 344874 - DNA, 20 bp, Artificial Sequence
  chemically synthesized
agagttccacgtagctaggg

SEQ ID NO: 344875 - DNA, 20 bp, Artificial Sequence
  chemically synthesized
cttagagttccacgtagcta

SEQ ID NO: 344876 - DNA, 20 bp, Artificial Sequence
  chemically synthesized
gtgaagcttccctagctacg

SEQ ID NO: 344877 - DNA, 20 bp, Artificial Sequence
  chemically synthesized
acttagagttccacgtagct

SEQ ID NO: 344878 - DNA, 20 bp, Artificial Sequence
  chemically synthesized
gacttagagttccacgtagc

SEQ ID NO: 344879 - DNA, 20 bp, Artificial Sequence
  chemically synthesized
aatggacttagagttccacg

SEQ ID NO: 344880 - DNA, 20 bp, Artificial Sequence
  chemically synthesized
ccctagctacgtggaactct

SEQ ID NO: 344881 - DNA, 20 bp, Artificial Sequence
  chemically synthesized
aaaagagtttaatggactta

SEQ ID NO: 344882 - DNA, 20 bp, Artificial Sequence
  chemically synthesized
gaaaaagagtttaatggact

SEQ ID NO: 344883 - DNA, 20 bp, Artificial Sequence
  chemically synthesized
atacaggaaaaagagtttaa

SEQ ID NO: 344884 - DNA, 20 bp, Artificial Sequence
  chemically synthesized
gataatttatacaggaaaaa

SEQ ID NO: 344885 - DNA, 20 bp, Artificial Sequence
  chemically synthesized
tggataatttatacaggaaa

SEQ ID NO: 344886 - DNA, 20 bp, Artificial Sequence
  chemically synthesized
agagaatggataatttatac

SEQ ID NO: 344887 - DNA, 20 bp, Artificial Sequence
  chemically synthesized
cagagaatggataatttata

SEQ ID NO: 344888 - DNA, 20 bp, Artificial Sequence
  chemically synthesized
tgtataaattatccattctc

SEQ ID NO: 344889 - DNA, 20 bp, Artificial Sequence
  chemically synthesized
gataaagtcatgccagagaa

SEQ ID NO: 344890 - DNA, 20 bp, Artificial Sequence
  chemically synthesized
ctgctgataaagtcatgcca

SEQ ID NO: 344891 - DNA, 20 bp, Artificial Sequence
  chemically synthesized
tactgctgataaagtcatgc

SEQ ID NO: 344892 - DNA, 20 bp, Artificial Sequence
  chemically synthesized
attctctggcatgactttat

SEQ ID NO: 344893 - DNA, 20 bp, Artificial Sequence
  chemically synthesized
ctctggcatgactttatcag

SEQ ID NO: 344894 - DNA, 20 bp, Artificial Sequence
  chemically synthesized
ttgtttttatactgctgata

SEQ ID NO: 344895 - DNA, 20 bp, Artificial Sequence
  chemically synthesized
agtataaaaacaaattaata

SEQ ID NO: 344896 - DNA, 20 bp, Artificial Sequence
  chemically synthesized
aacaaattaatacagtgaat

SEQ ID NO: 344897 - DNA, 20 bp, Artificial Sequence
  chemically synthesized
ttaatacagtgaattggtac

SEQ ID NO: 344898 - DNA, 20 bp, Artificial Sequence
  chemically synthesized
atacagtgaattggtaccag

SEQ ID NO: 344899 - DNA, 20 bp, Artificial Sequence
  chemically synthesized
acagtgaattggtaccagta

SEQ ID NO: 344900 - DNA, 20 bp, Artificial Sequence
  chemically synthesized
gtgaattggtaccagtagag

SEQ ID NO: 344901 - DNA, 20 bp, Artificial Sequence
  chemically synthesized
tgaattggtaccagtagagt

SEQ ID NO: 344902 - DNA, 20 bp, Artificial Sequence
  chemically synthesized
tcagcagcaccccactctac

SEQ ID NO: 344903 - DNA, 20 bp, Artificial Sequence
  chemically synthesized
gaattggtaccagtagagtg

SEQ ID NO: 344904 - DNA, 20 bp, Artificial Sequence
  chemically synthesized
tagagtggggtgctgctgaa

SEQ ID NO: 344905 - DNA, 20 bp, Artificial Sequence
  chemically synthesized
attttcacgtgtcttttcag

SEQ ID NO: 344906 - DNA, 20 bp, Artificial Sequence
  chemically synthesized
cacattttcacgtgtctttt

SEQ ID NO: 344907 - DNA, 20 bp, Artificial Sequence
  chemically synthesized
tgaaaagacacgtgaaaatg

SEQ ID NO: 344908 - DNA, 20 bp, Artificial Sequence
  chemically synthesized
aaagacacgtgaaaatgtgg

SEQ ID NO: 344909 - DNA, 20 bp, Artificial Sequence
  chemically synthesized
tgaaaatgtggaagcaactt

SEQ ID NO: 344910 - DNA, 20 bp, Artificial Sequence
  chemically synthesized
tgtggaagcaactttggaac

SEQ ID NO: 344911 - DNA, 20 bp, Artificial Sequence
  chemically synthesized
gtggaagcaactttggaact

SEQ ID NO: 344912 - DNA, 20 bp, Artificial Sequence
  chemically synthesized
ctgcctgttacccagttcca

SEQ ID NO: 344913 - DNA, 20 bp, Artificial Sequence
  chemically synthesized
gcaactttggaactgggtaa

SEQ ID NO: 344914 - DNA, 20 bp, Artificial Sequence
  chemically synthesized
caactttggaactgggtaac

SEQ ID NO: 344915 - DNA, 20 bp, Artificial Sequence
  chemically synthesized
tgcaacctctgcctgttacc

SEQ ID NO: 344916 - DNA, 20 bp, Artificial Sequence
  chemically synthesized
ctttggaactgggtaacagg

SEQ ID NO: 344917 - DNA, 20 bp, Artificial Sequence
  chemically synthesized
ttggaactgggtaacaggca

SEQ ID NO: 344918 - DNA, 20 bp, Artificial Sequence
  chemically synthesized
tggaactgggtaacaggcag

SEQ ID NO: 344919 - DNA, 20 bp, Artificial Sequence
  chemically synthesized
gtaacaggcagaggttgcaa

SEQ ID NO: 344920 - DNA, 20 bp, Artificial Sequence
  chemically synthesized
ggcagaggttgcaacagttt

SEQ ID NO: 344921 - DNA, 20 bp, Artificial Sequence
  chemically synthesized
cagaggttgcaacagtttga

SEQ ID NO: 344922 - DNA, 20 bp, Artificial Sequence
  chemically synthesized
gttgcaacagtttgagagct

SEQ ID NO: 344923 - DNA, 20 bp, Artificial Sequence
  chemically synthesized
gcaacagtttgagagctcag

SEQ ID NO: 344924 - DNA, 20 bp, Artificial Sequence
  chemically synthesized
cagtttgagagctcagaaga

SEQ ID NO: 344925 - DNA, 20 bp, Artificial Sequence
  chemically synthesized
agtttgagagctcagaagac

SEQ ID NO: 344926 - DNA, 20 bp, Artificial Sequence
  chemically synthesized
cccacattttcctgtcttct

SEQ ID NO: 344927 - DNA, 20 bp, Artificial Sequence
  chemically synthesized
gctcagaagacaggaaaatg

SEQ ID NO: 344928 - DNA, 20 bp, Artificial Sequence
  chemically synthesized
ctcagaagacaggaaaatgt

SEQ ID NO: 344929 - DNA, 20 bp, Artificial Sequence
  chemically synthesized
gaagacaggaaaatgtggga

SEQ ID NO: 344930 - DNA, 20 bp, Artificial Sequence
  chemically synthesized
caggaaaatgtgggaaagtt

SEQ ID NO: 344931 - DNA, 20 bp, Artificial Sequence
  chemically synthesized
aggaaaatgtgggaaagttt

SEQ ID NO: 344932 - DNA, 20 bp, Artificial Sequence
  chemically synthesized
tgggaaagtttgggacttcc

SEQ ID NO: 344933 - DNA, 20 bp, Artificial Sequence
  chemically synthesized
ggaaagtttgggacttccta

SEQ ID NO: 344934 - DNA, 20 bp, Artificial Sequence
  chemically synthesized
aagctattcaagtctctagg

SEQ ID NO: 344935 - DNA, 20 bp, Artificial Sequence
  chemically synthesized
tcaaagctattcaagtctct

SEQ ID NO: 344936 - DNA, 20 bp, Artificial Sequence
  chemically synthesized
gtcaaagctattcaagtctc

SEQ ID NO: 344937 - DNA, 20 bp, Artificial Sequence
  chemically synthesized
ggacttcctagagacttgaa

SEQ ID NO: 344938 - DNA, 20 bp, Artificial Sequence
  chemically synthesized
catcttggtcaaagctattc

SEQ ID NO: 344939 - DNA, 20 bp, Artificial Sequence
  chemically synthesized
agacttgaatagctttgacc

SEQ ID NO: 344940 - DNA, 20 bp, Artificial Sequence
  chemically synthesized
cattatcagcatcttggtca

SEQ ID NO: 344941 - DNA, 20 bp, Artificial Sequence
  chemically synthesized
ctacatcattatcagcatct

SEQ ID NO: 344942 - DNA, 20 bp, Artificial Sequence
  chemically synthesized
ttcattctctacatcattat

SEQ ID NO: 344943 - DNA, 20 bp, Artificial Sequence
  chemically synthesized
ccaagatgctgataatgatg

SEQ ID NO: 344944 - DNA, 20 bp, Artificial Sequence
  chemically synthesized
aagatgctgataatgatgta

SEQ ID NO: 344945 - DNA, 20 bp, Artificial Sequence
  chemically synthesized
tgatgtagagaatgaaatcc

SEQ ID NO: 344946 - DNA, 20 bp, Artificial Sequence
  chemically synthesized
tagagaatgaaatccaagct

SEQ ID NO: 344947 - DNA, 20 bp, Artificial Sequence
  chemically synthesized
tatctgagaccatctcagct

SEQ ID NO: 344948 - DNA, 20 bp, Artificial Sequence
  chemically synthesized
gaatgaaatccaagctgaga

SEQ ID NO: 344949 - DNA, 20 bp, Artificial Sequence
  chemically synthesized
atctctatctgagaccatct

SEQ ID NO: 344950 - DNA, 20 bp, Artificial Sequence
  chemically synthesized
aatccaagctgagatggtct

SEQ ID NO: 344951 - DNA, 20 bp, Artificial Sequence
  chemically synthesized
caagctgagatggtctcaga

SEQ ID NO: 344952 - DNA, 20 bp, Artificial Sequence
  chemically synthesized
agctgagatggtctcagata

SEQ ID NO: 344953 - DNA, 20 bp, Artificial Sequence
  chemically synthesized
caagttgctcatctctatct

SEQ ID NO: 344954 - DNA, 20 bp, Artificial Sequence
  chemically synthesized
agatggtctcagatagagat

SEQ ID NO: 344955 - DNA, 20 bp, Artificial Sequence
  chemically synthesized
gatagagatgagcaacttgt

SEQ ID NO: 344956 - DNA, 20 bp, Artificial Sequence
  chemically synthesized
atagagatgagcaacttgtt

SEQ ID NO: 344957 - DNA, 20 bp, Artificial Sequence
  chemically synthesized
agagatgagcaacttgttgg

SEQ ID NO: 344958 - DNA, 20 bp, Artificial Sequence
  chemically synthesized
cttttgttcgggctcccaac

SEQ ID NO: 344959 - DNA, 20 bp, Artificial Sequence
  chemically synthesized
cttgttgggagcccgaacaa

SEQ ID NO: 344960 - DNA, 20 bp, Artificial Sequence
  chemically synthesized
ataatgagtcacttttgttc

SEQ ID NO: 344961 - DNA, 20 bp, Artificial Sequence
  chemically synthesized
tataatgagtcacttttgtt

SEQ ID NO: 344962 - DNA, 20 bp, Artificial Sequence
  chemically synthesized
tctctttgctaaaatataat

SEQ ID NO: 344963 - DNA, 20 bp, Artificial Sequence
  chemically synthesized
aaaagtgactcattatattt

SEQ ID NO: 344964 - DNA, 20 bp, Artificial Sequence
  chemically synthesized
tgactcattatattttagca

SEQ ID NO: 344965 - DNA, 20 bp, Artificial Sequence
  chemically synthesized
actcattatattttagcaaa

SEQ ID NO: 344966 - DNA, 20 bp, Artificial Sequence
  chemically synthesized
ttatattttagcaaagagac

SEQ ID NO: 344967 - DNA, 20 bp, Artificial Sequence
  chemically synthesized
tatattttagcaaagagact

SEQ ID NO: 344968 - DNA, 20 bp, Artificial Sequence
  chemically synthesized
tattttagcaaagagactgg

SEQ ID NO: 344969 - DNA, 20 bp, Artificial Sequence
  chemically synthesized
gggcaggagcaaaatgctcc

SEQ ID NO: 344970 - DNA, 20 bp, Artificial Sequence
  chemically synthesized
ggagcattttgctcctgccc

SEQ ID NO: 344971 - DNA, 20 bp, Artificial Sequence
  chemically synthesized
tccctataactctagggcag

SEQ ID NO: 344972 - DNA, 20 bp, Artificial Sequence
  chemically synthesized
agcattttgctcctgcccta

SEQ ID NO: 344973 - DNA, 20 bp, Artificial Sequence
  chemically synthesized
gttccctataactctagggc

SEQ ID NO: 344974 - DNA, 20 bp, Artificial Sequence
  chemically synthesized
agttccctataactctaggg

SEQ ID NO: 344975 - DNA, 20 bp, Artificial Sequence
  chemically synthesized
caaagttccctataactcta

SEQ ID NO: 344976 - DNA, 20 bp, Artificial Sequence
  chemically synthesized
ttgctcctgccctagagtta

SEQ ID NO: 344977 - DNA, 20 bp, Artificial Sequence
  chemically synthesized
tcaaagttccctataactct

SEQ ID NO: 344978 - DNA, 20 bp, Artificial Sequence
  chemically synthesized
tgctcctgccctagagttat

SEQ ID NO: 344979 - DNA, 20 bp, Artificial Sequence
  chemically synthesized
ctcaaagttccctataactc

SEQ ID NO: 344980 - DNA, 20 bp, Artificial Sequence
  chemically synthesized
gctcctgccctagagttata

SEQ ID NO: 344981 - DNA, 20 bp, Artificial Sequence
  chemically synthesized
ctagagttatagggaacttt

SEQ ID NO: 344982 - DNA, 20 bp, Artificial Sequence
  chemically synthesized
ttatagggaactttgagctt

SEQ ID NO: 344983 - DNA, 20 bp, Artificial Sequence
  chemically synthesized
aatcacccctctcaagctca

SEQ ID NO: 344984 - DNA, 20 bp, Artificial Sequence
  chemically synthesized
atagggaactttgagcttga

SEQ ID NO: 344985 - DNA, 20 bp, Artificial Sequence
  chemically synthesized
tagggaactttgagcttgag

SEQ ID NO: 344986 - DNA, 20 bp, Artificial Sequence
  chemically synthesized
agggaactttgagcttgaga

SEQ ID NO: 344987 - DNA, 20 bp, Artificial Sequence
  chemically synthesized
gggaactttgagcttgagag

SEQ ID NO: 344988 - DNA, 20 bp, Artificial Sequence
  chemically synthesized
aacgctaaatcacccctctc

SEQ ID NO: 344989 - DNA, 20 bp, Artificial Sequence
  chemically synthesized
tgagcttgagaggggtgatt

SEQ ID NO: 344990 - DNA, 20 bp, Artificial Sequence
  chemically synthesized
aggggtgatttagcgttatc

SEQ ID NO: 344991 - DNA, 20 bp, Artificial Sequence
  chemically synthesized
ggtgatttagcgttatctgg

SEQ ID NO: 344992 - DNA, 20 bp, Artificial Sequence
  chemically synthesized
gtgatttagcgttatctggt

SEQ ID NO: 344993 - DNA, 20 bp, Artificial Sequence
  chemically synthesized
gatttagcgttatctggtgg

SEQ ID NO: 344994 - DNA, 20 bp, Artificial Sequence
  chemically synthesized
tgcttagaagtttctcccac

SEQ ID NO: 344995 - DNA, 20 bp, Artificial Sequence
  chemically synthesized
atctggtgggagaaacttct

SEQ ID NO: 344996 - DNA, 20 bp, Artificial Sequence
  chemically synthesized
tggtgggagaaacttctaag

SEQ ID NO: 344997 - DNA, 20 bp, Artificial Sequence
  chemically synthesized
acgaatgctttgctgcttag

SEQ ID NO: 344998 - DNA, 20 bp, Artificial Sequence
  chemically synthesized
ggagaaacttctaagcagca

SEQ ID NO: 344999 - DNA, 20 bp, Artificial Sequence
  chemically synthesized
ctcacgaatgctttgctgct

SEQ ID NO: 345000 - DNA, 20 bp, Artificial Sequence
  chemically synthesized
ctaagcagcaaagcattcgt

SEQ ID NO: 345001 - DNA, 20 bp, Artificial Sequence
  chemically synthesized
taagcagcaaagcattcgtg

SEQ ID NO: 345002 - DNA, 20 bp, Artificial Sequence
  chemically synthesized
aaagcattcgtgaggtgact

SEQ ID NO: 345003 - DNA, 20 bp, Artificial Sequence
  chemically synthesized
aagcattcgtgaggtgactt

SEQ ID NO: 345004 - DNA, 20 bp, Artificial Sequence
  chemically synthesized
tgaatgccttaacaggaccc

SEQ ID NO: 345005 - DNA, 20 bp, Artificial Sequence
  chemically synthesized
gaggtgacttgggtcctgtt

SEQ ID NO: 345006 - DNA, 20 bp, Artificial Sequence
  chemically synthesized
aggtgacttgggtcctgtta

SEQ ID NO: 345007 - DNA, 20 bp, Artificial Sequence
  chemically synthesized
ttaaaactgaatgccttaac

SEQ ID NO: 345008 - DNA, 20 bp, Artificial Sequence
  chemically synthesized
tttaaaactgaatgccttaa

SEQ ID NO: 345009 - DNA, 20 bp, Artificial Sequence
  chemically synthesized
ttgggtcctgttaaggcatt

SEQ ID NO: 345010 - DNA, 20 bp, Artificial Sequence
  chemically synthesized
gttaaggcattcagttttaa

SEQ ID NO: 345011 - DNA, 20 bp, Artificial Sequence
  chemically synthesized
ttaaggcattcagttttaaa

SEQ ID NO: 345012 - DNA, 20 bp, Artificial Sequence
  chemically synthesized
taaggcattcagttttaaaa

SEQ ID NO: 345013 - DNA, 20 bp, Artificial Sequence
  chemically synthesized
attcagttttaaaagggaaa

SEQ ID NO: 345014 - DNA, 20 bp, Artificial Sequence
  chemically synthesized
tcagttttaaaagggaaaca

SEQ ID NO: 345015 - DNA, 20 bp, Artificial Sequence
  chemically synthesized
aaaagggaaacagagcataa

SEQ ID NO: 345016 - DNA, 20 bp, Artificial Sequence
  chemically synthesized
ggaaacagagcataaaagtt

SEQ ID NO: 345017 - DNA, 20 bp, Artificial Sequence
  chemically synthesized
ataaaagtttggaaaaatta

SEQ ID NO: 345018 - DNA, 20 bp, Artificial Sequence
  chemically synthesized
ttcttttttatcacattgtc

SEQ ID NO: 345019 - DNA, 20 bp, Artificial Sequence
  chemically synthesized
tttcttttttatcacattgt

SEQ ID NO: 345020 - DNA, 20 bp, Artificial Sequence
  chemically synthesized
agcctgacaatgtgataaaa

SEQ ID NO: 345021 - DNA, 20 bp, Artificial Sequence
  chemically synthesized
aaaagaaaatcacactttct

SEQ ID NO: 345022 - DNA, 20 bp, Artificial Sequence
  chemically synthesized
agaaaatcacactttctgag

SEQ ID NO: 345023 - DNA, 20 bp, Artificial Sequence
  chemically synthesized
ggcgtgaatttcttctcaga

SEQ ID NO: 345024 - DNA, 20 bp, Artificial Sequence
  chemically synthesized
agtgggcgtgaatttcttct

SEQ ID NO: 345025 - DNA, 20 bp, Artificial Sequence
  chemically synthesized
gaagaaattcacgcccactg

SEQ ID NO: 345026 - DNA, 20 bp, Artificial Sequence
  chemically synthesized
cttatacaaatttctgcagt

SEQ ID NO: 345027 - DNA, 20 bp, Artificial Sequence
  chemically synthesized
acttatacaaatttctgcag

SEQ ID NO: 345028 - DNA, 20 bp, Artificial Sequence
  chemically synthesized
gttacttatacaaatttctg

SEQ ID NO: 345029 - DNA, 20 bp, Artificial Sequence
  chemically synthesized
cccactgcagaaatttgtat

SEQ ID NO: 345030 - DNA, 20 bp, Artificial Sequence
  chemically synthesized
cagaaatttgtataagtaac

SEQ ID NO: 345031 - DNA, 20 bp, Artificial Sequence
  chemically synthesized
agaaatttgtataagtaaca

SEQ ID NO: 345032 - DNA, 20 bp, Artificial Sequence
  chemically synthesized
ttgtcttggtgattaacatt

SEQ ID NO: 345033 - DNA, 20 bp, Artificial Sequence
  chemically synthesized
ggaactgaatgttaatcacc

SEQ ID NO: 345034 - DNA, 20 bp, Artificial Sequence
  chemically synthesized
atgttaatcaccaagacaat

SEQ ID NO: 345035 - DNA, 20 bp, Artificial Sequence
  chemically synthesized
agacatttttctcattgtct

SEQ ID NO: 345036 - DNA, 20 bp, Artificial Sequence
  chemically synthesized
gacaatgagaaaaatgtctc

SEQ ID NO: 345037 - DNA, 20 bp, Artificial Sequence
  chemically synthesized
acaatgagaaaaatgtctcc

SEQ ID NO: 345038 - DNA, 20 bp, Artificial Sequence
  chemically synthesized
caatgagaaaaatgtctcca

SEQ ID NO: 345039 - DNA, 20 bp, Artificial Sequence
  chemically synthesized
aaggtctctgacgtgccctg

SEQ ID NO: 345040 - DNA, 20 bp, Artificial Sequence
  chemically synthesized
caaaggtctctgacgtgccc

SEQ ID NO: 345041 - DNA, 20 bp, Artificial Sequence
  chemically synthesized
aaaatgtctccagggcacgt

SEQ ID NO: 345042 - DNA, 20 bp, Artificial Sequence
  chemically synthesized
aatgtctccagggcacgtca

SEQ ID NO: 345043 - DNA, 20 bp, Artificial Sequence
  chemically synthesized
gggcacgtcagagacctttg

SEQ ID NO: 345044 - DNA, 20 bp, Artificial Sequence
  chemically synthesized
cacgtcagagacctttgtgg

SEQ ID NO: 345045 - DNA, 20 bp, Artificial Sequence
  chemically synthesized
gatgggaggggctgccacaa

SEQ ID NO: 345046 - DNA, 20 bp, Artificial Sequence
  chemically synthesized
tgatgggaggggctgccaca

SEQ ID NO: 345047 - DNA, 20 bp, Artificial Sequence
  chemically synthesized
ctccagacatgtgatgggag

SEQ ID NO: 345048 - DNA, 20 bp, Artificial Sequence
  chemically synthesized
actccagacatgtgatggga

SEQ ID NO: 345049 - DNA, 20 bp, Artificial Sequence
  chemically synthesized
aactccagacatgtgatggg

SEQ ID NO: 345050 - DNA, 20 bp, Artificial Sequence
  chemically synthesized
aaactccagacatgtgatgg

SEQ ID NO: 345051 - DNA, 20 bp, Artificial Sequence
  chemically synthesized
ctaaactccagacatgtgat

SEQ ID NO: 345052 - DNA, 20 bp, Artificial Sequence
  chemically synthesized
cctaaactccagacatgtga

SEQ ID NO: 345053 - DNA, 20 bp, Artificial Sequence
  chemically synthesized
agcccctcccatcacatgtc

SEQ ID NO: 345054 - DNA, 20 bp, Artificial Sequence
  chemically synthesized
cccctcccatcacatgtctg

SEQ ID NO: 345055 - DNA, 20 bp, Artificial Sequence
  chemically synthesized
cccatcacatgtctggagtt

SEQ ID NO: 345056 - DNA, 20 bp, Artificial Sequence
  chemically synthesized
ccatcacatgtctggagttt

SEQ ID NO: 345057 - DNA, 20 bp, Artificial Sequence
  chemically synthesized
cattttttcctcctaaactc

SEQ ID NO: 345058 - DNA, 20 bp, Artificial Sequence
  chemically synthesized
atcacatgtctggagtttag

SEQ ID NO: 345059 - DNA, 20 bp, Artificial Sequence
  chemically synthesized
tcacatgtctggagtttagg

SEQ ID NO: 345060 - DNA, 20 bp, Artificial Sequence
  chemically synthesized
tggagtttaggaggaaaaaa

SEQ ID NO: 345061 - DNA, 20 bp, Artificial Sequence
  chemically synthesized
aggaggaaaaaatggttttg

SEQ ID NO: 345062 - DNA, 20 bp, Artificial Sequence
  chemically synthesized
ggaggaaaaaatggttttgt

SEQ ID NO: 345063 - DNA, 20 bp, Artificial Sequence
  chemically synthesized
gaaaaaatggttttgtgggc

SEQ ID NO: 345064 - DNA, 20 bp, Artificial Sequence
  chemically synthesized
aaaaaatggttttgtgggct

SEQ ID NO: 345065 - DNA, 20 bp, Artificial Sequence
  chemically synthesized
atggttttgtgggctaggcc

SEQ ID NO: 345066 - DNA, 20 bp, Artificial Sequence
  chemically synthesized
tggttttgtgggctaggccc

SEQ ID NO: 345067 - DNA, 20 bp, Artificial Sequence
  chemically synthesized
ggttttgtgggctaggccca

SEQ ID NO: 345068 - DNA, 20 bp, Artificial Sequence
  chemically synthesized
ccacagagggaccctgggcc

SEQ ID NO: 345069 - DNA, 20 bp, Artificial Sequence
  chemically synthesized
gcacaccacagagggaccct

SEQ ID NO: 345070 - DNA, 20 bp, Artificial Sequence
  chemically synthesized
tgcacaccacagagggaccc

SEQ ID NO: 345071 - DNA, 20 bp, Artificial Sequence
  chemically synthesized
ctaggcccagggtccctctg

SEQ ID NO: 345072 - DNA, 20 bp, Artificial Sequence
  chemically synthesized
tctaggctgcacaccacaga

SEQ ID NO: 345073 - DNA, 20 bp, Artificial Sequence
  chemically synthesized
ctctaggctgcacaccacag

SEQ ID NO: 345074 - DNA, 20 bp, Artificial Sequence
  chemically synthesized
tctctaggctgcacaccaca

SEQ ID NO: 345075 - DNA, 20 bp, Artificial Sequence
  chemically synthesized
cagggtccctctgtggtgtg

SEQ ID NO: 345076 - DNA, 20 bp, Artificial Sequence
  chemically synthesized
agtctctaggctgcacacca

SEQ ID NO: 345077 - DNA, 20 bp, Artificial Sequence
  chemically synthesized
tccctctgtggtgtgcagcc

SEQ ID NO: 345078 - DNA, 20 bp, Artificial Sequence
  chemically synthesized
cctctgtggtgtgcagccta

SEQ ID NO: 345079 - DNA, 20 bp, Artificial Sequence
  chemically synthesized
tggtgtgcagcctagagact

SEQ ID NO: 345080 - DNA, 20 bp, Artificial Sequence
  chemically synthesized
acacagggcaccaagtctct

SEQ ID NO: 345081 - DNA, 20 bp, Artificial Sequence
  chemically synthesized
gacacagggcaccaagtctc

SEQ ID NO: 345082 - DNA, 20 bp, Artificial Sequence
  chemically synthesized
tggctgggacacagggcacc

SEQ ID NO: 345083 - DNA, 20 bp, Artificial Sequence
  chemically synthesized
agacttggtgccctgtgtcc

SEQ ID NO: 345084 - DNA, 20 bp, Artificial Sequence
  chemically synthesized
gctggagtggctgggacaca

SEQ ID NO: 345085 - DNA, 20 bp, Artificial Sequence
  chemically synthesized
agctggagtggctgggacac

SEQ ID NO: 345086 - DNA, 20 bp, Artificial Sequence
  chemically synthesized
cagctggagtggctgggaca

SEQ ID NO: 345087 - DNA, 20 bp, Artificial Sequence
  chemically synthesized
tagtcacagctggagtggct

SEQ ID NO: 345088 - DNA, 20 bp, Artificial Sequence
  chemically synthesized
gccctgtgtcccagccactc

SEQ ID NO: 345089 - DNA, 20 bp, Artificial Sequence
  chemically synthesized
ttagtcacagctggagtggc

SEQ ID NO: 345090 - DNA, 20 bp, Artificial Sequence
  chemically synthesized
ccttttagtcacagctggag

SEQ ID NO: 345091 - DNA, 20 bp, Artificial Sequence
  chemically synthesized
gccccttttagtcacagctg

SEQ ID NO: 345092 - DNA, 20 bp, Artificial Sequence
  chemically synthesized
cggccccttttagtcacagc

SEQ ID NO: 345093 - DNA, 20 bp, Artificial Sequence
  chemically synthesized
gccactccagctgtgactaa

SEQ ID NO: 345094 - DNA, 20 bp, Artificial Sequence
  chemically synthesized
acctcggccccttttagtca

SEQ ID NO: 345095 - DNA, 20 bp, Artificial Sequence
  chemically synthesized
ccactccagctgtgactaaa

SEQ ID NO: 345096 - DNA, 20 bp, Artificial Sequence
  chemically synthesized
cactccagctgtgactaaaa

SEQ ID NO: 345097 - DNA, 20 bp, Artificial Sequence
  chemically synthesized
actccagctgtgactaaaag

SEQ ID NO: 345098 - DNA, 20 bp, Artificial Sequence
  chemically synthesized
agctgtacctcggccccttt

SEQ ID NO: 345099 - DNA, 20 bp, Artificial Sequence
  chemically synthesized
agctgtgactaaaaggggcc

SEQ ID NO: 345100 - DNA, 20 bp, Artificial Sequence
  chemically synthesized
gctgtgactaaaaggggccg

SEQ ID NO: 345101 - DNA, 20 bp, Artificial Sequence
  chemically synthesized
gactaaaaggggccgaggta

SEQ ID NO: 345102 - DNA, 20 bp, Artificial Sequence
  chemically synthesized
taacagcccaagctgtacct

SEQ ID NO: 345103 - DNA, 20 bp, Artificial Sequence
  chemically synthesized
aaaggggccgaggtacagct

SEQ ID NO: 345104 - DNA, 20 bp, Artificial Sequence
  chemically synthesized
aaggggccgaggtacagctt

SEQ ID NO: 345105 - DNA, 20 bp, Artificial Sequence
  chemically synthesized
gccctctgaagtaacagccc

SEQ ID NO: 345106 - DNA, 20 bp, Artificial Sequence
  chemically synthesized
tacagcttgggctgttactt

SEQ ID NO: 345107 - DNA, 20 bp, Artificial Sequence
  chemically synthesized
gcttccgccctctgaagtaa

SEQ ID NO: 345108 - DNA, 20 bp, Artificial Sequence
  chemically synthesized
cagcttgggctgttacttca

SEQ ID NO: 345109 - DNA, 20 bp, Artificial Sequence
  chemically synthesized
agcttgggctgttacttcag

SEQ ID NO: 345110 - DNA, 20 bp, Artificial Sequence
  chemically synthesized
gcttgggctgttacttcaga

SEQ ID NO: 345111 - DNA, 20 bp, Artificial Sequence
  chemically synthesized
tgggctgttacttcagaggg

SEQ ID NO: 345112 - DNA, 20 bp, Artificial Sequence
  chemically synthesized
gcttgggcttccgccctctg

SEQ ID NO: 345113 - DNA, 20 bp, Artificial Sequence
  chemically synthesized
gctgttacttcagagggcgg

SEQ ID NO: 345114 - DNA, 20 bp, Artificial Sequence
  chemically synthesized
acttcagagggcggaagccc

SEQ ID NO: 345115 - DNA, 20 bp, Artificial Sequence
  chemically synthesized
gagggcggaagcccaagcct

SEQ ID NO: 345116 - DNA, 20 bp, Artificial Sequence
  chemically synthesized
cgtggaagctgccaaggctt

SEQ ID NO: 345117 - DNA, 20 bp, Artificial Sequence
  chemically synthesized
acgtggaagctgccaaggct

SEQ ID NO: 345118 - DNA, 20 bp, Artificial Sequence
  chemically synthesized
ggcggaagcccaagccttgg

SEQ ID NO: 345119 - DNA, 20 bp, Artificial Sequence
  chemically synthesized
acacgacgtggaagctgcca

SEQ ID NO: 345120 - DNA, 20 bp, Artificial Sequence
  chemically synthesized
aacacgacgtggaagctgcc

SEQ ID NO: 345121 - DNA, 20 bp, Artificial Sequence
  chemically synthesized
gcgggctcaacacgacgtgg

SEQ ID NO: 345122 - DNA, 20 bp, Artificial Sequence
  chemically synthesized
cctgcgggctcaacacgacg

SEQ ID NO: 345123 - DNA, 20 bp, Artificial Sequence
  chemically synthesized
ggcagcttccacgtcgtgtt

SEQ ID NO: 345124 - DNA, 20 bp, Artificial Sequence
  chemically synthesized
tccacgtcgtgttgagcccg

SEQ ID NO: 345125 - DNA, 20 bp, Artificial Sequence
  chemically synthesized
ccacgtcgtgttgagcccgc

SEQ ID NO: 345126 - DNA, 20 bp, Artificial Sequence
  chemically synthesized
cttgacttctgtgcacctgc

SEQ ID NO: 345127 - DNA, 20 bp, Artificial Sequence
  chemically synthesized
tcttgacttctgtgcacctg

SEQ ID NO: 345128 - DNA, 20 bp, Artificial Sequence
  chemically synthesized
gtgttgagcccgcaggtgca

SEQ ID NO: 345129 - DNA, 20 bp, Artificial Sequence
  chemically synthesized
ttgagcccgcaggtgcacag

SEQ ID NO: 345130 - DNA, 20 bp, Artificial Sequence
  chemically synthesized
cccgcaggtgcacagaagtc

SEQ ID NO: 345131 - DNA, 20 bp, Artificial Sequence
  chemically synthesized
tgcacagaagtcaagaactg

SEQ ID NO: 345132 - DNA, 20 bp, Artificial Sequence
  chemically synthesized
agaagtcaagaactgcggtt

SEQ ID NO: 345133 - DNA, 20 bp, Artificial Sequence
  chemically synthesized
gaagtcaagaactgcggttt

SEQ ID NO: 345134 - DNA, 20 bp, Artificial Sequence
  chemically synthesized
aggcagaggttcccaaaccg

SEQ ID NO: 345135 - DNA, 20 bp, Artificial Sequence
  chemically synthesized
gcggtttgggaacctctgcc

SEQ ID NO: 345136 - DNA, 20 bp, Artificial Sequence
  chemically synthesized
atcctctgaaatctaggcag

SEQ ID NO: 345137 - DNA, 20 bp, Artificial Sequence
  chemically synthesized
catcctctgaaatctaggca

SEQ ID NO: 345138 - DNA, 20 bp, Artificial Sequence
  chemically synthesized
tacatcctctgaaatctagg

SEQ ID NO: 345139 - DNA, 20 bp, Artificial Sequence
  chemically synthesized
gggaacctctgcctagattt

SEQ ID NO: 345140 - DNA, 20 bp, Artificial Sequence
  chemically synthesized
ccatacatcctctgaaatct

SEQ ID NO: 345141 - DNA, 20 bp, Artificial Sequence
  chemically synthesized
gaacctctgcctagatttca

SEQ ID NO: 345142 - DNA, 20 bp, Artificial Sequence
  chemically synthesized
tccatacatcctctgaaatc

SEQ ID NO: 345143 - DNA, 20 bp, Artificial Sequence
  chemically synthesized
aacctctgcctagatttcag

SEQ ID NO: 345144 - DNA, 20 bp, Artificial Sequence
  chemically synthesized
cctagatttcagaggatgta

SEQ ID NO: 345145 - DNA, 20 bp, Artificial Sequence
  chemically synthesized
agaggatgtatggaaaaacc

SEQ ID NO: 345146 - DNA, 20 bp, Artificial Sequence
  chemically synthesized
tatggaaaaacctggatgcc

SEQ ID NO: 345147 - DNA, 20 bp, Artificial Sequence
  chemically synthesized
aaacttctacctgggcatcc

SEQ ID NO: 345148 - DNA, 20 bp, Artificial Sequence
  chemically synthesized
atggaaaaacctggatgccc

SEQ ID NO: 345149 - DNA, 20 bp, Artificial Sequence
  chemically synthesized
caaacttctacctgggcatc

SEQ ID NO: 345150 - DNA, 20 bp, Artificial Sequence
  chemically synthesized
gaaaaacctggatgcccagg

SEQ ID NO: 345151 - DNA, 20 bp, Artificial Sequence
  chemically synthesized
aaacctggatgcccaggtag

SEQ ID NO: 345152 - DNA, 20 bp, Artificial Sequence
  chemically synthesized
cctacagcaaacttctacct

SEQ ID NO: 345153 - DNA, 20 bp, Artificial Sequence
  chemically synthesized
ccctacagcaaacttctacc

SEQ ID NO: 345154 - DNA, 20 bp, Artificial Sequence
  chemically synthesized
gcccaggtagaagtttgctg

SEQ ID NO: 345155 - DNA, 20 bp, Artificial Sequence
  chemically synthesized
cccaggtagaagtttgctgt

SEQ ID NO: 345156 - DNA, 20 bp, Artificial Sequence
  chemically synthesized
ccaggtagaagtttgctgta

SEQ ID NO: 345157 - DNA, 20 bp, Artificial Sequence
  chemically synthesized
caggtagaagtttgctgtag

SEQ ID NO: 345158 - DNA, 20 bp, Artificial Sequence
  chemically synthesized
gtagaagtttgctgtagggg

SEQ ID NO: 345159 - DNA, 20 bp, Artificial Sequence
  chemically synthesized
tagaagtttgctgtaggggc

SEQ ID NO: 345160 - DNA, 20 bp, Artificial Sequence
  chemically synthesized
ccatgagggccctgccccta

SEQ ID NO: 345161 - DNA, 20 bp, Artificial Sequence
  chemically synthesized
agaagtttgctgtaggggca

SEQ ID NO: 345162 - DNA, 20 bp, Artificial Sequence
  chemically synthesized
ctgtaggggcagggccctca

SEQ ID NO: 345163 - DNA, 20 bp, Artificial Sequence
  chemically synthesized
gtaggggcagggccctcatg

SEQ ID NO: 345164 - DNA, 20 bp, Artificial Sequence
  chemically synthesized
ctagcagaggttctccatga

SEQ ID NO: 345165 - DNA, 20 bp, Artificial Sequence
  chemically synthesized
cctagcagaggttctccatg

SEQ ID NO: 345166 - DNA, 20 bp, Artificial Sequence
  chemically synthesized
ccctagcagaggttctccat

SEQ ID NO: 345167 - DNA, 20 bp, Artificial Sequence
  chemically synthesized
ccctcatggagaacctctgc

SEQ ID NO: 345168 - DNA, 20 bp, Artificial Sequence
  chemically synthesized
cctcatggagaacctctgct

SEQ ID NO: 345169 - DNA, 20 bp, Artificial Sequence
  chemically synthesized
ctcatggagaacctctgcta

SEQ ID NO: 345170 - DNA, 20 bp, Artificial Sequence
  chemically synthesized
cttttgcactgccctagcag

SEQ ID NO: 345171 - DNA, 20 bp, Artificial Sequence
  chemically synthesized
tcttttgcactgccctagca

SEQ ID NO: 345172 - DNA, 20 bp, Artificial Sequence
  chemically synthesized
atggagaacctctgctaggg

SEQ ID NO: 345173 - DNA, 20 bp, Artificial Sequence
  chemically synthesized
tttcttttgcactgccctag

SEQ ID NO: 345174 - DNA, 20 bp, Artificial Sequence
  chemically synthesized
atttttcttttgcactgccc

SEQ ID NO: 345175 - DNA, 20 bp, Artificial Sequence
  chemically synthesized
cctctgctagggcagtgcaa

SEQ ID NO: 345176 - DNA, 20 bp, Artificial Sequence
  chemically synthesized
ggcagtgcaaaagaaaaatg

SEQ ID NO: 345177 - DNA, 20 bp, Artificial Sequence
  chemically synthesized
gcagtgcaaaagaaaaatgt

SEQ ID NO: 345178 - DNA, 20 bp, Artificial Sequence
  chemically synthesized
cagtgcaaaagaaaaatgtg

SEQ ID NO: 345179 - DNA, 20 bp, Artificial Sequence
  chemically synthesized
gcaaaagaaaaatgtggggt

SEQ ID NO: 345180 - DNA, 20 bp, Artificial Sequence
  chemically synthesized
aaaagaaaaatgtggggtta

SEQ ID NO: 345181 - DNA, 20 bp, Artificial Sequence
  chemically synthesized
gtggggttagagccctcaca

SEQ ID NO: 345182 - DNA, 20 bp, Artificial Sequence
  chemically synthesized
ggggttagagccctcacaca

SEQ ID NO: 345183 - DNA, 20 bp, Artificial Sequence
  chemically synthesized
ctagtagggtctctgtgtga

SEQ ID NO: 345184 - DNA, 20 bp, Artificial Sequence
  chemically synthesized
tctagtagggtctctgtgtg

SEQ ID NO: 345185 - DNA, 20 bp, Artificial Sequence
  chemically synthesized
ctctagtagggtctctgtgt

SEQ ID NO: 345186 - DNA, 20 bp, Artificial Sequence
  chemically synthesized
ccctcacacagagaccctac

SEQ ID NO: 345187 - DNA, 20 bp, Artificial Sequence
  chemically synthesized
ctcacacagagaccctacta

SEQ ID NO: 345188 - DNA, 20 bp, Artificial Sequence
  chemically synthesized
taatagacagtgctctagta

SEQ ID NO: 345189 - DNA, 20 bp, Artificial Sequence
  chemically synthesized
ctaatagacagtgctctagt

SEQ ID NO: 345190 - DNA, 20 bp, Artificial Sequence
  chemically synthesized
tctaatagacagtgctctag

SEQ ID NO: 345191 - DNA, 20 bp, Artificial Sequence
  chemically synthesized
ggctctaatagacagtgctc

SEQ ID NO: 345192 - DNA, 20 bp, Artificial Sequence
  chemically synthesized
cctactagagcactgtctat

SEQ ID NO: 345193 - DNA, 20 bp, Artificial Sequence
  chemically synthesized
tactagagcactgtctatta

SEQ ID NO: 345194 - DNA, 20 bp, Artificial Sequence
  chemically synthesized
cttttcatggctctaataga

SEQ ID NO: 345195 - DNA, 20 bp, Artificial Sequence
  chemically synthesized
ccctcttttcatggctctaa

SEQ ID NO: 345196 - DNA, 20 bp, Artificial Sequence
  chemically synthesized
ctgtctattagagccatgaa

SEQ ID NO: 345197 - DNA, 20 bp, Artificial Sequence
  chemically synthesized
gtctattagagccatgaaaa

SEQ ID NO: 345198 - DNA, 20 bp, Artificial Sequence
  chemically synthesized
tctattagagccatgaaaag

SEQ ID NO: 345199 - DNA, 20 bp, Artificial Sequence
  chemically synthesized
ggacagtggccctcttttca

SEQ ID NO: 345200 - DNA, 20 bp, Artificial Sequence
  chemically synthesized
ctattagagccatgaaaaga

SEQ ID NO: 345201 - DNA, 20 bp, Artificial Sequence
  chemically synthesized
ttctggggtctggaggacag

SEQ ID NO: 345202 - DNA, 20 bp, Artificial Sequence
  chemically synthesized
aaaagagggccactgtcctc

SEQ ID NO: 345203 - DNA, 20 bp, Artificial Sequence
  chemically synthesized
ccattctggggtctggagga

SEQ ID NO: 345204 - DNA, 20 bp, Artificial Sequence
  chemically synthesized
tctaccattctggggtctgg

SEQ ID NO: 345205 - DNA, 20 bp, Artificial Sequence
  chemically synthesized
ggccactgtcctccagaccc

SEQ ID NO: 345206 - DNA, 20 bp, Artificial Sequence
  chemically synthesized
atctaccattctggggtctg

SEQ ID NO: 345207 - DNA, 20 bp, Artificial Sequence
  chemically synthesized
ggatctaccattctggggtc

SEQ ID NO: 345208 - DNA, 20 bp, Artificial Sequence
  chemically synthesized
ctgtcctccagaccccagaa

SEQ ID NO: 345209 - DNA, 20 bp, Artificial Sequence
  chemically synthesized
ccagtggatctaccattctg

SEQ ID NO: 345210 - DNA, 20 bp, Artificial Sequence
  chemically synthesized
tcctccagaccccagaatgg

SEQ ID NO: 345211 - DNA, 20 bp, Artificial Sequence
  chemically synthesized
gccagtggatctaccattct

SEQ ID NO: 345212 - DNA, 20 bp, Artificial Sequence
  chemically synthesized
tgccagtggatctaccattc

SEQ ID NO: 345213 - DNA, 20 bp, Artificial Sequence
  chemically synthesized
ccccagaatggtagatccac

SEQ ID NO: 345214 - DNA, 20 bp, Artificial Sequence
  chemically synthesized
cagaatggtagatccactgg

SEQ ID NO: 345215 - DNA, 20 bp, Artificial Sequence
  chemically synthesized
tgtgtgttgcaagctgccag

SEQ ID NO: 345216 - DNA, 20 bp, Artificial Sequence
  chemically synthesized
cggtgtgtgttgcaagctgc

SEQ ID NO: 345217 - DNA, 20 bp, Artificial Sequence
  chemically synthesized
ctttcctcggtgtgtgttgc

SEQ ID NO: 345218 - DNA, 20 bp, Artificial Sequence
  chemically synthesized
ggcagcttgcaacacacacc

SEQ ID NO: 345219 - DNA, 20 bp, Artificial Sequence
  chemically synthesized
gcagcttgcaacacacaccg

SEQ ID NO: 345220 - DNA, 20 bp, Artificial Sequence
  chemically synthesized
cttgcaacacacaccgagga

SEQ ID NO: 345221 - DNA, 20 bp, Artificial Sequence
  chemically synthesized
gcattgattgtggctttcct

SEQ ID NO: 345222 - DNA, 20 bp, Artificial Sequence
  chemically synthesized
tcatgagctggcattgattg

SEQ ID NO: 345223 - DNA, 20 bp, Artificial Sequence
  chemically synthesized
aggaaagccacaatcaatgc

SEQ ID NO: 345224 - DNA, 20 bp, Artificial Sequence
  chemically synthesized
tcctggatgctttcatgagc

SEQ ID NO: 345225 - DNA, 20 bp, Artificial Sequence
  chemically synthesized
caatcaatgccagctcatga

SEQ ID NO: 345226 - DNA, 20 bp, Artificial Sequence
  chemically synthesized
tccctcctggatgctttcat

SEQ ID NO: 345227 - DNA, 20 bp, Artificial Sequence
  chemically synthesized
tgccagctcatgaaagcatc

SEQ ID NO: 345228 - DNA, 20 bp, Artificial Sequence
  chemically synthesized
gccagctcatgaaagcatcc

SEQ ID NO: 345229 - DNA, 20 bp, Artificial Sequence
  chemically synthesized
cagctcatgaaagcatccag

SEQ ID NO: 345230 - DNA, 20 bp, Artificial Sequence
  chemically synthesized
agctcatgaaagcatccagg

SEQ ID NO: 345231 - DNA, 20 bp, Artificial Sequence
  chemically synthesized
gctcatgaaagcatccagga

SEQ ID NO: 345232 - DNA, 20 bp, Artificial Sequence
  chemically synthesized
tcatgaaagcatccaggagg

SEQ ID NO: 345233 - DNA, 20 bp, Artificial Sequence
  chemically synthesized
catgaaagcatccaggaggg

SEQ ID NO: 345234 - DNA, 20 bp, Artificial Sequence
  chemically synthesized
tcagggtacagcctccctcc

SEQ ID NO: 345235 - DNA, 20 bp, Artificial Sequence
  chemically synthesized
ccctgcggcttttcagggta

SEQ ID NO: 345236 - DNA, 20 bp, Artificial Sequence
  chemically synthesized
gagggaggctgtaccctgaa

SEQ ID NO: 345237 - DNA, 20 bp, Artificial Sequence
  chemically synthesized
tctgcccctgcggcttttca

SEQ ID NO: 345238 - DNA, 20 bp, Artificial Sequence
  chemically synthesized
ctctgcccctgcggcttttc

SEQ ID NO: 345239 - DNA, 20 bp, Artificial Sequence
  chemically synthesized
actctgcccctgcggctttt

SEQ ID NO: 345240 - DNA, 20 bp, Artificial Sequence
  chemically synthesized
ggctgtaccctgaaaagccg

SEQ ID NO: 345241 - DNA, 20 bp, Artificial Sequence
  chemically synthesized
gctgtaccctgaaaagccgc

SEQ ID NO: 345242 - DNA, 20 bp, Artificial Sequence
  chemically synthesized
ctgtaccctgaaaagccgca

SEQ ID NO: 345243 - DNA, 20 bp, Artificial Sequence
  chemically synthesized
tgtaccctgaaaagccgcag

SEQ ID NO: 345244 - DNA, 20 bp, Artificial Sequence
  chemically synthesized
accctgaaaagccgcagggg

SEQ ID NO: 345245 - DNA, 20 bp, Artificial Sequence
  chemically synthesized
cttgggccactctgcccctg

SEQ ID NO: 345246 - DNA, 20 bp, Artificial Sequence
  chemically synthesized
cctgaaaagccgcaggggca

SEQ ID NO: 345247 - DNA, 20 bp, Artificial Sequence
  chemically synthesized
gaaaagccgcaggggcagag

SEQ ID NO: 345248 - DNA, 20 bp, Artificial Sequence
  chemically synthesized
ccgcaggggcagagtggccc

SEQ ID NO: 345249 - DNA, 20 bp, Artificial Sequence
  chemically synthesized
agaggggttcacgtggtctt

SEQ ID NO: 345250 - DNA, 20 bp, Artificial Sequence
  chemically synthesized
gagaggggttcacgtggtct

SEQ ID NO: 345251 - DNA, 20 bp, Artificial Sequence
  chemically synthesized
atgcaagagaggggttcacg

SEQ ID NO: 345252 - DNA, 20 bp, Artificial Sequence
  chemically synthesized
gtcatgctgatgcaagagag

SEQ ID NO: 345253 - DNA, 20 bp, Artificial Sequence
  chemically synthesized
ggtcatgctgatgcaagaga

SEQ ID NO: 345254 - DNA, 20 bp, Artificial Sequence
  chemically synthesized
aggtcatgctgatgcaagag

SEQ ID NO: 345255 - DNA, 20 bp, Artificial Sequence
  chemically synthesized
caggtcatgctgatgcaaga

SEQ ID NO: 345256 - DNA, 20 bp, Artificial Sequence
  chemically synthesized
cgtgaacccctctcttgcat

SEQ ID NO: 345257 - DNA, 20 bp, Artificial Sequence
  chemically synthesized
tccaggtcatgctgatgcaa

SEQ ID NO: 345258 - DNA, 20 bp, Artificial Sequence
  chemically synthesized
catccaggtcatgctgatgc

SEQ ID NO: 345259 - DNA, 20 bp, Artificial Sequence
  chemically synthesized
tctcttgcatcagcatgacc

SEQ ID NO: 345260 - DNA, 20 bp, Artificial Sequence
  chemically synthesized
catcagcatgacctggatgt

SEQ ID NO: 345261 - DNA, 20 bp, Artificial Sequence
  chemically synthesized
tgactgcgtatctcacatcc

SEQ ID NO: 345262 - DNA, 20 bp, Artificial Sequence
  chemically synthesized
ttgactgcgtatctcacatc

SEQ ID NO: 345263 - DNA, 20 bp, Artificial Sequence
  chemically synthesized
tgacctggatgtgagatacg

SEQ ID NO: 345264 - DNA, 20 bp, Artificial Sequence
  chemically synthesized
ggatgtgagatacgcagtca

SEQ ID NO: 345265 - DNA, 20 bp, Artificial Sequence
  chemically synthesized
gatgtgagatacgcagtcaa

SEQ ID NO: 345266 - DNA, 20 bp, Artificial Sequence
  chemically synthesized
tgtgagatacgcagtcaaag

SEQ ID NO: 345267 - DNA, 20 bp, Artificial Sequence
  chemically synthesized
gcagtcaaaggagatcattt

SEQ ID NO: 345268 - DNA, 20 bp, Artificial Sequence
  chemically synthesized
agtcaaaggagatcattttg

SEQ ID NO: 345269 - DNA, 20 bp, Artificial Sequence
  chemically synthesized
ggagatcattttggagcttt

SEQ ID NO: 345270 - DNA, 20 bp, Artificial Sequence
  chemically synthesized
agcagggctgtcaaatctta

SEQ ID NO: 345271 - DNA, 20 bp, Artificial Sequence
  chemically synthesized
tttggagctttaagatttga

SEQ ID NO: 345272 - DNA, 20 bp, Artificial Sequence
  chemically synthesized
ttaagatttgacagccctgc

SEQ ID NO: 345273 - DNA, 20 bp, Artificial Sequence
  chemically synthesized
tgcaagtctgaaatccagca

SEQ ID NO: 345274 - DNA, 20 bp, Artificial Sequence
  chemically synthesized
atgcaagtctgaaatccagc

SEQ ID NO: 345275 - DNA, 20 bp, Artificial Sequence
  chemically synthesized
catgcaagtctgaaatccag

SEQ ID NO: 345276 - DNA, 20 bp, Artificial Sequence
  chemically synthesized
ttgacagccctgctggattt

SEQ ID NO: 345277 - DNA, 20 bp, Artificial Sequence
  chemically synthesized
gcacatgcaagtctgaaatc

SEQ ID NO: 345278 - DNA, 20 bp, Artificial Sequence
  chemically synthesized
aggggcttcagggcacatgc

SEQ ID NO: 345279 - DNA, 20 bp, Artificial Sequence
  chemically synthesized
tcagacttgcatgtgccctg

SEQ ID NO: 345280 - DNA, 20 bp, Artificial Sequence
  chemically synthesized
tccaaaacaaaggggcttca

SEQ ID NO: 345281 - DNA, 20 bp, Artificial Sequence
  chemically synthesized
gtccaaaacaaaggggcttc

SEQ ID NO: 345282 - DNA, 20 bp, Artificial Sequence
  chemically synthesized
tgtccaaaacaaaggggctt

SEQ ID NO: 345283 - DNA, 20 bp, Artificial Sequence
  chemically synthesized
agaaattgtccaaaacaaag

SEQ ID NO: 345284 - DNA, 20 bp, Artificial Sequence
  chemically synthesized
gccctgaagcccctttgttt

SEQ ID NO: 345285 - DNA, 20 bp, Artificial Sequence
  chemically synthesized
gagaaattgtccaaaacaaa

SEQ ID NO: 345286 - DNA, 20 bp, Artificial Sequence
  chemically synthesized
ggagaaattgtccaaaacaa

SEQ ID NO: 345287 - DNA, 20 bp, Artificial Sequence
  chemically synthesized
aggagaaattgtccaaaaca

SEQ ID NO: 345288 - DNA, 20 bp, Artificial Sequence
  chemically synthesized
tttggacaatttctcctatt

SEQ ID NO: 345289 - DNA, 20 bp, Artificial Sequence
  chemically synthesized
aatatagcccttccaaatag

SEQ ID NO: 345290 - DNA, 20 bp, Artificial Sequence
  chemically synthesized
ggacaatttctcctatttgg

SEQ ID NO: 345291 - DNA, 20 bp, Artificial Sequence
  chemically synthesized
gacaatttctcctatttgga

SEQ ID NO: 345292 - DNA, 20 bp, Artificial Sequence
  chemically synthesized
taaatatagcccttccaaat

SEQ ID NO: 345293 - DNA, 20 bp, Artificial Sequence
  chemically synthesized
acaatttctcctatttggaa

SEQ ID NO: 345294 - DNA, 20 bp, Artificial Sequence
  chemically synthesized
gtaaatatagcccttccaaa

SEQ ID NO: 345295 - DNA, 20 bp, Artificial Sequence
  chemically synthesized
ttacaggcattgggtaaata

SEQ ID NO: 345296 - DNA, 20 bp, Artificial Sequence
  chemically synthesized
acagtggggttacaggcatt

SEQ ID NO: 345297 - DNA, 20 bp, Artificial Sequence
  chemically synthesized
tacagtggggttacaggcat

SEQ ID NO: 345298 - DNA, 20 bp, Artificial Sequence
  chemically synthesized
cctagatacagtggggttac

SEQ ID NO: 345299 - DNA, 20 bp, Artificial Sequence
  chemically synthesized
tcctagatacagtggggtta

SEQ ID NO: 345300 - DNA, 20 bp, Artificial Sequence
  chemically synthesized
gttacttcctagatacagtg

SEQ ID NO: 345301 - DNA, 20 bp, Artificial Sequence
  chemically synthesized
agttacttcctagatacagt

SEQ ID NO: 345302 - DNA, 20 bp, Artificial Sequence
  chemically synthesized
gcctgtaaccccactgtatc

SEQ ID NO: 345303 - DNA, 20 bp, Artificial Sequence
  chemically synthesized
tagttacttcctagatacag

SEQ ID NO: 345304 - DNA, 20 bp, Artificial Sequence
  chemically synthesized
cctgtaaccccactgtatct

SEQ ID NO: 345305 - DNA, 20 bp, Artificial Sequence
  chemically synthesized
gattagttacttcctagata

SEQ ID NO: 345306 - DNA, 20 bp, Artificial Sequence
  chemically synthesized
gtaaccccactgtatctagg

SEQ ID NO: 345307 - DNA, 20 bp, Artificial Sequence
  chemically synthesized
aaagcagattagttacttcc

SEQ ID NO: 345308 - DNA, 20 bp, Artificial Sequence
  chemically synthesized
ctataaaatcaaaagcagat

SEQ ID NO: 345309 - DNA, 20 bp, Artificial Sequence
  chemically synthesized
tgagcctataaaatcaaaag

SEQ ID NO: 345310 - DNA, 20 bp, Artificial Sequence
  chemically synthesized
ctgtgagcctataaaatcaa

SEQ ID NO: 345311 - DNA, 20 bp, Artificial Sequence
  chemically synthesized
ctaatctgcttttgatttta

SEQ ID NO: 345312 - DNA, 20 bp, Artificial Sequence
  chemically synthesized
taatctgcttttgattttat

SEQ ID NO: 345313 - DNA, 20 bp, Artificial Sequence
  chemically synthesized
cttttgattttataggctca

SEQ ID NO: 345314 - DNA, 20 bp, Artificial Sequence
  chemically synthesized
ttttgattttataggctcac

SEQ ID NO: 345315 - DNA, 20 bp, Artificial Sequence
  chemically synthesized
tgattttataggctcacagg

SEQ ID NO: 345316 - DNA, 20 bp, Artificial Sequence
  chemically synthesized
ggcaatttccttctgcctgt

SEQ ID NO: 345317 - DNA, 20 bp, Artificial Sequence
  chemically synthesized
ttttataggctcacaggcag

SEQ ID NO: 345318 - DNA, 20 bp, Artificial Sequence
  chemically synthesized
tttataggctcacaggcaga

SEQ ID NO: 345319 - DNA, 20 bp, Artificial Sequence
  chemically synthesized
cagaaggaaattgccttatc

SEQ ID NO: 345320 - DNA, 20 bp, Artificial Sequence
  chemically synthesized
agaaggaaattgccttatct

SEQ ID NO: 345321 - DNA, 20 bp, Artificial Sequence
  chemically synthesized
ccaaagtgtcatcctagata

SEQ ID NO: 345322 - DNA, 20 bp, Artificial Sequence
  chemically synthesized
tccaaagtgtcatcctagat

SEQ ID NO: 345323 - DNA, 20 bp, Artificial Sequence
  chemically synthesized
cacagtccaaagtgtcatcc

SEQ ID NO: 345324 - DNA, 20 bp, Artificial Sequence
  chemically synthesized
ccttatctaggatgacactt

SEQ ID NO: 345325 - DNA, 20 bp, Artificial Sequence
  chemically synthesized
taggatgacactttggactg

SEQ ID NO: 345326 - DNA, 20 bp, Artificial Sequence
  chemically synthesized
actcaaaactccacagtcca

SEQ ID NO: 345327 - DNA, 20 bp, Artificial Sequence
  chemically synthesized
ggatgacactttggactgtg

SEQ ID NO: 345328 - DNA, 20 bp, Artificial Sequence
  chemically synthesized
ctcattaactcaaaactcca

SEQ ID NO: 345329 - DNA, 20 bp, Artificial Sequence
  chemically synthesized
actttggactgtggagtttt

SEQ ID NO: 345330 - DNA, 20 bp, Artificial Sequence
  chemically synthesized
ctgtggagttttgagttaat

SEQ ID NO: 345331 - DNA, 20 bp, Artificial Sequence
  chemically synthesized
tgtggagttttgagttaatg

SEQ ID NO: 345332 - DNA, 20 bp, Artificial Sequence
  chemically synthesized
gtggagttttgagttaatga

SEQ ID NO: 345333 - DNA, 20 bp, Artificial Sequence
  chemically synthesized
ttttgagttaatgagggaat

SEQ ID NO: 345334 - DNA, 20 bp, Artificial Sequence
  chemically synthesized
agttaatgagggaatgagta

SEQ ID NO: 345335 - DNA, 20 bp, Artificial Sequence
  chemically synthesized
gagggaatgagtaaagactt

SEQ ID NO: 345336 - DNA, 20 bp, Artificial Sequence
  chemically synthesized
gccttcccaacagtgcacca

SEQ ID NO: 345337 - DNA, 20 bp, Artificial Sequence
  chemically synthesized
taaagactttggtgcactgt

SEQ ID NO: 345338 - DNA, 20 bp, Artificial Sequence
  chemically synthesized
aaagactttggtgcactgtt

SEQ ID NO: 345339 - DNA, 20 bp, Artificial Sequence
  chemically synthesized
gactttggtgcactgttggg

SEQ ID NO: 345340 - DNA, 20 bp, Artificial Sequence
  chemically synthesized
actttggtgcactgttggga

SEQ ID NO: 345341 - DNA, 20 bp, Artificial Sequence
  chemically synthesized
aaccaatcttgccttcccaa

SEQ ID NO: 345342 - DNA, 20 bp, Artificial Sequence
  chemically synthesized
tggtgcactgttgggaaggc

SEQ ID NO: 345343 - DNA, 20 bp, Artificial Sequence
  chemically synthesized
cactgttgggaaggcaagat

SEQ ID NO: 345344 - DNA, 20 bp, Artificial Sequence
  chemically synthesized
caagattggttttcaaatgt

SEQ ID NO: 345345 - DNA, 20 bp, Artificial Sequence
  chemically synthesized
aagattggttttcaaatgtg

SEQ ID NO: 345346 - DNA, 20 bp, Artificial Sequence
  chemically synthesized
gttttcaaatgtgaggatat

SEQ ID NO: 345347 - DNA, 20 bp, Artificial Sequence
  chemically synthesized
aaatgtgaggatatgagatt

SEQ ID NO: 345348 - DNA, 20 bp, Artificial Sequence
  chemically synthesized
aatgtgaggatatgagattt

SEQ ID NO: 345349 - DNA, 20 bp, Artificial Sequence
  chemically synthesized
tgtgaggatatgagatttgg

SEQ ID NO: 345350 - DNA, 20 bp, Artificial Sequence
  chemically synthesized
gtgaggatatgagatttggg

SEQ ID NO: 345351 - DNA, 20 bp, Artificial Sequence
  chemically synthesized
tgaggatatgagatttggga

SEQ ID NO: 345352 - DNA, 20 bp, Artificial Sequence
  chemically synthesized
gaggatatgagatttgggag

SEQ ID NO: 345353 - DNA, 20 bp, Artificial Sequence
  chemically synthesized
atatgagatttgggaggggc

SEQ ID NO: 345354 - DNA, 20 bp, Artificial Sequence
  chemically synthesized
tatgagatttgggaggggcc

SEQ ID NO: 345355 - DNA, 20 bp, Artificial Sequence
  chemically synthesized
atgagatttgggaggggccg

SEQ ID NO: 345356 - DNA, 20 bp, Artificial Sequence
  chemically synthesized
tgagatttgggaggggccgg

SEQ ID NO: 345357 - DNA, 20 bp, Artificial Sequence
  chemically synthesized
gatttgggaggggccggggg

SEQ ID NO: 345358 - DNA, 20 bp, Artificial Sequence
  chemically synthesized
aaaccatatcattccacccc

SEQ ID NO: 345359 - DNA, 20 bp, Artificial Sequence
  chemically synthesized
gggccgggggtggaatgata

SEQ ID NO: 345360 - DNA, 20 bp, Artificial Sequence
  chemically synthesized
gggggtggaatgatatggtt

SEQ ID NO: 345361 - DNA, 20 bp, Artificial Sequence
  chemically synthesized
tggaatgatatggtttggct

SEQ ID NO: 345362 - DNA, 20 bp, Artificial Sequence
  chemically synthesized
atgagatttgggtggggact

SEQ ID NO: 345363 - DNA, 20 bp, Artificial Sequence
  chemically synthesized
ttcaagatgagatttgggtg

SEQ ID NO: 345364 - DNA, 20 bp, Artificial Sequence
  chemically synthesized
attcaagatgagatttgggt

SEQ ID NO: 345365 - DNA, 20 bp, Artificial Sequence
  chemically synthesized
aattcaagatgagatttggg

SEQ ID NO: 345366 - DNA, 20 bp, Artificial Sequence
  chemically synthesized
gggaattcaagatgagattt

SEQ ID NO: 345367 - DNA, 20 bp, Artificial Sequence
  chemically synthesized
tgggaattcaagatgagatt

SEQ ID NO: 345368 - DNA, 20 bp, Artificial Sequence
  chemically synthesized
aacatgtgggaattcaagat

SEQ ID NO: 345369 - DNA, 20 bp, Artificial Sequence
  chemically synthesized
ctgacaacatgtgggaattc

SEQ ID NO: 345370 - DNA, 20 bp, Artificial Sequence
  chemically synthesized
gggatcctctgacaacatgt

SEQ ID NO: 345371 - DNA, 20 bp, Artificial Sequence
  chemically synthesized
agggatcctctgacaacatg

SEQ ID NO: 345372 - DNA, 20 bp, Artificial Sequence
  chemically synthesized
cttgaattcccacatgttgt

SEQ ID NO: 345373 - DNA, 20 bp, Artificial Sequence
  chemically synthesized
tgaattcccacatgttgtca

SEQ ID NO: 345374 - DNA, 20 bp, Artificial Sequence
  chemically synthesized
gaattcccacatgttgtcag

SEQ ID NO: 345375 - DNA, 20 bp, Artificial Sequence
  chemically synthesized
atgttgtcagaggatccctg

SEQ ID NO: 345376 - DNA, 20 bp, Artificial Sequence
  chemically synthesized
tgttgtcagaggatccctgt

SEQ ID NO: 345377 - DNA, 20 bp, Artificial Sequence
  chemically synthesized
ttgtcagaggatccctgtgg

SEQ ID NO: 345378 - DNA, 20 bp, Artificial Sequence
  chemically synthesized
tgtcagaggatccctgtggg

SEQ ID NO: 345379 - DNA, 20 bp, Artificial Sequence
  chemically synthesized
tgattcaattacctcccaca

SEQ ID NO: 345380 - DNA, 20 bp, Artificial Sequence
  chemically synthesized
atgattcaattacctcccac

SEQ ID NO: 345381 - DNA, 20 bp, Artificial Sequence
  chemically synthesized
catgattcaattacctccca

SEQ ID NO: 345382 - DNA, 20 bp, Artificial Sequence
  chemically synthesized
tgtgggaggtaattgaatca

SEQ ID NO: 345383 - DNA, 20 bp, Artificial Sequence
  chemically synthesized
gtgggaggtaattgaatcat

SEQ ID NO: 345384 - DNA, 20 bp, Artificial Sequence
  chemically synthesized
tgggaggtaattgaatcatg

SEQ ID NO: 345385 - DNA, 20 bp, Artificial Sequence
  chemically synthesized
aggtaattgaatcatgggga

SEQ ID NO: 345386 - DNA, 20 bp, Artificial Sequence
  chemically synthesized
ggtaattgaatcatggggac

SEQ ID NO: 345387 - DNA, 20 bp, Artificial Sequence
  chemically synthesized
accacaagaacagcatggga

SEQ ID NO: 345388 - DNA, 20 bp, Artificial Sequence
  chemically synthesized
cactaccacaagaacagcat

SEQ ID NO: 345389 - DNA, 20 bp, Artificial Sequence
  chemically synthesized
tcactaccacaagaacagca

SEQ ID NO: 345390 - DNA, 20 bp, Artificial Sequence
  chemically synthesized
tctttcccatgctgttcttg

SEQ ID NO: 345391 - DNA, 20 bp, Artificial Sequence
  chemically synthesized
gactttcactaccacaagaa

SEQ ID NO: 345392 - DNA, 20 bp, Artificial Sequence
  chemically synthesized
ttcccatgctgttcttgtgg

SEQ ID NO: 345393 - DNA, 20 bp, Artificial Sequence
  chemically synthesized
cgtgagactttcactaccac

SEQ ID NO: 345394 - DNA, 20 bp, Artificial Sequence
  chemically synthesized
tgctgttcttgtggtagtga

SEQ ID NO: 345395 - DNA, 20 bp, Artificial Sequence
  chemically synthesized
tgtggtagtgaaagtctcac

SEQ ID NO: 345396 - DNA, 20 bp, Artificial Sequence
  chemically synthesized
acaaagccatcagatctcgt

SEQ ID NO: 345397 - DNA, 20 bp, Artificial Sequence
  chemically synthesized
gaaagtctcacgagatctga

SEQ ID NO: 345398 - DNA, 20 bp, Artificial Sequence
  chemically synthesized
aactccacttacaaagccat

SEQ ID NO: 345399 - DNA, 20 bp, Artificial Sequence
  chemically synthesized
acgagatctgatggctttgt

SEQ ID NO: 345400 - DNA, 20 bp, Artificial Sequence
  chemically synthesized
agatctgatggctttgtaag

SEQ ID NO: 345401 - DNA, 20 bp, Artificial Sequence
  chemically synthesized
gcagggaaactccacttaca

SEQ ID NO: 345402 - DNA, 20 bp, Artificial Sequence
  chemically synthesized
atctgatggctttgtaagtg

SEQ ID NO: 345403 - DNA, 20 bp, Artificial Sequence
  chemically synthesized
taagtggagtttccctgcac

SEQ ID NO: 345404 - DNA, 20 bp, Artificial Sequence
  chemically synthesized
gggcaaagaaagcttgtgca

SEQ ID NO: 345405 - DNA, 20 bp, Artificial Sequence
  chemically synthesized
agggcaaagaaagcttgtgc

SEQ ID NO: 345406 - DNA, 20 bp, Artificial Sequence
  chemically synthesized
gagggcaaagaaagcttgtg

SEQ ID NO: 345407 - DNA, 20 bp, Artificial Sequence
  chemically synthesized
ggaatgacagagggcaaaga

SEQ ID NO: 345408 - DNA, 20 bp, Artificial Sequence
  chemically synthesized
tacaggaatgacagagggca

SEQ ID NO: 345409 - DNA, 20 bp, Artificial Sequence
  chemically synthesized
cattttacaggaatgacaga

SEQ ID NO: 345410 - DNA, 20 bp, Artificial Sequence
  chemically synthesized
acattttacaggaatgacag

SEQ ID NO: 345411 - DNA, 20 bp, Artificial Sequence
  chemically synthesized
cacattttacaggaatgaca

SEQ ID NO: 345412 - DNA, 20 bp, Artificial Sequence
  chemically synthesized
gtcacattttacaggaatga

SEQ ID NO: 345413 - DNA, 20 bp, Artificial Sequence
  chemically synthesized
aggagtaagtcacattttac

SEQ ID NO: 345414 - DNA, 20 bp, Artificial Sequence
  chemically synthesized
gaggagtaagtcacatttta

SEQ ID NO: 345415 - DNA, 20 bp, Artificial Sequence
  chemically synthesized
ggtggaaggcaaggaggagt

SEQ ID NO: 345416 - DNA, 20 bp, Artificial Sequence
  chemically synthesized
tcatggtggaaggcaaggag

SEQ ID NO: 345417 - DNA, 20 bp, Artificial Sequence
  chemically synthesized
aatcatggtggaaggcaagg

SEQ ID NO: 345418 - DNA, 20 bp, Artificial Sequence
  chemically synthesized
caatcatggtggaaggcaag

SEQ ID NO: 345419 - DNA, 20 bp, Artificial Sequence
  chemically synthesized
cacaatcatggtggaaggca

SEQ ID NO: 345420 - DNA, 20 bp, Artificial Sequence
  chemically synthesized
tcacaatcatggtggaaggc

SEQ ID NO: 345421 - DNA, 20 bp, Artificial Sequence
  chemically synthesized
agcctcacaatcatggtgga

SEQ ID NO: 345422 - DNA, 20 bp, Artificial Sequence
  chemically synthesized
aagcctcacaatcatggtgg

SEQ ID NO: 345423 - DNA, 20 bp, Artificial Sequence
  chemically synthesized
gggaagcctcacaatcatgg

SEQ ID NO: 345424 - DNA, 20 bp, Artificial Sequence
  chemically synthesized
ttgccttccaccatgattgt

SEQ ID NO: 345425 - DNA, 20 bp, Artificial Sequence
  chemically synthesized
atggggaagcctcacaatca

SEQ ID NO: 345426 - DNA, 20 bp, Artificial Sequence
  chemically synthesized
tgccttccaccatgattgtg

SEQ ID NO: 345427 - DNA, 20 bp, Artificial Sequence
  chemically synthesized
gcaattctatgtggatgggg

SEQ ID NO: 345428 - DNA, 20 bp, Artificial Sequence
  chemically synthesized
cttgcaattctatgtggatg

SEQ ID NO: 345429 - DNA, 20 bp, Artificial Sequence
  chemically synthesized
gtgaggcttccccatccaca

SEQ ID NO: 345430 - DNA, 20 bp, Artificial Sequence
  chemically synthesized
acttgcaattctatgtggat

SEQ ID NO: 345431 - DNA, 20 bp, Artificial Sequence
  chemically synthesized
gacttgcaattctatgtgga

SEQ ID NO: 345432 - DNA, 20 bp, Artificial Sequence
  chemically synthesized
aatagacttgcaattctatg

SEQ ID NO: 345433 - DNA, 20 bp, Artificial Sequence
  chemically synthesized
ccccatccacatagaattgc

SEQ ID NO: 345434 - DNA, 20 bp, Artificial Sequence
  chemically synthesized
atacagcaaaaagggtttaa

SEQ ID NO: 345435 - DNA, 20 bp, Artificial Sequence
  chemically synthesized
ggtaatttatacagcaaaaa

SEQ ID NO: 345436 - DNA, 20 bp, Artificial Sequence
  chemically synthesized
gggtaatttatacagcaaaa

SEQ ID NO: 345437 - DNA, 20 bp, Artificial Sequence
  chemically synthesized
tgggtaatttatacagcaaa

SEQ ID NO: 345438 - DNA, 20 bp, Artificial Sequence
  chemically synthesized
ctgagattgggtaatttata

SEQ ID NO: 345439 - DNA, 20 bp, Artificial Sequence
  chemically synthesized
ctgtataaattacccaatct

SEQ ID NO: 345440 - DNA, 20 bp, Artificial Sequence
  chemically synthesized
tgtataaattacccaatctc

SEQ ID NO: 345441 - DNA, 20 bp, Artificial Sequence
  chemically synthesized
ataaagagatacctgagatt

SEQ ID NO: 345442 - DNA, 20 bp, Artificial Sequence
  chemically synthesized
gataaagagatacctgagat

SEQ ID NO: 345443 - DNA, 20 bp, Artificial Sequence
  chemically synthesized
ctgctgataaagagatacct

SEQ ID NO: 345444 - DNA, 20 bp, Artificial Sequence
  chemically synthesized
aatctcaggtatctctttat

SEQ ID NO: 345445 - DNA, 20 bp, Artificial Sequence
  chemically synthesized
gttttcatgctgctgataaa

SEQ ID NO: 345446 - DNA, 20 bp, Artificial Sequence
  chemically synthesized
ctcaggtatctctttatcag

SEQ ID NO: 345447 - DNA, 20 bp, Artificial Sequence
  chemically synthesized
ccgttttcatgctgctgata

SEQ ID NO: 345448 - DNA, 20 bp, Artificial Sequence
  chemically synthesized
ctttatcagcagcatgaaaa

SEQ ID NO: 345449 - DNA, 20 bp, Artificial Sequence
  chemically synthesized
atgaaaacggactaatacac

SEQ ID NO: 345450 - DNA, 20 bp, Artificial Sequence
  chemically synthesized
agaagtcagtgcttgtgtat

SEQ ID NO: 345451 - DNA, 20 bp, Artificial Sequence
  chemically synthesized
tgttctaagcagggagaagt

SEQ ID NO: 345452 - DNA, 20 bp, Artificial Sequence
  chemically synthesized
aaggtgttctaagcagggag

SEQ ID NO: 345453 - DNA, 20 bp, Artificial Sequence
  chemically synthesized
agcactgacttctccctgct

SEQ ID NO: 345454 - DNA, 20 bp, Artificial Sequence
  chemically synthesized
ggaaaggtgttctaagcagg

SEQ ID NO: 345455 - DNA, 20 bp, Artificial Sequence
  chemically synthesized
atggaaaggtgttctaagca

SEQ ID NO: 345456 - DNA, 20 bp, Artificial Sequence
  chemically synthesized
gatggaaaggtgttctaagc

SEQ ID NO: 345457 - DNA, 20 bp, Artificial Sequence
  chemically synthesized
ggatggaaaggtgttctaag

SEQ ID NO: 345458 - DNA, 20 bp, Artificial Sequence
  chemically synthesized
tggggatggaaaggtgttct

SEQ ID NO: 345459 - DNA, 20 bp, Artificial Sequence
  chemically synthesized
aaatacaggtggggatggaa

SEQ ID NO: 345460 - DNA, 20 bp, Artificial Sequence
  chemically synthesized
aaaatacaggtggggatgga

SEQ ID NO: 345461 - DNA, 20 bp, Artificial Sequence
  chemically synthesized
gaggaaaatacaggtgggga

SEQ ID NO: 345462 - DNA, 20 bp, Artificial Sequence
  chemically synthesized
gagggaggaaaatacaggtg

SEQ ID NO: 345463 - DNA, 20 bp, Artificial Sequence
  chemically synthesized
tgagggaggaaaatacaggt

SEQ ID NO: 345464 - DNA, 20 bp, Artificial Sequence
  chemically synthesized
atgagggaggaaaatacagg

SEQ ID NO: 345465 - DNA, 20 bp, Artificial Sequence
  chemically synthesized
ggcatgagggaggaaaatac

SEQ ID NO: 345466 - DNA, 20 bp, Artificial Sequence
  chemically synthesized
aggcatgagggaggaaaata

SEQ ID NO: 345467 - DNA, 20 bp, Artificial Sequence
  chemically synthesized
agagggtaaaggcatgaggg

SEQ ID NO: 345468 - DNA, 20 bp, Artificial Sequence
  chemically synthesized
aagagggtaaaggcatgagg

SEQ ID NO: 345469 - DNA, 20 bp, Artificial Sequence
  chemically synthesized
ggaagagggtaaaggcatga

SEQ ID NO: 345470 - DNA, 20 bp, Artificial Sequence
  chemically synthesized
aggaagagggtaaaggcatg

SEQ ID NO: 345471 - DNA, 20 bp, Artificial Sequence
  chemically synthesized
aaggaagagggtaaaggcat

SEQ ID NO: 345472 - DNA, 20 bp, Artificial Sequence
  chemically synthesized
gtggagaaggaagagggtaa

SEQ ID NO: 345473 - DNA, 20 bp, Artificial Sequence
  chemically synthesized
tgtggagaaggaagagggta

SEQ ID NO: 345474 - DNA, 20 bp, Artificial Sequence
  chemically synthesized
cttgttgtggagaaggaaga

SEQ ID NO: 345475 - DNA, 20 bp, Artificial Sequence
  chemically synthesized
gcttgttgtggagaaggaag

SEQ ID NO: 345476 - DNA, 20 bp, Artificial Sequence
  chemically synthesized
agcttgttgtggagaaggaa

SEQ ID NO: 345477 - DNA, 20 bp, Artificial Sequence
  chemically synthesized
ctagcttgttgtggagaagg

SEQ ID NO: 345478 - DNA, 20 bp, Artificial Sequence
  chemically synthesized
gtactagcttgttgtggaga

SEQ ID NO: 345479 - DNA, 20 bp, Artificial Sequence
  chemically synthesized
ggtactagcttgttgtggag

SEQ ID NO: 345480 - DNA, 20 bp, Artificial Sequence
  chemically synthesized
ccctcttccttctccacaac

SEQ ID NO: 345481 - DNA, 20 bp, Artificial Sequence
  chemically synthesized
ctgggtactagcttgttgtg

SEQ ID NO: 345482 - DNA, 20 bp, Artificial Sequence
  chemically synthesized
gtctgggtactagcttgttg

SEQ ID NO: 345483 - DNA, 20 bp, Artificial Sequence
  chemically synthesized
cttccttctccacaacaagc

SEQ ID NO: 345484 - DNA, 20 bp, Artificial Sequence
  chemically synthesized
ctccacaacaagctagtacc

SEQ ID NO: 345485 - DNA, 20 bp, Artificial Sequence
  chemically synthesized
ttagatggaagtctgggtac

SEQ ID NO: 345486 - DNA, 20 bp, Artificial Sequence
  chemically synthesized
tgatatttagatggaagtct

SEQ ID NO: 345487 - DNA, 20 bp, Artificial Sequence
  chemically synthesized
gtgatatttagatggaagtc

SEQ ID NO: 345488 - DNA, 20 bp, Artificial Sequence
  chemically synthesized
aggaagtgatatttagatgg

SEQ ID NO: 345489 - DNA, 20 bp, Artificial Sequence
  chemically synthesized
tgaaggaagtgatatttaga

SEQ ID NO: 345490 - DNA, 20 bp, Artificial Sequence
  chemically synthesized
tttttgaaggaagtgatatt

SEQ ID NO: 345491 - DNA, 20 bp, Artificial Sequence
  chemically synthesized
aaatgaagtctttttgaagg

SEQ ID NO: 345492 - DNA, 20 bp, Artificial Sequence
  chemically synthesized
taaatatcacttccttcaaa

SEQ ID NO: 345493 - DNA, 20 bp, Artificial Sequence
  chemically synthesized
aagaaatgaagtctttttga

SEQ ID NO: 345494 - DNA, 20 bp, Artificial Sequence
  chemically synthesized
taagaaatgaagtctttttg

SEQ ID NO: 345495 - DNA, 20 bp, Artificial Sequence
  chemically synthesized
atctggaggaataagaaatg

SEQ ID NO: 345496 - DNA, 20 bp, Artificial Sequence
  chemically synthesized
gacttcatttcttattcctc

SEQ ID NO: 345497 - DNA, 20 bp, Artificial Sequence
  chemically synthesized
gaatctgtatctggaggaat

SEQ ID NO: 345498 - DNA, 20 bp, Artificial Sequence
  chemically synthesized
atttcttattcctccagata

SEQ ID NO: 345499 - DNA, 20 bp, Artificial Sequence
  chemically synthesized
atcagggaatctgtatctgg

SEQ ID NO: 345500 - DNA, 20 bp, Artificial Sequence
  chemically synthesized
aatcagggaatctgtatctg

SEQ ID NO: 345501 - DNA, 20 bp, Artificial Sequence
  chemically synthesized
taaatcagggaatctgtatc

SEQ ID NO: 345502 - DNA, 20 bp, Artificial Sequence
  chemically synthesized
gctataaaaatagtaaatca

SEQ ID NO: 345503 - DNA, 20 bp, Artificial Sequence
  chemically synthesized
tgctataaaaatagtaaatc

SEQ ID NO: 345504 - DNA, 20 bp, Artificial Sequence
  chemically synthesized
gtgctataaaaatagtaaat

SEQ ID NO: 345505 - DNA, 20 bp, Artificial Sequence
  chemically synthesized
tccctgatttactattttta

SEQ ID NO: 345506 - DNA, 20 bp, Artificial Sequence
  chemically synthesized
aattcagagtgctataaaaa

SEQ ID NO: 345507 - DNA, 20 bp, Artificial Sequence
  chemically synthesized
tgtgtactatttaaaattca

SEQ ID NO: 345508 - DNA, 20 bp, Artificial Sequence
  chemically synthesized
gatgtgtactatttaaaatt

SEQ ID NO: 345509 - DNA, 20 bp, Artificial Sequence
  chemically synthesized
atagcactctgaattttaaa

SEQ ID NO: 345510 - DNA, 20 bp, Artificial Sequence
  chemically synthesized
gcataattatgattgtataa

SEQ ID NO: 345511 - DNA, 20 bp, Artificial Sequence
  chemically synthesized
ttatacaatcataattatgc

SEQ ID NO: 345512 - DNA, 20 bp, Artificial Sequence
  chemically synthesized
tattgtcttttgaggaatac

SEQ ID NO: 345513 - DNA, 20 bp, Artificial Sequence
  chemically synthesized
attatgctggtattcctcaa

SEQ ID NO: 345514 - DNA, 20 bp, Artificial Sequence
  chemically synthesized
ttggaatatattgtcttttg

SEQ ID NO: 345515 - DNA, 20 bp, Artificial Sequence
  chemically synthesized
cttggaatatattgtctttt

SEQ ID NO: 345516 - DNA, 20 bp, Artificial Sequence
  chemically synthesized
ctcaaaagacaatatattcc

SEQ ID NO: 345517 - DNA, 20 bp, Artificial Sequence
  chemically synthesized
gacaatatattccaagacat

SEQ ID NO: 345518 - DNA, 20 bp, Artificial Sequence
  chemically synthesized
ataagaaaaggctcatgtct

SEQ ID NO: 345519 - DNA, 20 bp, Artificial Sequence
  chemically synthesized
tttattgaagacataagaaa

SEQ ID NO: 345520 - DNA, 20 bp, Artificial Sequence
  chemically synthesized
atttattgaagacataagaa

SEQ ID NO: 345521 - DNA, 20 bp, Artificial Sequence
  chemically synthesized
aatgaatttattgaagacat

SEQ ID NO: 345522 - DNA, 20 bp, Artificial Sequence
  chemically synthesized
aggcctgaatgaatttattg

SEQ ID NO: 345523 - DNA, 20 bp, Artificial Sequence
  chemically synthesized
atgtcttcaataaattcatt

SEQ ID NO: 345524 - DNA, 20 bp, Artificial Sequence
  chemically synthesized
tgtcttcaataaattcattc

SEQ ID NO: 345525 - DNA, 20 bp, Artificial Sequence
  chemically synthesized
ataaattcattcaggcctaa

SEQ ID NO: 345526 - DNA, 20 bp, Artificial Sequence
  chemically synthesized
tatgggcaaagtgttctgtt

SEQ ID NO: 345527 - DNA, 20 bp, Artificial Sequence
  chemically synthesized
ctatgggcaaagtgttctgt

SEQ ID NO: 345528 - DNA, 20 bp, Artificial Sequence
  chemically synthesized
ctaacagaacactttgccca

SEQ ID NO: 345529 - DNA, 20 bp, Artificial Sequence
  chemically synthesized
taacagaacactttgcccat

SEQ ID NO: 345530 - DNA, 20 bp, Artificial Sequence
  chemically synthesized
ttaagcacctcctatgggca

SEQ ID NO: 345531 - DNA, 20 bp, Artificial Sequence
  chemically synthesized
acagaacactttgcccatag

SEQ ID NO: 345532 - DNA, 20 bp, Artificial Sequence
  chemically synthesized
cagaacactttgcccatagg

SEQ ID NO: 345533 - DNA, 20 bp, Artificial Sequence
  chemically synthesized
gttcattaagcacctcctat

SEQ ID NO: 345534 - DNA, 20 bp, Artificial Sequence
  chemically synthesized
tgttcattaagcacctccta

SEQ ID NO: 345535 - DNA, 20 bp, Artificial Sequence
  chemically synthesized
aaattccataaatgttcatt

SEQ ID NO: 345536 - DNA, 20 bp, Artificial Sequence
  chemically synthesized
aggtgcttaatgaacattta

SEQ ID NO: 345537 - DNA, 20 bp, Artificial Sequence
  chemically synthesized
atgaacatttatggaattta

SEQ ID NO: 345538 - DNA, 20 bp, Artificial Sequence
  chemically synthesized
tatggaatttatagttcttc

SEQ ID NO: 345539 - DNA, 20 bp, Artificial Sequence
  chemically synthesized
atttatagttcttccagatg

SEQ ID NO: 345540 - DNA, 20 bp, Artificial Sequence
  chemically synthesized
caaagtcgaaccacatctgg

SEQ ID NO: 345541 - DNA, 20 bp, Artificial Sequence
  chemically synthesized
atgcaaagtcgaaccacatc

SEQ ID NO: 345542 - DNA, 20 bp, Artificial Sequence
  chemically synthesized
atgtggttcgactttgcatt

SEQ ID NO: 345543 - DNA, 20 bp, Artificial Sequence
  chemically synthesized
tctaaggtagactcaatgca

SEQ ID NO: 345544 - DNA, 20 bp, Artificial Sequence
  chemically synthesized
actttgcattgagtctacct

SEQ ID NO: 345545 - DNA, 20 bp, Artificial Sequence
  chemically synthesized
tgaaaaacaaatttctaagg

SEQ ID NO: 345546 - DNA, 20 bp, Artificial Sequence
  chemically synthesized
gtatgaaaaacaaatttcta

SEQ ID NO: 345547 - DNA, 20 bp, Artificial Sequence
  chemically synthesized
agtatgaaaaacaaatttct

SEQ ID NO: 345548 - DNA, 20 bp, Artificial Sequence
  chemically synthesized
atttgtttttcatactcata

SEQ ID NO: 345549 - DNA, 20 bp, Artificial Sequence
  chemically synthesized
gtcaaataggaaatctttat

SEQ ID NO: 345550 - DNA, 20 bp, Artificial Sequence
  chemically synthesized
agggtttgtggtggtcaaat

SEQ ID NO: 345551 - DNA, 20 bp, Artificial Sequence
  chemically synthesized
gagggtttgtggtggtcaaa

SEQ ID NO: 345552 - DNA, 20 bp, Artificial Sequence
  chemically synthesized
gcagtgcagagggtttgtgg

SEQ ID NO: 345553 - DNA, 20 bp, Artificial Sequence
  chemically synthesized
gtggcagtgcagagggtttg

SEQ ID NO: 345554 - DNA, 20 bp, Artificial Sequence
  chemically synthesized
actatgagtggcagtgcaga

SEQ ID NO: 345555 - DNA, 20 bp, Artificial Sequence
  chemically synthesized
tactatgagtggcagtgcag

SEQ ID NO: 345556 - DNA, 20 bp, Artificial Sequence
  chemically synthesized
ttactatgagtggcagtgca

SEQ ID NO: 345557 - DNA, 20 bp, Artificial Sequence
  chemically synthesized
gcttactatgagtggcagtg

SEQ ID NO: 345558 - DNA, 20 bp, Artificial Sequence
  chemically synthesized
accctctgcactgccactca

SEQ ID NO: 345559 - DNA, 20 bp, Artificial Sequence
  chemically synthesized
gtgtggcttactatgagtgg

SEQ ID NO: 345560 - DNA, 20 bp, Artificial Sequence
  chemically synthesized
cctgtgtggcttactatgag

SEQ ID NO: 345561 - DNA, 20 bp, Artificial Sequence
  chemically synthesized
tctgcactgccactcatagt

SEQ ID NO: 345562 - DNA, 20 bp, Artificial Sequence
  chemically synthesized
ctccctgtgtggcttactat

SEQ ID NO: 345563 - DNA, 20 bp, Artificial Sequence
  chemically synthesized
gccactcatagtaagccaca

SEQ ID NO: 345564 - DNA, 20 bp, Artificial Sequence
  chemically synthesized
ccactcatagtaagccacac

SEQ ID NO: 345565 - DNA, 20 bp, Artificial Sequence
  chemically synthesized
cactcatagtaagccacaca

SEQ ID NO: 345566 - DNA, 20 bp, Artificial Sequence
  chemically synthesized
ctcatagtaagccacacagg

SEQ ID NO: 345567 - DNA, 20 bp, Artificial Sequence
  chemically synthesized
gttggagtatactccctgtg

SEQ ID NO: 345568 - DNA, 20 bp, Artificial Sequence
  chemically synthesized
acagggagtatactccaacc

SEQ ID NO: 345569 - DNA, 20 bp, Artificial Sequence
  chemically synthesized
tttgtactgaagcttggttg

SEQ ID NO: 345570 - DNA, 20 bp, Artificial Sequence
  chemically synthesized
aatttgtactgaagcttggt

SEQ ID NO: 345571 - DNA, 20 bp, Artificial Sequence
  chemically synthesized
agtatactccaaccaagctt

SEQ ID NO: 345572 - DNA, 20 bp, Artificial Sequence
  chemically synthesized
gaagaatttgtactgaagct

SEQ ID NO: 345573 - DNA, 20 bp, Artificial Sequence
  chemically synthesized
tgagggaagaatttgtactg

SEQ ID NO: 345574 - DNA, 20 bp, Artificial Sequence
  chemically synthesized
ttcagtacaaattcttccct

SEQ ID NO: 345575 - DNA, 20 bp, Artificial Sequence
  chemically synthesized
agaacacccacagctgaggg

SEQ ID NO: 345576 - DNA, 20 bp, Artificial Sequence
  chemically synthesized
acaaattcttccctcagctg

SEQ ID NO: 345577 - DNA, 20 bp, Artificial Sequence
  chemically synthesized
tatagaacacccacagctga

SEQ ID NO: 345578 - DNA, 20 bp, Artificial Sequence
  chemically synthesized
caaattcttccctcagctgt

SEQ ID NO: 345579 - DNA, 20 bp, Artificial Sequence
  chemically synthesized
ttatagaacacccacagctg

SEQ ID NO: 345580 - DNA, 20 bp, Artificial Sequence
  chemically synthesized
gttatagaacacccacagct

SEQ ID NO: 345581 - DNA, 20 bp, Artificial Sequence
  chemically synthesized
taaatgttatagaacaccca

SEQ ID NO: 345582 - DNA, 20 bp, Artificial Sequence
  chemically synthesized
agaaagccaattaaatgtta

SEQ ID NO: 345583 - DNA, 20 bp, Artificial Sequence
  chemically synthesized
ggtgttctataacatttaat

SEQ ID NO: 345584 - DNA, 20 bp, Artificial Sequence
  chemically synthesized
atttgtgtcagattttaaga

SEQ ID NO: 345585 - DNA, 20 bp, Artificial Sequence
  chemically synthesized
agttatttgtgtcagatttt

SEQ ID NO: 345586 - DNA, 20 bp, Artificial Sequence
  chemically synthesized
gagtctttagttatttgtgt

SEQ ID NO: 345587 - DNA, 20 bp, Artificial Sequence
  chemically synthesized
aaatctgacacaaataacta

SEQ ID NO: 345588 - DNA, 20 bp, Artificial Sequence
  chemically synthesized
gacaaagcatcaagagtctt

SEQ ID NO: 345589 - DNA, 20 bp, Artificial Sequence
  chemically synthesized
ttgctctgacaaagcatcaa

SEQ ID NO: 345590 - DNA, 20 bp, Artificial Sequence
  chemically synthesized
ctttgctctgacaaagcatc

SEQ ID NO: 345591 - DNA, 20 bp, Artificial Sequence
  chemically synthesized
aaagactcttgatgctttgt

SEQ ID NO: 345592 - DNA, 20 bp, Artificial Sequence
  chemically synthesized
agactcttgatgctttgtca

SEQ ID NO: 345593 - DNA, 20 bp, Artificial Sequence
  chemically synthesized
cacactcctttgctctgaca

SEQ ID NO: 345594 - DNA, 20 bp, Artificial Sequence
  chemically synthesized
cttgatgctttgtcagagca

SEQ ID NO: 345595 - DNA, 20 bp, Artificial Sequence
  chemically synthesized
ttgatgctttgtcagagcaa

SEQ ID NO: 345596 - DNA, 20 bp, Artificial Sequence
  chemically synthesized
gatgctttgtcagagcaaag

SEQ ID NO: 345597 - DNA, 20 bp, Artificial Sequence
  chemically synthesized
gtagtatttagaggagataa

SEQ ID NO: 345598 - DNA, 20 bp, Artificial Sequence
  chemically synthesized
gtataatgtagtatttagag

SEQ ID NO: 345599 - DNA, 20 bp, Artificial Sequence
  chemically synthesized
tagtataatgtagtatttag

SEQ ID NO: 345600 - DNA, 20 bp, Artificial Sequence
  chemically synthesized
atagtataatgtagtattta

SEQ ID NO: 345601 - DNA, 20 bp, Artificial Sequence
  chemically synthesized
gtatagtataatgtagtatt

SEQ ID NO: 345602 - DNA, 20 bp, Artificial Sequence
  chemically synthesized
atacaaagtatagtataatg

SEQ ID NO: 345603 - DNA, 20 bp, Artificial Sequence
  chemically synthesized
cagaaatatgatacaaagta

SEQ ID NO: 345604 - DNA, 20 bp, Artificial Sequence
  chemically synthesized
attaacagaaatatgataca

SEQ ID NO: 345605 - DNA, 20 bp, Artificial Sequence
  chemically synthesized
gtatcatatttctgttaatt

SEQ ID NO: 345606 - DNA, 20 bp, Artificial Sequence
  chemically synthesized
ttctaaaaatgctaaattaa

SEQ ID NO: 345607 - DNA, 20 bp, Artificial Sequence
  chemically synthesized
ttctgttaatttagcatttt

SEQ ID NO: 345608 - DNA, 20 bp, Artificial Sequence
  chemically synthesized
gaatatttataatacaatgt

SEQ ID NO: 345609 - DNA, 20 bp, Artificial Sequence
  chemically synthesized
tagacgcaagtacagaaagg

SEQ ID NO: 345610 - DNA, 20 bp, Artificial Sequence
  chemically synthesized
tgtagacgcaagtacagaaa

SEQ ID NO: 345611 - DNA, 20 bp, Artificial Sequence
  chemically synthesized
atgtagacgcaagtacagaa

SEQ ID NO: 345612 - DNA, 20 bp, Artificial Sequence
  chemically synthesized
catgtagacgcaagtacaga

SEQ ID NO: 345613 - DNA, 20 bp, Artificial Sequence
  chemically synthesized
ttaacatgtagacgcaagta

SEQ ID NO: 345614 - DNA, 20 bp, Artificial Sequence
  chemically synthesized
acatattaacatgtagacgc

SEQ ID NO: 345615 - DNA, 20 bp, Artificial Sequence
  chemically synthesized
ctcaagaacatattaacatg

SEQ ID NO: 345616 - DNA, 20 bp, Artificial Sequence
  chemically synthesized
ctacatgttaatatgttctt

SEQ ID NO: 345617 - DNA, 20 bp, Artificial Sequence
  chemically synthesized
tacatgttaatatgttcttg

SEQ ID NO: 345618 - DNA, 20 bp, Artificial Sequence
  chemically synthesized
acatgttaatatgttcttga

SEQ ID NO: 345619 - DNA, 20 bp, Artificial Sequence
  chemically synthesized
tgttaatatgttcttgaggg

SEQ ID NO: 345620 - DNA, 20 bp, Artificial Sequence
  chemically synthesized
gttaatatgttcttgaggga

SEQ ID NO: 345621 - DNA, 20 bp, Artificial Sequence
  chemically synthesized
aaggctcggttccttccctc

SEQ ID NO: 345622 - DNA, 20 bp, Artificial Sequence
  chemically synthesized
tgttcttgagggaaggaacc

SEQ ID NO: 345623 - DNA, 20 bp, Artificial Sequence
  chemically synthesized
atataaaggtgaataaggct

SEQ ID NO: 345624 - DNA, 20 bp, Artificial Sequence
  chemically synthesized
aggttatataaaggtgaata

SEQ ID NO: 345625 - DNA, 20 bp, Artificial Sequence
  chemically synthesized
taggttatataaaggtgaat

SEQ ID NO: 345626 - DNA, 20 bp, Artificial Sequence
  chemically synthesized
caacttgctaggttatataa

SEQ ID NO: 345627 - DNA, 20 bp, Artificial Sequence
  chemically synthesized
tcaacttgctaggttatata

SEQ ID NO: 345628 - DNA, 20 bp, Artificial Sequence
  chemically synthesized
ttattcacctttatataacc

SEQ ID NO: 345629 - DNA, 20 bp, Artificial Sequence
  chemically synthesized
tcacctttatataacctagc

SEQ ID NO: 345630 - DNA, 20 bp, Artificial Sequence
  chemically synthesized
aaccatgtggtcaacttgct

SEQ ID NO: 345631 - DNA, 20 bp, Artificial Sequence
  chemically synthesized
caaccatgtggtcaacttgc

SEQ ID NO: 345632 - DNA, 20 bp, Artificial Sequence
  chemically synthesized
aacctagcaagttgaccaca

SEQ ID NO: 345633 - DNA, 20 bp, Artificial Sequence
  chemically synthesized
tagcaagttgaccacatggt

SEQ ID NO: 345634 - DNA, 20 bp, Artificial Sequence
  chemically synthesized
gttatgtaacaccaaccatg

SEQ ID NO: 345635 - DNA, 20 bp, Artificial Sequence
  chemically synthesized
catggttggtgttacataac

SEQ ID NO: 345636 - DNA, 20 bp, Artificial Sequence
  chemically synthesized
cttgcttgctttattttcaa

SEQ ID NO: 345637 - DNA, 20 bp, Artificial Sequence
  chemically synthesized
ataacaagccattgaaaata

SEQ ID NO: 345638 - DNA, 20 bp, Artificial Sequence
  chemically synthesized
caagccattgaaaataaagc

SEQ ID NO: 345639 - DNA, 20 bp, Artificial Sequence
  chemically synthesized
ccattgaaaataaagcaagc

SEQ ID NO: 345640 - DNA, 20 bp, Artificial Sequence
  chemically synthesized
aataaagcaagcaagcaatt

SEQ ID NO: 345641 - DNA, 20 bp, Artificial Sequence
  chemically synthesized
aaagcaagcaagcaattaag

SEQ ID NO: 345642 - DNA, 20 bp, Artificial Sequence
  chemically synthesized
aagcaagcaagcaattaaga

SEQ ID NO: 345643 - DNA, 20 bp, Artificial Sequence
  chemically synthesized
aaatagaattgagcagggtt

SEQ ID NO: 345644 - DNA, 20 bp, Artificial Sequence
  chemically synthesized
ccacaaaatagaattgagca

SEQ ID NO: 345645 - DNA, 20 bp, Artificial Sequence
  chemically synthesized
cccacaaaatagaattgagc

SEQ ID NO: 345646 - DNA, 20 bp, Artificial Sequence
  chemically synthesized
acccacaaaatagaattgag

SEQ ID NO: 345647 - DNA, 20 bp, Artificial Sequence
  chemically synthesized
aaaacccacaaaatagaatt

SEQ ID NO: 345648 - DNA, 20 bp, Artificial Sequence
  chemically synthesized
ccctgctcaattctattttg

SEQ ID NO: 345649 - DNA, 20 bp, Artificial Sequence
  chemically synthesized
cctgctcaattctattttgt

SEQ ID NO: 345650 - DNA, 20 bp, Artificial Sequence
  chemically synthesized
cggggtcaaaacccacaaaa

SEQ ID NO: 345651 - DNA, 20 bp, Artificial Sequence
  chemically synthesized
tgggttttgaccccgtgatt

SEQ ID NO: 345652 - DNA, 20 bp, Artificial Sequence
  chemically synthesized
tcatgataggctaaatcacg

SEQ ID NO: 345653 - DNA, 20 bp, Artificial Sequence
  chemically synthesized
ttcatgataggctaaatcac

SEQ ID NO: 345654 - DNA, 20 bp, Artificial Sequence
  chemically synthesized
tttcatgataggctaaatca

SEQ ID NO: 345655 - DNA, 20 bp, Artificial Sequence
  chemically synthesized
agatgagaatttttcatgat

SEQ ID NO: 345656 - DNA, 20 bp, Artificial Sequence
  chemically synthesized
aagatgagaatttttcatga

SEQ ID NO: 345657 - DNA, 20 bp, Artificial Sequence
  chemically synthesized
tggggggtcaaaatgaagat

SEQ ID NO: 345658 - DNA, 20 bp, Artificial Sequence
  chemically synthesized
ctgggtggggggtcaaaatg

SEQ ID NO: 345659 - DNA, 20 bp, Artificial Sequence
  chemically synthesized
cttcattttgaccccccacc

SEQ ID NO: 345660 - DNA, 20 bp, Artificial Sequence
  chemically synthesized
atggcacaaatctgggtggg

SEQ ID NO: 345661 - DNA, 20 bp, Artificial Sequence
  chemically synthesized
gatggcacaaatctgggtgg

SEQ ID NO: 345662 - DNA, 20 bp, Artificial Sequence
  chemically synthesized
agatggcacaaatctgggtg

SEQ ID NO: 345663 - DNA, 20 bp, Artificial Sequence
  chemically synthesized
cagatggcacaaatctgggt

SEQ ID NO: 345664 - DNA, 20 bp, Artificial Sequence
  chemically synthesized
gcagatggcacaaatctggg

SEQ ID NO: 345665 - DNA, 20 bp, Artificial Sequence
  chemically synthesized
tttgcagatggcacaaatct

SEQ ID NO: 345666 - DNA, 20 bp, Artificial Sequence
  chemically synthesized
ttttgcagatggcacaaatc

SEQ ID NO: 345667 - DNA, 20 bp, Artificial Sequence
  chemically synthesized
gtaattttcaattttgcaga

SEQ ID NO: 345668 - DNA, 20 bp, Artificial Sequence
  chemically synthesized
aggggtaattttcaattttg

SEQ ID NO: 345669 - DNA, 20 bp, Artificial Sequence
  chemically synthesized
cttacataacatcagcaaag

SEQ ID NO: 345670 - DNA, 20 bp, Artificial Sequence
  chemically synthesized
ccttacataacatcagcaaa

SEQ ID NO: 345671 - DNA, 20 bp, Artificial Sequence
  chemically synthesized
accttacataacatcagcaa

SEQ ID NO: 345672 - DNA, 20 bp, Artificial Sequence
  chemically synthesized
taccttacataacatcagca

SEQ ID NO: 345673 - DNA, 20 bp, Artificial Sequence
  chemically synthesized
atcaataccttacataacat

SEQ ID NO: 345674 - DNA, 20 bp, Artificial Sequence
  chemically synthesized
cccctttgctgatgttatgt

SEQ ID NO: 345675 - DNA, 20 bp, Artificial Sequence
  chemically synthesized
ccctttgctgatgttatgta

SEQ ID NO: 345676 - DNA, 20 bp, Artificial Sequence
  chemically synthesized
taaggtattgatcaattatt

SEQ ID NO: 345677 - DNA, 20 bp, Artificial Sequence
  chemically synthesized
ggtattgatcaattattcag

SEQ ID NO: 345678 - DNA, 20 bp, Artificial Sequence
  chemically synthesized
tgatcaattattcagcagca

SEQ ID NO: 345679 - DNA, 20 bp, Artificial Sequence
  chemically synthesized
attcagcagcacagaacctg

SEQ ID NO: 345680 - DNA, 20 bp, Artificial Sequence
  chemically synthesized
cagcagcacagaacctgtgg

SEQ ID NO: 345681 - DNA, 20 bp, Artificial Sequence
  chemically synthesized
tataattagtaagctaccac

SEQ ID NO: 345682 - DNA, 20 bp, Artificial Sequence
  chemically synthesized
ttataattagtaagctacca

SEQ ID NO: 345683 - DNA, 20 bp, Artificial Sequence
  chemically synthesized
attgttttattataattagt

SEQ ID NO: 345684 - DNA, 20 bp, Artificial Sequence
  chemically synthesized
aaatattgttttattataat

SEQ ID NO: 345685 - DNA, 20 bp, Artificial Sequence
  chemically synthesized
aattataataaaacaatatt

SEQ ID NO: 345686 - DNA, 20 bp, Artificial Sequence
  chemically synthesized
ttataataaaacaatattta

SEQ ID NO: 345687 - DNA, 20 bp, Artificial Sequence
  chemically synthesized
aaaacaatatttagagttgc

SEQ ID NO: 345688 - DNA, 20 bp, Artificial Sequence
  chemically synthesized
cttggtagatattaagtgac

SEQ ID NO: 345689 - DNA, 20 bp, Artificial Sequence
  chemically synthesized
aaaggtgcttggtagatatt

SEQ ID NO: 345690 - DNA, 20 bp, Artificial Sequence
  chemically synthesized
ctggtcacttaatatctacc

SEQ ID NO: 345691 - DNA, 20 bp, Artificial Sequence
  chemically synthesized
gtatttaaaaaggtgcttgg

SEQ ID NO: 345692 - DNA, 20 bp, Artificial Sequence
  chemically synthesized
aaagtatttaaaaaggtgct

SEQ ID NO: 345693 - DNA, 20 bp, Artificial Sequence
  chemically synthesized
acatgtaaaagtatttaaaa

SEQ ID NO: 345694 - DNA, 20 bp, Artificial Sequence
  chemically synthesized
tacatgtaaaagtatttaaa

SEQ ID NO: 345695 - DNA, 20 bp, Artificial Sequence
  chemically synthesized
atgtagttacatacatgtaa

SEQ ID NO: 345696 - DNA, 20 bp, Artificial Sequence
  chemically synthesized
aagtttaacatgtatgtatg

SEQ ID NO: 345697 - DNA, 20 bp, Artificial Sequence
  chemically synthesized
agattgttttgaaaatattt

SEQ ID NO: 345698 - DNA, 20 bp, Artificial Sequence
  chemically synthesized
tattttcaaaacaatcttat

SEQ ID NO: 345699 - DNA, 20 bp, Artificial Sequence
  chemically synthesized
ttcaaaacaatcttatcaga

SEQ ID NO: 345700 - DNA, 20 bp, Artificial Sequence
  chemically synthesized
gataattgtatccatctgat

SEQ ID NO: 345701 - DNA, 20 bp, Artificial Sequence
  chemically synthesized
atacaattatcgccatttta

SEQ ID NO: 345702 - DNA, 20 bp, Artificial Sequence
  chemically synthesized
cagtttcctcatctgtaaaa

SEQ ID NO: 345703 - DNA, 20 bp, Artificial Sequence
  chemically synthesized
attatcgccattttacagat

SEQ ID NO: 345704 - DNA, 20 bp, Artificial Sequence
  chemically synthesized
ttatcgccattttacagatg

SEQ ID NO: 345705 - DNA, 20 bp, Artificial Sequence
  chemically synthesized
cagatgaggaaactgaaaca

SEQ ID NO: 345706 - DNA, 20 bp, Artificial Sequence
  chemically synthesized
aagttagtcatactgtgttt

SEQ ID NO: 345707 - DNA, 20 bp, Artificial Sequence
  chemically synthesized
cacagtatgactaactttct

SEQ ID NO: 345708 - DNA, 20 bp, Artificial Sequence
  chemically synthesized
ctgtgtggccctcagaaagt

SEQ ID NO: 345709 - DNA, 20 bp, Artificial Sequence
  chemically synthesized
acagtatgactaactttctg

SEQ ID NO: 345710 - DNA, 20 bp, Artificial Sequence
  chemically synthesized
cagtatgactaactttctga

SEQ ID NO: 345711 - DNA, 20 bp, Artificial Sequence
  chemically synthesized
aaagctgtgtggccctcaga

SEQ ID NO: 345712 - DNA, 20 bp, Artificial Sequence
  chemically synthesized
cttaaaagctgtgtggccct

SEQ ID NO: 345713 - DNA, 20 bp, Artificial Sequence
  chemically synthesized
ctaactttctgagggccaca

SEQ ID NO: 345714 - DNA, 20 bp, Artificial Sequence
  chemically synthesized
tgtattacttaaaagctgtg

SEQ ID NO: 345715 - DNA, 20 bp, Artificial Sequence
  chemically synthesized
ctgagggccacacagctttt

SEQ ID NO: 345716 - DNA, 20 bp, Artificial Sequence
  chemically synthesized
atcctagctgtattacttaa

SEQ ID NO: 345717 - DNA, 20 bp, Artificial Sequence
  chemically synthesized
cacacagcttttaagtaata

SEQ ID NO: 345718 - DNA, 20 bp, Artificial Sequence
  chemically synthesized
cagcttttaagtaatacagc

SEQ ID NO: 345719 - DNA, 20 bp, Artificial Sequence
  chemically synthesized
agcttttaagtaatacagct

SEQ ID NO: 345720 - DNA, 20 bp, Artificial Sequence
  chemically synthesized
cactgcttgggtttgaatcc

SEQ ID NO: 345721 - DNA, 20 bp, Artificial Sequence
  chemically synthesized
tacagctaggattcaaaccc

SEQ ID NO: 345722 - DNA, 20 bp, Artificial Sequence
  chemically synthesized
agctaggattcaaacccaag

SEQ ID NO: 345723 - DNA, 20 bp, Artificial Sequence
  chemically synthesized
gatcttgagatgcactgctt

SEQ ID NO: 345724 - DNA, 20 bp, Artificial Sequence
  chemically synthesized
agatcttgagatgcactgct

SEQ ID NO: 345725 - DNA, 20 bp, Artificial Sequence
  chemically synthesized
aaacccaagcagtgcatctc

SEQ ID NO: 345726 - DNA, 20 bp, Artificial Sequence
  chemically synthesized
agcagtgcatctcaagatct

SEQ ID NO: 345727 - DNA, 20 bp, Artificial Sequence
  chemically synthesized
tggtaaaagtctgagatctt

SEQ ID NO: 345728 - DNA, 20 bp, Artificial Sequence
  chemically synthesized
gggcagagtggtaaaagtct

SEQ ID NO: 345729 - DNA, 20 bp, Artificial Sequence
  chemically synthesized
tcaggagggcagagtggtaa

SEQ ID NO: 345730 - DNA, 20 bp, Artificial Sequence
  chemically synthesized
ttttagtcaggagggcagag

SEQ ID NO: 345731 - DNA, 20 bp, Artificial Sequence
  chemically synthesized
acattttagtcaggagggca

SEQ ID NO: 345732 - DNA, 20 bp, Artificial Sequence
  chemically synthesized
acacattttagtcaggaggg

SEQ ID NO: 345733 - DNA, 20 bp, Artificial Sequence
  chemically synthesized
aatacacattttagtcagga

SEQ ID NO: 345734 - DNA, 20 bp, Artificial Sequence
  chemically synthesized
gaatacacattttagtcagg

SEQ ID NO: 345735 - DNA, 20 bp, Artificial Sequence
  chemically synthesized
agaatacacattttagtcag

SEQ ID NO: 345736 - DNA, 20 bp, Artificial Sequence
  chemically synthesized
atagaatacacattttagtc

SEQ ID NO: 345737 - DNA, 20 bp, Artificial Sequence
  chemically synthesized
tatagaatacacattttagt

SEQ ID NO: 345738 - DNA, 20 bp, Artificial Sequence
  chemically synthesized
tgtatatagaatacacattt

SEQ ID NO: 345739 - DNA, 20 bp, Artificial Sequence
  chemically synthesized
taaaatgtgtattctatata

SEQ ID NO: 345740 - DNA, 20 bp, Artificial Sequence
  chemically synthesized
aaatgtgtattctatataca

SEQ ID NO: 345741 - DNA, 20 bp, Artificial Sequence
  chemically synthesized
gggagagtgagctctgtata

SEQ ID NO: 345742 - DNA, 20 bp, Artificial Sequence
  chemically synthesized
ccatattgacttgggagagt

SEQ ID NO: 345743 - DNA, 20 bp, Artificial Sequence
  chemically synthesized
tatacagagctcactctccc

SEQ ID NO: 345744 - DNA, 20 bp, Artificial Sequence
  chemically synthesized
ataaccatattgacttggga

SEQ ID NO: 345745 - DNA, 20 bp, Artificial Sequence
  chemically synthesized
taataaccatattgacttgg

SEQ ID NO: 345746 - DNA, 20 bp, Artificial Sequence
  chemically synthesized
attaataaccatattgactt

SEQ ID NO: 345747 - DNA, 20 bp, Artificial Sequence
  chemically synthesized
aattaataaccatattgact

SEQ ID NO: 345748 - DNA, 20 bp, Artificial Sequence
  chemically synthesized
ctcactctcccaagtcaata

SEQ ID NO: 345749 - DNA, 20 bp, Artificial Sequence
  chemically synthesized
ctatatgacagagttggcag

SEQ ID NO: 345750 - DNA, 20 bp, Artificial Sequence
  chemically synthesized
tctatatgacagagttggca

SEQ ID NO: 345751 - DNA, 20 bp, Artificial Sequence
  chemically synthesized
gatctatatgacagagttgg

SEQ ID NO: 345752 - DNA, 20 bp, Artificial Sequence
  chemically synthesized
agtgatctatatgacagagt

SEQ ID NO: 345753 - DNA, 20 bp, Artificial Sequence
  chemically synthesized
cctctgccaactctgtcata

SEQ ID NO: 345754 - DNA, 20 bp, Artificial Sequence
  chemically synthesized
gataagtgatctatatgaca

SEQ ID NO: 345755 - DNA, 20 bp, Artificial Sequence
  chemically synthesized
gtgataagtgatctatatga

SEQ ID NO: 345756 - DNA, 20 bp, Artificial Sequence
  chemically synthesized
tatcgggataagatggtgat

SEQ ID NO: 345757 - DNA, 20 bp, Artificial Sequence
  chemically synthesized
tctatggtatcgggataaga

SEQ ID NO: 345758 - DNA, 20 bp, Artificial Sequence
  chemically synthesized
aggttctatggtatcgggat

SEQ ID NO: 345759 - DNA, 20 bp, Artificial Sequence
  chemically synthesized
accatcttatcccgatacca

SEQ ID NO: 345760 - DNA, 20 bp, Artificial Sequence
  chemically synthesized
ggctaaggttctatggtatc

SEQ ID NO: 345761 - DNA, 20 bp, Artificial Sequence
  chemically synthesized
tggctaaggttctatggtat

SEQ ID NO: 345762 - DNA, 20 bp, Artificial Sequence
  chemically synthesized
aaacagtggctaaggttcta

SEQ ID NO: 345763 - DNA, 20 bp, Artificial Sequence
  chemically synthesized
atcccgataccatagaacct

SEQ ID NO: 345764 - DNA, 20 bp, Artificial Sequence
  chemically synthesized
tttgagtaaaacagtggcta

SEQ ID NO: 345765 - DNA, 20 bp, Artificial Sequence
  chemically synthesized
atttgagtaaaacagtggct

SEQ ID NO: 345766 - DNA, 20 bp, Artificial Sequence
  chemically synthesized
tttctatttgagtaaaacag

SEQ ID NO: 345767 - DNA, 20 bp, Artificial Sequence
  chemically synthesized
ttatttctatttgagtaaaa

SEQ ID NO: 345768 - DNA, 20 bp, Artificial Sequence
  chemically synthesized
tagccactgttttactcaaa

SEQ ID NO: 345769 - DNA, 20 bp, Artificial Sequence
  chemically synthesized
ttaatggtttatttctattt

SEQ ID NO: 345770 - DNA, 20 bp, Artificial Sequence
  chemically synthesized
cacctattttttttttttaa

SEQ ID NO: 345771 - DNA, 20 bp, Artificial Sequence
  chemically synthesized
aaaccattaaaaaaaaaaaa

SEQ ID NO: 345772 - DNA, 20 bp, Artificial Sequence
  chemically synthesized
aaccattaaaaaaaaaaaat

SEQ ID NO: 345773 - DNA, 20 bp, Artificial Sequence
  chemically synthesized
aaaaaaaaaaataggtgcca

SEQ ID NO: 345774 - DNA, 20 bp, Artificial Sequence
  chemically synthesized
aaaaataggtgccacagtaa

SEQ ID NO: 345775 - DNA, 20 bp, Artificial Sequence
  chemically synthesized
aagagatcatacttttactg

SEQ ID NO: 345776 - DNA, 20 bp, Artificial Sequence
  chemically synthesized
gatggtctcatcaggttgaa

SEQ ID NO: 345777 - DNA, 20 bp, Artificial Sequence
  chemically synthesized
gtgatggtctcatcaggttg

SEQ ID NO: 345778 - DNA, 20 bp, Artificial Sequence
  chemically synthesized
tatgatctcttcaacctgat

SEQ ID NO: 345779 - DNA, 20 bp, Artificial Sequence
  chemically synthesized
ctggttgtgatggtctcatc

SEQ ID NO: 345780 - DNA, 20 bp, Artificial Sequence
  chemically synthesized
actggttgtgatggtctcat

SEQ ID NO: 345781 - DNA, 20 bp, Artificial Sequence
  chemically synthesized
cctgatgagaccatcacaac

SEQ ID NO: 345782 - DNA, 20 bp, Artificial Sequence
  chemically synthesized
agttttgagactggttgtga

SEQ ID NO: 345783 - DNA, 20 bp, Artificial Sequence
  chemically synthesized
cagaaaagaagttttgagac

SEQ ID NO: 345784 - DNA, 20 bp, Artificial Sequence
  chemically synthesized
ttcttcagaaaagaagtttt

SEQ ID NO: 345785 - DNA, 20 bp, Artificial Sequence
  chemically synthesized
tagcttgttcttcagaaaag

SEQ ID NO: 345786 - DNA, 20 bp, Artificial Sequence
  chemically synthesized
gtctcaaaacttcttttctg

SEQ ID NO: 345787 - DNA, 20 bp, Artificial Sequence
  chemically synthesized
taatagcttgttcttcagaa

SEQ ID NO: 345788 - DNA, 20 bp, Artificial Sequence
  chemically synthesized
aaacttcttttctgaagaac

SEQ ID NO: 345789 - DNA, 20 bp, Artificial Sequence
  chemically synthesized
taaattaatagcttgttctt

SEQ ID NO: 345790 - DNA, 20 bp, Artificial Sequence
  chemically synthesized
tgaagaacaagctattaatt

SEQ ID NO: 345791 - DNA, 20 bp, Artificial Sequence
  chemically synthesized
gactcattcatctaaattaa

SEQ ID NO: 345792 - DNA, 20 bp, Artificial Sequence
  chemically synthesized
agctattaatttagatgaat

SEQ ID NO: 345793 - DNA, 20 bp, Artificial Sequence
  chemically synthesized
agtcaataacaaacttatcg

SEQ ID NO: 345794 - DNA, 20 bp, Artificial Sequence
  chemically synthesized
tgtatgtttaaatctgcgat

SEQ ID NO: 345795 - DNA, 20 bp, Artificial Sequence
  chemically synthesized
ttatcgcagatttaaacata

SEQ ID NO: 345796 - DNA, 20 bp, Artificial Sequence
  chemically synthesized
taaacatacagaaattttca

SEQ ID NO: 345797 - DNA, 20 bp, Artificial Sequence
  chemically synthesized
tttattgacctcatatttta

SEQ ID NO: 345798 - DNA, 20 bp, Artificial Sequence
  chemically synthesized
acggcaaatctgtaaaatat

SEQ ID NO: 345799 - DNA, 20 bp, Artificial Sequence
  chemically synthesized
cggcaaatctgtaaaatatg

SEQ ID NO: 345800 - DNA, 20 bp, Artificial Sequence
  chemically synthesized
aaatgctattgagtataaat

SEQ ID NO: 345801 - DNA, 20 bp, Artificial Sequence
  chemically synthesized
aatatctaatttatactcaa

SEQ ID NO: 345802 - DNA, 20 bp, Artificial Sequence
  chemically synthesized
ataacagtataaatgctatt

SEQ ID NO: 345803 - DNA, 20 bp, Artificial Sequence
  chemically synthesized
caatagcatttatactgtta

SEQ ID NO: 345804 - DNA, 20 bp, Artificial Sequence
  chemically synthesized
atattgcatcatttctataa

SEQ ID NO: 345805 - DNA, 20 bp, Artificial Sequence
  chemically synthesized
atagaaatgatgcaatatac

SEQ ID NO: 345806 - DNA, 20 bp, Artificial Sequence
  chemically synthesized
aatggctagggtgttatgta

SEQ ID NO: 345807 - DNA, 20 bp, Artificial Sequence
  chemically synthesized
cataactgtacataacaccc

SEQ ID NO: 345808 - DNA, 20 bp, Artificial Sequence
  chemically synthesized
gcacaatgatttaatggcta

SEQ ID NO: 345809 - DNA, 20 bp, Artificial Sequence
  chemically synthesized
tgcacaatgatttaatggct

SEQ ID NO: 345810 - DNA, 20 bp, Artificial Sequence
  chemically synthesized
ctgcacaatgatttaatggc

SEQ ID NO: 345811 - DNA, 20 bp, Artificial Sequence
  chemically synthesized
ccatctgcacaatgatttaa

SEQ ID NO: 345812 - DNA, 20 bp, Artificial Sequence
  chemically synthesized
ctagccattaaatcattgtg

SEQ ID NO: 345813 - DNA, 20 bp, Artificial Sequence
  chemically synthesized
ccattaaatcattgtgcaga

SEQ ID NO: 345814 - DNA, 20 bp, Artificial Sequence
  chemically synthesized
agaagtcacaatgatagtgg

SEQ ID NO: 345815 - DNA, 20 bp, Artificial Sequence
  chemically synthesized
acagaagtcacaatgatagt

SEQ ID NO: 345816 - DNA, 20 bp, Artificial Sequence
  chemically synthesized
cacagaagtcacaatgatag

SEQ ID NO: 345817 - DNA, 20 bp, Artificial Sequence
  chemically synthesized
aggcacagaagtcacaatga

SEQ ID NO: 345818 - DNA, 20 bp, Artificial Sequence
  chemically synthesized
ctatggggaaagaggcacag

SEQ ID NO: 345819 - DNA, 20 bp, Artificial Sequence
  chemically synthesized
acactatggggaaagaggca

SEQ ID NO: 345820 - DNA, 20 bp, Artificial Sequence
  chemically synthesized
ggcaaacactatggggaaag

SEQ ID NO: 345821 - DNA, 20 bp, Artificial Sequence
  chemically synthesized
tggcaaacactatggggaaa

SEQ ID NO: 345822 - DNA, 20 bp, Artificial Sequence
  chemically synthesized
cttctgtgcctctttcccca

SEQ ID NO: 345823 - DNA, 20 bp, Artificial Sequence
  chemically synthesized
cttggcaaacactatgggga

SEQ ID NO: 345824 - DNA, 20 bp, Artificial Sequence
  chemically synthesized
atggcttggcaaacactatg

SEQ ID NO: 345825 - DNA, 20 bp, Artificial Sequence
  chemically synthesized
tatggcttggcaaacactat

SEQ ID NO: 345826 - DNA, 20 bp, Artificial Sequence
  chemically synthesized
ttatggcttggcaaacacta

SEQ ID NO: 345827 - DNA, 20 bp, Artificial Sequence
  chemically synthesized
ctttccccatagtgtttgcc

SEQ ID NO: 345828 - DNA, 20 bp, Artificial Sequence
  chemically synthesized
catagtgtttgccaagccat

SEQ ID NO: 345829 - DNA, 20 bp, Artificial Sequence
  chemically synthesized
taaaatatcagcttatggct

SEQ ID NO: 345830 - DNA, 20 bp, Artificial Sequence
  chemically synthesized
taaaataaaatatcagctta

SEQ ID NO: 345831 - DNA, 20 bp, Artificial Sequence
  chemically synthesized
ctgaaggtaaaataaaatat

SEQ ID NO: 345832 - DNA, 20 bp, Artificial Sequence
  chemically synthesized
ctgatattttattttacctt

SEQ ID NO: 345833 - DNA, 20 bp, Artificial Sequence
  chemically synthesized
tgtaatgtacagagaactga

SEQ ID NO: 345834 - DNA, 20 bp, Artificial Sequence
  chemically synthesized
ctgtaatgtacagagaactg

SEQ ID NO: 345835 - DNA, 20 bp, Artificial Sequence
  chemically synthesized
cagagaagctgtaatgtaca

SEQ ID NO: 345836 - DNA, 20 bp, Artificial Sequence
  chemically synthesized
cttcagttctctgtacatta

SEQ ID NO: 345837 - DNA, 20 bp, Artificial Sequence
  chemically synthesized
ggcagagaagctgtaatgta

SEQ ID NO: 345838 - DNA, 20 bp, Artificial Sequence
  chemically synthesized
aaaggatgttgcaggcagag

SEQ ID NO: 345839 - DNA, 20 bp, Artificial Sequence
  chemically synthesized
tgaaaaggatgttgcaggca

SEQ ID NO: 345840 - DNA, 20 bp, Artificial Sequence
  chemically synthesized
gatgaaaaggatgttgcagg

SEQ ID NO: 345841 - DNA, 20 bp, Artificial Sequence
  chemically synthesized
ccagatgaaaaggatgttgc

SEQ ID NO: 345842 - DNA, 20 bp, Artificial Sequence
  chemically synthesized
gccagatgaaaaggatgttg

SEQ ID NO: 345843 - DNA, 20 bp, Artificial Sequence
  chemically synthesized
cctgcaacatccttttcatc

SEQ ID NO: 345844 - DNA, 20 bp, Artificial Sequence
  chemically synthesized
tgtaaaggagccagatgaaa

SEQ ID NO: 345845 - DNA, 20 bp, Artificial Sequence
  chemically synthesized
atgtaaaggagccagatgaa

SEQ ID NO: 345846 - DNA, 20 bp, Artificial Sequence
  chemically synthesized
tacctgacatgtaaaggagc

SEQ ID NO: 345847 - DNA, 20 bp, Artificial Sequence
  chemically synthesized
aacttacctgacatgtaaag

SEQ ID NO: 345848 - DNA, 20 bp, Artificial Sequence
  chemically synthesized
gtaacttacctgacatgtaa

SEQ ID NO: 345849 - DNA, 20 bp, Artificial Sequence
  chemically synthesized
catctggctcctttacatgt

SEQ ID NO: 345850 - DNA, 20 bp, Artificial Sequence
  chemically synthesized
ggtaacttacctgacatgta

SEQ ID NO: 345851 - DNA, 20 bp, Artificial Sequence
  chemically synthesized
atctggctcctttacatgtc

SEQ ID NO: 345852 - DNA, 20 bp, Artificial Sequence
  chemically synthesized
ggctcctttacatgtcaggt

SEQ ID NO: 345853 - DNA, 20 bp, Artificial Sequence
  chemically synthesized
gaaaggctttgaaggggcag

SEQ ID NO: 345854 - DNA, 20 bp, Artificial Sequence
  chemically synthesized
aaggaaaggctttgaagggg

SEQ ID NO: 345855 - DNA, 20 bp, Artificial Sequence
  chemically synthesized
aagttaccactgccccttca

SEQ ID NO: 345856 - DNA, 20 bp, Artificial Sequence
  chemically synthesized
cgtaaggaaaggctttgaag

SEQ ID NO: 345857 - DNA, 20 bp, Artificial Sequence
  chemically synthesized
ccgtaaggaaaggctttgaa

SEQ ID NO: 345858 - DNA, 20 bp, Artificial Sequence
  chemically synthesized
gccgtaaggaaaggctttga

SEQ ID NO: 345859 - DNA, 20 bp, Artificial Sequence
  chemically synthesized
ggccgtaaggaaaggctttg

SEQ ID NO: 345860 - DNA, 20 bp, Artificial Sequence
  chemically synthesized
cccttcaaagcctttcctta

SEQ ID NO: 345861 - DNA, 20 bp, Artificial Sequence
  chemically synthesized
aaaactcaggccgtaaggaa

SEQ ID NO: 345862 - DNA, 20 bp, Artificial Sequence
  chemically synthesized
caaaactcaggccgtaagga

SEQ ID NO: 345863 - DNA, 20 bp, Artificial Sequence
  chemically synthesized
gaaccaaaactcaggccgta

SEQ ID NO: 345864 - DNA, 20 bp, Artificial Sequence
  chemically synthesized
aaagcctttccttacggcct

SEQ ID NO: 345865 - DNA, 20 bp, Artificial Sequence
  chemically synthesized
tgaaccaaaactcaggccgt

SEQ ID NO: 345866 - DNA, 20 bp, Artificial Sequence
  chemically synthesized
tttccttacggcctgagttt

SEQ ID NO: 345867 - DNA, 20 bp, Artificial Sequence
  chemically synthesized
catgcattgaaccaaaactc

SEQ ID NO: 345868 - DNA, 20 bp, Artificial Sequence
  chemically synthesized
tcatgcattgaaccaaaact

SEQ ID NO: 345869 - DNA, 20 bp, Artificial Sequence
  chemically synthesized
ggaaatagtgttttacagtc

SEQ ID NO: 345870 - DNA, 20 bp, Artificial Sequence
  chemically synthesized
gggaaatagtgttttacagt

SEQ ID NO: 345871 - DNA, 20 bp, Artificial Sequence
  chemically synthesized
atgtgggaaatagtgtttta

SEQ ID NO: 345872 - DNA, 20 bp, Artificial Sequence
  chemically synthesized
gacatacatgatgtgggaaa

SEQ ID NO: 345873 - DNA, 20 bp, Artificial Sequence
  chemically synthesized
gggaaagacatacatgatgt

SEQ ID NO: 345874 - DNA, 20 bp, Artificial Sequence
  chemically synthesized
agggaaagacatacatgatg

SEQ ID NO: 345875 - DNA, 20 bp, Artificial Sequence
  chemically synthesized
agcaatgtgatgagtaggga

SEQ ID NO: 345876 - DNA, 20 bp, Artificial Sequence
  chemically synthesized
cttcagcaatgtgatgagta

SEQ ID NO: 345877 - DNA, 20 bp, Artificial Sequence
  chemically synthesized
tcttcagcaatgtgatgagt

SEQ ID NO: 345878 - DNA, 20 bp, Artificial Sequence
  chemically synthesized
ttcttcagcaatgtgatgag

SEQ ID NO: 345879 - DNA, 20 bp, Artificial Sequence
  chemically synthesized
caattcttcagcaatgtgat

SEQ ID NO: 345880 - DNA, 20 bp, Artificial Sequence
  chemically synthesized
ccctactcatcacattgctg

SEQ ID NO: 345881 - DNA, 20 bp, Artificial Sequence
  chemically synthesized
cagatacatgggcaattctt

SEQ ID NO: 345882 - DNA, 20 bp, Artificial Sequence
  chemically synthesized
tgggagacaagcagatacat

SEQ ID NO: 345883 - DNA, 20 bp, Artificial Sequence
  chemically synthesized
atgggagacaagcagataca

SEQ ID NO: 345884 - DNA, 20 bp, Artificial Sequence
  chemically synthesized
tccttatcatgggagacaag

SEQ ID NO: 345885 - DNA, 20 bp, Artificial Sequence
  chemically synthesized
ttgtccttatcatgggagac

SEQ ID NO: 345886 - DNA, 20 bp, Artificial Sequence
  chemically synthesized
atctgcttgtctcccatgat

SEQ ID NO: 345887 - DNA, 20 bp, Artificial Sequence
  chemically synthesized
agacattgtccttatcatgg

SEQ ID NO: 345888 - DNA, 20 bp, Artificial Sequence
  chemically synthesized
tctgcttgtctcccatgata

SEQ ID NO: 345889 - DNA, 20 bp, Artificial Sequence
  chemically synthesized
aaagacattgtccttatcat

SEQ ID NO: 345890 - DNA, 20 bp, Artificial Sequence
  chemically synthesized
aaaagacattgtccttatca

SEQ ID NO: 345891 - DNA, 20 bp, Artificial Sequence
  chemically synthesized
tcattatgttataaaggaaa

SEQ ID NO: 345892 - DNA, 20 bp, Artificial Sequence
  chemically synthesized
ctctcctcattatgttataa

SEQ ID NO: 345893 - DNA, 20 bp, Artificial Sequence
  chemically synthesized
gctctcctcattatgttata

SEQ ID NO: 345894 - DNA, 20 bp, Artificial Sequence
  chemically synthesized
tttttcctttataacataat

SEQ ID NO: 345895 - DNA, 20 bp, Artificial Sequence
  chemically synthesized
ttttcctttataacataatg

SEQ ID NO: 345896 - DNA, 20 bp, Artificial Sequence
  chemically synthesized
ttcctttataacataatgag

SEQ ID NO: 345897 - DNA, 20 bp, Artificial Sequence
  chemically synthesized
cctttataacataatgagga

SEQ ID NO: 345898 - DNA, 20 bp, Artificial Sequence
  chemically synthesized
aaagttgagctttcattatt

SEQ ID NO: 345899 - DNA, 20 bp, Artificial Sequence
  chemically synthesized
tgaggagagctcaataatga

SEQ ID NO: 345900 - DNA, 20 bp, Artificial Sequence
  chemically synthesized
acccatacaaaaaaaaagtt

SEQ ID NO: 345901 - DNA, 20 bp, Artificial Sequence
  chemically synthesized
cattcacccatacaaaaaaa

SEQ ID NO: 345902 - DNA, 20 bp, Artificial Sequence
  chemically synthesized
agctcaactttttttttgta

SEQ ID NO: 345903 - DNA, 20 bp, Artificial Sequence
  chemically synthesized
gctcaactttttttttgtat

SEQ ID NO: 345904 - DNA, 20 bp, Artificial Sequence
  chemically synthesized
ttttttttgtatgggtgaat

SEQ ID NO: 345905 - DNA, 20 bp, Artificial Sequence
  chemically synthesized
tttttgtatgggtgaatgag

SEQ ID NO: 345906 - DNA, 20 bp, Artificial Sequence
  chemically synthesized
atgggtgaatgagtagttct

SEQ ID NO: 345907 - DNA, 20 bp, Artificial Sequence
  chemically synthesized
gtaaatttactgtatttact

SEQ ID NO: 345908 - DNA, 20 bp, Artificial Sequence
  chemically synthesized
tgagtagttctaagtaaata

SEQ ID NO: 345909 - DNA, 20 bp, Artificial Sequence
  chemically synthesized
aaatacagtaaatttactta

SEQ ID NO: 345910 - DNA, 20 bp, Artificial Sequence
  chemically synthesized
ttctttgaaattgatactgt

SEQ ID NO: 345911 - DNA, 20 bp, Artificial Sequence
  chemically synthesized
tacttacagtatcaatttca

SEQ ID NO: 345912 - DNA, 20 bp, Artificial Sequence
  chemically synthesized
aagacaatatttttagagga

SEQ ID NO: 345913 - DNA, 20 bp, Artificial Sequence
  chemically synthesized
tgaagacaatatttttagag

SEQ ID NO: 345914 - DNA, 20 bp, Artificial Sequence
  chemically synthesized
tctgaagacaatatttttag

SEQ ID NO: 345915 - DNA, 20 bp, Artificial Sequence
  chemically synthesized
gtctgaagacaatattttta

SEQ ID NO: 345916 - DNA, 20 bp, Artificial Sequence
  chemically synthesized
ttgtctgaagacaatatttt

SEQ ID NO: 345917 - DNA, 20 bp, Artificial Sequence
  chemically synthesized
tcctctaaaaatattgtctt

SEQ ID NO: 345918 - DNA, 20 bp, Artificial Sequence
  chemically synthesized
taaaaatattgtcttcagac

SEQ ID NO: 345919 - DNA, 20 bp, Artificial Sequence
  chemically synthesized
aaaaatattgtcttcagaca

SEQ ID NO: 345920 - DNA, 20 bp, Artificial Sequence
  chemically synthesized
gtgttttttttccttgtctg

SEQ ID NO: 345921 - DNA, 20 bp, Artificial Sequence
  chemically synthesized
aggaaaaaaaacacaaaaaa

SEQ ID NO: 345922 - DNA, 20 bp, Artificial Sequence
  chemically synthesized
cgtatcttcctttaagattt

SEQ ID NO: 345923 - DNA, 20 bp, Artificial Sequence
  chemically synthesized
ggaacatgactaaaatctta

SEQ ID NO: 345924 - DNA, 20 bp, Artificial Sequence
  chemically synthesized
gaacatgactaaaatcttaa

SEQ ID NO: 345925 - DNA, 20 bp, Artificial Sequence
  chemically synthesized
catgactaaaatcttaaagg

SEQ ID NO: 345926 - DNA, 20 bp, Artificial Sequence
  chemically synthesized
tcacttccgtatcttccttt

SEQ ID NO: 345927 - DNA, 20 bp, Artificial Sequence
  chemically synthesized
taaaatcttaaaggaagata

SEQ ID NO: 345928 - DNA, 20 bp, Artificial Sequence
  chemically synthesized
aatcttaaaggaagatacgg

SEQ ID NO: 345929 - DNA, 20 bp, Artificial Sequence
  chemically synthesized
ttaaaggaagatacggaagt

SEQ ID NO: 345930 - DNA, 20 bp, Artificial Sequence
  chemically synthesized
gtgagcacacaatccttctg

SEQ ID NO: 345931 - DNA, 20 bp, Artificial Sequence
  chemically synthesized
agaaatattttaacttcaga

SEQ ID NO: 345932 - DNA, 20 bp, Artificial Sequence
  chemically synthesized
tagaaatattttaacttcag

SEQ ID NO: 345933 - DNA, 20 bp, Artificial Sequence
  chemically synthesized
ttatagaaatattttaactt

SEQ ID NO: 345934 - DNA, 20 bp, Artificial Sequence
  chemically synthesized
aatacagctatatgaattta

SEQ ID NO: 345935 - DNA, 20 bp, Artificial Sequence
  chemically synthesized
aatatttctataaattcata

SEQ ID NO: 345936 - DNA, 20 bp, Artificial Sequence
  chemically synthesized
taccaaaaagatttagaata

SEQ ID NO: 345937 - DNA, 20 bp, Artificial Sequence
  chemically synthesized
ggattcttaccaaaaagatt

SEQ ID NO: 345938 - DNA, 20 bp, Artificial Sequence
  chemically synthesized
agctgtattctaaatctttt

SEQ ID NO: 345939 - DNA, 20 bp, Artificial Sequence
  chemically synthesized
gtattctaaatctttttggt

SEQ ID NO: 345940 - DNA, 20 bp, Artificial Sequence
  chemically synthesized
tttcagggattcttaccaaa

SEQ ID NO: 345941 - DNA, 20 bp, Artificial Sequence
  chemically synthesized
agaattcagaatacatttca

SEQ ID NO: 345942 - DNA, 20 bp, Artificial Sequence
  chemically synthesized
tagaattcagaatacatttc

SEQ ID NO: 345943 - DNA, 20 bp, Artificial Sequence
  chemically synthesized
ttagaattcagaatacattt

SEQ ID NO: 345944 - DNA, 20 bp, Artificial Sequence
  chemically synthesized
acttttcatctattagaatt

SEQ ID NO: 345945 - DNA, 20 bp, Artificial Sequence
  chemically synthesized
aaatgtattctgaattctaa

SEQ ID NO: 345946 - DNA, 20 bp, Artificial Sequence
  chemically synthesized
acagggaacttttcatctat

SEQ ID NO: 345947 - DNA, 20 bp, Artificial Sequence
  chemically synthesized
tctgaattctaatagatgaa

SEQ ID NO: 345948 - DNA, 20 bp, Artificial Sequence
  chemically synthesized
aatagatgaaaagttccctg

SEQ ID NO: 345949 - DNA, 20 bp, Artificial Sequence
  chemically synthesized
atagatgaaaagttccctgt

SEQ ID NO: 345950 - DNA, 20 bp, Artificial Sequence
  chemically synthesized
gatgaaaagttccctgtggg

SEQ ID NO: 345951 - DNA, 20 bp, Artificial Sequence
  chemically synthesized
atgaaaagttccctgtgggc

SEQ ID NO: 345952 - DNA, 20 bp, Artificial Sequence
  chemically synthesized
aaacacattacctgcccaca

SEQ ID NO: 345953 - DNA, 20 bp, Artificial Sequence
  chemically synthesized
taaacacattacctgcccac

SEQ ID NO: 345954 - DNA, 20 bp, Artificial Sequence
  chemically synthesized
gtaaacacattacctgccca

SEQ ID NO: 345955 - DNA, 20 bp, Artificial Sequence
  chemically synthesized
gtaatgtgtttactccaact

SEQ ID NO: 345956 - DNA, 20 bp, Artificial Sequence
  chemically synthesized
aatgtgtttactccaactaa

SEQ ID NO: 345957 - DNA, 20 bp, Artificial Sequence
  chemically synthesized
tgttgggctgctcttagttg

SEQ ID NO: 345958 - DNA, 20 bp, Artificial Sequence
  chemically synthesized
tgtgttgggctgctcttagt

SEQ ID NO: 345959 - DNA, 20 bp, Artificial Sequence
  chemically synthesized
gtgtttactccaactaagag

SEQ ID NO: 345960 - DNA, 20 bp, Artificial Sequence
  chemically synthesized
ttcctgtgttgggctgctct

SEQ ID NO: 345961 - DNA, 20 bp, Artificial Sequence
  chemically synthesized
caactaagagcagcccaaca

SEQ ID NO: 345962 - DNA, 20 bp, Artificial Sequence
  chemically synthesized
aactaagagcagcccaacac

SEQ ID NO: 345963 - DNA, 20 bp, Artificial Sequence
  chemically synthesized
agagcaaatattcctgtgtt

SEQ ID NO: 345964 - DNA, 20 bp, Artificial Sequence
  chemically synthesized
aagagcaaatattcctgtgt

SEQ ID NO: 345965 - DNA, 20 bp, Artificial Sequence
  chemically synthesized
cacaggaatatttgctcttt

SEQ ID NO: 345966 - DNA, 20 bp, Artificial Sequence
  chemically synthesized
acaggaatatttgctctttg

SEQ ID NO: 345967 - DNA, 20 bp, Artificial Sequence
  chemically synthesized
aggaatatttgctctttgag

SEQ ID NO: 345968 - DNA, 20 bp, Artificial Sequence
  chemically synthesized
aacatgtattactcctcaaa

SEQ ID NO: 345969 - DNA, 20 bp, Artificial Sequence
  chemically synthesized
aaaacatgtattactcctca

SEQ ID NO: 345970 - DNA, 20 bp, Artificial Sequence
  chemically synthesized
aagaatatgaaaacatcatt

SEQ ID NO: 345971 - DNA, 20 bp, Artificial Sequence
  chemically synthesized
aatgatgttttcatattctt

SEQ ID NO: 345972 - DNA, 20 bp, Artificial Sequence
  chemically synthesized
atatttgtaattaagaactc

SEQ ID NO: 345973 - DNA, 20 bp, Artificial Sequence
  chemically synthesized
gtttgaaaatatttgtaatt

SEQ ID NO: 345974 - DNA, 20 bp, Artificial Sequence
  chemically synthesized
atattcaattatttgcttgc

SEQ ID NO: 345975 - DNA, 20 bp, Artificial Sequence
  chemically synthesized
tattcaattatttgcttgcc

SEQ ID NO: 345976 - DNA, 20 bp, Artificial Sequence
  chemically synthesized
acttatattttatacctggc

SEQ ID NO: 345977 - DNA, 20 bp, Artificial Sequence
  chemically synthesized
tttaacttatattttatacc

SEQ ID NO: 345978 - DNA, 20 bp, Artificial Sequence
  chemically synthesized
gcttgccaggtataaaatat

SEQ ID NO: 345979 - DNA, 20 bp, Artificial Sequence
  chemically synthesized
ggtataaaatataagttaaa

SEQ ID NO: 345980 - DNA, 20 bp, Artificial Sequence
  chemically synthesized
aatagcaataaaaatatcaa

SEQ ID NO: 345981 - DNA, 20 bp, Artificial Sequence
  chemically synthesized
ttaataacatgttttttcct

SEQ ID NO: 345982 - DNA, 20 bp, Artificial Sequence
  chemically synthesized
atttagaaaatatagtgcta

SEQ ID NO: 345983 - DNA, 20 bp, Artificial Sequence
  chemically synthesized
tatttagaaaatatagtgct

SEQ ID NO: 345984 - DNA, 20 bp, Artificial Sequence
  chemically synthesized
ctaatactatttagaaaata

SEQ ID NO: 345985 - DNA, 20 bp, Artificial Sequence
  chemically synthesized
ttagcactatattttctaaa

SEQ ID NO: 345986 - DNA, 20 bp, Artificial Sequence
  chemically synthesized
attaagtagctaatactatt

SEQ ID NO: 345987 - DNA, 20 bp, Artificial Sequence
  chemically synthesized
ctatattttctaaatagtat

SEQ ID NO: 345988 - DNA, 20 bp, Artificial Sequence
  chemically synthesized
tgaggaaaagtttaattaag

SEQ ID NO: 345989 - DNA, 20 bp, Artificial Sequence
  chemically synthesized
aattgaggaaaagtttaatt

SEQ ID NO: 345990 - DNA, 20 bp, Artificial Sequence
  chemically synthesized
atcacttcccaattgaggaa

SEQ ID NO: 345991 - DNA, 20 bp, Artificial Sequence
  chemically synthesized
taattaaacttttcctcaat

SEQ ID NO: 345992 - DNA, 20 bp, Artificial Sequence
  chemically synthesized
aattaaacttttcctcaatt

SEQ ID NO: 345993 - DNA, 20 bp, Artificial Sequence
  chemically synthesized
tcttgatcacttcccaattg

SEQ ID NO: 345994 - DNA, 20 bp, Artificial Sequence
  chemically synthesized
taaacttttcctcaattggg

SEQ ID NO: 345995 - DNA, 20 bp, Artificial Sequence
  chemically synthesized
ttcttgatcacttcccaatt

SEQ ID NO: 345996 - DNA, 20 bp, Artificial Sequence
  chemically synthesized
tcctcaattgggaagtgatc

SEQ ID NO: 345997 - DNA, 20 bp, Artificial Sequence
  chemically synthesized
ttgggaagtgatcaagaaaa

SEQ ID NO: 345998 - DNA, 20 bp, Artificial Sequence
  chemically synthesized
agaaaatggttgtgtatcaa

SEQ ID NO: 345999 - DNA, 20 bp, Artificial Sequence
  chemically synthesized
gaaaatggttgtgtatcaaa

SEQ ID NO: 346000 - DNA, 20 bp, Artificial Sequence
  chemically synthesized
aatggttgtgtatcaaaagg

SEQ ID NO: 346001 - DNA, 20 bp, Artificial Sequence
  chemically synthesized
tggttgtgtatcaaaaggca

SEQ ID NO: 346002 - DNA, 20 bp, Artificial Sequence
  chemically synthesized
tgtgtatcaaaaggcagagt

SEQ ID NO: 346003 - DNA, 20 bp, Artificial Sequence
  chemically synthesized
aaggcagagtaagtgaaaac

SEQ ID NO: 346004 - DNA, 20 bp, Artificial Sequence
  chemically synthesized
cagagtaagtgaaaacaagt

SEQ ID NO: 346005 - DNA, 20 bp, Artificial Sequence
  chemically synthesized
aagtgaaaacaagttggtta

SEQ ID NO: 346006 - DNA, 20 bp, Artificial Sequence
  chemically synthesized
agtgaaaacaagttggttac

SEQ ID NO: 346007 - DNA, 20 bp, Artificial Sequence
  chemically synthesized
tgaaaacaagttggttacag

SEQ ID NO: 346008 - DNA, 20 bp, Artificial Sequence
  chemically synthesized
gaaaacaagttggttacagg

SEQ ID NO: 346009 - DNA, 20 bp, Artificial Sequence
  chemically synthesized
aacaagttggttacaggagg

SEQ ID NO: 346010 - DNA, 20 bp, Artificial Sequence
  chemically synthesized
aagttggttacaggaggaag

SEQ ID NO: 346011 - DNA, 20 bp, Artificial Sequence
  chemically synthesized
agttggttacaggaggaagc

SEQ ID NO: 346012 - DNA, 20 bp, Artificial Sequence
  chemically synthesized
gttggttacaggaggaagca

SEQ ID NO: 346013 - DNA, 20 bp, Artificial Sequence
  chemically synthesized
ttacaggaggaagcagggta

SEQ ID NO: 346014 - DNA, 20 bp, Artificial Sequence
  chemically synthesized
tacaggaggaagcagggtat

SEQ ID NO: 346015 - DNA, 20 bp, Artificial Sequence
  chemically synthesized
tggagcagttaatatagcac

SEQ ID NO: 346016 - DNA, 20 bp, Artificial Sequence
  chemically synthesized
ctccagtggagcagttaata

SEQ ID NO: 346017 - DNA, 20 bp, Artificial Sequence
  chemically synthesized
tgctatattaactgctccac

SEQ ID NO: 346018 - DNA, 20 bp, Artificial Sequence
  chemically synthesized
attagtttgctccagtggag

SEQ ID NO: 346019 - DNA, 20 bp, Artificial Sequence
  chemically synthesized
ctatattaactgctccactg

SEQ ID NO: 346020 - DNA, 20 bp, Artificial Sequence
  chemically synthesized
ttaattagtttgctccagtg

SEQ ID NO: 346021 - DNA, 20 bp, Artificial Sequence
  chemically synthesized
aattaattagtttgctccag

SEQ ID NO: 346022 - DNA, 20 bp, Artificial Sequence
  chemically synthesized
aaaaattaattagtttgctc

SEQ ID NO: 346023 - DNA, 20 bp, Artificial Sequence
  chemically synthesized
tgcaatgaagaaaaattaat

SEQ ID NO: 346024 - DNA, 20 bp, Artificial Sequence
  chemically synthesized
ttgctgattacagtgcaatg

SEQ ID NO: 346025 - DNA, 20 bp, Artificial Sequence
  chemically synthesized
tttcttcattgcactgtaat

SEQ ID NO: 346026 - DNA, 20 bp, Artificial Sequence
  chemically synthesized
tagattaagcttgctgatta

SEQ ID NO: 346027 - DNA, 20 bp, Artificial Sequence
  chemically synthesized
ttcattgcactgtaatcagc

SEQ ID NO: 346028 - DNA, 20 bp, Artificial Sequence
  chemically synthesized
tgtaatcagcaagcttaatc

SEQ ID NO: 346029 - DNA, 20 bp, Artificial Sequence
  chemically synthesized
gtaatcagcaagcttaatct

SEQ ID NO: 346030 - DNA, 20 bp, Artificial Sequence
  chemically synthesized
taatcagcaagcttaatcta

SEQ ID NO: 346031 - DNA, 20 bp, Artificial Sequence
  chemically synthesized
attcttctttgccctagatt

SEQ ID NO: 346032 - DNA, 20 bp, Artificial Sequence
  chemically synthesized
agcaagcttaatctagggca

SEQ ID NO: 346033 - DNA, 20 bp, Artificial Sequence
  chemically synthesized
aattgtattcttctttgccc

SEQ ID NO: 346034 - DNA, 20 bp, Artificial Sequence
  chemically synthesized
aagcttaatctagggcaaag

SEQ ID NO: 346035 - DNA, 20 bp, Artificial Sequence
  chemically synthesized
caattgtgattgcaaatatt

SEQ ID NO: 346036 - DNA, 20 bp, Artificial Sequence
  chemically synthesized
aattgtgattgcaaatatta

SEQ ID NO: 346037 - DNA, 20 bp, Artificial Sequence
  chemically synthesized
gcaactgaatgacaggtagt

SEQ ID NO: 346038 - DNA, 20 bp, Artificial Sequence
  chemically synthesized
tactgcaactgaatgacagg

SEQ ID NO: 346039 - DNA, 20 bp, Artificial Sequence
  chemically synthesized
aggtcttactacctgtcatt

SEQ ID NO: 346040 - DNA, 20 bp, Artificial Sequence
  chemically synthesized
agttactgcaactgaatgac

SEQ ID NO: 346041 - DNA, 20 bp, Artificial Sequence
  chemically synthesized
tagttactgcaactgaatga

SEQ ID NO: 346042 - DNA, 20 bp, Artificial Sequence
  chemically synthesized
tactacctgtcattcagttg

SEQ ID NO: 346043 - DNA, 20 bp, Artificial Sequence
  chemically synthesized
tcattcagttgcagtaacta

SEQ ID NO: 346044 - DNA, 20 bp, Artificial Sequence
  chemically synthesized
tcagttgcagtaactacaga

SEQ ID NO: 346045 - DNA, 20 bp, Artificial Sequence
  chemically synthesized
attattgaatagactttctg

SEQ ID NO: 346046 - DNA, 20 bp, Artificial Sequence
  chemically synthesized
atagcacattaattattgaa

SEQ ID NO: 346047 - DNA, 20 bp, Artificial Sequence
  chemically synthesized
attcaataattaatgtgcta

SEQ ID NO: 346048 - DNA, 20 bp, Artificial Sequence
  chemically synthesized
aattaatgtgctatggctat

SEQ ID NO: 346049 - DNA, 20 bp, Artificial Sequence
  chemically synthesized
caaaacaaagccaatagcca

SEQ ID NO: 346050 - DNA, 20 bp, Artificial Sequence
  chemically synthesized
caataacaaaacaaagccaa

SEQ ID NO: 346051 - DNA, 20 bp, Artificial Sequence
  chemically synthesized
atgtattcaataacaaaaca

SEQ ID NO: 346052 - DNA, 20 bp, Artificial Sequence
  chemically synthesized
ttattgaatacatttatttt

SEQ ID NO: 346053 - DNA, 20 bp, Artificial Sequence
  chemically synthesized
ttgaatacatttattttaag

SEQ ID NO: 346054 - DNA, 20 bp, Artificial Sequence
  chemically synthesized
catttattttaagcagcatt

SEQ ID NO: 346055 - DNA, 20 bp, Artificial Sequence
  chemically synthesized
taagcgcataaattaaatct

SEQ ID NO: 346056 - DNA, 20 bp, Artificial Sequence
  chemically synthesized
acttatatgaaaatgttact

SEQ ID NO: 346057 - DNA, 20 bp, Artificial Sequence
  chemically synthesized
tcttagtaacattttcatat

SEQ ID NO: 346058 - DNA, 20 bp, Artificial Sequence
  chemically synthesized
gaacaaatgcattttaatga

SEQ ID NO: 346059 - DNA, 20 bp, Artificial Sequence
  chemically synthesized
attaaaatgcatttgttcca

SEQ ID NO: 346060 - DNA, 20 bp, Artificial Sequence
  chemically synthesized
aaaatgcatttgttccacag

SEQ ID NO: 346061 - DNA, 20 bp, Artificial Sequence
  chemically synthesized
tgcatttgttccacagaaga

SEQ ID NO: 346062 - DNA, 20 bp, Artificial Sequence
  chemically synthesized
tgagataattctttcttctg

SEQ ID NO: 346063 - DNA, 20 bp, Artificial Sequence
  chemically synthesized
aaagaattatctcaccattc

SEQ ID NO: 346064 - DNA, 20 bp, Artificial Sequence
  chemically synthesized
tcttgttgagccggaatggt

SEQ ID NO: 346065 - DNA, 20 bp, Artificial Sequence
  chemically synthesized
aatttcttgttgagccggaa

SEQ ID NO: 346066 - DNA, 20 bp, Artificial Sequence
  chemically synthesized
tctcaccattccggctcaac

SEQ ID NO: 346067 - DNA, 20 bp, Artificial Sequence
  chemically synthesized
gactgaatttcttgttgagc

SEQ ID NO: 346068 - DNA, 20 bp, Artificial Sequence
  chemically synthesized
tcaggactgaatttcttgtt

SEQ ID NO: 346069 - DNA, 20 bp, Artificial Sequence
  chemically synthesized
ttccggctcaacaagaaatt

SEQ ID NO: 346070 - DNA, 20 bp, Artificial Sequence
  chemically synthesized
acaagaaattcagtcctgaa

SEQ ID NO: 346071 - DNA, 20 bp, Artificial Sequence
  chemically synthesized
ttaaacttttttgtctgttc

SEQ ID NO: 346072 - DNA, 20 bp, Artificial Sequence
  chemically synthesized
tttaaacttttttgtctgtt

SEQ ID NO: 346073 - DNA, 20 bp, Artificial Sequence
  chemically synthesized
tcagtcctgaacagacaaaa

SEQ ID NO: 346074 - DNA, 20 bp, Artificial Sequence
  chemically synthesized
atattttataaacattaacc

SEQ ID NO: 346075 - DNA, 20 bp, Artificial Sequence
  chemically synthesized
atttcttctacgaaaagtcc

SEQ ID NO: 346076 - DNA, 20 bp, Artificial Sequence
  chemically synthesized
tatttcttctacgaaaagtc

SEQ ID NO: 346077 - DNA, 20 bp, Artificial Sequence
  chemically synthesized
acattaacctggacttttcg

SEQ ID NO: 346078 - DNA, 20 bp, Artificial Sequence
  chemically synthesized
ttaacctggacttttcgtag

SEQ ID NO: 346079 - DNA, 20 bp, Artificial Sequence
  chemically synthesized
agctttatttcttctacgaa

SEQ ID NO: 346080 - DNA, 20 bp, Artificial Sequence
  chemically synthesized
gacttttcgtagaagaaata

SEQ ID NO: 346081 - DNA, 20 bp, Artificial Sequence
  chemically synthesized
ttcgtagaagaaataaagct

SEQ ID NO: 346082 - DNA, 20 bp, Artificial Sequence
  chemically synthesized
ctgctgaaatatgacgttct

SEQ ID NO: 346083 - DNA, 20 bp, Artificial Sequence
  chemically synthesized
aagctgagaacgtcatattt

SEQ ID NO: 346084 - DNA, 20 bp, Artificial Sequence
  chemically synthesized
ctgagaacgtcatatttcag

SEQ ID NO: 346085 - DNA, 20 bp, Artificial Sequence
  chemically synthesized
caatcagaaaacaagtattg

SEQ ID NO: 346086 - DNA, 20 bp, Artificial Sequence
  chemically synthesized
ttatgattcaatcagaaaac

SEQ ID NO: 346087 - DNA, 20 bp, Artificial Sequence
  chemically synthesized
aatgaaatttatgattcaat

SEQ ID NO: 346088 - DNA, 20 bp, Artificial Sequence
  chemically synthesized
tcattgtagaagcaagtata

SEQ ID NO: 346089 - DNA, 20 bp, Artificial Sequence
  chemically synthesized
tactttgtcattgtagaagc

SEQ ID NO: 346090 - DNA, 20 bp, Artificial Sequence
  chemically synthesized
tgggtactttgtcattgtag

SEQ ID NO: 346091 - DNA, 20 bp, Artificial Sequence
  chemically synthesized
ctttgggtactttgtcattg

SEQ ID NO: 346092 - DNA, 20 bp, Artificial Sequence
  chemically synthesized
tacttgcttctacaatgaca

SEQ ID NO: 346093 - DNA, 20 bp, Artificial Sequence
  chemically synthesized
ctacaatgacaaagtaccca

SEQ ID NO: 346094 - DNA, 20 bp, Artificial Sequence
  chemically synthesized
agacattcacatttagcttt

SEQ ID NO: 346095 - DNA, 20 bp, Artificial Sequence
  chemically synthesized
tagacattcacatttagctt

SEQ ID NO: 346096 - DNA, 20 bp, Artificial Sequence
  chemically synthesized
acctactagacattcacatt

SEQ ID NO: 346097 - DNA, 20 bp, Artificial Sequence
  chemically synthesized
caaagctaaatgtgaatgtc

SEQ ID NO: 346098 - DNA, 20 bp, Artificial Sequence
  chemically synthesized
agctaaatgtgaatgtctag

SEQ ID NO: 346099 - DNA, 20 bp, Artificial Sequence
  chemically synthesized
gctaaatgtgaatgtctagt

SEQ ID NO: 346100 - DNA, 20 bp, Artificial Sequence
  chemically synthesized
aatgtgaatgtctagtaggt

SEQ ID NO: 346101 - DNA, 20 bp, Artificial Sequence
  chemically synthesized
tacacatttttctgacctac

SEQ ID NO: 346102 - DNA, 20 bp, Artificial Sequence
  chemically synthesized
tagtaggtcagaaaaatgtg

SEQ ID NO: 346103 - DNA, 20 bp, Artificial Sequence
  chemically synthesized
gaaaaatgtgtagtcgaata

SEQ ID NO: 346104 - DNA, 20 bp, Artificial Sequence
  chemically synthesized
ctctgaatgcttttggtttt

SEQ ID NO: 346105 - DNA, 20 bp, Artificial Sequence
  chemically synthesized
ataaaatcgctaaaaaccaa

SEQ ID NO: 346106 - DNA, 20 bp, Artificial Sequence
  chemically synthesized
ttacactctctgaatgcttt

SEQ ID NO: 346107 - DNA, 20 bp, Artificial Sequence
  chemically synthesized
cgctaaaaaccaaaagcatt

SEQ ID NO: 346108 - DNA, 20 bp, Artificial Sequence
  chemically synthesized
ctaaaaaccaaaagcattca

SEQ ID NO: 346109 - DNA, 20 bp, Artificial Sequence
  chemically synthesized
aaaaaccaaaagcattcaga

SEQ ID NO: 346110 - DNA, 20 bp, Artificial Sequence
  chemically synthesized
caaaagcattcagagagtgt

SEQ ID NO: 346111 - DNA, 20 bp, Artificial Sequence
  chemically synthesized
aaagcattcagagagtgtaa

SEQ ID NO: 346112 - DNA, 20 bp, Artificial Sequence
  chemically synthesized
gggttatttaaatatttgaa

SEQ ID NO: 346113 - DNA, 20 bp, Artificial Sequence
  chemically synthesized
tagggttatttaaatatttg

SEQ ID NO: 346114 - DNA, 20 bp, Artificial Sequence
  chemically synthesized
caaatatttaaataacccta

SEQ ID NO: 346115 - DNA, 20 bp, Artificial Sequence
  chemically synthesized
aaatatttaaataaccctat

SEQ ID NO: 346116 - DNA, 20 bp, Artificial Sequence
  chemically synthesized
atcatatcaagttgcccata

SEQ ID NO: 346117 - DNA, 20 bp, Artificial Sequence
  chemically synthesized
catcatatcaagttgcccat

SEQ ID NO: 346118 - DNA, 20 bp, Artificial Sequence
  chemically synthesized
acatcatatcaagttgccca

SEQ ID NO: 346119 - DNA, 20 bp, Artificial Sequence
  chemically synthesized
tataatattgacatcatatc

SEQ ID NO: 346120 - DNA, 20 bp, Artificial Sequence
  chemically synthesized
tattatatgtcttacgcatc

SEQ ID NO: 346121 - DNA, 20 bp, Artificial Sequence
  chemically synthesized
cttttataaactagatgcgt

SEQ ID NO: 346122 - DNA, 20 bp, Artificial Sequence
  chemically synthesized
tcctgatgacttttataaac

SEQ ID NO: 346123 - DNA, 20 bp, Artificial Sequence
  chemically synthesized
cttacgcatctagtttataa

SEQ ID NO: 346124 - DNA, 20 bp, Artificial Sequence
  chemically synthesized
atctagtttataaaagtcat

SEQ ID NO: 346125 - DNA, 20 bp, Artificial Sequence
  chemically synthesized
tctagtttataaaagtcatc

SEQ ID NO: 346126 - DNA, 20 bp, Artificial Sequence
  chemically synthesized
agtcatcaggaaaaaaatac

SEQ ID NO: 346127 - DNA, 20 bp, Artificial Sequence
  chemically synthesized
atacaagattaatctccttg

SEQ ID NO: 346128 - DNA, 20 bp, Artificial Sequence
  chemically synthesized
ttcccaaattgatccacaag

SEQ ID NO: 346129 - DNA, 20 bp, Artificial Sequence
  chemically synthesized
gtttcccaaattgatccaca

SEQ ID NO: 346130 - DNA, 20 bp, Artificial Sequence
  chemically synthesized
tgtttcccaaattgatccac

SEQ ID NO: 346131 - DNA, 20 bp, Artificial Sequence
  chemically synthesized
aatctccttgtggatcaatt

SEQ ID NO: 346132 - DNA, 20 bp, Artificial Sequence
  chemically synthesized
atctccttgtggatcaattt

SEQ ID NO: 346133 - DNA, 20 bp, Artificial Sequence
  chemically synthesized
gaaacaaatgaataaaacca

SEQ ID NO: 346134 - DNA, 20 bp, Artificial Sequence
  chemically synthesized
tctatctatgtgtagatctg

SEQ ID NO: 346135 - DNA, 20 bp, Artificial Sequence
  chemically synthesized
taaaaccacagatctacaca

SEQ ID NO: 346136 - DNA, 20 bp, Artificial Sequence
  chemically synthesized
aatgtccctctatctatgtg

SEQ ID NO: 346137 - DNA, 20 bp, Artificial Sequence
  chemically synthesized
accacagatctacacataga

SEQ ID NO: 346138 - DNA, 20 bp, Artificial Sequence
  chemically synthesized
cacagatctacacatagata

SEQ ID NO: 346139 - DNA, 20 bp, Artificial Sequence
  chemically synthesized
acagatctacacatagatag

SEQ ID NO: 346140 - DNA, 20 bp, Artificial Sequence
  chemically synthesized
cagatctacacatagataga

SEQ ID NO: 346141 - DNA, 20 bp, Artificial Sequence
  chemically synthesized
catagatagagggacattcc

SEQ ID NO: 346142 - DNA, 20 bp, Artificial Sequence
  chemically synthesized
atagatagagggacattcca

SEQ ID NO: 346143 - DNA, 20 bp, Artificial Sequence
  chemically synthesized
gctgaagtagtgattgtcct

SEQ ID NO: 346144 - DNA, 20 bp, Artificial Sequence
  chemically synthesized
tccaaggacaatcactactt

SEQ ID NO: 346145 - DNA, 20 bp, Artificial Sequence
  chemically synthesized
cagaagattaaaggctgaag

SEQ ID NO: 346146 - DNA, 20 bp, Artificial Sequence
  chemically synthesized
atccagaagattaaaggctg

SEQ ID NO: 346147 - DNA, 20 bp, Artificial Sequence
  chemically synthesized
ccagttatccagaagattaa

SEQ ID NO: 346148 - DNA, 20 bp, Artificial Sequence
  chemically synthesized
accagttatccagaagatta

SEQ ID NO: 346149 - DNA, 20 bp, Artificial Sequence
  chemically synthesized
tacttcagcctttaatcttc

SEQ ID NO: 346150 - DNA, 20 bp, Artificial Sequence
  chemically synthesized
ggctttcaccagttatccag

SEQ ID NO: 346151 - DNA, 20 bp, Artificial Sequence
  chemically synthesized
cctttaatcttctggataac

SEQ ID NO: 346152 - DNA, 20 bp, Artificial Sequence
  chemically synthesized
caaggctttcaccagttatc

SEQ ID NO: 346153 - DNA, 20 bp, Artificial Sequence
  chemically synthesized
atcttctggataactggtga

SEQ ID NO: 346154 - DNA, 20 bp, Artificial Sequence
  chemically synthesized
cttcctgccaaggctttcac

SEQ ID NO: 346155 - DNA, 20 bp, Artificial Sequence
  chemically synthesized
tggataactggtgaaagcct

SEQ ID NO: 346156 - DNA, 20 bp, Artificial Sequence
  chemically synthesized
ataactggtgaaagccttgg

SEQ ID NO: 346157 - DNA, 20 bp, Artificial Sequence
  chemically synthesized
taactggtgaaagccttggc

SEQ ID NO: 346158 - DNA, 20 bp, Artificial Sequence
  chemically synthesized
ctggtgaaagccttggcagg

SEQ ID NO: 346159 - DNA, 20 bp, Artificial Sequence
  chemically synthesized
gcttggagtgcttcctgcca

SEQ ID NO: 346160 - DNA, 20 bp, Artificial Sequence
  chemically synthesized
agcttggagtgcttcctgcc

SEQ ID NO: 346161 - DNA, 20 bp, Artificial Sequence
  chemically synthesized
gccttggcaggaagcactcc

SEQ ID NO: 346162 - DNA, 20 bp, Artificial Sequence
  chemically synthesized
cctttttaataagtagcttg

SEQ ID NO: 346163 - DNA, 20 bp, Artificial Sequence
  chemically synthesized
tacctttttaataagtagct

SEQ ID NO: 346164 - DNA, 20 bp, Artificial Sequence
  chemically synthesized
cctcttacctttttaataag

SEQ ID NO: 346165 - DNA, 20 bp, Artificial Sequence
  chemically synthesized
actccaagctacttattaaa

SEQ ID NO: 346166 - DNA, 20 bp, Artificial Sequence
  chemically synthesized
ctccaagctacttattaaaa

SEQ ID NO: 346167 - DNA, 20 bp, Artificial Sequence
  chemically synthesized
catcctcttacctttttaat

SEQ ID NO: 346168 - DNA, 20 bp, Artificial Sequence
  chemically synthesized
aagctacttattaaaaaggt

SEQ ID NO: 346169 - DNA, 20 bp, Artificial Sequence
  chemically synthesized
gctacttattaaaaaggtaa

SEQ ID NO: 346170 - DNA, 20 bp, Artificial Sequence
  chemically synthesized
ctacttattaaaaaggtaag

SEQ ID NO: 346171 - DNA, 20 bp, Artificial Sequence
  chemically synthesized
aaggtaagaggatgttctta

SEQ ID NO: 346172 - DNA, 20 bp, Artificial Sequence
  chemically synthesized
atatacttgattgtatccat

SEQ ID NO: 346173 - DNA, 20 bp, Artificial Sequence
  chemically synthesized
atgttcttatggatacaatc

SEQ ID NO: 346174 - DNA, 20 bp, Artificial Sequence
  chemically synthesized
atggggcaagtgacagcata

SEQ ID NO: 346175 - DNA, 20 bp, Artificial Sequence
  chemically synthesized
aatgtagatggggcaagtga

SEQ ID NO: 346176 - DNA, 20 bp, Artificial Sequence
  chemically synthesized
tgggaaaatgtagatggggc

SEQ ID NO: 346177 - DNA, 20 bp, Artificial Sequence
  chemically synthesized
aagttgggaaaatgtagatg

SEQ ID NO: 346178 - DNA, 20 bp, Artificial Sequence
  chemically synthesized
aaagttgggaaaatgtagat

SEQ ID NO: 346179 - DNA, 20 bp, Artificial Sequence
  chemically synthesized
taaagttgggaaaatgtaga

SEQ ID NO: 346180 - DNA, 20 bp, Artificial Sequence
  chemically synthesized
actgtaaagttgggaaaatg

SEQ ID NO: 346181 - DNA, 20 bp, Artificial Sequence
  chemically synthesized
tctacattttcccaacttta

SEQ ID NO: 346182 - DNA, 20 bp, Artificial Sequence
  chemically synthesized
ttaattctaactgtaaagtt

SEQ ID NO: 346183 - DNA, 20 bp, Artificial Sequence
  chemically synthesized
cttaattctaactgtaaagt

SEQ ID NO: 346184 - DNA, 20 bp, Artificial Sequence
  chemically synthesized
cattttcccaactttacagt

SEQ ID NO: 346185 - DNA, 20 bp, Artificial Sequence
  chemically synthesized
atcacttaattctaactgta

SEQ ID NO: 346186 - DNA, 20 bp, Artificial Sequence
  chemically synthesized
ccaactttacagttagaatt

SEQ ID NO: 346187 - DNA, 20 bp, Artificial Sequence
  chemically synthesized
tagaattaagtgatgcaaaa

SEQ ID NO: 346188 - DNA, 20 bp, Artificial Sequence
  chemically synthesized
taagtgatgcaaaacagctt

SEQ ID NO: 346189 - DNA, 20 bp, Artificial Sequence
  chemically synthesized
agtgatgcaaaacagcttaa

SEQ ID NO: 346190 - DNA, 20 bp, Artificial Sequence
  chemically synthesized
tgatgcaaaacagcttaaga

SEQ ID NO: 346191 - DNA, 20 bp, Artificial Sequence
  chemically synthesized
gatgcaaaacagcttaagag

SEQ ID NO: 346192 - DNA, 20 bp, Artificial Sequence
  chemically synthesized
tttccatcagatcctctctt

SEQ ID NO: 346193 - DNA, 20 bp, Artificial Sequence
  chemically synthesized
cagcttaagagaggatctga

SEQ ID NO: 346194 - DNA, 20 bp, Artificial Sequence
  chemically synthesized
ttaagagaggatctgatgga

SEQ ID NO: 346195 - DNA, 20 bp, Artificial Sequence
  chemically synthesized
tagggcactttgctttccat

SEQ ID NO: 346196 - DNA, 20 bp, Artificial Sequence
  chemically synthesized
agaggatctgatggaaagca

SEQ ID NO: 346197 - DNA, 20 bp, Artificial Sequence
  chemically synthesized
atgagctgtggagggatata

SEQ ID NO: 346198 - DNA, 20 bp, Artificial Sequence
  chemically synthesized
gatgagctgtggagggatat

SEQ ID NO: 346199 - DNA, 20 bp, Artificial Sequence
  chemically synthesized
tgatgagctgtggagggata

SEQ ID NO: 346200 - DNA, 20 bp, Artificial Sequence
  chemically synthesized
aagtgccctatatccctcca

SEQ ID NO: 346201 - DNA, 20 bp, Artificial Sequence
  chemically synthesized
aaccagtgatgagctgtgga

SEQ ID NO: 346202 - DNA, 20 bp, Artificial Sequence
  chemically synthesized
aaaccagtgatgagctgtgg

SEQ ID NO: 346203 - DNA, 20 bp, Artificial Sequence
  chemically synthesized
caaaccagtgatgagctgtg

SEQ ID NO: 346204 - DNA, 20 bp, Artificial Sequence
  chemically synthesized
ttcaaaccagtgatgagctg

SEQ ID NO: 346205 - DNA, 20 bp, Artificial Sequence
  chemically synthesized
atccctccacagctcatcac

SEQ ID NO: 346206 - DNA, 20 bp, Artificial Sequence
  chemically synthesized
cctgacttcaaaccagtgat

SEQ ID NO: 346207 - DNA, 20 bp, Artificial Sequence
  chemically synthesized
cacagctcatcactggtttg

SEQ ID NO: 346208 - DNA, 20 bp, Artificial Sequence
  chemically synthesized
cttatggcctgacttcaaac

SEQ ID NO: 346209 - DNA, 20 bp, Artificial Sequence
  chemically synthesized
gctcatcactggtttgaagt

SEQ ID NO: 346210 - DNA, 20 bp, Artificial Sequence
  chemically synthesized
ctcatcactggtttgaagtc

SEQ ID NO: 346211 - DNA, 20 bp, Artificial Sequence
  chemically synthesized
ctggtttgaagtcaggccat

SEQ ID NO: 346212 - DNA, 20 bp, Artificial Sequence
  chemically synthesized
ttcatgtcaccatgaactta

SEQ ID NO: 346213 - DNA, 20 bp, Artificial Sequence
  chemically synthesized
gaagtcaggccataagttca

SEQ ID NO: 346214 - DNA, 20 bp, Artificial Sequence
  chemically synthesized
ggtgacatgaaattctcttc

SEQ ID NO: 346215 - DNA, 20 bp, Artificial Sequence
  chemically synthesized
aagactaatttggtcttgaa

SEQ ID NO: 346216 - DNA, 20 bp, Artificial Sequence
  chemically synthesized
cgaagactaatttggtcttg

SEQ ID NO: 346217 - DNA, 20 bp, Artificial Sequence
  chemically synthesized
aattctcttcaagaccaaat

SEQ ID NO: 346218 - DNA, 20 bp, Artificial Sequence
  chemically synthesized
cttgctgacgaagactaatt

SEQ ID NO: 346219 - DNA, 20 bp, Artificial Sequence
  chemically synthesized
aagaccaaattagtcttcgt

SEQ ID NO: 346220 - DNA, 20 bp, Artificial Sequence
  chemically synthesized
ccaaattagtcttcgtcagc

SEQ ID NO: 346221 - DNA, 20 bp, Artificial Sequence
  chemically synthesized
tagggaatttcttgctgacg

SEQ ID NO: 346222 - DNA, 20 bp, Artificial Sequence
  chemically synthesized
gcaagaaattccctacaatt

SEQ ID NO: 346223 - DNA, 20 bp, Artificial Sequence
  chemically synthesized
gagttaaaccctgaattgta

SEQ ID NO: 346224 - DNA, 20 bp, Artificial Sequence
  chemically synthesized
caagaaattccctacaattc

SEQ ID NO: 346225 - DNA, 20 bp, Artificial Sequence
  chemically synthesized
agagttaaaccctgaattgt

SEQ ID NO: 346226 - DNA, 20 bp, Artificial Sequence
  chemically synthesized
aagaaattccctacaattca

SEQ ID NO: 346227 - DNA, 20 bp, Artificial Sequence
  chemically synthesized
aagagttaaaccctgaattg

SEQ ID NO: 346228 - DNA, 20 bp, Artificial Sequence
  chemically synthesized
aattcagggtttaactctta

SEQ ID NO: 346229 - DNA, 20 bp, Artificial Sequence
  chemically synthesized
ttcagggtttaactcttaaa

SEQ ID NO: 346230 - DNA, 20 bp, Artificial Sequence
  chemically synthesized
aatggagctaatctctttaa

SEQ ID NO: 346231 - DNA, 20 bp, Artificial Sequence
  chemically synthesized
aaaatggagctaatctcttt

SEQ ID NO: 346232 - DNA, 20 bp, Artificial Sequence
  chemically synthesized
ggtttaactcttaaagagat

SEQ ID NO: 346233 - DNA, 20 bp, Artificial Sequence
  chemically synthesized
tcgaaattagaaaaaaaatg

SEQ ID NO: 346234 - DNA, 20 bp, Artificial Sequence
  chemically synthesized
attcgaaattagaaaaaaaa

SEQ ID NO: 346235 - DNA, 20 bp, Artificial Sequence
  chemically synthesized
atgttaagtaaattcgaaat

SEQ ID NO: 346236 - DNA, 20 bp, Artificial Sequence
  chemically synthesized
tatataaaatttgtcatgtt

SEQ ID NO: 346237 - DNA, 20 bp, Artificial Sequence
  chemically synthesized
tgacaaattttatatattta

SEQ ID NO: 346238 - DNA, 20 bp, Artificial Sequence
  chemically synthesized
tagtatacaatatatcttga

SEQ ID NO: 346239 - DNA, 20 bp, Artificial Sequence
  chemically synthesized
agtatacaatatatcttgat

SEQ ID NO: 346240 - DNA, 20 bp, Artificial Sequence
  chemically synthesized
tttaaatgtatatgcctatc

SEQ ID NO: 346241 - DNA, 20 bp, Artificial Sequence
  chemically synthesized
taggcatatacatttaaaaa

SEQ ID NO: 346242 - DNA, 20 bp, Artificial Sequence
  chemically synthesized
catttaaaaatggctcaatc

SEQ ID NO: 346243 - DNA, 20 bp, Artificial Sequence
  chemically synthesized
atatatcaattggcttgatt

SEQ ID NO: 346244 - DNA, 20 bp, Artificial Sequence
  chemically synthesized
gaggtaatggatatatcaat

SEQ ID NO: 346245 - DNA, 20 bp, Artificial Sequence
  chemically synthesized
ctcacaagcatgtgaggtaa

SEQ ID NO: 346246 - DNA, 20 bp, Artificial Sequence
  chemically synthesized
aatgttctcacaagcatgtg

SEQ ID NO: 346247 - DNA, 20 bp, Artificial Sequence
  chemically synthesized
aaatgttctcacaagcatgt

SEQ ID NO: 346248 - DNA, 20 bp, Artificial Sequence
  chemically synthesized
ccattacctcacatgcttgt

SEQ ID NO: 346249 - DNA, 20 bp, Artificial Sequence
  chemically synthesized
tagactttaaatgttctcac

SEQ ID NO: 346250 - DNA, 20 bp, Artificial Sequence
  chemically synthesized
catgcttgtgagaacattta

SEQ ID NO: 346251 - DNA, 20 bp, Artificial Sequence
  chemically synthesized
cttgaaaatttcaaaaagaa

SEQ ID NO: 346252 - DNA, 20 bp, Artificial Sequence
  chemically synthesized
gtatgcttgaaaatttcaaa

SEQ ID NO: 346253 - DNA, 20 bp, Artificial Sequence
  chemically synthesized
ctattctttttgaaattttc

SEQ ID NO: 346254 - DNA, 20 bp, Artificial Sequence
  chemically synthesized
caatacattgctattaacta

SEQ ID NO: 346255 - DNA, 20 bp, Artificial Sequence
  chemically synthesized
tataacaagactatagttaa

SEQ ID NO: 346256 - DNA, 20 bp, Artificial Sequence
  chemically synthesized
gggtgtatataacaagacta

SEQ ID NO: 346257 - DNA, 20 bp, Artificial Sequence
  chemically synthesized
aactgttgggtgtatataac

SEQ ID NO: 346258 - DNA, 20 bp, Artificial Sequence
  chemically synthesized
gtcttgttatatacacccaa

SEQ ID NO: 346259 - DNA, 20 bp, Artificial Sequence
  chemically synthesized
ggaaattcaagagaactgtt

SEQ ID NO: 346260 - DNA, 20 bp, Artificial Sequence
  chemically synthesized
gggaaattcaagagaactgt

SEQ ID NO: 346261 - DNA, 20 bp, Artificial Sequence
  chemically synthesized
ggttggagagggaaattcaa

SEQ ID NO: 346262 - DNA, 20 bp, Artificial Sequence
  chemically synthesized
taggttggagagggaaattc

SEQ ID NO: 346263 - DNA, 20 bp, Artificial Sequence
  chemically synthesized
aatttcagttaggttggaga

SEQ ID NO: 346264 - DNA, 20 bp, Artificial Sequence
  chemically synthesized
aaatttcagttaggttggag

SEQ ID NO: 346265 - DNA, 20 bp, Artificial Sequence
  chemically synthesized
aaaatttcagttaggttgga

SEQ ID NO: 346266 - DNA, 20 bp, Artificial Sequence
  chemically synthesized
acaaaatttcagttaggttg

SEQ ID NO: 346267 - DNA, 20 bp, Artificial Sequence
  chemically synthesized
acacaaaatttcagttaggt

SEQ ID NO: 346268 - DNA, 20 bp, Artificial Sequence
  chemically synthesized
ggttacacaaaatttcagtt

SEQ ID NO: 346269 - DNA, 20 bp, Artificial Sequence
  chemically synthesized
gggttacacaaaatttcagt

SEQ ID NO: 346270 - DNA, 20 bp, Artificial Sequence
  chemically synthesized
aatggggttacacaaaattt

SEQ ID NO: 346271 - DNA, 20 bp, Artificial Sequence
  chemically synthesized
catataacttgttaagaatg

SEQ ID NO: 346272 - DNA, 20 bp, Artificial Sequence
  chemically synthesized
tcatataacttgttaagaat

SEQ ID NO: 346273 - DNA, 20 bp, Artificial Sequence
  chemically synthesized
atcatataacttgttaagaa

SEQ ID NO: 346274 - DNA, 20 bp, Artificial Sequence
  chemically synthesized
tgtgtaaccccattcttaac

SEQ ID NO: 346275 - DNA, 20 bp, Artificial Sequence
  chemically synthesized
cctgaatcatataacttgtt

SEQ ID NO: 346276 - DNA, 20 bp, Artificial Sequence
  chemically synthesized
tcttaacaagttatatgatt

SEQ ID NO: 346277 - DNA, 20 bp, Artificial Sequence
  chemically synthesized
cttaacaagttatatgattc

SEQ ID NO: 346278 - DNA, 20 bp, Artificial Sequence
  chemically synthesized
ttaacaagttatatgattca

SEQ ID NO: 346279 - DNA, 20 bp, Artificial Sequence
  chemically synthesized
tatatgattcagggatataa

SEQ ID NO: 346280 - DNA, 20 bp, Artificial Sequence
  chemically synthesized
gggatataatagaaaatgtt

SEQ ID NO: 346281 - DNA, 20 bp, Artificial Sequence
  chemically synthesized
tgagacatacacattctatc

SEQ ID NO: 346282 - DNA, 20 bp, Artificial Sequence
  chemically synthesized
aaagttgggctaaaactaga

SEQ ID NO: 346283 - DNA, 20 bp, Artificial Sequence
  chemically synthesized
atacacattctatctagttt

SEQ ID NO: 346284 - DNA, 20 bp, Artificial Sequence
  chemically synthesized
cttgaaagttgggctaaaac

SEQ ID NO: 346285 - DNA, 20 bp, Artificial Sequence
  chemically synthesized
ctagttttagcccaactttc

SEQ ID NO: 346286 - DNA, 20 bp, Artificial Sequence
  chemically synthesized
tctggagagccttgaaagtt

SEQ ID NO: 346287 - DNA, 20 bp, Artificial Sequence
  chemically synthesized
tagttttagcccaactttca

SEQ ID NO: 346288 - DNA, 20 bp, Artificial Sequence
  chemically synthesized
ttctggagagccttgaaagt

SEQ ID NO: 346289 - DNA, 20 bp, Artificial Sequence
  chemically synthesized
gaaattctggagagccttga

SEQ ID NO: 346290 - DNA, 20 bp, Artificial Sequence
  chemically synthesized
gcccaactttcaaggctctc

SEQ ID NO: 346291 - DNA, 20 bp, Artificial Sequence
  chemically synthesized
aaagtagaggaaattctgga

SEQ ID NO: 346292 - DNA, 20 bp, Artificial Sequence
  chemically synthesized
tcaaagtagaggaaattctg

SEQ ID NO: 346293 - DNA, 20 bp, Artificial Sequence
  chemically synthesized
agtcaaagtagaggaaattc

SEQ ID NO: 346294 - DNA, 20 bp, Artificial Sequence
  chemically synthesized
aaattataaagtcaaagtag

SEQ ID NO: 346295 - DNA, 20 bp, Artificial Sequence
  chemically synthesized
aaaattataaagtcaaagta

SEQ ID NO: 346296 - DNA, 20 bp, Artificial Sequence
  chemically synthesized
gaaaaattataaagtcaaag

SEQ ID NO: 346297 - DNA, 20 bp, Artificial Sequence
  chemically synthesized
aaagaaaaattataaagtca

SEQ ID NO: 346298 - DNA, 20 bp, Artificial Sequence
  chemically synthesized
gaatcgaaagaaaaattata

SEQ ID NO: 346299 - DNA, 20 bp, Artificial Sequence
  chemically synthesized
ccaaaccatatcagaatcga

SEQ ID NO: 346300 - DNA, 20 bp, Artificial Sequence
  chemically synthesized
tttttctttcgattctgata

SEQ ID NO: 346301 - DNA, 20 bp, Artificial Sequence
  chemically synthesized
aagaaacaaccaaaccatat

SEQ ID NO: 346302 - DNA, 20 bp, Artificial Sequence
  chemically synthesized
ctttcgattctgatatggtt

SEQ ID NO: 346303 - DNA, 20 bp, Artificial Sequence
  chemically synthesized
tacaattcaagatttggggg

SEQ ID NO: 346304 - DNA, 20 bp, Artificial Sequence
  chemically synthesized
agctacaattcaagatttgg

SEQ ID NO: 346305 - DNA, 20 bp, Artificial Sequence
  chemically synthesized
gagctacaattcaagatttg

SEQ ID NO: 346306 - DNA, 20 bp, Artificial Sequence
  chemically synthesized
ggagctacaattcaagattt

SEQ ID NO: 346307 - DNA, 20 bp, Artificial Sequence
  chemically synthesized
gggagctacaattcaagatt

SEQ ID NO: 346308 - DNA, 20 bp, Artificial Sequence
  chemically synthesized
ttcccccaaatcttgaattg

SEQ ID NO: 346309 - DNA, 20 bp, Artificial Sequence
  chemically synthesized
aattacgggagctacaattc

SEQ ID NO: 346310 - DNA, 20 bp, Artificial Sequence
  chemically synthesized
tgacatggtgggaattacgg

SEQ ID NO: 346311 - DNA, 20 bp, Artificial Sequence
  chemically synthesized
catgacatggtgggaattac

SEQ ID NO: 346312 - DNA, 20 bp, Artificial Sequence
  chemically synthesized
ccatgacatggtgggaatta

SEQ ID NO: 346313 - DNA, 20 bp, Artificial Sequence
  chemically synthesized
ggtccctcccatgacatggt

SEQ ID NO: 346314 - DNA, 20 bp, Artificial Sequence
  chemically synthesized
aggtccctcccatgacatgg

SEQ ID NO: 346315 - DNA, 20 bp, Artificial Sequence
  chemically synthesized
ccgtaattcccaccatgtca

SEQ ID NO: 346316 - DNA, 20 bp, Artificial Sequence
  chemically synthesized
cgtaattcccaccatgtcat

SEQ ID NO: 346317 - DNA, 20 bp, Artificial Sequence
  chemically synthesized
accaggtccctcccatgaca

SEQ ID NO: 346318 - DNA, 20 bp, Artificial Sequence
  chemically synthesized
taattcccaccatgtcatgg

SEQ ID NO: 346319 - DNA, 20 bp, Artificial Sequence
  chemically synthesized
aattcccaccatgtcatggg

SEQ ID NO: 346320 - DNA, 20 bp, Artificial Sequence
  chemically synthesized
attcccaccatgtcatggga

SEQ ID NO: 346321 - DNA, 20 bp, Artificial Sequence
  chemically synthesized
accatgtcatgggagggacc

SEQ ID NO: 346322 - DNA, 20 bp, Artificial Sequence
  chemically synthesized
atgtcatgggagggacctgg

SEQ ID NO: 346323 - DNA, 20 bp, Artificial Sequence
  chemically synthesized
tgtcatgggagggacctggt

SEQ ID NO: 346324 - DNA, 20 bp, Artificial Sequence
  chemically synthesized
tcatgggagggacctggtag

SEQ ID NO: 346325 - DNA, 20 bp, Artificial Sequence
  chemically synthesized
catgggagggacctggtagg

SEQ ID NO: 346326 - DNA, 20 bp, Artificial Sequence
  chemically synthesized
tgattcagttacctcctacc

SEQ ID NO: 346327 - DNA, 20 bp, Artificial Sequence
  chemically synthesized
atgattcagttacctcctac

SEQ ID NO: 346328 - DNA, 20 bp, Artificial Sequence
  chemically synthesized
ggtaggaggtaactgaatca

SEQ ID NO: 346329 - DNA, 20 bp, Artificial Sequence
  chemically synthesized
aaagacctgccgccatgatt

SEQ ID NO: 346330 - DNA, 20 bp, Artificial Sequence
  chemically synthesized
aggaggtaactgaatcatgg

SEQ ID NO: 346331 - DNA, 20 bp, Artificial Sequence
  chemically synthesized
aggtaactgaatcatggcgg

SEQ ID NO: 346332 - DNA, 20 bp, Artificial Sequence
  chemically synthesized
ggtaactgaatcatggcggc

SEQ ID NO: 346333 - DNA, 20 bp, Artificial Sequence
  chemically synthesized
atcacgagaacagcatggga

SEQ ID NO: 346334 - DNA, 20 bp, Artificial Sequence
  chemically synthesized
cactatcacgagaacagcat

SEQ ID NO: 346335 - DNA, 20 bp, Artificial Sequence
  chemically synthesized
tcactatcacgagaacagca

SEQ ID NO: 346336 - DNA, 20 bp, Artificial Sequence
  chemically synthesized
cgtattcactatcacgagaa

SEQ ID NO: 346337 - DNA, 20 bp, Artificial Sequence
  chemically synthesized
ttcccatgctgttctcgtga

SEQ ID NO: 346338 - DNA, 20 bp, Artificial Sequence
  chemically synthesized
tgagacgtattcactatcac

SEQ ID NO: 346339 - DNA, 20 bp, Artificial Sequence
  chemically synthesized
tgatagtgaatacgtctcac

SEQ ID NO: 346340 - DNA, 20 bp, Artificial Sequence
  chemically synthesized
ataaaaccatcagatctcgt

SEQ ID NO: 346341 - DNA, 20 bp, Artificial Sequence
  chemically synthesized
atacgtctcacgagatctga

SEQ ID NO: 346342 - DNA, 20 bp, Artificial Sequence
  chemically synthesized
actttcttgtataaaaccat

SEQ ID NO: 346343 - DNA, 20 bp, Artificial Sequence
  chemically synthesized
gagatctgatggttttatac

SEQ ID NO: 346344 - DNA, 20 bp, Artificial Sequence
  chemically synthesized
tctgatggttttatacaaga

SEQ ID NO: 346345 - DNA, 20 bp, Artificial Sequence
  chemically synthesized
ttttatacaagaaagtttcc

SEQ ID NO: 346346 - DNA, 20 bp, Artificial Sequence
  chemically synthesized
aagaagagaaagcatgttcc

SEQ ID NO: 346347 - DNA, 20 bp, Artificial Sequence
  chemically synthesized
caagaagagaaagcatgttc

SEQ ID NO: 346348 - DNA, 20 bp, Artificial Sequence
  chemically synthesized
tggagacaggcaagaagaga

SEQ ID NO: 346349 - DNA, 20 bp, Artificial Sequence
  chemically synthesized
tccatggagacaggcaagaa

SEQ ID NO: 346350 - DNA, 20 bp, Artificial Sequence
  chemically synthesized
cttccatggagacaggcaag

SEQ ID NO: 346351 - DNA, 20 bp, Artificial Sequence
  chemically synthesized
catcttccatggagacaggc

SEQ ID NO: 346352 - DNA, 20 bp, Artificial Sequence
  chemically synthesized
tctcttcttgcctgtctcca

SEQ ID NO: 346353 - DNA, 20 bp, Artificial Sequence
  chemically synthesized
gtcacatcttccatggagac

SEQ ID NO: 346354 - DNA, 20 bp, Artificial Sequence
  chemically synthesized
agtcacatcttccatggaga

SEQ ID NO: 346355 - DNA, 20 bp, Artificial Sequence
  chemically synthesized
cttcttgcctgtctccatgg

SEQ ID NO: 346356 - DNA, 20 bp, Artificial Sequence
  chemically synthesized
gcaaagtcacatcttccatg

SEQ ID NO: 346357 - DNA, 20 bp, Artificial Sequence
  chemically synthesized
cagcaaagtcacatcttcca

SEQ ID NO: 346358 - DNA, 20 bp, Artificial Sequence
  chemically synthesized
tggagggcaaatgagcagca

SEQ ID NO: 346359 - DNA, 20 bp, Artificial Sequence
  chemically synthesized
catggtggagggcaaatgag

SEQ ID NO: 346360 - DNA, 20 bp, Artificial Sequence
  chemically synthesized
aatcatggtggagggcaaat

SEQ ID NO: 346361 - DNA, 20 bp, Artificial Sequence
  chemically synthesized
ggcctcacaatcatggtgga

SEQ ID NO: 346362 - DNA, 20 bp, Artificial Sequence
  chemically synthesized
aggcctcacaatcatggtgg

SEQ ID NO: 346363 - DNA, 20 bp, Artificial Sequence
  chemically synthesized
gaggcctcacaatcatggtg

SEQ ID NO: 346364 - DNA, 20 bp, Artificial Sequence
  chemically synthesized
gggaggcctcacaatcatgg

SEQ ID NO: 346365 - DNA, 20 bp, Artificial Sequence
  chemically synthesized
ttgccctccaccatgattgt

SEQ ID NO: 346366 - DNA, 20 bp, Artificial Sequence
  chemically synthesized
ctggggaggcctcacaatca

SEQ ID NO: 346367 - DNA, 20 bp, Artificial Sequence
  chemically synthesized
tgccctccaccatgattgtg

SEQ ID NO: 346368 - DNA, 20 bp, Artificial Sequence
  chemically synthesized
ccatgattgtgaggcctccc

SEQ ID NO: 346369 - DNA, 20 bp, Artificial Sequence
  chemically synthesized
atagttctacatggctgggg

SEQ ID NO: 346370 - DNA, 20 bp, Artificial Sequence
  chemically synthesized
catagttctacatggctggg

SEQ ID NO: 346371 - DNA, 20 bp, Artificial Sequence
  chemically synthesized
ctcatagttctacatggctg

SEQ ID NO: 346372 - DNA, 20 bp, Artificial Sequence
  chemically synthesized
gtgaggcctccccagccatg

SEQ ID NO: 346373 - DNA, 20 bp, Artificial Sequence
  chemically synthesized
actcatagttctacatggct

SEQ ID NO: 346374 - DNA, 20 bp, Artificial Sequence
  chemically synthesized
gactcatagttctacatggc

SEQ ID NO: 346375 - DNA, 20 bp, Artificial Sequence
  chemically synthesized
aattgactcatagttctaca

SEQ ID NO: 346376 - DNA, 20 bp, Artificial Sequence
  chemically synthesized
ccccagccatgtagaactat

SEQ ID NO: 346377 - DNA, 20 bp, Artificial Sequence
  chemically synthesized
ggaaaggtttaattgactca

SEQ ID NO: 346378 - DNA, 20 bp, Artificial Sequence
  chemically synthesized
ctaggtaatttataaaggaa

SEQ ID NO: 346379 - DNA, 20 bp, Artificial Sequence
  chemically synthesized
actaggtaatttataaagga

SEQ ID NO: 346380 - DNA, 20 bp, Artificial Sequence
  chemically synthesized
aaagactaggtaatttataa

SEQ ID NO: 346381 - DNA, 20 bp, Artificial Sequence
  chemically synthesized
caaagactaggtaatttata

SEQ ID NO: 346382 - DNA, 20 bp, Artificial Sequence
  chemically synthesized
cctttcctttataaattacc

SEQ ID NO: 346383 - DNA, 20 bp, Artificial Sequence
  chemically synthesized
tttataaattacctagtctt

SEQ ID NO: 346384 - DNA, 20 bp, Artificial Sequence
  chemically synthesized
ataaaggcgtaccaaagact

SEQ ID NO: 346385 - DNA, 20 bp, Artificial Sequence
  chemically synthesized
aataaaggcgtaccaaagac

SEQ ID NO: 346386 - DNA, 20 bp, Artificial Sequence
  chemically synthesized
ctgctaataaaggcgtacca

SEQ ID NO: 346387 - DNA, 20 bp, Artificial Sequence
  chemically synthesized
agtctttggtacgcctttat

SEQ ID NO: 346388 - DNA, 20 bp, Artificial Sequence
  chemically synthesized
ctttggtacgcctttattag

SEQ ID NO: 346389 - DNA, 20 bp, Artificial Sequence
  chemically synthesized
tgttctcatgctgctaataa

SEQ ID NO: 346390 - DNA, 20 bp, Artificial Sequence
  chemically synthesized
ctgttctcatgctgctaata

SEQ ID NO: 346391 - DNA, 20 bp, Artificial Sequence
  chemically synthesized
tacgcctttattagcagcat

SEQ ID NO: 346392 - DNA, 20 bp, Artificial Sequence
  chemically synthesized
ctttattagcagcatgagaa

SEQ ID NO: 346393 - DNA, 20 bp, Artificial Sequence
  chemically synthesized
agcatgagaacagactaata

SEQ ID NO: 346394 - DNA, 20 bp, Artificial Sequence
  chemically synthesized
acctataaaggaatctgtat

SEQ ID NO: 346395 - DNA, 20 bp, Artificial Sequence
  chemically synthesized
gactaatacagattccttta

SEQ ID NO: 346396 - DNA, 20 bp, Artificial Sequence
  chemically synthesized
actaatacagattcctttat

SEQ ID NO: 346397 - DNA, 20 bp, Artificial Sequence
  chemically synthesized
tgttcaaaataaacctataa

SEQ ID NO: 346398 - DNA, 20 bp, Artificial Sequence
  chemically synthesized
ctgttcaaaataaacctata

SEQ ID NO: 346399 - DNA, 20 bp, Artificial Sequence
  chemically synthesized
ctttataggtttattttgaa

SEQ ID NO: 346400 - DNA, 20 bp, Artificial Sequence
  chemically synthesized
tataggtttattttgaacag

SEQ ID NO: 346401 - DNA, 20 bp, Artificial Sequence
  chemically synthesized
atacagtgcaaaatacaaag

SEQ ID NO: 346402 - DNA, 20 bp, Artificial Sequence
  chemically synthesized
gatacagtgcaaaatacaaa

SEQ ID NO: 346403 - DNA, 20 bp, Artificial Sequence
  chemically synthesized
gggatacagtgcaaaataca

SEQ ID NO: 346404 - DNA, 20 bp, Artificial Sequence
  chemically synthesized
agagatgggttgatgggata

SEQ ID NO: 346405 - DNA, 20 bp, Artificial Sequence
  chemically synthesized
aaaatgagagatgggttgat

SEQ ID NO: 346406 - DNA, 20 bp, Artificial Sequence
  chemically synthesized
aaaaatgagagatgggttga

SEQ ID NO: 346407 - DNA, 20 bp, Artificial Sequence
  chemically synthesized
ctgcagcaaaaatgagagat

SEQ ID NO: 346408 - DNA, 20 bp, Artificial Sequence
  chemically synthesized
actgcagcaaaaatgagaga

SEQ ID NO: 346409 - DNA, 20 bp, Artificial Sequence
  chemically synthesized
aggaactgcagcaaaaatga

SEQ ID NO: 346410 - DNA, 20 bp, Artificial Sequence
  chemically synthesized
acaggaactgcagcaaaaat

SEQ ID NO: 346411 - DNA, 20 bp, Artificial Sequence
  chemically synthesized
cccatctctcatttttgctg

SEQ ID NO: 346412 - DNA, 20 bp, Artificial Sequence
  chemically synthesized
aacagcagaaacaggaactg

SEQ ID NO: 346413 - DNA, 20 bp, Artificial Sequence
  chemically synthesized
aaccctctaacagcagaaac

SEQ ID NO: 346414 - DNA, 20 bp, Artificial Sequence
  chemically synthesized
taaccctctaacagcagaaa

SEQ ID NO: 346415 - DNA, 20 bp, Artificial Sequence
  chemically synthesized
gcagttcctgtttctgctgt

SEQ ID NO: 346416 - DNA, 20 bp, Artificial Sequence
  chemically synthesized
agttcctgtttctgctgtta

SEQ ID NO: 346417 - DNA, 20 bp, Artificial Sequence
  chemically synthesized
gttcctgtttctgctgttag

SEQ ID NO: 346418 - DNA, 20 bp, Artificial Sequence
  chemically synthesized
gggtgttaaccctctaacag

SEQ ID NO: 346419 - DNA, 20 bp, Artificial Sequence
  chemically synthesized
ttcctgtttctgctgttaga

SEQ ID NO: 346420 - DNA, 20 bp, Artificial Sequence
  chemically synthesized
aaagggtgttaaccctctaa

SEQ ID NO: 346421 - DNA, 20 bp, Artificial Sequence
  chemically synthesized
gctagagctaggaagtgaaa

SEQ ID NO: 346422 - DNA, 20 bp, Artificial Sequence
  chemically synthesized
tgctagagctaggaagtgaa

SEQ ID NO: 346423 - DNA, 20 bp, Artificial Sequence
  chemically synthesized
ttgctagagctaggaagtga

SEQ ID NO: 346424 - DNA, 20 bp, Artificial Sequence
  chemically synthesized
gttaacaccctttcacttcc

SEQ ID NO: 346425 - DNA, 20 bp, Artificial Sequence
  chemically synthesized
ctcctgttgctagagctagg

SEQ ID NO: 346426 - DNA, 20 bp, Artificial Sequence
  chemically synthesized
accctttcacttcctagctc

SEQ ID NO: 346427 - DNA, 20 bp, Artificial Sequence
  chemically synthesized
ctcctcctgttgctagagct

SEQ ID NO: 346428 - DNA, 20 bp, Artificial Sequence
  chemically synthesized
cctcctcctgttgctagagc

SEQ ID NO: 346429 - DNA, 20 bp, Artificial Sequence
  chemically synthesized
tcacttcctagctctagcaa

SEQ ID NO: 346430 - DNA, 20 bp, Artificial Sequence
  chemically synthesized
cacttcctagctctagcaac

SEQ ID NO: 346431 - DNA, 20 bp, Artificial Sequence
  chemically synthesized
tcctcctcctcctgttgcta

SEQ ID NO: 346432 - DNA, 20 bp, Artificial Sequence
  chemically synthesized
cttcctagctctagcaacag

SEQ ID NO: 346433 - DNA, 20 bp, Artificial Sequence
  chemically synthesized
cctcctcctcctcctgttgc

SEQ ID NO: 346434 - DNA, 20 bp, Artificial Sequence
  chemically synthesized
ttcctagctctagcaacagg

SEQ ID NO: 346435 - DNA, 20 bp, Artificial Sequence
  chemically synthesized
cctagctctagcaacaggag

SEQ ID NO: 346436 - DNA, 20 bp, Artificial Sequence
  chemically synthesized
ctagctctagcaacaggagg

SEQ ID NO: 346437 - DNA, 20 bp, Artificial Sequence
  chemically synthesized
agctctagcaacaggaggag

SEQ ID NO: 346438 - DNA, 20 bp, Artificial Sequence
  chemically synthesized
gctctagcaacaggaggagg

SEQ ID NO: 346439 - DNA, 20 bp, Artificial Sequence
  chemically synthesized
tctagcaacaggaggaggag

SEQ ID NO: 346440 - DNA, 20 bp, Artificial Sequence
  chemically synthesized
ctagcaacaggaggaggagg

SEQ ID NO: 346441 - DNA, 20 bp, Artificial Sequence
  chemically synthesized
gcaacaggaggaggaggagg

SEQ ID NO: 346442 - DNA, 20 bp, Artificial Sequence
  chemically synthesized
aacaggaggaggaggaggaa

SEQ ID NO: 346443 - DNA, 20 bp, Artificial Sequence
  chemically synthesized
acaggaggaggaggaggaag

SEQ ID NO: 346444 - DNA, 20 bp, Artificial Sequence
  chemically synthesized
aggaggaggaggaggaagag

SEQ ID NO: 346445 - DNA, 20 bp, Artificial Sequence
  chemically synthesized
ggaggaggaggaggaagagg

SEQ ID NO: 346446 - DNA, 20 bp, Artificial Sequence
  chemically synthesized
gaggaggaggaggaagagga

SEQ ID NO: 346447 - DNA, 20 bp, Artificial Sequence
  chemically synthesized
ggaggaggaggaagaggagg

SEQ ID NO: 346448 - DNA, 20 bp, Artificial Sequence
  chemically synthesized
gaggaggaggaagaggaggg

SEQ ID NO: 346449 - DNA, 20 bp, Artificial Sequence
  chemically synthesized
ggaaaataaattgtccttca

SEQ ID NO: 346450 - DNA, 20 bp, Artificial Sequence
  chemically synthesized
gaaaataaattgtccttcaa

SEQ ID NO: 346451 - DNA, 20 bp, Artificial Sequence
  chemically synthesized
aaaataaattgtccttcaaa

SEQ ID NO: 346452 - DNA, 20 bp, Artificial Sequence
  chemically synthesized
cctcagaaatgtccctttga

SEQ ID NO: 346453 - DNA, 20 bp, Artificial Sequence
  chemically synthesized
tcctcagaaatgtccctttg

SEQ ID NO: 346454 - DNA, 20 bp, Artificial Sequence
  chemically synthesized
tccttcaaagggacatttct

SEQ ID NO: 346455 - DNA, 20 bp, Artificial Sequence
  chemically synthesized
ccttcaaagggacatttctg

SEQ ID NO: 346456 - DNA, 20 bp, Artificial Sequence
  chemically synthesized
caaagggacatttctgagga

SEQ ID NO: 346457 - DNA, 20 bp, Artificial Sequence
  chemically synthesized
gaaccttatagaactgtcct

SEQ ID NO: 346458 - DNA, 20 bp, Artificial Sequence
  chemically synthesized
atttctgaggacagttctat

SEQ ID NO: 346459 - DNA, 20 bp, Artificial Sequence
  chemically synthesized
tttctgaggacagttctata

SEQ ID NO: 346460 - DNA, 20 bp, Artificial Sequence
  chemically synthesized
tgggacattatagaacctta

SEQ ID NO: 346461 - DNA, 20 bp, Artificial Sequence
  chemically synthesized
caaccttgcctgggacatta

SEQ ID NO: 346462 - DNA, 20 bp, Artificial Sequence
  chemically synthesized
tataaggttctataatgtcc

SEQ ID NO: 346463 - DNA, 20 bp, Artificial Sequence
  chemically synthesized
ataaggttctataatgtccc

SEQ ID NO: 346464 - DNA, 20 bp, Artificial Sequence
  chemically synthesized
ggttctataatgtcccaggc

SEQ ID NO: 346465 - DNA, 20 bp, Artificial Sequence
  chemically synthesized
gttctataatgtcccaggca

SEQ ID NO: 346466 - DNA, 20 bp, Artificial Sequence
  chemically synthesized
actgtacctcaaccttgcct

SEQ ID NO: 346467 - DNA, 20 bp, Artificial Sequence
  chemically synthesized
aactgtacctcaaccttgcc

SEQ ID NO: 346468 - DNA, 20 bp, Artificial Sequence
  chemically synthesized
ataatgtcccaggcaaggtt

SEQ ID NO: 346469 - DNA, 20 bp, Artificial Sequence
  chemically synthesized
taatgtcccaggcaaggttg

SEQ ID NO: 346470 - DNA, 20 bp, Artificial Sequence
  chemically synthesized
tcccaggcaaggttgaggta

SEQ ID NO: 346471 - DNA, 20 bp, Artificial Sequence
  chemically synthesized
tgaggtacagttacctatta

SEQ ID NO: 346472 - DNA, 20 bp, Artificial Sequence
  chemically synthesized
gttgaactgatgaccataat

SEQ ID NO: 346473 - DNA, 20 bp, Artificial Sequence
  chemically synthesized
tgttgaactgatgaccataa

SEQ ID NO: 346474 - DNA, 20 bp, Artificial Sequence
  chemically synthesized
cagttacctattatggtcat

SEQ ID NO: 346475 - DNA, 20 bp, Artificial Sequence
  chemically synthesized
ttcaacaatgttatctttat

SEQ ID NO: 346476 - DNA, 20 bp, Artificial Sequence
  chemically synthesized
ggaagaaggaaaagctaata

SEQ ID NO: 346477 - DNA, 20 bp, Artificial Sequence
  chemically synthesized
gtgagacaaggaagaaggaa

SEQ ID NO: 346478 - DNA, 20 bp, Artificial Sequence
  chemically synthesized
gaaaagtgagacaaggaaga

SEQ ID NO: 346479 - DNA, 20 bp, Artificial Sequence
  chemically synthesized
ggaaaagtgagacaaggaag

SEQ ID NO: 346480 - DNA, 20 bp, Artificial Sequence
  chemically synthesized
cctggaaaagtgagacaagg

SEQ ID NO: 346481 - DNA, 20 bp, Artificial Sequence
  chemically synthesized
ggacctggaaaagtgagaca

SEQ ID NO: 346482 - DNA, 20 bp, Artificial Sequence
  chemically synthesized
gggacctggaaaagtgagac

SEQ ID NO: 346483 - DNA, 20 bp, Artificial Sequence
  chemically synthesized
tcttccttgtctcacttttc

SEQ ID NO: 346484 - DNA, 20 bp, Artificial Sequence
  chemically synthesized
catgtgggacctggaaaagt

SEQ ID NO: 346485 - DNA, 20 bp, Artificial Sequence
  chemically synthesized
cttccttgtctcacttttcc

SEQ ID NO: 346486 - DNA, 20 bp, Artificial Sequence
  chemically synthesized
ggaacatgtgggacctggaa

SEQ ID NO: 346487 - DNA, 20 bp, Artificial Sequence
  chemically synthesized
actcaggaacatgtgggacc

SEQ ID NO: 346488 - DNA, 20 bp, Artificial Sequence
  chemically synthesized
aagaaaactcaggaacatgt

SEQ ID NO: 346489 - DNA, 20 bp, Artificial Sequence
  chemically synthesized
taagaaaactcaggaacatg

SEQ ID NO: 346490 - DNA, 20 bp, Artificial Sequence
  chemically synthesized
tccaggtcccacatgttcct

SEQ ID NO: 346491 - DNA, 20 bp, Artificial Sequence
  chemically synthesized
agaaactagtaagaaaactc

SEQ ID NO: 346492 - DNA, 20 bp, Artificial Sequence
  chemically synthesized
aagaaactagtaagaaaact

SEQ ID NO: 346493 - DNA, 20 bp, Artificial Sequence
  chemically synthesized
atgttcctgagttttcttac

SEQ ID NO: 346494 - DNA, 20 bp, Artificial Sequence
  chemically synthesized
tgattatcaaagaaactagt

SEQ ID NO: 346495 - DNA, 20 bp, Artificial Sequence
  chemically synthesized
tggctgattatcaaagaaac

SEQ ID NO: 346496 - DNA, 20 bp, Artificial Sequence
  chemically synthesized
ttactagtttctttgataat

SEQ ID NO: 346497 - DNA, 20 bp, Artificial Sequence
  chemically synthesized
ccatgattggctgattatca

SEQ ID NO: 346498 - DNA, 20 bp, Artificial Sequence
  chemically synthesized
ctttgataatcagccaatca

SEQ ID NO: 346499 - DNA, 20 bp, Artificial Sequence
  chemically synthesized
gcctgacagaaagccatgat

SEQ ID NO: 346500 - DNA, 20 bp, Artificial Sequence
  chemically synthesized
agccaatcatggctttctgt

SEQ ID NO: 346501 - DNA, 20 bp, Artificial Sequence
  chemically synthesized
gccaatcatggctttctgtc

SEQ ID NO: 346502 - DNA, 20 bp, Artificial Sequence
  chemically synthesized
ccaaagcaaagcctgacaga

SEQ ID NO: 346503 - DNA, 20 bp, Artificial Sequence
  chemically synthesized
tcccccaaagcaaagcctga

SEQ ID NO: 346504 - DNA, 20 bp, Artificial Sequence
  chemically synthesized
ctttctgtcaggctttgctt

SEQ ID NO: 346505 - DNA, 20 bp, Artificial Sequence
  chemically synthesized
tttctgtcaggctttgcttt

SEQ ID NO: 346506 - DNA, 20 bp, Artificial Sequence
  chemically synthesized
ttctgtcaggctttgctttg

SEQ ID NO: 346507 - DNA, 20 bp, Artificial Sequence
  chemically synthesized
ttgagttttcccccaaagca

SEQ ID NO: 346508 - DNA, 20 bp, Artificial Sequence
  chemically synthesized
tctgtcaggctttgctttgg

SEQ ID NO: 346509 - DNA, 20 bp, Artificial Sequence
  chemically synthesized
tcagtttgagttttccccca

SEQ ID NO: 346510 - DNA, 20 bp, Artificial Sequence
  chemically synthesized
atagtcaagagtgtcagttt

SEQ ID NO: 346511 - DNA, 20 bp, Artificial Sequence
  chemically synthesized
acagcaatagtcaagagtgt

SEQ ID NO: 346512 - DNA, 20 bp, Artificial Sequence
  chemically synthesized
taagtgacagcaatagtcaa

SEQ ID NO: 346513 - DNA, 20 bp, Artificial Sequence
  chemically synthesized
tttaagtgacagcaatagtc

SEQ ID NO: 346514 - DNA, 20 bp, Artificial Sequence
  chemically synthesized
ttcagtttaagtgacagcaa

SEQ ID NO: 346515 - DNA, 20 bp, Artificial Sequence
  chemically synthesized
taagagttcagtttaagtga

SEQ ID NO: 346516 - DNA, 20 bp, Artificial Sequence
  chemically synthesized
gctctctaagagttcagttt

SEQ ID NO: 346517 - DNA, 20 bp, Artificial Sequence
  chemically synthesized
tgtcacttaaactgaactct

SEQ ID NO: 346518 - DNA, 20 bp, Artificial Sequence
  chemically synthesized
accactgctctctaagagtt

SEQ ID NO: 346519 - DNA, 20 bp, Artificial Sequence
  chemically synthesized
tcacttaaactgaactctta

SEQ ID NO: 346520 - DNA, 20 bp, Artificial Sequence
  chemically synthesized
acttaaactgaactcttaga

SEQ ID NO: 346521 - DNA, 20 bp, Artificial Sequence
  chemically synthesized
gtatcaccactgctctctaa

SEQ ID NO: 346522 - DNA, 20 bp, Artificial Sequence
  chemically synthesized
taaactgaactcttagagag

SEQ ID NO: 346523 - DNA, 20 bp, Artificial Sequence
  chemically synthesized
atgtatcaccactgctctct

SEQ ID NO: 346524 - DNA, 20 bp, Artificial Sequence
  chemically synthesized
actgaactcttagagagcag

SEQ ID NO: 346525 - DNA, 20 bp, Artificial Sequence
  chemically synthesized
ggtgatacattttaattctt

SEQ ID NO: 346526 - DNA, 20 bp, Artificial Sequence
  chemically synthesized
acattttaattctttagctt

SEQ ID NO: 346527 - DNA, 20 bp, Artificial Sequence
  chemically synthesized
cattttaattctttagcttt

SEQ ID NO: 346528 - DNA, 20 bp, Artificial Sequence
  chemically synthesized
ctctctggcccctaaagcta

SEQ ID NO: 346529 - DNA, 20 bp, Artificial Sequence
  chemically synthesized
attttaattctttagcttta

SEQ ID NO: 346530 - DNA, 20 bp, Artificial Sequence
  chemically synthesized
ttttaattctttagctttag

SEQ ID NO: 346531 - DNA, 20 bp, Artificial Sequence
  chemically synthesized
aattctttagctttaggggc

SEQ ID NO: 346532 - DNA, 20 bp, Artificial Sequence
  chemically synthesized
tcttccctctctggccccta

SEQ ID NO: 346533 - DNA, 20 bp, Artificial Sequence
  chemically synthesized
ttctttagctttaggggcca

SEQ ID NO: 346534 - DNA, 20 bp, Artificial Sequence
  chemically synthesized
ctttagctttaggggccaga

SEQ ID NO: 346535 - DNA, 20 bp, Artificial Sequence
  chemically synthesized
tttagctttaggggccagag

SEQ ID NO: 346536 - DNA, 20 bp, Artificial Sequence
  chemically synthesized
ttagctttaggggccagaga

SEQ ID NO: 346537 - DNA, 20 bp, Artificial Sequence
  chemically synthesized
gctttaggggccagagaggg

SEQ ID NO: 346538 - DNA, 20 bp, Artificial Sequence
  chemically synthesized
tctgcatcatcttccctctc

SEQ ID NO: 346539 - DNA, 20 bp, Artificial Sequence
  chemically synthesized
gccagagagggaagatgatg

SEQ ID NO: 346540 - DNA, 20 bp, Artificial Sequence
  chemically synthesized
gaagatgatgcagacttctc

SEQ ID NO: 346541 - DNA, 20 bp, Artificial Sequence
  chemically synthesized
tagagctgcgtgagcttgag

SEQ ID NO: 346542 - DNA, 20 bp, Artificial Sequence
  chemically synthesized
atctagagctgcgtgagctt

SEQ ID NO: 346543 - DNA, 20 bp, Artificial Sequence
  chemically synthesized
gcagacttctcaagctcacg

SEQ ID NO: 346544 - DNA, 20 bp, Artificial Sequence
  chemically synthesized
tctgccatctagagctgcgt

SEQ ID NO: 346545 - DNA, 20 bp, Artificial Sequence
  chemically synthesized
ttctcaagctcacgcagctc

SEQ ID NO: 346546 - DNA, 20 bp, Artificial Sequence
  chemically synthesized
caagctcacgcagctctaga

SEQ ID NO: 346547 - DNA, 20 bp, Artificial Sequence
  chemically synthesized
gctcacgcagctctagatgg

SEQ ID NO: 346548 - DNA, 20 bp, Artificial Sequence
  chemically synthesized
aatgcagtctctgccatcta

SEQ ID NO: 346549 - DNA, 20 bp, Artificial Sequence
  chemically synthesized
tcacgcagctctagatggca

SEQ ID NO: 346550 - DNA, 20 bp, Artificial Sequence
  chemically synthesized
taaatgcagtctctgccatc

SEQ ID NO: 346551 - DNA, 20 bp, Artificial Sequence
  chemically synthesized
gaaagacctggatttaaatg

SEQ ID NO: 346552 - DNA, 20 bp, Artificial Sequence
  chemically synthesized
gcagagactgcatttaaatc

SEQ ID NO: 346553 - DNA, 20 bp, Artificial Sequence
  chemically synthesized
cagagactgcatttaaatcc

SEQ ID NO: 346554 - DNA, 20 bp, Artificial Sequence
  chemically synthesized
acgcagggaggagaaagacc

SEQ ID NO: 346555 - DNA, 20 bp, Artificial Sequence
  chemically synthesized
agcaacacgcagggaggaga

SEQ ID NO: 346556 - DNA, 20 bp, Artificial Sequence
  chemically synthesized
atgtagcaacacgcagggag

SEQ ID NO: 346557 - DNA, 20 bp, Artificial Sequence
  chemically synthesized
gcatgtagcaacacgcaggg

SEQ ID NO: 346558 - DNA, 20 bp, Artificial Sequence
  chemically synthesized
ggcatgtagcaacacgcagg

SEQ ID NO: 346559 - DNA, 20 bp, Artificial Sequence
  chemically synthesized
atggcatgtagcaacacgca

SEQ ID NO: 346560 - DNA, 20 bp, Artificial Sequence
  chemically synthesized
aatggcatgtagcaacacgc

SEQ ID NO: 346561 - DNA, 20 bp, Artificial Sequence
  chemically synthesized
aaatggcatgtagcaacacg

SEQ ID NO: 346562 - DNA, 20 bp, Artificial Sequence
  chemically synthesized
agaggtaccaaaatggcatg

SEQ ID NO: 346563 - DNA, 20 bp, Artificial Sequence
  chemically synthesized
cgtgttgctacatgccattt

SEQ ID NO: 346564 - DNA, 20 bp, Artificial Sequence
  chemically synthesized
cctgtagagaggtaccaaaa

SEQ ID NO: 346565 - DNA, 20 bp, Artificial Sequence
  chemically synthesized
gccattttggtacctctcta

SEQ ID NO: 346566 - DNA, 20 bp, Artificial Sequence
  chemically synthesized
ccattttggtacctctctac

SEQ ID NO: 346567 - DNA, 20 bp, Artificial Sequence
  chemically synthesized
tggaaggcaagcctgtagag

SEQ ID NO: 346568 - DNA, 20 bp, Artificial Sequence
  chemically synthesized
atggaaggcaagcctgtaga

SEQ ID NO: 346569 - DNA, 20 bp, Artificial Sequence
  chemically synthesized
ttatggaaggcaagcctgta

SEQ ID NO: 346570 - DNA, 20 bp, Artificial Sequence
  chemically synthesized
ggttatggaaggcaagcctg

SEQ ID NO: 346571 - DNA, 20 bp, Artificial Sequence
  chemically synthesized
tttgaaaggttatggaaggc

SEQ ID NO: 346572 - DNA, 20 bp, Artificial Sequence
  chemically synthesized
gaactttgaaaggttatgga

SEQ ID NO: 346573 - DNA, 20 bp, Artificial Sequence
  chemically synthesized
tgaactttgaaaggttatgg

SEQ ID NO: 346574 - DNA, 20 bp, Artificial Sequence
  chemically synthesized
tgctgaactttgaaaggtta

SEQ ID NO: 346575 - DNA, 20 bp, Artificial Sequence
  chemically synthesized
ttgccttccataacctttca

SEQ ID NO: 346576 - DNA, 20 bp, Artificial Sequence
  chemically synthesized
ggagaatgctgaactttgaa

SEQ ID NO: 346577 - DNA, 20 bp, Artificial Sequence
  chemically synthesized
aggagaatgctgaactttga

SEQ ID NO: 346578 - DNA, 20 bp, Artificial Sequence
  chemically synthesized
ttccataacctttcaaagtt

SEQ ID NO: 346579 - DNA, 20 bp, Artificial Sequence
  chemically synthesized
gtgttcatttggatgagtag

SEQ ID NO: 346580 - DNA, 20 bp, Artificial Sequence
  chemically synthesized
ctgtgttcatttggatgagt

SEQ ID NO: 346581 - DNA, 20 bp, Artificial Sequence
  chemically synthesized
actgtgttcatttggatgag

SEQ ID NO: 346582 - DNA, 20 bp, Artificial Sequence
  chemically synthesized
actactgtgttcatttggat

SEQ ID NO: 346583 - DNA, 20 bp, Artificial Sequence
  chemically synthesized
acatgactactgtgttcatt

SEQ ID NO: 346584 - DNA, 20 bp, Artificial Sequence
  chemically synthesized
cctactcatccaaatgaaca

SEQ ID NO: 346585 - DNA, 20 bp, Artificial Sequence
  chemically synthesized
actcatccaaatgaacacag

SEQ ID NO: 346586 - DNA, 20 bp, Artificial Sequence
  chemically synthesized
ccattattttatcaagtgga

SEQ ID NO: 346587 - DNA, 20 bp, Artificial Sequence
  chemically synthesized
tgacccattattttatcaag

SEQ ID NO: 346588 - DNA, 20 bp, Artificial Sequence
  chemically synthesized
ctgtgacccattattttatc

SEQ ID NO: 346589 - DNA, 20 bp, Artificial Sequence
  chemically synthesized
ccatccacttgataaaataa

SEQ ID NO: 346590 - DNA, 20 bp, Artificial Sequence
  chemically synthesized
catccacttgataaaataat

SEQ ID NO: 346591 - DNA, 20 bp, Artificial Sequence
  chemically synthesized
cttgataaaataatgggtca

SEQ ID NO: 346592 - DNA, 20 bp, Artificial Sequence
  chemically synthesized
taaaataatgggtcacagca

SEQ ID NO: 346593 - DNA, 20 bp, Artificial Sequence
  chemically synthesized
tcgttgaataacaatggatc

SEQ ID NO: 346594 - DNA, 20 bp, Artificial Sequence
  chemically synthesized
tcttggtcgttgaataacaa

SEQ ID NO: 346595 - DNA, 20 bp, Artificial Sequence
  chemically synthesized
tccattgttattcaacgacc

SEQ ID NO: 346596 - DNA, 20 bp, Artificial Sequence
  chemically synthesized
ttacaggaactcaagagtct

SEQ ID NO: 346597 - DNA, 20 bp, Artificial Sequence
  chemically synthesized
attcaacgaccaagactctt

SEQ ID NO: 346598 - DNA, 20 bp, Artificial Sequence
  chemically synthesized
acataattacaggaactcaa

SEQ ID NO: 346599 - DNA, 20 bp, Artificial Sequence
  chemically synthesized
ttacataattacaggaactc

SEQ ID NO: 346600 - DNA, 20 bp, Artificial Sequence
  chemically synthesized
ggggcttgttacataattac

SEQ ID NO: 346601 - DNA, 20 bp, Artificial Sequence
  chemically synthesized
aggggcttgttacataatta

SEQ ID NO: 346602 - DNA, 20 bp, Artificial Sequence
  chemically synthesized
agttcctgtaattatgtaac

SEQ ID NO: 346603 - DNA, 20 bp, Artificial Sequence
  chemically synthesized
tatgaccactgacagttaag

SEQ ID NO: 346604 - DNA, 20 bp, Artificial Sequence
  chemically synthesized
ttatgaccactgacagttaa

SEQ ID NO: 346605 - DNA, 20 bp, Artificial Sequence
  chemically synthesized
gtaacaagccccttaactgt

SEQ ID NO: 346606 - DNA, 20 bp, Artificial Sequence
  chemically synthesized
tttatgaccactgacagtta

SEQ ID NO: 346607 - DNA, 20 bp, Artificial Sequence
  chemically synthesized
ctttatgaccactgacagtt

SEQ ID NO: 346608 - DNA, 20 bp, Artificial Sequence
  chemically synthesized
acaagccccttaactgtcag

SEQ ID NO: 346609 - DNA, 20 bp, Artificial Sequence
  chemically synthesized
cttgcctttatgaccactga

SEQ ID NO: 346610 - DNA, 20 bp, Artificial Sequence
  chemically synthesized
cttaactgtcagtggtcata

SEQ ID NO: 346611 - DNA, 20 bp, Artificial Sequence
  chemically synthesized
ttaactgtcagtggtcataa

SEQ ID NO: 346612 - DNA, 20 bp, Artificial Sequence
  chemically synthesized
ctgtcagtggtcataaaggc

SEQ ID NO: 346613 - DNA, 20 bp, Artificial Sequence
  chemically synthesized
ggtcataaaggcaagaatct

SEQ ID NO: 346614 - DNA, 20 bp, Artificial Sequence
  chemically synthesized
aaggcaagaatctcagactt

SEQ ID NO: 346615 - DNA, 20 bp, Artificial Sequence
  chemically synthesized
ggggtttgattccgaagtct

SEQ ID NO: 346616 - DNA, 20 bp, Artificial Sequence
  chemically synthesized
aaatggggggtttgattccg

SEQ ID NO: 346617 - DNA, 20 bp, Artificial Sequence
  chemically synthesized
ttgcagtaagagtaaatggg

SEQ ID NO: 346618 - DNA, 20 bp, Artificial Sequence
  chemically synthesized
attgcagtaagagtaaatgg

SEQ ID NO: 346619 - DNA, 20 bp, Artificial Sequence
  chemically synthesized
aattgcagtaagagtaaatg

SEQ ID NO: 346620 - DNA, 20 bp, Artificial Sequence
  chemically synthesized
aaattgcagtaagagtaaat

SEQ ID NO: 346621 - DNA, 20 bp, Artificial Sequence
  chemically synthesized
caaattgcagtaagagtaaa

SEQ ID NO: 346622 - DNA, 20 bp, Artificial Sequence
  chemically synthesized
gtgagggcaaattgcagtaa

SEQ ID NO: 346623 - DNA, 20 bp, Artificial Sequence
  chemically synthesized
gtgtgagggcaaattgcagt

SEQ ID NO: 346624 - DNA, 20 bp, Artificial Sequence
  chemically synthesized
acctgtgtgagggcaaattg

SEQ ID NO: 346625 - DNA, 20 bp, Artificial Sequence
  chemically synthesized
tactgcaatttgccctcaca

SEQ ID NO: 346626 - DNA, 20 bp, Artificial Sequence
  chemically synthesized
actgcaatttgccctcacac

SEQ ID NO: 346627 - DNA, 20 bp, Artificial Sequence
  chemically synthesized
tcttgagaatacctgtgtga

SEQ ID NO: 346628 - DNA, 20 bp, Artificial Sequence
  chemically synthesized
atcttgagaatacctgtgtg

SEQ ID NO: 346629 - DNA, 20 bp, Artificial Sequence
  chemically synthesized
aatcttgagaatacctgtgt

SEQ ID NO: 346630 - DNA, 20 bp, Artificial Sequence
  chemically synthesized
gccctcacacaggtattctc

SEQ ID NO: 346631 - DNA, 20 bp, Artificial Sequence
  chemically synthesized
ctttgttatctcgtaatctt

SEQ ID NO: 346632 - DNA, 20 bp, Artificial Sequence
  chemically synthesized
acaggtattctcaagattac

SEQ ID NO: 346633 - DNA, 20 bp, Artificial Sequence
  chemically synthesized
ctcaagattacgagataaca

SEQ ID NO: 346634 - DNA, 20 bp, Artificial Sequence
  chemically synthesized
attacgagataacaaagtgt

SEQ ID NO: 346635 - DNA, 20 bp, Artificial Sequence
  chemically synthesized
tacgagataacaaagtgtaa

SEQ ID NO: 346636 - DNA, 20 bp, Artificial Sequence
  chemically synthesized
gataacaaagtgtaagagct

SEQ ID NO: 346637 - DNA, 20 bp, Artificial Sequence
  chemically synthesized
caaagtgtaagagcttagca

SEQ ID NO: 346638 - DNA, 20 bp, Artificial Sequence
  chemically synthesized
tgtgtttcaggcactgtgct

SEQ ID NO: 346639 - DNA, 20 bp, Artificial Sequence
  chemically synthesized
ttagcacagtgcctgaaaca

SEQ ID NO: 346640 - DNA, 20 bp, Artificial Sequence
  chemically synthesized
tagcacagtgcctgaaacac

SEQ ID NO: 346641 - DNA, 20 bp, Artificial Sequence
  chemically synthesized
ttgaacacatcctgtgtttc

SEQ ID NO: 346642 - DNA, 20 bp, Artificial Sequence
  chemically synthesized
attgaacacatcctgtgttt

SEQ ID NO: 346643 - DNA, 20 bp, Artificial Sequence
  chemically synthesized
aacacaggatgtgttcaata

SEQ ID NO: 346644 - DNA, 20 bp, Artificial Sequence
  chemically synthesized
acacaggatgtgttcaataa

SEQ ID NO: 346645 - DNA, 20 bp, Artificial Sequence
  chemically synthesized
cacaggatgtgttcaataaa

SEQ ID NO: 346646 - DNA, 20 bp, Artificial Sequence
  chemically synthesized
aggatgtgttcaataaaggg

SEQ ID NO: 346647 - DNA, 20 bp, Artificial Sequence
  chemically synthesized
tttgctccaggtgaaaataa

SEQ ID NO: 346648 - DNA, 20 bp, Artificial Sequence
  chemically synthesized
gggtggctattattttcacc

SEQ ID NO: 346649 - DNA, 20 bp, Artificial Sequence
  chemically synthesized
gtggctattattttcacctg

SEQ ID NO: 346650 - DNA, 20 bp, Artificial Sequence
  chemically synthesized
atttgtggtcgttttgctcc

SEQ ID NO: 346651 - DNA, 20 bp, Artificial Sequence
  chemically synthesized
tatttgtggtcgttttgctc

SEQ ID NO: 346652 - DNA, 20 bp, Artificial Sequence
  chemically synthesized
tggagcaaaacgaccacaaa

SEQ ID NO: 346653 - DNA, 20 bp, Artificial Sequence
  chemically synthesized
ggagcaaaacgaccacaaat

SEQ ID NO: 346654 - DNA, 20 bp, Artificial Sequence
  chemically synthesized
gagcaaaacgaccacaaata

SEQ ID NO: 346655 - DNA, 20 bp, Artificial Sequence
  chemically synthesized
agcaaaacgaccacaaatag

SEQ ID NO: 346656 - DNA, 20 bp, Artificial Sequence
  chemically synthesized
gagcacatggcccctatttg

SEQ ID NO: 346657 - DNA, 20 bp, Artificial Sequence
  chemically synthesized
aggggatgctgcggagcaca

SEQ ID NO: 346658 - DNA, 20 bp, Artificial Sequence
  chemically synthesized
aataggggccatgtgctccg

SEQ ID NO: 346659 - DNA, 20 bp, Artificial Sequence
  chemically synthesized
gacaggcaggggatgctgcg

SEQ ID NO: 346660 - DNA, 20 bp, Artificial Sequence
  chemically synthesized
gagacaggcaggggatgctg

SEQ ID NO: 346661 - DNA, 20 bp, Artificial Sequence
  chemically synthesized
tggctttgggagacaggcag

SEQ ID NO: 346662 - DNA, 20 bp, Artificial Sequence
  chemically synthesized
ctggctttgggagacaggca

SEQ ID NO: 346663 - DNA, 20 bp, Artificial Sequence
  chemically synthesized
tctggctttgggagacaggc

SEQ ID NO: 346664 - DNA, 20 bp, Artificial Sequence
  chemically synthesized
ttctggctttgggagacagg

SEQ ID NO: 346665 - DNA, 20 bp, Artificial Sequence
  chemically synthesized
ttgttctggctttgggagac

SEQ ID NO: 346666 - DNA, 20 bp, Artificial Sequence
  chemically synthesized
catcccctgcctgtctccca

SEQ ID NO: 346667 - DNA, 20 bp, Artificial Sequence
  chemically synthesized
attgttctggctttgggaga

SEQ ID NO: 346668 - DNA, 20 bp, Artificial Sequence
  chemically synthesized
ccctgcctgtctcccaaagc

SEQ ID NO: 346669 - DNA, 20 bp, Artificial Sequence
  chemically synthesized
tctcattgttctggctttgg

SEQ ID NO: 346670 - DNA, 20 bp, Artificial Sequence
  chemically synthesized
ggtctcattgttctggcttt

SEQ ID NO: 346671 - DNA, 20 bp, Artificial Sequence
  chemically synthesized
tggtctcattgttctggctt

SEQ ID NO: 346672 - DNA, 20 bp, Artificial Sequence
  chemically synthesized
tctcccaaagccagaacaat

SEQ ID NO: 346673 - DNA, 20 bp, Artificial Sequence
  chemically synthesized
cctatttggtctcattgttc

SEQ ID NO: 346674 - DNA, 20 bp, Artificial Sequence
  chemically synthesized
gccagaacaatgagaccaaa

SEQ ID NO: 346675 - DNA, 20 bp, Artificial Sequence
  chemically synthesized
ccagaacaatgagaccaaat

SEQ ID NO: 346676 - DNA, 20 bp, Artificial Sequence
  chemically synthesized
tttgtttgtggacgcctatt

SEQ ID NO: 346677 - DNA, 20 bp, Artificial Sequence
  chemically synthesized
ttacatgtctgttttgtttg

SEQ ID NO: 346678 - DNA, 20 bp, Artificial Sequence
  chemically synthesized
ataggcgtccacaaacaaaa

SEQ ID NO: 346679 - DNA, 20 bp, Artificial Sequence
  chemically synthesized
gtaaaatgaaaaaaataaaa

SEQ ID NO: 346680 - DNA, 20 bp, Artificial Sequence
  chemically synthesized
catacagatgaagtaaaaga

SEQ ID NO: 346681 - DNA, 20 bp, Artificial Sequence
  chemically synthesized
acatacagatgaagtaaaag

SEQ ID NO: 346682 - DNA, 20 bp, Artificial Sequence
  chemically synthesized
aacatacagatgaagtaaaa

SEQ ID NO: 346683 - DNA, 20 bp, Artificial Sequence
  chemically synthesized
aaaacatacagatgaagtaa

SEQ ID NO: 346684 - DNA, 20 bp, Artificial Sequence
  chemically synthesized
ataggaaaaacatacagatg

SEQ ID NO: 346685 - DNA, 20 bp, Artificial Sequence
  chemically synthesized
atgggcataggaaaaacata

SEQ ID NO: 346686 - DNA, 20 bp, Artificial Sequence
  chemically synthesized
tagagaagagggatgggcat

SEQ ID NO: 346687 - DNA, 20 bp, Artificial Sequence
  chemically synthesized
atagagaagagggatgggca

SEQ ID NO: 346688 - DNA, 20 bp, Artificial Sequence
  chemically synthesized
tcgaaatagagaagagggat

SEQ ID NO: 346689 - DNA, 20 bp, Artificial Sequence
  chemically synthesized
ttcgaaatagagaagaggga

SEQ ID NO: 346690 - DNA, 20 bp, Artificial Sequence
  chemically synthesized
atgtttcgaaatagagaaga

SEQ ID NO: 346691 - DNA, 20 bp, Artificial Sequence
  chemically synthesized
catgtttcgaaatagagaag

SEQ ID NO: 346692 - DNA, 20 bp, Artificial Sequence
  chemically synthesized
gcatgtttcgaaatagagaa

SEQ ID NO: 346693 - DNA, 20 bp, Artificial Sequence
  chemically synthesized
gagcatgtttcgaaatagag

SEQ ID NO: 346694 - DNA, 20 bp, Artificial Sequence
  chemically synthesized
tgagagcatgtttcgaaata

SEQ ID NO: 346695 - DNA, 20 bp, Artificial Sequence
  chemically synthesized
tgtgagagcatgtttcgaaa

SEQ ID NO: 346696 - DNA, 20 bp, Artificial Sequence
  chemically synthesized
ccagttgcaaaacaatgtga

SEQ ID NO: 346697 - DNA, 20 bp, Artificial Sequence
  chemically synthesized
tcccagttgcaaaacaatgt

SEQ ID NO: 346698 - DNA, 20 bp, Artificial Sequence
  chemically synthesized
ctctcacattgttttgcaac

SEQ ID NO: 346699 - DNA, 20 bp, Artificial Sequence
  chemically synthesized
tctcacattgttttgcaact

SEQ ID NO: 346700 - DNA, 20 bp, Artificial Sequence
  chemically synthesized
taagataaaatgagtattcc

SEQ ID NO: 346701 - DNA, 20 bp, Artificial Sequence
  chemically synthesized
agaattggataagataaaat

SEQ ID NO: 346702 - DNA, 20 bp, Artificial Sequence
  chemically synthesized
aaagatagttagaattggat

SEQ ID NO: 346703 - DNA, 20 bp, Artificial Sequence
  chemically synthesized
aacttaaagatagttagaat

SEQ ID NO: 346704 - DNA, 20 bp, Artificial Sequence
  chemically synthesized
agctgaaacttaaagatagt

SEQ ID NO: 346705 - DNA, 20 bp, Artificial Sequence
  chemically synthesized
atccaattctaactatcttt

SEQ ID NO: 346706 - DNA, 20 bp, Artificial Sequence
  chemically synthesized
gttgagctgaaacttaaaga

SEQ ID NO: 346707 - DNA, 20 bp, Artificial Sequence
  chemically synthesized
ttctaactatctttaagttt

SEQ ID NO: 346708 - DNA, 20 bp, Artificial Sequence
  chemically synthesized
agaagttgagctgaaactta

SEQ ID NO: 346709 - DNA, 20 bp, Artificial Sequence
  chemically synthesized
aacatccagaagtagaagtt

SEQ ID NO: 346710 - DNA, 20 bp, Artificial Sequence
  chemically synthesized
ttcagctcaacttctacttc

SEQ ID NO: 346711 - DNA, 20 bp, Artificial Sequence
  chemically synthesized
taggaaacatccagaagtag

SEQ ID NO: 346712 - DNA, 20 bp, Artificial Sequence
  chemically synthesized
aaataggaaacatccagaag

SEQ ID NO: 346713 - DNA, 20 bp, Artificial Sequence
  chemically synthesized
ggaaaataggaaacatccag

SEQ ID NO: 346714 - DNA, 20 bp, Artificial Sequence
  chemically synthesized
gatggaaaataggaaacatc

SEQ ID NO: 346715 - DNA, 20 bp, Artificial Sequence
  chemically synthesized
caagggctgtgatggaaaat

SEQ ID NO: 346716 - DNA, 20 bp, Artificial Sequence
  chemically synthesized
acaagggctgtgatggaaaa

SEQ ID NO: 346717 - DNA, 20 bp, Artificial Sequence
  chemically synthesized
atgtttcctattttccatca

SEQ ID NO: 346718 - DNA, 20 bp, Artificial Sequence
  chemically synthesized
gaaatcaacaagggctgtga

SEQ ID NO: 346719 - DNA, 20 bp, Artificial Sequence
  chemically synthesized
tatatgagagaaatcaacaa

SEQ ID NO: 346720 - DNA, 20 bp, Artificial Sequence
  chemically synthesized
atatatgagagaaatcaaca

SEQ ID NO: 346721 - DNA, 20 bp, Artificial Sequence
  chemically synthesized
aatatatgagagaaatcaac

SEQ ID NO: 346722 - DNA, 20 bp, Artificial Sequence
  chemically synthesized
aatgctgtagaaatatatga

SEQ ID NO: 346723 - DNA, 20 bp, Artificial Sequence
  chemically synthesized
tgaatgctgtagaaatatat

SEQ ID NO: 346724 - DNA, 20 bp, Artificial Sequence
  chemically synthesized
atttctctcatatatttcta

SEQ ID NO: 346725 - DNA, 20 bp, Artificial Sequence
  chemically synthesized
tttatagtgtatgaatgctg

SEQ ID NO: 346726 - DNA, 20 bp, Artificial Sequence
  chemically synthesized
tacagcattcatacactata

SEQ ID NO: 346727 - DNA, 20 bp, Artificial Sequence
  chemically synthesized
aagtagtaaatttcacttta

SEQ ID NO: 346728 - DNA, 20 bp, Artificial Sequence
  chemically synthesized
aagtaaaattatttgtgaag

SEQ ID NO: 346729 - DNA, 20 bp, Artificial Sequence
  chemically synthesized
ctgaagtaaaattatttgtg

SEQ ID NO: 346730 - DNA, 20 bp, Artificial Sequence
  chemically synthesized
cttcacaaataattttactt

SEQ ID NO: 346731 - DNA, 20 bp, Artificial Sequence
  chemically synthesized
aaaatagttcaataggtctg

SEQ ID NO: 346732 - DNA, 20 bp, Artificial Sequence
  chemically synthesized
actgaccaaaatagttcaat

SEQ ID NO: 346733 - DNA, 20 bp, Artificial Sequence
  chemically synthesized
gactgaccaaaatagttcaa

SEQ ID NO: 346734 - DNA, 20 bp, Artificial Sequence
  chemically synthesized
tcagacctattgaactattt

SEQ ID NO: 346735 - DNA, 20 bp, Artificial Sequence
  chemically synthesized
acctattgaactattttggt

SEQ ID NO: 346736 - DNA, 20 bp, Artificial Sequence
  chemically synthesized
agagtcaggactgaccaaaa

SEQ ID NO: 346737 - DNA, 20 bp, Artificial Sequence
  chemically synthesized
tttggtcagtcctgactctc

SEQ ID NO: 346738 - DNA, 20 bp, Artificial Sequence
  chemically synthesized
ttcagtgtaacttgagagtc

SEQ ID NO: 346739 - DNA, 20 bp, Artificial Sequence
  chemically synthesized
tttcagtgtaacttgagagt

SEQ ID NO: 346740 - DNA, 20 bp, Artificial Sequence
  chemically synthesized
caactttcagtgtaacttga

SEQ ID NO: 346741 - DNA, 20 bp, Artificial Sequence
  chemically synthesized
agcaactttcagtgtaactt

SEQ ID NO: 346742 - DNA, 20 bp, Artificial Sequence
  chemically synthesized
tgactctcaagttacactga

SEQ ID NO: 346743 - DNA, 20 bp, Artificial Sequence
  chemically synthesized
cctttccttctagcaacttt

SEQ ID NO: 346744 - DNA, 20 bp, Artificial Sequence
  chemically synthesized
caagttacactgaaagttgc

SEQ ID NO: 346745 - DNA, 20 bp, Artificial Sequence
  chemically synthesized
gttacactgaaagttgctag

SEQ ID NO: 346746 - DNA, 20 bp, Artificial Sequence
  chemically synthesized
ttacactgaaagttgctaga

SEQ ID NO: 346747 - DNA, 20 bp, Artificial Sequence
  chemically synthesized
actgaaagttgctagaagga

SEQ ID NO: 346748 - DNA, 20 bp, Artificial Sequence
  chemically synthesized
ctgaaagttgctagaaggaa

SEQ ID NO: 346749 - DNA, 20 bp, Artificial Sequence
  chemically synthesized
tagaaatgatcctttccttc

SEQ ID NO: 346750 - DNA, 20 bp, Artificial Sequence
  chemically synthesized
agaggaccccagagaaaaat

SEQ ID NO: 346751 - DNA, 20 bp, Artificial Sequence
  chemically synthesized
gatcatttctaatttttctc

SEQ ID NO: 346752 - DNA, 20 bp, Artificial Sequence
  chemically synthesized
atcatttctaatttttctct

SEQ ID NO: 346753 - DNA, 20 bp, Artificial Sequence
  chemically synthesized
tcatttctaatttttctctg

SEQ ID NO: 346754 - DNA, 20 bp, Artificial Sequence
  chemically synthesized
tattgtgccagaggacccca

SEQ ID NO: 346755 - DNA, 20 bp, Artificial Sequence
  chemically synthesized
agtattgtgccagaggaccc

SEQ ID NO: 346756 - DNA, 20 bp, Artificial Sequence
  chemically synthesized
aatttttctctggggtcctc

SEQ ID NO: 346757 - DNA, 20 bp, Artificial Sequence
  chemically synthesized
taagtttagtattgtgccag

SEQ ID NO: 346758 - DNA, 20 bp, Artificial Sequence
  chemically synthesized
ataagtttagtattgtgcca

SEQ ID NO: 346759 - DNA, 20 bp, Artificial Sequence
  chemically synthesized
tgataagtttagtattgtgc

SEQ ID NO: 346760 - DNA, 20 bp, Artificial Sequence
  chemically synthesized
tggcacaatactaaacttat

SEQ ID NO: 346761 - DNA, 20 bp, Artificial Sequence
  chemically synthesized
cattcagtgcctgataagtt

SEQ ID NO: 346762 - DNA, 20 bp, Artificial Sequence
  chemically synthesized
ggcacaatactaaacttatc

SEQ ID NO: 346763 - DNA, 20 bp, Artificial Sequence
  chemically synthesized
ttaagcattcagtgcctgat

SEQ ID NO: 346764 - DNA, 20 bp, Artificial Sequence
  chemically synthesized
tgtctacaggattaagcatt

SEQ ID NO: 346765 - DNA, 20 bp, Artificial Sequence
  chemically synthesized
gcactgaatgcttaatcctg

SEQ ID NO: 346766 - DNA, 20 bp, Artificial Sequence
  chemically synthesized
cacattttgtctacaggatt

SEQ ID NO: 346767 - DNA, 20 bp, Artificial Sequence
  chemically synthesized
tacttccacattttgtctac

SEQ ID NO: 346768 - DNA, 20 bp, Artificial Sequence
  chemically synthesized
ttacttccacattttgtcta

SEQ ID NO: 346769 - DNA, 20 bp, Artificial Sequence
  chemically synthesized
ttaatcctgtagacaaaatg

SEQ ID NO: 346770 - DNA, 20 bp, Artificial Sequence
  chemically synthesized
atcctgtagacaaaatgtgg

SEQ ID NO: 346771 - DNA, 20 bp, Artificial Sequence
  chemically synthesized
gacaaaatgtggaagtaaca

SEQ ID NO: 346772 - DNA, 20 bp, Artificial Sequence
  chemically synthesized
aaatgtggaagtaacaaaga

SEQ ID NO: 346773 - DNA, 20 bp, Artificial Sequence
  chemically synthesized
aatgtggaagtaacaaagac

SEQ ID NO: 346774 - DNA, 20 bp, Artificial Sequence
  chemically synthesized
aagtaacaaagacaggactc

SEQ ID NO: 346775 - DNA, 20 bp, Artificial Sequence
  chemically synthesized
gagtaaattaggtttttctt

SEQ ID NO: 346776 - DNA, 20 bp, Artificial Sequence
  chemically synthesized
gagaaagagaagagtaaatt

SEQ ID NO: 346777 - DNA, 20 bp, Artificial Sequence
  chemically synthesized
tgagaaagagaagagtaaat

SEQ ID NO: 346778 - DNA, 20 bp, Artificial Sequence
  chemically synthesized
agggggaatgagaaagagaa

SEQ ID NO: 346779 - DNA, 20 bp, Artificial Sequence
  chemically synthesized
taagggggaatgagaaagag

SEQ ID NO: 346780 - DNA, 20 bp, Artificial Sequence
  chemically synthesized
atctaagggggaatgagaaa

SEQ ID NO: 346781 - DNA, 20 bp, Artificial Sequence
  chemically synthesized
gcatctaagggggaatgaga

SEQ ID NO: 346782 - DNA, 20 bp, Artificial Sequence
  chemically synthesized
aaatgcatctaagggggaat

SEQ ID NO: 346783 - DNA, 20 bp, Artificial Sequence
  chemically synthesized
ttctctttctcattccccct

SEQ ID NO: 346784 - DNA, 20 bp, Artificial Sequence
  chemically synthesized
atatagaaatgcatctaagg

SEQ ID NO: 346785 - DNA, 20 bp, Artificial Sequence
  chemically synthesized
aatatagaaatgcatctaag

SEQ ID NO: 346786 - DNA, 20 bp, Artificial Sequence
  chemically synthesized
gaatatagaaatgcatctaa

SEQ ID NO: 346787 - DNA, 20 bp, Artificial Sequence
  chemically synthesized
tgaatatagaaatgcatcta

SEQ ID NO: 346788 - DNA, 20 bp, Artificial Sequence
  chemically synthesized
ttgaatatagaaatgcatct

SEQ ID NO: 346789 - DNA, 20 bp, Artificial Sequence
  chemically synthesized
atcagaatgaacattgaata

SEQ ID NO: 346790 - DNA, 20 bp, Artificial Sequence
  chemically synthesized
tcaatgttcattctgatttc

SEQ ID NO: 346791 - DNA, 20 bp, Artificial Sequence
  chemically synthesized
caatgttcattctgatttcc

SEQ ID NO: 346792 - DNA, 20 bp, Artificial Sequence
  chemically synthesized
ggaaagtgctacctggaaat

SEQ ID NO: 346793 - DNA, 20 bp, Artificial Sequence
  chemically synthesized
tgttcattctgatttccagg

SEQ ID NO: 346794 - DNA, 20 bp, Artificial Sequence
  chemically synthesized
aaagtggggaaagtgctacc

SEQ ID NO: 346795 - DNA, 20 bp, Artificial Sequence
  chemically synthesized
gctaggaaagaaagtgggga

SEQ ID NO: 346796 - DNA, 20 bp, Artificial Sequence
  chemically synthesized
ttaagctaggaaagaaagtg

SEQ ID NO: 346797 - DNA, 20 bp, Artificial Sequence
  chemically synthesized
attaagctaggaaagaaagt

SEQ ID NO: 346798 - DNA, 20 bp, Artificial Sequence
  chemically synthesized
gattaagctaggaaagaaag

SEQ ID NO: 346799 - DNA, 20 bp, Artificial Sequence
  chemically synthesized
actttccccactttctttcc

SEQ ID NO: 346800 - DNA, 20 bp, Artificial Sequence
  chemically synthesized
aaggattaagctaggaaaga

SEQ ID NO: 346801 - DNA, 20 bp, Artificial Sequence
  chemically synthesized
gtgaaaggattaagctagga

SEQ ID NO: 346802 - DNA, 20 bp, Artificial Sequence
  chemically synthesized
agcagtgaaaggattaagct

SEQ ID NO: 346803 - DNA, 20 bp, Artificial Sequence
  chemically synthesized
gagcagtgaaaggattaagc

SEQ ID NO: 346804 - DNA, 20 bp, Artificial Sequence
  chemically synthesized
tgctgagcagtgaaaggatt

SEQ ID NO: 346805 - DNA, 20 bp, Artificial Sequence
  chemically synthesized
gcatattgctgagcagtgaa

SEQ ID NO: 346806 - DNA, 20 bp, Artificial Sequence
  chemically synthesized
cgcatattgctgagcagtga

SEQ ID NO: 346807 - DNA, 20 bp, Artificial Sequence
  chemically synthesized
agcttaatcctttcactgct

SEQ ID NO: 346808 - DNA, 20 bp, Artificial Sequence
  chemically synthesized
gtgtgccgcatattgctgag

SEQ ID NO: 346809 - DNA, 20 bp, Artificial Sequence
  chemically synthesized
caggtgtgccgcatattgct

SEQ ID NO: 346810 - DNA, 20 bp, Artificial Sequence
  chemically synthesized
tttcactgctcagcaatatg

SEQ ID NO: 346811 - DNA, 20 bp, Artificial Sequence
  chemically synthesized
tcagcaatatgcggcacacc

SEQ ID NO: 346812 - DNA, 20 bp, Artificial Sequence
  chemically synthesized
atgcggcacacctggcaaca

SEQ ID NO: 346813 - DNA, 20 bp, Artificial Sequence
  chemically synthesized
ctcatctctcccatgttgcc

SEQ ID NO: 346814 - DNA, 20 bp, Artificial Sequence
  chemically synthesized
tgcggcacacctggcaacat

SEQ ID NO: 346815 - DNA, 20 bp, Artificial Sequence
  chemically synthesized
actcatctctcccatgttgc

SEQ ID NO: 346816 - DNA, 20 bp, Artificial Sequence
  chemically synthesized
cggcacacctggcaacatgg

SEQ ID NO: 346817 - DNA, 20 bp, Artificial Sequence
  chemically synthesized
gcacacctggcaacatggga

SEQ ID NO: 346818 - DNA, 20 bp, Artificial Sequence
  chemically synthesized
cctggcaacatgggagagat

SEQ ID NO: 346819 - DNA, 20 bp, Artificial Sequence
  chemically synthesized
gcaacatgggagagatgagt

SEQ ID NO: 346820 - DNA, 20 bp, Artificial Sequence
  chemically synthesized
agaacaagcaaacaattttg

SEQ ID NO: 346821 - DNA, 20 bp, Artificial Sequence
  chemically synthesized
aggtaaggcattaagagaac

SEQ ID NO: 346822 - DNA, 20 bp, Artificial Sequence
  chemically synthesized
aaattgaggtaaggcattaa

SEQ ID NO: 346823 - DNA, 20 bp, Artificial Sequence
  chemically synthesized
agaaattgaggtaaggcatt

SEQ ID NO: 346824 - DNA, 20 bp, Artificial Sequence
  chemically synthesized
gccatagagaaattgaggta

SEQ ID NO: 346825 - DNA, 20 bp, Artificial Sequence
  chemically synthesized
tgccatagagaaattgaggt

SEQ ID NO: 346826 - DNA, 20 bp, Artificial Sequence
  chemically synthesized
ttattgccatagagaaattg

SEQ ID NO: 346827 - DNA, 20 bp, Artificial Sequence
  chemically synthesized
cttattgccatagagaaatt

SEQ ID NO: 346828 - DNA, 20 bp, Artificial Sequence
  chemically synthesized
gccttacctcaatttctcta

SEQ ID NO: 346829 - DNA, 20 bp, Artificial Sequence
  chemically synthesized
atgatagccttattgccata

SEQ ID NO: 346830 - DNA, 20 bp, Artificial Sequence
  chemically synthesized
ctcaatttctctatggcaat

SEQ ID NO: 346831 - DNA, 20 bp, Artificial Sequence
  chemically synthesized
atatgatagccttattgcca

SEQ ID NO: 346832 - DNA, 20 bp, Artificial Sequence
  chemically synthesized
tcaatttctctatggcaata

SEQ ID NO: 346833 - DNA, 20 bp, Artificial Sequence
  chemically synthesized
gttcttctgtttggatatga

SEQ ID NO: 346834 - DNA, 20 bp, Artificial Sequence
  chemically synthesized
ataaggctatcatatccaaa

SEQ ID NO: 346835 - DNA, 20 bp, Artificial Sequence
  chemically synthesized
aggctatcatatccaaacag

SEQ ID NO: 346836 - DNA, 20 bp, Artificial Sequence
  chemically synthesized
tttagcttagttcttctgtt

SEQ ID NO: 346837 - DNA, 20 bp, Artificial Sequence
  chemically synthesized
catatccaaacagaagaact

SEQ ID NO: 346838 - DNA, 20 bp, Artificial Sequence
  chemically synthesized
aacagaagaactaagctaaa

SEQ ID NO: 346839 - DNA, 20 bp, Artificial Sequence
  chemically synthesized
aatgatgaatccatttagct

SEQ ID NO: 346840 - DNA, 20 bp, Artificial Sequence
  chemically synthesized
tgtgaaatgatgaatccatt

SEQ ID NO: 346841 - DNA, 20 bp, Artificial Sequence
  chemically synthesized
aatggattcatcatttcaca

SEQ ID NO: 346842 - DNA, 20 bp, Artificial Sequence
  chemically synthesized
catttcacaaagtgattctt

SEQ ID NO: 346843 - DNA, 20 bp, Artificial Sequence
  chemically synthesized
aaataataagaaaattgcta

SEQ ID NO: 346844 - DNA, 20 bp, Artificial Sequence
  chemically synthesized
ccaaaaatatataaaataat

SEQ ID NO: 346845 - DNA, 20 bp, Artificial Sequence
  chemically synthesized
cttattattttatatatttt

SEQ ID NO: 346846 - DNA, 20 bp, Artificial Sequence
  chemically synthesized
tttcatatataatgctacct

SEQ ID NO: 346847 - DNA, 20 bp, Artificial Sequence
  chemically synthesized
gcatatctgaatttctgagg

SEQ ID NO: 346848 - DNA, 20 bp, Artificial Sequence
  chemically synthesized
tttgcatatctgaatttctg

SEQ ID NO: 346849 - DNA, 20 bp, Artificial Sequence
  chemically synthesized
ataatgctacctcagaaatt

SEQ ID NO: 346850 - DNA, 20 bp, Artificial Sequence
  chemically synthesized
ctttgcatatctgaatttct

SEQ ID NO: 346851 - DNA, 20 bp, Artificial Sequence
  chemically synthesized
ctcagaaattcagatatgca

SEQ ID NO: 346852 - DNA, 20 bp, Artificial Sequence
  chemically synthesized
tctctgaaactttaaaaaag

SEQ ID NO: 346853 - DNA, 20 bp, Artificial Sequence
  chemically synthesized
agtttaaaactcctttttta

SEQ ID NO: 346854 - DNA, 20 bp, Artificial Sequence
  chemically synthesized
gctctctgaaactttaaaaa

SEQ ID NO: 346855 - DNA, 20 bp, Artificial Sequence
  chemically synthesized
agctctctgaaactttaaaa

SEQ ID NO: 346856 - DNA, 20 bp, Artificial Sequence
  chemically synthesized
aaactccttttttaaagttt

SEQ ID NO: 346857 - DNA, 20 bp, Artificial Sequence
  chemically synthesized
actccttttttaaagtttca

SEQ ID NO: 346858 - DNA, 20 bp, Artificial Sequence
  chemically synthesized
tccttttttaaagtttcaga

SEQ ID NO: 346859 - DNA, 20 bp, Artificial Sequence
  chemically synthesized
gtttcagagagctacaacta

SEQ ID NO: 346860 - DNA, 20 bp, Artificial Sequence
  chemically synthesized
gcttatctcgtctgtagttg

SEQ ID NO: 346861 - DNA, 20 bp, Artificial Sequence
  chemically synthesized
agagagctacaactacagac

SEQ ID NO: 346862 - DNA, 20 bp, Artificial Sequence
  chemically synthesized
gctaaagcttatctcgtctg

SEQ ID NO: 346863 - DNA, 20 bp, Artificial Sequence
  chemically synthesized
gctacaactacagacgagat

SEQ ID NO: 346864 - DNA, 20 bp, Artificial Sequence
  chemically synthesized
actacagacgagataagctt

SEQ ID NO: 346865 - DNA, 20 bp, Artificial Sequence
  chemically synthesized
gtatgaaattcatcaagcta

SEQ ID NO: 346866 - DNA, 20 bp, Artificial Sequence
  chemically synthesized
tagtcagtatgaaattcatc

SEQ ID NO: 346867 - DNA, 20 bp, Artificial Sequence
  chemically synthesized
atgaatttcatactgactac

SEQ ID NO: 346868 - DNA, 20 bp, Artificial Sequence
  chemically synthesized
taaacataagatccagtagt

SEQ ID NO: 346869 - DNA, 20 bp, Artificial Sequence
  chemically synthesized
gccttaaacataagatccag

SEQ ID NO: 346870 - DNA, 20 bp, Artificial Sequence
  chemically synthesized
tctgccttaaacataagatc

SEQ ID NO: 346871 - DNA, 20 bp, Artificial Sequence
  chemically synthesized
gactactggatcttatgttt

SEQ ID NO: 346872 - DNA, 20 bp, Artificial Sequence
  chemically synthesized
actactggatcttatgttta

SEQ ID NO: 346873 - DNA, 20 bp, Artificial Sequence
  chemically synthesized
cctgcatctgccttaaacat

SEQ ID NO: 346874 - DNA, 20 bp, Artificial Sequence
  chemically synthesized
actggatcttatgtttaagg

SEQ ID NO: 346875 - DNA, 20 bp, Artificial Sequence
  chemically synthesized
tcttatgtttaaggcagatg

SEQ ID NO: 346876 - DNA, 20 bp, Artificial Sequence
  chemically synthesized
cttatgtttaaggcagatgc

SEQ ID NO: 346877 - DNA, 20 bp, Artificial Sequence
  chemically synthesized
aggcagatgcaggtttttct

SEQ ID NO: 346878 - DNA, 20 bp, Artificial Sequence
  chemically synthesized
ggcagatgcaggtttttctt

SEQ ID NO: 346879 - DNA, 20 bp, Artificial Sequence
  chemically synthesized
gcagatgcaggtttttcttg

SEQ ID NO: 346880 - DNA, 20 bp, Artificial Sequence
  chemically synthesized
cagatgcaggtttttcttgg

SEQ ID NO: 346881 - DNA, 20 bp, Artificial Sequence
  chemically synthesized
agatgcaggtttttcttggg

SEQ ID NO: 346882 - DNA, 20 bp, Artificial Sequence
  chemically synthesized
gatgcaggtttttcttgggg

SEQ ID NO: 346883 - DNA, 20 bp, Artificial Sequence
  chemically synthesized
atgcaggtttttcttggggg

SEQ ID NO: 346884 - DNA, 20 bp, Artificial Sequence
  chemically synthesized
tgcaggtttttcttgggggg

SEQ ID NO: 346885 - DNA, 20 bp, Artificial Sequence
  chemically synthesized
gcaggtttttcttggggggg

SEQ ID NO: 346886 - DNA, 20 bp, Artificial Sequence
  chemically synthesized
cccgcccccccccccccccc

SEQ ID NO: 346887 - DNA, 20 bp, Artificial Sequence
  chemically synthesized
caggtttttcttgggggggg

SEQ ID NO: 346888 - DNA, 20 bp, Artificial Sequence
  chemically synthesized
aggtttttcttggggggggg

SEQ ID NO: 346889 - DNA, 20 bp, Artificial Sequence
  chemically synthesized
ggtttttcttgggggggggg

SEQ ID NO: 346890 - DNA, 20 bp, Artificial Sequence
  chemically synthesized
gtttttcttggggggggggg

SEQ ID NO: 346891 - DNA, 20 bp, Artificial Sequence
  chemically synthesized
tttttcttgggggggggggg

SEQ ID NO: 346892 - DNA, 20 bp, Artificial Sequence
  chemically synthesized
ttttcttggggggggggggg

SEQ ID NO: 346893 - DNA, 20 bp, Artificial Sequence
  chemically synthesized
tcttgggggggggggggggg

SEQ ID NO: 346894 - DNA, 20 bp, Artificial Sequence
  chemically synthesized
cttggggggggggggggggc

SEQ ID NO: 346895 - DNA, 20 bp, Artificial Sequence
  chemically synthesized
ttggggggggggggggggcg

SEQ ID NO: 346896 - DNA, 20 bp, Artificial Sequence
  chemically synthesized
tggggggggggggggggcgg

SEQ ID NO: 346897 - DNA, 20 bp, Artificial Sequence
  chemically synthesized
ggggggggggggggcggggg

SEQ ID NO: 346898 - DNA, 20 bp, Artificial Sequence
  chemically synthesized
ggggggggcgggggaagacc

SEQ ID NO: 346899 - DNA, 20 bp, Artificial Sequence
  chemically synthesized
gggggggcgggggaagaccc

SEQ ID NO: 346900 - DNA, 20 bp, Artificial Sequence
  chemically synthesized
ggggcgggggaagacccagg

SEQ ID NO: 346901 - DNA, 20 bp, Artificial Sequence
  chemically synthesized
gggcgggggaagacccaggc

SEQ ID NO: 346902 - DNA, 20 bp, Artificial Sequence
  chemically synthesized
tgtatcacatgggcctgcct

SEQ ID NO: 346903 - DNA, 20 bp, Artificial Sequence
  chemically synthesized
atgtatcacatgggcctgcc

SEQ ID NO: 346904 - DNA, 20 bp, Artificial Sequence
  chemically synthesized
cctgaagaaatgtatcacat

SEQ ID NO: 346905 - DNA, 20 bp, Artificial Sequence
  chemically synthesized
tcctgaagaaatgtatcaca

SEQ ID NO: 346906 - DNA, 20 bp, Artificial Sequence
  chemically synthesized
gcccatgtgatacatttctt

SEQ ID NO: 346907 - DNA, 20 bp, Artificial Sequence
  chemically synthesized
cccatgtgatacatttcttc

SEQ ID NO: 346908 - DNA, 20 bp, Artificial Sequence
  chemically synthesized
ggaaaattgttagaatcctg

SEQ ID NO: 346909 - DNA, 20 bp, Artificial Sequence
  chemically synthesized
ctttctgagtggaaaattgt

SEQ ID NO: 346910 - DNA, 20 bp, Artificial Sequence
  chemically synthesized
gattctaacaattttccact

SEQ ID NO: 346911 - DNA, 20 bp, Artificial Sequence
  chemically synthesized
ctaacaattttccactcaga

SEQ ID NO: 346912 - DNA, 20 bp, Artificial Sequence
  chemically synthesized
ctgagggactactttctgag

SEQ ID NO: 346913 - DNA, 20 bp, Artificial Sequence
  chemically synthesized
acaattttccactcagaaag

SEQ ID NO: 346914 - DNA, 20 bp, Artificial Sequence
  chemically synthesized
ttcctgagggactactttct

SEQ ID NO: 346915 - DNA, 20 bp, Artificial Sequence
  chemically synthesized
ccactcagaaagtagtccct

SEQ ID NO: 346916 - DNA, 20 bp, Artificial Sequence
  chemically synthesized
cactcagaaagtagtccctc

SEQ ID NO: 346917 - DNA, 20 bp, Artificial Sequence
  chemically synthesized
tacagttaataatttcctga

SEQ ID NO: 346918 - DNA, 20 bp, Artificial Sequence
  chemically synthesized
ttacagttaataatttcctg

SEQ ID NO: 346919 - DNA, 20 bp, Artificial Sequence
  chemically synthesized
tttacagttaataatttcct

SEQ ID NO: 346920 - DNA, 20 bp, Artificial Sequence
  chemically synthesized
gaaattattaactgtaaaat

SEQ ID NO: 346921 - DNA, 20 bp, Artificial Sequence
  chemically synthesized
ttatcctctatcttatttta

SEQ ID NO: 346922 - DNA, 20 bp, Artificial Sequence
  chemically synthesized
ttattaactgtaaaataaga

SEQ ID NO: 346923 - DNA, 20 bp, Artificial Sequence
  chemically synthesized
attaactgtaaaataagata

SEQ ID NO: 346924 - DNA, 20 bp, Artificial Sequence
  chemically synthesized
ttaactgtaaaataagatag

SEQ ID NO: 346925 - DNA, 20 bp, Artificial Sequence
  chemically synthesized
aataagatagaggataaaaa

SEQ ID NO: 346926 - DNA, 20 bp, Artificial Sequence
  chemically synthesized
aggataaaaaaagaattctg

SEQ ID NO: 346927 - DNA, 20 bp, Artificial Sequence
  chemically synthesized
ataaaaaaagaattctgaag

SEQ ID NO: 346928 - DNA, 20 bp, Artificial Sequence
  chemically synthesized
ttccatgtatttttctgctt

SEQ ID NO: 346929 - DNA, 20 bp, Artificial Sequence
  chemically synthesized
ttctgaagcagaaaaataca

SEQ ID NO: 346930 - DNA, 20 bp, Artificial Sequence
  chemically synthesized
agcagaaaaatacatggaat

SEQ ID NO: 346931 - DNA, 20 bp, Artificial Sequence
  chemically synthesized
agaaaaatacatggaatcag

SEQ ID NO: 346932 - DNA, 20 bp, Artificial Sequence
  chemically synthesized
aatacatggaatcagaagca

SEQ ID NO: 346933 - DNA, 20 bp, Artificial Sequence
  chemically synthesized
tttttcaatgcagatttatt

SEQ ID NO: 346934 - DNA, 20 bp, Artificial Sequence
  chemically synthesized
gaactttccatttttcaatg

SEQ ID NO: 346935 - DNA, 20 bp, Artificial Sequence
  chemically synthesized
aataaatctgcattgaaaaa

SEQ ID NO: 346936 - DNA, 20 bp, Artificial Sequence
  chemically synthesized
aatctgcattgaaaaatgga

SEQ ID NO: 346937 - DNA, 20 bp, Artificial Sequence
  chemically synthesized
gtataatataaacacaaaat

SEQ ID NO: 346938 - DNA, 20 bp, Artificial Sequence
  chemically synthesized
agtataatataaacacaaaa

SEQ ID NO: 346939 - DNA, 20 bp, Artificial Sequence
  chemically synthesized
agaataattacaagagtcaa

SEQ ID NO: 346940 - DNA, 20 bp, Artificial Sequence
  chemically synthesized
tttaagaagaataattacaa

SEQ ID NO: 346941 - DNA, 20 bp, Artificial Sequence
  chemically synthesized
catttaagaagaataattac

SEQ ID NO: 346942 - DNA, 20 bp, Artificial Sequence
  chemically synthesized
ggatttttgtgacatttaag

SEQ ID NO: 346943 - DNA, 20 bp, Artificial Sequence
  chemically synthesized
gggggatttttgtgacattt

SEQ ID NO: 346944 - DNA, 20 bp, Artificial Sequence
  chemically synthesized
gtggaatagtaatagttggg

SEQ ID NO: 346945 - DNA, 20 bp, Artificial Sequence
  chemically synthesized
agtggaatagtaatagttgg

SEQ ID NO: 346946 - DNA, 20 bp, Artificial Sequence
  chemically synthesized
cagtggaatagtaatagttg

SEQ ID NO: 346947 - DNA, 20 bp, Artificial Sequence
  chemically synthesized
gcagtggaatagtaatagtt

SEQ ID NO: 346948 - DNA, 20 bp, Artificial Sequence
  chemically synthesized
agcagtggaatagtaatagt

SEQ ID NO: 346949 - DNA, 20 bp, Artificial Sequence
  chemically synthesized
acatagcagtggaatagtaa

SEQ ID NO: 346950 - DNA, 20 bp, Artificial Sequence
  chemically synthesized
ccacatacatagcagtggaa

SEQ ID NO: 346951 - DNA, 20 bp, Artificial Sequence
  chemically synthesized
catctccacatacatagcag

SEQ ID NO: 346952 - DNA, 20 bp, Artificial Sequence
  chemically synthesized
gtacatctccacatacatag

SEQ ID NO: 346953 - DNA, 20 bp, Artificial Sequence
  chemically synthesized
ctattccactgctatgtatg

SEQ ID NO: 346954 - DNA, 20 bp, Artificial Sequence
  chemically synthesized
tatgtacatctccacataca

SEQ ID NO: 346955 - DNA, 20 bp, Artificial Sequence
  chemically synthesized
attccactgctatgtatgtg

SEQ ID NO: 346956 - DNA, 20 bp, Artificial Sequence
  chemically synthesized
agatgtacatacccaattat

SEQ ID NO: 346957 - DNA, 20 bp, Artificial Sequence
  chemically synthesized
gatgtacatacccaattatt

SEQ ID NO: 346958 - DNA, 20 bp, Artificial Sequence
  chemically synthesized
gggtacgttacctaataatt

SEQ ID NO: 346959 - DNA, 20 bp, Artificial Sequence
  chemically synthesized
tgggtacgttacctaataat

SEQ ID NO: 346960 - DNA, 20 bp, Artificial Sequence
  chemically synthesized
aattattaggtaacgtaccc

SEQ ID NO: 346961 - DNA, 20 bp, Artificial Sequence
  chemically synthesized
attattaggtaacgtaccca

SEQ ID NO: 346962 - DNA, 20 bp, Artificial Sequence
  chemically synthesized
ttattatctaattgatcctt

SEQ ID NO: 346963 - DNA, 20 bp, Artificial Sequence
  chemically synthesized
tttattatctaattgatcct

SEQ ID NO: 346964 - DNA, 20 bp, Artificial Sequence
  chemically synthesized
taacgtacccaaggatcaat

SEQ ID NO: 346965 - DNA, 20 bp, Artificial Sequence
  chemically synthesized
aaggatcaattagataataa

SEQ ID NO: 346966 - DNA, 20 bp, Artificial Sequence
  chemically synthesized
aaagaaacattactgtaaca

SEQ ID NO: 346967 - DNA, 20 bp, Artificial Sequence
  chemically synthesized
aagaaacattactgtaacac

SEQ ID NO: 346968 - DNA, 20 bp, Artificial Sequence
  chemically synthesized
taaaaagaagtcctgtgtta

SEQ ID NO: 346969 - DNA, 20 bp, Artificial Sequence
  chemically synthesized
atagaaggtagtgtaaaaag

SEQ ID NO: 346970 - DNA, 20 bp, Artificial Sequence
  chemically synthesized
ttaatagaaggtagtgtaaa

SEQ ID NO: 346971 - DNA, 20 bp, Artificial Sequence
  chemically synthesized
ctcctctttttaatagaagg

SEQ ID NO: 346972 - DNA, 20 bp, Artificial Sequence
  chemically synthesized
tgtctcctctttttaataga

SEQ ID NO: 346973 - DNA, 20 bp, Artificial Sequence
  chemically synthesized
atgtctcctctttttaatag

SEQ ID NO: 346974 - DNA, 20 bp, Artificial Sequence
  chemically synthesized
ttacactaccttctattaaa

SEQ ID NO: 346975 - DNA, 20 bp, Artificial Sequence
  chemically synthesized
acactaccttctattaaaaa

SEQ ID NO: 346976 - DNA, 20 bp, Artificial Sequence
  chemically synthesized
cttatgtctcctctttttaa

SEQ ID NO: 346977 - DNA, 20 bp, Artificial Sequence
  chemically synthesized
cactaccttctattaaaaag

SEQ ID NO: 346978 - DNA, 20 bp, Artificial Sequence
  chemically synthesized
ctaccttctattaaaaagag

SEQ ID NO: 346979 - DNA, 20 bp, Artificial Sequence
  chemically synthesized
ctattaaaaagaggagacat

SEQ ID NO: 346980 - DNA, 20 bp, Artificial Sequence
  chemically synthesized
ggagacataagtatgtgaaa

SEQ ID NO: 346981 - DNA, 20 bp, Artificial Sequence
  chemically synthesized
ataagtatgtgaaatggaat

SEQ ID NO: 346982 - DNA, 20 bp, Artificial Sequence
  chemically synthesized
aatggaatcagtatgccaca

SEQ ID NO: 346983 - DNA, 20 bp, Artificial Sequence
  chemically synthesized
taatgctgttaaatactatg

SEQ ID NO: 346984 - DNA, 20 bp, Artificial Sequence
  chemically synthesized
gtatgccacatagtatttaa

SEQ ID NO: 346985 - DNA, 20 bp, Artificial Sequence
  chemically synthesized
tattcaattgtcatatttgt

SEQ ID NO: 346986 - DNA, 20 bp, Artificial Sequence
  chemically synthesized
tctgcctaacatttatcatg

SEQ ID NO: 346987 - DNA, 20 bp, Artificial Sequence
  chemically synthesized
ttctgcctaacatttatcat

SEQ ID NO: 346988 - DNA, 20 bp, Artificial Sequence
  chemically synthesized
tagtacctcatgataaatgt

SEQ ID NO: 346989 - DNA, 20 bp, Artificial Sequence
  chemically synthesized
agtacctcatgataaatgtt

SEQ ID NO: 346990 - DNA, 20 bp, Artificial Sequence
  chemically synthesized
acctcatgataaatgttagg

SEQ ID NO: 346991 - DNA, 20 bp, Artificial Sequence
  chemically synthesized
catgataaatgttaggcaga

SEQ ID NO: 346992 - DNA, 20 bp, Artificial Sequence
  chemically synthesized
aaggtgaagagagatagaga

SEQ ID NO: 346993 - DNA, 20 bp, Artificial Sequence
  chemically synthesized
gaaggtgaagagagatagag

SEQ ID NO: 346994 - DNA, 20 bp, Artificial Sequence
  chemically synthesized
ctggaaggtgaagagagata

SEQ ID NO: 346995 - DNA, 20 bp, Artificial Sequence
  chemically synthesized
ccctggaaggtgaagagaga

SEQ ID NO: 346996 - DNA, 20 bp, Artificial Sequence
  chemically synthesized
tttgccctggaaggtgaaga

SEQ ID NO: 346997 - DNA, 20 bp, Artificial Sequence
  chemically synthesized
tatttgccctggaaggtgaa

SEQ ID NO: 346998 - DNA, 20 bp, Artificial Sequence
  chemically synthesized
ctctatctctcttcaccttc

SEQ ID NO: 346999 - DNA, 20 bp, Artificial Sequence
  chemically synthesized
gatatttgccctggaaggtg

SEQ ID NO: 347000 - DNA, 20 bp, Artificial Sequence
  chemically synthesized
tctatctctcttcaccttcc

SEQ ID NO: 347001 - DNA, 20 bp, Artificial Sequence
  chemically synthesized
ctatctctcttcaccttcca

SEQ ID NO: 347002 - DNA, 20 bp, Artificial Sequence
  chemically synthesized
gggcagatatttgccctgga

SEQ ID NO: 347003 - DNA, 20 bp, Artificial Sequence
  chemically synthesized
agggcagatatttgccctgg

SEQ ID NO: 347004 - DNA, 20 bp, Artificial Sequence
  chemically synthesized
agtagggcagatatttgccc

SEQ ID NO: 347005 - DNA, 20 bp, Artificial Sequence
  chemically synthesized
tctgtggcaacaaagtaggg

SEQ ID NO: 347006 - DNA, 20 bp, Artificial Sequence
  chemically synthesized
ttctctgtggcaacaaagta

SEQ ID NO: 347007 - DNA, 20 bp, Artificial Sequence
  chemically synthesized
attctctgtggcaacaaagt

SEQ ID NO: 347008 - DNA, 20 bp, Artificial Sequence
  chemically synthesized
tattctctgtggcaacaaag

SEQ ID NO: 347009 - DNA, 20 bp, Artificial Sequence
  chemically synthesized
atttattctctgtggcaaca

SEQ ID NO: 347010 - DNA, 20 bp, Artificial Sequence
  chemically synthesized
tctgccctactttgttgcca

SEQ ID NO: 347011 - DNA, 20 bp, Artificial Sequence
  chemically synthesized
tgccctactttgttgccaca

SEQ ID NO: 347012 - DNA, 20 bp, Artificial Sequence
  chemically synthesized
catggaaaatttattctctg

SEQ ID NO: 347013 - DNA, 20 bp, Artificial Sequence
  chemically synthesized
aataaattttccatgactgc

SEQ ID NO: 347014 - DNA, 20 bp, Artificial Sequence
  chemically synthesized
ttcaatagagcttgcagtca

SEQ ID NO: 347015 - DNA, 20 bp, Artificial Sequence
  chemically synthesized
tctattttcaatagagcttg

SEQ ID NO: 347016 - DNA, 20 bp, Artificial Sequence
  chemically synthesized
tttctcttctattttcaata

SEQ ID NO: 347017 - DNA, 20 bp, Artificial Sequence
  chemically synthesized
actgcaagctctattgaaaa

SEQ ID NO: 347018 - DNA, 20 bp, Artificial Sequence
  chemically synthesized
catttctcttctattttcaa

SEQ ID NO: 347019 - DNA, 20 bp, Artificial Sequence
  chemically synthesized
gcaagctctattgaaaatag

SEQ ID NO: 347020 - DNA, 20 bp, Artificial Sequence
  chemically synthesized
aagctctattgaaaatagaa

SEQ ID NO: 347021 - DNA, 20 bp, Artificial Sequence
  chemically synthesized
tattgaaaatagaagagaaa

SEQ ID NO: 347022 - DNA, 20 bp, Artificial Sequence
  chemically synthesized
gaaaatagaagagaaatgga

SEQ ID NO: 347023 - DNA, 20 bp, Artificial Sequence
  chemically synthesized
aaaatagaagagaaatggaa

SEQ ID NO: 347024 - DNA, 20 bp, Artificial Sequence
  chemically synthesized
agaagagaaatggaaaggtc

SEQ ID NO: 347025 - DNA, 20 bp, Artificial Sequence
  chemically synthesized
atggaaaggtccagaattta

SEQ ID NO: 347026 - DNA, 20 bp, Artificial Sequence
  chemically synthesized
gatacagttcctttaaattc

SEQ ID NO: 347027 - DNA, 20 bp, Artificial Sequence
  chemically synthesized
tggaaaggtccagaatttaa

SEQ ID NO: 347028 - DNA, 20 bp, Artificial Sequence
  chemically synthesized
agtagaatgggagagagata

SEQ ID NO: 347029 - DNA, 20 bp, Artificial Sequence
  chemically synthesized
acatacagtagaatgggaga

SEQ ID NO: 347030 - DNA, 20 bp, Artificial Sequence
  chemically synthesized
ggacatacagtagaatggga

SEQ ID NO: 347031 - DNA, 20 bp, Artificial Sequence
  chemically synthesized
agggacatacagtagaatgg

SEQ ID NO: 347032 - DNA, 20 bp, Artificial Sequence
  chemically synthesized
caagggacatacagtagaat

SEQ ID NO: 347033 - DNA, 20 bp, Artificial Sequence
  chemically synthesized
tcaagggacatacagtagaa

SEQ ID NO: 347034 - DNA, 20 bp, Artificial Sequence
  chemically synthesized
taatctcaagggacatacag

SEQ ID NO: 347035 - DNA, 20 bp, Artificial Sequence
  chemically synthesized
ctctaatctcaagggacata

SEQ ID NO: 347036 - DNA, 20 bp, Artificial Sequence
  chemically synthesized
cattctactgtatgtccctt

SEQ ID NO: 347037 - DNA, 20 bp, Artificial Sequence
  chemically synthesized
tactgtatgtcccttgagat

SEQ ID NO: 347038 - DNA, 20 bp, Artificial Sequence
  chemically synthesized
acaaatgtctctaatctcaa

SEQ ID NO: 347039 - DNA, 20 bp, Artificial Sequence
  chemically synthesized
aacaaatgtctctaatctca

SEQ ID NO: 347040 - DNA, 20 bp, Artificial Sequence
  chemically synthesized
ctgtatgtcccttgagatta

SEQ ID NO: 347041 - DNA, 20 bp, Artificial Sequence
  chemically synthesized
aaacaaatgtctctaatctc

SEQ ID NO: 347042 - DNA, 20 bp, Artificial Sequence
  chemically synthesized
attagagacatttgtttccc

SEQ ID NO: 347043 - DNA, 20 bp, Artificial Sequence
  chemically synthesized
catgtctctgattggcactg

SEQ ID NO: 347044 - DNA, 20 bp, Artificial Sequence
  chemically synthesized
tcatgtctctgattggcact

SEQ ID NO: 347045 - DNA, 20 bp, Artificial Sequence
  chemically synthesized
atcatgtctctgattggcac

SEQ ID NO: 347046 - DNA, 20 bp, Artificial Sequence
  chemically synthesized
tttgtttccccagtgccaat

SEQ ID NO: 347047 - DNA, 20 bp, Artificial Sequence
  chemically synthesized
tgtttccccagtgccaatca

SEQ ID NO: 347048 - DNA, 20 bp, Artificial Sequence
  chemically synthesized
ctatgtatcatgtctctgat

SEQ ID NO: 347049 - DNA, 20 bp, Artificial Sequence
  chemically synthesized
ccaatcagagacatgataca

SEQ ID NO: 347050 - DNA, 20 bp, Artificial Sequence
  chemically synthesized
catagtgttcaataaatgct

SEQ ID NO: 347051 - DNA, 20 bp, Artificial Sequence
  chemically synthesized
ttttcaccaattcattcacc

SEQ ID NO: 347052 - DNA, 20 bp, Artificial Sequence
  chemically synthesized
taaatgcttggtgaatgaat

SEQ ID NO: 347053 - DNA, 20 bp, Artificial Sequence
  chemically synthesized
ctcctgcaaccataattcat

SEQ ID NO: 347054 - DNA, 20 bp, Artificial Sequence
  chemically synthesized
tgaaaataacttatgaatta

SEQ ID NO: 347055 - DNA, 20 bp, Artificial Sequence
  chemically synthesized
taacttatgaattatggttg

SEQ ID NO: 347056 - DNA, 20 bp, Artificial Sequence
  chemically synthesized
aacttatgaattatggttgc

SEQ ID NO: 347057 - DNA, 20 bp, Artificial Sequence
  chemically synthesized
cttatgaattatggttgcag

SEQ ID NO: 347058 - DNA, 20 bp, Artificial Sequence
  chemically synthesized
ttatgaattatggttgcagg

SEQ ID NO: 347059 - DNA, 20 bp, Artificial Sequence
  chemically synthesized
tatgaattatggttgcagga

SEQ ID NO: 347060 - DNA, 20 bp, Artificial Sequence
  chemically synthesized
gaattatggttgcaggaggg

SEQ ID NO: 347061 - DNA, 20 bp, Artificial Sequence
  chemically synthesized
atggttgcaggagggaagaa

SEQ ID NO: 347062 - DNA, 20 bp, Artificial Sequence
  chemically synthesized
ggttgcaggagggaagaaca

SEQ ID NO: 347063 - DNA, 20 bp, Artificial Sequence
  chemically synthesized
gatataatgttaaacatatt

SEQ ID NO: 347064 - DNA, 20 bp, Artificial Sequence
  chemically synthesized
atataatgttaaacatattc

SEQ ID NO: 347065 - DNA, 20 bp, Artificial Sequence
  chemically synthesized
acatattcaggtttacttgc

SEQ ID NO: 347066 - DNA, 20 bp, Artificial Sequence
  chemically synthesized
catattcaggtttacttgca

SEQ ID NO: 347067 - DNA, 20 bp, Artificial Sequence
  chemically synthesized
ttcagtttcccattccttgc

SEQ ID NO: 347068 - DNA, 20 bp, Artificial Sequence
  chemically synthesized
tcaggtttacttgcaaggaa

SEQ ID NO: 347069 - DNA, 20 bp, Artificial Sequence
  chemically synthesized
caggtttacttgcaaggaat

SEQ ID NO: 347070 - DNA, 20 bp, Artificial Sequence
  chemically synthesized
acatcaatatatgaagtatt

SEQ ID NO: 347071 - DNA, 20 bp, Artificial Sequence
  chemically synthesized
atatgcaacatcaatatatg

SEQ ID NO: 347072 - DNA, 20 bp, Artificial Sequence
  chemically synthesized
tcatatattgatgttgcata

SEQ ID NO: 347073 - DNA, 20 bp, Artificial Sequence
  chemically synthesized
catatattgatgttgcatat

SEQ ID NO: 347074 - DNA, 20 bp, Artificial Sequence
  chemically synthesized
taggcatcattatgatcatt

SEQ ID NO: 347075 - DNA, 20 bp, Artificial Sequence
  chemically synthesized
cattatgatcatttggaaat

SEQ ID NO: 347076 - DNA, 20 bp, Artificial Sequence
  chemically synthesized
agatcaaaaggtatgcatta

SEQ ID NO: 347077 - DNA, 20 bp, Artificial Sequence
  chemically synthesized
ttaatgcataccttttgatc

SEQ ID NO: 347078 - DNA, 20 bp, Artificial Sequence
  chemically synthesized
cccaggatagctagatcaaa

SEQ ID NO: 347079 - DNA, 20 bp, Artificial Sequence
  chemically synthesized
acccaggatagctagatcaa

SEQ ID NO: 347080 - DNA, 20 bp, Artificial Sequence
  chemically synthesized
accttttgatctagctatcc

SEQ ID NO: 347081 - DNA, 20 bp, Artificial Sequence
  chemically synthesized
tgctaggaacccaggatagc

SEQ ID NO: 347082 - DNA, 20 bp, Artificial Sequence
  chemically synthesized
ccttttgatctagctatcct

SEQ ID NO: 347083 - DNA, 20 bp, Artificial Sequence
  chemically synthesized
atcatgctaggaacccagga

SEQ ID NO: 347084 - DNA, 20 bp, Artificial Sequence
  chemically synthesized
atctagctatcctgggttcc

SEQ ID NO: 347085 - DNA, 20 bp, Artificial Sequence
  chemically synthesized
aggtatcatgctaggaaccc

SEQ ID NO: 347086 - DNA, 20 bp, Artificial Sequence
  chemically synthesized
gaggtatcatgctaggaacc

SEQ ID NO: 347087 - DNA, 20 bp, Artificial Sequence
  chemically synthesized
tatatatgaggtatcatgct

SEQ ID NO: 347088 - DNA, 20 bp, Artificial Sequence
  chemically synthesized
ttatatatgaggtatcatgc

SEQ ID NO: 347089 - DNA, 20 bp, Artificial Sequence
  chemically synthesized
cgagtgtgcatttatatatg

SEQ ID NO: 347090 - DNA, 20 bp, Artificial Sequence
  chemically synthesized
tcgagtgtgcatttatatat

SEQ ID NO: 347091 - DNA, 20 bp, Artificial Sequence
  chemically synthesized
atatataaatgcacactcga

SEQ ID NO: 347092 - DNA, 20 bp, Artificial Sequence
  chemically synthesized
gtgaggtacaaaaagctatc

SEQ ID NO: 347093 - DNA, 20 bp, Artificial Sequence
  chemically synthesized
gtcattatgtgaggtacaaa

SEQ ID NO: 347094 - DNA, 20 bp, Artificial Sequence
  chemically synthesized
gaaaatcatgtcattatgtg

SEQ ID NO: 347095 - DNA, 20 bp, Artificial Sequence
  chemically synthesized
agaaaatcatgtcattatgt

SEQ ID NO: 347096 - DNA, 20 bp, Artificial Sequence
  chemically synthesized
aggaaggcatattcaaggta

SEQ ID NO: 347097 - DNA, 20 bp, Artificial Sequence
  chemically synthesized
ataagaggaaggcatattca

SEQ ID NO: 347098 - DNA, 20 bp, Artificial Sequence
  chemically synthesized
aataagaggaaggcatattc

SEQ ID NO: 347099 - DNA, 20 bp, Artificial Sequence
  chemically synthesized
atgaagaagaaataagagga

SEQ ID NO: 347100 - DNA, 20 bp, Artificial Sequence
  chemically synthesized
aatgaagaagaaataagagg

SEQ ID NO: 347101 - DNA, 20 bp, Artificial Sequence
  chemically synthesized
accaatgaagaagaaataag

SEQ ID NO: 347102 - DNA, 20 bp, Artificial Sequence
  chemically synthesized
caccaatgaagaagaaataa

SEQ ID NO: 347103 - DNA, 20 bp, Artificial Sequence
  chemically synthesized
agcaccaatgaagaagaaat

SEQ ID NO: 347104 - DNA, 20 bp, Artificial Sequence
  chemically synthesized
tcctcttatttcttcttcat

SEQ ID NO: 347105 - DNA, 20 bp, Artificial Sequence
  chemically synthesized
aggcaaaagcaccaatgaag

SEQ ID NO: 347106 - DNA, 20 bp, Artificial Sequence
  chemically synthesized
gcaaggcaaaagcaccaatg

SEQ ID NO: 347107 - DNA, 20 bp, Artificial Sequence
  chemically synthesized
caggtgaaatagcaaggcaa

SEQ ID NO: 347108 - DNA, 20 bp, Artificial Sequence
  chemically synthesized
gcattccaggtgaaatagca

SEQ ID NO: 347109 - DNA, 20 bp, Artificial Sequence
  chemically synthesized
agcattccaggtgaaatagc

SEQ ID NO: 347110 - DNA, 20 bp, Artificial Sequence
  chemically synthesized
ttttgccttgctatttcacc

SEQ ID NO: 347111 - DNA, 20 bp, Artificial Sequence
  chemically synthesized
gaatagcattccaggtgaaa

SEQ ID NO: 347112 - DNA, 20 bp, Artificial Sequence
  chemically synthesized
atagggaagaatagcattcc

SEQ ID NO: 347113 - DNA, 20 bp, Artificial Sequence
  chemically synthesized
aatagggaagaatagcattc

SEQ ID NO: 347114 - DNA, 20 bp, Artificial Sequence
  chemically synthesized
taggtagaaatagggaagaa

SEQ ID NO: 347115 - DNA, 20 bp, Artificial Sequence
  chemically synthesized
cttgataggtagaaataggg

SEQ ID NO: 347116 - DNA, 20 bp, Artificial Sequence
  chemically synthesized
ggccttgataggtagaaata

SEQ ID NO: 347117 - DNA, 20 bp, Artificial Sequence
  chemically synthesized
aggccttgataggtagaaat

SEQ ID NO: 347118 - DNA, 20 bp, Artificial Sequence
  chemically synthesized
aaggccttgataggtagaaa

SEQ ID NO: 347119 - DNA, 20 bp, Artificial Sequence
  chemically synthesized
cttccctatttctacctatc

SEQ ID NO: 347120 - DNA, 20 bp, Artificial Sequence
  chemically synthesized
ttccctatttctacctatca

SEQ ID NO: 347121 - DNA, 20 bp, Artificial Sequence
  chemically synthesized
tagagaaaggccttgatagg

SEQ ID NO: 347122 - DNA, 20 bp, Artificial Sequence
  chemically synthesized
ttttagagaaaggccttgat

SEQ ID NO: 347123 - DNA, 20 bp, Artificial Sequence
  chemically synthesized
attttagagaaaggccttga

SEQ ID NO: 347124 - DNA, 20 bp, Artificial Sequence
  chemically synthesized
ttgggctatattttagagaa

SEQ ID NO: 347125 - DNA, 20 bp, Artificial Sequence
  chemically synthesized
tttgggctatattttagaga

SEQ ID NO: 347126 - DNA, 20 bp, Artificial Sequence
  chemically synthesized
caaggcctttctctaaaata

SEQ ID NO: 347127 - DNA, 20 bp, Artificial Sequence
  chemically synthesized
tacatttgggctatatttta

SEQ ID NO: 347128 - DNA, 20 bp, Artificial Sequence
  chemically synthesized
agtacatttgggctatattt

SEQ ID NO: 347129 - DNA, 20 bp, Artificial Sequence
  chemically synthesized
aatgcccggagagtacattt

SEQ ID NO: 347130 - DNA, 20 bp, Artificial Sequence
  chemically synthesized
taatgcccggagagtacatt

SEQ ID NO: 347131 - DNA, 20 bp, Artificial Sequence
  chemically synthesized
tatagcccaaatgtactctc

SEQ ID NO: 347132 - DNA, 20 bp, Artificial Sequence
  chemically synthesized
atagcccaaatgtactctcc

SEQ ID NO: 347133 - DNA, 20 bp, Artificial Sequence
  chemically synthesized
agagagaaataatgcccgga

SEQ ID NO: 347134 - DNA, 20 bp, Artificial Sequence
  chemically synthesized
agagagagaaataatgcccg

SEQ ID NO: 347135 - DNA, 20 bp, Artificial Sequence
  chemically synthesized
agagagagagaaataatgcc

SEQ ID NO: 347136 - DNA, 20 bp, Artificial Sequence
  chemically synthesized
gcaatcacttgagagagaga

SEQ ID NO: 347137 - DNA, 20 bp, Artificial Sequence
  chemically synthesized
ttgcaatcacttgagagaga

SEQ ID NO: 347138 - DNA, 20 bp, Artificial Sequence
  chemically synthesized
attatttctctctctctctc

SEQ ID NO: 347139 - DNA, 20 bp, Artificial Sequence
  chemically synthesized
cattgcaatcacttgagaga

SEQ ID NO: 347140 - DNA, 20 bp, Artificial Sequence
  chemically synthesized
ggcattgcaatcacttgaga

SEQ ID NO: 347141 - DNA, 20 bp, Artificial Sequence
  chemically synthesized
aaggcattgcaatcacttga

SEQ ID NO: 347142 - DNA, 20 bp, Artificial Sequence
  chemically synthesized
aaaaggcattgcaatcactt

SEQ ID NO: 347143 - DNA, 20 bp, Artificial Sequence
  chemically synthesized
tccaaagagttcaaataaaa

SEQ ID NO: 347144 - DNA, 20 bp, Artificial Sequence
  chemically synthesized
gtccaaagagttcaaataaa

SEQ ID NO: 347145 - DNA, 20 bp, Artificial Sequence
  chemically synthesized
gcctttttatttgaactctt

SEQ ID NO: 347146 - DNA, 20 bp, Artificial Sequence
  chemically synthesized
acatttaagtgtagtccaaa

SEQ ID NO: 347147 - DNA, 20 bp, Artificial Sequence
  chemically synthesized
taacatttaagtgtagtcca

SEQ ID NO: 347148 - DNA, 20 bp, Artificial Sequence
  chemically synthesized
gagttgataacatttaagtg

SEQ ID NO: 347149 - DNA, 20 bp, Artificial Sequence
  chemically synthesized
gacatgagttgataacattt

SEQ ID NO: 347150 - DNA, 20 bp, Artificial Sequence
  chemically synthesized
aatgttatcaactcatgtcc

SEQ ID NO: 347151 - DNA, 20 bp, Artificial Sequence
  chemically synthesized
cttgtaaacatcttggacat

SEQ ID NO: 347152 - DNA, 20 bp, Artificial Sequence
  chemically synthesized
aatgacacttgtaaacatct

SEQ ID NO: 347153 - DNA, 20 bp, Artificial Sequence
  chemically synthesized
ctcatgtccaagatgtttac

SEQ ID NO: 347154 - DNA, 20 bp, Artificial Sequence
  chemically synthesized
gacaacattattaaagtcac

SEQ ID NO: 347155 - DNA, 20 bp, Artificial Sequence
  chemically synthesized
agacaacattattaaagtca

SEQ ID NO: 347156 - DNA, 20 bp, Artificial Sequence
  chemically synthesized
aaaaggagacaacattatta

SEQ ID NO: 347157 - DNA, 20 bp, Artificial Sequence
  chemically synthesized
aatagacgctgcaaaaaaag

SEQ ID NO: 347158 - DNA, 20 bp, Artificial Sequence
  chemically synthesized
aatgttgtctcctttttttg

SEQ ID NO: 347159 - DNA, 20 bp, Artificial Sequence
  chemically synthesized
taaatagacgctgcaaaaaa

SEQ ID NO: 347160 - DNA, 20 bp, Artificial Sequence
  chemically synthesized
ttaaatagacgctgcaaaaa

SEQ ID NO: 347161 - DNA, 20 bp, Artificial Sequence
  chemically synthesized
tggtaagagataaaattaaa

SEQ ID NO: 347162 - DNA, 20 bp, Artificial Sequence
  chemically synthesized
gccaggtgggtttatggtaa

SEQ ID NO: 347163 - DNA, 20 bp, Artificial Sequence
  chemically synthesized
aggccaggtgggtttatggt

SEQ ID NO: 347164 - DNA, 20 bp, Artificial Sequence
  chemically synthesized
ggataggccaggtgggttta

SEQ ID NO: 347165 - DNA, 20 bp, Artificial Sequence
  chemically synthesized
tctcttaccataaacccacc

SEQ ID NO: 347166 - DNA, 20 bp, Artificial Sequence
  chemically synthesized
aatccctggataggccaggt

SEQ ID NO: 347167 - DNA, 20 bp, Artificial Sequence
  chemically synthesized
aaatccctggataggccagg

SEQ ID NO: 347168 - DNA, 20 bp, Artificial Sequence
  chemically synthesized
aagaaatccctggataggcc

SEQ ID NO: 347169 - DNA, 20 bp, Artificial Sequence
  chemically synthesized
ataaacccacctggcctatc

SEQ ID NO: 347170 - DNA, 20 bp, Artificial Sequence
  chemically synthesized
gaagaaatccctggataggc

SEQ ID NO: 347171 - DNA, 20 bp, Artificial Sequence
  chemically synthesized
taaacccacctggcctatcc

SEQ ID NO: 347172 - DNA, 20 bp, Artificial Sequence
  chemically synthesized
aaacccacctggcctatcca

SEQ ID NO: 347173 - DNA, 20 bp, Artificial Sequence
  chemically synthesized
tcttgaagaaatccctggat

SEQ ID NO: 347174 - DNA, 20 bp, Artificial Sequence
  chemically synthesized
ttcttgaagaaatccctgga

SEQ ID NO: 347175 - DNA, 20 bp, Artificial Sequence
  chemically synthesized
gtgcttcttgaagaaatccc

SEQ ID NO: 347176 - DNA, 20 bp, Artificial Sequence
  chemically synthesized
gcctatccagggatttcttc

SEQ ID NO: 347177 - DNA, 20 bp, Artificial Sequence
  chemically synthesized
tatccagggatttcttcaag

SEQ ID NO: 347178 - DNA, 20 bp, Artificial Sequence
  chemically synthesized
tacagtagctgtgcttcttg

SEQ ID NO: 347179 - DNA, 20 bp, Artificial Sequence
  chemically synthesized
agggatttcttcaagaagca

SEQ ID NO: 347180 - DNA, 20 bp, Artificial Sequence
  chemically synthesized
caagaagcacagctactgta

SEQ ID NO: 347181 - DNA, 20 bp, Artificial Sequence
  chemically synthesized
gtgtagaatgtgccatacag

SEQ ID NO: 347182 - DNA, 20 bp, Artificial Sequence
  chemically synthesized
ttagtgtagaatgtgccata

SEQ ID NO: 347183 - DNA, 20 bp, Artificial Sequence
  chemically synthesized
tatatactggggatttagtg

SEQ ID NO: 347184 - DNA, 20 bp, Artificial Sequence
  chemically synthesized
cacattctacactaaatccc

SEQ ID NO: 347185 - DNA, 20 bp, Artificial Sequence
  chemically synthesized
cagattatatactggggatt

SEQ ID NO: 347186 - DNA, 20 bp, Artificial Sequence
  chemically synthesized
aatgagcagattatatactg

SEQ ID NO: 347187 - DNA, 20 bp, Artificial Sequence
  chemically synthesized
aaatgagcagattatatact

SEQ ID NO: 347188 - DNA, 20 bp, Artificial Sequence
  chemically synthesized
taaatgagcagattatatac

SEQ ID NO: 347189 - DNA, 20 bp, Artificial Sequence
  chemically synthesized
cagtatataatctgctcatt

SEQ ID NO: 347190 - DNA, 20 bp, Artificial Sequence
  chemically synthesized
ccgatttatcactaaatgag

SEQ ID NO: 347191 - DNA, 20 bp, Artificial Sequence
  chemically synthesized
tcaccgatttatcactaaat

SEQ ID NO: 347192 - DNA, 20 bp, Artificial Sequence
  chemically synthesized
ctgctcatttagtgataaat

SEQ ID NO: 347193 - DNA, 20 bp, Artificial Sequence
  chemically synthesized
taaatcggtgatgctcttca

SEQ ID NO: 347194 - DNA, 20 bp, Artificial Sequence
  chemically synthesized
aaatcggtgatgctcttcac

SEQ ID NO: 347195 - DNA, 20 bp, Artificial Sequence
  chemically synthesized
atcggtgatgctcttcacag

SEQ ID NO: 347196 - DNA, 20 bp, Artificial Sequence
  chemically synthesized
tctcttcagtctcctgtgaa

SEQ ID NO: 347197 - DNA, 20 bp, Artificial Sequence
  chemically synthesized
tctctcttcagtctcctgtg

SEQ ID NO: 347198 - DNA, 20 bp, Artificial Sequence
  chemically synthesized
atgctcttcacaggagactg

SEQ ID NO: 347199 - DNA, 20 bp, Artificial Sequence
  chemically synthesized
gctcttcacaggagactgaa

SEQ ID NO: 347200 - DNA, 20 bp, Artificial Sequence
  chemically synthesized
tcttcacaggagactgaaga

SEQ ID NO: 347201 - DNA, 20 bp, Artificial Sequence
  chemically synthesized
gacttctgagtgtctctctt

SEQ ID NO: 347202 - DNA, 20 bp, Artificial Sequence
  chemically synthesized
ggagactgaagagagacact

SEQ ID NO: 347203 - DNA, 20 bp, Artificial Sequence
  chemically synthesized
gactgaagagagacactcag

SEQ ID NO: 347204 - DNA, 20 bp, Artificial Sequence
  chemically synthesized
cacacaattctaagacttct

SEQ ID NO: 347205 - DNA, 20 bp, Artificial Sequence
  chemically synthesized
agagagacactcagaagtct

SEQ ID NO: 347206 - DNA, 20 bp, Artificial Sequence
  chemically synthesized
ttctagaagcacacaattct

SEQ ID NO: 347207 - DNA, 20 bp, Artificial Sequence
  chemically synthesized
gtcttagaattgtgtgcttc

SEQ ID NO: 347208 - DNA, 20 bp, Artificial Sequence
  chemically synthesized
ggaaattctttgtattctag

SEQ ID NO: 347209 - DNA, 20 bp, Artificial Sequence
  chemically synthesized
ttgtgtgcttctagaataca

SEQ ID NO: 347210 - DNA, 20 bp, Artificial Sequence
  chemically synthesized
tgtggaaattctttgtattc

SEQ ID NO: 347211 - DNA, 20 bp, Artificial Sequence
  chemically synthesized
acaaagaatttccacaatca

SEQ ID NO: 347212 - DNA, 20 bp, Artificial Sequence
  chemically synthesized
gtcctcagactctatgattg

SEQ ID NO: 347213 - DNA, 20 bp, Artificial Sequence
  chemically synthesized
aaagaatttccacaatcata

SEQ ID NO: 347214 - DNA, 20 bp, Artificial Sequence
  chemically synthesized
tttccacaatcatagagtct

SEQ ID NO: 347215 - DNA, 20 bp, Artificial Sequence
  chemically synthesized
ttccacaatcatagagtctg

SEQ ID NO: 347216 - DNA, 20 bp, Artificial Sequence
  chemically synthesized
tagtaatgattaaaagtcct

SEQ ID NO: 347217 - DNA, 20 bp, Artificial Sequence
  chemically synthesized
gtgaaaatagtaatgattaa

SEQ ID NO: 347218 - DNA, 20 bp, Artificial Sequence
  chemically synthesized
tttaatcattactattttca

SEQ ID NO: 347219 - DNA, 20 bp, Artificial Sequence
  chemically synthesized
tactccaaaagctgtgaaaa

SEQ ID NO: 347220 - DNA, 20 bp, Artificial Sequence
  chemically synthesized
attactattttcacagcttt

SEQ ID NO: 347221 - DNA, 20 bp, Artificial Sequence
  chemically synthesized
tactattttcacagcttttg

SEQ ID NO: 347222 - DNA, 20 bp, Artificial Sequence
  chemically synthesized
tattttcacagcttttggag

SEQ ID NO: 347223 - DNA, 20 bp, Artificial Sequence
  chemically synthesized
actgagtctgtctactccaa

SEQ ID NO: 347224 - DNA, 20 bp, Artificial Sequence
  chemically synthesized
ttcacagcttttggagtaga

SEQ ID NO: 347225 - DNA, 20 bp, Artificial Sequence
  chemically synthesized
gcttttggagtagacagact

SEQ ID NO: 347226 - DNA, 20 bp, Artificial Sequence
  chemically synthesized
gagtagacagactcagtccc

SEQ ID NO: 347227 - DNA, 20 bp, Artificial Sequence
  chemically synthesized
tggccatttttctggggact

SEQ ID NO: 347228 - DNA, 20 bp, Artificial Sequence
  chemically synthesized
ttacattggccatttttctg

SEQ ID NO: 347229 - DNA, 20 bp, Artificial Sequence
  chemically synthesized
agactcagtccccagaaaaa

SEQ ID NO: 347230 - DNA, 20 bp, Artificial Sequence
  chemically synthesized
gttacattggccatttttct

SEQ ID NO: 347231 - DNA, 20 bp, Artificial Sequence
  chemically synthesized
agttacattggccatttttc

SEQ ID NO: 347232 - DNA, 20 bp, Artificial Sequence
  chemically synthesized
tgtgtgtgtataagttacat

SEQ ID NO: 347233 - DNA, 20 bp, Artificial Sequence
  chemically synthesized
cattgtgtatgtgtgtgtat

SEQ ID NO: 347234 - DNA, 20 bp, Artificial Sequence
  chemically synthesized
gggtggacctgtcacattta

SEQ ID NO: 347235 - DNA, 20 bp, Artificial Sequence
  chemically synthesized
atgattatctttaaatgtga

SEQ ID NO: 347236 - DNA, 20 bp, Artificial Sequence
  chemically synthesized
tgattatctttaaatgtgac

SEQ ID NO: 347237 - DNA, 20 bp, Artificial Sequence
  chemically synthesized
ttaaatgtgacaggtccacc

SEQ ID NO: 347238 - DNA, 20 bp, Artificial Sequence
  chemically synthesized
aatgtgacaggtccacccag

SEQ ID NO: 347239 - DNA, 20 bp, Artificial Sequence
  chemically synthesized
ccacatggaaatctactggg

SEQ ID NO: 347240 - DNA, 20 bp, Artificial Sequence
  chemically synthesized
attccacatggaaatctact

SEQ ID NO: 347241 - DNA, 20 bp, Artificial Sequence
  chemically synthesized
gattccacatggaaatctac

SEQ ID NO: 347242 - DNA, 20 bp, Artificial Sequence
  chemically synthesized
ccacccagtagatttccatg

SEQ ID NO: 347243 - DNA, 20 bp, Artificial Sequence
  chemically synthesized
catctgactttgattccaca

SEQ ID NO: 347244 - DNA, 20 bp, Artificial Sequence
  chemically synthesized
tagatttccatgtggaatca

SEQ ID NO: 347245 - DNA, 20 bp, Artificial Sequence
  chemically synthesized
tttccatgtggaatcaaagt

SEQ ID NO: 347246 - DNA, 20 bp, Artificial Sequence
  chemically synthesized
tctgccactccagtcattta

SEQ ID NO: 347247 - DNA, 20 bp, Artificial Sequence
  chemically synthesized
agtcagatgccataaatgac

SEQ ID NO: 347248 - DNA, 20 bp, Artificial Sequence
  chemically synthesized
tcagatgccataaatgactg

SEQ ID NO: 347249 - DNA, 20 bp, Artificial Sequence
  chemically synthesized
gatgccataaatgactggag

SEQ ID NO: 347250 - DNA, 20 bp, Artificial Sequence
  chemically synthesized
gccataaatgactggagtgg

SEQ ID NO: 347251 - DNA, 20 bp, Artificial Sequence
  chemically synthesized
actgacagactctgccactc

SEQ ID NO: 347252 - DNA, 20 bp, Artificial Sequence
  chemically synthesized
cataaatgactggagtggca

SEQ ID NO: 347253 - DNA, 20 bp, Artificial Sequence
  chemically synthesized
actggagtggcagagtctgt

SEQ ID NO: 347254 - DNA, 20 bp, Artificial Sequence
  chemically synthesized
ggagtggcagagtctgtcag

SEQ ID NO: 347255 - DNA, 20 bp, Artificial Sequence
  chemically synthesized
agtggcagagtctgtcagtg

SEQ ID NO: 347256 - DNA, 20 bp, Artificial Sequence
  chemically synthesized
agtttatgtaactccactga

SEQ ID NO: 347257 - DNA, 20 bp, Artificial Sequence
  chemically synthesized
agttacataaactgtgtgta

SEQ ID NO: 347258 - DNA, 20 bp, Artificial Sequence
  chemically synthesized
agctgcactcgccatacaca

SEQ ID NO: 347259 - DNA, 20 bp, Artificial Sequence
  chemically synthesized
acataaactgtgtgtatggc

SEQ ID NO: 347260 - DNA, 20 bp, Artificial Sequence
  chemically synthesized
aactgtgtgtatggcgagtg

SEQ ID NO: 347261 - DNA, 20 bp, Artificial Sequence
  chemically synthesized
gtgtatggcgagtgcagctc

SEQ ID NO: 347262 - DNA, 20 bp, Artificial Sequence
  chemically synthesized
gcacattactgttcagtctg

SEQ ID NO: 347263 - DNA, 20 bp, Artificial Sequence
  chemically synthesized
gagtgcagctccagactgaa

SEQ ID NO: 347264 - DNA, 20 bp, Artificial Sequence
  chemically synthesized
gggcacattactgttcagtc

SEQ ID NO: 347265 - DNA, 20 bp, Artificial Sequence
  chemically synthesized
aaagcgggcacattactgtt

SEQ ID NO: 347266 - DNA, 20 bp, Artificial Sequence
  chemically synthesized
aacagtaatgtgcccgcttt

SEQ ID NO: 347267 - DNA, 20 bp, Artificial Sequence
  chemically synthesized
acagtaatgtgcccgctttg

SEQ ID NO: 347268 - DNA, 20 bp, Artificial Sequence
  chemically synthesized
cagtaatgtgcccgctttga

SEQ ID NO: 347269 - DNA, 20 bp, Artificial Sequence
  chemically synthesized
ctactctcctccctcaaagc

SEQ ID NO: 347270 - DNA, 20 bp, Artificial Sequence
  chemically synthesized
gctactctcctccctcaaag

SEQ ID NO: 347271 - DNA, 20 bp, Artificial Sequence
  chemically synthesized
gtaatgtgcccgctttgagg

SEQ ID NO: 347272 - DNA, 20 bp, Artificial Sequence
  chemically synthesized
taatgtgcccgctttgaggg

SEQ ID NO: 347273 - DNA, 20 bp, Artificial Sequence
  chemically synthesized
agtgctactctcctccctca

SEQ ID NO: 347274 - DNA, 20 bp, Artificial Sequence
  chemically synthesized
atgtgcccgctttgagggag

SEQ ID NO: 347275 - DNA, 20 bp, Artificial Sequence
  chemically synthesized
gtgcccgctttgagggagga

SEQ ID NO: 347276 - DNA, 20 bp, Artificial Sequence
  chemically synthesized
cccgctttgagggaggagag

SEQ ID NO: 347277 - DNA, 20 bp, Artificial Sequence
  chemically synthesized
gggaggagagtagcactcct

SEQ ID NO: 347278 - DNA, 20 bp, Artificial Sequence
  chemically synthesized
accatcctggtagtactgag

SEQ ID NO: 347279 - DNA, 20 bp, Artificial Sequence
  chemically synthesized
gcaccatcctggtagtactg

SEQ ID NO: 347280 - DNA, 20 bp, Artificial Sequence
  chemically synthesized
ggcaccatcctggtagtact

SEQ ID NO: 347281 - DNA, 20 bp, Artificial Sequence
  chemically synthesized
gtagcactcctcagtactac

SEQ ID NO: 347282 - DNA, 20 bp, Artificial Sequence
  chemically synthesized
tagcactcctcagtactacc

SEQ ID NO: 347283 - DNA, 20 bp, Artificial Sequence
  chemically synthesized
actcctcagtactaccagga

SEQ ID NO: 347284 - DNA, 20 bp, Artificial Sequence
  chemically synthesized
ctgcaatggcaccatcctgg

SEQ ID NO: 347285 - DNA, 20 bp, Artificial Sequence
  chemically synthesized
attctgcaatggcaccatcc

SEQ ID NO: 347286 - DNA, 20 bp, Artificial Sequence
  chemically synthesized
ctaccaggatggtgccattg

SEQ ID NO: 347287 - DNA, 20 bp, Artificial Sequence
  chemically synthesized
tctggggcaacattctgcaa

SEQ ID NO: 347288 - DNA, 20 bp, Artificial Sequence
  chemically synthesized
gccattgcagaatgttgccc

SEQ ID NO: 347289 - DNA, 20 bp, Artificial Sequence
  chemically synthesized
cattgcagaatgttgcccca

SEQ ID NO: 347290 - DNA, 20 bp, Artificial Sequence
  chemically synthesized
tagcagatctagcagctctg

SEQ ID NO: 347291 - DNA, 20 bp, Artificial Sequence
  chemically synthesized
ttagcagatctagcagctct

SEQ ID NO: 347292 - DNA, 20 bp, Artificial Sequence
  chemically synthesized
gaatgttgccccagagctgc

SEQ ID NO: 347293 - DNA, 20 bp, Artificial Sequence
  chemically synthesized
gttagcagatctagcagctc

SEQ ID NO: 347294 - DNA, 20 bp, Artificial Sequence
  chemically synthesized
gtttctgttagcagatctag

SEQ ID NO: 347295 - DNA, 20 bp, Artificial Sequence
  chemically synthesized
tgggtttctgttagcagatc

SEQ ID NO: 347296 - DNA, 20 bp, Artificial Sequence
  chemically synthesized
agagctgctagatctgctaa

SEQ ID NO: 347297 - DNA, 20 bp, Artificial Sequence
  chemically synthesized
cagatttgggtttctgttag

SEQ ID NO: 347298 - DNA, 20 bp, Artificial Sequence
  chemically synthesized
ctacagatttgggtttctgt

SEQ ID NO: 347299 - DNA, 20 bp, Artificial Sequence
  chemically synthesized
ctaacagaaacccaaatctg

SEQ ID NO: 347300 - DNA, 20 bp, Artificial Sequence
  chemically synthesized
ctacaccttactacagattt

SEQ ID NO: 347301 - DNA, 20 bp, Artificial Sequence
  chemically synthesized
tctacaccttactacagatt

SEQ ID NO: 347302 - DNA, 20 bp, Artificial Sequence
  chemically synthesized
cagaaacccaaatctgtagt

SEQ ID NO: 347303 - DNA, 20 bp, Artificial Sequence
  chemically synthesized
agaaacccaaatctgtagta

SEQ ID NO: 347304 - DNA, 20 bp, Artificial Sequence
  chemically synthesized
gtttgatctacaccttacta

SEQ ID NO: 347305 - DNA, 20 bp, Artificial Sequence
  chemically synthesized
cccaaatctgtagtaaggtg

SEQ ID NO: 347306 - DNA, 20 bp, Artificial Sequence
  chemically synthesized
gatcaaacaaaacatatctc

SEQ ID NO: 347307 - DNA, 20 bp, Artificial Sequence
  chemically synthesized
atcaaacaaaacatatctct

SEQ ID NO: 347308 - DNA, 20 bp, Artificial Sequence
  chemically synthesized
gaaagtctggaaggaaccca

SEQ ID NO: 347309 - DNA, 20 bp, Artificial Sequence
  chemically synthesized
tggaaagtctggaaggaacc

SEQ ID NO: 347310 - DNA, 20 bp, Artificial Sequence
  chemically synthesized
acatatctctgggttccttc

SEQ ID NO: 347311 - DNA, 20 bp, Artificial Sequence
  chemically synthesized
ctgttaatggaaagtctgga

SEQ ID NO: 347312 - DNA, 20 bp, Artificial Sequence
  chemically synthesized
actgttaatggaaagtctgg

SEQ ID NO: 347313 - DNA, 20 bp, Artificial Sequence
  chemically synthesized
taaactgttaatggaaagtc

SEQ ID NO: 347314 - DNA, 20 bp, Artificial Sequence
  chemically synthesized
cgttataaactgttaatgga

SEQ ID NO: 347315 - DNA, 20 bp, Artificial Sequence
  chemically synthesized
ccttccagactttccattaa

SEQ ID NO: 347316 - DNA, 20 bp, Artificial Sequence
  chemically synthesized
aagacgttataaactgttaa

SEQ ID NO: 347317 - DNA, 20 bp, Artificial Sequence
  chemically synthesized
tatgtgaacagatagttcag

SEQ ID NO: 347318 - DNA, 20 bp, Artificial Sequence
  chemically synthesized
aagtatgtgaacagatagtt

SEQ ID NO: 347319 - DNA, 20 bp, Artificial Sequence
  chemically synthesized
ggtttaagtatgtgaacaga

SEQ ID NO: 347320 - DNA, 20 bp, Artificial Sequence
  chemically synthesized
ctcaggtttaagtatgtgaa

SEQ ID NO: 347321 - DNA, 20 bp, Artificial Sequence
  chemically synthesized
ctgttcacatacttaaacct

SEQ ID NO: 347322 - DNA, 20 bp, Artificial Sequence
  chemically synthesized
cagcccgaggactcaggttt

SEQ ID NO: 347323 - DNA, 20 bp, Artificial Sequence
  chemically synthesized
catacttaaacctgagtcct

SEQ ID NO: 347324 - DNA, 20 bp, Artificial Sequence
  chemically synthesized
catgcccagcccgaggactc

SEQ ID NO: 347325 - DNA, 20 bp, Artificial Sequence
  chemically synthesized
atacttaaacctgagtcctc

SEQ ID NO: 347326 - DNA, 20 bp, Artificial Sequence
  chemically synthesized
ccatgcccagcccgaggact

SEQ ID NO: 347327 - DNA, 20 bp, Artificial Sequence
  chemically synthesized
ttaaacctgagtcctcgggc

SEQ ID NO: 347328 - DNA, 20 bp, Artificial Sequence
  chemically synthesized
taaacctgagtcctcgggct

SEQ ID NO: 347329 - DNA, 20 bp, Artificial Sequence
  chemically synthesized
gagccaccatgcccagcccg

SEQ ID NO: 347330 - DNA, 20 bp, Artificial Sequence
  chemically synthesized
tgagccaccatgcccagccc

SEQ ID NO: 347331 - DNA, 20 bp, Artificial Sequence
  chemically synthesized
ctgagtcctcgggctgggca

SEQ ID NO: 347332 - DNA, 20 bp, Artificial Sequence
  chemically synthesized
agtcctcgggctgggcatgg

SEQ ID NO: 347333 - DNA, 20 bp, Artificial Sequence
  chemically synthesized
caagcatgagccaccatgcc

SEQ ID NO: 347334 - DNA, 20 bp, Artificial Sequence
  chemically synthesized
agtgctgggataacaagcat

SEQ ID NO: 347335 - DNA, 20 bp, Artificial Sequence
  chemically synthesized
gtggctcatgcttgttatcc

SEQ ID NO: 347336 - DNA, 20 bp, Artificial Sequence
  chemically synthesized
tcccaaagtgctgggataac

SEQ ID NO: 347337 - DNA, 20 bp, Artificial Sequence
  chemically synthesized
tgcttgttatcccagcactt

SEQ ID NO: 347338 - DNA, 20 bp, Artificial Sequence
  chemically synthesized
tctcggcctcccaaagtgct

SEQ ID NO: 347339 - DNA, 20 bp, Artificial Sequence
  chemically synthesized
gcttgttatcccagcacttt

SEQ ID NO: 347340 - DNA, 20 bp, Artificial Sequence
  chemically synthesized
atctcggcctcccaaagtgc

SEQ ID NO: 347341 - DNA, 20 bp, Artificial Sequence
  chemically synthesized
ttgttatcccagcactttgg

SEQ ID NO: 347342 - DNA, 20 bp, Artificial Sequence
  chemically synthesized
tgttatcccagcactttggg

SEQ ID NO: 347343 - DNA, 20 bp, Artificial Sequence
  chemically synthesized
ctgcccatctcggcctccca

SEQ ID NO: 347344 - DNA, 20 bp, Artificial Sequence
  chemically synthesized
tcccagcactttgggaggcc

SEQ ID NO: 347345 - DNA, 20 bp, Artificial Sequence
  chemically synthesized
agcactttgggaggccgaga

SEQ ID NO: 347346 - DNA, 20 bp, Artificial Sequence
  chemically synthesized
gcactttgggaggccgagat

SEQ ID NO: 347347 - DNA, 20 bp, Artificial Sequence
  chemically synthesized
ctttgggaggccgagatggg

SEQ ID NO: 347348 - DNA, 20 bp, Artificial Sequence
  chemically synthesized
accttgtgatctgcccatct

SEQ ID NO: 347349 - DNA, 20 bp, Artificial Sequence
  chemically synthesized
ggccgagatgggcagatcac

SEQ ID NO: 347350 - DNA, 20 bp, Artificial Sequence
  chemically synthesized
gccgagatgggcagatcaca

SEQ ID NO: 347351 - DNA, 20 bp, Artificial Sequence
  chemically synthesized
agatgggcagatcacaaggt

SEQ ID NO: 347352 - DNA, 20 bp, Artificial Sequence
  chemically synthesized
gatgggcagatcacaaggta

SEQ ID NO: 347353 - DNA, 20 bp, Artificial Sequence
  chemically synthesized
tgggcagatcacaaggtaag

SEQ ID NO: 347354 - DNA, 20 bp, Artificial Sequence
  chemically synthesized
gatcacaaggtaaggagatc

SEQ ID NO: 347355 - DNA, 20 bp, Artificial Sequence
  chemically synthesized
taaggagatcgagaccattc

SEQ ID NO: 347356 - DNA, 20 bp, Artificial Sequence
  chemically synthesized
tttcactgtgttagccagaa

SEQ ID NO: 347357 - DNA, 20 bp, Artificial Sequence
  chemically synthesized
cgagaccattctggctaaca

SEQ ID NO: 347358 - DNA, 20 bp, Artificial Sequence
  chemically synthesized
ctgggtttcactgtgttagc

SEQ ID NO: 347359 - DNA, 20 bp, Artificial Sequence
  chemically synthesized
gagactgggtttcactgtgt

SEQ ID NO: 347360 - DNA, 20 bp, Artificial Sequence
  chemically synthesized
ctggctaacacagtgaaacc

SEQ ID NO: 347361 - DNA, 20 bp, Artificial Sequence
  chemically synthesized
ttgtgtttttagtagagact

SEQ ID NO: 347362 - DNA, 20 bp, Artificial Sequence
  chemically synthesized
tttgtgtttttagtagagac

SEQ ID NO: 347363 - DNA, 20 bp, Artificial Sequence
  chemically synthesized
aattttttgtgtttttagta

SEQ ID NO: 347364 - DNA, 20 bp, Artificial Sequence
  chemically synthesized
ctaattttttgtgtttttag

SEQ ID NO: 347365 - DNA, 20 bp, Artificial Sequence
  chemically synthesized
tggctaattttttgtgtttt

SEQ ID NO: 347366 - DNA, 20 bp, Artificial Sequence
  chemically synthesized
ctactaaaaacacaaaaaat

SEQ ID NO: 347367 - DNA, 20 bp, Artificial Sequence
  chemically synthesized
taaaaacacaaaaaattagc

SEQ ID NO: 347368 - DNA, 20 bp, Artificial Sequence
  chemically synthesized
aaaaacacaaaaaattagcc

SEQ ID NO: 347369 - DNA, 20 bp, Artificial Sequence
  chemically synthesized
cacaaaaaattagccaggca

SEQ ID NO: 347370 - DNA, 20 bp, Artificial Sequence
  chemically synthesized
caggcgcgtgcaactatgcc

SEQ ID NO: 347371 - DNA, 20 bp, Artificial Sequence
  chemically synthesized
gttgcacgcgcctgtaatcc

SEQ ID NO: 347372 - DNA, 20 bp, Artificial Sequence
  chemically synthesized
tcccgagtagctgggattac

SEQ ID NO: 347373 - DNA, 20 bp, Artificial Sequence
  chemically synthesized
ctcccgagtagctgggatta

SEQ ID NO: 347374 - DNA, 20 bp, Artificial Sequence
  chemically synthesized
cgcctgtaatcccagctact

SEQ ID NO: 347375 - DNA, 20 bp, Artificial Sequence
  chemically synthesized
tctcagcctcccgagtagct

SEQ ID NO: 347376 - DNA, 20 bp, Artificial Sequence
  chemically synthesized
gcctgtaatcccagctactc

SEQ ID NO: 347377 - DNA, 20 bp, Artificial Sequence
  chemically synthesized
gtctcagcctcccgagtagc

SEQ ID NO: 347378 - DNA, 20 bp, Artificial Sequence
  chemically synthesized
ctgtaatcccagctactcgg

SEQ ID NO: 347379 - DNA, 20 bp, Artificial Sequence
  chemically synthesized
tgtaatcccagctactcggg

SEQ ID NO: 347380 - DNA, 20 bp, Artificial Sequence
  chemically synthesized
tcctgtctcagcctcccgag

SEQ ID NO: 347381 - DNA, 20 bp, Artificial Sequence
  chemically synthesized
tcctcctgtctcagcctccc

SEQ ID NO: 347382 - DNA, 20 bp, Artificial Sequence
  chemically synthesized
tcccagctactcgggaggct

SEQ ID NO: 347383 - DNA, 20 bp, Artificial Sequence
  chemically synthesized
agctactcgggaggctgaga

SEQ ID NO: 347384 - DNA, 20 bp, Artificial Sequence
  chemically synthesized
gctactcgggaggctgagac

SEQ ID NO: 347385 - DNA, 20 bp, Artificial Sequence
  chemically synthesized
tactcgggaggctgagacag

SEQ ID NO: 347386 - DNA, 20 bp, Artificial Sequence
  chemically synthesized
actcgggaggctgagacagg

SEQ ID NO: 347387 - DNA, 20 bp, Artificial Sequence
  chemically synthesized
tcaaatgattcctcctgtct

SEQ ID NO: 347388 - DNA, 20 bp, Artificial Sequence
  chemically synthesized
caggaggaatcatttgaacc

SEQ ID NO: 347389 - DNA, 20 bp, Artificial Sequence
  chemically synthesized
aggaggaatcatttgaacct

SEQ ID NO: 347390 - DNA, 20 bp, Artificial Sequence
  chemically synthesized
gaggaatcatttgaacctag

SEQ ID NO: 347391 - DNA, 20 bp, Artificial Sequence
  chemically synthesized
aggaatcatttgaacctagg

SEQ ID NO: 347392 - DNA, 20 bp, Artificial Sequence
  chemically synthesized
aatcatttgaacctaggagg

SEQ ID NO: 347393 - DNA, 20 bp, Artificial Sequence
  chemically synthesized
cactgcaacctctgcctcct

SEQ ID NO: 347394 - DNA, 20 bp, Artificial Sequence
  chemically synthesized
tcatttgaacctaggaggca

SEQ ID NO: 347395 - DNA, 20 bp, Artificial Sequence
  chemically synthesized
tcactgcaacctctgcctcc

SEQ ID NO: 347396 - DNA, 20 bp, Artificial Sequence
  chemically synthesized
catttgaacctaggaggcag

SEQ ID NO: 347397 - DNA, 20 bp, Artificial Sequence
  chemically synthesized
aacctaggaggcagaggttg

SEQ ID NO: 347398 - DNA, 20 bp, Artificial Sequence
  chemically synthesized
taggaggcagaggttgcagt

SEQ ID NO: 347399 - DNA, 20 bp, Artificial Sequence
  chemically synthesized
aggaggcagaggttgcagtg

SEQ ID NO: 347400 - DNA, 20 bp, Artificial Sequence
  chemically synthesized
ggcagaggttgcagtgaggc

SEQ ID NO: 347401 - DNA, 20 bp, Artificial Sequence
  chemically synthesized
tggagtgcagtggtacgatc

SEQ ID NO: 347402 - DNA, 20 bp, Artificial Sequence
  chemically synthesized
tcacctagactggagtgcag

SEQ ID NO: 347403 - DNA, 20 bp, Artificial Sequence
  chemically synthesized
cagatcgtaccactgcactc

SEQ ID NO: 347404 - DNA, 20 bp, Artificial Sequence
  chemically synthesized
ctgtcacctagactggagtg

SEQ ID NO: 347405 - DNA, 20 bp, Artificial Sequence
  chemically synthesized
cgtaccactgcactccagtc

SEQ ID NO: 347406 - DNA, 20 bp, Artificial Sequence
  chemically synthesized
gtaccactgcactccagtct

SEQ ID NO: 347407 - DNA, 20 bp, Artificial Sequence
  chemically synthesized
ttgctctgtcacctagactg

SEQ ID NO: 347408 - DNA, 20 bp, Artificial Sequence
  chemically synthesized
tcttgctctgtcacctagac

SEQ ID NO: 347409 - DNA, 20 bp, Artificial Sequence
  chemically synthesized
ctgcactccagtctaggtga

SEQ ID NO: 347410 - DNA, 20 bp, Artificial Sequence
  chemically synthesized
gcactccagtctaggtgaca

SEQ ID NO: 347411 - DNA, 20 bp, Artificial Sequence
  chemically synthesized
cagagtcttgctctgtcacc

SEQ ID NO: 347412 - DNA, 20 bp, Artificial Sequence
  chemically synthesized
tccagtctaggtgacagagc

SEQ ID NO: 347413 - DNA, 20 bp, Artificial Sequence
  chemically synthesized
ttttttctttttttgagaca

SEQ ID NO: 347414 - DNA, 20 bp, Artificial Sequence
  chemically synthesized
ttttttttctttttttgaga

SEQ ID NO: 347415 - DNA, 20 bp, Artificial Sequence
  chemically synthesized
gcaagactctgtctcaaaaa

SEQ ID NO: 347416 - DNA, 20 bp, Artificial Sequence
  chemically synthesized
ttctttttttttcttttttt

SEQ ID NO: 347417 - DNA, 20 bp, Artificial Sequence
  chemically synthesized
gtctcaaaaaaagaaaaaaa

SEQ ID NO: 347418 - DNA, 20 bp, Artificial Sequence
  chemically synthesized
aaaaaaaacaaaaaaaccct

SEQ ID NO: 347419 - DNA, 20 bp, Artificial Sequence
  chemically synthesized
ggagagctagtcaggactca

SEQ ID NO: 347420 - DNA, 20 bp, Artificial Sequence
  chemically synthesized
aggagagctagtcaggactc

SEQ ID NO: 347421 - DNA, 20 bp, Artificial Sequence
  chemically synthesized
caggagagctagtcaggact

SEQ ID NO: 347422 - DNA, 20 bp, Artificial Sequence
  chemically synthesized
aaaaaaccctgagtcctgac

SEQ ID NO: 347423 - DNA, 20 bp, Artificial Sequence
  chemically synthesized
ctcctgcaggagagctagtc

SEQ ID NO: 347424 - DNA, 20 bp, Artificial Sequence
  chemically synthesized
tctcctgcaggagagctagt

SEQ ID NO: 347425 - DNA, 20 bp, Artificial Sequence
  chemically synthesized
acactctcctgcaggagagc

SEQ ID NO: 347426 - DNA, 20 bp, Artificial Sequence
  chemically synthesized
agtcctgactagctctcctg

SEQ ID NO: 347427 - DNA, 20 bp, Artificial Sequence
  chemically synthesized
gtcctgactagctctcctgc

SEQ ID NO: 347428 - DNA, 20 bp, Artificial Sequence
  chemically synthesized
agtaacactctcctgcagga

SEQ ID NO: 347429 - DNA, 20 bp, Artificial Sequence
  chemically synthesized
cctgactagctctcctgcag

SEQ ID NO: 347430 - DNA, 20 bp, Artificial Sequence
  chemically synthesized
tcagtaacactctcctgcag

SEQ ID NO: 347431 - DNA, 20 bp, Artificial Sequence
  chemically synthesized
tgactagctctcctgcagga

SEQ ID NO: 347432 - DNA, 20 bp, Artificial Sequence
  chemically synthesized
actcagtaacactctcctgc

SEQ ID NO: 347433 - DNA, 20 bp, Artificial Sequence
  chemically synthesized
aactcagtaacactctcctg

SEQ ID NO: 347434 - DNA, 20 bp, Artificial Sequence
  chemically synthesized
tcctgcaggagagtgttact

SEQ ID NO: 347435 - DNA, 20 bp, Artificial Sequence
  chemically synthesized
caggagagtgttactgagtt

SEQ ID NO: 347436 - DNA, 20 bp, Artificial Sequence
  chemically synthesized
tttctcctgattgcttaact

SEQ ID NO: 347437 - DNA, 20 bp, Artificial Sequence
  chemically synthesized
gtgttactgagttaagcaat

SEQ ID NO: 347438 - DNA, 20 bp, Artificial Sequence
  chemically synthesized
tgttactgagttaagcaatc

SEQ ID NO: 347439 - DNA, 20 bp, Artificial Sequence
  chemically synthesized
ttactgagttaagcaatcag

SEQ ID NO: 347440 - DNA, 20 bp, Artificial Sequence
  chemically synthesized
taggtgaccatcggttgata

SEQ ID NO: 347441 - DNA, 20 bp, Artificial Sequence
  chemically synthesized
aataggtgaccatcggttga

SEQ ID NO: 347442 - DNA, 20 bp, Artificial Sequence
  chemically synthesized
aatgaaactctatcaaccga

SEQ ID NO: 347443 - DNA, 20 bp, Artificial Sequence
  chemically synthesized
atttgttaataggtgaccat

SEQ ID NO: 347444 - DNA, 20 bp, Artificial Sequence
  chemically synthesized
atgccatcttatttgttaat

SEQ ID NO: 347445 - DNA, 20 bp, Artificial Sequence
  chemically synthesized
tatgccatcttatttgttaa

SEQ ID NO: 347446 - DNA, 20 bp, Artificial Sequence
  chemically synthesized
atggtcacctattaacaaat

SEQ ID NO: 347447 - DNA, 20 bp, Artificial Sequence
  chemically synthesized
tcacctattaacaaataaga

SEQ ID NO: 347448 - DNA, 20 bp, Artificial Sequence
  chemically synthesized
aatgaatagcaatagtacag

SEQ ID NO: 347449 - DNA, 20 bp, Artificial Sequence
  chemically synthesized
ataaatgaatagcaatagta

SEQ ID NO: 347450 - DNA, 20 bp, Artificial Sequence
  chemically synthesized
gataaataaatgaatagcaa

SEQ ID NO: 347451 - DNA, 20 bp, Artificial Sequence
  chemically synthesized
ggaatggataaataaatgaa

SEQ ID NO: 347452 - DNA, 20 bp, Artificial Sequence
  chemically synthesized
ggtgaaaaatgtttgtggaa

SEQ ID NO: 347453 - DNA, 20 bp, Artificial Sequence
  chemically synthesized
tggtaggtgaaaaatgtttg

SEQ ID NO: 347454 - DNA, 20 bp, Artificial Sequence
  chemically synthesized
gagaatgccgaagagatggt

SEQ ID NO: 347455 - DNA, 20 bp, Artificial Sequence
  chemically synthesized
ggagaatgccgaagagatgg

SEQ ID NO: 347456 - DNA, 20 bp, Artificial Sequence
  chemically synthesized
tttttcacctaccatctctt

SEQ ID NO: 347457 - DNA, 20 bp, Artificial Sequence
  chemically synthesized
ctaggagaatgccgaagaga

SEQ ID NO: 347458 - DNA, 20 bp, Artificial Sequence
  chemically synthesized
gtagctaggagaatgccgaa

SEQ ID NO: 347459 - DNA, 20 bp, Artificial Sequence
  chemically synthesized
cagtagctaggagaatgccg

SEQ ID NO: 347460 - DNA, 20 bp, Artificial Sequence
  chemically synthesized
ccatctcttcggcattctcc

SEQ ID NO: 347461 - DNA, 20 bp, Artificial Sequence
  chemically synthesized
actgtatagccagtagctag

SEQ ID NO: 347462 - DNA, 20 bp, Artificial Sequence
  chemically synthesized
ttcggcattctcctagctac

SEQ ID NO: 347463 - DNA, 20 bp, Artificial Sequence
  chemically synthesized
gtactgtatagccagtagct

SEQ ID NO: 347464 - DNA, 20 bp, Artificial Sequence
  chemically synthesized
agtactgtatagccagtagc

SEQ ID NO: 347465 - DNA, 20 bp, Artificial Sequence
  chemically synthesized
cttcagtactgtatagccag

SEQ ID NO: 347466 - DNA, 20 bp, Artificial Sequence
  chemically synthesized
tctcctagctactggctata

SEQ ID NO: 347467 - DNA, 20 bp, Artificial Sequence
  chemically synthesized
tggcttcagtactgtatagc

SEQ ID NO: 347468 - DNA, 20 bp, Artificial Sequence
  chemically synthesized
ccgttggcttcagtactgta

SEQ ID NO: 347469 - DNA, 20 bp, Artificial Sequence
  chemically synthesized
ctactggctatacagtactg

SEQ ID NO: 347470 - DNA, 20 bp, Artificial Sequence
  chemically synthesized
ctatacagtactgaagccaa

SEQ ID NO: 347471 - DNA, 20 bp, Artificial Sequence
  chemically synthesized
aggactttgtccgttggctt

SEQ ID NO: 347472 - DNA, 20 bp, Artificial Sequence
  chemically synthesized
agtactgaagccaacggaca

SEQ ID NO: 347473 - DNA, 20 bp, Artificial Sequence
  chemically synthesized
gtgtcaaggactttgtccgt

SEQ ID NO: 347474 - DNA, 20 bp, Artificial Sequence
  chemically synthesized
tactagaatgtttggtgtca

SEQ ID NO: 347475 - DNA, 20 bp, Artificial Sequence
  chemically synthesized
ctactagaatgtttggtgtc

SEQ ID NO: 347476 - DNA, 20 bp, Artificial Sequence
  chemically synthesized
gtccttgacaccaaacattc

SEQ ID NO: 347477 - DNA, 20 bp, Artificial Sequence
  chemically synthesized
gcttcccctactagaatgtt

SEQ ID NO: 347478 - DNA, 20 bp, Artificial Sequence
  chemically synthesized
cttgacaccaaacattctag

SEQ ID NO: 347479 - DNA, 20 bp, Artificial Sequence
  chemically synthesized
ttgacaccaaacattctagt

SEQ ID NO: 347480 - DNA, 20 bp, Artificial Sequence
  chemically synthesized
tgacaccaaacattctagta

SEQ ID NO: 347481 - DNA, 20 bp, Artificial Sequence
  chemically synthesized
gacaccaaacattctagtag

SEQ ID NO: 347482 - DNA, 20 bp, Artificial Sequence
  chemically synthesized
accaaacattctagtagggg

SEQ ID NO: 347483 - DNA, 20 bp, Artificial Sequence
  chemically synthesized
ttcttctctgcttcccctac

SEQ ID NO: 347484 - DNA, 20 bp, Artificial Sequence
  chemically synthesized
aaacattctagtaggggaag

SEQ ID NO: 347485 - DNA, 20 bp, Artificial Sequence
  chemically synthesized
acattctagtaggggaagca

SEQ ID NO: 347486 - DNA, 20 bp, Artificial Sequence
  chemically synthesized
ttctagtaggggaagcagag

SEQ ID NO: 347487 - DNA, 20 bp, Artificial Sequence
  chemically synthesized
aggggaagcagagaagaaat

SEQ ID NO: 347488 - DNA, 20 bp, Artificial Sequence
  chemically synthesized
gaagcagagaagaaataagc

SEQ ID NO: 347489 - DNA, 20 bp, Artificial Sequence
  chemically synthesized
aattaccttgtttgattatc

SEQ ID NO: 347490 - DNA, 20 bp, Artificial Sequence
  chemically synthesized
aataagctagataatcaaac

SEQ ID NO: 347491 - DNA, 20 bp, Artificial Sequence
  chemically synthesized
ataagctagataatcaaaca

SEQ ID NO: 347492 - DNA, 20 bp, Artificial Sequence
  chemically synthesized
ataatcaaacaaggtaattt

SEQ ID NO: 347493 - DNA, 20 bp, Artificial Sequence
  chemically synthesized
agataatgatgatgatttta

SEQ ID NO: 347494 - DNA, 20 bp, Artificial Sequence
  chemically synthesized
aatgatgatgattttaaagc

SEQ ID NO: 347495 - DNA, 20 bp, Artificial Sequence
  chemically synthesized
gatgatgattttaaagcaag

SEQ ID NO: 347496 - DNA, 20 bp, Artificial Sequence
  chemically synthesized
tttaaagcaagaagtgtgaa

SEQ ID NO: 347497 - DNA, 20 bp, Artificial Sequence
  chemically synthesized
ttaaagcaagaagtgtgaat

SEQ ID NO: 347498 - DNA, 20 bp, Artificial Sequence
  chemically synthesized
caagaagtgtgaataggata

SEQ ID NO: 347499 - DNA, 20 bp, Artificial Sequence
  chemically synthesized
aagaagtgtgaataggatac

SEQ ID NO: 347500 - DNA, 20 bp, Artificial Sequence
  chemically synthesized
gtgtgaataggatacaggaa

SEQ ID NO: 347501 - DNA, 20 bp, Artificial Sequence
  chemically synthesized
gaataggatacaggaatggc

SEQ ID NO: 347502 - DNA, 20 bp, Artificial Sequence
  chemically synthesized
aataggatacaggaatggct

SEQ ID NO: 347503 - DNA, 20 bp, Artificial Sequence
  chemically synthesized
taggatacaggaatggctgg

SEQ ID NO: 347504 - DNA, 20 bp, Artificial Sequence
  chemically synthesized
aggatacaggaatggctggg

SEQ ID NO: 347505 - DNA, 20 bp, Artificial Sequence
  chemically synthesized
ggatacaggaatggctggga

SEQ ID NO: 347506 - DNA, 20 bp, Artificial Sequence
  chemically synthesized
gctctcctgatgagccctcc

SEQ ID NO: 347507 - DNA, 20 bp, Artificial Sequence
  chemically synthesized
gaatggctgggagggctcat

SEQ ID NO: 347508 - DNA, 20 bp, Artificial Sequence
  chemically synthesized
aatggctgggagggctcatc

SEQ ID NO: 347509 - DNA, 20 bp, Artificial Sequence
  chemically synthesized
tggctgggagggctcatcag

SEQ ID NO: 347510 - DNA, 20 bp, Artificial Sequence
  chemically synthesized
gctgggagggctcatcagga

SEQ ID NO: 347511 - DNA, 20 bp, Artificial Sequence
  chemically synthesized
tgtaaaagagctctcctgat

SEQ ID NO: 347512 - DNA, 20 bp, Artificial Sequence
  chemically synthesized
gcagtctaccatatgtaaaa

SEQ ID NO: 347513 - DNA, 20 bp, Artificial Sequence
  chemically synthesized
caggagagctcttttacata

SEQ ID NO: 347514 - DNA, 20 bp, Artificial Sequence
  chemically synthesized
ttgcagtctaccatatgtaa

SEQ ID NO: 347515 - DNA, 20 bp, Artificial Sequence
  chemically synthesized
gagagctcttttacatatgg

SEQ ID NO: 347516 - DNA, 20 bp, Artificial Sequence
  chemically synthesized
tttacatatggtagactgca

SEQ ID NO: 347517 - DNA, 20 bp, Artificial Sequence
  chemically synthesized
ttacatatggtagactgcaa

SEQ ID NO: 347518 - DNA, 20 bp, Artificial Sequence
  chemically synthesized
atcttcagaagaatcctttg

SEQ ID NO: 347519 - DNA, 20 bp, Artificial Sequence
  chemically synthesized
gactgcaaaggattcttctg

SEQ ID NO: 347520 - DNA, 20 bp, Artificial Sequence
  chemically synthesized
ccgaaaggtctcatcttcag

SEQ ID NO: 347521 - DNA, 20 bp, Artificial Sequence
  chemically synthesized
caaaggattcttctgaagat

SEQ ID NO: 347522 - DNA, 20 bp, Artificial Sequence
  chemically synthesized
gagccgaaaggtctcatctt

SEQ ID NO: 347523 - DNA, 20 bp, Artificial Sequence
  chemically synthesized
cttctgaagatgagaccttt

SEQ ID NO: 347524 - DNA, 20 bp, Artificial Sequence
  chemically synthesized
gaagatgagacctttcggct

SEQ ID NO: 347525 - DNA, 20 bp, Artificial Sequence
  chemically synthesized
gccattcagtctgagccgaa

SEQ ID NO: 347526 - DNA, 20 bp, Artificial Sequence
  chemically synthesized
tgccattcagtctgagccga

SEQ ID NO: 347527 - DNA, 20 bp, Artificial Sequence
  chemically synthesized
aacttcctgccattcagtct

SEQ ID NO: 347528 - DNA, 20 bp, Artificial Sequence
  chemically synthesized
acctttcggctcagactgaa

SEQ ID NO: 347529 - DNA, 20 bp, Artificial Sequence
  chemically synthesized
tttcggctcagactgaatgg

SEQ ID NO: 347530 - DNA, 20 bp, Artificial Sequence
  chemically synthesized
ttcggctcagactgaatggc

SEQ ID NO: 347531 - DNA, 20 bp, Artificial Sequence
  chemically synthesized
gctgacaacttcctgccatt

SEQ ID NO: 347532 - DNA, 20 bp, Artificial Sequence
  chemically synthesized
ggctcagactgaatggcagg

SEQ ID NO: 347533 - DNA, 20 bp, Artificial Sequence
  chemically synthesized
actgaatggcaggaagttgt

SEQ ID NO: 347534 - DNA, 20 bp, Artificial Sequence
  chemically synthesized
aggaagttgtcagctatata

SEQ ID NO: 347535 - DNA, 20 bp, Artificial Sequence
  chemically synthesized
gaagttgtcagctatataaa

SEQ ID NO: 347536 - DNA, 20 bp, Artificial Sequence
  chemically synthesized
aagttgtcagctatataaag

SEQ ID NO: 347537 - DNA, 20 bp, Artificial Sequence
  chemically synthesized
acttcttctccctctttata

SEQ ID NO: 347538 - DNA, 20 bp, Artificial Sequence
  chemically synthesized
agttgtcagctatataaaga

SEQ ID NO: 347539 - DNA, 20 bp, Artificial Sequence
  chemically synthesized
ttgtcagctatataaagagg

SEQ ID NO: 347540 - DNA, 20 bp, Artificial Sequence
  chemically synthesized
tcagctatataaagagggag

SEQ ID NO: 347541 - DNA, 20 bp, Artificial Sequence
  chemically synthesized
gctatataaagagggagaag

SEQ ID NO: 347542 - DNA, 20 bp, Artificial Sequence
  chemically synthesized
gaagtatgttcttgcttgac

SEQ ID NO: 347543 - DNA, 20 bp, Artificial Sequence
  chemically synthesized
tcaccaggctccggtcaagc

SEQ ID NO: 347544 - DNA, 20 bp, Artificial Sequence
  chemically synthesized
agtatgttcttgcttgaccg

SEQ ID NO: 347545 - DNA, 20 bp, Artificial Sequence
  chemically synthesized
tacttcaccaggctccggtc

SEQ ID NO: 347546 - DNA, 20 bp, Artificial Sequence
  chemically synthesized
gttcttgcttgaccggagcc

SEQ ID NO: 347547 - DNA, 20 bp, Artificial Sequence
  chemically synthesized
tcccttacttcaccaggctc

SEQ ID NO: 347548 - DNA, 20 bp, Artificial Sequence
  chemically synthesized
tgcttgaccggagcctggtg

SEQ ID NO: 347549 - DNA, 20 bp, Artificial Sequence
  chemically synthesized
actggttcccttacttcacc

SEQ ID NO: 347550 - DNA, 20 bp, Artificial Sequence
  chemically synthesized
tgaccggagcctggtgaagt

SEQ ID NO: 347551 - DNA, 20 bp, Artificial Sequence
  chemically synthesized
cactggttcccttacttcac

SEQ ID NO: 347552 - DNA, 20 bp, Artificial Sequence
  chemically synthesized
gaccggagcctggtgaagta

SEQ ID NO: 347553 - DNA, 20 bp, Artificial Sequence
  chemically synthesized
accggagcctggtgaagtaa

SEQ ID NO: 347554 - DNA, 20 bp, Artificial Sequence
  chemically synthesized
gcctggtgaagtaagggaac

SEQ ID NO: 347555 - DNA, 20 bp, Artificial Sequence
  chemically synthesized
gaagtaagggaaccagtgtg

SEQ ID NO: 347556 - DNA, 20 bp, Artificial Sequence
  chemically synthesized
ttcttgatctcacttcacac

SEQ ID NO: 347557 - DNA, 20 bp, Artificial Sequence
  chemically synthesized
taagggaaccagtgtgaagt

SEQ ID NO: 347558 - DNA, 20 bp, Artificial Sequence
  chemically synthesized
aaccagtgtgaagtgagatc

SEQ ID NO: 347559 - DNA, 20 bp, Artificial Sequence
  chemically synthesized
cagtgtgaagtgagatcaag

SEQ ID NO: 347560 - DNA, 20 bp, Artificial Sequence
  chemically synthesized
gtgaagtgagatcaagaagc

SEQ ID NO: 347561 - DNA, 20 bp, Artificial Sequence
  chemically synthesized
aagtgagatcaagaagcaag

SEQ ID NO: 347562 - DNA, 20 bp, Artificial Sequence
  chemically synthesized
agtgagatcaagaagcaagc

SEQ ID NO: 347563 - DNA, 20 bp, Artificial Sequence
  chemically synthesized
gtgagatcaagaagcaagca

SEQ ID NO: 347564 - DNA, 20 bp, Artificial Sequence
  chemically synthesized
tgagatcaagaagcaagcag

SEQ ID NO: 347565 - DNA, 20 bp, Artificial Sequence
  chemically synthesized
atcaagaagcaagcagggga

SEQ ID NO: 347566 - DNA, 20 bp, Artificial Sequence
  chemically synthesized
caagcaggggacagatcaca

SEQ ID NO: 347567 - DNA, 20 bp, Artificial Sequence
  chemically synthesized
aagcaggggacagatcacac

SEQ ID NO: 347568 - DNA, 20 bp, Artificial Sequence
  chemically synthesized
agcaggggacagatcacaca

SEQ ID NO: 347569 - DNA, 20 bp, Artificial Sequence
  chemically synthesized
cagatcacacagggtcttgc

SEQ ID NO: 347570 - DNA, 20 bp, Artificial Sequence
  chemically synthesized
ggagtctgaaagcagccagc

SEQ ID NO: 347571 - DNA, 20 bp, Artificial Sequence
  chemically synthesized
gtctggagtctgaaagcagc

SEQ ID NO: 347572 - DNA, 20 bp, Artificial Sequence
  chemically synthesized
agggtcttgctggctgcttt

SEQ ID NO: 347573 - DNA, 20 bp, Artificial Sequence
  chemically synthesized
aaatgtctggagtctgaaag

SEQ ID NO: 347574 - DNA, 20 bp, Artificial Sequence
  chemically synthesized
gaaaaatgtctggagtctga

SEQ ID NO: 347575 - DNA, 20 bp, Artificial Sequence
  chemically synthesized
tgctggctgctttcagactc

SEQ ID NO: 347576 - DNA, 20 bp, Artificial Sequence
  chemically synthesized
tgtacttagaaaaatgtctg

SEQ ID NO: 347577 - DNA, 20 bp, Artificial Sequence
  chemically synthesized
attgtacttagaaaaatgtc

SEQ ID NO: 347578 - DNA, 20 bp, Artificial Sequence
  chemically synthesized
cagactccagacatttttct

SEQ ID NO: 347579 - DNA, 20 bp, Artificial Sequence
  chemically synthesized
tgaagactctacattgtact

SEQ ID NO: 347580 - DNA, 20 bp, Artificial Sequence
  chemically synthesized
acatttttctaagtacaatg

SEQ ID NO: 347581 - DNA, 20 bp, Artificial Sequence
  chemically synthesized
atttttctaagtacaatgta

SEQ ID NO: 347582 - DNA, 20 bp, Artificial Sequence
  chemically synthesized
taagtacaatgtagagtctt

SEQ ID NO: 347583 - DNA, 20 bp, Artificial Sequence
  chemically synthesized
gtacaatgtagagtcttcag

SEQ ID NO: 347584 - DNA, 20 bp, Artificial Sequence
  chemically synthesized
tacaatgtagagtcttcaga

SEQ ID NO: 347585 - DNA, 20 bp, Artificial Sequence
  chemically synthesized
tccctatttaacaccttctg

SEQ ID NO: 347586 - DNA, 20 bp, Artificial Sequence
  chemically synthesized
agtcttcagaaggtgttaaa

SEQ ID NO: 347587 - DNA, 20 bp, Artificial Sequence
  chemically synthesized
gtcttcagaaggtgttaaat

SEQ ID NO: 347588 - DNA, 20 bp, Artificial Sequence
  chemically synthesized
tcttcagaaggtgttaaata

SEQ ID NO: 347589 - DNA, 20 bp, Artificial Sequence
  chemically synthesized
atctttttactacattaatt

SEQ ID NO: 347590 - DNA, 20 bp, Artificial Sequence
  chemically synthesized
aacacatgacctaattaatg

SEQ ID NO: 347591 - DNA, 20 bp, Artificial Sequence
  chemically synthesized
tatctttttactacattaat

SEQ ID NO: 347592 - DNA, 20 bp, Artificial Sequence
  chemically synthesized
gacctaattaatgtagtaaa

SEQ ID NO: 347593 - DNA, 20 bp, Artificial Sequence
  chemically synthesized
tcagttcttcgcattataca

SEQ ID NO: 347594 - DNA, 20 bp, Artificial Sequence
  chemically synthesized
agataactttgtataatgcg

SEQ ID NO: 347595 - DNA, 20 bp, Artificial Sequence
  chemically synthesized
tttgtataatgcgaagaact

SEQ ID NO: 347596 - DNA, 20 bp, Artificial Sequence
  chemically synthesized
tgtataatgcgaagaactga

SEQ ID NO: 347597 - DNA, 20 bp, Artificial Sequence
  chemically synthesized
taacttcctaagcagtctct

SEQ ID NO: 347598 - DNA, 20 bp, Artificial Sequence
  chemically synthesized
cgaagaactgagagactgct

SEQ ID NO: 347599 - DNA, 20 bp, Artificial Sequence
  chemically synthesized
gaagaactgagagactgctt

SEQ ID NO: 347600 - DNA, 20 bp, Artificial Sequence
  chemically synthesized
gaactgagagactgcttagg

SEQ ID NO: 347601 - DNA, 20 bp, Artificial Sequence
  chemically synthesized
tattgcagtaacttcctaag

SEQ ID NO: 347602 - DNA, 20 bp, Artificial Sequence
  chemically synthesized
taatattgcagtaacttcct

SEQ ID NO: 347603 - DNA, 20 bp, Artificial Sequence
  chemically synthesized
ttaggaagttactgcaatat

SEQ ID NO: 347604 - DNA, 20 bp, Artificial Sequence
  chemically synthesized
taggaagttactgcaatatt

SEQ ID NO: 347605 - DNA, 20 bp, Artificial Sequence
  chemically synthesized
tccatagcctcctaatattg

SEQ ID NO: 347606 - DNA, 20 bp, Artificial Sequence
  chemically synthesized
ggaagttactgcaatattag

SEQ ID NO: 347607 - DNA, 20 bp, Artificial Sequence
  chemically synthesized
gaagttactgcaatattagg

SEQ ID NO: 347608 - DNA, 20 bp, Artificial Sequence
  chemically synthesized
actgcaatattaggaggcta

SEQ ID NO: 347609 - DNA, 20 bp, Artificial Sequence
  chemically synthesized
tgacactccatcatattcca

SEQ ID NO: 347610 - DNA, 20 bp, Artificial Sequence
  chemically synthesized
taggaggctatggaatatga

SEQ ID NO: 347611 - DNA, 20 bp, Artificial Sequence
  chemically synthesized
ggaggctatggaatatgatg

SEQ ID NO: 347612 - DNA, 20 bp, Artificial Sequence
  chemically synthesized
tatggaatatgatggagtgt

SEQ ID NO: 347613 - DNA, 20 bp, Artificial Sequence
  chemically synthesized
ggaatatgatggagtgtcag

SEQ ID NO: 347614 - DNA, 20 bp, Artificial Sequence
  chemically synthesized
aagctgcttttattcaaagg

SEQ ID NO: 347615 - DNA, 20 bp, Artificial Sequence
  chemically synthesized
taaaagctgcttttattcaa

SEQ ID NO: 347616 - DNA, 20 bp, Artificial Sequence
  chemically synthesized
gtggtgcttcctttgaataa

SEQ ID NO: 347617 - DNA, 20 bp, Artificial Sequence
  chemically synthesized
ataaaagctgcttttattca

SEQ ID NO: 347618 - DNA, 20 bp, Artificial Sequence
  chemically synthesized
gtgcttcctttgaataaaag

SEQ ID NO: 347619 - DNA, 20 bp, Artificial Sequence
  chemically synthesized
acattttaattgaaaaataa

SEQ ID NO: 347620 - DNA, 20 bp, Artificial Sequence
  chemically synthesized
caattaaaatgtaacataat

SEQ ID NO: 347621 - DNA, 20 bp, Artificial Sequence
  chemically synthesized
aaatgtaacataattggttt

SEQ ID NO: 347622 - DNA, 20 bp, Artificial Sequence
  chemically synthesized
tggtttcagtaaaaatgtct

SEQ ID NO: 347623 - DNA, 20 bp, Artificial Sequence
  chemically synthesized
caggagaaataaggtcaact

SEQ ID NO: 347624 - DNA, 20 bp, Artificial Sequence
  chemically synthesized
ccattaatgcaggagaaata

SEQ ID NO: 347625 - DNA, 20 bp, Artificial Sequence
  chemically synthesized
cccattaatgcaggagaaat

SEQ ID NO: 347626 - DNA, 20 bp, Artificial Sequence
  chemically synthesized
aaatgaccccattaatgcag

SEQ ID NO: 347627 - DNA, 20 bp, Artificial Sequence
  chemically synthesized
ccttatttctcctgcattaa

SEQ ID NO: 347628 - DNA, 20 bp, Artificial Sequence
  chemically synthesized
ataaatgaccccattaatgc

SEQ ID NO: 347629 - DNA, 20 bp, Artificial Sequence
  chemically synthesized
cttatttctcctgcattaat

SEQ ID NO: 347630 - DNA, 20 bp, Artificial Sequence
  chemically synthesized
tataaatgaccccattaatg

SEQ ID NO: 347631 - DNA, 20 bp, Artificial Sequence
  chemically synthesized
ttatttctcctgcattaatg

SEQ ID NO: 347632 - DNA, 20 bp, Artificial Sequence
  chemically synthesized
gggtcatttatatgatatgt

SEQ ID NO: 347633 - DNA, 20 bp, Artificial Sequence
  chemically synthesized
ggtcatttatatgatatgtc

SEQ ID NO: 347634 - DNA, 20 bp, Artificial Sequence
  chemically synthesized
tcatttatatgatatgtcag

SEQ ID NO: 347635 - DNA, 20 bp, Artificial Sequence
  chemically synthesized
ctgttcattgtgtacagcgg

SEQ ID NO: 347636 - DNA, 20 bp, Artificial Sequence
  chemically synthesized
aagctgttcattgtgtacag

SEQ ID NO: 347637 - DNA, 20 bp, Artificial Sequence
  chemically synthesized
aaaaagctgttcattgtgta

SEQ ID NO: 347638 - DNA, 20 bp, Artificial Sequence
  chemically synthesized
ctaccgctgtacacaatgaa

SEQ ID NO: 347639 - DNA, 20 bp, Artificial Sequence
  chemically synthesized
agctacgttttaattgaaaa

SEQ ID NO: 347640 - DNA, 20 bp, Artificial Sequence
  chemically synthesized
agcttttttcaattaaaacg

SEQ ID NO: 347641 - DNA, 20 bp, Artificial Sequence
  chemically synthesized
atttctggttcaagtcaatt

SEQ ID NO: 347642 - DNA, 20 bp, Artificial Sequence
  chemically synthesized
gtagcttaattgacttgaac

SEQ ID NO: 347643 - DNA, 20 bp, Artificial Sequence
  chemically synthesized
tcaagagtcatttctggttc

SEQ ID NO: 347644 - DNA, 20 bp, Artificial Sequence
  chemically synthesized
aagatgtcaagagtcatttc

SEQ ID NO: 347645 - DNA, 20 bp, Artificial Sequence
  chemically synthesized
tattaatacaaagatgtcaa

SEQ ID NO: 347646 - DNA, 20 bp, Artificial Sequence
  chemically synthesized
cctattaatacaaagatgtc

SEQ ID NO: 347647 - DNA, 20 bp, Artificial Sequence
  chemically synthesized
gaaatggtcctattaataca

SEQ ID NO: 347648 - DNA, 20 bp, Artificial Sequence
  chemically synthesized
tcttgacatctttgtattaa

SEQ ID NO: 347649 - DNA, 20 bp, Artificial Sequence
  chemically synthesized
cttgacatctttgtattaat

SEQ ID NO: 347650 - DNA, 20 bp, Artificial Sequence
  chemically synthesized
tagcatgatcattatagaaa

SEQ ID NO: 347651 - DNA, 20 bp, Artificial Sequence
  chemically synthesized
attaattagcatgatcatta

SEQ ID NO: 347652 - DNA, 20 bp, Artificial Sequence
  chemically synthesized
tttgaatgaagaagattaat

SEQ ID NO: 347653 - DNA, 20 bp, Artificial Sequence
  chemically synthesized
aacaatacttttgaatgaag

SEQ ID NO: 347654 - DNA, 20 bp, Artificial Sequence
  chemically synthesized
aattaatcttcttcattcaa

SEQ ID NO: 347655 - DNA, 20 bp, Artificial Sequence
  chemically synthesized
ataaacaatacttttgaatg

SEQ ID NO: 347656 - DNA, 20 bp, Artificial Sequence
  chemically synthesized
attcaaaagtattgtttatt

SEQ ID NO: 347657 - DNA, 20 bp, Artificial Sequence
  chemically synthesized
ataacattaaaatgatttaa

SEQ ID NO: 347658 - DNA, 20 bp, Artificial Sequence
  chemically synthesized
aatgttattaaatattatct

SEQ ID NO: 347659 - DNA, 20 bp, Artificial Sequence
  chemically synthesized
atgttattaaatattatctc

SEQ ID NO: 347660 - DNA, 20 bp, Artificial Sequence
  chemically synthesized
ccaatagacttcaagatcct

SEQ ID NO: 347661 - DNA, 20 bp, Artificial Sequence
  chemically synthesized
aatattatctcaggatcttg

SEQ ID NO: 347662 - DNA, 20 bp, Artificial Sequence
  chemically synthesized
ataacaatccaatagacttc

SEQ ID NO: 347663 - DNA, 20 bp, Artificial Sequence
  chemically synthesized
ctcaggatcttgaagtctat

SEQ ID NO: 347664 - DNA, 20 bp, Artificial Sequence
  chemically synthesized
aaatcagcataacaatccaa

SEQ ID NO: 347665 - DNA, 20 bp, Artificial Sequence
  chemically synthesized
tggattgttatgctgattta

SEQ ID NO: 347666 - DNA, 20 bp, Artificial Sequence
  chemically synthesized
gattgttatgctgatttaaa

SEQ ID NO: 347667 - DNA, 20 bp, Artificial Sequence
  chemically synthesized
tatttttgcactctttaaat

SEQ ID NO: 347668 - DNA, 20 bp, Artificial Sequence
  chemically synthesized
aaagagtgcaaaaatattta

SEQ ID NO: 347669 - DNA, 20 bp, Artificial Sequence
  chemically synthesized
aaatatttatagttatgttt

SEQ ID NO: 347670 - DNA, 20 bp, Artificial Sequence
  chemically synthesized
tatagttatgttttagttta

SEQ ID NO: 347671 - DNA, 20 bp, Artificial Sequence
  chemically synthesized
agttatgttttagtttaaag

SEQ ID NO: 347672 - DNA, 20 bp, Artificial Sequence
  chemically synthesized
attttggcctacagggtcac

SEQ ID NO: 347673 - DNA, 20 bp, Artificial Sequence
  chemically synthesized
tattttggcctacagggtca

SEQ ID NO: 347674 - DNA, 20 bp, Artificial Sequence
  chemically synthesized
ataatttgcctgtgaccctg

SEQ ID NO: 347675 - DNA, 20 bp, Artificial Sequence
  chemically synthesized
taatttgcctgtgaccctgt

SEQ ID NO: 347676 - DNA, 20 bp, Artificial Sequence
  chemically synthesized
atacattattttggcctaca

SEQ ID NO: 347677 - DNA, 20 bp, Artificial Sequence
  chemically synthesized
gatacattattttggcctac

SEQ ID NO: 347678 - DNA, 20 bp, Artificial Sequence
  chemically synthesized
tgatacattattttggccta

SEQ ID NO: 347679 - DNA, 20 bp, Artificial Sequence
  chemically synthesized
tttatcgtgatacattattt

SEQ ID NO: 347680 - DNA, 20 bp, Artificial Sequence
  chemically synthesized
taatgtatcacgataaactg

SEQ ID NO: 347681 - DNA, 20 bp, Artificial Sequence
  chemically synthesized
gtatcacgataaactgtaga

SEQ ID NO: 347682 - DNA, 20 bp, Artificial Sequence
  chemically synthesized
ttcatctctgacactatcta

SEQ ID NO: 347683 - DNA, 20 bp, Artificial Sequence
  chemically synthesized
cgataaactgtagatagtgt

SEQ ID NO: 347684 - DNA, 20 bp, Artificial Sequence
  chemically synthesized
ataaactgtagatagtgtca

SEQ ID NO: 347685 - DNA, 20 bp, Artificial Sequence
  chemically synthesized
gatagtgtcagagatgaaaa

SEQ ID NO: 347686 - DNA, 20 bp, Artificial Sequence
  chemically synthesized
aaaacagtgtttgtctgctt

SEQ ID NO: 347687 - DNA, 20 bp, Artificial Sequence
  chemically synthesized
cacatatgaatacactaaag

SEQ ID NO: 347688 - DNA, 20 bp, Artificial Sequence
  chemically synthesized
cctcacatatgaatacacta

SEQ ID NO: 347689 - DNA, 20 bp, Artificial Sequence
  chemically synthesized
gctttagtgtattcatatgt

SEQ ID NO: 347690 - DNA, 20 bp, Artificial Sequence
  chemically synthesized
ctttagtgtattcatatgtg

SEQ ID NO: 347691 - DNA, 20 bp, Artificial Sequence
  chemically synthesized
tcatatgtgaggatgaattt

SEQ ID NO: 347692 - DNA, 20 bp, Artificial Sequence
  chemically synthesized
ggatgaattttggcacttgt

SEQ ID NO: 347693 - DNA, 20 bp, Artificial Sequence
  chemically synthesized
gtaatttctcataggctgac

SEQ ID NO: 347694 - DNA, 20 bp, Artificial Sequence
  chemically synthesized
tttggcacttgtcagcctat

SEQ ID NO: 347695 - DNA, 20 bp, Artificial Sequence
  chemically synthesized
gtctagtagtaatttctcat

SEQ ID NO: 347696 - DNA, 20 bp, Artificial Sequence
  chemically synthesized
agtctagtagtaatttctca

SEQ ID NO: 347697 - DNA, 20 bp, Artificial Sequence
  chemically synthesized
agcctatgagaaattactac

SEQ ID NO: 347698 - DNA, 20 bp, Artificial Sequence
  chemically synthesized
actgacaagtattagtctag

SEQ ID NO: 347699 - DNA, 20 bp, Artificial Sequence
  chemically synthesized
tgtactgacaagtattagtc

SEQ ID NO: 347700 - DNA, 20 bp, Artificial Sequence
  chemically synthesized
gttactgtactgacaagtat

SEQ ID NO: 347701 - DNA, 20 bp, Artificial Sequence
  chemically synthesized
actactagactaatacttgt

SEQ ID NO: 347702 - DNA, 20 bp, Artificial Sequence
  chemically synthesized
tagactaatacttgtcagta

SEQ ID NO: 347703 - DNA, 20 bp, Artificial Sequence
  chemically synthesized
tgagttgttactgtactgac

SEQ ID NO: 347704 - DNA, 20 bp, Artificial Sequence
  chemically synthesized
agtggtgtttagagcatgat

SEQ ID NO: 347705 - DNA, 20 bp, Artificial Sequence
  chemically synthesized
ttctcccttagtggtgttta

SEQ ID NO: 347706 - DNA, 20 bp, Artificial Sequence
  chemically synthesized
ttttctcccttagtggtgtt

SEQ ID NO: 347707 - DNA, 20 bp, Artificial Sequence
  chemically synthesized
atcatgctctaaacaccact

SEQ ID NO: 347708 - DNA, 20 bp, Artificial Sequence
  chemically synthesized
tcatgctctaaacaccacta

SEQ ID NO: 347709 - DNA, 20 bp, Artificial Sequence
  chemically synthesized
catgctctaaacaccactaa

SEQ ID NO: 347710 - DNA, 20 bp, Artificial Sequence
  chemically synthesized
tgctctaaacaccactaagg

SEQ ID NO: 347711 - DNA, 20 bp, Artificial Sequence
  chemically synthesized
tcatcacttttctcccttag

SEQ ID NO: 347712 - DNA, 20 bp, Artificial Sequence
  chemically synthesized
tattcatcacttttctccct

SEQ ID NO: 347713 - DNA, 20 bp, Artificial Sequence
  chemically synthesized
taaacaccactaagggagaa

SEQ ID NO: 347714 - DNA, 20 bp, Artificial Sequence
  chemically synthesized
aaagtgatgaataacataca

SEQ ID NO: 347715 - DNA, 20 bp, Artificial Sequence
  chemically synthesized
cacaatcacattaatgactc

SEQ ID NO: 347716 - DNA, 20 bp, Artificial Sequence
  chemically synthesized
acattaatgactctagttca

SEQ ID NO: 347717 - DNA, 20 bp, Artificial Sequence
  chemically synthesized
cattactgtgctttgaacta

SEQ ID NO: 347718 - DNA, 20 bp, Artificial Sequence
  chemically synthesized
accattactgtgctttgaac

SEQ ID NO: 347719 - DNA, 20 bp, Artificial Sequence
  chemically synthesized
aatgactctagttcaaagca

SEQ ID NO: 347720 - DNA, 20 bp, Artificial Sequence
  chemically synthesized
tctagttcaaagcacagtaa

SEQ ID NO: 347721 - DNA, 20 bp, Artificial Sequence
  chemically synthesized
agattggacaataaggttgg

SEQ ID NO: 347722 - DNA, 20 bp, Artificial Sequence
  chemically synthesized
tatagattggacaataaggt

SEQ ID NO: 347723 - DNA, 20 bp, Artificial Sequence
  chemically synthesized
gaaatatagattggacaata

SEQ ID NO: 347724 - DNA, 20 bp, Artificial Sequence
  chemically synthesized
tgaaatatagattggacaat

SEQ ID NO: 347725 - DNA, 20 bp, Artificial Sequence
  chemically synthesized
tagacacttgaaatatagat

SEQ ID NO: 347726 - DNA, 20 bp, Artificial Sequence
  chemically synthesized
tattgtccaatctatatttc

SEQ ID NO: 347727 - DNA, 20 bp, Artificial Sequence
  chemically synthesized
caaggtagacacttgaaata

SEQ ID NO: 347728 - DNA, 20 bp, Artificial Sequence
  chemically synthesized
gattctgaaagatatcaagg

SEQ ID NO: 347729 - DNA, 20 bp, Artificial Sequence
  chemically synthesized
attgattctgaaagatatca

SEQ ID NO: 347730 - DNA, 20 bp, Artificial Sequence
  chemically synthesized
aattgattctgaaagatatc

SEQ ID NO: 347731 - DNA, 20 bp, Artificial Sequence
  chemically synthesized
gtgtctaccttgatatcttt

SEQ ID NO: 347732 - DNA, 20 bp, Artificial Sequence
  chemically synthesized
tgacgtaaaattgattctga

SEQ ID NO: 347733 - DNA, 20 bp, Artificial Sequence
  chemically synthesized
acgtcaaattccaattaaca

SEQ ID NO: 347734 - DNA, 20 bp, Artificial Sequence
  chemically synthesized
tgctttttttctatgttaat

SEQ ID NO: 347735 - DNA, 20 bp, Artificial Sequence
  chemically synthesized
ttccaattaacatagaaaaa

SEQ ID NO: 347736 - DNA, 20 bp, Artificial Sequence
  chemically synthesized
caattaacatagaaaaaaag

SEQ ID NO: 347737 - DNA, 20 bp, Artificial Sequence
  chemically synthesized
ttaacatagaaaaaaagcag

SEQ ID NO: 347738 - DNA, 20 bp, Artificial Sequence
  chemically synthesized
tgcttttggaaaagtcaata

SEQ ID NO: 347739 - DNA, 20 bp, Artificial Sequence
  chemically synthesized
attgcttttggaaaagtcaa

SEQ ID NO: 347740 - DNA, 20 bp, Artificial Sequence
  chemically synthesized
gtctctattgacttttccaa

SEQ ID NO: 347741 - DNA, 20 bp, Artificial Sequence
  chemically synthesized
gagcacgattgcttttggaa

SEQ ID NO: 347742 - DNA, 20 bp, Artificial Sequence
  chemically synthesized
ttggagagcacgattgcttt

SEQ ID NO: 347743 - DNA, 20 bp, Artificial Sequence
  chemically synthesized
aaatgaggctggggtttgga

SEQ ID NO: 347744 - DNA, 20 bp, Artificial Sequence
  chemically synthesized
caatcgtgctctccaaaccc

SEQ ID NO: 347745 - DNA, 20 bp, Artificial Sequence
  chemically synthesized
gtaaatgaggctggggtttg

SEQ ID NO: 347746 - DNA, 20 bp, Artificial Sequence
  chemically synthesized
tagtaaatgaggctggggtt

SEQ ID NO: 347747 - DNA, 20 bp, Artificial Sequence
  chemically synthesized
agtaatagtaaatgaggctg

SEQ ID NO: 347748 - DNA, 20 bp, Artificial Sequence
  chemically synthesized
cagtaatagtaaatgaggct

SEQ ID NO: 347749 - DNA, 20 bp, Artificial Sequence
  chemically synthesized
tcagtaatagtaaatgaggc

SEQ ID NO: 347750 - DNA, 20 bp, Artificial Sequence
  chemically synthesized
tgcttcagtaatagtaaatg

SEQ ID NO: 347751 - DNA, 20 bp, Artificial Sequence
  chemically synthesized
ttgcttcagtaatagtaaat

SEQ ID NO: 347752 - DNA, 20 bp, Artificial Sequence
  chemically synthesized
agcctcatttactattactg

SEQ ID NO: 347753 - DNA, 20 bp, Artificial Sequence
  chemically synthesized
atttcgttttgcttcagtaa

SEQ ID NO: 347754 - DNA, 20 bp, Artificial Sequence
  chemically synthesized
cttagtatttcgttttgctt

SEQ ID NO: 347755 - DNA, 20 bp, Artificial Sequence
  chemically synthesized
ctgaagcaaaacgaaatact

SEQ ID NO: 347756 - DNA, 20 bp, Artificial Sequence
  chemically synthesized
gaagcaaaacgaaatactaa

SEQ ID NO: 347757 - DNA, 20 bp, Artificial Sequence
  chemically synthesized
ttatttgcacacagtactct

SEQ ID NO: 347758 - DNA, 20 bp, Artificial Sequence
  chemically synthesized
aaacgttttttatttgcaca

SEQ ID NO: 347759 - DNA, 20 bp, Artificial Sequence
  chemically synthesized
ttgttgattatctgttaaaa

SEQ ID NO: 347760 - DNA, 20 bp, Artificial Sequence
  chemically synthesized
taatttggggtcttttttaa

SEQ ID NO: 347761 - DNA, 20 bp, Artificial Sequence
  chemically synthesized
tttaggctgtttttaatttg

SEQ ID NO: 347762 - DNA, 20 bp, Artificial Sequence
  chemically synthesized
atttaggctgtttttaattt

SEQ ID NO: 347763 - DNA, 20 bp, Artificial Sequence
  chemically synthesized
tatttaggctgtttttaatt

SEQ ID NO: 347764 - DNA, 20 bp, Artificial Sequence
  chemically synthesized
aaaagaccccaaattaaaaa

SEQ ID NO: 347765 - DNA, 20 bp, Artificial Sequence
  chemically synthesized
ttaaaaacagcctaaataat

SEQ ID NO: 347766 - DNA, 20 bp, Artificial Sequence
  chemically synthesized
gcgggtaatactcattattt

SEQ ID NO: 347767 - DNA, 20 bp, Artificial Sequence
  chemically synthesized
tgcgggtaatactcattatt

SEQ ID NO: 347768 - DNA, 20 bp, Artificial Sequence
  chemically synthesized
agcatactgttgttgtgtgc

SEQ ID NO: 347769 - DNA, 20 bp, Artificial Sequence
  chemically synthesized
tagcatactgttgttgtgtg

SEQ ID NO: 347770 - DNA, 20 bp, Artificial Sequence
  chemically synthesized
gtattacccgcacacaacaa

SEQ ID NO: 347771 - DNA, 20 bp, Artificial Sequence
  chemically synthesized
cacacaacaacagtatgcta

SEQ ID NO: 347772 - DNA, 20 bp, Artificial Sequence
  chemically synthesized
atgataattttataaatcca

SEQ ID NO: 347773 - DNA, 20 bp, Artificial Sequence
  chemically synthesized
attttcgttatcagtttagg

SEQ ID NO: 347774 - DNA, 20 bp, Artificial Sequence
  chemically synthesized
aagattttcgttatcagttt

SEQ ID NO: 347775 - DNA, 20 bp, Artificial Sequence
  chemically synthesized
aaagattttcgttatcagtt

SEQ ID NO: 347776 - DNA, 20 bp, Artificial Sequence
  chemically synthesized
attttaaagattttcgttat

SEQ ID NO: 347777 - DNA, 20 bp, Artificial Sequence
  chemically synthesized
gtaacattttattcatttta

SEQ ID NO: 347778 - DNA, 20 bp, Artificial Sequence
  chemically synthesized
gtgcatactgtgaaatatat

SEQ ID NO: 347779 - DNA, 20 bp, Artificial Sequence
  chemically synthesized
aatgttactaatatatttca

SEQ ID NO: 347780 - DNA, 20 bp, Artificial Sequence
  chemically synthesized
atttcacagtatgcactgaa

SEQ ID NO: 347781 - DNA, 20 bp, Artificial Sequence
  chemically synthesized
atggaattatgtagtccatt

SEQ ID NO: 347782 - DNA, 20 bp, Artificial Sequence
  chemically synthesized
taaacccaaatggaattatg

SEQ ID NO: 347783 - DNA, 20 bp, Artificial Sequence
  chemically synthesized
atggactacataattccatt

SEQ ID NO: 347784 - DNA, 20 bp, Artificial Sequence
  chemically synthesized
tggactacataattccattt

SEQ ID NO: 347785 - DNA, 20 bp, Artificial Sequence
  chemically synthesized
aacctcaacttaaacccaaa

SEQ ID NO: 347786 - DNA, 20 bp, Artificial Sequence
  chemically synthesized
acataattccatttgggttt

SEQ ID NO: 347787 - DNA, 20 bp, Artificial Sequence
  chemically synthesized
attccatttgggtttaagtt

SEQ ID NO: 347788 - DNA, 20 bp, Artificial Sequence
  chemically synthesized
ttccatttgggtttaagttg

SEQ ID NO: 347789 - DNA, 20 bp, Artificial Sequence
  chemically synthesized
tttttttttttccaactaaa

SEQ ID NO: 347790 - DNA, 20 bp, Artificial Sequence
  chemically synthesized
ataatttttaaccatttagt

SEQ ID NO: 347791 - DNA, 20 bp, Artificial Sequence
  chemically synthesized
aaacataatttttaaccatt

SEQ ID NO: 347792 - DNA, 20 bp, Artificial Sequence
  chemically synthesized
aaatggttaaaaattatgtt

SEQ ID NO: 347793 - DNA, 20 bp, Artificial Sequence
  chemically synthesized
atggttaaaaattatgttta

SEQ ID NO: 347794 - DNA, 20 bp, Artificial Sequence
  chemically synthesized
attatgtttagagaacaatc

SEQ ID NO: 347795 - DNA, 20 bp, Artificial Sequence
  chemically synthesized
gtctgtgagtatatattttc

SEQ ID NO: 347796 - DNA, 20 bp, Artificial Sequence
  chemically synthesized
atctggaaaatatatactca

SEQ ID NO: 347797 - DNA, 20 bp, Artificial Sequence
  chemically synthesized
attgtatgcctattgtctgt

SEQ ID NO: 347798 - DNA, 20 bp, Artificial Sequence
  chemically synthesized
aaatatatactcacagacaa

SEQ ID NO: 347799 - DNA, 20 bp, Artificial Sequence
  chemically synthesized
aatatatactcacagacaat

SEQ ID NO: 347800 - DNA, 20 bp, Artificial Sequence
  chemically synthesized
taggcatacaattgacaatt

SEQ ID NO: 347801 - DNA, 20 bp, Artificial Sequence
  chemically synthesized
tttatagtgtaaatttaatg

SEQ ID NO: 347802 - DNA, 20 bp, Artificial Sequence
  chemically synthesized
tgttggatgattgagtttta

SEQ ID NO: 347803 - DNA, 20 bp, Artificial Sequence
  chemically synthesized
ttcataagtgttggatgatt

SEQ ID NO: 347804 - DNA, 20 bp, Artificial Sequence
  chemically synthesized
atgtttggattcataagtgt

SEQ ID NO: 347805 - DNA, 20 bp, Artificial Sequence
  chemically synthesized
tagaaaatgtttggattcat

SEQ ID NO: 347806 - DNA, 20 bp, Artificial Sequence
  chemically synthesized
gtaaagttttagaaaatgtt

SEQ ID NO: 347807 - DNA, 20 bp, Artificial Sequence
  chemically synthesized
taagctttcttgtaaagttt

SEQ ID NO: 347808 - DNA, 20 bp, Artificial Sequence
  chemically synthesized
aacattttctaaaactttac

SEQ ID NO: 347809 - DNA, 20 bp, Artificial Sequence
  chemically synthesized
ttttctaaaactttacaaga

SEQ ID NO: 347810 - DNA, 20 bp, Artificial Sequence
  chemically synthesized
aacctataagctttcttgta

SEQ ID NO: 347811 - DNA, 20 bp, Artificial Sequence
  chemically synthesized
aaactttacaagaaagctta

SEQ ID NO: 347812 - DNA, 20 bp, Artificial Sequence
  chemically synthesized
aactttacaagaaagcttat

SEQ ID NO: 347813 - DNA, 20 bp, Artificial Sequence
  chemically synthesized
ttaccatgataaaaacctat

SEQ ID NO: 347814 - DNA, 20 bp, Artificial Sequence
  chemically synthesized
aagcttataggtttttatca

SEQ ID NO: 347815 - DNA, 20 bp, Artificial Sequence
  chemically synthesized
attgtatgcttataaatgat

SEQ ID NO: 347816 - DNA, 20 bp, Artificial Sequence
  chemically synthesized
atataattctaatcatttat

SEQ ID NO: 347817 - DNA, 20 bp, Artificial Sequence
  chemically synthesized
tttataagcatacaatttat

SEQ ID NO: 347818 - DNA, 20 bp, Artificial Sequence
  chemically synthesized
gcatacaatttatcagcatt

SEQ ID NO: 347819 - DNA, 20 bp, Artificial Sequence
  chemically synthesized
gtggggatggtgacacaaca

SEQ ID NO: 347820 - DNA, 20 bp, Artificial Sequence
  chemically synthesized
ggtggggatggtgacacaac

SEQ ID NO: 347821 - DNA, 20 bp, Artificial Sequence
  chemically synthesized
ttggaggtggatggtgggga

SEQ ID NO: 347822 - DNA, 20 bp, Artificial Sequence
  chemically synthesized
atttttggaggtggatggtg

SEQ ID NO: 347823 - DNA, 20 bp, Artificial Sequence
  chemically synthesized
aatttttggaggtggatggt

SEQ ID NO: 347824 - DNA, 20 bp, Artificial Sequence
  chemically synthesized
taatttttggaggtggatgg

SEQ ID NO: 347825 - DNA, 20 bp, Artificial Sequence
  chemically synthesized
agataatttttggaggtgga

SEQ ID NO: 347826 - DNA, 20 bp, Artificial Sequence
  chemically synthesized
gggaagataatttttggagg

SEQ ID NO: 347827 - DNA, 20 bp, Artificial Sequence
  chemically synthesized
tgggggaagataatttttgg

SEQ ID NO: 347828 - DNA, 20 bp, Artificial Sequence
  chemically synthesized
ttgggggaagataatttttg

SEQ ID NO: 347829 - DNA, 20 bp, Artificial Sequence
  chemically synthesized
ttttgggggaagataatttt

SEQ ID NO: 347830 - DNA, 20 bp, Artificial Sequence
  chemically synthesized
gatatgaagttttttggggg

SEQ ID NO: 347831 - DNA, 20 bp, Artificial Sequence
  chemically synthesized
atggatatgaagttttttgg

SEQ ID NO: 347832 - DNA, 20 bp, Artificial Sequence
  chemically synthesized
aatggatatgaagttttttg

SEQ ID NO: 347833 - DNA, 20 bp, Artificial Sequence
  chemically synthesized
taatggatatgaagtttttt

SEQ ID NO: 347834 - DNA, 20 bp, Artificial Sequence
  chemically synthesized
ttaatggatatgaagttttt

SEQ ID NO: 347835 - DNA, 20 bp, Artificial Sequence
  chemically synthesized
ggagttatttaatggatatg

SEQ ID NO: 347836 - DNA, 20 bp, Artificial Sequence
  chemically synthesized
aggtatggggagttatttaa

SEQ ID NO: 347837 - DNA, 20 bp, Artificial Sequence
  chemically synthesized
tgggggagagaaggtatggg

SEQ ID NO: 347838 - DNA, 20 bp, Artificial Sequence
  chemically synthesized
gctgggggagagaaggtatg

SEQ ID NO: 347839 - DNA, 20 bp, Artificial Sequence
  chemically synthesized
agctgggggagagaaggtat

SEQ ID NO: 347840 - DNA, 20 bp, Artificial Sequence
  chemically synthesized
aagctgggggagagaaggta

SEQ ID NO: 347841 - DNA, 20 bp, Artificial Sequence
  chemically synthesized
tctagaagctgggggagaga

SEQ ID NO: 347842 - DNA, 20 bp, Artificial Sequence
  chemically synthesized
ctctagaagctgggggagag

SEQ ID NO: 347843 - DNA, 20 bp, Artificial Sequence
  chemically synthesized
tccccataccttctctcccc

SEQ ID NO: 347844 - DNA, 20 bp, Artificial Sequence
  chemically synthesized
ggcctctagaagctggggga

SEQ ID NO: 347845 - DNA, 20 bp, Artificial Sequence
  chemically synthesized
gtggcctctagaagctgggg

SEQ ID NO: 347846 - DNA, 20 bp, Artificial Sequence
  chemically synthesized
tggtggcctctagaagctgg

SEQ ID NO: 347847 - DNA, 20 bp, Artificial Sequence
  chemically synthesized
accttctctcccccagcttc

SEQ ID NO: 347848 - DNA, 20 bp, Artificial Sequence
  chemically synthesized
atggtggcctctagaagctg

SEQ ID NO: 347849 - DNA, 20 bp, Artificial Sequence
  chemically synthesized
aatggtggcctctagaagct

SEQ ID NO: 347850 - DNA, 20 bp, Artificial Sequence
  chemically synthesized
cttctctcccccagcttcta

SEQ ID NO: 347851 - DNA, 20 bp, Artificial Sequence
  chemically synthesized
gaatggtggcctctagaagc

SEQ ID NO: 347852 - DNA, 20 bp, Artificial Sequence
  chemically synthesized
ttctctcccccagcttctag

SEQ ID NO: 347853 - DNA, 20 bp, Artificial Sequence
  chemically synthesized
agtagaatggtggcctctag

SEQ ID NO: 347854 - DNA, 20 bp, Artificial Sequence
  chemically synthesized
taaagtagaatggtggcctc

SEQ ID NO: 347855 - DNA, 20 bp, Artificial Sequence
  chemically synthesized
gcatagataaagtagaatgg

SEQ ID NO: 347856 - DNA, 20 bp, Artificial Sequence
  chemically synthesized
aatgcatagataaagtagaa

SEQ ID NO: 347857 - DNA, 20 bp, Artificial Sequence
  chemically synthesized
agtaaaatgcatagataaag

SEQ ID NO: 347858 - DNA, 20 bp, Artificial Sequence
  chemically synthesized
agcagtaaaatgcatagata

SEQ ID NO: 347859 - DNA, 20 bp, Artificial Sequence
  chemically synthesized
atctagagcagtaaaatgca

SEQ ID NO: 347860 - DNA, 20 bp, Artificial Sequence
  chemically synthesized
atctatgcattttactgctc

SEQ ID NO: 347861 - DNA, 20 bp, Artificial Sequence
  chemically synthesized
atgcattttactgctctaga

SEQ ID NO: 347862 - DNA, 20 bp, Artificial Sequence
  chemically synthesized
tttgtatgagctatctagag

SEQ ID NO: 347863 - DNA, 20 bp, Artificial Sequence
  chemically synthesized
ctatttgtatgagctatcta

SEQ ID NO: 347864 - DNA, 20 bp, Artificial Sequence
  chemically synthesized
ttctatttgtatgagctatc

SEQ ID NO: 347865 - DNA, 20 bp, Artificial Sequence
  chemically synthesized
ctctagatagctcatacaaa

SEQ ID NO: 347866 - DNA, 20 bp, Artificial Sequence
  chemically synthesized
acatatgattctatttgtat

SEQ ID NO: 347867 - DNA, 20 bp, Artificial Sequence
  chemically synthesized
gggaaaaagccagatacaaa

SEQ ID NO: 347868 - DNA, 20 bp, Artificial Sequence
  chemically synthesized
atatgttatccttttgtatc

SEQ ID NO: 347869 - DNA, 20 bp, Artificial Sequence
  chemically synthesized
ggggaaaaagccagatacaa

SEQ ID NO: 347870 - DNA, 20 bp, Artificial Sequence
  chemically synthesized
atatgctaaggggaaaaagc

SEQ ID NO: 347871 - DNA, 20 bp, Artificial Sequence
  chemically synthesized
gatgatatgctaaggggaaa

SEQ ID NO: 347872 - DNA, 20 bp, Artificial Sequence
  chemically synthesized
tgtatctggctttttcccct

SEQ ID NO: 347873 - DNA, 20 bp, Artificial Sequence
  chemically synthesized
cttgatgatgatatgctaag

SEQ ID NO: 347874 - DNA, 20 bp, Artificial Sequence
  chemically synthesized
tcttgatgatgatatgctaa

SEQ ID NO: 347875 - DNA, 20 bp, Artificial Sequence
  chemically synthesized
atcttgatgatgatatgcta

SEQ ID NO: 347876 - DNA, 20 bp, Artificial Sequence
  chemically synthesized
aatcttgatgatgatatgct

SEQ ID NO: 347877 - DNA, 20 bp, Artificial Sequence
  chemically synthesized
ccccttagcatatcatcatc

SEQ ID NO: 347878 - DNA, 20 bp, Artificial Sequence
  chemically synthesized
ttctgacacacattatagca

SEQ ID NO: 347879 - DNA, 20 bp, Artificial Sequence
  chemically synthesized
gaaagttctgacacacatta

SEQ ID NO: 347880 - DNA, 20 bp, Artificial Sequence
  chemically synthesized
atccatgctataatgtgtgt

SEQ ID NO: 347881 - DNA, 20 bp, Artificial Sequence
  chemically synthesized
atgtgtgtcagaactttctt

SEQ ID NO: 347882 - DNA, 20 bp, Artificial Sequence
  chemically synthesized
tgtgtgtcagaactttctta

SEQ ID NO: 347883 - DNA, 20 bp, Artificial Sequence
  chemically synthesized
aatattattcagccttaaga

SEQ ID NO: 347884 - DNA, 20 bp, Artificial Sequence
  chemically synthesized
gtagaatattattcagcctt

SEQ ID NO: 347885 - DNA, 20 bp, Artificial Sequence
  chemically synthesized
gtatacagtagaatattatt

SEQ ID NO: 347886 - DNA, 20 bp, Artificial Sequence
  chemically synthesized
aatgtggtaaatgtatacag

SEQ ID NO: 347887 - DNA, 20 bp, Artificial Sequence
  chemically synthesized
caaaatgtggtaaatgtata

SEQ ID NO: 347888 - DNA, 20 bp, Artificial Sequence
  chemically synthesized
atgaatggataaacaaaatg

SEQ ID NO: 347889 - DNA, 20 bp, Artificial Sequence
  chemically synthesized
aatgtccatctgaagatgaa

SEQ ID NO: 347890 - DNA, 20 bp, Artificial Sequence
  chemically synthesized
tttgtttatccattcatctt

SEQ ID NO: 347891 - DNA, 20 bp, Artificial Sequence
  chemically synthesized
tttatccattcatcttcaga

SEQ ID NO: 347892 - DNA, 20 bp, Artificial Sequence
  chemically synthesized
gcaactcaaatgtccatctg

SEQ ID NO: 347893 - DNA, 20 bp, Artificial Sequence
  chemically synthesized
tcatcttcagatggacattt

SEQ ID NO: 347894 - DNA, 20 bp, Artificial Sequence
  chemically synthesized
attcatagtagcaaaagatg

SEQ ID NO: 347895 - DNA, 20 bp, Artificial Sequence
  chemically synthesized
ttattcatagtagcaaaaga

SEQ ID NO: 347896 - DNA, 20 bp, Artificial Sequence
  chemically synthesized
agcattattcatagtagcaa

SEQ ID NO: 347897 - DNA, 20 bp, Artificial Sequence
  chemically synthesized
tatagcagcattattcatag

SEQ ID NO: 347898 - DNA, 20 bp, Artificial Sequence
  chemically synthesized
gtttatagcagcattattca

SEQ ID NO: 347899 - DNA, 20 bp, Artificial Sequence
  chemically synthesized
ttgtacacccatgtttatag

SEQ ID NO: 347900 - DNA, 20 bp, Artificial Sequence
  chemically synthesized
gaataatgctgctataaaca

SEQ ID NO: 347901 - DNA, 20 bp, Artificial Sequence
  chemically synthesized
aataatgctgctataaacat

SEQ ID NO: 347902 - DNA, 20 bp, Artificial Sequence
  chemically synthesized
tatttgtacacccatgttta

SEQ ID NO: 347903 - DNA, 20 bp, Artificial Sequence
  chemically synthesized
gggtgtacaaatatattttg

SEQ ID NO: 347904 - DNA, 20 bp, Artificial Sequence
  chemically synthesized
ggtgtacaaatatattttga

SEQ ID NO: 347905 - DNA, 20 bp, Artificial Sequence
  chemically synthesized
tactcaaaagaattgaaaaa

SEQ ID NO: 347906 - DNA, 20 bp, Artificial Sequence
  chemically synthesized
atactcaaaagaattgaaaa

SEQ ID NO: 347907 - DNA, 20 bp, Artificial Sequence
  chemically synthesized
gtccttttttcaattctttt

SEQ ID NO: 347908 - DNA, 20 bp, Artificial Sequence
  chemically synthesized
acttctgggaatatactcaa

SEQ ID NO: 347909 - DNA, 20 bp, Artificial Sequence
  chemically synthesized
aattcttttgagtatattcc

SEQ ID NO: 347910 - DNA, 20 bp, Artificial Sequence
  chemically synthesized
tcttttgagtatattcccag

SEQ ID NO: 347911 - DNA, 20 bp, Artificial Sequence
  chemically synthesized
tttgagtatattcccagaag

SEQ ID NO: 347912 - DNA, 20 bp, Artificial Sequence
  chemically synthesized
gatccagcaattccacttct

SEQ ID NO: 347913 - DNA, 20 bp, Artificial Sequence
  chemically synthesized
tgatccagcaattccacttc

SEQ ID NO: 347914 - DNA, 20 bp, Artificial Sequence
  chemically synthesized
attcccagaagtggaattgc

SEQ ID NO: 347915 - DNA, 20 bp, Artificial Sequence
  chemically synthesized
agtggaattgctggatcaca

SEQ ID NO: 347916 - DNA, 20 bp, Artificial Sequence
  chemically synthesized
cgtagaattaccatgtgatc

SEQ ID NO: 347917 - DNA, 20 bp, Artificial Sequence
  chemically synthesized
gtttctcaaaatatagaacg

SEQ ID NO: 347918 - DNA, 20 bp, Artificial Sequence
  chemically synthesized
aattctacgttctatatttt

SEQ ID NO: 347919 - DNA, 20 bp, Artificial Sequence
  chemically synthesized
tatgttggtttctcaaaata

SEQ ID NO: 347920 - DNA, 20 bp, Artificial Sequence
  chemically synthesized
cactgtggaaacaaatatgt

SEQ ID NO: 347921 - DNA, 20 bp, Artificial Sequence
  chemically synthesized
aaccaacatatttgtttcca

SEQ ID NO: 347922 - DNA, 20 bp, Artificial Sequence
  chemically synthesized
gtaaaaccttgcagtcactg

SEQ ID NO: 347923 - DNA, 20 bp, Artificial Sequence
  chemically synthesized
tttgtttccacagtgactgc

SEQ ID NO: 347924 - DNA, 20 bp, Artificial Sequence
  chemically synthesized
ttgtttccacagtgactgca

SEQ ID NO: 347925 - DNA, 20 bp, Artificial Sequence
  chemically synthesized
ggagggaatgtaaaaccttg

SEQ ID NO: 347926 - DNA, 20 bp, Artificial Sequence
  chemically synthesized
gcaaggttttacattccctc

SEQ ID NO: 347927 - DNA, 20 bp, Artificial Sequence
  chemically synthesized
aggttttacattccctccag

SEQ ID NO: 347928 - DNA, 20 bp, Artificial Sequence
  chemically synthesized
aacacttgtgaactgctgga

SEQ ID NO: 347929 - DNA, 20 bp, Artificial Sequence
  chemically synthesized
gaacacttgtgaactgctgg

SEQ ID NO: 347930 - DNA, 20 bp, Artificial Sequence
  chemically synthesized
tgaacacttgtgaactgctg

SEQ ID NO: 347931 - DNA, 20 bp, Artificial Sequence
  chemically synthesized
tttgaacacttgtgaactgc

SEQ ID NO: 347932 - DNA, 20 bp, Artificial Sequence
  chemically synthesized
cattccctccagcagttcac

SEQ ID NO: 347933 - DNA, 20 bp, Artificial Sequence
  chemically synthesized
aataaatatggttgaggatg

SEQ ID NO: 347934 - DNA, 20 bp, Artificial Sequence
  chemically synthesized
ccagaaaataaatatggttg

SEQ ID NO: 347935 - DNA, 20 bp, Artificial Sequence
  chemically synthesized
cccagaaaataaatatggtt

SEQ ID NO: 347936 - DNA, 20 bp, Artificial Sequence
  chemically synthesized
aaaaacccagaaaataaata

SEQ ID NO: 347937 - DNA, 20 bp, Artificial Sequence
  chemically synthesized
cctcaaccatatttattttc

SEQ ID NO: 347938 - DNA, 20 bp, Artificial Sequence
  chemically synthesized
ctcaaccatatttattttct

SEQ ID NO: 347939 - DNA, 20 bp, Artificial Sequence
  chemically synthesized
caaaaaaaaaaaaaaaaacc

SEQ ID NO: 347940 - DNA, 20 bp, Artificial Sequence
  chemically synthesized
tgggtttttttttttttttt

SEQ ID NO: 347941 - DNA, 20 bp, Artificial Sequence
  chemically synthesized
taaaataatcatcatcctaa

SEQ ID NO: 347942 - DNA, 20 bp, Artificial Sequence
  chemically synthesized
aaaataatcatcatcctaat

SEQ ID NO: 347943 - DNA, 20 bp, Artificial Sequence
  chemically synthesized
gatagcacttcacacccatt

SEQ ID NO: 347944 - DNA, 20 bp, Artificial Sequence
  chemically synthesized
agatagcacttcacacccat

SEQ ID NO: 347945 - DNA, 20 bp, Artificial Sequence
  chemically synthesized
tcatcatcctaatgggtgtg

SEQ ID NO: 347946 - DNA, 20 bp, Artificial Sequence
  chemically synthesized
gtgtgaagtgctatctcatt

SEQ ID NO: 347947 - DNA, 20 bp, Artificial Sequence
  chemically synthesized
cagataaatcccaaatgaga

SEQ ID NO: 347948 - DNA, 20 bp, Artificial Sequence
  chemically synthesized
tgtgaagtgctatctcattt

SEQ ID NO: 347949 - DNA, 20 bp, Artificial Sequence
  chemically synthesized
aatgcagataaatcccaaat

SEQ ID NO: 347950 - DNA, 20 bp, Artificial Sequence
  chemically synthesized
cgctgatcattagggaaatg

SEQ ID NO: 347951 - DNA, 20 bp, Artificial Sequence
  chemically synthesized
atctgcatttccctaatgat

SEQ ID NO: 347952 - DNA, 20 bp, Artificial Sequence
  chemically synthesized
atcgatatcgctgatcatta

SEQ ID NO: 347953 - DNA, 20 bp, Artificial Sequence
  chemically synthesized
aatcgatatcgctgatcatt

SEQ ID NO: 347954 - DNA, 20 bp, Artificial Sequence
  chemically synthesized
taatcgatatcgctgatcat

SEQ ID NO: 347955 - DNA, 20 bp, Artificial Sequence
  chemically synthesized
cgatatcgattatctactca

SEQ ID NO: 347956 - DNA, 20 bp, Artificial Sequence
  chemically synthesized
ttggccagtaagaccatgag

SEQ ID NO: 347957 - DNA, 20 bp, Artificial Sequence
  chemically synthesized
agtttggccagtaagaccat

SEQ ID NO: 347958 - DNA, 20 bp, Artificial Sequence
  chemically synthesized
ttatctactcatggtcttac

SEQ ID NO: 347959 - DNA, 20 bp, Artificial Sequence
  chemically synthesized
ttctctaaagtttggccagt

SEQ ID NO: 347960 - DNA, 20 bp, Artificial Sequence
  chemically synthesized
aaatttctctaaagtttggc

SEQ ID NO: 347961 - DNA, 20 bp, Artificial Sequence
  chemically synthesized
tggtcttactggccaaactt

SEQ ID NO: 347962 - DNA, 20 bp, Artificial Sequence
  chemically synthesized
gtcttactggccaaacttta

SEQ ID NO: 347963 - DNA, 20 bp, Artificial Sequence
  chemically synthesized
tcagaaatttctctaaagtt

SEQ ID NO: 347964 - DNA, 20 bp, Artificial Sequence
  chemically synthesized
gttgatcagaaatttctcta

SEQ ID NO: 347965 - DNA, 20 bp, Artificial Sequence
  chemically synthesized
aaatgaataaatgagttgat

SEQ ID NO: 347966 - DNA, 20 bp, Artificial Sequence
  chemically synthesized
aattaaaaaaatgaataaat

SEQ ID NO: 347967 - DNA, 20 bp, Artificial Sequence
  chemically synthesized
agaattcaacaacagaaaaa

SEQ ID NO: 347968 - DNA, 20 bp, Artificial Sequence
  chemically synthesized
atcatcgtagaattcaacaa

SEQ ID NO: 347969 - DNA, 20 bp, Artificial Sequence
  chemically synthesized
acagttaaattatatcatcg

SEQ ID NO: 347970 - DNA, 20 bp, Artificial Sequence
  chemically synthesized
atgagatttgagtggggaca

SEQ ID NO: 347971 - DNA, 20 bp, Artificial Sequence
  chemically synthesized
ttcaacatgagatttgagtg

SEQ ID NO: 347972 - DNA, 20 bp, Artificial Sequence
  chemically synthesized
attcaacatgagatttgagt

SEQ ID NO: 347973 - DNA, 20 bp, Artificial Sequence
  chemically synthesized
aattcaacatgagatttgag

SEQ ID NO: 347974 - DNA, 20 bp, Artificial Sequence
  chemically synthesized
tacaattcaacatgagattt

SEQ ID NO: 347975 - DNA, 20 bp, Artificial Sequence
  chemically synthesized
tggggattacaattcaacat

SEQ ID NO: 347976 - DNA, 20 bp, Artificial Sequence
  chemically synthesized
tgaattgtaatccccaatgt

SEQ ID NO: 347977 - DNA, 20 bp, Artificial Sequence
  chemically synthesized
agacaccaactccaacattg

SEQ ID NO: 347978 - DNA, 20 bp, Artificial Sequence
  chemically synthesized
aattgtaatccccaatgttg

SEQ ID NO: 347979 - DNA, 20 bp, Artificial Sequence
  chemically synthesized
cagacaccaactccaacatt

SEQ ID NO: 347980 - DNA, 20 bp, Artificial Sequence
  chemically synthesized
ccagacaccaactccaacat

SEQ ID NO: 347981 - DNA, 20 bp, Artificial Sequence
  chemically synthesized
gtaatccccaatgttggagt

SEQ ID NO: 347982 - DNA, 20 bp, Artificial Sequence
  chemically synthesized
ccaatgttggagttggtgtc

SEQ ID NO: 347983 - DNA, 20 bp, Artificial Sequence
  chemically synthesized
atgttggagttggtgtctgg

SEQ ID NO: 347984 - DNA, 20 bp, Artificial Sequence
  chemically synthesized
tgttggagttggtgtctggt

SEQ ID NO: 347985 - DNA, 20 bp, Artificial Sequence
  chemically synthesized
ttggagttggtgtctggtgg

SEQ ID NO: 347986 - DNA, 20 bp, Artificial Sequence
  chemically synthesized
tggagttggtgtctggtggg

SEQ ID NO: 347987 - DNA, 20 bp, Artificial Sequence
  chemically synthesized
gtgatccaatcacctcccac

SEQ ID NO: 347988 - DNA, 20 bp, Artificial Sequence
  chemically synthesized
ggtgtctggtgggaggtgat

SEQ ID NO: 347989 - DNA, 20 bp, Artificial Sequence
  chemically synthesized
gtgggaggtgattggatcac

SEQ ID NO: 347990 - DNA, 20 bp, Artificial Sequence
  chemically synthesized
tgggaggtgattggatcact

SEQ ID NO: 347991 - DNA, 20 bp, Artificial Sequence
  chemically synthesized
gggaggtgattggatcactg

SEQ ID NO: 347992 - DNA, 20 bp, Artificial Sequence
  chemically synthesized
cattcatcagaaatttgccc

SEQ ID NO: 347993 - DNA, 20 bp, Artificial Sequence
  chemically synthesized
tggggcaaatttctgatgaa

SEQ ID NO: 347994 - DNA, 20 bp, Artificial Sequence
  chemically synthesized
gacagtactaaaccattcat

SEQ ID NO: 347995 - DNA, 20 bp, Artificial Sequence
  chemically synthesized
caaatttctgatgaatggtt

SEQ ID NO: 347996 - DNA, 20 bp, Artificial Sequence
  chemically synthesized
atggtttagtactgtccgct

SEQ ID NO: 347997 - DNA, 20 bp, Artificial Sequence
  chemically synthesized
cgagaatagtaccaagcgga

SEQ ID NO: 347998 - DNA, 20 bp, Artificial Sequence
  chemically synthesized
atcacgagaatagtaccaag

SEQ ID NO: 347999 - DNA, 20 bp, Artificial Sequence
  chemically synthesized
tctatcacgagaatagtacc

SEQ ID NO: 348000 - DNA, 20 bp, Artificial Sequence
  chemically synthesized
agaactctctatcacgagaa

SEQ ID NO: 348001 - DNA, 20 bp, Artificial Sequence
  chemically synthesized
gcttggtactattctcgtga

SEQ ID NO: 348002 - DNA, 20 bp, Artificial Sequence
  chemically synthesized
ttggtactattctcgtgata

SEQ ID NO: 348003 - DNA, 20 bp, Artificial Sequence
  chemically synthesized
tcataagaactctctatcac

SEQ ID NO: 348004 - DNA, 20 bp, Artificial Sequence
  chemically synthesized
ggtactattctcgtgataga

SEQ ID NO: 348005 - DNA, 20 bp, Artificial Sequence
  chemically synthesized
tttaaacgaccagatttcat

SEQ ID NO: 348006 - DNA, 20 bp, Artificial Sequence
  chemically synthesized
tagagagttcttatgaaatc

SEQ ID NO: 348007 - DNA, 20 bp, Artificial Sequence
  chemically synthesized
gtcatacacttttaaacgac

SEQ ID NO: 348008 - DNA, 20 bp, Artificial Sequence
  chemically synthesized
tatgaaatctggtcgtttaa

SEQ ID NO: 348009 - DNA, 20 bp, Artificial Sequence
  chemically synthesized
aggagcaagaggggtggagg

SEQ ID NO: 348010 - DNA, 20 bp, Artificial Sequence
  chemically synthesized
acaggagcaagaggggtgga

SEQ ID NO: 348011 - DNA, 20 bp, Artificial Sequence
  chemically synthesized
aacaggagcaagaggggtgg

SEQ ID NO: 348012 - DNA, 20 bp, Artificial Sequence
  chemically synthesized
gaacaggagcaagaggggtg

SEQ ID NO: 348013 - DNA, 20 bp, Artificial Sequence
  chemically synthesized
cagaacaggagcaagagggg

SEQ ID NO: 348014 - DNA, 20 bp, Artificial Sequence
  chemically synthesized
ggtcagaacaggagcaagag

SEQ ID NO: 348015 - DNA, 20 bp, Artificial Sequence
  chemically synthesized
tggtcagaacaggagcaaga

SEQ ID NO: 348016 - DNA, 20 bp, Artificial Sequence
  chemically synthesized
atggtcagaacaggagcaag

SEQ ID NO: 348017 - DNA, 20 bp, Artificial Sequence
  chemically synthesized
tatggtcagaacaggagcaa

SEQ ID NO: 348018 - DNA, 20 bp, Artificial Sequence
  chemically synthesized
catatggtcagaacaggagc

SEQ ID NO: 348019 - DNA, 20 bp, Artificial Sequence
  chemically synthesized
aggtcatatggtcagaacag

SEQ ID NO: 348020 - DNA, 20 bp, Artificial Sequence
  chemically synthesized
gcaggtcatatggtcagaac

SEQ ID NO: 348021 - DNA, 20 bp, Artificial Sequence
  chemically synthesized
ggcaggtcatatggtcagaa

SEQ ID NO: 348022 - DNA, 20 bp, Artificial Sequence
  chemically synthesized
gacctggcaggtcatatggt

SEQ ID NO: 348023 - DNA, 20 bp, Artificial Sequence
  chemically synthesized
gggtgacctggcaggtcata

SEQ ID NO: 348024 - DNA, 20 bp, Artificial Sequence
  chemically synthesized
gttctgaccatatgacctgc

SEQ ID NO: 348025 - DNA, 20 bp, Artificial Sequence
  chemically synthesized
ttctgaccatatgacctgcc

SEQ ID NO: 348026 - DNA, 20 bp, Artificial Sequence
  chemically synthesized
aaagggaagggtgacctggc

SEQ ID NO: 348027 - DNA, 20 bp, Artificial Sequence
  chemically synthesized
gaaagggaagggtgacctgg

SEQ ID NO: 348028 - DNA, 20 bp, Artificial Sequence
  chemically synthesized
gcagaaagggaagggtgacc

SEQ ID NO: 348029 - DNA, 20 bp, Artificial Sequence
  chemically synthesized
aacataaagcagaaagggaa

SEQ ID NO: 348030 - DNA, 20 bp, Artificial Sequence
  chemically synthesized
aaacataaagcagaaaggga

SEQ ID NO: 348031 - DNA, 20 bp, Artificial Sequence
  chemically synthesized
gaaacataaagcagaaaggg

SEQ ID NO: 348032 - DNA, 20 bp, Artificial Sequence
  chemically synthesized
caggaaacataaagcagaaa

SEQ ID NO: 348033 - DNA, 20 bp, Artificial Sequence
  chemically synthesized
tcaggaaacataaagcagaa

SEQ ID NO: 348034 - DNA, 20 bp, Artificial Sequence
  chemically synthesized
ctcaggaaacataaagcaga

SEQ ID NO: 348035 - DNA, 20 bp, Artificial Sequence
  chemically synthesized
aggcctcaggaaacataaag

SEQ ID NO: 348036 - DNA, 20 bp, Artificial Sequence
  chemically synthesized
gggaggcctcaggaaacata

SEQ ID NO: 348037 - DNA, 20 bp, Artificial Sequence
  chemically synthesized
ctttctgctttatgtttcct

SEQ ID NO: 348038 - DNA, 20 bp, Artificial Sequence
  chemically synthesized
tttctgctttatgtttcctg

SEQ ID NO: 348039 - DNA, 20 bp, Artificial Sequence
  chemically synthesized
tcggcttctggggaggcctc

SEQ ID NO: 348040 - DNA, 20 bp, Artificial Sequence
  chemically synthesized
ctcggcttctggggaggcct

SEQ ID NO: 348041 - DNA, 20 bp, Artificial Sequence
  chemically synthesized
tatgtttcctgaggcctccc

SEQ ID NO: 348042 - DNA, 20 bp, Artificial Sequence
  chemically synthesized
gtttcctgaggcctccccag

SEQ ID NO: 348043 - DNA, 20 bp, Artificial Sequence
  chemically synthesized
catctgctcggcttctgggg

SEQ ID NO: 348044 - DNA, 20 bp, Artificial Sequence
  chemically synthesized
gcatctgctcggcttctggg

SEQ ID NO: 348045 - DNA, 20 bp, Artificial Sequence
  chemically synthesized
tggcatctgctcggcttctg

SEQ ID NO: 348046 - DNA, 20 bp, Artificial Sequence
  chemically synthesized
ctgaggcctccccagaagcc

SEQ ID NO: 348047 - DNA, 20 bp, Artificial Sequence
  chemically synthesized
ctggcatctgctcggcttct

SEQ ID NO: 348048 - DNA, 20 bp, Artificial Sequence
  chemically synthesized
gctggcatctgctcggcttc

SEQ ID NO: 348049 - DNA, 20 bp, Artificial Sequence
  chemically synthesized
aggcctccccagaagccgag

SEQ ID NO: 348050 - DNA, 20 bp, Artificial Sequence
  chemically synthesized
gcatgatgctggcatctgct

SEQ ID NO: 348051 - DNA, 20 bp, Artificial Sequence
  chemically synthesized
cccagaagccgagcagatgc

SEQ ID NO: 348052 - DNA, 20 bp, Artificial Sequence
  chemically synthesized
ctgtacaggaagcatgatgc

SEQ ID NO: 348053 - DNA, 20 bp, Artificial Sequence
  chemically synthesized
ccagcatcatgcttcctgta

SEQ ID NO: 348054 - DNA, 20 bp, Artificial Sequence
  chemically synthesized
atttctgtaggctgtacagg

SEQ ID NO: 348055 - DNA, 20 bp, Artificial Sequence
  chemically synthesized
cacatttctgtaggctgtac

SEQ ID NO: 348056 - DNA, 20 bp, Artificial Sequence
  chemically synthesized
tcacatttctgtaggctgta

SEQ ID NO: 348057 - DNA, 20 bp, Artificial Sequence
  chemically synthesized
catgcttcctgtacagccta

SEQ ID NO: 348058 - DNA, 20 bp, Artificial Sequence
  chemically synthesized
taattggctcacatttctgt

SEQ ID NO: 348059 - DNA, 20 bp, Artificial Sequence
  chemically synthesized
ttaattggctcacatttctg

SEQ ID NO: 348060 - DNA, 20 bp, Artificial Sequence
  chemically synthesized
tgtacagcctacagaaatgt

SEQ ID NO: 348061 - DNA, 20 bp, Artificial Sequence
  chemically synthesized
ataaagaaaagaggtttaat

SEQ ID NO: 348062 - DNA, 20 bp, Artificial Sequence
  chemically synthesized
gggtaaattataaagaaaag

SEQ ID NO: 348063 - DNA, 20 bp, Artificial Sequence
  chemically synthesized
tgggtaaattataaagaaaa

SEQ ID NO: 348064 - DNA, 20 bp, Artificial Sequence
  chemically synthesized
actgggtaaattataaagaa

SEQ ID NO: 348065 - DNA, 20 bp, Artificial Sequence
  chemically synthesized
ctgaaactgggtaaattata

SEQ ID NO: 348066 - DNA, 20 bp, Artificial Sequence
  chemically synthesized
tcttttctttataatttacc

SEQ ID NO: 348067 - DNA, 20 bp, Artificial Sequence
  chemically synthesized
ctttataatttacccagttt

SEQ ID NO: 348068 - DNA, 20 bp, Artificial Sequence
  chemically synthesized
ctaaagaaatatctgaaact

SEQ ID NO: 348069 - DNA, 20 bp, Artificial Sequence
  chemically synthesized
tctaaagaaatatctgaaac

SEQ ID NO: 348070 - DNA, 20 bp, Artificial Sequence
  chemically synthesized
cccagtttcagatatttctt

SEQ ID NO: 348071 - DNA, 20 bp, Artificial Sequence
  chemically synthesized
cagtttcagatatttcttta

SEQ ID NO: 348072 - DNA, 20 bp, Artificial Sequence
  chemically synthesized
tccattcttgcattgctcta

SEQ ID NO: 348073 - DNA, 20 bp, Artificial Sequence
  chemically synthesized
atatttctttagagcaatgc

SEQ ID NO: 348074 - DNA, 20 bp, Artificial Sequence
  chemically synthesized
tctttagagcaatgcaagaa

SEQ ID NO: 348075 - DNA, 20 bp, Artificial Sequence
  chemically synthesized
tgcaagaatggactaacata

SEQ ID NO: 348076 - DNA, 20 bp, Artificial Sequence
  chemically synthesized
gcaagaatggactaacatat

SEQ ID NO: 348077 - DNA, 20 bp, Artificial Sequence
  chemically synthesized
tgccaagaactcctatatgt

SEQ ID NO: 348078 - DNA, 20 bp, Artificial Sequence
  chemically synthesized
aagaatggactaacatatag

SEQ ID NO: 348079 - DNA, 20 bp, Artificial Sequence
  chemically synthesized
gactaacatataggagttct

SEQ ID NO: 348080 - DNA, 20 bp, Artificial Sequence
  chemically synthesized
acatataggagttcttggca

SEQ ID NO: 348081 - DNA, 20 bp, Artificial Sequence
  chemically synthesized
attaatatccagactgtgcc

SEQ ID NO: 348082 - DNA, 20 bp, Artificial Sequence
  chemically synthesized
taggagttcttggcacagtc

SEQ ID NO: 348083 - DNA, 20 bp, Artificial Sequence
  chemically synthesized
ttcaatagggaattaatatc

SEQ ID NO: 348084 - DNA, 20 bp, Artificial Sequence
  chemically synthesized
tgcgaatcatatattcaata

SEQ ID NO: 348085 - DNA, 20 bp, Artificial Sequence
  chemically synthesized
ttgcgaatcatatattcaat

SEQ ID NO: 348086 - DNA, 20 bp, Artificial Sequence
  chemically synthesized
tttgcgaatcatatattcaa

SEQ ID NO: 348087 - DNA, 20 bp, Artificial Sequence
  chemically synthesized
ggcaacttacggaatgggag

SEQ ID NO: 348088 - DNA, 20 bp, Artificial Sequence
  chemically synthesized
aaaggcaacttacggaatgg

SEQ ID NO: 348089 - DNA, 20 bp, Artificial Sequence
  chemically synthesized
aacatcttctcccattccgt

SEQ ID NO: 348090 - DNA, 20 bp, Artificial Sequence
  chemically synthesized
gaaaaggcaacttacggaat

SEQ ID NO: 348091 - DNA, 20 bp, Artificial Sequence
  chemically synthesized
tgaaaaggcaacttacggaa

SEQ ID NO: 348092 - DNA, 20 bp, Artificial Sequence
  chemically synthesized
cagagtgaaaaggcaactta

SEQ ID NO: 348093 - DNA, 20 bp, Artificial Sequence
  chemically synthesized
tgaacaccatcagagtgaaa

SEQ ID NO: 348094 - DNA, 20 bp, Artificial Sequence
  chemically synthesized
atgaacaccatcagagtgaa

SEQ ID NO: 348095 - DNA, 20 bp, Artificial Sequence
  chemically synthesized
aagttgccttttcactctga

SEQ ID NO: 348096 - DNA, 20 bp, Artificial Sequence
  chemically synthesized
tgcatgaatgaacaccatca

SEQ ID NO: 348097 - DNA, 20 bp, Artificial Sequence
  chemically synthesized
tgtgcatgaatgaacaccat

SEQ ID NO: 348098 - DNA, 20 bp, Artificial Sequence
  chemically synthesized
tgatggtgttcattcatgca

SEQ ID NO: 348099 - DNA, 20 bp, Artificial Sequence
  chemically synthesized
tggtgttcattcatgcacag

SEQ ID NO: 348100 - DNA, 20 bp, Artificial Sequence
  chemically synthesized
caggctacaacagaaaaatt

SEQ ID NO: 348101 - DNA, 20 bp, Artificial Sequence
  chemically synthesized
tcaggctacaacagaaaaat

SEQ ID NO: 348102 - DNA, 20 bp, Artificial Sequence
  chemically synthesized
tttacctaatttttctgttg

SEQ ID NO: 348103 - DNA, 20 bp, Artificial Sequence
  chemically synthesized
actaaaagctcaggctacaa

SEQ ID NO: 348104 - DNA, 20 bp, Artificial Sequence
  chemically synthesized
taatttttctgttgtagcct

SEQ ID NO: 348105 - DNA, 20 bp, Artificial Sequence
  chemically synthesized
tctgttgtagcctgagcttt

SEQ ID NO: 348106 - DNA, 20 bp, Artificial Sequence
  chemically synthesized
ggatatgacactaaaagctc

SEQ ID NO: 348107 - DNA, 20 bp, Artificial Sequence
  chemically synthesized
tggatatgacactaaaagct

SEQ ID NO: 348108 - DNA, 20 bp, Artificial Sequence
  chemically synthesized
tatcttggatatgacactaa

SEQ ID NO: 348109 - DNA, 20 bp, Artificial Sequence
  chemically synthesized
gagcttttagtgtcatatcc

SEQ ID NO: 348110 - DNA, 20 bp, Artificial Sequence
  chemically synthesized
gattgggcaattaaatatct

SEQ ID NO: 348111 - DNA, 20 bp, Artificial Sequence
  chemically synthesized
gaaaacataaacattagatt

SEQ ID NO: 348112 - DNA, 20 bp, Artificial Sequence
  chemically synthesized
agaaaacataaacattagat

SEQ ID NO: 348113 - DNA, 20 bp, Artificial Sequence
  chemically synthesized
ttggaagaaaacataaacat

SEQ ID NO: 348114 - DNA, 20 bp, Artificial Sequence
  chemically synthesized
aagaaagcgtagacatttgg

SEQ ID NO: 348115 - DNA, 20 bp, Artificial Sequence
  chemically synthesized
tagaagaaagcgtagacatt

SEQ ID NO: 348116 - DNA, 20 bp, Artificial Sequence
  chemically synthesized
agaacttttagaagaaagcg

SEQ ID NO: 348117 - DNA, 20 bp, Artificial Sequence
  chemically synthesized
agtacagaacttttagaaga

SEQ ID NO: 348118 - DNA, 20 bp, Artificial Sequence
  chemically synthesized
atgtctacgctttcttctaa

SEQ ID NO: 348119 - DNA, 20 bp, Artificial Sequence
  chemically synthesized
caaaagtacagaacttttag

SEQ ID NO: 348120 - DNA, 20 bp, Artificial Sequence
  chemically synthesized
ggccaaaagtacagaacttt

SEQ ID NO: 348121 - DNA, 20 bp, Artificial Sequence
  chemically synthesized
ttctaaaagttctgtacttt

SEQ ID NO: 348122 - DNA, 20 bp, Artificial Sequence
  chemically synthesized
agtaaacgtggccaaaagta

SEQ ID NO: 348123 - DNA, 20 bp, Artificial Sequence
  chemically synthesized
caggaagtaaacgtggccaa

SEQ ID NO: 348124 - DNA, 20 bp, Artificial Sequence
  chemically synthesized
aatggatcaggaagtaaacg

SEQ ID NO: 348125 - DNA, 20 bp, Artificial Sequence
  chemically synthesized
ttaagtcaaaatggatcagg

SEQ ID NO: 348126 - DNA, 20 bp, Artificial Sequence
  chemically synthesized
aaattaagtcaaaatggatc

SEQ ID NO: 348127 - DNA, 20 bp, Artificial Sequence
  chemically synthesized
aaaattaagtcaaaatggat

SEQ ID NO: 348128 - DNA, 20 bp, Artificial Sequence
  chemically synthesized
acacaaaaattaagtcaaaa

SEQ ID NO: 348129 - DNA, 20 bp, Artificial Sequence
  chemically synthesized
ttataaaatacacaaaaatt

SEQ ID NO: 348130 - DNA, 20 bp, Artificial Sequence
  chemically synthesized
ttaatttttgtgtattttat

SEQ ID NO: 348131 - DNA, 20 bp, Artificial Sequence
  chemically synthesized
aatttttgtgtattttataa

SEQ ID NO: 348132 - DNA, 20 bp, Artificial Sequence
  chemically synthesized
acatttaaaataaatgaagt

SEQ ID NO: 348133 - DNA, 20 bp, Artificial Sequence
  chemically synthesized
atatacatttaaaataaatg

SEQ ID NO: 348134 - DNA, 20 bp, Artificial Sequence
  chemically synthesized
ttattttaaatgtatatatt

SEQ ID NO: 348135 - DNA, 20 bp, Artificial Sequence
  chemically synthesized
aatgtatatattcagtttct

SEQ ID NO: 348136 - DNA, 20 bp, Artificial Sequence
  chemically synthesized
atgaagccacaaatgttgct

SEQ ID NO: 348137 - DNA, 20 bp, Artificial Sequence
  chemically synthesized
cagtttcttagcaacatttg

SEQ ID NO: 348138 - DNA, 20 bp, Artificial Sequence
  chemically synthesized
tttttaatgattttttaatg

SEQ ID NO: 348139 - DNA, 20 bp, Artificial Sequence
  chemically synthesized
aaaaaatcattaaaaaacct

SEQ ID NO: 348140 - DNA, 20 bp, Artificial Sequence
  chemically synthesized
aattttccataaggttgcca

SEQ ID NO: 348141 - DNA, 20 bp, Artificial Sequence
  chemically synthesized
caattttccataaggttgcc

SEQ ID NO: 348142 - DNA, 20 bp, Artificial Sequence
  chemically synthesized
aaaaaaccttggcaacctta

SEQ ID NO: 348143 - DNA, 20 bp, Artificial Sequence
  chemically synthesized
ttgtcaaacaattttccata

SEQ ID NO: 348144 - DNA, 20 bp, Artificial Sequence
  chemically synthesized
attgtcaaacaattttccat

SEQ ID NO: 348145 - DNA, 20 bp, Artificial Sequence
  chemically synthesized
gaaaattgtttgacaatata

SEQ ID NO: 348146 - DNA, 20 bp, Artificial Sequence
  chemically synthesized
aattgtttgacaatatatag

SEQ ID NO: 348147 - DNA, 20 bp, Artificial Sequence
  chemically synthesized
ttgtttgacaatatatagta

SEQ ID NO: 348148 - DNA, 20 bp, Artificial Sequence
  chemically synthesized
atatatagtagagtttactt

SEQ ID NO: 348149 - DNA, 20 bp, Artificial Sequence
  chemically synthesized
tatatagtagagtttacttc

SEQ ID NO: 348150 - DNA, 20 bp, Artificial Sequence
  chemically synthesized
atatagtagagtttacttca

SEQ ID NO: 348151 - DNA, 20 bp, Artificial Sequence
  chemically synthesized
aatagaatataatagccctg

SEQ ID NO: 348152 - DNA, 20 bp, Artificial Sequence
  chemically synthesized
tgtagaacaatagaatataa

SEQ ID NO: 348153 - DNA, 20 bp, Artificial Sequence
  chemically synthesized
aaaaagggaatgtagaacaa

SEQ ID NO: 348154 - DNA, 20 bp, Artificial Sequence
  chemically synthesized
tggcttaaaaaaagggaatg

SEQ ID NO: 348155 - DNA, 20 bp, Artificial Sequence
  chemically synthesized
gttctacattcccttttttt

SEQ ID NO: 348156 - DNA, 20 bp, Artificial Sequence
  chemically synthesized
gtggtattggcttaaaaaaa

SEQ ID NO: 348157 - DNA, 20 bp, Artificial Sequence
  chemically synthesized
tgtggtattggcttaaaaaa

SEQ ID NO: 348158 - DNA, 20 bp, Artificial Sequence
  chemically synthesized
ctgtggtattggcttaaaaa

SEQ ID NO: 348159 - DNA, 20 bp, Artificial Sequence
  chemically synthesized
ctttttttaagccaatacca

SEQ ID NO: 348160 - DNA, 20 bp, Artificial Sequence
  chemically synthesized
taatcaaaacactgtggtat

SEQ ID NO: 348161 - DNA, 20 bp, Artificial Sequence
  chemically synthesized
ctaccataatcaaaacactg

SEQ ID NO: 348162 - DNA, 20 bp, Artificial Sequence
  chemically synthesized
ataccacagtgttttgatta

SEQ ID NO: 348163 - DNA, 20 bp, Artificial Sequence
  chemically synthesized
ccacagtgttttgattatgg

SEQ ID NO: 348164 - DNA, 20 bp, Artificial Sequence
  chemically synthesized
ttttgattatggtagctttg

SEQ ID NO: 348165 - DNA, 20 bp, Artificial Sequence
  chemically synthesized
gattatggtagctttgtagt

SEQ ID NO: 348166 - DNA, 20 bp, Artificial Sequence
  chemically synthesized
tgatttcaaaacttactaca

SEQ ID NO: 348167 - DNA, 20 bp, Artificial Sequence
  chemically synthesized
tttgtagtaagttttgaaat

SEQ ID NO: 348168 - DNA, 20 bp, Artificial Sequence
  chemically synthesized
ttgtagtaagttttgaaatc

SEQ ID NO: 348169 - DNA, 20 bp, Artificial Sequence
  chemically synthesized
gaaaaaagaatgaagttgaa

SEQ ID NO: 348170 - DNA, 20 bp, Artificial Sequence
  chemically synthesized
tgaaaaaagaatgaagttga

SEQ ID NO: 348171 - DNA, 20 bp, Artificial Sequence
  chemically synthesized
ttgaaaaaagaatgaagttg

SEQ ID NO: 348172 - DNA, 20 bp, Artificial Sequence
  chemically synthesized
acgatcttgaaaaaagaatg

SEQ ID NO: 348173 - DNA, 20 bp, Artificial Sequence
  chemically synthesized
ttcaacttcattcttttttc

SEQ ID NO: 348174 - DNA, 20 bp, Artificial Sequence
  chemically synthesized
agttgaaacgatcttgaaaa

SEQ ID NO: 348175 - DNA, 20 bp, Artificial Sequence
  chemically synthesized
aagatcgtttcaactattcc

SEQ ID NO: 348176 - DNA, 20 bp, Artificial Sequence
  chemically synthesized
taatctcatggatccaggaa

SEQ ID NO: 348177 - DNA, 20 bp, Artificial Sequence
  chemically synthesized
ccatgtaatctcatggatcc

SEQ ID NO: 348178 - DNA, 20 bp, Artificial Sequence
  chemically synthesized
tcaactattcctggatccat

SEQ ID NO: 348179 - DNA, 20 bp, Artificial Sequence
  chemically synthesized
cccatgtaatctcatggatc

SEQ ID NO: 348180 - DNA, 20 bp, Artificial Sequence
  chemically synthesized
aaaattcccatgtaatctca

SEQ ID NO: 348181 - DNA, 20 bp, Artificial Sequence
  chemically synthesized
cctggatccatgagattaca

SEQ ID NO: 348182 - DNA, 20 bp, Artificial Sequence
  chemically synthesized
ctggatccatgagattacat

SEQ ID NO: 348183 - DNA, 20 bp, Artificial Sequence
  chemically synthesized
gattacatgggaatttttga

SEQ ID NO: 348184 - DNA, 20 bp, Artificial Sequence
  chemically synthesized
ttacatgggaatttttgata

SEQ ID NO: 348185 - DNA, 20 bp, Artificial Sequence
  chemically synthesized
gatagagttgtctatttctg

SEQ ID NO: 348186 - DNA, 20 bp, Artificial Sequence
  chemically synthesized
aattagtttttctgcagaaa

SEQ ID NO: 348187 - DNA, 20 bp, Artificial Sequence
  chemically synthesized
aatcccaattagtttttctg

SEQ ID NO: 348188 - DNA, 20 bp, Artificial Sequence
  chemically synthesized
atttctgcagaaaaactaat

SEQ ID NO: 348189 - DNA, 20 bp, Artificial Sequence
  chemically synthesized
tttctgcagaaaaactaatt

SEQ ID NO: 348190 - DNA, 20 bp, Artificial Sequence
  chemically synthesized
atctctaagaaaatcccaat

SEQ ID NO: 348191 - DNA, 20 bp, Artificial Sequence
  chemically synthesized
aaaactaattgggattttct

SEQ ID NO: 348192 - DNA, 20 bp, Artificial Sequence
  chemically synthesized
aactaattgggattttctta

SEQ ID NO: 348193 - DNA, 20 bp, Artificial Sequence
  chemically synthesized
aattgggattttcttagaga

SEQ ID NO: 348194 - DNA, 20 bp, Artificial Sequence
  chemically synthesized
acacattcagtgccatctct

SEQ ID NO: 348195 - DNA, 20 bp, Artificial Sequence
  chemically synthesized
tagagatggcactgaatgtg

SEQ ID NO: 348196 - DNA, 20 bp, Artificial Sequence
  chemically synthesized
ctcaaaacaaactacacatt

SEQ ID NO: 348197 - DNA, 20 bp, Artificial Sequence
  chemically synthesized
ctgaatgtgtagtttgtttt

SEQ ID NO: 348198 - DNA, 20 bp, Artificial Sequence
  chemically synthesized
gtagtttgttttgagtaact

SEQ ID NO: 348199 - DNA, 20 bp, Artificial Sequence
  chemically synthesized
atattgttgttgaggtatcc

SEQ ID NO: 348200 - DNA, 20 bp, Artificial Sequence
  chemically synthesized
aacactcaatattgttgttg

SEQ ID NO: 348201 - DNA, 20 bp, Artificial Sequence
  chemically synthesized
gaacactcaatattgttgtt

SEQ ID NO: 348202 - DNA, 20 bp, Artificial Sequence
  chemically synthesized
gatacctcaacaacaatatt

SEQ ID NO: 348203 - DNA, 20 bp, Artificial Sequence
  chemically synthesized
ggaaccccaggtttatgaaa

SEQ ID NO: 348204 - DNA, 20 bp, Artificial Sequence
  chemically synthesized
agtgttccatttcataaacc

SEQ ID NO: 348205 - DNA, 20 bp, Artificial Sequence
  chemically synthesized
gtgttccatttcataaacct

SEQ ID NO: 348206 - DNA, 20 bp, Artificial Sequence
  chemically synthesized
tgttccatttcataaacctg

SEQ ID NO: 348207 - DNA, 20 bp, Artificial Sequence
  chemically synthesized
aataaatgaaaaggaacccc

SEQ ID NO: 348208 - DNA, 20 bp, Artificial Sequence
  chemically synthesized
aaataaatgaaaaggaaccc

SEQ ID NO: 348209 - DNA, 20 bp, Artificial Sequence
  chemically synthesized
atttttataaataaatgaaa

SEQ ID NO: 348210 - DNA, 20 bp, Artificial Sequence
  chemically synthesized
tatttttataaataaatgaa

SEQ ID NO: 348211 - DNA, 20 bp, Artificial Sequence
  chemically synthesized
aataaatgtttaatttcttt

SEQ ID NO: 348212 - DNA, 20 bp, Artificial Sequence
  chemically synthesized
ataaatgtttaatttctttc

SEQ ID NO: 348213 - DNA, 20 bp, Artificial Sequence
  chemically synthesized
caactacaaaacaatcctga

SEQ ID NO: 348214 - DNA, 20 bp, Artificial Sequence
  chemically synthesized
tttctttcaggattgttttg

SEQ ID NO: 348215 - DNA, 20 bp, Artificial Sequence
  chemically synthesized
caggattgttttgtagttgt

SEQ ID NO: 348216 - DNA, 20 bp, Artificial Sequence
  chemically synthesized
ttttgtagttgtcagtgtat

SEQ ID NO: 348217 - DNA, 20 bp, Artificial Sequence
  chemically synthesized
ggaattaaccaagaaggtgg

SEQ ID NO: 348218 - DNA, 20 bp, Artificial Sequence
  chemically synthesized
gtataagtcttccaccttct

SEQ ID NO: 348219 - DNA, 20 bp, Artificial Sequence
  chemically synthesized
ttaggaattaaccaagaagg

SEQ ID NO: 348220 - DNA, 20 bp, Artificial Sequence
  chemically synthesized
tacttaggaattaaccaaga

SEQ ID NO: 348221 - DNA, 20 bp, Artificial Sequence
  chemically synthesized
atacttaggaattaaccaag

SEQ ID NO: 348222 - DNA, 20 bp, Artificial Sequence
  chemically synthesized
aaaatacttaggaattaacc

SEQ ID NO: 348223 - DNA, 20 bp, Artificial Sequence
  chemically synthesized
caccttcttggttaattcct

SEQ ID NO: 348224 - DNA, 20 bp, Artificial Sequence
  chemically synthesized
acaaaaagagtaaaatactt

SEQ ID NO: 348225 - DNA, 20 bp, Artificial Sequence
  chemically synthesized
aacaaaaagagtaaaatact

SEQ ID NO: 348226 - DNA, 20 bp, Artificial Sequence
  chemically synthesized
atttaaaatagtaacaaaaa

SEQ ID NO: 348227 - DNA, 20 bp, Artificial Sequence
  chemically synthesized
ttatttaaaatagtaacaaa

SEQ ID NO: 348228 - DNA, 20 bp, Artificial Sequence
  chemically synthesized
ggaaacaattttatttaaaa

SEQ ID NO: 348229 - DNA, 20 bp, Artificial Sequence
  chemically synthesized
gcagtccaaaaaggagatta

SEQ ID NO: 348230 - DNA, 20 bp, Artificial Sequence
  chemically synthesized
tgcagtccaaaaaggagatt

SEQ ID NO: 348231 - DNA, 20 bp, Artificial Sequence
  chemically synthesized
tgtttccttaatctcctttt

SEQ ID NO: 348232 - DNA, 20 bp, Artificial Sequence
  chemically synthesized
cagtgatgcagtccaaaaag

SEQ ID NO: 348233 - DNA, 20 bp, Artificial Sequence
  chemically synthesized
aacagtgatgcagtccaaaa

SEQ ID NO: 348234 - DNA, 20 bp, Artificial Sequence
  chemically synthesized
taacagtgatgcagtccaaa

SEQ ID NO: 348235 - DNA, 20 bp, Artificial Sequence
  chemically synthesized
tttatgcactaacagtgatg

SEQ ID NO: 348236 - DNA, 20 bp, Artificial Sequence
  chemically synthesized
tttttggactgcatcactgt

SEQ ID NO: 348237 - DNA, 20 bp, Artificial Sequence
  chemically synthesized
agttatattttatgcactaa

SEQ ID NO: 348238 - DNA, 20 bp, Artificial Sequence
  chemically synthesized
taaaatcaatatacagaaat

SEQ ID NO: 348239 - DNA, 20 bp, Artificial Sequence
  chemically synthesized
cagtaaataaaatcaatata

SEQ ID NO: 348240 - DNA, 20 bp, Artificial Sequence
  chemically synthesized
taataaattaagcacaattg

SEQ ID NO: 348241 - DNA, 20 bp, Artificial Sequence
  chemically synthesized
tgcaattgtgcttaatttat

SEQ ID NO: 348242 - DNA, 20 bp, Artificial Sequence
  chemically synthesized
cctgctagaactaataaatt

SEQ ID NO: 348243 - DNA, 20 bp, Artificial Sequence
  chemically synthesized
tgtgcttaatttattagttc

SEQ ID NO: 348244 - DNA, 20 bp, Artificial Sequence
  chemically synthesized
gcttaatttattagttctag

SEQ ID NO: 348245 - DNA, 20 bp, Artificial Sequence
  chemically synthesized
cttaatttattagttctagc

SEQ ID NO: 348246 - DNA, 20 bp, Artificial Sequence
  chemically synthesized
tttccacacaaaaaacctgc

SEQ ID NO: 348247 - DNA, 20 bp, Artificial Sequence
  chemically synthesized
gttctagcaggttttttgtg

SEQ ID NO: 348248 - DNA, 20 bp, Artificial Sequence
  chemically synthesized
gttttttgtgtggaaatctc

SEQ ID NO: 348249 - DNA, 20 bp, Artificial Sequence
  chemically synthesized
cttatatgtagaaaattcta

SEQ ID NO: 348250 - DNA, 20 bp, Artificial Sequence
  chemically synthesized
atcttatatgtagaaaattc

SEQ ID NO: 348251 - DNA, 20 bp, Artificial Sequence
  chemically synthesized
ctctagaattttctacatat

SEQ ID NO: 348252 - DNA, 20 bp, Artificial Sequence
  chemically synthesized
agatgatatgatcttatatg

SEQ ID NO: 348253 - DNA, 20 bp, Artificial Sequence
  chemically synthesized
catataagatcatatcatct

SEQ ID NO: 348254 - DNA, 20 bp, Artificial Sequence
  chemically synthesized
ataagatcatatcatctgag

SEQ ID NO: 348255 - DNA, 20 bp, Artificial Sequence
  chemically synthesized
caaaaattttataagcttct

SEQ ID NO: 348256 - DNA, 20 bp, Artificial Sequence
  chemically synthesized
agtgtatgcaaaaattttat

SEQ ID NO: 348257 - DNA, 20 bp, Artificial Sequence
  chemically synthesized
tttttgcatacactctttca

SEQ ID NO: 348258 - DNA, 20 bp, Artificial Sequence
  chemically synthesized
cagaaaaatcagctttgaaa

SEQ ID NO: 348259 - DNA, 20 bp, Artificial Sequence
  chemically synthesized
atcagaaaaatcagctttga

SEQ ID NO: 348260 - DNA, 20 bp, Artificial Sequence
  chemically synthesized
caaattttcatcagaaaaat

SEQ ID NO: 348261 - DNA, 20 bp, Artificial Sequence
  chemically synthesized
aatgcatttcaaattttcat

SEQ ID NO: 348262 - DNA, 20 bp, Artificial Sequence
  chemically synthesized
aaaatttgaaatgcattgca

SEQ ID NO: 348263 - DNA, 20 bp, Artificial Sequence
  chemically synthesized
tgcattgcacagcatgaata

SEQ ID NO: 348264 - DNA, 20 bp, Artificial Sequence
  chemically synthesized
cacagcatgaatatagttaa

SEQ ID NO: 348265 - DNA, 20 bp, Artificial Sequence
  chemically synthesized
cagcatgaatatagttaata

SEQ ID NO: 348266 - DNA, 20 bp, Artificial Sequence
  chemically synthesized
atagagtattgctcatttcg

SEQ ID NO: 348267 - DNA, 20 bp, Artificial Sequence
  chemically synthesized
tctcttagcagcttcgaaat

SEQ ID NO: 348268 - DNA, 20 bp, Artificial Sequence
  chemically synthesized
ttgctcatttcgaagctgct

SEQ ID NO: 348269 - DNA, 20 bp, Artificial Sequence
  chemically synthesized
gctcatttcgaagctgctaa

SEQ ID NO: 348270 - DNA, 20 bp, Artificial Sequence
  chemically synthesized
tcatttcgaagctgctaaga

SEQ ID NO: 348271 - DNA, 20 bp, Artificial Sequence
  chemically synthesized
tttgaagtgtactctcttag

SEQ ID NO: 348272 - DNA, 20 bp, Artificial Sequence
  chemically synthesized
acatttgaagtgtactctct

SEQ ID NO: 348273 - DNA, 20 bp, Artificial Sequence
  chemically synthesized
ttttgtggagagaacatttg

SEQ ID NO: 348274 - DNA, 20 bp, Artificial Sequence
  chemically synthesized
ttcaaatgttctctccacaa

SEQ ID NO: 348275 - DNA, 20 bp, Artificial Sequence
  chemically synthesized
acctcaaagacttttgtgga

SEQ ID NO: 348276 - DNA, 20 bp, Artificial Sequence
  chemically synthesized
tcacctcaaagacttttgtg

SEQ ID NO: 348277 - DNA, 20 bp, Artificial Sequence
  chemically synthesized
tatcacctcaaagacttttg

SEQ ID NO: 348278 - DNA, 20 bp, Artificial Sequence
  chemically synthesized
ttctctccacaaaagtcttt

SEQ ID NO: 348279 - DNA, 20 bp, Artificial Sequence
  chemically synthesized
tctctccacaaaagtctttg

SEQ ID NO: 348280 - DNA, 20 bp, Artificial Sequence
  chemically synthesized
ttaacatatctatcacctca

SEQ ID NO: 348281 - DNA, 20 bp, Artificial Sequence
  chemically synthesized
cacaaaagtctttgaggtga

SEQ ID NO: 348282 - DNA, 20 bp, Artificial Sequence
  chemically synthesized
gaggtgatagatatgttaac

SEQ ID NO: 348283 - DNA, 20 bp, Artificial Sequence
  chemically synthesized
gtggagtaattaaatcaagc

SEQ ID NO: 348284 - DNA, 20 bp, Artificial Sequence
  chemically synthesized
caatgtggagtaattaaatc

SEQ ID NO: 348285 - DNA, 20 bp, Artificial Sequence
  chemically synthesized
gaatttatgaatacaatgtg

SEQ ID NO: 348286 - DNA, 20 bp, Artificial Sequence
  chemically synthesized
tagaatttatgaatacaatg

SEQ ID NO: 348287 - DNA, 20 bp, Artificial Sequence
  chemically synthesized
tatggcatacaaagtgatgg

SEQ ID NO: 348288 - DNA, 20 bp, Artificial Sequence
  chemically synthesized
atatatggcatacaaagtga

SEQ ID NO: 348289 - DNA, 20 bp, Artificial Sequence
  chemically synthesized
gtataaatatatggcataca

SEQ ID NO: 348290 - DNA, 20 bp, Artificial Sequence
  chemically synthesized
tatataattgtataaatata

SEQ ID NO: 348291 - DNA, 20 bp, Artificial Sequence
  chemically synthesized
tattgtcaatttacaataaa

SEQ ID NO: 348292 - DNA, 20 bp, Artificial Sequence
  chemically synthesized
ttgtcaatttacaataaaaa

SEQ ID NO: 348293 - DNA, 20 bp, Artificial Sequence
  chemically synthesized
tgtcaatttacaataaaaag

SEQ ID NO: 348294 - DNA, 20 bp, Artificial Sequence
  chemically synthesized
ataaaatttgcattctctta

SEQ ID NO: 348295 - DNA, 20 bp, Artificial Sequence
  chemically synthesized
gcaagcattaaagactttaa

SEQ ID NO: 348296 - DNA, 20 bp, Artificial Sequence
  chemically synthesized
tggcaagcattaaagacttt

SEQ ID NO: 348297 - DNA, 20 bp, Artificial Sequence
  chemically synthesized
aatggtgttggcaagcatta

SEQ ID NO: 348298 - DNA, 20 bp, Artificial Sequence
  chemically synthesized
atcagagaaatggtgttggc

SEQ ID NO: 348299 - DNA, 20 bp, Artificial Sequence
  chemically synthesized
ttgaatcagagaaatggtgt

SEQ ID NO: 348300 - DNA, 20 bp, Artificial Sequence
  chemically synthesized
cttgaattgaatcagagaaa

SEQ ID NO: 348301 - DNA, 20 bp, Artificial Sequence
  chemically synthesized
ggacagcttgaattgaatca

SEQ ID NO: 348302 - DNA, 20 bp, Artificial Sequence
  chemically synthesized
ttggacagcttgaattgaat

SEQ ID NO: 348303 - DNA, 20 bp, Artificial Sequence
  chemically synthesized
ccatttctctgattcaattc

SEQ ID NO: 348304 - DNA, 20 bp, Artificial Sequence
  chemically synthesized
tgtattaatgcggcattgga

SEQ ID NO: 348305 - DNA, 20 bp, Artificial Sequence
  chemically synthesized
ggtatgtattaatgcggcat

SEQ ID NO: 348306 - DNA, 20 bp, Artificial Sequence
  chemically synthesized
tttaatggtatgtattaatg

SEQ ID NO: 348307 - DNA, 20 bp, Artificial Sequence
  chemically synthesized
tgcggagtagttttgtttaa

SEQ ID NO: 348308 - DNA, 20 bp, Artificial Sequence
  chemically synthesized
actatgcctataatgcggag

SEQ ID NO: 348309 - DNA, 20 bp, Artificial Sequence
  chemically synthesized
aacaaaactactccgcatta

SEQ ID NO: 348310 - DNA, 20 bp, Artificial Sequence
  chemically synthesized
attactatgcctataatgcg

SEQ ID NO: 348311 - DNA, 20 bp, Artificial Sequence
  chemically synthesized
acaaaactactccgcattat

SEQ ID NO: 348312 - DNA, 20 bp, Artificial Sequence
  chemically synthesized
ctattactatgcctataatg

SEQ ID NO: 348313 - DNA, 20 bp, Artificial Sequence
  chemically synthesized
actactccgcattataggca

SEQ ID NO: 348314 - DNA, 20 bp, Artificial Sequence
  chemically synthesized
ccgcattataggcatagtaa

SEQ ID NO: 348315 - DNA, 20 bp, Artificial Sequence
  chemically synthesized
cgcattataggcatagtaat

SEQ ID NO: 348316 - DNA, 20 bp, Artificial Sequence
  chemically synthesized
gtaataggattacatttacc

SEQ ID NO: 348317 - DNA, 20 bp, Artificial Sequence
  chemically synthesized
gttgcttttggttggaagcc

SEQ ID NO: 348318 - DNA, 20 bp, Artificial Sequence
  chemically synthesized
tgttgcttttggttggaagc

SEQ ID NO: 348319 - DNA, 20 bp, Artificial Sequence
  chemically synthesized
gcggtgttgcttttggttgg

SEQ ID NO: 348320 - DNA, 20 bp, Artificial Sequence
  chemically synthesized
tttacctggcttccaaccaa

SEQ ID NO: 348321 - DNA, 20 bp, Artificial Sequence
  chemically synthesized
ttagcggtgttgcttttggt

SEQ ID NO: 348322 - DNA, 20 bp, Artificial Sequence
  chemically synthesized
aatgttagcggtgttgcttt

SEQ ID NO: 348323 - DNA, 20 bp, Artificial Sequence
  chemically synthesized
atattttattttaatgttag

SEQ ID NO: 348324 - DNA, 20 bp, Artificial Sequence
  chemically synthesized
agaatattttattttaatgt

SEQ ID NO: 348325 - DNA, 20 bp, Artificial Sequence
  chemically synthesized
tgaaattactaattcatgat

SEQ ID NO: 348326 - DNA, 20 bp, Artificial Sequence
  chemically synthesized
aaaatattctcatcatgaat

SEQ ID NO: 348327 - DNA, 20 bp, Artificial Sequence
  chemically synthesized
aattagtaatttcatattaa

SEQ ID NO: 348328 - DNA, 20 bp, Artificial Sequence
  chemically synthesized
tagtaatttcatattaacag

SEQ ID NO: 348329 - DNA, 20 bp, Artificial Sequence
  chemically synthesized
tttcatattaacagaagcta

SEQ ID NO: 348330 - DNA, 20 bp, Artificial Sequence
  chemically synthesized
ttcatattaacagaagctaa

SEQ ID NO: 348331 - DNA, 20 bp, Artificial Sequence
  chemically synthesized
caaaaaatactaggtgcctt

SEQ ID NO: 348332 - DNA, 20 bp, Artificial Sequence
  chemically synthesized
taacagaagctaaaggcacc

SEQ ID NO: 348333 - DNA, 20 bp, Artificial Sequence
  chemically synthesized
aatgagcctcaaaaaatact

SEQ ID NO: 348334 - DNA, 20 bp, Artificial Sequence
  chemically synthesized
aaatgagcctcaaaaaatac

SEQ ID NO: 348335 - DNA, 20 bp, Artificial Sequence
  chemically synthesized
aaaggcacctagtatttttt

SEQ ID NO: 348336 - DNA, 20 bp, Artificial Sequence
  chemically synthesized
aaggcacctagtattttttg

SEQ ID NO: 348337 - DNA, 20 bp, Artificial Sequence
  chemically synthesized
gtatatacccatatgcaaat

SEQ ID NO: 348338 - DNA, 20 bp, Artificial Sequence
  chemically synthesized
ttttgaggctcatttgcata

SEQ ID NO: 348339 - DNA, 20 bp, Artificial Sequence
  chemically synthesized
tttgaggctcatttgcatat

SEQ ID NO: 348340 - DNA, 20 bp, Artificial Sequence
  chemically synthesized
tttgcatatgggtatatact

SEQ ID NO: 348341 - DNA, 20 bp, Artificial Sequence
  chemically synthesized
cttttttggaaaagaaatct

SEQ ID NO: 348342 - DNA, 20 bp, Artificial Sequence
  chemically synthesized
aaatggctacttttttggaa

SEQ ID NO: 348343 - DNA, 20 bp, Artificial Sequence
  chemically synthesized
ctcagatttcttttccaaaa

SEQ ID NO: 348344 - DNA, 20 bp, Artificial Sequence
  chemically synthesized
agatttcttttccaaaaaag

SEQ ID NO: 348345 - DNA, 20 bp, Artificial Sequence
  chemically synthesized
cctttaaatggctacttttt

SEQ ID NO: 348346 - DNA, 20 bp, Artificial Sequence
  chemically synthesized
tccaaaaaagtagccattta

SEQ ID NO: 348347 - DNA, 20 bp, Artificial Sequence
  chemically synthesized
ccaaaaaagtagccatttaa

SEQ ID NO: 348348 - DNA, 20 bp, Artificial Sequence
  chemically synthesized
caaaaaagtagccatttaaa

SEQ ID NO: 348349 - DNA, 20 bp, Artificial Sequence
  chemically synthesized
acaccagggttccctttaaa

SEQ ID NO: 348350 - DNA, 20 bp, Artificial Sequence
  chemically synthesized
tagccatttaaagggaaccc

SEQ ID NO: 348351 - DNA, 20 bp, Artificial Sequence
  chemically synthesized
gttttctaaattttacacca

SEQ ID NO: 348352 - DNA, 20 bp, Artificial Sequence
  chemically synthesized
tgttttctaaattttacacc

SEQ ID NO: 348353 - DNA, 20 bp, Artificial Sequence
  chemically synthesized
ctgttttctaaattttacac

SEQ ID NO: 348354 - DNA, 20 bp, Artificial Sequence
  chemically synthesized
gggaaccctggtgtaaaatt

SEQ ID NO: 348355 - DNA, 20 bp, Artificial Sequence
  chemically synthesized
ctggtgtaaaatttagaaaa

SEQ ID NO: 348356 - DNA, 20 bp, Artificial Sequence
  chemically synthesized
taaaatttagaaaacagatg

SEQ ID NO: 348357 - DNA, 20 bp, Artificial Sequence
  chemically synthesized
aaatcataaaatatccaaat

SEQ ID NO: 348358 - DNA, 20 bp, Artificial Sequence
  chemically synthesized
aaattttgtaaaaacttatt

SEQ ID NO: 348359 - DNA, 20 bp, Artificial Sequence
  chemically synthesized
aaatataaaggaaatagcat

SEQ ID NO: 348360 - DNA, 20 bp, Artificial Sequence
  chemically synthesized
aaaatataaaggaaatagca

SEQ ID NO: 348361 - DNA, 20 bp, Artificial Sequence
  chemically synthesized
taaagaaaatataaaggaaa

SEQ ID NO: 348362 - DNA, 20 bp, Artificial Sequence
  chemically synthesized
atggactaaagaaaatataa

SEQ ID NO: 348363 - DNA, 20 bp, Artificial Sequence
  chemically synthesized
gatggactaaagaaaatata

SEQ ID NO: 348364 - DNA, 20 bp, Artificial Sequence
  chemically synthesized
tatttcctttatattttctt

SEQ ID NO: 348365 - DNA, 20 bp, Artificial Sequence
  chemically synthesized
tcataaatggagatggacta

SEQ ID NO: 348366 - DNA, 20 bp, Artificial Sequence
  chemically synthesized
gaataattcataaatggaga

SEQ ID NO: 348367 - DNA, 20 bp, Artificial Sequence
  chemically synthesized
tcctgaataattcataaatg

SEQ ID NO: 348368 - DNA, 20 bp, Artificial Sequence
  chemically synthesized
tttcctgaataattcataaa

SEQ ID NO: 348369 - DNA, 20 bp, Artificial Sequence
  chemically synthesized
atctccatttatgaattatt

SEQ ID NO: 348370 - DNA, 20 bp, Artificial Sequence
  chemically synthesized
tctccatttatgaattattc

SEQ ID NO: 348371 - DNA, 20 bp, Artificial Sequence
  chemically synthesized
taacacggaaaatcattttg

SEQ ID NO: 348372 - DNA, 20 bp, Artificial Sequence
  chemically synthesized
ataacacggaaaatcatttt

SEQ ID NO: 348373 - DNA, 20 bp, Artificial Sequence
  chemically synthesized
tataacacggaaaatcattt

SEQ ID NO: 348374 - DNA, 20 bp, Artificial Sequence
  chemically synthesized
caaaatgattttccgtgtta

SEQ ID NO: 348375 - DNA, 20 bp, Artificial Sequence
  chemically synthesized
gagtatgatcttctataaca

SEQ ID NO: 348376 - DNA, 20 bp, Artificial Sequence
  chemically synthesized
aatgattttccgtgttatag

SEQ ID NO: 348377 - DNA, 20 bp, Artificial Sequence
  chemically synthesized
aagctttttggtcaattttg

SEQ ID NO: 348378 - DNA, 20 bp, Artificial Sequence
  chemically synthesized
tgaagctttttggtcaattt

SEQ ID NO: 348379 - DNA, 20 bp, Artificial Sequence
  chemically synthesized
atactccaaaattgaccaaa

SEQ ID NO: 348380 - DNA, 20 bp, Artificial Sequence
  chemically synthesized
tcttaacaaatgaagctttt

SEQ ID NO: 348381 - DNA, 20 bp, Artificial Sequence
  chemically synthesized
acttacagtcttaacaaatg

SEQ ID NO: 348382 - DNA, 20 bp, Artificial Sequence
  chemically synthesized
accaaaaagcttcatttgtt

SEQ ID NO: 348383 - DNA, 20 bp, Artificial Sequence
  chemically synthesized
gcttcatttgttaagactgt

SEQ ID NO: 348384 - DNA, 20 bp, Artificial Sequence
  chemically synthesized
aatggcacatatagaactta

SEQ ID NO: 348385 - DNA, 20 bp, Artificial Sequence
  chemically synthesized
agtatgtttaatggcacata

SEQ ID NO: 348386 - DNA, 20 bp, Artificial Sequence
  chemically synthesized
gaaaaagtaagtatgtttaa

SEQ ID NO: 348387 - DNA, 20 bp, Artificial Sequence
  chemically synthesized
actataagtctagaaaaagt

SEQ ID NO: 348388 - DNA, 20 bp, Artificial Sequence
  chemically synthesized
ttaaacatacttactttttc

SEQ ID NO: 348389 - DNA, 20 bp, Artificial Sequence
  chemically synthesized
tgggactataagtctagaaa

SEQ ID NO: 348390 - DNA, 20 bp, Artificial Sequence
  chemically synthesized
acttactttttctagactta

SEQ ID NO: 348391 - DNA, 20 bp, Artificial Sequence
  chemically synthesized
cagaattgggactataagtc

SEQ ID NO: 348392 - DNA, 20 bp, Artificial Sequence
  chemically synthesized
aacgtcagaattgggactat

SEQ ID NO: 348393 - DNA, 20 bp, Artificial Sequence
  chemically synthesized
tggatataaacgtcagaatt

SEQ ID NO: 348394 - DNA, 20 bp, Artificial Sequence
  chemically synthesized
ttggatataaacgtcagaat

SEQ ID NO: 348395 - DNA, 20 bp, Artificial Sequence
  chemically synthesized
tctaaattggatataaacgt

SEQ ID NO: 348396 - DNA, 20 bp, Artificial Sequence
  chemically synthesized
tctgacgtttatatccaatt

SEQ ID NO: 348397 - DNA, 20 bp, Artificial Sequence
  chemically synthesized
tgacgtttatatccaattta

SEQ ID NO: 348398 - DNA, 20 bp, Artificial Sequence
  chemically synthesized
aatagtctgacactctaaat

SEQ ID NO: 348399 - DNA, 20 bp, Artificial Sequence
  chemically synthesized
ttatatccaatttagagtgt

SEQ ID NO: 348400 - DNA, 20 bp, Artificial Sequence
  chemically synthesized
aaaatagaggagagaagaaa

SEQ ID NO: 348401 - DNA, 20 bp, Artificial Sequence
  chemically synthesized
gcctctaaaatagaggagag

SEQ ID NO: 348402 - DNA, 20 bp, Artificial Sequence
  chemically synthesized
actgcctctaaaatagagga

SEQ ID NO: 348403 - DNA, 20 bp, Artificial Sequence
  chemically synthesized
agactgcctctaaaatagag

SEQ ID NO: 348404 - DNA, 20 bp, Artificial Sequence
  chemically synthesized
atttcttctctcctctattt

SEQ ID NO: 348405 - DNA, 20 bp, Artificial Sequence
  chemically synthesized
tcagactgcctctaaaatag

SEQ ID NO: 348406 - DNA, 20 bp, Artificial Sequence
  chemically synthesized
ttcttctctcctctatttta

SEQ ID NO: 348407 - DNA, 20 bp, Artificial Sequence
  chemically synthesized
ttcagactgcctctaaaata

SEQ ID NO: 348408 - DNA, 20 bp, Artificial Sequence
  chemically synthesized
tcttctctcctctattttag

SEQ ID NO: 348409 - DNA, 20 bp, Artificial Sequence
  chemically synthesized
acttcagactgcctctaaaa

SEQ ID NO: 348410 - DNA, 20 bp, Artificial Sequence
  chemically synthesized
tctctcctctattttagagg

SEQ ID NO: 348411 - DNA, 20 bp, Artificial Sequence
  chemically synthesized
tctattttagaggcagtctg

SEQ ID NO: 348412 - DNA, 20 bp, Artificial Sequence
  chemically synthesized
attttcttgttgaaagactt

SEQ ID NO: 348413 - DNA, 20 bp, Artificial Sequence
  chemically synthesized
gcagtctgaagtctttcaac

SEQ ID NO: 348414 - DNA, 20 bp, Artificial Sequence
  chemically synthesized
ttacaaaattttcttgttga

SEQ ID NO: 348415 - DNA, 20 bp, Artificial Sequence
  chemically synthesized
caacaagaaaattttgtaat

SEQ ID NO: 348416 - DNA, 20 bp, Artificial Sequence
  chemically synthesized
aacaagaaaattttgtaatg

SEQ ID NO: 348417 - DNA, 20 bp, Artificial Sequence
  chemically synthesized
aagaaaattttgtaatgagg

SEQ ID NO: 348418 - DNA, 20 bp, Artificial Sequence
  chemically synthesized
agaaaattttgtaatgaggt

SEQ ID NO: 348419 - DNA, 20 bp, Artificial Sequence
  chemically synthesized
gaggtgggtttttttccact

SEQ ID NO: 348420 - DNA, 20 bp, Artificial Sequence
  chemically synthesized
gttcctgatcaaacactaag

SEQ ID NO: 348421 - DNA, 20 bp, Artificial Sequence
  chemically synthesized
tttgttcctgatcaaacact

SEQ ID NO: 348422 - DNA, 20 bp, Artificial Sequence
  chemically synthesized
ttttccacttagtgtttgat

SEQ ID NO: 348423 - DNA, 20 bp, Artificial Sequence
  chemically synthesized
tttccacttagtgtttgatc

SEQ ID NO: 348424 - DNA, 20 bp, Artificial Sequence
  chemically synthesized
ttagtgtttgatcaggaaca

SEQ ID NO: 348425 - DNA, 20 bp, Artificial Sequence
  chemically synthesized
gaacaaagcatctaattact

SEQ ID NO: 348426 - DNA, 20 bp, Artificial Sequence
  chemically synthesized
gaaaatgggctccaagtaat

SEQ ID NO: 348427 - DNA, 20 bp, Artificial Sequence
  chemically synthesized
acaaagcatctaattacttg

SEQ ID NO: 348428 - DNA, 20 bp, Artificial Sequence
  chemically synthesized
cagatgagaaaatgggctcc

SEQ ID NO: 348429 - DNA, 20 bp, Artificial Sequence
  chemically synthesized
aatattccagatgagaaaat

SEQ ID NO: 348430 - DNA, 20 bp, Artificial Sequence
  chemically synthesized
taatattccagatgagaaaa

SEQ ID NO: 348431 - DNA, 20 bp, Artificial Sequence
  chemically synthesized
ttggagcccattttctcatc

SEQ ID NO: 348432 - DNA, 20 bp, Artificial Sequence
  chemically synthesized
attagcttaatattccagat

SEQ ID NO: 348433 - DNA, 20 bp, Artificial Sequence
  chemically synthesized
attttctcatctggaatatt

SEQ ID NO: 348434 - DNA, 20 bp, Artificial Sequence
  chemically synthesized
atagcattagcttaatattc

SEQ ID NO: 348435 - DNA, 20 bp, Artificial Sequence
  chemically synthesized
tcctattgacaaaatagcat

SEQ ID NO: 348436 - DNA, 20 bp, Artificial Sequence
  chemically synthesized
caaaaatcctattgacaaaa

SEQ ID NO: 348437 - DNA, 20 bp, Artificial Sequence
  chemically synthesized
agctaatgctattttgtcaa

SEQ ID NO: 348438 - DNA, 20 bp, Artificial Sequence
  chemically synthesized
gctaatgctattttgtcaat

SEQ ID NO: 348439 - DNA, 20 bp, Artificial Sequence
  chemically synthesized
tttgtcaataggatttttgt

SEQ ID NO: 348440 - DNA, 20 bp, Artificial Sequence
  chemically synthesized
ttgtcaataggatttttgta

SEQ ID NO: 348441 - DNA, 20 bp, Artificial Sequence
  chemically synthesized
atttttgtaaggattataac

SEQ ID NO: 348442 - DNA, 20 bp, Artificial Sequence
  chemically synthesized
ttgcataatgttttatagac

SEQ ID NO: 348443 - DNA, 20 bp, Artificial Sequence
  chemically synthesized
aatacttgcataatgtttta

SEQ ID NO: 348444 - DNA, 20 bp, Artificial Sequence
  chemically synthesized
tagtctataaaacattatgc

SEQ ID NO: 348445 - DNA, 20 bp, Artificial Sequence
  chemically synthesized
gtatttgattctactgtcac

SEQ ID NO: 348446 - DNA, 20 bp, Artificial Sequence
  chemically synthesized
agcatcggttcttgtgacag

SEQ ID NO: 348447 - DNA, 20 bp, Artificial Sequence
  chemically synthesized
gaaagcatcggttcttgtga

SEQ ID NO: 348448 - DNA, 20 bp, Artificial Sequence
  chemically synthesized
taatgtatttttgaaagcat

SEQ ID NO: 348449 - DNA, 20 bp, Artificial Sequence
  chemically synthesized
ctgaattaatgtatttttga

SEQ ID NO: 348450 - DNA, 20 bp, Artificial Sequence
  chemically synthesized
ctttcaaaaatacattaatt

SEQ ID NO: 348451 - DNA, 20 bp, Artificial Sequence
  chemically synthesized
tatatatctaattggtgttg

SEQ ID NO: 348452 - DNA, 20 bp, Artificial Sequence
  chemically synthesized
ttatatatctaattggtgtt

SEQ ID NO: 348453 - DNA, 20 bp, Artificial Sequence
  chemically synthesized
attcagacctcaacaccaat

SEQ ID NO: 348454 - DNA, 20 bp, Artificial Sequence
  chemically synthesized
taaatgcttatatatctaat

SEQ ID NO: 348455 - DNA, 20 bp, Artificial Sequence
  chemically synthesized
tcaacaccaattagatatat

SEQ ID NO: 348456 - DNA, 20 bp, Artificial Sequence
  chemically synthesized
tatatatatagatgagcatc

SEQ ID NO: 348457 - DNA, 20 bp, Artificial Sequence
  chemically synthesized
gtatatatatagatgagcat

SEQ ID NO: 348458 - DNA, 20 bp, Artificial Sequence
  chemically synthesized
gggtgtgtatatatatagat

SEQ ID NO: 348459 - DNA, 20 bp, Artificial Sequence
  chemically synthesized
tagtagggtgtgtatatata

SEQ ID NO: 348460 - DNA, 20 bp, Artificial Sequence
  chemically synthesized
agatttacagacacatagta

SEQ ID NO: 348461 - DNA, 20 bp, Artificial Sequence
  chemically synthesized
gagatttacagacacatagt

SEQ ID NO: 348462 - DNA, 20 bp, Artificial Sequence
  chemically synthesized
agagatttacagacacatag

SEQ ID NO: 348463 - DNA, 20 bp, Artificial Sequence
  chemically synthesized
aacagagatttacagacaca

SEQ ID NO: 348464 - DNA, 20 bp, Artificial Sequence
  chemically synthesized
ttctcccaaacagagattta

SEQ ID NO: 348465 - DNA, 20 bp, Artificial Sequence
  chemically synthesized
tgtgtctgtaaatctctgtt

SEQ ID NO: 348466 - DNA, 20 bp, Artificial Sequence
  chemically synthesized
gtgtctgtaaatctctgttt

SEQ ID NO: 348467 - DNA, 20 bp, Artificial Sequence
  chemically synthesized
gtctgtaaatctctgtttgg

SEQ ID NO: 348468 - DNA, 20 bp, Artificial Sequence
  chemically synthesized
ttgcacctttctcccaaaca

SEQ ID NO: 348469 - DNA, 20 bp, Artificial Sequence
  chemically synthesized
tattgcacctttctcccaaa

SEQ ID NO: 348470 - DNA, 20 bp, Artificial Sequence
  chemically synthesized
gtaaatctctgtttgggaga

SEQ ID NO: 348471 - DNA, 20 bp, Artificial Sequence
  chemically synthesized
taaatctctgtttgggagaa

SEQ ID NO: 348472 - DNA, 20 bp, Artificial Sequence
  chemically synthesized
aggtgcaatacaccatgcta

SEQ ID NO: 348473 - DNA, 20 bp, Artificial Sequence
  chemically synthesized
aaataattgattctttagca

SEQ ID NO: 348474 - DNA, 20 bp, Artificial Sequence
  chemically synthesized
tatgaaaataattgattctt

SEQ ID NO: 348475 - DNA, 20 bp, Artificial Sequence
  chemically synthesized
aagaatcaattattttcata

SEQ ID NO: 348476 - DNA, 20 bp, Artificial Sequence
  chemically synthesized
agaatcaattattttcataa

SEQ ID NO: 348477 - DNA, 20 bp, Artificial Sequence
  chemically synthesized
tatatctcttatcaatagtt

SEQ ID NO: 348478 - DNA, 20 bp, Artificial Sequence
  chemically synthesized
ataaaggcttaactattgat

SEQ ID NO: 348479 - DNA, 20 bp, Artificial Sequence
  chemically synthesized
aaaggcttaactattgataa

SEQ ID NO: 348480 - DNA, 20 bp, Artificial Sequence
  chemically synthesized
atatctatatctcttatcaa

SEQ ID NO: 348481 - DNA, 20 bp, Artificial Sequence
  chemically synthesized
ttaactattgataagagata

SEQ ID NO: 348482 - DNA, 20 bp, Artificial Sequence
  chemically synthesized
agagatatagatataacatt

SEQ ID NO: 348483 - DNA, 20 bp, Artificial Sequence
  chemically synthesized
atataacattgagtgtttca

SEQ ID NO: 348484 - DNA, 20 bp, Artificial Sequence
  chemically synthesized
tataacattgagtgtttcac

SEQ ID NO: 348485 - DNA, 20 bp, Artificial Sequence
  chemically synthesized
taacattgagtgtttcacag

SEQ ID NO: 348486 - DNA, 20 bp, Artificial Sequence
  chemically synthesized
acattgctggaaattgaata

SEQ ID NO: 348487 - DNA, 20 bp, Artificial Sequence
  chemically synthesized
acataactttattcaatttc

SEQ ID NO: 348488 - DNA, 20 bp, Artificial Sequence
  chemically synthesized
atttttagttgaaacattgc

SEQ ID NO: 348489 - DNA, 20 bp, Artificial Sequence
  chemically synthesized
tgactttgacagaatatttt

SEQ ID NO: 348490 - DNA, 20 bp, Artificial Sequence
  chemically synthesized
caactaaaaatattctgtca

SEQ ID NO: 348491 - DNA, 20 bp, Artificial Sequence
  chemically synthesized
attatgtaaattgactttga

SEQ ID NO: 348492 - DNA, 20 bp, Artificial Sequence
  chemically synthesized
gtcaaagtcaatttacataa

SEQ ID NO: 348493 - DNA, 20 bp, Artificial Sequence
  chemically synthesized
aagtcaatttacataatggt

SEQ ID NO: 348494 - DNA, 20 bp, Artificial Sequence
  chemically synthesized
tttacataatggtgagatta

SEQ ID NO: 348495 - DNA, 20 bp, Artificial Sequence
  chemically synthesized
ggtgagattaaagtaaaact

SEQ ID NO: 348496 - DNA, 20 bp, Artificial Sequence
  chemically synthesized
tggtatccactgacgtttct

SEQ ID NO: 348497 - DNA, 20 bp, Artificial Sequence
  chemically synthesized
aaagtaaaactaagaaacgt

SEQ ID NO: 348498 - DNA, 20 bp, Artificial Sequence
  chemically synthesized
gtaaaactaagaaacgtcag

SEQ ID NO: 348499 - DNA, 20 bp, Artificial Sequence
  chemically synthesized
taagaaacgtcagtggatac

SEQ ID NO: 348500 - DNA, 20 bp, Artificial Sequence
  chemically synthesized
gaaacgtcagtggataccag

SEQ ID NO: 348501 - DNA, 20 bp, Artificial Sequence
  chemically synthesized
aataaactgtcatattctac

SEQ ID NO: 348502 - DNA, 20 bp, Artificial Sequence
  chemically synthesized
tggataccagtagaatatga

SEQ ID NO: 348503 - DNA, 20 bp, Artificial Sequence
  chemically synthesized
attttatttataacacacaa

SEQ ID NO: 348504 - DNA, 20 bp, Artificial Sequence
  chemically synthesized
agtagacagtgtttgcaaga

SEQ ID NO: 348505 - DNA, 20 bp, Artificial Sequence
  chemically synthesized
ccatagtagacagtgtttgc

SEQ ID NO: 348506 - DNA, 20 bp, Artificial Sequence
  chemically synthesized
cttgcaaacactgtctacta

SEQ ID NO: 348507 - DNA, 20 bp, Artificial Sequence
  chemically synthesized
ttagtgtctgccatagtaga

SEQ ID NO: 348508 - DNA, 20 bp, Artificial Sequence
  chemically synthesized
gcaaacactgtctactatgg

SEQ ID NO: 348509 - DNA, 20 bp, Artificial Sequence
  chemically synthesized
tttcttagtgtctgccatag

SEQ ID NO: 348510 - DNA, 20 bp, Artificial Sequence
  chemically synthesized
agttttcttagtgtctgcca

SEQ ID NO: 348511 - DNA, 20 bp, Artificial Sequence
  chemically synthesized
tgtctactatggcagacact

SEQ ID NO: 348512 - DNA, 20 bp, Artificial Sequence
  chemically synthesized
tgttattaaataagttttct

SEQ ID NO: 348513 - DNA, 20 bp, Artificial Sequence
  chemically synthesized
tttcagtcttgttattaaat

SEQ ID NO: 348514 - DNA, 20 bp, Artificial Sequence
  chemically synthesized
aagaaaacttatttaataac

SEQ ID NO: 348515 - DNA, 20 bp, Artificial Sequence
  chemically synthesized
tttaataacaagactgaaat

SEQ ID NO: 348516 - DNA, 20 bp, Artificial Sequence
  chemically synthesized
atctgacggaaatctaattt

SEQ ID NO: 348517 - DNA, 20 bp, Artificial Sequence
  chemically synthesized
gactgaaattagatttccgt

SEQ ID NO: 348518 - DNA, 20 bp, Artificial Sequence
  chemically synthesized
attctaaagacagcatctga

SEQ ID NO: 348519 - DNA, 20 bp, Artificial Sequence
  chemically synthesized
tttccgtcagatgctgtctt

SEQ ID NO: 348520 - DNA, 20 bp, Artificial Sequence
  chemically synthesized
tattccccaaattctaaaga

SEQ ID NO: 348521 - DNA, 20 bp, Artificial Sequence
  chemically synthesized
cagatgctgtctttagaatt

SEQ ID NO: 348522 - DNA, 20 bp, Artificial Sequence
  chemically synthesized
gctctattccccaaattcta

SEQ ID NO: 348523 - DNA, 20 bp, Artificial Sequence
  chemically synthesized
agatgctgtctttagaattt

SEQ ID NO: 348524 - DNA, 20 bp, Artificial Sequence
  chemically synthesized
gatgctgtctttagaatttg

SEQ ID NO: 348525 - DNA, 20 bp, Artificial Sequence
  chemically synthesized
tgtctttagaatttggggaa

SEQ ID NO: 348526 - DNA, 20 bp, Artificial Sequence
  chemically synthesized
tctttagaatttggggaata

SEQ ID NO: 348527 - DNA, 20 bp, Artificial Sequence
  chemically synthesized
gaaacacatccagggatgaa

SEQ ID NO: 348528 - DNA, 20 bp, Artificial Sequence
  chemically synthesized
ggaatagagctattcatccc

SEQ ID NO: 348529 - DNA, 20 bp, Artificial Sequence
  chemically synthesized
atctccaagaaacacatcca

SEQ ID NO: 348530 - DNA, 20 bp, Artificial Sequence
  chemically synthesized
catctccaagaaacacatcc

SEQ ID NO: 348531 - DNA, 20 bp, Artificial Sequence
  chemically synthesized
acatctccaagaaacacatc

SEQ ID NO: 348532 - DNA, 20 bp, Artificial Sequence
  chemically synthesized
tcatccctggatgtgtttct

SEQ ID NO: 348533 - DNA, 20 bp, Artificial Sequence
  chemically synthesized
atccctggatgtgtttcttg

SEQ ID NO: 348534 - DNA, 20 bp, Artificial Sequence
  chemically synthesized
tacgatattgacacatctcc

SEQ ID NO: 348535 - DNA, 20 bp, Artificial Sequence
  chemically synthesized
cagaaatatctaacggtata

SEQ ID NO: 348536 - DNA, 20 bp, Artificial Sequence
  chemically synthesized
acaaaattgctttataccgt

SEQ ID NO: 348537 - DNA, 20 bp, Artificial Sequence
  chemically synthesized
attgtatcagaaatatctaa

SEQ ID NO: 348538 - DNA, 20 bp, Artificial Sequence
  chemically synthesized
cgagtgggcaaagattgtat

SEQ ID NO: 348539 - DNA, 20 bp, Artificial Sequence
  chemically synthesized
atgaaacccacgagtgggca

SEQ ID NO: 348540 - DNA, 20 bp, Artificial Sequence
  chemically synthesized
atacaatctttgcccactcg

SEQ ID NO: 348541 - DNA, 20 bp, Artificial Sequence
  chemically synthesized
tacaatctttgcccactcgt

SEQ ID NO: 348542 - DNA, 20 bp, Artificial Sequence
  chemically synthesized
gctttatgaaacccacgagt

SEQ ID NO: 348543 - DNA, 20 bp, Artificial Sequence
  chemically synthesized
agctttatgaaacccacgag

SEQ ID NO: 348544 - DNA, 20 bp, Artificial Sequence
  chemically synthesized
caaagctttatgaaacccac

SEQ ID NO: 348545 - DNA, 20 bp, Artificial Sequence
  chemically synthesized
gcccactcgtgggtttcata

SEQ ID NO: 348546 - DNA, 20 bp, Artificial Sequence
  chemically synthesized
ttggtgacaaaattggcaca

SEQ ID NO: 348547 - DNA, 20 bp, Artificial Sequence
  chemically synthesized
acttgtcttggtgacaaaat

SEQ ID NO: 348548 - DNA, 20 bp, Artificial Sequence
  chemically synthesized
tttgtgccaattttgtcacc

SEQ ID NO: 348549 - DNA, 20 bp, Artificial Sequence
  chemically synthesized
gccaattttgtcaccaagac

SEQ ID NO: 348550 - DNA, 20 bp, Artificial Sequence
  chemically synthesized
tagatcagatacacttgtct

SEQ ID NO: 348551 - DNA, 20 bp, Artificial Sequence
  chemically synthesized
gtgttcaatttgtgttagat

SEQ ID NO: 348552 - DNA, 20 bp, Artificial Sequence
  chemically synthesized
gaaaagtgttcaatttgtgt

SEQ ID NO: 348553 - DNA, 20 bp, Artificial Sequence
  chemically synthesized
aacacaaattgaacactttt

SEQ ID NO: 348554 - DNA, 20 bp, Artificial Sequence
  chemically synthesized
aaattgaacacttttcagca

SEQ ID NO: 348555 - DNA, 20 bp, Artificial Sequence
  chemically synthesized
atacacaatgctttgctgaa

SEQ ID NO: 348556 - DNA, 20 bp, Artificial Sequence
  chemically synthesized
cccttcatgacatatgaatg

SEQ ID NO: 348557 - DNA, 20 bp, Artificial Sequence
  chemically synthesized
tcccttcatgacatatgaat

SEQ ID NO: 348558 - DNA, 20 bp, Artificial Sequence
  chemically synthesized
ttcccttcatgacatatgaa

SEQ ID NO: 348559 - DNA, 20 bp, Artificial Sequence
  chemically synthesized
ttccccattcatatgtcatg

SEQ ID NO: 348560 - DNA, 20 bp, Artificial Sequence
  chemically synthesized
tccccattcatatgtcatga

SEQ ID NO: 348561 - DNA, 20 bp, Artificial Sequence
  chemically synthesized
ccccattcatatgtcatgaa

SEQ ID NO: 348562 - DNA, 20 bp, Artificial Sequence
  chemically synthesized
tcatatgtcatgaagggaac

SEQ ID NO: 348563 - DNA, 20 bp, Artificial Sequence
  chemically synthesized
tgtcatgaagggaaccagca

SEQ ID NO: 348564 - DNA, 20 bp, Artificial Sequence
  chemically synthesized
atttattgtggtaaccatgc

SEQ ID NO: 348565 - DNA, 20 bp, Artificial Sequence
  chemically synthesized
tgatttaaataaatttattg

SEQ ID NO: 348566 - DNA, 20 bp, Artificial Sequence
  chemically synthesized
aaatcaacaaaattcaatgt

SEQ ID NO: 348567 - DNA, 20 bp, Artificial Sequence
  chemically synthesized
gaatgtatcatttttttcta

SEQ ID NO: 348568 - DNA, 20 bp, Artificial Sequence
  chemically synthesized
atggaaccttaagtatacca

SEQ ID NO: 348569 - DNA, 20 bp, Artificial Sequence
  chemically synthesized
tttttttctatggtatactt

SEQ ID NO: 348570 - DNA, 20 bp, Artificial Sequence
  chemically synthesized
ttttttctatggtatactta

SEQ ID NO: 348571 - DNA, 20 bp, Artificial Sequence
  chemically synthesized
agtaaatttaatggaacctt

SEQ ID NO: 348572 - DNA, 20 bp, Artificial Sequence
  chemically synthesized
aggaatgtcagtaaatttaa

SEQ ID NO: 348573 - DNA, 20 bp, Artificial Sequence
  chemically synthesized
tttctaaaatgaaggaatgt

SEQ ID NO: 348574 - DNA, 20 bp, Artificial Sequence
  chemically synthesized
ttactgacattccttcattt

SEQ ID NO: 348575 - DNA, 20 bp, Artificial Sequence
  chemically synthesized
gattataatttctaaaatga

SEQ ID NO: 348576 - DNA, 20 bp, Artificial Sequence
  chemically synthesized
ggattataatttctaaaatg

SEQ ID NO: 348577 - DNA, 20 bp, Artificial Sequence
  chemically synthesized
tttagaaattataatcccac

SEQ ID NO: 348578 - DNA, 20 bp, Artificial Sequence
  chemically synthesized
ttagaaattataatcccact

SEQ ID NO: 348579 - DNA, 20 bp, Artificial Sequence
  chemically synthesized
aagaaaatcgtggtcccagt

SEQ ID NO: 348580 - DNA, 20 bp, Artificial Sequence
  chemically synthesized
taagaaaatcgtggtcccag

SEQ ID NO: 348581 - DNA, 20 bp, Artificial Sequence
  chemically synthesized
tgttaagaaaatcgtggtcc

SEQ ID NO: 348582 - DNA, 20 bp, Artificial Sequence
  chemically synthesized
attctatgttaagaaaatcg

SEQ ID NO: 348583 - DNA, 20 bp, Artificial Sequence
  chemically synthesized
ggaccacgattttcttaaca

SEQ ID NO: 348584 - DNA, 20 bp, Artificial Sequence
  chemically synthesized
attagattcaattctatgtt

SEQ ID NO: 348585 - DNA, 20 bp, Artificial Sequence
  chemically synthesized
taacatagaattgaatctaa

SEQ ID NO: 348586 - DNA, 20 bp, Artificial Sequence
  chemically synthesized
aataagaggaaaatatccat

SEQ ID NO: 348587 - DNA, 20 bp, Artificial Sequence
  chemically synthesized
aattacctcaagtcaataag

SEQ ID NO: 348588 - DNA, 20 bp, Artificial Sequence
  chemically synthesized
taattacctcaagtcaataa

SEQ ID NO: 348589 - DNA, 20 bp, Artificial Sequence
  chemically synthesized
cttaattacctcaagtcaat

SEQ ID NO: 348590 - DNA, 20 bp, Artificial Sequence
  chemically synthesized
tattttcctcttattgactt

SEQ ID NO: 348591 - DNA, 20 bp, Artificial Sequence
  chemically synthesized
attttcctcttattgacttg

SEQ ID NO: 348592 - DNA, 20 bp, Artificial Sequence
  chemically synthesized
atggggagcttaattacctc

SEQ ID NO: 348593 - DNA, 20 bp, Artificial Sequence
  chemically synthesized
cttattgacttgaggtaatt

SEQ ID NO: 348594 - DNA, 20 bp, Artificial Sequence
  chemically synthesized
aggtaattaagctccccatt

SEQ ID NO: 348595 - DNA, 20 bp, Artificial Sequence
  chemically synthesized
ctggtggtcttctcaatggg

SEQ ID NO: 348596 - DNA, 20 bp, Artificial Sequence
  chemically synthesized
taattaagctccccattgag

SEQ ID NO: 348597 - DNA, 20 bp, Artificial Sequence
  chemically synthesized
atctggtggtcttctcaatg

SEQ ID NO: 348598 - DNA, 20 bp, Artificial Sequence
  chemically synthesized
tatctggtggtcttctcaat

SEQ ID NO: 348599 - DNA, 20 bp, Artificial Sequence
  chemically synthesized
ctatctggtggtcttctcaa

SEQ ID NO: 348600 - DNA, 20 bp, Artificial Sequence
  chemically synthesized
ctccccattgagaagaccac

SEQ ID NO: 348601 - DNA, 20 bp, Artificial Sequence
  chemically synthesized
ccattgagaagaccaccaga

SEQ ID NO: 348602 - DNA, 20 bp, Artificial Sequence
  chemically synthesized
tcataaataaaactatctgg

SEQ ID NO: 348603 - DNA, 20 bp, Artificial Sequence
  chemically synthesized
gcttcataaataaaactatc

SEQ ID NO: 348604 - DNA, 20 bp, Artificial Sequence
  chemically synthesized
accagatagttttatttatg

SEQ ID NO: 348605 - DNA, 20 bp, Artificial Sequence
  chemically synthesized
agttttatttatgaagctga

SEQ ID NO: 348606 - DNA, 20 bp, Artificial Sequence
  chemically synthesized
ctgccatagttaggaactat

SEQ ID NO: 348607 - DNA, 20 bp, Artificial Sequence
  chemically synthesized
aagctgatagttcctaacta

SEQ ID NO: 348608 - DNA, 20 bp, Artificial Sequence
  chemically synthesized
agcctgtctctgccatagtt

SEQ ID NO: 348609 - DNA, 20 bp, Artificial Sequence
  chemically synthesized
ctgatagttcctaactatgg

SEQ ID NO: 348610 - DNA, 20 bp, Artificial Sequence
  chemically synthesized
cagcctgtctctgccatagt

SEQ ID NO: 348611 - DNA, 20 bp, Artificial Sequence
  chemically synthesized
gatagttcctaactatggca

SEQ ID NO: 348612 - DNA, 20 bp, Artificial Sequence
  chemically synthesized
ttgacagcctgtctctgcca

SEQ ID NO: 348613 - DNA, 20 bp, Artificial Sequence
  chemically synthesized
gttcctaactatggcagaga

SEQ ID NO: 348614 - DNA, 20 bp, Artificial Sequence
  chemically synthesized
ttcctaactatggcagagac

SEQ ID NO: 348615 - DNA, 20 bp, Artificial Sequence
  chemically synthesized
gaaaggacatggttgtttga

SEQ ID NO: 348616 - DNA, 20 bp, Artificial Sequence
  chemically synthesized
taaaagctggagaaaggaca

SEQ ID NO: 348617 - DNA, 20 bp, Artificial Sequence
  chemically synthesized
aaacaaccatgtcctttctc

SEQ ID NO: 348618 - DNA, 20 bp, Artificial Sequence
  chemically synthesized
atactttaaaagctggagaa

SEQ ID NO: 348619 - DNA, 20 bp, Artificial Sequence
  chemically synthesized
tatactttaaaagctggaga

SEQ ID NO: 348620 - DNA, 20 bp, Artificial Sequence
  chemically synthesized
aatctatactttaaaagctg

SEQ ID NO: 348621 - DNA, 20 bp, Artificial Sequence
  chemically synthesized
tgtcctttctccagctttta

SEQ ID NO: 348622 - DNA, 20 bp, Artificial Sequence
  chemically synthesized
aaaatctatactttaaaagc

SEQ ID NO: 348623 - DNA, 20 bp, Artificial Sequence
  chemically synthesized
gtgaaaaatctatactttaa

SEQ ID NO: 348624 - DNA, 20 bp, Artificial Sequence
  chemically synthesized
tttctccagcttttaaagta

SEQ ID NO: 348625 - DNA, 20 bp, Artificial Sequence
  chemically synthesized
taaagtatagatttttcact

SEQ ID NO: 348626 - DNA, 20 bp, Artificial Sequence
  chemically synthesized
agtatagatttttcacttag

SEQ ID NO: 348627 - DNA, 20 bp, Artificial Sequence
  chemically synthesized
atagatttttcacttagaag

SEQ ID NO: 348628 - DNA, 20 bp, Artificial Sequence
  chemically synthesized
ctggctgagtggctgcttct

SEQ ID NO: 348629 - DNA, 20 bp, Artificial Sequence
  chemically synthesized
ttcacttagaagcagccact

SEQ ID NO: 348630 - DNA, 20 bp, Artificial Sequence
  chemically synthesized
cttagaagcagccactcagc

SEQ ID NO: 348631 - DNA, 20 bp, Artificial Sequence
  chemically synthesized
taatgcagtggctggctgag

SEQ ID NO: 348632 - DNA, 20 bp, Artificial Sequence
  chemically synthesized
ggataatgcagtggctggct

SEQ ID NO: 348633 - DNA, 20 bp, Artificial Sequence
  chemically synthesized
tacaaggataatgcagtggc

SEQ ID NO: 348634 - DNA, 20 bp, Artificial Sequence
  chemically synthesized
tgtctacaaggataatgcag

SEQ ID NO: 348635 - DNA, 20 bp, Artificial Sequence
  chemically synthesized
gcctgtctacaaggataatg

SEQ ID NO: 348636 - DNA, 20 bp, Artificial Sequence
  chemically synthesized
cagccactgcattatccttg

SEQ ID NO: 348637 - DNA, 20 bp, Artificial Sequence
  chemically synthesized
cactgcattatccttgtaga

SEQ ID NO: 348638 - DNA, 20 bp, Artificial Sequence
  chemically synthesized
actgcattatccttgtagac

SEQ ID NO: 348639 - DNA, 20 bp, Artificial Sequence
  chemically synthesized
tatagccatgcctgtctaca

SEQ ID NO: 348640 - DNA, 20 bp, Artificial Sequence
  chemically synthesized
atatagccatgcctgtctac

SEQ ID NO: 348641 - DNA, 20 bp, Artificial Sequence
  chemically synthesized
attatccttgtagacaggca

SEQ ID NO: 348642 - DNA, 20 bp, Artificial Sequence
  chemically synthesized
gtgctcatgaaacatgtata

SEQ ID NO: 348643 - DNA, 20 bp, Artificial Sequence
  chemically synthesized
tggctatatacatgtttcat

SEQ ID NO: 348644 - DNA, 20 bp, Artificial Sequence
  chemically synthesized
gagcacacatccccttcatg

SEQ ID NO: 348645 - DNA, 20 bp, Artificial Sequence
  chemically synthesized
ccttcactttccacatgaag

SEQ ID NO: 348646 - DNA, 20 bp, Artificial Sequence
  chemically synthesized
cccttcactttccacatgaa

SEQ ID NO: 348647 - DNA, 20 bp, Artificial Sequence
  chemically synthesized
tcccttcactttccacatga

SEQ ID NO: 348648 - DNA, 20 bp, Artificial Sequence
  chemically synthesized
ctcccttcactttccacatg

SEQ ID NO: 348649 - DNA, 20 bp, Artificial Sequence
  chemically synthesized
acacatccccttcatgtgga

SEQ ID NO: 348650 - DNA, 20 bp, Artificial Sequence
  chemically synthesized
tccccttcatgtggaaagtg

SEQ ID NO: 348651 - DNA, 20 bp, Artificial Sequence
  chemically synthesized
ccccttcatgtggaaagtga

SEQ ID NO: 348652 - DNA, 20 bp, Artificial Sequence
  chemically synthesized
cccttcatgtggaaagtgaa

SEQ ID NO: 348653 - DNA, 20 bp, Artificial Sequence
  chemically synthesized
cttcatgtggaaagtgaagg

SEQ ID NO: 348654 - DNA, 20 bp, Artificial Sequence
  chemically synthesized
atatgcatcacctctaccac

SEQ ID NO: 348655 - DNA, 20 bp, Artificial Sequence
  chemically synthesized
tcttagaagccttgtggtag

SEQ ID NO: 348656 - DNA, 20 bp, Artificial Sequence
  chemically synthesized
tatgcatcacctctaccaca

SEQ ID NO: 348657 - DNA, 20 bp, Artificial Sequence
  chemically synthesized
ttcttagaagccttgtggta

SEQ ID NO: 348658 - DNA, 20 bp, Artificial Sequence
  chemically synthesized
acttcttagaagccttgtgg

SEQ ID NO: 348659 - DNA, 20 bp, Artificial Sequence
  chemically synthesized
gtgacttcttagaagccttg

SEQ ID NO: 348660 - DNA, 20 bp, Artificial Sequence
  chemically synthesized
acctctaccacaaggcttct

SEQ ID NO: 348661 - DNA, 20 bp, Artificial Sequence
  chemically synthesized
tctaccacaaggcttctaag

SEQ ID NO: 348662 - DNA, 20 bp, Artificial Sequence
  chemically synthesized
aagccacagtgacttcttag

SEQ ID NO: 348663 - DNA, 20 bp, Artificial Sequence
  chemically synthesized
gaaaagccacagtgacttct

SEQ ID NO: 348664 - DNA, 20 bp, Artificial Sequence
  chemically synthesized
aggcttctaagaagtcactg

SEQ ID NO: 348665 - DNA, 20 bp, Artificial Sequence
  chemically synthesized
aagcaaatacagaaaagcca

SEQ ID NO: 348666 - DNA, 20 bp, Artificial Sequence
  chemically synthesized
agggggaagcaaatacagaa

SEQ ID NO: 348667 - DNA, 20 bp, Artificial Sequence
  chemically synthesized
tgaagagggggaagcaaata

SEQ ID NO: 348668 - DNA, 20 bp, Artificial Sequence
  chemically synthesized
tatagccattgaagaggggg

SEQ ID NO: 348669 - DNA, 20 bp, Artificial Sequence
  chemically synthesized
tcatatagccattgaagagg

SEQ ID NO: 348670 - DNA, 20 bp, Artificial Sequence
  chemically synthesized
ttcatatagccattgaagag

SEQ ID NO: 348671 - DNA, 20 bp, Artificial Sequence
  chemically synthesized
atttgcttccccctcttcaa

SEQ ID NO: 348672 - DNA, 20 bp, Artificial Sequence
  chemically synthesized
tttcatatagccattgaaga

SEQ ID NO: 348673 - DNA, 20 bp, Artificial Sequence
  chemically synthesized
ttttcatatagccattgaag

SEQ ID NO: 348674 - DNA, 20 bp, Artificial Sequence
  chemically synthesized
tttttcatatagccattgaa

SEQ ID NO: 348675 - DNA, 20 bp, Artificial Sequence
  chemically synthesized
gttttttcatatagccattg

SEQ ID NO: 348676 - DNA, 20 bp, Artificial Sequence
  chemically synthesized
tgtttttttgttttttcata

SEQ ID NO: 348677 - DNA, 20 bp, Artificial Sequence
  chemically synthesized
aaaaaacatcatcatctgtg

SEQ ID NO: 348678 - DNA, 20 bp, Artificial Sequence
  chemically synthesized
aaacatcatcatctgtgaag

SEQ ID NO: 348679 - DNA, 20 bp, Artificial Sequence
  chemically synthesized
aacatcatcatctgtgaaga

SEQ ID NO: 348680 - DNA, 20 bp, Artificial Sequence
  chemically synthesized
ttgtggctctaccttcttca

SEQ ID NO: 348681 - DNA, 20 bp, Artificial Sequence
  chemically synthesized
atcatcatctgtgaagaagg

SEQ ID NO: 348682 - DNA, 20 bp, Artificial Sequence
  chemically synthesized
catcatctgtgaagaaggta

SEQ ID NO: 348683 - DNA, 20 bp, Artificial Sequence
  chemically synthesized
aagaaggtagagccacaaca

SEQ ID NO: 348684 - DNA, 20 bp, Artificial Sequence
  chemically synthesized
agaaggtagagccacaacaa

SEQ ID NO: 348685 - DNA, 20 bp, Artificial Sequence
  chemically synthesized
atatttttctgcctttgttg

SEQ ID NO: 348686 - DNA, 20 bp, Artificial Sequence
  chemically synthesized
aggtagagccacaacaaagg

SEQ ID NO: 348687 - DNA, 20 bp, Artificial Sequence
  chemically synthesized
acaacaaaggcagaaaaata

SEQ ID NO: 348688 - DNA, 20 bp, Artificial Sequence
  chemically synthesized
agaaaaatatagaaaaatat

SEQ ID NO: 348689 - DNA, 20 bp, Artificial Sequence
  chemically synthesized
aaaatattagtcactgtaat

SEQ ID NO: 348690 - DNA, 20 bp, Artificial Sequence
  chemically synthesized
gtgtgaaaatggactaatta

SEQ ID NO: 348691 - DNA, 20 bp, Artificial Sequence
  chemically synthesized
atttatcagcagtgtgaaaa

SEQ ID NO: 348692 - DNA, 20 bp, Artificial Sequence
  chemically synthesized
tctcggcaggtatttatcag

SEQ ID NO: 348693 - DNA, 20 bp, Artificial Sequence
  chemically synthesized
cagtctcggcaggtatttat

SEQ ID NO: 348694 - DNA, 20 bp, Artificial Sequence
  chemically synthesized
actgctgataaatacctgcc

SEQ ID NO: 348695 - DNA, 20 bp, Artificial Sequence
  chemically synthesized
gtaaatcgtccagtctcggc

SEQ ID NO: 348696 - DNA, 20 bp, Artificial Sequence
  chemically synthesized
tgataaatacctgccgagac

SEQ ID NO: 348697 - DNA, 20 bp, Artificial Sequence
  chemically synthesized
tgtaaatcgtccagtctcgg

SEQ ID NO: 348698 - DNA, 20 bp, Artificial Sequence
  chemically synthesized
ttttgtaaatcgtccagtct

SEQ ID NO: 348699 - DNA, 20 bp, Artificial Sequence
  chemically synthesized
tctttcttttgtaaatcgtc

SEQ ID NO: 348700 - DNA, 20 bp, Artificial Sequence
  chemically synthesized
cgagactggacgatttacaa

SEQ ID NO: 348701 - DNA, 20 bp, Artificial Sequence
  chemically synthesized
actggacgatttacaaaaga

SEQ ID NO: 348702 - DNA, 20 bp, Artificial Sequence
  chemically synthesized
aaagacgtttaattcattta

SEQ ID NO: 348703 - DNA, 20 bp, Artificial Sequence
  chemically synthesized
aattcatttacggttccacg

SEQ ID NO: 348704 - DNA, 20 bp, Artificial Sequence
  chemically synthesized
catttacggttccacgtggc

SEQ ID NO: 348705 - DNA, 20 bp, Artificial Sequence
  chemically synthesized
atttacggttccacgtggct

SEQ ID NO: 348706 - DNA, 20 bp, Artificial Sequence
  chemically synthesized
gtgaggccaccccagccacg

SEQ ID NO: 348707 - DNA, 20 bp, Artificial Sequence
  chemically synthesized
tttacggttccacgtggctg

SEQ ID NO: 348708 - DNA, 20 bp, Artificial Sequence
  chemically synthesized
acggttccacgtggctgggg

SEQ ID NO: 348709 - DNA, 20 bp, Artificial Sequence
  chemically synthesized
ccatgattgtgaggccaccc

SEQ ID NO: 348710 - DNA, 20 bp, Artificial Sequence
  chemically synthesized
cgcattctgccatgattgtg

SEQ ID NO: 348711 - DNA, 20 bp, Artificial Sequence
  chemically synthesized
ctggggtggcctcacaatca

SEQ ID NO: 348712 - DNA, 20 bp, Artificial Sequence
  chemically synthesized
tcgcattctgccatgattgt

SEQ ID NO: 348713 - DNA, 20 bp, Artificial Sequence
  chemically synthesized
gggtggcctcacaatcatgg

SEQ ID NO: 348714 - DNA, 20 bp, Artificial Sequence
  chemically synthesized
acaatcatggcagaatgcga

SEQ ID NO: 348715 - DNA, 20 bp, Artificial Sequence
  chemically synthesized
caatcatggcagaatgcgaa

SEQ ID NO: 348716 - DNA, 20 bp, Artificial Sequence
  chemically synthesized
tgcgaaaggcatgtctcaca

SEQ ID NO: 348717 - DNA, 20 bp, Artificial Sequence
  chemically synthesized
gaaaggcatgtctcacatgg

SEQ ID NO: 348718 - DNA, 20 bp, Artificial Sequence
  chemically synthesized
cttctcgtctgccaccatgt

SEQ ID NO: 348719 - DNA, 20 bp, Artificial Sequence
  chemically synthesized
aggcatgtctcacatggtgg

SEQ ID NO: 348720 - DNA, 20 bp, Artificial Sequence
  chemically synthesized
tgtctcacatggtggcagac

SEQ ID NO: 348721 - DNA, 20 bp, Artificial Sequence
  chemically synthesized
ctcacatggtggcagacgag

SEQ ID NO: 348722 - DNA, 20 bp, Artificial Sequence
  chemically synthesized
tcacatggtggcagacgaga

SEQ ID NO: 348723 - DNA, 20 bp, Artificial Sequence
  chemically synthesized
gacgagaaggtaacttgtgc

SEQ ID NO: 348724 - DNA, 20 bp, Artificial Sequence
  chemically synthesized
acgagaaggtaacttgtgca

SEQ ID NO: 348725 - DNA, 20 bp, Artificial Sequence
  chemically synthesized
gagaaggtaacttgtgcaag

SEQ ID NO: 348726 - DNA, 20 bp, Artificial Sequence
  chemically synthesized
aagggggagactccttgcac

SEQ ID NO: 348727 - DNA, 20 bp, Artificial Sequence
  chemically synthesized
tctgatggcttcataagggg

SEQ ID NO: 348728 - DNA, 20 bp, Artificial Sequence
  chemically synthesized
caaggagtctcccccttatg

SEQ ID NO: 348729 - DNA, 20 bp, Artificial Sequence
  chemically synthesized
gatctgatggcttcataagg

SEQ ID NO: 348730 - DNA, 20 bp, Artificial Sequence
  chemically synthesized
agatctgatggcttcataag

SEQ ID NO: 348731 - DNA, 20 bp, Artificial Sequence
  chemically synthesized
gagatctgatggcttcataa

SEQ ID NO: 348732 - DNA, 20 bp, Artificial Sequence
  chemically synthesized
tgagatctgatggcttcata

SEQ ID NO: 348733 - DNA, 20 bp, Artificial Sequence
  chemically synthesized
gtgagatctgatggcttcat

SEQ ID NO: 348734 - DNA, 20 bp, Artificial Sequence
  chemically synthesized
tctcccccttatgaagccat

SEQ ID NO: 348735 - DNA, 20 bp, Artificial Sequence
  chemically synthesized
gtaagtctcgtgagatctga

SEQ ID NO: 348736 - DNA, 20 bp, Artificial Sequence
  chemically synthesized
atgaagccatcagatctcac

SEQ ID NO: 348737 - DNA, 20 bp, Artificial Sequence
  chemically synthesized
ttgatagtggtaagtctcgt

SEQ ID NO: 348738 - DNA, 20 bp, Artificial Sequence
  chemically synthesized
gctgttttcttgatagtggt

SEQ ID NO: 348739 - DNA, 20 bp, Artificial Sequence
  chemically synthesized
tcacgagacttaccactatc

SEQ ID NO: 348740 - DNA, 20 bp, Artificial Sequence
  chemically synthesized
ccgtgctgttttcttgatag

SEQ ID NO: 348741 - DNA, 20 bp, Artificial Sequence
  chemically synthesized
ttcccgtgctgttttcttga

SEQ ID NO: 348742 - DNA, 20 bp, Artificial Sequence
  chemically synthesized
acttaccactatcaagaaaa

SEQ ID NO: 348743 - DNA, 20 bp, Artificial Sequence
  chemically synthesized
ccactatcaagaaaacagca

SEQ ID NO: 348744 - DNA, 20 bp, Artificial Sequence
  chemically synthesized
cactatcaagaaaacagcac

SEQ ID NO: 348745 - DNA, 20 bp, Artificial Sequence
  chemically synthesized
atcaagaaaacagcacggga

SEQ ID NO: 348746 - DNA, 20 bp, Artificial Sequence
  chemically synthesized
ggtaattgaatcatgggggc

SEQ ID NO: 348747 - DNA, 20 bp, Artificial Sequence
  chemically synthesized
aggtaattgaatcatggggg

SEQ ID NO: 348748 - DNA, 20 bp, Artificial Sequence
  chemically synthesized
gggaggtaattgaatcatgg

SEQ ID NO: 348749 - DNA, 20 bp, Artificial Sequence
  chemically synthesized
tgggaggtaattgaatcatg

SEQ ID NO: 348750 - DNA, 20 bp, Artificial Sequence
  chemically synthesized
gtgggaggtaattgaatcat

SEQ ID NO: 348751 - DNA, 20 bp, Artificial Sequence
  chemically synthesized
agtgggaggtaattgaatca

SEQ ID NO: 348752 - DNA, 20 bp, Artificial Sequence
  chemically synthesized
atgattcaattacctcccac

SEQ ID NO: 348753 - DNA, 20 bp, Artificial Sequence
  chemically synthesized
tgattcaattacctcccact

SEQ ID NO: 348754 - DNA, 20 bp, Artificial Sequence
  chemically synthesized
tctgggagtggcccagtggg

SEQ ID NO: 348755 - DNA, 20 bp, Artificial Sequence
  chemically synthesized
ttctgggagtggcccagtgg

SEQ ID NO: 348756 - DNA, 20 bp, Artificial Sequence
  chemically synthesized
tgttctgggagtggcccagt

SEQ ID NO: 348757 - DNA, 20 bp, Artificial Sequence
  chemically synthesized
gtgttctgggagtggcccag

SEQ ID NO: 348758 - DNA, 20 bp, Artificial Sequence
  chemically synthesized
cacgtgttctgggagtggcc

SEQ ID NO: 348759 - DNA, 20 bp, Artificial Sequence
  chemically synthesized
acctcccactgggccactcc

SEQ ID NO: 348760 - DNA, 20 bp, Artificial Sequence
  chemically synthesized
attcccacgtgttctgggag

SEQ ID NO: 348761 - DNA, 20 bp, Artificial Sequence
  chemically synthesized
tgaattcccacgtgttctgg

SEQ ID NO: 348762 - DNA, 20 bp, Artificial Sequence
  chemically synthesized
cttgaattcccacgtgttct

SEQ ID NO: 348763 - DNA, 20 bp, Artificial Sequence
  chemically synthesized
tgggccactcccagaacacg

SEQ ID NO: 348764 - DNA, 20 bp, Artificial Sequence
  chemically synthesized
tcttgaattcccacgtgttc

SEQ ID NO: 348765 - DNA, 20 bp, Artificial Sequence
  chemically synthesized
gggccactcccagaacacgt

SEQ ID NO: 348766 - DNA, 20 bp, Artificial Sequence
  chemically synthesized
cccagaacacgtgggaattc

SEQ ID NO: 348767 - DNA, 20 bp, Artificial Sequence
  chemically synthesized
tgggaattcaagatgcaatt

SEQ ID NO: 348768 - DNA, 20 bp, Artificial Sequence
  chemically synthesized
gggaattcaagatgcaattt

SEQ ID NO: 348769 - DNA, 20 bp, Artificial Sequence
  chemically synthesized
aattcaagatgcaatttggg

SEQ ID NO: 348770 - DNA, 20 bp, Artificial Sequence
  chemically synthesized
attcaagatgcaatttgggt

SEQ ID NO: 348771 - DNA, 20 bp, Artificial Sequence
  chemically synthesized
ttcaagatgcaatttgggtg

SEQ ID NO: 348772 - DNA, 20 bp, Artificial Sequence
  chemically synthesized
atgcaatttgggtggggaca

SEQ ID NO: 348773 - DNA, 20 bp, Artificial Sequence
  chemically synthesized
tattggtgactgatatggtt

SEQ ID NO: 348774 - DNA, 20 bp, Artificial Sequence
  chemically synthesized
gggacacagccaaaccatat

SEQ ID NO: 348775 - DNA, 20 bp, Artificial Sequence
  chemically synthesized
ttccttattggtgactgata

SEQ ID NO: 348776 - DNA, 20 bp, Artificial Sequence
  chemically synthesized
aaaccatatcagtcaccaat

SEQ ID NO: 348777 - DNA, 20 bp, Artificial Sequence
  chemically synthesized
aaccatatcagtcaccaata

SEQ ID NO: 348778 - DNA, 20 bp, Artificial Sequence
  chemically synthesized
ccaatgtaggtgttccttat

SEQ ID NO: 348779 - DNA, 20 bp, Artificial Sequence
  chemically synthesized
ccaataaggaacacctacat

SEQ ID NO: 348780 - DNA, 20 bp, Artificial Sequence
  chemically synthesized
cccaggtataagtccaatgt

SEQ ID NO: 348781 - DNA, 20 bp, Artificial Sequence
  chemically synthesized
gcccaggtataagtccaatg

SEQ ID NO: 348782 - DNA, 20 bp, Artificial Sequence
  chemically synthesized
acctacattggacttatacc

SEQ ID NO: 348783 - DNA, 20 bp, Artificial Sequence
  chemically synthesized
cctacattggacttatacct

SEQ ID NO: 348784 - DNA, 20 bp, Artificial Sequence
  chemically synthesized
tttatatgtagcccaggtat

SEQ ID NO: 348785 - DNA, 20 bp, Artificial Sequence
  chemically synthesized
caatagtttatatgtagccc

SEQ ID NO: 348786 - DNA, 20 bp, Artificial Sequence
  chemically synthesized
acaatagtttatatgtagcc

SEQ ID NO: 348787 - DNA, 20 bp, Artificial Sequence
  chemically synthesized
ttaaaacaatagtttatatg

SEQ ID NO: 348788 - DNA, 20 bp, Artificial Sequence
  chemically synthesized
tacatataaactattgtttt

SEQ ID NO: 348789 - DNA, 20 bp, Artificial Sequence
  chemically synthesized
tagaaaggagcttaaaacaa

SEQ ID NO: 348790 - DNA, 20 bp, Artificial Sequence
  chemically synthesized
ataagtgccaaaatagaaag

SEQ ID NO: 348791 - DNA, 20 bp, Artificial Sequence
  chemically synthesized
acataagtgccaaaatagaa

SEQ ID NO: 348792 - DNA, 20 bp, Artificial Sequence
  chemically synthesized
ttttaagctcctttctattt

SEQ ID NO: 348793 - DNA, 20 bp, Artificial Sequence
  chemically synthesized
cacataagtgccaaaataga

SEQ ID NO: 348794 - DNA, 20 bp, Artificial Sequence
  chemically synthesized
ttaacacataagtgccaaaa

SEQ ID NO: 348795 - DNA, 20 bp, Artificial Sequence
  chemically synthesized
accttgctgctttaacacat

SEQ ID NO: 348796 - DNA, 20 bp, Artificial Sequence
  chemically synthesized
attttggcacttatgtgtta

SEQ ID NO: 348797 - DNA, 20 bp, Artificial Sequence
  chemically synthesized
ttggcacttatgtgttaaag

SEQ ID NO: 348798 - DNA, 20 bp, Artificial Sequence
  chemically synthesized
cacttatgtgttaaagcagc

SEQ ID NO: 348799 - DNA, 20 bp, Artificial Sequence
  chemically synthesized
acttatgtgttaaagcagca

SEQ ID NO: 348800 - DNA, 20 bp, Artificial Sequence
  chemically synthesized
gttaaagcagcaaggttgtt

SEQ ID NO: 348801 - DNA, 20 bp, Artificial Sequence
  chemically synthesized
gcaaggttgtttagctaatt

SEQ ID NO: 348802 - DNA, 20 bp, Artificial Sequence
  chemically synthesized
gtgatctcgtgtcactgaat

SEQ ID NO: 348803 - DNA, 20 bp, Artificial Sequence
  chemically synthesized
tttagctaattcagtgacac

SEQ ID NO: 348804 - DNA, 20 bp, Artificial Sequence
  chemically synthesized
tatttaaatcatcagaaaca

SEQ ID NO: 348805 - DNA, 20 bp, Artificial Sequence
  chemically synthesized
ttaattcttatttaaatcat

SEQ ID NO: 348806 - DNA, 20 bp, Artificial Sequence
  chemically synthesized
ttgtttctgatgatttaaat

SEQ ID NO: 348807 - DNA, 20 bp, Artificial Sequence
  chemically synthesized
atgatttaaataagaattaa

SEQ ID NO: 348808 - DNA, 20 bp, Artificial Sequence
  chemically synthesized
aaataagaattaatagaatt

SEQ ID NO: 348809 - DNA, 20 bp, Artificial Sequence
  chemically synthesized
ttaatagaattcagttgcac

SEQ ID NO: 348810 - DNA, 20 bp, Artificial Sequence
  chemically synthesized
taatagaattcagttgcacc

SEQ ID NO: 348811 - DNA, 20 bp, Artificial Sequence
  chemically synthesized
ttcagttgcaccaggccatc

SEQ ID NO: 348812 - DNA, 20 bp, Artificial Sequence
  chemically synthesized
catgattagtcttgatggcc

SEQ ID NO: 348813 - DNA, 20 bp, Artificial Sequence
  chemically synthesized
aagggcatgattagtcttga

SEQ ID NO: 348814 - DNA, 20 bp, Artificial Sequence
  chemically synthesized
tatctttccaagggcatgat

SEQ ID NO: 348815 - DNA, 20 bp, Artificial Sequence
  chemically synthesized
atcaagactaatcatgccct

SEQ ID NO: 348816 - DNA, 20 bp, Artificial Sequence
  chemically synthesized
agactaatcatgcccttgga

SEQ ID NO: 348817 - DNA, 20 bp, Artificial Sequence
  chemically synthesized
ctgctcttatatctttccaa

SEQ ID NO: 348818 - DNA, 20 bp, Artificial Sequence
  chemically synthesized
tctgctcttatatctttcca

SEQ ID NO: 348819 - DNA, 20 bp, Artificial Sequence
  chemically synthesized
atctgctcttatatctttcc

SEQ ID NO: 348820 - DNA, 20 bp, Artificial Sequence
  chemically synthesized
tcatgcccttggaaagatat

SEQ ID NO: 348821 - DNA, 20 bp, Artificial Sequence
  chemically synthesized
atgcccttggaaagatataa

SEQ ID NO: 348822 - DNA, 20 bp, Artificial Sequence
  chemically synthesized
cccttggaaagatataagag

SEQ ID NO: 348823 - DNA, 20 bp, Artificial Sequence
  chemically synthesized
ccacagaatttgaggtgaca

SEQ ID NO: 348824 - DNA, 20 bp, Artificial Sequence
  chemically synthesized
ctgtagtaccacagaatttg

SEQ ID NO: 348825 - DNA, 20 bp, Artificial Sequence
  chemically synthesized
gctgtagtaccacagaattt

SEQ ID NO: 348826 - DNA, 20 bp, Artificial Sequence
  chemically synthesized
ctgtgtcacctcaaattctg

SEQ ID NO: 348827 - DNA, 20 bp, Artificial Sequence
  chemically synthesized
ggctataagctgtagtacca

SEQ ID NO: 348828 - DNA, 20 bp, Artificial Sequence
  chemically synthesized
cctcaaattctgtggtacta

SEQ ID NO: 348829 - DNA, 20 bp, Artificial Sequence
  chemically synthesized
ttctgtggtactacagctta

SEQ ID NO: 348830 - DNA, 20 bp, Artificial Sequence
  chemically synthesized
tatcacttggctataagctg

SEQ ID NO: 348831 - DNA, 20 bp, Artificial Sequence
  chemically synthesized
tggtactacagcttatagcc

SEQ ID NO: 348832 - DNA, 20 bp, Artificial Sequence
  chemically synthesized
agaatatatcacttggctat

SEQ ID NO: 348833 - DNA, 20 bp, Artificial Sequence
  chemically synthesized
taaaactagaatatatcact

SEQ ID NO: 348834 - DNA, 20 bp, Artificial Sequence
  chemically synthesized
tatagccaagtgatatattc

SEQ ID NO: 348835 - DNA, 20 bp, Artificial Sequence
  chemically synthesized
gtgatatattctagttttat

SEQ ID NO: 348836 - DNA, 20 bp, Artificial Sequence
  chemically synthesized
actcaatttactaataaaac

SEQ ID NO: 348837 - DNA, 20 bp, Artificial Sequence
  chemically synthesized
tctagttttattagtaaatt

SEQ ID NO: 348838 - DNA, 20 bp, Artificial Sequence
  chemically synthesized
attgagtaaacattactatc

SEQ ID NO: 348839 - DNA, 20 bp, Artificial Sequence
  chemically synthesized
ttgagtaaacattactatcc

SEQ ID NO: 348840 - DNA, 20 bp, Artificial Sequence
  chemically synthesized
tttttctggtttttcctgga

SEQ ID NO: 348841 - DNA, 20 bp, Artificial Sequence
  chemically synthesized
tttttttttctggtttttcc

SEQ ID NO: 348842 - DNA, 20 bp, Artificial Sequence
  chemically synthesized
cattactatccaggaaaaac

SEQ ID NO: 348843 - DNA, 20 bp, Artificial Sequence
  chemically synthesized
ctcctgtttttttttttttc

SEQ ID NO: 348844 - DNA, 20 bp, Artificial Sequence
  chemically synthesized
aaaccagaaaaaaaaaaaaa

SEQ ID NO: 348845 - DNA, 20 bp, Artificial Sequence
  chemically synthesized
aaccagaaaaaaaaaaaaac

SEQ ID NO: 348846 - DNA, 20 bp, Artificial Sequence
  chemically synthesized
ccagaaaaaaaaaaaaacag

SEQ ID NO: 348847 - DNA, 20 bp, Artificial Sequence
  chemically synthesized
cagaaaaaaaaaaaaacagg

SEQ ID NO: 348848 - DNA, 20 bp, Artificial Sequence
  chemically synthesized
taaaatgtcatatttattat

SEQ ID NO: 348849 - DNA, 20 bp, Artificial Sequence
  chemically synthesized
tgaagctggtttatatttca

SEQ ID NO: 348850 - DNA, 20 bp, Artificial Sequence
  chemically synthesized
tttatctttgaaatataaac

SEQ ID NO: 348851 - DNA, 20 bp, Artificial Sequence
  chemically synthesized
tgaaatataaaccagcttca

SEQ ID NO: 348852 - DNA, 20 bp, Artificial Sequence
  chemically synthesized
agatgactattccatgaagc

SEQ ID NO: 348853 - DNA, 20 bp, Artificial Sequence
  chemically synthesized
tataaaccagcttcatggaa

SEQ ID NO: 348854 - DNA, 20 bp, Artificial Sequence
  chemically synthesized
ttaaagatgactattccatg

SEQ ID NO: 348855 - DNA, 20 bp, Artificial Sequence
  chemically synthesized
ttcatggaatagtcatcttt

SEQ ID NO: 348856 - DNA, 20 bp, Artificial Sequence
  chemically synthesized
gaatagtcatctttaagttc

SEQ ID NO: 348857 - DNA, 20 bp, Artificial Sequence
  chemically synthesized
tgccactgtcctagaactta

SEQ ID NO: 348858 - DNA, 20 bp, Artificial Sequence
  chemically synthesized
aatagtcatctttaagttct

SEQ ID NO: 348859 - DNA, 20 bp, Artificial Sequence
  chemically synthesized
gtcatctttaagttctagga

SEQ ID NO: 348860 - DNA, 20 bp, Artificial Sequence
  chemically synthesized
atctttaagttctaggacag

SEQ ID NO: 348861 - DNA, 20 bp, Artificial Sequence
  chemically synthesized
taaaaactttgccactgtcc

SEQ ID NO: 348862 - DNA, 20 bp, Artificial Sequence
  chemically synthesized
taagttctaggacagtggca

SEQ ID NO: 348863 - DNA, 20 bp, Artificial Sequence
  chemically synthesized
gacagtggcaaagtttttaa

SEQ ID NO: 348864 - DNA, 20 bp, Artificial Sequence
  chemically synthesized
tttttaaaagattgaacaca

SEQ ID NO: 348865 - DNA, 20 bp, Artificial Sequence
  chemically synthesized
tgtactaagtaagggtttat

SEQ ID NO: 348866 - DNA, 20 bp, Artificial Sequence
  chemically synthesized
atcaccaataaacccttact

SEQ ID NO: 348867 - DNA, 20 bp, Artificial Sequence
  chemically synthesized
gcatagtctgtactaagtaa

SEQ ID NO: 348868 - DNA, 20 bp, Artificial Sequence
  chemically synthesized
tgcatagtctgtactaagta

SEQ ID NO: 348869 - DNA, 20 bp, Artificial Sequence
  chemically synthesized
atgcatagtctgtactaagt

SEQ ID NO: 348870 - DNA, 20 bp, Artificial Sequence
  chemically synthesized
caataaacccttacttagta

SEQ ID NO: 348871 - DNA, 20 bp, Artificial Sequence
  chemically synthesized
cttcatgcatagtctgtact

SEQ ID NO: 348872 - DNA, 20 bp, Artificial Sequence
  chemically synthesized
cttagtacagactatgcatg

SEQ ID NO: 348873 - DNA, 20 bp, Artificial Sequence
  chemically synthesized
ttaccttagtacttcatgca

SEQ ID NO: 348874 - DNA, 20 bp, Artificial Sequence
  chemically synthesized
cagactatgcatgaagtact

SEQ ID NO: 348875 - DNA, 20 bp, Artificial Sequence
  chemically synthesized
agactatgcatgaagtacta

SEQ ID NO: 348876 - DNA, 20 bp, Artificial Sequence
  chemically synthesized
tatgcatgaagtactaaggt

SEQ ID NO: 348877 - DNA, 20 bp, Artificial Sequence
  chemically synthesized
cttacagaagtcacttacct

SEQ ID NO: 348878 - DNA, 20 bp, Artificial Sequence
  chemically synthesized
ctaaggtaagtgacttctgt

SEQ ID NO: 348879 - DNA, 20 bp, Artificial Sequence
  chemically synthesized
tccatgtttttatcttacag

SEQ ID NO: 348880 - DNA, 20 bp, Artificial Sequence
  chemically synthesized
tcctccatgtttttatctta

SEQ ID NO: 348881 - DNA, 20 bp, Artificial Sequence
  chemically synthesized
acttctgtaagataaaaaca

SEQ ID NO: 348882 - DNA, 20 bp, Artificial Sequence
  chemically synthesized
ttctgtaagataaaaacatg

SEQ ID NO: 348883 - DNA, 20 bp, Artificial Sequence
  chemically synthesized
tctgtaagataaaaacatgg

SEQ ID NO: 348884 - DNA, 20 bp, Artificial Sequence
  chemically synthesized
acatggaggaaacccttttg

SEQ ID NO: 348885 - DNA, 20 bp, Artificial Sequence
  chemically synthesized
catgttcctgaaccacaaaa

SEQ ID NO: 348886 - DNA, 20 bp, Artificial Sequence
  chemically synthesized
acatgttcctgaaccacaaa

SEQ ID NO: 348887 - DNA, 20 bp, Artificial Sequence
  chemically synthesized
tacatgttcctgaaccacaa

SEQ ID NO: 348888 - DNA, 20 bp, Artificial Sequence
  chemically synthesized
gaggaaacccttttgtggtt

SEQ ID NO: 348889 - DNA, 20 bp, Artificial Sequence
  chemically synthesized
aggaaacccttttgtggttc

SEQ ID NO: 348890 - DNA, 20 bp, Artificial Sequence
  chemically synthesized
gttcaggaacatgtattccc

SEQ ID NO: 348891 - DNA, 20 bp, Artificial Sequence
  chemically synthesized
ttcaggaacatgtattccca

SEQ ID NO: 348892 - DNA, 20 bp, Artificial Sequence
  chemically synthesized
ggaacatgtattcccaaggt

SEQ ID NO: 348893 - DNA, 20 bp, Artificial Sequence
  chemically synthesized
ccttcagttacaccaacctt

SEQ ID NO: 348894 - DNA, 20 bp, Artificial Sequence
  chemically synthesized
accttcagttacaccaacct

SEQ ID NO: 348895 - DNA, 20 bp, Artificial Sequence
  chemically synthesized
tcccaaggttggtgtaactg

SEQ ID NO: 348896 - DNA, 20 bp, Artificial Sequence
  chemically synthesized
cccaaggttggtgtaactga

SEQ ID NO: 348897 - DNA, 20 bp, Artificial Sequence
  chemically synthesized
aggttggtgtaactgaaggt

SEQ ID NO: 348898 - DNA, 20 bp, Artificial Sequence
  chemically synthesized
cccattcttaaactaacctt

SEQ ID NO: 348899 - DNA, 20 bp, Artificial Sequence
  chemically synthesized
gtgtaactgaaggttagttt

SEQ ID NO: 348900 - DNA, 20 bp, Artificial Sequence
  chemically synthesized
actgaaggttagtttaagaa

SEQ ID NO: 348901 - DNA, 20 bp, Artificial Sequence
  chemically synthesized
ctgaaggttagtttaagaat

SEQ ID NO: 348902 - DNA, 20 bp, Artificial Sequence
  chemically synthesized
ggttagtttaagaatgggta

SEQ ID NO: 348903 - DNA, 20 bp, Artificial Sequence
  chemically synthesized
aagaatgggtacagaacaca

SEQ ID NO: 348904 - DNA, 20 bp, Artificial Sequence
  chemically synthesized
aatgggtacagaacacatgg

SEQ ID NO: 348905 - DNA, 20 bp, Artificial Sequence
  chemically synthesized
atgggtacagaacacatggt

SEQ ID NO: 348906 - DNA, 20 bp, Artificial Sequence
  chemically synthesized
ggtacagaacacatggtggg

SEQ ID NO: 348907 - DNA, 20 bp, Artificial Sequence
  chemically synthesized
cacatggtgggaagcaataa

SEQ ID NO: 348908 - DNA, 20 bp, Artificial Sequence
  chemically synthesized
acatggtgggaagcaataaa

SEQ ID NO: 348909 - DNA, 20 bp, Artificial Sequence
  chemically synthesized
tggtgggaagcaataaaagg

SEQ ID NO: 348910 - DNA, 20 bp, Artificial Sequence
  chemically synthesized
ggtgggaagcaataaaaggc

SEQ ID NO: 348911 - DNA, 20 bp, Artificial Sequence
  chemically synthesized
gaagcaataaaaggcaggca

SEQ ID NO: 348912 - DNA, 20 bp, Artificial Sequence
  chemically synthesized
caataaaaggcaggcataga

SEQ ID NO: 348913 - DNA, 20 bp, Artificial Sequence
  chemically synthesized
aaaaggcaggcatagaaagc

SEQ ID NO: 348914 - DNA, 20 bp, Artificial Sequence
  chemically synthesized
tgttctttctaaacaaaatc

SEQ ID NO: 348915 - DNA, 20 bp, Artificial Sequence
  chemically synthesized
atagaaagccggattttgtt

SEQ ID NO: 348916 - DNA, 20 bp, Artificial Sequence
  chemically synthesized
aaagccggattttgtttaga

SEQ ID NO: 348917 - DNA, 20 bp, Artificial Sequence
  chemically synthesized
gattttgtttagaaagaaca

SEQ ID NO: 348918 - DNA, 20 bp, Artificial Sequence
  chemically synthesized
attttgtttagaaagaacat

SEQ ID NO: 348919 - DNA, 20 bp, Artificial Sequence
  chemically synthesized
ttttgtttagaaagaacatg

SEQ ID NO: 348920 - DNA, 20 bp, Artificial Sequence
  chemically synthesized
gaacatggggttgtattaac

SEQ ID NO: 348921 - DNA, 20 bp, Artificial Sequence
  chemically synthesized
acatggggttgtattaacaa

SEQ ID NO: 348922 - DNA, 20 bp, Artificial Sequence
  chemically synthesized
taacaagagaatgacatgct

SEQ ID NO: 348923 - DNA, 20 bp, Artificial Sequence
  chemically synthesized
tgtttgaagatgacaggtct

SEQ ID NO: 348924 - DNA, 20 bp, Artificial Sequence
  chemically synthesized
aattagtgtttgaagatgac

SEQ ID NO: 348925 - DNA, 20 bp, Artificial Sequence
  chemically synthesized
caattagtgtttgaagatga

SEQ ID NO: 348926 - DNA, 20 bp, Artificial Sequence
  chemically synthesized
gccaccacaattagtgtttg

SEQ ID NO: 348927 - DNA, 20 bp, Artificial Sequence
  chemically synthesized
tcatcttcaaacactaattg

SEQ ID NO: 348928 - DNA, 20 bp, Artificial Sequence
  chemically synthesized
tcttcaaacactaattgtgg

SEQ ID NO: 348929 - DNA, 20 bp, Artificial Sequence
  chemically synthesized
tgttcacatgccaccacaat

SEQ ID NO: 348930 - DNA, 20 bp, Artificial Sequence
  chemically synthesized
ggcatgtgaacaatgattta

SEQ ID NO: 348931 - DNA, 20 bp, Artificial Sequence
  chemically synthesized
atgtgaacaatgatttaaag

SEQ ID NO: 348932 - DNA, 20 bp, Artificial Sequence
  chemically synthesized
tgtgaacaatgatttaaagt

SEQ ID NO: 348933 - DNA, 20 bp, Artificial Sequence
  chemically synthesized
tgaacaatgatttaaagtag

SEQ ID NO: 348934 - DNA, 20 bp, Artificial Sequence
  chemically synthesized
gaacaatgatttaaagtagg

SEQ ID NO: 348935 - DNA, 20 bp, Artificial Sequence
  chemically synthesized
gatttaaagtaggaggaaat

SEQ ID NO: 348936 - DNA, 20 bp, Artificial Sequence
  chemically synthesized
tttaaagtaggaggaaatta

SEQ ID NO: 348937 - DNA, 20 bp, Artificial Sequence
  chemically synthesized
agtaggaggaaattagagac

SEQ ID NO: 348938 - DNA, 20 bp, Artificial Sequence
  chemically synthesized
aggaggaaattagagactgg

SEQ ID NO: 348939 - DNA, 20 bp, Artificial Sequence
  chemically synthesized
gaaattagagactggaagac

SEQ ID NO: 348940 - DNA, 20 bp, Artificial Sequence
  chemically synthesized
ccctctcttagcttgtcttc

SEQ ID NO: 348941 - DNA, 20 bp, Artificial Sequence
  chemically synthesized
tagagactggaagacaagct

SEQ ID NO: 348942 - DNA, 20 bp, Artificial Sequence
  chemically synthesized
gagactggaagacaagctaa

SEQ ID NO: 348943 - DNA, 20 bp, Artificial Sequence
  chemically synthesized
gactggaagacaagctaaga

SEQ ID NO: 348944 - DNA, 20 bp, Artificial Sequence
  chemically synthesized
actggaagacaagctaagag

SEQ ID NO: 348945 - DNA, 20 bp, Artificial Sequence
  chemically synthesized
ctggaagacaagctaagaga

SEQ ID NO: 348946 - DNA, 20 bp, Artificial Sequence
  chemically synthesized
ataattacagttccctctct

SEQ ID NO: 348947 - DNA, 20 bp, Artificial Sequence
  chemically synthesized
aactgctgcccagataatta

SEQ ID NO: 348948 - DNA, 20 bp, Artificial Sequence
  chemically synthesized
gagagggaactgtaattatc

SEQ ID NO: 348949 - DNA, 20 bp, Artificial Sequence
  chemically synthesized
agagggaactgtaattatct

SEQ ID NO: 348950 - DNA, 20 bp, Artificial Sequence
  chemically synthesized
gggaactgtaattatctggg

SEQ ID NO: 348951 - DNA, 20 bp, Artificial Sequence
  chemically synthesized
aactgtaattatctgggcag

SEQ ID NO: 348952 - DNA, 20 bp, Artificial Sequence
  chemically synthesized
gatcccccaaaactgctgcc

SEQ ID NO: 348953 - DNA, 20 bp, Artificial Sequence
  chemically synthesized
aattatctgggcagcagttt

SEQ ID NO: 348954 - DNA, 20 bp, Artificial Sequence
  chemically synthesized
attatctgggcagcagtttt

SEQ ID NO: 348955 - DNA, 20 bp, Artificial Sequence
  chemically synthesized
ttatctgggcagcagttttg

SEQ ID NO: 348956 - DNA, 20 bp, Artificial Sequence
  chemically synthesized
tatctgggcagcagttttgg

SEQ ID NO: 348957 - DNA, 20 bp, Artificial Sequence
  chemically synthesized
agcagttttgggggatcatc

SEQ ID NO: 348958 - DNA, 20 bp, Artificial Sequence
  chemically synthesized
agttttgggggatcatccag

SEQ ID NO: 348959 - DNA, 20 bp, Artificial Sequence
  chemically synthesized
ttttgggggatcatccagca

SEQ ID NO: 348960 - DNA, 20 bp, Artificial Sequence
  chemically synthesized
ttaaattctacattctctgc

SEQ ID NO: 348961 - DNA, 20 bp, Artificial Sequence
  chemically synthesized
ggatcatccagcagagaatg

SEQ ID NO: 348962 - DNA, 20 bp, Artificial Sequence
  chemically synthesized
agcagagaatgtagaattta

SEQ ID NO: 348963 - DNA, 20 bp, Artificial Sequence
  chemically synthesized
gaatttaaagtaaattcctc

SEQ ID NO: 348964 - DNA, 20 bp, Artificial Sequence
  chemically synthesized
attccgaatagcaatactag

SEQ ID NO: 348965 - DNA, 20 bp, Artificial Sequence
  chemically synthesized
tattccgaatagcaatacta

SEQ ID NO: 348966 - DNA, 20 bp, Artificial Sequence
  chemically synthesized
tctattccgaatagcaatac

SEQ ID NO: 348967 - DNA, 20 bp, Artificial Sequence
  chemically synthesized
attcctctagtattgctatt

SEQ ID NO: 348968 - DNA, 20 bp, Artificial Sequence
  chemically synthesized
tctagtattgctattcggaa

SEQ ID NO: 348969 - DNA, 20 bp, Artificial Sequence
  chemically synthesized
atgtagttttctattccgaa

SEQ ID NO: 348970 - DNA, 20 bp, Artificial Sequence
  chemically synthesized
gtattaaatcattgtaaatg

SEQ ID NO: 348971 - DNA, 20 bp, Artificial Sequence
  chemically synthesized
acaatatacattaataccaa

SEQ ID NO: 348972 - DNA, 20 bp, Artificial Sequence
  chemically synthesized
atacattaataccaaaagta

SEQ ID NO: 348973 - DNA, 20 bp, Artificial Sequence
  chemically synthesized
ctaaggtcttactatacttt

SEQ ID NO: 348974 - DNA, 20 bp, Artificial Sequence
  chemically synthesized
attaataccaaaagtatagt

SEQ ID NO: 348975 - DNA, 20 bp, Artificial Sequence
  chemically synthesized
ccaaaagtatagtaagacct

SEQ ID NO: 348976 - DNA, 20 bp, Artificial Sequence
  chemically synthesized
acgtaaacattttacatcta

SEQ ID NO: 348977 - DNA, 20 bp, Artificial Sequence
  chemically synthesized
cacgtaaacattttacatct

SEQ ID NO: 348978 - DNA, 20 bp, Artificial Sequence
  chemically synthesized
gtaaaatgtttacgtgttct

SEQ ID NO: 348979 - DNA, 20 bp, Artificial Sequence
  chemically synthesized
aaaatgtttacgtgttcttg

SEQ ID NO: 348980 - DNA, 20 bp, Artificial Sequence
  chemically synthesized
aagcatagaaaaggaactcc

SEQ ID NO: 348981 - DNA, 20 bp, Artificial Sequence
  chemically synthesized
ttgatcatcaagcatagaaa

SEQ ID NO: 348982 - DNA, 20 bp, Artificial Sequence
  chemically synthesized
attgatcatcaagcatagaa

SEQ ID NO: 348983 - DNA, 20 bp, Artificial Sequence
  chemically synthesized
catcaattgatcatcaagca

SEQ ID NO: 348984 - DNA, 20 bp, Artificial Sequence
  chemically synthesized
taatacatcaattgatcatc

SEQ ID NO: 348985 - DNA, 20 bp, Artificial Sequence
  chemically synthesized
atcaattgatgtattaattt

SEQ ID NO: 348986 - DNA, 20 bp, Artificial Sequence
  chemically synthesized
gccctcaaatacatttaggt

SEQ ID NO: 348987 - DNA, 20 bp, Artificial Sequence
  chemically synthesized
tagcgccctcaaatacattt

SEQ ID NO: 348988 - DNA, 20 bp, Artificial Sequence
  chemically synthesized
ttagcgccctcaaatacatt

SEQ ID NO: 348989 - DNA, 20 bp, Artificial Sequence
  chemically synthesized
tttctaacctaaatgtattt

SEQ ID NO: 348990 - DNA, 20 bp, Artificial Sequence
  chemically synthesized
ttctaacctaaatgtatttg

SEQ ID NO: 348991 - DNA, 20 bp, Artificial Sequence
  chemically synthesized
tctaacctaaatgtatttga

SEQ ID NO: 348992 - DNA, 20 bp, Artificial Sequence
  chemically synthesized
tttgagggcgctaattttga

SEQ ID NO: 348993 - DNA, 20 bp, Artificial Sequence
  chemically synthesized
atttatattgctttcaaaat

SEQ ID NO: 348994 - DNA, 20 bp, Artificial Sequence
  chemically synthesized
aaatatgtcgattactttat

SEQ ID NO: 348995 - DNA, 20 bp, Artificial Sequence
  chemically synthesized
ataattttatgcaactcata

SEQ ID NO: 348996 - DNA, 20 bp, Artificial Sequence
  chemically synthesized
ttgcataaaattatatacat

SEQ ID NO: 348997 - DNA, 20 bp, Artificial Sequence
  chemically synthesized
tccctctccaaatgtacatt

SEQ ID NO: 348998 - DNA, 20 bp, Artificial Sequence
  chemically synthesized
tacaataccaaatgtacatt

SEQ ID NO: 348999 - DNA, 20 bp, Artificial Sequence
  chemically synthesized
caataccaaatgtacatttg

SEQ ID NO: 349000 - DNA, 20 bp, Artificial Sequence
  chemically synthesized
ataccaaatgtacatttgga

SEQ ID NO: 349001 - DNA, 20 bp, Artificial Sequence
  chemically synthesized
taccaaatgtacatttggag

SEQ ID NO: 349002 - DNA, 20 bp, Artificial Sequence
  chemically synthesized
accaaatgtacatttggaga

SEQ ID NO: 349003 - DNA, 20 bp, Artificial Sequence
  chemically synthesized
gtacatttggagagggaata

SEQ ID NO: 349004 - DNA, 20 bp, Artificial Sequence
  chemically synthesized
agagggaatacagattctat

SEQ ID NO: 349005 - DNA, 20 bp, Artificial Sequence
  chemically synthesized
atgaatgattaaattactaa

SEQ ID NO: 349006 - DNA, 20 bp, Artificial Sequence
  chemically synthesized
atgtttttcattaaacattt

SEQ ID NO: 349007 - DNA, 20 bp, Artificial Sequence
  chemically synthesized
catttaagttcctactgttt

SEQ ID NO: 349008 - DNA, 20 bp, Artificial Sequence
  chemically synthesized
tctcctggtcctaaaacagt

SEQ ID NO: 349009 - DNA, 20 bp, Artificial Sequence
  chemically synthesized
atttaagttcctactgtttt

SEQ ID NO: 349010 - DNA, 20 bp, Artificial Sequence
  chemically synthesized
atctcctggtcctaaaacag

SEQ ID NO: 349011 - DNA, 20 bp, Artificial Sequence
  chemically synthesized
tatatctcctggtcctaaaa

SEQ ID NO: 349012 - DNA, 20 bp, Artificial Sequence
  chemically synthesized
agttcctactgttttaggac

SEQ ID NO: 349013 - DNA, 20 bp, Artificial Sequence
  chemically synthesized
gttcctactgttttaggacc

SEQ ID NO: 349014 - DNA, 20 bp, Artificial Sequence
  chemically synthesized
tcctactgttttaggaccag

SEQ ID NO: 349015 - DNA, 20 bp, Artificial Sequence
  chemically synthesized
tgttttaggaccaggagata

SEQ ID NO: 349016 - DNA, 20 bp, Artificial Sequence
  chemically synthesized
ttattcactgctatatctcc

SEQ ID NO: 349017 - DNA, 20 bp, Artificial Sequence
  chemically synthesized
tttaggaccaggagatatag

SEQ ID NO: 349018 - DNA, 20 bp, Artificial Sequence
  chemically synthesized
agcagtgaataaaatgtaca

SEQ ID NO: 349019 - DNA, 20 bp, Artificial Sequence
  chemically synthesized
aatttaagcttcataagtta

SEQ ID NO: 349020 - DNA, 20 bp, Artificial Sequence
  chemically synthesized
gaatttaagcttcataagtt

SEQ ID NO: 349021 - DNA, 20 bp, Artificial Sequence
  chemically synthesized
tacaaagtccttaacttatg

SEQ ID NO: 349022 - DNA, 20 bp, Artificial Sequence
  chemically synthesized
tcctagaatttaagcttcat

SEQ ID NO: 349023 - DNA, 20 bp, Artificial Sequence
  chemically synthesized
aacttatgaagcttaaattc

SEQ ID NO: 349024 - DNA, 20 bp, Artificial Sequence
  chemically synthesized
acttatgaagcttaaattct

SEQ ID NO: 349025 - DNA, 20 bp, Artificial Sequence
  chemically synthesized
tatttctagtcctagaattt

SEQ ID NO: 349026 - DNA, 20 bp, Artificial Sequence
  chemically synthesized
tgaagcttaaattctaggac

SEQ ID NO: 349027 - DNA, 20 bp, Artificial Sequence
  chemically synthesized
cttatttttatttctagtcc

SEQ ID NO: 349028 - DNA, 20 bp, Artificial Sequence
  chemically synthesized
tttgtccttatttttatttc

SEQ ID NO: 349029 - DNA, 20 bp, Artificial Sequence
  chemically synthesized
ctaggactagaaataaaaat

SEQ ID NO: 349030 - DNA, 20 bp, Artificial Sequence
  chemically synthesized
taggactagaaataaaaata

SEQ ID NO: 349031 - DNA, 20 bp, Artificial Sequence
  chemically synthesized
tgccatgacctgattttgtg

SEQ ID NO: 349032 - DNA, 20 bp, Artificial Sequence
  chemically synthesized
ataaatatgctacacaaaat

SEQ ID NO: 349033 - DNA, 20 bp, Artificial Sequence
  chemically synthesized
taaatatgctacacaaaatc

SEQ ID NO: 349034 - DNA, 20 bp, Artificial Sequence
  chemically synthesized
tgctacacaaaatcaggtca

SEQ ID NO: 349035 - DNA, 20 bp, Artificial Sequence
  chemically synthesized
acacaaaatcaggtcatggc

SEQ ID NO: 349036 - DNA, 20 bp, Artificial Sequence
  chemically synthesized
aggtcatggcaagtcctata

SEQ ID NO: 349037 - DNA, 20 bp, Artificial Sequence
  chemically synthesized
cttgctctatttttctttat

SEQ ID NO: 349038 - DNA, 20 bp, Artificial Sequence
  chemically synthesized
ccttgctctatttttcttta

SEQ ID NO: 349039 - DNA, 20 bp, Artificial Sequence
  chemically synthesized
gcaagtcctataaagaaaaa

SEQ ID NO: 349040 - DNA, 20 bp, Artificial Sequence
  chemically synthesized
aagtcctataaagaaaaata

SEQ ID NO: 349041 - DNA, 20 bp, Artificial Sequence
  chemically synthesized
cctataaagaaaaatagagc

SEQ ID NO: 349042 - DNA, 20 bp, Artificial Sequence
  chemically synthesized
ctataaagaaaaatagagca

SEQ ID NO: 349043 - DNA, 20 bp, Artificial Sequence
  chemically synthesized
aagaaaaatagagcaaggta

SEQ ID NO: 349044 - DNA, 20 bp, Artificial Sequence
  chemically synthesized
gaaaaatagagcaaggtaaa

SEQ ID NO: 349045 - DNA, 20 bp, Artificial Sequence
  chemically synthesized
aaaatagagcaaggtaaaga

SEQ ID NO: 349046 - DNA, 20 bp, Artificial Sequence
  chemically synthesized
aaatagagcaaggtaaagag

SEQ ID NO: 349047 - DNA, 20 bp, Artificial Sequence
  chemically synthesized
aatagagcaaggtaaagaga

SEQ ID NO: 349048 - DNA, 20 bp, Artificial Sequence
  chemically synthesized
aaggtaaagagagggaacaa

SEQ ID NO: 349049 - DNA, 20 bp, Artificial Sequence
  chemically synthesized
aggtaaagagagggaacaaa

SEQ ID NO: 349050 - DNA, 20 bp, Artificial Sequence
  chemically synthesized
aagagagggaacaaaaggca

SEQ ID NO: 349051 - DNA, 20 bp, Artificial Sequence
  chemically synthesized
gagagggaacaaaaggcatg

SEQ ID NO: 349052 - DNA, 20 bp, Artificial Sequence
  chemically synthesized
gagggaacaaaaggcatgga

SEQ ID NO: 349053 - DNA, 20 bp, Artificial Sequence
  chemically synthesized
agggaacaaaaggcatggag

SEQ ID NO: 349054 - DNA, 20 bp, Artificial Sequence
  chemically synthesized
aacaaaaggcatggagaggt

SEQ ID NO: 349055 - DNA, 20 bp, Artificial Sequence
  chemically synthesized
tggagaggttggctctactt

SEQ ID NO: 349056 - DNA, 20 bp, Artificial Sequence
  chemically synthesized
gagaggttggctctacttaa

SEQ ID NO: 349057 - DNA, 20 bp, Artificial Sequence
  chemically synthesized
tctaaatcctctcttaagta

SEQ ID NO: 349058 - DNA, 20 bp, Artificial Sequence
  chemically synthesized
gaggttggctctacttaaga

SEQ ID NO: 349059 - DNA, 20 bp, Artificial Sequence
  chemically synthesized
tctctaaatcctctcttaag

SEQ ID NO: 349060 - DNA, 20 bp, Artificial Sequence
  chemically synthesized
aggttggctctacttaagag

SEQ ID NO: 349061 - DNA, 20 bp, Artificial Sequence
  chemically synthesized
ccctctctaaatcctctctt

SEQ ID NO: 349062 - DNA, 20 bp, Artificial Sequence
  chemically synthesized
gctctacttaagagaggatt

SEQ ID NO: 349063 - DNA, 20 bp, Artificial Sequence
  chemically synthesized
tctacttaagagaggattta

SEQ ID NO: 349064 - DNA, 20 bp, Artificial Sequence
  chemically synthesized
tacttaagagaggatttaga

SEQ ID NO: 349065 - DNA, 20 bp, Artificial Sequence
  chemically synthesized
acttaagagaggatttagag

SEQ ID NO: 349066 - DNA, 20 bp, Artificial Sequence
  chemically synthesized
cttaagagaggatttagaga

SEQ ID NO: 349067 - DNA, 20 bp, Artificial Sequence
  chemically synthesized
agagaggatttagagaggga

SEQ ID NO: 349068 - DNA, 20 bp, Artificial Sequence
  chemically synthesized
taaatgttcctgtagttgaa

SEQ ID NO: 349069 - DNA, 20 bp, Artificial Sequence
  chemically synthesized
gagggaaagcctttcaacta

SEQ ID NO: 349070 - DNA, 20 bp, Artificial Sequence
  chemically synthesized
ttaaatgttcctgtagttga

SEQ ID NO: 349071 - DNA, 20 bp, Artificial Sequence
  chemically synthesized
agggaaagcctttcaactac

SEQ ID NO: 349072 - DNA, 20 bp, Artificial Sequence
  chemically synthesized
tctatttttaaatgttcctg

SEQ ID NO: 349073 - DNA, 20 bp, Artificial Sequence
  chemically synthesized
actacaggaacatttaaaaa

SEQ ID NO: 349074 - DNA, 20 bp, Artificial Sequence
  chemically synthesized
tacaggaacatttaaaaata

SEQ ID NO: 349075 - DNA, 20 bp, Artificial Sequence
  chemically synthesized
aaaatagagttgaatgaaat

SEQ ID NO: 349076 - DNA, 20 bp, Artificial Sequence
  chemically synthesized
atagagttgaatgaaataag

SEQ ID NO: 349077 - DNA, 20 bp, Artificial Sequence
  chemically synthesized
tttctccagagagtcatcac

SEQ ID NO: 349078 - DNA, 20 bp, Artificial Sequence
  chemically synthesized
ttttctccagagagtcatca

SEQ ID NO: 349079 - DNA, 20 bp, Artificial Sequence
  chemically synthesized
tgaatcctgtgatgactctc

SEQ ID NO: 349080 - DNA, 20 bp, Artificial Sequence
  chemically synthesized
aatcctgtgatgactctctg

SEQ ID NO: 349081 - DNA, 20 bp, Artificial Sequence
  chemically synthesized
ggaaatgtgttttctccaga

SEQ ID NO: 349082 - DNA, 20 bp, Artificial Sequence
  chemically synthesized
atggaaatgtgttttctcca

SEQ ID NO: 349083 - DNA, 20 bp, Artificial Sequence
  chemically synthesized
atatggaaatgtgttttctc

SEQ ID NO: 349084 - DNA, 20 bp, Artificial Sequence
  chemically synthesized
gaaaacacatttccatatta

SEQ ID NO: 349085 - DNA, 20 bp, Artificial Sequence
  chemically synthesized
aaaacacatttccatattaa

SEQ ID NO: 349086 - DNA, 20 bp, Artificial Sequence
  chemically synthesized
tacttgctgatcctttaata

SEQ ID NO: 349087 - DNA, 20 bp, Artificial Sequence
  chemically synthesized
acatttccatattaaaggat

SEQ ID NO: 349088 - DNA, 20 bp, Artificial Sequence
  chemically synthesized
ttccatattaaaggatcagc

SEQ ID NO: 349089 - DNA, 20 bp, Artificial Sequence
  chemically synthesized
ttaaaggatcagcaagtaca

SEQ ID NO: 349090 - DNA, 20 bp, Artificial Sequence
  chemically synthesized
taaaggatcagcaagtacaa

SEQ ID NO: 349091 - DNA, 20 bp, Artificial Sequence
  chemically synthesized
tcagcaagtacaaaggtcct

SEQ ID NO: 349092 - DNA, 20 bp, Artificial Sequence
  chemically synthesized
cagcaagtacaaaggtcctg

SEQ ID NO: 349093 - DNA, 20 bp, Artificial Sequence
  chemically synthesized
caagtacaaaggtcctgagg

SEQ ID NO: 349094 - DNA, 20 bp, Artificial Sequence
  chemically synthesized
aagtacaaaggtcctgaggc

SEQ ID NO: 349095 - DNA, 20 bp, Artificial Sequence
  chemically synthesized
tgccagagaggtcctgcctc

SEQ ID NO: 349096 - DNA, 20 bp, Artificial Sequence
  chemically synthesized
gtgccagagaggtcctgcct

SEQ ID NO: 349097 - DNA, 20 bp, Artificial Sequence
  chemically synthesized
gtcctgaggcaggacctctc

SEQ ID NO: 349098 - DNA, 20 bp, Artificial Sequence
  chemically synthesized
ttgggagtcaagtgccagag

SEQ ID NO: 349099 - DNA, 20 bp, Artificial Sequence
  chemically synthesized
attgggagtcaagtgccaga

SEQ ID NO: 349100 - DNA, 20 bp, Artificial Sequence
  chemically synthesized
tcattgggagtcaagtgcca

SEQ ID NO: 349101 - DNA, 20 bp, Artificial Sequence
  chemically synthesized
gctcattgggagtcaagtgc

SEQ ID NO: 349102 - DNA, 20 bp, Artificial Sequence
  chemically synthesized
atccaggctcattgggagtc

SEQ ID NO: 349103 - DNA, 20 bp, Artificial Sequence
  chemically synthesized
tctggcacttgactcccaat

SEQ ID NO: 349104 - DNA, 20 bp, Artificial Sequence
  chemically synthesized
gtcagatccaggctcattgg

SEQ ID NO: 349105 - DNA, 20 bp, Artificial Sequence
  chemically synthesized
tagtcagatccaggctcatt

SEQ ID NO: 349106 - DNA, 20 bp, Artificial Sequence
  chemically synthesized
cacttgactcccaatgagcc

SEQ ID NO: 349107 - DNA, 20 bp, Artificial Sequence
  chemically synthesized
ctagtcagatccaggctcat

SEQ ID NO: 349108 - DNA, 20 bp, Artificial Sequence
  chemically synthesized
cttcacttctagtcagatcc

SEQ ID NO: 349109 - DNA, 20 bp, Artificial Sequence
  chemically synthesized
ccttcacttctagtcagatc

SEQ ID NO: 349110 - DNA, 20 bp, Artificial Sequence
  chemically synthesized
ccaatgagcctggatctgac

SEQ ID NO: 349111 - DNA, 20 bp, Artificial Sequence
  chemically synthesized
atgagcctggatctgactag

SEQ ID NO: 349112 - DNA, 20 bp, Artificial Sequence
  chemically synthesized
tccatgccttcacttctagt

SEQ ID NO: 349113 - DNA, 20 bp, Artificial Sequence
  chemically synthesized
cctggatctgactagaagtg

SEQ ID NO: 349114 - DNA, 20 bp, Artificial Sequence
  chemically synthesized
ctggatctgactagaagtga

SEQ ID NO: 349115 - DNA, 20 bp, Artificial Sequence
  chemically synthesized
gctctccatgccttcacttc

SEQ ID NO: 349116 - DNA, 20 bp, Artificial Sequence
  chemically synthesized
tctgactagaagtgaaggca

SEQ ID NO: 349117 - DNA, 20 bp, Artificial Sequence
  chemically synthesized
tgactagaagtgaaggcatg

SEQ ID NO: 349118 - DNA, 20 bp, Artificial Sequence
  chemically synthesized
actagaagtgaaggcatgga

SEQ ID NO: 349119 - DNA, 20 bp, Artificial Sequence
  chemically synthesized
aggcatggagagcctatgat

SEQ ID NO: 349120 - DNA, 20 bp, Artificial Sequence
  chemically synthesized
atattgcatgcgctaatcat

SEQ ID NO: 349121 - DNA, 20 bp, Artificial Sequence
  chemically synthesized
aatattgcatgcgctaatca

SEQ ID NO: 349122 - DNA, 20 bp, Artificial Sequence
  chemically synthesized
caatattaattttgattaca

SEQ ID NO: 349123 - DNA, 20 bp, Artificial Sequence
  chemically synthesized
attacaaagttactttaaac

SEQ ID NO: 349124 - DNA, 20 bp, Artificial Sequence
  chemically synthesized
gataaagctaatccagttta

SEQ ID NO: 349125 - DNA, 20 bp, Artificial Sequence
  chemically synthesized
aaagttactttaaactggat

SEQ ID NO: 349126 - DNA, 20 bp, Artificial Sequence
  chemically synthesized
cactggagataaagctaatc

SEQ ID NO: 349127 - DNA, 20 bp, Artificial Sequence
  chemically synthesized
aactggattagctttatctc

SEQ ID NO: 349128 - DNA, 20 bp, Artificial Sequence
  chemically synthesized
aaagtgtttcactggagata

SEQ ID NO: 349129 - DNA, 20 bp, Artificial Sequence
  chemically synthesized
ctctgaaaagtgtttcactg

SEQ ID NO: 349130 - DNA, 20 bp, Artificial Sequence
  chemically synthesized
gtctctgaaaagtgtttcac

SEQ ID NO: 349131 - DNA, 20 bp, Artificial Sequence
  chemically synthesized
atctccagtgaaacactttt

SEQ ID NO: 349132 - DNA, 20 bp, Artificial Sequence
  chemically synthesized
ctccagtgaaacacttttca

SEQ ID NO: 349133 - DNA, 20 bp, Artificial Sequence
  chemically synthesized
atttgtctgtggtctctgaa

SEQ ID NO: 349134 - DNA, 20 bp, Artificial Sequence
  chemically synthesized
gaaacacttttcagagacca

SEQ ID NO: 349135 - DNA, 20 bp, Artificial Sequence
  chemically synthesized
tagtccaaaagatttgtctg

SEQ ID NO: 349136 - DNA, 20 bp, Artificial Sequence
  chemically synthesized
gagaccacagacaaatcttt

SEQ ID NO: 349137 - DNA, 20 bp, Artificial Sequence
  chemically synthesized
aatgtttagatgtagtccaa

SEQ ID NO: 349138 - DNA, 20 bp, Artificial Sequence
  chemically synthesized
ttccaaaaaatgtttagatg

SEQ ID NO: 349139 - DNA, 20 bp, Artificial Sequence
  chemically synthesized
taatccttccaaaaaatgtt

SEQ ID NO: 349140 - DNA, 20 bp, Artificial Sequence
  chemically synthesized
gactacatctaaacattttt

SEQ ID NO: 349141 - DNA, 20 bp, Artificial Sequence
  chemically synthesized
tacatctaaacattttttgg

SEQ ID NO: 349142 - DNA, 20 bp, Artificial Sequence
  chemically synthesized
acatctaaacattttttgga

SEQ ID NO: 349143 - DNA, 20 bp, Artificial Sequence
  chemically synthesized
ttcacatggcttcaaaatta

SEQ ID NO: 349144 - DNA, 20 bp, Artificial Sequence
  chemically synthesized
ttaatatttctataattttg

SEQ ID NO: 349145 - DNA, 20 bp, Artificial Sequence
  chemically synthesized
gactcatcttaattttcaca

SEQ ID NO: 349146 - DNA, 20 bp, Artificial Sequence
  chemically synthesized
tttgaagccatgtgaaaatt

SEQ ID NO: 349147 - DNA, 20 bp, Artificial Sequence
  chemically synthesized
agccatgtgaaaattaagat

SEQ ID NO: 349148 - DNA, 20 bp, Artificial Sequence
  chemically synthesized
gcatgatcactaaatgagaa

SEQ ID NO: 349149 - DNA, 20 bp, Artificial Sequence
  chemically synthesized
aagatgagtctattctcatt

SEQ ID NO: 349150 - DNA, 20 bp, Artificial Sequence
  chemically synthesized
ggctggcatgatcactaaat

SEQ ID NO: 349151 - DNA, 20 bp, Artificial Sequence
  chemically synthesized
ttctcatttagtgatcatgc

SEQ ID NO: 349152 - DNA, 20 bp, Artificial Sequence
  chemically synthesized
tttagtgatcatgccagcct

SEQ ID NO: 349153 - DNA, 20 bp, Artificial Sequence
  chemically synthesized
agtttcagtctttctaaggc

SEQ ID NO: 349154 - DNA, 20 bp, Artificial Sequence
  chemically synthesized
gtgatcatgccagccttaga

SEQ ID NO: 349155 - DNA, 20 bp, Artificial Sequence
  chemically synthesized
aatcagtttcagtctttcta

SEQ ID NO: 349156 - DNA, 20 bp, Artificial Sequence
  chemically synthesized
taatcagtttcagtctttct

SEQ ID NO: 349157 - DNA, 20 bp, Artificial Sequence
  chemically synthesized
ttcatttacttaatcagttt

SEQ ID NO: 349158 - DNA, 20 bp, Artificial Sequence
  chemically synthesized
tagaaagactgaaactgatt

SEQ ID NO: 349159 - DNA, 20 bp, Artificial Sequence
  chemically synthesized
caaactttcatttacttaat

SEQ ID NO: 349160 - DNA, 20 bp, Artificial Sequence
  chemically synthesized
gaaactgattaagtaaatga

SEQ ID NO: 349161 - DNA, 20 bp, Artificial Sequence
  chemically synthesized
aatgaaagtttgtcacactt

SEQ ID NO: 349162 - DNA, 20 bp, Artificial Sequence
  chemically synthesized
atgaaagtttgtcacactta

SEQ ID NO: 349163 - DNA, 20 bp, Artificial Sequence
  chemically synthesized
atctgtagtagttacacctt

SEQ ID NO: 349164 - DNA, 20 bp, Artificial Sequence
  chemically synthesized
cacttaaggtgtaactacta

SEQ ID NO: 349165 - DNA, 20 bp, Artificial Sequence
  chemically synthesized
gcttctgttttcatctgtag

SEQ ID NO: 349166 - DNA, 20 bp, Artificial Sequence
  chemically synthesized
gtggcttctgttttcatctg

SEQ ID NO: 349167 - DNA, 20 bp, Artificial Sequence
  chemically synthesized
gtaactactacagatgaaaa

SEQ ID NO: 349168 - DNA, 20 bp, Artificial Sequence
  chemically synthesized
actactacagatgaaaacag

SEQ ID NO: 349169 - DNA, 20 bp, Artificial Sequence
  chemically synthesized
ttagtttgctaggtttgtag

SEQ ID NO: 349170 - DNA, 20 bp, Artificial Sequence
  chemically synthesized
aacagaagccactacaaacc

SEQ ID NO: 349171 - DNA, 20 bp, Artificial Sequence
  chemically synthesized
tacttagtttgctaggtttg

SEQ ID NO: 349172 - DNA, 20 bp, Artificial Sequence
  chemically synthesized
agaaatctacttagtttgct

SEQ ID NO: 349173 - DNA, 20 bp, Artificial Sequence
  chemically synthesized
cactacaaacctagcaaact

SEQ ID NO: 349174 - DNA, 20 bp, Artificial Sequence
  chemically synthesized
tagaaatctacttagtttgc

SEQ ID NO: 349175 - DNA, 20 bp, Artificial Sequence
  chemically synthesized
tacaaacctagcaaactaag

SEQ ID NO: 349176 - DNA, 20 bp, Artificial Sequence
  chemically synthesized
gaaaactttagaaatctact

SEQ ID NO: 349177 - DNA, 20 bp, Artificial Sequence
  chemically synthesized
gcaaactaagtagatttcta

SEQ ID NO: 349178 - DNA, 20 bp, Artificial Sequence
  chemically synthesized
aagtagatttctaaagtttt

SEQ ID NO: 349179 - DNA, 20 bp, Artificial Sequence
  chemically synthesized
ttttcacttgctgaaaactt

SEQ ID NO: 349180 - DNA, 20 bp, Artificial Sequence
  chemically synthesized
agatttctaaagttttcagc

SEQ ID NO: 349181 - DNA, 20 bp, Artificial Sequence
  chemically synthesized
ttagggaatttgtcaatgat

SEQ ID NO: 349182 - DNA, 20 bp, Artificial Sequence
  chemically synthesized
gtattaacaaaatgggatta

SEQ ID NO: 349183 - DNA, 20 bp, Artificial Sequence
  chemically synthesized
tgtattaacaaaatgggatt

SEQ ID NO: 349184 - DNA, 20 bp, Artificial Sequence
  chemically synthesized
gtgtattaacaaaatgggat

SEQ ID NO: 349185 - DNA, 20 bp, Artificial Sequence
  chemically synthesized
tgtgtgtgtattaacaaaat

SEQ ID NO: 349186 - DNA, 20 bp, Artificial Sequence
  chemically synthesized
gtgtgtgtgtattaacaaaa

SEQ ID NO: 349187 - DNA, 20 bp, Artificial Sequence
  chemically synthesized
gcacagaaggagtagtggca

SEQ ID NO: 349188 - DNA, 20 bp, Artificial Sequence
  chemically synthesized
gggcacagaaggagtagtgg

SEQ ID NO: 349189 - DNA, 20 bp, Artificial Sequence
  chemically synthesized
ttggggcacagaaggagtag

SEQ ID NO: 349190 - DNA, 20 bp, Artificial Sequence
  chemically synthesized
gtattggggcacagaaggag

SEQ ID NO: 349191 - DNA, 20 bp, Artificial Sequence
  chemically synthesized
gccgtattggggcacagaag

SEQ ID NO: 349192 - DNA, 20 bp, Artificial Sequence
  chemically synthesized
aagccgtattggggcacaga

SEQ ID NO: 349193 - DNA, 20 bp, Artificial Sequence
  chemically synthesized
aaagccgtattggggcacag

SEQ ID NO: 349194 - DNA, 20 bp, Artificial Sequence
  chemically synthesized
aaaaaagccgtattggggca

SEQ ID NO: 349195 - DNA, 20 bp, Artificial Sequence
  chemically synthesized
actccttctgtgccccaata

SEQ ID NO: 349196 - DNA, 20 bp, Artificial Sequence
  chemically synthesized
gtttgaaaaaagccgtattg

SEQ ID NO: 349197 - DNA, 20 bp, Artificial Sequence
  chemically synthesized
agtttgaaaaaagccgtatt

SEQ ID NO: 349198 - DNA, 20 bp, Artificial Sequence
  chemically synthesized
tagtttgaaaaaagccgtat

SEQ ID NO: 349199 - DNA, 20 bp, Artificial Sequence
  chemically synthesized
atataatagtagtttgaaaa

SEQ ID NO: 349200 - DNA, 20 bp, Artificial Sequence
  chemically synthesized
cacagcccttgatataatag

SEQ ID NO: 349201 - DNA, 20 bp, Artificial Sequence
  chemically synthesized
tttcaaactactattatatc

SEQ ID NO: 349202 - DNA, 20 bp, Artificial Sequence
  chemically synthesized
aatcacagcccttgatataa

SEQ ID NO: 349203 - DNA, 20 bp, Artificial Sequence
  chemically synthesized
ttcaaactactattatatca

SEQ ID NO: 349204 - DNA, 20 bp, Artificial Sequence
  chemically synthesized
tcaaactactattatatcaa

SEQ ID NO: 349205 - DNA, 20 bp, Artificial Sequence
  chemically synthesized
atattgcaaagacataatca

SEQ ID NO: 349206 - DNA, 20 bp, Artificial Sequence
  chemically synthesized
gagacactgaaaatattgca

SEQ ID NO: 349207 - DNA, 20 bp, Artificial Sequence
  chemically synthesized
ttatgtctttgcaatatttt

SEQ ID NO: 349208 - DNA, 20 bp, Artificial Sequence
  chemically synthesized
gttatgcatctttcaggggt

SEQ ID NO: 349209 - DNA, 20 bp, Artificial Sequence
  chemically synthesized
tttcagtgtctcacccctga

SEQ ID NO: 349210 - DNA, 20 bp, Artificial Sequence
  chemically synthesized
tgttgttatgcatctttcag

SEQ ID NO: 349211 - DNA, 20 bp, Artificial Sequence
  chemically synthesized
ttgttgttatgcatctttca

SEQ ID NO: 349212 - DNA, 20 bp, Artificial Sequence
  chemically synthesized
attgttgttatgcatctttc

SEQ ID NO: 349213 - DNA, 20 bp, Artificial Sequence
  chemically synthesized
aattgttgttatgcatcttt

SEQ ID NO: 349214 - DNA, 20 bp, Artificial Sequence
  chemically synthesized
gaaagatgcataacaacaat

SEQ ID NO: 349215 - DNA, 20 bp, Artificial Sequence
  chemically synthesized
attggttaaatataactaaa

SEQ ID NO: 349216 - DNA, 20 bp, Artificial Sequence
  chemically synthesized
tcatcacagggaatactatt

SEQ ID NO: 349217 - DNA, 20 bp, Artificial Sequence
  chemically synthesized
tattttggagagtcatcaca

SEQ ID NO: 349218 - DNA, 20 bp, Artificial Sequence
  chemically synthesized
atattttggagagtcatcac

SEQ ID NO: 349219 - DNA, 20 bp, Artificial Sequence
  chemically synthesized
tatattttggagagtcatca

SEQ ID NO: 349220 - DNA, 20 bp, Artificial Sequence
  chemically synthesized
agaaactcgtatattttgga

SEQ ID NO: 349221 - DNA, 20 bp, Artificial Sequence
  chemically synthesized
acagaaactcgtatattttg

SEQ ID NO: 349222 - DNA, 20 bp, Artificial Sequence
  chemically synthesized
gtacagaaactcgtatattt

SEQ ID NO: 349223 - DNA, 20 bp, Artificial Sequence
  chemically synthesized
gatgactctccaaaatatac

SEQ ID NO: 349224 - DNA, 20 bp, Artificial Sequence
  chemically synthesized
ctgaaatagcaaaagtggta

SEQ ID NO: 349225 - DNA, 20 bp, Artificial Sequence
  chemically synthesized
aacctctgaaatagcaaaag

SEQ ID NO: 349226 - DNA, 20 bp, Artificial Sequence
  chemically synthesized
gtcaacctctgaaatagcaa

SEQ ID NO: 349227 - DNA, 20 bp, Artificial Sequence
  chemically synthesized
ctgtaccacttttgctattt

SEQ ID NO: 349228 - DNA, 20 bp, Artificial Sequence
  chemically synthesized
gtaccacttttgctatttca

SEQ ID NO: 349229 - DNA, 20 bp, Artificial Sequence
  chemically synthesized
taccacttttgctatttcag

SEQ ID NO: 349230 - DNA, 20 bp, Artificial Sequence
  chemically synthesized
aaaatagtcaacctctgaaa

SEQ ID NO: 349231 - DNA, 20 bp, Artificial Sequence
  chemically synthesized
ctctggctctagcattaaaa

SEQ ID NO: 349232 - DNA, 20 bp, Artificial Sequence
  chemically synthesized
gaggttgactattttaatgc

SEQ ID NO: 349233 - DNA, 20 bp, Artificial Sequence
  chemically synthesized
ggttgactattttaatgcta

SEQ ID NO: 349234 - DNA, 20 bp, Artificial Sequence
  chemically synthesized
gactattttaatgctagagc

SEQ ID NO: 349235 - DNA, 20 bp, Artificial Sequence
  chemically synthesized
ctattttaatgctagagcca

SEQ ID NO: 349236 - DNA, 20 bp, Artificial Sequence
  chemically synthesized
gattactgtgtctctggctc

SEQ ID NO: 349237 - DNA, 20 bp, Artificial Sequence
  chemically synthesized
taatgctagagccagagaca

SEQ ID NO: 349238 - DNA, 20 bp, Artificial Sequence
  chemically synthesized
cacttggattactgtgtctc

SEQ ID NO: 349239 - DNA, 20 bp, Artificial Sequence
  chemically synthesized
agccagagacacagtaatcc

SEQ ID NO: 349240 - DNA, 20 bp, Artificial Sequence
  chemically synthesized
tttagtttgagcatgtcact

SEQ ID NO: 349241 - DNA, 20 bp, Artificial Sequence
  chemically synthesized
aagtgacatgctcaaactaa

SEQ ID NO: 349242 - DNA, 20 bp, Artificial Sequence
  chemically synthesized
ttgatcagtgcttttagttt

SEQ ID NO: 349243 - DNA, 20 bp, Artificial Sequence
  chemically synthesized
tcattcttgatcagtgcttt

SEQ ID NO: 349244 - DNA, 20 bp, Artificial Sequence
  chemically synthesized
tcaaactaaaagcactgatc

SEQ ID NO: 349245 - DNA, 20 bp, Artificial Sequence
  chemically synthesized
aaaatcctctcattcttgat

SEQ ID NO: 349246 - DNA, 20 bp, Artificial Sequence
  chemically synthesized
taaaagcactgatcaagaat

SEQ ID NO: 349247 - DNA, 20 bp, Artificial Sequence
  chemically synthesized
aaagcactgatcaagaatga

SEQ ID NO: 349248 - DNA, 20 bp, Artificial Sequence
  chemically synthesized
aagcactgatcaagaatgag

SEQ ID NO: 349249 - DNA, 20 bp, Artificial Sequence
  chemically synthesized
gaggattttgttttatcttt

SEQ ID NO: 349250 - DNA, 20 bp, Artificial Sequence
  chemically synthesized
aggattttgttttatctttg

SEQ ID NO: 349251 - DNA, 20 bp, Artificial Sequence
  chemically synthesized
agaataatgtataaacctca

SEQ ID NO: 349252 - DNA, 20 bp, Artificial Sequence
  chemically synthesized
gtttatacattattcttctc

SEQ ID NO: 349253 - DNA, 20 bp, Artificial Sequence
  chemically synthesized
tttatacattattcttctca

SEQ ID NO: 349254 - DNA, 20 bp, Artificial Sequence
  chemically synthesized
atgttgagcccatccttgag

SEQ ID NO: 349255 - DNA, 20 bp, Artificial Sequence
  chemically synthesized
tacattattcttctcaagga

SEQ ID NO: 349256 - DNA, 20 bp, Artificial Sequence
  chemically synthesized
acattattcttctcaaggat

SEQ ID NO: 349257 - DNA, 20 bp, Artificial Sequence
  chemically synthesized
tagatgttgagcccatcctt

SEQ ID NO: 349258 - DNA, 20 bp, Artificial Sequence
  chemically synthesized
caaggatgggctcaacatct

SEQ ID NO: 349259 - DNA, 20 bp, Artificial Sequence
  chemically synthesized
atgtaagatacttagatgtt

SEQ ID NO: 349260 - DNA, 20 bp, Artificial Sequence
  chemically synthesized
catttaacatgtaagatact

SEQ ID NO: 349261 - DNA, 20 bp, Artificial Sequence
  chemically synthesized
aatggtttcatttaacatgt

SEQ ID NO: 349262 - DNA, 20 bp, Artificial Sequence
  chemically synthesized
atgttaaatgaaaccattcc

SEQ ID NO: 349263 - DNA, 20 bp, Artificial Sequence
  chemically synthesized
tttatctttttgacttggaa

SEQ ID NO: 349264 - DNA, 20 bp, Artificial Sequence
  chemically synthesized
tgaaaccattccaagtcaaa

SEQ ID NO: 349265 - DNA, 20 bp, Artificial Sequence
  chemically synthesized
gtatttttatctttttgact

SEQ ID NO: 349266 - DNA, 20 bp, Artificial Sequence
  chemically synthesized
agtgctctatataaatatat

SEQ ID NO: 349267 - DNA, 20 bp, Artificial Sequence
  chemically synthesized
aaaataccaatatatttata

SEQ ID NO: 349268 - DNA, 20 bp, Artificial Sequence
  chemically synthesized
aataccaatatatttatata

SEQ ID NO: 349269 - DNA, 20 bp, Artificial Sequence
  chemically synthesized
aatatatttatatagagcac

SEQ ID NO: 349270 - DNA, 20 bp, Artificial Sequence
  chemically synthesized
atatatttatatagagcact

SEQ ID NO: 349271 - DNA, 20 bp, Artificial Sequence
  chemically synthesized
atatttatatagagcactag

SEQ ID NO: 349272 - DNA, 20 bp, Artificial Sequence
  chemically synthesized
tatttatatagagcactagg

SEQ ID NO: 349273 - DNA, 20 bp, Artificial Sequence
  chemically synthesized
ctggcttagttaggacctcc

SEQ ID NO: 349274 - DNA, 20 bp, Artificial Sequence
  chemically synthesized
agcactaggaggtcctaact

SEQ ID NO: 349275 - DNA, 20 bp, Artificial Sequence
  chemically synthesized
tcaaaatcactggcttagtt

SEQ ID NO: 349276 - DNA, 20 bp, Artificial Sequence
  chemically synthesized
ctaggaggtcctaactaagc

SEQ ID NO: 349277 - DNA, 20 bp, Artificial Sequence
  chemically synthesized
atcaaaatcactggcttagt

SEQ ID NO: 349278 - DNA, 20 bp, Artificial Sequence
  chemically synthesized
gagtatcaaaatcactggct

SEQ ID NO: 349279 - DNA, 20 bp, Artificial Sequence
  chemically synthesized
agtcagagtatcaaaatcac

SEQ ID NO: 349280 - DNA, 20 bp, Artificial Sequence
  chemically synthesized
aattggctatggcatagtca

SEQ ID NO: 349281 - DNA, 20 bp, Artificial Sequence
  chemically synthesized
tgaattggctatggcatagt

SEQ ID NO: 349282 - DNA, 20 bp, Artificial Sequence
  chemically synthesized
ttgatactctgactatgcca

SEQ ID NO: 349283 - DNA, 20 bp, Artificial Sequence
  chemically synthesized
tccttgaattggctatggca

SEQ ID NO: 349284 - DNA, 20 bp, Artificial Sequence
  chemically synthesized
attactccttgaattggcta

SEQ ID NO: 349285 - DNA, 20 bp, Artificial Sequence
  chemically synthesized
gactatgccatagccaattc

SEQ ID NO: 349286 - DNA, 20 bp, Artificial Sequence
  chemically synthesized
actatgccatagccaattca

SEQ ID NO: 349287 - DNA, 20 bp, Artificial Sequence
  chemically synthesized
tatgccatagccaattcaag

SEQ ID NO: 349288 - DNA, 20 bp, Artificial Sequence
  chemically synthesized
ccttctattactccttgaat

SEQ ID NO: 349289 - DNA, 20 bp, Artificial Sequence
  chemically synthesized
atagccaattcaaggagtaa

SEQ ID NO: 349290 - DNA, 20 bp, Artificial Sequence
  chemically synthesized
gccaattcaaggagtaatag

SEQ ID NO: 349291 - DNA, 20 bp, Artificial Sequence
  chemically synthesized
ccaattcaaggagtaataga

SEQ ID NO: 349292 - DNA, 20 bp, Artificial Sequence
  chemically synthesized
tagaaggaaacacctgaaac

SEQ ID NO: 349293 - DNA, 20 bp, Artificial Sequence
  chemically synthesized
tcttcttctgtaccggtttc

SEQ ID NO: 349294 - DNA, 20 bp, Artificial Sequence
  chemically synthesized
atcttcttctgtaccggttt

SEQ ID NO: 349295 - DNA, 20 bp, Artificial Sequence
  chemically synthesized
ggaaacacctgaaaccggta

SEQ ID NO: 349296 - DNA, 20 bp, Artificial Sequence
  chemically synthesized
aacacctgaaaccggtacag

SEQ ID NO: 349297 - DNA, 20 bp, Artificial Sequence
  chemically synthesized
agttctatcttcttctgtac

SEQ ID NO: 349298 - DNA, 20 bp, Artificial Sequence
  chemically synthesized
acctgaaaccggtacagaag

SEQ ID NO: 349299 - DNA, 20 bp, Artificial Sequence
  chemically synthesized
gaaaccggtacagaagaaga

SEQ ID NO: 349300 - DNA, 20 bp, Artificial Sequence
  chemically synthesized
ggtacagaagaagatagaac

SEQ ID NO: 349301 - DNA, 20 bp, Artificial Sequence
  chemically synthesized
acagaagaagatagaactag

SEQ ID NO: 349302 - DNA, 20 bp, Artificial Sequence
  chemically synthesized
agaagatagaactagaagaa

SEQ ID NO: 349303 - DNA, 20 bp, Artificial Sequence
  chemically synthesized
gaagatagaactagaagaat

SEQ ID NO: 349304 - DNA, 20 bp, Artificial Sequence
  chemically synthesized
gcattgacagcccattcttc

SEQ ID NO: 349305 - DNA, 20 bp, Artificial Sequence
  chemically synthesized
cctcatcagttaggcattga

SEQ ID NO: 349306 - DNA, 20 bp, Artificial Sequence
  chemically synthesized
gctgtcaatgcctaactgat

SEQ ID NO: 349307 - DNA, 20 bp, Artificial Sequence
  chemically synthesized
aaccaatgccctcatcagtt

SEQ ID NO: 349308 - DNA, 20 bp, Artificial Sequence
  chemically synthesized
ctgtcaatgcctaactgatg

SEQ ID NO: 349309 - DNA, 20 bp, Artificial Sequence
  chemically synthesized
caaccaatgccctcatcagt

SEQ ID NO: 349310 - DNA, 20 bp, Artificial Sequence
  chemically synthesized
tgtcaatgcctaactgatga

SEQ ID NO: 349311 - DNA, 20 bp, Artificial Sequence
  chemically synthesized
tggccaaccaatgccctcat

SEQ ID NO: 349312 - DNA, 20 bp, Artificial Sequence
  chemically synthesized
tgcctaactgatgagggcat

SEQ ID NO: 349313 - DNA, 20 bp, Artificial Sequence
  chemically synthesized
taactgatgagggcattggt

SEQ ID NO: 349314 - DNA, 20 bp, Artificial Sequence
  chemically synthesized
ttaccatttcaaattatgaa

SEQ ID NO: 349315 - DNA, 20 bp, Artificial Sequence
  chemically synthesized
tggccattcataatttgaaa

SEQ ID NO: 349316 - DNA, 20 bp, Artificial Sequence
  chemically synthesized
aatttgaaatggtaaatcac

SEQ ID NO: 349317 - DNA, 20 bp, Artificial Sequence
  chemically synthesized
tatctgctttaggaaatagc

SEQ ID NO: 349318 - DNA, 20 bp, Artificial Sequence
  chemically synthesized
aaatcactagctatttccta

SEQ ID NO: 349319 - DNA, 20 bp, Artificial Sequence
  chemically synthesized
gcagtatctgctttaggaaa

SEQ ID NO: 349320 - DNA, 20 bp, Artificial Sequence
  chemically synthesized
tcactagctatttcctaaag

SEQ ID NO: 349321 - DNA, 20 bp, Artificial Sequence
  chemically synthesized
tttacagcagtatctgcttt

SEQ ID NO: 349322 - DNA, 20 bp, Artificial Sequence
  chemically synthesized
ttttacagcagtatctgctt

SEQ ID NO: 349323 - DNA, 20 bp, Artificial Sequence
  chemically synthesized
taaagcagatactgctgtaa

SEQ ID NO: 349324 - DNA, 20 bp, Artificial Sequence
  chemically synthesized
gaaatcagaaacttttacag

SEQ ID NO: 349325 - DNA, 20 bp, Artificial Sequence
  chemically synthesized
ggagaaatcagaaactttta

SEQ ID NO: 349326 - DNA, 20 bp, Artificial Sequence
  chemically synthesized
aaatgacctcagggagaaat

SEQ ID NO: 349327 - DNA, 20 bp, Artificial Sequence
  chemically synthesized
aaagtttctgatttctccct

SEQ ID NO: 349328 - DNA, 20 bp, Artificial Sequence
  chemically synthesized
aagtttctgatttctccctg

SEQ ID NO: 349329 - DNA, 20 bp, Artificial Sequence
  chemically synthesized
cctgtttaaatgacctcagg

SEQ ID NO: 349330 - DNA, 20 bp, Artificial Sequence
  chemically synthesized
gacctgtttaaatgacctca

SEQ ID NO: 349331 - DNA, 20 bp, Artificial Sequence
  chemically synthesized
agacctgtttaaatgacctc

SEQ ID NO: 349332 - DNA, 20 bp, Artificial Sequence
  chemically synthesized
aagacctgtttaaatgacct

SEQ ID NO: 349333 - DNA, 20 bp, Artificial Sequence
  chemically synthesized
tctccctgaggtcatttaaa

SEQ ID NO: 349334 - DNA, 20 bp, Artificial Sequence
  chemically synthesized
ctccctgaggtcatttaaac

SEQ ID NO: 349335 - DNA, 20 bp, Artificial Sequence
  chemically synthesized
cggcattcaaaaatgaagca

SEQ ID NO: 349336 - DNA, 20 bp, Artificial Sequence
  chemically synthesized
aataacggcattcaaaaatg

SEQ ID NO: 349337 - DNA, 20 bp, Artificial Sequence
  chemically synthesized
aatatgtcatgaattaataa

SEQ ID NO: 349338 - DNA, 20 bp, Artificial Sequence
  chemically synthesized
tgggatgtaagtgcatatag

SEQ ID NO: 349339 - DNA, 20 bp, Artificial Sequence
  chemically synthesized
ttgtgggatgtaagtgcata

SEQ ID NO: 349340 - DNA, 20 bp, Artificial Sequence
  chemically synthesized
agattcatcttgtgggatgt

SEQ ID NO: 349341 - DNA, 20 bp, Artificial Sequence
  chemically synthesized
tatatgcacttacatcccac

SEQ ID NO: 349342 - DNA, 20 bp, Artificial Sequence
  chemically synthesized
ccaaaggagattcatcttgt

SEQ ID NO: 349343 - DNA, 20 bp, Artificial Sequence
  chemically synthesized
tccaaaggagattcatcttg

SEQ ID NO: 349344 - DNA, 20 bp, Artificial Sequence
  chemically synthesized
cccacaagatgaatctcctt

SEQ ID NO: 349345 - DNA, 20 bp, Artificial Sequence
  chemically synthesized
cacaagatgaatctcctttg

SEQ ID NO: 349346 - DNA, 20 bp, Artificial Sequence
  chemically synthesized
acaagatgaatctcctttgg

SEQ ID NO: 349347 - DNA, 20 bp, Artificial Sequence
  chemically synthesized
caagatgaatctcctttgga

SEQ ID NO: 349348 - DNA, 20 bp, Artificial Sequence
  chemically synthesized
ggccaataggccctccaaag

SEQ ID NO: 349349 - DNA, 20 bp, Artificial Sequence
  chemically synthesized
tgggccaataggccctccaa

SEQ ID NO: 349350 - DNA, 20 bp, Artificial Sequence
  chemically synthesized
ttgggccaataggccctcca

SEQ ID NO: 349351 - DNA, 20 bp, Artificial Sequence
  chemically synthesized
atctcctttggagggcctat

SEQ ID NO: 349352 - DNA, 20 bp, Artificial Sequence
  chemically synthesized
atattagtagttgggccaat

SEQ ID NO: 349353 - DNA, 20 bp, Artificial Sequence
  chemically synthesized
tatattagtagttgggccaa

SEQ ID NO: 349354 - DNA, 20 bp, Artificial Sequence
  chemically synthesized
aatgacttatattagtagtt

SEQ ID NO: 349355 - DNA, 20 bp, Artificial Sequence
  chemically synthesized
caatgacttatattagtagt

SEQ ID NO: 349356 - DNA, 20 bp, Artificial Sequence
  chemically synthesized
attggcccaactactaatat

SEQ ID NO: 349357 - DNA, 20 bp, Artificial Sequence
  chemically synthesized
ctaacaatgacttatattag

SEQ ID NO: 349358 - DNA, 20 bp, Artificial Sequence
  chemically synthesized
ctactaacaatgacttatat

SEQ ID NO: 349359 - DNA, 20 bp, Artificial Sequence
  chemically synthesized
ctactaatataagtcattgt

SEQ ID NO: 349360 - DNA, 20 bp, Artificial Sequence
  chemically synthesized
ctaatataagtcattgttag

SEQ ID NO: 349361 - DNA, 20 bp, Artificial Sequence
  chemically synthesized
aaggttaggaaagggagatg

SEQ ID NO: 349362 - DNA, 20 bp, Artificial Sequence
  chemically synthesized
aaagaaaaggttaggaaagg

SEQ ID NO: 349363 - DNA, 20 bp, Artificial Sequence
  chemically synthesized
agaaagaaaaggttaggaaa

SEQ ID NO: 349364 - DNA, 20 bp, Artificial Sequence
  chemically synthesized
tagaaagaaaaggttaggaa

SEQ ID NO: 349365 - DNA, 20 bp, Artificial Sequence
  chemically synthesized
gtagaaagaaaaggttagga

SEQ ID NO: 349366 - DNA, 20 bp, Artificial Sequence
  chemically synthesized
aaacgtagaaagaaaaggtt

SEQ ID NO: 349367 - DNA, 20 bp, Artificial Sequence
  chemically synthesized
taaacgtagaaagaaaaggt

SEQ ID NO: 349368 - DNA, 20 bp, Artificial Sequence
  chemically synthesized
cttgtaaacgtagaaagaaa

SEQ ID NO: 349369 - DNA, 20 bp, Artificial Sequence
  chemically synthesized
ccttgtaaacgtagaaagaa

SEQ ID NO: 349370 - DNA, 20 bp, Artificial Sequence
  chemically synthesized
ttcccccttgtaaacgtaga

SEQ ID NO: 349371 - DNA, 20 bp, Artificial Sequence
  chemically synthesized
ccttttctttctacgtttac

SEQ ID NO: 349372 - DNA, 20 bp, Artificial Sequence
  chemically synthesized
gctgttcccccttgtaaacg

SEQ ID NO: 349373 - DNA, 20 bp, Artificial Sequence
  chemically synthesized
cttttctttctacgtttaca

SEQ ID NO: 349374 - DNA, 20 bp, Artificial Sequence
  chemically synthesized
ttttctttctacgtttacaa

SEQ ID NO: 349375 - DNA, 20 bp, Artificial Sequence
  chemically synthesized
tttctttctacgtttacaag

SEQ ID NO: 349376 - DNA, 20 bp, Artificial Sequence
  chemically synthesized
ttctttctacgtttacaagg

SEQ ID NO: 349377 - DNA, 20 bp, Artificial Sequence
  chemically synthesized
tctacgtttacaagggggaa

SEQ ID NO: 349378 - DNA, 20 bp, Artificial Sequence
  chemically synthesized
aataaacatcatttaaaaat

SEQ ID NO: 349379 - DNA, 20 bp, Artificial Sequence
  chemically synthesized
catcatttaaaaatcagcaa

SEQ ID NO: 349380 - DNA, 20 bp, Artificial Sequence
  chemically synthesized
ttaaaaatcagcaatagcat

SEQ ID NO: 349381 - DNA, 20 bp, Artificial Sequence
  chemically synthesized
atagcatgagttacaataac

SEQ ID NO: 349382 - DNA, 20 bp, Artificial Sequence
  chemically synthesized
atatagtacagagtaaagac

SEQ ID NO: 349383 - DNA, 20 bp, Artificial Sequence
  chemically synthesized
acttcatatagtacagagta

SEQ ID NO: 349384 - DNA, 20 bp, Artificial Sequence
  chemically synthesized
taaatacttcatatagtaca

SEQ ID NO: 349385 - DNA, 20 bp, Artificial Sequence
  chemically synthesized
gttaaatacttcatatagta

SEQ ID NO: 349386 - DNA, 20 bp, Artificial Sequence
  chemically synthesized
tctttactctgtactatatg

SEQ ID NO: 349387 - DNA, 20 bp, Artificial Sequence
  chemically synthesized
tgtatgttaaatacttcata

SEQ ID NO: 349388 - DNA, 20 bp, Artificial Sequence
  chemically synthesized
caatgtggttaataataaat

SEQ ID NO: 349389 - DNA, 20 bp, Artificial Sequence
  chemically synthesized
gcaatgtggttaataataaa

SEQ ID NO: 349390 - DNA, 20 bp, Artificial Sequence
  chemically synthesized
gtttcctcatttgtgcaatg

SEQ ID NO: 349391 - DNA, 20 bp, Artificial Sequence
  chemically synthesized
attaaccacattgcacaaat

SEQ ID NO: 349392 - DNA, 20 bp, Artificial Sequence
  chemically synthesized
ttaaccacattgcacaaatg

SEQ ID NO: 349393 - DNA, 20 bp, Artificial Sequence
  chemically synthesized
tacacaagcaattagttcgt

SEQ ID NO: 349394 - DNA, 20 bp, Artificial Sequence
  chemically synthesized
aaaaactttacacaagcaat

SEQ ID NO: 349395 - DNA, 20 bp, Artificial Sequence
  chemically synthesized
acgaactaattgcttgtgta

SEQ ID NO: 349396 - DNA, 20 bp, Artificial Sequence
  chemically synthesized
tgaccttaaaaactttacac

SEQ ID NO: 349397 - DNA, 20 bp, Artificial Sequence
  chemically synthesized
attgcttgtgtaaagttttt

SEQ ID NO: 349398 - DNA, 20 bp, Artificial Sequence
  chemically synthesized
ttgcttgtgtaaagttttta

SEQ ID NO: 349399 - DNA, 20 bp, Artificial Sequence
  chemically synthesized
agtttttaaggtcacacatc

SEQ ID NO: 349400 - DNA, 20 bp, Artificial Sequence
  chemically synthesized
ttttaaggtcacacatctgg

SEQ ID NO: 349401 - DNA, 20 bp, Artificial Sequence
  chemically synthesized
tttaaggtcacacatctggt

SEQ ID NO: 349402 - DNA, 20 bp, Artificial Sequence
  chemically synthesized
aaggtcacacatctggtagg

SEQ ID NO: 349403 - DNA, 20 bp, Artificial Sequence
  chemically synthesized
atcctagctctgctacctac

SEQ ID NO: 349404 - DNA, 20 bp, Artificial Sequence
  chemically synthesized
gtcacacatctggtaggtag

SEQ ID NO: 349405 - DNA, 20 bp, Artificial Sequence
  chemically synthesized
cacacatctggtaggtagca

SEQ ID NO: 349406 - DNA, 20 bp, Artificial Sequence
  chemically synthesized
catctggtaggtagcagagc

SEQ ID NO: 349407 - DNA, 20 bp, Artificial Sequence
  chemically synthesized
atctggtaggtagcagagct

SEQ ID NO: 349408 - DNA, 20 bp, Artificial Sequence
  chemically synthesized
ggtagcagagctaggattca

SEQ ID NO: 349409 - DNA, 20 bp, Artificial Sequence
  chemically synthesized
gctgcactgtctttgaatcc

SEQ ID NO: 349410 - DNA, 20 bp, Artificial Sequence
  chemically synthesized
gcagagctaggattcaaaga

SEQ ID NO: 349411 - DNA, 20 bp, Artificial Sequence
  chemically synthesized
gctaggattcaaagacagtg

SEQ ID NO: 349412 - DNA, 20 bp, Artificial Sequence
  chemically synthesized
attcaaagacagtgcagctc

SEQ ID NO: 349413 - DNA, 20 bp, Artificial Sequence
  chemically synthesized
tcaaagacagtgcagctcaa

SEQ ID NO: 349414 - DNA, 20 bp, Artificial Sequence
  chemically synthesized
agtaaagagcataggctctt

SEQ ID NO: 349415 - DNA, 20 bp, Artificial Sequence
  chemically synthesized
tatgtaagagtaaagagcat

SEQ ID NO: 349416 - DNA, 20 bp, Artificial Sequence
  chemically synthesized
ctatgtaagagtaaagagca

SEQ ID NO: 349417 - DNA, 20 bp, Artificial Sequence
  chemically synthesized
tacctctatgtaagagtaaa

SEQ ID NO: 349418 - DNA, 20 bp, Artificial Sequence
  chemically synthesized
tctacctctatgtaagagta

SEQ ID NO: 349419 - DNA, 20 bp, Artificial Sequence
  chemically synthesized
ctatgctctttactcttaca

SEQ ID NO: 349420 - DNA, 20 bp, Artificial Sequence
  chemically synthesized
atgctctttactcttacata

SEQ ID NO: 349421 - DNA, 20 bp, Artificial Sequence
  chemically synthesized
aaacgtctacctctatgtaa

SEQ ID NO: 349422 - DNA, 20 bp, Artificial Sequence
  chemically synthesized
tgctctttactcttacatag

SEQ ID NO: 349423 - DNA, 20 bp, Artificial Sequence
  chemically synthesized
taaaacgtctacctctatgt

SEQ ID NO: 349424 - DNA, 20 bp, Artificial Sequence
  chemically synthesized
tctttactcttacatagagg

SEQ ID NO: 349425 - DNA, 20 bp, Artificial Sequence
  chemically synthesized
acatagaggtagacgtttta

SEQ ID NO: 349426 - DNA, 20 bp, Artificial Sequence
  chemically synthesized
catagaggtagacgttttaa

SEQ ID NO: 349427 - DNA, 20 bp, Artificial Sequence
  chemically synthesized
atagaggtagacgttttaaa

SEQ ID NO: 349428 - DNA, 20 bp, Artificial Sequence
  chemically synthesized
taaagggacaaaaatattct

SEQ ID NO: 349429 - DNA, 20 bp, Artificial Sequence
  chemically synthesized
atagggagaaatgatcaact

SEQ ID NO: 349430 - DNA, 20 bp, Artificial Sequence
  chemically synthesized
ttgatcatttctccctatgt

SEQ ID NO: 349431 - DNA, 20 bp, Artificial Sequence
  chemically synthesized
tattagttcacttacatagg

SEQ ID NO: 349432 - DNA, 20 bp, Artificial Sequence
  chemically synthesized
tatattagttcacttacata

SEQ ID NO: 349433 - DNA, 20 bp, Artificial Sequence
  chemically synthesized
atatattagttcacttacat

SEQ ID NO: 349434 - DNA, 20 bp, Artificial Sequence
  chemically synthesized
gatatattagttcacttaca

SEQ ID NO: 349435 - DNA, 20 bp, Artificial Sequence
  chemically synthesized
ttgattagggagtgatatat

SEQ ID NO: 349436 - DNA, 20 bp, Artificial Sequence
  chemically synthesized
ggatacagggattgattagg

SEQ ID NO: 349437 - DNA, 20 bp, Artificial Sequence
  chemically synthesized
taggatacagggattgatta

SEQ ID NO: 349438 - DNA, 20 bp, Artificial Sequence
  chemically synthesized
ttaggatacagggattgatt

SEQ ID NO: 349439 - DNA, 20 bp, Artificial Sequence
  chemically synthesized
tttaggatacagggattgat

SEQ ID NO: 349440 - DNA, 20 bp, Artificial Sequence
  chemically synthesized
tattaactctttaggataca

SEQ ID NO: 349441 - DNA, 20 bp, Artificial Sequence
  chemically synthesized
atattaactctttaggatac

SEQ ID NO: 349442 - DNA, 20 bp, Artificial Sequence
  chemically synthesized
taatcaatccctgtatccta

SEQ ID NO: 349443 - DNA, 20 bp, Artificial Sequence
  chemically synthesized
tatattaactctttaggata

SEQ ID NO: 349444 - DNA, 20 bp, Artificial Sequence
  chemically synthesized
atcaatccctgtatcctaaa

SEQ ID NO: 349445 - DNA, 20 bp, Artificial Sequence
  chemically synthesized
acatcctatattaactcttt

SEQ ID NO: 349446 - DNA, 20 bp, Artificial Sequence
  chemically synthesized
tacatcctatattaactctt

SEQ ID NO: 349447 - DNA, 20 bp, Artificial Sequence
  chemically synthesized
tgtatcctaaagagttaata

SEQ ID NO: 349448 - DNA, 20 bp, Artificial Sequence
  chemically synthesized
gtatcctaaagagttaatat

SEQ ID NO: 349449 - DNA, 20 bp, Artificial Sequence
  chemically synthesized
agttaatataggatgtaata

SEQ ID NO: 349450 - DNA, 20 bp, Artificial Sequence
  chemically synthesized
gttaatataggatgtaatat

SEQ ID NO: 349451 - DNA, 20 bp, Artificial Sequence
  chemically synthesized
gatgtaatataggatgatct

SEQ ID NO: 349452 - DNA, 20 bp, Artificial Sequence
  chemically synthesized
tataggatgatctaagaact

SEQ ID NO: 349453 - DNA, 20 bp, Artificial Sequence
  chemically synthesized
gtctgttgtatccgagttct

SEQ ID NO: 349454 - DNA, 20 bp, Artificial Sequence
  chemically synthesized
ggggggagtctgttgtatcc

SEQ ID NO: 349455 - DNA, 20 bp, Artificial Sequence
  chemically synthesized
atctaagaactcggatacaa

SEQ ID NO: 349456 - DNA, 20 bp, Artificial Sequence
  chemically synthesized
ctcttgcttgatataggggg

SEQ ID NO: 349457 - DNA, 20 bp, Artificial Sequence
  chemically synthesized
gactcttgcttgatataggg

SEQ ID NO: 349458 - DNA, 20 bp, Artificial Sequence
  chemically synthesized
ggactcttgcttgatatagg

SEQ ID NO: 349459 - DNA, 20 bp, Artificial Sequence
  chemically synthesized
aacagactcccccctatatc

SEQ ID NO: 349460 - DNA, 20 bp, Artificial Sequence
  chemically synthesized
gggactcttgcttgatatag

SEQ ID NO: 349461 - DNA, 20 bp, Artificial Sequence
  chemically synthesized
agggactcttgcttgatata

SEQ ID NO: 349462 - DNA, 20 bp, Artificial Sequence
  chemically synthesized
aagggactcttgcttgatat

SEQ ID NO: 349463 - DNA, 20 bp, Artificial Sequence
  chemically synthesized
taagggactcttgcttgata

SEQ ID NO: 349464 - DNA, 20 bp, Artificial Sequence
  chemically synthesized
gactcccccctatatcaagc

SEQ ID NO: 349465 - DNA, 20 bp, Artificial Sequence
  chemically synthesized
ctcccccctatatcaagcaa

SEQ ID NO: 349466 - DNA, 20 bp, Artificial Sequence
  chemically synthesized
aagcaagagtcccttatgcc

SEQ ID NO: 349467 - DNA, 20 bp, Artificial Sequence
  chemically synthesized
ggtaattatgcttggcataa

SEQ ID NO: 349468 - DNA, 20 bp, Artificial Sequence
  chemically synthesized
gggtaattatgcttggcata

SEQ ID NO: 349469 - DNA, 20 bp, Artificial Sequence
  chemically synthesized
cgggtaattatgcttggcat

SEQ ID NO: 349470 - DNA, 20 bp, Artificial Sequence
  chemically synthesized
ccatcacgggtaattatgct

SEQ ID NO: 349471 - DNA, 20 bp, Artificial Sequence
  chemically synthesized
ccaagcataattacccgtga

SEQ ID NO: 349472 - DNA, 20 bp, Artificial Sequence
  chemically synthesized
gattttatgttagccatcac

SEQ ID NO: 349473 - DNA, 20 bp, Artificial Sequence
  chemically synthesized
cgattttatgttagccatca

SEQ ID NO: 349474 - DNA, 20 bp, Artificial Sequence
  chemically synthesized
ttccccaaacgattttatgt

SEQ ID NO: 349475 - DNA, 20 bp, Artificial Sequence
  chemically synthesized
atggctaacataaaatcgtt

SEQ ID NO: 349476 - DNA, 20 bp, Artificial Sequence
  chemically synthesized
tggctaacataaaatcgttt

SEQ ID NO: 349477 - DNA, 20 bp, Artificial Sequence
  chemically synthesized
ggctaacataaaatcgtttg

SEQ ID NO: 349478 - DNA, 20 bp, Artificial Sequence
  chemically synthesized
ataaacatatcaaattgttt

SEQ ID NO: 349479 - DNA, 20 bp, Artificial Sequence
  chemically synthesized
atatcaaattgtttaagctc

SEQ ID NO: 349480 - DNA, 20 bp, Artificial Sequence
  chemically synthesized
tcaaattgtttaagctcaag

SEQ ID NO: 349481 - DNA, 20 bp, Artificial Sequence
  chemically synthesized
gagtttctgtaaatctactt

SEQ ID NO: 349482 - DNA, 20 bp, Artificial Sequence
  chemically synthesized
tttaagctcaagtagattta

SEQ ID NO: 349483 - DNA, 20 bp, Artificial Sequence
  chemically synthesized
caagtagatttacagaaact

SEQ ID NO: 349484 - DNA, 20 bp, Artificial Sequence
  chemically synthesized
aagtagatttacagaaactc

SEQ ID NO: 349485 - DNA, 20 bp, Artificial Sequence
  chemically synthesized
tggaacacatgagtttgccc

SEQ ID NO: 349486 - DNA, 20 bp, Artificial Sequence
  chemically synthesized
ggtgttatcttggaacacat

SEQ ID NO: 349487 - DNA, 20 bp, Artificial Sequence
  chemically synthesized
cgggcaaactcatgtgttcc

SEQ ID NO: 349488 - DNA, 20 bp, Artificial Sequence
  chemically synthesized
gacagtctgtggtgttatct

SEQ ID NO: 349489 - DNA, 20 bp, Artificial Sequence
  chemically synthesized
tgtgttccaagataacacca

SEQ ID NO: 349490 - DNA, 20 bp, Artificial Sequence
  chemically synthesized
tgagttgctgtgacagtctg

SEQ ID NO: 349491 - DNA, 20 bp, Artificial Sequence
  chemically synthesized
gataacaccacagactgtca

SEQ ID NO: 349492 - DNA, 20 bp, Artificial Sequence
  chemically synthesized
taccagatgagttgctgtga

SEQ ID NO: 349493 - DNA, 20 bp, Artificial Sequence
  chemically synthesized
gactgtcacagcaactcatc

SEQ ID NO: 349494 - DNA, 20 bp, Artificial Sequence
  chemically synthesized
gtcacagcaactcatctggt

SEQ ID NO: 349495 - DNA, 20 bp, Artificial Sequence
  chemically synthesized
tcagaattagcttaccagat

SEQ ID NO: 349496 - DNA, 20 bp, Artificial Sequence
  chemically synthesized
attggtcagaattagcttac

SEQ ID NO: 349497 - DNA, 20 bp, Artificial Sequence
  chemically synthesized
ctcgacagattggtcagaat

SEQ ID NO: 349498 - DNA, 20 bp, Artificial Sequence
  chemically synthesized
tatgctctcgacagattggt

SEQ ID NO: 349499 - DNA, 20 bp, Artificial Sequence
  chemically synthesized
ctaattctgaccaatctgtc

SEQ ID NO: 349500 - DNA, 20 bp, Artificial Sequence
  chemically synthesized
taagtatgctctcgacagat

SEQ ID NO: 349501 - DNA, 20 bp, Artificial Sequence
  chemically synthesized
aattctgaccaatctgtcga

SEQ ID NO: 349502 - DNA, 20 bp, Artificial Sequence
  chemically synthesized
ggttctaagtatgctctcga

SEQ ID NO: 349503 - DNA, 20 bp, Artificial Sequence
  chemically synthesized
caatctgtcgagagcatact

SEQ ID NO: 349504 - DNA, 20 bp, Artificial Sequence
  chemically synthesized
acgctgagctggatggttct

SEQ ID NO: 349505 - DNA, 20 bp, Artificial Sequence
  chemically synthesized
agagcatacttagaaccatc

SEQ ID NO: 349506 - DNA, 20 bp, Artificial Sequence
  chemically synthesized
atacttagaaccatccagct

SEQ ID NO: 349507 - DNA, 20 bp, Artificial Sequence
  chemically synthesized
gttttacacgctgagctgga

SEQ ID NO: 349508 - DNA, 20 bp, Artificial Sequence
  chemically synthesized
aagagttttacacgctgagc

SEQ ID NO: 349509 - DNA, 20 bp, Artificial Sequence
  chemically synthesized
acttaagagttttacacgct

SEQ ID NO: 349510 - DNA, 20 bp, Artificial Sequence
  chemically synthesized
gctcagcgtgtaaaactctt

SEQ ID NO: 349511 - DNA, 20 bp, Artificial Sequence
  chemically synthesized
catgacggaaggatacttaa

SEQ ID NO: 349512 - DNA, 20 bp, Artificial Sequence
  chemically synthesized
agcatgacggaaggatactt

SEQ ID NO: 349513 - DNA, 20 bp, Artificial Sequence
  chemically synthesized
cagaagaggagcatgacgga

SEQ ID NO: 349514 - DNA, 20 bp, Artificial Sequence
  chemically synthesized
tcagaagaggagcatgacgg

SEQ ID NO: 349515 - DNA, 20 bp, Artificial Sequence
  chemically synthesized
ctctcagaagaggagcatga

SEQ ID NO: 349516 - DNA, 20 bp, Artificial Sequence
  chemically synthesized
ttccgtcatgctcctcttct

SEQ ID NO: 349517 - DNA, 20 bp, Artificial Sequence
  chemically synthesized
gtcatagcctctcagaagag

SEQ ID NO: 349518 - DNA, 20 bp, Artificial Sequence
  chemically synthesized
ccgtcatgctcctcttctga

SEQ ID NO: 349519 - DNA, 20 bp, Artificial Sequence
  chemically synthesized
tagtcatagcctctcagaag

SEQ ID NO: 349520 - DNA, 20 bp, Artificial Sequence
  chemically synthesized
cgtcatgctcctcttctgag

SEQ ID NO: 349521 - DNA, 20 bp, Artificial Sequence
  chemically synthesized
atagtcatagcctctcagaa

SEQ ID NO: 349522 - DNA, 20 bp, Artificial Sequence
  chemically synthesized
gaatagtcatagcctctcag

SEQ ID NO: 349523 - DNA, 20 bp, Artificial Sequence
  chemically synthesized
agggaatagtcatagcctct

SEQ ID NO: 349524 - DNA, 20 bp, Artificial Sequence
  chemically synthesized
ccaccttcagggaatagtca

SEQ ID NO: 349525 - DNA, 20 bp, Artificial Sequence
  chemically synthesized
gaggctatgactattccctg

SEQ ID NO: 349526 - DNA, 20 bp, Artificial Sequence
  chemically synthesized
taagcaccaccttcagggaa

SEQ ID NO: 349527 - DNA, 20 bp, Artificial Sequence
  chemically synthesized
aggctatgactattccctga

SEQ ID NO: 349528 - DNA, 20 bp, Artificial Sequence
  chemically synthesized
ctatgactattccctgaagg

SEQ ID NO: 349529 - DNA, 20 bp, Artificial Sequence
  chemically synthesized
aagggtaagcaccaccttca

SEQ ID NO: 349530 - DNA, 20 bp, Artificial Sequence
  chemically synthesized
aaagggtaagcaccaccttc

SEQ ID NO: 349531 - DNA, 20 bp, Artificial Sequence
  chemically synthesized
gaaagggtaagcaccacctt

SEQ ID NO: 349532 - DNA, 20 bp, Artificial Sequence
  chemically synthesized
taaatttacagggaaagggt

SEQ ID NO: 349533 - DNA, 20 bp, Artificial Sequence
  chemically synthesized
ttgttaaatttacagggaaa

SEQ ID NO: 349534 - DNA, 20 bp, Artificial Sequence
  chemically synthesized
cttgttaaatttacagggaa

SEQ ID NO: 349535 - DNA, 20 bp, Artificial Sequence
  chemically synthesized
gcttgttaaatttacaggga

SEQ ID NO: 349536 - DNA, 20 bp, Artificial Sequence
  chemically synthesized
ctgagcttgttaaatttaca

SEQ ID NO: 349537 - DNA, 20 bp, Artificial Sequence
  chemically synthesized
gctgagcttgttaaatttac

SEQ ID NO: 349538 - DNA, 20 bp, Artificial Sequence
  chemically synthesized
agctgagcttgttaaattta

SEQ ID NO: 349539 - DNA, 20 bp, Artificial Sequence
  chemically synthesized
cctttccctgtaaatttaac

SEQ ID NO: 349540 - DNA, 20 bp, Artificial Sequence
  chemically synthesized
ccctgtaaatttaacaagct

SEQ ID NO: 349541 - DNA, 20 bp, Artificial Sequence
  chemically synthesized
aaatttaacaagctcagctt

SEQ ID NO: 349542 - DNA, 20 bp, Artificial Sequence
  chemically synthesized
aatttaacaagctcagcttt

SEQ ID NO: 349543 - DNA, 20 bp, Artificial Sequence
  chemically synthesized
ggtgttgatcacccaaagct

SEQ ID NO: 349544 - DNA, 20 bp, Artificial Sequence
  chemically synthesized
tcaaaggtgttgatcaccca

SEQ ID NO: 349545 - DNA, 20 bp, Artificial Sequence
  chemically synthesized
gggtgatcaacacctttgac

SEQ ID NO: 349546 - DNA, 20 bp, Artificial Sequence
  chemically synthesized
gtgatcaacacctttgactg

SEQ ID NO: 349547 - DNA, 20 bp, Artificial Sequence
  chemically synthesized
ctgtaatgtcctccagtcaa

SEQ ID NO: 349548 - DNA, 20 bp, Artificial Sequence
  chemically synthesized
tgatcaacacctttgactgg

SEQ ID NO: 349549 - DNA, 20 bp, Artificial Sequence
  chemically synthesized
cctgtaatgtcctccagtca

SEQ ID NO: 349550 - DNA, 20 bp, Artificial Sequence
  chemically synthesized
gaaacacctgtaatgtcctc

SEQ ID NO: 349551 - DNA, 20 bp, Artificial Sequence
  chemically synthesized
cctttgactggaggacatta

SEQ ID NO: 349552 - DNA, 20 bp, Artificial Sequence
  chemically synthesized
ctttgactggaggacattac

SEQ ID NO: 349553 - DNA, 20 bp, Artificial Sequence
  chemically synthesized
ggacattacaggtgtttcta

SEQ ID NO: 349554 - DNA, 20 bp, Artificial Sequence
  chemically synthesized
tagtttatgaatgaatacca

SEQ ID NO: 349555 - DNA, 20 bp, Artificial Sequence
  chemically synthesized
ggtattcattcataaactaa

SEQ ID NO: 349556 - DNA, 20 bp, Artificial Sequence
  chemically synthesized
attcattcataaactaaaag

SEQ ID NO: 349557 - DNA, 20 bp, Artificial Sequence
  chemically synthesized
tcattcataaactaaaagta

SEQ ID NO: 349558 - DNA, 20 bp, Artificial Sequence
  chemically synthesized
ctttcagtcagctctacttt

SEQ ID NO: 349559 - DNA, 20 bp, Artificial Sequence
  chemically synthesized
ctaaaagtagagctgactga

SEQ ID NO: 349560 - DNA, 20 bp, Artificial Sequence
  chemically synthesized
ataaataccaggctttcagt

SEQ ID NO: 349561 - DNA, 20 bp, Artificial Sequence
  chemically synthesized
agtagagctgactgaaagcc

SEQ ID NO: 349562 - DNA, 20 bp, Artificial Sequence
  chemically synthesized
agctataaataccaggcttt

SEQ ID NO: 349563 - DNA, 20 bp, Artificial Sequence
  chemically synthesized
tctcgctagctataaatacc

SEQ ID NO: 349564 - DNA, 20 bp, Artificial Sequence
  chemically synthesized
gactgaaagcctggtattta

SEQ ID NO: 349565 - DNA, 20 bp, Artificial Sequence
  chemically synthesized
ctctcgctagctataaatac

SEQ ID NO: 349566 - DNA, 20 bp, Artificial Sequence
  chemically synthesized
gaaagcctggtatttatagc

SEQ ID NO: 349567 - DNA, 20 bp, Artificial Sequence
  chemically synthesized
gcctggtatttatagctagc

SEQ ID NO: 349568 - DNA, 20 bp, Artificial Sequence
  chemically synthesized
ctggtatttatagctagcga

SEQ ID NO: 349569 - DNA, 20 bp, Artificial Sequence
  chemically synthesized
taattggacatttctctcgc

SEQ ID NO: 349570 - DNA, 20 bp, Artificial Sequence
  chemically synthesized
cgagagaaatgtccaattat

SEQ ID NO: 349571 - DNA, 20 bp, Artificial Sequence
  chemically synthesized
aatgaacctcatctaataat

SEQ ID NO: 349572 - DNA, 20 bp, Artificial Sequence
  chemically synthesized
gaaatgtccaattattagat

SEQ ID NO: 349573 - DNA, 20 bp, Artificial Sequence
  chemically synthesized
aaatgtccaattattagatg

SEQ ID NO: 349574 - DNA, 20 bp, Artificial Sequence
  chemically synthesized
ttcattttcgttaattattt

SEQ ID NO: 349575 - DNA, 20 bp, Artificial Sequence
  chemically synthesized
tagttattatgactacataa

SEQ ID NO: 349576 - DNA, 20 bp, Artificial Sequence
  chemically synthesized
ccaaatgtacaactattatg

SEQ ID NO: 349577 - DNA, 20 bp, Artificial Sequence
  chemically synthesized
ctacataatagttgtacatt

SEQ ID NO: 349578 - DNA, 20 bp, Artificial Sequence
  chemically synthesized
tacataatagttgtacattt

SEQ ID NO: 349579 - DNA, 20 bp, Artificial Sequence
  chemically synthesized
acataatagttgtacatttg

SEQ ID NO: 349580 - DNA, 20 bp, Artificial Sequence
  chemically synthesized
agttgtacatttggggtgca

SEQ ID NO: 349581 - DNA, 20 bp, Artificial Sequence
  chemically synthesized
gttgtacatttggggtgcat

SEQ ID NO: 349582 - DNA, 20 bp, Artificial Sequence
  chemically synthesized
tacaacatgtaatgataaat

SEQ ID NO: 349583 - DNA, 20 bp, Artificial Sequence
  chemically synthesized
acaacatgtaatgataaatc

SEQ ID NO: 349584 - DNA, 20 bp, Artificial Sequence
  chemically synthesized
caacatgtaatgataaatca

SEQ ID NO: 349585 - DNA, 20 bp, Artificial Sequence
  chemically synthesized
taatgataaatcagggaaat

SEQ ID NO: 349586 - DNA, 20 bp, Artificial Sequence
  chemically synthesized
aatgataaatcagggaaatt

SEQ ID NO: 349587 - DNA, 20 bp, Artificial Sequence
  chemically synthesized
atgataaatcagggaaatta

SEQ ID NO: 349588 - DNA, 20 bp, Artificial Sequence
  chemically synthesized
attagggcatccatcacctc

SEQ ID NO: 349589 - DNA, 20 bp, Artificial Sequence
  chemically synthesized
atgataaatgcttgaggtga

SEQ ID NO: 349590 - DNA, 20 bp, Artificial Sequence
  chemically synthesized
acataaatgataaatgcttg

SEQ ID NO: 349591 - DNA, 20 bp, Artificial Sequence
  chemically synthesized
aacataaatgataaatgctt

SEQ ID NO: 349592 - DNA, 20 bp, Artificial Sequence
  chemically synthesized
caagcatttatcatttatgt

SEQ ID NO: 349593 - DNA, 20 bp, Artificial Sequence
  chemically synthesized
ataatagttaaattggaatt

SEQ ID NO: 349594 - DNA, 20 bp, Artificial Sequence
  chemically synthesized
tttcaaaataatagttaaat

SEQ ID NO: 349595 - DNA, 20 bp, Artificial Sequence
  chemically synthesized
taatttatatttcaaaataa

SEQ ID NO: 349596 - DNA, 20 bp, Artificial Sequence
  chemically synthesized
tattttgaaatataaattat

SEQ ID NO: 349597 - DNA, 20 bp, Artificial Sequence
  chemically synthesized
gtagcaccctagagtgatta

SEQ ID NO: 349598 - DNA, 20 bp, Artificial Sequence
  chemically synthesized
attggtaactataatcactc

SEQ ID NO: 349599 - DNA, 20 bp, Artificial Sequence
  chemically synthesized
ttggtaactataatcactct

SEQ ID NO: 349600 - DNA, 20 bp, Artificial Sequence
  chemically synthesized
tggtaactataatcactcta

SEQ ID NO: 349601 - DNA, 20 bp, Artificial Sequence
  chemically synthesized
tagtgtttggtagcacccta

SEQ ID NO: 349602 - DNA, 20 bp, Artificial Sequence
  chemically synthesized
tctagtgtttggtagcaccc

SEQ ID NO: 349603 - DNA, 20 bp, Artificial Sequence
  chemically synthesized
gaatcagatctagtgtttgg

SEQ ID NO: 349604 - DNA, 20 bp, Artificial Sequence
  chemically synthesized
tctagggtgctaccaaacac

SEQ ID NO: 349605 - DNA, 20 bp, Artificial Sequence
  chemically synthesized
aaggaatcagatctagtgtt

SEQ ID NO: 349606 - DNA, 20 bp, Artificial Sequence
  chemically synthesized
tagatagaaggaatcagatc

SEQ ID NO: 349607 - DNA, 20 bp, Artificial Sequence
  chemically synthesized
tatagttagatagaaggaat

SEQ ID NO: 349608 - DNA, 20 bp, Artificial Sequence
  chemically synthesized
aaagtatatagttagataga

SEQ ID NO: 349609 - DNA, 20 bp, Artificial Sequence
  chemically synthesized
aaaagtatatagttagatag

SEQ ID NO: 349610 - DNA, 20 bp, Artificial Sequence
  chemically synthesized
ataaaaagtatatagttaga

SEQ ID NO: 349611 - DNA, 20 bp, Artificial Sequence
  chemically synthesized
aaaaataaaaagtatatagt

SEQ ID NO: 349612 - DNA, 20 bp, Artificial Sequence
  chemically synthesized
aaaaaaaaataaaaagtata

SEQ ID NO: 349613 - DNA, 20 bp, Artificial Sequence
  chemically synthesized
aaaaaaaaaaaaaaaataaa

SEQ ID NO: 349614 - DNA, 20 bp, Artificial Sequence
  chemically synthesized
ataaggagggagtggtaaat

SEQ ID NO: 349615 - DNA, 20 bp, Artificial Sequence
  chemically synthesized
gataaggagggagtggtaaa

SEQ ID NO: 349616 - DNA, 20 bp, Artificial Sequence
  chemically synthesized
aggacaggataaggagggag

SEQ ID NO: 349617 - DNA, 20 bp, Artificial Sequence
  chemically synthesized
gggaggacaggataaggagg

SEQ ID NO: 349618 - DNA, 20 bp, Artificial Sequence
  chemically synthesized
tggggaggacaggataagga

SEQ ID NO: 349619 - DNA, 20 bp, Artificial Sequence
  chemically synthesized
gtggggaggacaggataagg

SEQ ID NO: 349620 - DNA, 20 bp, Artificial Sequence
  chemically synthesized
agtggggaggacaggataag

SEQ ID NO: 349621 - DNA, 20 bp, Artificial Sequence
  chemically synthesized
taagtggggaggacaggata

SEQ ID NO: 349622 - DNA, 20 bp, Artificial Sequence
  chemically synthesized
gtaagtggggaggacaggat

SEQ ID NO: 349623 - DNA, 20 bp, Artificial Sequence
  chemically synthesized
gaagggtaagtggggaggac

SEQ ID NO: 349624 - DNA, 20 bp, Artificial Sequence
  chemically synthesized
agaagggtaagtggggagga

SEQ ID NO: 349625 - DNA, 20 bp, Artificial Sequence
  chemically synthesized
gctgagaagggtaagtgggg

SEQ ID NO: 349626 - DNA, 20 bp, Artificial Sequence
  chemically synthesized
tgctgagaagggtaagtggg

SEQ ID NO: 349627 - DNA, 20 bp, Artificial Sequence
  chemically synthesized
gatgctgagaagggtaagtg

SEQ ID NO: 349628 - DNA, 20 bp, Artificial Sequence
  chemically synthesized
agatgctgagaagggtaagt

SEQ ID NO: 349629 - DNA, 20 bp, Artificial Sequence
  chemically synthesized
cagatgctgagaagggtaag

SEQ ID NO: 349630 - DNA, 20 bp, Artificial Sequence
  chemically synthesized
taccagatgctgagaagggt

SEQ ID NO: 349631 - DNA, 20 bp, Artificial Sequence
  chemically synthesized
tcctccccacttacccttct

SEQ ID NO: 349632 - DNA, 20 bp, Artificial Sequence
  chemically synthesized
tggttaccagatgctgagaa

SEQ ID NO: 349633 - DNA, 20 bp, Artificial Sequence
  chemically synthesized
atggttaccagatgctgaga

SEQ ID NO: 349634 - DNA, 20 bp, Artificial Sequence
  chemically synthesized
gatggttaccagatgctgag

SEQ ID NO: 349635 - DNA, 20 bp, Artificial Sequence
  chemically synthesized
cacttacccttctcagcatc

SEQ ID NO: 349636 - DNA, 20 bp, Artificial Sequence
  chemically synthesized
gatgatggttaccagatgct

SEQ ID NO: 349637 - DNA, 20 bp, Artificial Sequence
  chemically synthesized
gagagtgggatgatggttac

SEQ ID NO: 349638 - DNA, 20 bp, Artificial Sequence
  chemically synthesized
ggagatagagagtgggatga

SEQ ID NO: 349639 - DNA, 20 bp, Artificial Sequence
  chemically synthesized
aactcatggagatagagagt

SEQ ID NO: 349640 - DNA, 20 bp, Artificial Sequence
  chemically synthesized
gaactcatggagatagagag

SEQ ID NO: 349641 - DNA, 20 bp, Artificial Sequence
  chemically synthesized
attgaactcatggagataga

SEQ ID NO: 349642 - DNA, 20 bp, Artificial Sequence
  chemically synthesized
aaattgaactcatggagata

SEQ ID NO: 349643 - DNA, 20 bp, Artificial Sequence
  chemically synthesized
atcccactctctatctccat

SEQ ID NO: 349644 - DNA, 20 bp, Artificial Sequence
  chemically synthesized
gtaaattgaactcatggaga

SEQ ID NO: 349645 - DNA, 20 bp, Artificial Sequence
  chemically synthesized
taaagtaaattgaactcatg

SEQ ID NO: 349646 - DNA, 20 bp, Artificial Sequence
  chemically synthesized
gctaaagtaaattgaactca

SEQ ID NO: 349647 - DNA, 20 bp, Artificial Sequence
  chemically synthesized
tccatgagttcaatttactt

SEQ ID NO: 349648 - DNA, 20 bp, Artificial Sequence
  chemically synthesized
tcactcatatgtgggagcta

SEQ ID NO: 349649 - DNA, 20 bp, Artificial Sequence
  chemically synthesized
aagttctcactcatatgtgg

SEQ ID NO: 349650 - DNA, 20 bp, Artificial Sequence
  chemically synthesized
ttactttagctcccacatat

SEQ ID NO: 349651 - DNA, 20 bp, Artificial Sequence
  chemically synthesized
gcaagttctcactcatatgt

SEQ ID NO: 349652 - DNA, 20 bp, Artificial Sequence
  chemically synthesized
tgcaagttctcactcatatg

SEQ ID NO: 349653 - DNA, 20 bp, Artificial Sequence
  chemically synthesized
tttagctcccacatatgagt

SEQ ID NO: 349654 - DNA, 20 bp, Artificial Sequence
  chemically synthesized
cacagagacacaaatattgc

SEQ ID NO: 349655 - DNA, 20 bp, Artificial Sequence
  chemically synthesized
aatatttgtgtctctgtgcc

SEQ ID NO: 349656 - DNA, 20 bp, Artificial Sequence
  chemically synthesized
agtgaaatcaaccaggcaca

SEQ ID NO: 349657 - DNA, 20 bp, Artificial Sequence
  chemically synthesized
taagtgaaatcaaccaggca

SEQ ID NO: 349658 - DNA, 20 bp, Artificial Sequence
  chemically synthesized
attgttaagtgaaatcaacc

SEQ ID NO: 349659 - DNA, 20 bp, Artificial Sequence
  chemically synthesized
cattgttaagtgaaatcaac

SEQ ID NO: 349660 - DNA, 20 bp, Artificial Sequence
  chemically synthesized
taaaactggaggacattgtt

SEQ ID NO: 349661 - DNA, 20 bp, Artificial Sequence
  chemically synthesized
tttcacttaacaatgtcctc

SEQ ID NO: 349662 - DNA, 20 bp, Artificial Sequence
  chemically synthesized
ataatagaaaataaaactgg

SEQ ID NO: 349663 - DNA, 20 bp, Artificial Sequence
  chemically synthesized
aataatagaaaataaaactg

SEQ ID NO: 349664 - DNA, 20 bp, Artificial Sequence
  chemically synthesized
aaaataatagaaaataaaac

SEQ ID NO: 349665 - DNA, 20 bp, Artificial Sequence
  chemically synthesized
agcgagagaaagaaaaataa

SEQ ID NO: 349666 - DNA, 20 bp, Artificial Sequence
  chemically synthesized
taaaaaaggagagcgagaga

SEQ ID NO: 349667 - DNA, 20 bp, Artificial Sequence
  chemically synthesized
gctttaaaaaaggagagcga

SEQ ID NO: 349668 - DNA, 20 bp, Artificial Sequence
  chemically synthesized
gagctttaaaaaaggagagc

SEQ ID NO: 349669 - DNA, 20 bp, Artificial Sequence
  chemically synthesized
agaggagctttaaaaaagga

SEQ ID NO: 349670 - DNA, 20 bp, Artificial Sequence
  chemically synthesized
ccagaggagctttaaaaaag

SEQ ID NO: 349671 - DNA, 20 bp, Artificial Sequence
  chemically synthesized
tctctcgctctcctttttta

SEQ ID NO: 349672 - DNA, 20 bp, Artificial Sequence
  chemically synthesized
ctccagaggagctttaaaaa

SEQ ID NO: 349673 - DNA, 20 bp, Artificial Sequence
  chemically synthesized
actccagaggagctttaaaa

SEQ ID NO: 349674 - DNA, 20 bp, Artificial Sequence
  chemically synthesized
ctccttttttaaagctcctc

SEQ ID NO: 349675 - DNA, 20 bp, Artificial Sequence
  chemically synthesized
ccttttttaaagctcctctg

SEQ ID NO: 349676 - DNA, 20 bp, Artificial Sequence
  chemically synthesized
taagaaagagcactccagag

SEQ ID NO: 349677 - DNA, 20 bp, Artificial Sequence
  chemically synthesized
actaagaaagagcactccag

SEQ ID NO: 349678 - DNA, 20 bp, Artificial Sequence
  chemically synthesized
aactaagaaagagcactcca

SEQ ID NO: 349679 - DNA, 20 bp, Artificial Sequence
  chemically synthesized
aaaactaagaaagagcactc

SEQ ID NO: 349680 - DNA, 20 bp, Artificial Sequence
  chemically synthesized
tcctctggagtgctctttct

SEQ ID NO: 349681 - DNA, 20 bp, Artificial Sequence
  chemically synthesized
tagtattgaaaactaagaaa

SEQ ID NO: 349682 - DNA, 20 bp, Artificial Sequence
  chemically synthesized
tatagtattgaaaactaaga

SEQ ID NO: 349683 - DNA, 20 bp, Artificial Sequence
  chemically synthesized
aaaatatagtattgaaaact

SEQ ID NO: 349684 - DNA, 20 bp, Artificial Sequence
  chemically synthesized
aaaaacatgttcagaaaata

SEQ ID NO: 349685 - DNA, 20 bp, Artificial Sequence
  chemically synthesized
tagattttaaaaaacatgtt

SEQ ID NO: 349686 - DNA, 20 bp, Artificial Sequence
  chemically synthesized
tgttttttaaaatctacatc

SEQ ID NO: 349687 - DNA, 20 bp, Artificial Sequence
  chemically synthesized
aatagatcagatgccagatg

SEQ ID NO: 349688 - DNA, 20 bp, Artificial Sequence
  chemically synthesized
tgtaggaatagatcagatgc

SEQ ID NO: 349689 - DNA, 20 bp, Artificial Sequence
  chemically synthesized
gataggttgtaggaatagat

SEQ ID NO: 349690 - DNA, 20 bp, Artificial Sequence
  chemically synthesized
atatggataggttgtaggaa

SEQ ID NO: 349691 - DNA, 20 bp, Artificial Sequence
  chemically synthesized
acagaatatggataggttgt

SEQ ID NO: 349692 - DNA, 20 bp, Artificial Sequence
  chemically synthesized
gacagaatatggataggttg

SEQ ID NO: 349693 - DNA, 20 bp, Artificial Sequence
  chemically synthesized
aggtcagacagaatatggat

SEQ ID NO: 349694 - DNA, 20 bp, Artificial Sequence
  chemically synthesized
taggtcagacagaatatgga

SEQ ID NO: 349695 - DNA, 20 bp, Artificial Sequence
  chemically synthesized
aatataggtcagacagaata

SEQ ID NO: 349696 - DNA, 20 bp, Artificial Sequence
  chemically synthesized
aaataaaaatataggtcaga

SEQ ID NO: 349697 - DNA, 20 bp, Artificial Sequence
  chemically synthesized
gtataaataaaaatataggt

SEQ ID NO: 349698 - DNA, 20 bp, Artificial Sequence
  chemically synthesized
taaagtataaataaaaatat

SEQ ID NO: 349699 - DNA, 20 bp, Artificial Sequence
  chemically synthesized
ttaaagtataaataaaaata

SEQ ID NO: 349700 - DNA, 20 bp, Artificial Sequence
  chemically synthesized
cagaaattcaaatggaatta

SEQ ID NO: 349701 - DNA, 20 bp, Artificial Sequence
  chemically synthesized
gcccagagcagaaattcaaa

SEQ ID NO: 349702 - DNA, 20 bp, Artificial Sequence
  chemically synthesized
ttccatttgaatttctgctc

SEQ ID NO: 349703 - DNA, 20 bp, Artificial Sequence
  chemically synthesized
tccatttgaatttctgctct

SEQ ID NO: 349704 - DNA, 20 bp, Artificial Sequence
  chemically synthesized
gtgtaaactaaagcccagag

SEQ ID NO: 349705 - DNA, 20 bp, Artificial Sequence
  chemically synthesized
tgaatttctgctctgggctt

SEQ ID NO: 349706 - DNA, 20 bp, Artificial Sequence
  chemically synthesized
caagtgtaaactaaagccca

SEQ ID NO: 349707 - DNA, 20 bp, Artificial Sequence
  chemically synthesized
tgcaagtgtaaactaaagcc

SEQ ID NO: 349708 - DNA, 20 bp, Artificial Sequence
  chemically synthesized
cacattgcaagtgtaaacta

SEQ ID NO: 349709 - DNA, 20 bp, Artificial Sequence
  chemically synthesized
tatcagatatcacacattgc

SEQ ID NO: 349710 - DNA, 20 bp, Artificial Sequence
  chemically synthesized
aatgtgtgatatctgatatc

SEQ ID NO: 349711 - DNA, 20 bp, Artificial Sequence
  chemically synthesized
ttccaggatgggccagatat

SEQ ID NO: 349712 - DNA, 20 bp, Artificial Sequence
  chemically synthesized
tcttctgttccaggatgggc

SEQ ID NO: 349713 - DNA, 20 bp, Artificial Sequence
  chemically synthesized
atctgatatctggcccatcc

SEQ ID NO: 349714 - DNA, 20 bp, Artificial Sequence
  chemically synthesized
tatttcttctgttccaggat

SEQ ID NO: 349715 - DNA, 20 bp, Artificial Sequence
  chemically synthesized
atatttcttctgttccagga

SEQ ID NO: 349716 - DNA, 20 bp, Artificial Sequence
  chemically synthesized
atatctggcccatcctggaa

SEQ ID NO: 349717 - DNA, 20 bp, Artificial Sequence
  chemically synthesized
tctggcccatcctggaacag

SEQ ID NO: 349718 - DNA, 20 bp, Artificial Sequence
  chemically synthesized
tgatatatttcttctgttcc

SEQ ID NO: 349719 - DNA, 20 bp, Artificial Sequence
  chemically synthesized
atgatatatttcttctgttc

SEQ ID NO: 349720 - DNA, 20 bp, Artificial Sequence
  chemically synthesized
aagaaatatatcattaccaa

SEQ ID NO: 349721 - DNA, 20 bp, Artificial Sequence
  chemically synthesized
catttaatgtgtttttccat

SEQ ID NO: 349722 - DNA, 20 bp, Artificial Sequence
  chemically synthesized
tggaaaaacacattaaatga

SEQ ID NO: 349723 - DNA, 20 bp, Artificial Sequence
  chemically synthesized
ggaaaaacacattaaatgat

SEQ ID NO: 349724 - DNA, 20 bp, Artificial Sequence
  chemically synthesized
cacattaaatgataggaaca

SEQ ID NO: 349725 - DNA, 20 bp, Artificial Sequence
  chemically synthesized
acattaaatgataggaacat

SEQ ID NO: 349726 - DNA, 20 bp, Artificial Sequence
  chemically synthesized
taaatgataggaacatagga

SEQ ID NO: 349727 - DNA, 20 bp, Artificial Sequence
  chemically synthesized
tgataggaacataggaaagt

SEQ ID NO: 349728 - DNA, 20 bp, Artificial Sequence
  chemically synthesized
gaacataggaaagtcggttt

SEQ ID NO: 349729 - DNA, 20 bp, Artificial Sequence
  chemically synthesized
gaaagtcggtttaagataaa

SEQ ID NO: 349730 - DNA, 20 bp, Artificial Sequence
  chemically synthesized
aaagtcggtttaagataaat

SEQ ID NO: 349731 - DNA, 20 bp, Artificial Sequence
  chemically synthesized
gtttaagataaatgggcccc

SEQ ID NO: 349732 - DNA, 20 bp, Artificial Sequence
  chemically synthesized
aagataaatgggcccctaga

SEQ ID NO: 349733 - DNA, 20 bp, Artificial Sequence
  chemically synthesized
gtgcgagtgtatctttctag

SEQ ID NO: 349734 - DNA, 20 bp, Artificial Sequence
  chemically synthesized
tgtgcgagtgtatctttcta

SEQ ID NO: 349735 - DNA, 20 bp, Artificial Sequence
  chemically synthesized
ttgtgcgagtgtatctttct

SEQ ID NO: 349736 - DNA, 20 bp, Artificial Sequence
  chemically synthesized
gttgtgcgagtgtatctttc

SEQ ID NO: 349737 - DNA, 20 bp, Artificial Sequence
  chemically synthesized
agaaagatacactcgcacaa

SEQ ID NO: 349738 - DNA, 20 bp, Artificial Sequence
  chemically synthesized
taatgtacatactgttgtgc

SEQ ID NO: 349739 - DNA, 20 bp, Artificial Sequence
  chemically synthesized
aacagtatgtacattatata

SEQ ID NO: 349740 - DNA, 20 bp, Artificial Sequence
  chemically synthesized
gtacattatataaagatgtt

SEQ ID NO: 349741 - DNA, 20 bp, Artificial Sequence
  chemically synthesized
ttatataaagatgttaagat

SEQ ID NO: 349742 - DNA, 20 bp, Artificial Sequence
  chemically synthesized
tatataaagatgttaagatt

SEQ ID NO: 349743 - DNA, 20 bp, Artificial Sequence
  chemically synthesized
atataaagatgttaagatta

SEQ ID NO: 349744 - DNA, 20 bp, Artificial Sequence
  chemically synthesized
ccatttctcctaaggaattt

SEQ ID NO: 349745 - DNA, 20 bp, Artificial Sequence
  chemically synthesized
tagggatgtctgaaattcct

SEQ ID NO: 349746 - DNA, 20 bp, Artificial Sequence
  chemically synthesized
agggatgtctgaaattcctt

SEQ ID NO: 349747 - DNA, 20 bp, Artificial Sequence
  chemically synthesized
ggatgtctgaaattccttag

SEQ ID NO: 349748 - DNA, 20 bp, Artificial Sequence
  chemically synthesized
ttagcaggccatttctccta

SEQ ID NO: 349749 - DNA, 20 bp, Artificial Sequence
  chemically synthesized
tttagcaggccatttctcct

SEQ ID NO: 349750 - DNA, 20 bp, Artificial Sequence
  chemically synthesized
ctgaaattccttaggagaaa

SEQ ID NO: 349751 - DNA, 20 bp, Artificial Sequence
  chemically synthesized
ttaggagaaatggcctgcta

SEQ ID NO: 349752 - DNA, 20 bp, Artificial Sequence
  chemically synthesized
taggagaaatggcctgctaa

SEQ ID NO: 349753 - DNA, 20 bp, Artificial Sequence
  chemically synthesized
aggagaaatggcctgctaaa

SEQ ID NO: 349754 - DNA, 20 bp, Artificial Sequence
  chemically synthesized
tggaacccttgccctttagc

SEQ ID NO: 349755 - DNA, 20 bp, Artificial Sequence
  chemically synthesized
gtggaacccttgccctttag

SEQ ID NO: 349756 - DNA, 20 bp, Artificial Sequence
  chemically synthesized
gaaatggcctgctaaagggc

SEQ ID NO: 349757 - DNA, 20 bp, Artificial Sequence
  chemically synthesized
aaatggcctgctaaagggca

SEQ ID NO: 349758 - DNA, 20 bp, Artificial Sequence
  chemically synthesized
atcgtggaacccttgccctt

SEQ ID NO: 349759 - DNA, 20 bp, Artificial Sequence
  chemically synthesized
aatggcctgctaaagggcaa

SEQ ID NO: 349760 - DNA, 20 bp, Artificial Sequence
  chemically synthesized
actctcttatattacaatcg

SEQ ID NO: 349761 - DNA, 20 bp, Artificial Sequence
  chemically synthesized
gggttccacgattgtaatat

SEQ ID NO: 349762 - DNA, 20 bp, Artificial Sequence
  chemically synthesized
gttccacgattgtaatataa

SEQ ID NO: 349763 - DNA, 20 bp, Artificial Sequence
  chemically synthesized
tccacgattgtaatataaga

SEQ ID NO: 349764 - DNA, 20 bp, Artificial Sequence
  chemically synthesized
tattcaattttactaaaaat

SEQ ID NO: 349765 - DNA, 20 bp, Artificial Sequence
  chemically synthesized
aaaatattttaacttatttt

SEQ ID NO: 349766 - DNA, 20 bp, Artificial Sequence
  chemically synthesized
taacgtaatcaacatttacc

SEQ ID NO: 349767 - DNA, 20 bp, Artificial Sequence
  chemically synthesized
tacttgaaagaaggggtact

SEQ ID NO: 349768 - DNA, 20 bp, Artificial Sequence
  chemically synthesized
gtcccattacttgaaagaag

SEQ ID NO: 349769 - DNA, 20 bp, Artificial Sequence
  chemically synthesized
taccaagtaccccttctttc

SEQ ID NO: 349770 - DNA, 20 bp, Artificial Sequence
  chemically synthesized
agtcccattacttgaaagaa

SEQ ID NO: 349771 - DNA, 20 bp, Artificial Sequence
  chemically synthesized
tagtcccattacttgaaaga

SEQ ID NO: 349772 - DNA, 20 bp, Artificial Sequence
  chemically synthesized
ttagtcccattacttgaaag

SEQ ID NO: 349773 - DNA, 20 bp, Artificial Sequence
  chemically synthesized
gtcttagtcccattacttga

SEQ ID NO: 349774 - DNA, 20 bp, Artificial Sequence
  chemically synthesized
gtaccccttctttcaagtaa

SEQ ID NO: 349775 - DNA, 20 bp, Artificial Sequence
  chemically synthesized
taccccttctttcaagtaat

SEQ ID NO: 349776 - DNA, 20 bp, Artificial Sequence
  chemically synthesized
ttctttcaagtaatgggact

SEQ ID NO: 349777 - DNA, 20 bp, Artificial Sequence
  chemically synthesized
tcaagtaatgggactaagac

SEQ ID NO: 349778 - DNA, 20 bp, Artificial Sequence
  chemically synthesized
aagtaatgggactaagaccg

SEQ ID NO: 349779 - DNA, 20 bp, Artificial Sequence
  chemically synthesized
agtaatgggactaagaccgg

SEQ ID NO: 349780 - DNA, 20 bp, Artificial Sequence
  chemically synthesized
tgtttctttccctccggtct

SEQ ID NO: 349781 - DNA, 20 bp, Artificial Sequence
  chemically synthesized
gtaatgggactaagaccgga

SEQ ID NO: 349782 - DNA, 20 bp, Artificial Sequence
  chemically synthesized
tgggactaagaccggaggga

SEQ ID NO: 349783 - DNA, 20 bp, Artificial Sequence
  chemically synthesized
acgaattgtttctttccctc

SEQ ID NO: 349784 - DNA, 20 bp, Artificial Sequence
  chemically synthesized
gagggaaagaaacaattcgt

SEQ ID NO: 349785 - DNA, 20 bp, Artificial Sequence
  chemically synthesized
cttaaacagctttaatggag

SEQ ID NO: 349786 - DNA, 20 bp, Artificial Sequence
  chemically synthesized
aagatgcaacttctccatta

SEQ ID NO: 349787 - DNA, 20 bp, Artificial Sequence
  chemically synthesized
ggacttaaacagctttaatg

SEQ ID NO: 349788 - DNA, 20 bp, Artificial Sequence
  chemically synthesized
gtggacttaaacagctttaa

SEQ ID NO: 349789 - DNA, 20 bp, Artificial Sequence
  chemically synthesized
cttctccattaaagctgttt

SEQ ID NO: 349790 - DNA, 20 bp, Artificial Sequence
  chemically synthesized
taattgactgtggacttaaa

SEQ ID NO: 349791 - DNA, 20 bp, Artificial Sequence
  chemically synthesized
attaaagctgtttaagtcca

SEQ ID NO: 349792 - DNA, 20 bp, Artificial Sequence
  chemically synthesized
tgtttcagtgtaattgactg

SEQ ID NO: 349793 - DNA, 20 bp, Artificial Sequence
  chemically synthesized
tgctcttggaatcagtgttt

SEQ ID NO: 349794 - DNA, 20 bp, Artificial Sequence
  chemically synthesized
tacactgaaacactgattcc

SEQ ID NO: 349795 - DNA, 20 bp, Artificial Sequence
  chemically synthesized
cactgaaacactgattccaa

SEQ ID NO: 349796 - DNA, 20 bp, Artificial Sequence
  chemically synthesized
acttaagatgctcttggaat

SEQ ID NO: 349797 - DNA, 20 bp, Artificial Sequence
  chemically synthesized
agattaacttaagatgctct

SEQ ID NO: 349798 - DNA, 20 bp, Artificial Sequence
  chemically synthesized
actgattccaagagcatctt

SEQ ID NO: 349799 - DNA, 20 bp, Artificial Sequence
  chemically synthesized
gaataaatccagattaactt

SEQ ID NO: 349800 - DNA, 20 bp, Artificial Sequence
  chemically synthesized
aagagcatcttaagttaatc

SEQ ID NO: 349801 - DNA, 20 bp, Artificial Sequence
  chemically synthesized
ctacctagaaagaataaatc

SEQ ID NO: 349802 - DNA, 20 bp, Artificial Sequence
  chemically synthesized
taatctggatttattctttc

SEQ ID NO: 349803 - DNA, 20 bp, Artificial Sequence
  chemically synthesized
aatctggatttattctttct

SEQ ID NO: 349804 - DNA, 20 bp, Artificial Sequence
  chemically synthesized
ctggatttattctttctagg

SEQ ID NO: 349805 - DNA, 20 bp, Artificial Sequence
  chemically synthesized
aagtgatagaactacctaga

SEQ ID NO: 349806 - DNA, 20 bp, Artificial Sequence
  chemically synthesized
tactaagtgatagaactacc

SEQ ID NO: 349807 - DNA, 20 bp, Artificial Sequence
  chemically synthesized
ttctaggtagttctatcact

SEQ ID NO: 349808 - DNA, 20 bp, Artificial Sequence
  chemically synthesized
tacataagtatactaagtga

SEQ ID NO: 349809 - DNA, 20 bp, Artificial Sequence
  chemically synthesized
gactaatacataagtatact

SEQ ID NO: 349810 - DNA, 20 bp, Artificial Sequence
  chemically synthesized
cacttagtatacttatgtat

SEQ ID NO: 349811 - DNA, 20 bp, Artificial Sequence
  chemically synthesized
gtgaaaatggactaatacat

SEQ ID NO: 349812 - DNA, 20 bp, Artificial Sequence
  chemically synthesized
tccttatggcagtgtgaaaa

SEQ ID NO: 349813 - DNA, 20 bp, Artificial Sequence
  chemically synthesized
gtccattttcacactgccat

SEQ ID NO: 349814 - DNA, 20 bp, Artificial Sequence
  chemically synthesized
tccattttcacactgccata

SEQ ID NO: 349815 - DNA, 20 bp, Artificial Sequence
  chemically synthesized
gtctcaggtattccttatgg

SEQ ID NO: 349816 - DNA, 20 bp, Artificial Sequence
  chemically synthesized
ccagtctcaggtattcctta

SEQ ID NO: 349817 - DNA, 20 bp, Artificial Sequence
  chemically synthesized
cactgccataaggaatacct

SEQ ID NO: 349818 - DNA, 20 bp, Artificial Sequence
  chemically synthesized
ccataaggaatacctgagac

SEQ ID NO: 349819 - DNA, 20 bp, Artificial Sequence
  chemically synthesized
cataaggaatacctgagact

SEQ ID NO: 349820 - DNA, 20 bp, Artificial Sequence
  chemically synthesized
tttctaaattacccagtctc

SEQ ID NO: 349821 - DNA, 20 bp, Artificial Sequence
  chemically synthesized
ctttctaaattacccagtct

SEQ ID NO: 349822 - DNA, 20 bp, Artificial Sequence
  chemically synthesized
atacctgagactgggtaatt

SEQ ID NO: 349823 - DNA, 20 bp, Artificial Sequence
  chemically synthesized
ctctttctttctaaattacc

SEQ ID NO: 349824 - DNA, 20 bp, Artificial Sequence
  chemically synthesized
ctgagactgggtaatttaga

SEQ ID NO: 349825 - DNA, 20 bp, Artificial Sequence
  chemically synthesized
gactgggtaatttagaaaga

SEQ ID NO: 349826 - DNA, 20 bp, Artificial Sequence
  chemically synthesized
ctgggtaatttagaaagaaa

SEQ ID NO: 349827 - DNA, 20 bp, Artificial Sequence
  chemically synthesized
tgggtaatttagaaagaaag

SEQ ID NO: 349828 - DNA, 20 bp, Artificial Sequence
  chemically synthesized
aaagaggtttaattgattca

SEQ ID NO: 349829 - DNA, 20 bp, Artificial Sequence
  chemically synthesized
aattgattcacagttccgca

SEQ ID NO: 349830 - DNA, 20 bp, Artificial Sequence
  chemically synthesized
gattcacagttccgcatggc

SEQ ID NO: 349831 - DNA, 20 bp, Artificial Sequence
  chemically synthesized
attcacagttccgcatggct

SEQ ID NO: 349832 - DNA, 20 bp, Artificial Sequence
  chemically synthesized
ctgaggcttccccagccatg

SEQ ID NO: 349833 - DNA, 20 bp, Artificial Sequence
  chemically synthesized
ttcacagttccgcatggctg

SEQ ID NO: 349834 - DNA, 20 bp, Artificial Sequence
  chemically synthesized
acagttccgcatggctgggg

SEQ ID NO: 349835 - DNA, 20 bp, Artificial Sequence
  chemically synthesized
taactttcctgaggcttccc

SEQ ID NO: 349836 - DNA, 20 bp, Artificial Sequence
  chemically synthesized
ccgcatggctggggaagcct

SEQ ID NO: 349837 - DNA, 20 bp, Artificial Sequence
  chemically synthesized
cgcatggctggggaagcctc

SEQ ID NO: 349838 - DNA, 20 bp, Artificial Sequence
  chemically synthesized
tggctggggaagcctcagga

SEQ ID NO: 349839 - DNA, 20 bp, Artificial Sequence
  chemically synthesized
ccatgattttaactttcctg

SEQ ID NO: 349840 - DNA, 20 bp, Artificial Sequence
  chemically synthesized
accatgattttaactttcct

SEQ ID NO: 349841 - DNA, 20 bp, Artificial Sequence
  chemically synthesized
cctcaggaaagttaaaatca

SEQ ID NO: 349842 - DNA, 20 bp, Artificial Sequence
  chemically synthesized
gaaagttaaaatcatggtga

SEQ ID NO: 349843 - DNA, 20 bp, Artificial Sequence
  chemically synthesized
aaagttaaaatcatggtgaa

SEQ ID NO: 349844 - DNA, 20 bp, Artificial Sequence
  chemically synthesized
taaaatcatggtgaaaggca

SEQ ID NO: 349845 - DNA, 20 bp, Artificial Sequence
  chemically synthesized
aaaatcatggtgaaaggcaa

SEQ ID NO: 349846 - DNA, 20 bp, Artificial Sequence
  chemically synthesized
aaatcatggtgaaaggcaaa

SEQ ID NO: 349847 - DNA, 20 bp, Artificial Sequence
  chemically synthesized
aatcatggtgaaaggcaaag

SEQ ID NO: 349848 - DNA, 20 bp, Artificial Sequence
  chemically synthesized
catggtgaaaggcaaagggg

SEQ ID NO: 349849 - DNA, 20 bp, Artificial Sequence
  chemically synthesized
gtgaaaggcaaaggggaagc

SEQ ID NO: 349850 - DNA, 20 bp, Artificial Sequence
  chemically synthesized
gaagcaagcactctcttcac

SEQ ID NO: 349851 - DNA, 20 bp, Artificial Sequence
  chemically synthesized
ctcctgccacctagtgaaga

SEQ ID NO: 349852 - DNA, 20 bp, Artificial Sequence
  chemically synthesized
aagcaagcactctcttcact

SEQ ID NO: 349853 - DNA, 20 bp, Artificial Sequence
  chemically synthesized
ccctcctgccacctagtgaa

SEQ ID NO: 349854 - DNA, 20 bp, Artificial Sequence
  chemically synthesized
caagcactctcttcactagg

SEQ ID NO: 349855 - DNA, 20 bp, Artificial Sequence
  chemically synthesized
ccccctcctgccacctagtg

SEQ ID NO: 349856 - DNA, 20 bp, Artificial Sequence
  chemically synthesized
gcactctcttcactaggtgg

SEQ ID NO: 349857 - DNA, 20 bp, Artificial Sequence
  chemically synthesized
cactctcttcactaggtggc

SEQ ID NO: 349858 - DNA, 20 bp, Artificial Sequence
  chemically synthesized
ccctgccccctcctgccacc

SEQ ID NO: 349859 - DNA, 20 bp, Artificial Sequence
  chemically synthesized
ctctcttcactaggtggcag

SEQ ID NO: 349860 - DNA, 20 bp, Artificial Sequence
  chemically synthesized
tctcttcactaggtggcagg

SEQ ID NO: 349861 - DNA, 20 bp, Artificial Sequence
  chemically synthesized
ctcttcactaggtggcagga

SEQ ID NO: 349862 - DNA, 20 bp, Artificial Sequence
  chemically synthesized
tcttcactaggtggcaggag

SEQ ID NO: 349863 - DNA, 20 bp, Artificial Sequence
  chemically synthesized
cttcactaggtggcaggagg

SEQ ID NO: 349864 - DNA, 20 bp, Artificial Sequence
  chemically synthesized
cactaggtggcaggaggggg

SEQ ID NO: 349865 - DNA, 20 bp, Artificial Sequence
  chemically synthesized
actaggtggcaggagggggc

SEQ ID NO: 349866 - DNA, 20 bp, Artificial Sequence
  chemically synthesized
ctaggtggcaggagggggca

SEQ ID NO: 349867 - DNA, 20 bp, Artificial Sequence
  chemically synthesized
tggcaggagggggcagggaa

SEQ ID NO: 349868 - DNA, 20 bp, Artificial Sequence
  chemically synthesized
aggagggggcagggaacagc

SEQ ID NO: 349869 - DNA, 20 bp, Artificial Sequence
  chemically synthesized
gttctgatggtttaagtgtc

SEQ ID NO: 349870 - DNA, 20 bp, Artificial Sequence
  chemically synthesized
cagccagacacttaaaccat

SEQ ID NO: 349871 - DNA, 20 bp, Artificial Sequence
  chemically synthesized
ctcacaagttctgatggttt

SEQ ID NO: 349872 - DNA, 20 bp, Artificial Sequence
  chemically synthesized
atagttctcacaagttctga

SEQ ID NO: 349873 - DNA, 20 bp, Artificial Sequence
  chemically synthesized
cttaaaccatcagaacttgt

SEQ ID NO: 349874 - DNA, 20 bp, Artificial Sequence
  chemically synthesized
gcactcatgatagttctcac

SEQ ID NO: 349875 - DNA, 20 bp, Artificial Sequence
  chemically synthesized
gaacttgtgagaactatcat

SEQ ID NO: 349876 - DNA, 20 bp, Artificial Sequence
  chemically synthesized
cccctatgctgcactcatga

SEQ ID NO: 349877 - DNA, 20 bp, Artificial Sequence
  chemically synthesized
tgtgagaactatcatgagtg

SEQ ID NO: 349878 - DNA, 20 bp, Artificial Sequence
  chemically synthesized
gaactatcatgagtgcagca

SEQ ID NO: 349879 - DNA, 20 bp, Artificial Sequence
  chemically synthesized
aactatcatgagtgcagcat

SEQ ID NO: 349880 - DNA, 20 bp, Artificial Sequence
  chemically synthesized
actatcatgagtgcagcata

SEQ ID NO: 349881 - DNA, 20 bp, Artificial Sequence
  chemically synthesized
ctatcatgagtgcagcatag

SEQ ID NO: 349882 - DNA, 20 bp, Artificial Sequence
  chemically synthesized
tttgggggatgggggatggg

SEQ ID NO: 349883 - DNA, 20 bp, Artificial Sequence
  chemically synthesized
tcatttgggggatgggggat

SEQ ID NO: 349884 - DNA, 20 bp, Artificial Sequence
  chemically synthesized
atcatttgggggatggggga

SEQ ID NO: 349885 - DNA, 20 bp, Artificial Sequence
  chemically synthesized
ttggatcatttgggggatgg

SEQ ID NO: 349886 - DNA, 20 bp, Artificial Sequence
  chemically synthesized
attggatcatttgggggatg

SEQ ID NO: 349887 - DNA, 20 bp, Artificial Sequence
  chemically synthesized
tattggatcatttgggggat

SEQ ID NO: 349888 - DNA, 20 bp, Artificial Sequence
  chemically synthesized
atattggatcatttggggga

SEQ ID NO: 349889 - DNA, 20 bp, Artificial Sequence
  chemically synthesized
tgggatattggatcatttgg

SEQ ID NO: 349890 - DNA, 20 bp, Artificial Sequence
  chemically synthesized
gtgggatattggatcatttg

SEQ ID NO: 349891 - DNA, 20 bp, Artificial Sequence
  chemically synthesized
ggtgggatattggatcattt

SEQ ID NO: 349892 - DNA, 20 bp, Artificial Sequence
  chemically synthesized
tggtgggatattggatcatt

SEQ ID NO: 349893 - DNA, 20 bp, Artificial Sequence
  chemically synthesized
ggagggaactggtgggatat

SEQ ID NO: 349894 - DNA, 20 bp, Artificial Sequence
  chemically synthesized
caaatgatccaatatcccac

SEQ ID NO: 349895 - DNA, 20 bp, Artificial Sequence
  chemically synthesized
tgtcaagggagggaactggt

SEQ ID NO: 349896 - DNA, 20 bp, Artificial Sequence
  chemically synthesized
gtgtcaagggagggaactgg

SEQ ID NO: 349897 - DNA, 20 bp, Artificial Sequence
  chemically synthesized
cacgtgtcaagggagggaac

SEQ ID NO: 349898 - DNA, 20 bp, Artificial Sequence
  chemically synthesized
aatccccacgtgtcaaggga

SEQ ID NO: 349899 - DNA, 20 bp, Artificial Sequence
  chemically synthesized
taatccccacgtgtcaaggg

SEQ ID NO: 349900 - DNA, 20 bp, Artificial Sequence
  chemically synthesized
gtaatccccacgtgtcaagg

SEQ ID NO: 349901 - DNA, 20 bp, Artificial Sequence
  chemically synthesized
ttgtaatccccacgtgtcaa

SEQ ID NO: 349902 - DNA, 20 bp, Artificial Sequence
  chemically synthesized
cagttccctcccttgacacg

SEQ ID NO: 349903 - DNA, 20 bp, Artificial Sequence
  chemically synthesized
attgtaatccccacgtgtca

SEQ ID NO: 349904 - DNA, 20 bp, Artificial Sequence
  chemically synthesized
agttccctcccttgacacgt

SEQ ID NO: 349905 - DNA, 20 bp, Artificial Sequence
  chemically synthesized
aattgtaatccccacgtgtc

SEQ ID NO: 349906 - DNA, 20 bp, Artificial Sequence
  chemically synthesized
gttccctcccttgacacgtg

SEQ ID NO: 349907 - DNA, 20 bp, Artificial Sequence
  chemically synthesized
acacgtggggattacaattt

SEQ ID NO: 349908 - DNA, 20 bp, Artificial Sequence
  chemically synthesized
ttacaatttgagacaaaatt

SEQ ID NO: 349909 - DNA, 20 bp, Artificial Sequence
  chemically synthesized
tacaatttgagacaaaattt

SEQ ID NO: 349910 - DNA, 20 bp, Artificial Sequence
  chemically synthesized
aatttgagacaaaatttggg

SEQ ID NO: 349911 - DNA, 20 bp, Artificial Sequence
  chemically synthesized
atttgagacaaaatttgggt

SEQ ID NO: 349912 - DNA, 20 bp, Artificial Sequence
  chemically synthesized
aaaatttgggtgggtacaca

SEQ ID NO: 349913 - DNA, 20 bp, Artificial Sequence
  chemically synthesized
gggagcagaatgatatggtt

SEQ ID NO: 349914 - DNA, 20 bp, Artificial Sequence
  chemically synthesized
gggccgggagcagaatgata

SEQ ID NO: 349915 - DNA, 20 bp, Artificial Sequence
  chemically synthesized
aaaccatatcattctgctcc

SEQ ID NO: 349916 - DNA, 20 bp, Artificial Sequence
  chemically synthesized
ggcttgggaggggccgggag

SEQ ID NO: 349917 - DNA, 20 bp, Artificial Sequence
  chemically synthesized
tgaggcttgggaggggccgg

SEQ ID NO: 349918 - DNA, 20 bp, Artificial Sequence
  chemically synthesized
catgaggcttgggaggggcc

SEQ ID NO: 349919 - DNA, 20 bp, Artificial Sequence
  chemically synthesized
acatgaggcttgggaggggc

SEQ ID NO: 349920 - DNA, 20 bp, Artificial Sequence
  chemically synthesized
ttctgctcccggcccctccc

SEQ ID NO: 349921 - DNA, 20 bp, Artificial Sequence
  chemically synthesized
gatgacatgaggcttgggag

SEQ ID NO: 349922 - DNA, 20 bp, Artificial Sequence
  chemically synthesized
tgatgacatgaggcttggga

SEQ ID NO: 349923 - DNA, 20 bp, Artificial Sequence
  chemically synthesized
gtgatgacatgaggcttggg

SEQ ID NO: 349924 - DNA, 20 bp, Artificial Sequence
  chemically synthesized
tgtgatgacatgaggcttgg

SEQ ID NO: 349925 - DNA, 20 bp, Artificial Sequence
  chemically synthesized
aatgtgatgacatgaggctt

SEQ ID NO: 349926 - DNA, 20 bp, Artificial Sequence
  chemically synthesized
aaatgtgatgacatgaggct

SEQ ID NO: 349927 - DNA, 20 bp, Artificial Sequence
  chemically synthesized
ttttgaaatgtgatgacatg

SEQ ID NO: 349928 - DNA, 20 bp, Artificial Sequence
  chemically synthesized
gttttgaaatgtgatgacat

SEQ ID NO: 349929 - DNA, 20 bp, Artificial Sequence
  chemically synthesized
tgtcatcacatttcaaaaca

SEQ ID NO: 349930 - DNA, 20 bp, Artificial Sequence
  chemically synthesized
acacagtcatgccttcccaa

SEQ ID NO: 349931 - DNA, 20 bp, Artificial Sequence
  chemically synthesized
actttgcgagactgttggga

SEQ ID NO: 349932 - DNA, 20 bp, Artificial Sequence
  chemically synthesized
gactttgcgagactgttggg

SEQ ID NO: 349933 - DNA, 20 bp, Artificial Sequence
  chemically synthesized
taagactttgcgagactgtt

SEQ ID NO: 349934 - DNA, 20 bp, Artificial Sequence
  chemically synthesized
ttaagactttgcgagactgt

SEQ ID NO: 349935 - DNA, 20 bp, Artificial Sequence
  chemically synthesized
gccttcccaacagtctcgca

SEQ ID NO: 349936 - DNA, 20 bp, Artificial Sequence
  chemically synthesized
gaaatgagttaagactttgc

SEQ ID NO: 349937 - DNA, 20 bp, Artificial Sequence
  chemically synthesized
acttaatgccgaaatgagtt

SEQ ID NO: 349938 - DNA, 20 bp, Artificial Sequence
  chemically synthesized
cgcaaagtcttaactcattt

SEQ ID NO: 349939 - DNA, 20 bp, Artificial Sequence
  chemically synthesized
ttttgacttaatgccgaaat

SEQ ID NO: 349940 - DNA, 20 bp, Artificial Sequence
  chemically synthesized
tcttaactcatttcggcatt

SEQ ID NO: 349941 - DNA, 20 bp, Artificial Sequence
  chemically synthesized
cggcattaagtcaaaattcc

SEQ ID NO: 349942 - DNA, 20 bp, Artificial Sequence
  chemically synthesized
aagtcaaaattccaagtcca

SEQ ID NO: 349943 - DNA, 20 bp, Artificial Sequence
  chemically synthesized
ctcagatgaaactttggact

SEQ ID NO: 349944 - DNA, 20 bp, Artificial Sequence
  chemically synthesized
ccttgtctcagatgaaactt

SEQ ID NO: 349945 - DNA, 20 bp, Artificial Sequence
  chemically synthesized
ccaagtccaaagtttcatct

SEQ ID NO: 349946 - DNA, 20 bp, Artificial Sequence
  chemically synthesized
tccaaagtttcatctgagac

SEQ ID NO: 349947 - DNA, 20 bp, Artificial Sequence
  chemically synthesized
ccaaagtttcatctgagaca

SEQ ID NO: 349948 - DNA, 20 bp, Artificial Sequence
  chemically synthesized
agagagaacttgccttgtct

SEQ ID NO: 349949 - DNA, 20 bp, Artificial Sequence
  chemically synthesized
agtttcatctgagacaaggc

SEQ ID NO: 349950 - DNA, 20 bp, Artificial Sequence
  chemically synthesized
tttacaggcttgtaggcaga

SEQ ID NO: 349951 - DNA, 20 bp, Artificial Sequence
  chemically synthesized
ggcaagttctctctgcctac

SEQ ID NO: 349952 - DNA, 20 bp, Artificial Sequence
  chemically synthesized
gttttacaggcttgtaggca

SEQ ID NO: 349953 - DNA, 20 bp, Artificial Sequence
  chemically synthesized
tggttttacaggcttgtagg

SEQ ID NO: 349954 - DNA, 20 bp, Artificial Sequence
  chemically synthesized
ttttggttttacaggcttgt

SEQ ID NO: 349955 - DNA, 20 bp, Artificial Sequence
  chemically synthesized
cttttggttttacaggcttg

SEQ ID NO: 349956 - DNA, 20 bp, Artificial Sequence
  chemically synthesized
tagcttgcttttggttttac

SEQ ID NO: 349957 - DNA, 20 bp, Artificial Sequence
  chemically synthesized
ctagcttgcttttggtttta

SEQ ID NO: 349958 - DNA, 20 bp, Artificial Sequence
  chemically synthesized
ctacaagcctgtaaaaccaa

SEQ ID NO: 349959 - DNA, 20 bp, Artificial Sequence
  chemically synthesized
aagcctgtaaaaccaaaagc

SEQ ID NO: 349960 - DNA, 20 bp, Artificial Sequence
  chemically synthesized
ggaagtaactagcttgcttt

SEQ ID NO: 349961 - DNA, 20 bp, Artificial Sequence
  chemically synthesized
ctgtaaaaccaaaagcaagc

SEQ ID NO: 349962 - DNA, 20 bp, Artificial Sequence
  chemically synthesized
cattgtaccttggaagtaac

SEQ ID NO: 349963 - DNA, 20 bp, Artificial Sequence
  chemically synthesized
aaagcaagctagttacttcc

SEQ ID NO: 349964 - DNA, 20 bp, Artificial Sequence
  chemically synthesized
aagcaagctagttacttcca

SEQ ID NO: 349965 - DNA, 20 bp, Artificial Sequence
  chemically synthesized
atacctgcattgtaccttgg

SEQ ID NO: 349966 - DNA, 20 bp, Artificial Sequence
  chemically synthesized
cttatacctgcattgtacct

SEQ ID NO: 349967 - DNA, 20 bp, Artificial Sequence
  chemically synthesized
gttacttccaaggtacaatg

SEQ ID NO: 349968 - DNA, 20 bp, Artificial Sequence
  chemically synthesized
ttacttccaaggtacaatgc

SEQ ID NO: 349969 - DNA, 20 bp, Artificial Sequence
  chemically synthesized
ccaaggtacaatgcaggtat

SEQ ID NO: 349970 - DNA, 20 bp, Artificial Sequence
  chemically synthesized
tacaatgcaggtataagtat

SEQ ID NO: 349971 - DNA, 20 bp, Artificial Sequence
  chemically synthesized
acaatgcaggtataagtatt

SEQ ID NO: 349972 - DNA, 20 bp, Artificial Sequence
  chemically synthesized
gtaaatgtttccattctaaa

SEQ ID NO: 349973 - DNA, 20 bp, Artificial Sequence
  chemically synthesized
ccagtttcccccatttagaa

SEQ ID NO: 349974 - DNA, 20 bp, Artificial Sequence
  chemically synthesized
taaatgtttccattctaaat

SEQ ID NO: 349975 - DNA, 20 bp, Artificial Sequence
  chemically synthesized
aaatgtttccattctaaatg

SEQ ID NO: 349976 - DNA, 20 bp, Artificial Sequence
  chemically synthesized
aatgtttccattctaaatgg

SEQ ID NO: 349977 - DNA, 20 bp, Artificial Sequence
  chemically synthesized
tttgaccagtttcccccatt

SEQ ID NO: 349978 - DNA, 20 bp, Artificial Sequence
  chemically synthesized
ccattctaaatgggggaaac

SEQ ID NO: 349979 - DNA, 20 bp, Artificial Sequence
  chemically synthesized
taaatgggggaaactggtca

SEQ ID NO: 349980 - DNA, 20 bp, Artificial Sequence
  chemically synthesized
tgtgtctactttgctttgac

SEQ ID NO: 349981 - DNA, 20 bp, Artificial Sequence
  chemically synthesized
gggggaaactggtcaaagca

SEQ ID NO: 349982 - DNA, 20 bp, Artificial Sequence
  chemically synthesized
ggaaactggtcaaagcaaag

SEQ ID NO: 349983 - DNA, 20 bp, Artificial Sequence
  chemically synthesized
tggtcaaagcaaagtagaca

SEQ ID NO: 349984 - DNA, 20 bp, Artificial Sequence
  chemically synthesized
ggtcaaagcaaagtagacac

SEQ ID NO: 349985 - DNA, 20 bp, Artificial Sequence
  chemically synthesized
agtagacacaggtcccacgc

SEQ ID NO: 349986 - DNA, 20 bp, Artificial Sequence
  chemically synthesized
gctgcatttcaaacttgcgt

SEQ ID NO: 349987 - DNA, 20 bp, Artificial Sequence
  chemically synthesized
ggctgcatttcaaacttgcg

SEQ ID NO: 349988 - DNA, 20 bp, Artificial Sequence
  chemically synthesized
tcccacgcaagtttgaaatg

SEQ ID NO: 349989 - DNA, 20 bp, Artificial Sequence
  chemically synthesized
acgcaagtttgaaatgcagc

SEQ ID NO: 349990 - DNA, 20 bp, Artificial Sequence
  chemically synthesized
cgcaagtttgaaatgcagcc

SEQ ID NO: 349991 - DNA, 20 bp, Artificial Sequence
  chemically synthesized
tttaagatttaacgattgcc

SEQ ID NO: 349992 - DNA, 20 bp, Artificial Sequence
  chemically synthesized
caggcaatcgttaaatctta

SEQ ID NO: 349993 - DNA, 20 bp, Artificial Sequence
  chemically synthesized
aaggcagatttgggagcttt

SEQ ID NO: 349994 - DNA, 20 bp, Artificial Sequence
  chemically synthesized
tggagtcaaggcagatttgg

SEQ ID NO: 349995 - DNA, 20 bp, Artificial Sequence
  chemically synthesized
catggagtcaaggcagattt

SEQ ID NO: 349996 - DNA, 20 bp, Artificial Sequence
  chemically synthesized
acatggagtcaaggcagatt

SEQ ID NO: 349997 - DNA, 20 bp, Artificial Sequence
  chemically synthesized
tatgagacatggagtcaagg

SEQ ID NO: 349998 - DNA, 20 bp, Artificial Sequence
  chemically synthesized
ggatatgagacatggagtca

SEQ ID NO: 349999 - DNA, 20 bp, Artificial Sequence
  chemically synthesized
tggatatgagacatggagtc

SEQ ID NO: 350000 - DNA, 20 bp, Artificial Sequence
  chemically synthesized
tgccctggatatgagacatg

SEQ ID NO: 350001 - DNA, 20 bp, Artificial Sequence
  chemically synthesized
cctgccctggatatgagaca

SEQ ID NO: 350002 - DNA, 20 bp, Artificial Sequence
  chemically synthesized
ttgactccatgtctcatatc

SEQ ID NO: 350003 - DNA, 20 bp, Artificial Sequence
  chemically synthesized
tgactccatgtctcatatcc

SEQ ID NO: 350004 - DNA, 20 bp, Artificial Sequence
  chemically synthesized
gactccatgtctcatatcca

SEQ ID NO: 350005 - DNA, 20 bp, Artificial Sequence
  chemically synthesized
catcagcctgccctggatat

SEQ ID NO: 350006 - DNA, 20 bp, Artificial Sequence
  chemically synthesized
tccatgtctcatatccaggg

SEQ ID NO: 350007 - DNA, 20 bp, Artificial Sequence
  chemically synthesized
ccatgtctcatatccagggc

SEQ ID NO: 350008 - DNA, 20 bp, Artificial Sequence
  chemically synthesized
ccccttgcatcagcctgccc

SEQ ID NO: 350009 - DNA, 20 bp, Artificial Sequence
  chemically synthesized
tatccagggcaggctgatgc

SEQ ID NO: 350010 - DNA, 20 bp, Artificial Sequence
  chemically synthesized
atccagggcaggctgatgca

SEQ ID NO: 350011 - DNA, 20 bp, Artificial Sequence
  chemically synthesized
tccagggcaggctgatgcaa

SEQ ID NO: 350012 - DNA, 20 bp, Artificial Sequence
  chemically synthesized
ccagggcaggctgatgcaag

SEQ ID NO: 350013 - DNA, 20 bp, Artificial Sequence
  chemically synthesized
tgggagcccaccccttgcat

SEQ ID NO: 350014 - DNA, 20 bp, Artificial Sequence
  chemically synthesized
gggcaggctgatgcaagggg

SEQ ID NO: 350015 - DNA, 20 bp, Artificial Sequence
  chemically synthesized
ggcaggctgatgcaaggggt

SEQ ID NO: 350016 - DNA, 20 bp, Artificial Sequence
  chemically synthesized
ggagctgtccaaggtcatgg

SEQ ID NO: 350017 - DNA, 20 bp, Artificial Sequence
  chemically synthesized
ggggtgggctcccatgacct

SEQ ID NO: 350018 - DNA, 20 bp, Artificial Sequence
  chemically synthesized
gtggagctgtccaaggtcat

SEQ ID NO: 350019 - DNA, 20 bp, Artificial Sequence
  chemically synthesized
cgtggagctgtccaaggtca

SEQ ID NO: 350020 - DNA, 20 bp, Artificial Sequence
  chemically synthesized
tgggctcccatgaccttgga

SEQ ID NO: 350021 - DNA, 20 bp, Artificial Sequence
  chemically synthesized
cacaggcgtggagctgtcca

SEQ ID NO: 350022 - DNA, 20 bp, Artificial Sequence
  chemically synthesized
ccacaggcgtggagctgtcc

SEQ ID NO: 350023 - DNA, 20 bp, Artificial Sequence
  chemically synthesized
tctgcagagccacaggcgtg

SEQ ID NO: 350024 - DNA, 20 bp, Artificial Sequence
  chemically synthesized
cttggacagctccacgcctg

SEQ ID NO: 350025 - DNA, 20 bp, Artificial Sequence
  chemically synthesized
gctctgcagagccacaggcg

SEQ ID NO: 350026 - DNA, 20 bp, Artificial Sequence
  chemically synthesized
gctgtgctctgcagagccac

SEQ ID NO: 350027 - DNA, 20 bp, Artificial Sequence
  chemically synthesized
ggctgtgctctgcagagcca

SEQ ID NO: 350028 - DNA, 20 bp, Artificial Sequence
  chemically synthesized
gctccacgcctgtggctctg

SEQ ID NO: 350029 - DNA, 20 bp, Artificial Sequence
  chemically synthesized
tccacgcctgtggctctgca

SEQ ID NO: 350030 - DNA, 20 bp, Artificial Sequence
  chemically synthesized
catgggggctgtgctctgca

SEQ ID NO: 350031 - DNA, 20 bp, Artificial Sequence
  chemically synthesized
gcctgtggctctgcagagca

SEQ ID NO: 350032 - DNA, 20 bp, Artificial Sequence
  chemically synthesized
gccatgggggctgtgctctg

SEQ ID NO: 350033 - DNA, 20 bp, Artificial Sequence
  chemically synthesized
tctgcagagcacagccccca

SEQ ID NO: 350034 - DNA, 20 bp, Artificial Sequence
  chemically synthesized
aggcactgtgaaagccatgg

SEQ ID NO: 350035 - DNA, 20 bp, Artificial Sequence
  chemically synthesized
caggcactgtgaaagccatg

SEQ ID NO: 350036 - DNA, 20 bp, Artificial Sequence
  chemically synthesized
gcaggcactgtgaaagccat

SEQ ID NO: 350037 - DNA, 20 bp, Artificial Sequence
  chemically synthesized
tgcaggcactgtgaaagcca

SEQ ID NO: 350038 - DNA, 20 bp, Artificial Sequence
  chemically synthesized
cacagcccccatggctttca

SEQ ID NO: 350039 - DNA, 20 bp, Artificial Sequence
  chemically synthesized
aaaagctgcaggcactgtga

SEQ ID NO: 350040 - DNA, 20 bp, Artificial Sequence
  chemically synthesized
catggctttcacagtgcctg

SEQ ID NO: 350041 - DNA, 20 bp, Artificial Sequence
  chemically synthesized
catgcacttagaaaagctgc

SEQ ID NO: 350042 - DNA, 20 bp, Artificial Sequence
  chemically synthesized
ccatgcacttagaaaagctg

SEQ ID NO: 350043 - DNA, 20 bp, Artificial Sequence
  chemically synthesized
acagtgcctgcagcttttct

SEQ ID NO: 350044 - DNA, 20 bp, Artificial Sequence
  chemically synthesized
cttgcaccatgcacttagaa

SEQ ID NO: 350045 - DNA, 20 bp, Artificial Sequence
  chemically synthesized
ctgcagcttttctaagtgca

SEQ ID NO: 350046 - DNA, 20 bp, Artificial Sequence
  chemically synthesized
gacaacttgcaccatgcact

SEQ ID NO: 350047 - DNA, 20 bp, Artificial Sequence
  chemically synthesized
cttttctaagtgcatggtgc

SEQ ID NO: 350048 - DNA, 20 bp, Artificial Sequence
  chemically synthesized
aagtgcatggtgcaagttgt

SEQ ID NO: 350049 - DNA, 20 bp, Artificial Sequence
  chemically synthesized
tgcatggtgcaagttgtcag

SEQ ID NO: 350050 - DNA, 20 bp, Artificial Sequence
  chemically synthesized
tgtcagtggatctaccattc

SEQ ID NO: 350051 - DNA, 20 bp, Artificial Sequence
  chemically synthesized
gtcagtggatctaccattct

SEQ ID NO: 350052 - DNA, 20 bp, Artificial Sequence
  chemically synthesized
ccatctagaccccagaatgg

SEQ ID NO: 350053 - DNA, 20 bp, Artificial Sequence
  chemically synthesized
tcagtggatctaccattctg

SEQ ID NO: 350054 - DNA, 20 bp, Artificial Sequence
  chemically synthesized
ccaccatctagaccccagaa

SEQ ID NO: 350055 - DNA, 20 bp, Artificial Sequence
  chemically synthesized
ggatctaccattctggggtc

SEQ ID NO: 350056 - DNA, 20 bp, Artificial Sequence
  chemically synthesized
gaggcccaccatctagaccc

SEQ ID NO: 350057 - DNA, 20 bp, Artificial Sequence
  chemically synthesized
ctaccattctggggtctaga

SEQ ID NO: 350058 - DNA, 20 bp, Artificial Sequence
  chemically synthesized
ccattctggggtctagatgg

SEQ ID NO: 350059 - DNA, 20 bp, Artificial Sequence
  chemically synthesized
cattctggggtctagatggt

SEQ ID NO: 350060 - DNA, 20 bp, Artificial Sequence
  chemically synthesized
atgagaagaggcccaccatc

SEQ ID NO: 350061 - DNA, 20 bp, Artificial Sequence
  chemically synthesized
agatggtgggcctcttctca

SEQ ID NO: 350062 - DNA, 20 bp, Artificial Sequence
  chemically synthesized
cctagtggagccatgagaag

SEQ ID NO: 350063 - DNA, 20 bp, Artificial Sequence
  chemically synthesized
gcctagtggagccatgagaa

SEQ ID NO: 350064 - DNA, 20 bp, Artificial Sequence
  chemically synthesized
ctgcctagtggagccatgag

SEQ ID NO: 350065 - DNA, 20 bp, Artificial Sequence
  chemically synthesized
gcactgcctagtggagccat

SEQ ID NO: 350066 - DNA, 20 bp, Artificial Sequence
  chemically synthesized
gcctcttctcatggctccac

SEQ ID NO: 350067 - DNA, 20 bp, Artificial Sequence
  chemically synthesized
cctcttctcatggctccact

SEQ ID NO: 350068 - DNA, 20 bp, Artificial Sequence
  chemically synthesized
cttctcatggctccactagg

SEQ ID NO: 350069 - DNA, 20 bp, Artificial Sequence
  chemically synthesized
cactggggcactgcctagtg

SEQ ID NO: 350070 - DNA, 20 bp, Artificial Sequence
  chemically synthesized
ctcactggggcactgcctag

SEQ ID NO: 350071 - DNA, 20 bp, Artificial Sequence
  chemically synthesized
gtcctcactggggcactgcc

SEQ ID NO: 350072 - DNA, 20 bp, Artificial Sequence
  chemically synthesized
ggctccactaggcagtgccc

SEQ ID NO: 350073 - DNA, 20 bp, Artificial Sequence
  chemically synthesized
ccactaggcagtgccccagt

SEQ ID NO: 350074 - DNA, 20 bp, Artificial Sequence
  chemically synthesized
cactaggcagtgccccagtg

SEQ ID NO: 350075 - DNA, 20 bp, Artificial Sequence
  chemically synthesized
ccaccacagagtcctcactg

SEQ ID NO: 350076 - DNA, 20 bp, Artificial Sequence
  chemically synthesized
cccaccacagagtcctcact

SEQ ID NO: 350077 - DNA, 20 bp, Artificial Sequence
  chemically synthesized
ccccaccacagagtcctcac

SEQ ID NO: 350078 - DNA, 20 bp, Artificial Sequence
  chemically synthesized
gtgccccagtgaggactctg

SEQ ID NO: 350079 - DNA, 20 bp, Artificial Sequence
  chemically synthesized
ccccagtgaggactctgtgg

SEQ ID NO: 350080 - DNA, 20 bp, Artificial Sequence
  chemically synthesized
cccagtgaggactctgtggt

SEQ ID NO: 350081 - DNA, 20 bp, Artificial Sequence
  chemically synthesized
ccagtgaggactctgtggtg

SEQ ID NO: 350082 - DNA, 20 bp, Artificial Sequence
  chemically synthesized
gagcccttccccccaccaca

SEQ ID NO: 350083 - DNA, 20 bp, Artificial Sequence
  chemically synthesized
cagtgaggactctgtggtgg

SEQ ID NO: 350084 - DNA, 20 bp, Artificial Sequence
  chemically synthesized
agtgaggactctgtggtggg

SEQ ID NO: 350085 - DNA, 20 bp, Artificial Sequence
  chemically synthesized
tggagcccttccccccacca

SEQ ID NO: 350086 - DNA, 20 bp, Artificial Sequence
  chemically synthesized
gaggactctgtggtgggggg

SEQ ID NO: 350087 - DNA, 20 bp, Artificial Sequence
  chemically synthesized
aggactctgtggtgggggga

SEQ ID NO: 350088 - DNA, 20 bp, Artificial Sequence
  chemically synthesized
ggactctgtggtggggggaa

SEQ ID NO: 350089 - DNA, 20 bp, Artificial Sequence
  chemically synthesized
aggggggaaatgtggggttg

SEQ ID NO: 350090 - DNA, 20 bp, Artificial Sequence
  chemically synthesized
gcaggggggaaatgtggggt

SEQ ID NO: 350091 - DNA, 20 bp, Artificial Sequence
  chemically synthesized
caatgcaggggggaaatgtg

SEQ ID NO: 350092 - DNA, 20 bp, Artificial Sequence
  chemically synthesized
gcaatgcaggggggaaatgt

SEQ ID NO: 350093 - DNA, 20 bp, Artificial Sequence
  chemically synthesized
ggcaatgcaggggggaaatg

SEQ ID NO: 350094 - DNA, 20 bp, Artificial Sequence
  chemically synthesized
tctactagggcaatgcaggg

SEQ ID NO: 350095 - DNA, 20 bp, Artificial Sequence
  chemically synthesized
ctctactagggcaatgcagg

SEQ ID NO: 350096 - DNA, 20 bp, Artificial Sequence
  chemically synthesized
cctctactagggcaatgcag

SEQ ID NO: 350097 - DNA, 20 bp, Artificial Sequence
  chemically synthesized
acctctactagggcaatgca

SEQ ID NO: 350098 - DNA, 20 bp, Artificial Sequence
  chemically synthesized
aacctctactagggcaatgc

SEQ ID NO: 350099 - DNA, 20 bp, Artificial Sequence
  chemically synthesized
gaacctctactagggcaatg

SEQ ID NO: 350100 - DNA, 20 bp, Artificial Sequence
  chemically synthesized
atttcccccctgcattgccc

SEQ ID NO: 350101 - DNA, 20 bp, Artificial Sequence
  chemically synthesized
tcccccctgcattgccctag

SEQ ID NO: 350102 - DNA, 20 bp, Artificial Sequence
  chemically synthesized
ccccctgcattgccctagta

SEQ ID NO: 350103 - DNA, 20 bp, Artificial Sequence
  chemically synthesized
cccctgcattgccctagtag

SEQ ID NO: 350104 - DNA, 20 bp, Artificial Sequence
  chemically synthesized
ctcatggagaacctctacta

SEQ ID NO: 350105 - DNA, 20 bp, Artificial Sequence
  chemically synthesized
cctcatggagaacctctact

SEQ ID NO: 350106 - DNA, 20 bp, Artificial Sequence
  chemically synthesized
tcctcatggagaacctctac

SEQ ID NO: 350107 - DNA, 20 bp, Artificial Sequence
  chemically synthesized
ccctagtagaggttctccat

SEQ ID NO: 350108 - DNA, 20 bp, Artificial Sequence
  chemically synthesized
cctagtagaggttctccatg

SEQ ID NO: 350109 - DNA, 20 bp, Artificial Sequence
  chemically synthesized
gcaggggcggagtcctcatg

SEQ ID NO: 350110 - DNA, 20 bp, Artificial Sequence
  chemically synthesized
ctgcaggggcggagtcctca

SEQ ID NO: 350111 - DNA, 20 bp, Artificial Sequence
  chemically synthesized
agaagtctgctgcaggggcg

SEQ ID NO: 350112 - DNA, 20 bp, Artificial Sequence
  chemically synthesized
ccatgaggactccgcccctg

SEQ ID NO: 350113 - DNA, 20 bp, Artificial Sequence
  chemically synthesized
gtagaagtctgctgcagggg

SEQ ID NO: 350114 - DNA, 20 bp, Artificial Sequence
  chemically synthesized
tgaggactccgcccctgcag

SEQ ID NO: 350115 - DNA, 20 bp, Artificial Sequence
  chemically synthesized
caggtagaagtctgctgcag

SEQ ID NO: 350116 - DNA, 20 bp, Artificial Sequence
  chemically synthesized
tcaggtagaagtctgctgca

SEQ ID NO: 350117 - DNA, 20 bp, Artificial Sequence
  chemically synthesized
ttcaggtagaagtctgctgc

SEQ ID NO: 350118 - DNA, 20 bp, Artificial Sequence
  chemically synthesized
gttcaggtagaagtctgctg

SEQ ID NO: 350119 - DNA, 20 bp, Artificial Sequence
  chemically synthesized
acacctggatgttcaggtag

SEQ ID NO: 350120 - DNA, 20 bp, Artificial Sequence
  chemically synthesized
gaaacacctggatgttcagg

SEQ ID NO: 350121 - DNA, 20 bp, Artificial Sequence
  chemically synthesized
cagacttctacctgaacatc

SEQ ID NO: 350122 - DNA, 20 bp, Artificial Sequence
  chemically synthesized
atggaaacacctggatgttc

SEQ ID NO: 350123 - DNA, 20 bp, Artificial Sequence
  chemically synthesized
agacttctacctgaacatcc

SEQ ID NO: 350124 - DNA, 20 bp, Artificial Sequence
  chemically synthesized
tatggaaacacctggatgtt

SEQ ID NO: 350125 - DNA, 20 bp, Artificial Sequence
  chemically synthesized
agaggatgtatggaaacacc

SEQ ID NO: 350126 - DNA, 20 bp, Artificial Sequence
  chemically synthesized
ctagatgtctagaggatgta

SEQ ID NO: 350127 - DNA, 20 bp, Artificial Sequence
  chemically synthesized
aggtgtttccatacatcctc

SEQ ID NO: 350128 - DNA, 20 bp, Artificial Sequence
  chemically synthesized
acctctgcctagatgtctag

SEQ ID NO: 350129 - DNA, 20 bp, Artificial Sequence
  chemically synthesized
aacctctgcctagatgtcta

SEQ ID NO: 350130 - DNA, 20 bp, Artificial Sequence
  chemically synthesized
ccatacatcctctagacatc

SEQ ID NO: 350131 - DNA, 20 bp, Artificial Sequence
  chemically synthesized
catacatcctctagacatct

SEQ ID NO: 350132 - DNA, 20 bp, Artificial Sequence
  chemically synthesized
ggaacctctgcctagatgtc

SEQ ID NO: 350133 - DNA, 20 bp, Artificial Sequence
  chemically synthesized
acatcctctagacatctagg

SEQ ID NO: 350134 - DNA, 20 bp, Artificial Sequence
  chemically synthesized
atcctctagacatctaggca

SEQ ID NO: 350135 - DNA, 20 bp, Artificial Sequence
  chemically synthesized
tcctctagacatctaggcag

SEQ ID NO: 350136 - DNA, 20 bp, Artificial Sequence
  chemically synthesized
gaggtttgggaacctctgcc

SEQ ID NO: 350137 - DNA, 20 bp, Artificial Sequence
  chemically synthesized
gaaggcaagaaatgaggttt

SEQ ID NO: 350138 - DNA, 20 bp, Artificial Sequence
  chemically synthesized
agaaggcaagaaatgaggtt

SEQ ID NO: 350139 - DNA, 20 bp, Artificial Sequence
  chemically synthesized
tgtgcagaaggcaagaaatg

SEQ ID NO: 350140 - DNA, 20 bp, Artificial Sequence
  chemically synthesized
ctgtgcagaaggcaagaaat

SEQ ID NO: 350141 - DNA, 20 bp, Artificial Sequence
  chemically synthesized
cctacggctgtgcagaaggc

SEQ ID NO: 350142 - DNA, 20 bp, Artificial Sequence
  chemically synthesized
ctcatttcttgccttctgca

SEQ ID NO: 350143 - DNA, 20 bp, Artificial Sequence
  chemically synthesized
tctgcctacggctgtgcaga

SEQ ID NO: 350144 - DNA, 20 bp, Artificial Sequence
  chemically synthesized
ttctgcctacggctgtgcag

SEQ ID NO: 350145 - DNA, 20 bp, Artificial Sequence
  chemically synthesized
gtgttctgcctacggctgtg

SEQ ID NO: 350146 - DNA, 20 bp, Artificial Sequence
  chemically synthesized
tcttgccttctgcacagccg

SEQ ID NO: 350147 - DNA, 20 bp, Artificial Sequence
  chemically synthesized
cttgccttctgcacagccgt

SEQ ID NO: 350148 - DNA, 20 bp, Artificial Sequence
  chemically synthesized
gccttctgcacagccgtagg

SEQ ID NO: 350149 - DNA, 20 bp, Artificial Sequence
  chemically synthesized
tccatgtggtgttctgccta

SEQ ID NO: 350150 - DNA, 20 bp, Artificial Sequence
  chemically synthesized
gccgtaggcagaacaccaca

SEQ ID NO: 350151 - DNA, 20 bp, Artificial Sequence
  chemically synthesized
gtaggcagaacaccacatgg

SEQ ID NO: 350152 - DNA, 20 bp, Artificial Sequence
  chemically synthesized
aagccttggcagcttccatg

SEQ ID NO: 350153 - DNA, 20 bp, Artificial Sequence
  chemically synthesized
aacaccacatggaagctgcc

SEQ ID NO: 350154 - DNA, 20 bp, Artificial Sequence
  chemically synthesized
acaccacatggaagctgcca

SEQ ID NO: 350155 - DNA, 20 bp, Artificial Sequence
  chemically synthesized
gtgcaagccccaagccttgg

SEQ ID NO: 350156 - DNA, 20 bp, Artificial Sequence
  chemically synthesized
acatggaagctgccaaggct

SEQ ID NO: 350157 - DNA, 20 bp, Artificial Sequence
  chemically synthesized
catggaagctgccaaggctt

SEQ ID NO: 350158 - DNA, 20 bp, Artificial Sequence
  chemically synthesized
atggaagctgccaaggcttg

SEQ ID NO: 350159 - DNA, 20 bp, Artificial Sequence
  chemically synthesized
agggtgcaagccccaagcct

SEQ ID NO: 350160 - DNA, 20 bp, Artificial Sequence
  chemically synthesized
cttcagagggtgcaagcccc

SEQ ID NO: 350161 - DNA, 20 bp, Artificial Sequence
  chemically synthesized
accattgcttcagagggtgc

SEQ ID NO: 350162 - DNA, 20 bp, Artificial Sequence
  chemically synthesized
cttggggcttgcaccctctg

SEQ ID NO: 350163 - DNA, 20 bp, Artificial Sequence
  chemically synthesized
tcttgcaccattgcttcaga

SEQ ID NO: 350164 - DNA, 20 bp, Artificial Sequence
  chemically synthesized
atcttgcaccattgcttcag

SEQ ID NO: 350165 - DNA, 20 bp, Artificial Sequence
  chemically synthesized
catcttgcaccattgcttca

SEQ ID NO: 350166 - DNA, 20 bp, Artificial Sequence
  chemically synthesized
gcttgcaccctctgaagcaa

SEQ ID NO: 350167 - DNA, 20 bp, Artificial Sequence
  chemically synthesized
tacatcttgcaccattgctt

SEQ ID NO: 350168 - DNA, 20 bp, Artificial Sequence
  chemically synthesized
accctctgaagcaatggtgc

SEQ ID NO: 350169 - DNA, 20 bp, Artificial Sequence
  chemically synthesized
caatggtgcaagatgtacct

SEQ ID NO: 350170 - DNA, 20 bp, Artificial Sequence
  chemically synthesized
gccttggctaaaaggggcca

SEQ ID NO: 350171 - DNA, 20 bp, Artificial Sequence
  chemically synthesized
agccttggctaaaaggggcc

SEQ ID NO: 350172 - DNA, 20 bp, Artificial Sequence
  chemically synthesized
agatgtaccttggccccttt

SEQ ID NO: 350173 - DNA, 20 bp, Artificial Sequence
  chemically synthesized
gctccagccttggctaaaag

SEQ ID NO: 350174 - DNA, 20 bp, Artificial Sequence
  chemically synthesized
agctccagccttggctaaaa

SEQ ID NO: 350175 - DNA, 20 bp, Artificial Sequence
  chemically synthesized
taccttggccccttttagcc

SEQ ID NO: 350176 - DNA, 20 bp, Artificial Sequence
  chemically synthesized
cagctccagccttggctaaa

SEQ ID NO: 350177 - DNA, 20 bp, Artificial Sequence
  chemically synthesized
accttggccccttttagcca

SEQ ID NO: 350178 - DNA, 20 bp, Artificial Sequence
  chemically synthesized
tcagctccagccttggctaa

SEQ ID NO: 350179 - DNA, 20 bp, Artificial Sequence
  chemically synthesized
tggccccttttagccaaggc

SEQ ID NO: 350180 - DNA, 20 bp, Artificial Sequence
  chemically synthesized
gccccttttagccaaggctg

SEQ ID NO: 350181 - DNA, 20 bp, Artificial Sequence
  chemically synthesized
agctgcttcagctccagcct

SEQ ID NO: 350182 - DNA, 20 bp, Artificial Sequence
  chemically synthesized
tttagccaaggctggagctg

SEQ ID NO: 350183 - DNA, 20 bp, Artificial Sequence
  chemically synthesized
tgtcctagctgcttcagctc

SEQ ID NO: 350184 - DNA, 20 bp, Artificial Sequence
  chemically synthesized
agccaaggctggagctgaag

SEQ ID NO: 350185 - DNA, 20 bp, Artificial Sequence
  chemically synthesized
aaggctggagctgaagcagc

SEQ ID NO: 350186 - DNA, 20 bp, Artificial Sequence
  chemically synthesized
ttcctgtgtcctagctgctt

SEQ ID NO: 350187 - DNA, 20 bp, Artificial Sequence
  chemically synthesized
aggctggagctgaagcagct

SEQ ID NO: 350188 - DNA, 20 bp, Artificial Sequence
  chemically synthesized
gagctgaagcagctaggaca

SEQ ID NO: 350189 - DNA, 20 bp, Artificial Sequence
  chemically synthesized
agctgaagcagctaggacac

SEQ ID NO: 350190 - DNA, 20 bp, Artificial Sequence
  chemically synthesized
ggacctggcttcctgtgtcc

SEQ ID NO: 350191 - DNA, 20 bp, Artificial Sequence
  chemically synthesized
tgaagcagctaggacacagg

SEQ ID NO: 350192 - DNA, 20 bp, Artificial Sequence
  chemically synthesized
gcagctaggacacaggaagc

SEQ ID NO: 350193 - DNA, 20 bp, Artificial Sequence
  chemically synthesized
cagctaggacacaggaagcc

SEQ ID NO: 350194 - DNA, 20 bp, Artificial Sequence
  chemically synthesized
gacacaggaagccaggtccc

SEQ ID NO: 350195 - DNA, 20 bp, Artificial Sequence
  chemically synthesized
acacaggaagccaggtccca

SEQ ID NO: 350196 - DNA, 20 bp, Artificial Sequence
  chemically synthesized
ctctgtgcagccttgggacc

SEQ ID NO: 350197 - DNA, 20 bp, Artificial Sequence
  chemically synthesized
ccactgctctgtgcagcctt

SEQ ID NO: 350198 - DNA, 20 bp, Artificial Sequence
  chemically synthesized
cccactgctctgtgcagcct

SEQ ID NO: 350199 - DNA, 20 bp, Artificial Sequence
  chemically synthesized
agccaggtcccaaggctgca

SEQ ID NO: 350200 - DNA, 20 bp, Artificial Sequence
  chemically synthesized
ccaggtcccaaggctgcaca

SEQ ID NO: 350201 - DNA, 20 bp, Artificial Sequence
  chemically synthesized
ggtcccaaggctgcacagag

SEQ ID NO: 350202 - DNA, 20 bp, Artificial Sequence
  chemically synthesized
caaggccccactgctctgtg

SEQ ID NO: 350203 - DNA, 20 bp, Artificial Sequence
  chemically synthesized
cccaaggctgcacagagcag

SEQ ID NO: 350204 - DNA, 20 bp, Artificial Sequence
  chemically synthesized
ccaaggctgcacagagcagt

SEQ ID NO: 350205 - DNA, 20 bp, Artificial Sequence
  chemically synthesized
caaggctgcacagagcagtg

SEQ ID NO: 350206 - DNA, 20 bp, Artificial Sequence
  chemically synthesized
tgcacagagcagtggggcct

SEQ ID NO: 350207 - DNA, 20 bp, Artificial Sequence
  chemically synthesized
gcacagagcagtggggcctt

SEQ ID NO: 350208 - DNA, 20 bp, Artificial Sequence
  chemically synthesized
gagcagtggggccttgggcc

SEQ ID NO: 350209 - DNA, 20 bp, Artificial Sequence
  chemically synthesized
ggtttggtgggccaggccca

SEQ ID NO: 350210 - DNA, 20 bp, Artificial Sequence
  chemically synthesized
tggtttggtgggccaggccc

SEQ ID NO: 350211 - DNA, 20 bp, Artificial Sequence
  chemically synthesized
gaaaaatggtttggtgggcc

SEQ ID NO: 350212 - DNA, 20 bp, Artificial Sequence
  chemically synthesized
ggaaaaatggtttggtgggc

SEQ ID NO: 350213 - DNA, 20 bp, Artificial Sequence
  chemically synthesized
gaagggaaaaatggtttggt

SEQ ID NO: 350214 - DNA, 20 bp, Artificial Sequence
  chemically synthesized
agaagggaaaaatggtttgg

SEQ ID NO: 350215 - DNA, 20 bp, Artificial Sequence
  chemically synthesized
cctagaagggaaaaatggtt

SEQ ID NO: 350216 - DNA, 20 bp, Artificial Sequence
  chemically synthesized
agaggcctagaagggaaaaa

SEQ ID NO: 350217 - DNA, 20 bp, Artificial Sequence
  chemically synthesized
accaaaccatttttcccttc

SEQ ID NO: 350218 - DNA, 20 bp, Artificial Sequence
  chemically synthesized
ccaaaccatttttcccttct

SEQ ID NO: 350219 - DNA, 20 bp, Artificial Sequence
  chemically synthesized
acaggcccagaggcctagaa

SEQ ID NO: 350220 - DNA, 20 bp, Artificial Sequence
  chemically synthesized
cacaggcccagaggcctaga

SEQ ID NO: 350221 - DNA, 20 bp, Artificial Sequence
  chemically synthesized
tcacaggcccagaggcctag

SEQ ID NO: 350222 - DNA, 20 bp, Artificial Sequence
  chemically synthesized
atttttcccttctaggcctc

SEQ ID NO: 350223 - DNA, 20 bp, Artificial Sequence
  chemically synthesized
tttttcccttctaggcctct

SEQ ID NO: 350224 - DNA, 20 bp, Artificial Sequence
  chemically synthesized
ccatcacaggcccagaggcc

SEQ ID NO: 350225 - DNA, 20 bp, Artificial Sequence
  chemically synthesized
cccttccatcacaggcccag

SEQ ID NO: 350226 - DNA, 20 bp, Artificial Sequence
  chemically synthesized
ccccttccatcacaggccca

SEQ ID NO: 350227 - DNA, 20 bp, Artificial Sequence
  chemically synthesized
agccccttccatcacaggcc

SEQ ID NO: 350228 - DNA, 20 bp, Artificial Sequence
  chemically synthesized
ctaggcctctgggcctgtga

SEQ ID NO: 350229 - DNA, 20 bp, Artificial Sequence
  chemically synthesized
ggcctctgggcctgtgatgg

SEQ ID NO: 350230 - DNA, 20 bp, Artificial Sequence
  chemically synthesized
gtgccagccccttccatcac

SEQ ID NO: 350231 - DNA, 20 bp, Artificial Sequence
  chemically synthesized
gcctctgggcctgtgatgga

SEQ ID NO: 350232 - DNA, 20 bp, Artificial Sequence
  chemically synthesized
tgtgccagccccttccatca

SEQ ID NO: 350233 - DNA, 20 bp, Artificial Sequence
  chemically synthesized
cctctgggcctgtgatggaa

SEQ ID NO: 350234 - DNA, 20 bp, Artificial Sequence
  chemically synthesized
ctctgggcctgtgatggaag

SEQ ID NO: 350235 - DNA, 20 bp, Artificial Sequence
  chemically synthesized
gggcctgtgatggaaggggc

SEQ ID NO: 350236 - DNA, 20 bp, Artificial Sequence
  chemically synthesized
tgatggaaggggctggcaca

SEQ ID NO: 350237 - DNA, 20 bp, Artificial Sequence
  chemically synthesized
gatggaaggggctggcacaa

SEQ ID NO: 350238 - DNA, 20 bp, Artificial Sequence
  chemically synthesized
tatgtcagagacctttgtgc

SEQ ID NO: 350239 - DNA, 20 bp, Artificial Sequence
  chemically synthesized
aacgtcttcagggtatgtca

SEQ ID NO: 350240 - DNA, 20 bp, Artificial Sequence
  chemically synthesized
aaaacgtcttcagggtatgt

SEQ ID NO: 350241 - DNA, 20 bp, Artificial Sequence
  chemically synthesized
aaggtctctgacataccctg

SEQ ID NO: 350242 - DNA, 20 bp, Artificial Sequence
  chemically synthesized
caatggggaaaacgtcttca

SEQ ID NO: 350243 - DNA, 20 bp, Artificial Sequence
  chemically synthesized
acaatggggaaaacgtcttc

SEQ ID NO: 350244 - DNA, 20 bp, Artificial Sequence
  chemically synthesized
gacaatggggaaaacgtctt

SEQ ID NO: 350245 - DNA, 20 bp, Artificial Sequence
  chemically synthesized
tgttagtagccaagacaatg

SEQ ID NO: 350246 - DNA, 20 bp, Artificial Sequence
  chemically synthesized
agacgttttccccattgtct

SEQ ID NO: 350247 - DNA, 20 bp, Artificial Sequence
  chemically synthesized
atgttagtagccaagacaat

SEQ ID NO: 350248 - DNA, 20 bp, Artificial Sequence
  chemically synthesized
aatgttagtagccaagacaa

SEQ ID NO: 350249 - DNA, 20 bp, Artificial Sequence
  chemically synthesized
gaagcagaatgttagtagcc

SEQ ID NO: 350250 - DNA, 20 bp, Artificial Sequence
  chemically synthesized
aaagagaagcagaatgttag

SEQ ID NO: 350251 - DNA, 20 bp, Artificial Sequence
  chemically synthesized
agtaaagagaagcagaatgt

SEQ ID NO: 350252 - DNA, 20 bp, Artificial Sequence
  chemically synthesized
tttgcataagtaaagagaag

SEQ ID NO: 350253 - DNA, 20 bp, Artificial Sequence
  chemically synthesized
aaatttgcataagtaaagag

SEQ ID NO: 350254 - DNA, 20 bp, Artificial Sequence
  chemically synthesized
cagaaatttgcataagtaaa

SEQ ID NO: 350255 - DNA, 20 bp, Artificial Sequence
  chemically synthesized
tgcagaaatttgcataagta

SEQ ID NO: 350256 - DNA, 20 bp, Artificial Sequence
  chemically synthesized
cctgctgcagaaatttgcat

SEQ ID NO: 350257 - DNA, 20 bp, Artificial Sequence
  chemically synthesized
tttacttatgcaaatttctg

SEQ ID NO: 350258 - DNA, 20 bp, Artificial Sequence
  chemically synthesized
acttatgcaaatttctgcag

SEQ ID NO: 350259 - DNA, 20 bp, Artificial Sequence
  chemically synthesized
cttatgcaaatttctgcagc

SEQ ID NO: 350260 - DNA, 20 bp, Artificial Sequence
  chemically synthesized
ggagtaagtcaagcctgctg

SEQ ID NO: 350261 - DNA, 20 bp, Artificial Sequence
  chemically synthesized
cattttctagggagtaagtc

SEQ ID NO: 350262 - DNA, 20 bp, Artificial Sequence
  chemically synthesized
agcaggcttgacttactccc

SEQ ID NO: 350263 - DNA, 20 bp, Artificial Sequence
  chemically synthesized
aaacccattttctagggagt

SEQ ID NO: 350264 - DNA, 20 bp, Artificial Sequence
  chemically synthesized
agaaaaacccattttctagg

SEQ ID NO: 350265 - DNA, 20 bp, Artificial Sequence
  chemically synthesized
ttgacttactccctagaaaa

SEQ ID NO: 350266 - DNA, 20 bp, Artificial Sequence
  chemically synthesized
aaagaaaaacccattttcta

SEQ ID NO: 350267 - DNA, 20 bp, Artificial Sequence
  chemically synthesized
tgacttactccctagaaaat

SEQ ID NO: 350268 - DNA, 20 bp, Artificial Sequence
  chemically synthesized
aaaagaaaaacccattttct

SEQ ID NO: 350269 - DNA, 20 bp, Artificial Sequence
  chemically synthesized
gaaaagaaaaacccattttc

SEQ ID NO: 350270 - DNA, 20 bp, Artificial Sequence
  chemically synthesized
agcctgtccatgcggcagaa

SEQ ID NO: 350271 - DNA, 20 bp, Artificial Sequence
  chemically synthesized
ggtttttcttttctgccgca

SEQ ID NO: 350272 - DNA, 20 bp, Artificial Sequence
  chemically synthesized
tttgcagcctgtccatgcgg

SEQ ID NO: 350273 - DNA, 20 bp, Artificial Sequence
  chemically synthesized
tttcttttctgccgcatgga

SEQ ID NO: 350274 - DNA, 20 bp, Artificial Sequence
  chemically synthesized
ttcttttctgccgcatggac

SEQ ID NO: 350275 - DNA, 20 bp, Artificial Sequence
  chemically synthesized
aaatttgcagcctgtccatg

SEQ ID NO: 350276 - DNA, 20 bp, Artificial Sequence
  chemically synthesized
ataaaagtttggaaaatttg

SEQ ID NO: 350277 - DNA, 20 bp, Artificial Sequence
  chemically synthesized
gaaagcagagcataaaagtt

SEQ ID NO: 350278 - DNA, 20 bp, Artificial Sequence
  chemically synthesized
aaaaggaaagcagagcataa

SEQ ID NO: 350279 - DNA, 20 bp, Artificial Sequence
  chemically synthesized
ttttctttaaaaggaaagca

SEQ ID NO: 350280 - DNA, 20 bp, Artificial Sequence
  chemically synthesized
acttttctttaaaaggaaag

SEQ ID NO: 350281 - DNA, 20 bp, Artificial Sequence
  chemically synthesized
ggaacttttctttaaaagga

SEQ ID NO: 350282 - DNA, 20 bp, Artificial Sequence
  chemically synthesized
tatgctctgctttcctttta

SEQ ID NO: 350283 - DNA, 20 bp, Artificial Sequence
  chemically synthesized
aatgggaacttttctttaaa

SEQ ID NO: 350284 - DNA, 20 bp, Artificial Sequence
  chemically synthesized
aaatgggaacttttctttaa

SEQ ID NO: 350285 - DNA, 20 bp, Artificial Sequence
  chemically synthesized
tctgctttccttttaaagaa

SEQ ID NO: 350286 - DNA, 20 bp, Artificial Sequence
  chemically synthesized
ttaaagaaaagttcccattt

SEQ ID NO: 350287 - DNA, 20 bp, Artificial Sequence
  chemically synthesized
acagagagattatctgaaat

SEQ ID NO: 350288 - DNA, 20 bp, Artificial Sequence
  chemically synthesized
cacagagagattatctgaaa

SEQ ID NO: 350289 - DNA, 20 bp, Artificial Sequence
  chemically synthesized
cggttatatgcgttcacaga

SEQ ID NO: 350290 - DNA, 20 bp, Artificial Sequence
  chemically synthesized
tacggttatatgcgttcaca

SEQ ID NO: 350291 - DNA, 20 bp, Artificial Sequence
  chemically synthesized
catacggttatatgcgttca

SEQ ID NO: 350292 - DNA, 20 bp, Artificial Sequence
  chemically synthesized
tgactttttctgaaaacata

SEQ ID NO: 350293 - DNA, 20 bp, Artificial Sequence
  chemically synthesized
cgcatataaccgtatgtttt

SEQ ID NO: 350294 - DNA, 20 bp, Artificial Sequence
  chemically synthesized
taaccgtatgttttcagaaa

SEQ ID NO: 350295 - DNA, 20 bp, Artificial Sequence
  chemically synthesized
gtatgttttcagaaaaagtc

SEQ ID NO: 350296 - DNA, 20 bp, Artificial Sequence
  chemically synthesized
ctgtaagcagcaaggcattc

SEQ ID NO: 350297 - DNA, 20 bp, Artificial Sequence
  chemically synthesized
gcagaaatctgtaagcagca

SEQ ID NO: 350298 - DNA, 20 bp, Artificial Sequence
  chemically synthesized
ggcagaaatctgtaagcagc

SEQ ID NO: 350299 - DNA, 20 bp, Artificial Sequence
  chemically synthesized
cttgaatgccttgctgctta

SEQ ID NO: 350300 - DNA, 20 bp, Artificial Sequence
  chemically synthesized
atctggcagaaatctgtaag

SEQ ID NO: 350301 - DNA, 20 bp, Artificial Sequence
  chemically synthesized
ggtatctggcagaaatctgt

SEQ ID NO: 350302 - DNA, 20 bp, Artificial Sequence
  chemically synthesized
tgctgcttacagatttctgc

SEQ ID NO: 350303 - DNA, 20 bp, Artificial Sequence
  chemically synthesized
agatgatttagggtatctgg

SEQ ID NO: 350304 - DNA, 20 bp, Artificial Sequence
  chemically synthesized
gagagatgatttagggtatc

SEQ ID NO: 350305 - DNA, 20 bp, Artificial Sequence
  chemically synthesized
tgaacttgagagatgattta

SEQ ID NO: 350306 - DNA, 20 bp, Artificial Sequence
  chemically synthesized
ttgaacttgagagatgattt

SEQ ID NO: 350307 - DNA, 20 bp, Artificial Sequence
  chemically synthesized
tttgaacttgagagatgatt

SEQ ID NO: 350308 - DNA, 20 bp, Artificial Sequence
  chemically synthesized
gataccctaaatcatctctc

SEQ ID NO: 350309 - DNA, 20 bp, Artificial Sequence
  chemically synthesized
ctgtggaactttgaacttga

SEQ ID NO: 350310 - DNA, 20 bp, Artificial Sequence
  chemically synthesized
taaatcatctctcaagttca

SEQ ID NO: 350311 - DNA, 20 bp, Artificial Sequence
  chemically synthesized
atctgtggaactttgaactt

SEQ ID NO: 350312 - DNA, 20 bp, Artificial Sequence
  chemically synthesized
ctctcaagttcaaagttcca

SEQ ID NO: 350313 - DNA, 20 bp, Artificial Sequence
  chemically synthesized
gccccttccctagacatctg

SEQ ID NO: 350314 - DNA, 20 bp, Artificial Sequence
  chemically synthesized
ttcaaagttccacagatgtc

SEQ ID NO: 350315 - DNA, 20 bp, Artificial Sequence
  chemically synthesized
tcaaagttccacagatgtct

SEQ ID NO: 350316 - DNA, 20 bp, Artificial Sequence
  chemically synthesized
caaagttccacagatgtcta

SEQ ID NO: 350317 - DNA, 20 bp, Artificial Sequence
  chemically synthesized
agttccacagatgtctaggg

SEQ ID NO: 350318 - DNA, 20 bp, Artificial Sequence
  chemically synthesized
gttccacagatgtctaggga

SEQ ID NO: 350319 - DNA, 20 bp, Artificial Sequence
  chemically synthesized
ttccacagatgtctagggaa

SEQ ID NO: 350320 - DNA, 20 bp, Artificial Sequence
  chemically synthesized
tccacagatgtctagggaag

SEQ ID NO: 350321 - DNA, 20 bp, Artificial Sequence
  chemically synthesized
gtggcattttgccccttccc

SEQ ID NO: 350322 - DNA, 20 bp, Artificial Sequence
  chemically synthesized
tgctttagcaaagagattgg

SEQ ID NO: 350323 - DNA, 20 bp, Artificial Sequence
  chemically synthesized
ctatgctttagcaaagagat

SEQ ID NO: 350324 - DNA, 20 bp, Artificial Sequence
  chemically synthesized
tgccaccaatctctttgcta

SEQ ID NO: 350325 - DNA, 20 bp, Artificial Sequence
  chemically synthesized
tcttgctatgctttagcaaa

SEQ ID NO: 350326 - DNA, 20 bp, Artificial Sequence
  chemically synthesized
actcttgctatgctttagca

SEQ ID NO: 350327 - DNA, 20 bp, Artificial Sequence
  chemically synthesized
ccaatctctttgctaaagca

SEQ ID NO: 350328 - DNA, 20 bp, Artificial Sequence
  chemically synthesized
aagtgactcttgctatgctt

SEQ ID NO: 350329 - DNA, 20 bp, Artificial Sequence
  chemically synthesized
tctctttgctaaagcatagc

SEQ ID NO: 350330 - DNA, 20 bp, Artificial Sequence
  chemically synthesized
tctttgctaaagcatagcaa

SEQ ID NO: 350331 - DNA, 20 bp, Artificial Sequence
  chemically synthesized
agcaagagtcacttttactc

SEQ ID NO: 350332 - DNA, 20 bp, Artificial Sequence
  chemically synthesized
cttgttgggaactggagtaa

SEQ ID NO: 350333 - DNA, 20 bp, Artificial Sequence
  chemically synthesized
gaggaacttgttgggaactg

SEQ ID NO: 350334 - DNA, 20 bp, Artificial Sequence
  chemically synthesized
atgaggaacttgttgggaac

SEQ ID NO: 350335 - DNA, 20 bp, Artificial Sequence
  chemically synthesized
cttttactccagttcccaac

SEQ ID NO: 350336 - DNA, 20 bp, Artificial Sequence
  chemically synthesized
atggagatgaggaacttgtt

SEQ ID NO: 350337 - DNA, 20 bp, Artificial Sequence
  chemically synthesized
gatggagatgaggaacttgt

SEQ ID NO: 350338 - DNA, 20 bp, Artificial Sequence
  chemically synthesized
gatagtctcagatggagatg

SEQ ID NO: 350339 - DNA, 20 bp, Artificial Sequence
  chemically synthesized
agatagtctcagatggagat

SEQ ID NO: 350340 - DNA, 20 bp, Artificial Sequence
  chemically synthesized
caagttcctcatctccatct

SEQ ID NO: 350341 - DNA, 20 bp, Artificial Sequence
  chemically synthesized
ggctgagatagtctcagatg

SEQ ID NO: 350342 - DNA, 20 bp, Artificial Sequence
  chemically synthesized
caggctgagatagtctcaga

SEQ ID NO: 350343 - DNA, 20 bp, Artificial Sequence
  chemically synthesized
agtccaggctgagatagtct

SEQ ID NO: 350344 - DNA, 20 bp, Artificial Sequence
  chemically synthesized
atctccatctgagactatct

SEQ ID NO: 350345 - DNA, 20 bp, Artificial Sequence
  chemically synthesized
caatgaagtccaggctgaga

SEQ ID NO: 350346 - DNA, 20 bp, Artificial Sequence
  chemically synthesized
catctgagactatctcagcc

SEQ ID NO: 350347 - DNA, 20 bp, Artificial Sequence
  chemically synthesized
cggacaatgaagtccaggct

SEQ ID NO: 350348 - DNA, 20 bp, Artificial Sequence
  chemically synthesized
tgatacggacaatgaagtcc

SEQ ID NO: 350349 - DNA, 20 bp, Artificial Sequence
  chemically synthesized
gtgatacggacaatgaagtc

SEQ ID NO: 350350 - DNA, 20 bp, Artificial Sequence
  chemically synthesized
tgatagtgatacggacaatg

SEQ ID NO: 350351 - DNA, 20 bp, Artificial Sequence
  chemically synthesized
ccacaatgttgatagtgata

SEQ ID NO: 350352 - DNA, 20 bp, Artificial Sequence
  chemically synthesized
ggctttgaccacaatgttga

SEQ ID NO: 350353 - DNA, 20 bp, Artificial Sequence
  chemically synthesized
ccgtatcactatcaacattg

SEQ ID NO: 350354 - DNA, 20 bp, Artificial Sequence
  chemically synthesized
cactatcaacattgtggtca

SEQ ID NO: 350355 - DNA, 20 bp, Artificial Sequence
  chemically synthesized
tgtggtcaaagccattcaac

SEQ ID NO: 350356 - DNA, 20 bp, Artificial Sequence
  chemically synthesized
tttcccagagacttgttgaa

SEQ ID NO: 350357 - DNA, 20 bp, Artificial Sequence
  chemically synthesized
aaagccattcaacaagtctc

SEQ ID NO: 350358 - DNA, 20 bp, Artificial Sequence
  chemically synthesized
aagccattcaacaagtctct

SEQ ID NO: 350359 - DNA, 20 bp, Artificial Sequence
  chemically synthesized
ggagagtttggaatttccca

SEQ ID NO: 350360 - DNA, 20 bp, Artificial Sequence
  chemically synthesized
agggagagtttggaatttcc

SEQ ID NO: 350361 - DNA, 20 bp, Artificial Sequence
  chemically synthesized
cagaaagatgagggagagtt

SEQ ID NO: 350362 - DNA, 20 bp, Artificial Sequence
  chemically synthesized
gaagacagaaagatgaggga

SEQ ID NO: 350363 - DNA, 20 bp, Artificial Sequence
  chemically synthesized
aagaagacagaaagatgagg

SEQ ID NO: 350364 - DNA, 20 bp, Artificial Sequence
  chemically synthesized
agaagaagacagaaagatga

SEQ ID NO: 350365 - DNA, 20 bp, Artificial Sequence
  chemically synthesized
cagaagaagacagaaagatg

SEQ ID NO: 350366 - DNA, 20 bp, Artificial Sequence
  chemically synthesized
tcagaagaagacagaaagat

SEQ ID NO: 350367 - DNA, 20 bp, Artificial Sequence
  chemically synthesized
gggggtcagaagaagacaga

SEQ ID NO: 350368 - DNA, 20 bp, Artificial Sequence
  chemically synthesized
gggggggggtcagaagaaga

SEQ ID NO: 350369 - DNA, 20 bp, Artificial Sequence
  chemically synthesized
tttggggggggggtcagaag

SEQ ID NO: 350370 - DNA, 20 bp, Artificial Sequence
  chemically synthesized
caatttggggggggggtcag

SEQ ID NO: 350371 - DNA, 20 bp, Artificial Sequence
  chemically synthesized
gaacaatttggggggggggt

SEQ ID NO: 350372 - DNA, 20 bp, Artificial Sequence
  chemically synthesized
gttggaacaatttggggggg

SEQ ID NO: 350373 - DNA, 20 bp, Artificial Sequence
  chemically synthesized
ggttggaacaatttgggggg

SEQ ID NO: 350374 - DNA, 20 bp, Artificial Sequence
  chemically synthesized
aggttggaacaatttggggg

SEQ ID NO: 350375 - DNA, 20 bp, Artificial Sequence
  chemically synthesized
gaggttggaacaatttgggg

SEQ ID NO: 350376 - DNA, 20 bp, Artificial Sequence
  chemically synthesized
agaggttggaacaatttggg

SEQ ID NO: 350377 - DNA, 20 bp, Artificial Sequence
  chemically synthesized
cagaggttggaacaatttgg

SEQ ID NO: 350378 - DNA, 20 bp, Artificial Sequence
  chemically synthesized
gcagaggttggaacaatttg

SEQ ID NO: 350379 - DNA, 20 bp, Artificial Sequence
  chemically synthesized
ggcagaggttggaacaattt

SEQ ID NO: 350380 - DNA, 20 bp, Artificial Sequence
  chemically synthesized
tggcagaggttggaacaatt

SEQ ID NO: 350381 - DNA, 20 bp, Artificial Sequence
  chemically synthesized
actgggtaactggcagaggt

SEQ ID NO: 350382 - DNA, 20 bp, Artificial Sequence
  chemically synthesized
caaattgttccaacctctgc

SEQ ID NO: 350383 - DNA, 20 bp, Artificial Sequence
  chemically synthesized
tggaactgggtaactggcag

SEQ ID NO: 350384 - DNA, 20 bp, Artificial Sequence
  chemically synthesized
ttggaactgggtaactggca

SEQ ID NO: 350385 - DNA, 20 bp, Artificial Sequence
  chemically synthesized
ctttggaactgggtaactgg

SEQ ID NO: 350386 - DNA, 20 bp, Artificial Sequence
  chemically synthesized
tccaacctctgccagttacc

SEQ ID NO: 350387 - DNA, 20 bp, Artificial Sequence
  chemically synthesized
tgactttggaactgggtaac

SEQ ID NO: 350388 - DNA, 20 bp, Artificial Sequence
  chemically synthesized
ctgccagttacccagttcca

SEQ ID NO: 350389 - DNA, 20 bp, Artificial Sequence
  chemically synthesized
atagaagtgactttggaact

SEQ ID NO: 350390 - DNA, 20 bp, Artificial Sequence
  chemically synthesized
tatagaagtgactttggaac

SEQ ID NO: 350391 - DNA, 20 bp, Artificial Sequence
  chemically synthesized
agcaattatagaagtgactt

SEQ ID NO: 350392 - DNA, 20 bp, Artificial Sequence
  chemically synthesized
tataaatatagcaattatag

SEQ ID NO: 350393 - DNA, 20 bp, Artificial Sequence
  chemically synthesized
tgctataaatatagcaatta

SEQ ID NO: 350394 - DNA, 20 bp, Artificial Sequence
  chemically synthesized
ttctataattgctatattta

SEQ ID NO: 350395 - DNA, 20 bp, Artificial Sequence
  chemically synthesized
gtggggcattgctataaata

SEQ ID NO: 350396 - DNA, 20 bp, Artificial Sequence
  chemically synthesized
tatagcaatgccccactatc

SEQ ID NO: 350397 - DNA, 20 bp, Artificial Sequence
  chemically synthesized
aaattggtgcccagatagtg

SEQ ID NO: 350398 - DNA, 20 bp, Artificial Sequence
  chemically synthesized
atagcaatgccccactatct

SEQ ID NO: 350399 - DNA, 20 bp, Artificial Sequence
  chemically synthesized
aaaattggtgcccagatagt

SEQ ID NO: 350400 - DNA, 20 bp, Artificial Sequence
  chemically synthesized
gaaaattggtgcccagatag

SEQ ID NO: 350401 - DNA, 20 bp, Artificial Sequence
  chemically synthesized
acagaaaattggtgcccaga

SEQ ID NO: 350402 - DNA, 20 bp, Artificial Sequence
  chemically synthesized
taaaacagaaaattggtgcc

SEQ ID NO: 350403 - DNA, 20 bp, Artificial Sequence
  chemically synthesized
aacagactaaaacagaaaat

SEQ ID NO: 350404 - DNA, 20 bp, Artificial Sequence
  chemically synthesized
tgggcaccaattttctgttt

SEQ ID NO: 350405 - DNA, 20 bp, Artificial Sequence
  chemically synthesized
agtgtgaaaacagactaaaa

SEQ ID NO: 350406 - DNA, 20 bp, Artificial Sequence
  chemically synthesized
tctttataacagtgtgaaaa

SEQ ID NO: 350407 - DNA, 20 bp, Artificial Sequence
  chemically synthesized
tctgttttcacactgttata

SEQ ID NO: 350408 - DNA, 20 bp, Artificial Sequence
  chemically synthesized
tgttttcacactgttataaa

SEQ ID NO: 350409 - DNA, 20 bp, Artificial Sequence
  chemically synthesized
accacaggtactctttataa

SEQ ID NO: 350410 - DNA, 20 bp, Artificial Sequence
  chemically synthesized
actgttataaagagtacctg

SEQ ID NO: 350411 - DNA, 20 bp, Artificial Sequence
  chemically synthesized
ttataaagagtacctgtggt

SEQ ID NO: 350412 - DNA, 20 bp, Artificial Sequence
  chemically synthesized
tataaagagtacctgtggtt

SEQ ID NO: 350413 - DNA, 20 bp, Artificial Sequence
  chemically synthesized
cttataaattacccaaccac

SEQ ID NO: 350414 - DNA, 20 bp, Artificial Sequence
  chemically synthesized
acttataaattacccaacca

SEQ ID NO: 350415 - DNA, 20 bp, Artificial Sequence
  chemically synthesized
cctgtggttgggtaatttat

SEQ ID NO: 350416 - DNA, 20 bp, Artificial Sequence
  chemically synthesized
gttgggtaatttataagtaa

SEQ ID NO: 350417 - DNA, 20 bp, Artificial Sequence
  chemically synthesized
tgggtaatttataagtaaaa

SEQ ID NO: 350418 - DNA, 20 bp, Artificial Sequence
  chemically synthesized
gggtaatttataagtaaaag

SEQ ID NO: 350419 - DNA, 20 bp, Artificial Sequence
  chemically synthesized
tataagtaaaagaggattaa

SEQ ID NO: 350420 - DNA, 20 bp, Artificial Sequence
  chemically synthesized
aaagaggattaatagactca

SEQ ID NO: 350421 - DNA, 20 bp, Artificial Sequence
  chemically synthesized
ccccacccatgtagaactgt

SEQ ID NO: 350422 - DNA, 20 bp, Artificial Sequence
  chemically synthesized
aatagactcacagttctaca

SEQ ID NO: 350423 - DNA, 20 bp, Artificial Sequence
  chemically synthesized
atagactcacagttctacat

SEQ ID NO: 350424 - DNA, 20 bp, Artificial Sequence
  chemically synthesized
gactcacagttctacatggg

SEQ ID NO: 350425 - DNA, 20 bp, Artificial Sequence
  chemically synthesized
actcacagttctacatgggt

SEQ ID NO: 350426 - DNA, 20 bp, Artificial Sequence
  chemically synthesized
tgggggcctccccacccatg

SEQ ID NO: 350427 - DNA, 20 bp, Artificial Sequence
  chemically synthesized
ctcacagttctacatgggtg

SEQ ID NO: 350428 - DNA, 20 bp, Artificial Sequence
  chemically synthesized
cacagttctacatgggtggg

SEQ ID NO: 350429 - DNA, 20 bp, Artificial Sequence
  chemically synthesized
acagttctacatgggtgggg

SEQ ID NO: 350430 - DNA, 20 bp, Artificial Sequence
  chemically synthesized
tacatgggtggggaggcccc

SEQ ID NO: 350431 - DNA, 20 bp, Artificial Sequence
  chemically synthesized
acatgggtggggaggccccc

SEQ ID NO: 350432 - DNA, 20 bp, Artificial Sequence
  chemically synthesized
catgattgtaagtttcctgg

SEQ ID NO: 350433 - DNA, 20 bp, Artificial Sequence
  chemically synthesized
ccatgattgtaagtttcctg

SEQ ID NO: 350434 - DNA, 20 bp, Artificial Sequence
  chemically synthesized
accatgattgtaagtttcct

SEQ ID NO: 350435 - DNA, 20 bp, Artificial Sequence
  chemically synthesized
caccatgattgtaagtttcc

SEQ ID NO: 350436 - DNA, 20 bp, Artificial Sequence
  chemically synthesized
ccccaggaaacttacaatca

SEQ ID NO: 350437 - DNA, 20 bp, Artificial Sequence
  chemically synthesized
tcaccttccaccatgattgt

SEQ ID NO: 350438 - DNA, 20 bp, Artificial Sequence
  chemically synthesized
caggaaacttacaatcatgg

SEQ ID NO: 350439 - DNA, 20 bp, Artificial Sequence
  chemically synthesized
gaaacttacaatcatggtgg

SEQ ID NO: 350440 - DNA, 20 bp, Artificial Sequence
  chemically synthesized
aaacttacaatcatggtgga

SEQ ID NO: 350441 - DNA, 20 bp, Artificial Sequence
  chemically synthesized
tacaatcatggtggaaggtg

SEQ ID NO: 350442 - DNA, 20 bp, Artificial Sequence
  chemically synthesized
acaatcatggtggaaggtga

SEQ ID NO: 350443 - DNA, 20 bp, Artificial Sequence
  chemically synthesized
caatcatggtggaaggtgaa

SEQ ID NO: 350444 - DNA, 20 bp, Artificial Sequence
  chemically synthesized
aatcatggtggaaggtgaag

SEQ ID NO: 350445 - DNA, 20 bp, Artificial Sequence
  chemically synthesized
catggtggaaggtgaagggg

SEQ ID NO: 350446 - DNA, 20 bp, Artificial Sequence
  chemically synthesized
gtggaaggtgaaggggaagc

SEQ ID NO: 350447 - DNA, 20 bp, Artificial Sequence
  chemically synthesized
ggaagcaagtaccttcttca

SEQ ID NO: 350448 - DNA, 20 bp, Artificial Sequence
  chemically synthesized
gaagcaagtaccttcttcac

SEQ ID NO: 350449 - DNA, 20 bp, Artificial Sequence
  chemically synthesized
accccactgccctgtgaaga

SEQ ID NO: 350450 - DNA, 20 bp, Artificial Sequence
  chemically synthesized
aagcaagtaccttcttcaca

SEQ ID NO: 350451 - DNA, 20 bp, Artificial Sequence
  chemically synthesized
gaccccactgccctgtgaag

SEQ ID NO: 350452 - DNA, 20 bp, Artificial Sequence
  chemically synthesized
caagtaccttcttcacaggg

SEQ ID NO: 350453 - DNA, 20 bp, Artificial Sequence
  chemically synthesized
cccgaccccactgccctgtg

SEQ ID NO: 350454 - DNA, 20 bp, Artificial Sequence
  chemically synthesized
gtaccttcttcacagggcag

SEQ ID NO: 350455 - DNA, 20 bp, Artificial Sequence
  chemically synthesized
taccttcttcacagggcagt

SEQ ID NO: 350456 - DNA, 20 bp, Artificial Sequence
  chemically synthesized
accttcttcacagggcagtg

SEQ ID NO: 350457 - DNA, 20 bp, Artificial Sequence
  chemically synthesized
tcttcacagggcagtggggt

SEQ ID NO: 350458 - DNA, 20 bp, Artificial Sequence
  chemically synthesized
cttcacagggcagtggggtc

SEQ ID NO: 350459 - DNA, 20 bp, Artificial Sequence
  chemically synthesized
ttcacagggcagtggggtcg

SEQ ID NO: 350460 - DNA, 20 bp, Artificial Sequence
  chemically synthesized
tcacagggcagtggggtcgg

SEQ ID NO: 350461 - DNA, 20 bp, Artificial Sequence
  chemically synthesized
cacagggcagtggggtcggg

SEQ ID NO: 350462 - DNA, 20 bp, Artificial Sequence
  chemically synthesized
agggcagtggggtcgggggg

SEQ ID NO: 350463 - DNA, 20 bp, Artificial Sequence
  chemically synthesized
gggcagtggggtcgggggga

SEQ ID NO: 350464 - DNA, 20 bp, Artificial Sequence
  chemically synthesized
gatggtttaaaagtatttga

SEQ ID NO: 350465 - DNA, 20 bp, Artificial Sequence
  chemically synthesized
catgtgatctgatggtttaa

SEQ ID NO: 350466 - DNA, 20 bp, Artificial Sequence
  chemically synthesized
gtcaaatacttttaaaccat

SEQ ID NO: 350467 - DNA, 20 bp, Artificial Sequence
  chemically synthesized
tgaatgctcatgtgatctga

SEQ ID NO: 350468 - DNA, 20 bp, Artificial Sequence
  chemically synthesized
tttaaaccatcagatcacat

SEQ ID NO: 350469 - DNA, 20 bp, Artificial Sequence
  chemically synthesized
gagcattcacacactatcac

SEQ ID NO: 350470 - DNA, 20 bp, Artificial Sequence
  chemically synthesized
cattcacacactatcacaag

SEQ ID NO: 350471 - DNA, 20 bp, Artificial Sequence
  chemically synthesized
tccccatgctcttcttgtga

SEQ ID NO: 350472 - DNA, 20 bp, Artificial Sequence
  chemically synthesized
ttcacacactatcacaagaa

SEQ ID NO: 350473 - DNA, 20 bp, Artificial Sequence
  chemically synthesized
acactatcacaagaagagca

SEQ ID NO: 350474 - DNA, 20 bp, Artificial Sequence
  chemically synthesized
cactatcacaagaagagcat

SEQ ID NO: 350475 - DNA, 20 bp, Artificial Sequence
  chemically synthesized
actatcacaagaagagcatg

SEQ ID NO: 350476 - DNA, 20 bp, Artificial Sequence
  chemically synthesized
aggtgattggatcagggagg

SEQ ID NO: 350477 - DNA, 20 bp, Artificial Sequence
  chemically synthesized
gggaggtgattggatcaggg

SEQ ID NO: 350478 - DNA, 20 bp, Artificial Sequence
  chemically synthesized
tgggaggtgattggatcagg

SEQ ID NO: 350479 - DNA, 20 bp, Artificial Sequence
  chemically synthesized
ggtgggaggtgattggatca

SEQ ID NO: 350480 - DNA, 20 bp, Artificial Sequence
  chemically synthesized
tggtgggaggtgattggatc

SEQ ID NO: 350481 - DNA, 20 bp, Artificial Sequence
  chemically synthesized
ctggtgggaggtgattggat

SEQ ID NO: 350482 - DNA, 20 bp, Artificial Sequence
  chemically synthesized
gggtcctggtgggaggtgat

SEQ ID NO: 350483 - DNA, 20 bp, Artificial Sequence
  chemically synthesized
ctgatccaatcacctcccac

SEQ ID NO: 350484 - DNA, 20 bp, Artificial Sequence
  chemically synthesized
tgatccaatcacctcccacc

SEQ ID NO: 350485 - DNA, 20 bp, Artificial Sequence
  chemically synthesized
agagggagggtcctggtggg

SEQ ID NO: 350486 - DNA, 20 bp, Artificial Sequence
  chemically synthesized
tagagggagggtcctggtgg

SEQ ID NO: 350487 - DNA, 20 bp, Artificial Sequence
  chemically synthesized
tgtagagggagggtcctggt

SEQ ID NO: 350488 - DNA, 20 bp, Artificial Sequence
  chemically synthesized
gtgtagagggagggtcctgg

SEQ ID NO: 350489 - DNA, 20 bp, Artificial Sequence
  chemically synthesized
cacgtgtagagggagggtcc

SEQ ID NO: 350490 - DNA, 20 bp, Artificial Sequence
  chemically synthesized
aatccccacgtgtagaggga

SEQ ID NO: 350491 - DNA, 20 bp, Artificial Sequence
  chemically synthesized
taatccccacgtgtagaggg

SEQ ID NO: 350492 - DNA, 20 bp, Artificial Sequence
  chemically synthesized
gtaatccccacgtgtagagg

SEQ ID NO: 350493 - DNA, 20 bp, Artificial Sequence
  chemically synthesized
ttgtaatccccacgtgtaga

SEQ ID NO: 350494 - DNA, 20 bp, Artificial Sequence
  chemically synthesized
caggaccctccctctacacg

SEQ ID NO: 350495 - DNA, 20 bp, Artificial Sequence
  chemically synthesized
attgtaatccccacgtgtag

SEQ ID NO: 350496 - DNA, 20 bp, Artificial Sequence
  chemically synthesized
aggaccctccctctacacgt

SEQ ID NO: 350497 - DNA, 20 bp, Artificial Sequence
  chemically synthesized
aattgtaatccccacgtgta

SEQ ID NO: 350498 - DNA, 20 bp, Artificial Sequence
  chemically synthesized
ggaccctccctctacacgtg

SEQ ID NO: 350499 - DNA, 20 bp, Artificial Sequence
  chemically synthesized
caaattgtaatccccacgtg

SEQ ID NO: 350500 - DNA, 20 bp, Artificial Sequence
  chemically synthesized
acacgtggggattacaattt

SEQ ID NO: 350501 - DNA, 20 bp, Artificial Sequence
  chemically synthesized
tggggattacaatttgagat

SEQ ID NO: 350502 - DNA, 20 bp, Artificial Sequence
  chemically synthesized
ttacaatttgagatgagact

SEQ ID NO: 350503 - DNA, 20 bp, Artificial Sequence
  chemically synthesized
tacaatttgagatgagactt

SEQ ID NO: 350504 - DNA, 20 bp, Artificial Sequence
  chemically synthesized
aatttgagatgagacttggg

SEQ ID NO: 350505 - DNA, 20 bp, Artificial Sequence
  chemically synthesized
atttgagatgagacttgggt

SEQ ID NO: 350506 - DNA, 20 bp, Artificial Sequence
  chemically synthesized
tttgagatgagacttgggta

SEQ ID NO: 350507 - DNA, 20 bp, Artificial Sequence
  chemically synthesized
ttgagatgagacttgggtag

SEQ ID NO: 350508 - DNA, 20 bp, Artificial Sequence
  chemically synthesized
tggctctgtgtcccctaccc

SEQ ID NO: 350509 - DNA, 20 bp, Artificial Sequence
  chemically synthesized
tgagacttgggtaggggaca

SEQ ID NO: 350510 - DNA, 20 bp, Artificial Sequence
  chemically synthesized
agacttgggtaggggacaca

SEQ ID NO: 350511 - DNA, 20 bp, Artificial Sequence
  chemically synthesized
attaataagttgatataatt

SEQ ID NO: 350512 - DNA, 20 bp, Artificial Sequence
  chemically synthesized
attatatcaacttattaatg

SEQ ID NO: 350513 - DNA, 20 bp, Artificial Sequence
  chemically synthesized
acaatttattctgcattaat

SEQ ID NO: 350514 - DNA, 20 bp, Artificial Sequence
  chemically synthesized
taaattgtttccaatacaat

SEQ ID NO: 350515 - DNA, 20 bp, Artificial Sequence
  chemically synthesized
gggaaaatttctcattgtat

SEQ ID NO: 350516 - DNA, 20 bp, Artificial Sequence
  chemically synthesized
tacaatgagaaattttccct

SEQ ID NO: 350517 - DNA, 20 bp, Artificial Sequence
  chemically synthesized
gtcacaaatagaaaaactta

SEQ ID NO: 350518 - DNA, 20 bp, Artificial Sequence
  chemically synthesized
tgtcacaaatagaaaaactt

SEQ ID NO: 350519 - DNA, 20 bp, Artificial Sequence
  chemically synthesized
gtgtcacaaatagaaaaact

SEQ ID NO: 350520 - DNA, 20 bp, Artificial Sequence
  chemically synthesized
tagttttgaggtgtcacaaa

SEQ ID NO: 350521 - DNA, 20 bp, Artificial Sequence
  chemically synthesized
acatcagtggtttagttttg

SEQ ID NO: 350522 - DNA, 20 bp, Artificial Sequence
  chemically synthesized
aacatcagtggtttagtttt

SEQ ID NO: 350523 - DNA, 20 bp, Artificial Sequence
  chemically synthesized
atttgagaacatcagtggtt

SEQ ID NO: 350524 - DNA, 20 bp, Artificial Sequence
  chemically synthesized
taagcatttgagaacatcag

SEQ ID NO: 350525 - DNA, 20 bp, Artificial Sequence
  chemically synthesized
aattaagcatttgagaacat

SEQ ID NO: 350526 - DNA, 20 bp, Artificial Sequence
  chemically synthesized
gtttaattaattaagcattt

SEQ ID NO: 350527 - DNA, 20 bp, Artificial Sequence
  chemically synthesized
atgagtttgtttaattaatt

SEQ ID NO: 350528 - DNA, 20 bp, Artificial Sequence
  chemically synthesized
aagcatatttttggttggat

SEQ ID NO: 350529 - DNA, 20 bp, Artificial Sequence
  chemically synthesized
tgcacaagcatatttttggt

SEQ ID NO: 350530 - DNA, 20 bp, Artificial Sequence
  chemically synthesized
ttcatgcacaagcatatttt

SEQ ID NO: 350531 - DNA, 20 bp, Artificial Sequence
  chemically synthesized
aaacatcagctttcatgcac

SEQ ID NO: 350532 - DNA, 20 bp, Artificial Sequence
  chemically synthesized
aaaaatatgcttgtgcatga

SEQ ID NO: 350533 - DNA, 20 bp, Artificial Sequence
  chemically synthesized
tttttgtaaccataaaacat

SEQ ID NO: 350534 - DNA, 20 bp, Artificial Sequence
  chemically synthesized
gcatgaaagctgatgtttta

SEQ ID NO: 350535 - DNA, 20 bp, Artificial Sequence
  chemically synthesized
tgatgttttatggttacaaa

SEQ ID NO: 350536 - DNA, 20 bp, Artificial Sequence
  chemically synthesized
ttacaaaaagtaaaacaaaa

SEQ ID NO: 350537 - DNA, 20 bp, Artificial Sequence
  chemically synthesized
aaaacaaaatagtatgaaat

SEQ ID NO: 350538 - DNA, 20 bp, Artificial Sequence
  chemically synthesized
aaacaaaatagtatgaaata

SEQ ID NO: 350539 - DNA, 20 bp, Artificial Sequence
  chemically synthesized
ttttatcagtgcatagaatg

SEQ ID NO: 350540 - DNA, 20 bp, Artificial Sequence
  chemically synthesized
tcattcattttatcagtgca

SEQ ID NO: 350541 - DNA, 20 bp, Artificial Sequence
  chemically synthesized
tttagcttcattcattttat

SEQ ID NO: 350542 - DNA, 20 bp, Artificial Sequence
  chemically synthesized
atgcactgataaaatgaatg

SEQ ID NO: 350543 - DNA, 20 bp, Artificial Sequence
  chemically synthesized
ataaaatgaatgaagctaaa

SEQ ID NO: 350544 - DNA, 20 bp, Artificial Sequence
  chemically synthesized
taaaatgaatgaagctaaat

SEQ ID NO: 350545 - DNA, 20 bp, Artificial Sequence
  chemically synthesized
atacttttttatgacccatt

SEQ ID NO: 350546 - DNA, 20 bp, Artificial Sequence
  chemically synthesized
aagctaaatgggtcataaaa

SEQ ID NO: 350547 - DNA, 20 bp, Artificial Sequence
  chemically synthesized
gggtcataaaaaagtatatc

SEQ ID NO: 350548 - DNA, 20 bp, Artificial Sequence
  chemically synthesized
aaaaagtatatccagtttta

SEQ ID NO: 350549 - DNA, 20 bp, Artificial Sequence
  chemically synthesized
aaaagtatatccagttttat

SEQ ID NO: 350550 - DNA, 20 bp, Artificial Sequence
  chemically synthesized
ggcctcacgccctataaaac

SEQ ID NO: 350551 - DNA, 20 bp, Artificial Sequence
  chemically synthesized
aaagtatatccagttttata

SEQ ID NO: 350552 - DNA, 20 bp, Artificial Sequence
  chemically synthesized
tatccagttttatagggcgt

SEQ ID NO: 350553 - DNA, 20 bp, Artificial Sequence
  chemically synthesized
atccagttttatagggcgtg

SEQ ID NO: 350554 - DNA, 20 bp, Artificial Sequence
  chemically synthesized
tatagggcgtgaggcctata

SEQ ID NO: 350555 - DNA, 20 bp, Artificial Sequence
  chemically synthesized
agggcgtgaggcctatatag

SEQ ID NO: 350556 - DNA, 20 bp, Artificial Sequence
  chemically synthesized
acaaatttatgctgctatat

SEQ ID NO: 350557 - DNA, 20 bp, Artificial Sequence
  chemically synthesized
gacaaatttatgctgctata

SEQ ID NO: 350558 - DNA, 20 bp, Artificial Sequence
  chemically synthesized
tactgtaaaaacaaaaaaaa

SEQ ID NO: 350559 - DNA, 20 bp, Artificial Sequence
  chemically synthesized
gtcttttttttttgttttta

SEQ ID NO: 350560 - DNA, 20 bp, Artificial Sequence
  chemically synthesized
tttttgtttttacagtaatt

SEQ ID NO: 350561 - DNA, 20 bp, Artificial Sequence
  chemically synthesized
tttgtttttacagtaattaa

SEQ ID NO: 350562 - DNA, 20 bp, Artificial Sequence
  chemically synthesized
taattactcagataattgtg

SEQ ID NO: 350563 - DNA, 20 bp, Artificial Sequence
  chemically synthesized
tctaattactcagataattg

SEQ ID NO: 350564 - DNA, 20 bp, Artificial Sequence
  chemically synthesized
aacacgctccacaattatct

SEQ ID NO: 350565 - DNA, 20 bp, Artificial Sequence
  chemically synthesized
tccacaattatctgagtaat

SEQ ID NO: 350566 - DNA, 20 bp, Artificial Sequence
  chemically synthesized
attgagaaaatctaattact

SEQ ID NO: 350567 - DNA, 20 bp, Artificial Sequence
  chemically synthesized
atcagtgctcgtttttaatt

SEQ ID NO: 350568 - DNA, 20 bp, Artificial Sequence
  chemically synthesized
agattttctcaattaaaaac

SEQ ID NO: 350569 - DNA, 20 bp, Artificial Sequence
  chemically synthesized
aattaaaaacgagcactgat

SEQ ID NO: 350570 - DNA, 20 bp, Artificial Sequence
  chemically synthesized
aaaacgagcactgataagat

SEQ ID NO: 350571 - DNA, 20 bp, Artificial Sequence
  chemically synthesized
agaaatccagctaatcttat

SEQ ID NO: 350572 - DNA, 20 bp, Artificial Sequence
  chemically synthesized
cgagcactgataagattagc

SEQ ID NO: 350573 - DNA, 20 bp, Artificial Sequence
  chemically synthesized
gataagattagctggatttc

SEQ ID NO: 350574 - DNA, 20 bp, Artificial Sequence
  chemically synthesized
ataagattagctggatttct

SEQ ID NO: 350575 - DNA, 20 bp, Artificial Sequence
  chemically synthesized
aacaaagtgacctagaaatc

SEQ ID NO: 350576 - DNA, 20 bp, Artificial Sequence
  chemically synthesized
tgctgcgaaacaaagtgacc

SEQ ID NO: 350577 - DNA, 20 bp, Artificial Sequence
  chemically synthesized
ttctaggtcactttgtttcg

SEQ ID NO: 350578 - DNA, 20 bp, Artificial Sequence
  chemically synthesized
attgataatgctgcgaaaca

SEQ ID NO: 350579 - DNA, 20 bp, Artificial Sequence
  chemically synthesized
cgcagcattatcaatttatc

SEQ ID NO: 350580 - DNA, 20 bp, Artificial Sequence
  chemically synthesized
gcagcattatcaatttatcc

SEQ ID NO: 350581 - DNA, 20 bp, Artificial Sequence
  chemically synthesized
cattatcaatttatccaggt

SEQ ID NO: 350582 - DNA, 20 bp, Artificial Sequence
  chemically synthesized
ctagatgtaagattctgacc

SEQ ID NO: 350583 - DNA, 20 bp, Artificial Sequence
  chemically synthesized
ccaggtcagaatcttacatc

SEQ ID NO: 350584 - DNA, 20 bp, Artificial Sequence
  chemically synthesized
caggtcagaatcttacatct

SEQ ID NO: 350585 - DNA, 20 bp, Artificial Sequence
  chemically synthesized
aggtcagaatcttacatcta

SEQ ID NO: 350586 - DNA, 20 bp, Artificial Sequence
  chemically synthesized
cagtctgtatccctagatgt

SEQ ID NO: 350587 - DNA, 20 bp, Artificial Sequence
  chemically synthesized
gaatcttacatctagggata

SEQ ID NO: 350588 - DNA, 20 bp, Artificial Sequence
  chemically synthesized
tccagtccagtctgtatccc

SEQ ID NO: 350589 - DNA, 20 bp, Artificial Sequence
  chemically synthesized
ttacatctagggatacagac

SEQ ID NO: 350590 - DNA, 20 bp, Artificial Sequence
  chemically synthesized
tctagggatacagactggac

SEQ ID NO: 350591 - DNA, 20 bp, Artificial Sequence
  chemically synthesized
agggatacagactggactgg

SEQ ID NO: 350592 - DNA, 20 bp, Artificial Sequence
  chemically synthesized
aaaactaggaacttccagtc

SEQ ID NO: 350593 - DNA, 20 bp, Artificial Sequence
  chemically synthesized
acttaaaaactaggaacttc

SEQ ID NO: 350594 - DNA, 20 bp, Artificial Sequence
  chemically synthesized
cagactggactggaagttcc

SEQ ID NO: 350595 - DNA, 20 bp, Artificial Sequence
  chemically synthesized
actggaagttcctagttttt

SEQ ID NO: 350596 - DNA, 20 bp, Artificial Sequence
  chemically synthesized
agaaaccaaacttaaaaact

SEQ ID NO: 350597 - DNA, 20 bp, Artificial Sequence
  chemically synthesized
cagaaaccaaacttaaaaac

SEQ ID NO: 350598 - DNA, 20 bp, Artificial Sequence
  chemically synthesized
aagttcctagtttttaagtt

SEQ ID NO: 350599 - DNA, 20 bp, Artificial Sequence
  chemically synthesized
tagtttttaagtttggtttc

SEQ ID NO: 350600 - DNA, 20 bp, Artificial Sequence
  chemically synthesized
ttttaagtttggtttctggt

SEQ ID NO: 350601 - DNA, 20 bp, Artificial Sequence
  chemically synthesized
tttaagtttggtttctggtt

SEQ ID NO: 350602 - DNA, 20 bp, Artificial Sequence
  chemically synthesized
ttaagtttggtttctggttg

SEQ ID NO: 350603 - DNA, 20 bp, Artificial Sequence
  chemically synthesized
taagtttggtttctggttgg

SEQ ID NO: 350604 - DNA, 20 bp, Artificial Sequence
  chemically synthesized
aagtttggtttctggttggg

SEQ ID NO: 350605 - DNA, 20 bp, Artificial Sequence
  chemically synthesized
agtttggtttctggttgggg

SEQ ID NO: 350606 - DNA, 20 bp, Artificial Sequence
  chemically synthesized
ggtaggattccccccccaac

SEQ ID NO: 350607 - DNA, 20 bp, Artificial Sequence
  chemically synthesized
gtttggtttctggttggggg

SEQ ID NO: 350608 - DNA, 20 bp, Artificial Sequence
  chemically synthesized
gttggggggggaatcctacc

SEQ ID NO: 350609 - DNA, 20 bp, Artificial Sequence
  chemically synthesized
gggggggaatcctaccaagc

SEQ ID NO: 350610 - DNA, 20 bp, Artificial Sequence
  chemically synthesized
cattaatttcctagcttggt

SEQ ID NO: 350611 - DNA, 20 bp, Artificial Sequence
  chemically synthesized
ggggggaatcctaccaagct

SEQ ID NO: 350612 - DNA, 20 bp, Artificial Sequence
  chemically synthesized
ccattaatttcctagcttgg

SEQ ID NO: 350613 - DNA, 20 bp, Artificial Sequence
  chemically synthesized
ctcccattaatttcctagct

SEQ ID NO: 350614 - DNA, 20 bp, Artificial Sequence
  chemically synthesized
gcatcctcccattaatttcc

SEQ ID NO: 350615 - DNA, 20 bp, Artificial Sequence
  chemically synthesized
ctaccaagctaggaaattaa

SEQ ID NO: 350616 - DNA, 20 bp, Artificial Sequence
  chemically synthesized
taccaagctaggaaattaat

SEQ ID NO: 350617 - DNA, 20 bp, Artificial Sequence
  chemically synthesized
ccaagctaggaaattaatgg

SEQ ID NO: 350618 - DNA, 20 bp, Artificial Sequence
  chemically synthesized
caagctaggaaattaatggg

SEQ ID NO: 350619 - DNA, 20 bp, Artificial Sequence
  chemically synthesized
gaggatgcaattgaaataac

SEQ ID NO: 350620 - DNA, 20 bp, Artificial Sequence
  chemically synthesized
aggatgcaattgaaataact

SEQ ID NO: 350621 - DNA, 20 bp, Artificial Sequence
  chemically synthesized
tgcaattgaaataactagga

SEQ ID NO: 350622 - DNA, 20 bp, Artificial Sequence
  chemically synthesized
caacacattaagtactatcc

SEQ ID NO: 350623 - DNA, 20 bp, Artificial Sequence
  chemically synthesized
attattatttacaacacatt

SEQ ID NO: 350624 - DNA, 20 bp, Artificial Sequence
  chemically synthesized
taatgtgttgtaaataataa

SEQ ID NO: 350625 - DNA, 20 bp, Artificial Sequence
  chemically synthesized
tgtgttgtaaataataatgg

SEQ ID NO: 350626 - DNA, 20 bp, Artificial Sequence
  chemically synthesized
gcttaaaatatgtttttaca

SEQ ID NO: 350627 - DNA, 20 bp, Artificial Sequence
  chemically synthesized
actttgtaaaaacatatttt

SEQ ID NO: 350628 - DNA, 20 bp, Artificial Sequence
  chemically synthesized
tgtaaaaacatattttaagc

SEQ ID NO: 350629 - DNA, 20 bp, Artificial Sequence
  chemically synthesized
aaacatattttaagcaagta

SEQ ID NO: 350630 - DNA, 20 bp, Artificial Sequence
  chemically synthesized
taagcaagtatggaatttct

SEQ ID NO: 350631 - DNA, 20 bp, Artificial Sequence
  chemically synthesized
gctttgaggttaagttttct

SEQ ID NO: 350632 - DNA, 20 bp, Artificial Sequence
  chemically synthesized
tctcagaaaacttaacctca

SEQ ID NO: 350633 - DNA, 20 bp, Artificial Sequence
  chemically synthesized
aaaatttttgctttgaggtt

SEQ ID NO: 350634 - DNA, 20 bp, Artificial Sequence
  chemically synthesized
atcttaaaatttttgctttg

SEQ ID NO: 350635 - DNA, 20 bp, Artificial Sequence
  chemically synthesized
aatcttaaaatttttgcttt

SEQ ID NO: 350636 - DNA, 20 bp, Artificial Sequence
  chemically synthesized
aacctcaaagcaaaaatttt

SEQ ID NO: 350637 - DNA, 20 bp, Artificial Sequence
  chemically synthesized
aaaaattttaagattgttta

SEQ ID NO: 350638 - DNA, 20 bp, Artificial Sequence
  chemically synthesized
attttaagattgtttatggt

SEQ ID NO: 350639 - DNA, 20 bp, Artificial Sequence
  chemically synthesized
acagtaagaatgagaataca

SEQ ID NO: 350640 - DNA, 20 bp, Artificial Sequence
  chemically synthesized
gaaataataacagtaagaat

SEQ ID NO: 350641 - DNA, 20 bp, Artificial Sequence
  chemically synthesized
atgactgaaataataacagt

SEQ ID NO: 350642 - DNA, 20 bp, Artificial Sequence
  chemically synthesized
cccaatgactgaaataataa

SEQ ID NO: 350643 - DNA, 20 bp, Artificial Sequence
  chemically synthesized
cattcttactgttattattt

SEQ ID NO: 350644 - DNA, 20 bp, Artificial Sequence
  chemically synthesized
actgttattatttcagtcat

SEQ ID NO: 350645 - DNA, 20 bp, Artificial Sequence
  chemically synthesized
ctgttattatttcagtcatt

SEQ ID NO: 350646 - DNA, 20 bp, Artificial Sequence
  chemically synthesized
tgttattatttcagtcattg

SEQ ID NO: 350647 - DNA, 20 bp, Artificial Sequence
  chemically synthesized
attatttcagtcattgggga

SEQ ID NO: 350648 - DNA, 20 bp, Artificial Sequence
  chemically synthesized
ggggaaagttatgcttcctt

SEQ ID NO: 350649 - DNA, 20 bp, Artificial Sequence
  chemically synthesized
ctaatcaccccatctgaagg

SEQ ID NO: 350650 - DNA, 20 bp, Artificial Sequence
  chemically synthesized
aaagttatgcttccttcaga

SEQ ID NO: 350651 - DNA, 20 bp, Artificial Sequence
  chemically synthesized
aagttatgcttccttcagat

SEQ ID NO: 350652 - DNA, 20 bp, Artificial Sequence
  chemically synthesized
agttatgcttccttcagatg

SEQ ID NO: 350653 - DNA, 20 bp, Artificial Sequence
  chemically synthesized
attctaatcaccccatctga

SEQ ID NO: 350654 - DNA, 20 bp, Artificial Sequence
  chemically synthesized
tattctaatcaccccatctg

SEQ ID NO: 350655 - DNA, 20 bp, Artificial Sequence
  chemically synthesized
cttccttcagatggggtgat

SEQ ID NO: 350656 - DNA, 20 bp, Artificial Sequence
  chemically synthesized
atggggtgattagaataaac

SEQ ID NO: 350657 - DNA, 20 bp, Artificial Sequence
  chemically synthesized
tgattagaataaacaagaat

SEQ ID NO: 350658 - DNA, 20 bp, Artificial Sequence
  chemically synthesized
aagaataagacctctgaatt

SEQ ID NO: 350659 - DNA, 20 bp, Artificial Sequence
  chemically synthesized
ctgcgaagtcctgaattcag

SEQ ID NO: 350660 - DNA, 20 bp, Artificial Sequence
  chemically synthesized
agaataagacctctgaattc

SEQ ID NO: 350661 - DNA, 20 bp, Artificial Sequence
  chemically synthesized
actgcgaagtcctgaattca

SEQ ID NO: 350662 - DNA, 20 bp, Artificial Sequence
  chemically synthesized
aaactgcgaagtcctgaatt

SEQ ID NO: 350663 - DNA, 20 bp, Artificial Sequence
  chemically synthesized
cctctgaattcaggacttcg

SEQ ID NO: 350664 - DNA, 20 bp, Artificial Sequence
  chemically synthesized
atttcttttggaaaactgcg

SEQ ID NO: 350665 - DNA, 20 bp, Artificial Sequence
  chemically synthesized
aggacttcgcagttttccaa

SEQ ID NO: 350666 - DNA, 20 bp, Artificial Sequence
  chemically synthesized
taaaaaataccgatttcttt

SEQ ID NO: 350667 - DNA, 20 bp, Artificial Sequence
  chemically synthesized
cgcagttttccaaaagaaat

SEQ ID NO: 350668 - DNA, 20 bp, Artificial Sequence
  chemically synthesized
ggtattttttaaacttttaa

SEQ ID NO: 350669 - DNA, 20 bp, Artificial Sequence
  chemically synthesized
agaaaggagtaatctgttaa

SEQ ID NO: 350670 - DNA, 20 bp, Artificial Sequence
  chemically synthesized
aagatttgctcaatagaaag

SEQ ID NO: 350671 - DNA, 20 bp, Artificial Sequence
  chemically synthesized
acagattactcctttctatt

SEQ ID NO: 350672 - DNA, 20 bp, Artificial Sequence
  chemically synthesized
taaagatttgctcaatagaa

SEQ ID NO: 350673 - DNA, 20 bp, Artificial Sequence
  chemically synthesized
gtaaagatttgctcaataga

SEQ ID NO: 350674 - DNA, 20 bp, Artificial Sequence
  chemically synthesized
aaaggtaaagatttgctcaa

SEQ ID NO: 350675 - DNA, 20 bp, Artificial Sequence
  chemically synthesized
aaataccaattggaaaggta

SEQ ID NO: 350676 - DNA, 20 bp, Artificial Sequence
  chemically synthesized
caaatctttacctttccaat

SEQ ID NO: 350677 - DNA, 20 bp, Artificial Sequence
  chemically synthesized
tgtctaaataccaattggaa

SEQ ID NO: 350678 - DNA, 20 bp, Artificial Sequence
  chemically synthesized
atgtctaaataccaattgga

SEQ ID NO: 350679 - DNA, 20 bp, Artificial Sequence
  chemically synthesized
ttacatgtctaaataccaat

SEQ ID NO: 350680 - DNA, 20 bp, Artificial Sequence
  chemically synthesized
ttacctttccaattggtatt

SEQ ID NO: 350681 - DNA, 20 bp, Artificial Sequence
  chemically synthesized
agacatgtaaatttaaaaca

SEQ ID NO: 350682 - DNA, 20 bp, Artificial Sequence
  chemically synthesized
aaacaaagacattcttctgc

SEQ ID NO: 350683 - DNA, 20 bp, Artificial Sequence
  chemically synthesized
aacaaagacattcttctgca

SEQ ID NO: 350684 - DNA, 20 bp, Artificial Sequence
  chemically synthesized
catctgaaatttccttgcag

SEQ ID NO: 350685 - DNA, 20 bp, Artificial Sequence
  chemically synthesized
aagcatctgaaatttccttg

SEQ ID NO: 350686 - DNA, 20 bp, Artificial Sequence
  chemically synthesized
attcttctgcaaggaaattt

SEQ ID NO: 350687 - DNA, 20 bp, Artificial Sequence
  chemically synthesized
gaaatttcagatgcttccat

SEQ ID NO: 350688 - DNA, 20 bp, Artificial Sequence
  chemically synthesized
gctgtttcaaatgcttatgg

SEQ ID NO: 350689 - DNA, 20 bp, Artificial Sequence
  chemically synthesized
tgggctgtttcaaatgctta

SEQ ID NO: 350690 - DNA, 20 bp, Artificial Sequence
  chemically synthesized
gcttccataagcatttgaaa

SEQ ID NO: 350691 - DNA, 20 bp, Artificial Sequence
  chemically synthesized
ttaagtatgcaaaaacagtt

SEQ ID NO: 350692 - DNA, 20 bp, Artificial Sequence
  chemically synthesized
cttaagtatgcaaaaacagt

SEQ ID NO: 350693 - DNA, 20 bp, Artificial Sequence
  chemically synthesized
tttccttaagtatgcaaaaa

SEQ ID NO: 350694 - DNA, 20 bp, Artificial Sequence
  chemically synthesized
ccaactgtttttgcatactt

SEQ ID NO: 350695 - DNA, 20 bp, Artificial Sequence
  chemically synthesized
caactgtttttgcatactta

SEQ ID NO: 350696 - DNA, 20 bp, Artificial Sequence
  chemically synthesized
tgtttttgcatacttaagga

SEQ ID NO: 350697 - DNA, 20 bp, Artificial Sequence
  chemically synthesized
tttttgcatacttaaggaaa

SEQ ID NO: 350698 - DNA, 20 bp, Artificial Sequence
  chemically synthesized
cttaagatagctctttcctt

SEQ ID NO: 350699 - DNA, 20 bp, Artificial Sequence
  chemically synthesized
cttaaggaaagagctatctt

SEQ ID NO: 350700 - DNA, 20 bp, Artificial Sequence
  chemically synthesized
ttaaggaaagagctatctta

SEQ ID NO: 350701 - DNA, 20 bp, Artificial Sequence
  chemically synthesized
aactgttgccatccttaaga

SEQ ID NO: 350702 - DNA, 20 bp, Artificial Sequence
  chemically synthesized
ggaaagagctatcttaagga

SEQ ID NO: 350703 - DNA, 20 bp, Artificial Sequence
  chemically synthesized
cagtaactgttgccatcctt

SEQ ID NO: 350704 - DNA, 20 bp, Artificial Sequence
  chemically synthesized
agctatcttaaggatggcaa

SEQ ID NO: 350705 - DNA, 20 bp, Artificial Sequence
  chemically synthesized
ggatttctaaaatttttaca

SEQ ID NO: 350706 - DNA, 20 bp, Artificial Sequence
  chemically synthesized
cagttactgtgtaaaaattt

SEQ ID NO: 350707 - DNA, 20 bp, Artificial Sequence
  chemically synthesized
aaaattttagaaatcctttt

SEQ ID NO: 350708 - DNA, 20 bp, Artificial Sequence
  chemically synthesized
atgtatacttgatacttaaa

SEQ ID NO: 350709 - DNA, 20 bp, Artificial Sequence
  chemically synthesized
aatgtatacttgatacttaa

SEQ ID NO: 350710 - DNA, 20 bp, Artificial Sequence
  chemically synthesized
tagaaatccttttaagtatc

SEQ ID NO: 350711 - DNA, 20 bp, Artificial Sequence
  chemically synthesized
cagcgatgtgcacagggcat

SEQ ID NO: 350712 - DNA, 20 bp, Artificial Sequence
  chemically synthesized
attgagcagcgatgtgcaca

SEQ ID NO: 350713 - DNA, 20 bp, Artificial Sequence
  chemically synthesized
aattgagcagcgatgtgcac

SEQ ID NO: 350714 - DNA, 20 bp, Artificial Sequence
  chemically synthesized
aaattgagcagcgatgtgca

SEQ ID NO: 350715 - DNA, 20 bp, Artificial Sequence
  chemically synthesized
gctggacatccaaaattgag

SEQ ID NO: 350716 - DNA, 20 bp, Artificial Sequence
  chemically synthesized
tgcacatcgctgctcaattt

SEQ ID NO: 350717 - DNA, 20 bp, Artificial Sequence
  chemically synthesized
actgctggacatccaaaatt

SEQ ID NO: 350718 - DNA, 20 bp, Artificial Sequence
  chemically synthesized
gctgctcaattttggatgtc

SEQ ID NO: 350719 - DNA, 20 bp, Artificial Sequence
  chemically synthesized
gctcaattttggatgtccag

SEQ ID NO: 350720 - DNA, 20 bp, Artificial Sequence
  chemically synthesized
catggacgtgcgcacactgc

SEQ ID NO: 350721 - DNA, 20 bp, Artificial Sequence
  chemically synthesized
taattatgtgcatgcacaca

SEQ ID NO: 350722 - DNA, 20 bp, Artificial Sequence
  chemically synthesized
atgaatgtgctcatgtgcat

SEQ ID NO: 350723 - DNA, 20 bp, Artificial Sequence
  chemically synthesized
aattatatacccatgcacat

SEQ ID NO: 350724 - DNA, 20 bp, Artificial Sequence
  chemically synthesized
aatgaatgtgctcatgtgca

SEQ ID NO: 350725 - DNA, 20 bp, Artificial Sequence
  chemically synthesized
gcacattcatttaaccatac

SEQ ID NO: 350726 - DNA, 20 bp, Artificial Sequence
  chemically synthesized
cattcatttaaccatacaag

SEQ ID NO: 350727 - DNA, 20 bp, Artificial Sequence
  chemically synthesized
tgctgggattgcttcttgta

SEQ ID NO: 350728 - DNA, 20 bp, Artificial Sequence
  chemically synthesized
aaccatacaagaagcaatcc

SEQ ID NO: 350729 - DNA, 20 bp, Artificial Sequence
  chemically synthesized
atacaagaagcaatcccagc

SEQ ID NO: 350730 - DNA, 20 bp, Artificial Sequence
  chemically synthesized
agttttttagaattcttgct

SEQ ID NO: 350731 - DNA, 20 bp, Artificial Sequence
  chemically synthesized
cagttttttagaattcttgc

SEQ ID NO: 350732 - DNA, 20 bp, Artificial Sequence
  chemically synthesized
tcagacatatatcagttttt

SEQ ID NO: 350733 - DNA, 20 bp, Artificial Sequence
  chemically synthesized
agtaatattcagacatatat

SEQ ID NO: 350734 - DNA, 20 bp, Artificial Sequence
  chemically synthesized
gtctcttttccagtaatatt

SEQ ID NO: 350735 - DNA, 20 bp, Artificial Sequence
  chemically synthesized
gatatatgtctgaatattac

SEQ ID NO: 350736 - DNA, 20 bp, Artificial Sequence
  chemically synthesized
atgtctgaatattactggaa

SEQ ID NO: 350737 - DNA, 20 bp, Artificial Sequence
  chemically synthesized
gtctgaatattactggaaaa

SEQ ID NO: 350738 - DNA, 20 bp, Artificial Sequence
  chemically synthesized
ctcacctacagtctcttttc

SEQ ID NO: 350739 - DNA, 20 bp, Artificial Sequence
  chemically synthesized
tattactggaaaagagactg

SEQ ID NO: 350740 - DNA, 20 bp, Artificial Sequence
  chemically synthesized
attactggaaaagagactgt

SEQ ID NO: 350741 - DNA, 20 bp, Artificial Sequence
  chemically synthesized
ctggaaaagagactgtaggt

SEQ ID NO: 350742 - DNA, 20 bp, Artificial Sequence
  chemically synthesized
tgaagcccaggtctcaccta

SEQ ID NO: 350743 - DNA, 20 bp, Artificial Sequence
  chemically synthesized
aagagactgtaggtgagacc

SEQ ID NO: 350744 - DNA, 20 bp, Artificial Sequence
  chemically synthesized
agagactgtaggtgagacct

SEQ ID NO: 350745 - DNA, 20 bp, Artificial Sequence
  chemically synthesized
tgttgaaccatatgaagccc

SEQ ID NO: 350746 - DNA, 20 bp, Artificial Sequence
  chemically synthesized
atgttgaaccatatgaagcc

SEQ ID NO: 350747 - DNA, 20 bp, Artificial Sequence
  chemically synthesized
ggtgagacctgggcttcata

SEQ ID NO: 350748 - DNA, 20 bp, Artificial Sequence
  chemically synthesized
aatctatgttgaaccatatg

SEQ ID NO: 350749 - DNA, 20 bp, Artificial Sequence
  chemically synthesized
gggcttcatatggttcaaca

SEQ ID NO: 350750 - DNA, 20 bp, Artificial Sequence
  chemically synthesized
atggttcaacatagatttgt

SEQ ID NO: 350751 - DNA, 20 bp, Artificial Sequence
  chemically synthesized
tctgtattatttttaattaa

SEQ ID NO: 350752 - DNA, 20 bp, Artificial Sequence
  chemically synthesized
gctgttaattaaaaataata

SEQ ID NO: 350753 - DNA, 20 bp, Artificial Sequence
  chemically synthesized
taaaaataatacagaatata

SEQ ID NO: 350754 - DNA, 20 bp, Artificial Sequence
  chemically synthesized
aaaaataatacagaatatat

SEQ ID NO: 350755 - DNA, 20 bp, Artificial Sequence
  chemically synthesized
aatacagaatatataggaca

SEQ ID NO: 350756 - DNA, 20 bp, Artificial Sequence
  chemically synthesized
ttcttacctggcacagtcat

SEQ ID NO: 350757 - DNA, 20 bp, Artificial Sequence
  chemically synthesized
cttcttacctggcacagtca

SEQ ID NO: 350758 - DNA, 20 bp, Artificial Sequence
  chemically synthesized
taattgtcccatgactgtgc

SEQ ID NO: 350759 - DNA, 20 bp, Artificial Sequence
  chemically synthesized
aattgtcccatgactgtgcc

SEQ ID NO: 350760 - DNA, 20 bp, Artificial Sequence
  chemically synthesized
tctacgcttcttacctggca

SEQ ID NO: 350761 - DNA, 20 bp, Artificial Sequence
  chemically synthesized
gtcccatgactgtgccaggt

SEQ ID NO: 350762 - DNA, 20 bp, Artificial Sequence
  chemically synthesized
ccatgactgtgccaggtaag

SEQ ID NO: 350763 - DNA, 20 bp, Artificial Sequence
  chemically synthesized
tatcctctacgcttcttacc

SEQ ID NO: 350764 - DNA, 20 bp, Artificial Sequence
  chemically synthesized
actgtgccaggtaagaagcg

SEQ ID NO: 350765 - DNA, 20 bp, Artificial Sequence
  chemically synthesized
tgtgccaggtaagaagcgta

SEQ ID NO: 350766 - DNA, 20 bp, Artificial Sequence
  chemically synthesized
gtgccaggtaagaagcgtag

SEQ ID NO: 350767 - DNA, 20 bp, Artificial Sequence
  chemically synthesized
aggataatattccctgaaaa

SEQ ID NO: 350768 - DNA, 20 bp, Artificial Sequence
  chemically synthesized
agaaatccctactgttttca

SEQ ID NO: 350769 - DNA, 20 bp, Artificial Sequence
  chemically synthesized
tagaaatccctactgttttc

SEQ ID NO: 350770 - DNA, 20 bp, Artificial Sequence
  chemically synthesized
ataatattccctgaaaacag

SEQ ID NO: 350771 - DNA, 20 bp, Artificial Sequence
  chemically synthesized
gtagaaatccctactgtttt

SEQ ID NO: 350772 - DNA, 20 bp, Artificial Sequence
  chemically synthesized
taatattccctgaaaacagt

SEQ ID NO: 350773 - DNA, 20 bp, Artificial Sequence
  chemically synthesized
aatattccctgaaaacagta

SEQ ID NO: 350774 - DNA, 20 bp, Artificial Sequence
  chemically synthesized
ttttaaaagatgtttagcag

SEQ ID NO: 350775 - DNA, 20 bp, Artificial Sequence
  chemically synthesized
acattttaaaagatgtttag

SEQ ID NO: 350776 - DNA, 20 bp, Artificial Sequence
  chemically synthesized
ctgacattttaaaagatgtt

SEQ ID NO: 350777 - DNA, 20 bp, Artificial Sequence
  chemically synthesized
gcgaggatctgacattttaa

SEQ ID NO: 350778 - DNA, 20 bp, Artificial Sequence
  chemically synthesized
ctaaacatcttttaaaatgt

SEQ ID NO: 350779 - DNA, 20 bp, Artificial Sequence
  chemically synthesized
tttttttttttttttttgcg

SEQ ID NO: 350780 - DNA, 20 bp, Artificial Sequence
  chemically synthesized
ttttttttttttttttttgc

SEQ ID NO: 350781 - DNA, 20 bp, Artificial Sequence
  chemically synthesized
aaaaaaaaaaaaaaaaaata

SEQ ID NO: 350782 - DNA, 20 bp, Artificial Sequence
  chemically synthesized
aaaaaatatggactttcgtc

SEQ ID NO: 350783 - DNA, 20 bp, Artificial Sequence
  chemically synthesized
aaaaatatggactttcgtct

SEQ ID NO: 350784 - DNA, 20 bp, Artificial Sequence
  chemically synthesized
aaaatatggactttcgtcta

SEQ ID NO: 350785 - DNA, 20 bp, Artificial Sequence
  chemically synthesized
ttttccctcaccctagacga

SEQ ID NO: 350786 - DNA, 20 bp, Artificial Sequence
  chemically synthesized
tatggactttcgtctagggt

SEQ ID NO: 350787 - DNA, 20 bp, Artificial Sequence
  chemically synthesized
atggactttcgtctagggtg

SEQ ID NO: 350788 - DNA, 20 bp, Artificial Sequence
  chemically synthesized
tggactttcgtctagggtga

SEQ ID NO: 350789 - DNA, 20 bp, Artificial Sequence
  chemically synthesized
aaaaactttttccctcaccc

SEQ ID NO: 350790 - DNA, 20 bp, Artificial Sequence
  chemically synthesized
ttcgtctagggtgagggaaa

SEQ ID NO: 350791 - DNA, 20 bp, Artificial Sequence
  chemically synthesized
tgaatcacaaaaggcacgaa

SEQ ID NO: 350792 - DNA, 20 bp, Artificial Sequence
  chemically synthesized
ttgaatcacaaaaggcacga

SEQ ID NO: 350793 - DNA, 20 bp, Artificial Sequence
  chemically synthesized
cttgaatcacaaaaggcacg

SEQ ID NO: 350794 - DNA, 20 bp, Artificial Sequence
  chemically synthesized
ttcgggacttgaatcacaaa

SEQ ID NO: 350795 - DNA, 20 bp, Artificial Sequence
  chemically synthesized
gttcgggacttgaatcacaa

SEQ ID NO: 350796 - DNA, 20 bp, Artificial Sequence
  chemically synthesized
cttcgtgccttttgtgattc

SEQ ID NO: 350797 - DNA, 20 bp, Artificial Sequence
  chemically synthesized
tgctcatttctatagggttc

SEQ ID NO: 350798 - DNA, 20 bp, Artificial Sequence
  chemically synthesized
gattcaagtcccgaacccta

SEQ ID NO: 350799 - DNA, 20 bp, Artificial Sequence
  chemically synthesized
gtgctcatttctatagggtt

SEQ ID NO: 350800 - DNA, 20 bp, Artificial Sequence
  chemically synthesized
cagcagtgctcatttctata

SEQ ID NO: 350801 - DNA, 20 bp, Artificial Sequence
  chemically synthesized
ccagcagtgctcatttctat

SEQ ID NO: 350802 - DNA, 20 bp, Artificial Sequence
  chemically synthesized
gtcccgaaccctatagaaat

SEQ ID NO: 350803 - DNA, 20 bp, Artificial Sequence
  chemically synthesized
tccagcagtgctcatttcta

SEQ ID NO: 350804 - DNA, 20 bp, Artificial Sequence
  chemically synthesized
cctatagaaatgagcactgc

SEQ ID NO: 350805 - DNA, 20 bp, Artificial Sequence
  chemically synthesized
cctcaatggtagaagtccag

SEQ ID NO: 350806 - DNA, 20 bp, Artificial Sequence
  chemically synthesized
tgccctcaatggtagaagtc

SEQ ID NO: 350807 - DNA, 20 bp, Artificial Sequence
  chemically synthesized
caaactgccctcaatggtag

SEQ ID NO: 350808 - DNA, 20 bp, Artificial Sequence
  chemically synthesized
actgctggacttctaccatt

SEQ ID NO: 350809 - DNA, 20 bp, Artificial Sequence
  chemically synthesized
ctgctggacttctaccattg

SEQ ID NO: 350810 - DNA, 20 bp, Artificial Sequence
  chemically synthesized
tgctggacttctaccattga

SEQ ID NO: 350811 - DNA, 20 bp, Artificial Sequence
  chemically synthesized
tgacaaactgccctcaatgg

SEQ ID NO: 350812 - DNA, 20 bp, Artificial Sequence
  chemically synthesized
tggacttctaccattgaggg

SEQ ID NO: 350813 - DNA, 20 bp, Artificial Sequence
  chemically synthesized
gcctgacaaactgccctcaa

SEQ ID NO: 350814 - DNA, 20 bp, Artificial Sequence
  chemically synthesized
taccattgagggcagtttgt

SEQ ID NO: 350815 - DNA, 20 bp, Artificial Sequence
  chemically synthesized
accattgagggcagtttgtc

SEQ ID NO: 350816 - DNA, 20 bp, Artificial Sequence
  chemically synthesized
gggcagtttgtcaggcccca

SEQ ID NO: 350817 - DNA, 20 bp, Artificial Sequence
  chemically synthesized
tacttggctgttcagctttg

SEQ ID NO: 350818 - DNA, 20 bp, Artificial Sequence
  chemically synthesized
gtacttggctgttcagcttt

SEQ ID NO: 350819 - DNA, 20 bp, Artificial Sequence
  chemically synthesized
tgtacttggctgttcagctt

SEQ ID NO: 350820 - DNA, 20 bp, Artificial Sequence
  chemically synthesized
tgtcaggccccaaagctgaa

SEQ ID NO: 350821 - DNA, 20 bp, Artificial Sequence
  chemically synthesized
ggccccaaagctgaacagcc

SEQ ID NO: 350822 - DNA, 20 bp, Artificial Sequence
  chemically synthesized
gtctgttgtacttggctgtt

SEQ ID NO: 350823 - DNA, 20 bp, Artificial Sequence
  chemically synthesized
agctgaacagccaagtacaa

SEQ ID NO: 350824 - DNA, 20 bp, Artificial Sequence
  chemically synthesized
tagctctggtctgttgtact

SEQ ID NO: 350825 - DNA, 20 bp, Artificial Sequence
  chemically synthesized
aacagccaagtacaacagac

SEQ ID NO: 350826 - DNA, 20 bp, Artificial Sequence
  chemically synthesized
cagccaagtacaacagacca

SEQ ID NO: 350827 - DNA, 20 bp, Artificial Sequence
  chemically synthesized
aagtacaacagaccagagct

SEQ ID NO: 350828 - DNA, 20 bp, Artificial Sequence
  chemically synthesized
tctgttcagtttcttagctc

SEQ ID NO: 350829 - DNA, 20 bp, Artificial Sequence
  chemically synthesized
tttttttctgttcagtttct

SEQ ID NO: 350830 - DNA, 20 bp, Artificial Sequence
  chemically synthesized
accagagctaagaaactgaa

SEQ ID NO: 350831 - DNA, 20 bp, Artificial Sequence
  chemically synthesized
tctgtagttttttttctgtt

SEQ ID NO: 350832 - DNA, 20 bp, Artificial Sequence
  chemically synthesized
actgaacagaaaaaaaacta

SEQ ID NO: 350833 - DNA, 20 bp, Artificial Sequence
  chemically synthesized
tgaacagaaaaaaaactaca

SEQ ID NO: 350834 - DNA, 20 bp, Artificial Sequence
  chemically synthesized
aacagaaaaaaaactacaga

SEQ ID NO: 350835 - DNA, 20 bp, Artificial Sequence
  chemically synthesized
gaatactactgcactctctg

SEQ ID NO: 350836 - DNA, 20 bp, Artificial Sequence
  chemically synthesized
aaaaaaaactacagagagtg

SEQ ID NO: 350837 - DNA, 20 bp, Artificial Sequence
  chemically synthesized
aaaaactacagagagtgcag

SEQ ID NO: 350838 - DNA, 20 bp, Artificial Sequence
  chemically synthesized
attttgggaatatgttacaa

SEQ ID NO: 350839 - DNA, 20 bp, Artificial Sequence
  chemically synthesized
ttttaagccattaagatttt

SEQ ID NO: 350840 - DNA, 20 bp, Artificial Sequence
  chemically synthesized
gttttaagccattaagattt

SEQ ID NO: 350841 - DNA, 20 bp, Artificial Sequence
  chemically synthesized
acatattcccaaaatcttaa

SEQ ID NO: 350842 - DNA, 20 bp, Artificial Sequence
  chemically synthesized
ttgtcttgttttaagccatt

SEQ ID NO: 350843 - DNA, 20 bp, Artificial Sequence
  chemically synthesized
aaatcttaatggcttaaaac

SEQ ID NO: 350844 - DNA, 20 bp, Artificial Sequence
  chemically synthesized
taaaacatttgtcttgtttt

SEQ ID NO: 350845 - DNA, 20 bp, Artificial Sequence
  chemically synthesized
aagacaaatgttttatctta

SEQ ID NO: 350846 - DNA, 20 bp, Artificial Sequence
  chemically synthesized
aaatgttttatcttacagct

SEQ ID NO: 350847 - DNA, 20 bp, Artificial Sequence
  chemically synthesized
tgtctaacctactcagctgt

SEQ ID NO: 350848 - DNA, 20 bp, Artificial Sequence
  chemically synthesized
tgttttatcttacagctgag

SEQ ID NO: 350849 - DNA, 20 bp, Artificial Sequence
  chemically synthesized
gttttatcttacagctgagt

SEQ ID NO: 350850 - DNA, 20 bp, Artificial Sequence
  chemically synthesized
tatcttacagctgagtaggt

SEQ ID NO: 350851 - DNA, 20 bp, Artificial Sequence
  chemically synthesized
tgtcagatgtctaacctact

SEQ ID NO: 350852 - DNA, 20 bp, Artificial Sequence
  chemically synthesized
gtaggttagacatctgacat

SEQ ID NO: 350853 - DNA, 20 bp, Artificial Sequence
  chemically synthesized
tagtctaataagactcatgt

SEQ ID NO: 350854 - DNA, 20 bp, Artificial Sequence
  chemically synthesized
acatctgacatgagtcttat

SEQ ID NO: 350855 - DNA, 20 bp, Artificial Sequence
  chemically synthesized
ttgcttgagtttagtctaat

SEQ ID NO: 350856 - DNA, 20 bp, Artificial Sequence
  chemically synthesized
agtcttattagactaaactc

SEQ ID NO: 350857 - DNA, 20 bp, Artificial Sequence
  chemically synthesized
gccctgctgttgcttgagtt

SEQ ID NO: 350858 - DNA, 20 bp, Artificial Sequence
  chemically synthesized
attagactaaactcaagcaa

SEQ ID NO: 350859 - DNA, 20 bp, Artificial Sequence
  chemically synthesized
acaaagccctgctgttgctt

SEQ ID NO: 350860 - DNA, 20 bp, Artificial Sequence
  chemically synthesized
agactaaactcaagcaacag

SEQ ID NO: 350861 - DNA, 20 bp, Artificial Sequence
  chemically synthesized
gactaaactcaagcaacagc

SEQ ID NO: 350862 - DNA, 20 bp, Artificial Sequence
  chemically synthesized
actaaactcaagcaacagca

SEQ ID NO: 350863 - DNA, 20 bp, Artificial Sequence
  chemically synthesized
agaatttccagaaaggaaca

SEQ ID NO: 350864 - DNA, 20 bp, Artificial Sequence
  chemically synthesized
agcagggctttgttcctttc

SEQ ID NO: 350865 - DNA, 20 bp, Artificial Sequence
  chemically synthesized
ctcttctagaatttccagaa

SEQ ID NO: 350866 - DNA, 20 bp, Artificial Sequence
  chemically synthesized
tctcttctagaatttccaga

SEQ ID NO: 350867 - DNA, 20 bp, Artificial Sequence
  chemically synthesized
ttgttcctttctggaaattc

SEQ ID NO: 350868 - DNA, 20 bp, Artificial Sequence
  chemically synthesized
atgatctcttctagaatttc

SEQ ID NO: 350869 - DNA, 20 bp, Artificial Sequence
  chemically synthesized
ttcctttctggaaattctag

SEQ ID NO: 350870 - DNA, 20 bp, Artificial Sequence
  chemically synthesized
cctttctggaaattctagaa

SEQ ID NO: 350871 - DNA, 20 bp, Artificial Sequence
  chemically synthesized
gaaagaaacatgatctcttc

SEQ ID NO: 350872 - DNA, 20 bp, Artificial Sequence
  chemically synthesized
tataaaagctagaaaaggga

SEQ ID NO: 350873 - DNA, 20 bp, Artificial Sequence
  chemically synthesized
tcatgtttctttcccttttc

SEQ ID NO: 350874 - DNA, 20 bp, Artificial Sequence
  chemically synthesized
ggtctataaaagctagaaaa

SEQ ID NO: 350875 - DNA, 20 bp, Artificial Sequence
  chemically synthesized
aggtctataaaagctagaaa

SEQ ID NO: 350876 - DNA, 20 bp, Artificial Sequence
  chemically synthesized
gaggtctataaaagctagaa

SEQ ID NO: 350877 - DNA, 20 bp, Artificial Sequence
  chemically synthesized
tttcccttttctagctttta

SEQ ID NO: 350878 - DNA, 20 bp, Artificial Sequence
  chemically synthesized
tattggaggtctataaaagc

SEQ ID NO: 350879 - DNA, 20 bp, Artificial Sequence
  chemically synthesized
ggaatattggaggtctataa

SEQ ID NO: 350880 - DNA, 20 bp, Artificial Sequence
  chemically synthesized
caggggttaaggaatattgg

SEQ ID NO: 350881 - DNA, 20 bp, Artificial Sequence
  chemically synthesized
ccaggggttaaggaatattg

SEQ ID NO: 350882 - DNA, 20 bp, Artificial Sequence
  chemically synthesized
gaccaggggttaaggaatat

SEQ ID NO: 350883 - DNA, 20 bp, Artificial Sequence
  chemically synthesized
ctccaatattccttaacccc

SEQ ID NO: 350884 - DNA, 20 bp, Artificial Sequence
  chemically synthesized
tggaggaagaccaggggtta

SEQ ID NO: 350885 - DNA, 20 bp, Artificial Sequence
  chemically synthesized
atggaggaagaccaggggtt

SEQ ID NO: 350886 - DNA, 20 bp, Artificial Sequence
  chemically synthesized
gaagaatggaggaagaccag

SEQ ID NO: 350887 - DNA, 20 bp, Artificial Sequence
  chemically synthesized
tgaagaatggaggaagacca

SEQ ID NO: 350888 - DNA, 20 bp, Artificial Sequence
  chemically synthesized
ttgaagaatggaggaagacc

SEQ ID NO: 350889 - DNA, 20 bp, Artificial Sequence
  chemically synthesized
tttgaagaatggaggaagac

SEQ ID NO: 350890 - DNA, 20 bp, Artificial Sequence
  chemically synthesized
ttcgctttgaagaatggagg

SEQ ID NO: 350891 - DNA, 20 bp, Artificial Sequence
  chemically synthesized
ttgttcgctttgaagaatgg

SEQ ID NO: 350892 - DNA, 20 bp, Artificial Sequence
  chemically synthesized
gttgttcgctttgaagaatg

SEQ ID NO: 350893 - DNA, 20 bp, Artificial Sequence
  chemically synthesized
tggtcttcctccattcttca

SEQ ID NO: 350894 - DNA, 20 bp, Artificial Sequence
  chemically synthesized
ctgttgttcgctttgaagaa

SEQ ID NO: 350895 - DNA, 20 bp, Artificial Sequence
  chemically synthesized
acctactgttgttcgctttg

SEQ ID NO: 350896 - DNA, 20 bp, Artificial Sequence
  chemically synthesized
ccattcttcaaagcgaacaa

SEQ ID NO: 350897 - DNA, 20 bp, Artificial Sequence
  chemically synthesized
ttcttcaaagcgaacaacag

SEQ ID NO: 350898 - DNA, 20 bp, Artificial Sequence
  chemically synthesized
tcttcaaagcgaacaacagt

SEQ ID NO: 350899 - DNA, 20 bp, Artificial Sequence
  chemically synthesized
aaagcgaacaacagtaggta

SEQ ID NO: 350900 - DNA, 20 bp, Artificial Sequence
  chemically synthesized
ctgagtgatataatttgaga

SEQ ID NO: 350901 - DNA, 20 bp, Artificial Sequence
  chemically synthesized
aggcctgagtgatataattt

SEQ ID NO: 350902 - DNA, 20 bp, Artificial Sequence
  chemically synthesized
ctttctcaaattatatcact

SEQ ID NO: 350903 - DNA, 20 bp, Artificial Sequence
  chemically synthesized
tttctcaaattatatcactc

SEQ ID NO: 350904 - DNA, 20 bp, Artificial Sequence
  chemically synthesized
agaggcacaagagtaggcct

SEQ ID NO: 350905 - DNA, 20 bp, Artificial Sequence
  chemically synthesized
aatgaaagaggcacaagagt

SEQ ID NO: 350906 - DNA, 20 bp, Artificial Sequence
  chemically synthesized
aaatgaaagaggcacaagag

SEQ ID NO: 350907 - DNA, 20 bp, Artificial Sequence
  chemically synthesized
taaaaatgaaagaggcacaa

SEQ ID NO: 350908 - DNA, 20 bp, Artificial Sequence
  chemically synthesized
cttaaaaatgaaagaggcac

SEQ ID NO: 350909 - DNA, 20 bp, Artificial Sequence
  chemically synthesized
ggaatgcttaaaaatgaaag

SEQ ID NO: 350910 - DNA, 20 bp, Artificial Sequence
  chemically synthesized
cggaatgcttaaaaatgaaa

SEQ ID NO: 350911 - DNA, 20 bp, Artificial Sequence
  chemically synthesized
accggaatgcttaaaaatga

SEQ ID NO: 350912 - DNA, 20 bp, Artificial Sequence
  chemically synthesized
cttgtgcctctttcattttt

SEQ ID NO: 350913 - DNA, 20 bp, Artificial Sequence
  chemically synthesized
tctttcatttttaagcattc

SEQ ID NO: 350914 - DNA, 20 bp, Artificial Sequence
  chemically synthesized
agtgcacactatgtagtcac

SEQ ID NO: 350915 - DNA, 20 bp, Artificial Sequence
  chemically synthesized
taagcattccggtgactaca

SEQ ID NO: 350916 - DNA, 20 bp, Artificial Sequence
  chemically synthesized
ttacctgagtgcacactatg

SEQ ID NO: 350917 - DNA, 20 bp, Artificial Sequence
  chemically synthesized
gtgactacatagtgtgcact

SEQ ID NO: 350918 - DNA, 20 bp, Artificial Sequence
  chemically synthesized
tgactacatagtgtgcactc

SEQ ID NO: 350919 - DNA, 20 bp, Artificial Sequence
  chemically synthesized
gagattaacctggattacct

SEQ ID NO: 350920 - DNA, 20 bp, Artificial Sequence
  chemically synthesized
tagtgtgcactcaggtaatc

SEQ ID NO: 350921 - DNA, 20 bp, Artificial Sequence
  chemically synthesized
agtgtgcactcaggtaatcc

SEQ ID NO: 350922 - DNA, 20 bp, Artificial Sequence
  chemically synthesized
aatagggagggagattaacc

SEQ ID NO: 350923 - DNA, 20 bp, Artificial Sequence
  chemically synthesized
ctgatcttaaaatagggagg

SEQ ID NO: 350924 - DNA, 20 bp, Artificial Sequence
  chemically synthesized
agctgatcttaaaataggga

SEQ ID NO: 350925 - DNA, 20 bp, Artificial Sequence
  chemically synthesized
tagctgatcttaaaataggg

SEQ ID NO: 350926 - DNA, 20 bp, Artificial Sequence
  chemically synthesized
ttagctgatcttaaaatagg

SEQ ID NO: 350927 - DNA, 20 bp, Artificial Sequence
  chemically synthesized
ttaatctccctccctatttt

SEQ ID NO: 350928 - DNA, 20 bp, Artificial Sequence
  chemically synthesized
aattagctgatcttaaaata

SEQ ID NO: 350929 - DNA, 20 bp, Artificial Sequence
  chemically synthesized
taattagctgatcttaaaat

SEQ ID NO: 350930 - DNA, 20 bp, Artificial Sequence
  chemically synthesized
ttaattagctgatcttaaaa

SEQ ID NO: 350931 - DNA, 20 bp, Artificial Sequence
  chemically synthesized
ctccctccctattttaagat

SEQ ID NO: 350932 - DNA, 20 bp, Artificial Sequence
  chemically synthesized
ggggaattaaggttgttaat

SEQ ID NO: 350933 - DNA, 20 bp, Artificial Sequence
  chemically synthesized
tacatgacacaggggaatta

SEQ ID NO: 350934 - DNA, 20 bp, Artificial Sequence
  chemically synthesized
atacatgacacaggggaatt

SEQ ID NO: 350935 - DNA, 20 bp, Artificial Sequence
  chemically synthesized
gtacatgatacatgacacag

SEQ ID NO: 350936 - DNA, 20 bp, Artificial Sequence
  chemically synthesized
agtacatgatacatgacaca

SEQ ID NO: 350937 - DNA, 20 bp, Artificial Sequence
  chemically synthesized
tagtacatgatacatgacac

SEQ ID NO: 350938 - DNA, 20 bp, Artificial Sequence
  chemically synthesized
atagtacatgatacatgaca

SEQ ID NO: 350939 - DNA, 20 bp, Artificial Sequence
  chemically synthesized
tgtatcatgtactatactca

SEQ ID NO: 350940 - DNA, 20 bp, Artificial Sequence
  chemically synthesized
gtatcatgtactatactcac

SEQ ID NO: 350941 - DNA, 20 bp, Artificial Sequence
  chemically synthesized
atccctagaacctgtgagta

SEQ ID NO: 350942 - DNA, 20 bp, Artificial Sequence
  chemically synthesized
tcgaaatccctagaacctgt

SEQ ID NO: 350943 - DNA, 20 bp, Artificial Sequence
  chemically synthesized
tgtactatactcacaggttc

SEQ ID NO: 350944 - DNA, 20 bp, Artificial Sequence
  chemically synthesized
gtactatactcacaggttct

SEQ ID NO: 350945 - DNA, 20 bp, Artificial Sequence
  chemically synthesized
tactatactcacaggttcta

SEQ ID NO: 350946 - DNA, 20 bp, Artificial Sequence
  chemically synthesized
gatactcatgtcgaaatccc

SEQ ID NO: 350947 - DNA, 20 bp, Artificial Sequence
  chemically synthesized
ggttctagggatttcgacat

SEQ ID NO: 350948 - DNA, 20 bp, Artificial Sequence
  chemically synthesized
gatttcgacatgagtatcct

SEQ ID NO: 350949 - DNA, 20 bp, Artificial Sequence
  chemically synthesized
atttcgacatgagtatcctt

SEQ ID NO: 350950 - DNA, 20 bp, Artificial Sequence
  chemically synthesized
tttcgacatgagtatccttg

SEQ ID NO: 350951 - DNA, 20 bp, Artificial Sequence
  chemically synthesized
tcgacatgagtatccttggg

SEQ ID NO: 350952 - DNA, 20 bp, Artificial Sequence
  chemically synthesized
agttggatgctggctcccca

SEQ ID NO: 350953 - DNA, 20 bp, Artificial Sequence
  chemically synthesized
catgagtatccttggggagc

SEQ ID NO: 350954 - DNA, 20 bp, Artificial Sequence
  chemically synthesized
tagttggatgctggctcccc

SEQ ID NO: 350955 - DNA, 20 bp, Artificial Sequence
  chemically synthesized
ctcctttggtagttggatgc

SEQ ID NO: 350956 - DNA, 20 bp, Artificial Sequence
  chemically synthesized
gagccagcatccaactacca

SEQ ID NO: 350957 - DNA, 20 bp, Artificial Sequence
  chemically synthesized
ttaaactctcctttggtagt

SEQ ID NO: 350958 - DNA, 20 bp, Artificial Sequence
  chemically synthesized
agccagcatccaactaccaa

SEQ ID NO: 350959 - DNA, 20 bp, Artificial Sequence
  chemically synthesized
ccagcatccaactaccaaag

SEQ ID NO: 350960 - DNA, 20 bp, Artificial Sequence
  chemically synthesized
atatttaaactctcctttgg

SEQ ID NO: 350961 - DNA, 20 bp, Artificial Sequence
  chemically synthesized
agcatccaactaccaaagga

SEQ ID NO: 350962 - DNA, 20 bp, Artificial Sequence
  chemically synthesized
tgcatatttaaactctcctt

SEQ ID NO: 350963 - DNA, 20 bp, Artificial Sequence
  chemically synthesized
caaaggagagtttaaatatg

SEQ ID NO: 350964 - DNA, 20 bp, Artificial Sequence
  chemically synthesized
aaaggagagtttaaatatgc

SEQ ID NO: 350965 - DNA, 20 bp, Artificial Sequence
  chemically synthesized
atatgcaggtttaaacaaaa

SEQ ID NO: 350966 - DNA, 20 bp, Artificial Sequence
  chemically synthesized
caaaaaagtcgtatcatatt

SEQ ID NO: 350967 - DNA, 20 bp, Artificial Sequence
  chemically synthesized
gtcgtatcatattgagtatc

SEQ ID NO: 350968 - DNA, 20 bp, Artificial Sequence
  chemically synthesized
atcggagacaaagtgaaatc

SEQ ID NO: 350969 - DNA, 20 bp, Artificial Sequence
  chemically synthesized
attagagtatatcggagaca

SEQ ID NO: 350970 - DNA, 20 bp, Artificial Sequence
  chemically synthesized
accagaattagagtatatcg

SEQ ID NO: 350971 - DNA, 20 bp, Artificial Sequence
  chemically synthesized
ataccagaattagagtatat

SEQ ID NO: 350972 - DNA, 20 bp, Artificial Sequence
  chemically synthesized
tctccgatatactctaattc

SEQ ID NO: 350973 - DNA, 20 bp, Artificial Sequence
  chemically synthesized
acttgggaataccagaatta

SEQ ID NO: 350974 - DNA, 20 bp, Artificial Sequence
  chemically synthesized
atacttgggaataccagaat

SEQ ID NO: 350975 - DNA, 20 bp, Artificial Sequence
  chemically synthesized
tatttaatacttgggaatac

SEQ ID NO: 350976 - DNA, 20 bp, Artificial Sequence
  chemically synthesized
actctaattctggtattccc

SEQ ID NO: 350977 - DNA, 20 bp, Artificial Sequence
  chemically synthesized
gcccaagatatttaatactt

SEQ ID NO: 350978 - DNA, 20 bp, Artificial Sequence
  chemically synthesized
tgcccaagatatttaatact

SEQ ID NO: 350979 - DNA, 20 bp, Artificial Sequence
  chemically synthesized
ttcccaagtattaaatatct

SEQ ID NO: 350980 - DNA, 20 bp, Artificial Sequence
  chemically synthesized
tcccaagtattaaatatctt

SEQ ID NO: 350981 - DNA, 20 bp, Artificial Sequence
  chemically synthesized
tacaaaaataattggtgccc

SEQ ID NO: 350982 - DNA, 20 bp, Artificial Sequence
  chemically synthesized
caccagtttacaaaaataat

SEQ ID NO: 350983 - DNA, 20 bp, Artificial Sequence
  chemically synthesized
caccaattatttttgtaaac

SEQ ID NO: 350984 - DNA, 20 bp, Artificial Sequence
  chemically synthesized
gtcaaatttattacaggcac

SEQ ID NO: 350985 - DNA, 20 bp, Artificial Sequence
  chemically synthesized
aatttagtcaaatttattac

SEQ ID NO: 350986 - DNA, 20 bp, Artificial Sequence
  chemically synthesized
taatttagtcaaatttatta

SEQ ID NO: 350987 - DNA, 20 bp, Artificial Sequence
  chemically synthesized
gtaataaatttgactaaatt

SEQ ID NO: 350988 - DNA, 20 bp, Artificial Sequence
  chemically synthesized
cttaaataatcagcttaatt

SEQ ID NO: 350989 - DNA, 20 bp, Artificial Sequence
  chemically synthesized
ctaaattaagctgattattt

SEQ ID NO: 350990 - DNA, 20 bp, Artificial Sequence
  chemically synthesized
gaacaattagcttaaataat

SEQ ID NO: 350991 - DNA, 20 bp, Artificial Sequence
  chemically synthesized
ataattcatacatgaacaat

SEQ ID NO: 350992 - DNA, 20 bp, Artificial Sequence
  chemically synthesized
ttatttcatcattccactga

SEQ ID NO: 350993 - DNA, 20 bp, Artificial Sequence
  chemically synthesized
tatttcatcattccactgat

SEQ ID NO: 350994 - DNA, 20 bp, Artificial Sequence
  chemically synthesized
gctactgtgccacctatcag

SEQ ID NO: 350995 - DNA, 20 bp, Artificial Sequence
  chemically synthesized
ttcatcattccactgatagg

SEQ ID NO: 350996 - DNA, 20 bp, Artificial Sequence
  chemically synthesized
tgagctactgtgccacctat

SEQ ID NO: 350997 - DNA, 20 bp, Artificial Sequence
  chemically synthesized
cattccactgataggtggca

SEQ ID NO: 350998 - DNA, 20 bp, Artificial Sequence
  chemically synthesized
tccactgataggtggcacag

SEQ ID NO: 350999 - DNA, 20 bp, Artificial Sequence
  chemically synthesized
taaatctcttggaattgtgt

SEQ ID NO: 351000 - DNA, 20 bp, Artificial Sequence
  chemically synthesized
acagtagctcacacaattcc

SEQ ID NO: 351001 - DNA, 20 bp, Artificial Sequence
  chemically synthesized
agtagctcacacaattccaa

SEQ ID NO: 351002 - DNA, 20 bp, Artificial Sequence
  chemically synthesized
tcacacaattccaagagatt

SEQ ID NO: 351003 - DNA, 20 bp, Artificial Sequence
  chemically synthesized
tcatttgaaactaaatctct

SEQ ID NO: 351004 - DNA, 20 bp, Artificial Sequence
  chemically synthesized
agagatttagtttcaaatga

SEQ ID NO: 351005 - DNA, 20 bp, Artificial Sequence
  chemically synthesized
caataataaaggggatgaat

SEQ ID NO: 351006 - DNA, 20 bp, Artificial Sequence
  chemically synthesized
tcaataataaaggggatgaa

SEQ ID NO: 351007 - DNA, 20 bp, Artificial Sequence
  chemically synthesized
cagtaaaatcaataataaag

SEQ ID NO: 351008 - DNA, 20 bp, Artificial Sequence
  chemically synthesized
gcagtaaaatcaataataaa

SEQ ID NO: 351009 - DNA, 20 bp, Artificial Sequence
  chemically synthesized
tgcagtaaaatcaataataa

SEQ ID NO: 351010 - DNA, 20 bp, Artificial Sequence
  chemically synthesized
gtgcagtaaaatcaataata

SEQ ID NO: 351011 - DNA, 20 bp, Artificial Sequence
  chemically synthesized
aatgactctctgtgtgtgtg

SEQ ID NO: 351012 - DNA, 20 bp, Artificial Sequence
  chemically synthesized
ttgattttactgcacacaca

SEQ ID NO: 351013 - DNA, 20 bp, Artificial Sequence
  chemically synthesized
gattttactgcacacacaca

SEQ ID NO: 351014 - DNA, 20 bp, Artificial Sequence
  chemically synthesized
ttttactgcacacacacaga

SEQ ID NO: 351015 - DNA, 20 bp, Artificial Sequence
  chemically synthesized
cacacacagagagtcattac

SEQ ID NO: 351016 - DNA, 20 bp, Artificial Sequence
  chemically synthesized
cacagagagtcattactaga

SEQ ID NO: 351017 - DNA, 20 bp, Artificial Sequence
  chemically synthesized
acagagagtcattactagat

SEQ ID NO: 351018 - DNA, 20 bp, Artificial Sequence
  chemically synthesized
cattgttatcagttcccatc

SEQ ID NO: 351019 - DNA, 20 bp, Artificial Sequence
  chemically synthesized
tgtccgagcaacattgttat

SEQ ID NO: 351020 - DNA, 20 bp, Artificial Sequence
  chemically synthesized
gaactgataacaatgttgct

SEQ ID NO: 351021 - DNA, 20 bp, Artificial Sequence
  chemically synthesized
ttaggtgtcattgtgtgtcc

SEQ ID NO: 351022 - DNA, 20 bp, Artificial Sequence
  chemically synthesized
agcatattaatataaatatt

SEQ ID NO: 351023 - DNA, 20 bp, Artificial Sequence
  chemically synthesized
tagcatattaatataaatat

SEQ ID NO: 351024 - DNA, 20 bp, Artificial Sequence
  chemically synthesized
taatatttatattaatatgc

SEQ ID NO: 351025 - DNA, 20 bp, Artificial Sequence
  chemically synthesized
taggaacagaaaaaatgtgc

SEQ ID NO: 351026 - DNA, 20 bp, Artificial Sequence
  chemically synthesized
cagctatcaaaaaataggaa

SEQ ID NO: 351027 - DNA, 20 bp, Artificial Sequence
  chemically synthesized
atttgcagctatcaaaaaat

SEQ ID NO: 351028 - DNA, 20 bp, Artificial Sequence
  chemically synthesized
aatttgcagctatcaaaaaa

SEQ ID NO: 351029 - DNA, 20 bp, Artificial Sequence
  chemically synthesized
tttctgttcctattttttga

SEQ ID NO: 351030 - DNA, 20 bp, Artificial Sequence
  chemically synthesized
attttttgatagctgcaaat

SEQ ID NO: 351031 - DNA, 20 bp, Artificial Sequence
  chemically synthesized
tgcgacaaaagactaatttg

SEQ ID NO: 351032 - DNA, 20 bp, Artificial Sequence
  chemically synthesized
aaaaagggaatgtgcgacaa

SEQ ID NO: 351033 - DNA, 20 bp, Artificial Sequence
  chemically synthesized
tttaaaaacctcatgaaaaa

SEQ ID NO: 351034 - DNA, 20 bp, Artificial Sequence
  chemically synthesized
tcgcacattccctttttcat

SEQ ID NO: 351035 - DNA, 20 bp, Artificial Sequence
  chemically synthesized
ttttaaaaacctcatgaaaa

SEQ ID NO: 351036 - DNA, 20 bp, Artificial Sequence
  chemically synthesized
cgcacattccctttttcatg

SEQ ID NO: 351037 - DNA, 20 bp, Artificial Sequence
  chemically synthesized
attttaaaaacctcatgaaa

SEQ ID NO: 351038 - DNA, 20 bp, Artificial Sequence
  chemically synthesized
agtggtaaaaattaaatatg

SEQ ID NO: 351039 - DNA, 20 bp, Artificial Sequence
  chemically synthesized
acatatttaatttttaccac

SEQ ID NO: 351040 - DNA, 20 bp, Artificial Sequence
  chemically synthesized
taaaaatgtctaaatgctag

SEQ ID NO: 351041 - DNA, 20 bp, Artificial Sequence
  chemically synthesized
taatttttaccactagcatt

SEQ ID NO: 351042 - DNA, 20 bp, Artificial Sequence
  chemically synthesized
ctttaaaaatgtctaaatgc

SEQ ID NO: 351043 - DNA, 20 bp, Artificial Sequence
  chemically synthesized
ctagcatttagacattttta

SEQ ID NO: 351044 - DNA, 20 bp, Artificial Sequence
  chemically synthesized
taaaaataatttagtttcaa

SEQ ID NO: 351045 - DNA, 20 bp, Artificial Sequence
  chemically synthesized
tgtaaaatctaaaaataatt

SEQ ID NO: 351046 - DNA, 20 bp, Artificial Sequence
  chemically synthesized
ttttgaaactaaattatttt

SEQ ID NO: 351047 - DNA, 20 bp, Artificial Sequence
  chemically synthesized
taaattatttttagatttta

SEQ ID NO: 351048 - DNA, 20 bp, Artificial Sequence
  chemically synthesized
aacacatggacacaggaagg

SEQ ID NO: 351049 - DNA, 20 bp, Artificial Sequence
  chemically synthesized
gaacacatggacacaggaag

SEQ ID NO: 351050 - DNA, 20 bp, Artificial Sequence
  chemically synthesized
agaacacatggacacaggaa

SEQ ID NO: 351051 - DNA, 20 bp, Artificial Sequence
  chemically synthesized
gagaacacatggacacagga

SEQ ID NO: 351052 - DNA, 20 bp, Artificial Sequence
  chemically synthesized
tgagaacacatggacacagg

SEQ ID NO: 351053 - DNA, 20 bp, Artificial Sequence
  chemically synthesized
caatgagaacacatggacac

SEQ ID NO: 351054 - DNA, 20 bp, Artificial Sequence
  chemically synthesized
acaatgagaacacatggaca

SEQ ID NO: 351055 - DNA, 20 bp, Artificial Sequence
  chemically synthesized
aattgaacaatgagaacaca

SEQ ID NO: 351056 - DNA, 20 bp, Artificial Sequence
  chemically synthesized
ataggtgggaattgaacaat

SEQ ID NO: 351057 - DNA, 20 bp, Artificial Sequence
  chemically synthesized
attgttcaattcccacctat

SEQ ID NO: 351058 - DNA, 20 bp, Artificial Sequence
  chemically synthesized
gcatgttctcactcataggt

SEQ ID NO: 351059 - DNA, 20 bp, Artificial Sequence
  chemically synthesized
cgcatgttctcactcatagg

SEQ ID NO: 351060 - DNA, 20 bp, Artificial Sequence
  chemically synthesized
ttcaattcccacctatgagt

SEQ ID NO: 351061 - DNA, 20 bp, Artificial Sequence
  chemically synthesized
caccgcatgttctcactcat

SEQ ID NO: 351062 - DNA, 20 bp, Artificial Sequence
  chemically synthesized
acaccgcatgttctcactca

SEQ ID NO: 351063 - DNA, 20 bp, Artificial Sequence
  chemically synthesized
cacctatgagtgagaacatg

SEQ ID NO: 351064 - DNA, 20 bp, Artificial Sequence
  chemically synthesized
gagtgagaacatgcggtgtt

SEQ ID NO: 351065 - DNA, 20 bp, Artificial Sequence
  chemically synthesized
ttggttttttatccttgcga

SEQ ID NO: 351066 - DNA, 20 bp, Artificial Sequence
  chemically synthesized
attctcagcaaactatcgca

SEQ ID NO: 351067 - DNA, 20 bp, Artificial Sequence
  chemically synthesized
cattctcagcaaactatcgc

SEQ ID NO: 351068 - DNA, 20 bp, Artificial Sequence
  chemically synthesized
tatccttgcgatagtttgct

SEQ ID NO: 351069 - DNA, 20 bp, Artificial Sequence
  chemically synthesized
cgatagtttgctgagaatga

SEQ ID NO: 351070 - DNA, 20 bp, Artificial Sequence
  chemically synthesized
aagctggaaaccatcattct

SEQ ID NO: 351071 - DNA, 20 bp, Artificial Sequence
  chemically synthesized
ttgctgagaatgatggtttc

SEQ ID NO: 351072 - DNA, 20 bp, Artificial Sequence
  chemically synthesized
tgtagggacatggatgaagc

SEQ ID NO: 351073 - DNA, 20 bp, Artificial Sequence
  chemically synthesized
cctttgtagggacatggatg

SEQ ID NO: 351074 - DNA, 20 bp, Artificial Sequence
  chemically synthesized
tcatgtcctttgtagggaca

SEQ ID NO: 351075 - DNA, 20 bp, Artificial Sequence
  chemically synthesized
gcttcatccatgtccctaca

SEQ ID NO: 351076 - DNA, 20 bp, Artificial Sequence
  chemically synthesized
cttcatccatgtccctacaa

SEQ ID NO: 351077 - DNA, 20 bp, Artificial Sequence
  chemically synthesized
atgagttcatgtcctttgta

SEQ ID NO: 351078 - DNA, 20 bp, Artificial Sequence
  chemically synthesized
gatgagttcatgtcctttgt

SEQ ID NO: 351079 - DNA, 20 bp, Artificial Sequence
  chemically synthesized
ggatgagttcatgtcctttg

SEQ ID NO: 351080 - DNA, 20 bp, Artificial Sequence
  chemically synthesized
atgcagccataaaaaaggat

SEQ ID NO: 351081 - DNA, 20 bp, Artificial Sequence
  chemically synthesized
catgaactcatcctttttta

SEQ ID NO: 351082 - DNA, 20 bp, Artificial Sequence
  chemically synthesized
gccgtatgcagccataaaaa

SEQ ID NO: 351083 - DNA, 20 bp, Artificial Sequence
  chemically synthesized
ggccgtatgcagccataaaa

SEQ ID NO: 351084 - DNA, 20 bp, Artificial Sequence
  chemically synthesized
tccttttttatggctgcata

SEQ ID NO: 351085 - DNA, 20 bp, Artificial Sequence
  chemically synthesized
accccaccacaggccgtatg

SEQ ID NO: 351086 - DNA, 20 bp, Artificial Sequence
  chemically synthesized
ttatggctgcatacggcctg

SEQ ID NO: 351087 - DNA, 20 bp, Artificial Sequence
  chemically synthesized
tggctgcatacggcctgtgg

SEQ ID NO: 351088 - DNA, 20 bp, Artificial Sequence
  chemically synthesized
ggctgcatacggcctgtggt

SEQ ID NO: 351089 - DNA, 20 bp, Artificial Sequence
  chemically synthesized
gctgcatacggcctgtggtg

SEQ ID NO: 351090 - DNA, 20 bp, Artificial Sequence
  chemically synthesized
accccaccccaccccaccac

SEQ ID NO: 351091 - DNA, 20 bp, Artificial Sequence
  chemically synthesized
caccccaccccaccccacca

SEQ ID NO: 351092 - DNA, 20 bp, Artificial Sequence
  chemically synthesized
gcatacggcctgtggtgggg

SEQ ID NO: 351093 - DNA, 20 bp, Artificial Sequence
  chemically synthesized
catacggcctgtggtggggt

SEQ ID NO: 351094 - DNA, 20 bp, Artificial Sequence
  chemically synthesized
atacggcctgtggtggggtg

SEQ ID NO: 351095 - DNA, 20 bp, Artificial Sequence
  chemically synthesized
cggcctgtggtggggtgggg

SEQ ID NO: 351096 - DNA, 20 bp, Artificial Sequence
  chemically synthesized
ggcctgtggtggggtggggt

SEQ ID NO: 351097 - DNA, 20 bp, Artificial Sequence
  chemically synthesized
gcctgtggtggggtggggtg

SEQ ID NO: 351098 - DNA, 20 bp, Artificial Sequence
  chemically synthesized
tgtggtggggtggggtgggg

SEQ ID NO: 351099 - DNA, 20 bp, Artificial Sequence
  chemically synthesized
gtggtggggtggggtggggt

SEQ ID NO: 351100 - DNA, 20 bp, Artificial Sequence
  chemically synthesized
tggtggggtggggtggggtg

SEQ ID NO: 351101 - DNA, 20 bp, Artificial Sequence
  chemically synthesized
tggggtggggtggggtgggg

SEQ ID NO: 351102 - DNA, 20 bp, Artificial Sequence
  chemically synthesized
ggggtggggtggggtggggt

SEQ ID NO: 351103 - DNA, 20 bp, Artificial Sequence
  chemically synthesized
gggtggggtggggtggggtg

SEQ ID NO: 351104 - DNA, 20 bp, Artificial Sequence
  chemically synthesized
ggtggggtggggtggggtgg

SEQ ID NO: 351105 - DNA, 20 bp, Artificial Sequence
  chemically synthesized
ggtggggtggggtgggggta

SEQ ID NO: 351106 - DNA, 20 bp, Artificial Sequence
  chemically synthesized
gtggggtggggtgggggtat

SEQ ID NO: 351107 - DNA, 20 bp, Artificial Sequence
  chemically synthesized
tggggtggggtgggggtatg

SEQ ID NO: 351108 - DNA, 20 bp, Artificial Sequence
  chemically synthesized
ggggtggggtgggggtatgg

SEQ ID NO: 351109 - DNA, 20 bp, Artificial Sequence
  chemically synthesized
ggtggggtgggggtatgggg

SEQ ID NO: 351110 - DNA, 20 bp, Artificial Sequence
  chemically synthesized
gtggggtgggggtatggggg

SEQ ID NO: 351111 - DNA, 20 bp, Artificial Sequence
  chemically synthesized
tggggtgggggtatggggga

SEQ ID NO: 351112 - DNA, 20 bp, Artificial Sequence
  chemically synthesized
gtgggggtatgggggaggga

SEQ ID NO: 351113 - DNA, 20 bp, Artificial Sequence
  chemically synthesized
gtatgggggagggatagcat

SEQ ID NO: 351114 - DNA, 20 bp, Artificial Sequence
  chemically synthesized
tatgggggagggatagcatt

SEQ ID NO: 351115 - DNA, 20 bp, Artificial Sequence
  chemically synthesized
tgggggagggatagcattag

SEQ ID NO: 351116 - DNA, 20 bp, Artificial Sequence
  chemically synthesized
ttagctcgtcatttaacatt

SEQ ID NO: 351117 - DNA, 20 bp, Artificial Sequence
  chemically synthesized
attagctcgtcatttaacat

SEQ ID NO: 351118 - DNA, 20 bp, Artificial Sequence
  chemically synthesized
tatacctaatgttaaatgac

SEQ ID NO: 351119 - DNA, 20 bp, Artificial Sequence
  chemically synthesized
aatgttaaatgacgagctaa

SEQ ID NO: 351120 - DNA, 20 bp, Artificial Sequence
  chemically synthesized
atgttaaatgacgagctaat

SEQ ID NO: 351121 - DNA, 20 bp, Artificial Sequence
  chemically synthesized
aaatgacgagctaatgggtg

SEQ ID NO: 351122 - DNA, 20 bp, Artificial Sequence
  chemically synthesized
tgttggtgtgctgcacccat

SEQ ID NO: 351123 - DNA, 20 bp, Artificial Sequence
  chemically synthesized
atgggtgcagcacaccaaca

SEQ ID NO: 351124 - DNA, 20 bp, Artificial Sequence
  chemically synthesized
tatgtatacatgtgccatgt

SEQ ID NO: 351125 - DNA, 20 bp, Artificial Sequence
  chemically synthesized
ggtacatgtgcataacgtgc

SEQ ID NO: 351126 - DNA, 20 bp, Artificial Sequence
  chemically synthesized
gggtacatgtgcataacgtg

SEQ ID NO: 351127 - DNA, 20 bp, Artificial Sequence
  chemically synthesized
gttatgcacatgtaccctaa

SEQ ID NO: 351128 - DNA, 20 bp, Artificial Sequence
  chemically synthesized
atttttttattatactttta

SEQ ID NO: 351129 - DNA, 20 bp, Artificial Sequence
  chemically synthesized
gatttttttattatactttt

SEQ ID NO: 351130 - DNA, 20 bp, Artificial Sequence
  chemically synthesized
tgatttttttattatacttt

SEQ ID NO: 351131 - DNA, 20 bp, Artificial Sequence
  chemically synthesized
tataataaaaaaatcaaaaa

SEQ ID NO: 351132 - DNA, 20 bp, Artificial Sequence
  chemically synthesized
tcaaaaaaagaaaaatttta

SEQ ID NO: 351133 - DNA, 20 bp, Artificial Sequence
  chemically synthesized
aattttaaagattactattc

SEQ ID NO: 351134 - DNA, 20 bp, Artificial Sequence
  chemically synthesized
tttcccaagaatatcttgaa

SEQ ID NO: 351135 - DNA, 20 bp, Artificial Sequence
  chemically synthesized
attactattcaagatattct

SEQ ID NO: 351136 - DNA, 20 bp, Artificial Sequence
  chemically synthesized
ttactattcaagatattctt

SEQ ID NO: 351137 - DNA, 20 bp, Artificial Sequence
  chemically synthesized
tataatttaaatattttccc

SEQ ID NO: 351138 - DNA, 20 bp, Artificial Sequence
  chemically synthesized
attaaagtataatttaaatt

SEQ ID NO: 351139 - DNA, 20 bp, Artificial Sequence
  chemically synthesized
aattaaagtataatttaaat

SEQ ID NO: 351140 - DNA, 20 bp, Artificial Sequence
  chemically synthesized
ataaaatgaccacataatta

SEQ ID NO: 351141 - DNA, 20 bp, Artificial Sequence
  chemically synthesized
taaattatactttaattatg

SEQ ID NO: 351142 - DNA, 20 bp, Artificial Sequence
  chemically synthesized
tatgggagaagatacatgac

SEQ ID NO: 351143 - DNA, 20 bp, Artificial Sequence
  chemically synthesized
atatcaggcttgtatgggag

SEQ ID NO: 351144 - DNA, 20 bp, Artificial Sequence
  chemically synthesized
tcatgtatcttctcccatac

SEQ ID NO: 351145 - DNA, 20 bp, Artificial Sequence
  chemically synthesized
tttatatcaggcttgtatgg

SEQ ID NO: 351146 - DNA, 20 bp, Artificial Sequence
  chemically synthesized
aatttatatcaggcttgtat

SEQ ID NO: 351147 - DNA, 20 bp, Artificial Sequence
  chemically synthesized
aaatttatatcaggcttgta

SEQ ID NO: 351148 - DNA, 20 bp, Artificial Sequence
  chemically synthesized
ttctatgtaaaatttatatc

SEQ ID NO: 351149 - DNA, 20 bp, Artificial Sequence
  chemically synthesized
tttctatgtaaaatttatat

SEQ ID NO: 351150 - DNA, 20 bp, Artificial Sequence
  chemically synthesized
agcctgatataaattttaca

SEQ ID NO: 351151 - DNA, 20 bp, Artificial Sequence
  chemically synthesized
gggagaagtatatggataca

SEQ ID NO: 351152 - DNA, 20 bp, Artificial Sequence
  chemically synthesized
actatgaggggagaagtata

SEQ ID NO: 351153 - DNA, 20 bp, Artificial Sequence
  chemically synthesized
tgtgtgtactatgaggggag

SEQ ID NO: 351154 - DNA, 20 bp, Artificial Sequence
  chemically synthesized
tccatatacttctcccctca

SEQ ID NO: 351155 - DNA, 20 bp, Artificial Sequence
  chemically synthesized
aagtgtgtgtactatgaggg

SEQ ID NO: 351156 - DNA, 20 bp, Artificial Sequence
  chemically synthesized
gtaagtgtgtgtactatgag

SEQ ID NO: 351157 - DNA, 20 bp, Artificial Sequence
  chemically synthesized
ggtaagtgtgtgtactatga

SEQ ID NO: 351158 - DNA, 20 bp, Artificial Sequence
  chemically synthesized
gggtaagtgtgtgtactatg

SEQ ID NO: 351159 - DNA, 20 bp, Artificial Sequence
  chemically synthesized
cgggtaagtgtgtgtactat

SEQ ID NO: 351160 - DNA, 20 bp, Artificial Sequence
  chemically synthesized
atacacactacatatcgggt

SEQ ID NO: 351161 - DNA, 20 bp, Artificial Sequence
  chemically synthesized
acacacacttacccgatatg

SEQ ID NO: 351162 - DNA, 20 bp, Artificial Sequence
  chemically synthesized
agcaatacacactacatatc

SEQ ID NO: 351163 - DNA, 20 bp, Artificial Sequence
  chemically synthesized
aagcaatacacactacatat

SEQ ID NO: 351164 - DNA, 20 bp, Artificial Sequence
  chemically synthesized
atatgtagtgtgtattgctt

SEQ ID NO: 351165 - DNA, 20 bp, Artificial Sequence
  chemically synthesized
ggattttattgagtatgcta

SEQ ID NO: 351166 - DNA, 20 bp, Artificial Sequence
  chemically synthesized
ttgtctcaatggattttatt

SEQ ID NO: 351167 - DNA, 20 bp, Artificial Sequence
  chemically synthesized
catactcaataaaatccatt

SEQ ID NO: 351168 - DNA, 20 bp, Artificial Sequence
  chemically synthesized
taaggcatattttgtctcaa

SEQ ID NO: 351169 - DNA, 20 bp, Artificial Sequence
  chemically synthesized
ctgttacaattagaaacata

SEQ ID NO: 351170 - DNA, 20 bp, Artificial Sequence
  chemically synthesized
actgttacaattagaaacat

SEQ ID NO: 351171 - DNA, 20 bp, Artificial Sequence
  chemically synthesized
ccttatgtttctaattgtaa

SEQ ID NO: 351172 - DNA, 20 bp, Artificial Sequence
  chemically synthesized
taaaaattgactgttacaat

SEQ ID NO: 351173 - DNA, 20 bp, Artificial Sequence
  chemically synthesized
aatcctcttggtaatttata

SEQ ID NO: 351174 - DNA, 20 bp, Artificial Sequence
  chemically synthesized
tttttaccatataaattacc

SEQ ID NO: 351175 - DNA, 20 bp, Artificial Sequence
  chemically synthesized
tttaccatataaattaccaa

SEQ ID NO: 351176 - DNA, 20 bp, Artificial Sequence
  chemically synthesized
ttaccatataaattaccaag

SEQ ID NO: 351177 - DNA, 20 bp, Artificial Sequence
  chemically synthesized
taattttagaaaaatcctct

SEQ ID NO: 351178 - DNA, 20 bp, Artificial Sequence
  chemically synthesized
ctacattcatcgtataattt

SEQ ID NO: 351179 - DNA, 20 bp, Artificial Sequence
  chemically synthesized
ctaaaattatacgatgaatg

SEQ ID NO: 351180 - DNA, 20 bp, Artificial Sequence
  chemically synthesized
tatggtacaaaagttgtaga

SEQ ID NO: 351181 - DNA, 20 bp, Artificial Sequence
  chemically synthesized
tgtatggtacaaaagttgta

SEQ ID NO: 351182 - DNA, 20 bp, Artificial Sequence
  chemically synthesized
catgtatggtacaaaagttg

SEQ ID NO: 351183 - DNA, 20 bp, Artificial Sequence
  chemically synthesized
gaattccatgtatggtacaa

SEQ ID NO: 351184 - DNA, 20 bp, Artificial Sequence
  chemically synthesized
tacaacttttgtaccataca

SEQ ID NO: 351185 - DNA, 20 bp, Artificial Sequence
  chemically synthesized
ctagtatagaattccatgta

SEQ ID NO: 351186 - DNA, 20 bp, Artificial Sequence
  chemically synthesized
ccatacatggaattctatac

SEQ ID NO: 351187 - DNA, 20 bp, Artificial Sequence
  chemically synthesized
tacatggaattctatactag

SEQ ID NO: 351188 - DNA, 20 bp, Artificial Sequence
  chemically synthesized
aagaatgtcggcttctagta

SEQ ID NO: 351189 - DNA, 20 bp, Artificial Sequence
  chemically synthesized
ggcataagaatgtcggcttc

SEQ ID NO: 351190 - DNA, 20 bp, Artificial Sequence
  chemically synthesized
tctgtcgggcataagaatgt

SEQ ID NO: 351191 - DNA, 20 bp, Artificial Sequence
  chemically synthesized
taaatagttctgtcgggcat

SEQ ID NO: 351192 - DNA, 20 bp, Artificial Sequence
  chemically synthesized
gccgacattcttatgcccga

SEQ ID NO: 351193 - DNA, 20 bp, Artificial Sequence
  chemically synthesized
atgaactaaatagttctgtc

SEQ ID NO: 351194 - DNA, 20 bp, Artificial Sequence
  chemically synthesized
aatgaactaaatagttctgt

SEQ ID NO: 351195 - DNA, 20 bp, Artificial Sequence
  chemically synthesized
ttatgcccgacagaactatt

SEQ ID NO: 351196 - DNA, 20 bp, Artificial Sequence
  chemically synthesized
gtctcataaaatgaactaaa

SEQ ID NO: 351197 - DNA, 20 bp, Artificial Sequence
  chemically synthesized
aactatttagttcattttat

SEQ ID NO: 351198 - DNA, 20 bp, Artificial Sequence
  chemically synthesized
attttatgagacgtgctatt

SEQ ID NO: 351199 - DNA, 20 bp, Artificial Sequence
  chemically synthesized
aaactttatctaaaactcaa

SEQ ID NO: 351200 - DNA, 20 bp, Artificial Sequence
  chemically synthesized
tgagacgtgctattgagttt

SEQ ID NO: 351201 - DNA, 20 bp, Artificial Sequence
  chemically synthesized
gtgctattgagttttagata

SEQ ID NO: 351202 - DNA, 20 bp, Artificial Sequence
  chemically synthesized
taaagtttgaaattttataa

SEQ ID NO: 351203 - DNA, 20 bp, Artificial Sequence
  chemically synthesized
tttataacagcttattctgt

SEQ ID NO: 351204 - DNA, 20 bp, Artificial Sequence
  chemically synthesized
tgtatgcattcttacagaat

SEQ ID NO: 351205 - DNA, 20 bp, Artificial Sequence
  chemically synthesized
gataattgtatgcattctta

SEQ ID NO: 351206 - DNA, 20 bp, Artificial Sequence
  chemically synthesized
catacaattatcaattacct

SEQ ID NO: 351207 - DNA, 20 bp, Artificial Sequence
  chemically synthesized
atacaattatcaattacctt

SEQ ID NO: 351208 - DNA, 20 bp, Artificial Sequence
  chemically synthesized
tgtaaaacaatttattccca

SEQ ID NO: 351209 - DNA, 20 bp, Artificial Sequence
  chemically synthesized
atgtaaaacaatttattccc

SEQ ID NO: 351210 - DNA, 20 bp, Artificial Sequence
  chemically synthesized
aaattgttttacatatttct

SEQ ID NO: 351211 - DNA, 20 bp, Artificial Sequence
  chemically synthesized
aagaagctgcagaaggttct

SEQ ID NO: 351212 - DNA, 20 bp, Artificial Sequence
  chemically synthesized
atatttctgagaaccttctg

SEQ ID NO: 351213 - DNA, 20 bp, Artificial Sequence
  chemically synthesized
gatatacaagaagctgcaga

SEQ ID NO: 351214 - DNA, 20 bp, Artificial Sequence
  chemically synthesized
tgatatacaagaagctgcag

SEQ ID NO: 351215 - DNA, 20 bp, Artificial Sequence
  chemically synthesized
gtttgatatacaagaagctg

SEQ ID NO: 351216 - DNA, 20 bp, Artificial Sequence
  chemically synthesized
cctgtggtttgatatacaag

SEQ ID NO: 351217 - DNA, 20 bp, Artificial Sequence
  chemically synthesized
atacctgtggtttgatatac

SEQ ID NO: 351218 - DNA, 20 bp, Artificial Sequence
  chemically synthesized
gcttcttgtatatcaaacca

SEQ ID NO: 351219 - DNA, 20 bp, Artificial Sequence
  chemically synthesized
cttcttgtatatcaaaccac

SEQ ID NO: 351220 - DNA, 20 bp, Artificial Sequence
  chemically synthesized
tatgctaaaacatatacctg

SEQ ID NO: 351221 - DNA, 20 bp, Artificial Sequence
  chemically synthesized
caaaccacaggtatatgttt

SEQ ID NO: 351222 - DNA, 20 bp, Artificial Sequence
  chemically synthesized
cacaggtatatgttttagca

SEQ ID NO: 351223 - DNA, 20 bp, Artificial Sequence
  chemically synthesized
aaataaaataacagtggtga

SEQ ID NO: 351224 - DNA, 20 bp, Artificial Sequence
  chemically synthesized
taaataaaataacagtggtg

SEQ ID NO: 351225 - DNA, 20 bp, Artificial Sequence
  chemically synthesized
ttatttaaataaaataacag

SEQ ID NO: 351226 - DNA, 20 bp, Artificial Sequence
  chemically synthesized
cctttatttaaataaaataa

SEQ ID NO: 351227 - DNA, 20 bp, Artificial Sequence
  chemically synthesized
actgttattttatttaaata

SEQ ID NO: 351228 - DNA, 20 bp, Artificial Sequence
  chemically synthesized
ctgttattttatttaaataa

SEQ ID NO: 351229 - DNA, 20 bp, Artificial Sequence
  chemically synthesized
tttatttaaataaaggtaat

SEQ ID NO: 351230 - DNA, 20 bp, Artificial Sequence
  chemically synthesized
ttatttaaataaaggtaatc

SEQ ID NO: 351231 - DNA, 20 bp, Artificial Sequence
  chemically synthesized
tttaaataaaggtaatcagg

SEQ ID NO: 351232 - DNA, 20 bp, Artificial Sequence
  chemically synthesized
ttaaataaaggtaatcagga

SEQ ID NO: 351233 - DNA, 20 bp, Artificial Sequence
  chemically synthesized
taatcaggaaggcctttctt

SEQ ID NO: 351234 - DNA, 20 bp, Artificial Sequence
  chemically synthesized
ttgttgtctaagctgaagaa

SEQ ID NO: 351235 - DNA, 20 bp, Artificial Sequence
  chemically synthesized
tttgttgtctaagctgaaga

SEQ ID NO: 351236 - DNA, 20 bp, Artificial Sequence
  chemically synthesized
aggaaggcctttcttcagct

SEQ ID NO: 351237 - DNA, 20 bp, Artificial Sequence
  chemically synthesized
ctactttgttgtctaagctg

SEQ ID NO: 351238 - DNA, 20 bp, Artificial Sequence
  chemically synthesized
tactggctactttgttgtct

SEQ ID NO: 351239 - DNA, 20 bp, Artificial Sequence
  chemically synthesized
tttcttcagcttagacaaca

SEQ ID NO: 351240 - DNA, 20 bp, Artificial Sequence
  chemically synthesized
cttcagcttagacaacaaag

SEQ ID NO: 351241 - DNA, 20 bp, Artificial Sequence
  chemically synthesized
agcttagacaacaaagtagc

SEQ ID NO: 351242 - DNA, 20 bp, Artificial Sequence
  chemically synthesized
tagacaacaaagtagccagt

SEQ ID NO: 351243 - DNA, 20 bp, Artificial Sequence
  chemically synthesized
aatattttccttgatcttac

SEQ ID NO: 351244 - DNA, 20 bp, Artificial Sequence
  chemically synthesized
acaaagtagccagtaagatc

SEQ ID NO: 351245 - DNA, 20 bp, Artificial Sequence
  chemically synthesized
caaagtagccagtaagatca

SEQ ID NO: 351246 - DNA, 20 bp, Artificial Sequence
  chemically synthesized
agtaagatcaaggaaaatat

SEQ ID NO: 351247 - DNA, 20 bp, Artificial Sequence
  chemically synthesized
gtaagatcaaggaaaatatt

SEQ ID NO: 351248 - DNA, 20 bp, Artificial Sequence
  chemically synthesized
caagtattgaagttgtattt

SEQ ID NO: 351249 - DNA, 20 bp, Artificial Sequence
  chemically synthesized
ccaagtattgaagttgtatt

SEQ ID NO: 351250 - DNA, 20 bp, Artificial Sequence
  chemically synthesized
ccaaatacaacttcaatact

SEQ ID NO: 351251 - DNA, 20 bp, Artificial Sequence
  chemically synthesized
tggtcagtatccaagtattg

SEQ ID NO: 351252 - DNA, 20 bp, Artificial Sequence
  chemically synthesized
caatgaaatggtcagtatcc

SEQ ID NO: 351253 - DNA, 20 bp, Artificial Sequence
  chemically synthesized
ttaacaagcaatgaaatggt

SEQ ID NO: 351254 - DNA, 20 bp, Artificial Sequence
  chemically synthesized
aacattaacaagcaatgaaa

SEQ ID NO: 351255 - DNA, 20 bp, Artificial Sequence
  chemically synthesized
tccaaggaattaacattaac

SEQ ID NO: 351256 - DNA, 20 bp, Artificial Sequence
  chemically synthesized
gcttgttaatgttaattcct

SEQ ID NO: 351257 - DNA, 20 bp, Artificial Sequence
  chemically synthesized
taaattaactgattaatcca

SEQ ID NO: 351258 - DNA, 20 bp, Artificial Sequence
  chemically synthesized
ttaaattaactgattaatcc

SEQ ID NO: 351259 - DNA, 20 bp, Artificial Sequence
  chemically synthesized
tgttaattccttggattaat

SEQ ID NO: 351260 - DNA, 20 bp, Artificial Sequence
  chemically synthesized
aatcagttaatttaatctat

SEQ ID NO: 351261 - DNA, 20 bp, Artificial Sequence
  chemically synthesized
cagatacgttatcaagctga

SEQ ID NO: 351262 - DNA, 20 bp, Artificial Sequence
  chemically synthesized
ttctgatcagatacgttatc

SEQ ID NO: 351263 - DNA, 20 bp, Artificial Sequence
  chemically synthesized
agcttgataacgtatctgat

SEQ ID NO: 351264 - DNA, 20 bp, Artificial Sequence
  chemically synthesized
taggattttaaagttctgat

SEQ ID NO: 351265 - DNA, 20 bp, Artificial Sequence
  chemically synthesized
gaagaccagttaggatttta

SEQ ID NO: 351266 - DNA, 20 bp, Artificial Sequence
  chemically synthesized
cagaactttaaaatcctaac

SEQ ID NO: 351267 - DNA, 20 bp, Artificial Sequence
  chemically synthesized
aatatgtgtgaagaccagtt

SEQ ID NO: 351268 - DNA, 20 bp, Artificial Sequence
  chemically synthesized
taatatgtgtgaagaccagt

SEQ ID NO: 351269 - DNA, 20 bp, Artificial Sequence
  chemically synthesized
tcattaatatgtgtgaagac

SEQ ID NO: 351270 - DNA, 20 bp, Artificial Sequence
  chemically synthesized
gagggtcattaatatgtgtg

SEQ ID NO: 351271 - DNA, 20 bp, Artificial Sequence
  chemically synthesized
catattacatgaaagtgtga

SEQ ID NO: 351272 - DNA, 20 bp, Artificial Sequence
  chemically synthesized
gcatattacatgaaagtgtg

SEQ ID NO: 351273 - DNA, 20 bp, Artificial Sequence
  chemically synthesized
agcatattacatgaaagtgt

SEQ ID NO: 351274 - DNA, 20 bp, Artificial Sequence
  chemically synthesized
tacattagcatattacatga

SEQ ID NO: 351275 - DNA, 20 bp, Artificial Sequence
  chemically synthesized
catgtaatatgctaatgtaa

SEQ ID NO: 351276 - DNA, 20 bp, Artificial Sequence
  chemically synthesized
tgaagacacggcttttacat

SEQ ID NO: 351277 - DNA, 20 bp, Artificial Sequence
  chemically synthesized
aatgtaaaagccgtgtcttc

SEQ ID NO: 351278 - DNA, 20 bp, Artificial Sequence
  chemically synthesized
acaaatgtttcttgaagaca

SEQ ID NO: 351279 - DNA, 20 bp, Artificial Sequence
  chemically synthesized
tgtacaacaaatgtttcttg

SEQ ID NO: 351280 - DNA, 20 bp, Artificial Sequence
  chemically synthesized
atttgttgtacattaaaaaa

SEQ ID NO: 351281 - DNA, 20 bp, Artificial Sequence
  chemically synthesized
tttgttgtacattaaaaaac

SEQ ID NO: 351282 - DNA, 20 bp, Artificial Sequence
  chemically synthesized
aaaacaggcactcgcacttt

SEQ ID NO: 351283 - DNA, 20 bp, Artificial Sequence
  chemically synthesized
gcctcggcctctgaaagtgc

SEQ ID NO: 351284 - DNA, 20 bp, Artificial Sequence
  chemically synthesized
aacaggcactcgcactttca

SEQ ID NO: 351285 - DNA, 20 bp, Artificial Sequence
  chemically synthesized
acaggcactcgcactttcag

SEQ ID NO: 351286 - DNA, 20 bp, Artificial Sequence
  chemically synthesized
ctgcccgcctcggcctctga

SEQ ID NO: 351287 - DNA, 20 bp, Artificial Sequence
  chemically synthesized
cactcgcactttcagaggcc

SEQ ID NO: 351288 - DNA, 20 bp, Artificial Sequence
  chemically synthesized
actcgcactttcagaggccg

SEQ ID NO: 351289 - DNA, 20 bp, Artificial Sequence
  chemically synthesized
cgcactttcagaggccgagg

SEQ ID NO: 351290 - DNA, 20 bp, Artificial Sequence
  chemically synthesized
gcactttcagaggccgaggc

SEQ ID NO: 351291 - DNA, 20 bp, Artificial Sequence
  chemically synthesized
ctttcagaggccgaggcggg

SEQ ID NO: 351292 - DNA, 20 bp, Artificial Sequence
  chemically synthesized
acctcgtgatctgcccgcct

SEQ ID NO: 351293 - DNA, 20 bp, Artificial Sequence
  chemically synthesized
ggccgaggcgggcagatcac

SEQ ID NO: 351294 - DNA, 20 bp, Artificial Sequence
  chemically synthesized
gccgaggcgggcagatcacg

SEQ ID NO: 351295 - DNA, 20 bp, Artificial Sequence
  chemically synthesized
aggcgggcagatcacgaggt

SEQ ID NO: 351296 - DNA, 20 bp, Artificial Sequence
  chemically synthesized
ggcgggcagatcacgaggtc

SEQ ID NO: 351297 - DNA, 20 bp, Artificial Sequence
  chemically synthesized
cgggcagatcacgaggtcag

SEQ ID NO: 351298 - DNA, 20 bp, Artificial Sequence
  chemically synthesized
gatcacgaggtcaggagatc

SEQ ID NO: 351299 - DNA, 20 bp, Artificial Sequence
  chemically synthesized
tcaggagatcgagaccatcc

SEQ ID NO: 351300 - DNA, 20 bp, Artificial Sequence
  chemically synthesized
tttcactgtgttagccagga

SEQ ID NO: 351301 - DNA, 20 bp, Artificial Sequence
  chemically synthesized
ggggtttcactgtgttagcc

SEQ ID NO: 351302 - DNA, 20 bp, Artificial Sequence
  chemically synthesized
cgagaccatcctggctaaca

SEQ ID NO: 351303 - DNA, 20 bp, Artificial Sequence
  chemically synthesized
cggggtttcactgtgttagc

SEQ ID NO: 351304 - DNA, 20 bp, Artificial Sequence
  chemically synthesized
gagacggggtttcactgtgt

SEQ ID NO: 351305 - DNA, 20 bp, Artificial Sequence
  chemically synthesized
ttttatttttagtagagacg

SEQ ID NO: 351306 - DNA, 20 bp, Artificial Sequence
  chemically synthesized
tttttatttttagtagagac

SEQ ID NO: 351307 - DNA, 20 bp, Artificial Sequence
  chemically synthesized
ttttttatttttagtagaga

SEQ ID NO: 351308 - DNA, 20 bp, Artificial Sequence
  chemically synthesized
ttttttttttatttttagta

SEQ ID NO: 351309 - DNA, 20 bp, Artificial Sequence
  chemically synthesized
tattttttttttatttttag

SEQ ID NO: 351310 - DNA, 20 bp, Artificial Sequence
  chemically synthesized
ttttattttttttttatttt

SEQ ID NO: 351311 - DNA, 20 bp, Artificial Sequence
  chemically synthesized
aaaataaaaaataaaaaaat

SEQ ID NO: 351312 - DNA, 20 bp, Artificial Sequence
  chemically synthesized
taaaaaataaaaaaattagc

SEQ ID NO: 351313 - DNA, 20 bp, Artificial Sequence
  chemically synthesized
aaaaaataaaaaaattagcc

SEQ ID NO: 351314 - DNA, 20 bp, Artificial Sequence
  chemically synthesized
ataaaaaaattagccgggca

SEQ ID NO: 351315 - DNA, 20 bp, Artificial Sequence
  chemically synthesized
aaaaaattagccgggcatgg

SEQ ID NO: 351316 - DNA, 20 bp, Artificial Sequence
  chemically synthesized
caggcgcctgccaccatgcc

SEQ ID NO: 351317 - DNA, 20 bp, Artificial Sequence
  chemically synthesized
aaattagccgggcatggtgg

SEQ ID NO: 351318 - DNA, 20 bp, Artificial Sequence
  chemically synthesized
aattagccgggcatggtggc

SEQ ID NO: 351319 - DNA, 20 bp, Artificial Sequence
  chemically synthesized
ggcatggtggcaggcgcctg

SEQ ID NO: 351320 - DNA, 20 bp, Artificial Sequence
  chemically synthesized
gtggcaggcgcctgtagtcc

SEQ ID NO: 351321 - DNA, 20 bp, Artificial Sequence
  chemically synthesized
tcccgagtagctgggactac

SEQ ID NO: 351322 - DNA, 20 bp, Artificial Sequence
  chemically synthesized
ctcccgagtagctgggacta

SEQ ID NO: 351323 - DNA, 20 bp, Artificial Sequence
  chemically synthesized
cgcctgtagtcccagctact

SEQ ID NO: 351324 - DNA, 20 bp, Artificial Sequence
  chemically synthesized
cctcagcctcccgagtagct

SEQ ID NO: 351325 - DNA, 20 bp, Artificial Sequence
  chemically synthesized
gcctgtagtcccagctactc

SEQ ID NO: 351326 - DNA, 20 bp, Artificial Sequence
  chemically synthesized
gcctcagcctcccgagtagc

SEQ ID NO: 351327 - DNA, 20 bp, Artificial Sequence
  chemically synthesized
ctgtagtcccagctactcgg

SEQ ID NO: 351328 - DNA, 20 bp, Artificial Sequence
  chemically synthesized
tgtagtcccagctactcggg

SEQ ID NO: 351329 - DNA, 20 bp, Artificial Sequence
  chemically synthesized
tcctgcctcagcctcccgag

SEQ ID NO: 351330 - DNA, 20 bp, Artificial Sequence
  chemically synthesized
ttctcctgcctcagcctccc

SEQ ID NO: 351331 - DNA, 20 bp, Artificial Sequence
  chemically synthesized
tcccagctactcgggaggct

SEQ ID NO: 351332 - DNA, 20 bp, Artificial Sequence
  chemically synthesized
cccagctactcgggaggctg

SEQ ID NO: 351333 - DNA, 20 bp, Artificial Sequence
  chemically synthesized
agctactcgggaggctgagg

SEQ ID NO: 351334 - DNA, 20 bp, Artificial Sequence
  chemically synthesized
gctactcgggaggctgaggc

SEQ ID NO: 351335 - DNA, 20 bp, Artificial Sequence
  chemically synthesized
tactcgggaggctgaggcag

SEQ ID NO: 351336 - DNA, 20 bp, Artificial Sequence
  chemically synthesized
ttcacgctattctcctgcct

SEQ ID NO: 351337 - DNA, 20 bp, Artificial Sequence
  chemically synthesized
gggaggctgaggcaggagaa

SEQ ID NO: 351338 - DNA, 20 bp, Artificial Sequence
  chemically synthesized
gcaggagaatagcgtgaacc

SEQ ID NO: 351339 - DNA, 20 bp, Artificial Sequence
  chemically synthesized
caggagaatagcgtgaaccc

SEQ ID NO: 351340 - DNA, 20 bp, Artificial Sequence
  chemically synthesized
ggagaatagcgtgaacccgg

SEQ ID NO: 351341 - DNA, 20 bp, Artificial Sequence
  chemically synthesized
gagaatagcgtgaacccggg

SEQ ID NO: 351342 - DNA, 20 bp, Artificial Sequence
  chemically synthesized
aatagcgtgaacccgggagg

SEQ ID NO: 351343 - DNA, 20 bp, Artificial Sequence
  chemically synthesized
cactgcaagctccgcctccc

SEQ ID NO: 351344 - DNA, 20 bp, Artificial Sequence
  chemically synthesized
tagcgtgaacccgggaggcg

SEQ ID NO: 351345 - DNA, 20 bp, Artificial Sequence
  chemically synthesized
tcactgcaagctccgcctcc

SEQ ID NO: 351346 - DNA, 20 bp, Artificial Sequence
  chemically synthesized
aacccgggaggcggagcttg

SEQ ID NO: 351347 - DNA, 20 bp, Artificial Sequence
  chemically synthesized
cgggaggcggagcttgcagt

SEQ ID NO: 351348 - DNA, 20 bp, Artificial Sequence
  chemically synthesized
gcgcgatctcggctcactgc

SEQ ID NO: 351349 - DNA, 20 bp, Artificial Sequence
  chemically synthesized
ggcggagcttgcagtgagcc

SEQ ID NO: 351350 - DNA, 20 bp, Artificial Sequence
  chemically synthesized
ggagtgcagtggcgcgatct

SEQ ID NO: 351351 - DNA, 20 bp, Artificial Sequence
  chemically synthesized
tcgcccaggctggagtgcag

SEQ ID NO: 351352 - DNA, 20 bp, Artificial Sequence
  chemically synthesized
gagatcgcgccactgcactc

SEQ ID NO: 351353 - DNA, 20 bp, Artificial Sequence
  chemically synthesized
ccgtcgcccaggctggagtg

SEQ ID NO: 351354 - DNA, 20 bp, Artificial Sequence
  chemically synthesized
cgcgccactgcactccagcc

SEQ ID NO: 351355 - DNA, 20 bp, Artificial Sequence
  chemically synthesized
gcgccactgcactccagcct

SEQ ID NO: 351356 - DNA, 20 bp, Artificial Sequence
  chemically synthesized
tcgctccgtcgcccaggctg

SEQ ID NO: 351357 - DNA, 20 bp, Artificial Sequence
  chemically synthesized
gctcgctccgtcgcccaggc

SEQ ID NO: 351358 - DNA, 20 bp, Artificial Sequence
  chemically synthesized
ctgcactccagcctgggcga

SEQ ID NO: 351359 - DNA, 20 bp, Artificial Sequence
  chemically synthesized
agaggctcgctccgtcgccc

SEQ ID NO: 351360 - DNA, 20 bp, Artificial Sequence
  chemically synthesized
gcactccagcctgggcgacg

SEQ ID NO: 351361 - DNA, 20 bp, Artificial Sequence
  chemically synthesized
cagaggctcgctccgtcgcc

SEQ ID NO: 351362 - DNA, 20 bp, Artificial Sequence
  chemically synthesized
tccagcctgggcgacggagc

SEQ ID NO: 351363 - DNA, 20 bp, Artificial Sequence
  chemically synthesized
tttttctttttttgagacag

SEQ ID NO: 351364 - DNA, 20 bp, Artificial Sequence
  chemically synthesized
ttttttctttttttgagaca

SEQ ID NO: 351365 - DNA, 20 bp, Artificial Sequence
  chemically synthesized
ttttttttctttttttgaga

SEQ ID NO: 351366 - DNA, 20 bp, Artificial Sequence
  chemically synthesized
gcgagcctctgtctcaaaaa

SEQ ID NO: 351367 - DNA, 20 bp, Artificial Sequence
  chemically synthesized
ttttttttttttcttttttt

SEQ ID NO: 351368 - DNA, 20 bp, Artificial Sequence
  chemically synthesized
aaagaaaaaaaaaaaaaaaa

SEQ ID NO: 351369 - DNA, 20 bp, Artificial Sequence
  chemically synthesized
aagaaaaaaaaaaaaaaaaa

SEQ ID NO: 351370 - DNA, 20 bp, Artificial Sequence
  chemically synthesized
gctgaattcccagagcataa

SEQ ID NO: 351371 - DNA, 20 bp, Artificial Sequence
  chemically synthesized
aaaaaggcactcttatgctc

SEQ ID NO: 351372 - DNA, 20 bp, Artificial Sequence
  chemically synthesized
aaaaggcactcttatgctct

SEQ ID NO: 351373 - DNA, 20 bp, Artificial Sequence
  chemically synthesized
cagctgaattcccagagcat

SEQ ID NO: 351374 - DNA, 20 bp, Artificial Sequence
  chemically synthesized
tattcacagctgaattccca

SEQ ID NO: 351375 - DNA, 20 bp, Artificial Sequence
  chemically synthesized
actcttatgctctgggaatt

SEQ ID NO: 351376 - DNA, 20 bp, Artificial Sequence
  chemically synthesized
attattcacagctgaattcc

SEQ ID NO: 351377 - DNA, 20 bp, Artificial Sequence
  chemically synthesized
gctgggacctttattattca

SEQ ID NO: 351378 - DNA, 20 bp, Artificial Sequence
  chemically synthesized
gaattcagctgtgaataata

SEQ ID NO: 351379 - DNA, 20 bp, Artificial Sequence
  chemically synthesized
aattcagctgtgaataataa

SEQ ID NO: 351380 - DNA, 20 bp, Artificial Sequence
  chemically synthesized
gctgtgaataataaaggtcc

SEQ ID NO: 351381 - DNA, 20 bp, Artificial Sequence
  chemically synthesized
taataaaggtcccagcacat

SEQ ID NO: 351382 - DNA, 20 bp, Artificial Sequence
  chemically synthesized
tggtgacttcctcatgtgct

SEQ ID NO: 351383 - DNA, 20 bp, Artificial Sequence
  chemically synthesized
aataaaggtcccagcacatg

SEQ ID NO: 351384 - DNA, 20 bp, Artificial Sequence
  chemically synthesized
gtggtgacttcctcatgtgc

SEQ ID NO: 351385 - DNA, 20 bp, Artificial Sequence
  chemically synthesized
aaaggtcccagcacatgagg

SEQ ID NO: 351386 - DNA, 20 bp, Artificial Sequence
  chemically synthesized
gaggaagtcaccaccaataa

SEQ ID NO: 351387 - DNA, 20 bp, Artificial Sequence
  chemically synthesized
ttgttcagtcctgttattgg

SEQ ID NO: 351388 - DNA, 20 bp, Artificial Sequence
  chemically synthesized
aggaagtcaccaccaataac

SEQ ID NO: 351389 - DNA, 20 bp, Artificial Sequence
  chemically synthesized
gacttgttcagtcctgttat

SEQ ID NO: 351390 - DNA, 20 bp, Artificial Sequence
  chemically synthesized
caccaataacaggactgaac

SEQ ID NO: 351391 - DNA, 20 bp, Artificial Sequence
  chemically synthesized
taggtagttgtagacttgtt

SEQ ID NO: 351392 - DNA, 20 bp, Artificial Sequence
  chemically synthesized
cacaatgctgtaggtagttg

SEQ ID NO: 351393 - DNA, 20 bp, Artificial Sequence
  chemically synthesized
aacaagtctacaactaccta

SEQ ID NO: 351394 - DNA, 20 bp, Artificial Sequence
  chemically synthesized
gcctatcacaatgctgtagg

SEQ ID NO: 351395 - DNA, 20 bp, Artificial Sequence
  chemically synthesized
ctggcctatcacaatgctgt

SEQ ID NO: 351396 - DNA, 20 bp, Artificial Sequence
  chemically synthesized
gctggcctatcacaatgctg

SEQ ID NO: 351397 - DNA, 20 bp, Artificial Sequence
  chemically synthesized
aactacctacagcattgtga

SEQ ID NO: 351398 - DNA, 20 bp, Artificial Sequence
  chemically synthesized
actacctacagcattgtgat

SEQ ID NO: 351399 - DNA, 20 bp, Artificial Sequence
  chemically synthesized
cctacagcattgtgataggc

SEQ ID NO: 351400 - DNA, 20 bp, Artificial Sequence
  chemically synthesized
acagcattgtgataggccag

SEQ ID NO: 351401 - DNA, 20 bp, Artificial Sequence
  chemically synthesized
tgttcccaccatagtactgc

SEQ ID NO: 351402 - DNA, 20 bp, Artificial Sequence
  chemically synthesized
gtgataggccagcagtacta

SEQ ID NO: 351403 - DNA, 20 bp, Artificial Sequence
  chemically synthesized
ataggccagcagtactatgg

SEQ ID NO: 351404 - DNA, 20 bp, Artificial Sequence
  chemically synthesized
taggccagcagtactatggt

SEQ ID NO: 351405 - DNA, 20 bp, Artificial Sequence
  chemically synthesized
agtggagtttgttcccacca

SEQ ID NO: 351406 - DNA, 20 bp, Artificial Sequence
  chemically synthesized
atggtgggaacaaactccac

SEQ ID NO: 351407 - DNA, 20 bp, Artificial Sequence
  chemically synthesized
tctcacttaatgttccagtg

SEQ ID NO: 351408 - DNA, 20 bp, Artificial Sequence
  chemically synthesized
attctcacttaatgttccag

SEQ ID NO: 351409 - DNA, 20 bp, Artificial Sequence
  chemically synthesized
acaaactccactggaacatt

SEQ ID NO: 351410 - DNA, 20 bp, Artificial Sequence
  chemically synthesized
ataattctcacttaatgttc

SEQ ID NO: 351411 - DNA, 20 bp, Artificial Sequence
  chemically synthesized
actccactggaacattaagt

SEQ ID NO: 351412 - DNA, 20 bp, Artificial Sequence
  chemically synthesized
taagtgagaattattttttg

SEQ ID NO: 351413 - DNA, 20 bp, Artificial Sequence
  chemically synthesized
aagtgagaattattttttga

SEQ ID NO: 351414 - DNA, 20 bp, Artificial Sequence
  chemically synthesized
gagaattattttttgaaggt

SEQ ID NO: 351415 - DNA, 20 bp, Artificial Sequence
  chemically synthesized
agaattattttttgaaggtt

SEQ ID NO: 351416 - DNA, 20 bp, Artificial Sequence
  chemically synthesized
gaaggttaggaattttacgt

SEQ ID NO: 351417 - DNA, 20 bp, Artificial Sequence
  chemically synthesized
aaatatcaatgatacaatca

SEQ ID NO: 351418 - DNA, 20 bp, Artificial Sequence
  chemically synthesized
atacaatcaaagtgaaacat

SEQ ID NO: 351419 - DNA, 20 bp, Artificial Sequence
  chemically synthesized
caatcaaagtgaaacatgag

SEQ ID NO: 351420 - DNA, 20 bp, Artificial Sequence
  chemically synthesized
aatcaaagtgaaacatgaga

SEQ ID NO: 351421 - DNA, 20 bp, Artificial Sequence
  chemically synthesized
aacagagtaaacaacagtat

SEQ ID NO: 351422 - DNA, 20 bp, Artificial Sequence
  chemically synthesized
aatattaacagagtaaacaa

SEQ ID NO: 351423 - DNA, 20 bp, Artificial Sequence
  chemically synthesized
tgtttagtacaatattaaca

SEQ ID NO: 351424 - DNA, 20 bp, Artificial Sequence
  chemically synthesized
actgtttagtacaatattaa

SEQ ID NO: 351425 - DNA, 20 bp, Artificial Sequence
  chemically synthesized
tctgttaatattgtactaaa

SEQ ID NO: 351426 - DNA, 20 bp, Artificial Sequence
  chemically synthesized
ttgttttattcaatactgtt

SEQ ID NO: 351427 - DNA, 20 bp, Artificial Sequence
  chemically synthesized
tcaacgaaacatttgaaaaa

SEQ ID NO: 351428 - DNA, 20 bp, Artificial Sequence
  chemically synthesized
acgaaacatttgaaaaacag

SEQ ID NO: 351429 - DNA, 20 bp, Artificial Sequence
  chemically synthesized
aagacattgtatctttaaac

SEQ ID NO: 351430 - DNA, 20 bp, Artificial Sequence
  chemically synthesized
aaaatgacatcactagttta

SEQ ID NO: 351431 - DNA, 20 bp, Artificial Sequence
  chemically synthesized
atgcaagaaaatgacatcac

SEQ ID NO: 351432 - DNA, 20 bp, Artificial Sequence
  chemically synthesized
tgagttatatatgagaatgc

SEQ ID NO: 351433 - DNA, 20 bp, Artificial Sequence
  chemically synthesized
cggtatattgagttatatat

SEQ ID NO: 351434 - DNA, 20 bp, Artificial Sequence
  chemically synthesized
tcatatataactcaatatac

SEQ ID NO: 351435 - DNA, 20 bp, Artificial Sequence
  chemically synthesized
tacagtgttcccggtatatt

SEQ ID NO: 351436 - DNA, 20 bp, Artificial Sequence
  chemically synthesized
catatataactcaatatacc

SEQ ID NO: 351437 - DNA, 20 bp, Artificial Sequence
  chemically synthesized
tttagaatctacagtgttcc

SEQ ID NO: 351438 - DNA, 20 bp, Artificial Sequence
  chemically synthesized
tcaatataccgggaacactg

SEQ ID NO: 351439 - DNA, 20 bp, Artificial Sequence
  chemically synthesized
taatacttatttagaatcta

SEQ ID NO: 351440 - DNA, 20 bp, Artificial Sequence
  chemically synthesized
gaacactgtagattctaaat

SEQ ID NO: 351441 - DNA, 20 bp, Artificial Sequence
  chemically synthesized
ttaattacataatacttatt

SEQ ID NO: 351442 - DNA, 20 bp, Artificial Sequence
  chemically synthesized
taaataagtattatgtaatt

SEQ ID NO: 351443 - DNA, 20 bp, Artificial Sequence
  chemically synthesized
ttactggagtagaggcaagg

SEQ ID NO: 351444 - DNA, 20 bp, Artificial Sequence
  chemically synthesized
gattactggagtagaggcaa

SEQ ID NO: 351445 - DNA, 20 bp, Artificial Sequence
  chemically synthesized
ggattactggagtagaggca

SEQ ID NO: 351446 - DNA, 20 bp, Artificial Sequence
  chemically synthesized
gggattactggagtagaggc

SEQ ID NO: 351447 - DNA, 20 bp, Artificial Sequence
  chemically synthesized
attctcccttgcctctactc

SEQ ID NO: 351448 - DNA, 20 bp, Artificial Sequence
  chemically synthesized
aagagggattactggagtag

SEQ ID NO: 351449 - DNA, 20 bp, Artificial Sequence
  chemically synthesized
gaagagggattactggagta

SEQ ID NO: 351450 - DNA, 20 bp, Artificial Sequence
  chemically synthesized
gggaagagggattactggag

SEQ ID NO: 351451 - DNA, 20 bp, Artificial Sequence
  chemically synthesized
caagggaagagggattactg

SEQ ID NO: 351452 - DNA, 20 bp, Artificial Sequence
  chemically synthesized
agcaagggaagagggattac

SEQ ID NO: 351453 - DNA, 20 bp, Artificial Sequence
  chemically synthesized
caagcagcagcaagggaaga

SEQ ID NO: 351454 - DNA, 20 bp, Artificial Sequence
  chemically synthesized
acaagcagcagcaagggaag

SEQ ID NO: 351455 - DNA, 20 bp, Artificial Sequence
  chemically synthesized
cacaagcagcagcaagggaa

SEQ ID NO: 351456 - DNA, 20 bp, Artificial Sequence
  chemically synthesized
ttcacaagcagcagcaaggg

SEQ ID NO: 351457 - DNA, 20 bp, Artificial Sequence
  chemically synthesized
acattcacaagcagcagcaa

SEQ ID NO: 351458 - DNA, 20 bp, Artificial Sequence
  chemically synthesized
cacattcacaagcagcagca

SEQ ID NO: 351459 - DNA, 20 bp, Artificial Sequence
  chemically synthesized
acacattcacaagcagcagc

SEQ ID NO: 351460 - DNA, 20 bp, Artificial Sequence
  chemically synthesized
gctgacacattcacaagcag

SEQ ID NO: 351461 - DNA, 20 bp, Artificial Sequence
  chemically synthesized
gaggctgacacattcacaag

SEQ ID NO: 351462 - DNA, 20 bp, Artificial Sequence
  chemically synthesized
agagaggctgacacattcac

SEQ ID NO: 351463 - DNA, 20 bp, Artificial Sequence
  chemically synthesized
gctgctgcttgtgaatgtgt

SEQ ID NO: 351464 - DNA, 20 bp, Artificial Sequence
  chemically synthesized
gaaatttggttgcaggagag

SEQ ID NO: 351465 - DNA, 20 bp, Artificial Sequence
  chemically synthesized
agaaatttggttgcaggaga

SEQ ID NO: 351466 - DNA, 20 bp, Artificial Sequence
  chemically synthesized
gtagaaatttggttgcagga

SEQ ID NO: 351467 - DNA, 20 bp, Artificial Sequence
  chemically synthesized
gggtagaaatttggttgcag

SEQ ID NO: 351468 - DNA, 20 bp, Artificial Sequence
  chemically synthesized
tggggtagaaatttggttgc

SEQ ID NO: 351469 - DNA, 20 bp, Artificial Sequence
  chemically synthesized
ctggggtagaaatttggttg

SEQ ID NO: 351470 - DNA, 20 bp, Artificial Sequence
  chemically synthesized
gtatgtctggggtagaaatt

SEQ ID NO: 351471 - DNA, 20 bp, Artificial Sequence
  chemically synthesized
ctgcaaccaaatttctaccc

SEQ ID NO: 351472 - DNA, 20 bp, Artificial Sequence
  chemically synthesized
cgaatgtagtatgtctgggg

SEQ ID NO: 351473 - DNA, 20 bp, Artificial Sequence
  chemically synthesized
agacgaatgtagtatgtctg

SEQ ID NO: 351474 - DNA, 20 bp, Artificial Sequence
  chemically synthesized
aagacgaatgtagtatgtct

SEQ ID NO: 351475 - DNA, 20 bp, Artificial Sequence
  chemically synthesized
taagacgaatgtagtatgtc

SEQ ID NO: 351476 - DNA, 20 bp, Artificial Sequence
  chemically synthesized
gagatggaataagacgaatg

SEQ ID NO: 351477 - DNA, 20 bp, Artificial Sequence
  chemically synthesized
aatacatggagagatggaat

SEQ ID NO: 351478 - DNA, 20 bp, Artificial Sequence
  chemically synthesized
cttgtcaatacatggagaga

SEQ ID NO: 351479 - DNA, 20 bp, Artificial Sequence
  chemically synthesized
ccatcttgtcaatacatgga

SEQ ID NO: 351480 - DNA, 20 bp, Artificial Sequence
  chemically synthesized
gcccatcttgtcaatacatg

SEQ ID NO: 351481 - DNA, 20 bp, Artificial Sequence
  chemically synthesized
gtgcccatcttgtcaataca

SEQ ID NO: 351482 - DNA, 20 bp, Artificial Sequence
  chemically synthesized
ccatctctccatgtattgac

SEQ ID NO: 351483 - DNA, 20 bp, Artificial Sequence
  chemically synthesized
ctctccatgtattgacaaga

SEQ ID NO: 351484 - DNA, 20 bp, Artificial Sequence
  chemically synthesized
tctccatgtattgacaagat

SEQ ID NO: 351485 - DNA, 20 bp, Artificial Sequence
  chemically synthesized
tattgacaagatgggcacat

SEQ ID NO: 351486 - DNA, 20 bp, Artificial Sequence
  chemically synthesized
cacacatacatccgcatact

SEQ ID NO: 351487 - DNA, 20 bp, Artificial Sequence
  chemically synthesized
acacatacatccgcatacta

SEQ ID NO: 351488 - DNA, 20 bp, Artificial Sequence
  chemically synthesized
agctactttgccttagtatg

SEQ ID NO: 351489 - DNA, 20 bp, Artificial Sequence
  chemically synthesized
tacatccgcatactaaggca

SEQ ID NO: 351490 - DNA, 20 bp, Artificial Sequence
  chemically synthesized
taaagtaagctactttgcct

SEQ ID NO: 351491 - DNA, 20 bp, Artificial Sequence
  chemically synthesized
atccgcatactaaggcaaag

SEQ ID NO: 351492 - DNA, 20 bp, Artificial Sequence
  chemically synthesized
ctctctgagataggtaaagt

SEQ ID NO: 351493 - DNA, 20 bp, Artificial Sequence
  chemically synthesized
ttttctctctgagataggta

SEQ ID NO: 351494 - DNA, 20 bp, Artificial Sequence
  chemically synthesized
gtagcttactttacctatct

SEQ ID NO: 351495 - DNA, 20 bp, Artificial Sequence
  chemically synthesized
agcttactttacctatctca

SEQ ID NO: 351496 - DNA, 20 bp, Artificial Sequence
  chemically synthesized
gctagttttctctctgagat

SEQ ID NO: 351497 - DNA, 20 bp, Artificial Sequence
  chemically synthesized
cttactttacctatctcaga

SEQ ID NO: 351498 - DNA, 20 bp, Artificial Sequence
  chemically synthesized
ggctagttttctctctgaga

SEQ ID NO: 351499 - DNA, 20 bp, Artificial Sequence
  chemically synthesized
tttaggctagttttctctct

SEQ ID NO: 351500 - DNA, 20 bp, Artificial Sequence
  chemically synthesized
acctatctcagagagaaaac

SEQ ID NO: 351501 - DNA, 20 bp, Artificial Sequence
  chemically synthesized
attcttccttatgtttaggc

SEQ ID NO: 351502 - DNA, 20 bp, Artificial Sequence
  chemically synthesized
gagaaaactagcctaaacat

SEQ ID NO: 351503 - DNA, 20 bp, Artificial Sequence
  chemically synthesized
agaaaactagcctaaacata

SEQ ID NO: 351504 - DNA, 20 bp, Artificial Sequence
  chemically synthesized
gagcattcttccttatgttt

SEQ ID NO: 351505 - DNA, 20 bp, Artificial Sequence
  chemically synthesized
tgagcattcttccttatgtt

SEQ ID NO: 351506 - DNA, 20 bp, Artificial Sequence
  chemically synthesized
aaactagcctaaacataagg

SEQ ID NO: 351507 - DNA, 20 bp, Artificial Sequence
  chemically synthesized
ataaggaagaatgctcacta

SEQ ID NO: 351508 - DNA, 20 bp, Artificial Sequence
  chemically synthesized
tgtatcttaaaatctttagt

SEQ ID NO: 351509 - DNA, 20 bp, Artificial Sequence
  chemically synthesized
tatctgtatcttaaaatctt

SEQ ID NO: 351510 - DNA, 20 bp, Artificial Sequence
  chemically synthesized
gaatgctcactaaagatttt

SEQ ID NO: 351511 - DNA, 20 bp, Artificial Sequence
  chemically synthesized
tcactaaagattttaagata

SEQ ID NO: 351512 - DNA, 20 bp, Artificial Sequence
  chemically synthesized
aagattttaagatacagata

SEQ ID NO: 351513 - DNA, 20 bp, Artificial Sequence
  chemically synthesized
gatacagataaagaacattt

SEQ ID NO: 351514 - DNA, 20 bp, Artificial Sequence
  chemically synthesized
agaacatttgagtcaccttt

SEQ ID NO: 351515 - DNA, 20 bp, Artificial Sequence
  chemically synthesized
aacatttgagtcacctttaa

SEQ ID NO: 351516 - DNA, 20 bp, Artificial Sequence
  chemically synthesized
atgtaatttatgtctcttaa

SEQ ID NO: 351517 - DNA, 20 bp, Artificial Sequence
  chemically synthesized
catgtaatttatgtctctta

SEQ ID NO: 351518 - DNA, 20 bp, Artificial Sequence
  chemically synthesized
ggggaaatagagagaaagtg

SEQ ID NO: 351519 - DNA, 20 bp, Artificial Sequence
  chemically synthesized
ttggggaaatagagagaaag

SEQ ID NO: 351520 - DNA, 20 bp, Artificial Sequence
  chemically synthesized
tatttggggaaatagagaga

SEQ ID NO: 351521 - DNA, 20 bp, Artificial Sequence
  chemically synthesized
catatatttggggaaataga

SEQ ID NO: 351522 - DNA, 20 bp, Artificial Sequence
  chemically synthesized
accatatatttggggaaata

SEQ ID NO: 351523 - DNA, 20 bp, Artificial Sequence
  chemically synthesized
ataccatatatttggggaaa

SEQ ID NO: 351524 - DNA, 20 bp, Artificial Sequence
  chemically synthesized
aggagaataccatatatttg

SEQ ID NO: 351525 - DNA, 20 bp, Artificial Sequence
  chemically synthesized
tctctatttccccaaatata

SEQ ID NO: 351526 - DNA, 20 bp, Artificial Sequence
  chemically synthesized
gaggagaataccatatattt

SEQ ID NO: 351527 - DNA, 20 bp, Artificial Sequence
  chemically synthesized
tgaggagaataccatatatt

SEQ ID NO: 351528 - DNA, 20 bp, Artificial Sequence
  chemically synthesized
tcttgctatcttagtttgag

SEQ ID NO: 351529 - DNA, 20 bp, Artificial Sequence
  chemically synthesized
tatggtattctcctcaaact

SEQ ID NO: 351530 - DNA, 20 bp, Artificial Sequence
  chemically synthesized
tatcttgctatcttagtttg

SEQ ID NO: 351531 - DNA, 20 bp, Artificial Sequence
  chemically synthesized
atatcttgctatcttagttt

SEQ ID NO: 351532 - DNA, 20 bp, Artificial Sequence
  chemically synthesized
gtattctcctcaaactaaga

SEQ ID NO: 351533 - DNA, 20 bp, Artificial Sequence
  chemically synthesized
tctcctcaaactaagatagc

SEQ ID NO: 351534 - DNA, 20 bp, Artificial Sequence
  chemically synthesized
actgagatatcttgctatct

SEQ ID NO: 351535 - DNA, 20 bp, Artificial Sequence
  chemically synthesized
actaagatagcaagatatct

SEQ ID NO: 351536 - DNA, 20 bp, Artificial Sequence
  chemically synthesized
agtgtattaagatatcaact

SEQ ID NO: 351537 - DNA, 20 bp, Artificial Sequence
  chemically synthesized
acatgaatactgagtgtatt

SEQ ID NO: 351538 - DNA, 20 bp, Artificial Sequence
  chemically synthesized
agttgatatcttaatacact

SEQ ID NO: 351539 - DNA, 20 bp, Artificial Sequence
  chemically synthesized
tgggagcctacatgaatact

SEQ ID NO: 351540 - DNA, 20 bp, Artificial Sequence
  chemically synthesized
taatacactcagtattcatg

SEQ ID NO: 351541 - DNA, 20 bp, Artificial Sequence
  chemically synthesized
aatacactcagtattcatgt

SEQ ID NO: 351542 - DNA, 20 bp, Artificial Sequence
  chemically synthesized
tcagtattcatgtaggctcc

SEQ ID NO: 351543 - DNA, 20 bp, Artificial Sequence
  chemically synthesized
cagtattcatgtaggctccc

SEQ ID NO: 351544 - DNA, 20 bp, Artificial Sequence
  chemically synthesized
attcatgtaggctcccaggt

SEQ ID NO: 351545 - DNA, 20 bp, Artificial Sequence
  chemically synthesized
ataatttttttcttacctgg

SEQ ID NO: 351546 - DNA, 20 bp, Artificial Sequence
  chemically synthesized
taataatttttttcttacct

SEQ ID NO: 351547 - DNA, 20 bp, Artificial Sequence
  chemically synthesized
ataataatttttttcttacc

SEQ ID NO: 351548 - DNA, 20 bp, Artificial Sequence
  chemically synthesized
aaatgcaactaggattagac

SEQ ID NO: 351549 - DNA, 20 bp, Artificial Sequence
  chemically synthesized
tattgttgcttgtctaatcc

SEQ ID NO: 351550 - DNA, 20 bp, Artificial Sequence
  chemically synthesized
tatttaaatgcaactaggat

SEQ ID NO: 351551 - DNA, 20 bp, Artificial Sequence
  chemically synthesized
tttcatatttaaatgcaact

SEQ ID NO: 351552 - DNA, 20 bp, Artificial Sequence
  chemically synthesized
atttcatatttaaatgcaac

SEQ ID NO: 351553 - DNA, 20 bp, Artificial Sequence
  chemically synthesized
agttgcatttaaatatgaaa

SEQ ID NO: 351554 - DNA, 20 bp, Artificial Sequence
  chemically synthesized
ttaaatatgaaatagtaaca

SEQ ID NO: 351555 - DNA, 20 bp, Artificial Sequence
  chemically synthesized
atagtaacatggtaattttt

SEQ ID NO: 351556 - DNA, 20 bp, Artificial Sequence
  chemically synthesized
cattagattgtattcaaaat

SEQ ID NO: 351557 - DNA, 20 bp, Artificial Sequence
  chemically synthesized
acatttttcaaagttttcat

SEQ ID NO: 351558 - DNA, 20 bp, Artificial Sequence
  chemically synthesized
ttggaaatgaacatttttca

SEQ ID NO: 351559 - DNA, 20 bp, Artificial Sequence
  chemically synthesized
ttgaaaaatgttcatttcca

SEQ ID NO: 351560 - DNA, 20 bp, Artificial Sequence
  chemically synthesized
atctgtctttaatttatctt

SEQ ID NO: 351561 - DNA, 20 bp, Artificial Sequence
  chemically synthesized
tcatttccaaagataaatta

SEQ ID NO: 351562 - DNA, 20 bp, Artificial Sequence
  chemically synthesized
ttccaaagataaattaaaga

SEQ ID NO: 351563 - DNA, 20 bp, Artificial Sequence
  chemically synthesized
attaaagacagataatttca

SEQ ID NO: 351564 - DNA, 20 bp, Artificial Sequence
  chemically synthesized
acctttttaatgttaaggga

SEQ ID NO: 351565 - DNA, 20 bp, Artificial Sequence
  chemically synthesized
gaacctttttaatgttaagg

SEQ ID NO: 351566 - DNA, 20 bp, Artificial Sequence
  chemically synthesized
aagaacctttttaatgttaa

SEQ ID NO: 351567 - DNA, 20 bp, Artificial Sequence
  chemically synthesized
aaagaacctttttaatgtta

SEQ ID NO: 351568 - DNA, 20 bp, Artificial Sequence
  chemically synthesized
aaaagaacctttttaatgtt

SEQ ID NO: 351569 - DNA, 20 bp, Artificial Sequence
  chemically synthesized
tgctctcccttaacattaaa

SEQ ID NO: 351570 - DNA, 20 bp, Artificial Sequence
  chemically synthesized
gctctcccttaacattaaaa

SEQ ID NO: 351571 - DNA, 20 bp, Artificial Sequence
  chemically synthesized
atttaatacatatatgagaa

SEQ ID NO: 351572 - DNA, 20 bp, Artificial Sequence
  chemically synthesized
ataatatttaatacatatat

SEQ ID NO: 351573 - DNA, 20 bp, Artificial Sequence
  chemically synthesized
atattatcattaaaaatcac

SEQ ID NO: 351574 - DNA, 20 bp, Artificial Sequence
  chemically synthesized
aggctgtttttttgatattc

SEQ ID NO: 351575 - DNA, 20 bp, Artificial Sequence
  chemically synthesized
tcactagaatatcaaaaaaa

SEQ ID NO: 351576 - DNA, 20 bp, Artificial Sequence
  chemically synthesized
aatatcaaaaaaacagccta

SEQ ID NO: 351577 - DNA, 20 bp, Artificial Sequence
  chemically synthesized
aaaaaaacagcctacagact

SEQ ID NO: 351578 - DNA, 20 bp, Artificial Sequence
  chemically synthesized
actatacacaccaagtctgt

SEQ ID NO: 351579 - DNA, 20 bp, Artificial Sequence
  chemically synthesized
tactatacacaccaagtctg

SEQ ID NO: 351580 - DNA, 20 bp, Artificial Sequence
  chemically synthesized
tatcacatactatacacacc

SEQ ID NO: 351581 - DNA, 20 bp, Artificial Sequence
  chemically synthesized
gcctacagacttggtgtgta

SEQ ID NO: 351582 - DNA, 20 bp, Artificial Sequence
  chemically synthesized
tgtatagtatgtgataacat

SEQ ID NO: 351583 - DNA, 20 bp, Artificial Sequence
  chemically synthesized
acaaaacaaaacaaaaaact

SEQ ID NO: 351584 - DNA, 20 bp, Artificial Sequence
  chemically synthesized
acaaaacaaaaaactaagaa

SEQ ID NO: 351585 - DNA, 20 bp, Artificial Sequence
  chemically synthesized
atacatattgaaactattct

SEQ ID NO: 351586 - DNA, 20 bp, Artificial Sequence
  chemically synthesized
gaatagtttcaatatgtatg

SEQ ID NO: 351587 - DNA, 20 bp, Artificial Sequence
  chemically synthesized
tttcaatatgtatgcagtaa

SEQ ID NO: 351588 - DNA, 20 bp, Artificial Sequence
  chemically synthesized
tcaatatgtatgcagtaaca

SEQ ID NO: 351589 - DNA, 20 bp, Artificial Sequence
  chemically synthesized
acagagacacatgctattct

SEQ ID NO: 351590 - DNA, 20 bp, Artificial Sequence
  chemically synthesized
gagacacatgctattctgag

SEQ ID NO: 351591 - DNA, 20 bp, Artificial Sequence
  chemically synthesized
tgatttaacccttctcagaa

SEQ ID NO: 351592 - DNA, 20 bp, Artificial Sequence
  chemically synthesized
agacacatgctattctgaga

SEQ ID NO: 351593 - DNA, 20 bp, Artificial Sequence
  chemically synthesized
gacacatgctattctgagaa

SEQ ID NO: 351594 - DNA, 20 bp, Artificial Sequence
  chemically synthesized
tttgttgatttaacccttct

SEQ ID NO: 351595 - DNA, 20 bp, Artificial Sequence
  chemically synthesized
tgagaagggttaaatcaaca

SEQ ID NO: 351596 - DNA, 20 bp, Artificial Sequence
  chemically synthesized
gagaagggttaaatcaacaa

SEQ ID NO: 351597 - DNA, 20 bp, Artificial Sequence
  chemically synthesized
aacaaaggacataatctttc

SEQ ID NO: 351598 - DNA, 20 bp, Artificial Sequence
  chemically synthesized
acaaaggacataatctttct

SEQ ID NO: 351599 - DNA, 20 bp, Artificial Sequence
  chemically synthesized
caaaggacataatctttctg

SEQ ID NO: 351600 - DNA, 20 bp, Artificial Sequence
  chemically synthesized
tttcacagctgaaccccaga

SEQ ID NO: 351601 - DNA, 20 bp, Artificial Sequence
  chemically synthesized
gacataatctttctggggtt

SEQ ID NO: 351602 - DNA, 20 bp, Artificial Sequence
  chemically synthesized
tgcatttcacagctgaaccc

SEQ ID NO: 351603 - DNA, 20 bp, Artificial Sequence
  chemically synthesized
tggggttcagctgtgaaatg

SEQ ID NO: 351604 - DNA, 20 bp, Artificial Sequence
  chemically synthesized
ttcttccactctgcatttca

SEQ ID NO: 351605 - DNA, 20 bp, Artificial Sequence
  chemically synthesized
gggttcagctgtgaaatgca

SEQ ID NO: 351606 - DNA, 20 bp, Artificial Sequence
  chemically synthesized
ttcagctgtgaaatgcagag

SEQ ID NO: 351607 - DNA, 20 bp, Artificial Sequence
  chemically synthesized
agctgtgaaatgcagagtgg

SEQ ID NO: 351608 - DNA, 20 bp, Artificial Sequence
  chemically synthesized
agagtggaagaacaacatcc

SEQ ID NO: 351609 - DNA, 20 bp, Artificial Sequence
  chemically synthesized
gagtggaagaacaacatccc

SEQ ID NO: 351610 - DNA, 20 bp, Artificial Sequence
  chemically synthesized
agtggaagaacaacatccca

SEQ ID NO: 351611 - DNA, 20 bp, Artificial Sequence
  chemically synthesized
tggaagaacaacatcccagg

SEQ ID NO: 351612 - DNA, 20 bp, Artificial Sequence
  chemically synthesized
agaacaacatcccagggagt

SEQ ID NO: 351613 - DNA, 20 bp, Artificial Sequence
  chemically synthesized
acttgctgttccaactccct

SEQ ID NO: 351614 - DNA, 20 bp, Artificial Sequence
  chemically synthesized
cacttgctgttccaactccc

SEQ ID NO: 351615 - DNA, 20 bp, Artificial Sequence
  chemically synthesized
aacatcccagggagttggaa

SEQ ID NO: 351616 - DNA, 20 bp, Artificial Sequence
  chemically synthesized
tcccagggagttggaacagc

SEQ ID NO: 351617 - DNA, 20 bp, Artificial Sequence
  chemically synthesized
gagttggaacagcaagtgct

SEQ ID NO: 351618 - DNA, 20 bp, Artificial Sequence
  chemically synthesized
agttggaacagcaagtgcta

SEQ ID NO: 351619 - DNA, 20 bp, Artificial Sequence
  chemically synthesized
atttacatagtttaaggcct

SEQ ID NO: 351620 - DNA, 20 bp, Artificial Sequence
  chemically synthesized
catgatatttacatagttta

SEQ ID NO: 351621 - DNA, 20 bp, Artificial Sequence
  chemically synthesized
gcatgatatttacatagttt

SEQ ID NO: 351622 - DNA, 20 bp, Artificial Sequence
  chemically synthesized
catctagcatgatatttaca

SEQ ID NO: 351623 - DNA, 20 bp, Artificial Sequence
  chemically synthesized
aaactatgtaaatatcatgc

SEQ ID NO: 351624 - DNA, 20 bp, Artificial Sequence
  chemically synthesized
ctcttttacacacaatcatc

SEQ ID NO: 351625 - DNA, 20 bp, Artificial Sequence
  chemically synthesized
tgctagatgattgtgtgtaa

SEQ ID NO: 351626 - DNA, 20 bp, Artificial Sequence
  chemically synthesized
ctagatgattgtgtgtaaaa

SEQ ID NO: 351627 - DNA, 20 bp, Artificial Sequence
  chemically synthesized
attgtgtgtaaaagagaatt

SEQ ID NO: 351628 - DNA, 20 bp, Artificial Sequence
  chemically synthesized
aaagagaattaagttaaatc

SEQ ID NO: 351629 - DNA, 20 bp, Artificial Sequence
  chemically synthesized
agaattaagttaaatccaga

SEQ ID NO: 351630 - DNA, 20 bp, Artificial Sequence
  chemically synthesized
gactggccctattttctttc

SEQ ID NO: 351631 - DNA, 20 bp, Artificial Sequence
  chemically synthesized
agttaaatccagaaagaaaa

SEQ ID NO: 351632 - DNA, 20 bp, Artificial Sequence
  chemically synthesized
gttaaatccagaaagaaaat

SEQ ID NO: 351633 - DNA, 20 bp, Artificial Sequence
  chemically synthesized
ttaaatccagaaagaaaata

SEQ ID NO: 351634 - DNA, 20 bp, Artificial Sequence
  chemically synthesized
atccagaaagaaaatagggc

SEQ ID NO: 351635 - DNA, 20 bp, Artificial Sequence
  chemically synthesized
aggaagaacttgacaatgac

SEQ ID NO: 351636 - DNA, 20 bp, Artificial Sequence
  chemically synthesized
aaatagggccagtcattgtc

SEQ ID NO: 351637 - DNA, 20 bp, Artificial Sequence
  chemically synthesized
tcattgtcaagttcttcctg

SEQ ID NO: 351638 - DNA, 20 bp, Artificial Sequence
  chemically synthesized
tctttttctgtgactgcagg

SEQ ID NO: 351639 - DNA, 20 bp, Artificial Sequence
  chemically synthesized
tcaagttcttcctgcagtca

SEQ ID NO: 351640 - DNA, 20 bp, Artificial Sequence
  chemically synthesized
tcatctttttctgtgactgc

SEQ ID NO: 351641 - DNA, 20 bp, Artificial Sequence
  chemically synthesized
ctcatctttttctgtgactg

SEQ ID NO: 351642 - DNA, 20 bp, Artificial Sequence
  chemically synthesized
tcttcctgcagtcacagaaa

SEQ ID NO: 351643 - DNA, 20 bp, Artificial Sequence
  chemically synthesized
ctgcagtcacagaaaaagat

SEQ ID NO: 351644 - DNA, 20 bp, Artificial Sequence
  chemically synthesized
gatgagaataacttgaacta

SEQ ID NO: 351645 - DNA, 20 bp, Artificial Sequence
  chemically synthesized
tacaaccaccaccatagttc

SEQ ID NO: 351646 - DNA, 20 bp, Artificial Sequence
  chemically synthesized
gagaataacttgaactatgg

SEQ ID NO: 351647 - DNA, 20 bp, Artificial Sequence
  chemically synthesized
aataacttgaactatggtgg

SEQ ID NO: 351648 - DNA, 20 bp, Artificial Sequence
  chemically synthesized
cacctgtacaaccaccacca

SEQ ID NO: 351649 - DNA, 20 bp, Artificial Sequence
  chemically synthesized
gaactatggtggtggttgta

SEQ ID NO: 351650 - DNA, 20 bp, Artificial Sequence
  chemically synthesized
aactatggtggtggttgtac

SEQ ID NO: 351651 - DNA, 20 bp, Artificial Sequence
  chemically synthesized
tatggtggtggttgtacagg

SEQ ID NO: 351652 - DNA, 20 bp, Artificial Sequence
  chemically synthesized
tggtggtggttgtacaggtg

SEQ ID NO: 351653 - DNA, 20 bp, Artificial Sequence
  chemically synthesized
gtggtggttgtacaggtgga

SEQ ID NO: 351654 - DNA, 20 bp, Artificial Sequence
  chemically synthesized
tggtggttgtacaggtggag

SEQ ID NO: 351655 - DNA, 20 bp, Artificial Sequence
  chemically synthesized
gtggagaggtatgaatgatt

SEQ ID NO: 351656 - DNA, 20 bp, Artificial Sequence
  chemically synthesized
atgaatgatttagtgatata

SEQ ID NO: 351657 - DNA, 20 bp, Artificial Sequence
  chemically synthesized
aatgatttagtgatatacag

SEQ ID NO: 351658 - DNA, 20 bp, Artificial Sequence
  chemically synthesized
atgatttagtgatatacagt

SEQ ID NO: 351659 - DNA, 20 bp, Artificial Sequence
  chemically synthesized
acagaacccgcagatacgga

SEQ ID NO: 351660 - DNA, 20 bp, Artificial Sequence
  chemically synthesized
tacagaacccgcagatacgg

SEQ ID NO: 351661 - DNA, 20 bp, Artificial Sequence
  chemically synthesized
atacagaacccgcagatacg

SEQ ID NO: 351662 - DNA, 20 bp, Artificial Sequence
  chemically synthesized
cagtgggccctccgtatctg

SEQ ID NO: 351663 - DNA, 20 bp, Artificial Sequence
  chemically synthesized
agtgggccctccgtatctgc

SEQ ID NO: 351664 - DNA, 20 bp, Artificial Sequence
  chemically synthesized
agatacagaacccgcagata

SEQ ID NO: 351665 - DNA, 20 bp, Artificial Sequence
  chemically synthesized
atttgcagatacagaacccg

SEQ ID NO: 351666 - DNA, 20 bp, Artificial Sequence
  chemically synthesized
gttatttgaatttgcagata

SEQ ID NO: 351667 - DNA, 20 bp, Artificial Sequence
  chemically synthesized
tcagaggttatttgaatttg

SEQ ID NO: 351668 - DNA, 20 bp, Artificial Sequence
  chemically synthesized
accctattgtatcaaatcag

SEQ ID NO: 351669 - DNA, 20 bp, Artificial Sequence
  chemically synthesized
caccctattgtatcaaatca

SEQ ID NO: 351670 - DNA, 20 bp, Artificial Sequence
  chemically synthesized
ttcaccctattgtatcaaat

SEQ ID NO: 351671 - DNA, 20 bp, Artificial Sequence
  chemically synthesized
taacctctgatttgatacaa

SEQ ID NO: 351672 - DNA, 20 bp, Artificial Sequence
  chemically synthesized
aacctctgatttgatacaat

SEQ ID NO: 351673 - DNA, 20 bp, Artificial Sequence
  chemically synthesized
acctctgatttgatacaata

SEQ ID NO: 351674 - DNA, 20 bp, Artificial Sequence
  chemically synthesized
ttgatacaatagggtgaata

SEQ ID NO: 351675 - DNA, 20 bp, Artificial Sequence
  chemically synthesized
gtgcatttgaaaataacttc

SEQ ID NO: 351676 - DNA, 20 bp, Artificial Sequence
  chemically synthesized
gcatttgaaaataacttcaa

SEQ ID NO: 351677 - DNA, 20 bp, Artificial Sequence
  chemically synthesized
ataaactaattacactcttg

SEQ ID NO: 351678 - DNA, 20 bp, Artificial Sequence
  chemically synthesized
aataacttcaagagtgtaat

SEQ ID NO: 351679 - DNA, 20 bp, Artificial Sequence
  chemically synthesized
tgtaattagtttataactca

SEQ ID NO: 351680 - DNA, 20 bp, Artificial Sequence
  chemically synthesized
gtaattagtttataactcaa

SEQ ID NO: 351681 - DNA, 20 bp, Artificial Sequence
  chemically synthesized
acctcaagcatttatccttt

SEQ ID NO: 351682 - DNA, 20 bp, Artificial Sequence
  chemically synthesized
aactcaaaggataaatgctt

SEQ ID NO: 351683 - DNA, 20 bp, Artificial Sequence
  chemically synthesized
actcaaaggataaatgcttg

SEQ ID NO: 351684 - DNA, 20 bp, Artificial Sequence
  chemically synthesized
tgagaatagcatgtcacctc

SEQ ID NO: 351685 - DNA, 20 bp, Artificial Sequence
  chemically synthesized
gaataagcacgtcatgagaa

SEQ ID NO: 351686 - DNA, 20 bp, Artificial Sequence
  chemically synthesized
atatggaataagcacgtcat

SEQ ID NO: 351687 - DNA, 20 bp, Artificial Sequence
  chemically synthesized
agaggcatacaatatggaat

SEQ ID NO: 351688 - DNA, 20 bp, Artificial Sequence
  chemically synthesized
tttgatagaggcatacaata

SEQ ID NO: 351689 - DNA, 20 bp, Artificial Sequence
  chemically synthesized
tacgtgagatgttttgatag

SEQ ID NO: 351690 - DNA, 20 bp, Artificial Sequence
  chemically synthesized
gtacgtgagatgttttgata

SEQ ID NO: 351691 - DNA, 20 bp, Artificial Sequence
  chemically synthesized
tggtacgtgagatgttttga

SEQ ID NO: 351692 - DNA, 20 bp, Artificial Sequence
  chemically synthesized
tgtatatatatatggtacgt

SEQ ID NO: 351693 - DNA, 20 bp, Artificial Sequence
  chemically synthesized
cgtgtgtgtgtatatatata

SEQ ID NO: 351694 - DNA, 20 bp, Artificial Sequence
  chemically synthesized
ataatttttgtgggtacatg

SEQ ID NO: 351695 - DNA, 20 bp, Artificial Sequence
  chemically synthesized
tataatttttgtgggtacat

SEQ ID NO: 351696 - DNA, 20 bp, Artificial Sequence
  chemically synthesized
atataatttttgtgggtaca

SEQ ID NO: 351697 - DNA, 20 bp, Artificial Sequence
  chemically synthesized
tgtgtgtatataatttttgt

SEQ ID NO: 351698 - DNA, 20 bp, Artificial Sequence
  chemically synthesized
gtgtgtgtatataatttttg

SEQ ID NO: 351699 - DNA, 20 bp, Artificial Sequence
  chemically synthesized
cacacatatatatacctata

SEQ ID NO: 351700 - DNA, 20 bp, Artificial Sequence
  chemically synthesized
tatatatacacacaccatat

SEQ ID NO: 351701 - DNA, 20 bp, Artificial Sequence
  chemically synthesized
gtatatatacacacaccata

SEQ ID NO: 351702 - DNA, 20 bp, Artificial Sequence
  chemically synthesized
cacacgtatatatacatata

SEQ ID NO: 351703 - DNA, 20 bp, Artificial Sequence
  chemically synthesized
tacacacacatatacatata

SEQ ID NO: 351704 - DNA, 20 bp, Artificial Sequence
  chemically synthesized
tacacacacatatacatata

SEQ ID NO: 351705 - DNA, 20 bp, Artificial Sequence
  chemically synthesized
tacatatatgtatatacata

SEQ ID NO: 351706 - DNA, 20 bp, Artificial Sequence
  chemically synthesized
atatatatataccatatata

SEQ ID NO: 351707 - DNA, 20 bp, Artificial Sequence
  chemically synthesized
atgccatatatctatatata

SEQ ID NO: 351708 - DNA, 20 bp, Artificial Sequence
  chemically synthesized
ataccatatatatagatata

SEQ ID NO: 351709 - DNA, 20 bp, Artificial Sequence
  chemically synthesized
tgtgtatatgtatacatata

SEQ ID NO: 351710 - DNA, 20 bp, Artificial Sequence
  chemically synthesized
tatacgtatatacacatata

SEQ ID NO: 351711 - DNA, 20 bp, Artificial Sequence
  chemically synthesized
tacatatatgtgtgtatata

SEQ ID NO: 351712 - DNA, 20 bp, Artificial Sequence
  chemically synthesized
cacatatatgtacacatata

SEQ ID NO: 351713 - DNA, 20 bp, Artificial Sequence
  chemically synthesized
cacatatatatacacatata

SEQ ID NO: 351714 - DNA, 20 bp, Artificial Sequence
  chemically synthesized
ggggtgtgtgtgtatatata

SEQ ID NO: 351715 - DNA, 20 bp, Artificial Sequence
  chemically synthesized
tatatatacacacacacccc

SEQ ID NO: 351716 - DNA, 20 bp, Artificial Sequence
  chemically synthesized
tttttgtgggtacatactag

SEQ ID NO: 351717 - DNA, 20 bp, Artificial Sequence
  chemically synthesized
atttttgtgggtacatacta

SEQ ID NO: 351718 - DNA, 20 bp, Artificial Sequence
  chemically synthesized
aatttttgtgggtacatact

SEQ ID NO: 351719 - DNA, 20 bp, Artificial Sequence
  chemically synthesized
aaatttttgtgggtacatac

SEQ ID NO: 351720 - DNA, 20 bp, Artificial Sequence
  chemically synthesized
ttttttttggaaatttttgt

SEQ ID NO: 351721 - DNA, 20 bp, Artificial Sequence
  chemically synthesized
attttttttggaaatttttg

SEQ ID NO: 351722 - DNA, 20 bp, Artificial Sequence
  chemically synthesized
gggaaacaatttattttttt

SEQ ID NO: 351723 - DNA, 20 bp, Artificial Sequence
  chemically synthesized
tcctgaatatttttttattt

SEQ ID NO: 351724 - DNA, 20 bp, Artificial Sequence
  chemically synthesized
ttcctgaatatttttttatt

SEQ ID NO: 351725 - DNA, 20 bp, Artificial Sequence
  chemically synthesized
ttcccaaataaaaaaatatt

SEQ ID NO: 351726 - DNA, 20 bp, Artificial Sequence
  chemically synthesized
tcccaaataaaaaaatattc

SEQ ID NO: 351727 - DNA, 20 bp, Artificial Sequence
  chemically synthesized
ggaaatacaataaaaattaa

SEQ ID NO: 351728 - DNA, 20 bp, Artificial Sequence
  chemically synthesized
gaaatacaataaaaattaac

SEQ ID NO: 351729 - DNA, 20 bp, Artificial Sequence
  chemically synthesized
tacaataaaaattaacagga

SEQ ID NO: 351730 - DNA, 20 bp, Artificial Sequence
  chemically synthesized
caggatagaaatctccctgt

SEQ ID NO: 351731 - DNA, 20 bp, Artificial Sequence
  chemically synthesized
aggatagaaatctccctgtt

SEQ ID NO: 351732 - DNA, 20 bp, Artificial Sequence
  chemically synthesized
taagcatagtacccaacagg

SEQ ID NO: 351733 - DNA, 20 bp, Artificial Sequence
  chemically synthesized
aataagcatagtacccaaca

SEQ ID NO: 351734 - DNA, 20 bp, Artificial Sequence
  chemically synthesized
taataagcatagtacccaac

SEQ ID NO: 351735 - DNA, 20 bp, Artificial Sequence
  chemically synthesized
gtaataagcatagtacccaa

SEQ ID NO: 351736 - DNA, 20 bp, Artificial Sequence
  chemically synthesized
tgtcacccaggtaataagca

SEQ ID NO: 351737 - DNA, 20 bp, Artificial Sequence
  chemically synthesized
tgggtactatgcttattacc

SEQ ID NO: 351738 - DNA, 20 bp, Artificial Sequence
  chemically synthesized
gggtactatgcttattacct

SEQ ID NO: 351739 - DNA, 20 bp, Artificial Sequence
  chemically synthesized
tactttgtcacccaggtaat

SEQ ID NO: 351740 - DNA, 20 bp, Artificial Sequence
  chemically synthesized
tacagattactttgtcaccc

SEQ ID NO: 351741 - DNA, 20 bp, Artificial Sequence
  chemically synthesized
tgcttattacctgggtgaca

SEQ ID NO: 351742 - DNA, 20 bp, Artificial Sequence
  chemically synthesized
gtacagattactttgtcacc

SEQ ID NO: 351743 - DNA, 20 bp, Artificial Sequence
  chemically synthesized
gtgacaaagtaatctgtact

SEQ ID NO: 351744 - DNA, 20 bp, Artificial Sequence
  chemically synthesized
gacaaagtaatctgtactca

SEQ ID NO: 351745 - DNA, 20 bp, Artificial Sequence
  chemically synthesized
tgttacaggggctctgagta

SEQ ID NO: 351746 - DNA, 20 bp, Artificial Sequence
  chemically synthesized
ttatgtgttacaggggctct

SEQ ID NO: 351747 - DNA, 20 bp, Artificial Sequence
  chemically synthesized
agataaattatgtgttacag

SEQ ID NO: 351748 - DNA, 20 bp, Artificial Sequence
  chemically synthesized
tagataaattatgtgttaca

SEQ ID NO: 351749 - DNA, 20 bp, Artificial Sequence
  chemically synthesized
atagataaattatgtgttac

SEQ ID NO: 351750 - DNA, 20 bp, Artificial Sequence
  chemically synthesized
tatagataaattatgtgtta

SEQ ID NO: 351751 - DNA, 20 bp, Artificial Sequence
  chemically synthesized
acacatgcatttttgttata

SEQ ID NO: 351752 - DNA, 20 bp, Artificial Sequence
  chemically synthesized
tgcatgtgtaaccctgaacc

SEQ ID NO: 351753 - DNA, 20 bp, Artificial Sequence
  chemically synthesized
gtgtttaatttctaggttca

SEQ ID NO: 351754 - DNA, 20 bp, Artificial Sequence
  chemically synthesized
tgtgtttaatttctaggttc

SEQ ID NO: 351755 - DNA, 20 bp, Artificial Sequence
  chemically synthesized
ttgtgtttaatttctaggtt

SEQ ID NO: 351756 - DNA, 20 bp, Artificial Sequence
  chemically synthesized
attctttgtgtttaatttct

SEQ ID NO: 351757 - DNA, 20 bp, Artificial Sequence
  chemically synthesized
tattctttgtgtttaatttc

SEQ ID NO: 351758 - DNA, 20 bp, Artificial Sequence
  chemically synthesized
gaacctagaaattaaacaca

SEQ ID NO: 351759 - DNA, 20 bp, Artificial Sequence
  chemically synthesized
caatataaatagtacgtaaa

SEQ ID NO: 351760 - DNA, 20 bp, Artificial Sequence
  chemically synthesized
aatacctaatacaatataaa

SEQ ID NO: 351761 - DNA, 20 bp, Artificial Sequence
  chemically synthesized
acgtactatttatattgtat

SEQ ID NO: 351762 - DNA, 20 bp, Artificial Sequence
  chemically synthesized
cgtactatttatattgtatt

SEQ ID NO: 351763 - DNA, 20 bp, Artificial Sequence
  chemically synthesized
tatattgtattaggtattat

SEQ ID NO: 351764 - DNA, 20 bp, Artificial Sequence
  chemically synthesized
attaggtattataagtaatc

SEQ ID NO: 351765 - DNA, 20 bp, Artificial Sequence
  chemically synthesized
taggtattataagtaatcta

SEQ ID NO: 351766 - DNA, 20 bp, Artificial Sequence
  chemically synthesized
tgtttacattaaattatctc

SEQ ID NO: 351767 - DNA, 20 bp, Artificial Sequence
  chemically synthesized
tagagataatttaatgtaaa

SEQ ID NO: 351768 - DNA, 20 bp, Artificial Sequence
  chemically synthesized
agagataatttaatgtaaac

SEQ ID NO: 351769 - DNA, 20 bp, Artificial Sequence
  chemically synthesized
agataatttaatgtaaacag

SEQ ID NO: 351770 - DNA, 20 bp, Artificial Sequence
  chemically synthesized
gataatttaatgtaaacagg

SEQ ID NO: 351771 - DNA, 20 bp, Artificial Sequence
  chemically synthesized
tgtaaacaggaggatgtgca

SEQ ID NO: 351772 - DNA, 20 bp, Artificial Sequence
  chemically synthesized
gtaaacaggaggatgtgcat

SEQ ID NO: 351773 - DNA, 20 bp, Artificial Sequence
  chemically synthesized
aaatatgacatcatttatat

SEQ ID NO: 351774 - DNA, 20 bp, Artificial Sequence
  chemically synthesized
aatatgacatcatttatata

SEQ ID NO: 351775 - DNA, 20 bp, Artificial Sequence
  chemically synthesized
atcatttatataaggaactt

SEQ ID NO: 351776 - DNA, 20 bp, Artificial Sequence
  chemically synthesized
actaaaatctgtggatgctt

SEQ ID NO: 351777 - DNA, 20 bp, Artificial Sequence
  chemically synthesized
ataaggaacttaagcatcca

SEQ ID NO: 351778 - DNA, 20 bp, Artificial Sequence
  chemically synthesized
acttaagcatccacagattt

SEQ ID NO: 351779 - DNA, 20 bp, Artificial Sequence
  chemically synthesized
actccagatactaaaatctg

SEQ ID NO: 351780 - DNA, 20 bp, Artificial Sequence
  chemically synthesized
catccacagattttagtatc

SEQ ID NO: 351781 - DNA, 20 bp, Artificial Sequence
  chemically synthesized
tccacagattttagtatctg

SEQ ID NO: 351782 - DNA, 20 bp, Artificial Sequence
  chemically synthesized
attttagtatctggagttcc

SEQ ID NO: 351783 - DNA, 20 bp, Artificial Sequence
  chemically synthesized
agaactggttctaggaactc

SEQ ID NO: 351784 - DNA, 20 bp, Artificial Sequence
  chemically synthesized
gtatctggagttcctagaac

SEQ ID NO: 351785 - DNA, 20 bp, Artificial Sequence
  chemically synthesized
actatctgagaactggttct

SEQ ID NO: 351786 - DNA, 20 bp, Artificial Sequence
  chemically synthesized
cactatctgagaactggttc

SEQ ID NO: 351787 - DNA, 20 bp, Artificial Sequence
  chemically synthesized
gagttcctagaaccagttct

SEQ ID NO: 351788 - DNA, 20 bp, Artificial Sequence
  chemically synthesized
gtgcctcactatctgagaac

SEQ ID NO: 351789 - DNA, 20 bp, Artificial Sequence
  chemically synthesized
tcctagaaccagttctcaga

SEQ ID NO: 351790 - DNA, 20 bp, Artificial Sequence
  chemically synthesized
agaaccagttctcagatagt

SEQ ID NO: 351791 - DNA, 20 bp, Artificial Sequence
  chemically synthesized
acgactgtgcctcactatct

SEQ ID NO: 351792 - DNA, 20 bp, Artificial Sequence
  chemically synthesized
gaaccagttctcagatagtg

SEQ ID NO: 351793 - DNA, 20 bp, Artificial Sequence
  chemically synthesized
agttctcagatagtgaggca

SEQ ID NO: 351794 - DNA, 20 bp, Artificial Sequence
  chemically synthesized
gaggcacagtcgtattctta

SEQ ID NO: 351795 - DNA, 20 bp, Artificial Sequence
  chemically synthesized
tgccttatagattatacttt

SEQ ID NO: 351796 - DNA, 20 bp, Artificial Sequence
  chemically synthesized
attcttaaagtataatctat

SEQ ID NO: 351797 - DNA, 20 bp, Artificial Sequence
  chemically synthesized
ttcttaaagtataatctata

SEQ ID NO: 351798 - DNA, 20 bp, Artificial Sequence
  chemically synthesized
tttcaatccatgatgcctta

SEQ ID NO: 351799 - DNA, 20 bp, Artificial Sequence
  chemically synthesized
gtataatctataaggcatca

SEQ ID NO: 351800 - DNA, 20 bp, Artificial Sequence
  chemically synthesized
taaggcatcatggattgaaa

SEQ ID NO: 351801 - DNA, 20 bp, Artificial Sequence
  chemically synthesized
gtatgaaaaaagtgaagtat

SEQ ID NO: 351802 - DNA, 20 bp, Artificial Sequence
  chemically synthesized
ctttaagtatgaaaaaagtg

SEQ ID NO: 351803 - DNA, 20 bp, Artificial Sequence
  chemically synthesized
agcagctttaagtatgaaaa

SEQ ID NO: 351804 - DNA, 20 bp, Artificial Sequence
  chemically synthesized
cttcacttttttcatactta

SEQ ID NO: 351805 - DNA, 20 bp, Artificial Sequence
  chemically synthesized
ttggtcatttaagcagcttt

SEQ ID NO: 351806 - DNA, 20 bp, Artificial Sequence
  chemically synthesized
ttttaagttggtcatttaag

SEQ ID NO: 351807 - DNA, 20 bp, Artificial Sequence
  chemically synthesized
atcttttaagttggtcattt

SEQ ID NO: 351808 - DNA, 20 bp, Artificial Sequence
  chemically synthesized
tgcttaaatgaccaacttaa

SEQ ID NO: 351809 - DNA, 20 bp, Artificial Sequence
  chemically synthesized
aataaatctatcttttaagt

SEQ ID NO: 351810 - DNA, 20 bp, Artificial Sequence
  chemically synthesized
taaatgaccaacttaaaaga

SEQ ID NO: 351811 - DNA, 20 bp, Artificial Sequence
  chemically synthesized
taataataaatctatctttt

SEQ ID NO: 351812 - DNA, 20 bp, Artificial Sequence
  chemically synthesized
aaaagatagatttattatta

SEQ ID NO: 351813 - DNA, 20 bp, Artificial Sequence
  chemically synthesized
aagatagatttattattaca

SEQ ID NO: 351814 - DNA, 20 bp, Artificial Sequence
  chemically synthesized
ttacagagatttcccgatcc

SEQ ID NO: 351815 - DNA, 20 bp, Artificial Sequence
  chemically synthesized
tgacattaatagcttggatc

SEQ ID NO: 351816 - DNA, 20 bp, Artificial Sequence
  chemically synthesized
ctgacattaatagcttggat

SEQ ID NO: 351817 - DNA, 20 bp, Artificial Sequence
  chemically synthesized
ctgcactgacattaatagct

SEQ ID NO: 351818 - DNA, 20 bp, Artificial Sequence
  chemically synthesized
ccgatccaagctattaatgt

SEQ ID NO: 351819 - DNA, 20 bp, Artificial Sequence
  chemically synthesized
catgtctgcactgacattaa

SEQ ID NO: 351820 - DNA, 20 bp, Artificial Sequence
  chemically synthesized
ccaagctattaatgtcagtg

SEQ ID NO: 351821 - DNA, 20 bp, Artificial Sequence
  chemically synthesized
tattaatgtcagtgcagaca

SEQ ID NO: 351822 - DNA, 20 bp, Artificial Sequence
  chemically synthesized
gtgcagacatggttgattca

SEQ ID NO: 351823 - DNA, 20 bp, Artificial Sequence
  chemically synthesized
gcagacatggttgattcatg

SEQ ID NO: 351824 - DNA, 20 bp, Artificial Sequence
  chemically synthesized
gacatggttgattcatggag

SEQ ID NO: 351825 - DNA, 20 bp, Artificial Sequence
  chemically synthesized
acatggttgattcatggagc

SEQ ID NO: 351826 - DNA, 20 bp, Artificial Sequence
  chemically synthesized
catggttgattcatggagcg

SEQ ID NO: 351827 - DNA, 20 bp, Artificial Sequence
  chemically synthesized
atggttgattcatggagcgg

SEQ ID NO: 351828 - DNA, 20 bp, Artificial Sequence
  chemically synthesized
gttgattcatggagcggggg

SEQ ID NO: 351829 - DNA, 20 bp, Artificial Sequence
  chemically synthesized
ttgattcatggagcgggggt

SEQ ID NO: 351830 - DNA, 20 bp, Artificial Sequence
  chemically synthesized
tgattcatggagcgggggtg

SEQ ID NO: 351831 - DNA, 20 bp, Artificial Sequence
  chemically synthesized
gattcatggagcgggggtgg

SEQ ID NO: 351832 - DNA, 20 bp, Artificial Sequence
  chemically synthesized
attcatggagcgggggtggg

SEQ ID NO: 351833 - DNA, 20 bp, Artificial Sequence
  chemically synthesized
ttcatggagcgggggtgggg

SEQ ID NO: 351834 - DNA, 20 bp, Artificial Sequence
  chemically synthesized
tcatggagcgggggtggggg

SEQ ID NO: 351835 - DNA, 20 bp, Artificial Sequence
  chemically synthesized
catggagcgggggtgggggg

SEQ ID NO: 351836 - DNA, 20 bp, Artificial Sequence
  chemically synthesized
gggggggggaaatacacacc

SEQ ID NO: 351837 - DNA, 20 bp, Artificial Sequence
  chemically synthesized
taaacacacagatgagttcc

SEQ ID NO: 351838 - DNA, 20 bp, Artificial Sequence
  chemically synthesized
ctaaacacacagatgagttc

SEQ ID NO: 351839 - DNA, 20 bp, Artificial Sequence
  chemically synthesized
tgtcctctaaacacacagat

SEQ ID NO: 351840 - DNA, 20 bp, Artificial Sequence
  chemically synthesized
ctggaactcatctgtgtgtt

SEQ ID NO: 351841 - DNA, 20 bp, Artificial Sequence
  chemically synthesized
taatttgtcctctaaacaca

SEQ ID NO: 351842 - DNA, 20 bp, Artificial Sequence
  chemically synthesized
ggaactcatctgtgtgttta

SEQ ID NO: 351843 - DNA, 20 bp, Artificial Sequence
  chemically synthesized
gaactcatctgtgtgtttag

SEQ ID NO: 351844 - DNA, 20 bp, Artificial Sequence
  chemically synthesized
caaattaaatcatttttaaa

SEQ ID NO: 351845 - DNA, 20 bp, Artificial Sequence
  chemically synthesized
aaatcatttttaaatagccc

SEQ ID NO: 351846 - DNA, 20 bp, Artificial Sequence
  chemically synthesized
aatcatttttaaatagcccc

SEQ ID NO: 351847 - DNA, 20 bp, Artificial Sequence
  chemically synthesized
taatggctgagatcatcctg

SEQ ID NO: 351848 - DNA, 20 bp, Artificial Sequence
  chemically synthesized
ttaatggctgagatcatcct

SEQ ID NO: 351849 - DNA, 20 bp, Artificial Sequence
  chemically synthesized
tttaatggctgagatcatcc

SEQ ID NO: 351850 - DNA, 20 bp, Artificial Sequence
  chemically synthesized
aaatagccccaggatgatct

SEQ ID NO: 351851 - DNA, 20 bp, Artificial Sequence
  chemically synthesized
ccttctgctctttaatggct

SEQ ID NO: 351852 - DNA, 20 bp, Artificial Sequence
  chemically synthesized
caggatgatctcagccatta

SEQ ID NO: 351853 - DNA, 20 bp, Artificial Sequence
  chemically synthesized
ggatgatctcagccattaaa

SEQ ID NO: 351854 - DNA, 20 bp, Artificial Sequence
  chemically synthesized
attagccttctgctctttaa

SEQ ID NO: 351855 - DNA, 20 bp, Artificial Sequence
  chemically synthesized
tgatctcagccattaaagag

SEQ ID NO: 351856 - DNA, 20 bp, Artificial Sequence
  chemically synthesized
tctcagccattaaagagcag

SEQ ID NO: 351857 - DNA, 20 bp, Artificial Sequence
  chemically synthesized
ctcagccattaaagagcaga

SEQ ID NO: 351858 - DNA, 20 bp, Artificial Sequence
  chemically synthesized
aataggaacagttgttttat

SEQ ID NO: 351859 - DNA, 20 bp, Artificial Sequence
  chemically synthesized
agaaaacgatttaataggaa

SEQ ID NO: 351860 - DNA, 20 bp, Artificial Sequence
  chemically synthesized
aactcagaaaacgatttaat

SEQ ID NO: 351861 - DNA, 20 bp, Artificial Sequence
  chemically synthesized
aaactcagaaaacgatttaa

SEQ ID NO: 351862 - DNA, 20 bp, Artificial Sequence
  chemically synthesized
ttcctattaaatcgttttct

SEQ ID NO: 351863 - DNA, 20 bp, Artificial Sequence
  chemically synthesized
ggacatctacttataaaact

SEQ ID NO: 351864 - DNA, 20 bp, Artificial Sequence
  chemically synthesized
aatcgttttctgagttttat

SEQ ID NO: 351865 - DNA, 20 bp, Artificial Sequence
  chemically synthesized
cgttttctgagttttataag

SEQ ID NO: 351866 - DNA, 20 bp, Artificial Sequence
  chemically synthesized
gccaataaaatacataaggg

SEQ ID NO: 351867 - DNA, 20 bp, Artificial Sequence
  chemically synthesized
tgccaataaaatacataagg

SEQ ID NO: 351868 - DNA, 20 bp, Artificial Sequence
  chemically synthesized
attgccaataaaatacataa

SEQ ID NO: 351869 - DNA, 20 bp, Artificial Sequence
  chemically synthesized
tattgccaataaaatacata

SEQ ID NO: 351870 - DNA, 20 bp, Artificial Sequence
  chemically synthesized
atattgccaataaaatacat

SEQ ID NO: 351871 - DNA, 20 bp, Artificial Sequence
  chemically synthesized
tcctcccttatgtattttat

SEQ ID NO: 351872 - DNA, 20 bp, Artificial Sequence
  chemically synthesized
ggcaatatatgttaccttta

SEQ ID NO: 351873 - DNA, 20 bp, Artificial Sequence
  chemically synthesized
caatatatgttacctttata

SEQ ID NO: 351874 - DNA, 20 bp, Artificial Sequence
  chemically synthesized
gaaacgctgcttctctataa

SEQ ID NO: 351875 - DNA, 20 bp, Artificial Sequence
  chemically synthesized
tatatgttacctttatagag

SEQ ID NO: 351876 - DNA, 20 bp, Artificial Sequence
  chemically synthesized
agaaacgctgcttctctata

SEQ ID NO: 351877 - DNA, 20 bp, Artificial Sequence
  chemically synthesized
atgttacctttatagagaag

SEQ ID NO: 351878 - DNA, 20 bp, Artificial Sequence
  chemically synthesized
atagagaagcagcgtttcta

SEQ ID NO: 351879 - DNA, 20 bp, Artificial Sequence
  chemically synthesized
cttaacctttttgagagcta

SEQ ID NO: 351880 - DNA, 20 bp, Artificial Sequence
  chemically synthesized
gcgtttctatagctctcaaa

SEQ ID NO: 351881 - DNA, 20 bp, Artificial Sequence
  chemically synthesized
cgtttctatagctctcaaaa

SEQ ID NO: 351882 - DNA, 20 bp, Artificial Sequence
  chemically synthesized
cgggttcttaacctttttga

SEQ ID NO: 351883 - DNA, 20 bp, Artificial Sequence
  chemically synthesized
ctcgggttcttaaccttttt

SEQ ID NO: 351884 - DNA, 20 bp, Artificial Sequence
  chemically synthesized
ctatagctctcaaaaaggtt

SEQ ID NO: 351885 - DNA, 20 bp, Artificial Sequence
  chemically synthesized
ctcaaaaaggttaagaaccc

SEQ ID NO: 351886 - DNA, 20 bp, Artificial Sequence
  chemically synthesized
tcaaaaaggttaagaacccg

SEQ ID NO: 351887 - DNA, 20 bp, Artificial Sequence
  chemically synthesized
attggcctataatacacctc

SEQ ID NO: 351888 - DNA, 20 bp, Artificial Sequence
  chemically synthesized
aattggcctataatacacct

SEQ ID NO: 351889 - DNA, 20 bp, Artificial Sequence
  chemically synthesized
taagaacccgaggtgtatta

SEQ ID NO: 351890 - DNA, 20 bp, Artificial Sequence
  chemically synthesized
aagaacccgaggtgtattat

SEQ ID NO: 351891 - DNA, 20 bp, Artificial Sequence
  chemically synthesized
tcaacatttacaagagaaat

SEQ ID NO: 351892 - DNA, 20 bp, Artificial Sequence
  chemically synthesized
ttttaagtcaacatttacaa

SEQ ID NO: 351893 - DNA, 20 bp, Artificial Sequence
  chemically synthesized
tattttaagtcaacatttac

SEQ ID NO: 351894 - DNA, 20 bp, Artificial Sequence
  chemically synthesized
ttgtaaatgttgacttaaaa

SEQ ID NO: 351895 - DNA, 20 bp, Artificial Sequence
  chemically synthesized
aatgctctttaaactatttt

SEQ ID NO: 351896 - DNA, 20 bp, Artificial Sequence
  chemically synthesized
tgttgacttaaaatagttta

SEQ ID NO: 351897 - DNA, 20 bp, Artificial Sequence
  chemically synthesized
ttgacttaaaatagtttaaa

SEQ ID NO: 351898 - DNA, 20 bp, Artificial Sequence
  chemically synthesized
taaagagcattttctcatgt

SEQ ID NO: 351899 - DNA, 20 bp, Artificial Sequence
  chemically synthesized
aagagcattttctcatgttg

SEQ ID NO: 351900 - DNA, 20 bp, Artificial Sequence
  chemically synthesized
agagcattttctcatgttgg

SEQ ID NO: 351901 - DNA, 20 bp, Artificial Sequence
  chemically synthesized
caattaatcacctccaacat

SEQ ID NO: 351902 - DNA, 20 bp, Artificial Sequence
  chemically synthesized
tggaggtgattaattgcact

SEQ ID NO: 351903 - DNA, 20 bp, Artificial Sequence
  chemically synthesized
ggatttttacaagtgaaact

SEQ ID NO: 351904 - DNA, 20 bp, Artificial Sequence
  chemically synthesized
tttgagcaatggatttttac

SEQ ID NO: 351905 - DNA, 20 bp, Artificial Sequence
  chemically synthesized
ccatccttaggtttgagcaa

SEQ ID NO: 351906 - DNA, 20 bp, Artificial Sequence
  chemically synthesized
aaaatccattgctcaaacct

SEQ ID NO: 351907 - DNA, 20 bp, Artificial Sequence
  chemically synthesized
aaatccattgctcaaaccta

SEQ ID NO: 351908 - DNA, 20 bp, Artificial Sequence
  chemically synthesized
cccccaccatccttaggttt

SEQ ID NO: 351909 - DNA, 20 bp, Artificial Sequence
  chemically synthesized
ccattgctcaaacctaagga

SEQ ID NO: 351910 - DNA, 20 bp, Artificial Sequence
  chemically synthesized
ggtgtccccccaccatcctt

SEQ ID NO: 351911 - DNA, 20 bp, Artificial Sequence
  chemically synthesized
ttgctcaaacctaaggatgg

SEQ ID NO: 351912 - DNA, 20 bp, Artificial Sequence
  chemically synthesized
gggtgtccccccaccatcct

SEQ ID NO: 351913 - DNA, 20 bp, Artificial Sequence
  chemically synthesized
tgctcaaacctaaggatggt

SEQ ID NO: 351914 - DNA, 20 bp, Artificial Sequence
  chemically synthesized
gctcaaacctaaggatggtg

SEQ ID NO: 351915 - DNA, 20 bp, Artificial Sequence
  chemically synthesized
ctcaaacctaaggatggtgg

SEQ ID NO: 351916 - DNA, 20 bp, Artificial Sequence
  chemically synthesized
tcaaacctaaggatggtggg

SEQ ID NO: 351917 - DNA, 20 bp, Artificial Sequence
  chemically synthesized
gtccacacgtttgcacagat

SEQ ID NO: 351918 - DNA, 20 bp, Artificial Sequence
  chemically synthesized
agtccacacgtttgcacaga

SEQ ID NO: 351919 - DNA, 20 bp, Artificial Sequence
  chemically synthesized
tgtaagtccacacgtttgca

SEQ ID NO: 351920 - DNA, 20 bp, Artificial Sequence
  chemically synthesized
cacccatctgtgcaaacgtg

SEQ ID NO: 351921 - DNA, 20 bp, Artificial Sequence
  chemically synthesized
acataagcaaaagtcattgt

SEQ ID NO: 351922 - DNA, 20 bp, Artificial Sequence
  chemically synthesized
acctgagctaacataagcaa

SEQ ID NO: 351923 - DNA, 20 bp, Artificial Sequence
  chemically synthesized
acaatgacttttgcttatgt

SEQ ID NO: 351924 - DNA, 20 bp, Artificial Sequence
  chemically synthesized
actgacacctgagctaacat

SEQ ID NO: 351925 - DNA, 20 bp, Artificial Sequence
  chemically synthesized
gacttttgcttatgttagct

SEQ ID NO: 351926 - DNA, 20 bp, Artificial Sequence
  chemically synthesized
acttttgcttatgttagctc

SEQ ID NO: 351927 - DNA, 20 bp, Artificial Sequence
  chemically synthesized
gcttatgttagctcaggtgt

SEQ ID NO: 351928 - DNA, 20 bp, Artificial Sequence
  chemically synthesized
gttcattagaactgacacct

SEQ ID NO: 351929 - DNA, 20 bp, Artificial Sequence
  chemically synthesized
tcttgttgaaagttgttcat

SEQ ID NO: 351930 - DNA, 20 bp, Artificial Sequence
  chemically synthesized
tctaatgaacaactttcaac

SEQ ID NO: 351931 - DNA, 20 bp, Artificial Sequence
  chemically synthesized
taatgaacaactttcaacaa

SEQ ID NO: 351932 - DNA, 20 bp, Artificial Sequence
  chemically synthesized
gatttattttctcttgttga

SEQ ID NO: 351933 - DNA, 20 bp, Artificial Sequence
  chemically synthesized
tcaacaagagaaaataaatc

SEQ ID NO: 351934 - DNA, 20 bp, Artificial Sequence
  chemically synthesized
tgatttctaataaaaagttc

SEQ ID NO: 351935 - DNA, 20 bp, Artificial Sequence
  chemically synthesized
ataaatccagaactttttat

SEQ ID NO: 351936 - DNA, 20 bp, Artificial Sequence
  chemically synthesized
catgtgtgatttctaataaa

SEQ ID NO: 351937 - DNA, 20 bp, Artificial Sequence
  chemically synthesized
tagaaatcacacatgttaaa

SEQ ID NO: 351938 - DNA, 20 bp, Artificial Sequence
  chemically synthesized
ccactattttgagtaaggtt

SEQ ID NO: 351939 - DNA, 20 bp, Artificial Sequence
  chemically synthesized
gtccaccactattttgagta

SEQ ID NO: 351940 - DNA, 20 bp, Artificial Sequence
  chemically synthesized
agtccaccactattttgagt

SEQ ID NO: 351941 - DNA, 20 bp, Artificial Sequence
  chemically synthesized
taactaaaccttactcaaaa

SEQ ID NO: 351942 - DNA, 20 bp, Artificial Sequence
  chemically synthesized
ctaaaccttactcaaaatag

SEQ ID NO: 351943 - DNA, 20 bp, Artificial Sequence
  chemically synthesized
ataaagtccaccactatttt

SEQ ID NO: 351944 - DNA, 20 bp, Artificial Sequence
  chemically synthesized
aaccttactcaaaatagtgg

SEQ ID NO: 351945 - DNA, 20 bp, Artificial Sequence
  chemically synthesized
aattgatttcttaagtgata

SEQ ID NO: 351946 - DNA, 20 bp, Artificial Sequence
  chemically synthesized
agtggtggactttatcactt

SEQ ID NO: 351947 - DNA, 20 bp, Artificial Sequence
  chemically synthesized
tggaagttaattgatttctt

SEQ ID NO: 351948 - DNA, 20 bp, Artificial Sequence
  chemically synthesized
taagaaatcaattaacttcc

SEQ ID NO: 351949 - DNA, 20 bp, Artificial Sequence
  chemically synthesized
aagaaatcaattaacttcca

SEQ ID NO: 351950 - DNA, 20 bp, Artificial Sequence
  chemically synthesized
ctttttctatagttccttgg

SEQ ID NO: 351951 - DNA, 20 bp, Artificial Sequence
  chemically synthesized
taactttttctatagttcct

SEQ ID NO: 351952 - DNA, 20 bp, Artificial Sequence
  chemically synthesized
aattaacttccaaggaacta

SEQ ID NO: 351953 - DNA, 20 bp, Artificial Sequence
  chemically synthesized
cttccaaggaactatagaaa

SEQ ID NO: 351954 - DNA, 20 bp, Artificial Sequence
  chemically synthesized
cgggaacctaactttttcta

SEQ ID NO: 351955 - DNA, 20 bp, Artificial Sequence
  chemically synthesized
caaggaactatagaaaaagt

SEQ ID NO: 351956 - DNA, 20 bp, Artificial Sequence
  chemically synthesized
aaggaactatagaaaaagtt

SEQ ID NO: 351957 - DNA, 20 bp, Artificial Sequence
  chemically synthesized
cgataagatgattttggagc

SEQ ID NO: 351958 - DNA, 20 bp, Artificial Sequence
  chemically synthesized
tcgataagatgattttggag

SEQ ID NO: 351959 - DNA, 20 bp, Artificial Sequence
  chemically synthesized
aaatcgataagatgattttg

SEQ ID NO: 351960 - DNA, 20 bp, Artificial Sequence
  chemically synthesized
ataaatcgataagatgattt

SEQ ID NO: 351961 - DNA, 20 bp, Artificial Sequence
  chemically synthesized
acataaatgcataaatcgat

SEQ ID NO: 351962 - DNA, 20 bp, Artificial Sequence
  chemically synthesized
gcttccctaattttattagt

SEQ ID NO: 351963 - DNA, 20 bp, Artificial Sequence
  chemically synthesized
ttatgtccaactaataaaat

SEQ ID NO: 351964 - DNA, 20 bp, Artificial Sequence
  chemically synthesized
ctctgcttccctaattttat

SEQ ID NO: 351965 - DNA, 20 bp, Artificial Sequence
  chemically synthesized
tatgtccaactaataaaatt

SEQ ID NO: 351966 - DNA, 20 bp, Artificial Sequence
  chemically synthesized
atgtccaactaataaaatta

SEQ ID NO: 351967 - DNA, 20 bp, Artificial Sequence
  chemically synthesized
tccaactaataaaattaggg

SEQ ID NO: 351968 - DNA, 20 bp, Artificial Sequence
  chemically synthesized
aactaataaaattagggaag

SEQ ID NO: 351969 - DNA, 20 bp, Artificial Sequence
  chemically synthesized
ctaataaaattagggaagca

SEQ ID NO: 351970 - DNA, 20 bp, Artificial Sequence
  chemically synthesized
taaaattagggaagcagagt

SEQ ID NO: 351971 - DNA, 20 bp, Artificial Sequence
  chemically synthesized
gcagagtaagaactactgta

SEQ ID NO: 351972 - DNA, 20 bp, Artificial Sequence
  chemically synthesized
aaatccacggatccatacag

SEQ ID NO: 351973 - DNA, 20 bp, Artificial Sequence
  chemically synthesized
ccaaaatccacggatccata

SEQ ID NO: 351974 - DNA, 20 bp, Artificial Sequence
  chemically synthesized
agaactactgtatggatccg

SEQ ID NO: 351975 - DNA, 20 bp, Artificial Sequence
  chemically synthesized
ctgtatggatccgtggattt

SEQ ID NO: 351976 - DNA, 20 bp, Artificial Sequence
  chemically synthesized
tttaaatataccaaaatcca

SEQ ID NO: 351977 - DNA, 20 bp, Artificial Sequence
  chemically synthesized
gtatatttaaaatcccatat

SEQ ID NO: 351978 - DNA, 20 bp, Artificial Sequence
  chemically synthesized
ctgcatcataattcttatat

SEQ ID NO: 351979 - DNA, 20 bp, Artificial Sequence
  chemically synthesized
gctgcatcataattcttata

SEQ ID NO: 351980 - DNA, 20 bp, Artificial Sequence
  chemically synthesized
cccatataagaattatgatg

SEQ ID NO: 351981 - DNA, 20 bp, Artificial Sequence
  chemically synthesized
atttatgtcaaatgaaaatg

SEQ ID NO: 351982 - DNA, 20 bp, Artificial Sequence
  chemically synthesized
ataaatatttgtacatttat

SEQ ID NO: 351983 - DNA, 20 bp, Artificial Sequence
  chemically synthesized
agaatattttttaaagtaca

SEQ ID NO: 351984 - DNA, 20 bp, Artificial Sequence
  chemically synthesized
agagaatattttttaaagta

SEQ ID NO: 351985 - DNA, 20 bp, Artificial Sequence
  chemically synthesized
aattcagagaatatttttta

SEQ ID NO: 351986 - DNA, 20 bp, Artificial Sequence
  chemically synthesized
ttaaaaaatattctctgaat

SEQ ID NO: 351987 - DNA, 20 bp, Artificial Sequence
  chemically synthesized
acagaatgtgaactaattca

SEQ ID NO: 351988 - DNA, 20 bp, Artificial Sequence
  chemically synthesized
agacagaatgtgaactaatt

SEQ ID NO: 351989 - DNA, 20 bp, Artificial Sequence
  chemically synthesized
taggtaactgttatataaga

SEQ ID NO: 351990 - DNA, 20 bp, Artificial Sequence
  chemically synthesized
tcacattctgtcttatataa

SEQ ID NO: 351991 - DNA, 20 bp, Artificial Sequence
  chemically synthesized
tatataggtaactgttatat

SEQ ID NO: 351992 - DNA, 20 bp, Artificial Sequence
  chemically synthesized
taggccaacaaacaatatat

SEQ ID NO: 351993 - DNA, 20 bp, Artificial Sequence
  chemically synthesized
ataggccaacaaacaatata

SEQ ID NO: 351994 - DNA, 20 bp, Artificial Sequence
  chemically synthesized
gttacctatatattgtttgt

SEQ ID NO: 351995 - DNA, 20 bp, Artificial Sequence
  chemically synthesized
aggtattgaaaattgcatat

SEQ ID NO: 351996 - DNA, 20 bp, Artificial Sequence
  chemically synthesized
aaggtattgaaaattgcata

SEQ ID NO: 351997 - DNA, 20 bp, Artificial Sequence
  chemically synthesized
atatgcaattttcaatacct

SEQ ID NO: 351998 - DNA, 20 bp, Artificial Sequence
  chemically synthesized
tgcaattttcaataccttgg

SEQ ID NO: 351999 - DNA, 20 bp, Artificial Sequence
  chemically synthesized
aaaagatatacagtctgcca

SEQ ID NO: 352000 - DNA, 20 bp, Artificial Sequence
  chemically synthesized
taaaagatatacagtctgcc

SEQ ID NO: 352001 - DNA, 20 bp, Artificial Sequence
  chemically synthesized
gtcaggaagtaaaagatata

SEQ ID NO: 352002 - DNA, 20 bp, Artificial Sequence
  chemically synthesized
ccaagtgtgtcaggaagtaa

SEQ ID NO: 352003 - DNA, 20 bp, Artificial Sequence
  chemically synthesized
tatactccaagtgtgtcagg

SEQ ID NO: 352004 - DNA, 20 bp, Artificial Sequence
  chemically synthesized
ctatatactccaagtgtgtc

SEQ ID NO: 352005 - DNA, 20 bp, Artificial Sequence
  chemically synthesized
cttttacttcctgacacact

SEQ ID NO: 352006 - DNA, 20 bp, Artificial Sequence
  chemically synthesized
gctatatactccaagtgtgt

SEQ ID NO: 352007 - DNA, 20 bp, Artificial Sequence
  chemically synthesized
tttacttcctgacacacttg

SEQ ID NO: 352008 - DNA, 20 bp, Artificial Sequence
  chemically synthesized
ggaatagtgctatatactcc

SEQ ID NO: 352009 - DNA, 20 bp, Artificial Sequence
  chemically synthesized
cctgacacacttggagtata

SEQ ID NO: 352010 - DNA, 20 bp, Artificial Sequence
  chemically synthesized
tgataactttacataaggaa

SEQ ID NO: 352011 - DNA, 20 bp, Artificial Sequence
  chemically synthesized
atagcactattccttatgta

SEQ ID NO: 352012 - DNA, 20 bp, Artificial Sequence
  chemically synthesized
tctattgataactttacata

SEQ ID NO: 352013 - DNA, 20 bp, Artificial Sequence
  chemically synthesized
gtctattgataactttacat

SEQ ID NO: 352014 - DNA, 20 bp, Artificial Sequence
  chemically synthesized
tccttatgtaaagttatcaa

SEQ ID NO: 352015 - DNA, 20 bp, Artificial Sequence
  chemically synthesized
acatgcatttctactgaaca

SEQ ID NO: 352016 - DNA, 20 bp, Artificial Sequence
  chemically synthesized
cccaggcttactttgttcag

SEQ ID NO: 352017 - DNA, 20 bp, Artificial Sequence
  chemically synthesized
tgccccaggcttactttgtt

SEQ ID NO: 352018 - DNA, 20 bp, Artificial Sequence
  chemically synthesized
gcatttctactgaacaaagt

SEQ ID NO: 352019 - DNA, 20 bp, Artificial Sequence
  chemically synthesized
tctactgaacaaagtaagcc

SEQ ID NO: 352020 - DNA, 20 bp, Artificial Sequence
  chemically synthesized
ctactgaacaaagtaagcct

SEQ ID NO: 352021 - DNA, 20 bp, Artificial Sequence
  chemically synthesized
tactgaacaaagtaagcctg

SEQ ID NO: 352022 - DNA, 20 bp, Artificial Sequence
  chemically synthesized
attttaaagttatgtgcccc

SEQ ID NO: 352023 - DNA, 20 bp, Artificial Sequence
  chemically synthesized
cattttaaagttatgtgccc

SEQ ID NO: 352024 - DNA, 20 bp, Artificial Sequence
  chemically synthesized
gatgctacataagcatttta

SEQ ID NO: 352025 - DNA, 20 bp, Artificial Sequence
  chemically synthesized
ataactttaaaatgcttatg

SEQ ID NO: 352026 - DNA, 20 bp, Artificial Sequence
  chemically synthesized
aattctttcagatgctacat

SEQ ID NO: 352027 - DNA, 20 bp, Artificial Sequence
  chemically synthesized
aatgcttatgtagcatctga

SEQ ID NO: 352028 - DNA, 20 bp, Artificial Sequence
  chemically synthesized
tctgacattgtaaattcttt

SEQ ID NO: 352029 - DNA, 20 bp, Artificial Sequence
  chemically synthesized
tctgaaagaatttacaatgt

SEQ ID NO: 352030 - DNA, 20 bp, Artificial Sequence
  chemically synthesized
agaatttacaatgtcagact

SEQ ID NO: 352031 - DNA, 20 bp, Artificial Sequence
  chemically synthesized
gagcccctactttttattct

SEQ ID NO: 352032 - DNA, 20 bp, Artificial Sequence
  chemically synthesized
aatgtcagactaagaataaa

SEQ ID NO: 352033 - DNA, 20 bp, Artificial Sequence
  chemically synthesized
gtcagactaagaataaaaag

SEQ ID NO: 352034 - DNA, 20 bp, Artificial Sequence
  chemically synthesized
tcagactaagaataaaaagt

SEQ ID NO: 352035 - DNA, 20 bp, Artificial Sequence
  chemically synthesized
cagactaagaataaaaagta

SEQ ID NO: 352036 - DNA, 20 bp, Artificial Sequence
  chemically synthesized
agactaagaataaaaagtag

SEQ ID NO: 352037 - DNA, 20 bp, Artificial Sequence
  chemically synthesized
agaataaaaagtaggggctc

SEQ ID NO: 352038 - DNA, 20 bp, Artificial Sequence
  chemically synthesized
ttaataaagtagaaattctg

SEQ ID NO: 352039 - DNA, 20 bp, Artificial Sequence
  chemically synthesized
cattaataaagtagaaattc

SEQ ID NO: 352040 - DNA, 20 bp, Artificial Sequence
  chemically synthesized
tgaccacatcattaataaag

SEQ ID NO: 352041 - DNA, 20 bp, Artificial Sequence
  chemically synthesized
atttgaccacatcattaata

SEQ ID NO: 352042 - DNA, 20 bp, Artificial Sequence
  chemically synthesized
tttctactttattaatgatg

SEQ ID NO: 352043 - DNA, 20 bp, Artificial Sequence
  chemically synthesized
atgtggtcaaatcaacccat

SEQ ID NO: 352044 - DNA, 20 bp, Artificial Sequence
  chemically synthesized
agactaagattttttccaat

SEQ ID NO: 352045 - DNA, 20 bp, Artificial Sequence
  chemically synthesized
tagactaagattttttccaa

SEQ ID NO: 352046 - DNA, 20 bp, Artificial Sequence
  chemically synthesized
caacccattggaaaaaatct

SEQ ID NO: 352047 - DNA, 20 bp, Artificial Sequence
  chemically synthesized
tgcaggtggctgagtagact

SEQ ID NO: 352048 - DNA, 20 bp, Artificial Sequence
  chemically synthesized
ggaaaaaatcttagtctact

SEQ ID NO: 352049 - DNA, 20 bp, Artificial Sequence
  chemically synthesized
catttgtgcaggtggctgag

SEQ ID NO: 352050 - DNA, 20 bp, Artificial Sequence
  chemically synthesized
gagcatttgtgcaggtggct

SEQ ID NO: 352051 - DNA, 20 bp, Artificial Sequence
  chemically synthesized
agcacgagcatttgtgcagg

SEQ ID NO: 352052 - DNA, 20 bp, Artificial Sequence
  chemically synthesized
tagagcacgagcatttgtgc

SEQ ID NO: 352053 - DNA, 20 bp, Artificial Sequence
  chemically synthesized
atagagcacgagcatttgtg

SEQ ID NO: 352054 - DNA, 20 bp, Artificial Sequence
  chemically synthesized
ttaatgcttttatagagcac

SEQ ID NO: 352055 - DNA, 20 bp, Artificial Sequence
  chemically synthesized
caaatgctcgtgctctataa

SEQ ID NO: 352056 - DNA, 20 bp, Artificial Sequence
  chemically synthesized
ttttttttaatgcttttata

SEQ ID NO: 352057 - DNA, 20 bp, Artificial Sequence
  chemically synthesized
ttttttttttaatgctttta

SEQ ID NO: 352058 - DNA, 20 bp, Artificial Sequence
  chemically synthesized
attaaaaaaaaaaaaccttt

SEQ ID NO: 352059 - DNA, 20 bp, Artificial Sequence
  chemically synthesized
aaaaaaaaaaccttttagac

SEQ ID NO: 352060 - DNA, 20 bp, Artificial Sequence
  chemically synthesized
tacatatagactagtctaaa

SEQ ID NO: 352061 - DNA, 20 bp, Artificial Sequence
  chemically synthesized
gtacatatagactagtctaa

SEQ ID NO: 352062 - DNA, 20 bp, Artificial Sequence
  chemically synthesized
tctgcagagtacatatagac

SEQ ID NO: 352063 - DNA, 20 bp, Artificial Sequence
  chemically synthesized
tttactctgcagagtacata

SEQ ID NO: 352064 - DNA, 20 bp, Artificial Sequence
  chemically synthesized
actagtctatatgtactctg

SEQ ID NO: 352065 - DNA, 20 bp, Artificial Sequence
  chemically synthesized
tagtctatatgtactctgca

SEQ ID NO: 352066 - DNA, 20 bp, Artificial Sequence
  chemically synthesized
aatgtgtcttttactctgca

SEQ ID NO: 352067 - DNA, 20 bp, Artificial Sequence
  chemically synthesized
ctaatgtgtcttttactctg

SEQ ID NO: 352068 - DNA, 20 bp, Artificial Sequence
  chemically synthesized
atatgtactctgcagagtaa

SEQ ID NO: 352069 - DNA, 20 bp, Artificial Sequence
  chemically synthesized
ctgcagagtaaaagacacat

SEQ ID NO: 352070 - DNA, 20 bp, Artificial Sequence
  chemically synthesized
agacacattagctaaaacaa

SEQ ID NO: 352071 - DNA, 20 bp, Artificial Sequence
  chemically synthesized
tattatgagcactattgttt

SEQ ID NO: 352072 - DNA, 20 bp, Artificial Sequence
  chemically synthesized
gccaaatacattaatattat

SEQ ID NO: 352073 - DNA, 20 bp, Artificial Sequence
  chemically synthesized
gctcataatattaatgtatt

SEQ ID NO: 352074 - DNA, 20 bp, Artificial Sequence
  chemically synthesized
ttaatgtatttggcttgtgt

SEQ ID NO: 352075 - DNA, 20 bp, Artificial Sequence
  chemically synthesized
ttaaatattgttacttacac

SEQ ID NO: 352076 - DNA, 20 bp, Artificial Sequence
  chemically synthesized
ttgtgtaagtaacaatattt

SEQ ID NO: 352077 - DNA, 20 bp, Artificial Sequence
  chemically synthesized
taaaattagaattattgtca

SEQ ID NO: 352078 - DNA, 20 bp, Artificial Sequence
  chemically synthesized
tttaaaattagaattattgt

SEQ ID NO: 352079 - DNA, 20 bp, Artificial Sequence
  chemically synthesized
ggaatgaaaatgtttaaaat

SEQ ID NO: 352080 - DNA, 20 bp, Artificial Sequence
  chemically synthesized
aacattttcattccatctgc

SEQ ID NO: 352081 - DNA, 20 bp, Artificial Sequence
  chemically synthesized
tcaaactttaatcttgcaga

SEQ ID NO: 352082 - DNA, 20 bp, Artificial Sequence
  chemically synthesized
taattcaaactttaatcttg

SEQ ID NO: 352083 - DNA, 20 bp, Artificial Sequence
  chemically synthesized
tcattccatctgcaagatta

SEQ ID NO: 352084 - DNA, 20 bp, Artificial Sequence
  chemically synthesized
ctttcctcagattgatcaag

SEQ ID NO: 352085 - DNA, 20 bp, Artificial Sequence
  chemically synthesized
tctttcctcagattgatcaa

SEQ ID NO: 352086 - DNA, 20 bp, Artificial Sequence
  chemically synthesized
aatctttcctcagattgatc

SEQ ID NO: 352087 - DNA, 20 bp, Artificial Sequence
  chemically synthesized
caatgcctcttgatcaatct

SEQ ID NO: 352088 - DNA, 20 bp, Artificial Sequence
  chemically synthesized
aatgcctcttgatcaatctg

SEQ ID NO: 352089 - DNA, 20 bp, Artificial Sequence
  chemically synthesized
cctcttgatcaatctgagga

SEQ ID NO: 352090 - DNA, 20 bp, Artificial Sequence
  chemically synthesized
tattgaaagaaatctttcct

SEQ ID NO: 352091 - DNA, 20 bp, Artificial Sequence
  chemically synthesized
gaggaaagatttctttcaat

SEQ ID NO: 352092 - DNA, 20 bp, Artificial Sequence
  chemically synthesized
tgaaggaatgttcttattga

SEQ ID NO: 352093 - DNA, 20 bp, Artificial Sequence
  chemically synthesized
ttcaataagaacattccttc

SEQ ID NO: 352094 - DNA, 20 bp, Artificial Sequence
  chemically synthesized
atagcaaaggtagtgcttga

SEQ ID NO: 352095 - DNA, 20 bp, Artificial Sequence
  chemically synthesized
catagcaaaggtagtgcttg

SEQ ID NO: 352096 - DNA, 20 bp, Artificial Sequence
  chemically synthesized
agtgaagaacatagcaaagg

SEQ ID NO: 352097 - DNA, 20 bp, Artificial Sequence
  chemically synthesized
actagtgaagaacatagcaa

SEQ ID NO: 352098 - DNA, 20 bp, Artificial Sequence
  chemically synthesized
gactagtgaagaacatagca

SEQ ID NO: 352099 - DNA, 20 bp, Artificial Sequence
  chemically synthesized
acatagactagtgaagaaca

SEQ ID NO: 352100 - DNA, 20 bp, Artificial Sequence
  chemically synthesized
acctttgctatgttcttcac

SEQ ID NO: 352101 - DNA, 20 bp, Artificial Sequence
  chemically synthesized
aatcttaacatagactagtg

SEQ ID NO: 352102 - DNA, 20 bp, Artificial Sequence
  chemically synthesized
acgttaatcttaacatagac

SEQ ID NO: 352103 - DNA, 20 bp, Artificial Sequence
  chemically synthesized
gttcttcactagtctatgtt

SEQ ID NO: 352104 - DNA, 20 bp, Artificial Sequence
  chemically synthesized
tcttcacgttaatcttaaca

SEQ ID NO: 352105 - DNA, 20 bp, Artificial Sequence
  chemically synthesized
tctatgttaagattaacgtg

SEQ ID NO: 352106 - DNA, 20 bp, Artificial Sequence
  chemically synthesized
atgttaagattaacgtgaag

SEQ ID NO: 352107 - DNA, 20 bp, Artificial Sequence
  chemically synthesized
tgttaagattaacgtgaaga

SEQ ID NO: 352108 - DNA, 20 bp, Artificial Sequence
  chemically synthesized
aagattaacgtgaagaaggc

SEQ ID NO: 352109 - DNA, 20 bp, Artificial Sequence
  chemically synthesized
agattaacgtgaagaaggct

SEQ ID NO: 352110 - DNA, 20 bp, Artificial Sequence
  chemically synthesized
taacgtgaagaaggctaggt

SEQ ID NO: 352111 - DNA, 20 bp, Artificial Sequence
  chemically synthesized
aacgtgaagaaggctaggta

SEQ ID NO: 352112 - DNA, 20 bp, Artificial Sequence
  chemically synthesized
cgtgaagaaggctaggtaag

SEQ ID NO: 352113 - DNA, 20 bp, Artificial Sequence
  chemically synthesized
aaatgataatactccttacc

SEQ ID NO: 352114 - DNA, 20 bp, Artificial Sequence
  chemically synthesized
tttaagcaaaatcattataa

SEQ ID NO: 352115 - DNA, 20 bp, Artificial Sequence
  chemically synthesized
taaacagaaatgtacatttt

SEQ ID NO: 352116 - DNA, 20 bp, Artificial Sequence
  chemically synthesized
atctttgcattcatcataaa

SEQ ID NO: 352117 - DNA, 20 bp, Artificial Sequence
  chemically synthesized
ttctgtttatgatgaatgca

SEQ ID NO: 352118 - DNA, 20 bp, Artificial Sequence
  chemically synthesized
gcaaagatattatcatttaa

SEQ ID NO: 352119 - DNA, 20 bp, Artificial Sequence
  chemically synthesized
atttaatggaaaatttatgt

SEQ ID NO: 352120 - DNA, 20 bp, Artificial Sequence
  chemically synthesized
aatggaaaatttatgtaaga

SEQ ID NO: 352121 - DNA, 20 bp, Artificial Sequence
  chemically synthesized
ctgctaaagctagttgtagc

SEQ ID NO: 352122 - DNA, 20 bp, Artificial Sequence
  chemically synthesized
aagacagatctcgctacaac

SEQ ID NO: 352123 - DNA, 20 bp, Artificial Sequence
  chemically synthesized
aaaactgctaaagctagttg

SEQ ID NO: 352124 - DNA, 20 bp, Artificial Sequence
  chemically synthesized
gatctcgctacaactagctt

SEQ ID NO: 352125 - DNA, 20 bp, Artificial Sequence
  chemically synthesized
ctcgctacaactagctttag

SEQ ID NO: 352126 - DNA, 20 bp, Artificial Sequence
  chemically synthesized
ctaagtaaaactgctaaagc

SEQ ID NO: 352127 - DNA, 20 bp, Artificial Sequence
  chemically synthesized
taacctaagtaaaactgcta

SEQ ID NO: 352128 - DNA, 20 bp, Artificial Sequence
  chemically synthesized
ctagctttagcagttttact

SEQ ID NO: 352129 - DNA, 20 bp, Artificial Sequence
  chemically synthesized
tagctttagcagttttactt

SEQ ID NO: 352130 - DNA, 20 bp, Artificial Sequence
  chemically synthesized
tttttaaattgttataacct

SEQ ID NO: 352131 - DNA, 20 bp, Artificial Sequence
  chemically synthesized
tttaaaaatttctcatctta

SEQ ID NO: 352132 - DNA, 20 bp, Artificial Sequence
  chemically synthesized
atattaagggactataagat

SEQ ID NO: 352133 - DNA, 20 bp, Artificial Sequence
  chemically synthesized
atggaatattaagggactat

SEQ ID NO: 352134 - DNA, 20 bp, Artificial Sequence
  chemically synthesized
taaaaaatatggaatattaa

SEQ ID NO: 352135 - DNA, 20 bp, Artificial Sequence
  chemically synthesized
ttaaaaaatatggaatatta

SEQ ID NO: 352136 - DNA, 20 bp, Artificial Sequence
  chemically synthesized
gttaaaaaatatggaatatt

SEQ ID NO: 352137 - DNA, 20 bp, Artificial Sequence
  chemically synthesized
acgaaaaaagttaaaaaata

SEQ ID NO: 352138 - DNA, 20 bp, Artificial Sequence
  chemically synthesized
ctgcatgtgaaatacgaaaa

SEQ ID NO: 352139 - DNA, 20 bp, Artificial Sequence
  chemically synthesized
cttttttcgtatttcacatg

SEQ ID NO: 352140 - DNA, 20 bp, Artificial Sequence
  chemically synthesized
gtatttcacatgcagtttgt

SEQ ID NO: 352141 - DNA, 20 bp, Artificial Sequence
  chemically synthesized
cacatgcagtttgttggtga

SEQ ID NO: 352142 - DNA, 20 bp, Artificial Sequence
  chemically synthesized
tgttggtgaaagcaaaattc

SEQ ID NO: 352143 - DNA, 20 bp, Artificial Sequence
  chemically synthesized
aagcaaaattcgagatataa

SEQ ID NO: 352144 - DNA, 20 bp, Artificial Sequence
  chemically synthesized
gcaaaattcgagatataata

SEQ ID NO: 352145 - DNA, 20 bp, Artificial Sequence
  chemically synthesized
aaaattcgagatataataga

SEQ ID NO: 352146 - DNA, 20 bp, Artificial Sequence
  chemically synthesized
atacattatttatttttatc

SEQ ID NO: 352147 - DNA, 20 bp, Artificial Sequence
  chemically synthesized
tacattatttatttttatcc

SEQ ID NO: 352148 - DNA, 20 bp, Artificial Sequence
  chemically synthesized
cattatttatttttatccag

SEQ ID NO: 352149 - DNA, 20 bp, Artificial Sequence
  chemically synthesized
aaaaatgagacataagctcc

SEQ ID NO: 352150 - DNA, 20 bp, Artificial Sequence
  chemically synthesized
acgatataaaaatgagacat

SEQ ID NO: 352151 - DNA, 20 bp, Artificial Sequence
  chemically synthesized
tataacaacgatataaaaat

SEQ ID NO: 352152 - DNA, 20 bp, Artificial Sequence
  chemically synthesized
atcgttgttatattttgcaa

SEQ ID NO: 352153 - DNA, 20 bp, Artificial Sequence
  chemically synthesized
tcgttgttatattttgcaat

SEQ ID NO: 352154 - DNA, 20 bp, Artificial Sequence
  chemically synthesized
gtgaaatttgtctttctctt

SEQ ID NO: 352155 - DNA, 20 bp, Artificial Sequence
  chemically synthesized
gttttaaaagactgaagaga

SEQ ID NO: 352156 - DNA, 20 bp, Artificial Sequence
  chemically synthesized
ctaggttttaaaagactgaa

SEQ ID NO: 352157 - DNA, 20 bp, Artificial Sequence
  chemically synthesized
aactaggttttaaaagactg

SEQ ID NO: 352158 - DNA, 20 bp, Artificial Sequence
  chemically synthesized
gtgaagtaactaggttttaa

SEQ ID NO: 352159 - DNA, 20 bp, Artificial Sequence
  chemically synthesized
ctcttcagtcttttaaaacc

SEQ ID NO: 352160 - DNA, 20 bp, Artificial Sequence
  chemically synthesized
aaaaacctggtgaagtaact

SEQ ID NO: 352161 - DNA, 20 bp, Artificial Sequence
  chemically synthesized
aaaaaacctggtgaagtaac

SEQ ID NO: 352162 - DNA, 20 bp, Artificial Sequence
  chemically synthesized
ttaaaacctagttacttcac

SEQ ID NO: 352163 - DNA, 20 bp, Artificial Sequence
  chemically synthesized
taaaacctagttacttcacc

SEQ ID NO: 352164 - DNA, 20 bp, Artificial Sequence
  chemically synthesized
tatttggaaaaaacctggtg

SEQ ID NO: 352165 - DNA, 20 bp, Artificial Sequence
  chemically synthesized
ttgagtatttggaaaaaacc

SEQ ID NO: 352166 - DNA, 20 bp, Artificial Sequence
  chemically synthesized
cgattgggcatttgagtatt

SEQ ID NO: 352167 - DNA, 20 bp, Artificial Sequence
  chemically synthesized
aaaataacgattgggcattt

SEQ ID NO: 352168 - DNA, 20 bp, Artificial Sequence
  chemically synthesized
agtatagaaaaataacgatt

SEQ ID NO: 352169 - DNA, 20 bp, Artificial Sequence
  chemically synthesized
tagtatagaaaaataacgat

SEQ ID NO: 352170 - DNA, 20 bp, Artificial Sequence
  chemically synthesized
caatcgttatttttctatac

SEQ ID NO: 352171 - DNA, 20 bp, Artificial Sequence
  chemically synthesized
aagtggggaaaaaactagta

SEQ ID NO: 352172 - DNA, 20 bp, Artificial Sequence
  chemically synthesized
gccagaagtggggaaaaaac

SEQ ID NO: 352173 - DNA, 20 bp, Artificial Sequence
  chemically synthesized
actagttttttccccacttc

SEQ ID NO: 352174 - DNA, 20 bp, Artificial Sequence
  chemically synthesized
aaaagagacagccagaagtg

SEQ ID NO: 352175 - DNA, 20 bp, Artificial Sequence
  chemically synthesized
gaaaagagacagccagaagt

SEQ ID NO: 352176 - DNA, 20 bp, Artificial Sequence
  chemically synthesized
tgaaaagagacagccagaag

SEQ ID NO: 352177 - DNA, 20 bp, Artificial Sequence
  chemically synthesized
ctctgaaaagagacagccag

SEQ ID NO: 352178 - DNA, 20 bp, Artificial Sequence
  chemically synthesized
ggactctgaaaagagacagc

SEQ ID NO: 352179 - DNA, 20 bp, Artificial Sequence
  chemically synthesized
aaagggactctgaaaagaga

SEQ ID NO: 352180 - DNA, 20 bp, Artificial Sequence
  chemically synthesized
cacttctggctgtctctttt

SEQ ID NO: 352181 - DNA, 20 bp, Artificial Sequence
  chemically synthesized
cttctggctgtctcttttca

SEQ ID NO: 352182 - DNA, 20 bp, Artificial Sequence
  chemically synthesized
aatcaaagggactctgaaaa

SEQ ID NO: 352183 - DNA, 20 bp, Artificial Sequence
  chemically synthesized
ttaatcaaagggactctgaa

SEQ ID NO: 352184 - DNA, 20 bp, Artificial Sequence
  chemically synthesized
tgttgtagttgttaatcaaa

SEQ ID NO: 352185 - DNA, 20 bp, Artificial Sequence
  chemically synthesized
ttgttgtagttgttaatcaa

SEQ ID NO: 352186 - DNA, 20 bp, Artificial Sequence
  chemically synthesized
attgttgtagttgttaatca

SEQ ID NO: 352187 - DNA, 20 bp, Artificial Sequence
  chemically synthesized
agcagactatgatattgttg

SEQ ID NO: 352188 - DNA, 20 bp, Artificial Sequence
  chemically synthesized
taacaactacaacaatatca

SEQ ID NO: 352189 - DNA, 20 bp, Artificial Sequence
  chemically synthesized
acctcactgtagttaaacag

SEQ ID NO: 352190 - DNA, 20 bp, Artificial Sequence
  chemically synthesized
ttcacctcactgtagttaaa

SEQ ID NO: 352191 - DNA, 20 bp, Artificial Sequence
  chemically synthesized
catagtctgctgtttaacta

SEQ ID NO: 352192 - DNA, 20 bp, Artificial Sequence
  chemically synthesized
gtctgctgtttaactacagt

SEQ ID NO: 352193 - DNA, 20 bp, Artificial Sequence
  chemically synthesized
tctgctgtttaactacagtg

SEQ ID NO: 352194 - DNA, 20 bp, Artificial Sequence
  chemically synthesized
ttaataaattcacctcactg

SEQ ID NO: 352195 - DNA, 20 bp, Artificial Sequence
  chemically synthesized
tacagtgaggtgaatttatt

SEQ ID NO: 352196 - DNA, 20 bp, Artificial Sequence
  chemically synthesized
acagtgaggtgaatttatta

SEQ ID NO: 352197 - DNA, 20 bp, Artificial Sequence
  chemically synthesized
cagtgaggtgaatttattaa

SEQ ID NO: 352198 - DNA, 20 bp, Artificial Sequence
  chemically synthesized
agaggcaagagtacatggtg

SEQ ID NO: 352199 - DNA, 20 bp, Artificial Sequence
  chemically synthesized
cctcaagaggcaagagtaca

SEQ ID NO: 352200 - DNA, 20 bp, Artificial Sequence
  chemically synthesized
tattcctcctcaagaggcaa

SEQ ID NO: 352201 - DNA, 20 bp, Artificial Sequence
  chemically synthesized
accatgtactcttgcctctt

SEQ ID NO: 352202 - DNA, 20 bp, Artificial Sequence
  chemically synthesized
cttattcctcctcaagaggc

SEQ ID NO: 352203 - DNA, 20 bp, Artificial Sequence
  chemically synthesized
ccatgtactcttgcctcttg

SEQ ID NO: 352204 - DNA, 20 bp, Artificial Sequence
  chemically synthesized
atgtactcttgcctcttgag

SEQ ID NO: 352205 - DNA, 20 bp, Artificial Sequence
  chemically synthesized
tgtactcttgcctcttgagg

SEQ ID NO: 352206 - DNA, 20 bp, Artificial Sequence
  chemically synthesized
cactcttattcctcctcaag

SEQ ID NO: 352207 - DNA, 20 bp, Artificial Sequence
  chemically synthesized
acactcttattcctcctcaa

SEQ ID NO: 352208 - DNA, 20 bp, Artificial Sequence
  chemically synthesized
acacactcttattcctcctc

SEQ ID NO: 352209 - DNA, 20 bp, Artificial Sequence
  chemically synthesized
cttgcctcttgaggaggaat

SEQ ID NO: 352210 - DNA, 20 bp, Artificial Sequence
  chemically synthesized
tgcctcttgaggaggaataa

SEQ ID NO: 352211 - DNA, 20 bp, Artificial Sequence
  chemically synthesized
aaactgtttttattaataat

SEQ ID NO: 352212 - DNA, 20 bp, Artificial Sequence
  chemically synthesized
attccaattattaataaaaa

SEQ ID NO: 352213 - DNA, 20 bp, Artificial Sequence
  chemically synthesized
agttttcaaatcacttttcc

SEQ ID NO: 352214 - DNA, 20 bp, Artificial Sequence
  chemically synthesized
ttttcaaatcacttttccaa

SEQ ID NO: 352215 - DNA, 20 bp, Artificial Sequence
  chemically synthesized
ggcaagtgagtctcttggaa

SEQ ID NO: 352216 - DNA, 20 bp, Artificial Sequence
  chemically synthesized
agttgggcaagtgagtctct

SEQ ID NO: 352217 - DNA, 20 bp, Artificial Sequence
  chemically synthesized
atagaatcagttgggcaagt

SEQ ID NO: 352218 - DNA, 20 bp, Artificial Sequence
  chemically synthesized
ctgtatagaatcagttgggc

SEQ ID NO: 352219 - DNA, 20 bp, Artificial Sequence
  chemically synthesized
ttttctgtatagaatcagtt

SEQ ID NO: 352220 - DNA, 20 bp, Artificial Sequence
  chemically synthesized
tttttctgtatagaatcagt

SEQ ID NO: 352221 - DNA, 20 bp, Artificial Sequence
  chemically synthesized
taagtttttctgtatagaat

SEQ ID NO: 352222 - DNA, 20 bp, Artificial Sequence
  chemically synthesized
cttgcccaactgattctata

SEQ ID NO: 352223 - DNA, 20 bp, Artificial Sequence
  chemically synthesized
aatatctaagtttttctgta

SEQ ID NO: 352224 - DNA, 20 bp, Artificial Sequence
  chemically synthesized
tgattctatacagaaaaact

SEQ ID NO: 352225 - DNA, 20 bp, Artificial Sequence
  chemically synthesized
ttacctaggctttaatatct

SEQ ID NO: 352226 - DNA, 20 bp, Artificial Sequence
  chemically synthesized
acagaaaaacttagatatta

SEQ ID NO: 352227 - DNA, 20 bp, Artificial Sequence
  chemically synthesized
aaaacttagatattaaagcc

SEQ ID NO: 352228 - DNA, 20 bp, Artificial Sequence
  chemically synthesized
aaacttagatattaaagcct

SEQ ID NO: 352229 - DNA, 20 bp, Artificial Sequence
  chemically synthesized
taaaaagatacattttacct

SEQ ID NO: 352230 - DNA, 20 bp, Artificial Sequence
  chemically synthesized
ataaaaagatacattttacc

SEQ ID NO: 352231 - DNA, 20 bp, Artificial Sequence
  chemically synthesized
gtaaaatgtatctttttatt

SEQ ID NO: 352232 - DNA, 20 bp, Artificial Sequence
  chemically synthesized
tctgagaaagtctaaataaa

SEQ ID NO: 352233 - DNA, 20 bp, Artificial Sequence
  chemically synthesized
tctttttatttagactttct

SEQ ID NO: 352234 - DNA, 20 bp, Artificial Sequence
  chemically synthesized
aaaaaagctattatctgaga

SEQ ID NO: 352235 - DNA, 20 bp, Artificial Sequence
  chemically synthesized
atttagactttctcagataa

SEQ ID NO: 352236 - DNA, 20 bp, Artificial Sequence
  chemically synthesized
aaaaaaaaaagctattatct

SEQ ID NO: 352237 - DNA, 20 bp, Artificial Sequence
  chemically synthesized
catatgtggattaaaaaaaa

SEQ ID NO: 352238 - DNA, 20 bp, Artificial Sequence
  chemically synthesized
atcccaccttgagtcatatg

SEQ ID NO: 352239 - DNA, 20 bp, Artificial Sequence
  chemically synthesized
ttttaatccacatatgactc

SEQ ID NO: 352240 - DNA, 20 bp, Artificial Sequence
  chemically synthesized
tttaatccacatatgactca

SEQ ID NO: 352241 - DNA, 20 bp, Artificial Sequence
  chemically synthesized
aatccacatatgactcaagg

SEQ ID NO: 352242 - DNA, 20 bp, Artificial Sequence
  chemically synthesized
atccacatatgactcaaggt

SEQ ID NO: 352243 - DNA, 20 bp, Artificial Sequence
  chemically synthesized
ctagattgaaatcccacctt

SEQ ID NO: 352244 - DNA, 20 bp, Artificial Sequence
  chemically synthesized
ctcaaggtgggatttcaatc

SEQ ID NO: 352245 - DNA, 20 bp, Artificial Sequence
  chemically synthesized
ggtgggatttcaatctagat

SEQ ID NO: 352246 - DNA, 20 bp, Artificial Sequence
  chemically synthesized
tgggatttcaatctagataa

SEQ ID NO: 352247 - DNA, 20 bp, Artificial Sequence
  chemically synthesized
tgatgtgaacatctcttatc

SEQ ID NO: 352248 - DNA, 20 bp, Artificial Sequence
  chemically synthesized
gttcacatcacgacctcact

SEQ ID NO: 352249 - DNA, 20 bp, Artificial Sequence
  chemically synthesized
ttcacatcacgacctcactg

SEQ ID NO: 352250 - DNA, 20 bp, Artificial Sequence
  chemically synthesized
tctcaaatatttcctcagtg

SEQ ID NO: 352251 - DNA, 20 bp, Artificial Sequence
  chemically synthesized
atctcaaatatttcctcagt

SEQ ID NO: 352252 - DNA, 20 bp, Artificial Sequence
  chemically synthesized
cactatctcaaatatttcct

SEQ ID NO: 352253 - DNA, 20 bp, Artificial Sequence
  chemically synthesized
acctcactgaggaaatattt

SEQ ID NO: 352254 - DNA, 20 bp, Artificial Sequence
  chemically synthesized
cactgaggaaatatttgaga

SEQ ID NO: 352255 - DNA, 20 bp, Artificial Sequence
  chemically synthesized
gaggaaatatttgagatagt

SEQ ID NO: 352256 - DNA, 20 bp, Artificial Sequence
  chemically synthesized
actctaaaattagatggcaa

SEQ ID NO: 352257 - DNA, 20 bp, Artificial Sequence
  chemically synthesized
aactctaaaattagatggca

SEQ ID NO: 352258 - DNA, 20 bp, Artificial Sequence
  chemically synthesized
cagttaactctaaaattaga

SEQ ID NO: 352259 - DNA, 20 bp, Artificial Sequence
  chemically synthesized
atgcctttgccatctaattt

SEQ ID NO: 352260 - DNA, 20 bp, Artificial Sequence
  chemically synthesized
gcctttgccatctaatttta

SEQ ID NO: 352261 - DNA, 20 bp, Artificial Sequence
  chemically synthesized
ttctcagttaactctaaaat

SEQ ID NO: 352262 - DNA, 20 bp, Artificial Sequence
  chemically synthesized
atctaattttagagttaact

SEQ ID NO: 352263 - DNA, 20 bp, Artificial Sequence
  chemically synthesized
aattttagagttaactgaga

SEQ ID NO: 352264 - DNA, 20 bp, Artificial Sequence
  chemically synthesized
ttttagagttaactgagaaa

SEQ ID NO: 352265 - DNA, 20 bp, Artificial Sequence
  chemically synthesized
tattcccctctactctttct

SEQ ID NO: 352266 - DNA, 20 bp, Artificial Sequence
  chemically synthesized
tagagttaactgagaaagag

SEQ ID NO: 352267 - DNA, 20 bp, Artificial Sequence
  chemically synthesized
gagttaactgagaaagagta

SEQ ID NO: 352268 - DNA, 20 bp, Artificial Sequence
  chemically synthesized
agttaactgagaaagagtag

SEQ ID NO: 352269 - DNA, 20 bp, Artificial Sequence
  chemically synthesized
gttaactgagaaagagtaga

SEQ ID NO: 352270 - DNA, 20 bp, Artificial Sequence
  chemically synthesized
ttaactgagaaagagtagag

SEQ ID NO: 352271 - DNA, 20 bp, Artificial Sequence
  chemically synthesized
gaggggaatattttcataac

SEQ ID NO: 352272 - DNA, 20 bp, Artificial Sequence
  chemically synthesized
ggaatattttcataactggt

SEQ ID NO: 352273 - DNA, 20 bp, Artificial Sequence
  chemically synthesized
tatcaaagggagacactcac

SEQ ID NO: 352274 - DNA, 20 bp, Artificial Sequence
  chemically synthesized
cacactaaagttatcaaagg

SEQ ID NO: 352275 - DNA, 20 bp, Artificial Sequence
  chemically synthesized
gccacactaaagttatcaaa

SEQ ID NO: 352276 - DNA, 20 bp, Artificial Sequence
  chemically synthesized
agccacactaaagttatcaa

SEQ ID NO: 352277 - DNA, 20 bp, Artificial Sequence
  chemically synthesized
aagccacactaaagttatca

SEQ ID NO: 352278 - DNA, 20 bp, Artificial Sequence
  chemically synthesized
gtgtctccctttgataactt

SEQ ID NO: 352279 - DNA, 20 bp, Artificial Sequence
  chemically synthesized
tccctttgataactttagtg

SEQ ID NO: 352280 - DNA, 20 bp, Artificial Sequence
  chemically synthesized
attctatccaagccacacta

SEQ ID NO: 352281 - DNA, 20 bp, Artificial Sequence
  chemically synthesized
ttgataactttagtgtggct

SEQ ID NO: 352282 - DNA, 20 bp, Artificial Sequence
  chemically synthesized
taactttagtgtggcttgga

SEQ ID NO: 352283 - DNA, 20 bp, Artificial Sequence
  chemically synthesized
gcaagtatgacattctatcc

SEQ ID NO: 352284 - DNA, 20 bp, Artificial Sequence
  chemically synthesized
ggatagaatgtcatacttgc

SEQ ID NO: 352285 - DNA, 20 bp, Artificial Sequence
  chemically synthesized
aggatgtttacaaatcttgc

SEQ ID NO: 352286 - DNA, 20 bp, Artificial Sequence
  chemically synthesized
cattaaataattaaagtaga

SEQ ID NO: 352287 - DNA, 20 bp, Artificial Sequence
  chemically synthesized
tcattaaataattaaagtag

SEQ ID NO: 352288 - DNA, 20 bp, Artificial Sequence
  chemically synthesized
gaatcattaaataattaaag

SEQ ID NO: 352289 - DNA, 20 bp, Artificial Sequence
  chemically synthesized
agagaatcattaaataatta

SEQ ID NO: 352290 - DNA, 20 bp, Artificial Sequence
  chemically synthesized
aattatttaatgattctctc

SEQ ID NO: 352291 - DNA, 20 bp, Artificial Sequence
  chemically synthesized
attatttaatgattctctca

SEQ ID NO: 352292 - DNA, 20 bp, Artificial Sequence
  chemically synthesized
ttactatgatgtttccttga

SEQ ID NO: 352293 - DNA, 20 bp, Artificial Sequence
  chemically synthesized
ttttactatgatgtttcctt

SEQ ID NO: 352294 - DNA, 20 bp, Artificial Sequence
  chemically synthesized
attctctcaaggaaacatca

SEQ ID NO: 352295 - DNA, 20 bp, Artificial Sequence
  chemically synthesized
caaggaaacatcatagtaaa

SEQ ID NO: 352296 - DNA, 20 bp, Artificial Sequence
  chemically synthesized
acatcatagtaaaaagaatt

SEQ ID NO: 352297 - DNA, 20 bp, Artificial Sequence
  chemically synthesized
aaactagagccagaataaga

SEQ ID NO: 352298 - DNA, 20 bp, Artificial Sequence
  chemically synthesized
attcagtatccctcttattc

SEQ ID NO: 352299 - DNA, 20 bp, Artificial Sequence
  chemically synthesized
taaactagagccagaataag

SEQ ID NO: 352300 - DNA, 20 bp, Artificial Sequence
  chemically synthesized
ataaactagagccagaataa

SEQ ID NO: 352301 - DNA, 20 bp, Artificial Sequence
  chemically synthesized
ttataaactagagccagaat

SEQ ID NO: 352302 - DNA, 20 bp, Artificial Sequence
  chemically synthesized
tatccctcttattctggctc

SEQ ID NO: 352303 - DNA, 20 bp, Artificial Sequence
  chemically synthesized
aaagttttataaactagagc

SEQ ID NO: 352304 - DNA, 20 bp, Artificial Sequence
  chemically synthesized
tggaaaagttttataaacta

SEQ ID NO: 352305 - DNA, 20 bp, Artificial Sequence
  chemically synthesized
aatggaaaagttttataaac

SEQ ID NO: 352306 - DNA, 20 bp, Artificial Sequence
  chemically synthesized
tgttttgaaaataaatggaa

SEQ ID NO: 352307 - DNA, 20 bp, Artificial Sequence
  chemically synthesized
ccaaatgttttgaaaataaa

SEQ ID NO: 352308 - DNA, 20 bp, Artificial Sequence
  chemically synthesized
ccatttattttcaaaacatt

SEQ ID NO: 352309 - DNA, 20 bp, Artificial Sequence
  chemically synthesized
aaacatttggaatcaactga

SEQ ID NO: 352310 - DNA, 20 bp, Artificial Sequence
  chemically synthesized
ttaattggatgcacatccat

SEQ ID NO: 352311 - DNA, 20 bp, Artificial Sequence
  chemically synthesized
taattgggtttgtttttaat

SEQ ID NO: 352312 - DNA, 20 bp, Artificial Sequence
  chemically synthesized
caattaaaaacaaacccaat

SEQ ID NO: 352313 - DNA, 20 bp, Artificial Sequence
  chemically synthesized
attttattacagggctaatt

SEQ ID NO: 352314 - DNA, 20 bp, Artificial Sequence
  chemically synthesized
cattttattacagggctaat

SEQ ID NO: 352315 - DNA, 20 bp, Artificial Sequence
  chemically synthesized
aggttactcattttattaca

SEQ ID NO: 352316 - DNA, 20 bp, Artificial Sequence
  chemically synthesized
aaggttactcattttattac

SEQ ID NO: 352317 - DNA, 20 bp, Artificial Sequence
  chemically synthesized
aaaggttactcattttatta

SEQ ID NO: 352318 - DNA, 20 bp, Artificial Sequence
  chemically synthesized
aattagccctgtaataaaat

SEQ ID NO: 352319 - DNA, 20 bp, Artificial Sequence
  chemically synthesized
taataaaatgagtaaccttt

SEQ ID NO: 352320 - DNA, 20 bp, Artificial Sequence
  chemically synthesized
ttttctttgcattaactaaa

SEQ ID NO: 352321 - DNA, 20 bp, Artificial Sequence
  chemically synthesized
attttctttgcattaactaa

SEQ ID NO: 352322 - DNA, 20 bp, Artificial Sequence
  chemically synthesized
gtaaccttttagttaatgca

SEQ ID NO: 352323 - DNA, 20 bp, Artificial Sequence
  chemically synthesized
taatgcaaagaaaatattca

SEQ ID NO: 352324 - DNA, 20 bp, Artificial Sequence
  chemically synthesized
tgcaaagaaaatattcatgg

SEQ ID NO: 352325 - DNA, 20 bp, Artificial Sequence
  chemically synthesized
aaagaaaatattcatggaag

SEQ ID NO: 352326 - DNA, 20 bp, Artificial Sequence
  chemically synthesized
agaaaatattcatggaagaa

SEQ ID NO: 352327 - DNA, 20 bp, Artificial Sequence
  chemically synthesized
aaaatattcatggaagaaga

SEQ ID NO: 352328 - DNA, 20 bp, Artificial Sequence
  chemically synthesized
aaatattcatggaagaagag

SEQ ID NO: 352329 - DNA, 20 bp, Artificial Sequence
  chemically synthesized
agagaggaatattctgccat

SEQ ID NO: 352330 - DNA, 20 bp, Artificial Sequence
  chemically synthesized
tacagaatataatcttatgg

SEQ ID NO: 352331 - DNA, 20 bp, Artificial Sequence
  chemically synthesized
tactacagaatataatctta

SEQ ID NO: 352332 - DNA, 20 bp, Artificial Sequence
  chemically synthesized
tgccataagattatattctg

SEQ ID NO: 352333 - DNA, 20 bp, Artificial Sequence
  chemically synthesized
cataagattatattctgtag

SEQ ID NO: 352334 - DNA, 20 bp, Artificial Sequence
  chemically synthesized
ttccctacttgtaactacta

SEQ ID NO: 352335 - DNA, 20 bp, Artificial Sequence
  chemically synthesized
ttatattctgtagtagttac

SEQ ID NO: 352336 - DNA, 20 bp, Artificial Sequence
  chemically synthesized
tattctgtagtagttacaag

SEQ ID NO: 352337 - DNA, 20 bp, Artificial Sequence
  chemically synthesized
attctgtagtagttacaagt

SEQ ID NO: 352338 - DNA, 20 bp, Artificial Sequence
  chemically synthesized
ttctgtagtagttacaagta

SEQ ID NO: 352339 - DNA, 20 bp, Artificial Sequence
  chemically synthesized
tcagctagtgagttggagtt

SEQ ID NO: 352340 - DNA, 20 bp, Artificial Sequence
  chemically synthesized
atcactcagctagtgagttg

SEQ ID NO: 352341 - DNA, 20 bp, Artificial Sequence
  chemically synthesized
gaatcttaactccaactcac

SEQ ID NO: 352342 - DNA, 20 bp, Artificial Sequence
  chemically synthesized
acatcactcagctagtgagt

SEQ ID NO: 352343 - DNA, 20 bp, Artificial Sequence
  chemically synthesized
ttaactccaactcactagct

SEQ ID NO: 352344 - DNA, 20 bp, Artificial Sequence
  chemically synthesized
gcccacatcactcagctagt

SEQ ID NO: 352345 - DNA, 20 bp, Artificial Sequence
  chemically synthesized
aattgcccacatcactcagc

SEQ ID NO: 352346 - DNA, 20 bp, Artificial Sequence
  chemically synthesized
aactcactagctgagtgatg

SEQ ID NO: 352347 - DNA, 20 bp, Artificial Sequence
  chemically synthesized
tgtaaattgcccacatcact

SEQ ID NO: 352348 - DNA, 20 bp, Artificial Sequence
  chemically synthesized
actcactagctgagtgatgt

SEQ ID NO: 352349 - DNA, 20 bp, Artificial Sequence
  chemically synthesized
ggcaatttacataaactctt

SEQ ID NO: 352350 - DNA, 20 bp, Artificial Sequence
  chemically synthesized
tttggtcatttgcaactgaa

SEQ ID NO: 352351 - DNA, 20 bp, Artificial Sequence
  chemically synthesized
attttggtcatttgcaactg

SEQ ID NO: 352352 - DNA, 20 bp, Artificial Sequence
  chemically synthesized
gttgcaaatgaccaaaataa

SEQ ID NO: 352353 - DNA, 20 bp, Artificial Sequence
  chemically synthesized
ggaggtagagactattattt

SEQ ID NO: 352354 - DNA, 20 bp, Artificial Sequence
  chemically synthesized
aaataatagtctctacctcc

SEQ ID NO: 352355 - DNA, 20 bp, Artificial Sequence
  chemically synthesized
tgcaaaaactctaggaggta

SEQ ID NO: 352356 - DNA, 20 bp, Artificial Sequence
  chemically synthesized
ataatagtctctacctccta

SEQ ID NO: 352357 - DNA, 20 bp, Artificial Sequence
  chemically synthesized
tctgcaaaaactctaggagg

SEQ ID NO: 352358 - DNA, 20 bp, Artificial Sequence
  chemically synthesized
atttctgcaaaaactctagg

SEQ ID NO: 352359 - DNA, 20 bp, Artificial Sequence
  chemically synthesized
tatttctgcaaaaactctag

SEQ ID NO: 352360 - DNA, 20 bp, Artificial Sequence
  chemically synthesized
tttatttctgcaaaaactct

SEQ ID NO: 352361 - DNA, 20 bp, Artificial Sequence
  chemically synthesized
ttttatttctgcaaaaactc

SEQ ID NO: 352362 - DNA, 20 bp, Artificial Sequence
  chemically synthesized
tctacctcctagagtttttg

SEQ ID NO: 352363 - DNA, 20 bp, Artificial Sequence
  chemically synthesized
aaacgaaattatacaatatc

SEQ ID NO: 352364 - DNA, 20 bp, Artificial Sequence
  chemically synthesized
acaatatcaagcaatgtgcc

SEQ ID NO: 352365 - DNA, 20 bp, Artificial Sequence
  chemically synthesized
tttattaaacattaagtgct

SEQ ID NO: 352366 - DNA, 20 bp, Artificial Sequence
  chemically synthesized
atttattaaacattaagtgc

SEQ ID NO: 352367 - DNA, 20 bp, Artificial Sequence
  chemically synthesized
tgtgatatttattaaacatt

SEQ ID NO: 352368 - DNA, 20 bp, Artificial Sequence
  chemically synthesized
atgtttaataaatatcacac

SEQ ID NO: 352369 - DNA, 20 bp, Artificial Sequence
  chemically synthesized
atagtaatattgatgtaatc

SEQ ID NO: 352370 - DNA, 20 bp, Artificial Sequence
  chemically synthesized
agctgggagtaatacataca

SEQ ID NO: 352371 - DNA, 20 bp, Artificial Sequence
  chemically synthesized
tactatgtatgtattactcc

SEQ ID NO: 352372 - DNA, 20 bp, Artificial Sequence
  chemically synthesized
gtatgtattactcccagctt

SEQ ID NO: 352373 - DNA, 20 bp, Artificial Sequence
  chemically synthesized
aactcaacttctgaagctgg

SEQ ID NO: 352374 - DNA, 20 bp, Artificial Sequence
  chemically synthesized
aaaactcaacttctgaagct

SEQ ID NO: 352375 - DNA, 20 bp, Artificial Sequence
  chemically synthesized
tgtattactcccagcttcag

SEQ ID NO: 352376 - DNA, 20 bp, Artificial Sequence
  chemically synthesized
aaaaactcaacttctgaagc

SEQ ID NO: 352377 - DNA, 20 bp, Artificial Sequence
  chemically synthesized
tcagaaaaactcaacttctg

SEQ ID NO: 352378 - DNA, 20 bp, Artificial Sequence
  chemically synthesized
tactcccagcttcagaagtt

SEQ ID NO: 352379 - DNA, 20 bp, Artificial Sequence
  chemically synthesized
ttcagaagttgagtttttct

SEQ ID NO: 352380 - DNA, 20 bp, Artificial Sequence
  chemically synthesized
cagaagttgagtttttctga

SEQ ID NO: 352381 - DNA, 20 bp, Artificial Sequence
  chemically synthesized
gttgagtttttctgagagtc

SEQ ID NO: 352382 - DNA, 20 bp, Artificial Sequence
  chemically synthesized
ttgagtttttctgagagtct

SEQ ID NO: 352383 - DNA, 20 bp, Artificial Sequence
  chemically synthesized
tgaattggttcccagactct

SEQ ID NO: 352384 - DNA, 20 bp, Artificial Sequence
  chemically synthesized
aaagtggttgaattggttcc

SEQ ID NO: 352385 - DNA, 20 bp, Artificial Sequence
  chemically synthesized
catcgtaaaagtggttgaat

SEQ ID NO: 352386 - DNA, 20 bp, Artificial Sequence
  chemically synthesized
gtcatatgacatcgtaaaag

SEQ ID NO: 352387 - DNA, 20 bp, Artificial Sequence
  chemically synthesized
tacgtcatatgacatcgtaa

SEQ ID NO: 352388 - DNA, 20 bp, Artificial Sequence
  chemically synthesized
tcatatgacgtaatgactac

SEQ ID NO: 352389 - DNA, 20 bp, Artificial Sequence
  chemically synthesized
atatgacgtaatgactacaa

SEQ ID NO: 352390 - DNA, 20 bp, Artificial Sequence
  chemically synthesized
tataactaggttttctcttg

SEQ ID NO: 352391 - DNA, 20 bp, Artificial Sequence
  chemically synthesized
aatgactacaagagaaaacc

SEQ ID NO: 352392 - DNA, 20 bp, Artificial Sequence
  chemically synthesized
acacttgcaaaagtataact

SEQ ID NO: 352393 - DNA, 20 bp, Artificial Sequence
  chemically synthesized
cacacttgcaaaagtataac

SEQ ID NO: 352394 - DNA, 20 bp, Artificial Sequence
  chemically synthesized
aaacctagttatacttttgc

SEQ ID NO: 352395 - DNA, 20 bp, Artificial Sequence
  chemically synthesized
attagttagcacacttgcaa

SEQ ID NO: 352396 - DNA, 20 bp, Artificial Sequence
  chemically synthesized
agtatttgtaagacattagt

SEQ ID NO: 352397 - DNA, 20 bp, Artificial Sequence
  chemically synthesized
tcatagtatttgtaagacat

SEQ ID NO: 352398 - DNA, 20 bp, Artificial Sequence
  chemically synthesized
ataattgtcatagtatttgt

SEQ ID NO: 352399 - DNA, 20 bp, Artificial Sequence
  chemically synthesized
atagtaccttataattgtca

SEQ ID NO: 352400 - DNA, 20 bp, Artificial Sequence
  chemically synthesized
acaaatactatgacaattat

SEQ ID NO: 352401 - DNA, 20 bp, Artificial Sequence
  chemically synthesized
caaatactatgacaattata

SEQ ID NO: 352402 - DNA, 20 bp, Artificial Sequence
  chemically synthesized
tcctgaaggctggttcatga

SEQ ID NO: 352403 - DNA, 20 bp, Artificial Sequence
  chemically synthesized
tataaggtactatcatgaac

SEQ ID NO: 352404 - DNA, 20 bp, Artificial Sequence
  chemically synthesized
tactatcatgaaccagcctt

SEQ ID NO: 352405 - DNA, 20 bp, Artificial Sequence
  chemically synthesized
actatcatgaaccagccttc

SEQ ID NO: 352406 - DNA, 20 bp, Artificial Sequence
  chemically synthesized
ctagcaagtctcctgaaggc

SEQ ID NO: 352407 - DNA, 20 bp, Artificial Sequence
  chemically synthesized
tatcatgaaccagccttcag

SEQ ID NO: 352408 - DNA, 20 bp, Artificial Sequence
  chemically synthesized
atttctagcaagtctcctga

SEQ ID NO: 352409 - DNA, 20 bp, Artificial Sequence
  chemically synthesized
gatttctagcaagtctcctg

SEQ ID NO: 352410 - DNA, 20 bp, Artificial Sequence
  chemically synthesized
ccagccttcaggagacttgc

SEQ ID NO: 352411 - DNA, 20 bp, Artificial Sequence
  chemically synthesized
atacatggtagatttctagc

SEQ ID NO: 352412 - DNA, 20 bp, Artificial Sequence
  chemically synthesized
atggatacatggtagatttc

SEQ ID NO: 352413 - DNA, 20 bp, Artificial Sequence
  chemically synthesized
cagttgtcatggatacatgg

SEQ ID NO: 352414 - DNA, 20 bp, Artificial Sequence
  chemically synthesized
tcacagttgtcatggataca

SEQ ID NO: 352415 - DNA, 20 bp, Artificial Sequence
  chemically synthesized
agattgattcacagttgtca

SEQ ID NO: 352416 - DNA, 20 bp, Artificial Sequence
  chemically synthesized
ttgacagagagattgattca

SEQ ID NO: 352417 - DNA, 20 bp, Artificial Sequence
  chemically synthesized
tgtgaatcaatctctctgtc

SEQ ID NO: 352418 - DNA, 20 bp, Artificial Sequence
  chemically synthesized
acacacacacacttgacaga

SEQ ID NO: 352419 - DNA, 20 bp, Artificial Sequence
  chemically synthesized
acacacacacacacttgaca

SEQ ID NO: 352420 - DNA, 20 bp, Artificial Sequence
  chemically synthesized
acacacacacacacacttga

SEQ ID NO: 352421 - DNA, 20 bp, Artificial Sequence
  chemically synthesized
gtgtgtgtgtgtgtgtgtgt

SEQ ID NO: 352422 - DNA, 20 bp, Artificial Sequence
  chemically synthesized
gtgtgtgtgtgtgtgtgtga

SEQ ID NO: 352423 - DNA, 20 bp, Artificial Sequence
  chemically synthesized
gtgtgtgtgtgtgtgtgaga

SEQ ID NO: 352424 - DNA, 20 bp, Artificial Sequence
  chemically synthesized
gtgtgtgtgtgtgtgagaga

SEQ ID NO: 352425 - DNA, 20 bp, Artificial Sequence
  chemically synthesized
gtgtgtgtgtgtgagagaga

SEQ ID NO: 352426 - DNA, 20 bp, Artificial Sequence
  chemically synthesized
gtgtgtgtgtgagagagaga

SEQ ID NO: 352427 - DNA, 20 bp, Artificial Sequence
  chemically synthesized
gtgtgtgtgagagagagaga

SEQ ID NO: 352428 - DNA, 20 bp, Artificial Sequence
  chemically synthesized
gtgtgtgagagagagagaga

SEQ ID NO: 352429 - DNA, 20 bp, Artificial Sequence
  chemically synthesized
gtgtgagagagagagagaga

SEQ ID NO: 352430 - DNA, 20 bp, Artificial Sequence
  chemically synthesized
gtgagagagagagagagaga

SEQ ID NO: 352431 - DNA, 20 bp, Artificial Sequence
  chemically synthesized
gagagagagagagagagaga

SEQ ID NO: 352432 - DNA, 20 bp, Artificial Sequence
  chemically synthesized
gagagagagagagagagaga

SEQ ID NO: 352433 - DNA, 20 bp, Artificial Sequence
  chemically synthesized
gagagagagagagagagaga

SEQ ID NO: 352434 - DNA, 20 bp, Artificial Sequence
  chemically synthesized
gagagagagagagagagaaa

SEQ ID NO: 352435 - DNA, 20 bp, Artificial Sequence
  chemically synthesized
gagagagagagagagaaaga

SEQ ID NO: 352436 - DNA, 20 bp, Artificial Sequence
  chemically synthesized
gagagagagagagaaagaga

SEQ ID NO: 352437 - DNA, 20 bp, Artificial Sequence
  chemically synthesized
gagagagagagaaagagaga

SEQ ID NO: 352438 - DNA, 20 bp, Artificial Sequence
  chemically synthesized
aagagagagagaaccactct

SEQ ID NO: 352439 - DNA, 20 bp, Artificial Sequence
  chemically synthesized
agagagagagaaccactctg

SEQ ID NO: 352440 - DNA, 20 bp, Artificial Sequence
  chemically synthesized
atatcttaaattcctcagag

SEQ ID NO: 352441 - DNA, 20 bp, Artificial Sequence
  chemically synthesized
actatatcttaaattcctca

SEQ ID NO: 352442 - DNA, 20 bp, Artificial Sequence
  chemically synthesized
atactatatcttaaattcct

SEQ ID NO: 352443 - DNA, 20 bp, Artificial Sequence
  chemically synthesized
agaaccactctgaggaattt

SEQ ID NO: 352444 - DNA, 20 bp, Artificial Sequence
  chemically synthesized
actctgaggaatttaagata

SEQ ID NO: 352445 - DNA, 20 bp, Artificial Sequence
  chemically synthesized
gtctaatctagttttcataa

SEQ ID NO: 352446 - DNA, 20 bp, Artificial Sequence
  chemically synthesized
tataaatcttttatgaaaac

SEQ ID NO: 352447 - DNA, 20 bp, Artificial Sequence
  chemically synthesized
atcttttatgaaaactagat

SEQ ID NO: 352448 - DNA, 20 bp, Artificial Sequence
  chemically synthesized
ttgagctccagagtctaatc

SEQ ID NO: 352449 - DNA, 20 bp, Artificial Sequence
  chemically synthesized
atgaaaactagattagactc

SEQ ID NO: 352450 - DNA, 20 bp, Artificial Sequence
  chemically synthesized
gaaaactagattagactctg

SEQ ID NO: 352451 - DNA, 20 bp, Artificial Sequence
  chemically synthesized
tttgatatccttgagctcca

SEQ ID NO: 352452 - DNA, 20 bp, Artificial Sequence
  chemically synthesized
tagattagactctggagctc

SEQ ID NO: 352453 - DNA, 20 bp, Artificial Sequence
  chemically synthesized
agattagactctggagctca

SEQ ID NO: 352454 - DNA, 20 bp, Artificial Sequence
  chemically synthesized
tctttgatatccttgagctc

SEQ ID NO: 352455 - DNA, 20 bp, Artificial Sequence
  chemically synthesized
tggtaatctttgatatcctt

SEQ ID NO: 352456 - DNA, 20 bp, Artificial Sequence
  chemically synthesized
tctggagctcaaggatatca

SEQ ID NO: 352457 - DNA, 20 bp, Artificial Sequence
  chemically synthesized
ggatatcaaagattaccacc

SEQ ID NO: 352458 - DNA, 20 bp, Artificial Sequence
  chemically synthesized
ctcacagctggtgtactggg

SEQ ID NO: 352459 - DNA, 20 bp, Artificial Sequence
  chemically synthesized
aagattaccacccagtacac

SEQ ID NO: 352460 - DNA, 20 bp, Artificial Sequence
  chemically synthesized
tggctcacagctggtgtact

SEQ ID NO: 352461 - DNA, 20 bp, Artificial Sequence
  chemically synthesized
ctggctcacagctggtgtac

SEQ ID NO: 352462 - DNA, 20 bp, Artificial Sequence
  chemically synthesized
ccacccagtacaccagctgt

SEQ ID NO: 352463 - DNA, 20 bp, Artificial Sequence
  chemically synthesized
gaatactgctggctcacagc

SEQ ID NO: 352464 - DNA, 20 bp, Artificial Sequence
  chemically synthesized
ccagtacaccagctgtgagc

SEQ ID NO: 352465 - DNA, 20 bp, Artificial Sequence
  chemically synthesized
tgaggaatactgctggctca

SEQ ID NO: 352466 - DNA, 20 bp, Artificial Sequence
  chemically synthesized
gtacaccagctgtgagccag

SEQ ID NO: 352467 - DNA, 20 bp, Artificial Sequence
  chemically synthesized
tctggtctgaggaatactgc

SEQ ID NO: 352468 - DNA, 20 bp, Artificial Sequence
  chemically synthesized
tgtgagccagcagtattcct

SEQ ID NO: 352469 - DNA, 20 bp, Artificial Sequence
  chemically synthesized
gccagcagtattcctcagac

SEQ ID NO: 352470 - DNA, 20 bp, Artificial Sequence
  chemically synthesized
cattctggttttctggtctg

SEQ ID NO: 352471 - DNA, 20 bp, Artificial Sequence
  chemically synthesized
tcattctggttttctggtct

SEQ ID NO: 352472 - DNA, 20 bp, Artificial Sequence
  chemically synthesized
tattcctcagaccagaaaac

SEQ ID NO: 352473 - DNA, 20 bp, Artificial Sequence
  chemically synthesized
tcccactcattctggttttc

SEQ ID NO: 352474 - DNA, 20 bp, Artificial Sequence
  chemically synthesized
tcagaccagaaaaccagaat

SEQ ID NO: 352475 - DNA, 20 bp, Artificial Sequence
  chemically synthesized
gaccagaaaaccagaatgag

SEQ ID NO: 352476 - DNA, 20 bp, Artificial Sequence
  chemically synthesized
tgtgaccttcccactcattc

SEQ ID NO: 352477 - DNA, 20 bp, Artificial Sequence
  chemically synthesized
accagaaaaccagaatgagt

SEQ ID NO: 352478 - DNA, 20 bp, Artificial Sequence
  chemically synthesized
agaaaaccagaatgagtggg

SEQ ID NO: 352479 - DNA, 20 bp, Artificial Sequence
  chemically synthesized
gaaaaccagaatgagtggga

SEQ ID NO: 352480 - DNA, 20 bp, Artificial Sequence
  chemically synthesized
cagaatgagtgggaaggtca

SEQ ID NO: 352481 - DNA, 20 bp, Artificial Sequence
  chemically synthesized
agaatgagtgggaaggtcac

SEQ ID NO: 352482 - DNA, 20 bp, Artificial Sequence
  chemically synthesized
atgagtgggaaggtcacagg

SEQ ID NO: 352483 - DNA, 20 bp, Artificial Sequence
  chemically synthesized
tgggaaggtcacaggaagac

SEQ ID NO: 352484 - DNA, 20 bp, Artificial Sequence
  chemically synthesized
aaggtcacaggaagaccagc

SEQ ID NO: 352485 - DNA, 20 bp, Artificial Sequence
  chemically synthesized
tttcccatttgaaatcttgc

SEQ ID NO: 352486 - DNA, 20 bp, Artificial Sequence
  chemically synthesized
aagaccagcaagatttcaaa

SEQ ID NO: 352487 - DNA, 20 bp, Artificial Sequence
  chemically synthesized
agaccagcaagatttcaaat

SEQ ID NO: 352488 - DNA, 20 bp, Artificial Sequence
  chemically synthesized
agatttcaaatgggaaatga

SEQ ID NO: 352489 - DNA, 20 bp, Artificial Sequence
  chemically synthesized
tttcaaatgggaaatgacag

SEQ ID NO: 352490 - DNA, 20 bp, Artificial Sequence
  chemically synthesized
catatcccccgtggaaaagg

SEQ ID NO: 352491 - DNA, 20 bp, Artificial Sequence
  chemically synthesized
acatatcccccgtggaaaag

SEQ ID NO: 352492 - DNA, 20 bp, Artificial Sequence
  chemically synthesized
cagtagatcccccttttcca

SEQ ID NO: 352493 - DNA, 20 bp, Artificial Sequence
  chemically synthesized
aacatatcccccgtggaaaa

SEQ ID NO: 352494 - DNA, 20 bp, Artificial Sequence
  chemically synthesized
agtagatcccccttttccac

SEQ ID NO: 352495 - DNA, 20 bp, Artificial Sequence
  chemically synthesized
gaacatatcccccgtggaaa

SEQ ID NO: 352496 - DNA, 20 bp, Artificial Sequence
  chemically synthesized
gtagatcccccttttccacg

SEQ ID NO: 352497 - DNA, 20 bp, Artificial Sequence
  chemically synthesized
ggaacatatcccccgtggaa

SEQ ID NO: 352498 - DNA, 20 bp, Artificial Sequence
  chemically synthesized
tagatcccccttttccacgg

SEQ ID NO: 352499 - DNA, 20 bp, Artificial Sequence
  chemically synthesized
gtcttggaacatatcccccg

SEQ ID NO: 352500 - DNA, 20 bp, Artificial Sequence
  chemically synthesized
ttccacgggggatatgttcc

SEQ ID NO: 352501 - DNA, 20 bp, Artificial Sequence
  chemically synthesized
gggatatgttccaagaccta

SEQ ID NO: 352502 - DNA, 20 bp, Artificial Sequence
  chemically synthesized
cagacatctgctgtaggtct

SEQ ID NO: 352503 - DNA, 20 bp, Artificial Sequence
  chemically synthesized
atatgttccaagacctacag

SEQ ID NO: 352504 - DNA, 20 bp, Artificial Sequence
  chemically synthesized
tggtttcagacatctgctgt

SEQ ID NO: 352505 - DNA, 20 bp, Artificial Sequence
  chemically synthesized
gtggtttcagacatctgctg

SEQ ID NO: 352506 - DNA, 20 bp, Artificial Sequence
  chemically synthesized
atagggcctatttgtggttt

SEQ ID NO: 352507 - DNA, 20 bp, Artificial Sequence
  chemically synthesized
cagatgtctgaaaccacaaa

SEQ ID NO: 352508 - DNA, 20 bp, Artificial Sequence
  chemically synthesized
agatgtctgaaaccacaaat

SEQ ID NO: 352509 - DNA, 20 bp, Artificial Sequence
  chemically synthesized
gtatatatagggcctatttg

SEQ ID NO: 352510 - DNA, 20 bp, Artificial Sequence
  chemically synthesized
tgggaaaaacagtatatata

SEQ ID NO: 352511 - DNA, 20 bp, Artificial Sequence
  chemically synthesized
atgggaaaaacagtatatat

SEQ ID NO: 352512 - DNA, 20 bp, Artificial Sequence
  chemically synthesized
tatgggaaaaacagtatata

SEQ ID NO: 352513 - DNA, 20 bp, Artificial Sequence
  chemically synthesized
atgtatatgtatgggaaaaa

SEQ ID NO: 352514 - DNA, 20 bp, Artificial Sequence
  chemically synthesized
tcataggtatgtatatgtat

SEQ ID NO: 352515 - DNA, 20 bp, Artificial Sequence
  chemically synthesized
atcataggtatgtatatgta

SEQ ID NO: 352516 - DNA, 20 bp, Artificial Sequence
  chemically synthesized
tataagttaaattttatcat

SEQ ID NO: 352517 - DNA, 20 bp, Artificial Sequence
  chemically synthesized
ttataagttaaattttatca

SEQ ID NO: 352518 - DNA, 20 bp, Artificial Sequence
  chemically synthesized
ataaaatttaacttataaat

SEQ ID NO: 352519 - DNA, 20 bp, Artificial Sequence
  chemically synthesized
taaaatttaacttataaatt

SEQ ID NO: 352520 - DNA, 20 bp, Artificial Sequence
  chemically synthesized
tttttctgtgcctaatttat

SEQ ID NO: 352521 - DNA, 20 bp, Artificial Sequence
  chemically synthesized
tttaacttataaattaggca

SEQ ID NO: 352522 - DNA, 20 bp, Artificial Sequence
  chemically synthesized
ttataaattaggcacagaaa

SEQ ID NO: 352523 - DNA, 20 bp, Artificial Sequence
  chemically synthesized
agaaaaagattaataactaa

SEQ ID NO: 352524 - DNA, 20 bp, Artificial Sequence
  chemically synthesized
tattgctataattgttctat

SEQ ID NO: 352525 - DNA, 20 bp, Artificial Sequence
  chemically synthesized
aataactaatagaacaatta

SEQ ID NO: 352526 - DNA, 20 bp, Artificial Sequence
  chemically synthesized
agaacaattatagcaatatg

SEQ ID NO: 352527 - DNA, 20 bp, Artificial Sequence
  chemically synthesized
atagcaatatgcagtaataa

SEQ ID NO: 352528 - DNA, 20 bp, Artificial Sequence
  chemically synthesized
taataaaagttacgtgaatg

SEQ ID NO: 352529 - DNA, 20 bp, Artificial Sequence
  chemically synthesized
gggtgggcagggagaggtga

SEQ ID NO: 352530 - DNA, 20 bp, Artificial Sequence
  chemically synthesized
gagggtgggcagggagaggt

SEQ ID NO: 352531 - DNA, 20 bp, Artificial Sequence
  chemically synthesized
tggggagggtgggcagggag

SEQ ID NO: 352532 - DNA, 20 bp, Artificial Sequence
  chemically synthesized
gtggggagggtgggcaggga

SEQ ID NO: 352533 - DNA, 20 bp, Artificial Sequence
  chemically synthesized
tggtggggagggtgggcagg

SEQ ID NO: 352534 - DNA, 20 bp, Artificial Sequence
  chemically synthesized
gatggtggggagggtgggca

SEQ ID NO: 352535 - DNA, 20 bp, Artificial Sequence
  chemically synthesized
tgatggtggggagggtgggc

SEQ ID NO: 352536 - DNA, 20 bp, Artificial Sequence
  chemically synthesized
atgatggtggggagggtggg

SEQ ID NO: 352537 - DNA, 20 bp, Artificial Sequence
  chemically synthesized
tagatgatggtggggagggt

SEQ ID NO: 352538 - DNA, 20 bp, Artificial Sequence
  chemically synthesized
ttagatgatggtggggaggg

SEQ ID NO: 352539 - DNA, 20 bp, Artificial Sequence
  chemically synthesized
caattagatgatggtgggga

SEQ ID NO: 352540 - DNA, 20 bp, Artificial Sequence
  chemically synthesized
acaattagatgatggtgggg

SEQ ID NO: 352541 - DNA, 20 bp, Artificial Sequence
  chemically synthesized
tacaattagatgatggtggg

SEQ ID NO: 352542 - DNA, 20 bp, Artificial Sequence
  chemically synthesized
agtacaattagatgatggtg

SEQ ID NO: 352543 - DNA, 20 bp, Artificial Sequence
  chemically synthesized
cagtacaattagatgatggt

SEQ ID NO: 352544 - DNA, 20 bp, Artificial Sequence
  chemically synthesized
acagtacaattagatgatgg

SEQ ID NO: 352545 - DNA, 20 bp, Artificial Sequence
  chemically synthesized
agtacagtacaattagatga

SEQ ID NO: 352546 - DNA, 20 bp, Artificial Sequence
  chemically synthesized
attgatgagtacagtacaat

SEQ ID NO: 352547 - DNA, 20 bp, Artificial Sequence
  chemically synthesized
ggtccttaaattgatgagta

SEQ ID NO: 352548 - DNA, 20 bp, Artificial Sequence
  chemically synthesized
accgtggtccttaaattgat

SEQ ID NO: 352549 - DNA, 20 bp, Artificial Sequence
  chemically synthesized
tgtactgtactcatcaattt

SEQ ID NO: 352550 - DNA, 20 bp, Artificial Sequence
  chemically synthesized
gtactgtactcatcaattta

SEQ ID NO: 352551 - DNA, 20 bp, Artificial Sequence
  chemically synthesized
actcatcaatttaaggacca

SEQ ID NO: 352552 - DNA, 20 bp, Artificial Sequence
  chemically synthesized
ctgctacccatggtcaaccg

SEQ ID NO: 352553 - DNA, 20 bp, Artificial Sequence
  chemically synthesized
ttaaggaccacggttgacca

SEQ ID NO: 352554 - DNA, 20 bp, Artificial Sequence
  chemically synthesized
taaggaccacggttgaccat

SEQ ID NO: 352555 - DNA, 20 bp, Artificial Sequence
  chemically synthesized
ggaccacggttgaccatggg

SEQ ID NO: 352556 - DNA, 20 bp, Artificial Sequence
  chemically synthesized
ccacggttgaccatgggtag

SEQ ID NO: 352557 - DNA, 20 bp, Artificial Sequence
  chemically synthesized
attacagtttctgctaccca

SEQ ID NO: 352558 - DNA, 20 bp, Artificial Sequence
  chemically synthesized
gagtcctcccttattcatta

SEQ ID NO: 352559 - DNA, 20 bp, Artificial Sequence
  chemically synthesized
tagcagaaactgtaatgaat

SEQ ID NO: 352560 - DNA, 20 bp, Artificial Sequence
  chemically synthesized
agcagaaactgtaatgaata

SEQ ID NO: 352561 - DNA, 20 bp, Artificial Sequence
  chemically synthesized
gcagaaactgtaatgaataa

SEQ ID NO: 352562 - DNA, 20 bp, Artificial Sequence
  chemically synthesized
agaaactgtaatgaataagg

SEQ ID NO: 352563 - DNA, 20 bp, Artificial Sequence
  chemically synthesized
gaaactgtaatgaataaggg

SEQ ID NO: 352564 - DNA, 20 bp, Artificial Sequence
  chemically synthesized
tctccccaaattaaatacag

SEQ ID NO: 352565 - DNA, 20 bp, Artificial Sequence
  chemically synthesized
actctccccaaattaaatac

SEQ ID NO: 352566 - DNA, 20 bp, Artificial Sequence
  chemically synthesized
gactctccccaaattaaata

SEQ ID NO: 352567 - DNA, 20 bp, Artificial Sequence
  chemically synthesized
gaggactcctgtatttaatt

SEQ ID NO: 352568 - DNA, 20 bp, Artificial Sequence
  chemically synthesized
aggactcctgtatttaattt

SEQ ID NO: 352569 - DNA, 20 bp, Artificial Sequence
  chemically synthesized
ggactcctgtatttaatttg

SEQ ID NO: 352570 - DNA, 20 bp, Artificial Sequence
  chemically synthesized
actcctgtatttaatttggg

SEQ ID NO: 352571 - DNA, 20 bp, Artificial Sequence
  chemically synthesized
tcctgtatttaatttgggga

SEQ ID NO: 352572 - DNA, 20 bp, Artificial Sequence
  chemically synthesized
gtatttaatttggggagagt

SEQ ID NO: 352573 - DNA, 20 bp, Artificial Sequence
  chemically synthesized
gggagagtcagcatttattc

SEQ ID NO: 352574 - DNA, 20 bp, Artificial Sequence
  chemically synthesized
gagagtcagcatttattcta

SEQ ID NO: 352575 - DNA, 20 bp, Artificial Sequence
  chemically synthesized
agagtcagcatttattctag

SEQ ID NO: 352576 - DNA, 20 bp, Artificial Sequence
  chemically synthesized
gtcagcatttattctagagg

SEQ ID NO: 352577 - DNA, 20 bp, Artificial Sequence
  chemically synthesized
tcagcatttattctagaggc

SEQ ID NO: 352578 - DNA, 20 bp, Artificial Sequence
  chemically synthesized
ccagttattttgcctgcctc

SEQ ID NO: 352579 - DNA, 20 bp, Artificial Sequence
  chemically synthesized
ctagaggcaggcaaaataac

SEQ ID NO: 352580 - DNA, 20 bp, Artificial Sequence
  chemically synthesized
aggcaggcaaaataactgga

SEQ ID NO: 352581 - DNA, 20 bp, Artificial Sequence
  chemically synthesized
ggcaaaataactggaaagat

SEQ ID NO: 352582 - DNA, 20 bp, Artificial Sequence
  chemically synthesized
gtagggaaaactgatctttc

SEQ ID NO: 352583 - DNA, 20 bp, Artificial Sequence
  chemically synthesized
ggaaagatcagttttcccta

SEQ ID NO: 352584 - DNA, 20 bp, Artificial Sequence
  chemically synthesized
gaaagatcagttttccctac

SEQ ID NO: 352585 - DNA, 20 bp, Artificial Sequence
  chemically synthesized
aagatcagttttccctacag

SEQ ID NO: 352586 - DNA, 20 bp, Artificial Sequence
  chemically synthesized
ggtccctttatactcctgta

SEQ ID NO: 352587 - DNA, 20 bp, Artificial Sequence
  chemically synthesized
tggtccctttatactcctgt

SEQ ID NO: 352588 - DNA, 20 bp, Artificial Sequence
  chemically synthesized
atggtccctttatactcctg

SEQ ID NO: 352589 - DNA, 20 bp, Artificial Sequence
  chemically synthesized
gttttccctacaggagtata

SEQ ID NO: 352590 - DNA, 20 bp, Artificial Sequence
  chemically synthesized
ttttccctacaggagtataa

SEQ ID NO: 352591 - DNA, 20 bp, Artificial Sequence
  chemically synthesized
tttccctacaggagtataaa

SEQ ID NO: 352592 - DNA, 20 bp, Artificial Sequence
  chemically synthesized
ggaatgttgtaaaaattaaa

SEQ ID NO: 352593 - DNA, 20 bp, Artificial Sequence
  chemically synthesized
atttaatttttacaacattc

SEQ ID NO: 352594 - DNA, 20 bp, Artificial Sequence
  chemically synthesized
ctaaagttatgtcaaataac

SEQ ID NO: 352595 - DNA, 20 bp, Artificial Sequence
  chemically synthesized
ccagttatttgacataactt

SEQ ID NO: 352596 - DNA, 20 bp, Artificial Sequence
  chemically synthesized
gagcccagaaacagtagcta

SEQ ID NO: 352597 - DNA, 20 bp, Artificial Sequence
  chemically synthesized
ataactttagctactgtttc

SEQ ID NO: 352598 - DNA, 20 bp, Artificial Sequence
  chemically synthesized
taatatgagcccagaaacag

SEQ ID NO: 352599 - DNA, 20 bp, Artificial Sequence
  chemically synthesized
taactttagctactgtttct

SEQ ID NO: 352600 - DNA, 20 bp, Artificial Sequence
  chemically synthesized
ccgtaatatgagcccagaaa

SEQ ID NO: 352601 - DNA, 20 bp, Artificial Sequence
  chemically synthesized
tttggcccgtaatatgagcc

SEQ ID NO: 352602 - DNA, 20 bp, Artificial Sequence
  chemically synthesized
ctgtttctgggctcatatta

SEQ ID NO: 352603 - DNA, 20 bp, Artificial Sequence
  chemically synthesized
tgtttctgggctcatattac

SEQ ID NO: 352604 - DNA, 20 bp, Artificial Sequence
  chemically synthesized
atgtatttggcccgtaatat

SEQ ID NO: 352605 - DNA, 20 bp, Artificial Sequence
  chemically synthesized
aagtaaaacctgtatgtatt

SEQ ID NO: 352606 - DNA, 20 bp, Artificial Sequence
  chemically synthesized
tattacgggccaaatacata

SEQ ID NO: 352607 - DNA, 20 bp, Artificial Sequence
  chemically synthesized
attacgggccaaatacatac

SEQ ID NO: 352608 - DNA, 20 bp, Artificial Sequence
  chemically synthesized
ccactgctacttcaaggagt

SEQ ID NO: 352609 - DNA, 20 bp, Artificial Sequence
  chemically synthesized
caggttttacttactccttg

SEQ ID NO: 352610 - DNA, 20 bp, Artificial Sequence
  chemically synthesized
gttttacttactccttgaag

SEQ ID NO: 352611 - DNA, 20 bp, Artificial Sequence
  chemically synthesized
cctcccactgctacttcaag

SEQ ID NO: 352612 - DNA, 20 bp, Artificial Sequence
  chemically synthesized
tacctcccactgctacttca

SEQ ID NO: 352613 - DNA, 20 bp, Artificial Sequence
  chemically synthesized
ttacttactccttgaagtag

SEQ ID NO: 352614 - DNA, 20 bp, Artificial Sequence
  chemically synthesized
ttacctcccactgctacttc

SEQ ID NO: 352615 - DNA, 20 bp, Artificial Sequence
  chemically synthesized
cttactccttgaagtagcag

SEQ ID NO: 352616 - DNA, 20 bp, Artificial Sequence
  chemically synthesized
ttactccttgaagtagcagt

SEQ ID NO: 352617 - DNA, 20 bp, Artificial Sequence
  chemically synthesized
actccttgaagtagcagtgg

SEQ ID NO: 352618 - DNA, 20 bp, Artificial Sequence
  chemically synthesized
ctccttgaagtagcagtggg

SEQ ID NO: 352619 - DNA, 20 bp, Artificial Sequence
  chemically synthesized
aatatttttactttacacgt

SEQ ID NO: 352620 - DNA, 20 bp, Artificial Sequence
  chemically synthesized
ctcagtattgctcacgtgta

SEQ ID NO: 352621 - DNA, 20 bp, Artificial Sequence
  chemically synthesized
ctttacacgtgagcaatact

SEQ ID NO: 352622 - DNA, 20 bp, Artificial Sequence
  chemically synthesized
actggaaaattattgaggct

SEQ ID NO: 352623 - DNA, 20 bp, Artificial Sequence
  chemically synthesized
aggccactggaaaattattg

SEQ ID NO: 352624 - DNA, 20 bp, Artificial Sequence
  chemically synthesized
taggccactggaaaattatt

SEQ ID NO: 352625 - DNA, 20 bp, Artificial Sequence
  chemically synthesized
actgagcctcaataattttc

SEQ ID NO: 352626 - DNA, 20 bp, Artificial Sequence
  chemically synthesized
gagcctcaataattttccag

SEQ ID NO: 352627 - DNA, 20 bp, Artificial Sequence
  chemically synthesized
ctttattagttttaggccac

SEQ ID NO: 352628 - DNA, 20 bp, Artificial Sequence
  chemically synthesized
tttttgcctttattagtttt

SEQ ID NO: 352629 - DNA, 20 bp, Artificial Sequence
  chemically synthesized
atttttgcctttattagttt

SEQ ID NO: 352630 - DNA, 20 bp, Artificial Sequence
  chemically synthesized
ccagtggcctaaaactaata

SEQ ID NO: 352631 - DNA, 20 bp, Artificial Sequence
  chemically synthesized
cagtggcctaaaactaataa

SEQ ID NO: 352632 - DNA, 20 bp, Artificial Sequence
  chemically synthesized
aatctgatttttgcctttat

SEQ ID NO: 352633 - DNA, 20 bp, Artificial Sequence
  chemically synthesized
aaactaataaaggcaaaaat

SEQ ID NO: 352634 - DNA, 20 bp, Artificial Sequence
  chemically synthesized
atcagattttaacccaaaac

SEQ ID NO: 352635 - DNA, 20 bp, Artificial Sequence
  chemically synthesized
acacagagccaactagtttt

SEQ ID NO: 352636 - DNA, 20 bp, Artificial Sequence
  chemically synthesized
tacacagagccaactagttt

SEQ ID NO: 352637 - DNA, 20 bp, Artificial Sequence
  chemically synthesized
gattttaacccaaaactagt

SEQ ID NO: 352638 - DNA, 20 bp, Artificial Sequence
  chemically synthesized
tttttctacacagagccaac

SEQ ID NO: 352639 - DNA, 20 bp, Artificial Sequence
  chemically synthesized
caaaactagttggctctgtg

SEQ ID NO: 352640 - DNA, 20 bp, Artificial Sequence
  chemically synthesized
gatttaactttttctacaca

SEQ ID NO: 352641 - DNA, 20 bp, Artificial Sequence
  chemically synthesized
ttgatttaactttttctaca

SEQ ID NO: 352642 - DNA, 20 bp, Artificial Sequence
  chemically synthesized
tagttggctctgtgtagaaa

SEQ ID NO: 352643 - DNA, 20 bp, Artificial Sequence
  chemically synthesized
agaaaaagttaaatcaaccc

SEQ ID NO: 352644 - DNA, 20 bp, Artificial Sequence
  chemically synthesized
gaaaaagttaaatcaaccct

SEQ ID NO: 352645 - DNA, 20 bp, Artificial Sequence
  chemically synthesized
ggcagcatcagattaaccta

SEQ ID NO: 352646 - DNA, 20 bp, Artificial Sequence
  chemically synthesized
aggcagcatcagattaacct

SEQ ID NO: 352647 - DNA, 20 bp, Artificial Sequence
  chemically synthesized
taggcagcatcagattaacc

SEQ ID NO: 352648 - DNA, 20 bp, Artificial Sequence
  chemically synthesized
ttcattttcctaggcagcat

SEQ ID NO: 352649 - DNA, 20 bp, Artificial Sequence
  chemically synthesized
taggttaatctgatgctgcc

SEQ ID NO: 352650 - DNA, 20 bp, Artificial Sequence
  chemically synthesized
aggttaatctgatgctgcct

SEQ ID NO: 352651 - DNA, 20 bp, Artificial Sequence
  chemically synthesized
tctatgttcattttcctagg

SEQ ID NO: 352652 - DNA, 20 bp, Artificial Sequence
  chemically synthesized
gtttctatgttcattttcct

SEQ ID NO: 352653 - DNA, 20 bp, Artificial Sequence
  chemically synthesized
agtttctatgttcattttcc

SEQ ID NO: 352654 - DNA, 20 bp, Artificial Sequence
  chemically synthesized
gctgcctaggaaaatgaaca

SEQ ID NO: 352655 - DNA, 20 bp, Artificial Sequence
  chemically synthesized
aacatagaaacttattttct

SEQ ID NO: 352656 - DNA, 20 bp, Artificial Sequence
  chemically synthesized
actcttaatcctaagaaaat

SEQ ID NO: 352657 - DNA, 20 bp, Artificial Sequence
  chemically synthesized
acatagaaacttattttctt

SEQ ID NO: 352658 - DNA, 20 bp, Artificial Sequence
  chemically synthesized
aaacttattttcttaggatt

SEQ ID NO: 352659 - DNA, 20 bp, Artificial Sequence
  chemically synthesized
ttatcttaactcttaatcct

SEQ ID NO: 352660 - DNA, 20 bp, Artificial Sequence
  chemically synthesized
acttattttcttaggattaa

SEQ ID NO: 352661 - DNA, 20 bp, Artificial Sequence
  chemically synthesized
ttttcttaggattaagagtt

SEQ ID NO: 352662 - DNA, 20 bp, Artificial Sequence
  chemically synthesized
aggattaagagttaagataa

SEQ ID NO: 352663 - DNA, 20 bp, Artificial Sequence
  chemically synthesized
attaagagttaagataatag

SEQ ID NO: 352664 - DNA, 20 bp, Artificial Sequence
  chemically synthesized
acctagcaaacaagagtgac

SEQ ID NO: 352665 - DNA, 20 bp, Artificial Sequence
  chemically synthesized
tagtcctacctagcaaacaa

SEQ ID NO: 352666 - DNA, 20 bp, Artificial Sequence
  chemically synthesized
ttcttgtcactcttgtttgc

SEQ ID NO: 352667 - DNA, 20 bp, Artificial Sequence
  chemically synthesized
tcttgtcactcttgtttgct

SEQ ID NO: 352668 - DNA, 20 bp, Artificial Sequence
  chemically synthesized
agtagtcctacctagcaaac

SEQ ID NO: 352669 - DNA, 20 bp, Artificial Sequence
  chemically synthesized
tgtcactcttgtttgctagg

SEQ ID NO: 352670 - DNA, 20 bp, Artificial Sequence
  chemically synthesized
gtcactcttgtttgctaggt

SEQ ID NO: 352671 - DNA, 20 bp, Artificial Sequence
  chemically synthesized
aatttaatagtagtcctacc

SEQ ID NO: 352672 - DNA, 20 bp, Artificial Sequence
  chemically synthesized
ctccccagttaatttaatag

SEQ ID NO: 352673 - DNA, 20 bp, Artificial Sequence
  chemically synthesized
ccactccccagttaatttaa

SEQ ID NO: 352674 - DNA, 20 bp, Artificial Sequence
  chemically synthesized
aggactactattaaattaac

SEQ ID NO: 352675 - DNA, 20 bp, Artificial Sequence
  chemically synthesized
ggactactattaaattaact

SEQ ID NO: 352676 - DNA, 20 bp, Artificial Sequence
  chemically synthesized
gactactattaaattaactg

SEQ ID NO: 352677 - DNA, 20 bp, Artificial Sequence
  chemically synthesized
ctactattaaattaactggg

SEQ ID NO: 352678 - DNA, 20 bp, Artificial Sequence
  chemically synthesized
ctattaaattaactggggag

SEQ ID NO: 352679 - DNA, 20 bp, Artificial Sequence
  chemically synthesized
tattaaattaactggggagt

SEQ ID NO: 352680 - DNA, 20 bp, Artificial Sequence
  chemically synthesized
attaaattaactggggagtg

SEQ ID NO: 352681 - DNA, 20 bp, Artificial Sequence
  chemically synthesized
tgcctctctgccccactccc

SEQ ID NO: 352682 - DNA, 20 bp, Artificial Sequence
  chemically synthesized
aaattaactggggagtgggg

SEQ ID NO: 352683 - DNA, 20 bp, Artificial Sequence
  chemically synthesized
attaactggggagtggggca

SEQ ID NO: 352684 - DNA, 20 bp, Artificial Sequence
  chemically synthesized
taactggggagtggggcaga

SEQ ID NO: 352685 - DNA, 20 bp, Artificial Sequence
  chemically synthesized
aactggggagtggggcagag

SEQ ID NO: 352686 - DNA, 20 bp, Artificial Sequence
  chemically synthesized
tggggcagagaggcaatata

SEQ ID NO: 352687 - DNA, 20 bp, Artificial Sequence
  chemically synthesized
attgttgtcacataggacaa

SEQ ID NO: 352688 - DNA, 20 bp, Artificial Sequence
  chemically synthesized
taataccattgttgtcacat

SEQ ID NO: 352689 - DNA, 20 bp, Artificial Sequence
  chemically synthesized
ttaataccattgttgtcaca

SEQ ID NO: 352690 - DNA, 20 bp, Artificial Sequence
  chemically synthesized
tttgtcctatgtgacaacaa

SEQ ID NO: 352691 - DNA, 20 bp, Artificial Sequence
  chemically synthesized
acaacaatggtattaaatat

SEQ ID NO: 352692 - DNA, 20 bp, Artificial Sequence
  chemically synthesized
acaatggtattaaatattgg

SEQ ID NO: 352693 - DNA, 20 bp, Artificial Sequence
  chemically synthesized
caatggtattaaatattggt

SEQ ID NO: 352694 - DNA, 20 bp, Artificial Sequence
  chemically synthesized
tacttgacatgaagaaattg

SEQ ID NO: 352695 - DNA, 20 bp, Artificial Sequence
  chemically synthesized
tgctgcaatttcttcatgtc

SEQ ID NO: 352696 - DNA, 20 bp, Artificial Sequence
  chemically synthesized
agtgtggtttacttgacatg

SEQ ID NO: 352697 - DNA, 20 bp, Artificial Sequence
  chemically synthesized
gacaacggccaaaatcagtg

SEQ ID NO: 352698 - DNA, 20 bp, Artificial Sequence
  chemically synthesized
caagtaaaccacactgattt

SEQ ID NO: 352699 - DNA, 20 bp, Artificial Sequence
  chemically synthesized
gctaggacaacggccaaaat

SEQ ID NO: 352700 - DNA, 20 bp, Artificial Sequence
  chemically synthesized
actgattttggccgttgtcc

SEQ ID NO: 352701 - DNA, 20 bp, Artificial Sequence
  chemically synthesized
ccatatagctgctaggacaa

SEQ ID NO: 352702 - DNA, 20 bp, Artificial Sequence
  chemically synthesized
gattttggccgttgtcctag

SEQ ID NO: 352703 - DNA, 20 bp, Artificial Sequence
  chemically synthesized
atgtgctccatatagctgct

SEQ ID NO: 352704 - DNA, 20 bp, Artificial Sequence
  chemically synthesized
aatgtgctccatatagctgc

SEQ ID NO: 352705 - DNA, 20 bp, Artificial Sequence
  chemically synthesized
ccgttgtcctagcagctata

SEQ ID NO: 352706 - DNA, 20 bp, Artificial Sequence
  chemically synthesized
gttgtcctagcagctatatg

SEQ ID NO: 352707 - DNA, 20 bp, Artificial Sequence
  chemically synthesized
tcacccaaatgtgctccata

SEQ ID NO: 352708 - DNA, 20 bp, Artificial Sequence
  chemically synthesized
gcagctatatggagcacatt

SEQ ID NO: 352709 - DNA, 20 bp, Artificial Sequence
  chemically synthesized
cagctatatggagcacattt

SEQ ID NO: 352710 - DNA, 20 bp, Artificial Sequence
  chemically synthesized
tatatggagcacatttgggt

SEQ ID NO: 352711 - DNA, 20 bp, Artificial Sequence
  chemically synthesized
tatggagcacatttgggtga

SEQ ID NO: 352712 - DNA, 20 bp, Artificial Sequence
  chemically synthesized
atggagcacatttgggtgag

SEQ ID NO: 352713 - DNA, 20 bp, Artificial Sequence
  chemically synthesized
acatttgggtgagaggcatg

SEQ ID NO: 352714 - DNA, 20 bp, Artificial Sequence
  chemically synthesized
gcatgtggaaatctgtatgt

SEQ ID NO: 352715 - DNA, 20 bp, Artificial Sequence
  chemically synthesized
gcccagaagcaaccaacata

SEQ ID NO: 352716 - DNA, 20 bp, Artificial Sequence
  chemically synthesized
atctgtatgttggttgcttc

SEQ ID NO: 352717 - DNA, 20 bp, Artificial Sequence
  chemically synthesized
tctgtatgttggttgcttct

SEQ ID NO: 352718 - DNA, 20 bp, Artificial Sequence
  chemically synthesized
tgtatcattggatggcccag

SEQ ID NO: 352719 - DNA, 20 bp, Artificial Sequence
  chemically synthesized
ctttgtatcattggatggcc

SEQ ID NO: 352720 - DNA, 20 bp, Artificial Sequence
  chemically synthesized
agaatctttgtatcattgga

SEQ ID NO: 352721 - DNA, 20 bp, Artificial Sequence
  chemically synthesized
tcatagaatctttgtatcat

SEQ ID NO: 352722 - DNA, 20 bp, Artificial Sequence
  chemically synthesized
ctgggccatccaatgataca

SEQ ID NO: 352723 - DNA, 20 bp, Artificial Sequence
  chemically synthesized
atgatacaaagattctatga

SEQ ID NO: 352724 - DNA, 20 bp, Artificial Sequence
  chemically synthesized
aggcaggagatacactgtca

SEQ ID NO: 352725 - DNA, 20 bp, Artificial Sequence
  chemically synthesized
tacagaaggatacaaggcag

SEQ ID NO: 352726 - DNA, 20 bp, Artificial Sequence
  chemically synthesized
tgtacagaaggatacaaggc

SEQ ID NO: 352727 - DNA, 20 bp, Artificial Sequence
  chemically synthesized
ctgtacagaaggatacaagg

SEQ ID NO: 352728 - DNA, 20 bp, Artificial Sequence
  chemically synthesized
tagctgtacagaaggataca

SEQ ID NO: 352729 - DNA, 20 bp, Artificial Sequence
  chemically synthesized
ttagctgtacagaaggatac

SEQ ID NO: 352730 - DNA, 20 bp, Artificial Sequence
  chemically synthesized
ctgccttgtatccttctgta

SEQ ID NO: 352731 - DNA, 20 bp, Artificial Sequence
  chemically synthesized
catttacttagctgtacaga

SEQ ID NO: 352732 - DNA, 20 bp, Artificial Sequence
  chemically synthesized
acatttacttagctgtacag

SEQ ID NO: 352733 - DNA, 20 bp, Artificial Sequence
  chemically synthesized
ttgtatccttctgtacagct

SEQ ID NO: 352734 - DNA, 20 bp, Artificial Sequence
  chemically synthesized
atgacatttacttagctgta

SEQ ID NO: 352735 - DNA, 20 bp, Artificial Sequence
  chemically synthesized
tttaatctatgacatttact

SEQ ID NO: 352736 - DNA, 20 bp, Artificial Sequence
  chemically synthesized
gtacagctaagtaaatgtca

SEQ ID NO: 352737 - DNA, 20 bp, Artificial Sequence
  chemically synthesized
aattatactcacagatggaa

SEQ ID NO: 352738 - DNA, 20 bp, Artificial Sequence
  chemically synthesized
ttaaattctattccatctgt

SEQ ID NO: 352739 - DNA, 20 bp, Artificial Sequence
  chemically synthesized
ttggcaattatactcacaga

SEQ ID NO: 352740 - DNA, 20 bp, Artificial Sequence
  chemically synthesized
aaaattggcaattatactca

SEQ ID NO: 352741 - DNA, 20 bp, Artificial Sequence
  chemically synthesized
tagttgtaaggagataaaat

SEQ ID NO: 352742 - DNA, 20 bp, Artificial Sequence
  chemically synthesized
actgttagtgtagttgtaag

SEQ ID NO: 352743 - DNA, 20 bp, Artificial Sequence
  chemically synthesized
gcactgttagtgtagttgta

SEQ ID NO: 352744 - DNA, 20 bp, Artificial Sequence
  chemically synthesized
tgcactgttagtgtagttgt

SEQ ID NO: 352745 - DNA, 20 bp, Artificial Sequence
  chemically synthesized
tctccttacaactacactaa

SEQ ID NO: 352746 - DNA, 20 bp, Artificial Sequence
  chemically synthesized
tggagcctgcactgttagtg

SEQ ID NO: 352747 - DNA, 20 bp, Artificial Sequence
  chemically synthesized
ttacaactacactaacagtg

SEQ ID NO: 352748 - DNA, 20 bp, Artificial Sequence
  chemically synthesized
tacaactacactaacagtgc

SEQ ID NO: 352749 - DNA, 20 bp, Artificial Sequence
  chemically synthesized
aactttggagcctgcactgt

SEQ ID NO: 352750 - DNA, 20 bp, Artificial Sequence
  chemically synthesized
cactaacagtgcaggctcca

SEQ ID NO: 352751 - DNA, 20 bp, Artificial Sequence
  chemically synthesized
acaggacataatgaactttg

SEQ ID NO: 352752 - DNA, 20 bp, Artificial Sequence
  chemically synthesized
tgacaggacataatgaactt

SEQ ID NO: 352753 - DNA, 20 bp, Artificial Sequence
  chemically synthesized
caaagttcattatgtcctgt

SEQ ID NO: 352754 - DNA, 20 bp, Artificial Sequence
  chemically synthesized
gatatgcaacttttactgac

SEQ ID NO: 352755 - DNA, 20 bp, Artificial Sequence
  chemically synthesized
tcattatgtcctgtcagtaa

SEQ ID NO: 352756 - DNA, 20 bp, Artificial Sequence
  chemically synthesized
agatatgcaacttttactga

SEQ ID NO: 352757 - DNA, 20 bp, Artificial Sequence
  chemically synthesized
gtcagtaaaagttgcatatc

SEQ ID NO: 352758 - DNA, 20 bp, Artificial Sequence
  chemically synthesized
taaacagtttgtattttagc

SEQ ID NO: 352759 - DNA, 20 bp, Artificial Sequence
  chemically synthesized
ttgctaaacagtttgtattt

SEQ ID NO: 352760 - DNA, 20 bp, Artificial Sequence
  chemically synthesized
tggctaaaatacaaactgtt

SEQ ID NO: 352761 - DNA, 20 bp, Artificial Sequence
  chemically synthesized
ccagggttagttttgctaaa

SEQ ID NO: 352762 - DNA, 20 bp, Artificial Sequence
  chemically synthesized
ctgtttagcaaaactaaccc

SEQ ID NO: 352763 - DNA, 20 bp, Artificial Sequence
  chemically synthesized
atttaccatttatccagggt

SEQ ID NO: 352764 - DNA, 20 bp, Artificial Sequence
  chemically synthesized
atttatttaccatttatcca

SEQ ID NO: 352765 - DNA, 20 bp, Artificial Sequence
  chemically synthesized
caaaactaaccctggataaa

SEQ ID NO: 352766 - DNA, 20 bp, Artificial Sequence
  chemically synthesized
aatttatttaccatttatcc

SEQ ID NO: 352767 - DNA, 20 bp, Artificial Sequence
  chemically synthesized
gaatttatttaccatttatc

SEQ ID NO: 352768 - DNA, 20 bp, Artificial Sequence
  chemically synthesized
aaataaattcaacctattta

SEQ ID NO: 352769 - DNA, 20 bp, Artificial Sequence
  chemically synthesized
ctgatattaatgccataaat

SEQ ID NO: 352770 - DNA, 20 bp, Artificial Sequence
  chemically synthesized
tctgatattaatgccataaa

SEQ ID NO: 352771 - DNA, 20 bp, Artificial Sequence
  chemically synthesized
cctatttatggcattaatat

SEQ ID NO: 352772 - DNA, 20 bp, Artificial Sequence
  chemically synthesized
tatttatggcattaatatca

SEQ ID NO: 352773 - DNA, 20 bp, Artificial Sequence
  chemically synthesized
atatcagagatcataaaatt

SEQ ID NO: 352774 - DNA, 20 bp, Artificial Sequence
  chemically synthesized
atccacttgaaataagcaaa

SEQ ID NO: 352775 - DNA, 20 bp, Artificial Sequence
  chemically synthesized
ttaagccatttgcttatttc

SEQ ID NO: 352776 - DNA, 20 bp, Artificial Sequence
  chemically synthesized
cccataaatccacttgaaat

SEQ ID NO: 352777 - DNA, 20 bp, Artificial Sequence
  chemically synthesized
agccatttgcttatttcaag

SEQ ID NO: 352778 - DNA, 20 bp, Artificial Sequence
  chemically synthesized
gcttatttcaagtggattta

SEQ ID NO: 352779 - DNA, 20 bp, Artificial Sequence
  chemically synthesized
cttatttcaagtggatttat

SEQ ID NO: 352780 - DNA, 20 bp, Artificial Sequence
  chemically synthesized
ttcaagtggatttatgggat

SEQ ID NO: 352781 - DNA, 20 bp, Artificial Sequence
  chemically synthesized
aataatagttttcaaattag

SEQ ID NO: 352782 - DNA, 20 bp, Artificial Sequence
  chemically synthesized
taaaataatagttttcaaat

SEQ ID NO: 352783 - DNA, 20 bp, Artificial Sequence
  chemically synthesized
ttaaaatgatggtaaaataa

SEQ ID NO: 352784 - DNA, 20 bp, Artificial Sequence
  chemically synthesized
agggaaaacaattaaaatga

SEQ ID NO: 352785 - DNA, 20 bp, Artificial Sequence
  chemically synthesized
ttttaattgttttcccttat

SEQ ID NO: 352786 - DNA, 20 bp, Artificial Sequence
  chemically synthesized
taataactaagggctaataa

SEQ ID NO: 352787 - DNA, 20 bp, Artificial Sequence
  chemically synthesized
ataataactaagggctaata

SEQ ID NO: 352788 - DNA, 20 bp, Artificial Sequence
  chemically synthesized
aataataactaagggctaat

SEQ ID NO: 352789 - DNA, 20 bp, Artificial Sequence
  chemically synthesized
tgttttcccttattagccct

SEQ ID NO: 352790 - DNA, 20 bp, Artificial Sequence
  chemically synthesized
gaatttttaataataactaa

SEQ ID NO: 352791 - DNA, 20 bp, Artificial Sequence
  chemically synthesized
agaatttttaataataacta

SEQ ID NO: 352792 - DNA, 20 bp, Artificial Sequence
  chemically synthesized
aagaatttttaataataact

SEQ ID NO: 352793 - DNA, 20 bp, Artificial Sequence
  chemically synthesized
gttattattaaaaattcttc

SEQ ID NO: 352794 - DNA, 20 bp, Artificial Sequence
  chemically synthesized
cagagctgataaagaactag

SEQ ID NO: 352795 - DNA, 20 bp, Artificial Sequence
  chemically synthesized
tggcagagctgataaagaac

SEQ ID NO: 352796 - DNA, 20 bp, Artificial Sequence
  chemically synthesized
aaattcttctagttctttat

SEQ ID NO: 352797 - DNA, 20 bp, Artificial Sequence
  chemically synthesized
tttcattggcagagctgata

SEQ ID NO: 352798 - DNA, 20 bp, Artificial Sequence
  chemically synthesized
aaaaatgtctttcattggca

SEQ ID NO: 352799 - DNA, 20 bp, Artificial Sequence
  chemically synthesized
tttatcagctctgccaatga

SEQ ID NO: 352800 - DNA, 20 bp, Artificial Sequence
  chemically synthesized
ataaaaatgtctttcattgg

SEQ ID NO: 352801 - DNA, 20 bp, Artificial Sequence
  chemically synthesized
ccaataaaaatgtctttcat

SEQ ID NO: 352802 - DNA, 20 bp, Artificial Sequence
  chemically synthesized
ccaatgaaagacatttttat

SEQ ID NO: 352803 - DNA, 20 bp, Artificial Sequence
  chemically synthesized
gacatttttattggctgcaa

SEQ ID NO: 352804 - DNA, 20 bp, Artificial Sequence
  chemically synthesized
acatttttattggctgcaaa

SEQ ID NO: 352805 - DNA, 20 bp, Artificial Sequence
  chemically synthesized
aggtttgttgatgccttttg

SEQ ID NO: 352806 - DNA, 20 bp, Artificial Sequence
  chemically synthesized
caaaaggcatcaacaaacct

SEQ ID NO: 352807 - DNA, 20 bp, Artificial Sequence
  chemically synthesized
aggcatcaacaaacctcaga

SEQ ID NO: 352808 - DNA, 20 bp, Artificial Sequence
  chemically synthesized
catcaacaaacctcagatag

SEQ ID NO: 352809 - DNA, 20 bp, Artificial Sequence
  chemically synthesized
tcactgtgttctgctatctg

SEQ ID NO: 352810 - DNA, 20 bp, Artificial Sequence
  chemically synthesized
atcactgtgttctgctatct

SEQ ID NO: 352811 - DNA, 20 bp, Artificial Sequence
  chemically synthesized
aaacctcagatagcagaaca

SEQ ID NO: 352812 - DNA, 20 bp, Artificial Sequence
  chemically synthesized
cagaacacagtgatgtcaat

SEQ ID NO: 352813 - DNA, 20 bp, Artificial Sequence
  chemically synthesized
cagtgatgtcaattagtaac

SEQ ID NO: 352814 - DNA, 20 bp, Artificial Sequence
  chemically synthesized
atgtcaattagtaacaagat

SEQ ID NO: 352815 - DNA, 20 bp, Artificial Sequence
  chemically synthesized
gtcaattagtaacaagatga

SEQ ID NO: 352816 - DNA, 20 bp, Artificial Sequence
  chemically synthesized
caattagtaacaagatgaga

SEQ ID NO: 352817 - DNA, 20 bp, Artificial Sequence
  chemically synthesized
aattagtaacaagatgagag

SEQ ID NO: 352818 - DNA, 20 bp, Artificial Sequence
  chemically synthesized
tagtaacaagatgagagagg

SEQ ID NO: 352819 - DNA, 20 bp, Artificial Sequence
  chemically synthesized
agtaacaagatgagagaggc

SEQ ID NO: 352820 - DNA, 20 bp, Artificial Sequence
  chemically synthesized
aagatgagagaggcaggcaa

SEQ ID NO: 352821 - DNA, 20 bp, Artificial Sequence
  chemically synthesized
atgagagaggcaggcaaaag

SEQ ID NO: 352822 - DNA, 20 bp, Artificial Sequence
  chemically synthesized
gcaaaagaagaaataaatta

SEQ ID NO: 352823 - DNA, 20 bp, Artificial Sequence
  chemically synthesized
aagaaataaattaaagaaca

SEQ ID NO: 352824 - DNA, 20 bp, Artificial Sequence
  chemically synthesized
gaaataaattaaagaacaaa

SEQ ID NO: 352825 - DNA, 20 bp, Artificial Sequence
  chemically synthesized
taaattaaagaacaaagagt

SEQ ID NO: 352826 - DNA, 20 bp, Artificial Sequence
  chemically synthesized
aaattaaagaacaaagagtc

SEQ ID NO: 352827 - DNA, 20 bp, Artificial Sequence
  chemically synthesized
aattaaagaacaaagagtca

SEQ ID NO: 352828 - DNA, 20 bp, Artificial Sequence
  chemically synthesized
tcagggatcacctctgcaaa

SEQ ID NO: 352829 - DNA, 20 bp, Artificial Sequence
  chemically synthesized
gtgagaggagctgtttgcag

SEQ ID NO: 352830 - DNA, 20 bp, Artificial Sequence
  chemically synthesized
ggtgagaggagctgtttgca

SEQ ID NO: 352831 - DNA, 20 bp, Artificial Sequence
  chemically synthesized
caggtgagaggagctgtttg

SEQ ID NO: 352832 - DNA, 20 bp, Artificial Sequence
  chemically synthesized
aagggttgcccaggtgagag

SEQ ID NO: 352833 - DNA, 20 bp, Artificial Sequence
  chemically synthesized
tgcaaacagctcctctcacc

SEQ ID NO: 352834 - DNA, 20 bp, Artificial Sequence
  chemically synthesized
gcaaacagctcctctcacct

SEQ ID NO: 352835 - DNA, 20 bp, Artificial Sequence
  chemically synthesized
gcaagggttgcccaggtgag

SEQ ID NO: 352836 - DNA, 20 bp, Artificial Sequence
  chemically synthesized
agcaagggttgcccaggtga

SEQ ID NO: 352837 - DNA, 20 bp, Artificial Sequence
  chemically synthesized
ccagcaagggttgcccaggt

SEQ ID NO: 352838 - DNA, 20 bp, Artificial Sequence
  chemically synthesized
gtttccagcaagggttgccc

SEQ ID NO: 352839 - DNA, 20 bp, Artificial Sequence
  chemically synthesized
agtttccagcaagggttgcc

SEQ ID NO: 352840 - DNA, 20 bp, Artificial Sequence
  chemically synthesized
ctcacctgggcaacccttgc

SEQ ID NO: 352841 - DNA, 20 bp, Artificial Sequence
  chemically synthesized
actcaaacagtttccagcaa

SEQ ID NO: 352842 - DNA, 20 bp, Artificial Sequence
  chemically synthesized
gactcaaacagtttccagca

SEQ ID NO: 352843 - DNA, 20 bp, Artificial Sequence
  chemically synthesized
tgactcaaacagtttccagc

SEQ ID NO: 352844 - DNA, 20 bp, Artificial Sequence
  chemically synthesized
actctgactcaaacagtttc

SEQ ID NO: 352845 - DNA, 20 bp, Artificial Sequence
  chemically synthesized
acccttgctggaaactgttt

SEQ ID NO: 352846 - DNA, 20 bp, Artificial Sequence
  chemically synthesized
ttgctggaaactgtttgagt

SEQ ID NO: 352847 - DNA, 20 bp, Artificial Sequence
  chemically synthesized
gaatggtactctgactcaaa

SEQ ID NO: 352848 - DNA, 20 bp, Artificial Sequence
  chemically synthesized
gctggaaactgtttgagtca

SEQ ID NO: 352849 - DNA, 20 bp, Artificial Sequence
  chemically synthesized
cggacatgtttgtgatagaa

SEQ ID NO: 352850 - DNA, 20 bp, Artificial Sequence
  chemically synthesized
cttcacggacatgtttgtga

SEQ ID NO: 352851 - DNA, 20 bp, Artificial Sequence
  chemically synthesized
ctatcacaaacatgtccgtg

SEQ ID NO: 352852 - DNA, 20 bp, Artificial Sequence
  chemically synthesized
ttcttctatttattgcttca

SEQ ID NO: 352853 - DNA, 20 bp, Artificial Sequence
  chemically synthesized
catgtccgtgaagcaataaa

SEQ ID NO: 352854 - DNA, 20 bp, Artificial Sequence
  chemically synthesized
gtccgtgaagcaataaatag

SEQ ID NO: 352855 - DNA, 20 bp, Artificial Sequence
  chemically synthesized
cgtgaagcaataaatagaag

SEQ ID NO: 352856 - DNA, 20 bp, Artificial Sequence
  chemically synthesized
gtgaagcaataaatagaaga

SEQ ID NO: 352857 - DNA, 20 bp, Artificial Sequence
  chemically synthesized
aataaatagaagaaggaatg

SEQ ID NO: 352858 - DNA, 20 bp, Artificial Sequence
  chemically synthesized
taaatagaagaaggaatgaa

SEQ ID NO: 352859 - DNA, 20 bp, Artificial Sequence
  chemically synthesized
aatagaagaaggaatgaaga

SEQ ID NO: 352860 - DNA, 20 bp, Artificial Sequence
  chemically synthesized
aatgaagagagacaactgtg

SEQ ID NO: 352861 - DNA, 20 bp, Artificial Sequence
  chemically synthesized
aagagagacaactgtgcaga

SEQ ID NO: 352862 - DNA, 20 bp, Artificial Sequence
  chemically synthesized
agagagacaactgtgcagac

SEQ ID NO: 352863 - DNA, 20 bp, Artificial Sequence
  chemically synthesized
tgccttatctcctgtctgca

SEQ ID NO: 352864 - DNA, 20 bp, Artificial Sequence
  chemically synthesized
agagacaactgtgcagacag

SEQ ID NO: 352865 - DNA, 20 bp, Artificial Sequence
  chemically synthesized
caactgtgcagacaggagat

SEQ ID NO: 352866 - DNA, 20 bp, Artificial Sequence
  chemically synthesized
aactgtgcagacaggagata

SEQ ID NO: 352867 - DNA, 20 bp, Artificial Sequence
  chemically synthesized
gtgcagacaggagataaggc

SEQ ID NO: 352868 - DNA, 20 bp, Artificial Sequence
  chemically synthesized
aggcaagtttcttaatccta

SEQ ID NO: 352869 - DNA, 20 bp, Artificial Sequence
  chemically synthesized
aaaacattctctttaggatt

SEQ ID NO: 352870 - DNA, 20 bp, Artificial Sequence
  chemically synthesized
gcaagtttcttaatcctaaa

SEQ ID NO: 352871 - DNA, 20 bp, Artificial Sequence
  chemically synthesized
gccatcaaaacattctcttt

SEQ ID NO: 352872 - DNA, 20 bp, Artificial Sequence
  chemically synthesized
ggccatcaaaacattctctt

SEQ ID NO: 352873 - DNA, 20 bp, Artificial Sequence
  chemically synthesized
tcctaaagagaatgttttga

SEQ ID NO: 352874 - DNA, 20 bp, Artificial Sequence
  chemically synthesized
aaagagaatgttttgatggc

SEQ ID NO: 352875 - DNA, 20 bp, Artificial Sequence
  chemically synthesized
gactagctgtcacataagac

SEQ ID NO: 352876 - DNA, 20 bp, Artificial Sequence
  chemically synthesized
tgatggccagtcttatgtga

SEQ ID NO: 352877 - DNA, 20 bp, Artificial Sequence
  chemically synthesized
aaatagactagctgtcacat

SEQ ID NO: 352878 - DNA, 20 bp, Artificial Sequence
  chemically synthesized
ggccagtcttatgtgacagc

SEQ ID NO: 352879 - DNA, 20 bp, Artificial Sequence
  chemically synthesized
cagacaaagtaaaaatagac

SEQ ID NO: 352880 - DNA, 20 bp, Artificial Sequence
  chemically synthesized
atccacagacaaagtaaaaa

SEQ ID NO: 352881 - DNA, 20 bp, Artificial Sequence
  chemically synthesized
gtctatttttactttgtctg

SEQ ID NO: 352882 - DNA, 20 bp, Artificial Sequence
  chemically synthesized
aaattgttcatccacagaca

SEQ ID NO: 352883 - DNA, 20 bp, Artificial Sequence
  chemically synthesized
aatgagaaattgttcatcca

SEQ ID NO: 352884 - DNA, 20 bp, Artificial Sequence
  chemically synthesized
gatgaacaatttctcattaa

SEQ ID NO: 352885 - DNA, 20 bp, Artificial Sequence
  chemically synthesized
ttgctaacagttctgttaat

SEQ ID NO: 352886 - DNA, 20 bp, Artificial Sequence
  chemically synthesized
tttctcattaacagaactgt

SEQ ID NO: 352887 - DNA, 20 bp, Artificial Sequence
  chemically synthesized
ggagtactgcttattgctaa

SEQ ID NO: 352888 - DNA, 20 bp, Artificial Sequence
  chemically synthesized
ttaacagaactgttagcaat

SEQ ID NO: 352889 - DNA, 20 bp, Artificial Sequence
  chemically synthesized
acagaactgttagcaataag

SEQ ID NO: 352890 - DNA, 20 bp, Artificial Sequence
  chemically synthesized
gttagcaataagcagtactc

SEQ ID NO: 352891 - DNA, 20 bp, Artificial Sequence
  chemically synthesized
gttcacatcttcaattactg

SEQ ID NO: 352892 - DNA, 20 bp, Artificial Sequence
  chemically synthesized
aagcagtactccagtaattg

SEQ ID NO: 352893 - DNA, 20 bp, Artificial Sequence
  chemically synthesized
ctgttcacatcttcaattac

SEQ ID NO: 352894 - DNA, 20 bp, Artificial Sequence
  chemically synthesized
ccagtaattgaagatgtgaa

SEQ ID NO: 352895 - DNA, 20 bp, Artificial Sequence
  chemically synthesized
gtaattgaagatgtgaacag

SEQ ID NO: 352896 - DNA, 20 bp, Artificial Sequence
  chemically synthesized
taattgaagatgtgaacagc

SEQ ID NO: 352897 - DNA, 20 bp, Artificial Sequence
  chemically synthesized
gaagatgtgaacagcaggct

SEQ ID NO: 352898 - DNA, 20 bp, Artificial Sequence
  chemically synthesized
ttcttccttaaaaaatgact

SEQ ID NO: 352899 - DNA, 20 bp, Artificial Sequence
  chemically synthesized
agcaggcttagtcatttttt

SEQ ID NO: 352900 - DNA, 20 bp, Artificial Sequence
  chemically synthesized
gcaggcttagtcatttttta

SEQ ID NO: 352901 - DNA, 20 bp, Artificial Sequence
  chemically synthesized
ggcttagtcattttttaagg

SEQ ID NO: 352902 - DNA, 20 bp, Artificial Sequence
  chemically synthesized
ttttttaaggaagaaaatgc

SEQ ID NO: 352903 - DNA, 20 bp, Artificial Sequence
  chemically synthesized
tttaaggaagaaaatgctag

SEQ ID NO: 352904 - DNA, 20 bp, Artificial Sequence
  chemically synthesized
ccagcatttgtttagacttc

SEQ ID NO: 352905 - DNA, 20 bp, Artificial Sequence
  chemically synthesized
ctgttgtcccagcatttgtt

SEQ ID NO: 352906 - DNA, 20 bp, Artificial Sequence
  chemically synthesized
ctagaagtctaaacaaatgc

SEQ ID NO: 352907 - DNA, 20 bp, Artificial Sequence
  chemically synthesized
tagaagtctaaacaaatgct

SEQ ID NO: 352908 - DNA, 20 bp, Artificial Sequence
  chemically synthesized
ctaaacaaatgctgggacaa

SEQ ID NO: 352909 - DNA, 20 bp, Artificial Sequence
  chemically synthesized
agatccagaatctgttgtcc

SEQ ID NO: 352910 - DNA, 20 bp, Artificial Sequence
  chemically synthesized
aatgctgggacaacagattc

SEQ ID NO: 352911 - DNA, 20 bp, Artificial Sequence
  chemically synthesized
cccttttataggataagatc

SEQ ID NO: 352912 - DNA, 20 bp, Artificial Sequence
  chemically synthesized
gatatgcccttttataggat

SEQ ID NO: 352913 - DNA, 20 bp, Artificial Sequence
  chemically synthesized
ttctggatcttatcctataa

SEQ ID NO: 352914 - DNA, 20 bp, Artificial Sequence
  chemically synthesized
tctggatcttatcctataaa

SEQ ID NO: 352915 - DNA, 20 bp, Artificial Sequence
  chemically synthesized
ctggatcttatcctataaaa

SEQ ID NO: 352916 - DNA, 20 bp, Artificial Sequence
  chemically synthesized
tgtgagatatgcccttttat

SEQ ID NO: 352917 - DNA, 20 bp, Artificial Sequence
  chemically synthesized
ctgtgagatatgccctttta

SEQ ID NO: 352918 - DNA, 20 bp, Artificial Sequence
  chemically synthesized
ctataaaagggcatatctca

SEQ ID NO: 352919 - DNA, 20 bp, Artificial Sequence
  chemically synthesized
aatggaacaattgtttctgt

SEQ ID NO: 352920 - DNA, 20 bp, Artificial Sequence
  chemically synthesized
cagaaacaattgttccattg

SEQ ID NO: 352921 - DNA, 20 bp, Artificial Sequence
  chemically synthesized
taagatagaaacaactacaa

SEQ ID NO: 352922 - DNA, 20 bp, Artificial Sequence
  chemically synthesized
cattgtagttgtttctatct

SEQ ID NO: 352923 - DNA, 20 bp, Artificial Sequence
  chemically synthesized
agagtatcctgcagctaaga

SEQ ID NO: 352924 - DNA, 20 bp, Artificial Sequence
  chemically synthesized
agttgtttctatcttagctg

SEQ ID NO: 352925 - DNA, 20 bp, Artificial Sequence
  chemically synthesized
gttgtttctatcttagctgc

SEQ ID NO: 352926 - DNA, 20 bp, Artificial Sequence
  chemically synthesized
agtgagagtatcctgcagct

SEQ ID NO: 352927 - DNA, 20 bp, Artificial Sequence
  chemically synthesized
cagtaagtgagagtatcctg

SEQ ID NO: 352928 - DNA, 20 bp, Artificial Sequence
  chemically synthesized
tttagaagctcagtaagtga

SEQ ID NO: 352929 - DNA, 20 bp, Artificial Sequence
  chemically synthesized
gcaggatactctcacttact

SEQ ID NO: 352930 - DNA, 20 bp, Artificial Sequence
  chemically synthesized
tttttagaagctcagtaagt

SEQ ID NO: 352931 - DNA, 20 bp, Artificial Sequence
  chemically synthesized
gcaatttttagaagctcagt

SEQ ID NO: 352932 - DNA, 20 bp, Artificial Sequence
  chemically synthesized
atcagcaatttttagaagct

SEQ ID NO: 352933 - DNA, 20 bp, Artificial Sequence
  chemically synthesized
gtgacatcagcaatttttag

SEQ ID NO: 352934 - DNA, 20 bp, Artificial Sequence
  chemically synthesized
gctgtgacatcagcaatttt

SEQ ID NO: 352935 - DNA, 20 bp, Artificial Sequence
  chemically synthesized
tctaaaaattgctgatgtca

SEQ ID NO: 352936 - DNA, 20 bp, Artificial Sequence
  chemically synthesized
ctgaggacgggctgtgacat

SEQ ID NO: 352937 - DNA, 20 bp, Artificial Sequence
  chemically synthesized
ctgatgtcacagcccgtcct

SEQ ID NO: 352938 - DNA, 20 bp, Artificial Sequence
  chemically synthesized
tattttatttcactgaggac

SEQ ID NO: 352939 - DNA, 20 bp, Artificial Sequence
  chemically synthesized
gtattttatttcactgagga

SEQ ID NO: 352940 - DNA, 20 bp, Artificial Sequence
  chemically synthesized
actagtattttatttcactg

SEQ ID NO: 352941 - DNA, 20 bp, Artificial Sequence
  chemically synthesized
aactagtattttatttcact

SEQ ID NO: 352942 - DNA, 20 bp, Artificial Sequence
  chemically synthesized
tcctcagtgaaataaaatac

SEQ ID NO: 352943 - DNA, 20 bp, Artificial Sequence
  chemically synthesized
ggcaacactgggattgaaac

SEQ ID NO: 352944 - DNA, 20 bp, Artificial Sequence
  chemically synthesized
taaaatactagtttcaatcc

SEQ ID NO: 352945 - DNA, 20 bp, Artificial Sequence
  chemically synthesized
ggaagctttatggcaacact

SEQ ID NO: 352946 - DNA, 20 bp, Artificial Sequence
  chemically synthesized
gggaagctttatggcaacac

SEQ ID NO: 352947 - DNA, 20 bp, Artificial Sequence
  chemically synthesized
tcaatcccagtgttgccata

SEQ ID NO: 352948 - DNA, 20 bp, Artificial Sequence
  chemically synthesized
aatcggttggggaagcttta

SEQ ID NO: 352949 - DNA, 20 bp, Artificial Sequence
  chemically synthesized
tccaataaaatcggttgggg

SEQ ID NO: 352950 - DNA, 20 bp, Artificial Sequence
  chemically synthesized
ctgtccaataaaatcggttg

SEQ ID NO: 352951 - DNA, 20 bp, Artificial Sequence
  chemically synthesized
actgtccaataaaatcggtt

SEQ ID NO: 352952 - DNA, 20 bp, Artificial Sequence
  chemically synthesized
gactgtccaataaaatcggt

SEQ ID NO: 352953 - DNA, 20 bp, Artificial Sequence
  chemically synthesized
gcttccccaaccgattttat

SEQ ID NO: 352954 - DNA, 20 bp, Artificial Sequence
  chemically synthesized
acaagactgtccaataaaat

SEQ ID NO: 352955 - DNA, 20 bp, Artificial Sequence
  chemically synthesized
ccccaaccgattttattgga

SEQ ID NO: 352956 - DNA, 20 bp, Artificial Sequence
  chemically synthesized
attttattggacagtcttgt

SEQ ID NO: 352957 - DNA, 20 bp, Artificial Sequence
  chemically synthesized
aagtccgtgttatttctcac

SEQ ID NO: 352958 - DNA, 20 bp, Artificial Sequence
  chemically synthesized
cagtcttgtgagaaataaca

SEQ ID NO: 352959 - DNA, 20 bp, Artificial Sequence
  chemically synthesized
tgagaaataacacggacttt

SEQ ID NO: 352960 - DNA, 20 bp, Artificial Sequence
  chemically synthesized
gaaataacacggactttaag

SEQ ID NO: 352961 - DNA, 20 bp, Artificial Sequence
  chemically synthesized
aataacacggactttaagaa

SEQ ID NO: 352962 - DNA, 20 bp, Artificial Sequence
  chemically synthesized
ccagggtttatctcttctta

SEQ ID NO: 352963 - DNA, 20 bp, Artificial Sequence
  chemically synthesized
ctttaagaagagataaaccc

SEQ ID NO: 352964 - DNA, 20 bp, Artificial Sequence
  chemically synthesized
ctgagctataatcaaatcca

SEQ ID NO: 352965 - DNA, 20 bp, Artificial Sequence
  chemically synthesized
actgagctataatcaaatcc

SEQ ID NO: 352966 - DNA, 20 bp, Artificial Sequence
  chemically synthesized
aactgagctataatcaaatc

SEQ ID NO: 352967 - DNA, 20 bp, Artificial Sequence
  chemically synthesized
ataaaccctggatttgatta

SEQ ID NO: 352968 - DNA, 20 bp, Artificial Sequence
  chemically synthesized
ccctggatttgattatagct

SEQ ID NO: 352969 - DNA, 20 bp, Artificial Sequence
  chemically synthesized
cacacagccaatagataact

SEQ ID NO: 352970 - DNA, 20 bp, Artificial Sequence
  chemically synthesized
attatagctcagttatctat

SEQ ID NO: 352971 - DNA, 20 bp, Artificial Sequence
  chemically synthesized
aatcaagatcacacagccaa

SEQ ID NO: 352972 - DNA, 20 bp, Artificial Sequence
  chemically synthesized
ttattaaaatcaagatcaca

SEQ ID NO: 352973 - DNA, 20 bp, Artificial Sequence
  chemically synthesized
tagagagctttattaaaatc

SEQ ID NO: 352974 - DNA, 20 bp, Artificial Sequence
  chemically synthesized
gtgtgatcttgattttaata

SEQ ID NO: 352975 - DNA, 20 bp, Artificial Sequence
  chemically synthesized
tgattttaataaagctctct

SEQ ID NO: 352976 - DNA, 20 bp, Artificial Sequence
  chemically synthesized
tggaaaaactgaggcttaga

SEQ ID NO: 352977 - DNA, 20 bp, Artificial Sequence
  chemically synthesized
taataaagctctctaagcct

SEQ ID NO: 352978 - DNA, 20 bp, Artificial Sequence
  chemically synthesized
aatggaaaaactgaggctta

SEQ ID NO: 352979 - DNA, 20 bp, Artificial Sequence
  chemically synthesized
taaatggaaaaactgaggct

SEQ ID NO: 352980 - DNA, 20 bp, Artificial Sequence
  chemically synthesized
ttttataaatggaaaaactg

SEQ ID NO: 352981 - DNA, 20 bp, Artificial Sequence
  chemically synthesized
cttttataaatggaaaaact

SEQ ID NO: 352982 - DNA, 20 bp, Artificial Sequence
  chemically synthesized
ctcagtttttccatttataa

SEQ ID NO: 352983 - DNA, 20 bp, Artificial Sequence
  chemically synthesized
gtttatccttcttttataaa

SEQ ID NO: 352984 - DNA, 20 bp, Artificial Sequence
  chemically synthesized
agtttttccatttataaaag

SEQ ID NO: 352985 - DNA, 20 bp, Artificial Sequence
  chemically synthesized
gtttttccatttataaaaga

SEQ ID NO: 352986 - DNA, 20 bp, Artificial Sequence
  chemically synthesized
aaaagaaggataaacttacc

SEQ ID NO: 352987 - DNA, 20 bp, Artificial Sequence
  chemically synthesized
tgtacacaacaattccaggt

SEQ ID NO: 352988 - DNA, 20 bp, Artificial Sequence
  chemically synthesized
gtcttgtacacaacaattcc

SEQ ID NO: 352989 - DNA, 20 bp, Artificial Sequence
  chemically synthesized
tgtcttgtacacaacaattc

SEQ ID NO: 352990 - DNA, 20 bp, Artificial Sequence
  chemically synthesized
tacctggaattgttgtgtac

SEQ ID NO: 352991 - DNA, 20 bp, Artificial Sequence
  chemically synthesized
aattgttgtgtacaagacat

SEQ ID NO: 352992 - DNA, 20 bp, Artificial Sequence
  chemically synthesized
tgtgtacaagacataagata

SEQ ID NO: 352993 - DNA, 20 bp, Artificial Sequence
  chemically synthesized
acaagacataagataaagta

SEQ ID NO: 352994 - DNA, 20 bp, Artificial Sequence
  chemically synthesized
gataaagtatggaaattatc

SEQ ID NO: 352995 - DNA, 20 bp, Artificial Sequence
  chemically synthesized
taagtagggcagtcatgttc

SEQ ID NO: 352996 - DNA, 20 bp, Artificial Sequence
  chemically synthesized
gtgcaaatgtttaagtaggg

SEQ ID NO: 352997 - DNA, 20 bp, Artificial Sequence
  chemically synthesized
agagtgcaaatgtttaagta

SEQ ID NO: 352998 - DNA, 20 bp, Artificial Sequence
  chemically synthesized
aagagtgcaaatgtttaagt

SEQ ID NO: 352999 - DNA, 20 bp, Artificial Sequence
  chemically synthesized
gaagagtgcaaatgtttaag

SEQ ID NO: 353000 - DNA, 20 bp, Artificial Sequence
  chemically synthesized
gtagaagagtgcaaatgttt

SEQ ID NO: 353001 - DNA, 20 bp, Artificial Sequence
  chemically synthesized
gcaagttccttttggtagaa

SEQ ID NO: 353002 - DNA, 20 bp, Artificial Sequence
  chemically synthesized
catttgcactcttctaccaa

SEQ ID NO: 353003 - DNA, 20 bp, Artificial Sequence
  chemically synthesized
ttgcaagttccttttggtag

SEQ ID NO: 353004 - DNA, 20 bp, Artificial Sequence
  chemically synthesized
atttgcactcttctaccaaa

SEQ ID NO: 353005 - DNA, 20 bp, Artificial Sequence
  chemically synthesized
aatttgcaagttccttttgg

SEQ ID NO: 353006 - DNA, 20 bp, Artificial Sequence
  chemically synthesized
tcaaatttgcaagttccttt

SEQ ID NO: 353007 - DNA, 20 bp, Artificial Sequence
  chemically synthesized
tgatataaactcaaatttgc

SEQ ID NO: 353008 - DNA, 20 bp, Artificial Sequence
  chemically synthesized
caaaaggaacttgcaaattt

SEQ ID NO: 353009 - DNA, 20 bp, Artificial Sequence
  chemically synthesized
agatttttctaatttatcat

SEQ ID NO: 353010 - DNA, 20 bp, Artificial Sequence
  chemically synthesized
ttatatcactgatgataaat

SEQ ID NO: 353011 - DNA, 20 bp, Artificial Sequence
  chemically synthesized
ataaattagaaaaatctttg

SEQ ID NO: 353012 - DNA, 20 bp, Artificial Sequence
  chemically synthesized
taaattagaaaaatctttgc

SEQ ID NO: 353013 - DNA, 20 bp, Artificial Sequence
  chemically synthesized
aaattagaaaaatctttgca

SEQ ID NO: 353014 - DNA, 20 bp, Artificial Sequence
  chemically synthesized
aattagaaaaatctttgcag

SEQ ID NO: 353015 - DNA, 20 bp, Artificial Sequence
  chemically synthesized
aagcacatttttcccctgca

SEQ ID NO: 353016 - DNA, 20 bp, Artificial Sequence
  chemically synthesized
gaaaaatgtgctttgatttg

SEQ ID NO: 353017 - DNA, 20 bp, Artificial Sequence
  chemically synthesized
taaacttttgcttcaaatca

SEQ ID NO: 353018 - DNA, 20 bp, Artificial Sequence
  chemically synthesized
tgtgctttgatttgaagcaa

SEQ ID NO: 353019 - DNA, 20 bp, Artificial Sequence
  chemically synthesized
atttgaagcaaaagtttatt

SEQ ID NO: 353020 - DNA, 20 bp, Artificial Sequence
  chemically synthesized
cagcaatattaacatctcac

SEQ ID NO: 353021 - DNA, 20 bp, Artificial Sequence
  chemically synthesized
tcctgtaatatcattcttgt

SEQ ID NO: 353022 - DNA, 20 bp, Artificial Sequence
  chemically synthesized
atctcacaagaatgatatta

SEQ ID NO: 353023 - DNA, 20 bp, Artificial Sequence
  chemically synthesized
tctcacaagaatgatattac

SEQ ID NO: 353024 - DNA, 20 bp, Artificial Sequence
  chemically synthesized
tattacaggatatttcctaa

SEQ ID NO: 353025 - DNA, 20 bp, Artificial Sequence
  chemically synthesized
aaaccagtgtttttactttt

SEQ ID NO: 353026 - DNA, 20 bp, Artificial Sequence
  chemically synthesized
gaaaccagtgtttttacttt

SEQ ID NO: 353027 - DNA, 20 bp, Artificial Sequence
  chemically synthesized
tttcctaaaagtaaaaacac

SEQ ID NO: 353028 - DNA, 20 bp, Artificial Sequence
  chemically synthesized
tttaataaggtggttgaaac

SEQ ID NO: 353029 - DNA, 20 bp, Artificial Sequence
  chemically synthesized
attattacaatttaataagg

SEQ ID NO: 353030 - DNA, 20 bp, Artificial Sequence
  chemically synthesized
tatattattacaatttaata

SEQ ID NO: 353031 - DNA, 20 bp, Artificial Sequence
  chemically synthesized
atatattattacaatttaat

SEQ ID NO: 353032 - DNA, 20 bp, Artificial Sequence
  chemically synthesized
gttacaactattaaattatt

SEQ ID NO: 353033 - DNA, 20 bp, Artificial Sequence
  chemically synthesized
tgttacaactattaaattat

SEQ ID NO: 353034 - DNA, 20 bp, Artificial Sequence
  chemically synthesized
taaaattcctaataatttaa

SEQ ID NO: 353035 - DNA, 20 bp, Artificial Sequence
  chemically synthesized
taataatttaatagttgtaa

SEQ ID NO: 353036 - DNA, 20 bp, Artificial Sequence
  chemically synthesized
atgatatccagttgaaaagt

SEQ ID NO: 353037 - DNA, 20 bp, Artificial Sequence
  chemically synthesized
cagttttctcacttttcaac

SEQ ID NO: 353038 - DNA, 20 bp, Artificial Sequence
  chemically synthesized
tcatatgatatccagttgaa

SEQ ID NO: 353039 - DNA, 20 bp, Artificial Sequence
  chemically synthesized
ttagtggatcatatgatatc

SEQ ID NO: 353040 - DNA, 20 bp, Artificial Sequence
  chemically synthesized
tggcaatcgtgtggagttag

SEQ ID NO: 353041 - DNA, 20 bp, Artificial Sequence
  chemically synthesized
ttatggcaatcgtgtggagt

SEQ ID NO: 353042 - DNA, 20 bp, Artificial Sequence
  chemically synthesized
tgtcttatggcaatcgtgtg

SEQ ID NO: 353043 - DNA, 20 bp, Artificial Sequence
  chemically synthesized
tttgtcttatggcaatcgtg

SEQ ID NO: 353044 - DNA, 20 bp, Artificial Sequence
  chemically synthesized
taactccacacgattgccat

SEQ ID NO: 353045 - DNA, 20 bp, Artificial Sequence
  chemically synthesized
gccccagattttttgtctta

SEQ ID NO: 353046 - DNA, 20 bp, Artificial Sequence
  chemically synthesized
ttgccataagacaaaaaatc

SEQ ID NO: 353047 - DNA, 20 bp, Artificial Sequence
  chemically synthesized
tgccataagacaaaaaatct

SEQ ID NO: 353048 - DNA, 20 bp, Artificial Sequence
  chemically synthesized
gccataagacaaaaaatctg

SEQ ID NO: 353049 - DNA, 20 bp, Artificial Sequence
  chemically synthesized
attcagccattttgaagccc

SEQ ID NO: 353050 - DNA, 20 bp, Artificial Sequence
  chemically synthesized
aaaaatctggggcttcaaaa

SEQ ID NO: 353051 - DNA, 20 bp, Artificial Sequence
  chemically synthesized
ccatcaattcagccattttg

SEQ ID NO: 353052 - DNA, 20 bp, Artificial Sequence
  chemically synthesized
cttcaaaatggctgaattga

SEQ ID NO: 353053 - DNA, 20 bp, Artificial Sequence
  chemically synthesized
gagtaacagatccatcaatt

SEQ ID NO: 353054 - DNA, 20 bp, Artificial Sequence
  chemically synthesized
tccatggaagaggtgagtaa

SEQ ID NO: 353055 - DNA, 20 bp, Artificial Sequence
  chemically synthesized
ttcctctccatggaagaggt

SEQ ID NO: 353056 - DNA, 20 bp, Artificial Sequence
  chemically synthesized
tctgttactcacctcttcca

SEQ ID NO: 353057 - DNA, 20 bp, Artificial Sequence
  chemically synthesized
ttggttcctctccatggaag

SEQ ID NO: 353058 - DNA, 20 bp, Artificial Sequence
  chemically synthesized
tgttactcacctcttccatg

SEQ ID NO: 353059 - DNA, 20 bp, Artificial Sequence
  chemically synthesized
tttggttcctctccatggaa

SEQ ID NO: 353060 - DNA, 20 bp, Artificial Sequence
  chemically synthesized
ttactcacctcttccatgga

SEQ ID NO: 353061 - DNA, 20 bp, Artificial Sequence
  chemically synthesized
actttggttcctctccatgg

SEQ ID NO: 353062 - DNA, 20 bp, Artificial Sequence
  chemically synthesized
tactcacctcttccatggag

SEQ ID NO: 353063 - DNA, 20 bp, Artificial Sequence
  chemically synthesized
ggtactttggttcctctcca

SEQ ID NO: 353064 - DNA, 20 bp, Artificial Sequence
  chemically synthesized
tcttccatggagaggaacca

SEQ ID NO: 353065 - DNA, 20 bp, Artificial Sequence
  chemically synthesized
tggagaggaaccaaagtacc

SEQ ID NO: 353066 - DNA, 20 bp, Artificial Sequence
  chemically synthesized
tgattatctacttggtactt

SEQ ID NO: 353067 - DNA, 20 bp, Artificial Sequence
  chemically synthesized
agaggaaccaaagtaccaag

SEQ ID NO: 353068 - DNA, 20 bp, Artificial Sequence
  chemically synthesized
tcaaagtatgattatctact

SEQ ID NO: 353069 - DNA, 20 bp, Artificial Sequence
  chemically synthesized
tctcttagttaatgtattca

SEQ ID NO: 353070 - DNA, 20 bp, Artificial Sequence
  chemically synthesized
atactttgaatacattaact

SEQ ID NO: 353071 - DNA, 20 bp, Artificial Sequence
  chemically synthesized
actttgaatacattaactaa

SEQ ID NO: 353072 - DNA, 20 bp, Artificial Sequence
  chemically synthesized
tgaatttcagtgttttctct

SEQ ID NO: 353073 - DNA, 20 bp, Artificial Sequence
  chemically synthesized
attgcttctctgttgaattt

SEQ ID NO: 353074 - DNA, 20 bp, Artificial Sequence
  chemically synthesized
gagaaaacactgaaattcaa

SEQ ID NO: 353075 - DNA, 20 bp, Artificial Sequence
  chemically synthesized
gaaaacactgaaattcaaca

SEQ ID NO: 353076 - DNA, 20 bp, Artificial Sequence
  chemically synthesized
aacactgaaattcaacagag

SEQ ID NO: 353077 - DNA, 20 bp, Artificial Sequence
  chemically synthesized
gaagcaatgaaaaccactaa

SEQ ID NO: 353078 - DNA, 20 bp, Artificial Sequence
  chemically synthesized
aagcaatgaaaaccactaaa

SEQ ID NO: 353079 - DNA, 20 bp, Artificial Sequence
  chemically synthesized
ttccttctttttccttttag

SEQ ID NO: 353080 - DNA, 20 bp, Artificial Sequence
  chemically synthesized
catttccttctttttccttt

SEQ ID NO: 353081 - DNA, 20 bp, Artificial Sequence
  chemically synthesized
tgaaaaccactaaaaggaaa

SEQ ID NO: 353082 - DNA, 20 bp, Artificial Sequence
  chemically synthesized
aaaccactaaaaggaaaaag

SEQ ID NO: 353083 - DNA, 20 bp, Artificial Sequence
  chemically synthesized
aaccactaaaaggaaaaaga

SEQ ID NO: 353084 - DNA, 20 bp, Artificial Sequence
  chemically synthesized
aaaaggaaaaagaaggaaat

SEQ ID NO: 353085 - DNA, 20 bp, Artificial Sequence
  chemically synthesized
aaaggaaaaagaaggaaatg

SEQ ID NO: 353086 - DNA, 20 bp, Artificial Sequence
  chemically synthesized
aggaaatgaggcactctatc

SEQ ID NO: 353087 - DNA, 20 bp, Artificial Sequence
  chemically synthesized
tagccaatctcagctggata

SEQ ID NO: 353088 - DNA, 20 bp, Artificial Sequence
  chemically synthesized
atgaggcactctatccagct

SEQ ID NO: 353089 - DNA, 20 bp, Artificial Sequence
  chemically synthesized
cctagccaatctcagctgga

SEQ ID NO: 353090 - DNA, 20 bp, Artificial Sequence
  chemically synthesized
gactcctagccaatctcagc

SEQ ID NO: 353091 - DNA, 20 bp, Artificial Sequence
  chemically synthesized
gcactctatccagctgagat

SEQ ID NO: 353092 - DNA, 20 bp, Artificial Sequence
  chemically synthesized
tccagactcctagccaatct

SEQ ID NO: 353093 - DNA, 20 bp, Artificial Sequence
  chemically synthesized
tctatccagctgagattggc

SEQ ID NO: 353094 - DNA, 20 bp, Artificial Sequence
  chemically synthesized
ctatccagctgagattggct

SEQ ID NO: 353095 - DNA, 20 bp, Artificial Sequence
  chemically synthesized
atccagctgagattggctag

SEQ ID NO: 353096 - DNA, 20 bp, Artificial Sequence
  chemically synthesized
gctgagattggctaggagtc

SEQ ID NO: 353097 - DNA, 20 bp, Artificial Sequence
  chemically synthesized
agggagcctctccagactcc

SEQ ID NO: 353098 - DNA, 20 bp, Artificial Sequence
  chemically synthesized
tgagattggctaggagtctg

SEQ ID NO: 353099 - DNA, 20 bp, Artificial Sequence
  chemically synthesized
agattggctaggagtctgga

SEQ ID NO: 353100 - DNA, 20 bp, Artificial Sequence
  chemically synthesized
gattggctaggagtctggag

SEQ ID NO: 353101 - DNA, 20 bp, Artificial Sequence
  chemically synthesized
cccatgttagggagcctctc

SEQ ID NO: 353102 - DNA, 20 bp, Artificial Sequence
  chemically synthesized
tctggagaggctccctaaca

SEQ ID NO: 353103 - DNA, 20 bp, Artificial Sequence
  chemically synthesized
aattctctccccatgttagg

SEQ ID NO: 353104 - DNA, 20 bp, Artificial Sequence
  chemically synthesized
ctggagaggctccctaacat

SEQ ID NO: 353105 - DNA, 20 bp, Artificial Sequence
  chemically synthesized
tggagaggctccctaacatg

SEQ ID NO: 353106 - DNA, 20 bp, Artificial Sequence
  chemically synthesized
ctaattctctccccatgtta

SEQ ID NO: 353107 - DNA, 20 bp, Artificial Sequence
  chemically synthesized
tctaattctctccccatgtt

SEQ ID NO: 353108 - DNA, 20 bp, Artificial Sequence
  chemically synthesized
gagaggctccctaacatggg

SEQ ID NO: 353109 - DNA, 20 bp, Artificial Sequence
  chemically synthesized
ctctaattctctccccatgt

SEQ ID NO: 353110 - DNA, 20 bp, Artificial Sequence
  chemically synthesized
gaggctccctaacatgggga

SEQ ID NO: 353111 - DNA, 20 bp, Artificial Sequence
  chemically synthesized
ccctaacatggggagagaat

SEQ ID NO: 353112 - DNA, 20 bp, Artificial Sequence
  chemically synthesized
ctaacatggggagagaatta

SEQ ID NO: 353113 - DNA, 20 bp, Artificial Sequence
  chemically synthesized
gagagaattagagatgcaca

SEQ ID NO: 353114 - DNA, 20 bp, Artificial Sequence
  chemically synthesized
agagaattagagatgcacaa

SEQ ID NO: 353115 - DNA, 20 bp, Artificial Sequence
  chemically synthesized
aaaggtacacattcttgtac

SEQ ID NO: 353116 - DNA, 20 bp, Artificial Sequence
  chemically synthesized
ggattgtaggaatcttgtac

SEQ ID NO: 353117 - DNA, 20 bp, Artificial Sequence
  chemically synthesized
gtacaagattcctacaatcc

SEQ ID NO: 353118 - DNA, 20 bp, Artificial Sequence
  chemically synthesized
tctcaattggctaggattgt

SEQ ID NO: 353119 - DNA, 20 bp, Artificial Sequence
  chemically synthesized
ctctcaattggctaggattg

SEQ ID NO: 353120 - DNA, 20 bp, Artificial Sequence
  chemically synthesized
tgaagggctctcaattggct

SEQ ID NO: 353121 - DNA, 20 bp, Artificial Sequence
  chemically synthesized
tcctacaatcctagccaatt

SEQ ID NO: 353122 - DNA, 20 bp, Artificial Sequence
  chemically synthesized
ttgaagggctctcaattggc

SEQ ID NO: 353123 - DNA, 20 bp, Artificial Sequence
  chemically synthesized
ctacaatcctagccaattga

SEQ ID NO: 353124 - DNA, 20 bp, Artificial Sequence
  chemically synthesized
cgggttgaagggctctcaat

SEQ ID NO: 353125 - DNA, 20 bp, Artificial Sequence
  chemically synthesized
gggggcccacacgggttgaa

SEQ ID NO: 353126 - DNA, 20 bp, Artificial Sequence
  chemically synthesized
tgggggcccacacgggttga

SEQ ID NO: 353127 - DNA, 20 bp, Artificial Sequence
  chemically synthesized
ttgggggcccacacgggttg

SEQ ID NO: 353128 - DNA, 20 bp, Artificial Sequence
  chemically synthesized
tgagagcccttcaacccgtg

SEQ ID NO: 353129 - DNA, 20 bp, Artificial Sequence
  chemically synthesized
gagagcccttcaacccgtgt

SEQ ID NO: 353130 - DNA, 20 bp, Artificial Sequence
  chemically synthesized
gttggtttgggggcccacac

SEQ ID NO: 353131 - DNA, 20 bp, Artificial Sequence
  chemically synthesized
tgttggtttgggggcccaca

SEQ ID NO: 353132 - DNA, 20 bp, Artificial Sequence
  chemically synthesized
acagctgtgtgttggtttgg

SEQ ID NO: 353133 - DNA, 20 bp, Artificial Sequence
  chemically synthesized
gacagctgtgtgttggtttg

SEQ ID NO: 353134 - DNA, 20 bp, Artificial Sequence
  chemically synthesized
agacagctgtgtgttggttt

SEQ ID NO: 353135 - DNA, 20 bp, Artificial Sequence
  chemically synthesized
tagacagctgtgtgttggtt

SEQ ID NO: 353136 - DNA, 20 bp, Artificial Sequence
  chemically synthesized
tgggcccccaaaccaacaca

SEQ ID NO: 353137 - DNA, 20 bp, Artificial Sequence
  chemically synthesized
gtatctagacagctgtgtgt

SEQ ID NO: 353138 - DNA, 20 bp, Artificial Sequence
  chemically synthesized
caaaccaacacacagctgtc

SEQ ID NO: 353139 - DNA, 20 bp, Artificial Sequence
  chemically synthesized
gcctttgcacagtatctaga

SEQ ID NO: 353140 - DNA, 20 bp, Artificial Sequence
  chemically synthesized
caatgcctttgcacagtatc

SEQ ID NO: 353141 - DNA, 20 bp, Artificial Sequence
  chemically synthesized
agctgtctagatactgtgca

SEQ ID NO: 353142 - DNA, 20 bp, Artificial Sequence
  chemically synthesized
gctgtctagatactgtgcaa

SEQ ID NO: 353143 - DNA, 20 bp, Artificial Sequence
  chemically synthesized
cgtgaagcaatgcctttgca

SEQ ID NO: 353144 - DNA, 20 bp, Artificial Sequence
  chemically synthesized
tgtgcaaaggcattgcttca

SEQ ID NO: 353145 - DNA, 20 bp, Artificial Sequence
  chemically synthesized
gcaaaggcattgcttcacgg

SEQ ID NO: 353146 - DNA, 20 bp, Artificial Sequence
  chemically synthesized
cagcatgggcttcttccgtg

SEQ ID NO: 353147 - DNA, 20 bp, Artificial Sequence
  chemically synthesized
aaggcattgcttcacggaag

SEQ ID NO: 353148 - DNA, 20 bp, Artificial Sequence
  chemically synthesized
ttcacggaagaagcccatgc

SEQ ID NO: 353149 - DNA, 20 bp, Artificial Sequence
  chemically synthesized
tcacggaagaagcccatgct

SEQ ID NO: 353150 - DNA, 20 bp, Artificial Sequence
  chemically synthesized
gagtttgtggaacccagcat

SEQ ID NO: 353151 - DNA, 20 bp, Artificial Sequence
  chemically synthesized
agagtttgtggaacccagca

SEQ ID NO: 353152 - DNA, 20 bp, Artificial Sequence
  chemically synthesized
actctagagtttgtggaacc

SEQ ID NO: 353153 - DNA, 20 bp, Artificial Sequence
  chemically synthesized
atgctgggttccacaaactc

SEQ ID NO: 353154 - DNA, 20 bp, Artificial Sequence
  chemically synthesized
gcttaggactctagagtttg

SEQ ID NO: 353155 - DNA, 20 bp, Artificial Sequence
  chemically synthesized
gctgggttccacaaactcta

SEQ ID NO: 353156 - DNA, 20 bp, Artificial Sequence
  chemically synthesized
tgcagctgcttaggactcta

SEQ ID NO: 353157 - DNA, 20 bp, Artificial Sequence
  chemically synthesized
tccacaaactctagagtcct

SEQ ID NO: 353158 - DNA, 20 bp, Artificial Sequence
  chemically synthesized
gttgcagctgcttaggactc

SEQ ID NO: 353159 - DNA, 20 bp, Artificial Sequence
  chemically synthesized
acaaactctagagtcctaag

SEQ ID NO: 353160 - DNA, 20 bp, Artificial Sequence
  chemically synthesized
aggccatgttgcagctgctt

SEQ ID NO: 353161 - DNA, 20 bp, Artificial Sequence
  chemically synthesized
caggccatgttgcagctgct

SEQ ID NO: 353162 - DNA, 20 bp, Artificial Sequence
  chemically synthesized
agtcctaagcagctgcaaca

SEQ ID NO: 353163 - DNA, 20 bp, Artificial Sequence
  chemically synthesized
ctcaaaaccaggccatgttg

SEQ ID NO: 353164 - DNA, 20 bp, Artificial Sequence
  chemically synthesized
taagcagctgcaacatggcc

SEQ ID NO: 353165 - DNA, 20 bp, Artificial Sequence
  chemically synthesized
ctgcaacatggcctggtttt

SEQ ID NO: 353166 - DNA, 20 bp, Artificial Sequence
  chemically synthesized
ggggctgggctctcaaaacc

SEQ ID NO: 353167 - DNA, 20 bp, Artificial Sequence
  chemically synthesized
gcaacatggcctggttttga

SEQ ID NO: 353168 - DNA, 20 bp, Artificial Sequence
  chemically synthesized
gggggctgggctctcaaaac

SEQ ID NO: 353169 - DNA, 20 bp, Artificial Sequence
  chemically synthesized
atggcctggttttgagagcc

SEQ ID NO: 353170 - DNA, 20 bp, Artificial Sequence
  chemically synthesized
gacatagactggtgggggct

SEQ ID NO: 353171 - DNA, 20 bp, Artificial Sequence
  chemically synthesized
ggacatagactggtgggggc

SEQ ID NO: 353172 - DNA, 20 bp, Artificial Sequence
  chemically synthesized
tttgagagcccagcccccac

SEQ ID NO: 353173 - DNA, 20 bp, Artificial Sequence
  chemically synthesized
gtcaggacatagactggtgg

SEQ ID NO: 353174 - DNA, 20 bp, Artificial Sequence
  chemically synthesized
ggtcaggacatagactggtg

SEQ ID NO: 353175 - DNA, 20 bp, Artificial Sequence
  chemically synthesized
aggtcaggacatagactggt

SEQ ID NO: 353176 - DNA, 20 bp, Artificial Sequence
  chemically synthesized
taggtcaggacatagactgg

SEQ ID NO: 353177 - DNA, 20 bp, Artificial Sequence
  chemically synthesized
tcctaggtcaggacatagac

SEQ ID NO: 353178 - DNA, 20 bp, Artificial Sequence
  chemically synthesized
tttagtcctaggtcaggaca

SEQ ID NO: 353179 - DNA, 20 bp, Artificial Sequence
  chemically synthesized
caccagtctatgtcctgacc

SEQ ID NO: 353180 - DNA, 20 bp, Artificial Sequence
  chemically synthesized
accagtctatgtcctgacct

SEQ ID NO: 353181 - DNA, 20 bp, Artificial Sequence
  chemically synthesized
aagatttttagtcctaggtc

SEQ ID NO: 353182 - DNA, 20 bp, Artificial Sequence
  chemically synthesized
gaagatttttagtcctaggt

SEQ ID NO: 353183 - DNA, 20 bp, Artificial Sequence
  chemically synthesized
tagggaagatttttagtcct

SEQ ID NO: 353184 - DNA, 20 bp, Artificial Sequence
  chemically synthesized
atagggaagatttttagtcc

SEQ ID NO: 353185 - DNA, 20 bp, Artificial Sequence
  chemically synthesized
gtggagatagggaagatttt

SEQ ID NO: 353186 - DNA, 20 bp, Artificial Sequence
  chemically synthesized
ccaggaatgtggagataggg

SEQ ID NO: 353187 - DNA, 20 bp, Artificial Sequence
  chemically synthesized
actccaggaatgtggagata

SEQ ID NO: 353188 - DNA, 20 bp, Artificial Sequence
  chemically synthesized
gactccaggaatgtggagat

SEQ ID NO: 353189 - DNA, 20 bp, Artificial Sequence
  chemically synthesized
agactccaggaatgtggaga

SEQ ID NO: 353190 - DNA, 20 bp, Artificial Sequence
  chemically synthesized
actgagactccaggaatgtg

SEQ ID NO: 353191 - DNA, 20 bp, Artificial Sequence
  chemically synthesized
cttccctatctccacattcc

SEQ ID NO: 353192 - DNA, 20 bp, Artificial Sequence
  chemically synthesized
tcactgagactccaggaatg

SEQ ID NO: 353193 - DNA, 20 bp, Artificial Sequence
  chemically synthesized
tccctatctccacattcctg

SEQ ID NO: 353194 - DNA, 20 bp, Artificial Sequence
  chemically synthesized
tctccacattcctggagtct

SEQ ID NO: 353195 - DNA, 20 bp, Artificial Sequence
  chemically synthesized
ggaaatatcactgagactcc

SEQ ID NO: 353196 - DNA, 20 bp, Artificial Sequence
  chemically synthesized
gggaaatatcactgagactc

SEQ ID NO: 353197 - DNA, 20 bp, Artificial Sequence
  chemically synthesized
catgggtgggaaatatcact

SEQ ID NO: 353198 - DNA, 20 bp, Artificial Sequence
  chemically synthesized
tcagtgatatttcccaccca

SEQ ID NO: 353199 - DNA, 20 bp, Artificial Sequence
  chemically synthesized
cagcagttgcagccatgggt

SEQ ID NO: 353200 - DNA, 20 bp, Artificial Sequence
  chemically synthesized
ccagcagttgcagccatggg

SEQ ID NO: 353201 - DNA, 20 bp, Artificial Sequence
  chemically synthesized
gccccagcagttgcagccat

SEQ ID NO: 353202 - DNA, 20 bp, Artificial Sequence
  chemically synthesized
ggccccagcagttgcagcca

SEQ ID NO: 353203 - DNA, 20 bp, Artificial Sequence
  chemically synthesized
ccacccatggctgcaactgc

SEQ ID NO: 353204 - DNA, 20 bp, Artificial Sequence
  chemically synthesized
tgccttggccccagcagttg

SEQ ID NO: 353205 - DNA, 20 bp, Artificial Sequence
  chemically synthesized
cacccatggctgcaactgct

SEQ ID NO: 353206 - DNA, 20 bp, Artificial Sequence
  chemically synthesized
acccatggctgcaactgctg

SEQ ID NO: 353207 - DNA, 20 bp, Artificial Sequence
  chemically synthesized
ggttcctgccttggccccag

SEQ ID NO: 353208 - DNA, 20 bp, Artificial Sequence
  chemically synthesized
tggctgcaactgctggggcc

SEQ ID NO: 353209 - DNA, 20 bp, Artificial Sequence
  chemically synthesized
ggctgcaactgctggggcca

SEQ ID NO: 353210 - DNA, 20 bp, Artificial Sequence
  chemically synthesized
agtggttcctgccttggccc

SEQ ID NO: 353211 - DNA, 20 bp, Artificial Sequence
  chemically synthesized
tgcaactgctggggccaagg

SEQ ID NO: 353212 - DNA, 20 bp, Artificial Sequence
  chemically synthesized
gcaactgctggggccaaggc

SEQ ID NO: 353213 - DNA, 20 bp, Artificial Sequence
  chemically synthesized
gctgccagtggttcctgcct

SEQ ID NO: 353214 - DNA, 20 bp, Artificial Sequence
  chemically synthesized
ggggccaaggcaggaaccac

SEQ ID NO: 353215 - DNA, 20 bp, Artificial Sequence
  chemically synthesized
gccaaggcaggaaccactgg

SEQ ID NO: 353216 - DNA, 20 bp, Artificial Sequence
  chemically synthesized
aggggagggtttgctgccag

SEQ ID NO: 353217 - DNA, 20 bp, Artificial Sequence
  chemically synthesized
ggcaggggagggtttgctgc

SEQ ID NO: 353218 - DNA, 20 bp, Artificial Sequence
  chemically synthesized
cccctctgttgggcagggga

SEQ ID NO: 353219 - DNA, 20 bp, Artificial Sequence
  chemically synthesized
acccctctgttgggcagggg

SEQ ID NO: 353220 - DNA, 20 bp, Artificial Sequence
  chemically synthesized
cacccctctgttgggcaggg

SEQ ID NO: 353221 - DNA, 20 bp, Artificial Sequence
  chemically synthesized
gccacccctctgttgggcag

SEQ ID NO: 353222 - DNA, 20 bp, Artificial Sequence
  chemically synthesized
gcaaaccctcccctgcccaa

SEQ ID NO: 353223 - DNA, 20 bp, Artificial Sequence
  chemically synthesized
ggccacccctctgttgggca

SEQ ID NO: 353224 - DNA, 20 bp, Artificial Sequence
  chemically synthesized
tggccacccctctgttgggc

SEQ ID NO: 353225 - DNA, 20 bp, Artificial Sequence
  chemically synthesized
aaaccctcccctgcccaaca

SEQ ID NO: 353226 - DNA, 20 bp, Artificial Sequence
  chemically synthesized
gtggccacccctctgttggg

SEQ ID NO: 353227 - DNA, 20 bp, Artificial Sequence
  chemically synthesized
aaccctcccctgcccaacag

SEQ ID NO: 353228 - DNA, 20 bp, Artificial Sequence
  chemically synthesized
accctcccctgcccaacaga

SEQ ID NO: 353229 - DNA, 20 bp, Artificial Sequence
  chemically synthesized
ccctcccctgcccaacagag

SEQ ID NO: 353230 - DNA, 20 bp, Artificial Sequence
  chemically synthesized
tgagtggccacccctctgtt

SEQ ID NO: 353231 - DNA, 20 bp, Artificial Sequence
  chemically synthesized
ttgagtggccacccctctgt

SEQ ID NO: 353232 - DNA, 20 bp, Artificial Sequence
  chemically synthesized
tcccctgcccaacagagggg

SEQ ID NO: 353233 - DNA, 20 bp, Artificial Sequence
  chemically synthesized
tcagtgtgcatgaagttgag

SEQ ID NO: 353234 - DNA, 20 bp, Artificial Sequence
  chemically synthesized
tcttcagtgtgcatgaagtt

SEQ ID NO: 353235 - DNA, 20 bp, Artificial Sequence
  chemically synthesized
attagtcttcagtgtgcatg

SEQ ID NO: 353236 - DNA, 20 bp, Artificial Sequence
  chemically synthesized
actcaacttcatgcacactg

SEQ ID NO: 353237 - DNA, 20 bp, Artificial Sequence
  chemically synthesized
caggcagtggaattagtctt

SEQ ID NO: 353238 - DNA, 20 bp, Artificial Sequence
  chemically synthesized
gcatttgcaggcagtggaat

SEQ ID NO: 353239 - DNA, 20 bp, Artificial Sequence
  chemically synthesized
gtgacagcatttgcaggcag

SEQ ID NO: 353240 - DNA, 20 bp, Artificial Sequence
  chemically synthesized
acagtgacagcatttgcagg

SEQ ID NO: 353241 - DNA, 20 bp, Artificial Sequence
  chemically synthesized
ttcacagtgacagcatttgc

SEQ ID NO: 353242 - DNA, 20 bp, Artificial Sequence
  chemically synthesized
gttcacagtgacagcatttg

SEQ ID NO: 353243 - DNA, 20 bp, Artificial Sequence
  chemically synthesized
tccacagcagttcacagtga

SEQ ID NO: 353244 - DNA, 20 bp, Artificial Sequence
  chemically synthesized
ctcaactccacagcagttca

SEQ ID NO: 353245 - DNA, 20 bp, Artificial Sequence
  chemically synthesized
gctgtcactgtgaactgctg

SEQ ID NO: 353246 - DNA, 20 bp, Artificial Sequence
  chemically synthesized
tgtcactgtgaactgctgtg

SEQ ID NO: 353247 - DNA, 20 bp, Artificial Sequence
  chemically synthesized
cttgtgtctcaactccacag

SEQ ID NO: 353248 - DNA, 20 bp, Artificial Sequence
  chemically synthesized
ctgtgaactgctgtggagtt

SEQ ID NO: 353249 - DNA, 20 bp, Artificial Sequence
  chemically synthesized
tcgcttgtgtctcaactcca

SEQ ID NO: 353250 - DNA, 20 bp, Artificial Sequence
  chemically synthesized
ctgctgtggagttgagacac

SEQ ID NO: 353251 - DNA, 20 bp, Artificial Sequence
  chemically synthesized
gttgagacacaagcgacgca

SEQ ID NO: 353252 - DNA, 20 bp, Artificial Sequence
  chemically synthesized
ttgagacacaagcgacgcac

SEQ ID NO: 353253 - DNA, 20 bp, Artificial Sequence
  chemically synthesized
caagcgacgcacaggctacc

SEQ ID NO: 353254 - DNA, 20 bp, Artificial Sequence
  chemically synthesized
aagcgacgcacaggctaccc

SEQ ID NO: 353255 - DNA, 20 bp, Artificial Sequence
  chemically synthesized
gccataagcagttgcctggg

SEQ ID NO: 353256 - DNA, 20 bp, Artificial Sequence
  chemically synthesized
gcagccataagcagttgcct

SEQ ID NO: 353257 - DNA, 20 bp, Artificial Sequence
  chemically synthesized
agcagccataagcagttgcc

SEQ ID NO: 353258 - DNA, 20 bp, Artificial Sequence
  chemically synthesized
gctacccaggcaactgctta

SEQ ID NO: 353259 - DNA, 20 bp, Artificial Sequence
  chemically synthesized
tccttgggagcagccataag

SEQ ID NO: 353260 - DNA, 20 bp, Artificial Sequence
  chemically synthesized
ctttccttgggagcagccat

SEQ ID NO: 353261 - DNA, 20 bp, Artificial Sequence
  chemically synthesized
aactgcttatggctgctccc

SEQ ID NO: 353262 - DNA, 20 bp, Artificial Sequence
  chemically synthesized
actgcttatggctgctccca

SEQ ID NO: 353263 - DNA, 20 bp, Artificial Sequence
  chemically synthesized
aaggttgctttccttgggag

SEQ ID NO: 353264 - DNA, 20 bp, Artificial Sequence
  chemically synthesized
cttatggctgctcccaagga

SEQ ID NO: 353265 - DNA, 20 bp, Artificial Sequence
  chemically synthesized
ggtaaggttgctttccttgg

SEQ ID NO: 353266 - DNA, 20 bp, Artificial Sequence
  chemically synthesized
agggtaaggttgctttcctt

SEQ ID NO: 353267 - DNA, 20 bp, Artificial Sequence
  chemically synthesized
gagggtaaggttgctttcct

SEQ ID NO: 353268 - DNA, 20 bp, Artificial Sequence
  chemically synthesized
ccctgctactggagagggta

SEQ ID NO: 353269 - DNA, 20 bp, Artificial Sequence
  chemically synthesized
gccctgctactggagagggt

SEQ ID NO: 353270 - DNA, 20 bp, Artificial Sequence
  chemically synthesized
gaaagcaaccttaccctctc

SEQ ID NO: 353271 - DNA, 20 bp, Artificial Sequence
  chemically synthesized
agcaaccttaccctctccag

SEQ ID NO: 353272 - DNA, 20 bp, Artificial Sequence
  chemically synthesized
tgtggccctgctactggaga

SEQ ID NO: 353273 - DNA, 20 bp, Artificial Sequence
  chemically synthesized
ctgtggccctgctactggag

SEQ ID NO: 353274 - DNA, 20 bp, Artificial Sequence
  chemically synthesized
actgtggccctgctactgga

SEQ ID NO: 353275 - DNA, 20 bp, Artificial Sequence
  chemically synthesized
aaccttaccctctccagtag

SEQ ID NO: 353276 - DNA, 20 bp, Artificial Sequence
  chemically synthesized
accttaccctctccagtagc

SEQ ID NO: 353277 - DNA, 20 bp, Artificial Sequence
  chemically synthesized
acactgtggccctgctactg

SEQ ID NO: 353278 - DNA, 20 bp, Artificial Sequence
  chemically synthesized
ccttaccctctccagtagca

SEQ ID NO: 353279 - DNA, 20 bp, Artificial Sequence
  chemically synthesized
ctacactgtggccctgctac

SEQ ID NO: 353280 - DNA, 20 bp, Artificial Sequence
  chemically synthesized
cctctccagtagcagggcca

SEQ ID NO: 353281 - DNA, 20 bp, Artificial Sequence
  chemically synthesized
ccagtagcagggccacagtg

SEQ ID NO: 353282 - DNA, 20 bp, Artificial Sequence
  chemically synthesized
aggcagtgttggctacactg

SEQ ID NO: 353283 - DNA, 20 bp, Artificial Sequence
  chemically synthesized
gctcaggtggaaggcagtgt

SEQ ID NO: 353284 - DNA, 20 bp, Artificial Sequence
  chemically synthesized
tgcaatgctcaggtggaagg

SEQ ID NO: 353285 - DNA, 20 bp, Artificial Sequence
  chemically synthesized
gccaacactgccttccacct

SEQ ID NO: 353286 - DNA, 20 bp, Artificial Sequence
  chemically synthesized
ttgtgcaatgctcaggtgga

SEQ ID NO: 353287 - DNA, 20 bp, Artificial Sequence
  chemically synthesized
cttgtgcaatgctcaggtgg

SEQ ID NO: 353288 - DNA, 20 bp, Artificial Sequence
  chemically synthesized
tcccttgtgcaatgctcagg

SEQ ID NO: 353289 - DNA, 20 bp, Artificial Sequence
  chemically synthesized
aggtcccttgtgcaatgctc

SEQ ID NO: 353290 - DNA, 20 bp, Artificial Sequence
  chemically synthesized
caggtcccttgtgcaatgct

SEQ ID NO: 353291 - DNA, 20 bp, Artificial Sequence
  chemically synthesized
cttccacctgagcattgcac

SEQ ID NO: 353292 - DNA, 20 bp, Artificial Sequence
  chemically synthesized
ttccacctgagcattgcaca

SEQ ID NO: 353293 - DNA, 20 bp, Artificial Sequence
  chemically synthesized
tccacctgagcattgcacaa

SEQ ID NO: 353294 - DNA, 20 bp, Artificial Sequence
  chemically synthesized
tgagcattgcacaagggacc

SEQ ID NO: 353295 - DNA, 20 bp, Artificial Sequence
  chemically synthesized
gagcattgcacaagggacct

SEQ ID NO: 353296 - DNA, 20 bp, Artificial Sequence
  chemically synthesized
agcattgcacaagggacctg

SEQ ID NO: 353297 - DNA, 20 bp, Artificial Sequence
  chemically synthesized
cattgcacaagggacctggg

SEQ ID NO: 353298 - DNA, 20 bp, Artificial Sequence
  chemically synthesized
cgaggggcaaggtgctcccc

SEQ ID NO: 353299 - DNA, 20 bp, Artificial Sequence
  chemically synthesized
tcgaggggcaaggtgctccc

SEQ ID NO: 353300 - DNA, 20 bp, Artificial Sequence
  chemically synthesized
gttattgtagtcgaggggca

SEQ ID NO: 353301 - DNA, 20 bp, Artificial Sequence
  chemically synthesized
ggttattgtagtcgaggggc

SEQ ID NO: 353302 - DNA, 20 bp, Artificial Sequence
  chemically synthesized
cactggttattgtagtcgag

SEQ ID NO: 353303 - DNA, 20 bp, Artificial Sequence
  chemically synthesized
ccactggttattgtagtcga

SEQ ID NO: 353304 - DNA, 20 bp, Artificial Sequence
  chemically synthesized
accactggttattgtagtcg

SEQ ID NO: 353305 - DNA, 20 bp, Artificial Sequence
  chemically synthesized
aaccactggttattgtagtc

SEQ ID NO: 353306 - DNA, 20 bp, Artificial Sequence
  chemically synthesized
tgcccctcgactacaataac

SEQ ID NO: 353307 - DNA, 20 bp, Artificial Sequence
  chemically synthesized
catgcaaccactggttattg

SEQ ID NO: 353308 - DNA, 20 bp, Artificial Sequence
  chemically synthesized
ccctcgactacaataaccag

SEQ ID NO: 353309 - DNA, 20 bp, Artificial Sequence
  chemically synthesized
ctggtggtgcatgcaaccac

SEQ ID NO: 353310 - DNA, 20 bp, Artificial Sequence
  chemically synthesized
ccagtggttgcatgcaccac

SEQ ID NO: 353311 - DNA, 20 bp, Artificial Sequence
  chemically synthesized
cagtggttgcatgcaccacc

SEQ ID NO: 353312 - DNA, 20 bp, Artificial Sequence
  chemically synthesized
gtggttgcatgcaccaccag

SEQ ID NO: 353313 - DNA, 20 bp, Artificial Sequence
  chemically synthesized
cctgtcctcaggactcctgg

SEQ ID NO: 353314 - DNA, 20 bp, Artificial Sequence
  chemically synthesized
agacctgtcctcaggactcc

SEQ ID NO: 353315 - DNA, 20 bp, Artificial Sequence
  chemically synthesized
catgcaccaccaggagtcct

SEQ ID NO: 353316 - DNA, 20 bp, Artificial Sequence
  chemically synthesized
atgcaccaccaggagtcctg

SEQ ID NO: 353317 - DNA, 20 bp, Artificial Sequence
  chemically synthesized
accaccaggagtcctgagga

SEQ ID NO: 353318 - DNA, 20 bp, Artificial Sequence
  chemically synthesized
ccaccaggagtcctgaggac

SEQ ID NO: 353319 - DNA, 20 bp, Artificial Sequence
  chemically synthesized
agctgggaagacctgtcctc

SEQ ID NO: 353320 - DNA, 20 bp, Artificial Sequence
  chemically synthesized
gagctgggaagacctgtcct

SEQ ID NO: 353321 - DNA, 20 bp, Artificial Sequence
  chemically synthesized
gtcctgaggacaggtcttcc

SEQ ID NO: 353322 - DNA, 20 bp, Artificial Sequence
  chemically synthesized
tttggaagagcagagctggg

SEQ ID NO: 353323 - DNA, 20 bp, Artificial Sequence
  chemically synthesized
ggatttggaagagcagagct

SEQ ID NO: 353324 - DNA, 20 bp, Artificial Sequence
  chemically synthesized
gggatttggaagagcagagc

SEQ ID NO: 353325 - DNA, 20 bp, Artificial Sequence
  chemically synthesized
ctgggggatttggaagagca

SEQ ID NO: 353326 - DNA, 20 bp, Artificial Sequence
  chemically synthesized
tactgggggatttggaagag

SEQ ID NO: 353327 - DNA, 20 bp, Artificial Sequence
  chemically synthesized
atgtactgggggatttggaa

SEQ ID NO: 353328 - DNA, 20 bp, Artificial Sequence
  chemically synthesized
ttatgtactgggggatttgg

SEQ ID NO: 353329 - DNA, 20 bp, Artificial Sequence
  chemically synthesized
ctctgctcttccaaatcccc

SEQ ID NO: 353330 - DNA, 20 bp, Artificial Sequence
  chemically synthesized
tttttatgtactgggggatt

SEQ ID NO: 353331 - DNA, 20 bp, Artificial Sequence
  chemically synthesized
tacaaatttttatgtactgg

SEQ ID NO: 353332 - DNA, 20 bp, Artificial Sequence
  chemically synthesized
atacaaatttttatgtactg

SEQ ID NO: 353333 - DNA, 20 bp, Artificial Sequence
  chemically synthesized
tatacaaatttttatgtact

SEQ ID NO: 353334 - DNA, 20 bp, Artificial Sequence
  chemically synthesized
ctatacaaatttttatgtac

SEQ ID NO: 353335 - DNA, 20 bp, Artificial Sequence
  chemically synthesized
ccagtacataaaaatttgta

SEQ ID NO: 353336 - DNA, 20 bp, Artificial Sequence
  chemically synthesized
agtacataaaaatttgtata

SEQ ID NO: 353337 - DNA, 20 bp, Artificial Sequence
  chemically synthesized
taaaaatttgtatagagacc

SEQ ID NO: 353338 - DNA, 20 bp, Artificial Sequence
  chemically synthesized
aaaaatttgtatagagacct

SEQ ID NO: 353339 - DNA, 20 bp, Artificial Sequence
  chemically synthesized
aaaatttgtatagagacctg

SEQ ID NO: 353340 - DNA, 20 bp, Artificial Sequence
  chemically synthesized
aactggggtgggagagcccc

SEQ ID NO: 353341 - DNA, 20 bp, Artificial Sequence
  chemically synthesized
aaactggggtgggagagccc

SEQ ID NO: 353342 - DNA, 20 bp, Artificial Sequence
  chemically synthesized
ggtggtaaactggggtggga

SEQ ID NO: 353343 - DNA, 20 bp, Artificial Sequence
  chemically synthesized
gacctggggctctcccaccc

SEQ ID NO: 353344 - DNA, 20 bp, Artificial Sequence
  chemically synthesized
atggtggtaaactggggtgg

SEQ ID NO: 353345 - DNA, 20 bp, Artificial Sequence
  chemically synthesized
caatggtggtaaactggggt

SEQ ID NO: 353346 - DNA, 20 bp, Artificial Sequence
  chemically synthesized
ccaatggtggtaaactgggg

SEQ ID NO: 353347 - DNA, 20 bp, Artificial Sequence
  chemically synthesized
atgccaatggtggtaaactg

SEQ ID NO: 353348 - DNA, 20 bp, Artificial Sequence
  chemically synthesized
gatgccaatggtggtaaact

SEQ ID NO: 353349 - DNA, 20 bp, Artificial Sequence
  chemically synthesized
agatgccaatggtggtaaac

SEQ ID NO: 353350 - DNA, 20 bp, Artificial Sequence
  chemically synthesized
ccaccccagtttaccaccat

SEQ ID NO: 353351 - DNA, 20 bp, Artificial Sequence
  chemically synthesized
gactagtcagatgccaatgg

SEQ ID NO: 353352 - DNA, 20 bp, Artificial Sequence
  chemically synthesized
gaagactagtcagatgccaa

SEQ ID NO: 353353 - DNA, 20 bp, Artificial Sequence
  chemically synthesized
taccaccattggcatctgac

SEQ ID NO: 353354 - DNA, 20 bp, Artificial Sequence
  chemically synthesized
caggccccaggaagactagt

SEQ ID NO: 353355 - DNA, 20 bp, Artificial Sequence
  chemically synthesized
tggcatctgactagtcttcc

SEQ ID NO: 353356 - DNA, 20 bp, Artificial Sequence
  chemically synthesized
aattcaggccccaggaagac

SEQ ID NO: 353357 - DNA, 20 bp, Artificial Sequence
  chemically synthesized
ggcatctgactagtcttcct

SEQ ID NO: 353358 - DNA, 20 bp, Artificial Sequence
  chemically synthesized
gcatctgactagtcttcctg

SEQ ID NO: 353359 - DNA, 20 bp, Artificial Sequence
  chemically synthesized
gcccaaattcaggccccagg

SEQ ID NO: 353360 - DNA, 20 bp, Artificial Sequence
  chemically synthesized
tgggcccaaattcaggcccc

SEQ ID NO: 353361 - DNA, 20 bp, Artificial Sequence
  chemically synthesized
gtgggcccaaattcaggccc

SEQ ID NO: 353362 - DNA, 20 bp, Artificial Sequence
  chemically synthesized
gtcttcctggggcctgaatt

SEQ ID NO: 353363 - DNA, 20 bp, Artificial Sequence
  chemically synthesized
tcttcctggggcctgaattt

SEQ ID NO: 353364 - DNA, 20 bp, Artificial Sequence
  chemically synthesized
gcttgagtgggcccaaattc

SEQ ID NO: 353365 - DNA, 20 bp, Artificial Sequence
  chemically synthesized
agcttgagtgggcccaaatt

SEQ ID NO: 353366 - DNA, 20 bp, Artificial Sequence
  chemically synthesized
gcctgaatttgggcccactc

SEQ ID NO: 353367 - DNA, 20 bp, Artificial Sequence
  chemically synthesized
gtggtagtggaagcttgagt

SEQ ID NO: 353368 - DNA, 20 bp, Artificial Sequence
  chemically synthesized
ggtggtagtggaagcttgag

SEQ ID NO: 353369 - DNA, 20 bp, Artificial Sequence
  chemically synthesized
tttggtggtagtggaagctt

SEQ ID NO: 353370 - DNA, 20 bp, Artificial Sequence
  chemically synthesized
gccagctttggtggtagtgg

SEQ ID NO: 353371 - DNA, 20 bp, Artificial Sequence
  chemically synthesized
gacgccagctttggtggtag

SEQ ID NO: 353372 - DNA, 20 bp, Artificial Sequence
  chemically synthesized
tcaagcttccactaccacca

SEQ ID NO: 353373 - DNA, 20 bp, Artificial Sequence
  chemically synthesized
gttgacgccagctttggtgg

SEQ ID NO: 353374 - DNA, 20 bp, Artificial Sequence
  chemically synthesized
gcttccactaccaccaaagc

SEQ ID NO: 353375 - DNA, 20 bp, Artificial Sequence
  chemically synthesized
taggttgacgccagctttgg

SEQ ID NO: 353376 - DNA, 20 bp, Artificial Sequence
  chemically synthesized
atgtaggttgacgccagctt

SEQ ID NO: 353377 - DNA, 20 bp, Artificial Sequence
  chemically synthesized
tggtgcatgtaggttgacgc

SEQ ID NO: 353378 - DNA, 20 bp, Artificial Sequence
  chemically synthesized
ggcctgcagatggtgcatgt

SEQ ID NO: 353379 - DNA, 20 bp, Artificial Sequence
  chemically synthesized
aggcctgcagatggtgcatg

SEQ ID NO: 353380 - DNA, 20 bp, Artificial Sequence
  chemically synthesized
caacctacatgcaccatctg

SEQ ID NO: 353381 - DNA, 20 bp, Artificial Sequence
  chemically synthesized
aacctacatgcaccatctgc

SEQ ID NO: 353382 - DNA, 20 bp, Artificial Sequence
  chemically synthesized
ccagttcctaggcctgcaga

SEQ ID NO: 353383 - DNA, 20 bp, Artificial Sequence
  chemically synthesized
acatgcaccatctgcaggcc

SEQ ID NO: 353384 - DNA, 20 bp, Artificial Sequence
  chemically synthesized
catgcaccatctgcaggcct

SEQ ID NO: 353385 - DNA, 20 bp, Artificial Sequence
  chemically synthesized
caagccagttcctaggcctg

SEQ ID NO: 353386 - DNA, 20 bp, Artificial Sequence
  chemically synthesized
ccatctgcaggcctaggaac

SEQ ID NO: 353387 - DNA, 20 bp, Artificial Sequence
  chemically synthesized
gattgggcaagccagttcct

SEQ ID NO: 353388 - DNA, 20 bp, Artificial Sequence
  chemically synthesized
agattgggcaagccagttcc

SEQ ID NO: 353389 - DNA, 20 bp, Artificial Sequence
  chemically synthesized
atgcaacagattgggcaagc

SEQ ID NO: 353390 - DNA, 20 bp, Artificial Sequence
  chemically synthesized
gtggatgcaacagattgggc

SEQ ID NO: 353391 - DNA, 20 bp, Artificial Sequence
  chemically synthesized
ggtggtggatgcaacagatt

SEQ ID NO: 353392 - DNA, 20 bp, Artificial Sequence
  chemically synthesized
tggtggtggatgcaacagat

SEQ ID NO: 353393 - DNA, 20 bp, Artificial Sequence
  chemically synthesized
ggtgttggtggtggatgcaa

SEQ ID NO: 353394 - DNA, 20 bp, Artificial Sequence
  chemically synthesized
atccatgatggtgttggtgg

SEQ ID NO: 353395 - DNA, 20 bp, Artificial Sequence
  chemically synthesized
gcaatccatgatggtgttgg

SEQ ID NO: 353396 - DNA, 20 bp, Artificial Sequence
  chemically synthesized
caagcaatccatgatggtgt

SEQ ID NO: 353397 - DNA, 20 bp, Artificial Sequence
  chemically synthesized
atccaccaccaacaccatca

SEQ ID NO: 353398 - DNA, 20 bp, Artificial Sequence
  chemically synthesized
ggaatgcaagcaatccatga

SEQ ID NO: 353399 - DNA, 20 bp, Artificial Sequence
  chemically synthesized
atcatggattgcttgcattc

SEQ ID NO: 353400 - DNA, 20 bp, Artificial Sequence
  chemically synthesized
ggggcaaccctctggaatgc

SEQ ID NO: 353401 - DNA, 20 bp, Artificial Sequence
  chemically synthesized
catggattgcttgcattcca

SEQ ID NO: 353402 - DNA, 20 bp, Artificial Sequence
  chemically synthesized
atggattgcttgcattccag

SEQ ID NO: 353403 - DNA, 20 bp, Artificial Sequence
  chemically synthesized
tggattgcttgcattccaga

SEQ ID NO: 353404 - DNA, 20 bp, Artificial Sequence
  chemically synthesized
gtgggaggggggcaaccctc

SEQ ID NO: 353405 - DNA, 20 bp, Artificial Sequence
  chemically synthesized
taatggcaatagtgggaggg

SEQ ID NO: 353406 - DNA, 20 bp, Artificial Sequence
  chemically synthesized
gtaatggcaatagtgggagg

SEQ ID NO: 353407 - DNA, 20 bp, Artificial Sequence
  chemically synthesized
ggtaatggcaatagtgggag

SEQ ID NO: 353408 - DNA, 20 bp, Artificial Sequence
  chemically synthesized
gggtaatggcaatagtggga

SEQ ID NO: 353409 - DNA, 20 bp, Artificial Sequence
  chemically synthesized
cgggtaatggcaatagtggg

SEQ ID NO: 353410 - DNA, 20 bp, Artificial Sequence
  chemically synthesized
gcgggtaatggcaatagtgg

SEQ ID NO: 353411 - DNA, 20 bp, Artificial Sequence
  chemically synthesized
gtgcgggtaatggcaatagt

SEQ ID NO: 353412 - DNA, 20 bp, Artificial Sequence
  chemically synthesized
ggtgcgggtaatggcaatag

SEQ ID NO: 353413 - DNA, 20 bp, Artificial Sequence
  chemically synthesized
catggtgcgggtaatggcaa

SEQ ID NO: 353414 - DNA, 20 bp, Artificial Sequence
  chemically synthesized
agcaagcatggtgcgggtaa

SEQ ID NO: 353415 - DNA, 20 bp, Artificial Sequence
  chemically synthesized
aggggcagcaagcatggtgc

SEQ ID NO: 353416 - DNA, 20 bp, Artificial Sequence
  chemically synthesized
caggggcagcaagcatggtg

SEQ ID NO: 353417 - DNA, 20 bp, Artificial Sequence
  chemically synthesized
cagcccaggggcagcaagca

SEQ ID NO: 353418 - DNA, 20 bp, Artificial Sequence
  chemically synthesized
gttcccagcccaggggcagc

SEQ ID NO: 353419 - DNA, 20 bp, Artificial Sequence
  chemically synthesized
cgcaccatgcttgctgcccc

SEQ ID NO: 353420 - DNA, 20 bp, Artificial Sequence
  chemically synthesized
gcaccatgcttgctgcccct

SEQ ID NO: 353421 - DNA, 20 bp, Artificial Sequence
  chemically synthesized
acaggttcccagcccagggg

SEQ ID NO: 353422 - DNA, 20 bp, Artificial Sequence
  chemically synthesized
catgcttgctgcccctgggc

SEQ ID NO: 353423 - DNA, 20 bp, Artificial Sequence
  chemically synthesized
atgcttgctgcccctgggct

SEQ ID NO: 353424 - DNA, 20 bp, Artificial Sequence
  chemically synthesized
tacacaggttcccagcccag

SEQ ID NO: 353425 - DNA, 20 bp, Artificial Sequence
  chemically synthesized
gtacacaggttcccagccca

SEQ ID NO: 353426 - DNA, 20 bp, Artificial Sequence
  chemically synthesized
ggtacacaggttcccagccc

SEQ ID NO: 353427 - DNA, 20 bp, Artificial Sequence
  chemically synthesized
gggtacacaggttcccagcc

SEQ ID NO: 353428 - DNA, 20 bp, Artificial Sequence
  chemically synthesized
tgggtgggtacacaggttcc

SEQ ID NO: 353429 - DNA, 20 bp, Artificial Sequence
  chemically synthesized
ggtgggctgggtgggtacac

SEQ ID NO: 353430 - DNA, 20 bp, Artificial Sequence
  chemically synthesized
aggtgggctgggtgggtaca

SEQ ID NO: 353431 - DNA, 20 bp, Artificial Sequence
  chemically synthesized
tgggaacctgtgtacccacc

SEQ ID NO: 353432 - DNA, 20 bp, Artificial Sequence
  chemically synthesized
aaagcataggtgggctgggt

SEQ ID NO: 353433 - DNA, 20 bp, Artificial Sequence
  chemically synthesized
aaaagcataggtgggctggg

SEQ ID NO: 353434 - DNA, 20 bp, Artificial Sequence
  chemically synthesized
aggaaaagcataggtgggct

SEQ ID NO: 353435 - DNA, 20 bp, Artificial Sequence
  chemically synthesized
caggaaaagcataggtgggc

SEQ ID NO: 353436 - DNA, 20 bp, Artificial Sequence
  chemically synthesized
ttgtcaggaaaagcataggt

SEQ ID NO: 353437 - DNA, 20 bp, Artificial Sequence
  chemically synthesized
gttgtcaggaaaagcatagg

SEQ ID NO: 353438 - DNA, 20 bp, Artificial Sequence
  chemically synthesized
ttggttgtcaggaaaagcat

SEQ ID NO: 353439 - DNA, 20 bp, Artificial Sequence
  chemically synthesized
cttggttgtcaggaaaagca

SEQ ID NO: 353440 - DNA, 20 bp, Artificial Sequence
  chemically synthesized
gcttgcttggttgtcaggaa

SEQ ID NO: 353441 - DNA, 20 bp, Artificial Sequence
  chemically synthesized
ctatgcttttcctgacaacc

SEQ ID NO: 353442 - DNA, 20 bp, Artificial Sequence
  chemically synthesized
aggtggcttgcttggttgtc

SEQ ID NO: 353443 - DNA, 20 bp, Artificial Sequence
  chemically synthesized
taggtggcttgcttggttgt

SEQ ID NO: 353444 - DNA, 20 bp, Artificial Sequence
  chemically synthesized
gcttttcctgacaaccaagc

SEQ ID NO: 353445 - DNA, 20 bp, Artificial Sequence
  chemically synthesized
tggcttataggtggcttgct

SEQ ID NO: 353446 - DNA, 20 bp, Artificial Sequence
  chemically synthesized
caaccaagcaagccacctat

SEQ ID NO: 353447 - DNA, 20 bp, Artificial Sequence
  chemically synthesized
ctaaccctttggcttatagg

SEQ ID NO: 353448 - DNA, 20 bp, Artificial Sequence
  chemically synthesized
aggctaaccctttggcttat

SEQ ID NO: 353449 - DNA, 20 bp, Artificial Sequence
  chemically synthesized
agcaagccacctataagcca

SEQ ID NO: 353450 - DNA, 20 bp, Artificial Sequence
  chemically synthesized
caggctaaccctttggctta

SEQ ID NO: 353451 - DNA, 20 bp, Artificial Sequence
  chemically synthesized
gcaagccacctataagccaa

SEQ ID NO: 353452 - DNA, 20 bp, Artificial Sequence
  chemically synthesized
caagccacctataagccaaa

SEQ ID NO: 353453 - DNA, 20 bp, Artificial Sequence
  chemically synthesized
ccacctataagccaaagggt

SEQ ID NO: 353454 - DNA, 20 bp, Artificial Sequence
  chemically synthesized
gtccaggcaggctaaccctt

SEQ ID NO: 353455 - DNA, 20 bp, Artificial Sequence
  chemically synthesized
agccaaagggttagcctgcc

SEQ ID NO: 353456 - DNA, 20 bp, Artificial Sequence
  chemically synthesized
tgatgttagtgtgtccaggc

SEQ ID NO: 353457 - DNA, 20 bp, Artificial Sequence
  chemically synthesized
ttgatgttagtgtgtccagg

SEQ ID NO: 353458 - DNA, 20 bp, Artificial Sequence
  chemically synthesized
gcattgatgttagtgtgtcc

SEQ ID NO: 353459 - DNA, 20 bp, Artificial Sequence
  chemically synthesized
ggcattgatgttagtgtgtc

SEQ ID NO: 353460 - DNA, 20 bp, Artificial Sequence
  chemically synthesized
gtgtacattggcattgatgt

SEQ ID NO: 353461 - DNA, 20 bp, Artificial Sequence
  chemically synthesized
aacatcaatgccaatgtaca

SEQ ID NO: 353462 - DNA, 20 bp, Artificial Sequence
  chemically synthesized
ggcctcagagctgtgtacat

SEQ ID NO: 353463 - DNA, 20 bp, Artificial Sequence
  chemically synthesized
atgccaatgtacacagctct

SEQ ID NO: 353464 - DNA, 20 bp, Artificial Sequence
  chemically synthesized
tgccaatgtacacagctctg

SEQ ID NO: 353465 - DNA, 20 bp, Artificial Sequence
  chemically synthesized
gtgcctgtcctcaggcctca

SEQ ID NO: 353466 - DNA, 20 bp, Artificial Sequence
  chemically synthesized
tgtacacagctctgaggcct

SEQ ID NO: 353467 - DNA, 20 bp, Artificial Sequence
  chemically synthesized
gtacacagctctgaggcctg

SEQ ID NO: 353468 - DNA, 20 bp, Artificial Sequence
  chemically synthesized
gcgtgcctgtcctcaggcct

SEQ ID NO: 353469 - DNA, 20 bp, Artificial Sequence
  chemically synthesized
acagctctgaggcctgagga

SEQ ID NO: 353470 - DNA, 20 bp, Artificial Sequence
  chemically synthesized
cagctctgaggcctgaggac

SEQ ID NO: 353471 - DNA, 20 bp, Artificial Sequence
  chemically synthesized
ggttgagcgtgcctgtcctc

SEQ ID NO: 353472 - DNA, 20 bp, Artificial Sequence
  chemically synthesized
tggttgagcgtgcctgtcct

SEQ ID NO: 353473 - DNA, 20 bp, Artificial Sequence
  chemically synthesized
agtggtggcatcagttggtt

SEQ ID NO: 353474 - DNA, 20 bp, Artificial Sequence
  chemically synthesized
gccccagtggtggcatcagt

SEQ ID NO: 353475 - DNA, 20 bp, Artificial Sequence
  chemically synthesized
tcaggccccagtggtggcat

SEQ ID NO: 353476 - DNA, 20 bp, Artificial Sequence
  chemically synthesized
caaccaactgatgccaccac

SEQ ID NO: 353477 - DNA, 20 bp, Artificial Sequence
  chemically synthesized
aaccaactgatgccaccact

SEQ ID NO: 353478 - DNA, 20 bp, Artificial Sequence
  chemically synthesized
accaactgatgccaccactg

SEQ ID NO: 353479 - DNA, 20 bp, Artificial Sequence
  chemically synthesized
cagtcttcaggccccagtgg

SEQ ID NO: 353480 - DNA, 20 bp, Artificial Sequence
  chemically synthesized
gtccagtcttcaggccccag

SEQ ID NO: 353481 - DNA, 20 bp, Artificial Sequence
  chemically synthesized
gatgccaccactggggcctg

SEQ ID NO: 353482 - DNA, 20 bp, Artificial Sequence
  chemically synthesized
gtggtccagtcttcaggccc

SEQ ID NO: 353483 - DNA, 20 bp, Artificial Sequence
  chemically synthesized
caccactggggcctgaagac

SEQ ID NO: 353484 - DNA, 20 bp, Artificial Sequence
  chemically synthesized
caccaagtggtccagtcttc

SEQ ID NO: 353485 - DNA, 20 bp, Artificial Sequence
  chemically synthesized
acaccaagtggtccagtctt

SEQ ID NO: 353486 - DNA, 20 bp, Artificial Sequence
  chemically synthesized
ggcctgaagactggaccact

SEQ ID NO: 353487 - DNA, 20 bp, Artificial Sequence
  chemically synthesized
gactgggacaccaagtggtc

SEQ ID NO: 353488 - DNA, 20 bp, Artificial Sequence
  chemically synthesized
ccggtgactgggacaccaag

SEQ ID NO: 353489 - DNA, 20 bp, Artificial Sequence
  chemically synthesized
gactggaccacttggtgtcc

SEQ ID NO: 353490 - DNA, 20 bp, Artificial Sequence
  chemically synthesized
ttgccggtgactgggacacc

SEQ ID NO: 353491 - DNA, 20 bp, Artificial Sequence
  chemically synthesized
ccacttggtgtcccagtcac

SEQ ID NO: 353492 - DNA, 20 bp, Artificial Sequence
  chemically synthesized
gtgaagttttgccggtgact

SEQ ID NO: 353493 - DNA, 20 bp, Artificial Sequence
  chemically synthesized
ggtgaagttttgccggtgac

SEQ ID NO: 353494 - DNA, 20 bp, Artificial Sequence
  chemically synthesized
aagctgtggtgaagttttgc

SEQ ID NO: 353495 - DNA, 20 bp, Artificial Sequence
  chemically synthesized
tcaccggcaaaacttcacca

SEQ ID NO: 353496 - DNA, 20 bp, Artificial Sequence
  chemically synthesized
tgttagcagaagctgtggtg

SEQ ID NO: 353497 - DNA, 20 bp, Artificial Sequence
  chemically synthesized
gcagttgttagcagaagctg

SEQ ID NO: 353498 - DNA, 20 bp, Artificial Sequence
  chemically synthesized
tagggtgcagttgttagcag

SEQ ID NO: 353499 - DNA, 20 bp, Artificial Sequence
  chemically synthesized
gcttagggtgcagttgttag

SEQ ID NO: 353500 - DNA, 20 bp, Artificial Sequence
  chemically synthesized
gtagcttagggtgcagttgt

SEQ ID NO: 353501 - DNA, 20 bp, Artificial Sequence
  chemically synthesized
tctgctaacaactgcaccct

SEQ ID NO: 353502 - DNA, 20 bp, Artificial Sequence
  chemically synthesized
ttcctcagtagcttagggtg

SEQ ID NO: 353503 - DNA, 20 bp, Artificial Sequence
  chemically synthesized
gtaacttcctcagtagctta

SEQ ID NO: 353504 - DNA, 20 bp, Artificial Sequence
  chemically synthesized
tgtaacttcctcagtagctt

SEQ ID NO: 353505 - DNA, 20 bp, Artificial Sequence
  chemically synthesized
caactgcaccctaagctact

SEQ ID NO: 353506 - DNA, 20 bp, Artificial Sequence
  chemically synthesized
ctgtaacttcctcagtagct

SEQ ID NO: 353507 - DNA, 20 bp, Artificial Sequence
  chemically synthesized
aactgcaccctaagctactg

SEQ ID NO: 353508 - DNA, 20 bp, Artificial Sequence
  chemically synthesized
tgcaccctaagctactgagg

SEQ ID NO: 353509 - DNA, 20 bp, Artificial Sequence
  chemically synthesized
ggtgtctgtaacttcctcag

SEQ ID NO: 353510 - DNA, 20 bp, Artificial Sequence
  chemically synthesized
aatggtgtctgtaacttcct

SEQ ID NO: 353511 - DNA, 20 bp, Artificial Sequence
  chemically synthesized
ctaagctactgaggaagtta

SEQ ID NO: 353512 - DNA, 20 bp, Artificial Sequence
  chemically synthesized
ttggatgtaaacagtatgaa

SEQ ID NO: 353513 - DNA, 20 bp, Artificial Sequence
  chemically synthesized
atgatttctttggatgtaaa

SEQ ID NO: 353514 - DNA, 20 bp, Artificial Sequence
  chemically synthesized
attcatactgtttacatcca

SEQ ID NO: 353515 - DNA, 20 bp, Artificial Sequence
  chemically synthesized
tacttcctgtatgatttctt

SEQ ID NO: 353516 - DNA, 20 bp, Artificial Sequence
  chemically synthesized
ttacatccaaagaaatcata

SEQ ID NO: 353517 - DNA, 20 bp, Artificial Sequence
  chemically synthesized
tacatccaaagaaatcatac

SEQ ID NO: 353518 - DNA, 20 bp, Artificial Sequence
  chemically synthesized
atccaaagaaatcatacagg

SEQ ID NO: 353519 - DNA, 20 bp, Artificial Sequence
  chemically synthesized
ttgattctgaatgtatatag

SEQ ID NO: 353520 - DNA, 20 bp, Artificial Sequence
  chemically synthesized
cctttgattctgaatgtata

SEQ ID NO: 353521 - DNA, 20 bp, Artificial Sequence
  chemically synthesized
agtatactactatatacatt

SEQ ID NO: 353522 - DNA, 20 bp, Artificial Sequence
  chemically synthesized
actatatacattcagaatca

SEQ ID NO: 353523 - DNA, 20 bp, Artificial Sequence
  chemically synthesized
ctatatacattcagaatcaa

SEQ ID NO: 353524 - DNA, 20 bp, Artificial Sequence
  chemically synthesized
tacattcagaatcaaaggca

SEQ ID NO: 353525 - DNA, 20 bp, Artificial Sequence
  chemically synthesized
agaatcaaaggcaaagactc

SEQ ID NO: 353526 - DNA, 20 bp, Artificial Sequence
  chemically synthesized
aatcaaaggcaaagactcaa

SEQ ID NO: 353527 - DNA, 20 bp, Artificial Sequence
  chemically synthesized
atcaaaggcaaagactcaag

SEQ ID NO: 353528 - DNA, 20 bp, Artificial Sequence
  chemically synthesized
caaaggcaaagactcaagag

SEQ ID NO: 353529 - DNA, 20 bp, Artificial Sequence
  chemically synthesized
gttttatctagtctcctctt

SEQ ID NO: 353530 - DNA, 20 bp, Artificial Sequence
  chemically synthesized
gcaaagactcaagaggagac

SEQ ID NO: 353531 - DNA, 20 bp, Artificial Sequence
  chemically synthesized
caagaggagactagataaaa

SEQ ID NO: 353532 - DNA, 20 bp, Artificial Sequence
  chemically synthesized
tgagattcttctgttttatc

SEQ ID NO: 353533 - DNA, 20 bp, Artificial Sequence
  chemically synthesized
gaggagactagataaaacag

SEQ ID NO: 353534 - DNA, 20 bp, Artificial Sequence
  chemically synthesized
tagataaaacagaagaatct

SEQ ID NO: 353535 - DNA, 20 bp, Artificial Sequence
  chemically synthesized
aagacctgttttcatgttct

SEQ ID NO: 353536 - DNA, 20 bp, Artificial Sequence
  chemically synthesized
agaatctcagaacatgaaaa

SEQ ID NO: 353537 - DNA, 20 bp, Artificial Sequence
  chemically synthesized
gaatctcagaacatgaaaac

SEQ ID NO: 353538 - DNA, 20 bp, Artificial Sequence
  chemically synthesized
gtttgagtaggttattttaa

SEQ ID NO: 353539 - DNA, 20 bp, Artificial Sequence
  chemically synthesized
ttgttattttttgtttgagt

SEQ ID NO: 353540 - DNA, 20 bp, Artificial Sequence
  chemically synthesized
tttgttattttttgtttgag

SEQ ID NO: 353541 - DNA, 20 bp, Artificial Sequence
  chemically synthesized
ttttttgttattttttgttt

SEQ ID NO: 353542 - DNA, 20 bp, Artificial Sequence
  chemically synthesized
acaaaaaattttaaaaaaat

SEQ ID NO: 353543 - DNA, 20 bp, Artificial Sequence
  chemically synthesized
aaattttaaaaaaatgagca

SEQ ID NO: 353544 - DNA, 20 bp, Artificial Sequence
  chemically synthesized
tggtgttgtatatgtcacat

SEQ ID NO: 353545 - DNA, 20 bp, Artificial Sequence
  chemically synthesized
atggtgttgtatatgtcaca

SEQ ID NO: 353546 - DNA, 20 bp, Artificial Sequence
  chemically synthesized
gtgacatatacaacaccata

SEQ ID NO: 353547 - DNA, 20 bp, Artificial Sequence
  chemically synthesized
gcaagcatttcatggcttta

SEQ ID NO: 353548 - DNA, 20 bp, Artificial Sequence
  chemically synthesized
taaaaaatgcaagcatttca

SEQ ID NO: 353549 - DNA, 20 bp, Artificial Sequence
  chemically synthesized
ttctaggacataaaaaatgc

SEQ ID NO: 353550 - DNA, 20 bp, Artificial Sequence
  chemically synthesized
tgcttgcattttttatgtcc

SEQ ID NO: 353551 - DNA, 20 bp, Artificial Sequence
  chemically synthesized
ttgcattttttatgtcctag

SEQ ID NO: 353552 - DNA, 20 bp, Artificial Sequence
  chemically synthesized
tgcattttttatgtcctaga

SEQ ID NO: 353553 - DNA, 20 bp, Artificial Sequence
  chemically synthesized
tagtttctcctttaccttct

SEQ ID NO: 353554 - DNA, 20 bp, Artificial Sequence
  chemically synthesized
tttttatgtcctagaaggta

SEQ ID NO: 353555 - DNA, 20 bp, Artificial Sequence
  chemically synthesized
ttagtttctcctttaccttc

SEQ ID NO: 353556 - DNA, 20 bp, Artificial Sequence
  chemically synthesized
ttttatgtcctagaaggtaa

SEQ ID NO: 353557 - DNA, 20 bp, Artificial Sequence
  chemically synthesized
ttatgtcctagaaggtaaag

SEQ ID NO: 353558 - DNA, 20 bp, Artificial Sequence
  chemically synthesized
agaaggtaaaggagaaacta

SEQ ID NO: 353559 - DNA, 20 bp, Artificial Sequence
  chemically synthesized
gaaggtaaaggagaaactaa

SEQ ID NO: 353560 - DNA, 20 bp, Artificial Sequence
  chemically synthesized
taaaggagaaactaaaggtt

SEQ ID NO: 353561 - DNA, 20 bp, Artificial Sequence
  chemically synthesized
aaatagggtttctaaacctt

SEQ ID NO: 353562 - DNA, 20 bp, Artificial Sequence
  chemically synthesized
atctattattttgttaaata

SEQ ID NO: 353563 - DNA, 20 bp, Artificial Sequence
  chemically synthesized
catctattattttgttaaat

SEQ ID NO: 353564 - DNA, 20 bp, Artificial Sequence
  chemically synthesized
tcatctattattttgttaaa

SEQ ID NO: 353565 - DNA, 20 bp, Artificial Sequence
  chemically synthesized
aaccctatttaacaaaataa

SEQ ID NO: 353566 - DNA, 20 bp, Artificial Sequence
  chemically synthesized
ataatagatgaaatcttccc

SEQ ID NO: 353567 - DNA, 20 bp, Artificial Sequence
  chemically synthesized
aatctcttgctagacttggg

SEQ ID NO: 353568 - DNA, 20 bp, Artificial Sequence
  chemically synthesized
agatgaaatcttcccaagtc

SEQ ID NO: 353569 - DNA, 20 bp, Artificial Sequence
  chemically synthesized
ctaaatctcttgctagactt

SEQ ID NO: 353570 - DNA, 20 bp, Artificial Sequence
  chemically synthesized
tctaaatctcttgctagact

SEQ ID NO: 353571 - DNA, 20 bp, Artificial Sequence
  chemically synthesized
gaaatcttcccaagtctagc

SEQ ID NO: 353572 - DNA, 20 bp, Artificial Sequence
  chemically synthesized
aatcttcccaagtctagcaa

SEQ ID NO: 353573 - DNA, 20 bp, Artificial Sequence
  chemically synthesized
tggatgtctaaatctcttgc

SEQ ID NO: 353574 - DNA, 20 bp, Artificial Sequence
  chemically synthesized
cccaagtctagcaagagatt

SEQ ID NO: 353575 - DNA, 20 bp, Artificial Sequence
  chemically synthesized
tagcaagagatttagacatc

SEQ ID NO: 353576 - DNA, 20 bp, Artificial Sequence
  chemically synthesized
gagatttagacatccagata

SEQ ID NO: 353577 - DNA, 20 bp, Artificial Sequence
  chemically synthesized
agatttagacatccagatac

SEQ ID NO: 353578 - DNA, 20 bp, Artificial Sequence
  chemically synthesized
atctttcagcatcctgtatc

SEQ ID NO: 353579 - DNA, 20 bp, Artificial Sequence
  chemically synthesized
atccagatacaggatgctga

SEQ ID NO: 353580 - DNA, 20 bp, Artificial Sequence
  chemically synthesized
tatccctttttgagatcttt

SEQ ID NO: 353581 - DNA, 20 bp, Artificial Sequence
  chemically synthesized
ggatgctgaaagatctcaaa

SEQ ID NO: 353582 - DNA, 20 bp, Artificial Sequence
  chemically synthesized
gatgctgaaagatctcaaaa

SEQ ID NO: 353583 - DNA, 20 bp, Artificial Sequence
  chemically synthesized
atgctgaaagatctcaaaaa

SEQ ID NO: 353584 - DNA, 20 bp, Artificial Sequence
  chemically synthesized
tttgaattgtatcccttttt

SEQ ID NO: 353585 - DNA, 20 bp, Artificial Sequence
  chemically synthesized
ggctataatgtgtcatggac

SEQ ID NO: 353586 - DNA, 20 bp, Artificial Sequence
  chemically synthesized
agtttggctataatgtgtca

SEQ ID NO: 353587 - DNA, 20 bp, Artificial Sequence
  chemically synthesized
gtcttgtccatgacacatta

SEQ ID NO: 353588 - DNA, 20 bp, Artificial Sequence
  chemically synthesized
gtctttggcttttgagagtt

SEQ ID NO: 353589 - DNA, 20 bp, Artificial Sequence
  chemically synthesized
cattatagccaaactctcaa

SEQ ID NO: 353590 - DNA, 20 bp, Artificial Sequence
  chemically synthesized
tttttgtctttggcttttga

SEQ ID NO: 353591 - DNA, 20 bp, Artificial Sequence
  chemically synthesized
tctttttgtctttggctttt

SEQ ID NO: 353592 - DNA, 20 bp, Artificial Sequence
  chemically synthesized
agccaaactctcaaaagcca

SEQ ID NO: 353593 - DNA, 20 bp, Artificial Sequence
  chemically synthesized
tagaattctctttttgtctt

SEQ ID NO: 353594 - DNA, 20 bp, Artificial Sequence
  chemically synthesized
tctcaaaagccaaagacaaa

SEQ ID NO: 353595 - DNA, 20 bp, Artificial Sequence
  chemically synthesized
tcaaaagccaaagacaaaaa

SEQ ID NO: 353596 - DNA, 20 bp, Artificial Sequence
  chemically synthesized
caaaaagagaattctaaaaa

SEQ ID NO: 353597 - DNA, 20 bp, Artificial Sequence
  chemically synthesized
tgcttttctcttgctgtttt

SEQ ID NO: 353598 - DNA, 20 bp, Artificial Sequence
  chemically synthesized
aagagaattctaaaaacagc

SEQ ID NO: 353599 - DNA, 20 bp, Artificial Sequence
  chemically synthesized
gagaattctaaaaacagcaa

SEQ ID NO: 353600 - DNA, 20 bp, Artificial Sequence
  chemically synthesized
ttctaaaaacagcaagagaa

SEQ ID NO: 353601 - DNA, 20 bp, Artificial Sequence
  chemically synthesized
aggtttctttataagtgaca

SEQ ID NO: 353602 - DNA, 20 bp, Artificial Sequence
  chemically synthesized
gaggtttctttataagtgac

SEQ ID NO: 353603 - DNA, 20 bp, Artificial Sequence
  chemically synthesized
aaagcaccttgtcacttata

SEQ ID NO: 353604 - DNA, 20 bp, Artificial Sequence
  chemically synthesized
tctgatggaggtttctttat

SEQ ID NO: 353605 - DNA, 20 bp, Artificial Sequence
  chemically synthesized
acttataaagaaacctccat

SEQ ID NO: 353606 - DNA, 20 bp, Artificial Sequence
  chemically synthesized
attcactgttaatctgatgg

SEQ ID NO: 353607 - DNA, 20 bp, Artificial Sequence
  chemically synthesized
aattcactgttaatctgatg

SEQ ID NO: 353608 - DNA, 20 bp, Artificial Sequence
  chemically synthesized
gaaattcactgttaatctga

SEQ ID NO: 353609 - DNA, 20 bp, Artificial Sequence
  chemically synthesized
agaaacctccatcagattaa

SEQ ID NO: 353610 - DNA, 20 bp, Artificial Sequence
  chemically synthesized
cagattaacagtgaatttct

SEQ ID NO: 353611 - DNA, 20 bp, Artificial Sequence
  chemically synthesized
attaacagtgaatttctcag

SEQ ID NO: 353612 - DNA, 20 bp, Artificial Sequence
  chemically synthesized
tggcctgtaaggtttcttct

SEQ ID NO: 353613 - DNA, 20 bp, Artificial Sequence
  chemically synthesized
atttctcagaagaaacctta

SEQ ID NO: 353614 - DNA, 20 bp, Artificial Sequence
  chemically synthesized
tttctcagaagaaaccttac

SEQ ID NO: 353615 - DNA, 20 bp, Artificial Sequence
  chemically synthesized
tcagaagaaaccttacaggc

SEQ ID NO: 353616 - DNA, 20 bp, Artificial Sequence
  chemically synthesized
tcattcttctctggcctgta

SEQ ID NO: 353617 - DNA, 20 bp, Artificial Sequence
  chemically synthesized
ctcattcttctctggcctgt

SEQ ID NO: 353618 - DNA, 20 bp, Artificial Sequence
  chemically synthesized
agaagaaaccttacaggcca

SEQ ID NO: 353619 - DNA, 20 bp, Artificial Sequence
  chemically synthesized
agaaaccttacaggccagag

SEQ ID NO: 353620 - DNA, 20 bp, Artificial Sequence
  chemically synthesized
tataacatctcattcttctc

SEQ ID NO: 353621 - DNA, 20 bp, Artificial Sequence
  chemically synthesized
cttacaggccagagaagaat

SEQ ID NO: 353622 - DNA, 20 bp, Artificial Sequence
  chemically synthesized
tgttatattaaacttgctga

SEQ ID NO: 353623 - DNA, 20 bp, Artificial Sequence
  chemically synthesized
ggtggttgttttctttcagc

SEQ ID NO: 353624 - DNA, 20 bp, Artificial Sequence
  chemically synthesized
ggctggtggttgttttcttt

SEQ ID NO: 353625 - DNA, 20 bp, Artificial Sequence
  chemically synthesized
tgctgaaagaaaacaaccac

SEQ ID NO: 353626 - DNA, 20 bp, Artificial Sequence
  chemically synthesized
aaagaaaacaaccaccagcc

SEQ ID NO: 353627 - DNA, 20 bp, Artificial Sequence
  chemically synthesized
aagaaaacaaccaccagcca

SEQ ID NO: 353628 - DNA, 20 bp, Artificial Sequence
  chemically synthesized
ggtagagtatccttggctgg

SEQ ID NO: 353629 - DNA, 20 bp, Artificial Sequence
  chemically synthesized
ctgggtagagtatccttggc

SEQ ID NO: 353630 - DNA, 20 bp, Artificial Sequence
  chemically synthesized
ttggctgggtagagtatcct

SEQ ID NO: 353631 - DNA, 20 bp, Artificial Sequence
  chemically synthesized
ccagccaaggatactctacc

SEQ ID NO: 353632 - DNA, 20 bp, Artificial Sequence
  chemically synthesized
aaggctaccttggctgggta

SEQ ID NO: 353633 - DNA, 20 bp, Artificial Sequence
  chemically synthesized
caaggatactctacccagcc

SEQ ID NO: 353634 - DNA, 20 bp, Artificial Sequence
  chemically synthesized
tgaaggctaccttggctggg

SEQ ID NO: 353635 - DNA, 20 bp, Artificial Sequence
  chemically synthesized
aaggatactctacccagcca

SEQ ID NO: 353636 - DNA, 20 bp, Artificial Sequence
  chemically synthesized
ttatgaaggctaccttggct

SEQ ID NO: 353637 - DNA, 20 bp, Artificial Sequence
  chemically synthesized
gatactctacccagccaagg

SEQ ID NO: 353638 - DNA, 20 bp, Artificial Sequence
  chemically synthesized
tttatgaaggctaccttggc

SEQ ID NO: 353639 - DNA, 20 bp, Artificial Sequence
  chemically synthesized
ttgatttatgaaggctacct

SEQ ID NO: 353640 - DNA, 20 bp, Artificial Sequence
  chemically synthesized
tatttctccttgatttatga

SEQ ID NO: 353641 - DNA, 20 bp, Artificial Sequence
  chemically synthesized
ttatttctccttgatttatg

SEQ ID NO: 353642 - DNA, 20 bp, Artificial Sequence
  chemically synthesized
caaggtagccttcataaatc

SEQ ID NO: 353643 - DNA, 20 bp, Artificial Sequence
  chemically synthesized
aaggtagccttcataaatca

SEQ ID NO: 353644 - DNA, 20 bp, Artificial Sequence
  chemically synthesized
ggtagccttcataaatcaag

SEQ ID NO: 353645 - DNA, 20 bp, Artificial Sequence
  chemically synthesized
taaatcaaggagaaataaaa

SEQ ID NO: 353646 - DNA, 20 bp, Artificial Sequence
  chemically synthesized
aggagaaataaaatagttcc

SEQ ID NO: 353647 - DNA, 20 bp, Artificial Sequence
  chemically synthesized
aaataaaatagttcctagac

SEQ ID NO: 353648 - DNA, 20 bp, Artificial Sequence
  chemically synthesized
tccacagctttcactcgtct

SEQ ID NO: 353649 - DNA, 20 bp, Artificial Sequence
  chemically synthesized
ttccacagctttcactcgtc

SEQ ID NO: 353650 - DNA, 20 bp, Artificial Sequence
  chemically synthesized
aatagttcctagacgagtga

SEQ ID NO: 353651 - DNA, 20 bp, Artificial Sequence
  chemically synthesized
tcctagacgagtgaaagctg

SEQ ID NO: 353652 - DNA, 20 bp, Artificial Sequence
  chemically synthesized
atcatggtgataaatttcca

SEQ ID NO: 353653 - DNA, 20 bp, Artificial Sequence
  chemically synthesized
gaaatttatcaccatgatac

SEQ ID NO: 353654 - DNA, 20 bp, Artificial Sequence
  chemically synthesized
ttcttgtaaggccagtatca

SEQ ID NO: 353655 - DNA, 20 bp, Artificial Sequence
  chemically synthesized
caccatgatactggccttac

SEQ ID NO: 353656 - DNA, 20 bp, Artificial Sequence
  chemically synthesized
ttaaacctttcttgtaaggc

SEQ ID NO: 353657 - DNA, 20 bp, Artificial Sequence
  chemically synthesized
atgatactggccttacaaga

SEQ ID NO: 353658 - DNA, 20 bp, Artificial Sequence
  chemically synthesized
tcccttaaacctttcttgta

SEQ ID NO: 353659 - DNA, 20 bp, Artificial Sequence
  chemically synthesized
tgatactggccttacaagaa

SEQ ID NO: 353660 - DNA, 20 bp, Artificial Sequence
  chemically synthesized
ctcccttaaacctttcttgt

SEQ ID NO: 353661 - DNA, 20 bp, Artificial Sequence
  chemically synthesized
tggccttacaagaaaggttt

SEQ ID NO: 353662 - DNA, 20 bp, Artificial Sequence
  chemically synthesized
ggccttacaagaaaggttta

SEQ ID NO: 353663 - DNA, 20 bp, Artificial Sequence
  chemically synthesized
gccttacaagaaaggtttaa

SEQ ID NO: 353664 - DNA, 20 bp, Artificial Sequence
  chemically synthesized
cttacaagaaaggtttaagg

SEQ ID NO: 353665 - DNA, 20 bp, Artificial Sequence
  chemically synthesized
gtttaagggagtcctatacc

SEQ ID NO: 353666 - DNA, 20 bp, Artificial Sequence
  chemically synthesized
attctttcacttccaggtat

SEQ ID NO: 353667 - DNA, 20 bp, Artificial Sequence
  chemically synthesized
taagggagtcctatacctgg

SEQ ID NO: 353668 - DNA, 20 bp, Artificial Sequence
  chemically synthesized
cattctttcacttccaggta

SEQ ID NO: 353669 - DNA, 20 bp, Artificial Sequence
  chemically synthesized
gttgtcattctttcacttcc

SEQ ID NO: 353670 - DNA, 20 bp, Artificial Sequence
  chemically synthesized
agtcctatacctggaagtga

SEQ ID NO: 353671 - DNA, 20 bp, Artificial Sequence
  chemically synthesized
agttgtcattctttcacttc

SEQ ID NO: 353672 - DNA, 20 bp, Artificial Sequence
  chemically synthesized
tttatgtgttttcatgatgg

SEQ ID NO: 353673 - DNA, 20 bp, Artificial Sequence
  chemically synthesized
atttttatgtgttttcatga

SEQ ID NO: 353674 - DNA, 20 bp, Artificial Sequence
  chemically synthesized
cataaaaatataaaaacaac

SEQ ID NO: 353675 - DNA, 20 bp, Artificial Sequence
  chemically synthesized
aaaaatataaaaacaactag

SEQ ID NO: 353676 - DNA, 20 bp, Artificial Sequence
  chemically synthesized
tttttgtgtgtttgcactac

SEQ ID NO: 353677 - DNA, 20 bp, Artificial Sequence
  chemically synthesized
gcaaacacacaaaaaaaatc

SEQ ID NO: 353678 - DNA, 20 bp, Artificial Sequence
  chemically synthesized
cacacaaaaaaaatcaagaa

SEQ ID NO: 353679 - DNA, 20 bp, Artificial Sequence
  chemically synthesized
attctttagtggtaacattt

SEQ ID NO: 353680 - DNA, 20 bp, Artificial Sequence
  chemically synthesized
ttactcaaatgttaccacta

SEQ ID NO: 353681 - DNA, 20 bp, Artificial Sequence
  chemically synthesized
agtgtgatggtattctttag

SEQ ID NO: 353682 - DNA, 20 bp, Artificial Sequence
  chemically synthesized
tatagtgtgatggtattctt

SEQ ID NO: 353683 - DNA, 20 bp, Artificial Sequence
  chemically synthesized
tcattatcattatagtgtga

SEQ ID NO: 353684 - DNA, 20 bp, Artificial Sequence
  chemically synthesized
tttttccctcattatcatta

SEQ ID NO: 353685 - DNA, 20 bp, Artificial Sequence
  chemically synthesized
catcacactataatgataat

SEQ ID NO: 353686 - DNA, 20 bp, Artificial Sequence
  chemically synthesized
atcacactataatgataatg

SEQ ID NO: 353687 - DNA, 20 bp, Artificial Sequence
  chemically synthesized
tcacactataatgataatga

SEQ ID NO: 353688 - DNA, 20 bp, Artificial Sequence
  chemically synthesized
gataatgagggaaaaaaatg

SEQ ID NO: 353689 - DNA, 20 bp, Artificial Sequence
  chemically synthesized
tctttcattttattgattta

SEQ ID NO: 353690 - DNA, 20 bp, Artificial Sequence
  chemically synthesized
accataaatcaataaaatga

SEQ ID NO: 353691 - DNA, 20 bp, Artificial Sequence
  chemically synthesized
atcaataaaatgaaagaaat

SEQ ID NO: 353692 - DNA, 20 bp, Artificial Sequence
  chemically synthesized
acattattactgatatgtga

SEQ ID NO: 353693 - DNA, 20 bp, Artificial Sequence
  chemically synthesized
agaaataagccctcacatat

SEQ ID NO: 353694 - DNA, 20 bp, Artificial Sequence
  chemically synthesized
aacattattactgatatgtg

SEQ ID NO: 353695 - DNA, 20 bp, Artificial Sequence
  chemically synthesized
caacattattactgatatgt

SEQ ID NO: 353696 - DNA, 20 bp, Artificial Sequence
  chemically synthesized
tgattaaacattccacataa

SEQ ID NO: 353697 - DNA, 20 bp, Artificial Sequence
  chemically synthesized
gccagtttatgtcttttatg

SEQ ID NO: 353698 - DNA, 20 bp, Artificial Sequence
  chemically synthesized
tccacataaaagacataaac

SEQ ID NO: 353699 - DNA, 20 bp, Artificial Sequence
  chemically synthesized
aaagacataaactggctgaa

SEQ ID NO: 353700 - DNA, 20 bp, Artificial Sequence
  chemically synthesized
tattttttaatccattcagc

SEQ ID NO: 353701 - DNA, 20 bp, Artificial Sequence
  chemically synthesized
tatatattttttaatccatt

SEQ ID NO: 353702 - DNA, 20 bp, Artificial Sequence
  chemically synthesized
attttaggcagaatattttt

SEQ ID NO: 353703 - DNA, 20 bp, Artificial Sequence
  chemically synthesized
tattttaggcagaatatttt

SEQ ID NO: 353704 - DNA, 20 bp, Artificial Sequence
  chemically synthesized
tgaaatgagtttattttagg

SEQ ID NO: 353705 - DNA, 20 bp, Artificial Sequence
  chemically synthesized
aggtgaaatgagtttatttt

SEQ ID NO: 353706 - DNA, 20 bp, Artificial Sequence
  chemically synthesized
caggtgaaatgagtttattt

SEQ ID NO: 353707 - DNA, 20 bp, Artificial Sequence
  chemically synthesized
tgtgtctttacaggtgaaat

SEQ ID NO: 353708 - DNA, 20 bp, Artificial Sequence
  chemically synthesized
ataaactcatttcacctgta

SEQ ID NO: 353709 - DNA, 20 bp, Artificial Sequence
  chemically synthesized
aaatctatatgtgtctttac

SEQ ID NO: 353710 - DNA, 20 bp, Artificial Sequence
  chemically synthesized
caaatctatatgtgtcttta

SEQ ID NO: 353711 - DNA, 20 bp, Artificial Sequence
  chemically synthesized
ttcacctgtaaagacacata

SEQ ID NO: 353712 - DNA, 20 bp, Artificial Sequence
  chemically synthesized
taaagacacatatagatttg

SEQ ID NO: 353713 - DNA, 20 bp, Artificial Sequence
  chemically synthesized
acacatatagatttgaagta

SEQ ID NO: 353714 - DNA, 20 bp, Artificial Sequence
  chemically synthesized
cacatatagatttgaagtaa

SEQ ID NO: 353715 - DNA, 20 bp, Artificial Sequence
  chemically synthesized
acatatagatttgaagtaaa

SEQ ID NO: 353716 - DNA, 20 bp, Artificial Sequence
  chemically synthesized
atagatttgaagtaaaggga

SEQ ID NO: 353717 - DNA, 20 bp, Artificial Sequence
  chemically synthesized
tttgaagtaaagggatggaa

SEQ ID NO: 353718 - DNA, 20 bp, Artificial Sequence
  chemically synthesized
agtatattttatgcaaaccg

SEQ ID NO: 353719 - DNA, 20 bp, Artificial Sequence
  chemically synthesized
ttttatgcaaaccgaagcca

SEQ ID NO: 353720 - DNA, 20 bp, Artificial Sequence
  chemically synthesized
tttatgcaaaccgaagccaa

SEQ ID NO: 353721 - DNA, 20 bp, Artificial Sequence
  chemically synthesized
ctgcttctcccctttggctt

SEQ ID NO: 353722 - DNA, 20 bp, Artificial Sequence
  chemically synthesized
ttatgcaaaccgaagccaaa

SEQ ID NO: 353723 - DNA, 20 bp, Artificial Sequence
  chemically synthesized
tatgcaaaccgaagccaaag

SEQ ID NO: 353724 - DNA, 20 bp, Artificial Sequence
  chemically synthesized
tgcaaaccgaagccaaaggg

SEQ ID NO: 353725 - DNA, 20 bp, Artificial Sequence
  chemically synthesized
tagctgctgcttctcccctt

SEQ ID NO: 353726 - DNA, 20 bp, Artificial Sequence
  chemically synthesized
aaaccgaagccaaaggggag

SEQ ID NO: 353727 - DNA, 20 bp, Artificial Sequence
  chemically synthesized
ccgaagccaaaggggagaag

SEQ ID NO: 353728 - DNA, 20 bp, Artificial Sequence
  chemically synthesized
aagccaaaggggagaagcag

SEQ ID NO: 353729 - DNA, 20 bp, Artificial Sequence
  chemically synthesized
aagtctgttttatgtaagca

SEQ ID NO: 353730 - DNA, 20 bp, Artificial Sequence
  chemically synthesized
actgaaagtctgttttatgt

SEQ ID NO: 353731 - DNA, 20 bp, Artificial Sequence
  chemically synthesized
gcagctatgcttacataaaa

SEQ ID NO: 353732 - DNA, 20 bp, Artificial Sequence
  chemically synthesized
gcttacataaaacagacttt

SEQ ID NO: 353733 - DNA, 20 bp, Artificial Sequence
  chemically synthesized
tttttactgtttttgactga

SEQ ID NO: 353734 - DNA, 20 bp, Artificial Sequence
  chemically synthesized
aacagactttcagtcaaaaa

SEQ ID NO: 353735 - DNA, 20 bp, Artificial Sequence
  chemically synthesized
aaacagtaaaaacaaacaat

SEQ ID NO: 353736 - DNA, 20 bp, Artificial Sequence
  chemically synthesized
aacagtaaaaacaaacaata

SEQ ID NO: 353737 - DNA, 20 bp, Artificial Sequence
  chemically synthesized
aaggtcattatataatgata

SEQ ID NO: 353738 - DNA, 20 bp, Artificial Sequence
  chemically synthesized
aggtcattatataatgataa

SEQ ID NO: 353739 - DNA, 20 bp, Artificial Sequence
  chemically synthesized
ggtcattatataatgataaa

SEQ ID NO: 353740 - DNA, 20 bp, Artificial Sequence
  chemically synthesized
ttatataatgataaagggat

SEQ ID NO: 353741 - DNA, 20 bp, Artificial Sequence
  chemically synthesized
taatgataaagggataagtt

SEQ ID NO: 353742 - DNA, 20 bp, Artificial Sequence
  chemically synthesized
gataaagggataagtttagc

SEQ ID NO: 353743 - DNA, 20 bp, Artificial Sequence
  chemically synthesized
taaagggataagtttagcaa

SEQ ID NO: 353744 - DNA, 20 bp, Artificial Sequence
  chemically synthesized
gtgttgggtgtatgtatgtt

SEQ ID NO: 353745 - DNA, 20 bp, Artificial Sequence
  chemically synthesized
aacatacatacacccaacac

SEQ ID NO: 353746 - DNA, 20 bp, Artificial Sequence
  chemically synthesized
catacatacacccaacacga

SEQ ID NO: 353747 - DNA, 20 bp, Artificial Sequence
  chemically synthesized
tatctgggagctctcgtgtt

SEQ ID NO: 353748 - DNA, 20 bp, Artificial Sequence
  chemically synthesized
atatctgggagctctcgtgt

SEQ ID NO: 353749 - DNA, 20 bp, Artificial Sequence
  chemically synthesized
acacccaacacgagagctcc

SEQ ID NO: 353750 - DNA, 20 bp, Artificial Sequence
  chemically synthesized
tacttgctttatatatctgg

SEQ ID NO: 353751 - DNA, 20 bp, Artificial Sequence
  chemically synthesized
aatacttgctttatatatct

SEQ ID NO: 353752 - DNA, 20 bp, Artificial Sequence
  chemically synthesized
taatacttgctttatatatc

SEQ ID NO: 353753 - DNA, 20 bp, Artificial Sequence
  chemically synthesized
cgagagctcccagatatata

SEQ ID NO: 353754 - DNA, 20 bp, Artificial Sequence
  chemically synthesized
agctcccagatatataaagc

SEQ ID NO: 353755 - DNA, 20 bp, Artificial Sequence
  chemically synthesized
cagatatataaagcaagtat

SEQ ID NO: 353756 - DNA, 20 bp, Artificial Sequence
  chemically synthesized
taaagcaagtattagatcta

SEQ ID NO: 353757 - DNA, 20 bp, Artificial Sequence
  chemically synthesized
aaagcaagtattagatctaa

SEQ ID NO: 353758 - DNA, 20 bp, Artificial Sequence
  chemically synthesized
aagcaagtattagatctaaa

SEQ ID NO: 353759 - DNA, 20 bp, Artificial Sequence
  chemically synthesized
gcaagtattagatctaaagg

SEQ ID NO: 353760 - DNA, 20 bp, Artificial Sequence
  chemically synthesized
aagtattagatctaaaggga

SEQ ID NO: 353761 - DNA, 20 bp, Artificial Sequence
  chemically synthesized
tttgcatctagctctccctt

SEQ ID NO: 353762 - DNA, 20 bp, Artificial Sequence
  chemically synthesized
attagatctaaagggagagc

SEQ ID NO: 353763 - DNA, 20 bp, Artificial Sequence
  chemically synthesized
gatattactgtatttgcatc

SEQ ID NO: 353764 - DNA, 20 bp, Artificial Sequence
  chemically synthesized
gggagagctagatgcaaata

SEQ ID NO: 353765 - DNA, 20 bp, Artificial Sequence
  chemically synthesized
atgcaaatacagtaatatct

SEQ ID NO: 353766 - DNA, 20 bp, Artificial Sequence
  chemically synthesized
tgcaaatacagtaatatctg

SEQ ID NO: 353767 - DNA, 20 bp, Artificial Sequence
  chemically synthesized
gagtggggtgttgaagtcct

SEQ ID NO: 353768 - DNA, 20 bp, Artificial Sequence
  chemically synthesized
atgctgagagtggggtgttg

SEQ ID NO: 353769 - DNA, 20 bp, Artificial Sequence
  chemically synthesized
ggacttcaacaccccactct

SEQ ID NO: 353770 - DNA, 20 bp, Artificial Sequence
  chemically synthesized
gtgatctaatgctgagagtg

SEQ ID NO: 353771 - DNA, 20 bp, Artificial Sequence
  chemically synthesized
agtgatctaatgctgagagt

SEQ ID NO: 353772 - DNA, 20 bp, Artificial Sequence
  chemically synthesized
aagtgatctaatgctgagag

SEQ ID NO: 353773 - DNA, 20 bp, Artificial Sequence
  chemically synthesized
caacaccccactctcagcat

SEQ ID NO: 353774 - DNA, 20 bp, Artificial Sequence
  chemically synthesized
tctaagtgatctaatgctga

SEQ ID NO: 353775 - DNA, 20 bp, Artificial Sequence
  chemically synthesized
tgtctaagtgatctaatgct

SEQ ID NO: 353776 - DNA, 20 bp, Artificial Sequence
  chemically synthesized
actctcagcattagatcact

SEQ ID NO: 353777 - DNA, 20 bp, Artificial Sequence
  chemically synthesized
tctttgttaattttttgtct

SEQ ID NO: 353778 - DNA, 20 bp, Artificial Sequence
  chemically synthesized
acttagacaaaaaattaaca

SEQ ID NO: 353779 - DNA, 20 bp, Artificial Sequence
  chemically synthesized
aaaaattaacaaagaaacat

SEQ ID NO: 353780 - DNA, 20 bp, Artificial Sequence
  chemically synthesized
ttggtctaaggagcagtttc

SEQ ID NO: 353781 - DNA, 20 bp, Artificial Sequence
  chemically synthesized
attggcttgaaactgctcct

SEQ ID NO: 353782 - DNA, 20 bp, Artificial Sequence
  chemically synthesized
ggactatttggtctaaggag

SEQ ID NO: 353783 - DNA, 20 bp, Artificial Sequence
  chemically synthesized
ttaggactatttggtctaag

SEQ ID NO: 353784 - DNA, 20 bp, Artificial Sequence
  chemically synthesized
tgttaggactatttggtcta

SEQ ID NO: 353785 - DNA, 20 bp, Artificial Sequence
  chemically synthesized
ctgttaggactatttggtct

SEQ ID NO: 353786 - DNA, 20 bp, Artificial Sequence
  chemically synthesized
aaactgctccttagaccaaa

SEQ ID NO: 353787 - DNA, 20 bp, Artificial Sequence
  chemically synthesized
aagtgtctgttaggactatt

SEQ ID NO: 353788 - DNA, 20 bp, Artificial Sequence
  chemically synthesized
cttagaccaaatagtcctaa

SEQ ID NO: 353789 - DNA, 20 bp, Artificial Sequence
  chemically synthesized
ttgtcctataagtgtctgtt

SEQ ID NO: 353790 - DNA, 20 bp, Artificial Sequence
  chemically synthesized
attgtcctataagtgtctgt

SEQ ID NO: 353791 - DNA, 20 bp, Artificial Sequence
  chemically synthesized
atagtcctaacagacactta

SEQ ID NO: 353792 - DNA, 20 bp, Artificial Sequence
  chemically synthesized
tagtcctaacagacacttat

SEQ ID NO: 353793 - DNA, 20 bp, Artificial Sequence
  chemically synthesized
tgttgaaggaattgtcctat

SEQ ID NO: 353794 - DNA, 20 bp, Artificial Sequence
  chemically synthesized
ttataggacaattccttcaa

SEQ ID NO: 353795 - DNA, 20 bp, Artificial Sequence
  chemically synthesized
aaaatgtgtatgactgttga

SEQ ID NO: 353796 - DNA, 20 bp, Artificial Sequence
  chemically synthesized
aaaaatgtgtatgactgttg

SEQ ID NO: 353797 - DNA, 20 bp, Artificial Sequence
  chemically synthesized
catacacatttttttctcat

SEQ ID NO: 353798 - DNA, 20 bp, Artificial Sequence
  chemically synthesized
agaatgttctgtgtgcttat

SEQ ID NO: 353799 - DNA, 20 bp, Artificial Sequence
  chemically synthesized
atttttttctcataagcaca

SEQ ID NO: 353800 - DNA, 20 bp, Artificial Sequence
  chemically synthesized
taagcacacagaacattctc

SEQ ID NO: 353801 - DNA, 20 bp, Artificial Sequence
  chemically synthesized
aagcacacagaacattctcc

SEQ ID NO: 353802 - DNA, 20 bp, Artificial Sequence
  chemically synthesized
acacagaacattctccagga

SEQ ID NO: 353803 - DNA, 20 bp, Artificial Sequence
  chemically synthesized
ataacatatggtctgtcctg

SEQ ID NO: 353804 - DNA, 20 bp, Artificial Sequence
  chemically synthesized
tcataacatatggtctgtcc

SEQ ID NO: 353805 - DNA, 20 bp, Artificial Sequence
  chemically synthesized
acatattctgtcataacata

SEQ ID NO: 353806 - DNA, 20 bp, Artificial Sequence
  chemically synthesized
ggacagaccatatgttatga

SEQ ID NO: 353807 - DNA, 20 bp, Artificial Sequence
  chemically synthesized
tgattttttataaatttgtt

SEQ ID NO: 353808 - DNA, 20 bp, Artificial Sequence
  chemically synthesized
cttgtgttttaagaagatat

SEQ ID NO: 353809 - DNA, 20 bp, Artificial Sequence
  chemically synthesized
ttatttccttgtgttttaag

SEQ ID NO: 353810 - DNA, 20 bp, Artificial Sequence
  chemically synthesized
ctaatatcttcttaaaacac

SEQ ID NO: 353811 - DNA, 20 bp, Artificial Sequence
  chemically synthesized
ttgttatttccttgtgtttt

SEQ ID NO: 353812 - DNA, 20 bp, Artificial Sequence
  chemically synthesized
taatatcttcttaaaacaca

SEQ ID NO: 353813 - DNA, 20 bp, Artificial Sequence
  chemically synthesized
aaacacaaggaaataacaaa

SEQ ID NO: 353814 - DNA, 20 bp, Artificial Sequence
  chemically synthesized
acacaaggaaataacaaaaa

SEQ ID NO: 353815 - DNA, 20 bp, Artificial Sequence
  chemically synthesized
aataacaaaaagagaaactt

SEQ ID NO: 353816 - DNA, 20 bp, Artificial Sequence
  chemically synthesized
atgtttttgtacaggttcca

SEQ ID NO: 353817 - DNA, 20 bp, Artificial Sequence
  chemically synthesized
caatttccatgtttttgtac

SEQ ID NO: 353818 - DNA, 20 bp, Artificial Sequence
  chemically synthesized
tcaatttccatgtttttgta

SEQ ID NO: 353819 - DNA, 20 bp, Artificial Sequence
  chemically synthesized
ttggaacctgtacaaaaaca

SEQ ID NO: 353820 - DNA, 20 bp, Artificial Sequence
  chemically synthesized
ttgacccaatggtcattcag

SEQ ID NO: 353821 - DNA, 20 bp, Artificial Sequence
  chemically synthesized
ccttgacccaatggtcattc

SEQ ID NO: 353822 - DNA, 20 bp, Artificial Sequence
  chemically synthesized
tccttgacccaatggtcatt

SEQ ID NO: 353823 - DNA, 20 bp, Artificial Sequence
  chemically synthesized
acatactcctgaatgaccat

SEQ ID NO: 353824 - DNA, 20 bp, Artificial Sequence
  chemically synthesized
catactcctgaatgaccatt

SEQ ID NO: 353825 - DNA, 20 bp, Artificial Sequence
  chemically synthesized
tcctgaatgaccattgggtc

SEQ ID NO: 353826 - DNA, 20 bp, Artificial Sequence
  chemically synthesized
aattttcttccttgacccaa

SEQ ID NO: 353827 - DNA, 20 bp, Artificial Sequence
  chemically synthesized
cctgaatgaccattgggtca

SEQ ID NO: 353828 - DNA, 20 bp, Artificial Sequence
  chemically synthesized
gaatgaccattgggtcaagg

SEQ ID NO: 353829 - DNA, 20 bp, Artificial Sequence
  chemically synthesized
ttgggtcaaggaagaaaatt

SEQ ID NO: 353830 - DNA, 20 bp, Artificial Sequence
  chemically synthesized
tgggtcaaggaagaaaattg

SEQ ID NO: 353831 - DNA, 20 bp, Artificial Sequence
  chemically synthesized
tcaaaatataataacaccta

SEQ ID NO: 353832 - DNA, 20 bp, Artificial Sequence
  chemically synthesized
caaaatataataacacctac

SEQ ID NO: 353833 - DNA, 20 bp, Artificial Sequence
  chemically synthesized
ctgcttttgccatatcccgt

SEQ ID NO: 353834 - DNA, 20 bp, Artificial Sequence
  chemically synthesized
ataataacacctacgggata

SEQ ID NO: 353835 - DNA, 20 bp, Artificial Sequence
  chemically synthesized
actgcttttgccatatcccg

SEQ ID NO: 353836 - DNA, 20 bp, Artificial Sequence
  chemically synthesized
acacctacgggatatggcaa

SEQ ID NO: 353837 - DNA, 20 bp, Artificial Sequence
  chemically synthesized
cctacgggatatggcaaaag

SEQ ID NO: 353838 - DNA, 20 bp, Artificial Sequence
  chemically synthesized
gatatggcaaaagcagtgct

SEQ ID NO: 353839 - DNA, 20 bp, Artificial Sequence
  chemically synthesized
atatggcaaaagcagtgcta

SEQ ID NO: 353840 - DNA, 20 bp, Artificial Sequence
  chemically synthesized
tatggcaaaagcagtgctaa

SEQ ID NO: 353841 - DNA, 20 bp, Artificial Sequence
  chemically synthesized
atggcaaaagcagtgctaag

SEQ ID NO: 353842 - DNA, 20 bp, Artificial Sequence
  chemically synthesized
tggcaaaagcagtgctaagg

SEQ ID NO: 353843 - DNA, 20 bp, Artificial Sequence
  chemically synthesized
tttgctatatacatccccct

SEQ ID NO: 353844 - DNA, 20 bp, Artificial Sequence
  chemically synthesized
agtgctaagggggatgtata

SEQ ID NO: 353845 - DNA, 20 bp, Artificial Sequence
  chemically synthesized
tatttcaacatttttgatgt

SEQ ID NO: 353846 - DNA, 20 bp, Artificial Sequence
  chemically synthesized
atatttcaaacaatctaaca

SEQ ID NO: 353847 - DNA, 20 bp, Artificial Sequence
  chemically synthesized
agctccttgaagtactttgt

SEQ ID NO: 353848 - DNA, 20 bp, Artificial Sequence
  chemically synthesized
acaatctaacaaagtacttc

SEQ ID NO: 353849 - DNA, 20 bp, Artificial Sequence
  chemically synthesized
caatctaacaaagtacttca

SEQ ID NO: 353850 - DNA, 20 bp, Artificial Sequence
  chemically synthesized
atctaacaaagtacttcaag

SEQ ID NO: 353851 - DNA, 20 bp, Artificial Sequence
  chemically synthesized
tttctttgactagctccttg

SEQ ID NO: 353852 - DNA, 20 bp, Artificial Sequence
  chemically synthesized
aacaaagtacttcaaggagc

SEQ ID NO: 353853 - DNA, 20 bp, Artificial Sequence
  chemically synthesized
gtacttcaaggagctagtca

SEQ ID NO: 353854 - DNA, 20 bp, Artificial Sequence
  chemically synthesized
tttgtttttttttctttgac

SEQ ID NO: 353855 - DNA, 20 bp, Artificial Sequence
  chemically synthesized
aaaaaaaaacaaaccaaacc

SEQ ID NO: 353856 - DNA, 20 bp, Artificial Sequence
  chemically synthesized
ccttctactaattctgggtt

SEQ ID NO: 353857 - DNA, 20 bp, Artificial Sequence
  chemically synthesized
aaacaaaccaaacccagaat

SEQ ID NO: 353858 - DNA, 20 bp, Artificial Sequence
  chemically synthesized
ttcatccttctactaattct

SEQ ID NO: 353859 - DNA, 20 bp, Artificial Sequence
  chemically synthesized
caaaccaaacccagaattag

SEQ ID NO: 353860 - DNA, 20 bp, Artificial Sequence
  chemically synthesized
tttcatccttctactaattc

SEQ ID NO: 353861 - DNA, 20 bp, Artificial Sequence
  chemically synthesized
accaaacccagaattagtag

SEQ ID NO: 353862 - DNA, 20 bp, Artificial Sequence
  chemically synthesized
ccaaacccagaattagtaga

SEQ ID NO: 353863 - DNA, 20 bp, Artificial Sequence
  chemically synthesized
ggatgaaaatcctaaaaatt

SEQ ID NO: 353864 - DNA, 20 bp, Artificial Sequence
  chemically synthesized
ttgagttttgctcaattttt

SEQ ID NO: 353865 - DNA, 20 bp, Artificial Sequence
  chemically synthesized
cttgagttttgctcaatttt

SEQ ID NO: 353866 - DNA, 20 bp, Artificial Sequence
  chemically synthesized
ctaaaaattgagcaaaactc

SEQ ID NO: 353867 - DNA, 20 bp, Artificial Sequence
  chemically synthesized
ttgagcaaaactcaagaaaa

SEQ ID NO: 353868 - DNA, 20 bp, Artificial Sequence
  chemically synthesized
tttttgctctctattttctt

SEQ ID NO: 353869 - DNA, 20 bp, Artificial Sequence
  chemically synthesized
gagcaaaactcaagaaaata

SEQ ID NO: 353870 - DNA, 20 bp, Artificial Sequence
  chemically synthesized
gcaaaactcaagaaaataga

SEQ ID NO: 353871 - DNA, 20 bp, Artificial Sequence
  chemically synthesized
aatagagagcaaaaaataca

SEQ ID NO: 353872 - DNA, 20 bp, Artificial Sequence
  chemically synthesized
atacaaagtatcaatgaaat

SEQ ID NO: 353873 - DNA, 20 bp, Artificial Sequence
  chemically synthesized
caaagtatcaatgaaatgag

SEQ ID NO: 353874 - DNA, 20 bp, Artificial Sequence
  chemically synthesized
tgagaagtttgatttttaaa

SEQ ID NO: 353875 - DNA, 20 bp, Artificial Sequence
  chemically synthesized
tttttaaaaagatgaaaata

SEQ ID NO: 353876 - DNA, 20 bp, Artificial Sequence
  chemically synthesized
gatgaaaataaagcacttgc

SEQ ID NO: 353877 - DNA, 20 bp, Artificial Sequence
  chemically synthesized
tttttcttggttagtctagc

SEQ ID NO: 353878 - DNA, 20 bp, Artificial Sequence
  chemically synthesized
tttttttttcttggttagtc

SEQ ID NO: 353879 - DNA, 20 bp, Artificial Sequence
  chemically synthesized
aagcacttgctagactaacc

SEQ ID NO: 353880 - DNA, 20 bp, Artificial Sequence
  chemically synthesized
agtcttttttttttcttggt

SEQ ID NO: 353881 - DNA, 20 bp, Artificial Sequence
  chemically synthesized
tttgagtcttttttttttct

SEQ ID NO: 353882 - DNA, 20 bp, Artificial Sequence
  chemically synthesized
agactaaccaagaaaaaaaa

SEQ ID NO: 353883 - DNA, 20 bp, Artificial Sequence
  chemically synthesized
ccgtcttcatttatgatttt

SEQ ID NO: 353884 - DNA, 20 bp, Artificial Sequence
  chemically synthesized
aagactcaaaatcataaatg

SEQ ID NO: 353885 - DNA, 20 bp, Artificial Sequence
  chemically synthesized
ctcaaaatcataaatgaaga

SEQ ID NO: 353886 - DNA, 20 bp, Artificial Sequence
  chemically synthesized
caaaatcataaatgaagacg

SEQ ID NO: 353887 - DNA, 20 bp, Artificial Sequence
  chemically synthesized
agacattacaactgatacca

SEQ ID NO: 353888 - DNA, 20 bp, Artificial Sequence
  chemically synthesized
actttttatttctatggtat

SEQ ID NO: 353889 - DNA, 20 bp, Artificial Sequence
  chemically synthesized
ctctgaactttttatttcta

SEQ ID NO: 353890 - DNA, 20 bp, Artificial Sequence
  chemically synthesized
actgataccatagaaataaa

SEQ ID NO: 353891 - DNA, 20 bp, Artificial Sequence
  chemically synthesized
taccatagaaataaaaagtt

SEQ ID NO: 353892 - DNA, 20 bp, Artificial Sequence
  chemically synthesized
ccatagaaataaaaagttca

SEQ ID NO: 353893 - DNA, 20 bp, Artificial Sequence
  chemically synthesized
tatttaatagttgttcagta

SEQ ID NO: 353894 - DNA, 20 bp, Artificial Sequence
  chemically synthesized
tttattatttaatagttgtt

SEQ ID NO: 353895 - DNA, 20 bp, Artificial Sequence
  chemically synthesized
atttttagtttattatttaa

SEQ ID NO: 353896 - DNA, 20 bp, Artificial Sequence
  chemically synthesized
taaataataaactaaaaatc

SEQ ID NO: 353897 - DNA, 20 bp, Artificial Sequence
  chemically synthesized
tatacattcctctagatttt

SEQ ID NO: 353898 - DNA, 20 bp, Artificial Sequence
  chemically synthesized
aataataaactaaaaatcta

SEQ ID NO: 353899 - DNA, 20 bp, Artificial Sequence
  chemically synthesized
ataataaactaaaaatctag

SEQ ID NO: 353900 - DNA, 20 bp, Artificial Sequence
  chemically synthesized
cgggaatttatacattcctc

SEQ ID NO: 353901 - DNA, 20 bp, Artificial Sequence
  chemically synthesized
tagaggaatgtataaattcc

SEQ ID NO: 353902 - DNA, 20 bp, Artificial Sequence
  chemically synthesized
acggttggttgtatgtgtcc

SEQ ID NO: 353903 - DNA, 20 bp, Artificial Sequence
  chemically synthesized
cacggttggttgtatgtgtc

SEQ ID NO: 353904 - DNA, 20 bp, Artificial Sequence
  chemically synthesized
cggacacatacaaccaaccg

SEQ ID NO: 353905 - DNA, 20 bp, Artificial Sequence
  chemically synthesized
atttcttcttgatccacggt

SEQ ID NO: 353906 - DNA, 20 bp, Artificial Sequence
  chemically synthesized
catacaaccaaccgtggatc

SEQ ID NO: 353907 - DNA, 20 bp, Artificial Sequence
  chemically synthesized
ttctatttcttcttgatcca

SEQ ID NO: 353908 - DNA, 20 bp, Artificial Sequence
  chemically synthesized
acaaccaaccgtggatcaag

SEQ ID NO: 353909 - DNA, 20 bp, Artificial Sequence
  chemically synthesized
aaccgtggatcaagaagaaa

SEQ ID NO: 353910 - DNA, 20 bp, Artificial Sequence
  chemically synthesized
gaagaaatagaaaatctgaa

SEQ ID NO: 353911 - DNA, 20 bp, Artificial Sequence
  chemically synthesized
ttactaattatagatctgtt

SEQ ID NO: 353912 - DNA, 20 bp, Artificial Sequence
  chemically synthesized
aatctgaacagatctataat

SEQ ID NO: 353913 - DNA, 20 bp, Artificial Sequence
  chemically synthesized
ttcaagatcattactaatta

SEQ ID NO: 353914 - DNA, 20 bp, Artificial Sequence
  chemically synthesized
aattagtaatgatcttgaat

SEQ ID NO: 353915 - DNA, 20 bp, Artificial Sequence
  chemically synthesized
ttttttaagattactgattc

SEQ ID NO: 353916 - DNA, 20 bp, Artificial Sequence
  chemically synthesized
tcttcgttgggaaatttttt

SEQ ID NO: 353917 - DNA, 20 bp, Artificial Sequence
  chemically synthesized
tcttaaaaaatttcccaacg

SEQ ID NO: 353918 - DNA, 20 bp, Artificial Sequence
  chemically synthesized
ggtcctggactgtcttcgtt

SEQ ID NO: 353919 - DNA, 20 bp, Artificial Sequence
  chemically synthesized
aaaaaatttcccaacgaaga

SEQ ID NO: 353920 - DNA, 20 bp, Artificial Sequence
  chemically synthesized
tggtcctggactgtcttcgt

SEQ ID NO: 353921 - DNA, 20 bp, Artificial Sequence
  chemically synthesized
atttcccaacgaagacagtc

SEQ ID NO: 353922 - DNA, 20 bp, Artificial Sequence
  chemically synthesized
tttcccaacgaagacagtcc

SEQ ID NO: 353923 - DNA, 20 bp, Artificial Sequence
  chemically synthesized
caacgaagacagtccaggac

SEQ ID NO: 353924 - DNA, 20 bp, Artificial Sequence
  chemically synthesized
gcagtaaagacatctggtcc

SEQ ID NO: 353925 - DNA, 20 bp, Artificial Sequence
  chemically synthesized
aattcagcagtaaagacatc

SEQ ID NO: 353926 - DNA, 20 bp, Artificial Sequence
  chemically synthesized
tttggtagaattcagcagta

SEQ ID NO: 353927 - DNA, 20 bp, Artificial Sequence
  chemically synthesized
taaagtttggtagaattcag

SEQ ID NO: 353928 - DNA, 20 bp, Artificial Sequence
  chemically synthesized
tggtaaagtttggtagaatt

SEQ ID NO: 353929 - DNA, 20 bp, Artificial Sequence
  chemically synthesized
ggagaattggtaaagtttgg

SEQ ID NO: 353930 - DNA, 20 bp, Artificial Sequence
  chemically synthesized
acaggagaattggtaaagtt

SEQ ID NO: 353931 - DNA, 20 bp, Artificial Sequence
  chemically synthesized
cacttacaggagaattggta

SEQ ID NO: 353932 - DNA, 20 bp, Artificial Sequence
  chemically synthesized
tggaacacttacaggagaat

SEQ ID NO: 353933 - DNA, 20 bp, Artificial Sequence
  chemically synthesized
aactttaccaattctcctgt

SEQ ID NO: 353934 - DNA, 20 bp, Artificial Sequence
  chemically synthesized
ttttcttggaacacttacag

SEQ ID NO: 353935 - DNA, 20 bp, Artificial Sequence
  chemically synthesized
atttttcttggaacacttac

SEQ ID NO: 353936 - DNA, 20 bp, Artificial Sequence
  chemically synthesized
aatttttcttggaacactta

SEQ ID NO: 353937 - DNA, 20 bp, Artificial Sequence
  chemically synthesized
aattctcctgtaagtgttcc

SEQ ID NO: 353938 - DNA, 20 bp, Artificial Sequence
  chemically synthesized
ccttcctcttcaatttttct

SEQ ID NO: 353939 - DNA, 20 bp, Artificial Sequence
  chemically synthesized
aagtgttccaagaaaaattg

SEQ ID NO: 353940 - DNA, 20 bp, Artificial Sequence
  chemically synthesized
gtgttccaagaaaaattgaa

SEQ ID NO: 353941 - DNA, 20 bp, Artificial Sequence
  chemically synthesized
tgttccaagaaaaattgaag

SEQ ID NO: 353942 - DNA, 20 bp, Artificial Sequence
  chemically synthesized
tccaagaaaaattgaagagg

SEQ ID NO: 353943 - DNA, 20 bp, Artificial Sequence
  chemically synthesized
ccaagaaaaattgaagagga

SEQ ID NO: 353944 - DNA, 20 bp, Artificial Sequence
  chemically synthesized
gcttcatagaatgagatagg

SEQ ID NO: 353945 - DNA, 20 bp, Artificial Sequence
  chemically synthesized
ggcttcatagaatgagatag

SEQ ID NO: 353946 - DNA, 20 bp, Artificial Sequence
  chemically synthesized
tggcttcatagaatgagata

SEQ ID NO: 353947 - DNA, 20 bp, Artificial Sequence
  chemically synthesized
ctggcttcatagaatgagat

SEQ ID NO: 353948 - DNA, 20 bp, Artificial Sequence
  chemically synthesized
gctggcttcatagaatgaga

SEQ ID NO: 353949 - DNA, 20 bp, Artificial Sequence
  chemically synthesized
taatgctggcttcatagaat

SEQ ID NO: 353950 - DNA, 20 bp, Artificial Sequence
  chemically synthesized
tccccctatctcattctatg

SEQ ID NO: 353951 - DNA, 20 bp, Artificial Sequence
  chemically synthesized
cctatctcattctatgaagc

SEQ ID NO: 353952 - DNA, 20 bp, Artificial Sequence
  chemically synthesized
tcagggtaatgctggcttca

SEQ ID NO: 353953 - DNA, 20 bp, Artificial Sequence
  chemically synthesized
gtttggcatcagggtaatgc

SEQ ID NO: 353954 - DNA, 20 bp, Artificial Sequence
  chemically synthesized
attgtctgggtttggcatca

SEQ ID NO: 353955 - DNA, 20 bp, Artificial Sequence
  chemically synthesized
aattgtctgggtttggcatc

SEQ ID NO: 353956 - DNA, 20 bp, Artificial Sequence
  chemically synthesized
taattgtctgggtttggcat

SEQ ID NO: 353957 - DNA, 20 bp, Artificial Sequence
  chemically synthesized
cattaccctgatgccaaacc

SEQ ID NO: 353958 - DNA, 20 bp, Artificial Sequence
  chemically synthesized
gttgcataattgtctgggtt

SEQ ID NO: 353959 - DNA, 20 bp, Artificial Sequence
  chemically synthesized
tttttgttgcataattgtct

SEQ ID NO: 353960 - DNA, 20 bp, Artificial Sequence
  chemically synthesized
ttttttgttgcataattgtc

SEQ ID NO: 353961 - DNA, 20 bp, Artificial Sequence
  chemically synthesized
caattatgcaacaaaaaata

SEQ ID NO: 353962 - DNA, 20 bp, Artificial Sequence
  chemically synthesized
aattatgcaacaaaaaatac

SEQ ID NO: 353963 - DNA, 20 bp, Artificial Sequence
  chemically synthesized
ttctacatcagtgttcatca

SEQ ID NO: 353964 - DNA, 20 bp, Artificial Sequence
  chemically synthesized
tttctacatcagtgttcatc

SEQ ID NO: 353965 - DNA, 20 bp, Artificial Sequence
  chemically synthesized
atttctacatcagtgttcat

SEQ ID NO: 353966 - DNA, 20 bp, Artificial Sequence
  chemically synthesized
atccctgatgaacactgatg

SEQ ID NO: 353967 - DNA, 20 bp, Artificial Sequence
  chemically synthesized
tttgtagagaatttctacat

SEQ ID NO: 353968 - DNA, 20 bp, Artificial Sequence
  chemically synthesized
tggattgctagcattttgta

SEQ ID NO: 353969 - DNA, 20 bp, Artificial Sequence
  chemically synthesized
attggattgctagcattttg

SEQ ID NO: 353970 - DNA, 20 bp, Artificial Sequence
  chemically synthesized
agaaattctctacaaaatgc

SEQ ID NO: 353971 - DNA, 20 bp, Artificial Sequence
  chemically synthesized
tttatgttctattggattgc

SEQ ID NO: 353972 - DNA, 20 bp, Artificial Sequence
  chemically synthesized
acaaaatgctagcaatccaa

SEQ ID NO: 353973 - DNA, 20 bp, Artificial Sequence
  chemically synthesized
ttacattttttatgttctat

SEQ ID NO: 353974 - DNA, 20 bp, Artificial Sequence
  chemically synthesized
ataaaaaatgtaatattatc

SEQ ID NO: 353975 - DNA, 20 bp, Artificial Sequence
  chemically synthesized
aaaaatgtaatattatcaag

SEQ ID NO: 353976 - DNA, 20 bp, Artificial Sequence
  chemically synthesized
tgatgtatccttgtatcatt

SEQ ID NO: 353977 - DNA, 20 bp, Artificial Sequence
  chemically synthesized
ggaatttatcccaatgatac

SEQ ID NO: 353978 - DNA, 20 bp, Artificial Sequence
  chemically synthesized
atgatgtatccttgtatcat

SEQ ID NO: 353979 - DNA, 20 bp, Artificial Sequence
  chemically synthesized
gaatttatcccaatgataca

SEQ ID NO: 353980 - DNA, 20 bp, Artificial Sequence
  chemically synthesized
atatgacatattacatcaaa

SEQ ID NO: 353981 - DNA, 20 bp, Artificial Sequence
  chemically synthesized
acatcaaacagaatgaaaaa

SEQ ID NO: 353982 - DNA, 20 bp, Artificial Sequence
  chemically synthesized
agaaaacatgatcctttcaa

SEQ ID NO: 353983 - DNA, 20 bp, Artificial Sequence
  chemically synthesized
gttcttttgtgtctattgaa

SEQ ID NO: 353984 - DNA, 20 bp, Artificial Sequence
  chemically synthesized
tgttcttttgtgtctattga

SEQ ID NO: 353985 - DNA, 20 bp, Artificial Sequence
  chemically synthesized
gatcctttcaatagacacaa

SEQ ID NO: 353986 - DNA, 20 bp, Artificial Sequence
  chemically synthesized
ataaaatttaacatcccttc

SEQ ID NO: 353987 - DNA, 20 bp, Artificial Sequence
  chemically synthesized
gttggagtttttatctcgaa

SEQ ID NO: 353988 - DNA, 20 bp, Artificial Sequence
  chemically synthesized
tgttggagtttttatctcga

SEQ ID NO: 353989 - DNA, 20 bp, Artificial Sequence
  chemically synthesized
ttgttggagtttttatctcg

SEQ ID NO: 353990 - DNA, 20 bp, Artificial Sequence
  chemically synthesized
tttgtatgcctagtttgttg

SEQ ID NO: 353991 - DNA, 20 bp, Artificial Sequence
  chemically synthesized
agataaaaactccaacaaac

SEQ ID NO: 353992 - DNA, 20 bp, Artificial Sequence
  chemically synthesized
gataaaaactccaacaaact

SEQ ID NO: 353993 - DNA, 20 bp, Artificial Sequence
  chemically synthesized
tttttgtatgcctagtttgt

SEQ ID NO: 353994 - DNA, 20 bp, Artificial Sequence
  chemically synthesized
gttaattttttttgtatgcc

SEQ ID NO: 353995 - DNA, 20 bp, Artificial Sequence
  chemically synthesized
caaaaaaaattaacaaaata

SEQ ID NO: 353996 - DNA, 20 bp, Artificial Sequence
  chemically synthesized
acttgtagatttgtcatata

SEQ ID NO: 353997 - DNA, 20 bp, Artificial Sequence
  chemically synthesized
accatatatgacaaatctac

SEQ ID NO: 353998 - DNA, 20 bp, Artificial Sequence
  chemically synthesized
atatatgacaaatctacaag

SEQ ID NO: 353999 - DNA, 20 bp, Artificial Sequence
  chemically synthesized
attcagtttgatactacttg

SEQ ID NO: 354000 - DNA, 20 bp, Artificial Sequence
  chemically synthesized
acaagtagtatcaaactgaa

SEQ ID NO: 354001 - DNA, 20 bp, Artificial Sequence
  chemically synthesized
caagtagtatcaaactgaat

SEQ ID NO: 354002 - DNA, 20 bp, Artificial Sequence
  chemically synthesized
aagtagtatcaaactgaatg

SEQ ID NO: 354003 - DNA, 20 bp, Artificial Sequence
  chemically synthesized
tttttcagcttttccccatt

SEQ ID NO: 354004 - DNA, 20 bp, Artificial Sequence
  chemically synthesized
gtatcaaactgaatggggaa

SEQ ID NO: 354005 - DNA, 20 bp, Artificial Sequence
  chemically synthesized
ttttatagggagaaattttt

SEQ ID NO: 354006 - DNA, 20 bp, Artificial Sequence
  chemically synthesized
gaccattccagttttatagg

SEQ ID NO: 354007 - DNA, 20 bp, Artificial Sequence
  chemically synthesized
ctgaccattccagttttata

SEQ ID NO: 354008 - DNA, 20 bp, Artificial Sequence
  chemically synthesized
aaaatttctccctataaaac

SEQ ID NO: 354009 - DNA, 20 bp, Artificial Sequence
  chemically synthesized
cctgaccattccagttttat

SEQ ID NO: 354010 - DNA, 20 bp, Artificial Sequence
  chemically synthesized
gcctgaccattccagtttta

SEQ ID NO: 354011 - DNA, 20 bp, Artificial Sequence
  chemically synthesized
ttctccctataaaactggaa

SEQ ID NO: 354012 - DNA, 20 bp, Artificial Sequence
  chemically synthesized
ccctataaaactggaatggt

SEQ ID NO: 354013 - DNA, 20 bp, Artificial Sequence
  chemically synthesized
gccaccacgcctgaccattc

SEQ ID NO: 354014 - DNA, 20 bp, Artificial Sequence
  chemically synthesized
cctataaaactggaatggtc

SEQ ID NO: 354015 - DNA, 20 bp, Artificial Sequence
  chemically synthesized
aaaactggaatggtcaggcg

SEQ ID NO: 354016 - DNA, 20 bp, Artificial Sequence
  chemically synthesized
actggaatggtcaggcgtgg

SEQ ID NO: 354017 - DNA, 20 bp, Artificial Sequence
  chemically synthesized
agtgctgggattacaggcgt

SEQ ID NO: 354018 - DNA, 20 bp, Artificial Sequence
  chemically synthesized
gtggctcacgcctgtaatcc

SEQ ID NO: 354019 - DNA, 20 bp, Artificial Sequence
  chemically synthesized
tcccaaagtgctgggattac

SEQ ID NO: 354020 - DNA, 20 bp, Artificial Sequence
  chemically synthesized
ctcccaaagtgctgggatta

SEQ ID NO: 354021 - DNA, 20 bp, Artificial Sequence
  chemically synthesized
cgcctgtaatcccagcactt

SEQ ID NO: 354022 - DNA, 20 bp, Artificial Sequence
  chemically synthesized
cctctgcctcccaaagtgct

SEQ ID NO: 354023 - DNA, 20 bp, Artificial Sequence
  chemically synthesized
gcctgtaatcccagcacttt

SEQ ID NO: 354024 - DNA, 20 bp, Artificial Sequence
  chemically synthesized
acctctgcctcccaaagtgc

SEQ ID NO: 354025 - DNA, 20 bp, Artificial Sequence
  chemically synthesized
ctgtaatcccagcactttgg

SEQ ID NO: 354026 - DNA, 20 bp, Artificial Sequence
  chemically synthesized
tgtaatcccagcactttggg

SEQ ID NO: 354027 - DNA, 20 bp, Artificial Sequence
  chemically synthesized
aatcccagcactttgggagg

SEQ ID NO: 354028 - DNA, 20 bp, Artificial Sequence
  chemically synthesized
ccacccacctctgcctccca

SEQ ID NO: 354029 - DNA, 20 bp, Artificial Sequence
  chemically synthesized
tcccagcactttgggaggca

SEQ ID NO: 354030 - DNA, 20 bp, Artificial Sequence
  chemically synthesized
cccagcactttgggaggcag

SEQ ID NO: 354031 - DNA, 20 bp, Artificial Sequence
  chemically synthesized
agcactttgggaggcagagg

SEQ ID NO: 354032 - DNA, 20 bp, Artificial Sequence
  chemically synthesized
gcactttgggaggcagaggt

SEQ ID NO: 354033 - DNA, 20 bp, Artificial Sequence
  chemically synthesized
ctttgggaggcagaggtggg

SEQ ID NO: 354034 - DNA, 20 bp, Artificial Sequence
  chemically synthesized
ggcagaggtgggtggatcaa

SEQ ID NO: 354035 - DNA, 20 bp, Artificial Sequence
  chemically synthesized
aggtgggtggatcaatagat

SEQ ID NO: 354036 - DNA, 20 bp, Artificial Sequence
  chemically synthesized
ggtgggtggatcaatagatc

SEQ ID NO: 354037 - DNA, 20 bp, Artificial Sequence
  chemically synthesized
tgggtggatcaatagatcag

SEQ ID NO: 354038 - DNA, 20 bp, Artificial Sequence
  chemically synthesized
gatcaatagatcaggagatc

SEQ ID NO: 354039 - DNA, 20 bp, Artificial Sequence
  chemically synthesized
tcaggagatcgagatcatcc

SEQ ID NO: 354040 - DNA, 20 bp, Artificial Sequence
  chemically synthesized
ggggtttcaccgtgttagcc

SEQ ID NO: 354041 - DNA, 20 bp, Artificial Sequence
  chemically synthesized
cgagatcatcctggctaaca

SEQ ID NO: 354042 - DNA, 20 bp, Artificial Sequence
  chemically synthesized
tggggtttcaccgtgttagc

SEQ ID NO: 354043 - DNA, 20 bp, Artificial Sequence
  chemically synthesized
gagatggggtttcaccgtgt

SEQ ID NO: 354044 - DNA, 20 bp, Artificial Sequence
  chemically synthesized
ttgtatttttagtagagatg

SEQ ID NO: 354045 - DNA, 20 bp, Artificial Sequence
  chemically synthesized
tttgtatttttagtagagat

SEQ ID NO: 354046 - DNA, 20 bp, Artificial Sequence
  chemically synthesized
ttttgtatttttagtagaga

SEQ ID NO: 354047 - DNA, 20 bp, Artificial Sequence
  chemically synthesized
aattttttgtatttttagta

SEQ ID NO: 354048 - DNA, 20 bp, Artificial Sequence
  chemically synthesized
ctaattttttgtatttttag

SEQ ID NO: 354049 - DNA, 20 bp, Artificial Sequence
  chemically synthesized
cggctaattttttgtatttt

SEQ ID NO: 354050 - DNA, 20 bp, Artificial Sequence
  chemically synthesized
ctactaaaaatacaaaaaat

SEQ ID NO: 354051 - DNA, 20 bp, Artificial Sequence
  chemically synthesized
taaaaatacaaaaaattagc

SEQ ID NO: 354052 - DNA, 20 bp, Artificial Sequence
  chemically synthesized
aaaaatacaaaaaattagcc

SEQ ID NO: 354053 - DNA, 20 bp, Artificial Sequence
  chemically synthesized
tacaaaaaattagccgggca

SEQ ID NO: 354054 - DNA, 20 bp, Artificial Sequence
  chemically synthesized
aaaaaattagccgggcatgg

SEQ ID NO: 354055 - DNA, 20 bp, Artificial Sequence
  chemically synthesized
caggcatctgccaccatgcc

SEQ ID NO: 354056 - DNA, 20 bp, Artificial Sequence
  chemically synthesized
aaattagccgggcatggtgg

SEQ ID NO: 354057 - DNA, 20 bp, Artificial Sequence
  chemically synthesized
ggcatggtggcagatgcctg

SEQ ID NO: 354058 - DNA, 20 bp, Artificial Sequence
  chemically synthesized
gtggcagatgcctgtggtcc

SEQ ID NO: 354059 - DNA, 20 bp, Artificial Sequence
  chemically synthesized
tcccgagcagctgggaccac

SEQ ID NO: 354060 - DNA, 20 bp, Artificial Sequence
  chemically synthesized
ctcccgagcagctgggacca

SEQ ID NO: 354061 - DNA, 20 bp, Artificial Sequence
  chemically synthesized
tgcctgtggtcccagctgct

SEQ ID NO: 354062 - DNA, 20 bp, Artificial Sequence
  chemically synthesized
cctcagcctcccgagcagct

SEQ ID NO: 354063 - DNA, 20 bp, Artificial Sequence
  chemically synthesized
gcctgtggtcccagctgctc

SEQ ID NO: 354064 - DNA, 20 bp, Artificial Sequence
  chemically synthesized
gcctcagcctcccgagcagc

SEQ ID NO: 354065 - DNA, 20 bp, Artificial Sequence
  chemically synthesized
ctgtggtcccagctgctcgg

SEQ ID NO: 354066 - DNA, 20 bp, Artificial Sequence
  chemically synthesized
tgtggtcccagctgctcggg

SEQ ID NO: 354067 - DNA, 20 bp, Artificial Sequence
  chemically synthesized
tcttgcctcagcctcccgag

SEQ ID NO: 354068 - DNA, 20 bp, Artificial Sequence
  chemically synthesized
ttctcttgcctcagcctccc

SEQ ID NO: 354069 - DNA, 20 bp, Artificial Sequence
  chemically synthesized
tcccagctgctcgggaggct

SEQ ID NO: 354070 - DNA, 20 bp, Artificial Sequence
  chemically synthesized
cccagctgctcgggaggctg

SEQ ID NO: 354071 - DNA, 20 bp, Artificial Sequence
  chemically synthesized
gctgctcgggaggctgaggc

SEQ ID NO: 354072 - DNA, 20 bp, Artificial Sequence
  chemically synthesized
tgctcgggaggctgaggcaa

SEQ ID NO: 354073 - DNA, 20 bp, Artificial Sequence
  chemically synthesized
ttcatgccgttctcttgcct

SEQ ID NO: 354074 - DNA, 20 bp, Artificial Sequence
  chemically synthesized
gggaggctgaggcaagagaa

SEQ ID NO: 354075 - DNA, 20 bp, Artificial Sequence
  chemically synthesized
caagagaacggcatgaaccc

SEQ ID NO: 354076 - DNA, 20 bp, Artificial Sequence
  chemically synthesized
agagaacggcatgaaccctg

SEQ ID NO: 354077 - DNA, 20 bp, Artificial Sequence
  chemically synthesized
gagaacggcatgaaccctgg

SEQ ID NO: 354078 - DNA, 20 bp, Artificial Sequence
  chemically synthesized
cattgcaagctcagcctcca

SEQ ID NO: 354079 - DNA, 20 bp, Artificial Sequence
  chemically synthesized
cggcatgaaccctggaggct

SEQ ID NO: 354080 - DNA, 20 bp, Artificial Sequence
  chemically synthesized
tcattgcaagctcagcctcc

SEQ ID NO: 354081 - DNA, 20 bp, Artificial Sequence
  chemically synthesized
ctcattgcaagctcagcctc

SEQ ID NO: 354082 - DNA, 20 bp, Artificial Sequence
  chemically synthesized
atcttggctcattgcaagct

SEQ ID NO: 354083 - DNA, 20 bp, Artificial Sequence
  chemically synthesized
ctggaggctgagcttgcaat

SEQ ID NO: 354084 - DNA, 20 bp, Artificial Sequence
  chemically synthesized
gcccaatcttggctcattgc

SEQ ID NO: 354085 - DNA, 20 bp, Artificial Sequence
  chemically synthesized
ggctgagcttgcaatgagcc

SEQ ID NO: 354086 - DNA, 20 bp, Artificial Sequence
  chemically synthesized
agcttgcaatgagccaagat

SEQ ID NO: 354087 - DNA, 20 bp, Artificial Sequence
  chemically synthesized
gcttgcaatgagccaagatt

SEQ ID NO: 354088 - DNA, 20 bp, Artificial Sequence
  chemically synthesized
ggagtacagtggcccaatct

SEQ ID NO: 354089 - DNA, 20 bp, Artificial Sequence
  chemically synthesized
ttgcccaggctggagtacag

SEQ ID NO: 354090 - DNA, 20 bp, Artificial Sequence
  chemically synthesized
aagattgggccactgtactc

SEQ ID NO: 354091 - DNA, 20 bp, Artificial Sequence
  chemically synthesized
ctgttgcccaggctggagta

SEQ ID NO: 354092 - DNA, 20 bp, Artificial Sequence
  chemically synthesized
tgggccactgtactccagcc

SEQ ID NO: 354093 - DNA, 20 bp, Artificial Sequence
  chemically synthesized
gggccactgtactccagcct

SEQ ID NO: 354094 - DNA, 20 bp, Artificial Sequence
  chemically synthesized
ttgctctgttgcccaggctg

SEQ ID NO: 354095 - DNA, 20 bp, Artificial Sequence
  chemically synthesized
tcttgctctgttgcccaggc

SEQ ID NO: 354096 - DNA, 20 bp, Artificial Sequence
  chemically synthesized
ctgtactccagcctgggcaa

SEQ ID NO: 354097 - DNA, 20 bp, Artificial Sequence
  chemically synthesized
ggagtcttgctctgttgccc

SEQ ID NO: 354098 - DNA, 20 bp, Artificial Sequence
  chemically synthesized
gtactccagcctgggcaaca

SEQ ID NO: 354099 - DNA, 20 bp, Artificial Sequence
  chemically synthesized
tggagtcttgctctgttgcc

SEQ ID NO: 354100 - DNA, 20 bp, Artificial Sequence
  chemically synthesized
tccagcctgggcaacagagc

SEQ ID NO: 354101 - DNA, 20 bp, Artificial Sequence
  chemically synthesized
ggttttttgtttttgagatg

SEQ ID NO: 354102 - DNA, 20 bp, Artificial Sequence
  chemically synthesized
ttggttttttgtttttgaga

SEQ ID NO: 354103 - DNA, 20 bp, Artificial Sequence
  chemically synthesized
gtttttggttttttgttttt

SEQ ID NO: 354104 - DNA, 20 bp, Artificial Sequence
  chemically synthesized
cttgttcttttttttgtttt

SEQ ID NO: 354105 - DNA, 20 bp, Artificial Sequence
  chemically synthesized
aaaaaaccaaaaacaaaaaa

SEQ ID NO: 354106 - DNA, 20 bp, Artificial Sequence
  chemically synthesized
ccaaaaacaaaaaaaagaac

SEQ ID NO: 354107 - DNA, 20 bp, Artificial Sequence
  chemically synthesized
aacaaaaaaaagaacaagac

SEQ ID NO: 354108 - DNA, 20 bp, Artificial Sequence
  chemically synthesized
acaaaaaaaagaacaagaca

SEQ ID NO: 354109 - DNA, 20 bp, Artificial Sequence
  chemically synthesized
gttgaatgagtggtgaaagt

SEQ ID NO: 354110 - DNA, 20 bp, Artificial Sequence
  chemically synthesized
tgttgaatgagtggtgaaag

SEQ ID NO: 354111 - DNA, 20 bp, Artificial Sequence
  chemically synthesized
ctatgttgaatgagtggtga

SEQ ID NO: 354112 - DNA, 20 bp, Artificial Sequence
  chemically synthesized
ccagtactatgttgaatgag

SEQ ID NO: 354113 - DNA, 20 bp, Artificial Sequence
  chemically synthesized
cctccagtactatgttgaat

SEQ ID NO: 354114 - DNA, 20 bp, Artificial Sequence
  chemically synthesized
ctttcaccactcattcaaca

SEQ ID NO: 354115 - DNA, 20 bp, Artificial Sequence
  chemically synthesized
ccactcattcaacatagtac

SEQ ID NO: 354116 - DNA, 20 bp, Artificial Sequence
  chemically synthesized
actcattcaacatagtactg

SEQ ID NO: 354117 - DNA, 20 bp, Artificial Sequence
  chemically synthesized
ctcattcaacatagtactgg

SEQ ID NO: 354118 - DNA, 20 bp, Artificial Sequence
  chemically synthesized
caacatagtactggaggtcc

SEQ ID NO: 354119 - DNA, 20 bp, Artificial Sequence
  chemically synthesized
attgctctggctaggacctc

SEQ ID NO: 354120 - DNA, 20 bp, Artificial Sequence
  chemically synthesized
atagtactggaggtcctagc

SEQ ID NO: 354121 - DNA, 20 bp, Artificial Sequence
  chemically synthesized
agtactggaggtcctagcca

SEQ ID NO: 354122 - DNA, 20 bp, Artificial Sequence
  chemically synthesized
ttctcttgattgctctggct

SEQ ID NO: 354123 - DNA, 20 bp, Artificial Sequence
  chemically synthesized
tttctcttgattgctctggc

SEQ ID NO: 354124 - DNA, 20 bp, Artificial Sequence
  chemically synthesized
tttctttctcttgattgctc

SEQ ID NO: 354125 - DNA, 20 bp, Artificial Sequence
  chemically synthesized
aggtcctagccagagcaatc

SEQ ID NO: 354126 - DNA, 20 bp, Artificial Sequence
  chemically synthesized
gtcctagccagagcaatcaa

SEQ ID NO: 354127 - DNA, 20 bp, Artificial Sequence
  chemically synthesized
tagccagagcaatcaagaga

SEQ ID NO: 354128 - DNA, 20 bp, Artificial Sequence
  chemically synthesized
caatcaagagaaagaaatac

SEQ ID NO: 354129 - DNA, 20 bp, Artificial Sequence
  chemically synthesized
aatcaagagaaagaaataca

SEQ ID NO: 354130 - DNA, 20 bp, Artificial Sequence
  chemically synthesized
agaaatacaaggcgtcctaa

SEQ ID NO: 354131 - DNA, 20 bp, Artificial Sequence
  chemically synthesized
aatacaaggcgtcctaatag

SEQ ID NO: 354132 - DNA, 20 bp, Artificial Sequence
  chemically synthesized
ggacaacgatttcttctatt

SEQ ID NO: 354133 - DNA, 20 bp, Artificial Sequence
  chemically synthesized
tggacaacgatttcttctat

SEQ ID NO: 354134 - DNA, 20 bp, Artificial Sequence
  chemically synthesized
aatagaagaaatcgttgtcc

SEQ ID NO: 354135 - DNA, 20 bp, Artificial Sequence
  chemically synthesized
tattaacaaagagcagtact

SEQ ID NO: 354136 - DNA, 20 bp, Artificial Sequence
  chemically synthesized
tataagttattaacaaagag

SEQ ID NO: 354137 - DNA, 20 bp, Artificial Sequence
  chemically synthesized
agctataagttattaacaaa

SEQ ID NO: 354138 - DNA, 20 bp, Artificial Sequence
  chemically synthesized
ctagctataagttattaaca

SEQ ID NO: 354139 - DNA, 20 bp, Artificial Sequence
  chemically synthesized
tgctctttgttaataactta

SEQ ID NO: 354140 - DNA, 20 bp, Artificial Sequence
  chemically synthesized
ctttgttaataacttatagc

SEQ ID NO: 354141 - DNA, 20 bp, Artificial Sequence
  chemically synthesized
gtttagctttttctagctat

SEQ ID NO: 354142 - DNA, 20 bp, Artificial Sequence
  chemically synthesized
taataacttatagctagaaa

SEQ ID NO: 354143 - DNA, 20 bp, Artificial Sequence
  chemically synthesized
ggtgagggtttagctttttc

SEQ ID NO: 354144 - DNA, 20 bp, Artificial Sequence
  chemically synthesized
agagctttctggtgagggtt

SEQ ID NO: 354145 - DNA, 20 bp, Artificial Sequence
  chemically synthesized
agaaaaagctaaaccctcac

SEQ ID NO: 354146 - DNA, 20 bp, Artificial Sequence
  chemically synthesized
atctgagagctttctggtga

SEQ ID NO: 354147 - DNA, 20 bp, Artificial Sequence
  chemically synthesized
aaagctaaaccctcaccaga

SEQ ID NO: 354148 - DNA, 20 bp, Artificial Sequence
  chemically synthesized
gatctgagagctttctggtg

SEQ ID NO: 354149 - DNA, 20 bp, Artificial Sequence
  chemically synthesized
agatctgagagctttctggt

SEQ ID NO: 354150 - DNA, 20 bp, Artificial Sequence
  chemically synthesized
tatcagatctgagagctttc

SEQ ID NO: 354151 - DNA, 20 bp, Artificial Sequence
  chemically synthesized
aaccctcaccagaaagctct

SEQ ID NO: 354152 - DNA, 20 bp, Artificial Sequence
  chemically synthesized
aatttatttatcagatctga

SEQ ID NO: 354153 - DNA, 20 bp, Artificial Sequence
  chemically synthesized
taaatttatttatcagatct

SEQ ID NO: 354154 - DNA, 20 bp, Artificial Sequence
  chemically synthesized
actttactaaatttatttat

SEQ ID NO: 354155 - DNA, 20 bp, Artificial Sequence
  chemically synthesized
tcagatctgataaataaatt

SEQ ID NO: 354156 - DNA, 20 bp, Artificial Sequence
  chemically synthesized
tctgataaataaatttagta

SEQ ID NO: 354157 - DNA, 20 bp, Artificial Sequence
  chemically synthesized
aaataaatttagtaaagttg

SEQ ID NO: 354158 - DNA, 20 bp, Artificial Sequence
  chemically synthesized
aataaatttagtaaagttgc

SEQ ID NO: 354159 - DNA, 20 bp, Artificial Sequence
  chemically synthesized
aaaaatcaacatacacaatt

SEQ ID NO: 354160 - DNA, 20 bp, Artificial Sequence
  chemically synthesized
aatcaacatacacaattcag

SEQ ID NO: 354161 - DNA, 20 bp, Artificial Sequence
  chemically synthesized
gccagttcattattggtata

SEQ ID NO: 354162 - DNA, 20 bp, Artificial Sequence
  chemically synthesized
tttctcagccagttcattat

SEQ ID NO: 354163 - DNA, 20 bp, Artificial Sequence
  chemically synthesized
tctatataccaataatgaac

SEQ ID NO: 354164 - DNA, 20 bp, Artificial Sequence
  chemically synthesized
ataccaataatgaactggct

SEQ ID NO: 354165 - DNA, 20 bp, Artificial Sequence
  chemically synthesized
caataatgaactggctgaga

SEQ ID NO: 354166 - DNA, 20 bp, Artificial Sequence
  chemically synthesized
ttcttgatttctttctcagc

SEQ ID NO: 354167 - DNA, 20 bp, Artificial Sequence
  chemically synthesized
tgccttcttgatttctttct

SEQ ID NO: 354168 - DNA, 20 bp, Artificial Sequence
  chemically synthesized
aactggctgagaaagaaatc

SEQ ID NO: 354169 - DNA, 20 bp, Artificial Sequence
  chemically synthesized
tggctgagaaagaaatcaag

SEQ ID NO: 354170 - DNA, 20 bp, Artificial Sequence
  chemically synthesized
ggctgagaaagaaatcaaga

SEQ ID NO: 354171 - DNA, 20 bp, Artificial Sequence
  chemically synthesized
tatttccagccgttgtaaat

SEQ ID NO: 354172 - DNA, 20 bp, Artificial Sequence
  chemically synthesized
gaaggcaaacctatttacaa

SEQ ID NO: 354173 - DNA, 20 bp, Artificial Sequence
  chemically synthesized
ttatttccagccgttgtaaa

SEQ ID NO: 354174 - DNA, 20 bp, Artificial Sequence
  chemically synthesized
gcaaacctatttacaacggc

SEQ ID NO: 354175 - DNA, 20 bp, Artificial Sequence
  chemically synthesized
ttactcctaggtattatttc

SEQ ID NO: 354176 - DNA, 20 bp, Artificial Sequence
  chemically synthesized
caacggctggaaataatacc

SEQ ID NO: 354177 - DNA, 20 bp, Artificial Sequence
  chemically synthesized
aacggctggaaataatacct

SEQ ID NO: 354178 - DNA, 20 bp, Artificial Sequence
  chemically synthesized
cggctggaaataatacctag

SEQ ID NO: 354179 - DNA, 20 bp, Artificial Sequence
  chemically synthesized
tggaaataatacctaggagt

SEQ ID NO: 354180 - DNA, 20 bp, Artificial Sequence
  chemically synthesized
cctgggctaaacttactcct

SEQ ID NO: 354181 - DNA, 20 bp, Artificial Sequence
  chemically synthesized
tcctgggctaaacttactcc

SEQ ID NO: 354182 - DNA, 20 bp, Artificial Sequence
  chemically synthesized
ataatacctaggagtaagtt

SEQ ID NO: 354183 - DNA, 20 bp, Artificial Sequence
  chemically synthesized
acctaggagtaagtttagcc

SEQ ID NO: 354184 - DNA, 20 bp, Artificial Sequence
  chemically synthesized
cctaggagtaagtttagccc

SEQ ID NO: 354185 - DNA, 20 bp, Artificial Sequence
  chemically synthesized
taggagtaagtttagcccag

SEQ ID NO: 354186 - DNA, 20 bp, Artificial Sequence
  chemically synthesized
aggagtaagtttagcccagg

SEQ ID NO: 354187 - DNA, 20 bp, Artificial Sequence
  chemically synthesized
ggagtaagtttagcccagga

SEQ ID NO: 354188 - DNA, 20 bp, Artificial Sequence
  chemically synthesized
tatacggacctttccctcct

SEQ ID NO: 354189 - DNA, 20 bp, Artificial Sequence
  chemically synthesized
taagtttagcccaggaggga

SEQ ID NO: 354190 - DNA, 20 bp, Artificial Sequence
  chemically synthesized
ttatacggacctttccctcc

SEQ ID NO: 354191 - DNA, 20 bp, Artificial Sequence
  chemically synthesized
aagtttagcccaggagggaa

SEQ ID NO: 354192 - DNA, 20 bp, Artificial Sequence
  chemically synthesized
tcagtgttctgtattttata

SEQ ID NO: 354193 - DNA, 20 bp, Artificial Sequence
  chemically synthesized
ggaaaggtccgtataaaata

SEQ ID NO: 354194 - DNA, 20 bp, Artificial Sequence
  chemically synthesized
tactcttcaatttgttttgt

SEQ ID NO: 354195 - DNA, 20 bp, Artificial Sequence
  chemically synthesized
aacactgacaaaacaaattg

SEQ ID NO: 354196 - DNA, 20 bp, Artificial Sequence
  chemically synthesized
cactgacaaaacaaattgaa

SEQ ID NO: 354197 - DNA, 20 bp, Artificial Sequence
  chemically synthesized
ttgaagagtacaccaacaaa

SEQ ID NO: 354198 - DNA, 20 bp, Artificial Sequence
  chemically synthesized
tgggatgactttccatttgt

SEQ ID NO: 354199 - DNA, 20 bp, Artificial Sequence
  chemically synthesized
agagtacaccaacaaatgga

SEQ ID NO: 354200 - DNA, 20 bp, Artificial Sequence
  chemically synthesized
ttcttctgaccgataaacat

SEQ ID NO: 354201 - DNA, 20 bp, Artificial Sequence
  chemically synthesized
gaaagtcatcccatgtttat

SEQ ID NO: 354202 - DNA, 20 bp, Artificial Sequence
  chemically synthesized
attcttctgaccgataaaca

SEQ ID NO: 354203 - DNA, 20 bp, Artificial Sequence
  chemically synthesized
gtcatcccatgtttatcggt

SEQ ID NO: 354204 - DNA, 20 bp, Artificial Sequence
  chemically synthesized
atcccatgtttatcggtcag

SEQ ID NO: 354205 - DNA, 20 bp, Artificial Sequence
  chemically synthesized
tgtagaatgctttgagtaga

SEQ ID NO: 354206 - DNA, 20 bp, Artificial Sequence
  chemically synthesized
taacatgatctttctactca

SEQ ID NO: 354207 - DNA, 20 bp, Artificial Sequence
  chemically synthesized
tcaatgtagaatgctttgag

SEQ ID NO: 354208 - DNA, 20 bp, Artificial Sequence
  chemically synthesized
tattcaatgtagaatgcttt

SEQ ID NO: 354209 - DNA, 20 bp, Artificial Sequence
  chemically synthesized
agggactgcattattcaatg

SEQ ID NO: 354210 - DNA, 20 bp, Artificial Sequence
  chemically synthesized
gcattctacattgaataatg

SEQ ID NO: 354211 - DNA, 20 bp, Artificial Sequence
  chemically synthesized
ttgaataatgcagtccctat

SEQ ID NO: 354212 - DNA, 20 bp, Artificial Sequence
  chemically synthesized
tccatttctgtattctgata

SEQ ID NO: 354213 - DNA, 20 bp, Artificial Sequence
  chemically synthesized
ttccatttctgtattctgat

SEQ ID NO: 354214 - DNA, 20 bp, Artificial Sequence
  chemically synthesized
attccatttctgtattctga

SEQ ID NO: 354215 - DNA, 20 bp, Artificial Sequence
  chemically synthesized
atgcagtccctatcagaata

SEQ ID NO: 354216 - DNA, 20 bp, Artificial Sequence
  chemically synthesized
tccctatcagaatacagaaa

SEQ ID NO: 354217 - DNA, 20 bp, Artificial Sequence
  chemically synthesized
gaatacagaaatggaataaa

SEQ ID NO: 354218 - DNA, 20 bp, Artificial Sequence
  chemically synthesized
tcataaaatttgtacgatca

SEQ ID NO: 354219 - DNA, 20 bp, Artificial Sequence
  chemically synthesized
aaatttgtacgatcaaagac

SEQ ID NO: 354220 - DNA, 20 bp, Artificial Sequence
  chemically synthesized
tttgtacgatcaaagaccag

SEQ ID NO: 354221 - DNA, 20 bp, Artificial Sequence
  chemically synthesized
tgtacgatcaaagaccagca

SEQ ID NO: 354222 - DNA, 20 bp, Artificial Sequence
  chemically synthesized
tacgatcaaagaccagcaga

SEQ ID NO: 354223 - DNA, 20 bp, Artificial Sequence
  chemically synthesized
tggctattcaggctctctgc

SEQ ID NO: 354224 - DNA, 20 bp, Artificial Sequence
  chemically synthesized
agaccagcagagagcctgaa

SEQ ID NO: 354225 - DNA, 20 bp, Artificial Sequence
  chemically synthesized
caggattgctttggctattc

SEQ ID NO: 354226 - DNA, 20 bp, Artificial Sequence
  chemically synthesized
tcaggattgctttggctatt

SEQ ID NO: 354227 - DNA, 20 bp, Artificial Sequence
  chemically synthesized
gcagagagcctgaatagcca

SEQ ID NO: 354228 - DNA, 20 bp, Artificial Sequence
  chemically synthesized
ctttttgctcaggattgctt

SEQ ID NO: 354229 - DNA, 20 bp, Artificial Sequence
  chemically synthesized
tgaatagccaaagcaatcct

SEQ ID NO: 354230 - DNA, 20 bp, Artificial Sequence
  chemically synthesized
ccaaagcaatcctgagcaaa

SEQ ID NO: 354231 - DNA, 20 bp, Artificial Sequence
  chemically synthesized
agtctttgttctttttgctc

SEQ ID NO: 354232 - DNA, 20 bp, Artificial Sequence
  chemically synthesized
aagtctttgttctttttgct

SEQ ID NO: 354233 - DNA, 20 bp, Artificial Sequence
  chemically synthesized
aatcctgagcaaaaagaaca

SEQ ID NO: 354234 - DNA, 20 bp, Artificial Sequence
  chemically synthesized
tgtcaagtagtgtgattcat

SEQ ID NO: 354235 - DNA, 20 bp, Artificial Sequence
  chemically synthesized
caccttgctgttttgtcaag

SEQ ID NO: 354236 - DNA, 20 bp, Artificial Sequence
  chemically synthesized
aatcacactacttgacaaaa

SEQ ID NO: 354237 - DNA, 20 bp, Artificial Sequence
  chemically synthesized
taacaccttgctgttttgtc

SEQ ID NO: 354238 - DNA, 20 bp, Artificial Sequence
  chemically synthesized
acactacttgacaaaacagc

SEQ ID NO: 354239 - DNA, 20 bp, Artificial Sequence
  chemically synthesized
cactacttgacaaaacagca

SEQ ID NO: 354240 - DNA, 20 bp, Artificial Sequence
  chemically synthesized
ttgacaaaacagcaaggtgt

SEQ ID NO: 354241 - DNA, 20 bp, Artificial Sequence
  chemically synthesized
gcaaggtgttagaataaaaa

SEQ ID NO: 354242 - DNA, 20 bp, Artificial Sequence
  chemically synthesized
ttagaataaaaacagacata

SEQ ID NO: 354243 - DNA, 20 bp, Artificial Sequence
  chemically synthesized
aaaacagacatatagaacaa

SEQ ID NO: 354244 - DNA, 20 bp, Artificial Sequence
  chemically synthesized
agacatatagaacaatggaa

SEQ ID NO: 354245 - DNA, 20 bp, Artificial Sequence
  chemically synthesized
tatagaacaatggaatagat

SEQ ID NO: 354246 - DNA, 20 bp, Artificial Sequence
  chemically synthesized
tagaacaatggaatagatta

SEQ ID NO: 354247 - DNA, 20 bp, Artificial Sequence
  chemically synthesized
atggaatagattagagaact

SEQ ID NO: 354248 - DNA, 20 bp, Artificial Sequence
  chemically synthesized
aaatacatggatttaattct

SEQ ID NO: 354249 - DNA, 20 bp, Artificial Sequence
  chemically synthesized
acaagttgtatgtaaataca

SEQ ID NO: 354250 - DNA, 20 bp, Artificial Sequence
  chemically synthesized
ttggtgcttttgtcaaaaac

SEQ ID NO: 354251 - DNA, 20 bp, Artificial Sequence
  chemically synthesized
atacaacttgtttttgacaa

SEQ ID NO: 354252 - DNA, 20 bp, Artificial Sequence
  chemically synthesized
ttgtttttgacaaaagcacc

SEQ ID NO: 354253 - DNA, 20 bp, Artificial Sequence
  chemically synthesized
ttccccctaatgcatgttct

SEQ ID NO: 354254 - DNA, 20 bp, Artificial Sequence
  chemically synthesized
aaagcaccaagaacatgcat

SEQ ID NO: 354255 - DNA, 20 bp, Artificial Sequence
  chemically synthesized
aagcaccaagaacatgcatt

SEQ ID NO: 354256 - DNA, 20 bp, Artificial Sequence
  chemically synthesized
agcaccaagaacatgcatta

SEQ ID NO: 354257 - DNA, 20 bp, Artificial Sequence
  chemically synthesized
gcaccaagaacatgcattag

SEQ ID NO: 354258 - DNA, 20 bp, Artificial Sequence
  chemically synthesized
caccaagaacatgcattagg

SEQ ID NO: 354259 - DNA, 20 bp, Artificial Sequence
  chemically synthesized
caagaacatgcattaggggg

SEQ ID NO: 354260 - DNA, 20 bp, Artificial Sequence
  chemically synthesized
aagaacatgcattaggggga

SEQ ID NO: 354261 - DNA, 20 bp, Artificial Sequence
  chemically synthesized
ttctcagcaccatttgaaga

SEQ ID NO: 354262 - DNA, 20 bp, Artificial Sequence
  chemically synthesized
ggaaggacaccttcttcaaa

SEQ ID NO: 354263 - DNA, 20 bp, Artificial Sequence
  chemically synthesized
attctcagcaccatttgaag

SEQ ID NO: 354264 - DNA, 20 bp, Artificial Sequence
  chemically synthesized
ccaattctcagcaccatttg

SEQ ID NO: 354265 - DNA, 20 bp, Artificial Sequence
  chemically synthesized
caccttcttcaaatggtgct

SEQ ID NO: 354266 - DNA, 20 bp, Artificial Sequence
  chemically synthesized
cttcaaatggtgctgagaat

SEQ ID NO: 354267 - DNA, 20 bp, Artificial Sequence
  chemically synthesized
gcatctgacaatccaattct

SEQ ID NO: 354268 - DNA, 20 bp, Artificial Sequence
  chemically synthesized
ggtgctgagaattggattgt

SEQ ID NO: 354269 - DNA, 20 bp, Artificial Sequence
  chemically synthesized
gagaattggattgtcagatg

SEQ ID NO: 354270 - DNA, 20 bp, Artificial Sequence
  chemically synthesized
aattggattgtcagatgcag

SEQ ID NO: 354271 - DNA, 20 bp, Artificial Sequence
  chemically synthesized
cagatgcagaagtatgaaac

SEQ ID NO: 354272 - DNA, 20 bp, Artificial Sequence
  chemically synthesized
tatggtgagagacagggatc

SEQ ID NO: 354273 - DNA, 20 bp, Artificial Sequence
  chemically synthesized
ttctaatatggtgagagaca

SEQ ID NO: 354274 - DNA, 20 bp, Artificial Sequence
  chemically synthesized
tttctaatatggtgagagac

SEQ ID NO: 354275 - DNA, 20 bp, Artificial Sequence
  chemically synthesized
ttttctaatatggtgagaga

SEQ ID NO: 354276 - DNA, 20 bp, Artificial Sequence
  chemically synthesized
tgaattttctaatatggtga

SEQ ID NO: 354277 - DNA, 20 bp, Artificial Sequence
  chemically synthesized
atccctgtctctcaccatat

SEQ ID NO: 354278 - DNA, 20 bp, Artificial Sequence
  chemically synthesized
gctgaattttctaatatggt

SEQ ID NO: 354279 - DNA, 20 bp, Artificial Sequence
  chemically synthesized
ttgagctgaattttctaata

SEQ ID NO: 354280 - DNA, 20 bp, Artificial Sequence
  chemically synthesized
tctcaccatattagaaaatt

SEQ ID NO: 354281 - DNA, 20 bp, Artificial Sequence
  chemically synthesized
catattagaaaattcagctc

SEQ ID NO: 354282 - DNA, 20 bp, Artificial Sequence
  chemically synthesized
ttagaaaattcagctcaaga

SEQ ID NO: 354283 - DNA, 20 bp, Artificial Sequence
  chemically synthesized
ttaaatccttaatccatctt

SEQ ID NO: 354284 - DNA, 20 bp, Artificial Sequence
  chemically synthesized
aattcagctcaagatggatt

SEQ ID NO: 354285 - DNA, 20 bp, Artificial Sequence
  chemically synthesized
attcagctcaagatggatta

SEQ ID NO: 354286 - DNA, 20 bp, Artificial Sequence
  chemically synthesized
caagatggattaaggattta

SEQ ID NO: 354287 - DNA, 20 bp, Artificial Sequence
  chemically synthesized
aagatggattaaggatttaa

SEQ ID NO: 354288 - DNA, 20 bp, Artificial Sequence
  chemically synthesized
tggattaaggatttaaaggt

SEQ ID NO: 354289 - DNA, 20 bp, Artificial Sequence
  chemically synthesized
cttcatgtagtttcagtttt

SEQ ID NO: 354290 - DNA, 20 bp, Artificial Sequence
  chemically synthesized
gcttcatgtagtttcagttt

SEQ ID NO: 354291 - DNA, 20 bp, Artificial Sequence
  chemically synthesized
atgtttgcttcatgtagttt

SEQ ID NO: 354292 - DNA, 20 bp, Artificial Sequence
  chemically synthesized
cctaaaactgaaactacatg

SEQ ID NO: 354293 - DNA, 20 bp, Artificial Sequence
  chemically synthesized
ttccctatgtttgcttcatg

SEQ ID NO: 354294 - DNA, 20 bp, Artificial Sequence
  chemically synthesized
gaaactacatgaagcaaaca

SEQ ID NO: 354295 - DNA, 20 bp, Artificial Sequence
  chemically synthesized
aaactacatgaagcaaacat

SEQ ID NO: 354296 - DNA, 20 bp, Artificial Sequence
  chemically synthesized
aactacatgaagcaaacata

SEQ ID NO: 354297 - DNA, 20 bp, Artificial Sequence
  chemically synthesized
tgaagcaaacatagggaaaa

SEQ ID NO: 354298 - DNA, 20 bp, Artificial Sequence
  chemically synthesized
gcaaacatagggaaaacaga

SEQ ID NO: 354299 - DNA, 20 bp, Artificial Sequence
  chemically synthesized
caaacatagggaaaacagac

SEQ ID NO: 354300 - DNA, 20 bp, Artificial Sequence
  chemically synthesized
agggaaaacagacaggacct

SEQ ID NO: 354301 - DNA, 20 bp, Artificial Sequence
  chemically synthesized
aaacagacaggaccttggtc

SEQ ID NO: 354302 - DNA, 20 bp, Artificial Sequence
  chemically synthesized
aacagacaggaccttggtct

SEQ ID NO: 354303 - DNA, 20 bp, Artificial Sequence
  chemically synthesized
taaaatctttgcctagacca

SEQ ID NO: 354304 - DNA, 20 bp, Artificial Sequence
  chemically synthesized
ataaaatctttgcctagacc

SEQ ID NO: 354305 - DNA, 20 bp, Artificial Sequence
  chemically synthesized
acaggaccttggtctaggca

SEQ ID NO: 354306 - DNA, 20 bp, Artificial Sequence
  chemically synthesized
ataaccataaaatctttgcc

SEQ ID NO: 354307 - DNA, 20 bp, Artificial Sequence
  chemically synthesized
tggtctaggcaaagatttta

SEQ ID NO: 354308 - DNA, 20 bp, Artificial Sequence
  chemically synthesized
ttttatggttatgacctcaa

SEQ ID NO: 354309 - DNA, 20 bp, Artificial Sequence
  chemically synthesized
ttttgttgcctgcgcttttg

SEQ ID NO: 354310 - DNA, 20 bp, Artificial Sequence
  chemically synthesized
tggttatgacctcaaaagcg

SEQ ID NO: 354311 - DNA, 20 bp, Artificial Sequence
  chemically synthesized
tttttgttgcctgcgctttt

SEQ ID NO: 354312 - DNA, 20 bp, Artificial Sequence
  chemically synthesized
ggttatgacctcaaaagcgc

SEQ ID NO: 354313 - DNA, 20 bp, Artificial Sequence
  chemically synthesized
gcaggcaacaaaaacataaa

SEQ ID NO: 354314 - DNA, 20 bp, Artificial Sequence
  chemically synthesized
caaaaacataaatagataat

SEQ ID NO: 354315 - DNA, 20 bp, Artificial Sequence
  chemically synthesized
aaaaacataaatagataatt

SEQ ID NO: 354316 - DNA, 20 bp, Artificial Sequence
  chemically synthesized
taaatagataattgggactg

SEQ ID NO: 354317 - DNA, 20 bp, Artificial Sequence
  chemically synthesized
agaagctctttcattttcta

SEQ ID NO: 354318 - DNA, 20 bp, Artificial Sequence
  chemically synthesized
attgggactgtagaaaatga

SEQ ID NO: 354319 - DNA, 20 bp, Artificial Sequence
  chemically synthesized
tgggactgtagaaaatgaaa

SEQ ID NO: 354320 - DNA, 20 bp, Artificial Sequence
  chemically synthesized
atccttcctttgttttacag

SEQ ID NO: 354321 - DNA, 20 bp, Artificial Sequence
  chemically synthesized
gaaagagcttctgtaaaaca

SEQ ID NO: 354322 - DNA, 20 bp, Artificial Sequence
  chemically synthesized
tgaatccttcctttgtttta

SEQ ID NO: 354323 - DNA, 20 bp, Artificial Sequence
  chemically synthesized
aaagagcttctgtaaaacaa

SEQ ID NO: 354324 - DNA, 20 bp, Artificial Sequence
  chemically synthesized
gagcttctgtaaaacaaagg

SEQ ID NO: 354325 - DNA, 20 bp, Artificial Sequence
  chemically synthesized
agcttctgtaaaacaaagga

SEQ ID NO: 354326 - DNA, 20 bp, Artificial Sequence
  chemically synthesized
aaaacaaaggaaggattcaa

SEQ ID NO: 354327 - DNA, 20 bp, Artificial Sequence
  chemically synthesized
aacaaaggaaggattcaaca

SEQ ID NO: 354328 - DNA, 20 bp, Artificial Sequence
  chemically synthesized
aggaaggattcaacagagtg

SEQ ID NO: 354329 - DNA, 20 bp, Artificial Sequence
  chemically synthesized
gaaggattcaacagagtgaa

SEQ ID NO: 354330 - DNA, 20 bp, Artificial Sequence
  chemically synthesized
tgaagagacaacctgctgaa

SEQ ID NO: 354331 - DNA, 20 bp, Artificial Sequence
  chemically synthesized
gaagagacaacctgctgaat

SEQ ID NO: 354332 - DNA, 20 bp, Artificial Sequence
  chemically synthesized
aatcttttctcccattcagc

SEQ ID NO: 354333 - DNA, 20 bp, Artificial Sequence
  chemically synthesized
aaatcttttctcccattcag

SEQ ID NO: 354334 - DNA, 20 bp, Artificial Sequence
  chemically synthesized
agagacaacctgctgaatgg

SEQ ID NO: 354335 - DNA, 20 bp, Artificial Sequence
  chemically synthesized
tacaaatcttttctcccatt

SEQ ID NO: 354336 - DNA, 20 bp, Artificial Sequence
  chemically synthesized
caacctgctgaatgggagaa

SEQ ID NO: 354337 - DNA, 20 bp, Artificial Sequence
  chemically synthesized
gaaaagatttgtaaactatt

SEQ ID NO: 354338 - DNA, 20 bp, Artificial Sequence
  chemically synthesized
gatttgtaaactattcagac

SEQ ID NO: 354339 - DNA, 20 bp, Artificial Sequence
  chemically synthesized
atattagtctcttgtctgaa

SEQ ID NO: 354340 - DNA, 20 bp, Artificial Sequence
  chemically synthesized
tttgtaaactattcagacaa

SEQ ID NO: 354341 - DNA, 20 bp, Artificial Sequence
  chemically synthesized
tcagacaagagactaatatc

SEQ ID NO: 354342 - DNA, 20 bp, Artificial Sequence
  chemically synthesized
cagacaagagactaatatct

SEQ ID NO: 354343 - DNA, 20 bp, Artificial Sequence
  chemically synthesized
tcctcgtatttcctagatat

SEQ ID NO: 354344 - DNA, 20 bp, Artificial Sequence
  chemically synthesized
tttgggatcctcgtatttcc

SEQ ID NO: 354345 - DNA, 20 bp, Artificial Sequence
  chemically synthesized
gactaatatctaggaaatac

SEQ ID NO: 354346 - DNA, 20 bp, Artificial Sequence
  chemically synthesized
actaatatctaggaaatacg

SEQ ID NO: 354347 - DNA, 20 bp, Artificial Sequence
  chemically synthesized
tttttactgttaaattgttt

SEQ ID NO: 354348 - DNA, 20 bp, Artificial Sequence
  chemically synthesized
ttttttactgttaaattgtt

SEQ ID NO: 354349 - DNA, 20 bp, Artificial Sequence
  chemically synthesized
gaggatcccaaacaatttaa

SEQ ID NO: 354350 - DNA, 20 bp, Artificial Sequence
  chemically synthesized
aaaaataatcacattaaaaa

SEQ ID NO: 354351 - DNA, 20 bp, Artificial Sequence
  chemically synthesized
aatcacattaaaaatggaca

SEQ ID NO: 354352 - DNA, 20 bp, Artificial Sequence
  chemically synthesized
atcacattaaaaatggacaa

SEQ ID NO: 354353 - DNA, 20 bp, Artificial Sequence
  chemically synthesized
aatggacaaaggacaataat

SEQ ID NO: 354354 - DNA, 20 bp, Artificial Sequence
  chemically synthesized
caataataagtatttctcaa

SEQ ID NO: 354355 - DNA, 20 bp, Artificial Sequence
  chemically synthesized
taataagtatttctcaaaag

SEQ ID NO: 354356 - DNA, 20 bp, Artificial Sequence
  chemically synthesized
ttggtcatttgtcttctttt

SEQ ID NO: 354357 - DNA, 20 bp, Artificial Sequence
  chemically synthesized
aaaagaagacaaatgaccaa

SEQ ID NO: 354358 - DNA, 20 bp, Artificial Sequence
  chemically synthesized
aaagaagacaaatgaccaac

SEQ ID NO: 354359 - DNA, 20 bp, Artificial Sequence
  chemically synthesized
gcattttttcatatacccgt

SEQ ID NO: 354360 - DNA, 20 bp, Artificial Sequence
  chemically synthesized
ccctaatgattagtgatgtt

SEQ ID NO: 354361 - DNA, 20 bp, Artificial Sequence
  chemically synthesized
tgctcaacatcactaatcat

SEQ ID NO: 354362 - DNA, 20 bp, Artificial Sequence
  chemically synthesized
gctcaacatcactaatcatt

SEQ ID NO: 354363 - DNA, 20 bp, Artificial Sequence
  chemically synthesized
ctcaacatcactaatcatta

SEQ ID NO: 354364 - DNA, 20 bp, Artificial Sequence
  chemically synthesized
atttgcatttccctaatgat

SEQ ID NO: 354365 - DNA, 20 bp, Artificial Sequence
  chemically synthesized
tcattagggaaatgcaaatc

SEQ ID NO: 354366 - DNA, 20 bp, Artificial Sequence
  chemically synthesized
aatgcaaatcaagtcatgat

SEQ ID NO: 354367 - DNA, 20 bp, Artificial Sequence
  chemically synthesized
ttctaactggggcaagatga

SEQ ID NO: 354368 - DNA, 20 bp, Artificial Sequence
  chemically synthesized
gatgagccatcatcttgccc

SEQ ID NO: 354369 - DNA, 20 bp, Artificial Sequence
  chemically synthesized
atagccattctaactggggc

SEQ ID NO: 354370 - DNA, 20 bp, Artificial Sequence
  chemically synthesized
agccatcatcttgccccagt

SEQ ID NO: 354371 - DNA, 20 bp, Artificial Sequence
  chemically synthesized
aataatagccattctaactg

SEQ ID NO: 354372 - DNA, 20 bp, Artificial Sequence
  chemically synthesized
taataatagccattctaact

SEQ ID NO: 354373 - DNA, 20 bp, Artificial Sequence
  chemically synthesized
tcatcttgccccagttagaa

SEQ ID NO: 354374 - DNA, 20 bp, Artificial Sequence
  chemically synthesized
ttaataatagccattctaac

SEQ ID NO: 354375 - DNA, 20 bp, Artificial Sequence
  chemically synthesized
ttttcttgtctttttaataa

SEQ ID NO: 354376 - DNA, 20 bp, Artificial Sequence
  chemically synthesized
ttagaatggctattattaaa

SEQ ID NO: 354377 - DNA, 20 bp, Artificial Sequence
  chemically synthesized
atggctattattaaaaagac

SEQ ID NO: 354378 - DNA, 20 bp, Artificial Sequence
  chemically synthesized
ttaaaaagacaagaaaacaa

SEQ ID NO: 354379 - DNA, 20 bp, Artificial Sequence
  chemically synthesized
agaaaacaacagatgttgac

SEQ ID NO: 354380 - DNA, 20 bp, Artificial Sequence
  chemically synthesized
gaaaacaacagatgttgacg

SEQ ID NO: 354381 - DNA, 20 bp, Artificial Sequence
  chemically synthesized
tgttgacgaggtgcaacgaa

SEQ ID NO: 354382 - DNA, 20 bp, Artificial Sequence
  chemically synthesized
gttgacgaggtgcaacgaaa

SEQ ID NO: 354383 - DNA, 20 bp, Artificial Sequence
  chemically synthesized
ttgacgaggtgcaacgaaaa

SEQ ID NO: 354384 - DNA, 20 bp, Artificial Sequence
  chemically synthesized
gaactacaacaatgtattaa

SEQ ID NO: 354385 - DNA, 20 bp, Artificial Sequence
  chemically synthesized
ctgaactacaacaatgtatt

SEQ ID NO: 354386 - DNA, 20 bp, Artificial Sequence
  chemically synthesized
gaactcttaatacattgttg

SEQ ID NO: 354387 - DNA, 20 bp, Artificial Sequence
  chemically synthesized
cttaatacattgttgtagtt

SEQ ID NO: 354388 - DNA, 20 bp, Artificial Sequence
  chemically synthesized
attgttgtagttcagaatat

SEQ ID NO: 354389 - DNA, 20 bp, Artificial Sequence
  chemically synthesized
ttgtagttcagaatataagt

SEQ ID NO: 354390 - DNA, 20 bp, Artificial Sequence
  chemically synthesized
gttcagaatataagtcagta

SEQ ID NO: 354391 - DNA, 20 bp, Artificial Sequence
  chemically synthesized
ctccatactgttttcaatag

SEQ ID NO: 354392 - DNA, 20 bp, Artificial Sequence
  chemically synthesized
agtatagccactattgaaaa

SEQ ID NO: 354393 - DNA, 20 bp, Artificial Sequence
  chemically synthesized
cttctccatactgttttcaa

SEQ ID NO: 354394 - DNA, 20 bp, Artificial Sequence
  chemically synthesized
agccactattgaaaacagta

SEQ ID NO: 354395 - DNA, 20 bp, Artificial Sequence
  chemically synthesized
ccactattgaaaacagtatg

SEQ ID NO: 354396 - DNA, 20 bp, Artificial Sequence
  chemically synthesized
ctattgaaaacagtatggag

SEQ ID NO: 354397 - DNA, 20 bp, Artificial Sequence
  chemically synthesized
atttctatgtttagtttttt

SEQ ID NO: 354398 - DNA, 20 bp, Artificial Sequence
  chemically synthesized
atttctcaaaaaactaaaca

SEQ ID NO: 354399 - DNA, 20 bp, Artificial Sequence
  chemically synthesized
acatactctatttctatgtt

SEQ ID NO: 354400 - DNA, 20 bp, Artificial Sequence
  chemically synthesized
caaaaaactaaacatagaaa

SEQ ID NO: 354401 - DNA, 20 bp, Artificial Sequence
  chemically synthesized
aaaaactaaacatagaaata

SEQ ID NO: 354402 - DNA, 20 bp, Artificial Sequence
  chemically synthesized
catagaaatagagtatgtgt

SEQ ID NO: 354403 - DNA, 20 bp, Artificial Sequence
  chemically synthesized
gtgtcagcaatgccactaat

SEQ ID NO: 354404 - DNA, 20 bp, Artificial Sequence
  chemically synthesized
tttacatatatacttattag

SEQ ID NO: 354405 - DNA, 20 bp, Artificial Sequence
  chemically synthesized
ccctttacatatatacttat

SEQ ID NO: 354406 - DNA, 20 bp, Artificial Sequence
  chemically synthesized
cactaataagtatatatgta

SEQ ID NO: 354407 - DNA, 20 bp, Artificial Sequence
  chemically synthesized
actaataagtatatatgtaa

SEQ ID NO: 354408 - DNA, 20 bp, Artificial Sequence
  chemically synthesized
ctaataagtatatatgtaaa

SEQ ID NO: 354409 - DNA, 20 bp, Artificial Sequence
  chemically synthesized
taagtatatatgtaaaggga

SEQ ID NO: 354410 - DNA, 20 bp, Artificial Sequence
  chemically synthesized
acttttcctgatagttagaa

SEQ ID NO: 354411 - DNA, 20 bp, Artificial Sequence
  chemically synthesized
tcatatacttttctaactat

SEQ ID NO: 354412 - DNA, 20 bp, Artificial Sequence
  chemically synthesized
catatacttttctaactatc

SEQ ID NO: 354413 - DNA, 20 bp, Artificial Sequence
  chemically synthesized
catatacttttcctgatagt

SEQ ID NO: 354414 - DNA, 20 bp, Artificial Sequence
  chemically synthesized
acttttctaactatcaggaa

SEQ ID NO: 354415 - DNA, 20 bp, Artificial Sequence
  chemically synthesized
catgcatatacttttcctga

SEQ ID NO: 354416 - DNA, 20 bp, Artificial Sequence
  chemically synthesized
tatcaggaaaagtatatgca

SEQ ID NO: 354417 - DNA, 20 bp, Artificial Sequence
  chemically synthesized
ctcaataagcatgcaagtac

SEQ ID NO: 354418 - DNA, 20 bp, Artificial Sequence
  chemically synthesized
cctcaataagcatgcaagta

SEQ ID NO: 354419 - DNA, 20 bp, Artificial Sequence
  chemically synthesized
tagtgcctcaataagcatgc

SEQ ID NO: 354420 - DNA, 20 bp, Artificial Sequence
  chemically synthesized
cctgtacttgcatgcttatt

SEQ ID NO: 354421 - DNA, 20 bp, Artificial Sequence
  chemically synthesized
ctgtacttgcatgcttattg

SEQ ID NO: 354422 - DNA, 20 bp, Artificial Sequence
  chemically synthesized
attataaatagtgcctcaat

SEQ ID NO: 354423 - DNA, 20 bp, Artificial Sequence
  chemically synthesized
tattgaggcactatttataa

SEQ ID NO: 354424 - DNA, 20 bp, Artificial Sequence
  chemically synthesized
acttaagttgctattataaa

SEQ ID NO: 354425 - DNA, 20 bp, Artificial Sequence
  chemically synthesized
actatttataatagcaactt

SEQ ID NO: 354426 - DNA, 20 bp, Artificial Sequence
  chemically synthesized
ttgttcactaatggacactt

SEQ ID NO: 354427 - DNA, 20 bp, Artificial Sequence
  chemically synthesized
atagcaacttaagtgtccat

SEQ ID NO: 354428 - DNA, 20 bp, Artificial Sequence
  chemically synthesized
tttatccatttgttcactaa

SEQ ID NO: 354429 - DNA, 20 bp, Artificial Sequence
  chemically synthesized
agtgtccattagtgaacaaa

SEQ ID NO: 354430 - DNA, 20 bp, Artificial Sequence
  chemically synthesized
cattagtgaacaaatggata

SEQ ID NO: 354431 - DNA, 20 bp, Artificial Sequence
  chemically synthesized
acaaatggataaagaaaatg

SEQ ID NO: 354432 - DNA, 20 bp, Artificial Sequence
  chemically synthesized
gaaaatgtggtacatatata

SEQ ID NO: 354433 - DNA, 20 bp, Artificial Sequence
  chemically synthesized
aatgtggtacatatatacag

SEQ ID NO: 354434 - DNA, 20 bp, Artificial Sequence
  chemically synthesized
aattcttttttatggatgaa

SEQ ID NO: 354435 - DNA, 20 bp, Artificial Sequence
  chemically synthesized
gtaattcttttttatggatg

SEQ ID NO: 354436 - DNA, 20 bp, Artificial Sequence
  chemically synthesized
aatactcttcatccataaaa

SEQ ID NO: 354437 - DNA, 20 bp, Artificial Sequence
  chemically synthesized
gaaaatgtaattctttttta

SEQ ID NO: 354438 - DNA, 20 bp, Artificial Sequence
  chemically synthesized
cagtttcattcatgttggtg

SEQ ID NO: 354439 - DNA, 20 bp, Artificial Sequence
  chemically synthesized
acctgcagtttcattcatgt

SEQ ID NO: 354440 - DNA, 20 bp, Artificial Sequence
  chemically synthesized
caccaacatgaatgaaactg

SEQ ID NO: 354441 - DNA, 20 bp, Artificial Sequence
  chemically synthesized
accaacatgaatgaaactgc

SEQ ID NO: 354442 - DNA, 20 bp, Artificial Sequence
  chemically synthesized
ttgtctcacttaataacctg

SEQ ID NO: 354443 - DNA, 20 bp, Artificial Sequence
  chemically synthesized
gaatgaaactgcaggttatt

SEQ ID NO: 354444 - DNA, 20 bp, Artificial Sequence
  chemically synthesized
gaaactgcaggttattaagt

SEQ ID NO: 354445 - DNA, 20 bp, Artificial Sequence
  chemically synthesized
ggttattaagtgagacaatc

SEQ ID NO: 354446 - DNA, 20 bp, Artificial Sequence
  chemically synthesized
gttattaagtgagacaatcg

SEQ ID NO: 354447 - DNA, 20 bp, Artificial Sequence
  chemically synthesized
taagtgagacaatcgaggca

SEQ ID NO: 354448 - DNA, 20 bp, Artificial Sequence
  chemically synthesized
acaatcgaggcaaagataaa

SEQ ID NO: 354449 - DNA, 20 bp, Artificial Sequence
  chemically synthesized
ttttacacctatatatgagt

SEQ ID NO: 354450 - DNA, 20 bp, Artificial Sequence
  chemically synthesized
tacattttcttactcatata

SEQ ID NO: 354451 - DNA, 20 bp, Artificial Sequence
  chemically synthesized
acattttcttactcatatat

SEQ ID NO: 354452 - DNA, 20 bp, Artificial Sequence
  chemically synthesized
ctttttttacacctatatat

SEQ ID NO: 354453 - DNA, 20 bp, Artificial Sequence
  chemically synthesized
ctcatatataggtgtaaaaa

SEQ ID NO: 354454 - DNA, 20 bp, Artificial Sequence
  chemically synthesized
tgtaaaaaaagttgttctca

SEQ ID NO: 354455 - DNA, 20 bp, Artificial Sequence
  chemically synthesized
aaaagttgttctcatggaaa

SEQ ID NO: 354456 - DNA, 20 bp, Artificial Sequence
  chemically synthesized
attatactctctatttccat

SEQ ID NO: 354457 - DNA, 20 bp, Artificial Sequence
  chemically synthesized
aagttgttctcatggaaata

SEQ ID NO: 354458 - DNA, 20 bp, Artificial Sequence
  chemically synthesized
gttgttctcatggaaataga

SEQ ID NO: 354459 - DNA, 20 bp, Artificial Sequence
  chemically synthesized
atggaaatagagagtataat

SEQ ID NO: 354460 - DNA, 20 bp, Artificial Sequence
  chemically synthesized
tagagagtataataagatac

SEQ ID NO: 354461 - DNA, 20 bp, Artificial Sequence
  chemically synthesized
gagagtataataagatacca

SEQ ID NO: 354462 - DNA, 20 bp, Artificial Sequence
  chemically synthesized
agagtataataagataccag

SEQ ID NO: 354463 - DNA, 20 bp, Artificial Sequence
  chemically synthesized
tataataagataccagaggc

SEQ ID NO: 354464 - DNA, 20 bp, Artificial Sequence
  chemically synthesized
ataataagataccagaggct

SEQ ID NO: 354465 - DNA, 20 bp, Artificial Sequence
  chemically synthesized
ttcctacccttcctagcctc

SEQ ID NO: 354466 - DNA, 20 bp, Artificial Sequence
  chemically synthesized
ataagataccagaggctagg

SEQ ID NO: 354467 - DNA, 20 bp, Artificial Sequence
  chemically synthesized
taagataccagaggctagga

SEQ ID NO: 354468 - DNA, 20 bp, Artificial Sequence
  chemically synthesized
aagataccagaggctaggaa

SEQ ID NO: 354469 - DNA, 20 bp, Artificial Sequence
  chemically synthesized
ataccagaggctaggaaggg

SEQ ID NO: 354470 - DNA, 20 bp, Artificial Sequence
  chemically synthesized
tattcccttcctacccttcc

SEQ ID NO: 354471 - DNA, 20 bp, Artificial Sequence
  chemically synthesized
taccagaggctaggaagggt

SEQ ID NO: 354472 - DNA, 20 bp, Artificial Sequence
  chemically synthesized
cagaggctaggaagggtagg

SEQ ID NO: 354473 - DNA, 20 bp, Artificial Sequence
  chemically synthesized
agaggctaggaagggtagga

SEQ ID NO: 354474 - DNA, 20 bp, Artificial Sequence
  chemically synthesized
gaggctaggaagggtaggaa

SEQ ID NO: 354475 - DNA, 20 bp, Artificial Sequence
  chemically synthesized
gggtaggaagggaatataaa

SEQ ID NO: 354476 - DNA, 20 bp, Artificial Sequence
  chemically synthesized
ggtaggaagggaatataaaa

SEQ ID NO: 354477 - DNA, 20 bp, Artificial Sequence
  chemically synthesized
gtaggaagggaatataaaaa

SEQ ID NO: 354478 - DNA, 20 bp, Artificial Sequence
  chemically synthesized
taggaagggaatataaaaag

SEQ ID NO: 354479 - DNA, 20 bp, Artificial Sequence
  chemically synthesized
tataaaaaggggttatttaa

SEQ ID NO: 354480 - DNA, 20 bp, Artificial Sequence
  chemically synthesized
ataaaaaggggttatttaat

SEQ ID NO: 354481 - DNA, 20 bp, Artificial Sequence
  chemically synthesized
atttaatgggtacaaatata

SEQ ID NO: 354482 - DNA, 20 bp, Artificial Sequence
  chemically synthesized
aatgggtacaaatatatagt

SEQ ID NO: 354483 - DNA, 20 bp, Artificial Sequence
  chemically synthesized
gggtacaaatatatagttgg

SEQ ID NO: 354484 - DNA, 20 bp, Artificial Sequence
  chemically synthesized
ggtacaaatatatagttgga

SEQ ID NO: 354485 - DNA, 20 bp, Artificial Sequence
  chemically synthesized
ccctttctgctgttgaacat

SEQ ID NO: 354486 - DNA, 20 bp, Artificial Sequence
  chemically synthesized
gtatatattctaatgttcaa

SEQ ID NO: 354487 - DNA, 20 bp, Artificial Sequence
  chemically synthesized
tatattctaatgttcaacag

SEQ ID NO: 354488 - DNA, 20 bp, Artificial Sequence
  chemically synthesized
ttctaatgttcaacagcaga

SEQ ID NO: 354489 - DNA, 20 bp, Artificial Sequence
  chemically synthesized
tctaatgttcaacagcagaa

SEQ ID NO: 354490 - DNA, 20 bp, Artificial Sequence
  chemically synthesized
ctaatgttcaacagcagaaa

SEQ ID NO: 354491 - DNA, 20 bp, Artificial Sequence
  chemically synthesized
taatgttcaacagcagaaag

SEQ ID NO: 354492 - DNA, 20 bp, Artificial Sequence
  chemically synthesized
caacagcagaaaggggtgac

SEQ ID NO: 354493 - DNA, 20 bp, Artificial Sequence
  chemically synthesized
acagcagaaaggggtgacta

SEQ ID NO: 354494 - DNA, 20 bp, Artificial Sequence
  chemically synthesized
cagaaaggggtgactagagt

SEQ ID NO: 354495 - DNA, 20 bp, Artificial Sequence
  chemically synthesized
catcatattgttgctaactc

SEQ ID NO: 354496 - DNA, 20 bp, Artificial Sequence
  chemically synthesized
acaatatgatgtacatttca

SEQ ID NO: 354497 - DNA, 20 bp, Artificial Sequence
  chemically synthesized
atatgatgtacatttcaaag

SEQ ID NO: 354498 - DNA, 20 bp, Artificial Sequence
  chemically synthesized
atgtacatttcaaagtagat

SEQ ID NO: 354499 - DNA, 20 bp, Artificial Sequence
  chemically synthesized
gtacatttcaaagtagatga

SEQ ID NO: 354500 - DNA, 20 bp, Artificial Sequence
  chemically synthesized
ttatgttctgtgaacatttt

SEQ ID NO: 354501 - DNA, 20 bp, Artificial Sequence
  chemically synthesized
gagagaactcaaaatgttca

SEQ ID NO: 354502 - DNA, 20 bp, Artificial Sequence
  chemically synthesized
ataaaaatgataaatactca

SEQ ID NO: 354503 - DNA, 20 bp, Artificial Sequence
  chemically synthesized
tttggggtattcattacttt

SEQ ID NO: 354504 - DNA, 20 bp, Artificial Sequence
  chemically synthesized
tggtcaagtcagtgtatttg

SEQ ID NO: 354505 - DNA, 20 bp, Artificial Sequence
  chemically synthesized
atggtcaagtcagtgtattt

SEQ ID NO: 354506 - DNA, 20 bp, Artificial Sequence
  chemically synthesized
aatggtcaagtcagtgtatt

SEQ ID NO: 354507 - DNA, 20 bp, Artificial Sequence
  chemically synthesized
tgaatgtgtaatggtcaagt

SEQ ID NO: 354508 - DNA, 20 bp, Artificial Sequence
  chemically synthesized
gcactgaatgtgtaatggtc

SEQ ID NO: 354509 - DNA, 20 bp, Artificial Sequence
  chemically synthesized
taaacgcactgaatgtgtaa

SEQ ID NO: 354510 - DNA, 20 bp, Artificial Sequence
  chemically synthesized
tgacttgaccattacacatt

SEQ ID NO: 354511 - DNA, 20 bp, Artificial Sequence
  chemically synthesized
ttatgcatcaataaaaataa

SEQ ID NO: 354512 - DNA, 20 bp, Artificial Sequence
  chemically synthesized
ataaaaataaaagttctaaa

SEQ ID NO: 354513 - DNA, 20 bp, Artificial Sequence
  chemically synthesized
aaaaataaaagttctaaaaa

SEQ ID NO: 354514 - DNA, 20 bp, Artificial Sequence
  chemically synthesized
tcttagatttattctctttt

SEQ ID NO: 354515 - DNA, 20 bp, Artificial Sequence
  chemically synthesized
tctaaaaagagaataaatct

SEQ ID NO: 354516 - DNA, 20 bp, Artificial Sequence
  chemically synthesized
taaaaagagaataaatctaa

SEQ ID NO: 354517 - DNA, 20 bp, Artificial Sequence
  chemically synthesized
aaaaagagaataaatctaag

SEQ ID NO: 354518 - DNA, 20 bp, Artificial Sequence
  chemically synthesized
agagaataaatctaagagga

SEQ ID NO: 354519 - DNA, 20 bp, Artificial Sequence
  chemically synthesized
aaagcaataagctatcctct

SEQ ID NO: 354520 - DNA, 20 bp, Artificial Sequence
  chemically synthesized
tcattttattttaaagcaat

SEQ ID NO: 354521 - DNA, 20 bp, Artificial Sequence
  chemically synthesized
tgtcttgtcattttatttta

SEQ ID NO: 354522 - DNA, 20 bp, Artificial Sequence
  chemically synthesized
ttgctttaaaataaaatgac

SEQ ID NO: 354523 - DNA, 20 bp, Artificial Sequence
  chemically synthesized
gagggaaacctgaagattta

SEQ ID NO: 354524 - DNA, 20 bp, Artificial Sequence
  chemically synthesized
acaagacaactataaatctt

SEQ ID NO: 354525 - DNA, 20 bp, Artificial Sequence
  chemically synthesized
caagacaactataaatcttc

SEQ ID NO: 354526 - DNA, 20 bp, Artificial Sequence
  chemically synthesized
tccttgcagagggaaacctg

SEQ ID NO: 354527 - DNA, 20 bp, Artificial Sequence
  chemically synthesized
atcttcaggtttccctctgc

SEQ ID NO: 354528 - DNA, 20 bp, Artificial Sequence
  chemically synthesized
tcttcaggtttccctctgca

SEQ ID NO: 354529 - DNA, 20 bp, Artificial Sequence
  chemically synthesized
taggatttattccttgcaga

SEQ ID NO: 354530 - DNA, 20 bp, Artificial Sequence
  chemically synthesized
ataggatttattccttgcag

SEQ ID NO: 354531 - DNA, 20 bp, Artificial Sequence
  chemically synthesized
aataggatttattccttgca

SEQ ID NO: 354532 - DNA, 20 bp, Artificial Sequence
  chemically synthesized
acaataggatttattccttg

SEQ ID NO: 354533 - DNA, 20 bp, Artificial Sequence
  chemically synthesized
aaatttaattgtcatacaat

SEQ ID NO: 354534 - DNA, 20 bp, Artificial Sequence
  chemically synthesized
gaaatttaattgtcatacaa

SEQ ID NO: 354535 - DNA, 20 bp, Artificial Sequence
  chemically synthesized
caattaaatttccctcttat

SEQ ID NO: 354536 - DNA, 20 bp, Artificial Sequence
  chemically synthesized
gtcatttaaatcttataaga

SEQ ID NO: 354537 - DNA, 20 bp, Artificial Sequence
  chemically synthesized
tgtcatttaaatcttataag

SEQ ID NO: 354538 - DNA, 20 bp, Artificial Sequence
  chemically synthesized
atgtcatttaaatcttataa

SEQ ID NO: 354539 - DNA, 20 bp, Artificial Sequence
  chemically synthesized
tgatgtcatttaaatcttat

SEQ ID NO: 354540 - DNA, 20 bp, Artificial Sequence
  chemically synthesized
agatttaaatgacatcaaca

SEQ ID NO: 354541 - DNA, 20 bp, Artificial Sequence
  chemically synthesized
aatgacatcaacaaagactt

SEQ ID NO: 354542 - DNA, 20 bp, Artificial Sequence
  chemically synthesized
ggtaaaataatgatgaacta

SEQ ID NO: 354543 - DNA, 20 bp, Artificial Sequence
  chemically synthesized
actattttacaacaatattt

SEQ ID NO: 354544 - DNA, 20 bp, Artificial Sequence
  chemically synthesized
tactattttacaacaatatt

SEQ ID NO: 354545 - DNA, 20 bp, Artificial Sequence
  chemically synthesized
acccaaatattgttgtaaaa

SEQ ID NO: 354546 - DNA, 20 bp, Artificial Sequence
  chemically synthesized
acagctggaacatgaaatat

SEQ ID NO: 354547 - DNA, 20 bp, Artificial Sequence
  chemically synthesized
tcatcttatatttcatgttc

SEQ ID NO: 354548 - DNA, 20 bp, Artificial Sequence
  chemically synthesized
tgcatgtgacattttacagc

SEQ ID NO: 354549 - DNA, 20 bp, Artificial Sequence
  chemically synthesized
aaaatgcatgtgacatttta

SEQ ID NO: 354550 - DNA, 20 bp, Artificial Sequence
  chemically synthesized
tgtcacatgcattttatata

SEQ ID NO: 354551 - DNA, 20 bp, Artificial Sequence
  chemically synthesized
atatatagaaattatttaat

SEQ ID NO: 354552 - DNA, 20 bp, Artificial Sequence
  chemically synthesized
tggaaaaatagatattaggt

SEQ ID NO: 354553 - DNA, 20 bp, Artificial Sequence
  chemically synthesized
gcactggaaaaatagatatt

SEQ ID NO: 354554 - DNA, 20 bp, Artificial Sequence
  chemically synthesized
ggcactggaaaaatagatat

SEQ ID NO: 354555 - DNA, 20 bp, Artificial Sequence
  chemically synthesized
caacctaatatctatttttc

SEQ ID NO: 354556 - DNA, 20 bp, Artificial Sequence
  chemically synthesized
aaagctgggcactggaaaaa

SEQ ID NO: 354557 - DNA, 20 bp, Artificial Sequence
  chemically synthesized
atatctatttttccagtgcc

SEQ ID NO: 354558 - DNA, 20 bp, Artificial Sequence
  chemically synthesized
aaaaccttaaagctgggcac

SEQ ID NO: 354559 - DNA, 20 bp, Artificial Sequence
  chemically synthesized
tttttccagtgcccagcttt

SEQ ID NO: 354560 - DNA, 20 bp, Artificial Sequence
  chemically synthesized
ttttccagtgcccagcttta

SEQ ID NO: 354561 - DNA, 20 bp, Artificial Sequence
  chemically synthesized
tatccaaaaaccttaaagct

SEQ ID NO: 354562 - DNA, 20 bp, Artificial Sequence
  chemically synthesized
atatccaaaaaccttaaagc

SEQ ID NO: 354563 - DNA, 20 bp, Artificial Sequence
  chemically synthesized
atgaatatccaaaaacctta

SEQ ID NO: 354564 - DNA, 20 bp, Artificial Sequence
  chemically synthesized
gtgcccagctttaaggtttt

SEQ ID NO: 354565 - DNA, 20 bp, Artificial Sequence
  chemically synthesized
ggtttttggatattcatttg

SEQ ID NO: 354566 - DNA, 20 bp, Artificial Sequence
  chemically synthesized
gtttttggatattcatttgc

SEQ ID NO: 354567 - DNA, 20 bp, Artificial Sequence
  chemically synthesized
acaaacaaaaaaagacatca

SEQ ID NO: 354568 - DNA, 20 bp, Artificial Sequence
  chemically synthesized
cccacaaaaacaaacaaaaa

SEQ ID NO: 354569 - DNA, 20 bp, Artificial Sequence
  chemically synthesized
tctttttttgtttgtttttg

SEQ ID NO: 354570 - DNA, 20 bp, Artificial Sequence
  chemically synthesized
ctttttttgtttgtttttgt

SEQ ID NO: 354571 - DNA, 20 bp, Artificial Sequence
  chemically synthesized
ttttgtttgtttttgtggga

SEQ ID NO: 354572 - DNA, 20 bp, Artificial Sequence
  chemically synthesized
tttgtttgtttttgtgggat

SEQ ID NO: 354573 - DNA, 20 bp, Artificial Sequence
  chemically synthesized
ttgtttgtttttgtgggatg

SEQ ID NO: 354574 - DNA, 20 bp, Artificial Sequence
  chemically synthesized
tgtttgtttttgtgggatgg

SEQ ID NO: 354575 - DNA, 20 bp, Artificial Sequence
  chemically synthesized
gtttgtttttgtgggatggg

SEQ ID NO: 354576 - DNA, 20 bp, Artificial Sequence
  chemically synthesized
gtttttgtgggatgggggga

SEQ ID NO: 354577 - DNA, 20 bp, Artificial Sequence
  chemically synthesized
tttttgtgggatggggggac

SEQ ID NO: 354578 - DNA, 20 bp, Artificial Sequence
  chemically synthesized
ttttgtgggatggggggaca

SEQ ID NO: 354579 - DNA, 20 bp, Artificial Sequence
  chemically synthesized
gggatggggggacagggcct

SEQ ID NO: 354580 - DNA, 20 bp, Artificial Sequence
  chemically synthesized
aagcctaggcaaaagaactg

SEQ ID NO: 354581 - DNA, 20 bp, Artificial Sequence
  chemically synthesized
caagcctaggcaaaagaact

SEQ ID NO: 354582 - DNA, 20 bp, Artificial Sequence
  chemically synthesized
agggcctcagttcttttgcc

SEQ ID NO: 354583 - DNA, 20 bp, Artificial Sequence
  chemically synthesized
gggcctcagttcttttgcct

SEQ ID NO: 354584 - DNA, 20 bp, Artificial Sequence
  chemically synthesized
ctactctcaagcctaggcaa

SEQ ID NO: 354585 - DNA, 20 bp, Artificial Sequence
  chemically synthesized
cagttcttttgcctaggctt

SEQ ID NO: 354586 - DNA, 20 bp, Artificial Sequence
  chemically synthesized
gtgccactactctcaagcct

SEQ ID NO: 354587 - DNA, 20 bp, Artificial Sequence
  chemically synthesized
gttcttttgcctaggcttga

SEQ ID NO: 354588 - DNA, 20 bp, Artificial Sequence
  chemically synthesized
tgtgccactactctcaagcc

SEQ ID NO: 354589 - DNA, 20 bp, Artificial Sequence
  chemically synthesized
cttttgcctaggcttgagag

SEQ ID NO: 354590 - DNA, 20 bp, Artificial Sequence
  chemically synthesized
atgattgtgccactactctc

SEQ ID NO: 354591 - DNA, 20 bp, Artificial Sequence
  chemically synthesized
ttgcctaggcttgagagtag

SEQ ID NO: 354592 - DNA, 20 bp, Artificial Sequence
  chemically synthesized
tgagagtagtggcacaatca

SEQ ID NO: 354593 - DNA, 20 bp, Artificial Sequence
  chemically synthesized
ggcacaatcatagctcaccg

SEQ ID NO: 354594 - DNA, 20 bp, Artificial Sequence
  chemically synthesized
caggagttcaaggctgcggt

SEQ ID NO: 354595 - DNA, 20 bp, Artificial Sequence
  chemically synthesized
aggccaggagttcaaggctg

SEQ ID NO: 354596 - DNA, 20 bp, Artificial Sequence
  chemically synthesized
tgctttaggccaggagttca

SEQ ID NO: 354597 - DNA, 20 bp, Artificial Sequence
  chemically synthesized
tcaccgcagccttgaactcc

SEQ ID NO: 354598 - DNA, 20 bp, Artificial Sequence
  chemically synthesized
ttgctttaggccaggagttc

SEQ ID NO: 354599 - DNA, 20 bp, Artificial Sequence
  chemically synthesized
ggagaattgctttaggccag

SEQ ID NO: 354600 - DNA, 20 bp, Artificial Sequence
  chemically synthesized
agccttgaactcctggccta

SEQ ID NO: 354601 - DNA, 20 bp, Artificial Sequence
  chemically synthesized
caggagaattgctttaggcc

SEQ ID NO: 354602 - DNA, 20 bp, Artificial Sequence
  chemically synthesized
gcaggagaattgctttaggc

SEQ ID NO: 354603 - DNA, 20 bp, Artificial Sequence
  chemically synthesized
caaggcaggagaattgcttt

SEQ ID NO: 354604 - DNA, 20 bp, Artificial Sequence
  chemically synthesized
ccaaggcaggagaattgctt

SEQ ID NO: 354605 - DNA, 20 bp, Artificial Sequence
  chemically synthesized
ctaaagcaattctcctgcct

SEQ ID NO: 354606 - DNA, 20 bp, Artificial Sequence
  chemically synthesized
acattgggaggccaaggcag

SEQ ID NO: 354607 - DNA, 20 bp, Artificial Sequence
  chemically synthesized
gcacattgggaggccaaggc

SEQ ID NO: 354608 - DNA, 20 bp, Artificial Sequence
  chemically synthesized
agcacattgggaggccaagg

SEQ ID NO: 354609 - DNA, 20 bp, Artificial Sequence
  chemically synthesized
cccagcacattgggaggcca

SEQ ID NO: 354610 - DNA, 20 bp, Artificial Sequence
  chemically synthesized
tcccagcacattgggaggcc

SEQ ID NO: 354611 - DNA, 20 bp, Artificial Sequence
  chemically synthesized
tgtaatcccagcacattggg

SEQ ID NO: 354612 - DNA, 20 bp, Artificial Sequence
  chemically synthesized
ctgtaatcccagcacattgg

SEQ ID NO: 354613 - DNA, 20 bp, Artificial Sequence
  chemically synthesized
gccttggcctcccaatgtgc

SEQ ID NO: 354614 - DNA, 20 bp, Artificial Sequence
  chemically synthesized
acctgtaatcccagcacatt

SEQ ID NO: 354615 - DNA, 20 bp, Artificial Sequence
  chemically synthesized
ccttggcctcccaatgtgct

SEQ ID NO: 354616 - DNA, 20 bp, Artificial Sequence
  chemically synthesized
cacctgtaatcccagcacat

SEQ ID NO: 354617 - DNA, 20 bp, Artificial Sequence
  chemically synthesized
ctcccaatgtgctgggatta

SEQ ID NO: 354618 - DNA, 20 bp, Artificial Sequence
  chemically synthesized
tcccaatgtgctgggattac

SEQ ID NO: 354619 - DNA, 20 bp, Artificial Sequence
  chemically synthesized
atggctgacacctgtaatcc

SEQ ID NO: 354620 - DNA, 20 bp, Artificial Sequence
  chemically synthesized
tgtgctgggattacaggtgt

SEQ ID NO: 354621 - DNA, 20 bp, Artificial Sequence
  chemically synthesized
caggtgtcagccatcacacc

SEQ ID NO: 354622 - DNA, 20 bp, Artificial Sequence
  chemically synthesized
tatcacagggctgggtgtga

SEQ ID NO: 354623 - DNA, 20 bp, Artificial Sequence
  chemically synthesized
ataagtgatatcacagggct

SEQ ID NO: 354624 - DNA, 20 bp, Artificial Sequence
  chemically synthesized
tataagtgatatcacagggc

SEQ ID NO: 354625 - DNA, 20 bp, Artificial Sequence
  chemically synthesized
taattataagtgatatcaca

SEQ ID NO: 354626 - DNA, 20 bp, Artificial Sequence
  chemically synthesized
ataattataagtgatatcac

SEQ ID NO: 354627 - DNA, 20 bp, Artificial Sequence
  chemically synthesized
cataattataagtgatatca

SEQ ID NO: 354628 - DNA, 20 bp, Artificial Sequence
  chemically synthesized
tgtgttttatacataattat

SEQ ID NO: 354629 - DNA, 20 bp, Artificial Sequence
  chemically synthesized
ttataattatgtataaaaca

SEQ ID NO: 354630 - DNA, 20 bp, Artificial Sequence
  chemically synthesized
acacagttaactccattttg

SEQ ID NO: 354631 - DNA, 20 bp, Artificial Sequence
  chemically synthesized
acttcactgtcttcaaaatg

SEQ ID NO: 354632 - DNA, 20 bp, Artificial Sequence
  chemically synthesized
ttacttcactgtcttcaaaa

SEQ ID NO: 354633 - DNA, 20 bp, Artificial Sequence
  chemically synthesized
agttaactccattttgaaga

SEQ ID NO: 354634 - DNA, 20 bp, Artificial Sequence
  chemically synthesized
actccattttgaagacagtg

SEQ ID NO: 354635 - DNA, 20 bp, Artificial Sequence
  chemically synthesized
cattttgaagacagtgaagt

SEQ ID NO: 354636 - DNA, 20 bp, Artificial Sequence
  chemically synthesized
gaagtaagttttccaactat

SEQ ID NO: 354637 - DNA, 20 bp, Artificial Sequence
  chemically synthesized
atgtatattttgctgatagt

SEQ ID NO: 354638 - DNA, 20 bp, Artificial Sequence
  chemically synthesized
tgtaatgtatattttgctga

SEQ ID NO: 354639 - DNA, 20 bp, Artificial Sequence
  chemically synthesized
ttttctatgtggttttaagt

SEQ ID NO: 354640 - DNA, 20 bp, Artificial Sequence
  chemically synthesized
aaaattttctatgtggtttt

SEQ ID NO: 354641 - DNA, 20 bp, Artificial Sequence
  chemically synthesized
atcactgacttaaaaccaca

SEQ ID NO: 354642 - DNA, 20 bp, Artificial Sequence
  chemically synthesized
gtagtttaaaattttctatg

SEQ ID NO: 354643 - DNA, 20 bp, Artificial Sequence
  chemically synthesized
tgagaataaaatggcataag

SEQ ID NO: 354644 - DNA, 20 bp, Artificial Sequence
  chemically synthesized
aaatgagaataaaatggcat

SEQ ID NO: 354645 - DNA, 20 bp, Artificial Sequence
  chemically synthesized
gatggtaaatgagaataaaa

SEQ ID NO: 354646 - DNA, 20 bp, Artificial Sequence
  chemically synthesized
ccattctaatgatggtaaat

SEQ ID NO: 354647 - DNA, 20 bp, Artificial Sequence
  chemically synthesized
ttattctcatttaccatcat

SEQ ID NO: 354648 - DNA, 20 bp, Artificial Sequence
  chemically synthesized
cattttgaccattctaatga

SEQ ID NO: 354649 - DNA, 20 bp, Artificial Sequence
  chemically synthesized
ctcatttaccatcattagaa

SEQ ID NO: 354650 - DNA, 20 bp, Artificial Sequence
  chemically synthesized
atggtcaaaatgtttttgcc

SEQ ID NO: 354651 - DNA, 20 bp, Artificial Sequence
  chemically synthesized
tggtcaaaatgtttttgcca

SEQ ID NO: 354652 - DNA, 20 bp, Artificial Sequence
  chemically synthesized
cttgtcacagaattttgcct

SEQ ID NO: 354653 - DNA, 20 bp, Artificial Sequence
  chemically synthesized
ccaaggcaaaattctgtgac

SEQ ID NO: 354654 - DNA, 20 bp, Artificial Sequence
  chemically synthesized
gatatctgtgtttcttgtca

SEQ ID NO: 354655 - DNA, 20 bp, Artificial Sequence
  chemically synthesized
aaattctgtgacaagaaaca

SEQ ID NO: 354656 - DNA, 20 bp, Artificial Sequence
  chemically synthesized
agaaacacagatatcaacta

SEQ ID NO: 354657 - DNA, 20 bp, Artificial Sequence
  chemically synthesized
tgattcagaaaagtgttcta

SEQ ID NO: 354658 - DNA, 20 bp, Artificial Sequence
  chemically synthesized
atattaggtttgattcagaa

SEQ ID NO: 354659 - DNA, 20 bp, Artificial Sequence
  chemically synthesized
atgagatattaggtttgatt

SEQ ID NO: 354660 - DNA, 20 bp, Artificial Sequence
  chemically synthesized
gaaggaatacatgagatatt

SEQ ID NO: 354661 - DNA, 20 bp, Artificial Sequence
  chemically synthesized
tgaaggaatacatgagatat

SEQ ID NO: 354662 - DNA, 20 bp, Artificial Sequence
  chemically synthesized
tcagctatgaaggaatacat

SEQ ID NO: 354663 - DNA, 20 bp, Artificial Sequence
  chemically synthesized
atatctcatgtattccttca

SEQ ID NO: 354664 - DNA, 20 bp, Artificial Sequence
  chemically synthesized
taattttatttcagctatga

SEQ ID NO: 354665 - DNA, 20 bp, Artificial Sequence
  chemically synthesized
ttaattttatttcagctatg

SEQ ID NO: 354666 - DNA, 20 bp, Artificial Sequence
  chemically synthesized
ggtatttgttaattttattt

SEQ ID NO: 354667 - DNA, 20 bp, Artificial Sequence
  chemically synthesized
ataaaattaacaaataccaa

SEQ ID NO: 354668 - DNA, 20 bp, Artificial Sequence
  chemically synthesized
aatatattaaaaacatctat

SEQ ID NO: 354669 - DNA, 20 bp, Artificial Sequence
  chemically synthesized
atgtttttaatatatttctt

SEQ ID NO: 354670 - DNA, 20 bp, Artificial Sequence
  chemically synthesized
acaatgagttcatgagacta

SEQ ID NO: 354671 - DNA, 20 bp, Artificial Sequence
  chemically synthesized
tatcatcacaatgagttcat

SEQ ID NO: 354672 - DNA, 20 bp, Artificial Sequence
  chemically synthesized
cctagtcatatcatcacaat

SEQ ID NO: 354673 - DNA, 20 bp, Artificial Sequence
  chemically synthesized
actcattgtgatgatatgac

SEQ ID NO: 354674 - DNA, 20 bp, Artificial Sequence
  chemically synthesized
ctcattgtgatgatatgact

SEQ ID NO: 354675 - DNA, 20 bp, Artificial Sequence
  chemically synthesized
cactttgtggatggttttcc

SEQ ID NO: 354676 - DNA, 20 bp, Artificial Sequence
  chemically synthesized
gactaggaaaaccatccaca

SEQ ID NO: 354677 - DNA, 20 bp, Artificial Sequence
  chemically synthesized
tgtaatagacactttgtgga

SEQ ID NO: 354678 - DNA, 20 bp, Artificial Sequence
  chemically synthesized
aatatgtaatagacactttg

SEQ ID NO: 354679 - DNA, 20 bp, Artificial Sequence
  chemically synthesized
taatgctaaataatatgtaa

SEQ ID NO: 354680 - DNA, 20 bp, Artificial Sequence
  chemically synthesized
agtgtctattacatattatt

SEQ ID NO: 354681 - DNA, 20 bp, Artificial Sequence
  chemically synthesized
tattacatattatttagcat

SEQ ID NO: 354682 - DNA, 20 bp, Artificial Sequence
  chemically synthesized
tatttagcattagaacctca

SEQ ID NO: 354683 - DNA, 20 bp, Artificial Sequence
  chemically synthesized
taatgagaaatgcagccatg

SEQ ID NO: 354684 - DNA, 20 bp, Artificial Sequence
  chemically synthesized
ataatgagaaatgcagccat

SEQ ID NO: 354685 - DNA, 20 bp, Artificial Sequence
  chemically synthesized
taaattaataatgagaaatg

SEQ ID NO: 354686 - DNA, 20 bp, Artificial Sequence
  chemically synthesized
gacattaataaattaataat

SEQ ID NO: 354687 - DNA, 20 bp, Artificial Sequence
  chemically synthesized
gtgatttttgaatgattgac

SEQ ID NO: 354688 - DNA, 20 bp, Artificial Sequence
  chemically synthesized
ttggcctatacagtgacatt

SEQ ID NO: 354689 - DNA, 20 bp, Artificial Sequence
  chemically synthesized
aatcacttaatgtcactgta

SEQ ID NO: 354690 - DNA, 20 bp, Artificial Sequence
  chemically synthesized
atcacttaatgtcactgtat

SEQ ID NO: 354691 - DNA, 20 bp, Artificial Sequence
  chemically synthesized
aacaatatccttggcctata

SEQ ID NO: 354692 - DNA, 20 bp, Artificial Sequence
  chemically synthesized
ttaatgtcactgtataggcc

SEQ ID NO: 354693 - DNA, 20 bp, Artificial Sequence
  chemically synthesized
taatgtcactgtataggcca

SEQ ID NO: 354694 - DNA, 20 bp, Artificial Sequence
  chemically synthesized
aggtgaaataacaatatcct

SEQ ID NO: 354695 - DNA, 20 bp, Artificial Sequence
  chemically synthesized
aactttttttttttaattac

SEQ ID NO: 354696 - DNA, 20 bp, Artificial Sequence
  chemically synthesized
caactttttttttttaatta

SEQ ID NO: 354697 - DNA, 20 bp, Artificial Sequence
  chemically synthesized
cacctgtaattaaaaaaaaa

SEQ ID NO: 354698 - DNA, 20 bp, Artificial Sequence
  chemically synthesized
aaaagttgtgaaaataatcc

SEQ ID NO: 354699 - DNA, 20 bp, Artificial Sequence
  chemically synthesized
gttgtgaaaataatcctggt

SEQ ID NO: 354700 - DNA, 20 bp, Artificial Sequence
  chemically synthesized
ctcttttcaattagcttacc

SEQ ID NO: 354701 - DNA, 20 bp, Artificial Sequence
  chemically synthesized
tctcttttcaattagcttac

SEQ ID NO: 354702 - DNA, 20 bp, Artificial Sequence
  chemically synthesized
atcctggtaagctaattgaa

SEQ ID NO: 354703 - DNA, 20 bp, Artificial Sequence
  chemically synthesized
actgagaatctcttttcaat

SEQ ID NO: 354704 - DNA, 20 bp, Artificial Sequence
  chemically synthesized
cctggtaagctaattgaaaa

SEQ ID NO: 354705 - DNA, 20 bp, Artificial Sequence
  chemically synthesized
gctaattgaaaagagattct

SEQ ID NO: 354706 - DNA, 20 bp, Artificial Sequence
  chemically synthesized
aaaagagattctcagttatc

SEQ ID NO: 354707 - DNA, 20 bp, Artificial Sequence
  chemically synthesized
taattcttacctagataact

SEQ ID NO: 354708 - DNA, 20 bp, Artificial Sequence
  chemically synthesized
aaagagattctcagttatct

SEQ ID NO: 354709 - DNA, 20 bp, Artificial Sequence
  chemically synthesized
agattctcagttatctaggt

SEQ ID NO: 354710 - DNA, 20 bp, Artificial Sequence
  chemically synthesized
atttaaatataattcttacc

SEQ ID NO: 354711 - DNA, 20 bp, Artificial Sequence
  chemically synthesized
ggttctatgccaaatttgtt

SEQ ID NO: 354712 - DNA, 20 bp, Artificial Sequence
  chemically synthesized
taaatgtttctgaacaaatt

SEQ ID NO: 354713 - DNA, 20 bp, Artificial Sequence
  chemically synthesized
gtttctgaacaaatttggca

SEQ ID NO: 354714 - DNA, 20 bp, Artificial Sequence
  chemically synthesized
gaagatgtgcattatggatt

SEQ ID NO: 354715 - DNA, 20 bp, Artificial Sequence
  chemically synthesized
tgaagatgtgcattatggat

SEQ ID NO: 354716 - DNA, 20 bp, Artificial Sequence
  chemically synthesized
gcgattgaagatgtgcatta

SEQ ID NO: 354717 - DNA, 20 bp, Artificial Sequence
  chemically synthesized
gaagtataatcatgcgattg

SEQ ID NO: 354718 - DNA, 20 bp, Artificial Sequence
  chemically synthesized
gttggggaatttaaataatg

SEQ ID NO: 354719 - DNA, 20 bp, Artificial Sequence
  chemically synthesized
attatttaaattccccaact

SEQ ID NO: 354720 - DNA, 20 bp, Artificial Sequence
  chemically synthesized
aagagtttcttactcagttg

SEQ ID NO: 354721 - DNA, 20 bp, Artificial Sequence
  chemically synthesized
taagagtttcttactcagtt

SEQ ID NO: 354722 - DNA, 20 bp, Artificial Sequence
  chemically synthesized
tttaaattccccaactgagt

SEQ ID NO: 354723 - DNA, 20 bp, Artificial Sequence
  chemically synthesized
gtaagagtttcttactcagt

SEQ ID NO: 354724 - DNA, 20 bp, Artificial Sequence
  chemically synthesized
ttaagtaagagtttcttact

SEQ ID NO: 354725 - DNA, 20 bp, Artificial Sequence
  chemically synthesized
agtatgctttagttaagtaa

SEQ ID NO: 354726 - DNA, 20 bp, Artificial Sequence
  chemically synthesized
aaagtatgctttagttaagt

SEQ ID NO: 354727 - DNA, 20 bp, Artificial Sequence
  chemically synthesized
aagaaactcttacttaacta

SEQ ID NO: 354728 - DNA, 20 bp, Artificial Sequence
  chemically synthesized
tgttaaagtatgctttagtt

SEQ ID NO: 354729 - DNA, 20 bp, Artificial Sequence
  chemically synthesized
tgatttgttaaagtatgctt

SEQ ID NO: 354730 - DNA, 20 bp, Artificial Sequence
  chemically synthesized
ccctaggggctgatttgtta

SEQ ID NO: 354731 - DNA, 20 bp, Artificial Sequence
  chemically synthesized
taaagcatactttaacaaat

SEQ ID NO: 354732 - DNA, 20 bp, Artificial Sequence
  chemically synthesized
tactttaacaaatcagcccc

SEQ ID NO: 354733 - DNA, 20 bp, Artificial Sequence
  chemically synthesized
actttaacaaatcagcccct

SEQ ID NO: 354734 - DNA, 20 bp, Artificial Sequence
  chemically synthesized
ctttaacaaatcagccccta

SEQ ID NO: 354735 - DNA, 20 bp, Artificial Sequence
  chemically synthesized
tttaacaaatcagcccctag

SEQ ID NO: 354736 - DNA, 20 bp, Artificial Sequence
  chemically synthesized
taacaaatcagcccctaggg

SEQ ID NO: 354737 - DNA, 20 bp, Artificial Sequence
  chemically synthesized
ataatttctatctcccctag

SEQ ID NO: 354738 - DNA, 20 bp, Artificial Sequence
  chemically synthesized
tataatttctatctccccta

SEQ ID NO: 354739 - DNA, 20 bp, Artificial Sequence
  chemically synthesized
ttataatttctatctcccct

SEQ ID NO: 354740 - DNA, 20 bp, Artificial Sequence
  chemically synthesized
aaatcagcccctaggggaga

SEQ ID NO: 354741 - DNA, 20 bp, Artificial Sequence
  chemically synthesized
tttataatttctatctcccc

SEQ ID NO: 354742 - DNA, 20 bp, Artificial Sequence
  chemically synthesized
cattttaactttatggaaaa

SEQ ID NO: 354743 - DNA, 20 bp, Artificial Sequence
  chemically synthesized
taaattgaccattttccata

SEQ ID NO: 354744 - DNA, 20 bp, Artificial Sequence
  chemically synthesized
ttgtcaccattttaacttta

SEQ ID NO: 354745 - DNA, 20 bp, Artificial Sequence
  chemically synthesized
cattttccataaagttaaaa

SEQ ID NO: 354746 - DNA, 20 bp, Artificial Sequence
  chemically synthesized
gttaaaatggtgacaaatca

SEQ ID NO: 354747 - DNA, 20 bp, Artificial Sequence
  chemically synthesized
aaaatggtgacaaatcatag

SEQ ID NO: 354748 - DNA, 20 bp, Artificial Sequence
  chemically synthesized
caaatcatagaagaatgtga

SEQ ID NO: 354749 - DNA, 20 bp, Artificial Sequence
  chemically synthesized
catagaagaatgtgaaagat

SEQ ID NO: 354750 - DNA, 20 bp, Artificial Sequence
  chemically synthesized
agaagaatgtgaaagattag

SEQ ID NO: 354751 - DNA, 20 bp, Artificial Sequence
  chemically synthesized
ttaccctttataacaaattt

SEQ ID NO: 354752 - DNA, 20 bp, Artificial Sequence
  chemically synthesized
aaataccaaaatttgttata

SEQ ID NO: 354753 - DNA, 20 bp, Artificial Sequence
  chemically synthesized
aataccaaaatttgttataa

SEQ ID NO: 354754 - DNA, 20 bp, Artificial Sequence
  chemically synthesized
ataccaaaatttgttataaa

SEQ ID NO: 354755 - DNA, 20 bp, Artificial Sequence
  chemically synthesized
ttgttataaagggtaaattc

SEQ ID NO: 354756 - DNA, 20 bp, Artificial Sequence
  chemically synthesized
tataaagggtaaattcaagc

SEQ ID NO: 354757 - DNA, 20 bp, Artificial Sequence
  chemically synthesized
ataaagggtaaattcaagcc

SEQ ID NO: 354758 - DNA, 20 bp, Artificial Sequence
  chemically synthesized
tatttgtgtgtgcgggagcc

SEQ ID NO: 354759 - DNA, 20 bp, Artificial Sequence
  chemically synthesized
tatgatatttgtgtgtgcgg

SEQ ID NO: 354760 - DNA, 20 bp, Artificial Sequence
  chemically synthesized
aatatgatatttgtgtgtgc

SEQ ID NO: 354761 - DNA, 20 bp, Artificial Sequence
  chemically synthesized
aaatatgatatttgtgtgtg

SEQ ID NO: 354762 - DNA, 20 bp, Artificial Sequence
  chemically synthesized
tatcatatttaatgtttttc

SEQ ID NO: 354763 - DNA, 20 bp, Artificial Sequence
  chemically synthesized
attcacctacttagacaaca

SEQ ID NO: 354764 - DNA, 20 bp, Artificial Sequence
  chemically synthesized
ttttcaagtctctgttgtct

SEQ ID NO: 354765 - DNA, 20 bp, Artificial Sequence
  chemically synthesized
aaattcacctacttagacaa

SEQ ID NO: 354766 - DNA, 20 bp, Artificial Sequence
  chemically synthesized
tcaagtctctgttgtctaag

SEQ ID NO: 354767 - DNA, 20 bp, Artificial Sequence
  chemically synthesized
caagtctctgttgtctaagt

SEQ ID NO: 354768 - DNA, 20 bp, Artificial Sequence
  chemically synthesized
ctgtcccaaattcacctact

SEQ ID NO: 354769 - DNA, 20 bp, Artificial Sequence
  chemically synthesized
gttgtctaagtaggtgaatt

SEQ ID NO: 354770 - DNA, 20 bp, Artificial Sequence
  chemically synthesized
ttgtctaagtaggtgaattt

SEQ ID NO: 354771 - DNA, 20 bp, Artificial Sequence
  chemically synthesized
ctaagtaggtgaatttggga

SEQ ID NO: 354772 - DNA, 20 bp, Artificial Sequence
  chemically synthesized
ccttatccatttcagttgtt

SEQ ID NO: 354773 - DNA, 20 bp, Artificial Sequence
  chemically synthesized
tgtcatccaaacaactgaaa

SEQ ID NO: 354774 - DNA, 20 bp, Artificial Sequence
  chemically synthesized
tttgttctccttatccattt

SEQ ID NO: 354775 - DNA, 20 bp, Artificial Sequence
  chemically synthesized
tccaaacaactgaaatggat

SEQ ID NO: 354776 - DNA, 20 bp, Artificial Sequence
  chemically synthesized
ccaaacaactgaaatggata

SEQ ID NO: 354777 - DNA, 20 bp, Artificial Sequence
  chemically synthesized
aaacaactgaaatggataag

SEQ ID NO: 354778 - DNA, 20 bp, Artificial Sequence
  chemically synthesized
aaccagtcactaataaatga

SEQ ID NO: 354779 - DNA, 20 bp, Artificial Sequence
  chemically synthesized
caaaaattgctttcatttat

SEQ ID NO: 354780 - DNA, 20 bp, Artificial Sequence
  chemically synthesized
tgctttcatttattagtgac

SEQ ID NO: 354781 - DNA, 20 bp, Artificial Sequence
  chemically synthesized
attttctgggcagttggaac

SEQ ID NO: 354782 - DNA, 20 bp, Artificial Sequence
  chemically synthesized
agtgactggttccaactgcc

SEQ ID NO: 354783 - DNA, 20 bp, Artificial Sequence
  chemically synthesized
ctgagtattttctgggcagt

SEQ ID NO: 354784 - DNA, 20 bp, Artificial Sequence
  chemically synthesized
aaaactgagtattttctggg

SEQ ID NO: 354785 - DNA, 20 bp, Artificial Sequence
  chemically synthesized
aaaaaaactgagtattttct

SEQ ID NO: 354786 - DNA, 20 bp, Artificial Sequence
  chemically synthesized
taaaaaaactgagtattttc

SEQ ID NO: 354787 - DNA, 20 bp, Artificial Sequence
  chemically synthesized
ccaactgcccagaaaatact

SEQ ID NO: 354788 - DNA, 20 bp, Artificial Sequence
  chemically synthesized
tcagataccataaaaaaact

SEQ ID NO: 354789 - DNA, 20 bp, Artificial Sequence
  chemically synthesized
gaaaatactcagttttttta

SEQ ID NO: 354790 - DNA, 20 bp, Artificial Sequence
  chemically synthesized
ttttttatggtatctgaact

SEQ ID NO: 354791 - DNA, 20 bp, Artificial Sequence
  chemically synthesized
gttgtacatctttctcagtt

SEQ ID NO: 354792 - DNA, 20 bp, Artificial Sequence
  chemically synthesized
ttatggtatctgaactgaga

SEQ ID NO: 354793 - DNA, 20 bp, Artificial Sequence
  chemically synthesized
tatgtgttgtacatctttct

SEQ ID NO: 354794 - DNA, 20 bp, Artificial Sequence
  chemically synthesized
gatgtacaacacataacatc

SEQ ID NO: 354795 - DNA, 20 bp, Artificial Sequence
  chemically synthesized
tgtacaacacataacatcaa

SEQ ID NO: 354796 - DNA, 20 bp, Artificial Sequence
  chemically synthesized
ataacatcaagagaacacac

SEQ ID NO: 354797 - DNA, 20 bp, Artificial Sequence
  chemically synthesized
gaagaggcatgagagtattc

SEQ ID NO: 354798 - DNA, 20 bp, Artificial Sequence
  chemically synthesized
aaaagttagaagaggcatga

SEQ ID NO: 354799 - DNA, 20 bp, Artificial Sequence
  chemically synthesized
ctaaaagttagaagaggcat

SEQ ID NO: 354800 - DNA, 20 bp, Artificial Sequence
  chemically synthesized
agtggcctaaaagttagaag

SEQ ID NO: 354801 - DNA, 20 bp, Artificial Sequence
  chemically synthesized
cagtggcctaaaagttagaa

SEQ ID NO: 354802 - DNA, 20 bp, Artificial Sequence
  chemically synthesized
cccagtggcctaaaagttag

SEQ ID NO: 354803 - DNA, 20 bp, Artificial Sequence
  chemically synthesized
ctcatgcctcttctaacttt

SEQ ID NO: 354804 - DNA, 20 bp, Artificial Sequence
  chemically synthesized
tcatgcctcttctaactttt

SEQ ID NO: 354805 - DNA, 20 bp, Artificial Sequence
  chemically synthesized
tttcccagtggcctaaaagt

SEQ ID NO: 354806 - DNA, 20 bp, Artificial Sequence
  chemically synthesized
gttatttcccagtggcctaa

SEQ ID NO: 354807 - DNA, 20 bp, Artificial Sequence
  chemically synthesized
tcttctaacttttaggccac

SEQ ID NO: 354808 - DNA, 20 bp, Artificial Sequence
  chemically synthesized
cttctaacttttaggccact

SEQ ID NO: 354809 - DNA, 20 bp, Artificial Sequence
  chemically synthesized
acgtaaatgttatttcccag

SEQ ID NO: 354810 - DNA, 20 bp, Artificial Sequence
  chemically synthesized
aagacgtaaatgttatttcc

SEQ ID NO: 354811 - DNA, 20 bp, Artificial Sequence
  chemically synthesized
tgctcttcatgacaaaaatt

SEQ ID NO: 354812 - DNA, 20 bp, Artificial Sequence
  chemically synthesized
acgtcttaatttttgtcatg

SEQ ID NO: 354813 - DNA, 20 bp, Artificial Sequence
  chemically synthesized
gtcttaatttttgtcatgaa

SEQ ID NO: 354814 - DNA, 20 bp, Artificial Sequence
  chemically synthesized
ttgtcatgaagagcaatttc

SEQ ID NO: 354815 - DNA, 20 bp, Artificial Sequence
  chemically synthesized
gcaatttcaagatttcccat

SEQ ID NO: 354816 - DNA, 20 bp, Artificial Sequence
  chemically synthesized
caatttcaagatttcccatc

SEQ ID NO: 354817 - DNA, 20 bp, Artificial Sequence
  chemically synthesized
aatttcaagatttcccatca

SEQ ID NO: 354818 - DNA, 20 bp, Artificial Sequence
  chemically synthesized
ttcaagatttcccatcaggg

SEQ ID NO: 354819 - DNA, 20 bp, Artificial Sequence
  chemically synthesized
gcaatttcctcttccctgat

SEQ ID NO: 354820 - DNA, 20 bp, Artificial Sequence
  chemically synthesized
agcaatttcctcttccctga

SEQ ID NO: 354821 - DNA, 20 bp, Artificial Sequence
  chemically synthesized
caagatttcccatcagggaa

SEQ ID NO: 354822 - DNA, 20 bp, Artificial Sequence
  chemically synthesized
aagatttcccatcagggaag

SEQ ID NO: 354823 - DNA, 20 bp, Artificial Sequence
  chemically synthesized
ttaacattcagatattattg

SEQ ID NO: 354824 - DNA, 20 bp, Artificial Sequence
  chemically synthesized
cagatgattatattaacatt

SEQ ID NO: 354825 - DNA, 20 bp, Artificial Sequence
  chemically synthesized
tataccaaataggtatgata

SEQ ID NO: 354826 - DNA, 20 bp, Artificial Sequence
  chemically synthesized
tcatctgtatcatacctatt

SEQ ID NO: 354827 - DNA, 20 bp, Artificial Sequence
  chemically synthesized
caaagtaatatataccaaat

SEQ ID NO: 354828 - DNA, 20 bp, Artificial Sequence
  chemically synthesized
acaaagtaatatataccaaa

SEQ ID NO: 354829 - DNA, 20 bp, Artificial Sequence
  chemically synthesized
ccattgcctttttgatgaca

SEQ ID NO: 354830 - DNA, 20 bp, Artificial Sequence
  chemically synthesized
tatattactttgtcatcaaa

SEQ ID NO: 354831 - DNA, 20 bp, Artificial Sequence
  chemically synthesized
atattactttgtcatcaaaa

SEQ ID NO: 354832 - DNA, 20 bp, Artificial Sequence
  chemically synthesized
ctttgtcatcaaaaaggcaa

SEQ ID NO: 354833 - DNA, 20 bp, Artificial Sequence
  chemically synthesized
gcacttacatgaatgaaaaa

SEQ ID NO: 354834 - DNA, 20 bp, Artificial Sequence
  chemically synthesized
tggccatttttcattcatgt

SEQ ID NO: 354835 - DNA, 20 bp, Artificial Sequence
  chemically synthesized
tttttcattcatgtaagtgc

SEQ ID NO: 354836 - DNA, 20 bp, Artificial Sequence
  chemically synthesized
tatttaagaaaatatttcac

SEQ ID NO: 354837 - DNA, 20 bp, Artificial Sequence
  chemically synthesized
atatatttaagaaaatattt

SEQ ID NO: 354838 - DNA, 20 bp, Artificial Sequence
  chemically synthesized
ctgcagttgaaaatatattt

SEQ ID NO: 354839 - DNA, 20 bp, Artificial Sequence
  chemically synthesized
cttaaatatattttcaactg

SEQ ID NO: 354840 - DNA, 20 bp, Artificial Sequence
  chemically synthesized
taaatatattttcaactgca

SEQ ID NO: 354841 - DNA, 20 bp, Artificial Sequence
  chemically synthesized
caatttagagtcaaactctg

SEQ ID NO: 354842 - DNA, 20 bp, Artificial Sequence
  chemically synthesized
taaatatttcagacaattta

SEQ ID NO: 354843 - DNA, 20 bp, Artificial Sequence
  chemically synthesized
tgtaaatatttcagacaatt

SEQ ID NO: 354844 - DNA, 20 bp, Artificial Sequence
  chemically synthesized
aatccttactgtaaatattt

SEQ ID NO: 354845 - DNA, 20 bp, Artificial Sequence
  chemically synthesized
taaattgtctgaaatattta

SEQ ID NO: 354846 - DNA, 20 bp, Artificial Sequence
  chemically synthesized
ttgtctgaaatatttacagt

SEQ ID NO: 354847 - DNA, 20 bp, Artificial Sequence
  chemically synthesized
tgtctgaaatatttacagta

SEQ ID NO: 354848 - DNA, 20 bp, Artificial Sequence
  chemically synthesized
atatttacagtaaggatttc

SEQ ID NO: 354849 - DNA, 20 bp, Artificial Sequence
  chemically synthesized
tctatatacggtatttcaac

SEQ ID NO: 354850 - DNA, 20 bp, Artificial Sequence
  chemically synthesized
tctagttgaaataccgtata

SEQ ID NO: 354851 - DNA, 20 bp, Artificial Sequence
  chemically synthesized
tagttgaaataccgtatata

SEQ ID NO: 354852 - DNA, 20 bp, Artificial Sequence
  chemically synthesized
aggtgttccttctctatata

SEQ ID NO: 354853 - DNA, 20 bp, Artificial Sequence
  chemically synthesized
ttgaaataccgtatatagag

SEQ ID NO: 354854 - DNA, 20 bp, Artificial Sequence
  chemically synthesized
tgaaataccgtatatagaga

SEQ ID NO: 354855 - DNA, 20 bp, Artificial Sequence
  chemically synthesized
taatgcgattgcaatattat

SEQ ID NO: 354856 - DNA, 20 bp, Artificial Sequence
  chemically synthesized
ctaatgcgattgcaatatta

SEQ ID NO: 354857 - DNA, 20 bp, Artificial Sequence
  chemically synthesized
ctataatattgcaatcgcat

SEQ ID NO: 354858 - DNA, 20 bp, Artificial Sequence
  chemically synthesized
gcattagattttctgaaaac

SEQ ID NO: 354859 - DNA, 20 bp, Artificial Sequence
  chemically synthesized
cattagattttctgaaaaca

SEQ ID NO: 354860 - DNA, 20 bp, Artificial Sequence
  chemically synthesized
attatagagtaccttgtttt

SEQ ID NO: 354861 - DNA, 20 bp, Artificial Sequence
  chemically synthesized
aaaacaaggtactctataat

SEQ ID NO: 354862 - DNA, 20 bp, Artificial Sequence
  chemically synthesized
tttgtctagaactcattata

SEQ ID NO: 354863 - DNA, 20 bp, Artificial Sequence
  chemically synthesized
tttttgtctagaactcatta

SEQ ID NO: 354864 - DNA, 20 bp, Artificial Sequence
  chemically synthesized
aggtactctataatgagttc

SEQ ID NO: 354865 - DNA, 20 bp, Artificial Sequence
  chemically synthesized
catttagattgatttttgtc

SEQ ID NO: 354866 - DNA, 20 bp, Artificial Sequence
  chemically synthesized
aacactaattttatatcatt

SEQ ID NO: 354867 - DNA, 20 bp, Artificial Sequence
  chemically synthesized
caatctaaatgatataaaat

SEQ ID NO: 354868 - DNA, 20 bp, Artificial Sequence
  chemically synthesized
gttaattctcaggaggatta

SEQ ID NO: 354869 - DNA, 20 bp, Artificial Sequence
  chemically synthesized
gggttaattctcaggaggat

SEQ ID NO: 354870 - DNA, 20 bp, Artificial Sequence
  chemically synthesized
aaattaactctaatcctcct

SEQ ID NO: 354871 - DNA, 20 bp, Artificial Sequence
  chemically synthesized
tgagagggttaattctcagg

SEQ ID NO: 354872 - DNA, 20 bp, Artificial Sequence
  chemically synthesized
ttgagagggttaattctcag

SEQ ID NO: 354873 - DNA, 20 bp, Artificial Sequence
  chemically synthesized
aattgagagggttaattctc

SEQ ID NO: 354874 - DNA, 20 bp, Artificial Sequence
  chemically synthesized
aaattgagagggttaattct

SEQ ID NO: 354875 - DNA, 20 bp, Artificial Sequence
  chemically synthesized
tacacaggttaaaattgaga

SEQ ID NO: 354876 - DNA, 20 bp, Artificial Sequence
  chemically synthesized
ttacacaggttaaaattgag

SEQ ID NO: 354877 - DNA, 20 bp, Artificial Sequence
  chemically synthesized
tttacacaggttaaaattga

SEQ ID NO: 354878 - DNA, 20 bp, Artificial Sequence
  chemically synthesized
agtttacacaggttaaaatt

SEQ ID NO: 354879 - DNA, 20 bp, Artificial Sequence
  chemically synthesized
aaatgtttataagtttacac

SEQ ID NO: 354880 - DNA, 20 bp, Artificial Sequence
  chemically synthesized
gaaatgtttataagtttaca

SEQ ID NO: 354881 - DNA, 20 bp, Artificial Sequence
  chemically synthesized
taatggcaagaaatgtttat

SEQ ID NO: 354882 - DNA, 20 bp, Artificial Sequence
  chemically synthesized
ataaacatttcttgccatta

SEQ ID NO: 354883 - DNA, 20 bp, Artificial Sequence
  chemically synthesized
cattttgataccataatggc

SEQ ID NO: 354884 - DNA, 20 bp, Artificial Sequence
  chemically synthesized
atcacattttgataccataa

SEQ ID NO: 354885 - DNA, 20 bp, Artificial Sequence
  chemically synthesized
gtatcaaaatgtgatgatta

SEQ ID NO: 354886 - DNA, 20 bp, Artificial Sequence
  chemically synthesized
tcaaaatgtgatgattacag

SEQ ID NO: 354887 - DNA, 20 bp, Artificial Sequence
  chemically synthesized
aaaatgtgatgattacagca

SEQ ID NO: 354888 - DNA, 20 bp, Artificial Sequence
  chemically synthesized
aaatgtgatgattacagcag

SEQ ID NO: 354889 - DNA, 20 bp, Artificial Sequence
  chemically synthesized
tgtgatgattacagcagagg

SEQ ID NO: 354890 - DNA, 20 bp, Artificial Sequence
  chemically synthesized
attacagcagaggcggaaaa

SEQ ID NO: 354891 - DNA, 20 bp, Artificial Sequence
  chemically synthesized
gaggcggaaaaaagttaaaa

SEQ ID NO: 354892 - DNA, 20 bp, Artificial Sequence
  chemically synthesized
aagttaaaacagcccttgtt

SEQ ID NO: 354893 - DNA, 20 bp, Artificial Sequence
  chemically synthesized
gatatcaattggctgaacaa

SEQ ID NO: 354894 - DNA, 20 bp, Artificial Sequence
  chemically synthesized
tgatatcaattggctgaaca

SEQ ID NO: 354895 - DNA, 20 bp, Artificial Sequence
  chemically synthesized
ttgatatcaattggctgaac

SEQ ID NO: 354896 - DNA, 20 bp, Artificial Sequence
  chemically synthesized
atgttgggtttgatatcaat

SEQ ID NO: 354897 - DNA, 20 bp, Artificial Sequence
  chemically synthesized
attgatatcaaacccaacat

SEQ ID NO: 354898 - DNA, 20 bp, Artificial Sequence
  chemically synthesized
tgatatcaaacccaacataa

SEQ ID NO: 354899 - DNA, 20 bp, Artificial Sequence
  chemically synthesized
tttttaaggcctcttatgtt

SEQ ID NO: 354900 - DNA, 20 bp, Artificial Sequence
  chemically synthesized
gatatcaaacccaacataag

SEQ ID NO: 354901 - DNA, 20 bp, Artificial Sequence
  chemically synthesized
atttttaaggcctcttatgt

SEQ ID NO: 354902 - DNA, 20 bp, Artificial Sequence
  chemically synthesized
aaaagagaagaatattttta

SEQ ID NO: 354903 - DNA, 20 bp, Artificial Sequence
  chemically synthesized
taaaagagaagaatattttt

SEQ ID NO: 354904 - DNA, 20 bp, Artificial Sequence
  chemically synthesized
tagaatttgctataaaagag

SEQ ID NO: 354905 - DNA, 20 bp, Artificial Sequence
  chemically synthesized
aaaaatattcttctctttta

SEQ ID NO: 354906 - DNA, 20 bp, Artificial Sequence
  chemically synthesized
acatagaatttgctataaaa

SEQ ID NO: 354907 - DNA, 20 bp, Artificial Sequence
  chemically synthesized
atacatagaatttgctataa

SEQ ID NO: 354908 - DNA, 20 bp, Artificial Sequence
  chemically synthesized
aataatcatggaaagataca

SEQ ID NO: 354909 - DNA, 20 bp, Artificial Sequence
  chemically synthesized
cctacaaaaataatcatgga

SEQ ID NO: 354910 - DNA, 20 bp, Artificial Sequence
  chemically synthesized
ttaacctacaaaaataatca

SEQ ID NO: 354911 - DNA, 20 bp, Artificial Sequence
  chemically synthesized
tctttccatgattatttttg

SEQ ID NO: 354912 - DNA, 20 bp, Artificial Sequence
  chemically synthesized
ctttccatgattatttttgt

SEQ ID NO: 354913 - DNA, 20 bp, Artificial Sequence
  chemically synthesized
acttggctttgtatgcatgc

SEQ ID NO: 354914 - DNA, 20 bp, Artificial Sequence
  chemically synthesized
gacttggctttgtatgcatg

SEQ ID NO: 354915 - DNA, 20 bp, Artificial Sequence
  chemically synthesized
taaaatcctgcatgcataca

SEQ ID NO: 354916 - DNA, 20 bp, Artificial Sequence
  chemically synthesized
tcctgcatgcatacaaagcc

SEQ ID NO: 354917 - DNA, 20 bp, Artificial Sequence
  chemically synthesized
gcatacaaagccaagtctga

SEQ ID NO: 354918 - DNA, 20 bp, Artificial Sequence
  chemically synthesized
ggagtgaatgctttcagact

SEQ ID NO: 354919 - DNA, 20 bp, Artificial Sequence
  chemically synthesized
actcctggagtgaatgcttt

SEQ ID NO: 354920 - DNA, 20 bp, Artificial Sequence
  chemically synthesized
aagtctgaaagcattcactc

SEQ ID NO: 354921 - DNA, 20 bp, Artificial Sequence
  chemically synthesized
agtctgaaagcattcactcc

SEQ ID NO: 354922 - DNA, 20 bp, Artificial Sequence
  chemically synthesized
tctgaaagcattcactccag

SEQ ID NO: 354923 - DNA, 20 bp, Artificial Sequence
  chemically synthesized
gttggaaagttttactcctg

SEQ ID NO: 354924 - DNA, 20 bp, Artificial Sequence
  chemically synthesized
ctgttggaaagttttactcc

SEQ ID NO: 354925 - DNA, 20 bp, Artificial Sequence
  chemically synthesized
ccaggagtaaaactttccaa

SEQ ID NO: 354926 - DNA, 20 bp, Artificial Sequence
  chemically synthesized
caggagtaaaactttccaac

SEQ ID NO: 354927 - DNA, 20 bp, Artificial Sequence
  chemically synthesized
aattagctctgcctgttgga

SEQ ID NO: 354928 - DNA, 20 bp, Artificial Sequence
  chemically synthesized
gagtaaaactttccaacagg

SEQ ID NO: 354929 - DNA, 20 bp, Artificial Sequence
  chemically synthesized
gtaaaactttccaacaggca

SEQ ID NO: 354930 - DNA, 20 bp, Artificial Sequence
  chemically synthesized
caagaattagctctgcctgt

SEQ ID NO: 354931 - DNA, 20 bp, Artificial Sequence
  chemically synthesized
caacaggcagagctaattct

SEQ ID NO: 354932 - DNA, 20 bp, Artificial Sequence
  chemically synthesized
tagccttcttttccaagaat

SEQ ID NO: 354933 - DNA, 20 bp, Artificial Sequence
  chemically synthesized
ggcagagctaattcttggaa

SEQ ID NO: 354934 - DNA, 20 bp, Artificial Sequence
  chemically synthesized
agagctaattcttggaaaag

SEQ ID NO: 354935 - DNA, 20 bp, Artificial Sequence
  chemically synthesized
tttttatagccttcttttcc

SEQ ID NO: 354936 - DNA, 20 bp, Artificial Sequence
  chemically synthesized
gagctaattcttggaaaaga

SEQ ID NO: 354937 - DNA, 20 bp, Artificial Sequence
  chemically synthesized
tcactcttgagttgttttta

SEQ ID NO: 354938 - DNA, 20 bp, Artificial Sequence
  chemically synthesized
gaaggctataaaaacaactc

SEQ ID NO: 354939 - DNA, 20 bp, Artificial Sequence
  chemically synthesized
aggctataaaaacaactcaa

SEQ ID NO: 354940 - DNA, 20 bp, Artificial Sequence
  chemically synthesized
ctaatccctgcatcactctt

SEQ ID NO: 354941 - DNA, 20 bp, Artificial Sequence
  chemically synthesized
aaaacaactcaagagtgatg

SEQ ID NO: 354942 - DNA, 20 bp, Artificial Sequence
  chemically synthesized
aaacaactcaagagtgatgc

SEQ ID NO: 354943 - DNA, 20 bp, Artificial Sequence
  chemically synthesized
aacaactcaagagtgatgca

SEQ ID NO: 354944 - DNA, 20 bp, Artificial Sequence
  chemically synthesized
ctcaagagtgatgcagggat

SEQ ID NO: 354945 - DNA, 20 bp, Artificial Sequence
  chemically synthesized
gagtgatgcagggattagcc

SEQ ID NO: 354946 - DNA, 20 bp, Artificial Sequence
  chemically synthesized
tgatgcagggattagccaag

SEQ ID NO: 354947 - DNA, 20 bp, Artificial Sequence
  chemically synthesized
cacggattctattttctgct

SEQ ID NO: 354948 - DNA, 20 bp, Artificial Sequence
  chemically synthesized
gggattagccaagcagaaaa

SEQ ID NO: 354949 - DNA, 20 bp, Artificial Sequence
  chemically synthesized
acttcctgagaatggtgaca

SEQ ID NO: 354950 - DNA, 20 bp, Artificial Sequence
  chemically synthesized
agaatccgtgtcaccattct

SEQ ID NO: 354951 - DNA, 20 bp, Artificial Sequence
  chemically synthesized
gaatccgtgtcaccattctc

SEQ ID NO: 354952 - DNA, 20 bp, Artificial Sequence
  chemically synthesized
ttattttgacttcctgagaa

SEQ ID NO: 354953 - DNA, 20 bp, Artificial Sequence
  chemically synthesized
tccgtgtcaccattctcagg

SEQ ID NO: 354954 - DNA, 20 bp, Artificial Sequence
  chemically synthesized
cccctttattttgacttcct

SEQ ID NO: 354955 - DNA, 20 bp, Artificial Sequence
  chemically synthesized
attctcaggaagtcaaaata

SEQ ID NO: 354956 - DNA, 20 bp, Artificial Sequence
  chemically synthesized
ttctcaggaagtcaaaataa

SEQ ID NO: 354957 - DNA, 20 bp, Artificial Sequence
  chemically synthesized
tctcaggaagtcaaaataaa

SEQ ID NO: 354958 - DNA, 20 bp, Artificial Sequence
  chemically synthesized
ctcaggaagtcaaaataaag

SEQ ID NO: 354959 - DNA, 20 bp, Artificial Sequence
  chemically synthesized
tttacaaacccgttagggtt

SEQ ID NO: 354960 - DNA, 20 bp, Artificial Sequence
  chemically synthesized
ggattaaaaccaaaccctaa

SEQ ID NO: 354961 - DNA, 20 bp, Artificial Sequence
  chemically synthesized
gattaaaaccaaaccctaac

SEQ ID NO: 354962 - DNA, 20 bp, Artificial Sequence
  chemically synthesized
tgacatttacaaacccgtta

SEQ ID NO: 354963 - DNA, 20 bp, Artificial Sequence
  chemically synthesized
atgacatttacaaacccgtt

SEQ ID NO: 354964 - DNA, 20 bp, Artificial Sequence
  chemically synthesized
aatgacatttacaaacccgt

SEQ ID NO: 354965 - DNA, 20 bp, Artificial Sequence
  chemically synthesized
gggtttgtaaatgtcatttt

SEQ ID NO: 354966 - DNA, 20 bp, Artificial Sequence
  chemically synthesized
ggtttgtaaatgtcattttg

SEQ ID NO: 354967 - DNA, 20 bp, Artificial Sequence
  chemically synthesized
aggatacaaaaatttctctc

SEQ ID NO: 354968 - DNA, 20 bp, Artificial Sequence
  chemically synthesized
ggaaggacactaggactcga

SEQ ID NO: 354969 - DNA, 20 bp, Artificial Sequence
  chemically synthesized
caaaaatttctctcgagtcc

SEQ ID NO: 354970 - DNA, 20 bp, Artificial Sequence
  chemically synthesized
aaggaaggacactaggactc

SEQ ID NO: 354971 - DNA, 20 bp, Artificial Sequence
  chemically synthesized
accaaaaaaggaaggacact

SEQ ID NO: 354972 - DNA, 20 bp, Artificial Sequence
  chemically synthesized
gaccaaaaaaggaaggacac

SEQ ID NO: 354973 - DNA, 20 bp, Artificial Sequence
  chemically synthesized
caaatttgaccaaaaaagga

SEQ ID NO: 354974 - DNA, 20 bp, Artificial Sequence
  chemically synthesized
tcctagtgtccttccttttt

SEQ ID NO: 354975 - DNA, 20 bp, Artificial Sequence
  chemically synthesized
tcaaatttgaccaaaaaagg

SEQ ID NO: 354976 - DNA, 20 bp, Artificial Sequence
  chemically synthesized
cagtcaaatttgaccaaaaa

SEQ ID NO: 354977 - DNA, 20 bp, Artificial Sequence
  chemically synthesized
acagtcaaatttgaccaaaa

SEQ ID NO: 354978 - DNA, 20 bp, Artificial Sequence
  chemically synthesized
agaacaaaaatgaataatga

SEQ ID NO: 354979 - DNA, 20 bp, Artificial Sequence
  chemically synthesized
cattattcatttttgttcta

SEQ ID NO: 354980 - DNA, 20 bp, Artificial Sequence
  chemically synthesized
cttatttaccagggtaactt

SEQ ID NO: 354981 - DNA, 20 bp, Artificial Sequence
  chemically synthesized
tttttgttctaaagttaccc

SEQ ID NO: 354982 - DNA, 20 bp, Artificial Sequence
  chemically synthesized
atgttcttacttatttacca

SEQ ID NO: 354983 - DNA, 20 bp, Artificial Sequence
  chemically synthesized
ctaaagttaccctggtaaat

SEQ ID NO: 354984 - DNA, 20 bp, Artificial Sequence
  chemically synthesized
aatgttcttacttatttacc

SEQ ID NO: 354985 - DNA, 20 bp, Artificial Sequence
  chemically synthesized
aaatgttcttacttatttac

SEQ ID NO: 354986 - DNA, 20 bp, Artificial Sequence
  chemically synthesized
agttaccctggtaaataagt

SEQ ID NO: 354987 - DNA, 20 bp, Artificial Sequence
  chemically synthesized
ttaggatatgaaatatgata

SEQ ID NO: 354988 - DNA, 20 bp, Artificial Sequence
  chemically synthesized
atcatatttcatatcctaaa

SEQ ID NO: 354989 - DNA, 20 bp, Artificial Sequence
  chemically synthesized
gtagaaagccatttccattt

SEQ ID NO: 354990 - DNA, 20 bp, Artificial Sequence
  chemically synthesized
tgtagaaagccatttccatt

SEQ ID NO: 354991 - DNA, 20 bp, Artificial Sequence
  chemically synthesized
tttcatatcctaaatggaaa

SEQ ID NO: 354992 - DNA, 20 bp, Artificial Sequence
  chemically synthesized
cttttgaatattagtgtaga

SEQ ID NO: 354993 - DNA, 20 bp, Artificial Sequence
  chemically synthesized
atgtcttttgaatattagtg

SEQ ID NO: 354994 - DNA, 20 bp, Artificial Sequence
  chemically synthesized
tctagatgtcttttgaatat

SEQ ID NO: 354995 - DNA, 20 bp, Artificial Sequence
  chemically synthesized
ctttctacactaatattcaa

SEQ ID NO: 354996 - DNA, 20 bp, Artificial Sequence
  chemically synthesized
actaatattcaaaagacatc

SEQ ID NO: 354997 - DNA, 20 bp, Artificial Sequence
  chemically synthesized
tattcaaaagacatctagaa

SEQ ID NO: 354998 - DNA, 20 bp, Artificial Sequence
  chemically synthesized
attcaaaagacatctagaac

SEQ ID NO: 354999 - DNA, 20 bp, Artificial Sequence
  chemically synthesized
ataaaagattgcgcctgttc

SEQ ID NO: 355000 - DNA, 20 bp, Artificial Sequence
  chemically synthesized
aaacaaaaaatcagggataa

SEQ ID NO: 355001 - DNA, 20 bp, Artificial Sequence
  chemically synthesized
aggaataaaacaaaaaatca

SEQ ID NO: 355002 - DNA, 20 bp, Artificial Sequence
  chemically synthesized
aaggaataaaacaaaaaatc

SEQ ID NO: 355003 - DNA, 20 bp, Artificial Sequence
  chemically synthesized
aaaggaataaaacaaaaaat

SEQ ID NO: 355004 - DNA, 20 bp, Artificial Sequence
  chemically synthesized
ttttttgttttattccttta

SEQ ID NO: 355005 - DNA, 20 bp, Artificial Sequence
  chemically synthesized
ttttgttttattcctttaaa

SEQ ID NO: 355006 - DNA, 20 bp, Artificial Sequence
  chemically synthesized
agtgaggatgttctctttaa

SEQ ID NO: 355007 - DNA, 20 bp, Artificial Sequence
  chemically synthesized
aagtgaggatgttctcttta

SEQ ID NO: 355008 - DNA, 20 bp, Artificial Sequence
  chemically synthesized
cccctgtgaataacaaagtg

SEQ ID NO: 355009 - DNA, 20 bp, Artificial Sequence
  chemically synthesized
tcccctgtgaataacaaagt

SEQ ID NO: 355010 - DNA, 20 bp, Artificial Sequence
  chemically synthesized
gctttcccctgtgaataaca

SEQ ID NO: 355011 - DNA, 20 bp, Artificial Sequence
  chemically synthesized
catcctcactttgttattca

SEQ ID NO: 355012 - DNA, 20 bp, Artificial Sequence
  chemically synthesized
atcctcactttgttattcac

SEQ ID NO: 355013 - DNA, 20 bp, Artificial Sequence
  chemically synthesized
tcctcactttgttattcaca

SEQ ID NO: 355014 - DNA, 20 bp, Artificial Sequence
  chemically synthesized
cctcactttgttattcacag

SEQ ID NO: 355015 - DNA, 20 bp, Artificial Sequence
  chemically synthesized
actttgttattcacagggga

SEQ ID NO: 355016 - DNA, 20 bp, Artificial Sequence
  chemically synthesized
ttcacaggggaaagctgaca

SEQ ID NO: 355017 - DNA, 20 bp, Artificial Sequence
  chemically synthesized
atattaagagagtgctttgt

SEQ ID NO: 355018 - DNA, 20 bp, Artificial Sequence
  chemically synthesized
aaatcctccctatattaaga

SEQ ID NO: 355019 - DNA, 20 bp, Artificial Sequence
  chemically synthesized
gacaaagcactctcttaata

SEQ ID NO: 355020 - DNA, 20 bp, Artificial Sequence
  chemically synthesized
acaaagcactctcttaatat

SEQ ID NO: 355021 - DNA, 20 bp, Artificial Sequence
  chemically synthesized
aaaaatcctccctatattaa

SEQ ID NO: 355022 - DNA, 20 bp, Artificial Sequence
  chemically synthesized
caaagcactctcttaatata

SEQ ID NO: 355023 - DNA, 20 bp, Artificial Sequence
  chemically synthesized
aaaaaaatcctccctatatt

SEQ ID NO: 355024 - DNA, 20 bp, Artificial Sequence
  chemically synthesized
aagcactctcttaatatagg

SEQ ID NO: 355025 - DNA, 20 bp, Artificial Sequence
  chemically synthesized
agcactctcttaatataggg

SEQ ID NO: 355026 - DNA, 20 bp, Artificial Sequence
  chemically synthesized
gaggattttttttttttttt

SEQ ID NO: 355027 - DNA, 20 bp, Artificial Sequence
  chemically synthesized
ttttttttttttttttggac

SEQ ID NO: 355028 - DNA, 20 bp, Artificial Sequence
  chemically synthesized
aaacagattggtttgtttgc

SEQ ID NO: 355029 - DNA, 20 bp, Artificial Sequence
  chemically synthesized
tctctgagtttcaaacagat

SEQ ID NO: 355030 - DNA, 20 bp, Artificial Sequence
  chemically synthesized
ttgtttctctgagtttcaaa

SEQ ID NO: 355031 - DNA, 20 bp, Artificial Sequence
  chemically synthesized
aaaccaatctgtttgaaact

SEQ ID NO: 355032 - DNA, 20 bp, Artificial Sequence
  chemically synthesized
accaatctgtttgaaactca

SEQ ID NO: 355033 - DNA, 20 bp, Artificial Sequence
  chemically synthesized
ttcatatacattgtttctct

SEQ ID NO: 355034 - DNA, 20 bp, Artificial Sequence
  chemically synthesized
attctacatgcgttggtcgt

SEQ ID NO: 355035 - DNA, 20 bp, Artificial Sequence
  chemically synthesized
cattctacatgcgttggtcg

SEQ ID NO: 355036 - DNA, 20 bp, Artificial Sequence
  chemically synthesized
aaacccacgaccaacgcatg

SEQ ID NO: 355037 - DNA, 20 bp, Artificial Sequence
  chemically synthesized
acagtacattctacatgcgt

SEQ ID NO: 355038 - DNA, 20 bp, Artificial Sequence
  chemically synthesized
atgtagaatgtactgtctta

SEQ ID NO: 355039 - DNA, 20 bp, Artificial Sequence
  chemically synthesized
gtagaatgtactgtcttaca

SEQ ID NO: 355040 - DNA, 20 bp, Artificial Sequence
  chemically synthesized
gttatgatttctctgtaaga

SEQ ID NO: 355041 - DNA, 20 bp, Artificial Sequence
  chemically synthesized
tcccgttatgatttctctgt

SEQ ID NO: 355042 - DNA, 20 bp, Artificial Sequence
  chemically synthesized
gtcttacagagaaatcataa

SEQ ID NO: 355043 - DNA, 20 bp, Artificial Sequence
  chemically synthesized
tcttacagagaaatcataac

SEQ ID NO: 355044 - DNA, 20 bp, Artificial Sequence
  chemically synthesized
tacagagaaatcataacggg

SEQ ID NO: 355045 - DNA, 20 bp, Artificial Sequence
  chemically synthesized
cagagaaatcataacgggaa

SEQ ID NO: 355046 - DNA, 20 bp, Artificial Sequence
  chemically synthesized
aaaaatatccttttgtgaat

SEQ ID NO: 355047 - DNA, 20 bp, Artificial Sequence
  chemically synthesized
gagaattgtctgattcacaa

SEQ ID NO: 355048 - DNA, 20 bp, Artificial Sequence
  chemically synthesized
agaattgtctgattcacaaa

SEQ ID NO: 355049 - DNA, 20 bp, Artificial Sequence
  chemically synthesized
ttcacaaaaggatattttta

SEQ ID NO: 355050 - DNA, 20 bp, Artificial Sequence
  chemically synthesized
cacaaaaggatatttttaaa

SEQ ID NO: 355051 - DNA, 20 bp, Artificial Sequence
  chemically synthesized
tgtttatgctcatagataat

SEQ ID NO: 355052 - DNA, 20 bp, Artificial Sequence
  chemically synthesized
atgtttatgctcatagataa

SEQ ID NO: 355053 - DNA, 20 bp, Artificial Sequence
  chemically synthesized
gagatatacctattatctat

SEQ ID NO: 355054 - DNA, 20 bp, Artificial Sequence
  chemically synthesized
attatgtatgtttatgctca

SEQ ID NO: 355055 - DNA, 20 bp, Artificial Sequence
  chemically synthesized
ataaacatacataatttatt

SEQ ID NO: 355056 - DNA, 20 bp, Artificial Sequence
  chemically synthesized
ataatttattaagtttaccc

SEQ ID NO: 355057 - DNA, 20 bp, Artificial Sequence
  chemically synthesized
tgcaaaaataagtacatcta

SEQ ID NO: 355058 - DNA, 20 bp, Artificial Sequence
  chemically synthesized
atgcaaaaataagtacatct

SEQ ID NO: 355059 - DNA, 20 bp, Artificial Sequence
  chemically synthesized
tatgcaaaaataagtacatc

SEQ ID NO: 355060 - DNA, 20 bp, Artificial Sequence
  chemically synthesized
atgctaacatatgcaaaaat

SEQ ID NO: 355061 - DNA, 20 bp, Artificial Sequence
  chemically synthesized
gtacttatttttgcatatgt

SEQ ID NO: 355062 - DNA, 20 bp, Artificial Sequence
  chemically synthesized
atgttagcatctaaacacac

SEQ ID NO: 355063 - DNA, 20 bp, Artificial Sequence
  chemically synthesized
ggagctgtttctagtgtgtt

SEQ ID NO: 355064 - DNA, 20 bp, Artificial Sequence
  chemically synthesized
gcatctaaacacactagaaa

SEQ ID NO: 355065 - DNA, 20 bp, Artificial Sequence
  chemically synthesized
gcgatttcaggagctgtttc

SEQ ID NO: 355066 - DNA, 20 bp, Artificial Sequence
  chemically synthesized
attagcataagcgatttcag

SEQ ID NO: 355067 - DNA, 20 bp, Artificial Sequence
  chemically synthesized
gcattagcataagcgatttc

SEQ ID NO: 355068 - DNA, 20 bp, Artificial Sequence
  chemically synthesized
ggcattagcataagcgattt

SEQ ID NO: 355069 - DNA, 20 bp, Artificial Sequence
  chemically synthesized
gtagcagtaggcattagcat

SEQ ID NO: 355070 - DNA, 20 bp, Artificial Sequence
  chemically synthesized
aaatgagtagcagtaggcat

SEQ ID NO: 355071 - DNA, 20 bp, Artificial Sequence
  chemically synthesized
cttttaaaatgagtagcagt

SEQ ID NO: 355072 - DNA, 20 bp, Artificial Sequence
  chemically synthesized
ccttttaaaatgagtagcag

SEQ ID NO: 355073 - DNA, 20 bp, Artificial Sequence
  chemically synthesized
ttgccttttaaaatgagtag

SEQ ID NO: 355074 - DNA, 20 bp, Artificial Sequence
  chemically synthesized
gaattgccttttaaaatgag

SEQ ID NO: 355075 - DNA, 20 bp, Artificial Sequence
  chemically synthesized
cctactgctactcattttaa

SEQ ID NO: 355076 - DNA, 20 bp, Artificial Sequence
  chemically synthesized
gtggaattgccttttaaaat

SEQ ID NO: 355077 - DNA, 20 bp, Artificial Sequence
  chemically synthesized
ctactgctactcattttaaa

SEQ ID NO: 355078 - DNA, 20 bp, Artificial Sequence
  chemically synthesized
gcctgaggtttagttttaag

SEQ ID NO: 355079 - DNA, 20 bp, Artificial Sequence
  chemically synthesized
gaggcctgaggtttagtttt

SEQ ID NO: 355080 - DNA, 20 bp, Artificial Sequence
  chemically synthesized
ttccacttaaaactaaacct

SEQ ID NO: 355081 - DNA, 20 bp, Artificial Sequence
  chemically synthesized
tccacttaaaactaaacctc

SEQ ID NO: 355082 - DNA, 20 bp, Artificial Sequence
  chemically synthesized
gtgttttgaggcctgaggtt

SEQ ID NO: 355083 - DNA, 20 bp, Artificial Sequence
  chemically synthesized
aactggtgttttgaggcctg

SEQ ID NO: 355084 - DNA, 20 bp, Artificial Sequence
  chemically synthesized
taactggtgttttgaggcct

SEQ ID NO: 355085 - DNA, 20 bp, Artificial Sequence
  chemically synthesized
tggccttaactggtgttttg

SEQ ID NO: 355086 - DNA, 20 bp, Artificial Sequence
  chemically synthesized
aacctcaggcctcaaaacac

SEQ ID NO: 355087 - DNA, 20 bp, Artificial Sequence
  chemically synthesized
ttggccttaactggtgtttt

SEQ ID NO: 355088 - DNA, 20 bp, Artificial Sequence
  chemically synthesized
caggcctcaaaacaccagtt

SEQ ID NO: 355089 - DNA, 20 bp, Artificial Sequence
  chemically synthesized
aggcctcaaaacaccagtta

SEQ ID NO: 355090 - DNA, 20 bp, Artificial Sequence
  chemically synthesized
tgatatgctttggccttaac

SEQ ID NO: 355091 - DNA, 20 bp, Artificial Sequence
  chemically synthesized
caaaacaccagttaaggcca

SEQ ID NO: 355092 - DNA, 20 bp, Artificial Sequence
  chemically synthesized
atatagaatttgatatgctt

SEQ ID NO: 355093 - DNA, 20 bp, Artificial Sequence
  chemically synthesized
accttgtaggatttcatata

SEQ ID NO: 355094 - DNA, 20 bp, Artificial Sequence
  chemically synthesized
ttctatatatgaaatcctac

SEQ ID NO: 355095 - DNA, 20 bp, Artificial Sequence
  chemically synthesized
tctatatatgaaatcctaca

SEQ ID NO: 355096 - DNA, 20 bp, Artificial Sequence
  chemically synthesized
ggaagtcattgaaaccttgt

SEQ ID NO: 355097 - DNA, 20 bp, Artificial Sequence
  chemically synthesized
aggaagtcattgaaaccttg

SEQ ID NO: 355098 - DNA, 20 bp, Artificial Sequence
  chemically synthesized
aattgctttataaaattagg

SEQ ID NO: 355099 - DNA, 20 bp, Artificial Sequence
  chemically synthesized
tagaattgctttataaaatt

SEQ ID NO: 355100 - DNA, 20 bp, Artificial Sequence
  chemically synthesized
atagaattgctttataaaat

SEQ ID NO: 355101 - DNA, 20 bp, Artificial Sequence
  chemically synthesized
aatgacttcctaattttata

SEQ ID NO: 355102 - DNA, 20 bp, Artificial Sequence
  chemically synthesized
ataaagcaattctatcaaca

SEQ ID NO: 355103 - DNA, 20 bp, Artificial Sequence
  chemically synthesized
ttaaacataagctttgttga

SEQ ID NO: 355104 - DNA, 20 bp, Artificial Sequence
  chemically synthesized
gctttgacaattttaaacat

SEQ ID NO: 355105 - DNA, 20 bp, Artificial Sequence
  chemically synthesized
gcttatgtttaaaattgtca

SEQ ID NO: 355106 - DNA, 20 bp, Artificial Sequence
  chemically synthesized
aaaattgtcaaagcattatt

SEQ ID NO: 355107 - DNA, 20 bp, Artificial Sequence
  chemically synthesized
attgtcaaagcattatttgg

SEQ ID NO: 355108 - DNA, 20 bp, Artificial Sequence
  chemically synthesized
ttgtcaaagcattatttggc

SEQ ID NO: 355109 - DNA, 20 bp, Artificial Sequence
  chemically synthesized
attgaagctatatttggttt

SEQ ID NO: 355110 - DNA, 20 bp, Artificial Sequence
  chemically synthesized
ggtatttcttaaaccaaata

SEQ ID NO: 355111 - DNA, 20 bp, Artificial Sequence
  chemically synthesized
tgggggattgaagctatatt

SEQ ID NO: 355112 - DNA, 20 bp, Artificial Sequence
  chemically synthesized
attttattattgggggattg

SEQ ID NO: 355113 - DNA, 20 bp, Artificial Sequence
  chemically synthesized
ggggagaattttattattgg

SEQ ID NO: 355114 - DNA, 20 bp, Artificial Sequence
  chemically synthesized
tggggagaattttattattg

SEQ ID NO: 355115 - DNA, 20 bp, Artificial Sequence
  chemically synthesized
ttggggagaattttattatt

SEQ ID NO: 355116 - DNA, 20 bp, Artificial Sequence
  chemically synthesized
tttggggagaattttattat

SEQ ID NO: 355117 - DNA, 20 bp, Artificial Sequence
  chemically synthesized
agaataatgaaacatttggg

SEQ ID NO: 355118 - DNA, 20 bp, Artificial Sequence
  chemically synthesized
ggagaataatgaaacatttg

SEQ ID NO: 355119 - DNA, 20 bp, Artificial Sequence
  chemically synthesized
aggagaataatgaaacattt

SEQ ID NO: 355120 - DNA, 20 bp, Artificial Sequence
  chemically synthesized
taggagaataatgaaacatt

SEQ ID NO: 355121 - DNA, 20 bp, Artificial Sequence
  chemically synthesized
aaatgtttcattattctcct

SEQ ID NO: 355122 - DNA, 20 bp, Artificial Sequence
  chemically synthesized
aatgtttcattattctccta

SEQ ID NO: 355123 - DNA, 20 bp, Artificial Sequence
  chemically synthesized
atgtttcattattctcctaa

SEQ ID NO: 355124 - DNA, 20 bp, Artificial Sequence
  chemically synthesized
tgtttcattattctcctaag

SEQ ID NO: 355125 - DNA, 20 bp, Artificial Sequence
  chemically synthesized
aaattagttatgccccttag

SEQ ID NO: 355126 - DNA, 20 bp, Artificial Sequence
  chemically synthesized
ttaaattagttatgcccctt

SEQ ID NO: 355127 - DNA, 20 bp, Artificial Sequence
  chemically synthesized
tttaaattagttatgcccct

SEQ ID NO: 355128 - DNA, 20 bp, Artificial Sequence
  chemically synthesized
aaagaaatttcattttaaat

SEQ ID NO: 355129 - DNA, 20 bp, Artificial Sequence
  chemically synthesized
aatttaaaatgaaatttctt

SEQ ID NO: 355130 - DNA, 20 bp, Artificial Sequence
  chemically synthesized
tttaaaatgaaatttctttg

SEQ ID NO: 355131 - DNA, 20 bp, Artificial Sequence
  chemically synthesized
taaaatgaaatttctttgga

SEQ ID NO: 355132 - DNA, 20 bp, Artificial Sequence
  chemically synthesized
aatgaaatttctttggagag

SEQ ID NO: 355133 - DNA, 20 bp, Artificial Sequence
  chemically synthesized
atgatgttggctactctcca

SEQ ID NO: 355134 - DNA, 20 bp, Artificial Sequence
  chemically synthesized
ctgtagcttatgcatgatgt

SEQ ID NO: 355135 - DNA, 20 bp, Artificial Sequence
  chemically synthesized
gagtagccaacatcatgcat

SEQ ID NO: 355136 - DNA, 20 bp, Artificial Sequence
  chemically synthesized
ccaacatcatgcataagcta

SEQ ID NO: 355137 - DNA, 20 bp, Artificial Sequence
  chemically synthesized
ttaaccagatattggttctg

SEQ ID NO: 355138 - DNA, 20 bp, Artificial Sequence
  chemically synthesized
taagctacagaaccaatatc

SEQ ID NO: 355139 - DNA, 20 bp, Artificial Sequence
  chemically synthesized
atttttatttaaccagatat

SEQ ID NO: 355140 - DNA, 20 bp, Artificial Sequence
  chemically synthesized
tgttcatatttttatttaac

SEQ ID NO: 355141 - DNA, 20 bp, Artificial Sequence
  chemically synthesized
taaaaatatgaacatcacaa

SEQ ID NO: 355142 - DNA, 20 bp, Artificial Sequence
  chemically synthesized
tcacaaaagcaattactata

SEQ ID NO: 355143 - DNA, 20 bp, Artificial Sequence
  chemically synthesized
cacaaaagcaattactatac

SEQ ID NO: 355144 - DNA, 20 bp, Artificial Sequence
  chemically synthesized
attcgtgattcatgcctgta

SEQ ID NO: 355145 - DNA, 20 bp, Artificial Sequence
  chemically synthesized
gcatgaatcacgaattttgc

SEQ ID NO: 355146 - DNA, 20 bp, Artificial Sequence
  chemically synthesized
actctcttcgatagatttac

SEQ ID NO: 355147 - DNA, 20 bp, Artificial Sequence
  chemically synthesized
ttttgctggtaaatctatcg

SEQ ID NO: 355148 - DNA, 20 bp, Artificial Sequence
  chemically synthesized
ttgctggtaaatctatcgaa

SEQ ID NO: 355149 - DNA, 20 bp, Artificial Sequence
  chemically synthesized
gctggtaaatctatcgaaga

SEQ ID NO: 355150 - DNA, 20 bp, Artificial Sequence
  chemically synthesized
acttagaacactctcttcga

SEQ ID NO: 355151 - DNA, 20 bp, Artificial Sequence
  chemically synthesized
tctatcgaagagagtgttct

SEQ ID NO: 355152 - DNA, 20 bp, Artificial Sequence
  chemically synthesized
gaagagagtgttctaagtct

SEQ ID NO: 355153 - DNA, 20 bp, Artificial Sequence
  chemically synthesized
atctcttgaagtctcagact

SEQ ID NO: 355154 - DNA, 20 bp, Artificial Sequence
  chemically synthesized
tgttctaagtctgagacttc

SEQ ID NO: 355155 - DNA, 20 bp, Artificial Sequence
  chemically synthesized
aacaccatctcttgaagtct

SEQ ID NO: 355156 - DNA, 20 bp, Artificial Sequence
  chemically synthesized
ttctaagtctgagacttcaa

SEQ ID NO: 355157 - DNA, 20 bp, Artificial Sequence
  chemically synthesized
aagtctgagacttcaagaga

SEQ ID NO: 355158 - DNA, 20 bp, Artificial Sequence
  chemically synthesized
agacagaacaccatctcttg

SEQ ID NO: 355159 - DNA, 20 bp, Artificial Sequence
  chemically synthesized
gactgcttagtcacaaaaga

SEQ ID NO: 355160 - DNA, 20 bp, Artificial Sequence
  chemically synthesized
tactgactgcttagtcacaa

SEQ ID NO: 355161 - DNA, 20 bp, Artificial Sequence
  chemically synthesized
gtgttctgtcttttgtgact

SEQ ID NO: 355162 - DNA, 20 bp, Artificial Sequence
  chemically synthesized
ttctgtcttttgtgactaag

SEQ ID NO: 355163 - DNA, 20 bp, Artificial Sequence
  chemically synthesized
gtcttttgtgactaagcagt

SEQ ID NO: 355164 - DNA, 20 bp, Artificial Sequence
  chemically synthesized
atttttatttactgactgct

SEQ ID NO: 355165 - DNA, 20 bp, Artificial Sequence
  chemically synthesized
cagtaaataaaaattcttat

SEQ ID NO: 355166 - DNA, 20 bp, Artificial Sequence
  chemically synthesized
agaaaaaaataataactcat

SEQ ID NO: 355167 - DNA, 20 bp, Artificial Sequence
  chemically synthesized
ataatctcaatgatgattca

SEQ ID NO: 355168 - DNA, 20 bp, Artificial Sequence
  chemically synthesized
tttttctttgaatcatcatt

SEQ ID NO: 355169 - DNA, 20 bp, Artificial Sequence
  chemically synthesized
ttttgctcagcatttttcag

SEQ ID NO: 355170 - DNA, 20 bp, Artificial Sequence
  chemically synthesized
atttttgctcagcatttttc

SEQ ID NO: 355171 - DNA, 20 bp, Artificial Sequence
  chemically synthesized
catttttgctcagcattttt

SEQ ID NO: 355172 - DNA, 20 bp, Artificial Sequence
  chemically synthesized
attatctcctgaaaaatgct

SEQ ID NO: 355173 - DNA, 20 bp, Artificial Sequence
  chemically synthesized
cacatttatacatttttgct

SEQ ID NO: 355174 - DNA, 20 bp, Artificial Sequence
  chemically synthesized
aaaatgtataaatgtgtact

SEQ ID NO: 355175 - DNA, 20 bp, Artificial Sequence
  chemically synthesized
atgtataaatgtgtacttgg

SEQ ID NO: 355176 - DNA, 20 bp, Artificial Sequence
  chemically synthesized
attgtgttagggaaaccacc

SEQ ID NO: 355177 - DNA, 20 bp, Artificial Sequence
  chemically synthesized
caattcttgccattgtgtta

SEQ ID NO: 355178 - DNA, 20 bp, Artificial Sequence
  chemically synthesized
tggtggtttccctaacacaa

SEQ ID NO: 355179 - DNA, 20 bp, Artificial Sequence
  chemically synthesized
tcaattcttgccattgtgtt

SEQ ID NO: 355180 - DNA, 20 bp, Artificial Sequence
  chemically synthesized
gtcaattcttgccattgtgt

SEQ ID NO: 355181 - DNA, 20 bp, Artificial Sequence
  chemically synthesized
ggtttccctaacacaatggc

SEQ ID NO: 355182 - DNA, 20 bp, Artificial Sequence
  chemically synthesized
ataagatgaggattcagcat

SEQ ID NO: 355183 - DNA, 20 bp, Artificial Sequence
  chemically synthesized
ctgcaaataagatgaggatt

SEQ ID NO: 355184 - DNA, 20 bp, Artificial Sequence
  chemically synthesized
ttatggctgcaaataagatg

SEQ ID NO: 355185 - DNA, 20 bp, Artificial Sequence
  chemically synthesized
cttatggctgcaaataagat

SEQ ID NO: 355186 - DNA, 20 bp, Artificial Sequence
  chemically synthesized
ctgaatcctcatcttatttg

SEQ ID NO: 355187 - DNA, 20 bp, Artificial Sequence
  chemically synthesized
gtttacttatggctgcaaat

SEQ ID NO: 355188 - DNA, 20 bp, Artificial Sequence
  chemically synthesized
ctcatcttatttgcagccat

SEQ ID NO: 355189 - DNA, 20 bp, Artificial Sequence
  chemically synthesized
agtttcttaaagtttactta

SEQ ID NO: 355190 - DNA, 20 bp, Artificial Sequence
  chemically synthesized
tgcagccataagtaaacttt

SEQ ID NO: 355191 - DNA, 20 bp, Artificial Sequence
  chemically synthesized
taataataaaaagtttctta

SEQ ID NO: 355192 - DNA, 20 bp, Artificial Sequence
  chemically synthesized
acttaaagtataataataaa

SEQ ID NO: 355193 - DNA, 20 bp, Artificial Sequence
  chemically synthesized
actttttattattatacttt

SEQ ID NO: 355194 - DNA, 20 bp, Artificial Sequence
  chemically synthesized
tattattatactttaagttt

SEQ ID NO: 355195 - DNA, 20 bp, Artificial Sequence
  chemically synthesized
cacatgtatcccaaaactta

SEQ ID NO: 355196 - DNA, 20 bp, Artificial Sequence
  chemically synthesized
attattatactttaagtttt

SEQ ID NO: 355197 - DNA, 20 bp, Artificial Sequence
  chemically synthesized
taagttttgggatacatgtg

SEQ ID NO: 355198 - DNA, 20 bp, Artificial Sequence
  chemically synthesized
ggatacatgtgcagaacgtg

SEQ ID NO: 355199 - DNA, 20 bp, Artificial Sequence
  chemically synthesized
gatacatgtgcagaacgtgc

SEQ ID NO: 355200 - DNA, 20 bp, Artificial Sequence
  chemically synthesized
gaacgtgcaggtttgttaca

SEQ ID NO: 355201 - DNA, 20 bp, Artificial Sequence
  chemically synthesized
aacgtgcaggtttgttacat

SEQ ID NO: 355202 - DNA, 20 bp, Artificial Sequence
  chemically synthesized
acataggtatacacatgcca

SEQ ID NO: 355203 - DNA, 20 bp, Artificial Sequence
  chemically synthesized
taggtatacacatgccatgg

SEQ ID NO: 355204 - DNA, 20 bp, Artificial Sequence
  chemically synthesized
attggtacagcaaaccacca

SEQ ID NO: 355205 - DNA, 20 bp, Artificial Sequence
  chemically synthesized
acatagatgacggattggta

SEQ ID NO: 355206 - DNA, 20 bp, Artificial Sequence
  chemically synthesized
acctaacatagatgacggat

SEQ ID NO: 355207 - DNA, 20 bp, Artificial Sequence
  chemically synthesized
gaaatacctaacatagatga

SEQ ID NO: 355208 - DNA, 20 bp, Artificial Sequence
  chemically synthesized
taccaatccgtcatctatgt

SEQ ID NO: 355209 - DNA, 20 bp, Artificial Sequence
  chemically synthesized
accaatccgtcatctatgtt

SEQ ID NO: 355210 - DNA, 20 bp, Artificial Sequence
  chemically synthesized
attaggggaaatacctaaca

SEQ ID NO: 355211 - DNA, 20 bp, Artificial Sequence
  chemically synthesized
taggggagtgatagcattag

SEQ ID NO: 355212 - DNA, 20 bp, Artificial Sequence
  chemically synthesized
ctaggggagtgatagcatta

SEQ ID NO: 355213 - DNA, 20 bp, Artificial Sequence
  chemically synthesized
gctaggggagtgatagcatt

SEQ ID NO: 355214 - DNA, 20 bp, Artificial Sequence
  chemically synthesized
ggctaggggagtgatagcat

SEQ ID NO: 355215 - DNA, 20 bp, Artificial Sequence
  chemically synthesized
gtgtggggctaggggagtga

SEQ ID NO: 355216 - DNA, 20 bp, Artificial Sequence
  chemically synthesized
ccctaatgctatcactcccc

SEQ ID NO: 355217 - DNA, 20 bp, Artificial Sequence
  chemically synthesized
tggggtgtgtggggctaggg

SEQ ID NO: 355218 - DNA, 20 bp, Artificial Sequence
  chemically synthesized
tttggggtgtgtggggctag

SEQ ID NO: 355219 - DNA, 20 bp, Artificial Sequence
  chemically synthesized
ttttggggtgtgtggggcta

SEQ ID NO: 355220 - DNA, 20 bp, Artificial Sequence
  chemically synthesized
cttttggggtgtgtggggct

SEQ ID NO: 355221 - DNA, 20 bp, Artificial Sequence
  chemically synthesized
ccttttggggtgtgtggggc

SEQ ID NO: 355222 - DNA, 20 bp, Artificial Sequence
  chemically synthesized
ggggccttttggggtgtgtg

SEQ ID NO: 355223 - DNA, 20 bp, Artificial Sequence
  chemically synthesized
tggggccttttggggtgtgt

SEQ ID NO: 355224 - DNA, 20 bp, Artificial Sequence
  chemically synthesized
ctggggccttttggggtgtg

SEQ ID NO: 355225 - DNA, 20 bp, Artificial Sequence
  chemically synthesized
cctagccccacacaccccaa

SEQ ID NO: 355226 - DNA, 20 bp, Artificial Sequence
  chemically synthesized
ctagccccacacaccccaaa

SEQ ID NO: 355227 - DNA, 20 bp, Artificial Sequence
  chemically synthesized
tcacacactggggccttttg

SEQ ID NO: 355228 - DNA, 20 bp, Artificial Sequence
  chemically synthesized
atcacacactggggcctttt

SEQ ID NO: 355229 - DNA, 20 bp, Artificial Sequence
  chemically synthesized
catcacacactggggccttt

SEQ ID NO: 355230 - DNA, 20 bp, Artificial Sequence
  chemically synthesized
ccacacaccccaaaaggccc

SEQ ID NO: 355231 - DNA, 20 bp, Artificial Sequence
  chemically synthesized
cagtggagcatcacacactg

SEQ ID NO: 355232 - DNA, 20 bp, Artificial Sequence
  chemically synthesized
gcagtggagcatcacacact

SEQ ID NO: 355233 - DNA, 20 bp, Artificial Sequence
  chemically synthesized
tgcagtggagcatcacacac

SEQ ID NO: 355234 - DNA, 20 bp, Artificial Sequence
  chemically synthesized
cagaagacatggatgcagtg

SEQ ID NO: 355235 - DNA, 20 bp, Artificial Sequence
  chemically synthesized
accagaagacatggatgcag

SEQ ID NO: 355236 - DNA, 20 bp, Artificial Sequence
  chemically synthesized
acaaccagaagacatggatg

SEQ ID NO: 355237 - DNA, 20 bp, Artificial Sequence
  chemically synthesized
tccactgcatccatgtcttc

SEQ ID NO: 355238 - DNA, 20 bp, Artificial Sequence
  chemically synthesized
agttgaacaaccagaagaca

SEQ ID NO: 355239 - DNA, 20 bp, Artificial Sequence
  chemically synthesized
aatcggagttgaacaaccag

SEQ ID NO: 355240 - DNA, 20 bp, Artificial Sequence
  chemically synthesized
ataaatcggagttgaacaac

SEQ ID NO: 355241 - DNA, 20 bp, Artificial Sequence
  chemically synthesized
atgttctcactcataaatcg

SEQ ID NO: 355242 - DNA, 20 bp, Artificial Sequence
  chemically synthesized
gttgttcaactccgatttat

SEQ ID NO: 355243 - DNA, 20 bp, Artificial Sequence
  chemically synthesized
gcatgttctcactcataaat

SEQ ID NO: 355244 - DNA, 20 bp, Artificial Sequence
  chemically synthesized
ttcaactccgatttatgagt

SEQ ID NO: 355245 - DNA, 20 bp, Artificial Sequence
  chemically synthesized
tttatgagtgagaacatgcc

SEQ ID NO: 355246 - DNA, 20 bp, Artificial Sequence
  chemically synthesized
taggaacagaaaatcaaact

SEQ ID NO: 355247 - DNA, 20 bp, Artificial Sequence
  chemically synthesized
tcagcaaactaacataggaa

SEQ ID NO: 355248 - DNA, 20 bp, Artificial Sequence
  chemically synthesized
ttgattttctgttcctatgt

SEQ ID NO: 355249 - DNA, 20 bp, Artificial Sequence
  chemically synthesized
cattctcagcaaactaacat

SEQ ID NO: 355250 - DNA, 20 bp, Artificial Sequence
  chemically synthesized
tcattctcagcaaactaaca

SEQ ID NO: 355251 - DNA, 20 bp, Artificial Sequence
  chemically synthesized
tgttcctatgttagtttgct

SEQ ID NO: 355252 - DNA, 20 bp, Artificial Sequence
  chemically synthesized
aagctggaaaacatcattct

SEQ ID NO: 355253 - DNA, 20 bp, Artificial Sequence
  chemically synthesized
ttgctgagaatgatgttttc

SEQ ID NO: 355254 - DNA, 20 bp, Artificial Sequence
  chemically synthesized
tgcagggatgtggatgaagc

SEQ ID NO: 355255 - DNA, 20 bp, Artificial Sequence
  chemically synthesized
cctttgcagggatgtggatg

SEQ ID NO: 355256 - DNA, 20 bp, Artificial Sequence
  chemically synthesized
tcatgtcctttgcagggatg

SEQ ID NO: 355257 - DNA, 20 bp, Artificial Sequence
  chemically synthesized
gcttcatccacatccctgca

SEQ ID NO: 355258 - DNA, 20 bp, Artificial Sequence
  chemically synthesized
cttcatccacatccctgcaa

SEQ ID NO: 355259 - DNA, 20 bp, Artificial Sequence
  chemically synthesized
tgagtttcatgtcctttgca

SEQ ID NO: 355260 - DNA, 20 bp, Artificial Sequence
  chemically synthesized
atgagtttcatgtcctttgc

SEQ ID NO: 355261 - DNA, 20 bp, Artificial Sequence
  chemically synthesized
gatgagtttcatgtcctttg

SEQ ID NO: 355262 - DNA, 20 bp, Artificial Sequence
  chemically synthesized
atgcagcaacaaaaaaggat

SEQ ID NO: 355263 - DNA, 20 bp, Artificial Sequence
  chemically synthesized
atactatgcagcaacaaaaa

SEQ ID NO: 355264 - DNA, 20 bp, Artificial Sequence
  chemically synthesized
aatactatgcagcaacaaaa

SEQ ID NO: 355265 - DNA, 20 bp, Artificial Sequence
  chemically synthesized
catccttttttgttgctgca

SEQ ID NO: 355266 - DNA, 20 bp, Artificial Sequence
  chemically synthesized
atacaccatggaatactatg

SEQ ID NO: 355267 - DNA, 20 bp, Artificial Sequence
  chemically synthesized
tgttgctgcatagtattcca

SEQ ID NO: 355268 - DNA, 20 bp, Artificial Sequence
  chemically synthesized
aatttggcacatatacacca

SEQ ID NO: 355269 - DNA, 20 bp, Artificial Sequence
  chemically synthesized
tagactggataaagaaaatt

SEQ ID NO: 355270 - DNA, 20 bp, Artificial Sequence
  chemically synthesized
tgtgccaaattttctttatc

SEQ ID NO: 355271 - DNA, 20 bp, Artificial Sequence
  chemically synthesized
catcaatgatagactggata

SEQ ID NO: 355272 - DNA, 20 bp, Artificial Sequence
  chemically synthesized
aatgcccatcaatgatagac

SEQ ID NO: 355273 - DNA, 20 bp, Artificial Sequence
  chemically synthesized
tttatccagtctatcattga

SEQ ID NO: 355274 - DNA, 20 bp, Artificial Sequence
  chemically synthesized
acccaaatgcccatcaatga

SEQ ID NO: 355275 - DNA, 20 bp, Artificial Sequence
  chemically synthesized
ttatccagtctatcattgat

SEQ ID NO: 355276 - DNA, 20 bp, Artificial Sequence
  chemically synthesized
gtctatcattgatgggcatt

SEQ ID NO: 355277 - DNA, 20 bp, Artificial Sequence
  chemically synthesized
tctatcattgatgggcattt

SEQ ID NO: 355278 - DNA, 20 bp, Artificial Sequence
  chemically synthesized
tcattgatgggcatttgggt

SEQ ID NO: 355279 - DNA, 20 bp, Artificial Sequence
  chemically synthesized
tgggcatttgggttggtttc

SEQ ID NO: 355280 - DNA, 20 bp, Artificial Sequence
  chemically synthesized
cagcactattcacaatagca

SEQ ID NO: 355281 - DNA, 20 bp, Artificial Sequence
  chemically synthesized
caagtctttgctattgtgaa

SEQ ID NO: 355282 - DNA, 20 bp, Artificial Sequence
  chemically synthesized
tatttcagcactattcacaa

SEQ ID NO: 355283 - DNA, 20 bp, Artificial Sequence
  chemically synthesized
attgtgaatagtgctgaaat

SEQ ID NO: 355284 - DNA, 20 bp, Artificial Sequence
  chemically synthesized
aaattattctgtgcttattt

SEQ ID NO: 355285 - DNA, 20 bp, Artificial Sequence
  chemically synthesized
gaatagtgctgaaataagca

SEQ ID NO: 355286 - DNA, 20 bp, Artificial Sequence
  chemically synthesized
cagaataatttataatcctt

SEQ ID NO: 355287 - DNA, 20 bp, Artificial Sequence
  chemically synthesized
agaataatttataatccttt

SEQ ID NO: 355288 - DNA, 20 bp, Artificial Sequence
  chemically synthesized
atcactgggtatatacccaa

SEQ ID NO: 355289 - DNA, 20 bp, Artificial Sequence
  chemically synthesized
catcactgggtatataccca

SEQ ID NO: 355290 - DNA, 20 bp, Artificial Sequence
  chemically synthesized
taatcctttgggtatatacc

SEQ ID NO: 355291 - DNA, 20 bp, Artificial Sequence
  chemically synthesized
tttgggtatatacccagtga

SEQ ID NO: 355292 - DNA, 20 bp, Artificial Sequence
  chemically synthesized
ttgggtatatacccagtgat

SEQ ID NO: 355293 - DNA, 20 bp, Artificial Sequence
  chemically synthesized
gaccaagcaatcccatcact

SEQ ID NO: 355294 - DNA, 20 bp, Artificial Sequence
  chemically synthesized
tgaccaagcaatcccatcac

SEQ ID NO: 355295 - DNA, 20 bp, Artificial Sequence
  chemically synthesized
tacccagtgatgggattgct

SEQ ID NO: 355296 - DNA, 20 bp, Artificial Sequence
  chemically synthesized
gatgggattgcttggtcaaa

SEQ ID NO: 355297 - DNA, 20 bp, Artificial Sequence
  chemically synthesized
gccagaaataccatttgacc

SEQ ID NO: 355298 - DNA, 20 bp, Artificial Sequence
  chemically synthesized
gcttggtcaaatggtatttc

SEQ ID NO: 355299 - DNA, 20 bp, Artificial Sequence
  chemically synthesized
tcaaatggtatttctggctc

SEQ ID NO: 355300 - DNA, 20 bp, Artificial Sequence
  chemically synthesized
attgctcaaggatctagagc

SEQ ID NO: 355301 - DNA, 20 bp, Artificial Sequence
  chemically synthesized
ggtgattgctcaaggatcta

SEQ ID NO: 355302 - DNA, 20 bp, Artificial Sequence
  chemically synthesized
atttctggctctagatcctt

SEQ ID NO: 355303 - DNA, 20 bp, Artificial Sequence
  chemically synthesized
gtggtgattgctcaaggatc

SEQ ID NO: 355304 - DNA, 20 bp, Artificial Sequence
  chemically synthesized
gacagtgtggtgattgctca

SEQ ID NO: 355305 - DNA, 20 bp, Artificial Sequence
  chemically synthesized
agacagtgtggtgattgctc

SEQ ID NO: 355306 - DNA, 20 bp, Artificial Sequence
  chemically synthesized
aaacattgtggaagacagtg

SEQ ID NO: 355307 - DNA, 20 bp, Artificial Sequence
  chemically synthesized
agttcaaacattgtggaaga

SEQ ID NO: 355308 - DNA, 20 bp, Artificial Sequence
  chemically synthesized
aattagttcaaacattgtgg

SEQ ID NO: 355309 - DNA, 20 bp, Artificial Sequence
  chemically synthesized
gtaaattagttcaaacattg

SEQ ID NO: 355310 - DNA, 20 bp, Artificial Sequence
  chemically synthesized
acactgttgggagtgtaaat

SEQ ID NO: 355311 - DNA, 20 bp, Artificial Sequence
  chemically synthesized
gaactaatttacactcccaa

SEQ ID NO: 355312 - DNA, 20 bp, Artificial Sequence
  chemically synthesized
gaatgattttacactgttgg

SEQ ID NO: 355313 - DNA, 20 bp, Artificial Sequence
  chemically synthesized
aggaatgattttacactgtt

SEQ ID NO: 355314 - DNA, 20 bp, Artificial Sequence
  chemically synthesized
taggaatgattttacactgt

SEQ ID NO: 355315 - DNA, 20 bp, Artificial Sequence
  chemically synthesized
tggagagaatatggagaaat

SEQ ID NO: 355316 - DNA, 20 bp, Artificial Sequence
  chemically synthesized
ctggagagaatatggagaaa

SEQ ID NO: 355317 - DNA, 20 bp, Artificial Sequence
  chemically synthesized
cagatgctggagagaatatg

SEQ ID NO: 355318 - DNA, 20 bp, Artificial Sequence
  chemically synthesized
aacagatgctggagagaata

SEQ ID NO: 355319 - DNA, 20 bp, Artificial Sequence
  chemically synthesized
ctatttctccatattctctc

SEQ ID NO: 355320 - DNA, 20 bp, Artificial Sequence
  chemically synthesized
aggaaacaacagatgctgga

SEQ ID NO: 355321 - DNA, 20 bp, Artificial Sequence
  chemically synthesized
tcaggaaacaacagatgctg

SEQ ID NO: 355322 - DNA, 20 bp, Artificial Sequence
  chemically synthesized
agtcaggaaacaacagatgc

SEQ ID NO: 355323 - DNA, 20 bp, Artificial Sequence
  chemically synthesized
atcaaaaagtcaggaaacaa

SEQ ID NO: 355324 - DNA, 20 bp, Artificial Sequence
  chemically synthesized
atggtgatcatcaaaaagtc

SEQ ID NO: 355325 - DNA, 20 bp, Artificial Sequence
  chemically synthesized
aatggtgatcatcaaaaagt

SEQ ID NO: 355326 - DNA, 20 bp, Artificial Sequence
  chemically synthesized
ttagaatggtgatcatcaaa

SEQ ID NO: 355327 - DNA, 20 bp, Artificial Sequence
  chemically synthesized
ttgatgatcaccattctaac

SEQ ID NO: 355328 - DNA, 20 bp, Artificial Sequence
  chemically synthesized
ccatctcatgctagttagaa

SEQ ID NO: 355329 - DNA, 20 bp, Artificial Sequence
  chemically synthesized
agataccatctcatgctagt

SEQ ID NO: 355330 - DNA, 20 bp, Artificial Sequence
  chemically synthesized
atcaccattctaactagcat

SEQ ID NO: 355331 - DNA, 20 bp, Artificial Sequence
  chemically synthesized
aatgagataccatctcatgc

SEQ ID NO: 355332 - DNA, 20 bp, Artificial Sequence
  chemically synthesized
ccattctaactagcatgaga

SEQ ID NO: 355333 - DNA, 20 bp, Artificial Sequence
  chemically synthesized
catgagatggtatctcattg

SEQ ID NO: 355334 - DNA, 20 bp, Artificial Sequence
  chemically synthesized
atgaaaatcaaaaccacaat

SEQ ID NO: 355335 - DNA, 20 bp, Artificial Sequence
  chemically synthesized
attttcatttctctaatgac

SEQ ID NO: 355336 - DNA, 20 bp, Artificial Sequence
  chemically synthesized
ttcatcatcactggtcatta

SEQ ID NO: 355337 - DNA, 20 bp, Artificial Sequence
  chemically synthesized
agttcatcatcactggtcat

SEQ ID NO: 355338 - DNA, 20 bp, Artificial Sequence
  chemically synthesized
aaaaaaaagttcatcatcac

SEQ ID NO: 355339 - DNA, 20 bp, Artificial Sequence
  chemically synthesized
ccaacaagtatgtgaaaaaa

SEQ ID NO: 355340 - DNA, 20 bp, Artificial Sequence
  chemically synthesized
cttttttttcacatacttgt

SEQ ID NO: 355341 - DNA, 20 bp, Artificial Sequence
  chemically synthesized
aagacatttatgtggccaac

SEQ ID NO: 355342 - DNA, 20 bp, Artificial Sequence
  chemically synthesized
tctcaaagaagacatttatg

SEQ ID NO: 355343 - DNA, 20 bp, Artificial Sequence
  chemically synthesized
gccacataaatgtcttcttt

SEQ ID NO: 355344 - DNA, 20 bp, Artificial Sequence
  chemically synthesized
acataaatgtcttctttgag

SEQ ID NO: 355345 - DNA, 20 bp, Artificial Sequence
  chemically synthesized
tgaacagacccttctcaaag

SEQ ID NO: 355346 - DNA, 20 bp, Artificial Sequence
  chemically synthesized
cataaatgtcttctttgaga

SEQ ID NO: 355347 - DNA, 20 bp, Artificial Sequence
  chemically synthesized
ataaatgtcttctttgagaa

SEQ ID NO: 355348 - DNA, 20 bp, Artificial Sequence
  chemically synthesized
gtatgaacagacccttctca

SEQ ID NO: 355349 - DNA, 20 bp, Artificial Sequence
  chemically synthesized
aagtaggcaaagggtatgaa

SEQ ID NO: 355350 - DNA, 20 bp, Artificial Sequence
  chemically synthesized
cccatcaaaaagtaggcaaa

SEQ ID NO: 355351 - DNA, 20 bp, Artificial Sequence
  chemically synthesized
ccccatcaaaaagtaggcaa

SEQ ID NO: 355352 - DNA, 20 bp, Artificial Sequence
  chemically synthesized
accccatcaaaaagtaggca

SEQ ID NO: 355353 - DNA, 20 bp, Artificial Sequence
  chemically synthesized
aaataaccccatcaaaaagt

SEQ ID NO: 355354 - DNA, 20 bp, Artificial Sequence
  chemically synthesized
aaaataaccccatcaaaaag

SEQ ID NO: 355355 - DNA, 20 bp, Artificial Sequence
  chemically synthesized
accctttgcctactttttga

SEQ ID NO: 355356 - DNA, 20 bp, Artificial Sequence
  chemically synthesized
ccctttgcctactttttgat

SEQ ID NO: 355357 - DNA, 20 bp, Artificial Sequence
  chemically synthesized
cctttgcctactttttgatg

SEQ ID NO: 355358 - DNA, 20 bp, Artificial Sequence
  chemically synthesized
aggaaaataaccccatcaaa

SEQ ID NO: 355359 - DNA, 20 bp, Artificial Sequence
  chemically synthesized
tctacaagaaacaaatttac

SEQ ID NO: 355360 - DNA, 20 bp, Artificial Sequence
  chemically synthesized
atctacaagaaacaaattta

SEQ ID NO: 355361 - DNA, 20 bp, Artificial Sequence
  chemically synthesized
tcctgtaaatttgtttcttg

SEQ ID NO: 355362 - DNA, 20 bp, Artificial Sequence
  chemically synthesized
ggctaatatccagaatctac

SEQ ID NO: 355363 - DNA, 20 bp, Artificial Sequence
  chemically synthesized
aatttgtttcttgtagattc

SEQ ID NO: 355364 - DNA, 20 bp, Artificial Sequence
  chemically synthesized
ttcttgtagattctggatat

SEQ ID NO: 355365 - DNA, 20 bp, Artificial Sequence
  chemically synthesized
tctgacaaagggctaatatc

SEQ ID NO: 355366 - DNA, 20 bp, Artificial Sequence
  chemically synthesized
tctggatattagccctttgt

SEQ ID NO: 355367 - DNA, 20 bp, Artificial Sequence
  chemically synthesized
caatctatctatctgacaaa

SEQ ID NO: 355368 - DNA, 20 bp, Artificial Sequence
  chemically synthesized
gcaatctatctatctgacaa

SEQ ID NO: 355369 - DNA, 20 bp, Artificial Sequence
  chemically synthesized
gatattagccctttgtcaga

SEQ ID NO: 355370 - DNA, 20 bp, Artificial Sequence
  chemically synthesized
tgcaatctatctatctgaca

SEQ ID NO: 355371 - DNA, 20 bp, Artificial Sequence
  chemically synthesized
ttagccctttgtcagataga

SEQ ID NO: 355372 - DNA, 20 bp, Artificial Sequence
  chemically synthesized
acaggcagcctataggatgg

SEQ ID NO: 355373 - DNA, 20 bp, Artificial Sequence
  chemically synthesized
aaaaattttctcccatccta

SEQ ID NO: 355374 - DNA, 20 bp, Artificial Sequence
  chemically synthesized
aaaattttctcccatcctat

SEQ ID NO: 355375 - DNA, 20 bp, Artificial Sequence
  chemically synthesized
gaacaggcagcctataggat

SEQ ID NO: 355376 - DNA, 20 bp, Artificial Sequence
  chemically synthesized
tgaacaggcagcctatagga

SEQ ID NO: 355377 - DNA, 20 bp, Artificial Sequence
  chemically synthesized
agagtgaacaggcagcctat

SEQ ID NO: 355378 - DNA, 20 bp, Artificial Sequence
  chemically synthesized
cagagtgaacaggcagccta

SEQ ID NO: 355379 - DNA, 20 bp, Artificial Sequence
  chemically synthesized
ctatcatcagagtgaacagg

SEQ ID NO: 355380 - DNA, 20 bp, Artificial Sequence
  chemically synthesized
aaactatcatcagagtgaac

SEQ ID NO: 355381 - DNA, 20 bp, Artificial Sequence
  chemically synthesized
aaaactatcatcagagtgaa

SEQ ID NO: 355382 - DNA, 20 bp, Artificial Sequence
  chemically synthesized
ctgcctgttcactctgatga

SEQ ID NO: 355383 - DNA, 20 bp, Artificial Sequence
  chemically synthesized
gcaaaagaaaactatcatca

SEQ ID NO: 355384 - DNA, 20 bp, Artificial Sequence
  chemically synthesized
cagcaaaagaaaactatcat

SEQ ID NO: 355385 - DNA, 20 bp, Artificial Sequence
  chemically synthesized
aaatagctcctgcacagcaa

SEQ ID NO: 355386 - DNA, 20 bp, Artificial Sequence
  chemically synthesized
gatagttttcttttgctgtg

SEQ ID NO: 355387 - DNA, 20 bp, Artificial Sequence
  chemically synthesized
atagttttcttttgctgtgc

SEQ ID NO: 355388 - DNA, 20 bp, Artificial Sequence
  chemically synthesized
agttttcttttgctgtgcag

SEQ ID NO: 355389 - DNA, 20 bp, Artificial Sequence
  chemically synthesized
cttactaaatagctcctgca

SEQ ID NO: 355390 - DNA, 20 bp, Artificial Sequence
  chemically synthesized
tttgctgtgcaggagctatt

SEQ ID NO: 355391 - DNA, 20 bp, Artificial Sequence
  chemically synthesized
ctgtgcaggagctatttagt

SEQ ID NO: 355392 - DNA, 20 bp, Artificial Sequence
  chemically synthesized
acaaatgagatcttactaaa

SEQ ID NO: 355393 - DNA, 20 bp, Artificial Sequence
  chemically synthesized
aaaagccaaaattgacaaat

SEQ ID NO: 355394 - DNA, 20 bp, Artificial Sequence
  chemically synthesized
aagatctcatttgtcaattt

SEQ ID NO: 355395 - DNA, 20 bp, Artificial Sequence
  chemically synthesized
accaaaagcaatggcaagaa

SEQ ID NO: 355396 - DNA, 20 bp, Artificial Sequence
  chemically synthesized
gaaacaccaaaagcaatggc

SEQ ID NO: 355397 - DNA, 20 bp, Artificial Sequence
  chemically synthesized
gcttttcttgccattgcttt

SEQ ID NO: 355398 - DNA, 20 bp, Artificial Sequence
  chemically synthesized
gactgaaacaccaaaagcaa

SEQ ID NO: 355399 - DNA, 20 bp, Artificial Sequence
  chemically synthesized
cttcatgactgaaacaccaa

SEQ ID NO: 355400 - DNA, 20 bp, Artificial Sequence
  chemically synthesized
tgccattgcttttggtgttt

SEQ ID NO: 355401 - DNA, 20 bp, Artificial Sequence
  chemically synthesized
cttttggtgtttcagtcatg

SEQ ID NO: 355402 - DNA, 20 bp, Artificial Sequence
  chemically synthesized
tcaggacataggcatgggca

SEQ ID NO: 355403 - DNA, 20 bp, Artificial Sequence
  chemically synthesized
acctttcaggacataggcat

SEQ ID NO: 355404 - DNA, 20 bp, Artificial Sequence
  chemically synthesized
tacctttcaggacataggca

SEQ ID NO: 355405 - DNA, 20 bp, Artificial Sequence
  chemically synthesized
ggcaatacctttcaggacat

SEQ ID NO: 355406 - DNA, 20 bp, Artificial Sequence
  chemically synthesized
aggcaatacctttcaggaca

SEQ ID NO: 355407 - DNA, 20 bp, Artificial Sequence
  chemically synthesized
tgcccatgcctatgtcctga

SEQ ID NO: 355408 - DNA, 20 bp, Artificial Sequence
  chemically synthesized
gcccatgcctatgtcctgaa

SEQ ID NO: 355409 - DNA, 20 bp, Artificial Sequence
  chemically synthesized
aaacctaggcaatacctttc

SEQ ID NO: 355410 - DNA, 20 bp, Artificial Sequence
  chemically synthesized
aaaacctaggcaataccttt

SEQ ID NO: 355411 - DNA, 20 bp, Artificial Sequence
  chemically synthesized
atgtcctgaaaggtattgcc

SEQ ID NO: 355412 - DNA, 20 bp, Artificial Sequence
  chemically synthesized
tgtcctgaaaggtattgcct

SEQ ID NO: 355413 - DNA, 20 bp, Artificial Sequence
  chemically synthesized
aaaaccctagaagaaaacct

SEQ ID NO: 355414 - DNA, 20 bp, Artificial Sequence
  chemically synthesized
aaaaaccctagaagaaaacc

SEQ ID NO: 355415 - DNA, 20 bp, Artificial Sequence
  chemically synthesized
gtattgcctaggttttcttc

SEQ ID NO: 355416 - DNA, 20 bp, Artificial Sequence
  chemically synthesized
tattgcctaggttttcttct

SEQ ID NO: 355417 - DNA, 20 bp, Artificial Sequence
  chemically synthesized
attgcctaggttttcttcta

SEQ ID NO: 355418 - DNA, 20 bp, Artificial Sequence
  chemically synthesized
taaaaccataaaaaccctag

SEQ ID NO: 355419 - DNA, 20 bp, Artificial Sequence
  chemically synthesized
acctaaaaccataaaaaccc

SEQ ID NO: 355420 - DNA, 20 bp, Artificial Sequence
  chemically synthesized
gttttcttctagggttttta

SEQ ID NO: 355421 - DNA, 20 bp, Artificial Sequence
  chemically synthesized
ttctagggtttttatggttt

SEQ ID NO: 355422 - DNA, 20 bp, Artificial Sequence
  chemically synthesized
tctagggtttttatggtttt

SEQ ID NO: 355423 - DNA, 20 bp, Artificial Sequence
  chemically synthesized
tggttttaggtattacattt

SEQ ID NO: 355424 - DNA, 20 bp, Artificial Sequence
  chemically synthesized
aattaactcaagatggatta

SEQ ID NO: 355425 - DNA, 20 bp, Artificial Sequence
  chemically synthesized
ttaagtctttaatccatctt

SEQ ID NO: 355426 - DNA, 20 bp, Artificial Sequence
  chemically synthesized
atacaaaaattaactcaaga

SEQ ID NO: 355427 - DNA, 20 bp, Artificial Sequence
  chemically synthesized
ccttatacaaaaattaactc

SEQ ID NO: 355428 - DNA, 20 bp, Artificial Sequence
  chemically synthesized
tcttgagttaatttttgtat

SEQ ID NO: 355429 - DNA, 20 bp, Artificial Sequence
  chemically synthesized
cttgagttaatttttgtata

SEQ ID NO: 355430 - DNA, 20 bp, Artificial Sequence
  chemically synthesized
ttgagttaatttttgtataa

SEQ ID NO: 355431 - DNA, 20 bp, Artificial Sequence
  chemically synthesized
tgagttaatttttgtataag

SEQ ID NO: 355432 - DNA, 20 bp, Artificial Sequence
  chemically synthesized
ttaatttttgtataaggggt

SEQ ID NO: 355433 - DNA, 20 bp, Artificial Sequence
  chemically synthesized
taatttttgtataaggggta

SEQ ID NO: 355434 - DNA, 20 bp, Artificial Sequence
  chemically synthesized
tttttgtataaggggtaagg

SEQ ID NO: 355435 - DNA, 20 bp, Artificial Sequence
  chemically synthesized
ttttgtataaggggtaagga

SEQ ID NO: 355436 - DNA, 20 bp, Artificial Sequence
  chemically synthesized
tttgtataaggggtaaggaa

SEQ ID NO: 355437 - DNA, 20 bp, Artificial Sequence
  chemically synthesized
ttgtataaggggtaaggaag

SEQ ID NO: 355438 - DNA, 20 bp, Artificial Sequence
  chemically synthesized
taaggggtaaggaaggggtc

SEQ ID NO: 355439 - DNA, 20 bp, Artificial Sequence
  chemically synthesized
gtaaggaaggggtccagttt

SEQ ID NO: 355440 - DNA, 20 bp, Artificial Sequence
  chemically synthesized
catatgcagaagactgaaac

SEQ ID NO: 355441 - DNA, 20 bp, Artificial Sequence
  chemically synthesized
cagtttcagtcttctgcata

SEQ ID NO: 355442 - DNA, 20 bp, Artificial Sequence
  chemically synthesized
aactggctagccatatgcag

SEQ ID NO: 355443 - DNA, 20 bp, Artificial Sequence
  chemically synthesized
gaaaactggctagccatatg

SEQ ID NO: 355444 - DNA, 20 bp, Artificial Sequence
  chemically synthesized
ttcagtcttctgcatatggc

SEQ ID NO: 355445 - DNA, 20 bp, Artificial Sequence
  chemically synthesized
gtcttctgcatatggctagc

SEQ ID NO: 355446 - DNA, 20 bp, Artificial Sequence
  chemically synthesized
atgatgatgggaaaactggc

SEQ ID NO: 355447 - DNA, 20 bp, Artificial Sequence
  chemically synthesized
ataaatgatgatgggaaaac

SEQ ID NO: 355448 - DNA, 20 bp, Artificial Sequence
  chemically synthesized
cctatttaataaatgatgat

SEQ ID NO: 355449 - DNA, 20 bp, Artificial Sequence
  chemically synthesized
ccctatttaataaatgatga

SEQ ID NO: 355450 - DNA, 20 bp, Artificial Sequence
  chemically synthesized
tcccatcatcatttattaaa

SEQ ID NO: 355451 - DNA, 20 bp, Artificial Sequence
  chemically synthesized
cccatcatcatttattaaat

SEQ ID NO: 355452 - DNA, 20 bp, Artificial Sequence
  chemically synthesized
ccatcatcatttattaaata

SEQ ID NO: 355453 - DNA, 20 bp, Artificial Sequence
  chemically synthesized
ccaaaaacaagcaatgggga

SEQ ID NO: 355454 - DNA, 20 bp, Artificial Sequence
  chemically synthesized
cctgccaaaaacaagcaatg

SEQ ID NO: 355455 - DNA, 20 bp, Artificial Sequence
  chemically synthesized
acctgccaaaaacaagcaat

SEQ ID NO: 355456 - DNA, 20 bp, Artificial Sequence
  chemically synthesized
aacctgccaaaaacaagcaa

SEQ ID NO: 355457 - DNA, 20 bp, Artificial Sequence
  chemically synthesized
ctttccccattgcttgtttt

SEQ ID NO: 355458 - DNA, 20 bp, Artificial Sequence
  chemically synthesized
ttgacaaacctgccaaaaac

SEQ ID NO: 355459 - DNA, 20 bp, Artificial Sequence
  chemically synthesized
tccccattgcttgtttttgg

SEQ ID NO: 355460 - DNA, 20 bp, Artificial Sequence
  chemically synthesized
ccccattgcttgtttttggc

SEQ ID NO: 355461 - DNA, 20 bp, Artificial Sequence
  chemically synthesized
tgtttttggcaggtttgtca

SEQ ID NO: 355462 - DNA, 20 bp, Artificial Sequence
  chemically synthesized
ttggcaggtttgtcaaagat

SEQ ID NO: 355463 - DNA, 20 bp, Artificial Sequence
  chemically synthesized
caggtttgtcaaagatcaga

SEQ ID NO: 355464 - DNA, 20 bp, Artificial Sequence
  chemically synthesized
tgtcaaagatcagatggttg

SEQ ID NO: 355465 - DNA, 20 bp, Artificial Sequence
  chemically synthesized
atcagatggttgtagatgtg

SEQ ID NO: 355466 - DNA, 20 bp, Artificial Sequence
  chemically synthesized
agatgtgtggtgttatttct

SEQ ID NO: 355467 - DNA, 20 bp, Artificial Sequence
  chemically synthesized
gatgtgtggtgttatttctg

SEQ ID NO: 355468 - DNA, 20 bp, Artificial Sequence
  chemically synthesized
atggaacagaacagaggcct

SEQ ID NO: 355469 - DNA, 20 bp, Artificial Sequence
  chemically synthesized
agacgaatggaacagaacag

SEQ ID NO: 355470 - DNA, 20 bp, Artificial Sequence
  chemically synthesized
tagacgaatggaacagaaca

SEQ ID NO: 355471 - DNA, 20 bp, Artificial Sequence
  chemically synthesized
catagacgaatggaacagaa

SEQ ID NO: 355472 - DNA, 20 bp, Artificial Sequence
  chemically synthesized
agatacatagacgaatggaa

SEQ ID NO: 355473 - DNA, 20 bp, Artificial Sequence
  chemically synthesized
agaacagatacatagacgaa

SEQ ID NO: 355474 - DNA, 20 bp, Artificial Sequence
  chemically synthesized
ctggtaccagaacagataca

SEQ ID NO: 355475 - DNA, 20 bp, Artificial Sequence
  chemically synthesized
attcgtctatgtatctgttc

SEQ ID NO: 355476 - DNA, 20 bp, Artificial Sequence
  chemically synthesized
gcatgatactggtaccagaa

SEQ ID NO: 355477 - DNA, 20 bp, Artificial Sequence
  chemically synthesized
ctatgtatctgttctggtac

SEQ ID NO: 355478 - DNA, 20 bp, Artificial Sequence
  chemically synthesized
aaacagcatgatactggtac

SEQ ID NO: 355479 - DNA, 20 bp, Artificial Sequence
  chemically synthesized
taaccaaaacagcatgatac

SEQ ID NO: 355480 - DNA, 20 bp, Artificial Sequence
  chemically synthesized
gtaccagtatcatgctgttt

SEQ ID NO: 355481 - DNA, 20 bp, Artificial Sequence
  chemically synthesized
caaggctacagtaaccaaaa

SEQ ID NO: 355482 - DNA, 20 bp, Artificial Sequence
  chemically synthesized
tcatgctgttttggttactg

SEQ ID NO: 355483 - DNA, 20 bp, Artificial Sequence
  chemically synthesized
gaaactacactacaaggcta

SEQ ID NO: 355484 - DNA, 20 bp, Artificial Sequence
  chemically synthesized
ttttggttactgtagccttg

SEQ ID NO: 355485 - DNA, 20 bp, Artificial Sequence
  chemically synthesized
gttactgtagccttgtagtg

SEQ ID NO: 355486 - DNA, 20 bp, Artificial Sequence
  chemically synthesized
ttacttgaaactacactaca

SEQ ID NO: 355487 - DNA, 20 bp, Artificial Sequence
  chemically synthesized
cttacttgaaactacactac

SEQ ID NO: 355488 - DNA, 20 bp, Artificial Sequence
  chemically synthesized
tagccttgtagtgtagtttc

SEQ ID NO: 355489 - DNA, 20 bp, Artificial Sequence
  chemically synthesized
cttgtagtgtagtttcaagt

SEQ ID NO: 355490 - DNA, 20 bp, Artificial Sequence
  chemically synthesized
ttgtagtgtagtttcaagta

SEQ ID NO: 355491 - DNA, 20 bp, Artificial Sequence
  chemically synthesized
tagtgtagtttcaagtaagg

SEQ ID NO: 355492 - DNA, 20 bp, Artificial Sequence
  chemically synthesized
gtaaggtagcatgatgcctc

SEQ ID NO: 355493 - DNA, 20 bp, Artificial Sequence
  chemically synthesized
agcaaaaataacaaagctgg

SEQ ID NO: 355494 - DNA, 20 bp, Artificial Sequence
  chemically synthesized
aagcaaaaataacaaagctg

SEQ ID NO: 355495 - DNA, 20 bp, Artificial Sequence
  chemically synthesized
ctaagcaaaaataacaaagc

SEQ ID NO: 355496 - DNA, 20 bp, Artificial Sequence
  chemically synthesized
catcctaagcaaaaataaca

SEQ ID NO: 355497 - DNA, 20 bp, Artificial Sequence
  chemically synthesized
ccagctttgttatttttgct

SEQ ID NO: 355498 - DNA, 20 bp, Artificial Sequence
  chemically synthesized
cagctttgttatttttgctt

SEQ ID NO: 355499 - DNA, 20 bp, Artificial Sequence
  chemically synthesized
tttgttatttttgcttagga

SEQ ID NO: 355500 - DNA, 20 bp, Artificial Sequence
  chemically synthesized
tgcattgccaaaaccatcct

SEQ ID NO: 355501 - DNA, 20 bp, Artificial Sequence
  chemically synthesized
atttttgcttaggatggttt

SEQ ID NO: 355502 - DNA, 20 bp, Artificial Sequence
  chemically synthesized
ttaggatggttttggcaatg

SEQ ID NO: 355503 - DNA, 20 bp, Artificial Sequence
  chemically synthesized
taggatggttttggcaatgc

SEQ ID NO: 355504 - DNA, 20 bp, Artificial Sequence
  chemically synthesized
tggcaatgcaggctcttttt

SEQ ID NO: 355505 - DNA, 20 bp, Artificial Sequence
  chemically synthesized
tttcatgtggaactaaaaaa

SEQ ID NO: 355506 - DNA, 20 bp, Artificial Sequence
  chemically synthesized
aatttcatgtggaactaaaa

SEQ ID NO: 355507 - DNA, 20 bp, Artificial Sequence
  chemically synthesized
aaactactttaaatttcatg

SEQ ID NO: 355508 - DNA, 20 bp, Artificial Sequence
  chemically synthesized
ttagttccacatgaaattta

SEQ ID NO: 355509 - DNA, 20 bp, Artificial Sequence
  chemically synthesized
gttccacatgaaatttaaag

SEQ ID NO: 355510 - DNA, 20 bp, Artificial Sequence
  chemically synthesized
attcactttcttcacagaat

SEQ ID NO: 355511 - DNA, 20 bp, Artificial Sequence
  chemically synthesized
agtttttttctaattctgtg

SEQ ID NO: 355512 - DNA, 20 bp, Artificial Sequence
  chemically synthesized
tttttctaattctgtgaaga

SEQ ID NO: 355513 - DNA, 20 bp, Artificial Sequence
  chemically synthesized
gctacaattcactttcttca

SEQ ID NO: 355514 - DNA, 20 bp, Artificial Sequence
  chemically synthesized
tctgtgaagaaagtgaattg

SEQ ID NO: 355515 - DNA, 20 bp, Artificial Sequence
  chemically synthesized
aaagtgaattgtagcttaat

SEQ ID NO: 355516 - DNA, 20 bp, Artificial Sequence
  chemically synthesized
aagtgaattgtagcttaatg

SEQ ID NO: 355517 - DNA, 20 bp, Artificial Sequence
  chemically synthesized
agattcaatgttacctcatt

SEQ ID NO: 355518 - DNA, 20 bp, Artificial Sequence
  chemically synthesized
atactgcccgaagtaattta

SEQ ID NO: 355519 - DNA, 20 bp, Artificial Sequence
  chemically synthesized
attgaatctataaattactt

SEQ ID NO: 355520 - DNA, 20 bp, Artificial Sequence
  chemically synthesized
ttgaatctataaattacttc

SEQ ID NO: 355521 - DNA, 20 bp, Artificial Sequence
  chemically synthesized
aatctataaattacttcggg

SEQ ID NO: 355522 - DNA, 20 bp, Artificial Sequence
  chemically synthesized
gaaaatggccatactgcccg

SEQ ID NO: 355523 - DNA, 20 bp, Artificial Sequence
  chemically synthesized
ataaattacttcgggcagta

SEQ ID NO: 355524 - DNA, 20 bp, Artificial Sequence
  chemically synthesized
aagaatcaatatcatgaaaa

SEQ ID NO: 355525 - DNA, 20 bp, Artificial Sequence
  chemically synthesized
attccatgcttatggatagg

SEQ ID NO: 355526 - DNA, 20 bp, Artificial Sequence
  chemically synthesized
tattgattcttcctatccat

SEQ ID NO: 355527 - DNA, 20 bp, Artificial Sequence
  chemically synthesized
aacattccatgcttatggat

SEQ ID NO: 355528 - DNA, 20 bp, Artificial Sequence
  chemically synthesized
aaacattccatgcttatgga

SEQ ID NO: 355529 - DNA, 20 bp, Artificial Sequence
  chemically synthesized
attcttcctatccataagca

SEQ ID NO: 355530 - DNA, 20 bp, Artificial Sequence
  chemically synthesized
gaaaaaacattccatgctta

SEQ ID NO: 355531 - DNA, 20 bp, Artificial Sequence
  chemically synthesized
actgctcaaggaagtaagag

SEQ ID NO: 355532 - DNA, 20 bp, Artificial Sequence
  chemically synthesized
cactgctcaaggaagtaaga

SEQ ID NO: 355533 - DNA, 20 bp, Artificial Sequence
  chemically synthesized
accactgctcaaggaagtaa

SEQ ID NO: 355534 - DNA, 20 bp, Artificial Sequence
  chemically synthesized
aaaccactgctcaaggaagt

SEQ ID NO: 355535 - DNA, 20 bp, Artificial Sequence
  chemically synthesized
gcgtcctctcttacttcctt

SEQ ID NO: 355536 - DNA, 20 bp, Artificial Sequence
  chemically synthesized
tcctctcttacttccttgag

SEQ ID NO: 355537 - DNA, 20 bp, Artificial Sequence
  chemically synthesized
ctacaaaccactgctcaagg

SEQ ID NO: 355538 - DNA, 20 bp, Artificial Sequence
  chemically synthesized
tctcttacttccttgagcag

SEQ ID NO: 355539 - DNA, 20 bp, Artificial Sequence
  chemically synthesized
gaactacaaaccactgctca

SEQ ID NO: 355540 - DNA, 20 bp, Artificial Sequence
  chemically synthesized
agaactacaaaccactgctc

SEQ ID NO: 355541 - DNA, 20 bp, Artificial Sequence
  chemically synthesized
cttccttgagcagtggtttg

SEQ ID NO: 355542 - DNA, 20 bp, Artificial Sequence
  chemically synthesized
gtggtttgtagttctccttg

SEQ ID NO: 355543 - DNA, 20 bp, Artificial Sequence
  chemically synthesized
ggtttgtagttctccttgaa

SEQ ID NO: 355544 - DNA, 20 bp, Artificial Sequence
  chemically synthesized
gtttgtagttctccttgaag

SEQ ID NO: 355545 - DNA, 20 bp, Artificial Sequence
  chemically synthesized
atgtgaaggacctcttcaag

SEQ ID NO: 355546 - DNA, 20 bp, Artificial Sequence
  chemically synthesized
ggatgtgaaggacctcttca

SEQ ID NO: 355547 - DNA, 20 bp, Artificial Sequence
  chemically synthesized
gggatgtgaaggacctcttc

SEQ ID NO: 355548 - DNA, 20 bp, Artificial Sequence
  chemically synthesized
ccaacttataagggatgtga

SEQ ID NO: 355549 - DNA, 20 bp, Artificial Sequence
  chemically synthesized
tccaacttataagggatgtg

SEQ ID NO: 355550 - DNA, 20 bp, Artificial Sequence
  chemically synthesized
aggtccttcacatcccttat

SEQ ID NO: 355551 - DNA, 20 bp, Artificial Sequence
  chemically synthesized
cctagcaatccaacttataa

SEQ ID NO: 355552 - DNA, 20 bp, Artificial Sequence
  chemically synthesized
ccttcacatcccttataagt

SEQ ID NO: 355553 - DNA, 20 bp, Artificial Sequence
  chemically synthesized
tcctagcaatccaacttata

SEQ ID NO: 355554 - DNA, 20 bp, Artificial Sequence
  chemically synthesized
ttcctagcaatccaacttat

SEQ ID NO: 355555 - DNA, 20 bp, Artificial Sequence
  chemically synthesized
tcccttataagttggattgc

SEQ ID NO: 355556 - DNA, 20 bp, Artificial Sequence
  chemically synthesized
cccttataagttggattgct

SEQ ID NO: 355557 - DNA, 20 bp, Artificial Sequence
  chemically synthesized
tacaaggagaatagaattcc

SEQ ID NO: 355558 - DNA, 20 bp, Artificial Sequence
  chemically synthesized
tacaattgctacaaggagaa

SEQ ID NO: 355559 - DNA, 20 bp, Artificial Sequence
  chemically synthesized
taggaattctattctccttg

SEQ ID NO: 355560 - DNA, 20 bp, Artificial Sequence
  chemically synthesized
ccatttacaattgctacaag

SEQ ID NO: 355561 - DNA, 20 bp, Artificial Sequence
  chemically synthesized
tcccatttacaattgctaca

SEQ ID NO: 355562 - DNA, 20 bp, Artificial Sequence
  chemically synthesized
ctcccatttacaattgctac

SEQ ID NO: 355563 - DNA, 20 bp, Artificial Sequence
  chemically synthesized
ctccttgtagcaattgtaaa

SEQ ID NO: 355564 - DNA, 20 bp, Artificial Sequence
  chemically synthesized
tccttgtagcaattgtaaat

SEQ ID NO: 355565 - DNA, 20 bp, Artificial Sequence
  chemically synthesized
cttgtagcaattgtaaatgg

SEQ ID NO: 355566 - DNA, 20 bp, Artificial Sequence
  chemically synthesized
atgggagttcactcatgatt

SEQ ID NO: 355567 - DNA, 20 bp, Artificial Sequence
  chemically synthesized
ataataaacagccaaatcat

SEQ ID NO: 355568 - DNA, 20 bp, Artificial Sequence
  chemically synthesized
tcctatacaccgataataaa

SEQ ID NO: 355569 - DNA, 20 bp, Artificial Sequence
  chemically synthesized
atgatttggctgtttattat

SEQ ID NO: 355570 - DNA, 20 bp, Artificial Sequence
  chemically synthesized
ggctgtttattatcggtgta

SEQ ID NO: 355571 - DNA, 20 bp, Artificial Sequence
  chemically synthesized
gctgtttattatcggtgtat

SEQ ID NO: 355572 - DNA, 20 bp, Artificial Sequence
  chemically synthesized
aatcgatgtggaaaaataac

SEQ ID NO: 355573 - DNA, 20 bp, Artificial Sequence
  chemically synthesized
ctcaggatacaaaatcgatg

SEQ ID NO: 355574 - DNA, 20 bp, Artificial Sequence
  chemically synthesized
ccacatcgattttgtatcct

SEQ ID NO: 355575 - DNA, 20 bp, Artificial Sequence
  chemically synthesized
ggcagtgtcaacaaagtctc

SEQ ID NO: 355576 - DNA, 20 bp, Artificial Sequence
  chemically synthesized
aggcagtgtcaacaaagtct

SEQ ID NO: 355577 - DNA, 20 bp, Artificial Sequence
  chemically synthesized
gctgataggcagtgtcaaca

SEQ ID NO: 355578 - DNA, 20 bp, Artificial Sequence
  chemically synthesized
actttgttgacactgcctat

SEQ ID NO: 355579 - DNA, 20 bp, Artificial Sequence
  chemically synthesized
aatctccttaagctgatagg

SEQ ID NO: 355580 - DNA, 20 bp, Artificial Sequence
  chemically synthesized
gaaaatctccttaagctgat

SEQ ID NO: 355581 - DNA, 20 bp, Artificial Sequence
  chemically synthesized
ttgacactgcctatcagctt

SEQ ID NO: 355582 - DNA, 20 bp, Artificial Sequence
  chemically synthesized
cgaaaatctccttaagctga

SEQ ID NO: 355583 - DNA, 20 bp, Artificial Sequence
  chemically synthesized
tgacactgcctatcagctta

SEQ ID NO: 355584 - DNA, 20 bp, Artificial Sequence
  chemically synthesized
acactgcctatcagcttaag

SEQ ID NO: 355585 - DNA, 20 bp, Artificial Sequence
  chemically synthesized
tctcagccgaaaatctcctt

SEQ ID NO: 355586 - DNA, 20 bp, Artificial Sequence
  chemically synthesized
tatcagcttaaggagatttt

SEQ ID NO: 355587 - DNA, 20 bp, Artificial Sequence
  chemically synthesized
gcttaaggagattttcggct

SEQ ID NO: 355588 - DNA, 20 bp, Artificial Sequence
  chemically synthesized
gagattttcggctgagatga

SEQ ID NO: 355589 - DNA, 20 bp, Artificial Sequence
  chemically synthesized
agattttcggctgagatgat

SEQ ID NO: 355590 - DNA, 20 bp, Artificial Sequence
  chemically synthesized
tttagaaaaccccatcatct

SEQ ID NO: 355591 - DNA, 20 bp, Artificial Sequence
  chemically synthesized
gattttcggctgagatgatg

SEQ ID NO: 355592 - DNA, 20 bp, Artificial Sequence
  chemically synthesized
agatgacatgattgtatatt

SEQ ID NO: 355593 - DNA, 20 bp, Artificial Sequence
  chemically synthesized
acaatcatgtcatctgcaaa

SEQ ID NO: 355594 - DNA, 20 bp, Artificial Sequence
  chemically synthesized
aatcatgtcatctgcaaaca

SEQ ID NO: 355595 - DNA, 20 bp, Artificial Sequence
  chemically synthesized
gtattcaaattctctgtttg

SEQ ID NO: 355596 - DNA, 20 bp, Artificial Sequence
  chemically synthesized
aatcaggcaggagaaagaaa

SEQ ID NO: 355597 - DNA, 20 bp, Artificial Sequence
  chemically synthesized
caatcaggcaggagaaagaa

SEQ ID NO: 355598 - DNA, 20 bp, Artificial Sequence
  chemically synthesized
acaatcaggcaggagaaaga

SEQ ID NO: 355599 - DNA, 20 bp, Artificial Sequence
  chemically synthesized
cagcacaatcaggcaggaga

SEQ ID NO: 355600 - DNA, 20 bp, Artificial Sequence
  chemically synthesized
tggccagcacaatcaggcag

SEQ ID NO: 355601 - DNA, 20 bp, Artificial Sequence
  chemically synthesized
tctggccagcacaatcaggc

SEQ ID NO: 355602 - DNA, 20 bp, Artificial Sequence
  chemically synthesized
ttctggccagcacaatcagg

SEQ ID NO: 355603 - DNA, 20 bp, Artificial Sequence
  chemically synthesized
aagttctggccagcacaatc

SEQ ID NO: 355604 - DNA, 20 bp, Artificial Sequence
  chemically synthesized
tttctcctgcctgattgtgc

SEQ ID NO: 355605 - DNA, 20 bp, Artificial Sequence
  chemically synthesized
gaagttctggccagcacaat

SEQ ID NO: 355606 - DNA, 20 bp, Artificial Sequence
  chemically synthesized
tcctgcctgattgtgctggc

SEQ ID NO: 355607 - DNA, 20 bp, Artificial Sequence
  chemically synthesized
atagtattggaagttctggc

SEQ ID NO: 355608 - DNA, 20 bp, Artificial Sequence
  chemically synthesized
caacatagtattggaagttc

SEQ ID NO: 355609 - DNA, 20 bp, Artificial Sequence
  chemically synthesized
cctattcaacatagtattgg

SEQ ID NO: 355610 - DNA, 20 bp, Artificial Sequence
  chemically synthesized
actcctattcaacatagtat

SEQ ID NO: 355611 - DNA, 20 bp, Artificial Sequence
  chemically synthesized
acttccaatactatgttgaa

SEQ ID NO: 355612 - DNA, 20 bp, Artificial Sequence
  chemically synthesized
ctcatcactcctattcaaca

SEQ ID NO: 355613 - DNA, 20 bp, Artificial Sequence
  chemically synthesized
cttccaatactatgttgaat

SEQ ID NO: 355614 - DNA, 20 bp, Artificial Sequence
  chemically synthesized
tccaatactatgttgaatag

SEQ ID NO: 355615 - DNA, 20 bp, Artificial Sequence
  chemically synthesized
ctatgttgaataggagtgat

SEQ ID NO: 355616 - DNA, 20 bp, Artificial Sequence
  chemically synthesized
atgttgaataggagtgatga

SEQ ID NO: 355617 - DNA, 20 bp, Artificial Sequence
  chemically synthesized
gttgaataggagtgatgaga

SEQ ID NO: 355618 - DNA, 20 bp, Artificial Sequence
  chemically synthesized
ttgaataggagtgatgagag

SEQ ID NO: 355619 - DNA, 20 bp, Artificial Sequence
  chemically synthesized
tgaataggagtgatgagaga

SEQ ID NO: 355620 - DNA, 20 bp, Artificial Sequence
  chemically synthesized
agggaatttttgtcttgtgc

SEQ ID NO: 355621 - DNA, 20 bp, Artificial Sequence
  chemically synthesized
ctccctttaaaaactggcac

SEQ ID NO: 355622 - DNA, 20 bp, Artificial Sequence
  chemically synthesized
ttgtcttgtgccagttttta

SEQ ID NO: 355623 - DNA, 20 bp, Artificial Sequence
  chemically synthesized
gaagcactccctttaaaaac

SEQ ID NO: 355624 - DNA, 20 bp, Artificial Sequence
  chemically synthesized
tgtcttgtgccagtttttaa

SEQ ID NO: 355625 - DNA, 20 bp, Artificial Sequence
  chemically synthesized
gtcttgtgccagtttttaaa

SEQ ID NO: 355626 - DNA, 20 bp, Artificial Sequence
  chemically synthesized
cttgtgccagtttttaaagg

SEQ ID NO: 355627 - DNA, 20 bp, Artificial Sequence
  chemically synthesized
gtttttaaagggagtgcttc

SEQ ID NO: 355628 - DNA, 20 bp, Artificial Sequence
  chemically synthesized
actgaatgggcaaaagctgg

SEQ ID NO: 355629 - DNA, 20 bp, Artificial Sequence
  chemically synthesized
catactgaatgggcaaaagc

SEQ ID NO: 355630 - DNA, 20 bp, Artificial Sequence
  chemically synthesized
atatcatactgaatgggcaa

SEQ ID NO: 355631 - DNA, 20 bp, Artificial Sequence
  chemically synthesized
gcttccagcttttgcccatt

SEQ ID NO: 355632 - DNA, 20 bp, Artificial Sequence
  chemically synthesized
cagccaatatcatactgaat

SEQ ID NO: 355633 - DNA, 20 bp, Artificial Sequence
  chemically synthesized
acagccaatatcatactgaa

SEQ ID NO: 355634 - DNA, 20 bp, Artificial Sequence
  chemically synthesized
ttgcccattcagtatgatat

SEQ ID NO: 355635 - DNA, 20 bp, Artificial Sequence
  chemically synthesized
attcagtatgatattggctg

SEQ ID NO: 355636 - DNA, 20 bp, Artificial Sequence
  chemically synthesized
ttcagtatgatattggctgt

SEQ ID NO: 355637 - DNA, 20 bp, Artificial Sequence
  chemically synthesized
agctatttatgacataccca

SEQ ID NO: 355638 - DNA, 20 bp, Artificial Sequence
  chemically synthesized
ggctgtgggtatgtcataaa

SEQ ID NO: 355639 - DNA, 20 bp, Artificial Sequence
  chemically synthesized
tcataaatagctcttatttt

SEQ ID NO: 355640 - DNA, 20 bp, Artificial Sequence
  chemically synthesized
tggaatgtgtctcaaaataa

SEQ ID NO: 355641 - DNA, 20 bp, Artificial Sequence
  chemically synthesized
gatggaatgtgtctcaaaat

SEQ ID NO: 355642 - DNA, 20 bp, Artificial Sequence
  chemically synthesized
ttcaataaactaggtattga

SEQ ID NO: 355643 - DNA, 20 bp, Artificial Sequence
  chemically synthesized
agacacattccatcaatacc

SEQ ID NO: 355644 - DNA, 20 bp, Artificial Sequence
  chemically synthesized
ctaaaaattttcaataaact

SEQ ID NO: 355645 - DNA, 20 bp, Artificial Sequence
  chemically synthesized
gctaaaaattttcaataaac

SEQ ID NO: 355646 - DNA, 20 bp, Artificial Sequence
  chemically synthesized
cctagtttattgaaaatttt

SEQ ID NO: 355647 - DNA, 20 bp, Artificial Sequence
  chemically synthesized
tattgaaaatttttagcatg

SEQ ID NO: 355648 - DNA, 20 bp, Artificial Sequence
  chemically synthesized
attgaaaatttttagcatga

SEQ ID NO: 355649 - DNA, 20 bp, Artificial Sequence
  chemically synthesized
ttgaaaatttttagcatgaa

SEQ ID NO: 355650 - DNA, 20 bp, Artificial Sequence
  chemically synthesized
aaaatttttagcatgaaggg

SEQ ID NO: 355651 - DNA, 20 bp, Artificial Sequence
  chemically synthesized
aagggtagtgaattttatca

SEQ ID NO: 355652 - DNA, 20 bp, Artificial Sequence
  chemically synthesized
agggtagtgaattttatcaa

SEQ ID NO: 355653 - DNA, 20 bp, Artificial Sequence
  chemically synthesized
tatctcaatagatgcagaaa

SEQ ID NO: 355654 - DNA, 20 bp, Artificial Sequence
  chemically synthesized
ttatctcaatagatgcagaa

SEQ ID NO: 355655 - DNA, 20 bp, Artificial Sequence
  chemically synthesized
catgattatctcaatagatg

SEQ ID NO: 355656 - DNA, 20 bp, Artificial Sequence
  chemically synthesized
aggccttttctgcatctatt

SEQ ID NO: 355657 - DNA, 20 bp, Artificial Sequence
  chemically synthesized
aaaccacatgattatctcaa

SEQ ID NO: 355658 - DNA, 20 bp, Artificial Sequence
  chemically synthesized
catctattgagataatcatg

SEQ ID NO: 355659 - DNA, 20 bp, Artificial Sequence
  chemically synthesized
aatcatgtggtttttgtcat

SEQ ID NO: 355660 - DNA, 20 bp, Artificial Sequence
  chemically synthesized
aacgtaatccatcacataaa

SEQ ID NO: 355661 - DNA, 20 bp, Artificial Sequence
  chemically synthesized
cattggttctgtttatgtga

SEQ ID NO: 355662 - DNA, 20 bp, Artificial Sequence
  chemically synthesized
atgtgatggattacgtttgt

SEQ ID NO: 355663 - DNA, 20 bp, Artificial Sequence
  chemically synthesized
tgcaagattagtttaacata

SEQ ID NO: 355664 - DNA, 20 bp, Artificial Sequence
  chemically synthesized
tcatccctgggatgcaagat

SEQ ID NO: 355665 - DNA, 20 bp, Artificial Sequence
  chemically synthesized
gttaaactaatcttgcatcc

SEQ ID NO: 355666 - DNA, 20 bp, Artificial Sequence
  chemically synthesized
ttaaactaatcttgcatccc

SEQ ID NO: 355667 - DNA, 20 bp, Artificial Sequence
  chemically synthesized
tggcttcatccctgggatgc

SEQ ID NO: 355668 - DNA, 20 bp, Artificial Sequence
  chemically synthesized
taaactaatcttgcatccca

SEQ ID NO: 355669 - DNA, 20 bp, Artificial Sequence
  chemically synthesized
aatcttgcatcccagggatg

SEQ ID NO: 355670 - DNA, 20 bp, Artificial Sequence
  chemically synthesized
atcaagttggcttcatccct

SEQ ID NO: 355671 - DNA, 20 bp, Artificial Sequence
  chemically synthesized
gatcaagttggcttcatccc

SEQ ID NO: 355672 - DNA, 20 bp, Artificial Sequence
  chemically synthesized
gttatccaccatgatcaagt

SEQ ID NO: 355673 - DNA, 20 bp, Artificial Sequence
  chemically synthesized
ggatgaagccaacttgatca

SEQ ID NO: 355674 - DNA, 20 bp, Artificial Sequence
  chemically synthesized
aaaggttatccaccatgatc

SEQ ID NO: 355675 - DNA, 20 bp, Artificial Sequence
  chemically synthesized
tgaagccaacttgatcatgg

SEQ ID NO: 355676 - DNA, 20 bp, Artificial Sequence
  chemically synthesized
aatccagcagcacatcaaaa

SEQ ID NO: 355677 - DNA, 20 bp, Artificial Sequence
  chemically synthesized
gaatccagcagcacatcaaa

SEQ ID NO: 355678 - DNA, 20 bp, Artificial Sequence
  chemically synthesized
taacctttttgatgtgctgc

SEQ ID NO: 355679 - DNA, 20 bp, Artificial Sequence
  chemically synthesized
ttttgatgtgctgctggatt

SEQ ID NO: 355680 - DNA, 20 bp, Artificial Sequence
  chemically synthesized
tactggcaaaccgaatccag

SEQ ID NO: 355681 - DNA, 20 bp, Artificial Sequence
  chemically synthesized
aaatactggcaaaccgaatc

SEQ ID NO: 355682 - DNA, 20 bp, Artificial Sequence
  chemically synthesized
tgctgctggattcggtttgc

SEQ ID NO: 355683 - DNA, 20 bp, Artificial Sequence
  chemically synthesized
tgaaaggctcaataaaatac

SEQ ID NO: 355684 - DNA, 20 bp, Artificial Sequence
  chemically synthesized
cggtttgccagtattttatt

SEQ ID NO: 355685 - DNA, 20 bp, Artificial Sequence
  chemically synthesized
ctgatgaacatcaatgtgaa

SEQ ID NO: 355686 - DNA, 20 bp, Artificial Sequence
  chemically synthesized
cctgatgaacatcaatgtga

SEQ ID NO: 355687 - DNA, 20 bp, Artificial Sequence
  chemically synthesized
cctttcacattgatgttcat

SEQ ID NO: 355688 - DNA, 20 bp, Artificial Sequence
  chemically synthesized
ctttcacattgatgttcatc

SEQ ID NO: 355689 - DNA, 20 bp, Artificial Sequence
  chemically synthesized
tttcacattgatgttcatca

SEQ ID NO: 355690 - DNA, 20 bp, Artificial Sequence
  chemically synthesized
gacacaataaaaaaaatttc

SEQ ID NO: 355691 - DNA, 20 bp, Artificial Sequence
  chemically synthesized
agacacaataaaaaaaattt

SEQ ID NO: 355692 - DNA, 20 bp, Artificial Sequence
  chemically synthesized
tttttttattgtgtctctgc

SEQ ID NO: 355693 - DNA, 20 bp, Artificial Sequence
  chemically synthesized
ttttttattgtgtctctgcc

SEQ ID NO: 355694 - DNA, 20 bp, Artificial Sequence
  chemically synthesized
cctgataccaaaacctggca

SEQ ID NO: 355695 - DNA, 20 bp, Artificial Sequence
  chemically synthesized
atcctgataccaaaacctgg

SEQ ID NO: 355696 - DNA, 20 bp, Artificial Sequence
  chemically synthesized
attgtgtctctgccaggttt

SEQ ID NO: 355697 - DNA, 20 bp, Artificial Sequence
  chemically synthesized
atcatcctgataccaaaacc

SEQ ID NO: 355698 - DNA, 20 bp, Artificial Sequence
  chemically synthesized
tctctgccaggttttggtat

SEQ ID NO: 355699 - DNA, 20 bp, Artificial Sequence
  chemically synthesized
ctctgccaggttttggtatc

SEQ ID NO: 355700 - DNA, 20 bp, Artificial Sequence
  chemically synthesized
ttttggtatcaggatgatgt

SEQ ID NO: 355701 - DNA, 20 bp, Artificial Sequence
  chemically synthesized
cctccctaactcattttatg

SEQ ID NO: 355702 - DNA, 20 bp, Artificial Sequence
  chemically synthesized
tgatgttggcctcataaaat

SEQ ID NO: 355703 - DNA, 20 bp, Artificial Sequence
  chemically synthesized
tcctccctaactcattttat

SEQ ID NO: 355704 - DNA, 20 bp, Artificial Sequence
  chemically synthesized
gttggcctcataaaatgagt

SEQ ID NO: 355705 - DNA, 20 bp, Artificial Sequence
  chemically synthesized
ttggcctcataaaatgagtt

SEQ ID NO: 355706 - DNA, 20 bp, Artificial Sequence
  chemically synthesized
tggcctcataaaatgagtta

SEQ ID NO: 355707 - DNA, 20 bp, Artificial Sequence
  chemically synthesized
gcctcataaaatgagttagg

SEQ ID NO: 355708 - DNA, 20 bp, Artificial Sequence
  chemically synthesized
cctcataaaatgagttaggg

SEQ ID NO: 355709 - DNA, 20 bp, Artificial Sequence
  chemically synthesized
tcataaaatgagttagggag

SEQ ID NO: 355710 - DNA, 20 bp, Artificial Sequence
  chemically synthesized
ttccaaacaatagaaaaata

SEQ ID NO: 355711 - DNA, 20 bp, Artificial Sequence
  chemically synthesized
attccaaacaatagaaaaat

SEQ ID NO: 355712 - DNA, 20 bp, Artificial Sequence
  chemically synthesized
gtccttatttttctattgtt

SEQ ID NO: 355713 - DNA, 20 bp, Artificial Sequence
  chemically synthesized
tctgaaactattccaaacaa

SEQ ID NO: 355714 - DNA, 20 bp, Artificial Sequence
  chemically synthesized
tatttttctattgtttggaa

SEQ ID NO: 355715 - DNA, 20 bp, Artificial Sequence
  chemically synthesized
tctattgtttggaatagttt

SEQ ID NO: 355716 - DNA, 20 bp, Artificial Sequence
  chemically synthesized
attgtttggaatagtttcag

SEQ ID NO: 355717 - DNA, 20 bp, Artificial Sequence
  chemically synthesized
ttgtttggaatagtttcaga

SEQ ID NO: 355718 - DNA, 20 bp, Artificial Sequence
  chemically synthesized
tggaatagtttcagaaggaa

SEQ ID NO: 355719 - DNA, 20 bp, Artificial Sequence
  chemically synthesized
agtttcagaaggaatggtac

SEQ ID NO: 355720 - DNA, 20 bp, Artificial Sequence
  chemically synthesized
ccagaggtacaaagaggagc

SEQ ID NO: 355721 - DNA, 20 bp, Artificial Sequence
  chemically synthesized
tctaccagaggtacaaagag

SEQ ID NO: 355722 - DNA, 20 bp, Artificial Sequence
  chemically synthesized
attctaccagaggtacaaag

SEQ ID NO: 355723 - DNA, 20 bp, Artificial Sequence
  chemically synthesized
aattctaccagaggtacaaa

SEQ ID NO: 355724 - DNA, 20 bp, Artificial Sequence
  chemically synthesized
cgaattctaccagaggtaca

SEQ ID NO: 355725 - DNA, 20 bp, Artificial Sequence
  chemically synthesized
ctagctcctctttgtacctc

SEQ ID NO: 355726 - DNA, 20 bp, Artificial Sequence
  chemically synthesized
gctcctctttgtacctctgg

SEQ ID NO: 355727 - DNA, 20 bp, Artificial Sequence
  chemically synthesized
tcacagccgaattctaccag

SEQ ID NO: 355728 - DNA, 20 bp, Artificial Sequence
  chemically synthesized
ttcacagccgaattctacca

SEQ ID NO: 355729 - DNA, 20 bp, Artificial Sequence
  chemically synthesized
gattcacagccgaattctac

SEQ ID NO: 355730 - DNA, 20 bp, Artificial Sequence
  chemically synthesized
tttgtacctctggtagaatt

SEQ ID NO: 355731 - DNA, 20 bp, Artificial Sequence
  chemically synthesized
cccaggaccagacagattca

SEQ ID NO: 355732 - DNA, 20 bp, Artificial Sequence
  chemically synthesized
aattcggctgtgaatctgtc

SEQ ID NO: 355733 - DNA, 20 bp, Artificial Sequence
  chemically synthesized
aaaaaaagcccaggaccaga

SEQ ID NO: 355734 - DNA, 20 bp, Artificial Sequence
  chemically synthesized
gctgtgaatctgtctggtcc

SEQ ID NO: 355735 - DNA, 20 bp, Artificial Sequence
  chemically synthesized
ctgtgaatctgtctggtcct

SEQ ID NO: 355736 - DNA, 20 bp, Artificial Sequence
  chemically synthesized
aaccaaaaaaagcccaggac

SEQ ID NO: 355737 - DNA, 20 bp, Artificial Sequence
  chemically synthesized
ctacaaaccaaaaaaagccc

SEQ ID NO: 355738 - DNA, 20 bp, Artificial Sequence
  chemically synthesized
cctacaaaccaaaaaaagcc

SEQ ID NO: 355739 - DNA, 20 bp, Artificial Sequence
  chemically synthesized
gtctggtcctgggctttttt

SEQ ID NO: 355740 - DNA, 20 bp, Artificial Sequence
  chemically synthesized
aatagcctacaaaccaaaaa

SEQ ID NO: 355741 - DNA, 20 bp, Artificial Sequence
  chemically synthesized
cctgggctttttttggtttg

SEQ ID NO: 355742 - DNA, 20 bp, Artificial Sequence
  chemically synthesized
ctgggctttttttggtttgt

SEQ ID NO: 355743 - DNA, 20 bp, Artificial Sequence
  chemically synthesized
gaaattgaggcagtaattaa

SEQ ID NO: 355744 - DNA, 20 bp, Artificial Sequence
  chemically synthesized
aacaagttctgaaattgagg

SEQ ID NO: 355745 - DNA, 20 bp, Artificial Sequence
  chemically synthesized
attaattactgcctcaattt

SEQ ID NO: 355746 - DNA, 20 bp, Artificial Sequence
  chemically synthesized
aataacaagttctgaaattg

SEQ ID NO: 355747 - DNA, 20 bp, Artificial Sequence
  chemically synthesized
caataacaagttctgaaatt

SEQ ID NO: 355748 - DNA, 20 bp, Artificial Sequence
  chemically synthesized
tccctgaatagaacaataac

SEQ ID NO: 355749 - DNA, 20 bp, Artificial Sequence
  chemically synthesized
gaacttgttattgttctatt

SEQ ID NO: 355750 - DNA, 20 bp, Artificial Sequence
  chemically synthesized
aacttgttattgttctattc

SEQ ID NO: 355751 - DNA, 20 bp, Artificial Sequence
  chemically synthesized
acttgttattgttctattca

SEQ ID NO: 355752 - DNA, 20 bp, Artificial Sequence
  chemically synthesized
gaagaagtcaaatccctgaa

SEQ ID NO: 355753 - DNA, 20 bp, Artificial Sequence
  chemically synthesized
tcagggatttgacttcttcc

SEQ ID NO: 355754 - DNA, 20 bp, Artificial Sequence
  chemically synthesized
tccaagattaaaccaggaag

SEQ ID NO: 355755 - DNA, 20 bp, Artificial Sequence
  chemically synthesized
tcttccaagattaaaccagg

SEQ ID NO: 355756 - DNA, 20 bp, Artificial Sequence
  chemically synthesized
cactcttccaagattaaacc

SEQ ID NO: 355757 - DNA, 20 bp, Artificial Sequence
  chemically synthesized
acactcttccaagattaaac

SEQ ID NO: 355758 - DNA, 20 bp, Artificial Sequence
  chemically synthesized
acttcttcctggtttaatct

SEQ ID NO: 355759 - DNA, 20 bp, Artificial Sequence
  chemically synthesized
tcttcctggtttaatcttgg

SEQ ID NO: 355760 - DNA, 20 bp, Artificial Sequence
  chemically synthesized
ttcctggtttaatcttggaa

SEQ ID NO: 355761 - DNA, 20 bp, Artificial Sequence
  chemically synthesized
ctgtacatatacactcttcc

SEQ ID NO: 355762 - DNA, 20 bp, Artificial Sequence
  chemically synthesized
cttggaagagtgtatatgta

SEQ ID NO: 355763 - DNA, 20 bp, Artificial Sequence
  chemically synthesized
ttggaagagtgtatatgtac

SEQ ID NO: 355764 - DNA, 20 bp, Artificial Sequence
  chemically synthesized
aggaatttttccatttcttc

SEQ ID NO: 355765 - DNA, 20 bp, Artificial Sequence
  chemically synthesized
actagaaaatctagaagaaa

SEQ ID NO: 355766 - DNA, 20 bp, Artificial Sequence
  chemically synthesized
aaataaactagaaaatctag

SEQ ID NO: 355767 - DNA, 20 bp, Artificial Sequence
  chemically synthesized
tccatttcttctagattttc

SEQ ID NO: 355768 - DNA, 20 bp, Artificial Sequence
  chemically synthesized
cgcaaataaactagaaaatc

SEQ ID NO: 355769 - DNA, 20 bp, Artificial Sequence
  chemically synthesized
acatctccacgcaaataaac

SEQ ID NO: 355770 - DNA, 20 bp, Artificial Sequence
  chemically synthesized
gattttctagtttatttgcg

SEQ ID NO: 355771 - DNA, 20 bp, Artificial Sequence
  chemically synthesized
ttttctagtttatttgcgtg

SEQ ID NO: 355772 - DNA, 20 bp, Artificial Sequence
  chemically synthesized
tatttgcgtggagatgttta

SEQ ID NO: 355773 - DNA, 20 bp, Artificial Sequence
  chemically synthesized
atgtttatagtattctctga

SEQ ID NO: 355774 - DNA, 20 bp, Artificial Sequence
  chemically synthesized
tttatagtattctctgatgg

SEQ ID NO: 355775 - DNA, 20 bp, Artificial Sequence
  chemically synthesized
agaaatacaaactaccatca

SEQ ID NO: 355776 - DNA, 20 bp, Artificial Sequence
  chemically synthesized
acagaaatacaaactaccat

SEQ ID NO: 355777 - DNA, 20 bp, Artificial Sequence
  chemically synthesized
gatggtagtttgtatttctg

SEQ ID NO: 355778 - DNA, 20 bp, Artificial Sequence
  chemically synthesized
atggtagtttgtatttctgt

SEQ ID NO: 355779 - DNA, 20 bp, Artificial Sequence
  chemically synthesized
agtttgtatttctgtgggat

SEQ ID NO: 355780 - DNA, 20 bp, Artificial Sequence
  chemically synthesized
ggatatcaccactgatccca

SEQ ID NO: 355781 - DNA, 20 bp, Artificial Sequence
  chemically synthesized
ttgtatttctgtgggatcag

SEQ ID NO: 355782 - DNA, 20 bp, Artificial Sequence
  chemically synthesized
cacagtaaaaaatgataaag

SEQ ID NO: 355783 - DNA, 20 bp, Artificial Sequence
  chemically synthesized
acacagtaaaaaatgataaa

SEQ ID NO: 355784 - DNA, 20 bp, Artificial Sequence
  chemically synthesized
gacacagtaaaaaatgataa

SEQ ID NO: 355785 - DNA, 20 bp, Artificial Sequence
  chemically synthesized
agacacagtaaaaaatgata

SEQ ID NO: 355786 - DNA, 20 bp, Artificial Sequence
  chemically synthesized
agagaagaatcaaatagaca

SEQ ID NO: 355787 - DNA, 20 bp, Artificial Sequence
  chemically synthesized
gaaaagagagaagaatcaaa

SEQ ID NO: 355788 - DNA, 20 bp, Artificial Sequence
  chemically synthesized
taaaaaagaagaaaagagag

SEQ ID NO: 355789 - DNA, 20 bp, Artificial Sequence
  chemically synthesized
gactaaaaaagaagaaaaga

SEQ ID NO: 355790 - DNA, 20 bp, Artificial Sequence
  chemically synthesized
cagactaaaaaagaagaaaa

SEQ ID NO: 355791 - DNA, 20 bp, Artificial Sequence
  chemically synthesized
gccagactaaaaaagaagaa

SEQ ID NO: 355792 - DNA, 20 bp, Artificial Sequence
  chemically synthesized
ttctctcttttcttcttttt

SEQ ID NO: 355793 - DNA, 20 bp, Artificial Sequence
  chemically synthesized
ggctagccagactaaaaaag

SEQ ID NO: 355794 - DNA, 20 bp, Artificial Sequence
  chemically synthesized
gatggctagccagactaaaa

SEQ ID NO: 355795 - DNA, 20 bp, Artificial Sequence
  chemically synthesized
tcttttcttcttttttagtc

SEQ ID NO: 355796 - DNA, 20 bp, Artificial Sequence
  chemically synthesized
ttcttcttttttagtctggc

SEQ ID NO: 355797 - DNA, 20 bp, Artificial Sequence
  chemically synthesized
taacaaaatagatggctagc

SEQ ID NO: 355798 - DNA, 20 bp, Artificial Sequence
  chemically synthesized
agattaacaaaatagatggc

SEQ ID NO: 355799 - DNA, 20 bp, Artificial Sequence
  chemically synthesized
gaaaagattaacaaaataga

SEQ ID NO: 355800 - DNA, 20 bp, Artificial Sequence
  chemically synthesized
ttttgaaaagattaacaaaa

SEQ ID NO: 355801 - DNA, 20 bp, Artificial Sequence
  chemically synthesized
tcaggagctgtttttttgaa

SEQ ID NO: 355802 - DNA, 20 bp, Artificial Sequence
  chemically synthesized
tgttaatcttttcaaaaaaa

SEQ ID NO: 355803 - DNA, 20 bp, Artificial Sequence
  chemically synthesized
aaaaaaacagctcctgaatt

SEQ ID NO: 355804 - DNA, 20 bp, Artificial Sequence
  chemically synthesized
aaaaaaaaaactcaattcag

SEQ ID NO: 355805 - DNA, 20 bp, Artificial Sequence
  chemically synthesized
aaaaaaaaaaaactcaattc

SEQ ID NO: 355806 - DNA, 20 bp, Artificial Sequence
  chemically synthesized
taaaaaaaaaaaactcaatt

SEQ ID NO: 355807 - DNA, 20 bp, Artificial Sequence
  chemically synthesized
gaattgagtttttttttttt

SEQ ID NO: 355808 - DNA, 20 bp, Artificial Sequence
  chemically synthesized
aattgagtttttttttttta

SEQ ID NO: 355809 - DNA, 20 bp, Artificial Sequence
  chemically synthesized
attgagttttttttttttaa

SEQ ID NO: 355810 - DNA, 20 bp, Artificial Sequence
  chemically synthesized
gagcagaactgaaggagata

SEQ ID NO: 355811 - DNA, 20 bp, Artificial Sequence
  chemically synthesized
tttcgtgtctctatctcctt

SEQ ID NO: 355812 - DNA, 20 bp, Artificial Sequence
  chemically synthesized
aagagcagaactgaaggaga

SEQ ID NO: 355813 - DNA, 20 bp, Artificial Sequence
  chemically synthesized
aactaagagcagaactgaag

SEQ ID NO: 355814 - DNA, 20 bp, Artificial Sequence
  chemically synthesized
ataactaagagcagaactga

SEQ ID NO: 355815 - DNA, 20 bp, Artificial Sequence
  chemically synthesized
aataactaagagcagaactg

SEQ ID NO: 355816 - DNA, 20 bp, Artificial Sequence
  chemically synthesized
atctccttcagttctgctct

SEQ ID NO: 355817 - DNA, 20 bp, Artificial Sequence
  chemically synthesized
agaagacaaataactaagag

SEQ ID NO: 355818 - DNA, 20 bp, Artificial Sequence
  chemically synthesized
atcagaagacaaataactaa

SEQ ID NO: 355819 - DNA, 20 bp, Artificial Sequence
  chemically synthesized
ctatcagaagacaaataact

SEQ ID NO: 355820 - DNA, 20 bp, Artificial Sequence
  chemically synthesized
cttagttatttgtcttctga

SEQ ID NO: 355821 - DNA, 20 bp, Artificial Sequence
  chemically synthesized
acaaattcaaaagctatcag

SEQ ID NO: 355822 - DNA, 20 bp, Artificial Sequence
  chemically synthesized
caaacaaattcaaaagctat

SEQ ID NO: 355823 - DNA, 20 bp, Artificial Sequence
  chemically synthesized
gcaagagcaaacaaattcaa

SEQ ID NO: 355824 - DNA, 20 bp, Artificial Sequence
  chemically synthesized
taaatgaactagagcagcaa

SEQ ID NO: 355825 - DNA, 20 bp, Artificial Sequence
  chemically synthesized
tttgtttgctcttgctgctc

SEQ ID NO: 355826 - DNA, 20 bp, Artificial Sequence
  chemically synthesized
attaaatgaactagagcagc

SEQ ID NO: 355827 - DNA, 20 bp, Artificial Sequence
  chemically synthesized
cacaattaaatgaactagag

SEQ ID NO: 355828 - DNA, 20 bp, Artificial Sequence
  chemically synthesized
catcacaattaaatgaacta

SEQ ID NO: 355829 - DNA, 20 bp, Artificial Sequence
  chemically synthesized
aacatcacaattaaatgaac

SEQ ID NO: 355830 - DNA, 20 bp, Artificial Sequence
  chemically synthesized
agttcatttaattgtgatgt

SEQ ID NO: 355831 - DNA, 20 bp, Artificial Sequence
  chemically synthesized
gttcatttaattgtgatgtt

SEQ ID NO: 355832 - DNA, 20 bp, Artificial Sequence
  chemically synthesized
tgatgttaggatgtcgatta

SEQ ID NO: 355833 - DNA, 20 bp, Artificial Sequence
  chemically synthesized
gcccacaggagaaagtggga

SEQ ID NO: 355834 - DNA, 20 bp, Artificial Sequence
  chemically synthesized
aaatgcccacaggagaaagt

SEQ ID NO: 355835 - DNA, 20 bp, Artificial Sequence
  chemically synthesized
taaatgcccacaggagaaag

SEQ ID NO: 355836 - DNA, 20 bp, Artificial Sequence
  chemically synthesized
atctttcccactttctcctg

SEQ ID NO: 355837 - DNA, 20 bp, Artificial Sequence
  chemically synthesized
cactaaatgcccacaggaga

SEQ ID NO: 355838 - DNA, 20 bp, Artificial Sequence
  chemically synthesized
tctttcccactttctcctgt

SEQ ID NO: 355839 - DNA, 20 bp, Artificial Sequence
  chemically synthesized
atagcactaaatgcccacag

SEQ ID NO: 355840 - DNA, 20 bp, Artificial Sequence
  chemically synthesized
ttatagcactaaatgcccac

SEQ ID NO: 355841 - DNA, 20 bp, Artificial Sequence
  chemically synthesized
tttatagcactaaatgccca

SEQ ID NO: 355842 - DNA, 20 bp, Artificial Sequence
  chemically synthesized
cactttctcctgtgggcatt

SEQ ID NO: 355843 - DNA, 20 bp, Artificial Sequence
  chemically synthesized
gtttagaagagggaaattta

SEQ ID NO: 355844 - DNA, 20 bp, Artificial Sequence
  chemically synthesized
ctaaagaagtgtttagaaga

SEQ ID NO: 355845 - DNA, 20 bp, Artificial Sequence
  chemically synthesized
gctaaagaagtgtttagaag

SEQ ID NO: 355846 - DNA, 20 bp, Artificial Sequence
  chemically synthesized
agctaaagaagtgtttagaa

SEQ ID NO: 355847 - DNA, 20 bp, Artificial Sequence
  chemically synthesized
acagctaaagaagtgtttag

SEQ ID NO: 355848 - DNA, 20 bp, Artificial Sequence
  chemically synthesized
gacacagctaaagaagtgtt

SEQ ID NO: 355849 - DNA, 20 bp, Artificial Sequence
  chemically synthesized
ccctcttctaaacacttctt

SEQ ID NO: 355850 - DNA, 20 bp, Artificial Sequence
  chemically synthesized
tctgtgggacacagctaaag

SEQ ID NO: 355851 - DNA, 20 bp, Artificial Sequence
  chemically synthesized
gaatctgtgggacacagcta

SEQ ID NO: 355852 - DNA, 20 bp, Artificial Sequence
  chemically synthesized
acttctttagctgtgtccca

SEQ ID NO: 355853 - DNA, 20 bp, Artificial Sequence
  chemically synthesized
gtagcagaatctgtgggaca

SEQ ID NO: 355854 - DNA, 20 bp, Artificial Sequence
  chemically synthesized
cacaatgtagcagaatctgt

SEQ ID NO: 355855 - DNA, 20 bp, Artificial Sequence
  chemically synthesized
acacaatgtagcagaatctg

SEQ ID NO: 355856 - DNA, 20 bp, Artificial Sequence
  chemically synthesized
agaacaaacacacaatgtag

SEQ ID NO: 355857 - DNA, 20 bp, Artificial Sequence
  chemically synthesized
atgagaacaaacacacaatg

SEQ ID NO: 355858 - DNA, 20 bp, Artificial Sequence
  chemically synthesized
cattgtgtgtttgttctcat

SEQ ID NO: 355859 - DNA, 20 bp, Artificial Sequence
  chemically synthesized
ataagttctttgaaaccaat

SEQ ID NO: 355860 - DNA, 20 bp, Artificial Sequence
  chemically synthesized
gtttgttctcattggtttca

SEQ ID NO: 355861 - DNA, 20 bp, Artificial Sequence
  chemically synthesized
aaattaaggcagaaataaat

SEQ ID NO: 355862 - DNA, 20 bp, Artificial Sequence
  chemically synthesized
ggtaaataatgaaattaagg

SEQ ID NO: 355863 - DNA, 20 bp, Artificial Sequence
  chemically synthesized
ctgggtaaataatgaaatta

SEQ ID NO: 355864 - DNA, 20 bp, Artificial Sequence
  chemically synthesized
actgggtaaataatgaaatt

SEQ ID NO: 355865 - DNA, 20 bp, Artificial Sequence
  chemically synthesized
ccttaatttcattatttacc

SEQ ID NO: 355866 - DNA, 20 bp, Artificial Sequence
  chemically synthesized
taatttcattatttacccag

SEQ ID NO: 355867 - DNA, 20 bp, Artificial Sequence
  chemically synthesized
cctgctcctgggtgactact

SEQ ID NO: 355868 - DNA, 20 bp, Artificial Sequence
  chemically synthesized
acctgctcctgggtgactac

SEQ ID NO: 355869 - DNA, 20 bp, Artificial Sequence
  chemically synthesized
ttatttacccagtagtcacc

SEQ ID NO: 355870 - DNA, 20 bp, Artificial Sequence
  chemically synthesized
tatttacccagtagtcaccc

SEQ ID NO: 355871 - DNA, 20 bp, Artificial Sequence
  chemically synthesized
tttacccagtagtcacccag

SEQ ID NO: 355872 - DNA, 20 bp, Artificial Sequence
  chemically synthesized
acccagtagtcacccaggag

SEQ ID NO: 355873 - DNA, 20 bp, Artificial Sequence
  chemically synthesized
cccagtagtcacccaggagc

SEQ ID NO: 355874 - DNA, 20 bp, Artificial Sequence
  chemically synthesized
agctgaacaaacctgctcct

SEQ ID NO: 355875 - DNA, 20 bp, Artificial Sequence
  chemically synthesized
aagctgaacaaacctgctcc

SEQ ID NO: 355876 - DNA, 20 bp, Artificial Sequence
  chemically synthesized
cacccaggagcaggtttgtt

SEQ ID NO: 355877 - DNA, 20 bp, Artificial Sequence
  chemically synthesized
aggtttgttcagcttccatg

SEQ ID NO: 355878 - DNA, 20 bp, Artificial Sequence
  chemically synthesized
aaaagtgcacaactacatgg

SEQ ID NO: 355879 - DNA, 20 bp, Artificial Sequence
  chemically synthesized
ctcaaaagtgcacaactaca

SEQ ID NO: 355880 - DNA, 20 bp, Artificial Sequence
  chemically synthesized
ccatgtagttgtgcactttt

SEQ ID NO: 355881 - DNA, 20 bp, Artificial Sequence
  chemically synthesized
tgcgggattaagaaactcaa

SEQ ID NO: 355882 - DNA, 20 bp, Artificial Sequence
  chemically synthesized
tctaattagaatgcgggatt

SEQ ID NO: 355883 - DNA, 20 bp, Artificial Sequence
  chemically synthesized
gtgcaatctaattagaatgc

SEQ ID NO: 355884 - DNA, 20 bp, Artificial Sequence
  chemically synthesized
agtgcaatctaattagaatg

SEQ ID NO: 355885 - DNA, 20 bp, Artificial Sequence
  chemically synthesized
tcttaatcccgcattctaat

SEQ ID NO: 355886 - DNA, 20 bp, Artificial Sequence
  chemically synthesized
agatcacagtgcaatctaat

SEQ ID NO: 355887 - DNA, 20 bp, Artificial Sequence
  chemically synthesized
attagattgcactgtgatct

SEQ ID NO: 355888 - DNA, 20 bp, Artificial Sequence
  chemically synthesized
cataacagcctctcagatca

SEQ ID NO: 355889 - DNA, 20 bp, Artificial Sequence
  chemically synthesized
tagattgcactgtgatctga

SEQ ID NO: 355890 - DNA, 20 bp, Artificial Sequence
  chemically synthesized
agattgcactgtgatctgag

SEQ ID NO: 355891 - DNA, 20 bp, Artificial Sequence
  chemically synthesized
tgaaaatcataacagcctct

SEQ ID NO: 355892 - DNA, 20 bp, Artificial Sequence
  chemically synthesized
caaaagaatgaaaatcataa

SEQ ID NO: 355893 - DNA, 20 bp, Artificial Sequence
  chemically synthesized
atactcctcagcaaatgcaa

SEQ ID NO: 355894 - DNA, 20 bp, Artificial Sequence
  chemically synthesized
ttcattcttttgcatttgct

SEQ ID NO: 355895 - DNA, 20 bp, Artificial Sequence
  chemically synthesized
tcattcttttgcatttgctg

SEQ ID NO: 355896 - DNA, 20 bp, Artificial Sequence
  chemically synthesized
attcttttgcatttgctgag

SEQ ID NO: 355897 - DNA, 20 bp, Artificial Sequence
  chemically synthesized
attggaagtaaaatactcct

SEQ ID NO: 355898 - DNA, 20 bp, Artificial Sequence
  chemically synthesized
aaaattgacgacataattgg

SEQ ID NO: 355899 - DNA, 20 bp, Artificial Sequence
  chemically synthesized
tctaaaattgacgacataat

SEQ ID NO: 355900 - DNA, 20 bp, Artificial Sequence
  chemically synthesized
tccaattatgtcgtcaattt

SEQ ID NO: 355901 - DNA, 20 bp, Artificial Sequence
  chemically synthesized
tatgtcgtcaattttagaat

SEQ ID NO: 355902 - DNA, 20 bp, Artificial Sequence
  chemically synthesized
attttagaataagtgcaatg

SEQ ID NO: 355903 - DNA, 20 bp, Artificial Sequence
  chemically synthesized
aataagtgcaatgtggtgct

SEQ ID NO: 355904 - DNA, 20 bp, Artificial Sequence
  chemically synthesized
aagtgcaatgtggtgctgag

SEQ ID NO: 355905 - DNA, 20 bp, Artificial Sequence
  chemically synthesized
aacagaatatacattcttct

SEQ ID NO: 355906 - DNA, 20 bp, Artificial Sequence
  chemically synthesized
gaatgtatattctgttgatt

SEQ ID NO: 355907 - DNA, 20 bp, Artificial Sequence
  chemically synthesized
aatgtatattctgttgattt

SEQ ID NO: 355908 - DNA, 20 bp, Artificial Sequence
  chemically synthesized
aactctccaccccaaatcaa

SEQ ID NO: 355909 - DNA, 20 bp, Artificial Sequence
  chemically synthesized
atgtatattctgttgatttg

SEQ ID NO: 355910 - DNA, 20 bp, Artificial Sequence
  chemically synthesized
tatattctgttgatttgggg

SEQ ID NO: 355911 - DNA, 20 bp, Artificial Sequence
  chemically synthesized
tattctgttgatttggggtg

SEQ ID NO: 355912 - DNA, 20 bp, Artificial Sequence
  chemically synthesized
ttctgttgatttggggtgga

SEQ ID NO: 355913 - DNA, 20 bp, Artificial Sequence
  chemically synthesized
atttggggtggagagttctg

SEQ ID NO: 355914 - DNA, 20 bp, Artificial Sequence
  chemically synthesized
gcagacctaatagacatcta

SEQ ID NO: 355915 - DNA, 20 bp, Artificial Sequence
  chemically synthesized
agagttctgtagatgtctat

SEQ ID NO: 355916 - DNA, 20 bp, Artificial Sequence
  chemically synthesized
gagttctgtagatgtctatt

SEQ ID NO: 355917 - DNA, 20 bp, Artificial Sequence
  chemically synthesized
tctggaccaagcagacctaa

SEQ ID NO: 355918 - DNA, 20 bp, Artificial Sequence
  chemically synthesized
agatgtctattaggtctgct

SEQ ID NO: 355919 - DNA, 20 bp, Artificial Sequence
  chemically synthesized
tctattaggtctgcttggtc

SEQ ID NO: 355920 - DNA, 20 bp, Artificial Sequence
  chemically synthesized
gagctcagctctggaccaag

SEQ ID NO: 355921 - DNA, 20 bp, Artificial Sequence
  chemically synthesized
tattaggtctgcttggtcca

SEQ ID NO: 355922 - DNA, 20 bp, Artificial Sequence
  chemically synthesized
cttgagctcagctctggacc

SEQ ID NO: 355923 - DNA, 20 bp, Artificial Sequence
  chemically synthesized
ggtctgcttggtccagagct

SEQ ID NO: 355924 - DNA, 20 bp, Artificial Sequence
  chemically synthesized
tcagtacttgagctcagctc

SEQ ID NO: 355925 - DNA, 20 bp, Artificial Sequence
  chemically synthesized
cttggtccagagctgagctc

SEQ ID NO: 355926 - DNA, 20 bp, Artificial Sequence
  chemically synthesized
ggatattcagtacttgagct

SEQ ID NO: 355927 - DNA, 20 bp, Artificial Sequence
  chemically synthesized
aaaaaggatattcagtactt

SEQ ID NO: 355928 - DNA, 20 bp, Artificial Sequence
  chemically synthesized
agaaaattaaaaaggatatt

SEQ ID NO: 355929 - DNA, 20 bp, Artificial Sequence
  chemically synthesized
aacgagacagaaaattaaaa

SEQ ID NO: 355930 - DNA, 20 bp, Artificial Sequence
  chemically synthesized
caacgagacagaaaattaaa

SEQ ID NO: 355931 - DNA, 20 bp, Artificial Sequence
  chemically synthesized
tattagacagatcaacgaga

SEQ ID NO: 355932 - DNA, 20 bp, Artificial Sequence
  chemically synthesized
tcaatattagacagatcaac

SEQ ID NO: 355933 - DNA, 20 bp, Artificial Sequence
  chemically synthesized
accccactgtcaatattaga

SEQ ID NO: 355934 - DNA, 20 bp, Artificial Sequence
  chemically synthesized
gttgatctgtctaatattga

SEQ ID NO: 355935 - DNA, 20 bp, Artificial Sequence
  chemically synthesized
acacaccccactgtcaatat

SEQ ID NO: 355936 - DNA, 20 bp, Artificial Sequence
  chemically synthesized
gatctgtctaatattgacag

SEQ ID NO: 355937 - DNA, 20 bp, Artificial Sequence
  chemically synthesized
atctgtctaatattgacagt

SEQ ID NO: 355938 - DNA, 20 bp, Artificial Sequence
  chemically synthesized
tctgtctaatattgacagtg

SEQ ID NO: 355939 - DNA, 20 bp, Artificial Sequence
  chemically synthesized
attgacagtggggtgtgttc

SEQ ID NO: 355940 - DNA, 20 bp, Artificial Sequence
  chemically synthesized
ctcccacacaataatagtgg

SEQ ID NO: 355941 - DNA, 20 bp, Artificial Sequence
  chemically synthesized
gactcccacacaataatagt

SEQ ID NO: 355942 - DNA, 20 bp, Artificial Sequence
  chemically synthesized
agactcccacacaataatag

SEQ ID NO: 355943 - DNA, 20 bp, Artificial Sequence
  chemically synthesized
attagactcccacacaataa

SEQ ID NO: 355944 - DNA, 20 bp, Artificial Sequence
  chemically synthesized
agtctcccactattattgtg

SEQ ID NO: 355945 - DNA, 20 bp, Artificial Sequence
  chemically synthesized
gtctcccactattattgtgt

SEQ ID NO: 355946 - DNA, 20 bp, Artificial Sequence
  chemically synthesized
ctcccactattattgtgtgg

SEQ ID NO: 355947 - DNA, 20 bp, Artificial Sequence
  chemically synthesized
ttgtgtgggagtctaatacc

SEQ ID NO: 355948 - DNA, 20 bp, Artificial Sequence
  chemically synthesized
ttccaggcaccactgggtat

SEQ ID NO: 355949 - DNA, 20 bp, Artificial Sequence
  chemically synthesized
tgtgggagtctaatacccag

SEQ ID NO: 355950 - DNA, 20 bp, Artificial Sequence
  chemically synthesized
ctggcgttccaggcaccact

SEQ ID NO: 355951 - DNA, 20 bp, Artificial Sequence
  chemically synthesized
gctggcgttccaggcaccac

SEQ ID NO: 355952 - DNA, 20 bp, Artificial Sequence
  chemically synthesized
gtctaatacccagtggtgcc

SEQ ID NO: 355953 - DNA, 20 bp, Artificial Sequence
  chemically synthesized
cccagtggtgcctggaacgc

SEQ ID NO: 355954 - DNA, 20 bp, Artificial Sequence
  chemically synthesized
ttctgtctcgctggcgttcc

SEQ ID NO: 355955 - DNA, 20 bp, Artificial Sequence
  chemically synthesized
gttctgtctcgctggcgttc

SEQ ID NO: 355956 - DNA, 20 bp, Artificial Sequence
  chemically synthesized
gtggtgcctggaacgccagc

SEQ ID NO: 355957 - DNA, 20 bp, Artificial Sequence
  chemically synthesized
tgcctggaacgccagcgaga

SEQ ID NO: 355958 - DNA, 20 bp, Artificial Sequence
  chemically synthesized
agtgaacggttctgtctcgc

SEQ ID NO: 355959 - DNA, 20 bp, Artificial Sequence
  chemically synthesized
cccctttccaggggagtgaa

SEQ ID NO: 355960 - DNA, 20 bp, Artificial Sequence
  chemically synthesized
gacagaaccgttcactcccc

SEQ ID NO: 355961 - DNA, 20 bp, Artificial Sequence
  chemically synthesized
gaaccgttcactcccctgga

SEQ ID NO: 355962 - DNA, 20 bp, Artificial Sequence
  chemically synthesized
tttcagccccctttccaggg

SEQ ID NO: 355963 - DNA, 20 bp, Artificial Sequence
  chemically synthesized
aaccgttcactcccctggaa

SEQ ID NO: 355964 - DNA, 20 bp, Artificial Sequence
  chemically synthesized
accgttcactcccctggaaa

SEQ ID NO: 355965 - DNA, 20 bp, Artificial Sequence
  chemically synthesized
ggtttcagccccctttccag

SEQ ID NO: 355966 - DNA, 20 bp, Artificial Sequence
  chemically synthesized
ccgttcactcccctggaaag

SEQ ID NO: 355967 - DNA, 20 bp, Artificial Sequence
  chemically synthesized
tggtttcagccccctttcca

SEQ ID NO: 355968 - DNA, 20 bp, Artificial Sequence
  chemically synthesized
cgttcactcccctggaaagg

SEQ ID NO: 355969 - DNA, 20 bp, Artificial Sequence
  chemically synthesized
ctggtttcagccccctttcc

SEQ ID NO: 355970 - DNA, 20 bp, Artificial Sequence
  chemically synthesized
cctggtttcagccccctttc

SEQ ID NO: 355971 - DNA, 20 bp, Artificial Sequence
  chemically synthesized
cctggaaagggggctgaaac

SEQ ID NO: 355972 - DNA, 20 bp, Artificial Sequence
  chemically synthesized
ctggaaagggggctgaaacc

SEQ ID NO: 355973 - DNA, 20 bp, Artificial Sequence
  chemically synthesized
tggaaagggggctgaaacca

SEQ ID NO: 355974 - DNA, 20 bp, Artificial Sequence
  chemically synthesized
accacttggctccctggttt

SEQ ID NO: 355975 - DNA, 20 bp, Artificial Sequence
  chemically synthesized
gaaagggggctgaaaccagg

SEQ ID NO: 355976 - DNA, 20 bp, Artificial Sequence
  chemically synthesized
ggggctgaaaccagggagcc

SEQ ID NO: 355977 - DNA, 20 bp, Artificial Sequence
  chemically synthesized
aacttgaccacttggctccc

SEQ ID NO: 355978 - DNA, 20 bp, Artificial Sequence
  chemically synthesized
gctgaaaccagggagccaag

SEQ ID NO: 355979 - DNA, 20 bp, Artificial Sequence
  chemically synthesized
aaccagggagccaagtggtc

SEQ ID NO: 355980 - DNA, 20 bp, Artificial Sequence
  chemically synthesized
atctgctgaacttgaccact

SEQ ID NO: 355981 - DNA, 20 bp, Artificial Sequence
  chemically synthesized
gggagccaagtggtcaagtt

SEQ ID NO: 355982 - DNA, 20 bp, Artificial Sequence
  chemically synthesized
agccaagtggtcaagttcag

SEQ ID NO: 355983 - DNA, 20 bp, Artificial Sequence
  chemically synthesized
ttcagcagatccaacgccca

SEQ ID NO: 355984 - DNA, 20 bp, Artificial Sequence
  chemically synthesized
ttgctgggctccgtgggcgt

SEQ ID NO: 355985 - DNA, 20 bp, Artificial Sequence
  chemically synthesized
cagcagatccaacgcccacg

SEQ ID NO: 355986 - DNA, 20 bp, Artificial Sequence
  chemically synthesized
ctcagcttgctgggctccgt

SEQ ID NO: 355987 - DNA, 20 bp, Artificial Sequence
  chemically synthesized
gatccaacgcccacggagcc

SEQ ID NO: 355988 - DNA, 20 bp, Artificial Sequence
  chemically synthesized
tctcagcttgctgggctccg

SEQ ID NO: 355989 - DNA, 20 bp, Artificial Sequence
  chemically synthesized
caacgcccacggagcccagc

SEQ ID NO: 355990 - DNA, 20 bp, Artificial Sequence
  chemically synthesized
ccagtggatctcagcttgct

SEQ ID NO: 355991 - DNA, 20 bp, Artificial Sequence
  chemically synthesized
cccacggagcccagcaagct

SEQ ID NO: 355992 - DNA, 20 bp, Artificial Sequence
  chemically synthesized
gccagtggatctcagcttgc

SEQ ID NO: 355993 - DNA, 20 bp, Artificial Sequence
  chemically synthesized
aattacaagccagtggatct

SEQ ID NO: 355994 - DNA, 20 bp, Artificial Sequence
  chemically synthesized
cccagcaagctgagatccac

SEQ ID NO: 355995 - DNA, 20 bp, Artificial Sequence
  chemically synthesized
cagcgagaattacaagccag

SEQ ID NO: 355996 - DNA, 20 bp, Artificial Sequence
  chemically synthesized
tggcagcgagaattacaagc

SEQ ID NO: 355997 - DNA, 20 bp, Artificial Sequence
  chemically synthesized
gtgctggcagcgagaattac

SEQ ID NO: 355998 - DNA, 20 bp, Artificial Sequence
  chemically synthesized
tggcttgtaattctcgctgc

SEQ ID NO: 355999 - DNA, 20 bp, Artificial Sequence
  chemically synthesized
cagactgctgtgctggcagc

SEQ ID NO: 356000 - DNA, 20 bp, Artificial Sequence
  chemically synthesized
tgtaattctcgctgccagca

SEQ ID NO: 356001 - DNA, 20 bp, Artificial Sequence
  chemically synthesized
acttcagactgctgtgctgg

SEQ ID NO: 356002 - DNA, 20 bp, Artificial Sequence
  chemically synthesized
aattctcgctgccagcacag

SEQ ID NO: 356003 - DNA, 20 bp, Artificial Sequence
  chemically synthesized
tccacttcagactgctgtgc

SEQ ID NO: 356004 - DNA, 20 bp, Artificial Sequence
  chemically synthesized
gctgccagcacagcagtctg

SEQ ID NO: 356005 - DNA, 20 bp, Artificial Sequence
  chemically synthesized
gccagcacagcagtctgaag

SEQ ID NO: 356006 - DNA, 20 bp, Artificial Sequence
  chemically synthesized
ctggagcctcaggtccactt

SEQ ID NO: 356007 - DNA, 20 bp, Artificial Sequence
  chemically synthesized
cagcagtctgaagtggacct

SEQ ID NO: 356008 - DNA, 20 bp, Artificial Sequence
  chemically synthesized
agcagtctgaagtggacctg

SEQ ID NO: 356009 - DNA, 20 bp, Artificial Sequence
  chemically synthesized
ctgaagtggacctgaggctc

SEQ ID NO: 356010 - DNA, 20 bp, Artificial Sequence
  chemically synthesized
ctccaccaagctggagcctc

SEQ ID NO: 356011 - DNA, 20 bp, Artificial Sequence
  chemically synthesized
cctccaccaagctggagcct

SEQ ID NO: 356012 - DNA, 20 bp, Artificial Sequence
  chemically synthesized
gtggacctgaggctccagct

SEQ ID NO: 356013 - DNA, 20 bp, Artificial Sequence
  chemically synthesized
cccctccctccaccaagctg

SEQ ID NO: 356014 - DNA, 20 bp, Artificial Sequence
  chemically synthesized
gacctgaggctccagcttgg

SEQ ID NO: 356015 - DNA, 20 bp, Artificial Sequence
  chemically synthesized
cgcccctccctccaccaagc

SEQ ID NO: 356016 - DNA, 20 bp, Artificial Sequence
  chemically synthesized
cctgaggctccagcttggtg

SEQ ID NO: 356017 - DNA, 20 bp, Artificial Sequence
  chemically synthesized
ctgaggctccagcttggtgg

SEQ ID NO: 356018 - DNA, 20 bp, Artificial Sequence
  chemically synthesized
tgaggctccagcttggtgga

SEQ ID NO: 356019 - DNA, 20 bp, Artificial Sequence
  chemically synthesized
cggacgcccctccctccacc

SEQ ID NO: 356020 - DNA, 20 bp, Artificial Sequence
  chemically synthesized
aggctccagcttggtggagg

SEQ ID NO: 356021 - DNA, 20 bp, Artificial Sequence
  chemically synthesized
ggctccagcttggtggaggg

SEQ ID NO: 356022 - DNA, 20 bp, Artificial Sequence
  chemically synthesized
gctccagcttggtggaggga

SEQ ID NO: 356023 - DNA, 20 bp, Artificial Sequence
  chemically synthesized
ctccagcttggtggagggag

SEQ ID NO: 356024 - DNA, 20 bp, Artificial Sequence
  chemically synthesized
tactcaagcctcagtaatgg

SEQ ID NO: 356025 - DNA, 20 bp, Artificial Sequence
  chemically synthesized
gaggggcgtccgccattact

SEQ ID NO: 356026 - DNA, 20 bp, Artificial Sequence
  chemically synthesized
aggggcgtccgccattactg

SEQ ID NO: 356027 - DNA, 20 bp, Artificial Sequence
  chemically synthesized
gcctactcaagcctcagtaa

SEQ ID NO: 356028 - DNA, 20 bp, Artificial Sequence
  chemically synthesized
gtccgccattactgaggctt

SEQ ID NO: 356029 - DNA, 20 bp, Artificial Sequence
  chemically synthesized
aaaaccgcctactcaagcct

SEQ ID NO: 356030 - DNA, 20 bp, Artificial Sequence
  chemically synthesized
cgccattactgaggcttgag

SEQ ID NO: 356031 - DNA, 20 bp, Artificial Sequence
  chemically synthesized
gccattactgaggcttgagt

SEQ ID NO: 356032 - DNA, 20 bp, Artificial Sequence
  chemically synthesized
attactgaggcttgagtagg

SEQ ID NO: 356033 - DNA, 20 bp, Artificial Sequence
  chemically synthesized
tgagggaaaaccgcctactc

SEQ ID NO: 356034 - DNA, 20 bp, Artificial Sequence
  chemically synthesized
gagtaggcggttttccctca

SEQ ID NO: 356035 - DNA, 20 bp, Artificial Sequence
  chemically synthesized
cgactttgtttacactgtga

SEQ ID NO: 356036 - DNA, 20 bp, Artificial Sequence
  chemically synthesized
gcgactttgtttacactgtg

SEQ ID NO: 356037 - DNA, 20 bp, Artificial Sequence
  chemically synthesized
agcgactttgtttacactgt

SEQ ID NO: 356038 - DNA, 20 bp, Artificial Sequence
  chemically synthesized
tttccctcacagtgtaaaca

SEQ ID NO: 356039 - DNA, 20 bp, Artificial Sequence
  chemically synthesized
cacagtgtaaacaaagtcgc

SEQ ID NO: 356040 - DNA, 20 bp, Artificial Sequence
  chemically synthesized
acagtgtaaacaaagtcgct

SEQ ID NO: 356041 - DNA, 20 bp, Artificial Sequence
  chemically synthesized
gtgtaaacaaagtcgctggg

SEQ ID NO: 356042 - DNA, 20 bp, Artificial Sequence
  chemically synthesized
tctgcccagtttgaacttcc

SEQ ID NO: 356043 - DNA, 20 bp, Artificial Sequence
  chemically synthesized
agtcgctgggaagttcaaac

SEQ ID NO: 356044 - DNA, 20 bp, Artificial Sequence
  chemically synthesized
gtcgctgggaagttcaaact

SEQ ID NO: 356045 - DNA, 20 bp, Artificial Sequence
  chemically synthesized
gctgggaagttcaaactggg

SEQ ID NO: 356046 - DNA, 20 bp, Artificial Sequence
  chemically synthesized
tgggaagttcaaactgggca

SEQ ID NO: 356047 - DNA, 20 bp, Artificial Sequence
  chemically synthesized
gagctacagtgggctctgcc

SEQ ID NO: 356048 - DNA, 20 bp, Artificial Sequence
  chemically synthesized
aaactgggcagagcccactg

SEQ ID NO: 356049 - DNA, 20 bp, Artificial Sequence
  chemically synthesized
tggctttgctgagctacagt

SEQ ID NO: 356050 - DNA, 20 bp, Artificial Sequence
  chemically synthesized
gtggctttgctgagctacag

SEQ ID NO: 356051 - DNA, 20 bp, Artificial Sequence
  chemically synthesized
gggcagagcccactgtagct

SEQ ID NO: 356052 - DNA, 20 bp, Artificial Sequence
  chemically synthesized
acagtggctttgctgagcta

SEQ ID NO: 356053 - DNA, 20 bp, Artificial Sequence
  chemically synthesized
gagcccactgtagctcagca

SEQ ID NO: 356054 - DNA, 20 bp, Artificial Sequence
  chemically synthesized
ctggctacagtggctttgct

SEQ ID NO: 356055 - DNA, 20 bp, Artificial Sequence
  chemically synthesized
gtagctcagcaaagccactg

SEQ ID NO: 356056 - DNA, 20 bp, Artificial Sequence
  chemically synthesized
ctcagcaaagccactgtagc

SEQ ID NO: 356057 - DNA, 20 bp, Artificial Sequence
  chemically synthesized
gagaggcagtctggctacag

SEQ ID NO: 356058 - DNA, 20 bp, Artificial Sequence
  chemically synthesized
ctagagaggcagtctggcta

SEQ ID NO: 356059 - DNA, 20 bp, Artificial Sequence
  chemically synthesized
aagaatctagagaggcagtc

SEQ ID NO: 356060 - DNA, 20 bp, Artificial Sequence
  chemically synthesized
ctgtagccagactgcctctc

SEQ ID NO: 356061 - DNA, 20 bp, Artificial Sequence
  chemically synthesized
agaggaagaatctagagagg

SEQ ID NO: 356062 - DNA, 20 bp, Artificial Sequence
  chemically synthesized
cagagaggaagaatctagag

SEQ ID NO: 356063 - DNA, 20 bp, Artificial Sequence
  chemically synthesized
ccagagaggaagaatctaga

SEQ ID NO: 356064 - DNA, 20 bp, Artificial Sequence
  chemically synthesized
gcccagagaggaagaatcta

SEQ ID NO: 356065 - DNA, 20 bp, Artificial Sequence
  chemically synthesized
ctgcccagagaggaagaatc

SEQ ID NO: 356066 - DNA, 20 bp, Artificial Sequence
  chemically synthesized
ctctctagattcttcctctc

SEQ ID NO: 356067 - DNA, 20 bp, Artificial Sequence
  chemically synthesized
tctctagattcttcctctct

SEQ ID NO: 356068 - DNA, 20 bp, Artificial Sequence
  chemically synthesized
agatgccctgcccagagagg

SEQ ID NO: 356069 - DNA, 20 bp, Artificial Sequence
  chemically synthesized
ctagattcttcctctctggg

SEQ ID NO: 356070 - DNA, 20 bp, Artificial Sequence
  chemically synthesized
cagagatgccctgcccagag

SEQ ID NO: 356071 - DNA, 20 bp, Artificial Sequence
  chemically synthesized
tagattcttcctctctgggc

SEQ ID NO: 356072 - DNA, 20 bp, Artificial Sequence
  chemically synthesized
tcagagatgccctgcccaga

SEQ ID NO: 356073 - DNA, 20 bp, Artificial Sequence
  chemically synthesized
agattcttcctctctgggca

SEQ ID NO: 356074 - DNA, 20 bp, Artificial Sequence
  chemically synthesized
tttcagagatgccctgccca

SEQ ID NO: 356075 - DNA, 20 bp, Artificial Sequence
  chemically synthesized
tctttcagagatgccctgcc

SEQ ID NO: 356076 - DNA, 20 bp, Artificial Sequence
  chemically synthesized
tctgggcagggcatctctga

SEQ ID NO: 356077 - DNA, 20 bp, Artificial Sequence
  chemically synthesized
ggcagggcatctctgaaaga

SEQ ID NO: 356078 - DNA, 20 bp, Artificial Sequence
  chemically synthesized
gggctgctgcctttctttca

SEQ ID NO: 356079 - DNA, 20 bp, Artificial Sequence
  chemically synthesized
gcagggcatctctgaaagaa

SEQ ID NO: 356080 - DNA, 20 bp, Artificial Sequence
  chemically synthesized
tggggctgctgcctttcttt

SEQ ID NO: 356081 - DNA, 20 bp, Artificial Sequence
  chemically synthesized
gggcatctctgaaagaaagg

SEQ ID NO: 356082 - DNA, 20 bp, Artificial Sequence
  chemically synthesized
catctctgaaagaaaggcag

SEQ ID NO: 356083 - DNA, 20 bp, Artificial Sequence
  chemically synthesized
tgaaagaaaggcagcagccc

SEQ ID NO: 356084 - DNA, 20 bp, Artificial Sequence
  chemically synthesized
agaaaggcagcagccccagt

SEQ ID NO: 356085 - DNA, 20 bp, Artificial Sequence
  chemically synthesized
aaggcagcagccccagtcag

SEQ ID NO: 356086 - DNA, 20 bp, Artificial Sequence
  chemically synthesized
tatctgtaagccgctgactg

SEQ ID NO: 356087 - DNA, 20 bp, Artificial Sequence
  chemically synthesized
ttatctgtaagccgctgact

SEQ ID NO: 356088 - DNA, 20 bp, Artificial Sequence
  chemically synthesized
tttatctgtaagccgctgac

SEQ ID NO: 356089 - DNA, 20 bp, Artificial Sequence
  chemically synthesized
cagccccagtcagcggctta

SEQ ID NO: 356090 - DNA, 20 bp, Artificial Sequence
  chemically synthesized
gagatgggagttttatctgt

SEQ ID NO: 356091 - DNA, 20 bp, Artificial Sequence
  chemically synthesized
gctctgtctcagggagatgg

SEQ ID NO: 356092 - DNA, 20 bp, Artificial Sequence
  chemically synthesized
gtgctctgtctcagggagat

SEQ ID NO: 356093 - DNA, 20 bp, Artificial Sequence
  chemically synthesized
gataaaactcccatctccct

SEQ ID NO: 356094 - DNA, 20 bp, Artificial Sequence
  chemically synthesized
cgtgctctgtctcagggaga

SEQ ID NO: 356095 - DNA, 20 bp, Artificial Sequence
  chemically synthesized
aaactcccatctccctgaga

SEQ ID NO: 356096 - DNA, 20 bp, Artificial Sequence
  chemically synthesized
ctcacgtgctctgtctcagg

SEQ ID NO: 356097 - DNA, 20 bp, Artificial Sequence
  chemically synthesized
actcccatctccctgagaca

SEQ ID NO: 356098 - DNA, 20 bp, Artificial Sequence
  chemically synthesized
ccctcacgtgctctgtctca

SEQ ID NO: 356099 - DNA, 20 bp, Artificial Sequence
  chemically synthesized
tccctcacgtgctctgtctc

SEQ ID NO: 356100 - DNA, 20 bp, Artificial Sequence
  chemically synthesized
ttccctcacgtgctctgtct

SEQ ID NO: 356101 - DNA, 20 bp, Artificial Sequence
  chemically synthesized
ctccctgagacagagcacgt

SEQ ID NO: 356102 - DNA, 20 bp, Artificial Sequence
  chemically synthesized
tccctgagacagagcacgtg

SEQ ID NO: 356103 - DNA, 20 bp, Artificial Sequence
  chemically synthesized
ccctgagacagagcacgtga

SEQ ID NO: 356104 - DNA, 20 bp, Artificial Sequence
  chemically synthesized
tgagacagagcacgtgaggg

SEQ ID NO: 356105 - DNA, 20 bp, Artificial Sequence
  chemically synthesized
gagacagagcacgtgaggga

SEQ ID NO: 356106 - DNA, 20 bp, Artificial Sequence
  chemically synthesized
agacagagcacgtgagggaa

SEQ ID NO: 356107 - DNA, 20 bp, Artificial Sequence
  chemically synthesized
gacagagcacgtgagggaag

SEQ ID NO: 356108 - DNA, 20 bp, Artificial Sequence
  chemically synthesized
agagcacgtgagggaagggg

SEQ ID NO: 356109 - DNA, 20 bp, Artificial Sequence
  chemically synthesized
cgtgagggaaggggcagctg

SEQ ID NO: 356110 - DNA, 20 bp, Artificial Sequence
  chemically synthesized
gtgagggaaggggcagctgt

SEQ ID NO: 356111 - DNA, 20 bp, Artificial Sequence
  chemically synthesized
ggaaggggcagctgtgggtg

SEQ ID NO: 356112 - DNA, 20 bp, Artificial Sequence
  chemically synthesized
gtctgctgatgctgcaccca

SEQ ID NO: 356113 - DNA, 20 bp, Artificial Sequence
  chemically synthesized
ggcagctgtgggtgcagcat

SEQ ID NO: 356114 - DNA, 20 bp, Artificial Sequence
  chemically synthesized
agctgtgggtgcagcatcag

SEQ ID NO: 356115 - DNA, 20 bp, Artificial Sequence
  chemically synthesized
agccggcaggcaagaacgtt

SEQ ID NO: 356116 - DNA, 20 bp, Artificial Sequence
  chemically synthesized
gactaaacgttcttgcctgc

SEQ ID NO: 356117 - DNA, 20 bp, Artificial Sequence
  chemically synthesized
tctcttcagagccggcaggc

SEQ ID NO: 356118 - DNA, 20 bp, Artificial Sequence
  chemically synthesized
ctgctctcttcagagccggc

SEQ ID NO: 356119 - DNA, 20 bp, Artificial Sequence
  chemically synthesized
gctgctctcttcagagccgg

SEQ ID NO: 356120 - DNA, 20 bp, Artificial Sequence
  chemically synthesized
gttcttgcctgccggctctg

SEQ ID NO: 356121 - DNA, 20 bp, Artificial Sequence
  chemically synthesized
tctgctgctctcttcagagc

SEQ ID NO: 356122 - DNA, 20 bp, Artificial Sequence
  chemically synthesized
tcttgcctgccggctctgaa

SEQ ID NO: 356123 - DNA, 20 bp, Artificial Sequence
  chemically synthesized
ttgcctgccggctctgaaga

SEQ ID NO: 356124 - DNA, 20 bp, Artificial Sequence
  chemically synthesized
gagatctgctgctctcttca

SEQ ID NO: 356125 - DNA, 20 bp, Artificial Sequence
  chemically synthesized
cctgccggctctgaagagag

SEQ ID NO: 356126 - DNA, 20 bp, Artificial Sequence
  chemically synthesized
gggagatctgctgctctctt

SEQ ID NO: 356127 - DNA, 20 bp, Artificial Sequence
  chemically synthesized
gccggctctgaagagagcag

SEQ ID NO: 356128 - DNA, 20 bp, Artificial Sequence
  chemically synthesized
gaagagagcagcagatctcc

SEQ ID NO: 356129 - DNA, 20 bp, Artificial Sequence
  chemically synthesized
gagcagcagatctcccagca

SEQ ID NO: 356130 - DNA, 20 bp, Artificial Sequence
  chemically synthesized
gagctccagtgctgtgctgg

SEQ ID NO: 356131 - DNA, 20 bp, Artificial Sequence
  chemically synthesized
cagagctccagtgctgtgct

SEQ ID NO: 356132 - DNA, 20 bp, Artificial Sequence
  chemically synthesized
gcagagctccagtgctgtgc

SEQ ID NO: 356133 - DNA, 20 bp, Artificial Sequence
  chemically synthesized
cagatctcccagcacagcac

SEQ ID NO: 356134 - DNA, 20 bp, Artificial Sequence
  chemically synthesized
gatctcccagcacagcactg

SEQ ID NO: 356135 - DNA, 20 bp, Artificial Sequence
  chemically synthesized
tctgtcccttagcagagctc

SEQ ID NO: 356136 - DNA, 20 bp, Artificial Sequence
  chemically synthesized
cacagcactggagctctgct

SEQ ID NO: 356137 - DNA, 20 bp, Artificial Sequence
  chemically synthesized
acagcactggagctctgcta

SEQ ID NO: 356138 - DNA, 20 bp, Artificial Sequence
  chemically synthesized
cagcactggagctctgctaa

SEQ ID NO: 356139 - DNA, 20 bp, Artificial Sequence
  chemically synthesized
aggcaatctgtcccttagca

SEQ ID NO: 356140 - DNA, 20 bp, Artificial Sequence
  chemically synthesized
gaaggcaatctgtcccttag

SEQ ID NO: 356141 - DNA, 20 bp, Artificial Sequence
  chemically synthesized
actggagctctgctaaggga

SEQ ID NO: 356142 - DNA, 20 bp, Artificial Sequence
  chemically synthesized
tgagaaggcaatctgtccct

SEQ ID NO: 356143 - DNA, 20 bp, Artificial Sequence
  chemically synthesized
aagggacagattgccttctc

SEQ ID NO: 356144 - DNA, 20 bp, Artificial Sequence
  chemically synthesized
ggacagattgccttctcaag

SEQ ID NO: 356145 - DNA, 20 bp, Artificial Sequence
  chemically synthesized
ggtcagggccccacttgaga

SEQ ID NO: 356146 - DNA, 20 bp, Artificial Sequence
  chemically synthesized
gacagattgccttctcaagt

SEQ ID NO: 356147 - DNA, 20 bp, Artificial Sequence
  chemically synthesized
gggtcagggccccacttgag

SEQ ID NO: 356148 - DNA, 20 bp, Artificial Sequence
  chemically synthesized
acagattgccttctcaagtg

SEQ ID NO: 356149 - DNA, 20 bp, Artificial Sequence
  chemically synthesized
cgggggtcagggccccactt

SEQ ID NO: 356150 - DNA, 20 bp, Artificial Sequence
  chemically synthesized
ggcaggaggcacgggggtca

SEQ ID NO: 356151 - DNA, 20 bp, Artificial Sequence
  chemically synthesized
aggcaggaggcacgggggtc

SEQ ID NO: 356152 - DNA, 20 bp, Artificial Sequence
  chemically synthesized
taggcaggaggcacgggggt

SEQ ID NO: 356153 - DNA, 20 bp, Artificial Sequence
  chemically synthesized
ctcctaggcaggaggcacgg

SEQ ID NO: 356154 - DNA, 20 bp, Artificial Sequence
  chemically synthesized
tctcctaggcaggaggcacg

SEQ ID NO: 356155 - DNA, 20 bp, Artificial Sequence
  chemically synthesized
atctcctaggcaggaggcac

SEQ ID NO: 356156 - DNA, 20 bp, Artificial Sequence
  chemically synthesized
catctcctaggcaggaggca

SEQ ID NO: 356157 - DNA, 20 bp, Artificial Sequence
  chemically synthesized
tgacccccgtgcctcctgcc

SEQ ID NO: 356158 - DNA, 20 bp, Artificial Sequence
  chemically synthesized
gacccccgtgcctcctgcct

SEQ ID NO: 356159 - DNA, 20 bp, Artificial Sequence
  chemically synthesized
ggaggcatctcctaggcagg

SEQ ID NO: 356160 - DNA, 20 bp, Artificial Sequence
  chemically synthesized
gggaggcatctcctaggcag

SEQ ID NO: 356161 - DNA, 20 bp, Artificial Sequence
  chemically synthesized
cccccgtgcctcctgcctag

SEQ ID NO: 356162 - DNA, 20 bp, Artificial Sequence
  chemically synthesized
ctgggaggcatctcctaggc

SEQ ID NO: 356163 - DNA, 20 bp, Artificial Sequence
  chemically synthesized
gctgggaggcatctcctagg

SEQ ID NO: 356164 - DNA, 20 bp, Artificial Sequence
  chemically synthesized
cctgctgggaggcatctcct

SEQ ID NO: 356165 - DNA, 20 bp, Artificial Sequence
  chemically synthesized
ccctgctgggaggcatctcc

SEQ ID NO: 356166 - DNA, 20 bp, Artificial Sequence
  chemically synthesized
cctgcctaggagatgcctcc

SEQ ID NO: 356167 - DNA, 20 bp, Artificial Sequence
  chemically synthesized
gcctaggagatgcctcccag

SEQ ID NO: 356168 - DNA, 20 bp, Artificial Sequence
  chemically synthesized
cctaggagatgcctcccagc

SEQ ID NO: 356169 - DNA, 20 bp, Artificial Sequence
  chemically synthesized
ctaggagatgcctcccagca

SEQ ID NO: 356170 - DNA, 20 bp, Artificial Sequence
  chemically synthesized
gtctgtcgacccctgctggg

SEQ ID NO: 356171 - DNA, 20 bp, Artificial Sequence
  chemically synthesized
taggagatgcctcccagcag

SEQ ID NO: 356172 - DNA, 20 bp, Artificial Sequence
  chemically synthesized
tgtctgtcgacccctgctgg

SEQ ID NO: 356173 - DNA, 20 bp, Artificial Sequence
  chemically synthesized
tgtgtctgtcgacccctgct

SEQ ID NO: 356174 - DNA, 20 bp, Artificial Sequence
  chemically synthesized
atgtgtctgtcgacccctgc

SEQ ID NO: 356175 - DNA, 20 bp, Artificial Sequence
  chemically synthesized
tgcctcccagcaggggtcga

SEQ ID NO: 356176 - DNA, 20 bp, Artificial Sequence
  chemically synthesized
gggtcgacagacacatcata

SEQ ID NO: 356177 - DNA, 20 bp, Artificial Sequence
  chemically synthesized
ggtcgacagacacatcatac

SEQ ID NO: 356178 - DNA, 20 bp, Artificial Sequence
  chemically synthesized
tcgacagacacatcatacag

SEQ ID NO: 356179 - DNA, 20 bp, Artificial Sequence
  chemically synthesized
gacagacacatcatacagga

SEQ ID NO: 356180 - DNA, 20 bp, Artificial Sequence
  chemically synthesized
cacatcatacaggagagctc

SEQ ID NO: 356181 - DNA, 20 bp, Artificial Sequence
  chemically synthesized
tcatacaggagagctctggc

SEQ ID NO: 356182 - DNA, 20 bp, Artificial Sequence
  chemically synthesized
cacccaccagttgccagcca

SEQ ID NO: 356183 - DNA, 20 bp, Artificial Sequence
  chemically synthesized
ggcacccaccagttgccagc

SEQ ID NO: 356184 - DNA, 20 bp, Artificial Sequence
  chemically synthesized
ggagagctctggctggcaac

SEQ ID NO: 356185 - DNA, 20 bp, Artificial Sequence
  chemically synthesized
gaggggcacccaccagttgc

SEQ ID NO: 356186 - DNA, 20 bp, Artificial Sequence
  chemically synthesized
gagctctggctggcaactgg

SEQ ID NO: 356187 - DNA, 20 bp, Artificial Sequence
  chemically synthesized
agctctggctggcaactggt

SEQ ID NO: 356188 - DNA, 20 bp, Artificial Sequence
  chemically synthesized
cgtcccagaggggcacccac

SEQ ID NO: 356189 - DNA, 20 bp, Artificial Sequence
  chemically synthesized
gcaactggtgggtgcccctc

SEQ ID NO: 356190 - DNA, 20 bp, Artificial Sequence
  chemically synthesized
caactggtgggtgcccctct

SEQ ID NO: 356191 - DNA, 20 bp, Artificial Sequence
  chemically synthesized
ctggaagcttcgtcccagag

SEQ ID NO: 356192 - DNA, 20 bp, Artificial Sequence
  chemically synthesized
tctggaagcttcgtcccaga

SEQ ID NO: 356193 - DNA, 20 bp, Artificial Sequence
  chemically synthesized
ctctggaagcttcgtcccag

SEQ ID NO: 356194 - DNA, 20 bp, Artificial Sequence
  chemically synthesized
gtgggtgcccctctgggacg

SEQ ID NO: 356195 - DNA, 20 bp, Artificial Sequence
  chemically synthesized
cctctggaagcttcgtccca

SEQ ID NO: 356196 - DNA, 20 bp, Artificial Sequence
  chemically synthesized
atcctctggaagcttcgtcc

SEQ ID NO: 356197 - DNA, 20 bp, Artificial Sequence
  chemically synthesized
cccctctgggacgaagcttc

SEQ ID NO: 356198 - DNA, 20 bp, Artificial Sequence
  chemically synthesized
cctctgggacgaagcttcca

SEQ ID NO: 356199 - DNA, 20 bp, Artificial Sequence
  chemically synthesized
ctctgggacgaagcttccag

SEQ ID NO: 356200 - DNA, 20 bp, Artificial Sequence
  chemically synthesized
ctgcctgttccatcctctgg

SEQ ID NO: 356201 - DNA, 20 bp, Artificial Sequence
  chemically synthesized
gggacgaagcttccagagga

SEQ ID NO: 356202 - DNA, 20 bp, Artificial Sequence
  chemically synthesized
ttgctgcctgttccatcctc

SEQ ID NO: 356203 - DNA, 20 bp, Artificial Sequence
  chemically synthesized
gaagcttccagaggatggaa

SEQ ID NO: 356204 - DNA, 20 bp, Artificial Sequence
  chemically synthesized
aagcttccagaggatggaac

SEQ ID NO: 356205 - DNA, 20 bp, Artificial Sequence
  chemically synthesized
cttccagaggatggaacagg

SEQ ID NO: 356206 - DNA, 20 bp, Artificial Sequence
  chemically synthesized
gcagagactgcagaacagca

SEQ ID NO: 356207 - DNA, 20 bp, Artificial Sequence
  chemically synthesized
cagcaatctttgctgttctg

SEQ ID NO: 356208 - DNA, 20 bp, Artificial Sequence
  chemically synthesized
caccagcagagactgcagaa

SEQ ID NO: 356209 - DNA, 20 bp, Artificial Sequence
  chemically synthesized
ggtatcaccagcagagactg

SEQ ID NO: 356210 - DNA, 20 bp, Artificial Sequence
  chemically synthesized
tgctgttctgcagtctctgc

SEQ ID NO: 356211 - DNA, 20 bp, Artificial Sequence
  chemically synthesized
ttgcctgggtatcaccagca

SEQ ID NO: 356212 - DNA, 20 bp, Artificial Sequence
  chemically synthesized
atttgcctgggtatcaccag

SEQ ID NO: 356213 - DNA, 20 bp, Artificial Sequence
  chemically synthesized
cctatttgcctgggtatcac

SEQ ID NO: 356214 - DNA, 20 bp, Artificial Sequence
  chemically synthesized
cagtctctgctggtgatacc

SEQ ID NO: 356215 - DNA, 20 bp, Artificial Sequence
  chemically synthesized
agtctctgctggtgataccc

SEQ ID NO: 356216 - DNA, 20 bp, Artificial Sequence
  chemically synthesized
gctggtgatacccaggcaaa

SEQ ID NO: 356217 - DNA, 20 bp, Artificial Sequence
  chemically synthesized
actctagaccctatttgcct

SEQ ID NO: 356218 - DNA, 20 bp, Artificial Sequence
  chemically synthesized
ctggtgatacccaggcaaat

SEQ ID NO: 356219 - DNA, 20 bp, Artificial Sequence
  chemically synthesized
cactctagaccctatttgcc

SEQ ID NO: 356220 - DNA, 20 bp, Artificial Sequence
  chemically synthesized
tggtgatacccaggcaaata

SEQ ID NO: 356221 - DNA, 20 bp, Artificial Sequence
  chemically synthesized
atacccaggcaaatagggtc

SEQ ID NO: 356222 - DNA, 20 bp, Artificial Sequence
  chemically synthesized
acccaggcaaatagggtcta

SEQ ID NO: 356223 - DNA, 20 bp, Artificial Sequence
  chemically synthesized
caggcaaatagggtctagag

SEQ ID NO: 356224 - DNA, 20 bp, Artificial Sequence
  chemically synthesized
agtttactggaggtccactc

SEQ ID NO: 356225 - DNA, 20 bp, Artificial Sequence
  chemically synthesized
tagggtctagagtggacctc

SEQ ID NO: 356226 - DNA, 20 bp, Artificial Sequence
  chemically synthesized
ggtttgctggagtttactgg

SEQ ID NO: 356227 - DNA, 20 bp, Artificial Sequence
  chemically synthesized
aggtttgctggagtttactg

SEQ ID NO: 356228 - DNA, 20 bp, Artificial Sequence
  chemically synthesized
gcaggtttgctggagtttac

SEQ ID NO: 356229 - DNA, 20 bp, Artificial Sequence
  chemically synthesized
agtggacctccagtaaactc

SEQ ID NO: 356230 - DNA, 20 bp, Artificial Sequence
  chemically synthesized
cctctgctgcaggtttgctg

SEQ ID NO: 356231 - DNA, 20 bp, Artificial Sequence
  chemically synthesized
cccctctgctgcaggtttgc

SEQ ID NO: 356232 - DNA, 20 bp, Artificial Sequence
  chemically synthesized
agtaaactccagcaaacctg

SEQ ID NO: 356233 - DNA, 20 bp, Artificial Sequence
  chemically synthesized
aaactccagcaaacctgcag

SEQ ID NO: 356234 - DNA, 20 bp, Artificial Sequence
  chemically synthesized
actccagcaaacctgcagca

SEQ ID NO: 356235 - DNA, 20 bp, Artificial Sequence
  chemically synthesized
ctccagcaaacctgcagcag

SEQ ID NO: 356236 - DNA, 20 bp, Artificial Sequence
  chemically synthesized
caaacaggcccctctgctgc

SEQ ID NO: 356237 - DNA, 20 bp, Artificial Sequence
  chemically synthesized
tccagcaaacctgcagcaga

SEQ ID NO: 356238 - DNA, 20 bp, Artificial Sequence
  chemically synthesized
tcaaacaggcccctctgctg

SEQ ID NO: 356239 - DNA, 20 bp, Artificial Sequence
  chemically synthesized
ccagcaaacctgcagcagag

SEQ ID NO: 356240 - DNA, 20 bp, Artificial Sequence
  chemically synthesized
gcagcagaggggcctgtttg

SEQ ID NO: 356241 - DNA, 20 bp, Artificial Sequence
  chemically synthesized
cagcagaggggcctgtttga

SEQ ID NO: 356242 - DNA, 20 bp, Artificial Sequence
  chemically synthesized
gttttagttttccttcaaac

SEQ ID NO: 356243 - DNA, 20 bp, Artificial Sequence
  chemically synthesized
tgttttagttttccttcaaa

SEQ ID NO: 356244 - DNA, 20 bp, Artificial Sequence
  chemically synthesized
tgtttgaaggaaaactaaaa

SEQ ID NO: 356245 - DNA, 20 bp, Artificial Sequence
  chemically synthesized
tgaaggaaaactaaaacaga

SEQ ID NO: 356246 - DNA, 20 bp, Artificial Sequence
  chemically synthesized
gatgctattcctttctgttt

SEQ ID NO: 356247 - DNA, 20 bp, Artificial Sequence
  chemically synthesized
gaaggaaaactaaaacagaa

SEQ ID NO: 356248 - DNA, 20 bp, Artificial Sequence
  chemically synthesized
aaaactaaaacagaaaggaa

SEQ ID NO: 356249 - DNA, 20 bp, Artificial Sequence
  chemically synthesized
aaaggaatagcatcaacaaa

SEQ ID NO: 356250 - DNA, 20 bp, Artificial Sequence
  chemically synthesized
aaggaatagcatcaacaaaa

SEQ ID NO: 356251 - DNA, 20 bp, Artificial Sequence
  chemically synthesized
caacaaaaaggacatccact

SEQ ID NO: 356252 - DNA, 20 bp, Artificial Sequence
  chemically synthesized
cttcagatggggtttctgag

SEQ ID NO: 356253 - DNA, 20 bp, Artificial Sequence
  chemically synthesized
gaccttcagatggggtttct

SEQ ID NO: 356254 - DNA, 20 bp, Artificial Sequence
  chemically synthesized
ccactcagaaaccccatctg

SEQ ID NO: 356255 - DNA, 20 bp, Artificial Sequence
  chemically synthesized
cactcagaaaccccatctga

SEQ ID NO: 356256 - DNA, 20 bp, Artificial Sequence
  chemically synthesized
acattggtgaccttcagatg

SEQ ID NO: 356257 - DNA, 20 bp, Artificial Sequence
  chemically synthesized
gacattggtgaccttcagat

SEQ ID NO: 356258 - DNA, 20 bp, Artificial Sequence
  chemically synthesized
tgacattggtgaccttcaga

SEQ ID NO: 356259 - DNA, 20 bp, Artificial Sequence
  chemically synthesized
tctttgacattggtgacctt

SEQ ID NO: 356260 - DNA, 20 bp, Artificial Sequence
  chemically synthesized
tctgaaggtcaccaatgtca

SEQ ID NO: 356261 - DNA, 20 bp, Artificial Sequence
  chemically synthesized
ctacctttgatctttgacat

SEQ ID NO: 356262 - DNA, 20 bp, Artificial Sequence
  chemically synthesized
gtcaccaatgtcaaagatca

SEQ ID NO: 356263 - DNA, 20 bp, Artificial Sequence
  chemically synthesized
tcaccaatgtcaaagatcaa

SEQ ID NO: 356264 - DNA, 20 bp, Artificial Sequence
  chemically synthesized
ccaatgtcaaagatcaaagg

SEQ ID NO: 356265 - DNA, 20 bp, Artificial Sequence
  chemically synthesized
caaaggtagataaatccaca

SEQ ID NO: 356266 - DNA, 20 bp, Artificial Sequence
  chemically synthesized
gtagataaatccacaaagat

SEQ ID NO: 356267 - DNA, 20 bp, Artificial Sequence
  chemically synthesized
ctggtttttcctcatctttg

SEQ ID NO: 356268 - DNA, 20 bp, Artificial Sequence
  chemically synthesized
tagataaatccacaaagatg

SEQ ID NO: 356269 - DNA, 20 bp, Artificial Sequence
  chemically synthesized
ccacaaagatgaggaaaaac

SEQ ID NO: 356270 - DNA, 20 bp, Artificial Sequence
  chemically synthesized
tgaggaaaaaccagcacaaa

SEQ ID NO: 356271 - DNA, 20 bp, Artificial Sequence
  chemically synthesized
aattttcaccctttttgtgc

SEQ ID NO: 356272 - DNA, 20 bp, Artificial Sequence
  chemically synthesized
gaggaaaaaccagcacaaaa

SEQ ID NO: 356273 - DNA, 20 bp, Artificial Sequence
  chemically synthesized
aggaaaaaccagcacaaaaa

SEQ ID NO: 356274 - DNA, 20 bp, Artificial Sequence
  chemically synthesized
agggtgaaaattccaaaacc

SEQ ID NO: 356275 - DNA, 20 bp, Artificial Sequence
  chemically synthesized
agaagaggtgttctgggttt

SEQ ID NO: 356276 - DNA, 20 bp, Artificial Sequence
  chemically synthesized
tggaggagaagaggtgttct

SEQ ID NO: 356277 - DNA, 20 bp, Artificial Sequence
  chemically synthesized
ttggaggagaagaggtgttc

SEQ ID NO: 356278 - DNA, 20 bp, Artificial Sequence
  chemically synthesized
gtgatcctttggaggagaag

SEQ ID NO: 356279 - DNA, 20 bp, Artificial Sequence
  chemically synthesized
tgtgatcctttggaggagaa

SEQ ID NO: 356280 - DNA, 20 bp, Artificial Sequence
  chemically synthesized
gttgtgatcctttggaggag

SEQ ID NO: 356281 - DNA, 20 bp, Artificial Sequence
  chemically synthesized
agaacacctcttctcctcca

SEQ ID NO: 356282 - DNA, 20 bp, Artificial Sequence
  chemically synthesized
gaacacctcttctcctccaa

SEQ ID NO: 356283 - DNA, 20 bp, Artificial Sequence
  chemically synthesized
ggagttgtgatcctttggag

SEQ ID NO: 356284 - DNA, 20 bp, Artificial Sequence
  chemically synthesized
gaggagttgtgatcctttgg

SEQ ID NO: 356285 - DNA, 20 bp, Artificial Sequence
  chemically synthesized
tgaggagttgtgatcctttg

SEQ ID NO: 356286 - DNA, 20 bp, Artificial Sequence
  chemically synthesized
ggtgaggagttgtgatcctt

SEQ ID NO: 356287 - DNA, 20 bp, Artificial Sequence
  chemically synthesized
ttgttctcttgtttggtgag

SEQ ID NO: 356288 - DNA, 20 bp, Artificial Sequence
  chemically synthesized
ttttgttctcttgtttggtg

SEQ ID NO: 356289 - DNA, 20 bp, Artificial Sequence
  chemically synthesized
atcacaactcctcaccaaac

SEQ ID NO: 356290 - DNA, 20 bp, Artificial Sequence
  chemically synthesized
gttttgttctcttgtttggt

SEQ ID NO: 356291 - DNA, 20 bp, Artificial Sequence
  chemically synthesized
cacaactcctcaccaaacaa

SEQ ID NO: 356292 - DNA, 20 bp, Artificial Sequence
  chemically synthesized
tccagttttgttctcttgtt

SEQ ID NO: 356293 - DNA, 20 bp, Artificial Sequence
  chemically synthesized
accaaacaagagaacaaaac

SEQ ID NO: 356294 - DNA, 20 bp, Artificial Sequence
  chemically synthesized
aacaagagaacaaaactgga

SEQ ID NO: 356295 - DNA, 20 bp, Artificial Sequence
  chemically synthesized
caagagaacaaaactggatg

SEQ ID NO: 356296 - DNA, 20 bp, Artificial Sequence
  chemically synthesized
cgtcatactcattctccatc

SEQ ID NO: 356297 - DNA, 20 bp, Artificial Sequence
  chemically synthesized
aacaaaactggatggagaat

SEQ ID NO: 356298 - DNA, 20 bp, Artificial Sequence
  chemically synthesized
tgagtatgacgaattgacat

SEQ ID NO: 356299 - DNA, 20 bp, Artificial Sequence
  chemically synthesized
gtatgacgaattgacataag

SEQ ID NO: 356300 - DNA, 20 bp, Artificial Sequence
  chemically synthesized
tatgacgaattgacataagt

SEQ ID NO: 356301 - DNA, 20 bp, Artificial Sequence
  chemically synthesized
gaattgacataagtaggctt

SEQ ID NO: 356302 - DNA, 20 bp, Artificial Sequence
  chemically synthesized
ttgacataagtaggcttcag

SEQ ID NO: 356303 - DNA, 20 bp, Artificial Sequence
  chemically synthesized
tgacataagtaggcttcaga

SEQ ID NO: 356304 - DNA, 20 bp, Artificial Sequence
  chemically synthesized
cataagtaggcttcagaagg

SEQ ID NO: 356305 - DNA, 20 bp, Artificial Sequence
  chemically synthesized
agtttattacccaccttctg

SEQ ID NO: 356306 - DNA, 20 bp, Artificial Sequence
  chemically synthesized
ataagtaggcttcagaaggt

SEQ ID NO: 356307 - DNA, 20 bp, Artificial Sequence
  chemically synthesized
ggtgggtaataaactcctcc

SEQ ID NO: 356308 - DNA, 20 bp, Artificial Sequence
  chemically synthesized
catgctcctttagcttggag

SEQ ID NO: 356309 - DNA, 20 bp, Artificial Sequence
  chemically synthesized
aacatgctcctttagcttgg

SEQ ID NO: 356310 - DNA, 20 bp, Artificial Sequence
  chemically synthesized
taataaactcctccaagcta

SEQ ID NO: 356311 - DNA, 20 bp, Artificial Sequence
  chemically synthesized
gaacatgctcctttagcttg

SEQ ID NO: 356312 - DNA, 20 bp, Artificial Sequence
  chemically synthesized
aataaactcctccaagctaa

SEQ ID NO: 356313 - DNA, 20 bp, Artificial Sequence
  chemically synthesized
tagaacatgctcctttagct

SEQ ID NO: 356314 - DNA, 20 bp, Artificial Sequence
  chemically synthesized
taaactcctccaagctaaag

SEQ ID NO: 356315 - DNA, 20 bp, Artificial Sequence
  chemically synthesized
tgggttagaacatgctcctt

SEQ ID NO: 356316 - DNA, 20 bp, Artificial Sequence
  chemically synthesized
aggagcatgttctaacccaa

SEQ ID NO: 356317 - DNA, 20 bp, Artificial Sequence
  chemically synthesized
ttagcttccttccattgggt

SEQ ID NO: 356318 - DNA, 20 bp, Artificial Sequence
  chemically synthesized
agcatgttctaacccaatgg

SEQ ID NO: 356319 - DNA, 20 bp, Artificial Sequence
  chemically synthesized
gcatgttctaacccaatgga

SEQ ID NO: 356320 - DNA, 20 bp, Artificial Sequence
  chemically synthesized
gttcttagcttccttccatt

SEQ ID NO: 356321 - DNA, 20 bp, Artificial Sequence
  chemically synthesized
ggttcttagcttccttccat

SEQ ID NO: 356322 - DNA, 20 bp, Artificial Sequence
  chemically synthesized
tgttctaacccaatggaagg

SEQ ID NO: 356323 - DNA, 20 bp, Artificial Sequence
  chemically synthesized
taacccaatggaaggaagct

SEQ ID NO: 356324 - DNA, 20 bp, Artificial Sequence
  chemically synthesized
taaccttttttcaaggttct

SEQ ID NO: 356325 - DNA, 20 bp, Artificial Sequence
  chemically synthesized
gaagctaagaaccttgaaaa

SEQ ID NO: 356326 - DNA, 20 bp, Artificial Sequence
  chemically synthesized
aagctaagaaccttgaaaaa

SEQ ID NO: 356327 - DNA, 20 bp, Artificial Sequence
  chemically synthesized
actcctctaaccttttttca

SEQ ID NO: 356328 - DNA, 20 bp, Artificial Sequence
  chemically synthesized
aactcctctaaccttttttc

SEQ ID NO: 356329 - DNA, 20 bp, Artificial Sequence
  chemically synthesized
taagaaccttgaaaaaaggt

SEQ ID NO: 356330 - DNA, 20 bp, Artificial Sequence
  chemically synthesized
agaaccttgaaaaaaggtta

SEQ ID NO: 356331 - DNA, 20 bp, Artificial Sequence
  chemically synthesized
gaaccttgaaaaaaggttag

SEQ ID NO: 356332 - DNA, 20 bp, Artificial Sequence
  chemically synthesized
accttgaaaaaaggttagag

SEQ ID NO: 356333 - DNA, 20 bp, Artificial Sequence
  chemically synthesized
cctaaactggttattgtagt

SEQ ID NO: 356334 - DNA, 20 bp, Artificial Sequence
  chemically synthesized
gagttgctaactacaataac

SEQ ID NO: 356335 - DNA, 20 bp, Artificial Sequence
  chemically synthesized
tttgcctaaactggttattg

SEQ ID NO: 356336 - DNA, 20 bp, Artificial Sequence
  chemically synthesized
gctaactacaataaccagtt

SEQ ID NO: 356337 - DNA, 20 bp, Artificial Sequence
  chemically synthesized
ctaactacaataaccagttt

SEQ ID NO: 356338 - DNA, 20 bp, Artificial Sequence
  chemically synthesized
atttattgttttgcctaaac

SEQ ID NO: 356339 - DNA, 20 bp, Artificial Sequence
  chemically synthesized
caaaacaataaatgacctga

SEQ ID NO: 356340 - DNA, 20 bp, Artificial Sequence
  chemically synthesized
ctgtgtttttcagttccatc

SEQ ID NO: 356341 - DNA, 20 bp, Artificial Sequence
  chemically synthesized
gctgtgtttttcagttccat

SEQ ID NO: 356342 - DNA, 20 bp, Artificial Sequence
  chemically synthesized
cctgatggaactgaaaaaca

SEQ ID NO: 356343 - DNA, 20 bp, Artificial Sequence
  chemically synthesized
agttgttgtgctgtgttttt

SEQ ID NO: 356344 - DNA, 20 bp, Artificial Sequence
  chemically synthesized
cacagcacaacaacttcatg

SEQ ID NO: 356345 - DNA, 20 bp, Artificial Sequence
  chemically synthesized
atacttgtgtatgcttcatg

SEQ ID NO: 356346 - DNA, 20 bp, Artificial Sequence
  chemically synthesized
caacttcatgaagcatacac

SEQ ID NO: 356347 - DNA, 20 bp, Artificial Sequence
  chemically synthesized
gaagcatacacaagtatcaa

SEQ ID NO: 356348 - DNA, 20 bp, Artificial Sequence
  chemically synthesized
tttcttctgctggatcgatt

SEQ ID NO: 356349 - DNA, 20 bp, Artificial Sequence
  chemically synthesized
tatcaatagctcaatcgatc

SEQ ID NO: 356350 - DNA, 20 bp, Artificial Sequence
  chemically synthesized
caatagctcaatcgatccag

SEQ ID NO: 356351 - DNA, 20 bp, Artificial Sequence
  chemically synthesized
tagctcaatcgatccagcag

SEQ ID NO: 356352 - DNA, 20 bp, Artificial Sequence
  chemically synthesized
tctgatatcttttcttctgc

SEQ ID NO: 356353 - DNA, 20 bp, Artificial Sequence
  chemically synthesized
caatcgatccagcagaagaa

SEQ ID NO: 356354 - DNA, 20 bp, Artificial Sequence
  chemically synthesized
tccagcagaagaaaagatat

SEQ ID NO: 356355 - DNA, 20 bp, Artificial Sequence
  chemically synthesized
cagcagaagaaaagatatca

SEQ ID NO: 356356 - DNA, 20 bp, Artificial Sequence
  chemically synthesized
agaaaagatatcagagattg

SEQ ID NO: 356357 - DNA, 20 bp, Artificial Sequence
  chemically synthesized
tcttcacactttatttcatt

SEQ ID NO: 356358 - DNA, 20 bp, Artificial Sequence
  chemically synthesized
aagatcaacttaatgaaata

SEQ ID NO: 356359 - DNA, 20 bp, Artificial Sequence
  chemically synthesized
acttaatgaaataaagtgtg

SEQ ID NO: 356360 - DNA, 20 bp, Artificial Sequence
  chemically synthesized
atgaaataaagtgtgaagac

SEQ ID NO: 356361 - DNA, 20 bp, Artificial Sequence
  chemically synthesized
ataaagtgtgaagacaagat

SEQ ID NO: 356362 - DNA, 20 bp, Artificial Sequence
  chemically synthesized
aaagtgtgaagacaagatta

SEQ ID NO: 356363 - DNA, 20 bp, Artificial Sequence
  chemically synthesized
gaagacaagattagagaaaa

SEQ ID NO: 356364 - DNA, 20 bp, Artificial Sequence
  chemically synthesized
attagagaaaaaagaatgaa

SEQ ID NO: 356365 - DNA, 20 bp, Artificial Sequence
  chemically synthesized
ttagagaaaaaagaatgaaa

SEQ ID NO: 356366 - DNA, 20 bp, Artificial Sequence
  chemically synthesized
agaatgaaaaggaatgaaca

SEQ ID NO: 356367 - DNA, 20 bp, Artificial Sequence
  chemically synthesized
catagtcccatatttcgtgg

SEQ ID NO: 356368 - DNA, 20 bp, Artificial Sequence
  chemically synthesized
acatagtcccatatttcgtg

SEQ ID NO: 356369 - DNA, 20 bp, Artificial Sequence
  chemically synthesized
aacaaagcctccacgaaata

SEQ ID NO: 356370 - DNA, 20 bp, Artificial Sequence
  chemically synthesized
tcacatagtcccatatttcg

SEQ ID NO: 356371 - DNA, 20 bp, Artificial Sequence
  chemically synthesized
acaaagcctccacgaaatat

SEQ ID NO: 356372 - DNA, 20 bp, Artificial Sequence
  chemically synthesized
gaaatatgggactatgtgaa

SEQ ID NO: 356373 - DNA, 20 bp, Artificial Sequence
  chemically synthesized
ttaggttttgtcttttcaca

SEQ ID NO: 356374 - DNA, 20 bp, Artificial Sequence
  chemically synthesized
tatgtgaaaagacaaaacct

SEQ ID NO: 356375 - DNA, 20 bp, Artificial Sequence
  chemically synthesized
caggtatactaatcaaactt

SEQ ID NO: 356376 - DNA, 20 bp, Artificial Sequence
  chemically synthesized
ccaggtatactaatcaaact

SEQ ID NO: 356377 - DNA, 20 bp, Artificial Sequence
  chemically synthesized
agacaaaacctaagtttgat

SEQ ID NO: 356378 - DNA, 20 bp, Artificial Sequence
  chemically synthesized
ctaagtttgattagtatacc

SEQ ID NO: 356379 - DNA, 20 bp, Artificial Sequence
  chemically synthesized
taagtttgattagtatacct

SEQ ID NO: 356380 - DNA, 20 bp, Artificial Sequence
  chemically synthesized
atcctgaagaatgttttccc

SEQ ID NO: 356381 - DNA, 20 bp, Artificial Sequence
  chemically synthesized
tatcctgaagaatgttttcc

SEQ ID NO: 356382 - DNA, 20 bp, Artificial Sequence
  chemically synthesized
atacctgggaaaacattctt

SEQ ID NO: 356383 - DNA, 20 bp, Artificial Sequence
  chemically synthesized
tacctgggaaaacattcttc

SEQ ID NO: 356384 - DNA, 20 bp, Artificial Sequence
  chemically synthesized
ttcgccgggataatatcctg

SEQ ID NO: 356385 - DNA, 20 bp, Artificial Sequence
  chemically synthesized
cattcttcaggatattatcc

SEQ ID NO: 356386 - DNA, 20 bp, Artificial Sequence
  chemically synthesized
ctagtttgggaaagttcgcc

SEQ ID NO: 356387 - DNA, 20 bp, Artificial Sequence
  chemically synthesized
gctagtttgggaaagttcgc

SEQ ID NO: 356388 - DNA, 20 bp, Artificial Sequence
  chemically synthesized
gctgtcttgctagtttggga

SEQ ID NO: 356389 - DNA, 20 bp, Artificial Sequence
  chemically synthesized
cccggcgaactttcccaaac

SEQ ID NO: 356390 - DNA, 20 bp, Artificial Sequence
  chemically synthesized
gtgggctgtcttgctagttt

SEQ ID NO: 356391 - DNA, 20 bp, Artificial Sequence
  chemically synthesized
gcgaactttcccaaactagc

SEQ ID NO: 356392 - DNA, 20 bp, Artificial Sequence
  chemically synthesized
ggtgggctgtcttgctagtt

SEQ ID NO: 356393 - DNA, 20 bp, Artificial Sequence
  chemically synthesized
actttcccaaactagcaaga

SEQ ID NO: 356394 - DNA, 20 bp, Artificial Sequence
  chemically synthesized
tgaatggtgggctgtcttgc

SEQ ID NO: 356395 - DNA, 20 bp, Artificial Sequence
  chemically synthesized
atttcctaaatttgaatggt

SEQ ID NO: 356396 - DNA, 20 bp, Artificial Sequence
  chemically synthesized
tatttcctaaatttgaatgg

SEQ ID NO: 356397 - DNA, 20 bp, Artificial Sequence
  chemically synthesized
ctgtatttcctaaatttgaa

SEQ ID NO: 356398 - DNA, 20 bp, Artificial Sequence
  chemically synthesized
gacagcccaccattcaaatt

SEQ ID NO: 356399 - DNA, 20 bp, Artificial Sequence
  chemically synthesized
acagcccaccattcaaattt

SEQ ID NO: 356400 - DNA, 20 bp, Artificial Sequence
  chemically synthesized
ccattcaaatttaggaaata

SEQ ID NO: 356401 - DNA, 20 bp, Artificial Sequence
  chemically synthesized
attcaaatttaggaaataca

SEQ ID NO: 356402 - DNA, 20 bp, Artificial Sequence
  chemically synthesized
ctttttgaggagtatttttg

SEQ ID NO: 356403 - DNA, 20 bp, Artificial Sequence
  chemically synthesized
ccacaaaaatactcctcaaa

SEQ ID NO: 356404 - DNA, 20 bp, Artificial Sequence
  chemically synthesized
ttggggttgctctttttgag

SEQ ID NO: 356405 - DNA, 20 bp, Artificial Sequence
  chemically synthesized
acaaaaatactcctcaaaaa

SEQ ID NO: 356406 - DNA, 20 bp, Artificial Sequence
  chemically synthesized
tcttggggttgctctttttg

SEQ ID NO: 356407 - DNA, 20 bp, Artificial Sequence
  chemically synthesized
gtcttggggttgctcttttt

SEQ ID NO: 356408 - DNA, 20 bp, Artificial Sequence
  chemically synthesized
tcctcaaaaagagcaacccc

SEQ ID NO: 356409 - DNA, 20 bp, Artificial Sequence
  chemically synthesized
tctgacaattatgtgtcttg

SEQ ID NO: 356410 - DNA, 20 bp, Artificial Sequence
  chemically synthesized
atctgacaattatgtgtctt

SEQ ID NO: 356411 - DNA, 20 bp, Artificial Sequence
  chemically synthesized
aatctgacaattatgtgtct

SEQ ID NO: 356412 - DNA, 20 bp, Artificial Sequence
  chemically synthesized
accccaagacacataattgt

SEQ ID NO: 356413 - DNA, 20 bp, Artificial Sequence
  chemically synthesized
acataattgtcagattcacc

SEQ ID NO: 356414 - DNA, 20 bp, Artificial Sequence
  chemically synthesized
cataattgtcagattcacca

SEQ ID NO: 356415 - DNA, 20 bp, Artificial Sequence
  chemically synthesized
tttttccttcatttcaacct

SEQ ID NO: 356416 - DNA, 20 bp, Artificial Sequence
  chemically synthesized
gattcaccaaggttgaaatg

SEQ ID NO: 356417 - DNA, 20 bp, Artificial Sequence
  chemically synthesized
attcaccaaggttgaaatga

SEQ ID NO: 356418 - DNA, 20 bp, Artificial Sequence
  chemically synthesized
gaaatgaaggaaaaaatgtt

SEQ ID NO: 356419 - DNA, 20 bp, Artificial Sequence
  chemically synthesized
aaatgaaggaaaaaatgttc

SEQ ID NO: 356420 - DNA, 20 bp, Artificial Sequence
  chemically synthesized
gaaggaaaaaatgttcagga

SEQ ID NO: 356421 - DNA, 20 bp, Artificial Sequence
  chemically synthesized
aaaaatgttcaggacagtca

SEQ ID NO: 356422 - DNA, 20 bp, Artificial Sequence
  chemically synthesized
aaatgttcaggacagtcaaa

SEQ ID NO: 356423 - DNA, 20 bp, Artificial Sequence
  chemically synthesized
gttcaggacagtcaaagaga

SEQ ID NO: 356424 - DNA, 20 bp, Artificial Sequence
  chemically synthesized
ttcaggacagtcaaagagaa

SEQ ID NO: 356425 - DNA, 20 bp, Artificial Sequence
  chemically synthesized
ggacagtcaaagagaaaggt

SEQ ID NO: 356426 - DNA, 20 bp, Artificial Sequence
  chemically synthesized
gaaaggtcggcttacccaca

SEQ ID NO: 356427 - DNA, 20 bp, Artificial Sequence
  chemically synthesized
atgggcttccctttgtgggt

SEQ ID NO: 356428 - DNA, 20 bp, Artificial Sequence
  chemically synthesized
aaaggtcggcttacccacaa

SEQ ID NO: 356429 - DNA, 20 bp, Artificial Sequence
  chemically synthesized
aaggtcggcttacccacaaa

SEQ ID NO: 356430 - DNA, 20 bp, Artificial Sequence
  chemically synthesized
tctgatgggcttccctttgt

SEQ ID NO: 356431 - DNA, 20 bp, Artificial Sequence
  chemically synthesized
gtcggcttacccacaaaggg

SEQ ID NO: 356432 - DNA, 20 bp, Artificial Sequence
  chemically synthesized
gtctgatgggcttccctttg

SEQ ID NO: 356433 - DNA, 20 bp, Artificial Sequence
  chemically synthesized
acccacaaagggaagcccat

SEQ ID NO: 356434 - DNA, 20 bp, Artificial Sequence
  chemically synthesized
agatctgctgttagtctgat

SEQ ID NO: 356435 - DNA, 20 bp, Artificial Sequence
  chemically synthesized
aagatctgctgttagtctga

SEQ ID NO: 356436 - DNA, 20 bp, Artificial Sequence
  chemically synthesized
agggaagcccatcagactaa

SEQ ID NO: 356437 - DNA, 20 bp, Artificial Sequence
  chemically synthesized
gaagcccatcagactaacag

SEQ ID NO: 356438 - DNA, 20 bp, Artificial Sequence
  chemically synthesized
tctgcagaaagatctgctgt

SEQ ID NO: 356439 - DNA, 20 bp, Artificial Sequence
  chemically synthesized
actaacagcagatctttctg

SEQ ID NO: 356440 - DNA, 20 bp, Artificial Sequence
  chemically synthesized
gcttgtagggtttctgcaga

SEQ ID NO: 356441 - DNA, 20 bp, Artificial Sequence
  chemically synthesized
tctggcttgtagggtttctg

SEQ ID NO: 356442 - DNA, 20 bp, Artificial Sequence
  chemically synthesized
tctttctgcagaaaccctac

SEQ ID NO: 356443 - DNA, 20 bp, Artificial Sequence
  chemically synthesized
tctgcagaaaccctacaagc

SEQ ID NO: 356444 - DNA, 20 bp, Artificial Sequence
  chemically synthesized
ctactctcttctggcttgta

SEQ ID NO: 356445 - DNA, 20 bp, Artificial Sequence
  chemically synthesized
cctactctcttctggcttgt

SEQ ID NO: 356446 - DNA, 20 bp, Artificial Sequence
  chemically synthesized
ccctactctcttctggcttg

SEQ ID NO: 356447 - DNA, 20 bp, Artificial Sequence
  chemically synthesized
gcagaaaccctacaagccag

SEQ ID NO: 356448 - DNA, 20 bp, Artificial Sequence
  chemically synthesized
agaaaccctacaagccagaa

SEQ ID NO: 356449 - DNA, 20 bp, Artificial Sequence
  chemically synthesized
aaaccctacaagccagaaga

SEQ ID NO: 356450 - DNA, 20 bp, Artificial Sequence
  chemically synthesized
tattggcccctactctcttc

SEQ ID NO: 356451 - DNA, 20 bp, Artificial Sequence
  chemically synthesized
ccctacaagccagaagagag

SEQ ID NO: 356452 - DNA, 20 bp, Artificial Sequence
  chemically synthesized
cctacaagccagaagagagt

SEQ ID NO: 356453 - DNA, 20 bp, Artificial Sequence
  chemically synthesized
ctacaagccagaagagagta

SEQ ID NO: 356454 - DNA, 20 bp, Artificial Sequence
  chemically synthesized
tacaagccagaagagagtag

SEQ ID NO: 356455 - DNA, 20 bp, Artificial Sequence
  chemically synthesized
attttaagaatgttgaatat

SEQ ID NO: 356456 - DNA, 20 bp, Artificial Sequence
  chemically synthesized
tctgagttaaaaattatttt

SEQ ID NO: 356457 - DNA, 20 bp, Artificial Sequence
  chemically synthesized
tcttaaaataatttttaact

SEQ ID NO: 356458 - DNA, 20 bp, Artificial Sequence
  chemically synthesized
ttgactggctatgaaattct

SEQ ID NO: 356459 - DNA, 20 bp, Artificial Sequence
  chemically synthesized
atttttaactcagaatttca

SEQ ID NO: 356460 - DNA, 20 bp, Artificial Sequence
  chemically synthesized
ttaactcagaatttcatagc

SEQ ID NO: 356461 - DNA, 20 bp, Artificial Sequence
  chemically synthesized
cttatgaagcttagtttgac

SEQ ID NO: 356462 - DNA, 20 bp, Artificial Sequence
  chemically synthesized
atttcatagccagtcaaact

SEQ ID NO: 356463 - DNA, 20 bp, Artificial Sequence
  chemically synthesized
tctccttcgcttatgaagct

SEQ ID NO: 356464 - DNA, 20 bp, Artificial Sequence
  chemically synthesized
ccagtcaaactaagcttcat

SEQ ID NO: 356465 - DNA, 20 bp, Artificial Sequence
  chemically synthesized
ctatttctccttcgcttatg

SEQ ID NO: 356466 - DNA, 20 bp, Artificial Sequence
  chemically synthesized
caaactaagcttcataagcg

SEQ ID NO: 356467 - DNA, 20 bp, Artificial Sequence
  chemically synthesized
aaactaagcttcataagcga

SEQ ID NO: 356468 - DNA, 20 bp, Artificial Sequence
  chemically synthesized
actaagcttcataagcgaag

SEQ ID NO: 356469 - DNA, 20 bp, Artificial Sequence
  chemically synthesized
cttcataagcgaaggagaaa

SEQ ID NO: 356470 - DNA, 20 bp, Artificial Sequence
  chemically synthesized
aggagaaatagaatgcttta

SEQ ID NO: 356471 - DNA, 20 bp, Artificial Sequence
  chemically synthesized
aaatagaatgctttaaagac

SEQ ID NO: 356472 - DNA, 20 bp, Artificial Sequence
  chemically synthesized
tcagcatttgctcgtcttta

SEQ ID NO: 356473 - DNA, 20 bp, Artificial Sequence
  chemically synthesized
tttaaagacgagcaaatgct

SEQ ID NO: 356474 - DNA, 20 bp, Artificial Sequence
  chemically synthesized
taaagacgagcaaatgctga

SEQ ID NO: 356475 - DNA, 20 bp, Artificial Sequence
  chemically synthesized
ctggtggtgacaaaatctct

SEQ ID NO: 356476 - DNA, 20 bp, Artificial Sequence
  chemically synthesized
ctgagagattttgtcaccac

SEQ ID NO: 356477 - DNA, 20 bp, Artificial Sequence
  chemically synthesized
tgagagattttgtcaccacc

SEQ ID NO: 356478 - DNA, 20 bp, Artificial Sequence
  chemically synthesized
ctcttgtaagacaggcctgg

SEQ ID NO: 356479 - DNA, 20 bp, Artificial Sequence
  chemically synthesized
gagctcttgtaagacaggcc

SEQ ID NO: 356480 - DNA, 20 bp, Artificial Sequence
  chemically synthesized
caccaccaggcctgtcttac

SEQ ID NO: 356481 - DNA, 20 bp, Artificial Sequence
  chemically synthesized
tgaaggagctcttgtaagac

SEQ ID NO: 356482 - DNA, 20 bp, Artificial Sequence
  chemically synthesized
ctgaaggagctcttgtaaga

SEQ ID NO: 356483 - DNA, 20 bp, Artificial Sequence
  chemically synthesized
ccaccaggcctgtcttacaa

SEQ ID NO: 356484 - DNA, 20 bp, Artificial Sequence
  chemically synthesized
cttcctgaaggagctcttgt

SEQ ID NO: 356485 - DNA, 20 bp, Artificial Sequence
  chemically synthesized
ctgtcttacaagagctcctt

SEQ ID NO: 356486 - DNA, 20 bp, Artificial Sequence
  chemically synthesized
tgtcttacaagagctccttc

SEQ ID NO: 356487 - DNA, 20 bp, Artificial Sequence
  chemically synthesized
cttacaagagctccttcagg

SEQ ID NO: 356488 - DNA, 20 bp, Artificial Sequence
  chemically synthesized
atatttagtgcttcctgaag

SEQ ID NO: 356489 - DNA, 20 bp, Artificial Sequence
  chemically synthesized
ccatatttagtgcttcctga

SEQ ID NO: 356490 - DNA, 20 bp, Artificial Sequence
  chemically synthesized
gccatatttagtgcttcctg

SEQ ID NO: 356491 - DNA, 20 bp, Artificial Sequence
  chemically synthesized
ccttcaggaagcactaaata

SEQ ID NO: 356492 - DNA, 20 bp, Artificial Sequence
  chemically synthesized
tggtttgtccttgccatatt

SEQ ID NO: 356493 - DNA, 20 bp, Artificial Sequence
  chemically synthesized
caggaagcactaaatatggc

SEQ ID NO: 356494 - DNA, 20 bp, Artificial Sequence
  chemically synthesized
aggaagcactaaatatggca

SEQ ID NO: 356495 - DNA, 20 bp, Artificial Sequence
  chemically synthesized
taaatatggcaaggacaaac

SEQ ID NO: 356496 - DNA, 20 bp, Artificial Sequence
  chemically synthesized
tggcaaggacaaaccagtac

SEQ ID NO: 356497 - DNA, 20 bp, Artificial Sequence
  chemically synthesized
gcttctgcagtggctggtac

SEQ ID NO: 356498 - DNA, 20 bp, Artificial Sequence
  chemically synthesized
caaaccagtaccagccactg

SEQ ID NO: 356499 - DNA, 20 bp, Artificial Sequence
  chemically synthesized
tggtatgcttctgcagtggc

SEQ ID NO: 356500 - DNA, 20 bp, Artificial Sequence
  chemically synthesized
accagtaccagccactgcag

SEQ ID NO: 356501 - DNA, 20 bp, Artificial Sequence
  chemically synthesized
aatttggtatgcttctgcag

SEQ ID NO: 356502 - DNA, 20 bp, Artificial Sequence
  chemically synthesized
tacaatttggtatgcttctg

SEQ ID NO: 356503 - DNA, 20 bp, Artificial Sequence
  chemically synthesized
tgtcgatggtgtttacaatt

SEQ ID NO: 356504 - DNA, 20 bp, Artificial Sequence
  chemically synthesized
cagtttcttcatggtgtcga

SEQ ID NO: 356505 - DNA, 20 bp, Artificial Sequence
  chemically synthesized
taaacaccatcgacaccatg

SEQ ID NO: 356506 - DNA, 20 bp, Artificial Sequence
  chemically synthesized
tagttgatgcagtttcttca

SEQ ID NO: 356507 - DNA, 20 bp, Artificial Sequence
  chemically synthesized
attttgcttgttagttgatg

SEQ ID NO: 356508 - DNA, 20 bp, Artificial Sequence
  chemically synthesized
aagaaactgcatcaactaac

SEQ ID NO: 356509 - DNA, 20 bp, Artificial Sequence
  chemically synthesized
tagctggttattttgcttgt

SEQ ID NO: 356510 - DNA, 20 bp, Artificial Sequence
  chemically synthesized
caactaacaagcaaaataac

SEQ ID NO: 356511 - DNA, 20 bp, Artificial Sequence
  chemically synthesized
taacaagcaaaataaccagc

SEQ ID NO: 356512 - DNA, 20 bp, Artificial Sequence
  chemically synthesized
cctgtcattatgatgctagc

SEQ ID NO: 356513 - DNA, 20 bp, Artificial Sequence
  chemically synthesized
tgatcctgtcattatgatgc

SEQ ID NO: 356514 - DNA, 20 bp, Artificial Sequence
  chemically synthesized
accagctagcatcataatga

SEQ ID NO: 356515 - DNA, 20 bp, Artificial Sequence
  chemically synthesized
ccagctagcatcataatgac

SEQ ID NO: 356516 - DNA, 20 bp, Artificial Sequence
  chemically synthesized
atttagcccatttacattta

SEQ ID NO: 356517 - DNA, 20 bp, Artificial Sequence
  chemically synthesized
catttagcccatttacattt

SEQ ID NO: 356518 - DNA, 20 bp, Artificial Sequence
  chemically synthesized
atattaaccttaaatgtaaa

SEQ ID NO: 356519 - DNA, 20 bp, Artificial Sequence
  chemically synthesized
tattaaccttaaatgtaaat

SEQ ID NO: 356520 - DNA, 20 bp, Artificial Sequence
  chemically synthesized
tgtcttttaattggggcatt

SEQ ID NO: 356521 - DNA, 20 bp, Artificial Sequence
  chemically synthesized
gggctaaatgccccaattaa

SEQ ID NO: 356522 - DNA, 20 bp, Artificial Sequence
  chemically synthesized
cagtctgtgtcttttaattg

SEQ ID NO: 356523 - DNA, 20 bp, Artificial Sequence
  chemically synthesized
ccagtctgtgtcttttaatt

SEQ ID NO: 356524 - DNA, 20 bp, Artificial Sequence
  chemically synthesized
gccagtctgtgtcttttaat

SEQ ID NO: 356525 - DNA, 20 bp, Artificial Sequence
  chemically synthesized
aatgccccaattaaaagaca

SEQ ID NO: 356526 - DNA, 20 bp, Artificial Sequence
  chemically synthesized
cccaattaaaagacacagac

SEQ ID NO: 356527 - DNA, 20 bp, Artificial Sequence
  chemically synthesized
aaagacacagactggcaaat

SEQ ID NO: 356528 - DNA, 20 bp, Artificial Sequence
  chemically synthesized
tgactcttcatccaatttgc

SEQ ID NO: 356529 - DNA, 20 bp, Artificial Sequence
  chemically synthesized
acagactggcaaattggatg

SEQ ID NO: 356530 - DNA, 20 bp, Artificial Sequence
  chemically synthesized
agactggcaaattggatgaa

SEQ ID NO: 356531 - DNA, 20 bp, Artificial Sequence
  chemically synthesized
ggcaaattggatgaagagtc

SEQ ID NO: 356532 - DNA, 20 bp, Artificial Sequence
  chemically synthesized
gatgaagagtcaagaccaaa

SEQ ID NO: 356533 - DNA, 20 bp, Artificial Sequence
  chemically synthesized
cctgactacagcacaccatt

SEQ ID NO: 356534 - DNA, 20 bp, Artificial Sequence
  chemically synthesized
caagaccaaatggtgtgctg

SEQ ID NO: 356535 - DNA, 20 bp, Artificial Sequence
  chemically synthesized
accaaatggtgtgctgtagt

SEQ ID NO: 356536 - DNA, 20 bp, Artificial Sequence
  chemically synthesized
ccaaatggtgtgctgtagtc

SEQ ID NO: 356537 - DNA, 20 bp, Artificial Sequence
  chemically synthesized
aaatggtgtgctgtagtcag

SEQ ID NO: 356538 - DNA, 20 bp, Artificial Sequence
  chemically synthesized
tgagattgctctcctgacta

SEQ ID NO: 356539 - DNA, 20 bp, Artificial Sequence
  chemically synthesized
atggtgtgctgtagtcagga

SEQ ID NO: 356540 - DNA, 20 bp, Artificial Sequence
  chemically synthesized
ggagagcaatctcacgtgca

SEQ ID NO: 356541 - DNA, 20 bp, Artificial Sequence
  chemically synthesized
ctatgtgtgtctttgcacgt

SEQ ID NO: 356542 - DNA, 20 bp, Artificial Sequence
  chemically synthesized
ctcacgtgcaaagacacaca

SEQ ID NO: 356543 - DNA, 20 bp, Artificial Sequence
  chemically synthesized
tcacgtgcaaagacacacat

SEQ ID NO: 356544 - DNA, 20 bp, Artificial Sequence
  chemically synthesized
cacacataggctcaaaataa

SEQ ID NO: 356545 - DNA, 20 bp, Artificial Sequence
  chemically synthesized
ttcctctatccttttatttt

SEQ ID NO: 356546 - DNA, 20 bp, Artificial Sequence
  chemically synthesized
acacataggctcaaaataaa

SEQ ID NO: 356547 - DNA, 20 bp, Artificial Sequence
  chemically synthesized
ataggctcaaaataaaagga

SEQ ID NO: 356548 - DNA, 20 bp, Artificial Sequence
  chemically synthesized
aggctcaaaataaaaggata

SEQ ID NO: 356549 - DNA, 20 bp, Artificial Sequence
  chemically synthesized
ggctcaaaataaaaggatag

SEQ ID NO: 356550 - DNA, 20 bp, Artificial Sequence
  chemically synthesized
aggatagaggaatatttacc

SEQ ID NO: 356551 - DNA, 20 bp, Artificial Sequence
  chemically synthesized
aggaatatttaccaagcaaa

SEQ ID NO: 356552 - DNA, 20 bp, Artificial Sequence
  chemically synthesized
ttttttgctttccatttgct

SEQ ID NO: 356553 - DNA, 20 bp, Artificial Sequence
  chemically synthesized
atatttaccaagcaaatgga

SEQ ID NO: 356554 - DNA, 20 bp, Artificial Sequence
  chemically synthesized
atggaaagcaaaaaaaataa

SEQ ID NO: 356555 - DNA, 20 bp, Artificial Sequence
  chemically synthesized
gaaagcaaaaaaaataaaag

SEQ ID NO: 356556 - DNA, 20 bp, Artificial Sequence
  chemically synthesized
aaagcaaaaaaaataaaagc

SEQ ID NO: 356557 - DNA, 20 bp, Artificial Sequence
  chemically synthesized
aagcaaaaaaaataaaagca

SEQ ID NO: 356558 - DNA, 20 bp, Artificial Sequence
  chemically synthesized
agcaaaaaaaataaaagcag

SEQ ID NO: 356559 - DNA, 20 bp, Artificial Sequence
  chemically synthesized
aagtctattttatcagagaa

SEQ ID NO: 356560 - DNA, 20 bp, Artificial Sequence
  chemically synthesized
gtttaaagtctattttatca

SEQ ID NO: 356561 - DNA, 20 bp, Artificial Sequence
  chemically synthesized
aattctattctctgataaaa

SEQ ID NO: 356562 - DNA, 20 bp, Artificial Sequence
  chemically synthesized
tagtttaaagtctattttat

SEQ ID NO: 356563 - DNA, 20 bp, Artificial Sequence
  chemically synthesized
tttaaatctttgttagttta

SEQ ID NO: 356564 - DNA, 20 bp, Artificial Sequence
  chemically synthesized
aaatagactttaaactaaca

SEQ ID NO: 356565 - DNA, 20 bp, Artificial Sequence
  chemically synthesized
tgttttttttaaatctttgt

SEQ ID NO: 356566 - DNA, 20 bp, Artificial Sequence
  chemically synthesized
agatttaaaaaaaacaaaaa

SEQ ID NO: 356567 - DNA, 20 bp, Artificial Sequence
  chemically synthesized
aaaaaaaacaaaaaaagaca

SEQ ID NO: 356568 - DNA, 20 bp, Artificial Sequence
  chemically synthesized
aaaaacaaaaaaagacaaag

SEQ ID NO: 356569 - DNA, 20 bp, Artificial Sequence
  chemically synthesized
aaaacaaaaaaagacaaaga

SEQ ID NO: 356570 - DNA, 20 bp, Artificial Sequence
  chemically synthesized
aaacaaaaaaagacaaagaa

SEQ ID NO: 356571 - DNA, 20 bp, Artificial Sequence
  chemically synthesized
caaagaagggcattacataa

SEQ ID NO: 356572 - DNA, 20 bp, Artificial Sequence
  chemically synthesized
aagggcattacataatggta

SEQ ID NO: 356573 - DNA, 20 bp, Artificial Sequence
  chemically synthesized
agggcattacataatggtaa

SEQ ID NO: 356574 - DNA, 20 bp, Artificial Sequence
  chemically synthesized
gggcattacataatggtaaa

SEQ ID NO: 356575 - DNA, 20 bp, Artificial Sequence
  chemically synthesized
ggtaaagggatcaatgcaat

SEQ ID NO: 356576 - DNA, 20 bp, Artificial Sequence
  chemically synthesized
aaagggatcaatgcaataag

SEQ ID NO: 356577 - DNA, 20 bp, Artificial Sequence
  chemically synthesized
catatatatttaggatagtt

SEQ ID NO: 356578 - DNA, 20 bp, Artificial Sequence
  chemically synthesized
gcatatatatttaggatagt

SEQ ID NO: 356579 - DNA, 20 bp, Artificial Sequence
  chemically synthesized
gggtgcatatatatttagga

SEQ ID NO: 356580 - DNA, 20 bp, Artificial Sequence
  chemically synthesized
tattgggtgcatatatattt

SEQ ID NO: 356581 - DNA, 20 bp, Artificial Sequence
  chemically synthesized
gtattgggtgcatatatatt

SEQ ID NO: 356582 - DNA, 20 bp, Artificial Sequence
  chemically synthesized
aaatatatatgcacccaata

SEQ ID NO: 356583 - DNA, 20 bp, Artificial Sequence
  chemically synthesized
aatatatatgcacccaatac

SEQ ID NO: 356584 - DNA, 20 bp, Artificial Sequence
  chemically synthesized
tatatatgcacccaatacag

SEQ ID NO: 356585 - DNA, 20 bp, Artificial Sequence
  chemically synthesized
aatctgggtgctcctgtatt

SEQ ID NO: 356586 - DNA, 20 bp, Artificial Sequence
  chemically synthesized
gaatctgggtgctcctgtat

SEQ ID NO: 356587 - DNA, 20 bp, Artificial Sequence
  chemically synthesized
gcacccaatacaggagcacc

SEQ ID NO: 356588 - DNA, 20 bp, Artificial Sequence
  chemically synthesized
agaacttgctttatgaatct

SEQ ID NO: 356589 - DNA, 20 bp, Artificial Sequence
  chemically synthesized
aagaacttgctttatgaatc

SEQ ID NO: 356590 - DNA, 20 bp, Artificial Sequence
  chemically synthesized
caggagcacccagattcata

SEQ ID NO: 356591 - DNA, 20 bp, Artificial Sequence
  chemically synthesized
agcacccagattcataaagc

SEQ ID NO: 356592 - DNA, 20 bp, Artificial Sequence
  chemically synthesized
agattcataaagcaagttct

SEQ ID NO: 356593 - DNA, 20 bp, Artificial Sequence
  chemically synthesized
attcataaagcaagttctta

SEQ ID NO: 356594 - DNA, 20 bp, Artificial Sequence
  chemically synthesized
ctgtctctatgtaggtctct

SEQ ID NO: 356595 - DNA, 20 bp, Artificial Sequence
  chemically synthesized
caagttcttagagacctaca

SEQ ID NO: 356596 - DNA, 20 bp, Artificial Sequence
  chemically synthesized
agttcttagagacctacata

SEQ ID NO: 356597 - DNA, 20 bp, Artificial Sequence
  chemically synthesized
ttgggagtctgtctctatgt

SEQ ID NO: 356598 - DNA, 20 bp, Artificial Sequence
  chemically synthesized
tttgggagtctgtctctatg

SEQ ID NO: 356599 - DNA, 20 bp, Artificial Sequence
  chemically synthesized
cttagagacctacatagaga

SEQ ID NO: 356600 - DNA, 20 bp, Artificial Sequence
  chemically synthesized
ctcccactattattgtttgg

SEQ ID NO: 356601 - DNA, 20 bp, Artificial Sequence
  chemically synthesized
gtctcccactattattgttt

SEQ ID NO: 356602 - DNA, 20 bp, Artificial Sequence
  chemically synthesized
agtctcccactattattgtt

SEQ ID NO: 356603 - DNA, 20 bp, Artificial Sequence
  chemically synthesized
gacagactcccaaacaataa

SEQ ID NO: 356604 - DNA, 20 bp, Artificial Sequence
  chemically synthesized
agactcccaaacaataatag

SEQ ID NO: 356605 - DNA, 20 bp, Artificial Sequence
  chemically synthesized
gactcccaaacaataatagt

SEQ ID NO: 356606 - DNA, 20 bp, Artificial Sequence
  chemically synthesized
ctcccaaacaataatagtgg

SEQ ID NO: 356607 - DNA, 20 bp, Artificial Sequence
  chemically synthesized
atgttggcagtggggtgtta

SEQ ID NO: 356608 - DNA, 20 bp, Artificial Sequence
  chemically synthesized
ttgatctaatgttggcagtg

SEQ ID NO: 356609 - DNA, 20 bp, Artificial Sequence
  chemically synthesized
gttgatctaatgttggcagt

SEQ ID NO: 356610 - DNA, 20 bp, Artificial Sequence
  chemically synthesized
cgttgatctaatgttggcag

SEQ ID NO: 356611 - DNA, 20 bp, Artificial Sequence
  chemically synthesized
taacaccccactgccaacat

SEQ ID NO: 356612 - DNA, 20 bp, Artificial Sequence
  chemically synthesized
tctcgttgatctaatgttgg

SEQ ID NO: 356613 - DNA, 20 bp, Artificial Sequence
  chemically synthesized
ctgtctcgttgatctaatgt

SEQ ID NO: 356614 - DNA, 20 bp, Artificial Sequence
  chemically synthesized
actgccaacattagatcaac

SEQ ID NO: 356615 - DNA, 20 bp, Artificial Sequence
  chemically synthesized
ccaacattagatcaacgaga

SEQ ID NO: 356616 - DNA, 20 bp, Artificial Sequence
  chemically synthesized
caacgagacagaaaattaac

SEQ ID NO: 356617 - DNA, 20 bp, Artificial Sequence
  chemically synthesized
aacgagacagaaaattaaca

SEQ ID NO: 356618 - DNA, 20 bp, Artificial Sequence
  chemically synthesized
agaaaattaacaaggatgtt

SEQ ID NO: 356619 - DNA, 20 bp, Artificial Sequence
  chemically synthesized
ggatgttcagtacttgaact

SEQ ID NO: 356620 - DNA, 20 bp, Artificial Sequence
  chemically synthesized
cttggtccagagctgagttc

SEQ ID NO: 356621 - DNA, 20 bp, Artificial Sequence
  chemically synthesized
tcagtacttgaactcagctc

SEQ ID NO: 356622 - DNA, 20 bp, Artificial Sequence
  chemically synthesized
ggtccacttggtccagagct

SEQ ID NO: 356623 - DNA, 20 bp, Artificial Sequence
  chemically synthesized
cttgaactcagctctggacc

SEQ ID NO: 356624 - DNA, 20 bp, Artificial Sequence
  chemically synthesized
tgtgaggtccacttggtcca

SEQ ID NO: 356625 - DNA, 20 bp, Artificial Sequence
  chemically synthesized
gaactcagctctggaccaag

SEQ ID NO: 356626 - DNA, 20 bp, Artificial Sequence
  chemically synthesized
tctgtgaggtccacttggtc

SEQ ID NO: 356627 - DNA, 20 bp, Artificial Sequence
  chemically synthesized
agatgtctgtgaggtccact

SEQ ID NO: 356628 - DNA, 20 bp, Artificial Sequence
  chemically synthesized
tctggaccaagtggacctca

SEQ ID NO: 356629 - DNA, 20 bp, Artificial Sequence
  chemically synthesized
gagttctgtagatgtctgtg

SEQ ID NO: 356630 - DNA, 20 bp, Artificial Sequence
  chemically synthesized
agagttctgtagatgtctgt

SEQ ID NO: 356631 - DNA, 20 bp, Artificial Sequence
  chemically synthesized
gtggacctcacagacatcta

SEQ ID NO: 356632 - DNA, 20 bp, Artificial Sequence
  chemically synthesized
atttggggtggagagttctg

SEQ ID NO: 356633 - DNA, 20 bp, Artificial Sequence
  chemically synthesized
ttctgttgatttggggtgga

SEQ ID NO: 356634 - DNA, 20 bp, Artificial Sequence
  chemically synthesized
tattctgttgatttggggtg

SEQ ID NO: 356635 - DNA, 20 bp, Artificial Sequence
  chemically synthesized
tatattctgttgatttgggg

SEQ ID NO: 356636 - DNA, 20 bp, Artificial Sequence
  chemically synthesized
atgtatattctgttgatttg

SEQ ID NO: 356637 - DNA, 20 bp, Artificial Sequence
  chemically synthesized
aactctccaccccaaatcaa

SEQ ID NO: 356638 - DNA, 20 bp, Artificial Sequence
  chemically synthesized
aatgtatattctgttgattt

SEQ ID NO: 356639 - DNA, 20 bp, Artificial Sequence
  chemically synthesized
gaatgtatattctgttgatt

SEQ ID NO: 356640 - DNA, 20 bp, Artificial Sequence
  chemically synthesized
aacagaatatacattcttct

SEQ ID NO: 356641 - DNA, 20 bp, Artificial Sequence
  chemically synthesized
aagtatgatgtggtgctgag

SEQ ID NO: 356642 - DNA, 20 bp, Artificial Sequence
  chemically synthesized
aataagtatgatgtggtgct

SEQ ID NO: 356643 - DNA, 20 bp, Artificial Sequence
  chemically synthesized
attttagaataagtatgatg

SEQ ID NO: 356644 - DNA, 20 bp, Artificial Sequence
  chemically synthesized
tatgtgatcaattttagaat

SEQ ID NO: 356645 - DNA, 20 bp, Artificial Sequence
  chemically synthesized
tctaattatgtgatcaattt

SEQ ID NO: 356646 - DNA, 20 bp, Artificial Sequence
  chemically synthesized
tctaaaattgatcacataat

SEQ ID NO: 356647 - DNA, 20 bp, Artificial Sequence
  chemically synthesized
aaaattgatcacataattag

SEQ ID NO: 356648 - DNA, 20 bp, Artificial Sequence
  chemically synthesized
attagaagtaaaacactcct

SEQ ID NO: 356649 - DNA, 20 bp, Artificial Sequence
  chemically synthesized
attcttttgcatttgctgag

SEQ ID NO: 356650 - DNA, 20 bp, Artificial Sequence
  chemically synthesized
tcattcttttgcatttgctg

SEQ ID NO: 356651 - DNA, 20 bp, Artificial Sequence
  chemically synthesized
ttcattcttttgcatttgct

SEQ ID NO: 356652 - DNA, 20 bp, Artificial Sequence
  chemically synthesized
acactcctcagcaaatgcaa

SEQ ID NO: 356653 - DNA, 20 bp, Artificial Sequence
  chemically synthesized
aatcataacaaccaacctct

SEQ ID NO: 356654 - DNA, 20 bp, Artificial Sequence
  chemically synthesized
tgcactgtggtctgagaggt

SEQ ID NO: 356655 - DNA, 20 bp, Artificial Sequence
  chemically synthesized
tgtttgcactgtggtctgag

SEQ ID NO: 356656 - DNA, 20 bp, Artificial Sequence
  chemically synthesized
ttgtttgcactgtggtctga

SEQ ID NO: 356657 - DNA, 20 bp, Artificial Sequence
  chemically synthesized
acaaccaacctctcagacca

SEQ ID NO: 356658 - DNA, 20 bp, Artificial Sequence
  chemically synthesized
atttgtttgcactgtggtct

SEQ ID NO: 356659 - DNA, 20 bp, Artificial Sequence
  chemically synthesized
gttctaatttgtttgcactg

SEQ ID NO: 356660 - DNA, 20 bp, Artificial Sequence
  chemically synthesized
agaccacagtgcaaacaaat

SEQ ID NO: 356661 - DNA, 20 bp, Artificial Sequence
  chemically synthesized
agtgcaaacaaattagaact

SEQ ID NO: 356662 - DNA, 20 bp, Artificial Sequence
  chemically synthesized
gtgcaaacaaattagaactc

SEQ ID NO: 356663 - DNA, 20 bp, Artificial Sequence
  chemically synthesized
acaaattagaactcaggatt

SEQ ID NO: 356664 - DNA, 20 bp, Artificial Sequence
  chemically synthesized
tgagtgagtttcttaatcct

SEQ ID NO: 356665 - DNA, 20 bp, Artificial Sequence
  chemically synthesized
gtagttgtatggttttgagt

SEQ ID NO: 356666 - DNA, 20 bp, Artificial Sequence
  chemically synthesized
ccatgtagttgtatggtttt

SEQ ID NO: 356667 - DNA, 20 bp, Artificial Sequence
  chemically synthesized
ttagtttccatgtagttgta

SEQ ID NO: 356668 - DNA, 20 bp, Artificial Sequence
  chemically synthesized
ctcaaaaccatacaactaca

SEQ ID NO: 356669 - DNA, 20 bp, Artificial Sequence
  chemically synthesized
gcagattgttagtttccatg

SEQ ID NO: 356670 - DNA, 20 bp, Artificial Sequence
  chemically synthesized
gttattcagaagcagattgt

SEQ ID NO: 356671 - DNA, 20 bp, Artificial Sequence
  chemically synthesized
acccagtagttattcagaag

SEQ ID NO: 356672 - DNA, 20 bp, Artificial Sequence
  chemically synthesized
tttacccagtagttattcag

SEQ ID NO: 356673 - DNA, 20 bp, Artificial Sequence
  chemically synthesized
ttatttacccagtagttatt

SEQ ID NO: 356674 - DNA, 20 bp, Artificial Sequence
  chemically synthesized
atctgcttctgaataactac

SEQ ID NO: 356675 - DNA, 20 bp, Artificial Sequence
  chemically synthesized
tctgcttctgaataactact

SEQ ID NO: 356676 - DNA, 20 bp, Artificial Sequence
  chemically synthesized
gaattctgttatttacccag

SEQ ID NO: 356677 - DNA, 20 bp, Artificial Sequence
  chemically synthesized
tcagaattctgttatttacc

SEQ ID NO: 356678 - DNA, 20 bp, Artificial Sequence
  chemically synthesized
aataactactgggtaaataa

SEQ ID NO: 356679 - DNA, 20 bp, Artificial Sequence
  chemically synthesized
ggtaaataacagaattctga

SEQ ID NO: 356680 - DNA, 20 bp, Artificial Sequence
  chemically synthesized
aagaacttctttatttctgt

SEQ ID NO: 356681 - DNA, 20 bp, Artificial Sequence
  chemically synthesized
acagaattctgacagaaata

SEQ ID NO: 356682 - DNA, 20 bp, Artificial Sequence
  chemically synthesized
gaattctgacagaaataaag

SEQ ID NO: 356683 - DNA, 20 bp, Artificial Sequence
  chemically synthesized
ctttgttctcattggtttca

SEQ ID NO: 356684 - DNA, 20 bp, Artificial Sequence
  chemically synthesized
agaagttctttgaaaccaat

SEQ ID NO: 356685 - DNA, 20 bp, Artificial Sequence
  chemically synthesized
cattgtatctttgttctcat

SEQ ID NO: 356686 - DNA, 20 bp, Artificial Sequence
  chemically synthesized
ctttgaaaccaatgagaaca

SEQ ID NO: 356687 - DNA, 20 bp, Artificial Sequence
  chemically synthesized
agaacaaagatacaatgtgc

SEQ ID NO: 356688 - DNA, 20 bp, Artificial Sequence
  chemically synthesized
atacaatgtgccagaatctc

SEQ ID NO: 356689 - DNA, 20 bp, Artificial Sequence
  chemically synthesized
tagctgtgtcccagagattc

SEQ ID NO: 356690 - DNA, 20 bp, Artificial Sequence
  chemically synthesized
tacaatgtgccagaatctct

SEQ ID NO: 356691 - DNA, 20 bp, Artificial Sequence
  chemically synthesized
gtgccagaatctctgggaca

SEQ ID NO: 356692 - DNA, 20 bp, Artificial Sequence
  chemically synthesized
actgctttagctgtgtccca

SEQ ID NO: 356693 - DNA, 20 bp, Artificial Sequence
  chemically synthesized
acactgctttagctgtgtcc

SEQ ID NO: 356694 - DNA, 20 bp, Artificial Sequence
  chemically synthesized
gaatctctgggacacagcta

SEQ ID NO: 356695 - DNA, 20 bp, Artificial Sequence
  chemically synthesized
tctctgggacacagctaaag

SEQ ID NO: 356696 - DNA, 20 bp, Artificial Sequence
  chemically synthesized
tttccctctcaacactgctt

SEQ ID NO: 356697 - DNA, 20 bp, Artificial Sequence
  chemically synthesized
gacacagctaaagcagtgtt

SEQ ID NO: 356698 - DNA, 20 bp, Artificial Sequence
  chemically synthesized
cacagctaaagcagtgttga

SEQ ID NO: 356699 - DNA, 20 bp, Artificial Sequence
  chemically synthesized
acagctaaagcagtgttgag

SEQ ID NO: 356700 - DNA, 20 bp, Artificial Sequence
  chemically synthesized
cagctaaagcagtgttgaga

SEQ ID NO: 356701 - DNA, 20 bp, Artificial Sequence
  chemically synthesized
agtgttgagagggaaattta

SEQ ID NO: 356702 - DNA, 20 bp, Artificial Sequence
  chemically synthesized
cgctttctcctgtgggcatt

SEQ ID NO: 356703 - DNA, 20 bp, Artificial Sequence
  chemically synthesized
tttacagcactaaatgccca

SEQ ID NO: 356704 - DNA, 20 bp, Artificial Sequence
  chemically synthesized
ttacagcactaaatgcccac

SEQ ID NO: 356705 - DNA, 20 bp, Artificial Sequence
  chemically synthesized
acagcactaaatgcccacag

SEQ ID NO: 356706 - DNA, 20 bp, Artificial Sequence
  chemically synthesized
tctttcccgctttctcctgt

SEQ ID NO: 356707 - DNA, 20 bp, Artificial Sequence
  chemically synthesized
cactaaatgcccacaggaga

SEQ ID NO: 356708 - DNA, 20 bp, Artificial Sequence
  chemically synthesized
atctttcccgctttctcctg

SEQ ID NO: 356709 - DNA, 20 bp, Artificial Sequence
  chemically synthesized
taaatgcccacaggagaaag

SEQ ID NO: 356710 - DNA, 20 bp, Artificial Sequence
  chemically synthesized
aaatgcccacaggagaaagc

SEQ ID NO: 356711 - DNA, 20 bp, Artificial Sequence
  chemically synthesized
gcccacaggagaaagcggga

SEQ ID NO: 356712 - DNA, 20 bp, Artificial Sequence
  chemically synthesized
tgatgttagggtgttgattt

SEQ ID NO: 356713 - DNA, 20 bp, Artificial Sequence
  chemically synthesized
ttctttcagttgtgatgtta

SEQ ID NO: 356714 - DNA, 20 bp, Artificial Sequence
  chemically synthesized
gttctttcagttgtgatgtt

SEQ ID NO: 356715 - DNA, 20 bp, Artificial Sequence
  chemically synthesized
agttctttcagttgtgatgt

SEQ ID NO: 356716 - DNA, 20 bp, Artificial Sequence
  chemically synthesized
caccctaacatcacaactga

SEQ ID NO: 356717 - DNA, 20 bp, Artificial Sequence
  chemically synthesized
aacatcacaactgaaagaac

SEQ ID NO: 356718 - DNA, 20 bp, Artificial Sequence
  chemically synthesized
tctggcttctctagttcttt

SEQ ID NO: 356719 - DNA, 20 bp, Artificial Sequence
  chemically synthesized
catcacaactgaaagaacta

SEQ ID NO: 356720 - DNA, 20 bp, Artificial Sequence
  chemically synthesized
cacaactgaaagaactagag

SEQ ID NO: 356721 - DNA, 20 bp, Artificial Sequence
  chemically synthesized
actgaaagaactagagaagc

SEQ ID NO: 356722 - DNA, 20 bp, Artificial Sequence
  chemically synthesized
tttgcttgctctggcttctc

SEQ ID NO: 356723 - DNA, 20 bp, Artificial Sequence
  chemically synthesized
tgaaagaactagagaagcca

SEQ ID NO: 356724 - DNA, 20 bp, Artificial Sequence
  chemically synthesized
agaactagagaagccagagc

SEQ ID NO: 356725 - DNA, 20 bp, Artificial Sequence
  chemically synthesized
agcttttgatttgcttgctc

SEQ ID NO: 356726 - DNA, 20 bp, Artificial Sequence
  chemically synthesized
agccagagcaagcaaatcaa

SEQ ID NO: 356727 - DNA, 20 bp, Artificial Sequence
  chemically synthesized
agagcaagcaaatcaaaagc

SEQ ID NO: 356728 - DNA, 20 bp, Artificial Sequence
  chemically synthesized
gcaagcaaatcaaaagctag

SEQ ID NO: 356729 - DNA, 20 bp, Artificial Sequence
  chemically synthesized
agcaaatcaaaagctagcag

SEQ ID NO: 356730 - DNA, 20 bp, Artificial Sequence
  chemically synthesized
agttatttcttgtcttctgc

SEQ ID NO: 356731 - DNA, 20 bp, Artificial Sequence
  chemically synthesized
atcaaaagctagcagaagac

SEQ ID NO: 356732 - DNA, 20 bp, Artificial Sequence
  chemically synthesized
gcagaagacaagaaataact

SEQ ID NO: 356733 - DNA, 20 bp, Artificial Sequence
  chemically synthesized
agacaagaaataactaagat

SEQ ID NO: 356734 - DNA, 20 bp, Artificial Sequence
  chemically synthesized
acaagaaataactaagatca

SEQ ID NO: 356735 - DNA, 20 bp, Artificial Sequence
  chemically synthesized
cttcagttctgctctgatct

SEQ ID NO: 356736 - DNA, 20 bp, Artificial Sequence
  chemically synthesized
agaaataactaagatcagag

SEQ ID NO: 356737 - DNA, 20 bp, Artificial Sequence
  chemically synthesized
ctaagatcagagcagaactg

SEQ ID NO: 356738 - DNA, 20 bp, Artificial Sequence
  chemically synthesized
taagatcagagcagaactga

SEQ ID NO: 356739 - DNA, 20 bp, Artificial Sequence
  chemically synthesized
agatcagagcagaactgaag

SEQ ID NO: 356740 - DNA, 20 bp, Artificial Sequence
  chemically synthesized
cagagcagaactgaaggaga

SEQ ID NO: 356741 - DNA, 20 bp, Artificial Sequence
  chemically synthesized
ttaaatgtttccgtctcctt

SEQ ID NO: 356742 - DNA, 20 bp, Artificial Sequence
  chemically synthesized
aaaaaaaacatcaacaaatc

SEQ ID NO: 356743 - DNA, 20 bp, Artificial Sequence
  chemically synthesized
aaaaaaacatcaacaaatcc

SEQ ID NO: 356744 - DNA, 20 bp, Artificial Sequence
  chemically synthesized
aaaaacatcaacaaatccag

SEQ ID NO: 356745 - DNA, 20 bp, Artificial Sequence
  chemically synthesized
aaaacatcaacaaatccagg

SEQ ID NO: 356746 - DNA, 20 bp, Artificial Sequence
  chemically synthesized
cttcaaaaaaaaacacctcc

SEQ ID NO: 356747 - DNA, 20 bp, Artificial Sequence
  chemically synthesized
ccaggaggtgtttttttttg

SEQ ID NO: 356748 - DNA, 20 bp, Artificial Sequence
  chemically synthesized
aggaggtgtttttttttgaa

SEQ ID NO: 356749 - DNA, 20 bp, Artificial Sequence
  chemically synthesized
ttttgaagagattaacaaaa

SEQ ID NO: 356750 - DNA, 20 bp, Artificial Sequence
  chemically synthesized
agattaacaaaatagactgc

SEQ ID NO: 356751 - DNA, 20 bp, Artificial Sequence
  chemically synthesized
taacaaaatagactgctaga

SEQ ID NO: 356752 - DNA, 20 bp, Artificial Sequence
  chemically synthesized
ttctttattagtctatctag

SEQ ID NO: 356753 - DNA, 20 bp, Artificial Sequence
  chemically synthesized
tttttctttattagtctatc

SEQ ID NO: 356754 - DNA, 20 bp, Artificial Sequence
  chemically synthesized
gactgctagatagactaata

SEQ ID NO: 356755 - DNA, 20 bp, Artificial Sequence
  chemically synthesized
tcttctctatttttctttat

SEQ ID NO: 356756 - DNA, 20 bp, Artificial Sequence
  chemically synthesized
gatagactaataaagaaaaa

SEQ ID NO: 356757 - DNA, 20 bp, Artificial Sequence
  chemically synthesized
tagactaataaagaaaaata

SEQ ID NO: 356758 - DNA, 20 bp, Artificial Sequence
  chemically synthesized
actaataaagaaaaatagag

SEQ ID NO: 356759 - DNA, 20 bp, Artificial Sequence
  chemically synthesized
aaaaatagagaagaatcaaa

SEQ ID NO: 356760 - DNA, 20 bp, Artificial Sequence
  chemically synthesized
agacacaataaaaaatgata

SEQ ID NO: 356761 - DNA, 20 bp, Artificial Sequence
  chemically synthesized
gacacaataaaaaatgataa

SEQ ID NO: 356762 - DNA, 20 bp, Artificial Sequence
  chemically synthesized
acacaataaaaaatgataaa

SEQ ID NO: 356763 - DNA, 20 bp, Artificial Sequence
  chemically synthesized
cacaataaaaaatgataaag

SEQ ID NO: 356764 - DNA, 20 bp, Artificial Sequence
  chemically synthesized
ttgtatttctgtgggatcag

SEQ ID NO: 356765 - DNA, 20 bp, Artificial Sequence
  chemically synthesized
ggatatcaccactgatccca

SEQ ID NO: 356766 - DNA, 20 bp, Artificial Sequence
  chemically synthesized
agtttgtatttctgtgggat

SEQ ID NO: 356767 - DNA, 20 bp, Artificial Sequence
  chemically synthesized
atggtagtttgtatttctgt

SEQ ID NO: 356768 - DNA, 20 bp, Artificial Sequence
  chemically synthesized
gatggtagtttgtatttctg

SEQ ID NO: 356769 - DNA, 20 bp, Artificial Sequence
  chemically synthesized
acagaaatacaaactaccat

SEQ ID NO: 356770 - DNA, 20 bp, Artificial Sequence
  chemically synthesized
agaaatacaaactaccatca

SEQ ID NO: 356771 - DNA, 20 bp, Artificial Sequence
  chemically synthesized
tttgtagtattctctgatgg

SEQ ID NO: 356772 - DNA, 20 bp, Artificial Sequence
  chemically synthesized
gtgtttgtagtattctctga

SEQ ID NO: 356773 - DNA, 20 bp, Artificial Sequence
  chemically synthesized
tatttgcgtagaggtgtttg

SEQ ID NO: 356774 - DNA, 20 bp, Artificial Sequence
  chemically synthesized
tttcctgtttatttgcgtag

SEQ ID NO: 356775 - DNA, 20 bp, Artificial Sequence
  chemically synthesized
gtttcctgtttatttgcgta

SEQ ID NO: 356776 - DNA, 20 bp, Artificial Sequence
  chemically synthesized
aggtttcctgtttatttgcg

SEQ ID NO: 356777 - DNA, 20 bp, Artificial Sequence
  chemically synthesized
aacacctctacgcaaataaa

SEQ ID NO: 356778 - DNA, 20 bp, Artificial Sequence
  chemically synthesized
acacctctacgcaaataaac

SEQ ID NO: 356779 - DNA, 20 bp, Artificial Sequence
  chemically synthesized
aataaacaggaaacctgttt

SEQ ID NO: 356780 - DNA, 20 bp, Artificial Sequence
  chemically synthesized
gagcatcttatcgcttaaac

SEQ ID NO: 356781 - DNA, 20 bp, Artificial Sequence
  chemically synthesized
agagcatcttatcgcttaaa

SEQ ID NO: 356782 - DNA, 20 bp, Artificial Sequence
  chemically synthesized
aggaaacctgtttaagcgat

SEQ ID NO: 356783 - DNA, 20 bp, Artificial Sequence
  chemically synthesized
cgataagatgctctttcaat

SEQ ID NO: 356784 - DNA, 20 bp, Artificial Sequence
  chemically synthesized
atagactcttccaattgaaa

SEQ ID NO: 356785 - DNA, 20 bp, Artificial Sequence
  chemically synthesized
atatagactcttccaattga

SEQ ID NO: 356786 - DNA, 20 bp, Artificial Sequence
  chemically synthesized
taagatgctctttcaattgg

SEQ ID NO: 356787 - DNA, 20 bp, Artificial Sequence
  chemically synthesized
agatgctctttcaattggaa

SEQ ID NO: 356788 - DNA, 20 bp, Artificial Sequence
  chemically synthesized
caattggaagagtctatata

SEQ ID NO: 356789 - DNA, 20 bp, Artificial Sequence
  chemically synthesized
ctgtaaagcctttctatata

SEQ ID NO: 356790 - DNA, 20 bp, Artificial Sequence
  chemically synthesized
tggaagagtctatatataga

SEQ ID NO: 356791 - DNA, 20 bp, Artificial Sequence
  chemically synthesized
ggaagagtctatatatagaa

SEQ ID NO: 356792 - DNA, 20 bp, Artificial Sequence
  chemically synthesized
ctatatatagaaaggcttta

SEQ ID NO: 356793 - DNA, 20 bp, Artificial Sequence
  chemically synthesized
aataaaatctcatatctgta

SEQ ID NO: 356794 - DNA, 20 bp, Artificial Sequence
  chemically synthesized
tagaaaggctttacagatat

SEQ ID NO: 356795 - DNA, 20 bp, Artificial Sequence
  chemically synthesized
ttacagatatgagattttat

SEQ ID NO: 356796 - DNA, 20 bp, Artificial Sequence
  chemically synthesized
tacagatatgagattttatt

SEQ ID NO: 356797 - DNA, 20 bp, Artificial Sequence
  chemically synthesized
tgagattttattgggaaaac

SEQ ID NO: 356798 - DNA, 20 bp, Artificial Sequence
  chemically synthesized
tattgggaaaacgagaccat

SEQ ID NO: 356799 - DNA, 20 bp, Artificial Sequence
  chemically synthesized
tgggaaaacgagaccataag

SEQ ID NO: 356800 - DNA, 20 bp, Artificial Sequence
  chemically synthesized
gaaaacgagaccataagcag

SEQ ID NO: 356801 - DNA, 20 bp, Artificial Sequence
  chemically synthesized
gaagatccagccactgctta

SEQ ID NO: 356802 - DNA, 20 bp, Artificial Sequence
  chemically synthesized
acgagaccataagcagtggc

SEQ ID NO: 356803 - DNA, 20 bp, Artificial Sequence
  chemically synthesized
caggctgattaatgaagatc

SEQ ID NO: 356804 - DNA, 20 bp, Artificial Sequence
  chemically synthesized
gtggctggatcttcattaat

SEQ ID NO: 356805 - DNA, 20 bp, Artificial Sequence
  chemically synthesized
gaaatacaggctgattaatg

SEQ ID NO: 356806 - DNA, 20 bp, Artificial Sequence
  chemically synthesized
caaaatgtaatatgaaatac

SEQ ID NO: 356807 - DNA, 20 bp, Artificial Sequence
  chemically synthesized
acaaaatgtaatatgaaata

SEQ ID NO: 356808 - DNA, 20 bp, Artificial Sequence
  chemically synthesized
ttgttgattttaaattgttg

SEQ ID NO: 356809 - DNA, 20 bp, Artificial Sequence
  chemically synthesized
attttaaattgttgaagttt

SEQ ID NO: 356810 - DNA, 20 bp, Artificial Sequence
  chemically synthesized
taaattgttgaagtttgaga

SEQ ID NO: 356811 - DNA, 20 bp, Artificial Sequence
  chemically synthesized
tgaagtttgagacagtaaaa

SEQ ID NO: 356812 - DNA, 20 bp, Artificial Sequence
  chemically synthesized
acagtaaaatggtgatctta

SEQ ID NO: 356813 - DNA, 20 bp, Artificial Sequence
  chemically synthesized
cagtaaaatggtgatcttat

SEQ ID NO: 356814 - DNA, 20 bp, Artificial Sequence
  chemically synthesized
aggtacattgtatatcctat

SEQ ID NO: 356815 - DNA, 20 bp, Artificial Sequence
  chemically synthesized
agtgggaagtatatgtagaa

SEQ ID NO: 356816 - DNA, 20 bp, Artificial Sequence
  chemically synthesized
aagtgggaagtatatgtaga

SEQ ID NO: 356817 - DNA, 20 bp, Artificial Sequence
  chemically synthesized
tcctaagtgggaagtatatg

SEQ ID NO: 356818 - DNA, 20 bp, Artificial Sequence
  chemically synthesized
ttctacatatacttcccact

SEQ ID NO: 356819 - DNA, 20 bp, Artificial Sequence
  chemically synthesized
tctacatatacttcccactt

SEQ ID NO: 356820 - DNA, 20 bp, Artificial Sequence
  chemically synthesized
catatgctctcctaagtggg

SEQ ID NO: 356821 - DNA, 20 bp, Artificial Sequence
  chemically synthesized
tacatatacttcccacttag

SEQ ID NO: 356822 - DNA, 20 bp, Artificial Sequence
  chemically synthesized
ctccatatgctctcctaagt

SEQ ID NO: 356823 - DNA, 20 bp, Artificial Sequence
  chemically synthesized
catatacttcccacttagga

SEQ ID NO: 356824 - DNA, 20 bp, Artificial Sequence
  chemically synthesized
actccatatgctctcctaag

SEQ ID NO: 356825 - DNA, 20 bp, Artificial Sequence
  chemically synthesized
ctaactccatatgctctcct

SEQ ID NO: 356826 - DNA, 20 bp, Artificial Sequence
  chemically synthesized
ttcccacttaggagagcata

SEQ ID NO: 356827 - DNA, 20 bp, Artificial Sequence
  chemically synthesized
cccacttaggagagcatatg

SEQ ID NO: 356828 - DNA, 20 bp, Artificial Sequence
  chemically synthesized
cttaggagagcatatggagt

SEQ ID NO: 356829 - DNA, 20 bp, Artificial Sequence
  chemically synthesized
ttaggagagcatatggagtt

SEQ ID NO: 356830 - DNA, 20 bp, Artificial Sequence
  chemically synthesized
gcatatggagttaggtatac

SEQ ID NO: 356831 - DNA, 20 bp, Artificial Sequence
  chemically synthesized
catatggagttaggtatacc

SEQ ID NO: 356832 - DNA, 20 bp, Artificial Sequence
  chemically synthesized
attttatagctaaaagagcc

SEQ ID NO: 356833 - DNA, 20 bp, Artificial Sequence
  chemically synthesized
ttaggtataccaggctcttt

SEQ ID NO: 356834 - DNA, 20 bp, Artificial Sequence
  chemically synthesized
agtgtattttatagctaaaa

SEQ ID NO: 356835 - DNA, 20 bp, Artificial Sequence
  chemically synthesized
atagtgtattttatagctaa

SEQ ID NO: 356836 - DNA, 20 bp, Artificial Sequence
  chemically synthesized
tacatgaatagtgtatttta

SEQ ID NO: 356837 - DNA, 20 bp, Artificial Sequence
  chemically synthesized
gaaaaaggcaggtacatgaa

SEQ ID NO: 356838 - DNA, 20 bp, Artificial Sequence
  chemically synthesized
gcctgtaatcagaaaaaggc

SEQ ID NO: 356839 - DNA, 20 bp, Artificial Sequence
  chemically synthesized
agcctgtaatcagaaaaagg

SEQ ID NO: 356840 - DNA, 20 bp, Artificial Sequence
  chemically synthesized
acgagcctgtaatcagaaaa

SEQ ID NO: 356841 - DNA, 20 bp, Artificial Sequence
  chemically synthesized
gacgagcctgtaatcagaaa

SEQ ID NO: 356842 - DNA, 20 bp, Artificial Sequence
  chemically synthesized
tacctgcctttttctgatta

SEQ ID NO: 356843 - DNA, 20 bp, Artificial Sequence
  chemically synthesized
acctgcctttttctgattac

SEQ ID NO: 356844 - DNA, 20 bp, Artificial Sequence
  chemically synthesized
taggttgacgagcctgtaat

SEQ ID NO: 356845 - DNA, 20 bp, Artificial Sequence
  chemically synthesized
attttaaaaagtaggttgac

SEQ ID NO: 356846 - DNA, 20 bp, Artificial Sequence
  chemically synthesized
taaaaacaattttaaaaagt

SEQ ID NO: 356847 - DNA, 20 bp, Artificial Sequence
  chemically synthesized
ataaaaacaattttaaaaag

SEQ ID NO: 356848 - DNA, 20 bp, Artificial Sequence
  chemically synthesized
tgaataaaaacaattttaaa

SEQ ID NO: 356849 - DNA, 20 bp, Artificial Sequence
  chemically synthesized
ttattcatttaaattttttg

SEQ ID NO: 356850 - DNA, 20 bp, Artificial Sequence
  chemically synthesized
attttttgtggatatataca

SEQ ID NO: 356851 - DNA, 20 bp, Artificial Sequence
  chemically synthesized
ttttttgtggatatatacat

SEQ ID NO: 356852 - DNA, 20 bp, Artificial Sequence
  chemically synthesized
ccacatcataatcagaaaat

SEQ ID NO: 356853 - DNA, 20 bp, Artificial Sequence
  chemically synthesized
tccacatcataatcagaaaa

SEQ ID NO: 356854 - DNA, 20 bp, Artificial Sequence
  chemically synthesized
atgggcatccacatcataat

SEQ ID NO: 356855 - DNA, 20 bp, Artificial Sequence
  chemically synthesized
cctattttctgattatgatg

SEQ ID NO: 356856 - DNA, 20 bp, Artificial Sequence
  chemically synthesized
ttatgatgtggatgcccatt

SEQ ID NO: 356857 - DNA, 20 bp, Artificial Sequence
  chemically synthesized
tatgatgtggatgcccattt

SEQ ID NO: 356858 - DNA, 20 bp, Artificial Sequence
  chemically synthesized
cagaataggagtgcctaaat

SEQ ID NO: 356859 - DNA, 20 bp, Artificial Sequence
  chemically synthesized
acagaataggagtgcctaaa

SEQ ID NO: 356860 - DNA, 20 bp, Artificial Sequence
  chemically synthesized
cctttgaacttacagaatag

SEQ ID NO: 356861 - DNA, 20 bp, Artificial Sequence
  chemically synthesized
tttaggcactcctattctgt

SEQ ID NO: 356862 - DNA, 20 bp, Artificial Sequence
  chemically synthesized
ctcctttgaacttacagaat

SEQ ID NO: 356863 - DNA, 20 bp, Artificial Sequence
  chemically synthesized
gctcctttgaacttacagaa

SEQ ID NO: 356864 - DNA, 20 bp, Artificial Sequence
  chemically synthesized
ctagtgctcctttgaactta

SEQ ID NO: 356865 - DNA, 20 bp, Artificial Sequence
  chemically synthesized
actcctattctgtaagttca

SEQ ID NO: 356866 - DNA, 20 bp, Artificial Sequence
  chemically synthesized
ctcctattctgtaagttcaa

SEQ ID NO: 356867 - DNA, 20 bp, Artificial Sequence
  chemically synthesized
cctattctgtaagttcaaag

SEQ ID NO: 356868 - DNA, 20 bp, Artificial Sequence
  chemically synthesized
ctgtaagttcaaaggagcac

SEQ ID NO: 356869 - DNA, 20 bp, Artificial Sequence
  chemically synthesized
gtaagttcaaaggagcacta

SEQ ID NO: 356870 - DNA, 20 bp, Artificial Sequence
  chemically synthesized
taagttcaaaggagcactag

SEQ ID NO: 356871 - DNA, 20 bp, Artificial Sequence
  chemically synthesized
acaaaatggcttttgacctc

SEQ ID NO: 356872 - DNA, 20 bp, Artificial Sequence
  chemically synthesized
aaaggagcactagaggtcaa

SEQ ID NO: 356873 - DNA, 20 bp, Artificial Sequence
  chemically synthesized
tttcttattaagtgacaaaa

SEQ ID NO: 356874 - DNA, 20 bp, Artificial Sequence
  chemically synthesized
aagccattttgtcacttaat

SEQ ID NO: 356875 - DNA, 20 bp, Artificial Sequence
  chemically synthesized
aaatagatatttttcttatt

SEQ ID NO: 356876 - DNA, 20 bp, Artificial Sequence
  chemically synthesized
agtaagagaagatttaaaaa

SEQ ID NO: 356877 - DNA, 20 bp, Artificial Sequence
  chemically synthesized
ctttcataaaacagtaagag

SEQ ID NO: 356878 - DNA, 20 bp, Artificial Sequence
  chemically synthesized
atcctttcataaaacagtaa

SEQ ID NO: 356879 - DNA, 20 bp, Artificial Sequence
  chemically synthesized
ctatcctttcataaaacagt

SEQ ID NO: 356880 - DNA, 20 bp, Artificial Sequence
  chemically synthesized
tgtcctatcctttcataaaa

SEQ ID NO: 356881 - DNA, 20 bp, Artificial Sequence
  chemically synthesized
cttctcttactgttttatga

SEQ ID NO: 356882 - DNA, 20 bp, Artificial Sequence
  chemically synthesized
ttctcttactgttttatgaa

SEQ ID NO: 356883 - DNA, 20 bp, Artificial Sequence
  chemically synthesized
cttactgttttatgaaagga

SEQ ID NO: 356884 - DNA, 20 bp, Artificial Sequence
  chemically synthesized
ttactgttttatgaaaggat

SEQ ID NO: 356885 - DNA, 20 bp, Artificial Sequence
  chemically synthesized
tgaaaggataggacacacac

SEQ ID NO: 356886 - DNA, 20 bp, Artificial Sequence
  chemically synthesized
aggacacacacaagaataac

SEQ ID NO: 356887 - DNA, 20 bp, Artificial Sequence
  chemically synthesized
gacacacacaagaataacta

SEQ ID NO: 356888 - DNA, 20 bp, Artificial Sequence
  chemically synthesized
cattattggggtgtatgctc

SEQ ID NO: 356889 - DNA, 20 bp, Artificial Sequence
  chemically synthesized
tagagcatacaccccaataa

SEQ ID NO: 356890 - DNA, 20 bp, Artificial Sequence
  chemically synthesized
agagcatacaccccaataat

SEQ ID NO: 356891 - DNA, 20 bp, Artificial Sequence
  chemically synthesized
atggtcagttcccattattg

SEQ ID NO: 356892 - DNA, 20 bp, Artificial Sequence
  chemically synthesized
tatggtcagttcccattatt

SEQ ID NO: 356893 - DNA, 20 bp, Artificial Sequence
  chemically synthesized
atatggtcagttcccattat

SEQ ID NO: 356894 - DNA, 20 bp, Artificial Sequence
  chemically synthesized
tttattgaatcacatatggt

SEQ ID NO: 356895 - DNA, 20 bp, Artificial Sequence
  chemically synthesized
gttttttattgaatcacata

SEQ ID NO: 356896 - DNA, 20 bp, Artificial Sequence
  chemically synthesized
ataaaaaacaaacatattaa

SEQ ID NO: 356897 - DNA, 20 bp, Artificial Sequence
  chemically synthesized
ctgtatgaatttgaaagata

SEQ ID NO: 356898 - DNA, 20 bp, Artificial Sequence
  chemically synthesized
actgtatgaatttgaaagat

SEQ ID NO: 356899 - DNA, 20 bp, Artificial Sequence
  chemically synthesized
gctatactgtatgaatttga

SEQ ID NO: 356900 - DNA, 20 bp, Artificial Sequence
  chemically synthesized
ccttatctttcaaattcata

SEQ ID NO: 356901 - DNA, 20 bp, Artificial Sequence
  chemically synthesized
tctttcaaattcatacagta

SEQ ID NO: 356902 - DNA, 20 bp, Artificial Sequence
  chemically synthesized
cttcaacctctgaggataaa

SEQ ID NO: 356903 - DNA, 20 bp, Artificial Sequence
  chemically synthesized
acagtatagctctttatcct

SEQ ID NO: 356904 - DNA, 20 bp, Artificial Sequence
  chemically synthesized
gacttcaacctctgaggata

SEQ ID NO: 356905 - DNA, 20 bp, Artificial Sequence
  chemically synthesized
agtatagctctttatcctca

SEQ ID NO: 356906 - DNA, 20 bp, Artificial Sequence
  chemically synthesized
gtatagctctttatcctcag

SEQ ID NO: 356907 - DNA, 20 bp, Artificial Sequence
  chemically synthesized
aatacggacttcaacctctg

SEQ ID NO: 356908 - DNA, 20 bp, Artificial Sequence
  chemically synthesized
aaatacggacttcaacctct

SEQ ID NO: 356909 - DNA, 20 bp, Artificial Sequence
  chemically synthesized
ctctttatcctcagaggttg

SEQ ID NO: 356910 - DNA, 20 bp, Artificial Sequence
  chemically synthesized
gggcagacataatgaaaata

SEQ ID NO: 356911 - DNA, 20 bp, Artificial Sequence
  chemically synthesized
gttcagtgaggtagaaaggg

SEQ ID NO: 356912 - DNA, 20 bp, Artificial Sequence
  chemically synthesized
ttagttcagtgaggtagaaa

SEQ ID NO: 356913 - DNA, 20 bp, Artificial Sequence
  chemically synthesized
cttagttcagtgaggtagaa

SEQ ID NO: 356914 - DNA, 20 bp, Artificial Sequence
  chemically synthesized
tcttagttcagtgaggtaga

SEQ ID NO: 356915 - DNA, 20 bp, Artificial Sequence
  chemically synthesized
tttctcttagttcagtgagg

SEQ ID NO: 356916 - DNA, 20 bp, Artificial Sequence
  chemically synthesized
tgttttctcttagttcagtg

SEQ ID NO: 356917 - DNA, 20 bp, Artificial Sequence
  chemically synthesized
atgttttctcttagttcagt

SEQ ID NO: 356918 - DNA, 20 bp, Artificial Sequence
  chemically synthesized
cctttctacctcactgaact

SEQ ID NO: 356919 - DNA, 20 bp, Artificial Sequence
  chemically synthesized
tttctacctcactgaactaa

SEQ ID NO: 356920 - DNA, 20 bp, Artificial Sequence
  chemically synthesized
ttgtatgttttctcttagtt

SEQ ID NO: 356921 - DNA, 20 bp, Artificial Sequence
  chemically synthesized
cacatttgtatgttttctct

SEQ ID NO: 356922 - DNA, 20 bp, Artificial Sequence
  chemically synthesized
aacatacaaatgtgtactac

SEQ ID NO: 356923 - DNA, 20 bp, Artificial Sequence
  chemically synthesized
attactttactattgactcg

SEQ ID NO: 356924 - DNA, 20 bp, Artificial Sequence
  chemically synthesized
aaatgtgtactacgagtcaa

SEQ ID NO: 356925 - DNA, 20 bp, Artificial Sequence
  chemically synthesized
tgtactacgagtcaatagta

SEQ ID NO: 356926 - DNA, 20 bp, Artificial Sequence
  chemically synthesized
cttagtttgcagtatagggg

SEQ ID NO: 356927 - DNA, 20 bp, Artificial Sequence
  chemically synthesized
ccttagtttgcagtataggg

SEQ ID NO: 356928 - DNA, 20 bp, Artificial Sequence
  chemically synthesized
gtccttagtttgcagtatag

SEQ ID NO: 356929 - DNA, 20 bp, Artificial Sequence
  chemically synthesized
cgtccttagtttgcagtata

SEQ ID NO: 356930 - DNA, 20 bp, Artificial Sequence
  chemically synthesized
acgtccttagtttgcagtat

SEQ ID NO: 356931 - DNA, 20 bp, Artificial Sequence
  chemically synthesized
tacgtccttagtttgcagta

SEQ ID NO: 356932 - DNA, 20 bp, Artificial Sequence
  chemically synthesized
cctcccctatactgcaaact

SEQ ID NO: 356933 - DNA, 20 bp, Artificial Sequence
  chemically synthesized
ctcccctatactgcaaacta

SEQ ID NO: 356934 - DNA, 20 bp, Artificial Sequence
  chemically synthesized
aatcctacgtccttagtttg

SEQ ID NO: 356935 - DNA, 20 bp, Artificial Sequence
  chemically synthesized
tatactgcaaactaaggacg

SEQ ID NO: 356936 - DNA, 20 bp, Artificial Sequence
  chemically synthesized
atactgcaaactaaggacgt

SEQ ID NO: 356937 - DNA, 20 bp, Artificial Sequence
  chemically synthesized
aactattaatcctacgtcct

SEQ ID NO: 356938 - DNA, 20 bp, Artificial Sequence
  chemically synthesized
aactaaggacgtaggattaa

SEQ ID NO: 356939 - DNA, 20 bp, Artificial Sequence
  chemically synthesized
aggattaatagtttctccct

SEQ ID NO: 356940 - DNA, 20 bp, Artificial Sequence
  chemically synthesized
gattaatagtttctccctta

SEQ ID NO: 356941 - DNA, 20 bp, Artificial Sequence
  chemically synthesized
ccctgtttttagctctaagg

SEQ ID NO: 356942 - DNA, 20 bp, Artificial Sequence
  chemically synthesized
acccctgtttttagctctaa

SEQ ID NO: 356943 - DNA, 20 bp, Artificial Sequence
  chemically synthesized
tacccctgtttttagctcta

SEQ ID NO: 356944 - DNA, 20 bp, Artificial Sequence
  chemically synthesized
ctacccctgtttttagctct

SEQ ID NO: 356945 - DNA, 20 bp, Artificial Sequence
  chemically synthesized
ttctcccttagagctaaaaa

SEQ ID NO: 356946 - DNA, 20 bp, Artificial Sequence
  chemically synthesized
tctcccttagagctaaaaac

SEQ ID NO: 356947 - DNA, 20 bp, Artificial Sequence
  chemically synthesized
ctcccttagagctaaaaaca

SEQ ID NO: 356948 - DNA, 20 bp, Artificial Sequence
  chemically synthesized
tcccttagagctaaaaacag

SEQ ID NO: 356949 - DNA, 20 bp, Artificial Sequence
  chemically synthesized
atccctcctacccctgtttt

SEQ ID NO: 356950 - DNA, 20 bp, Artificial Sequence
  chemically synthesized
cttagagctaaaaacagggg

SEQ ID NO: 356951 - DNA, 20 bp, Artificial Sequence
  chemically synthesized
ttagagctaaaaacaggggt

SEQ ID NO: 356952 - DNA, 20 bp, Artificial Sequence
  chemically synthesized
agagctaaaaacaggggtag

SEQ ID NO: 356953 - DNA, 20 bp, Artificial Sequence
  chemically synthesized
gagctaaaaacaggggtagg

SEQ ID NO: 356954 - DNA, 20 bp, Artificial Sequence
  chemically synthesized
agctaaaaacaggggtagga

SEQ ID NO: 356955 - DNA, 20 bp, Artificial Sequence
  chemically synthesized
aggagggatactatcgtgta

SEQ ID NO: 356956 - DNA, 20 bp, Artificial Sequence
  chemically synthesized
tttattgcttctatacacga

SEQ ID NO: 356957 - DNA, 20 bp, Artificial Sequence
  chemically synthesized
agggatactatcgtgtatag

SEQ ID NO: 356958 - DNA, 20 bp, Artificial Sequence
  chemically synthesized
tcgtgtatagaagcaataaa

SEQ ID NO: 356959 - DNA, 20 bp, Artificial Sequence
  chemically synthesized
cgtgtatagaagcaataaaa

SEQ ID NO: 356960 - DNA, 20 bp, Artificial Sequence
  chemically synthesized
gtgtatagaagcaataaaaa

SEQ ID NO: 356961 - DNA, 20 bp, Artificial Sequence
  chemically synthesized
tgtatagaagcaataaaaag

SEQ ID NO: 356962 - DNA, 20 bp, Artificial Sequence
  chemically synthesized
gaagcaataaaaaggggtta

SEQ ID NO: 356963 - DNA, 20 bp, Artificial Sequence
  chemically synthesized
taaaaaggggttacagtatt

SEQ ID NO: 356964 - DNA, 20 bp, Artificial Sequence
  chemically synthesized
gggttacagtattcagtgtt

SEQ ID NO: 356965 - DNA, 20 bp, Artificial Sequence
  chemically synthesized
cttctcctttggataatgca

SEQ ID NO: 356966 - DNA, 20 bp, Artificial Sequence
  chemically synthesized
gttcagccatgcattatcca

SEQ ID NO: 356967 - DNA, 20 bp, Artificial Sequence
  chemically synthesized
ttcagccatgcattatccaa

SEQ ID NO: 356968 - DNA, 20 bp, Artificial Sequence
  chemically synthesized
cagccatgcattatccaaag

SEQ ID NO: 356969 - DNA, 20 bp, Artificial Sequence
  chemically synthesized
ccatgcattatccaaaggag

SEQ ID NO: 356970 - DNA, 20 bp, Artificial Sequence
  chemically synthesized
ttgaaatgtttcttctcctt

SEQ ID NO: 356971 - DNA, 20 bp, Artificial Sequence
  chemically synthesized
caaaggagaagaaacatttc

SEQ ID NO: 356972 - DNA, 20 bp, Artificial Sequence
  chemically synthesized
tgtgaagttgggatcagatt

SEQ ID NO: 356973 - DNA, 20 bp, Artificial Sequence
  chemically synthesized
ttagtttgtgaagttgggat

SEQ ID NO: 356974 - DNA, 20 bp, Artificial Sequence
  chemically synthesized
aaatgttagtttgtgaagtt

SEQ ID NO: 356975 - DNA, 20 bp, Artificial Sequence
  chemically synthesized
aaaatgttagtttgtgaagt

SEQ ID NO: 356976 - DNA, 20 bp, Artificial Sequence
  chemically synthesized
aacaaaaatgttagtttgtg

SEQ ID NO: 356977 - DNA, 20 bp, Artificial Sequence
  chemically synthesized
gcaaattacaacaaaaatgt

SEQ ID NO: 356978 - DNA, 20 bp, Artificial Sequence
  chemically synthesized
ttgttgtaatttgctttccc

SEQ ID NO: 356979 - DNA, 20 bp, Artificial Sequence
  chemically synthesized
ataagcacatgtacttggga

SEQ ID NO: 356980 - DNA, 20 bp, Artificial Sequence
  chemically synthesized
cttgataagcacatgtactt

SEQ ID NO: 356981 - DNA, 20 bp, Artificial Sequence
  chemically synthesized
tcttgataagcacatgtact

SEQ ID NO: 356982 - DNA, 20 bp, Artificial Sequence
  chemically synthesized
cccaagtacatgtgcttatc

SEQ ID NO: 356983 - DNA, 20 bp, Artificial Sequence
  chemically synthesized
caagtacatgtgcttatcaa

SEQ ID NO: 356984 - DNA, 20 bp, Artificial Sequence
  chemically synthesized
acaaatatattgctcttgat

SEQ ID NO: 356985 - DNA, 20 bp, Artificial Sequence
  chemically synthesized
aaatgagatataacaagcag

SEQ ID NO: 356986 - DNA, 20 bp, Artificial Sequence
  chemically synthesized
cttaaatgagatataacaag

SEQ ID NO: 356987 - DNA, 20 bp, Artificial Sequence
  chemically synthesized
aatcttaaatgagatataac

SEQ ID NO: 356988 - DNA, 20 bp, Artificial Sequence
  chemically synthesized
ctgcttgttatatctcattt

SEQ ID NO: 356989 - DNA, 20 bp, Artificial Sequence
  chemically synthesized
gaaattcagtaatcttaaat

SEQ ID NO: 356990 - DNA, 20 bp, Artificial Sequence
  chemically synthesized
tataaataaaaatggaaatt

SEQ ID NO: 356991 - DNA, 20 bp, Artificial Sequence
  chemically synthesized
aagtgatatataaataaaaa

SEQ ID NO: 356992 - DNA, 20 bp, Artificial Sequence
  chemically synthesized
gagttaactttaagtttaaa

SEQ ID NO: 356993 - DNA, 20 bp, Artificial Sequence
  chemically synthesized
tatatcactttttaaactta

SEQ ID NO: 356994 - DNA, 20 bp, Artificial Sequence
  chemically synthesized
gggtgggaggagttaacttt

SEQ ID NO: 356995 - DNA, 20 bp, Artificial Sequence
  chemically synthesized
gatccacattggggtgggag

SEQ ID NO: 356996 - DNA, 20 bp, Artificial Sequence
  chemically synthesized
cagatccacattggggtggg

SEQ ID NO: 356997 - DNA, 20 bp, Artificial Sequence
  chemically synthesized
gcagatccacattggggtgg

SEQ ID NO: 356998 - DNA, 20 bp, Artificial Sequence
  chemically synthesized
tagcagatccacattggggt

SEQ ID NO: 356999 - DNA, 20 bp, Artificial Sequence
  chemically synthesized
ctagcagatccacattgggg

SEQ ID NO: 357000 - DNA, 20 bp, Artificial Sequence
  chemically synthesized
taactcctcccaccccaatg

SEQ ID NO: 357001 - DNA, 20 bp, Artificial Sequence
  chemically synthesized
catctagcagatccacattg

SEQ ID NO: 357002 - DNA, 20 bp, Artificial Sequence
  chemically synthesized
tcatctagcagatccacatt

SEQ ID NO: 357003 - DNA, 20 bp, Artificial Sequence
  chemically synthesized
atcatctagcagatccacat

SEQ ID NO: 357004 - DNA, 20 bp, Artificial Sequence
  chemically synthesized
ccaccccaatgtggatctgc

SEQ ID NO: 357005 - DNA, 20 bp, Artificial Sequence
  chemically synthesized
gattgcctcagatcatctag

SEQ ID NO: 357006 - DNA, 20 bp, Artificial Sequence
  chemically synthesized
cctgattgcctcagatcatc

SEQ ID NO: 357007 - DNA, 20 bp, Artificial Sequence
  chemically synthesized
gtggatctgctagatgatct

SEQ ID NO: 357008 - DNA, 20 bp, Artificial Sequence
  chemically synthesized
tggatctgctagatgatctg

SEQ ID NO: 357009 - DNA, 20 bp, Artificial Sequence
  chemically synthesized
gctagatgatctgaggcaat

SEQ ID NO: 357010 - DNA, 20 bp, Artificial Sequence
  chemically synthesized
acgcagaagcctgattgcct

SEQ ID NO: 357011 - DNA, 20 bp, Artificial Sequence
  chemically synthesized
ctagatgatctgaggcaatc

SEQ ID NO: 357012 - DNA, 20 bp, Artificial Sequence
  chemically synthesized
actcagttttgcagacgcag

SEQ ID NO: 357013 - DNA, 20 bp, Artificial Sequence
  chemically synthesized
agtactcagttttgcagacg

SEQ ID NO: 357014 - DNA, 20 bp, Artificial Sequence
  chemically synthesized
gcttctgcgtctgcaaaact

SEQ ID NO: 357015 - DNA, 20 bp, Artificial Sequence
  chemically synthesized
gaatctagtactcagttttg

SEQ ID NO: 357016 - DNA, 20 bp, Artificial Sequence
  chemically synthesized
gcgtctgcaaaactgagtac

SEQ ID NO: 357017 - DNA, 20 bp, Artificial Sequence
  chemically synthesized
atcaaccagaatctagtact

SEQ ID NO: 357018 - DNA, 20 bp, Artificial Sequence
  chemically synthesized
caaaactgagtactagattc

SEQ ID NO: 357019 - DNA, 20 bp, Artificial Sequence
  chemically synthesized
atttattatcaaccagaatc

SEQ ID NO: 357020 - DNA, 20 bp, Artificial Sequence
  chemically synthesized
ccagtgaatttattatcaac

SEQ ID NO: 357021 - DNA, 20 bp, Artificial Sequence
  chemically synthesized
ctggttgataataaattcac

SEQ ID NO: 357022 - DNA, 20 bp, Artificial Sequence
  chemically synthesized
gataataaattcactggcaa

SEQ ID NO: 357023 - DNA, 20 bp, Artificial Sequence
  chemically synthesized
ataataaattcactggcaaa

SEQ ID NO: 357024 - DNA, 20 bp, Artificial Sequence
  chemically synthesized
cccagaagacagccttttgc

SEQ ID NO: 357025 - DNA, 20 bp, Artificial Sequence
  chemically synthesized
actggcaaaaggctgtcttc

SEQ ID NO: 357026 - DNA, 20 bp, Artificial Sequence
  chemically synthesized
ctggcaaaaggctgtcttct

SEQ ID NO: 357027 - DNA, 20 bp, Artificial Sequence
  chemically synthesized
ctcaaaaatgacccagaaga

SEQ ID NO: 357028 - DNA, 20 bp, Artificial Sequence
  chemically synthesized
aaaactcaaaaatgacccag

SEQ ID NO: 357029 - DNA, 20 bp, Artificial Sequence
  chemically synthesized
aagaaaactcaaaaatgacc

SEQ ID NO: 357030 - DNA, 20 bp, Artificial Sequence
  chemically synthesized
ctgtcttctgggtcattttt

SEQ ID NO: 357031 - DNA, 20 bp, Artificial Sequence
  chemically synthesized
tcatttttgagttttcttga

SEQ ID NO: 357032 - DNA, 20 bp, Artificial Sequence
  chemically synthesized
catttttgagttttcttgat

SEQ ID NO: 357033 - DNA, 20 bp, Artificial Sequence
  chemically synthesized
tatggatggtaggtcccatc

SEQ ID NO: 357034 - DNA, 20 bp, Artificial Sequence
  chemically synthesized
gatctttcaatatggatggt

SEQ ID NO: 357035 - DNA, 20 bp, Artificial Sequence
  chemically synthesized
agatctttcaatatggatgg

SEQ ID NO: 357036 - DNA, 20 bp, Artificial Sequence
  chemically synthesized
aggagatctttcaatatgga

SEQ ID NO: 357037 - DNA, 20 bp, Artificial Sequence
  chemically synthesized
ggacctaccatccatattga

SEQ ID NO: 357038 - DNA, 20 bp, Artificial Sequence
  chemically synthesized
aaacaggagatctttcaata

SEQ ID NO: 357039 - DNA, 20 bp, Artificial Sequence
  chemically synthesized
tattgaaagatctcctgttt

SEQ ID NO: 357040 - DNA, 20 bp, Artificial Sequence
  chemically synthesized
tttcatcaattccaaaacag

SEQ ID NO: 357041 - DNA, 20 bp, Artificial Sequence
  chemically synthesized
gatttcatcaattccaaaac

SEQ ID NO: 357042 - DNA, 20 bp, Artificial Sequence
  chemically synthesized
cgatttcatcaattccaaaa

SEQ ID NO: 357043 - DNA, 20 bp, Artificial Sequence
  chemically synthesized
aatcgatttaatattcccaa

SEQ ID NO: 357044 - DNA, 20 bp, Artificial Sequence
  chemically synthesized
gctgataattaaatgctttt

SEQ ID NO: 357045 - DNA, 20 bp, Artificial Sequence
  chemically synthesized
agctgataattaaatgcttt

SEQ ID NO: 357046 - DNA, 20 bp, Artificial Sequence
  chemically synthesized
tcccaaaagcatttaattat

SEQ ID NO: 357047 - DNA, 20 bp, Artificial Sequence
  chemically synthesized
ttaattatcagcttctattg

SEQ ID NO: 357048 - DNA, 20 bp, Artificial Sequence
  chemically synthesized
tagaagctgttctacaatag

SEQ ID NO: 357049 - DNA, 20 bp, Artificial Sequence
  chemically synthesized
gggtagaagctgttctacaa

SEQ ID NO: 357050 - DNA, 20 bp, Artificial Sequence
  chemically synthesized
tatcagcttctattgtagaa

SEQ ID NO: 357051 - DNA, 20 bp, Artificial Sequence
  chemically synthesized
tgaagatgatatttgggtag

SEQ ID NO: 357052 - DNA, 20 bp, Artificial Sequence
  chemically synthesized
gattgaagatgatatttggg

SEQ ID NO: 357053 - DNA, 20 bp, Artificial Sequence
  chemically synthesized
tgggattgaagatgatattt

SEQ ID NO: 357054 - DNA, 20 bp, Artificial Sequence
  chemically synthesized
gtgggattgaagatgatatt

SEQ ID NO: 357055 - DNA, 20 bp, Artificial Sequence
  chemically synthesized
aagtgaaatcggtgggattg

SEQ ID NO: 357056 - DNA, 20 bp, Artificial Sequence
  chemically synthesized
gttggaaaagtgaaatcggt

SEQ ID NO: 357057 - DNA, 20 bp, Artificial Sequence
  chemically synthesized
agttggaaaagtgaaatcgg

SEQ ID NO: 357058 - DNA, 20 bp, Artificial Sequence
  chemically synthesized
aggagttggaaaagtgaaat

SEQ ID NO: 357059 - DNA, 20 bp, Artificial Sequence
  chemically synthesized
tctaaaatcaggagttggaa

SEQ ID NO: 357060 - DNA, 20 bp, Artificial Sequence
  chemically synthesized
tacactctaaaatcaggagt

SEQ ID NO: 357061 - DNA, 20 bp, Artificial Sequence
  chemically synthesized
acttttccaactcctgattt

SEQ ID NO: 357062 - DNA, 20 bp, Artificial Sequence
  chemically synthesized
ttactacactctaaaatcag

SEQ ID NO: 357063 - DNA, 20 bp, Artificial Sequence
  chemically synthesized
ttttccaactcctgatttta

SEQ ID NO: 357064 - DNA, 20 bp, Artificial Sequence
  chemically synthesized
ctttactacactctaaaatc

SEQ ID NO: 357065 - DNA, 20 bp, Artificial Sequence
  chemically synthesized
gctttactacactctaaaat

SEQ ID NO: 357066 - DNA, 20 bp, Artificial Sequence
  chemically synthesized
caactcctgattttagagtg

SEQ ID NO: 357067 - DNA, 20 bp, Artificial Sequence
  chemically synthesized
cctgattttagagtgtagta

SEQ ID NO: 357068 - DNA, 20 bp, Artificial Sequence
  chemically synthesized
ttagagtgtagtaaagcctt

SEQ ID NO: 357069 - DNA, 20 bp, Artificial Sequence
  chemically synthesized
gcctctgttctcaattctca

SEQ ID NO: 357070 - DNA, 20 bp, Artificial Sequence
  chemically synthesized
gtagtaaagccttgagaatt

SEQ ID NO: 357071 - DNA, 20 bp, Artificial Sequence
  chemically synthesized
agcctctgttctcaattctc

SEQ ID NO: 357072 - DNA, 20 bp, Artificial Sequence
  chemically synthesized
aaagccttgagaattgagaa

SEQ ID NO: 357073 - DNA, 20 bp, Artificial Sequence
  chemically synthesized
agccttgagaattgagaaca

SEQ ID NO: 357074 - DNA, 20 bp, Artificial Sequence
  chemically synthesized
gccttgagaattgagaacag

SEQ ID NO: 357075 - DNA, 20 bp, Artificial Sequence
  chemically synthesized
ccatgccaattttgaaatgg

SEQ ID NO: 357076 - DNA, 20 bp, Artificial Sequence
  chemically synthesized
ttgccatgccaattttgaaa

SEQ ID NO: 357077 - DNA, 20 bp, Artificial Sequence
  chemically synthesized
agaggctaccatttcaaaat

SEQ ID NO: 357078 - DNA, 20 bp, Artificial Sequence
  chemically synthesized
ctaccatttcaaaattggca

SEQ ID NO: 357079 - DNA, 20 bp, Artificial Sequence
  chemically synthesized
ttcaaaattggcatggcaaa

SEQ ID NO: 357080 - DNA, 20 bp, Artificial Sequence
  chemically synthesized
atggcaaaaagtgtacttca

SEQ ID NO: 357081 - DNA, 20 bp, Artificial Sequence
  chemically synthesized
tggcaaaaagtgtacttcat

SEQ ID NO: 357082 - DNA, 20 bp, Artificial Sequence
  chemically synthesized
aaaaagtgtacttcataggc

SEQ ID NO: 357083 - DNA, 20 bp, Artificial Sequence
  chemically synthesized
tactcttcttctagcctatg

SEQ ID NO: 357084 - DNA, 20 bp, Artificial Sequence
  chemically synthesized
aagtgtacttcataggctag

SEQ ID NO: 357085 - DNA, 20 bp, Artificial Sequence
  chemically synthesized
tgtacttcataggctagaag

SEQ ID NO: 357086 - DNA, 20 bp, Artificial Sequence
  chemically synthesized
tacttcataggctagaagaa

SEQ ID NO: 357087 - DNA, 20 bp, Artificial Sequence
  chemically synthesized
tgtgacctctactcttcttc

SEQ ID NO: 357088 - DNA, 20 bp, Artificial Sequence
  chemically synthesized
ttcataggctagaagaagag

SEQ ID NO: 357089 - DNA, 20 bp, Artificial Sequence
  chemically synthesized
cataggctagaagaagagta

SEQ ID NO: 357090 - DNA, 20 bp, Artificial Sequence
  chemically synthesized
ataggctagaagaagagtag

SEQ ID NO: 357091 - DNA, 20 bp, Artificial Sequence
  chemically synthesized
tagaagaagagtagaggtca

SEQ ID NO: 357092 - DNA, 20 bp, Artificial Sequence
  chemically synthesized
ttccagacgtagagattaca

SEQ ID NO: 357093 - DNA, 20 bp, Artificial Sequence
  chemically synthesized
ccttccagacgtagagatta

SEQ ID NO: 357094 - DNA, 20 bp, Artificial Sequence
  chemically synthesized
atctctgtaatctctacgtc

SEQ ID NO: 357095 - DNA, 20 bp, Artificial Sequence
  chemically synthesized
agtcataccttccagacgta

SEQ ID NO: 357096 - DNA, 20 bp, Artificial Sequence
  chemically synthesized
tctgtaatctctacgtctgg

SEQ ID NO: 357097 - DNA, 20 bp, Artificial Sequence
  chemically synthesized
atagtcataccttccagacg

SEQ ID NO: 357098 - DNA, 20 bp, Artificial Sequence
  chemically synthesized
ctgtaatctctacgtctgga

SEQ ID NO: 357099 - DNA, 20 bp, Artificial Sequence
  chemically synthesized
tgctacatagtcataccttc

SEQ ID NO: 357100 - DNA, 20 bp, Artificial Sequence
  chemically synthesized
gtctggaaggtatgactatg

SEQ ID NO: 357101 - DNA, 20 bp, Artificial Sequence
  chemically synthesized
ctcttatctctggtgctaca

SEQ ID NO: 357102 - DNA, 20 bp, Artificial Sequence
  chemically synthesized
aaggtatgactatgtagcac

SEQ ID NO: 357103 - DNA, 20 bp, Artificial Sequence
  chemically synthesized
ggtatgactatgtagcacca

SEQ ID NO: 357104 - DNA, 20 bp, Artificial Sequence
  chemically synthesized
gactatgtagcaccagagat

SEQ ID NO: 357105 - DNA, 20 bp, Artificial Sequence
  chemically synthesized
ctatgtagcaccagagataa

SEQ ID NO: 357106 - DNA, 20 bp, Artificial Sequence
  chemically synthesized
ataactttgactcttatctc

SEQ ID NO: 357107 - DNA, 20 bp, Artificial Sequence
  chemically synthesized
agcaccagagataagagtca

SEQ ID NO: 357108 - DNA, 20 bp, Artificial Sequence
  chemically synthesized
gataagagtcaaagttattg

SEQ ID NO: 357109 - DNA, 20 bp, Artificial Sequence
  chemically synthesized
cttctttagttgataggcag

SEQ ID NO: 357110 - DNA, 20 bp, Artificial Sequence
  chemically synthesized
ctgcttctttagttgatagg

SEQ ID NO: 357111 - DNA, 20 bp, Artificial Sequence
  chemically synthesized
tttctgcttctttagttgat

SEQ ID NO: 357112 - DNA, 20 bp, Artificial Sequence
  chemically synthesized
acacttctgcctatcaacta

SEQ ID NO: 357113 - DNA, 20 bp, Artificial Sequence
  chemically synthesized
ttttctgcttctttagttga

SEQ ID NO: 357114 - DNA, 20 bp, Artificial Sequence
  chemically synthesized
cttctgcctatcaactaaag

SEQ ID NO: 357115 - DNA, 20 bp, Artificial Sequence
  chemically synthesized
ctgcctatcaactaaagaag

SEQ ID NO: 357116 - DNA, 20 bp, Artificial Sequence
  chemically synthesized
ttactcattttctgcttctt

SEQ ID NO: 357117 - DNA, 20 bp, Artificial Sequence
  chemically synthesized
caactaaagaagcagaaaat

SEQ ID NO: 357118 - DNA, 20 bp, Artificial Sequence
  chemically synthesized
gaaaatgagtaaccatccaa

SEQ ID NO: 357119 - DNA, 20 bp, Artificial Sequence
  chemically synthesized
aaatgagtaaccatccaaca

SEQ ID NO: 357120 - DNA, 20 bp, Artificial Sequence
  chemically synthesized
tggggagatcctctgttgga

SEQ ID NO: 357121 - DNA, 20 bp, Artificial Sequence
  chemically synthesized
aatgagtaaccatccaacag

SEQ ID NO: 357122 - DNA, 20 bp, Artificial Sequence
  chemically synthesized
actctggggagatcctctgt

SEQ ID NO: 357123 - DNA, 20 bp, Artificial Sequence
  chemically synthesized
catccaacagaggatctccc

SEQ ID NO: 357124 - DNA, 20 bp, Artificial Sequence
  chemically synthesized
tccaacagaggatctcccca

SEQ ID NO: 357125 - DNA, 20 bp, Artificial Sequence
  chemically synthesized
ttgtaatttttcactctggg

SEQ ID NO: 357126 - DNA, 20 bp, Artificial Sequence
  chemically synthesized
tgttgtaatttttcactctg

SEQ ID NO: 357127 - DNA, 20 bp, Artificial Sequence
  chemically synthesized
ctgttgtaatttttcactct

SEQ ID NO: 357128 - DNA, 20 bp, Artificial Sequence
  chemically synthesized
tctgttgtaatttttcactc

SEQ ID NO: 357129 - DNA, 20 bp, Artificial Sequence
  chemically synthesized
cccagagtgaaaaattacaa

SEQ ID NO: 357130 - DNA, 20 bp, Artificial Sequence
  chemically synthesized
agagtgaaaaattacaacag

SEQ ID NO: 357131 - DNA, 20 bp, Artificial Sequence
  chemically synthesized
gtgaaaaattacaacagaag

SEQ ID NO: 357132 - DNA, 20 bp, Artificial Sequence
  chemically synthesized
aaaaattacaacagaagtag

SEQ ID NO: 357133 - DNA, 20 bp, Artificial Sequence
  chemically synthesized
aattacaacagaagtagtgg

SEQ ID NO: 357134 - DNA, 20 bp, Artificial Sequence
  chemically synthesized
attacaacagaagtagtggc

SEQ ID NO: 357135 - DNA, 20 bp, Artificial Sequence
  chemically synthesized
aacagaagtagtggcaggaa

SEQ ID NO: 357136 - DNA, 20 bp, Artificial Sequence
  chemically synthesized
catggtttactatttaaatc

SEQ ID NO: 357137 - DNA, 20 bp, Artificial Sequence
  chemically synthesized
aatagatttcctgatttaaa

SEQ ID NO: 357138 - DNA, 20 bp, Artificial Sequence
  chemically synthesized
acatggtttactatttaaat

SEQ ID NO: 357139 - DNA, 20 bp, Artificial Sequence
  chemically synthesized
atactctataaaaggcaaca

SEQ ID NO: 357140 - DNA, 20 bp, Artificial Sequence
  chemically synthesized
gtaaaccatgttgcctttta

SEQ ID NO: 357141 - DNA, 20 bp, Artificial Sequence
  chemically synthesized
aaaccatgttgccttttata

SEQ ID NO: 357142 - DNA, 20 bp, Artificial Sequence
  chemically synthesized
tcattcatatactctataaa

SEQ ID NO: 357143 - DNA, 20 bp, Artificial Sequence
  chemically synthesized
ttcattcatatactctataa

SEQ ID NO: 357144 - DNA, 20 bp, Artificial Sequence
  chemically synthesized
atagagtatatgaatgaaat

SEQ ID NO: 357145 - DNA, 20 bp, Artificial Sequence
  chemically synthesized
agtatatgaatgaaattggc

SEQ ID NO: 357146 - DNA, 20 bp, Artificial Sequence
  chemically synthesized
tatatgaatgaaattggcaa

SEQ ID NO: 357147 - DNA, 20 bp, Artificial Sequence
  chemically synthesized
atgaatgaaattggcaagag

SEQ ID NO: 357148 - DNA, 20 bp, Artificial Sequence
  chemically synthesized
agtaatcagctataattaat

SEQ ID NO: 357149 - DNA, 20 bp, Artificial Sequence
  chemically synthesized
caagagtagctaattaatta

SEQ ID NO: 357150 - DNA, 20 bp, Artificial Sequence
  chemically synthesized
aagagatttgatagagtaat

SEQ ID NO: 357151 - DNA, 20 bp, Artificial Sequence
  chemically synthesized
tgctaccaagagatttgata

SEQ ID NO: 357152 - DNA, 20 bp, Artificial Sequence
  chemically synthesized
tatgctaccaagagatttga

SEQ ID NO: 357153 - DNA, 20 bp, Artificial Sequence
  chemically synthesized
gattactctatcaaatctct

SEQ ID NO: 357154 - DNA, 20 bp, Artificial Sequence
  chemically synthesized
tactctatcaaatctcttgg

SEQ ID NO: 357155 - DNA, 20 bp, Artificial Sequence
  chemically synthesized
tgttttgcttatgctaccaa

SEQ ID NO: 357156 - DNA, 20 bp, Artificial Sequence
  chemically synthesized
aatgttttgcttatgctacc

SEQ ID NO: 357157 - DNA, 20 bp, Artificial Sequence
  chemically synthesized
atcaaatctcttggtagcat

SEQ ID NO: 357158 - DNA, 20 bp, Artificial Sequence
  chemically synthesized
tgactccaaataattataaa

SEQ ID NO: 357159 - DNA, 20 bp, Artificial Sequence
  chemically synthesized
attaactttttataattatt

SEQ ID NO: 357160 - DNA, 20 bp, Artificial Sequence
  chemically synthesized
taactttttataattatttg

SEQ ID NO: 357161 - DNA, 20 bp, Artificial Sequence
  chemically synthesized
gagtcaatgcactccaaatg

SEQ ID NO: 357162 - DNA, 20 bp, Artificial Sequence
  chemically synthesized
gatggagcatactgcatttg

SEQ ID NO: 357163 - DNA, 20 bp, Artificial Sequence
  chemically synthesized
tggatggagcatactgcatt

SEQ ID NO: 357164 - DNA, 20 bp, Artificial Sequence
  chemically synthesized
aatgcagtatgctccatcca

SEQ ID NO: 357165 - DNA, 20 bp, Artificial Sequence
  chemically synthesized
atgcagtatgctccatccat

SEQ ID NO: 357166 - DNA, 20 bp, Artificial Sequence
  chemically synthesized
atgtgtatgccctatggatg

SEQ ID NO: 357167 - DNA, 20 bp, Artificial Sequence
  chemically synthesized
tgcagtatgctccatccata

SEQ ID NO: 357168 - DNA, 20 bp, Artificial Sequence
  chemically synthesized
aaatgtgtatgccctatgga

SEQ ID NO: 357169 - DNA, 20 bp, Artificial Sequence
  chemically synthesized
tttaaaatgtgtatgcccta

SEQ ID NO: 357170 - DNA, 20 bp, Artificial Sequence
  chemically synthesized
catagggcatacacatttta

SEQ ID NO: 357171 - DNA, 20 bp, Artificial Sequence
  chemically synthesized
atagggcatacacattttaa

SEQ ID NO: 357172 - DNA, 20 bp, Artificial Sequence
  chemically synthesized
agtgaagacttttaggaaaa

SEQ ID NO: 357173 - DNA, 20 bp, Artificial Sequence
  chemically synthesized
tttaaaggcttttttcctaa

SEQ ID NO: 357174 - DNA, 20 bp, Artificial Sequence
  chemically synthesized
aaattgcagtgaagactttt

SEQ ID NO: 357175 - DNA, 20 bp, Artificial Sequence
  chemically synthesized
aaaattgcagtgaagacttt

SEQ ID NO: 357176 - DNA, 20 bp, Artificial Sequence
  chemically synthesized
cagtatctaaaattgcagtg

SEQ ID NO: 357177 - DNA, 20 bp, Artificial Sequence
  chemically synthesized
aaaagtcttcactgcaattt

SEQ ID NO: 357178 - DNA, 20 bp, Artificial Sequence
  chemically synthesized
aataccagtatctaaaattg

SEQ ID NO: 357179 - DNA, 20 bp, Artificial Sequence
  chemically synthesized
ttcactgcaattttagatac

SEQ ID NO: 357180 - DNA, 20 bp, Artificial Sequence
  chemically synthesized
attttagatactggtatttt

SEQ ID NO: 357181 - DNA, 20 bp, Artificial Sequence
  chemically synthesized
aattctagttctcaaaatac

SEQ ID NO: 357182 - DNA, 20 bp, Artificial Sequence
  chemically synthesized
gatactggtattttgagaac

SEQ ID NO: 357183 - DNA, 20 bp, Artificial Sequence
  chemically synthesized
tgaattgtcttatttaattc

SEQ ID NO: 357184 - DNA, 20 bp, Artificial Sequence
  chemically synthesized
tttgagaactagaattaaat

SEQ ID NO: 357185 - DNA, 20 bp, Artificial Sequence
  chemically synthesized
aaataagacaattcataata

SEQ ID NO: 357186 - DNA, 20 bp, Artificial Sequence
  chemically synthesized
gacaattcataatatagtgc

SEQ ID NO: 357187 - DNA, 20 bp, Artificial Sequence
  chemically synthesized
aattcataatatagtgcaag

SEQ ID NO: 357188 - DNA, 20 bp, Artificial Sequence
  chemically synthesized
attcataatatagtgcaaga

SEQ ID NO: 357189 - DNA, 20 bp, Artificial Sequence
  chemically synthesized
gtagatatatttaaaatgtt

SEQ ID NO: 357190 - DNA, 20 bp, Artificial Sequence
  chemically synthesized
gaacattttaaatatatcta

SEQ ID NO: 357191 - DNA, 20 bp, Artificial Sequence
  chemically synthesized
tttaaatatatctacagtat

SEQ ID NO: 357192 - DNA, 20 bp, Artificial Sequence
  chemically synthesized
tcttaagttttccaatactg

SEQ ID NO: 357193 - DNA, 20 bp, Artificial Sequence
  chemically synthesized
tctacagtattggaaaactt

SEQ ID NO: 357194 - DNA, 20 bp, Artificial Sequence
  chemically synthesized
aatacaaaactacatatctt

SEQ ID NO: 357195 - DNA, 20 bp, Artificial Sequence
  chemically synthesized
attggaaaacttaagatatg

SEQ ID NO: 357196 - DNA, 20 bp, Artificial Sequence
  chemically synthesized
atgtagttttgtattttgtg

SEQ ID NO: 357197 - DNA, 20 bp, Artificial Sequence
  chemically synthesized
gtattttgtgtagaaatgac

SEQ ID NO: 357198 - DNA, 20 bp, Artificial Sequence
  chemically synthesized
tgtgtagaaatgacaagtct

SEQ ID NO: 357199 - DNA, 20 bp, Artificial Sequence
  chemically synthesized
agagtttaatgttttcatct

SEQ ID NO: 357200 - DNA, 20 bp, Artificial Sequence
  chemically synthesized
ccactgcttttagtatggta

SEQ ID NO: 357201 - DNA, 20 bp, Artificial Sequence
  chemically synthesized
taccactgcttttagtatgg

SEQ ID NO: 357202 - DNA, 20 bp, Artificial Sequence
  chemically synthesized
attaaactctaccatactaa

SEQ ID NO: 357203 - DNA, 20 bp, Artificial Sequence
  chemically synthesized
gactaccactgcttttagta

SEQ ID NO: 357204 - DNA, 20 bp, Artificial Sequence
  chemically synthesized
aaactctaccatactaaaag

SEQ ID NO: 357205 - DNA, 20 bp, Artificial Sequence
  chemically synthesized
ctctaccatactaaaagcag

SEQ ID NO: 357206 - DNA, 20 bp, Artificial Sequence
  chemically synthesized
ttctggactaccactgcttt

SEQ ID NO: 357207 - DNA, 20 bp, Artificial Sequence
  chemically synthesized
taccatactaaaagcagtgg

SEQ ID NO: 357208 - DNA, 20 bp, Artificial Sequence
  chemically synthesized
tactaaaagcagtggtagtc

SEQ ID NO: 357209 - DNA, 20 bp, Artificial Sequence
  chemically synthesized
cctgaaggttggtaaatttc

SEQ ID NO: 357210 - DNA, 20 bp, Artificial Sequence
  chemically synthesized
tccagaaatttaccaacctt

SEQ ID NO: 357211 - DNA, 20 bp, Artificial Sequence
  chemically synthesized
ccagaaatttaccaaccttc

SEQ ID NO: 357212 - DNA, 20 bp, Artificial Sequence
  chemically synthesized
aactactcgatcctgaaggt

SEQ ID NO: 357213 - DNA, 20 bp, Artificial Sequence
  chemically synthesized
gagaaactactcgatcctga

SEQ ID NO: 357214 - DNA, 20 bp, Artificial Sequence
  chemically synthesized
atttaccaaccttcaggatc

SEQ ID NO: 357215 - DNA, 20 bp, Artificial Sequence
  chemically synthesized
agagaaactactcgatcctg

SEQ ID NO: 357216 - DNA, 20 bp, Artificial Sequence
  chemically synthesized
taccaaccttcaggatcgag

SEQ ID NO: 357217 - DNA, 20 bp, Artificial Sequence
  chemically synthesized
ccagatatcaattaggcata

SEQ ID NO: 357218 - DNA, 20 bp, Artificial Sequence
  chemically synthesized
cgccagatatcaattaggca

SEQ ID NO: 357219 - DNA, 20 bp, Artificial Sequence
  chemically synthesized
aacatcgccagatatcaatt

SEQ ID NO: 357220 - DNA, 20 bp, Artificial Sequence
  chemically synthesized
caacatcgccagatatcaat

SEQ ID NO: 357221 - DNA, 20 bp, Artificial Sequence
  chemically synthesized
ctctatgcctaattgatatc

SEQ ID NO: 357222 - DNA, 20 bp, Artificial Sequence
  chemically synthesized
gaacatgcattcaacatcgc

SEQ ID NO: 357223 - DNA, 20 bp, Artificial Sequence
  chemically synthesized
gcgatgttgaatgcatgttc

SEQ ID NO: 357224 - DNA, 20 bp, Artificial Sequence
  chemically synthesized
gcagtcagccacacaacgac

SEQ ID NO: 357225 - DNA, 20 bp, Artificial Sequence
  chemically synthesized
tgcatgttccagtcgttgtg

SEQ ID NO: 357226 - DNA, 20 bp, Artificial Sequence
  chemically synthesized
gtcgttgtgtggctgactgc

SEQ ID NO: 357227 - DNA, 20 bp, Artificial Sequence
  chemically synthesized
tagtgtggtttgccagcagt

SEQ ID NO: 357228 - DNA, 20 bp, Artificial Sequence
  chemically synthesized
ggaatagtgtggtttgccag

SEQ ID NO: 357229 - DNA, 20 bp, Artificial Sequence
  chemically synthesized
actggaatagtgtggtttgc

SEQ ID NO: 357230 - DNA, 20 bp, Artificial Sequence
  chemically synthesized
cctatttgactggaatagtg

SEQ ID NO: 357231 - DNA, 20 bp, Artificial Sequence
  chemically synthesized
gctggcaaaccacactattc

SEQ ID NO: 357232 - DNA, 20 bp, Artificial Sequence
  chemically synthesized
ccagacctatttgactggaa

SEQ ID NO: 357233 - DNA, 20 bp, Artificial Sequence
  chemically synthesized
accacactattccagtcaaa

SEQ ID NO: 357234 - DNA, 20 bp, Artificial Sequence
  chemically synthesized
ccacactattccagtcaaat

SEQ ID NO: 357235 - DNA, 20 bp, Artificial Sequence
  chemically synthesized
ttaggccagacctatttgac

SEQ ID NO: 357236 - DNA, 20 bp, Artificial Sequence
  chemically synthesized
ctattccagtcaaataggtc

SEQ ID NO: 357237 - DNA, 20 bp, Artificial Sequence
  chemically synthesized
tatgtgtatgtgttttaggc

SEQ ID NO: 357238 - DNA, 20 bp, Artificial Sequence
  chemically synthesized
tgtgtatgtgtatgtgtttt

SEQ ID NO: 357239 - DNA, 20 bp, Artificial Sequence
  chemically synthesized
gtgtgtatgtgtatgtgttt

SEQ ID NO: 357240 - DNA, 20 bp, Artificial Sequence
  chemically synthesized
tacacatacacacatacaca

SEQ ID NO: 357241 - DNA, 20 bp, Artificial Sequence
  chemically synthesized
aagacaaatataaatcaatc

SEQ ID NO: 357242 - DNA, 20 bp, Artificial Sequence
  chemically synthesized
gtaaatctcatggaacattc

SEQ ID NO: 357243 - DNA, 20 bp, Artificial Sequence
  chemically synthesized
atcaatctagaatgttccat

SEQ ID NO: 357244 - DNA, 20 bp, Artificial Sequence
  chemically synthesized
aagcatggaagtaaatctca

SEQ ID NO: 357245 - DNA, 20 bp, Artificial Sequence
  chemically synthesized
tcaatgaaaattaagcatgg

SEQ ID NO: 357246 - DNA, 20 bp, Artificial Sequence
  chemically synthesized
ttgtcaatgaaaattaagca

SEQ ID NO: 357247 - DNA, 20 bp, Artificial Sequence
  chemically synthesized
attggttgtcaatgaaaatt

SEQ ID NO: 357248 - DNA, 20 bp, Artificial Sequence
  chemically synthesized
tcattgacaaccaatgccca

SEQ ID NO: 357249 - DNA, 20 bp, Artificial Sequence
  chemically synthesized
gacttaaggactatgggcat

SEQ ID NO: 357250 - DNA, 20 bp, Artificial Sequence
  chemically synthesized
actcaagacttaaggactat

SEQ ID NO: 357251 - DNA, 20 bp, Artificial Sequence
  chemically synthesized
cactcaagacttaaggacta

SEQ ID NO: 357252 - DNA, 20 bp, Artificial Sequence
  chemically synthesized
aaccaatgcccatagtcctt

SEQ ID NO: 357253 - DNA, 20 bp, Artificial Sequence
  chemically synthesized
tgaattacactcaagactta

SEQ ID NO: 357254 - DNA, 20 bp, Artificial Sequence
  chemically synthesized
gcccatagtccttaagtctt

SEQ ID NO: 357255 - DNA, 20 bp, Artificial Sequence
  chemically synthesized
atgaattacactcaagactt

SEQ ID NO: 357256 - DNA, 20 bp, Artificial Sequence
  chemically synthesized
agggtaaatgaattacactc

SEQ ID NO: 357257 - DNA, 20 bp, Artificial Sequence
  chemically synthesized
ttaaatagaaatattttaaa

SEQ ID NO: 357258 - DNA, 20 bp, Artificial Sequence
  chemically synthesized
tttaaatagaaatattttaa

SEQ ID NO: 357259 - DNA, 20 bp, Artificial Sequence
  chemically synthesized
gtttaaatagaaatatttta

SEQ ID NO: 357260 - DNA, 20 bp, Artificial Sequence
  chemically synthesized
taaaatatttctatttaaac

SEQ ID NO: 357261 - DNA, 20 bp, Artificial Sequence
  chemically synthesized
aaaattattacttgtttaaa

SEQ ID NO: 357262 - DNA, 20 bp, Artificial Sequence
  chemically synthesized
taaacaagtaataattttaa

SEQ ID NO: 357263 - DNA, 20 bp, Artificial Sequence
  chemically synthesized
acaagtaataattttaatgg

SEQ ID NO: 357264 - DNA, 20 bp, Artificial Sequence
  chemically synthesized
attttaatggaagatctcat

SEQ ID NO: 357265 - DNA, 20 bp, Artificial Sequence
  chemically synthesized
ttttaatggaagatctcatt

SEQ ID NO: 357266 - DNA, 20 bp, Artificial Sequence
  chemically synthesized
catgagccaccacacccaat

SEQ ID NO: 357267 - DNA, 20 bp, Artificial Sequence
  chemically synthesized
atggaagatctcattgggtg

SEQ ID NO: 357268 - DNA, 20 bp, Artificial Sequence
  chemically synthesized
gaagatctcattgggtgtgg

SEQ ID NO: 357269 - DNA, 20 bp, Artificial Sequence
  chemically synthesized
attgttgagattacaggcat

SEQ ID NO: 357270 - DNA, 20 bp, Artificial Sequence
  chemically synthesized
tcccaaattgttgagattac

SEQ ID NO: 357271 - DNA, 20 bp, Artificial Sequence
  chemically synthesized
ctcccaaattgttgagatta

SEQ ID NO: 357272 - DNA, 20 bp, Artificial Sequence
  chemically synthesized
tgcctgtaatctcaacaatt

SEQ ID NO: 357273 - DNA, 20 bp, Artificial Sequence
  chemically synthesized
cctccgtctcccaaattgtt

SEQ ID NO: 357274 - DNA, 20 bp, Artificial Sequence
  chemically synthesized
gcctgtaatctcaacaattt

SEQ ID NO: 357275 - DNA, 20 bp, Artificial Sequence
  chemically synthesized
ctgtaatctcaacaatttgg

SEQ ID NO: 357276 - DNA, 20 bp, Artificial Sequence
  chemically synthesized
aatctcaacaatttgggaga

SEQ ID NO: 357277 - DNA, 20 bp, Artificial Sequence
  chemically synthesized
tctcaacaatttgggagacg

SEQ ID NO: 357278 - DNA, 20 bp, Artificial Sequence
  chemically synthesized
ctcaacaatttgggagacgg

SEQ ID NO: 357279 - DNA, 20 bp, Artificial Sequence
  chemically synthesized
aacaatttgggagacggagg

SEQ ID NO: 357280 - DNA, 20 bp, Artificial Sequence
  chemically synthesized
acaatttgggagacggaggt

SEQ ID NO: 357281 - DNA, 20 bp, Artificial Sequence
  chemically synthesized
atttgggagacggaggtggg

SEQ ID NO: 357282 - DNA, 20 bp, Artificial Sequence
  chemically synthesized
cggaggtgggcagatccttt

SEQ ID NO: 357283 - DNA, 20 bp, Artificial Sequence
  chemically synthesized
gtgggcagatcctttgagcc

SEQ ID NO: 357284 - DNA, 20 bp, Artificial Sequence
  chemically synthesized
tcttgaacttctgggctcaa

SEQ ID NO: 357285 - DNA, 20 bp, Artificial Sequence
  chemically synthesized
gtcttgaacttctgggctca

SEQ ID NO: 357286 - DNA, 20 bp, Artificial Sequence
  chemically synthesized
ggcagatcctttgagcccag

SEQ ID NO: 357287 - DNA, 20 bp, Artificial Sequence
  chemically synthesized
taggctggtcttgaacttct

SEQ ID NO: 357288 - DNA, 20 bp, Artificial Sequence
  chemically synthesized
tcctttgagcccagaagttc

SEQ ID NO: 357289 - DNA, 20 bp, Artificial Sequence
  chemically synthesized
ctaggctggtcttgaacttc

SEQ ID NO: 357290 - DNA, 20 bp, Artificial Sequence
  chemically synthesized
tgagcccagaagttcaagac

SEQ ID NO: 357291 - DNA, 20 bp, Artificial Sequence
  chemically synthesized
ccagaagttcaagaccagcc

SEQ ID NO: 357292 - DNA, 20 bp, Artificial Sequence
  chemically synthesized
tttcaccaaattgtctaggc

SEQ ID NO: 357293 - DNA, 20 bp, Artificial Sequence
  chemically synthesized
aaggtttcaccaaattgtct

SEQ ID NO: 357294 - DNA, 20 bp, Artificial Sequence
  chemically synthesized
caagaccagcctagacaatt

SEQ ID NO: 357295 - DNA, 20 bp, Artificial Sequence
  chemically synthesized
caaggtttcaccaaattgtc

SEQ ID NO: 357296 - DNA, 20 bp, Artificial Sequence
  chemically synthesized
ttttttttttggtagaaaca

SEQ ID NO: 357297 - DNA, 20 bp, Artificial Sequence
  chemically synthesized
tttttttttttggtagaaac

SEQ ID NO: 357298 - DNA, 20 bp, Artificial Sequence
  chemically synthesized
ttttttttttttttttttgg

SEQ ID NO: 357299 - DNA, 20 bp, Artificial Sequence
  chemically synthesized
tttttttttttttttttttt

SEQ ID NO: 357300 - DNA, 20 bp, Artificial Sequence
  chemically synthesized
aaaaaaaaaaaaaaaaaaaa

SEQ ID NO: 357301 - DNA, 20 bp, Artificial Sequence
  chemically synthesized
aaaaaaaaaaaaaaaaaaga

SEQ ID NO: 357302 - DNA, 20 bp, Artificial Sequence
  chemically synthesized
aaaaaaaaaaaaaagaaaga

SEQ ID NO: 357303 - DNA, 20 bp, Artificial Sequence
  chemically synthesized
aaaaaaaaaagaaagaaaga

SEQ ID NO: 357304 - DNA, 20 bp, Artificial Sequence
  chemically synthesized
aaaaaagaaagaaagaaaga

SEQ ID NO: 357305 - DNA, 20 bp, Artificial Sequence
  chemically synthesized
aagaaagaaagaaagaaaga

SEQ ID NO: 357306 - DNA, 20 bp, Artificial Sequence
  chemically synthesized
agaaagaaagaaagaaaaac

SEQ ID NO: 357307 - DNA, 20 bp, Artificial Sequence
  chemically synthesized
agaaagaaagaaaaactagc

SEQ ID NO: 357308 - DNA, 20 bp, Artificial Sequence
  chemically synthesized
gaaagaaagaaaaactagct

SEQ ID NO: 357309 - DNA, 20 bp, Artificial Sequence
  chemically synthesized
catgtgacaccacacccagc

SEQ ID NO: 357310 - DNA, 20 bp, Artificial Sequence
  chemically synthesized
aaagaaaaactagctgggtg

SEQ ID NO: 357311 - DNA, 20 bp, Artificial Sequence
  chemically synthesized
taggcatgtgacaccacacc

SEQ ID NO: 357312 - DNA, 20 bp, Artificial Sequence
  chemically synthesized
ggtgtggtgtcacatgccta

SEQ ID NO: 357313 - DNA, 20 bp, Artificial Sequence
  chemically synthesized
ttctgagtagttggaactgt

SEQ ID NO: 357314 - DNA, 20 bp, Artificial Sequence
  chemically synthesized
cttctgagtagttggaactg

SEQ ID NO: 357315 - DNA, 20 bp, Artificial Sequence
  chemically synthesized
tgcctacagttccaactact

SEQ ID NO: 357316 - DNA, 20 bp, Artificial Sequence
  chemically synthesized
acctcagccttctgagtagt

SEQ ID NO: 357317 - DNA, 20 bp, Artificial Sequence
  chemically synthesized
ctacagttccaactactcag

SEQ ID NO: 357318 - DNA, 20 bp, Artificial Sequence
  chemically synthesized
tacagttccaactactcaga

SEQ ID NO: 357319 - DNA, 20 bp, Artificial Sequence
  chemically synthesized
tcccacctcagccttctgag

SEQ ID NO: 357320 - DNA, 20 bp, Artificial Sequence
  chemically synthesized
tcctcccacctcagccttct

SEQ ID NO: 357321 - DNA, 20 bp, Artificial Sequence
  chemically synthesized
ttccaactactcagaaggct

SEQ ID NO: 357322 - DNA, 20 bp, Artificial Sequence
  chemically synthesized
tccaactactcagaaggctg

SEQ ID NO: 357323 - DNA, 20 bp, Artificial Sequence
  chemically synthesized
aactactcagaaggctgagg

SEQ ID NO: 357324 - DNA, 20 bp, Artificial Sequence
  chemically synthesized
actactcagaaggctgaggt

SEQ ID NO: 357325 - DNA, 20 bp, Artificial Sequence
  chemically synthesized
tactcagaaggctgaggtgg

SEQ ID NO: 357326 - DNA, 20 bp, Artificial Sequence
  chemically synthesized
actcagaaggctgaggtggg

SEQ ID NO: 357327 - DNA, 20 bp, Artificial Sequence
  chemically synthesized
ctcaggtgatcctcccacct

SEQ ID NO: 357328 - DNA, 20 bp, Artificial Sequence
  chemically synthesized
ctgaggtgggaggatcacct

SEQ ID NO: 357329 - DNA, 20 bp, Artificial Sequence
  chemically synthesized
gtgggaggatcacctgagcc

SEQ ID NO: 357330 - DNA, 20 bp, Artificial Sequence
  chemically synthesized
tgggaggatcacctgagccc

SEQ ID NO: 357331 - DNA, 20 bp, Artificial Sequence
  chemically synthesized
gggaggatcacctgagccca

SEQ ID NO: 357332 - DNA, 20 bp, Artificial Sequence
  chemically synthesized
ccctcaacctccctgggctc

SEQ ID NO: 357333 - DNA, 20 bp, Artificial Sequence
  chemically synthesized
accctcaacctccctgggct

SEQ ID NO: 357334 - DNA, 20 bp, Artificial Sequence
  chemically synthesized
gaggatcacctgagcccagg

SEQ ID NO: 357335 - DNA, 20 bp, Artificial Sequence
  chemically synthesized
aggatcacctgagcccaggg

SEQ ID NO: 357336 - DNA, 20 bp, Artificial Sequence
  chemically synthesized
actgaaccctcaacctccct

SEQ ID NO: 357337 - DNA, 20 bp, Artificial Sequence
  chemically synthesized
cactgaaccctcaacctccc

SEQ ID NO: 357338 - DNA, 20 bp, Artificial Sequence
  chemically synthesized
cacctgagcccagggaggtt

SEQ ID NO: 357339 - DNA, 20 bp, Artificial Sequence
  chemically synthesized
acctgagcccagggaggttg

SEQ ID NO: 357340 - DNA, 20 bp, Artificial Sequence
  chemically synthesized
cctgagcccagggaggttga

SEQ ID NO: 357341 - DNA, 20 bp, Artificial Sequence
  chemically synthesized
gcccagggaggttgagggtt

SEQ ID NO: 357342 - DNA, 20 bp, Artificial Sequence
  chemically synthesized
agagtacagtggcacgatta

SEQ ID NO: 357343 - DNA, 20 bp, Artificial Sequence
  chemically synthesized
ttgcccaggctagagtacag

SEQ ID NO: 357344 - DNA, 20 bp, Artificial Sequence
  chemically synthesized
ataatcgtgccactgtactc

SEQ ID NO: 357345 - DNA, 20 bp, Artificial Sequence
  chemically synthesized
ctgttgcccaggctagagta

SEQ ID NO: 357346 - DNA, 20 bp, Artificial Sequence
  chemically synthesized
cgtgccactgtactctagcc

SEQ ID NO: 357347 - DNA, 20 bp, Artificial Sequence
  chemically synthesized
gtgccactgtactctagcct

SEQ ID NO: 357348 - DNA, 20 bp, Artificial Sequence
  chemically synthesized
tcactctgttgcccaggcta

SEQ ID NO: 357349 - DNA, 20 bp, Artificial Sequence
  chemically synthesized
tctcactctgttgcccaggc

SEQ ID NO: 357350 - DNA, 20 bp, Artificial Sequence
  chemically synthesized
ctgtactctagcctgggcaa

SEQ ID NO: 357351 - DNA, 20 bp, Artificial Sequence
  chemically synthesized
agggtctcactctgttgccc

SEQ ID NO: 357352 - DNA, 20 bp, Artificial Sequence
  chemically synthesized
gtactctagcctgggcaaca

SEQ ID NO: 357353 - DNA, 20 bp, Artificial Sequence
  chemically synthesized
cagggtctcactctgttgcc

SEQ ID NO: 357354 - DNA, 20 bp, Artificial Sequence
  chemically synthesized
tctagcctgggcaacagagt

SEQ ID NO: 357355 - DNA, 20 bp, Artificial Sequence
  chemically synthesized
cagcattcttttttgataca

SEQ ID NO: 357356 - DNA, 20 bp, Artificial Sequence
  chemically synthesized
tcagcattcttttttgatac

SEQ ID NO: 357357 - DNA, 20 bp, Artificial Sequence
  chemically synthesized
ctcagcattcttttttgata

SEQ ID NO: 357358 - DNA, 20 bp, Artificial Sequence
  chemically synthesized
agtgagaccctgtatcaaaa

SEQ ID NO: 357359 - DNA, 20 bp, Artificial Sequence
  chemically synthesized
ctgtatcaaaaaagaatgct

SEQ ID NO: 357360 - DNA, 20 bp, Artificial Sequence
  chemically synthesized
tgtatcaaaaaagaatgctg

SEQ ID NO: 357361 - DNA, 20 bp, Artificial Sequence
  chemically synthesized
gtatttaaggtatacatcct

SEQ ID NO: 357362 - DNA, 20 bp, Artificial Sequence
  chemically synthesized
ataaacgttgtatgtattta

SEQ ID NO: 357363 - DNA, 20 bp, Artificial Sequence
  chemically synthesized
aataaacgttgtatgtattt

SEQ ID NO: 357364 - DNA, 20 bp, Artificial Sequence
  chemically synthesized
acgtttatttgtcaattata

SEQ ID NO: 357365 - DNA, 20 bp, Artificial Sequence
  chemically synthesized
ttgtcaattatacagcaata

SEQ ID NO: 357366 - DNA, 20 bp, Artificial Sequence
  chemically synthesized
attatacagcaataaagatg

SEQ ID NO: 357367 - DNA, 20 bp, Artificial Sequence
  chemically synthesized
ttatacagcaataaagatgt

SEQ ID NO: 357368 - DNA, 20 bp, Artificial Sequence
  chemically synthesized
tatacagcaataaagatgtg

SEQ ID NO: 357369 - DNA, 20 bp, Artificial Sequence
  chemically synthesized
caataaagatgtggggaaaa

SEQ ID NO: 357370 - DNA, 20 bp, Artificial Sequence
  chemically synthesized
ggggaaaaaagaaaatcctg

SEQ ID NO: 357371 - DNA, 20 bp, Artificial Sequence
  chemically synthesized
gtagattatttgtcatcttc

SEQ ID NO: 357372 - DNA, 20 bp, Artificial Sequence
  chemically synthesized
cgtagattatttgtcatctt

SEQ ID NO: 357373 - DNA, 20 bp, Artificial Sequence
  chemically synthesized
agatgacaaataatctacgc

SEQ ID NO: 357374 - DNA, 20 bp, Artificial Sequence
  chemically synthesized
gttgcttggataagctagcg

SEQ ID NO: 357375 - DNA, 20 bp, Artificial Sequence
  chemically synthesized
tttttgttgcttggataagc

SEQ ID NO: 357376 - DNA, 20 bp, Artificial Sequence
  chemically synthesized
taatctacgctagcttatcc

SEQ ID NO: 357377 - DNA, 20 bp, Artificial Sequence
  chemically synthesized
taaatttttgttgcttggat

SEQ ID NO: 357378 - DNA, 20 bp, Artificial Sequence
  chemically synthesized
atagataaatttttgttgct

SEQ ID NO: 357379 - DNA, 20 bp, Artificial Sequence
  chemically synthesized
aaaaatttatctatctcatc

SEQ ID NO: 357380 - DNA, 20 bp, Artificial Sequence
  chemically synthesized
atccacgagactggatgaga

SEQ ID NO: 357381 - DNA, 20 bp, Artificial Sequence
  chemically synthesized
tgaaatccacgagactggat

SEQ ID NO: 357382 - DNA, 20 bp, Artificial Sequence
  chemically synthesized
atctatctcatccagtctcg

SEQ ID NO: 357383 - DNA, 20 bp, Artificial Sequence
  chemically synthesized
ggtattgaaatccacgagac

SEQ ID NO: 357384 - DNA, 20 bp, Artificial Sequence
  chemically synthesized
tggctggtattgaaatccac

SEQ ID NO: 357385 - DNA, 20 bp, Artificial Sequence
  chemically synthesized
agtctcgtggatttcaatac

SEQ ID NO: 357386 - DNA, 20 bp, Artificial Sequence
  chemically synthesized
gggcattaccagtaaatggc

SEQ ID NO: 357387 - DNA, 20 bp, Artificial Sequence
  chemically synthesized
tttcaataccagccatttac

SEQ ID NO: 357388 - DNA, 20 bp, Artificial Sequence
  chemically synthesized
aactgggcattaccagtaaa

SEQ ID NO: 357389 - DNA, 20 bp, Artificial Sequence
  chemically synthesized
catataaaactgggcattac

SEQ ID NO: 357390 - DNA, 20 bp, Artificial Sequence
  chemically synthesized
agccatttactggtaatgcc

SEQ ID NO: 357391 - DNA, 20 bp, Artificial Sequence
  chemically synthesized
tgggttagacatataaaact

SEQ ID NO: 357392 - DNA, 20 bp, Artificial Sequence
  chemically synthesized
ctgggttagacatataaaac

SEQ ID NO: 357393 - DNA, 20 bp, Artificial Sequence
  chemically synthesized
ccagttttatatgtctaacc

SEQ ID NO: 357394 - DNA, 20 bp, Artificial Sequence
  chemically synthesized
tttagggaagaggtctgggt

SEQ ID NO: 357395 - DNA, 20 bp, Artificial Sequence
  chemically synthesized
gaagtttagggaagaggtct

SEQ ID NO: 357396 - DNA, 20 bp, Artificial Sequence
  chemically synthesized
tgaagtttagggaagaggtc

SEQ ID NO: 357397 - DNA, 20 bp, Artificial Sequence
  chemically synthesized
taatttgaagtttagggaag

SEQ ID NO: 357398 - DNA, 20 bp, Artificial Sequence
  chemically synthesized
ataatttgaagtttagggaa

SEQ ID NO: 357399 - DNA, 20 bp, Artificial Sequence
  chemically synthesized
ctataatttgaagtttaggg

SEQ ID NO: 357400 - DNA, 20 bp, Artificial Sequence
  chemically synthesized
aatctataatttgaagttta

SEQ ID NO: 357401 - DNA, 20 bp, Artificial Sequence
  chemically synthesized
gaatctataatttgaagttt

SEQ ID NO: 357402 - DNA, 20 bp, Artificial Sequence
  chemically synthesized
agaatctataatttgaagtt

SEQ ID NO: 357403 - DNA, 20 bp, Artificial Sequence
  chemically synthesized
cttccctaaacttcaaatta

SEQ ID NO: 357404 - DNA, 20 bp, Artificial Sequence
  chemically synthesized
ttagaagaatctataatttg

SEQ ID NO: 357405 - DNA, 20 bp, Artificial Sequence
  chemically synthesized
tggagataatgagtgtttag

SEQ ID NO: 357406 - DNA, 20 bp, Artificial Sequence
  chemically synthesized
aaatggagataatgagtgtt

SEQ ID NO: 357407 - DNA, 20 bp, Artificial Sequence
  chemically synthesized
gattactaaatggagataat

SEQ ID NO: 357408 - DNA, 20 bp, Artificial Sequence
  chemically synthesized
aaacactcattatctccatt

SEQ ID NO: 357409 - DNA, 20 bp, Artificial Sequence
  chemically synthesized
aagcttgtgattactaaatg

SEQ ID NO: 357410 - DNA, 20 bp, Artificial Sequence
  chemically synthesized
tgaagcttgtgattactaaa

SEQ ID NO: 357411 - DNA, 20 bp, Artificial Sequence
  chemically synthesized
tatctccatttagtaatcac

SEQ ID NO: 357412 - DNA, 20 bp, Artificial Sequence
  chemically synthesized
atttagtaatcacaagcttc

SEQ ID NO: 357413 - DNA, 20 bp, Artificial Sequence
  chemically synthesized
agctcagttcaggacacttg

SEQ ID NO: 357414 - DNA, 20 bp, Artificial Sequence
  chemically synthesized
agcttcaagtgtcctgaact

SEQ ID NO: 357415 - DNA, 20 bp, Artificial Sequence
  chemically synthesized
aaacatcagaagctcagttc

SEQ ID NO: 357416 - DNA, 20 bp, Artificial Sequence
  chemically synthesized
taaacatcagaagctcagtt

SEQ ID NO: 357417 - DNA, 20 bp, Artificial Sequence
  chemically synthesized
gaggataaacatcagaagct

SEQ ID NO: 357418 - DNA, 20 bp, Artificial Sequence
  chemically synthesized
atgatgaggataaacatcag

SEQ ID NO: 357419 - DNA, 20 bp, Artificial Sequence
  chemically synthesized
agtatgatgaggataaacat

SEQ ID NO: 357420 - DNA, 20 bp, Artificial Sequence
  chemically synthesized
aggtttgggggagtatgatg

SEQ ID NO: 357421 - DNA, 20 bp, Artificial Sequence
  chemically synthesized
taggtttgggggagtatgat

SEQ ID NO: 357422 - DNA, 20 bp, Artificial Sequence
  chemically synthesized
aaaagtaggtaggtttgggg

SEQ ID NO: 357423 - DNA, 20 bp, Artificial Sequence
  chemically synthesized
agaaaagtaggtaggtttgg

SEQ ID NO: 357424 - DNA, 20 bp, Artificial Sequence
  chemically synthesized
aagaaaagtaggtaggtttg

SEQ ID NO: 357425 - DNA, 20 bp, Artificial Sequence
  chemically synthesized
caagaaaagtaggtaggttt

SEQ ID NO: 357426 - DNA, 20 bp, Artificial Sequence
  chemically synthesized
gcaagaaaagtaggtaggtt

SEQ ID NO: 357427 - DNA, 20 bp, Artificial Sequence
  chemically synthesized
gaacagcaagaaaagtaggt

SEQ ID NO: 357428 - DNA, 20 bp, Artificial Sequence
  chemically synthesized
agaacagcaagaaaagtagg

SEQ ID NO: 357429 - DNA, 20 bp, Artificial Sequence
  chemically synthesized
gggagaacagcaagaaaagt

SEQ ID NO: 357430 - DNA, 20 bp, Artificial Sequence
  chemically synthesized
agggagaacagcaagaaaag

SEQ ID NO: 357431 - DNA, 20 bp, Artificial Sequence
  chemically synthesized
ggaagggagaacagcaagaa

SEQ ID NO: 357432 - DNA, 20 bp, Artificial Sequence
  chemically synthesized
attgaggaagggagaacagc

SEQ ID NO: 357433 - DNA, 20 bp, Artificial Sequence
  chemically synthesized
cattattgaggaagggagaa

SEQ ID NO: 357434 - DNA, 20 bp, Artificial Sequence
  chemically synthesized
ttgttcattattgaggaagg

SEQ ID NO: 357435 - DNA, 20 bp, Artificial Sequence
  chemically synthesized
cattgttcattattgaggaa

SEQ ID NO: 357436 - DNA, 20 bp, Artificial Sequence
  chemically synthesized
acattgttcattattgagga

SEQ ID NO: 357437 - DNA, 20 bp, Artificial Sequence
  chemically synthesized
cacattgttcattattgagg

SEQ ID NO: 357438 - DNA, 20 bp, Artificial Sequence
  chemically synthesized
aaacacattgttcattattg

SEQ ID NO: 357439 - DNA, 20 bp, Artificial Sequence
  chemically synthesized
taaacacattgttcattatt

SEQ ID NO: 357440 - DNA, 20 bp, Artificial Sequence
  chemically synthesized
gaacaatgtgtttaaaattg

SEQ ID NO: 357441 - DNA, 20 bp, Artificial Sequence
  chemically synthesized
tgtttaaaattgcagttgct

SEQ ID NO: 357442 - DNA, 20 bp, Artificial Sequence
  chemically synthesized
gactccaagggtttttatct

SEQ ID NO: 357443 - DNA, 20 bp, Artificial Sequence
  chemically synthesized
gttgctcagataaaaaccct

SEQ ID NO: 357444 - DNA, 20 bp, Artificial Sequence
  chemically synthesized
tgctcagataaaaacccttg

SEQ ID NO: 357445 - DNA, 20 bp, Artificial Sequence
  chemically synthesized
gtcattaaggatgactccaa

SEQ ID NO: 357446 - DNA, 20 bp, Artificial Sequence
  chemically synthesized
agtcattaaggatgactcca

SEQ ID NO: 357447 - DNA, 20 bp, Artificial Sequence
  chemically synthesized
tagtcattaaggatgactcc

SEQ ID NO: 357448 - DNA, 20 bp, Artificial Sequence
  chemically synthesized
tgagagtaaaatagtcatta

SEQ ID NO: 357449 - DNA, 20 bp, Artificial Sequence
  chemically synthesized
gtgagagtaaaatagtcatt

SEQ ID NO: 357450 - DNA, 20 bp, Artificial Sequence
  chemically synthesized
aatgttgtgtgagagtaaaa

SEQ ID NO: 357451 - DNA, 20 bp, Artificial Sequence
  chemically synthesized
ttgaattaaatgttgtgtga

SEQ ID NO: 357452 - DNA, 20 bp, Artificial Sequence
  chemically synthesized
ttttgaattaaatgttgtgt

SEQ ID NO: 357453 - DNA, 20 bp, Artificial Sequence
  chemically synthesized
catttaattcaaaatgtatt

SEQ ID NO: 357454 - DNA, 20 bp, Artificial Sequence
  chemically synthesized
gcagtgaggatagtcagaag

SEQ ID NO: 357455 - DNA, 20 bp, Artificial Sequence
  chemically synthesized
atggcagtgaggatagtcag

SEQ ID NO: 357456 - DNA, 20 bp, Artificial Sequence
  chemically synthesized
gtgatggcagtgaggatagt

SEQ ID NO: 357457 - DNA, 20 bp, Artificial Sequence
  chemically synthesized
tagagtgatggcagtgagga

SEQ ID NO: 357458 - DNA, 20 bp, Artificial Sequence
  chemically synthesized
ggactagagtgatggcagtg

SEQ ID NO: 357459 - DNA, 20 bp, Artificial Sequence
  chemically synthesized
tggactagagtgatggcagt

SEQ ID NO: 357460 - DNA, 20 bp, Artificial Sequence
  chemically synthesized
attttggactagagtgatgg

SEQ ID NO: 357461 - DNA, 20 bp, Artificial Sequence
  chemically synthesized
tatcctcactgccatcactc

SEQ ID NO: 357462 - DNA, 20 bp, Artificial Sequence
  chemically synthesized
tggattttggactagagtga

SEQ ID NO: 357463 - DNA, 20 bp, Artificial Sequence
  chemically synthesized
ataaaatggattttggacta

SEQ ID NO: 357464 - DNA, 20 bp, Artificial Sequence
  chemically synthesized
agataaaatggattttggac

SEQ ID NO: 357465 - DNA, 20 bp, Artificial Sequence
  chemically synthesized
atgcaagataaaatggattt

SEQ ID NO: 357466 - DNA, 20 bp, Artificial Sequence
  chemically synthesized
ataattcatgcaagataaaa

SEQ ID NO: 357467 - DNA, 20 bp, Artificial Sequence
  chemically synthesized
gctattgtgataattcatgc

SEQ ID NO: 357468 - DNA, 20 bp, Artificial Sequence
  chemically synthesized
tcttgcatgaattatcacaa

SEQ ID NO: 357469 - DNA, 20 bp, Artificial Sequence
  chemically synthesized
agagtgagagaagagttatg

SEQ ID NO: 357470 - DNA, 20 bp, Artificial Sequence
  chemically synthesized
aagagtgagagaagagttat

SEQ ID NO: 357471 - DNA, 20 bp, Artificial Sequence
  chemically synthesized
cgcaggcaagagtgagagaa

SEQ ID NO: 357472 - DNA, 20 bp, Artificial Sequence
  chemically synthesized
aacgcaggcaagagtgagag

SEQ ID NO: 357473 - DNA, 20 bp, Artificial Sequence
  chemically synthesized
attaacgcaggcaagagtga

SEQ ID NO: 357474 - DNA, 20 bp, Artificial Sequence
  chemically synthesized
taattaacgcaggcaagagt

SEQ ID NO: 357475 - DNA, 20 bp, Artificial Sequence
  chemically synthesized
gcactaattaacgcaggcaa

SEQ ID NO: 357476 - DNA, 20 bp, Artificial Sequence
  chemically synthesized
atgcactaattaacgcaggc

SEQ ID NO: 357477 - DNA, 20 bp, Artificial Sequence
  chemically synthesized
tgctatgcactaattaacgc

SEQ ID NO: 357478 - DNA, 20 bp, Artificial Sequence
  chemically synthesized
tcactcttgcctgcgttaat

SEQ ID NO: 357479 - DNA, 20 bp, Artificial Sequence
  chemically synthesized
ctgctatgcactaattaacg

SEQ ID NO: 357480 - DNA, 20 bp, Artificial Sequence
  chemically synthesized
tgcctgcgttaattagtgca

SEQ ID NO: 357481 - DNA, 20 bp, Artificial Sequence
  chemically synthesized
ctgcgttaattagtgcatag

SEQ ID NO: 357482 - DNA, 20 bp, Artificial Sequence
  chemically synthesized
gcgttaattagtgcatagca

SEQ ID NO: 357483 - DNA, 20 bp, Artificial Sequence
  chemically synthesized
ttagtgcatagcagagttgc

SEQ ID NO: 357484 - DNA, 20 bp, Artificial Sequence
  chemically synthesized
agtgcatagcagagttgcca

SEQ ID NO: 357485 - DNA, 20 bp, Artificial Sequence
  chemically synthesized
aacatgttaacagatcactc

SEQ ID NO: 357486 - DNA, 20 bp, Artificial Sequence
  chemically synthesized
gatatgatgaaacatgttaa

SEQ ID NO: 357487 - DNA, 20 bp, Artificial Sequence
  chemically synthesized
aaagcagagatttgagaaga

SEQ ID NO: 357488 - DNA, 20 bp, Artificial Sequence
  chemically synthesized
ccctaaagcagagatttgag

SEQ ID NO: 357489 - DNA, 20 bp, Artificial Sequence
  chemically synthesized
ttcccctaaagcagagattt

SEQ ID NO: 357490 - DNA, 20 bp, Artificial Sequence
  chemically synthesized
gtcttctcaaatctctgctt

SEQ ID NO: 357491 - DNA, 20 bp, Artificial Sequence
  chemically synthesized
tcttctcaaatctctgcttt

SEQ ID NO: 357492 - DNA, 20 bp, Artificial Sequence
  chemically synthesized
cttctcaaatctctgcttta

SEQ ID NO: 357493 - DNA, 20 bp, Artificial Sequence
  chemically synthesized
tttgtacttcccctaaagca

SEQ ID NO: 357494 - DNA, 20 bp, Artificial Sequence
  chemically synthesized
ttctcaaatctctgctttag

SEQ ID NO: 357495 - DNA, 20 bp, Artificial Sequence
  chemically synthesized
aatttgtacttcccctaaag

SEQ ID NO: 357496 - DNA, 20 bp, Artificial Sequence
  chemically synthesized
tcaaatctctgctttagggg

SEQ ID NO: 357497 - DNA, 20 bp, Artificial Sequence
  chemically synthesized
cgtaatttgtacttccccta

SEQ ID NO: 357498 - DNA, 20 bp, Artificial Sequence
  chemically synthesized
cgtatttcatgtgatctacg

SEQ ID NO: 357499 - DNA, 20 bp, Artificial Sequence
  chemically synthesized
ctggaccctgttggacttcg

SEQ ID NO: 357500 - DNA, 20 bp, Artificial Sequence
  chemically synthesized
atgtgatctacgaagtccaa

SEQ ID NO: 357501 - DNA, 20 bp, Artificial Sequence
  chemically synthesized
tgtgatctacgaagtccaac

SEQ ID NO: 357502 - DNA, 20 bp, Artificial Sequence
  chemically synthesized
gtgatctacgaagtccaaca

SEQ ID NO: 357503 - DNA, 20 bp, Artificial Sequence
  chemically synthesized
aatagggacctggaccctgt

SEQ ID NO: 357504 - DNA, 20 bp, Artificial Sequence
  chemically synthesized
ctacgaagtccaacagggtc

SEQ ID NO: 357505 - DNA, 20 bp, Artificial Sequence
  chemically synthesized
tacgaagtccaacagggtcc

SEQ ID NO: 357506 - DNA, 20 bp, Artificial Sequence
  chemically synthesized
tcagagagttaatagggacc

SEQ ID NO: 357507 - DNA, 20 bp, Artificial Sequence
  chemically synthesized
ataaaatcagagagttaata

SEQ ID NO: 357508 - DNA, 20 bp, Artificial Sequence
  chemically synthesized
aataaaatcagagagttaat

SEQ ID NO: 357509 - DNA, 20 bp, Artificial Sequence
  chemically synthesized
aaataaaatcagagagttaa

SEQ ID NO: 357510 - DNA, 20 bp, Artificial Sequence
  chemically synthesized
agacaagaaataaaatcaga

SEQ ID NO: 357511 - DNA, 20 bp, Artificial Sequence
  chemically synthesized
agagacaagaaataaaatca

SEQ ID NO: 357512 - DNA, 20 bp, Artificial Sequence
  chemically synthesized
aaagagacaagaaataaaat

SEQ ID NO: 357513 - DNA, 20 bp, Artificial Sequence
  chemically synthesized
tggaatatgaggaaagagac

SEQ ID NO: 357514 - DNA, 20 bp, Artificial Sequence
  chemically synthesized
gtttatggaatatgaggaaa

SEQ ID NO: 357515 - DNA, 20 bp, Artificial Sequence
  chemically synthesized
ctgtttatggaatatgagga

SEQ ID NO: 357516 - DNA, 20 bp, Artificial Sequence
  chemically synthesized
gatcctgtttatggaatatg

SEQ ID NO: 357517 - DNA, 20 bp, Artificial Sequence
  chemically synthesized
ggatcctgtttatggaatat

SEQ ID NO: 357518 - DNA, 20 bp, Artificial Sequence
  chemically synthesized
ctttcctcatattccataaa

SEQ ID NO: 357519 - DNA, 20 bp, Artificial Sequence
  chemically synthesized
tttcctcatattccataaac

SEQ ID NO: 357520 - DNA, 20 bp, Artificial Sequence
  chemically synthesized
gaaactatggatcctgttta

SEQ ID NO: 357521 - DNA, 20 bp, Artificial Sequence
  chemically synthesized
tattccataaacaggatcca

SEQ ID NO: 357522 - DNA, 20 bp, Artificial Sequence
  chemically synthesized
aatccaagtgcaggaaacta

SEQ ID NO: 357523 - DNA, 20 bp, Artificial Sequence
  chemically synthesized
gatccatagtttcctgcact

SEQ ID NO: 357524 - DNA, 20 bp, Artificial Sequence
  chemically synthesized
cgaattccaaatccaagtgc

SEQ ID NO: 357525 - DNA, 20 bp, Artificial Sequence
  chemically synthesized
gcgaattccaaatccaagtg

SEQ ID NO: 357526 - DNA, 20 bp, Artificial Sequence
  chemically synthesized
tagtttcctgcacttggatt

SEQ ID NO: 357527 - DNA, 20 bp, Artificial Sequence
  chemically synthesized
gaaaagcgaattccaaatcc

SEQ ID NO: 357528 - DNA, 20 bp, Artificial Sequence
  chemically synthesized
gatttggaattcgcttttcg

SEQ ID NO: 357529 - DNA, 20 bp, Artificial Sequence
  chemically synthesized
gccatgtttatgtcttcgaa

SEQ ID NO: 357530 - DNA, 20 bp, Artificial Sequence
  chemically synthesized
gcttttcgaagacataaaca

SEQ ID NO: 357531 - DNA, 20 bp, Artificial Sequence
  chemically synthesized
cccaatggaagtaaaggagt

SEQ ID NO: 357532 - DNA, 20 bp, Artificial Sequence
  chemically synthesized
aagacccaatggaagtaaag

SEQ ID NO: 357533 - DNA, 20 bp, Artificial Sequence
  chemically synthesized
taaagacccaatggaagtaa

SEQ ID NO: 357534 - DNA, 20 bp, Artificial Sequence
  chemically synthesized
gtaaagacccaatggaagta

SEQ ID NO: 357535 - DNA, 20 bp, Artificial Sequence
  chemically synthesized
gctcactcctttacttccat

SEQ ID NO: 357536 - DNA, 20 bp, Artificial Sequence
  chemically synthesized
ctcactcctttacttccatt

SEQ ID NO: 357537 - DNA, 20 bp, Artificial Sequence
  chemically synthesized
ttcgagtaaagacccaatgg

SEQ ID NO: 357538 - DNA, 20 bp, Artificial Sequence
  chemically synthesized
attttcgagtaaagacccaa

SEQ ID NO: 357539 - DNA, 20 bp, Artificial Sequence
  chemically synthesized
agtgatgtgattttcgagta

SEQ ID NO: 357540 - DNA, 20 bp, Artificial Sequence
  chemically synthesized
ttatcagtgatgtgattttc

SEQ ID NO: 357541 - DNA, 20 bp, Artificial Sequence
  chemically synthesized
tcgaaaatcacatcactgat

SEQ ID NO: 357542 - DNA, 20 bp, Artificial Sequence
  chemically synthesized
ttgggcagggaagaacttat

SEQ ID NO: 357543 - DNA, 20 bp, Artificial Sequence
  chemically synthesized
tagatagggcttgggcaggg

SEQ ID NO: 357544 - DNA, 20 bp, Artificial Sequence
  chemically synthesized
tgataagttcttccctgccc

SEQ ID NO: 357545 - DNA, 20 bp, Artificial Sequence
  chemically synthesized
ttttagatagggcttgggca

SEQ ID NO: 357546 - DNA, 20 bp, Artificial Sequence
  chemically synthesized
attttagatagggcttgggc

SEQ ID NO: 357547 - DNA, 20 bp, Artificial Sequence
  chemically synthesized
aattttagatagggcttggg

SEQ ID NO: 357548 - DNA, 20 bp, Artificial Sequence
  chemically synthesized
tgcaattttagatagggctt

SEQ ID NO: 357549 - DNA, 20 bp, Artificial Sequence
  chemically synthesized
atgcaattttagatagggct

SEQ ID NO: 357550 - DNA, 20 bp, Artificial Sequence
  chemically synthesized
ccagcatgcaattttagata

SEQ ID NO: 357551 - DNA, 20 bp, Artificial Sequence
  chemically synthesized
gccagcatgcaattttagat

SEQ ID NO: 357552 - DNA, 20 bp, Artificial Sequence
  chemically synthesized
ggccagcatgcaattttaga

SEQ ID NO: 357553 - DNA, 20 bp, Artificial Sequence
  chemically synthesized
gcctggccagcatgcaattt

SEQ ID NO: 357554 - DNA, 20 bp, Artificial Sequence
  chemically synthesized
ccctatctaaaattgcatgc

SEQ ID NO: 357555 - DNA, 20 bp, Artificial Sequence
  chemically synthesized
atctaaaattgcatgctggc

SEQ ID NO: 357556 - DNA, 20 bp, Artificial Sequence
  chemically synthesized
tctaaaattgcatgctggcc

SEQ ID NO: 357557 - DNA, 20 bp, Artificial Sequence
  chemically synthesized
tgtgagccaaggtgcctggc

SEQ ID NO: 357558 - DNA, 20 bp, Artificial Sequence
  chemically synthesized
tgcatgctggccaggcacct

SEQ ID NO: 357559 - DNA, 20 bp, Artificial Sequence
  chemically synthesized
caggtgtgagccaaggtgcc

SEQ ID NO: 357560 - DNA, 20 bp, Artificial Sequence
  chemically synthesized
tggtttacaggtgtgagcca

SEQ ID NO: 357561 - DNA, 20 bp, Artificial Sequence
  chemically synthesized
ttggtttacaggtgtgagcc

SEQ ID NO: 357562 - DNA, 20 bp, Artificial Sequence
  chemically synthesized
agtgcttggtttacaggtgt

SEQ ID NO: 357563 - DNA, 20 bp, Artificial Sequence
  chemically synthesized
ttggctcacacctgtaaacc

SEQ ID NO: 357564 - DNA, 20 bp, Artificial Sequence
  chemically synthesized
tcccaaagtgcttggtttac

SEQ ID NO: 357565 - DNA, 20 bp, Artificial Sequence
  chemically synthesized
ctcccaaagtgcttggttta

SEQ ID NO: 357566 - DNA, 20 bp, Artificial Sequence
  chemically synthesized
cacctgtaaaccaagcactt

SEQ ID NO: 357567 - DNA, 20 bp, Artificial Sequence
  chemically synthesized
cctcagcctcccaaagtgct

SEQ ID NO: 357568 - DNA, 20 bp, Artificial Sequence
  chemically synthesized
acctgtaaaccaagcacttt

SEQ ID NO: 357569 - DNA, 20 bp, Artificial Sequence
  chemically synthesized
ctgtaaaccaagcactttgg

SEQ ID NO: 357570 - DNA, 20 bp, Artificial Sequence
  chemically synthesized
tgtaaaccaagcactttggg

SEQ ID NO: 357571 - DNA, 20 bp, Artificial Sequence
  chemically synthesized
ccttcagcctcagcctccca

SEQ ID NO: 357572 - DNA, 20 bp, Artificial Sequence
  chemically synthesized
accaagcactttgggaggct

SEQ ID NO: 357573 - DNA, 20 bp, Artificial Sequence
  chemically synthesized
ccaagcactttgggaggctg

SEQ ID NO: 357574 - DNA, 20 bp, Artificial Sequence
  chemically synthesized
actttgggaggctgaggctg

SEQ ID NO: 357575 - DNA, 20 bp, Artificial Sequence
  chemically synthesized
ctttgggaggctgaggctga

SEQ ID NO: 357576 - DNA, 20 bp, Artificial Sequence
  chemically synthesized
tcaagcaaatccttcagcct

SEQ ID NO: 357577 - DNA, 20 bp, Artificial Sequence
  chemically synthesized
ctggcctcaagcaaatcctt

SEQ ID NO: 357578 - DNA, 20 bp, Artificial Sequence
  chemically synthesized
tgaggctgaaggatttgctt

SEQ ID NO: 357579 - DNA, 20 bp, Artificial Sequence
  chemically synthesized
gaggctgaaggatttgcttg

SEQ ID NO: 357580 - DNA, 20 bp, Artificial Sequence
  chemically synthesized
ctgaaggatttgcttgaggc

SEQ ID NO: 357581 - DNA, 20 bp, Artificial Sequence
  chemically synthesized
tgaaggatttgcttgaggcc

SEQ ID NO: 357582 - DNA, 20 bp, Artificial Sequence
  chemically synthesized
ggtctctaactcctggcctc

SEQ ID NO: 357583 - DNA, 20 bp, Artificial Sequence
  chemically synthesized
aaggatttgcttgaggccag

SEQ ID NO: 357584 - DNA, 20 bp, Artificial Sequence
  chemically synthesized
atttgcttgaggccaggagt

SEQ ID NO: 357585 - DNA, 20 bp, Artificial Sequence
  chemically synthesized
ttgcttgaggccaggagtta

SEQ ID NO: 357586 - DNA, 20 bp, Artificial Sequence
  chemically synthesized
tcaggttggtctctaactcc

SEQ ID NO: 357587 - DNA, 20 bp, Artificial Sequence
  chemically synthesized
tctcactatgtggttcaggt

SEQ ID NO: 357588 - DNA, 20 bp, Artificial Sequence
  chemically synthesized
caggtctcactatgtggttc

SEQ ID NO: 357589 - DNA, 20 bp, Artificial Sequence
  chemically synthesized
agagaccaacctgaaccaca

SEQ ID NO: 357590 - DNA, 20 bp, Artificial Sequence
  chemically synthesized
ccaggtctcactatgtggtt

SEQ ID NO: 357591 - DNA, 20 bp, Artificial Sequence
  chemically synthesized
accaacctgaaccacatagt

SEQ ID NO: 357592 - DNA, 20 bp, Artificial Sequence
  chemically synthesized
agagaccaggtctcactatg

SEQ ID NO: 357593 - DNA, 20 bp, Artificial Sequence
  chemically synthesized
ctgaaccacatagtgagacc

SEQ ID NO: 357594 - DNA, 20 bp, Artificial Sequence
  chemically synthesized
tttaataagttgtagagacc

SEQ ID NO: 357595 - DNA, 20 bp, Artificial Sequence
  chemically synthesized
ttttaataagttgtagagac

SEQ ID NO: 357596 - DNA, 20 bp, Artificial Sequence
  chemically synthesized
tttttttttaataagttgta

SEQ ID NO: 357597 - DNA, 20 bp, Artificial Sequence
  chemically synthesized
tttttttttttaataagttg

SEQ ID NO: 357598 - DNA, 20 bp, Artificial Sequence
  chemically synthesized
tttttttttttttttttaat

SEQ ID NO: 357599 - DNA, 20 bp, Artificial Sequence
  chemically synthesized
ttaaaaaaaaaaaaaaaaaa

SEQ ID NO: 357600 - DNA, 20 bp, Artificial Sequence
  chemically synthesized
aaaaaaaaaaaaaaatagcc

SEQ ID NO: 357601 - DNA, 20 bp, Artificial Sequence
  chemically synthesized
aaaaaaatagccaagtgtgc

SEQ ID NO: 357602 - DNA, 20 bp, Artificial Sequence
  chemically synthesized
caggggcatgccagcacact

SEQ ID NO: 357603 - DNA, 20 bp, Artificial Sequence
  chemically synthesized
ctgggaccacaggggcatgc

SEQ ID NO: 357604 - DNA, 20 bp, Artificial Sequence
  chemically synthesized
agtgtgctggcatgcccctg

SEQ ID NO: 357605 - DNA, 20 bp, Artificial Sequence
  chemically synthesized
ctgagtagctgggaccacag

SEQ ID NO: 357606 - DNA, 20 bp, Artificial Sequence
  chemically synthesized
cctgagtagctgggaccaca

SEQ ID NO: 357607 - DNA, 20 bp, Artificial Sequence
  chemically synthesized
ctggcatgcccctgtggtcc

SEQ ID NO: 357608 - DNA, 20 bp, Artificial Sequence
  chemically synthesized
tcctgagtagctgggaccac

SEQ ID NO: 357609 - DNA, 20 bp, Artificial Sequence
  chemically synthesized
ctcctgagtagctgggacca

SEQ ID NO: 357610 - DNA, 20 bp, Artificial Sequence
  chemically synthesized
cccctgtggtcccagctact

SEQ ID NO: 357611 - DNA, 20 bp, Artificial Sequence
  chemically synthesized
cctcagcctcctgagtagct

SEQ ID NO: 357612 - DNA, 20 bp, Artificial Sequence
  chemically synthesized
ccctgtggtcccagctactc

SEQ ID NO: 357613 - DNA, 20 bp, Artificial Sequence
  chemically synthesized
acctcagcctcctgagtagc

SEQ ID NO: 357614 - DNA, 20 bp, Artificial Sequence
  chemically synthesized
ctgtggtcccagctactcag

SEQ ID NO: 357615 - DNA, 20 bp, Artificial Sequence
  chemically synthesized
tgtggtcccagctactcagg

SEQ ID NO: 357616 - DNA, 20 bp, Artificial Sequence
  chemically synthesized
tccaacctcagcctcctgag

SEQ ID NO: 357617 - DNA, 20 bp, Artificial Sequence
  chemically synthesized
ttctccaacctcagcctcct

SEQ ID NO: 357618 - DNA, 20 bp, Artificial Sequence
  chemically synthesized
tcccagctactcaggaggct

SEQ ID NO: 357619 - DNA, 20 bp, Artificial Sequence
  chemically synthesized
cccagctactcaggaggctg

SEQ ID NO: 357620 - DNA, 20 bp, Artificial Sequence
  chemically synthesized
gctactcaggaggctgaggt

SEQ ID NO: 357621 - DNA, 20 bp, Artificial Sequence
  chemically synthesized
tactcaggaggctgaggttg

SEQ ID NO: 357622 - DNA, 20 bp, Artificial Sequence
  chemically synthesized
ctcaagtgattctccaacct

SEQ ID NO: 357623 - DNA, 20 bp, Artificial Sequence
  chemically synthesized
ctgaggttggagaatcactt

SEQ ID NO: 357624 - DNA, 20 bp, Artificial Sequence
  chemically synthesized
gttggagaatcacttgagcc

SEQ ID NO: 357625 - DNA, 20 bp, Artificial Sequence
  chemically synthesized
ttggagaatcacttgagcct

SEQ ID NO: 357626 - DNA, 20 bp, Artificial Sequence
  chemically synthesized
cactatagccacccaggctc

SEQ ID NO: 357627 - DNA, 20 bp, Artificial Sequence
  chemically synthesized
gagaatcacttgagcctggg

SEQ ID NO: 357628 - DNA, 20 bp, Artificial Sequence
  chemically synthesized
atggctcactatagccaccc

SEQ ID NO: 357629 - DNA, 20 bp, Artificial Sequence
  chemically synthesized
catggctcactatagccacc

SEQ ID NO: 357630 - DNA, 20 bp, Artificial Sequence
  chemically synthesized
cacttgagcctgggtggcta

SEQ ID NO: 357631 - DNA, 20 bp, Artificial Sequence
  chemically synthesized
tgagcctgggtggctatagt

SEQ ID NO: 357632 - DNA, 20 bp, Artificial Sequence
  chemically synthesized
ggtacaatcatggctcacta

SEQ ID NO: 357633 - DNA, 20 bp, Artificial Sequence
  chemically synthesized
ggagtgcagtggtacaatca

SEQ ID NO: 357634 - DNA, 20 bp, Artificial Sequence
  chemically synthesized
tcacccaggctggagtgcag

SEQ ID NO: 357635 - DNA, 20 bp, Artificial Sequence
  chemically synthesized
atgattgtaccactgcactc

SEQ ID NO: 357636 - DNA, 20 bp, Artificial Sequence
  chemically synthesized
cagtcacccaggctggagtg

SEQ ID NO: 357637 - DNA, 20 bp, Artificial Sequence
  chemically synthesized
tgtaccactgcactccagcc

SEQ ID NO: 357638 - DNA, 20 bp, Artificial Sequence
  chemically synthesized
gtaccactgcactccagcct

SEQ ID NO: 357639 - DNA, 20 bp, Artificial Sequence
  chemically synthesized
ttcctcagtcacccaggctg

SEQ ID NO: 357640 - DNA, 20 bp, Artificial Sequence
  chemically synthesized
tcttcctcagtcacccaggc

SEQ ID NO: 357641 - DNA, 20 bp, Artificial Sequence
  chemically synthesized
tggttcttcctcagtcaccc

SEQ ID NO: 357642 - DNA, 20 bp, Artificial Sequence
  chemically synthesized
gcactccagcctgggtgact

SEQ ID NO: 357643 - DNA, 20 bp, Artificial Sequence
  chemically synthesized
ctggttcttcctcagtcacc

SEQ ID NO: 357644 - DNA, 20 bp, Artificial Sequence
  chemically synthesized
cactccagcctgggtgactg

SEQ ID NO: 357645 - DNA, 20 bp, Artificial Sequence
  chemically synthesized
tccagcctgggtgactgagg

SEQ ID NO: 357646 - DNA, 20 bp, Artificial Sequence
  chemically synthesized
ttaggagactggttcttcct

SEQ ID NO: 357647 - DNA, 20 bp, Artificial Sequence
  chemically synthesized
ctgggtgactgaggaagaac

SEQ ID NO: 357648 - DNA, 20 bp, Artificial Sequence
  chemically synthesized
catttatctatttaggagac

SEQ ID NO: 357649 - DNA, 20 bp, Artificial Sequence
  chemically synthesized
ggaagaaccagtctcctaaa

SEQ ID NO: 357650 - DNA, 20 bp, Artificial Sequence
  chemically synthesized
tctttcatttatctatttag

SEQ ID NO: 357651 - DNA, 20 bp, Artificial Sequence
  chemically synthesized
tttctttcatttatctattt

SEQ ID NO: 357652 - DNA, 20 bp, Artificial Sequence
  chemically synthesized
ttttctttcatttatctatt

SEQ ID NO: 357653 - DNA, 20 bp, Artificial Sequence
  chemically synthesized
tctcctaaatagataaatga

SEQ ID NO: 357654 - DNA, 20 bp, Artificial Sequence
  chemically synthesized
tgagtttgatttgaggcatg

SEQ ID NO: 357655 - DNA, 20 bp, Artificial Sequence
  chemically synthesized
gtatatgtgagtttgatttg

SEQ ID NO: 357656 - DNA, 20 bp, Artificial Sequence
  chemically synthesized
agtatatgtgagtttgattt

SEQ ID NO: 357657 - DNA, 20 bp, Artificial Sequence
  chemically synthesized
gaaagaaaataagtatatgt

SEQ ID NO: 357658 - DNA, 20 bp, Artificial Sequence
  chemically synthesized
cagataaggagaaagaaaat

SEQ ID NO: 357659 - DNA, 20 bp, Artificial Sequence
  chemically synthesized
gtataaagcagataaggaga

SEQ ID NO: 357660 - DNA, 20 bp, Artificial Sequence
  chemically synthesized
aatagtataaagcagataag

SEQ ID NO: 357661 - DNA, 20 bp, Artificial Sequence
  chemically synthesized
agaatagtataaagcagata

SEQ ID NO: 357662 - DNA, 20 bp, Artificial Sequence
  chemically synthesized
gagaatagtataaagcagat

SEQ ID NO: 357663 - DNA, 20 bp, Artificial Sequence
  chemically synthesized
ttaatgagaatagtataaag

SEQ ID NO: 357664 - DNA, 20 bp, Artificial Sequence
  chemically synthesized
gtgttaatgagaatagtata

SEQ ID NO: 357665 - DNA, 20 bp, Artificial Sequence
  chemically synthesized
atagtaagtgttaatgagaa

SEQ ID NO: 357666 - DNA, 20 bp, Artificial Sequence
  chemically synthesized
gttaaatagtaagtgttaat

SEQ ID NO: 357667 - DNA, 20 bp, Artificial Sequence
  chemically synthesized
tatataatacgttaaatagt

SEQ ID NO: 357668 - DNA, 20 bp, Artificial Sequence
  chemically synthesized
aaattatataatacgttaaa

SEQ ID NO: 357669 - DNA, 20 bp, Artificial Sequence
  chemically synthesized
gtggaagagaaagatacaca

SEQ ID NO: 357670 - DNA, 20 bp, Artificial Sequence
  chemically synthesized
tagtggaagagaaagataca

SEQ ID NO: 357671 - DNA, 20 bp, Artificial Sequence
  chemically synthesized
gtacattctagtggaagaga

SEQ ID NO: 357672 - DNA, 20 bp, Artificial Sequence
  chemically synthesized
tgtgtatctttctcttccac

SEQ ID NO: 357673 - DNA, 20 bp, Artificial Sequence
  chemically synthesized
gattgtacattctagtggaa

SEQ ID NO: 357674 - DNA, 20 bp, Artificial Sequence
  chemically synthesized
aagattgtacattctagtgg

SEQ ID NO: 357675 - DNA, 20 bp, Artificial Sequence
  chemically synthesized
taaaagattgtacattctag

SEQ ID NO: 357676 - DNA, 20 bp, Artificial Sequence
  chemically synthesized
caataaaagattgtacattc

SEQ ID NO: 357677 - DNA, 20 bp, Artificial Sequence
  chemically synthesized
gtgaacaaaataggcaataa

SEQ ID NO: 357678 - DNA, 20 bp, Artificial Sequence
  chemically synthesized
tttccagcagtgaacaaaat

SEQ ID NO: 357679 - DNA, 20 bp, Artificial Sequence
  chemically synthesized
gtttccagcagtgaacaaaa

SEQ ID NO: 357680 - DNA, 20 bp, Artificial Sequence
  chemically synthesized
ttgcctattttgttcactgc

SEQ ID NO: 357681 - DNA, 20 bp, Artificial Sequence
  chemically synthesized
gtgtcaggctaggtttccag

SEQ ID NO: 357682 - DNA, 20 bp, Artificial Sequence
  chemically synthesized
tttgttcactgctggaaacc

SEQ ID NO: 357683 - DNA, 20 bp, Artificial Sequence
  chemically synthesized
tttgtgtcaggctaggtttc

SEQ ID NO: 357684 - DNA, 20 bp, Artificial Sequence
  chemically synthesized
cctttattttgtgtcaggct

SEQ ID NO: 357685 - DNA, 20 bp, Artificial Sequence
  chemically synthesized
gcctttattttgtgtcaggc

SEQ ID NO: 357686 - DNA, 20 bp, Artificial Sequence
  chemically synthesized
ttgagcctttattttgtgtc

SEQ ID NO: 357687 - DNA, 20 bp, Artificial Sequence
  chemically synthesized
gttgagcctttattttgtgt

SEQ ID NO: 357688 - DNA, 20 bp, Artificial Sequence
  chemically synthesized
acctagcctgacacaaaata

SEQ ID NO: 357689 - DNA, 20 bp, Artificial Sequence
  chemically synthesized
cctagcctgacacaaaataa

SEQ ID NO: 357690 - DNA, 20 bp, Artificial Sequence
  chemically synthesized
gtagttgataaatatttgtt

SEQ ID NO: 357691 - DNA, 20 bp, Artificial Sequence
  chemically synthesized
caaatatttatcaactacac

SEQ ID NO: 357692 - DNA, 20 bp, Artificial Sequence
  chemically synthesized
aatatttatcaactacacga

SEQ ID NO: 357693 - DNA, 20 bp, Artificial Sequence
  chemically synthesized
tgctcatccattctctcgtg

SEQ ID NO: 357694 - DNA, 20 bp, Artificial Sequence
  chemically synthesized
ttatcaactacacgagagaa

SEQ ID NO: 357695 - DNA, 20 bp, Artificial Sequence
  chemically synthesized
aactacacgagagaatggat

SEQ ID NO: 357696 - DNA, 20 bp, Artificial Sequence
  chemically synthesized
tatcaagtaacatggtatgt

SEQ ID NO: 357697 - DNA, 20 bp, Artificial Sequence
  chemically synthesized
ttctctattatcaagtaaca

SEQ ID NO: 357698 - DNA, 20 bp, Artificial Sequence
  chemically synthesized
cataccatgttacttgataa

SEQ ID NO: 357699 - DNA, 20 bp, Artificial Sequence
  chemically synthesized
taccatgttacttgataata

SEQ ID NO: 357700 - DNA, 20 bp, Artificial Sequence
  chemically synthesized
tttgcattttctctattatc

SEQ ID NO: 357701 - DNA, 20 bp, Artificial Sequence
  chemically synthesized
ttgataatagagaaaatgca

SEQ ID NO: 357702 - DNA, 20 bp, Artificial Sequence
  chemically synthesized
tgataatagagaaaatgcaa

SEQ ID NO: 357703 - DNA, 20 bp, Artificial Sequence
  chemically synthesized
ataatagagaaaatgcaaag

SEQ ID NO: 357704 - DNA, 20 bp, Artificial Sequence
  chemically synthesized
gagaaaatgcaaaggagtgt

SEQ ID NO: 357705 - DNA, 20 bp, Artificial Sequence
  chemically synthesized
gaaaatgcaaaggagtgtaa

SEQ ID NO: 357706 - DNA, 20 bp, Artificial Sequence
  chemically synthesized
aaaatgcaaaggagtgtaag

SEQ ID NO: 357707 - DNA, 20 bp, Artificial Sequence
  chemically synthesized
atgcaaaggagtgtaagagg

SEQ ID NO: 357708 - DNA, 20 bp, Artificial Sequence
  chemically synthesized
agaggcagttcttgtcttat

SEQ ID NO: 357709 - DNA, 20 bp, Artificial Sequence
  chemically synthesized
atttaaaatccttataagac

SEQ ID NO: 357710 - DNA, 20 bp, Artificial Sequence
  chemically synthesized
gaggcagttcttgtcttata

SEQ ID NO: 357711 - DNA, 20 bp, Artificial Sequence
  chemically synthesized
attaaatttaaaatccttat

SEQ ID NO: 357712 - DNA, 20 bp, Artificial Sequence
  chemically synthesized
ataaggattttaaatttaat

SEQ ID NO: 357713 - DNA, 20 bp, Artificial Sequence
  chemically synthesized
ggattttaaatttaatgagc

SEQ ID NO: 357714 - DNA, 20 bp, Artificial Sequence
  chemically synthesized
tttaatgagcaagaaaaatg

SEQ ID NO: 357715 - DNA, 20 bp, Artificial Sequence
  chemically synthesized
aatgagcaagaaaaatgaag

SEQ ID NO: 357716 - DNA, 20 bp, Artificial Sequence
  chemically synthesized
tagagtttaattaattcata

SEQ ID NO: 357717 - DNA, 20 bp, Artificial Sequence
  chemically synthesized
tctgtgttttttcacattta

SEQ ID NO: 357718 - DNA, 20 bp, Artificial Sequence
  chemically synthesized
tgtctgtgttttttcacatt

SEQ ID NO: 357719 - DNA, 20 bp, Artificial Sequence
  chemically synthesized
actctaaatgtgaaaaaaca

SEQ ID NO: 357720 - DNA, 20 bp, Artificial Sequence
  chemically synthesized
tgtgaaaaaacacagacaat

SEQ ID NO: 357721 - DNA, 20 bp, Artificial Sequence
  chemically synthesized
aaaatgttttgtaaaatctg

SEQ ID NO: 357722 - DNA, 20 bp, Artificial Sequence
  chemically synthesized
atgttttgtaaaatctgaag

SEQ ID NO: 357723 - DNA, 20 bp, Artificial Sequence
  chemically synthesized
gaaaactttcttgaccgctt

SEQ ID NO: 357724 - DNA, 20 bp, Artificial Sequence
  chemically synthesized
ttgtaaaatctgaagcggtc

SEQ ID NO: 357725 - DNA, 20 bp, Artificial Sequence
  chemically synthesized
aaaatctgaagcggtcaaga

SEQ ID NO: 357726 - DNA, 20 bp, Artificial Sequence
  chemically synthesized
agcggtcaagaaagttttct

SEQ ID NO: 357727 - DNA, 20 bp, Artificial Sequence
  chemically synthesized
gcggtcaagaaagttttctg

SEQ ID NO: 357728 - DNA, 20 bp, Artificial Sequence
  chemically synthesized
agaaagttttctgaggctga

SEQ ID NO: 357729 - DNA, 20 bp, Artificial Sequence
  chemically synthesized
tttaatctgtctttcagcct

SEQ ID NO: 357730 - DNA, 20 bp, Artificial Sequence
  chemically synthesized
agttttctgaggctgaaaga

SEQ ID NO: 357731 - DNA, 20 bp, Artificial Sequence
  chemically synthesized
cgtctatttaatctgtcttt

SEQ ID NO: 357732 - DNA, 20 bp, Artificial Sequence
  chemically synthesized
aggctgaaagacagattaaa

SEQ ID NO: 357733 - DNA, 20 bp, Artificial Sequence
  chemically synthesized
caatacattttttttaatgc

SEQ ID NO: 357734 - DNA, 20 bp, Artificial Sequence
  chemically synthesized
taaaaaaaatgtattgataa

SEQ ID NO: 357735 - DNA, 20 bp, Artificial Sequence
  chemically synthesized
tgtattgataatagaattct

SEQ ID NO: 357736 - DNA, 20 bp, Artificial Sequence
  chemically synthesized
tctctaacgctcacacaact

SEQ ID NO: 357737 - DNA, 20 bp, Artificial Sequence
  chemically synthesized
aatagaattctaagttgtgt

SEQ ID NO: 357738 - DNA, 20 bp, Artificial Sequence
  chemically synthesized
attctaagttgtgtgagcgt

SEQ ID NO: 357739 - DNA, 20 bp, Artificial Sequence
  chemically synthesized
tctaagttgtgtgagcgtta

SEQ ID NO: 357740 - DNA, 20 bp, Artificial Sequence
  chemically synthesized
gtgtgagcgttagagaatta

SEQ ID NO: 357741 - DNA, 20 bp, Artificial Sequence
  chemically synthesized
cgttagagaattaaagttct

SEQ ID NO: 357742 - DNA, 20 bp, Artificial Sequence
  chemically synthesized
gttagagaattaaagttctt

SEQ ID NO: 357743 - DNA, 20 bp, Artificial Sequence
  chemically synthesized
ttagagaattaaagttctta

SEQ ID NO: 357744 - DNA, 20 bp, Artificial Sequence
  chemically synthesized
gagaattaaagttcttaggg

SEQ ID NO: 357745 - DNA, 20 bp, Artificial Sequence
  chemically synthesized
agaattaaagttcttaggga

SEQ ID NO: 357746 - DNA, 20 bp, Artificial Sequence
  chemically synthesized
ttttgcttttttccttccct

SEQ ID NO: 357747 - DNA, 20 bp, Artificial Sequence
  chemically synthesized
aagttcttagggaaggaaaa

SEQ ID NO: 357748 - DNA, 20 bp, Artificial Sequence
  chemically synthesized
ggaaaaaagcaaaacatgct

SEQ ID NO: 357749 - DNA, 20 bp, Artificial Sequence
  chemically synthesized
ctgtgaggtcttgattatct

SEQ ID NO: 357750 - DNA, 20 bp, Artificial Sequence
  chemically synthesized
caaaacatgctcagataatc

SEQ ID NO: 357751 - DNA, 20 bp, Artificial Sequence
  chemically synthesized
ctcagataatcaagacctca

SEQ ID NO: 357752 - DNA, 20 bp, Artificial Sequence
  chemically synthesized
tcagataatcaagacctcac

SEQ ID NO: 357753 - DNA, 20 bp, Artificial Sequence
  chemically synthesized
ccaatggagccaggcctgtg

SEQ ID NO: 357754 - DNA, 20 bp, Artificial Sequence
  chemically synthesized
taatcaagacctcacaggcc

SEQ ID NO: 357755 - DNA, 20 bp, Artificial Sequence
  chemically synthesized
tccaatggagccaggcctgt

SEQ ID NO: 357756 - DNA, 20 bp, Artificial Sequence
  chemically synthesized
tagaatcttccaatggagcc

SEQ ID NO: 357757 - DNA, 20 bp, Artificial Sequence
  chemically synthesized
cctcacaggcctggctccat

SEQ ID NO: 357758 - DNA, 20 bp, Artificial Sequence
  chemically synthesized
ttagaatcttccaatggagc

SEQ ID NO: 357759 - DNA, 20 bp, Artificial Sequence
  chemically synthesized
cacaggcctggctccattgg

SEQ ID NO: 357760 - DNA, 20 bp, Artificial Sequence
  chemically synthesized
atacttagaatcttccaatg

SEQ ID NO: 357761 - DNA, 20 bp, Artificial Sequence
  chemically synthesized
tgatacttagaatcttccaa

SEQ ID NO: 357762 - DNA, 20 bp, Artificial Sequence
  chemically synthesized
tggctccattggaagattct

SEQ ID NO: 357763 - DNA, 20 bp, Artificial Sequence
  chemically synthesized
attggaagattctaagtatc

SEQ ID NO: 357764 - DNA, 20 bp, Artificial Sequence
  chemically synthesized
atctcccaccacttgatact

SEQ ID NO: 357765 - DNA, 20 bp, Artificial Sequence
  chemically synthesized
ggaagattctaagtatcaag

SEQ ID NO: 357766 - DNA, 20 bp, Artificial Sequence
  chemically synthesized
agattctaagtatcaagtgg

SEQ ID NO: 357767 - DNA, 20 bp, Artificial Sequence
  chemically synthesized
gattctaagtatcaagtggt

SEQ ID NO: 357768 - DNA, 20 bp, Artificial Sequence
  chemically synthesized
ttctaagtatcaagtggtgg

SEQ ID NO: 357769 - DNA, 20 bp, Artificial Sequence
  chemically synthesized
aagtatcaagtggtgggaga

SEQ ID NO: 357770 - DNA, 20 bp, Artificial Sequence
  chemically synthesized
agtatcaagtggtgggagat

SEQ ID NO: 357771 - DNA, 20 bp, Artificial Sequence
  chemically synthesized
gtggtgggagataggtttaa

SEQ ID NO: 357772 - DNA, 20 bp, Artificial Sequence
  chemically synthesized
tgggagataggtttaaaaga

SEQ ID NO: 357773 - DNA, 20 bp, Artificial Sequence
  chemically synthesized
taggtttaaaagaaagaaac

SEQ ID NO: 357774 - DNA, 20 bp, Artificial Sequence
  chemically synthesized
ttaaaagaaagaaactggct

SEQ ID NO: 357775 - DNA, 20 bp, Artificial Sequence
  chemically synthesized
acaccttatgcaaactcagc

SEQ ID NO: 357776 - DNA, 20 bp, Artificial Sequence
  chemically synthesized
gccaacaccttatgcaaact

SEQ ID NO: 357777 - DNA, 20 bp, Artificial Sequence
  chemically synthesized
gaaactggctgagtttgcat

SEQ ID NO: 357778 - DNA, 20 bp, Artificial Sequence
  chemically synthesized
aaactggctgagtttgcata

SEQ ID NO: 357779 - DNA, 20 bp, Artificial Sequence
  chemically synthesized
gctgagtttgcataaggtgt

SEQ ID NO: 357780 - DNA, 20 bp, Artificial Sequence
  chemically synthesized
gataaattataatacgttaa

SEQ ID NO: 357781 - DNA, 20 bp, Artificial Sequence
  chemically synthesized
cgtattataatttatcccaa

SEQ ID NO: 357782 - DNA, 20 bp, Artificial Sequence
  chemically synthesized
taatgacttccagtgctgtt

SEQ ID NO: 357783 - DNA, 20 bp, Artificial Sequence
  chemically synthesized
ataatttatcccaacagcac

SEQ ID NO: 357784 - DNA, 20 bp, Artificial Sequence
  chemically synthesized
ctaatgacttccagtgctgt

SEQ ID NO: 357785 - DNA, 20 bp, Artificial Sequence
  chemically synthesized
atttatcccaacagcactgg

SEQ ID NO: 357786 - DNA, 20 bp, Artificial Sequence
  chemically synthesized
accacttgactaatgacttc

SEQ ID NO: 357787 - DNA, 20 bp, Artificial Sequence
  chemically synthesized
ccaacagcactggaagtcat

SEQ ID NO: 357788 - DNA, 20 bp, Artificial Sequence
  chemically synthesized
agcactggaagtcattagtc

SEQ ID NO: 357789 - DNA, 20 bp, Artificial Sequence
  chemically synthesized
actggaagtcattagtcaag

SEQ ID NO: 357790 - DNA, 20 bp, Artificial Sequence
  chemically synthesized
tctgtgattcagaataggtg

SEQ ID NO: 357791 - DNA, 20 bp, Artificial Sequence
  chemically synthesized
aggtgtctgtgattcagaat

SEQ ID NO: 357792 - DNA, 20 bp, Artificial Sequence
  chemically synthesized
aaggtgtctgtgattcagaa

SEQ ID NO: 357793 - DNA, 20 bp, Artificial Sequence
  chemically synthesized
tcttcacctattctgaatca

SEQ ID NO: 357794 - DNA, 20 bp, Artificial Sequence
  chemically synthesized
tctcaaaggtgtctgtgatt

SEQ ID NO: 357795 - DNA, 20 bp, Artificial Sequence
  chemically synthesized
tctgaatcacagacaccttt

SEQ ID NO: 357796 - DNA, 20 bp, Artificial Sequence
  chemically synthesized
agctctcaacagattctcaa

SEQ ID NO: 357797 - DNA, 20 bp, Artificial Sequence
  chemically synthesized
tagctctcaacagattctca

SEQ ID NO: 357798 - DNA, 20 bp, Artificial Sequence
  chemically synthesized
gacacctttgagaatctgtt

SEQ ID NO: 357799 - DNA, 20 bp, Artificial Sequence
  chemically synthesized
cacctttgagaatctgttga

SEQ ID NO: 357800 - DNA, 20 bp, Artificial Sequence
  chemically synthesized
agaagtttcatagctctcaa

SEQ ID NO: 357801 - DNA, 20 bp, Artificial Sequence
  chemically synthesized
ttgtaggagtagaagtttca

SEQ ID NO: 357802 - DNA, 20 bp, Artificial Sequence
  chemically synthesized
gagtttttttgtaggagtag

SEQ ID NO: 357803 - DNA, 20 bp, Artificial Sequence
  chemically synthesized
ggagagtttttttgtaggag

SEQ ID NO: 357804 - DNA, 20 bp, Artificial Sequence
  chemically synthesized
tatggagagtttttttgtag

SEQ ID NO: 357805 - DNA, 20 bp, Artificial Sequence
  chemically synthesized
gatatggagagtttttttgt

SEQ ID NO: 357806 - DNA, 20 bp, Artificial Sequence
  chemically synthesized
agatatggagagtttttttg

SEQ ID NO: 357807 - DNA, 20 bp, Artificial Sequence
  chemically synthesized
actctgttcacagatatgga

SEQ ID NO: 357808 - DNA, 20 bp, Artificial Sequence
  chemically synthesized
agactctgttcacagatatg

SEQ ID NO: 357809 - DNA, 20 bp, Artificial Sequence
  chemically synthesized
gtagactctgttcacagata

SEQ ID NO: 357810 - DNA, 20 bp, Artificial Sequence
  chemically synthesized
aaactctccatatctgtgaa

SEQ ID NO: 357811 - DNA, 20 bp, Artificial Sequence
  chemically synthesized
actctccatatctgtgaaca

SEQ ID NO: 357812 - DNA, 20 bp, Artificial Sequence
  chemically synthesized
ctgtatgtagactctgttca

SEQ ID NO: 357813 - DNA, 20 bp, Artificial Sequence
  chemically synthesized
ctgtgaacagagtctacata

SEQ ID NO: 357814 - DNA, 20 bp, Artificial Sequence
  chemically synthesized
aaatattctaaaactgtatg

SEQ ID NO: 357815 - DNA, 20 bp, Artificial Sequence
  chemically synthesized
acagagtctacatacagttt

SEQ ID NO: 357816 - DNA, 20 bp, Artificial Sequence
  chemically synthesized
agaatatttgaatctattaa

SEQ ID NO: 357817 - DNA, 20 bp, Artificial Sequence
  chemically synthesized
cttaaacaggagtccattaa

SEQ ID NO: 357818 - DNA, 20 bp, Artificial Sequence
  chemically synthesized
ctattaatggactcctgttt

SEQ ID NO: 357819 - DNA, 20 bp, Artificial Sequence
  chemically synthesized
tagcatgagctcttaaacag

SEQ ID NO: 357820 - DNA, 20 bp, Artificial Sequence
  chemically synthesized
attaatggactcctgtttaa

SEQ ID NO: 357821 - DNA, 20 bp, Artificial Sequence
  chemically synthesized
catagcatgagctcttaaac

SEQ ID NO: 357822 - DNA, 20 bp, Artificial Sequence
  chemically synthesized
gcatagcatgagctcttaaa

SEQ ID NO: 357823 - DNA, 20 bp, Artificial Sequence
  chemically synthesized
tttttgtttttgcatagcat

SEQ ID NO: 357824 - DNA, 20 bp, Artificial Sequence
  chemically synthesized
tttgtttttttgtttttgca

SEQ ID NO: 357825 - DNA, 20 bp, Artificial Sequence
  chemically synthesized
taacgaaaaaaacaaaaaaa

SEQ ID NO: 357826 - DNA, 20 bp, Artificial Sequence
  chemically synthesized
aaaacaaaaaaaaagttaca

SEQ ID NO: 357827 - DNA, 20 bp, Artificial Sequence
  chemically synthesized
aaacaaaaaaaaagttacaa

SEQ ID NO: 357828 - DNA, 20 bp, Artificial Sequence
  chemically synthesized
caaaaaaaaagttacaaagg

SEQ ID NO: 357829 - DNA, 20 bp, Artificial Sequence
  chemically synthesized
aaaaagttacaaaggtagtt

SEQ ID NO: 357830 - DNA, 20 bp, Artificial Sequence
  chemically synthesized
ttacagttttagaaaaataa

SEQ ID NO: 357831 - DNA, 20 bp, Artificial Sequence
  chemically synthesized
ccaattttgaattacagttt

SEQ ID NO: 357832 - DNA, 20 bp, Artificial Sequence
  chemically synthesized
gcctggccaattttgaatta

SEQ ID NO: 357833 - DNA, 20 bp, Artificial Sequence
  chemically synthesized
ctaaaactgtaattcaaaat

SEQ ID NO: 357834 - DNA, 20 bp, Artificial Sequence
  chemically synthesized
aactgtaattcaaaattggc

SEQ ID NO: 357835 - DNA, 20 bp, Artificial Sequence
  chemically synthesized
actgtaattcaaaattggcc

SEQ ID NO: 357836 - DNA, 20 bp, Artificial Sequence
  chemically synthesized
aattcaaaattggccaggcg

SEQ ID NO: 357837 - DNA, 20 bp, Artificial Sequence
  chemically synthesized
tcaaaattggccaggcgcag

SEQ ID NO: 357838 - DNA, 20 bp, Artificial Sequence
  chemically synthesized
taggcgggagccactgcgcc

SEQ ID NO: 357839 - DNA, 20 bp, Artificial Sequence
  chemically synthesized
agtgctgggagtataggcgg

SEQ ID NO: 357840 - DNA, 20 bp, Artificial Sequence
  chemically synthesized
aaagtgctgggagtataggc

SEQ ID NO: 357841 - DNA, 20 bp, Artificial Sequence
  chemically synthesized
caaagtgctgggagtatagg

SEQ ID NO: 357842 - DNA, 20 bp, Artificial Sequence
  chemically synthesized
gtggctcccgcctatactcc

SEQ ID NO: 357843 - DNA, 20 bp, Artificial Sequence
  chemically synthesized
tcccaaagtgctgggagtat

SEQ ID NO: 357844 - DNA, 20 bp, Artificial Sequence
  chemically synthesized
ctcccaaagtgctgggagta

SEQ ID NO: 357845 - DNA, 20 bp, Artificial Sequence
  chemically synthesized
tcggcctcccaaagtgctgg

SEQ ID NO: 357846 - DNA, 20 bp, Artificial Sequence
  chemically synthesized
cgcctatactcccagcactt

SEQ ID NO: 357847 - DNA, 20 bp, Artificial Sequence
  chemically synthesized
tctcggcctcccaaagtgct

SEQ ID NO: 357848 - DNA, 20 bp, Artificial Sequence
  chemically synthesized
gcctatactcccagcacttt

SEQ ID NO: 357849 - DNA, 20 bp, Artificial Sequence
  chemically synthesized
gtctcggcctcccaaagtgc

SEQ ID NO: 357850 - DNA, 20 bp, Artificial Sequence
  chemically synthesized
ctatactcccagcactttgg

SEQ ID NO: 357851 - DNA, 20 bp, Artificial Sequence
  chemically synthesized
tatactcccagcactttggg

SEQ ID NO: 357852 - DNA, 20 bp, Artificial Sequence
  chemically synthesized
tgacccgtctcggcctccca

SEQ ID NO: 357853 - DNA, 20 bp, Artificial Sequence
  chemically synthesized
tcccagcactttgggaggcc

SEQ ID NO: 357854 - DNA, 20 bp, Artificial Sequence
  chemically synthesized
agcactttgggaggccgaga

SEQ ID NO: 357855 - DNA, 20 bp, Artificial Sequence
  chemically synthesized
gcactttgggaggccgagac

SEQ ID NO: 357856 - DNA, 20 bp, Artificial Sequence
  chemically synthesized
ctcaggtgattgacccgtct

SEQ ID NO: 357857 - DNA, 20 bp, Artificial Sequence
  chemically synthesized
ccgagacgggtcaatcacct

SEQ ID NO: 357858 - DNA, 20 bp, Artificial Sequence
  chemically synthesized
cgagacgggtcaatcacctg

SEQ ID NO: 357859 - DNA, 20 bp, Artificial Sequence
  chemically synthesized
acgggtcaatcacctgaggc

SEQ ID NO: 357860 - DNA, 20 bp, Artificial Sequence
  chemically synthesized
cgggtcaatcacctgaggcc

SEQ ID NO: 357861 - DNA, 20 bp, Artificial Sequence
  chemically synthesized
ggtctcgaaatcctggcctc

SEQ ID NO: 357862 - DNA, 20 bp, Artificial Sequence
  chemically synthesized
tggtctcgaaatcctggcct

SEQ ID NO: 357863 - DNA, 20 bp, Artificial Sequence
  chemically synthesized
tcacctgaggccaggatttc

SEQ ID NO: 357864 - DNA, 20 bp, Artificial Sequence
  chemically synthesized
ccaggctggtctcgaaatcc

SEQ ID NO: 357865 - DNA, 20 bp, Artificial Sequence
  chemically synthesized
tgaggccaggatttcgagac

SEQ ID NO: 357866 - DNA, 20 bp, Artificial Sequence
  chemically synthesized
ccaggatttcgagaccagcc

SEQ ID NO: 357867 - DNA, 20 bp, Artificial Sequence
  chemically synthesized
ttttaccatgttgtccaggc

SEQ ID NO: 357868 - DNA, 20 bp, Artificial Sequence
  chemically synthesized
ggggttttaccatgttgtcc

SEQ ID NO: 357869 - DNA, 20 bp, Artificial Sequence
  chemically synthesized
cgagaccagcctggacaaca

SEQ ID NO: 357870 - DNA, 20 bp, Artificial Sequence
  chemically synthesized
cggggttttaccatgttgtc

SEQ ID NO: 357871 - DNA, 20 bp, Artificial Sequence
  chemically synthesized
ttgtatttttagtagtgtcg

SEQ ID NO: 357872 - DNA, 20 bp, Artificial Sequence
  chemically synthesized
tttgtatttttagtagtgtc

SEQ ID NO: 357873 - DNA, 20 bp, Artificial Sequence
  chemically synthesized
ttttgtatttttagtagtgt

SEQ ID NO: 357874 - DNA, 20 bp, Artificial Sequence
  chemically synthesized
gctaatttttgtatttttag

SEQ ID NO: 357875 - DNA, 20 bp, Artificial Sequence
  chemically synthesized
cctgctaatttttgtatttt

SEQ ID NO: 357876 - DNA, 20 bp, Artificial Sequence
  chemically synthesized
actactaaaaatacaaaaat

SEQ ID NO: 357877 - DNA, 20 bp, Artificial Sequence
  chemically synthesized
actaaaaatacaaaaattag

SEQ ID NO: 357878 - DNA, 20 bp, Artificial Sequence
  chemically synthesized
ctaaaaatacaaaaattagc

SEQ ID NO: 357879 - DNA, 20 bp, Artificial Sequence
  chemically synthesized
taaaaatacaaaaattagca

SEQ ID NO: 357880 - DNA, 20 bp, Artificial Sequence
  chemically synthesized
atacaaaaattagcagggca

SEQ ID NO: 357881 - DNA, 20 bp, Artificial Sequence
  chemically synthesized
caaaaattagcagggcatgg

SEQ ID NO: 357882 - DNA, 20 bp, Artificial Sequence
  chemically synthesized
ggcatggtggctcgtgccta

SEQ ID NO: 357883 - DNA, 20 bp, Artificial Sequence
  chemically synthesized
gtagctgggactataggcac

SEQ ID NO: 357884 - DNA, 20 bp, Artificial Sequence
  chemically synthesized
gtggctcgtgcctatagtcc

SEQ ID NO: 357885 - DNA, 20 bp, Artificial Sequence
  chemically synthesized
tcctgagtagctgggactat

SEQ ID NO: 357886 - DNA, 20 bp, Artificial Sequence
  chemically synthesized
ctcctgagtagctgggacta

SEQ ID NO: 357887 - DNA, 20 bp, Artificial Sequence
  chemically synthesized
tgcctatagtcccagctact

SEQ ID NO: 357888 - DNA, 20 bp, Artificial Sequence
  chemically synthesized
cctcagcctcctgagtagct

SEQ ID NO: 357889 - DNA, 20 bp, Artificial Sequence
  chemically synthesized
gcctatagtcccagctactc

SEQ ID NO: 357890 - DNA, 20 bp, Artificial Sequence
  chemically synthesized
gcctcagcctcctgagtagc

SEQ ID NO: 357891 - DNA, 20 bp, Artificial Sequence
  chemically synthesized
ctatagtcccagctactcag

SEQ ID NO: 357892 - DNA, 20 bp, Artificial Sequence
  chemically synthesized
tatagtcccagctactcagg

SEQ ID NO: 357893 - DNA, 20 bp, Artificial Sequence
  chemically synthesized
tactgcctcagcctcctgag

SEQ ID NO: 357894 - DNA, 20 bp, Artificial Sequence
  chemically synthesized
ttctactgcctcagcctcct

SEQ ID NO: 357895 - DNA, 20 bp, Artificial Sequence
  chemically synthesized
tcccagctactcaggaggct

SEQ ID NO: 357896 - DNA, 20 bp, Artificial Sequence
  chemically synthesized
cccagctactcaggaggctg

SEQ ID NO: 357897 - DNA, 20 bp, Artificial Sequence
  chemically synthesized
agctactcaggaggctgagg

SEQ ID NO: 357898 - DNA, 20 bp, Artificial Sequence
  chemically synthesized
tactcaggaggctgaggcag

SEQ ID NO: 357899 - DNA, 20 bp, Artificial Sequence
  chemically synthesized
ttcaagcgattctactgcct

SEQ ID NO: 357900 - DNA, 20 bp, Artificial Sequence
  chemically synthesized
gcagtagaatcgcttgaacc

SEQ ID NO: 357901 - DNA, 20 bp, Artificial Sequence
  chemically synthesized
cagtagaatcgcttgaacct

SEQ ID NO: 357902 - DNA, 20 bp, Artificial Sequence
  chemically synthesized
aacctccacttcccaggttc

SEQ ID NO: 357903 - DNA, 20 bp, Artificial Sequence
  chemically synthesized
tagaatcgcttgaacctggg

SEQ ID NO: 357904 - DNA, 20 bp, Artificial Sequence
  chemically synthesized
aatcgcttgaacctgggaag

SEQ ID NO: 357905 - DNA, 20 bp, Artificial Sequence
  chemically synthesized
cactgcaacctccacttccc

SEQ ID NO: 357906 - DNA, 20 bp, Artificial Sequence
  chemically synthesized
tcgcttgaacctgggaagtg

SEQ ID NO: 357907 - DNA, 20 bp, Artificial Sequence
  chemically synthesized
tcactgcaacctccacttcc

SEQ ID NO: 357908 - DNA, 20 bp, Artificial Sequence
  chemically synthesized
cgcttgaacctgggaagtgg

SEQ ID NO: 357909 - DNA, 20 bp, Artificial Sequence
  chemically synthesized
aacctgggaagtggaggttg

SEQ ID NO: 357910 - DNA, 20 bp, Artificial Sequence
  chemically synthesized
tgggaagtggaggttgcagt

SEQ ID NO: 357911 - DNA, 20 bp, Artificial Sequence
  chemically synthesized
agtggaggttgcagtgagcc

SEQ ID NO: 357912 - DNA, 20 bp, Artificial Sequence
  chemically synthesized
gtggaggttgcagtgagcca

SEQ ID NO: 357913 - DNA, 20 bp, Artificial Sequence
  chemically synthesized
aggttgcagtgagccaaggt

SEQ ID NO: 357914 - DNA, 20 bp, Artificial Sequence
  chemically synthesized
agagcgcagtgggccaacct

SEQ ID NO: 357915 - DNA, 20 bp, Artificial Sequence
  chemically synthesized
tgcacaggctagagcgcagt

SEQ ID NO: 357916 - DNA, 20 bp, Artificial Sequence
  chemically synthesized
ttgcacaggctagagcgcag

SEQ ID NO: 357917 - DNA, 20 bp, Artificial Sequence
  chemically synthesized
aaggttggcccactgcgctc

SEQ ID NO: 357918 - DNA, 20 bp, Artificial Sequence
  chemically synthesized
ctgttgcacaggctagagcg

SEQ ID NO: 357919 - DNA, 20 bp, Artificial Sequence
  chemically synthesized
tcgctctgttgcacaggcta

SEQ ID NO: 357920 - DNA, 20 bp, Artificial Sequence
  chemically synthesized
tctcgctctgttgcacaggc

SEQ ID NO: 357921 - DNA, 20 bp, Artificial Sequence
  chemically synthesized
ctgcgctctagcctgtgcaa

SEQ ID NO: 357922 - DNA, 20 bp, Artificial Sequence
  chemically synthesized
ggagtctcgctctgttgcac

SEQ ID NO: 357923 - DNA, 20 bp, Artificial Sequence
  chemically synthesized
gcgctctagcctgtgcaaca

SEQ ID NO: 357924 - DNA, 20 bp, Artificial Sequence
  chemically synthesized
cggagtctcgctctgttgca

SEQ ID NO: 357925 - DNA, 20 bp, Artificial Sequence
  chemically synthesized
tctagcctgtgcaacagagc

SEQ ID NO: 357926 - DNA, 20 bp, Artificial Sequence
  chemically synthesized
ttatgtatttttttgagacg

SEQ ID NO: 357927 - DNA, 20 bp, Artificial Sequence
  chemically synthesized
atttatgtatttttttgaga

SEQ ID NO: 357928 - DNA, 20 bp, Artificial Sequence
  chemically synthesized
ctttatttatgtattttttt

SEQ ID NO: 357929 - DNA, 20 bp, Artificial Sequence
  chemically synthesized
ctcaaaaaaatacataaata

SEQ ID NO: 357930 - DNA, 20 bp, Artificial Sequence
  chemically synthesized
tcaaaaaaatacataaataa

SEQ ID NO: 357931 - DNA, 20 bp, Artificial Sequence
  chemically synthesized
aaaatacataaataaaggta

SEQ ID NO: 357932 - DNA, 20 bp, Artificial Sequence
  chemically synthesized
aaatacataaataaaggtat

SEQ ID NO: 357933 - DNA, 20 bp, Artificial Sequence
  chemically synthesized
aaataaaggtataggtttat

SEQ ID NO: 357934 - DNA, 20 bp, Artificial Sequence
  chemically synthesized
ctagagtagaagcaattaag

SEQ ID NO: 357935 - DNA, 20 bp, Artificial Sequence
  chemically synthesized
taactagagtagaagcaatt

SEQ ID NO: 357936 - DNA, 20 bp, Artificial Sequence
  chemically synthesized
cttcttaattgcttctactc

SEQ ID NO: 357937 - DNA, 20 bp, Artificial Sequence
  chemically synthesized
tggtgtattaactagagtag

SEQ ID NO: 357938 - DNA, 20 bp, Artificial Sequence
  chemically synthesized
ttctggtgtattaactagag

SEQ ID NO: 357939 - DNA, 20 bp, Artificial Sequence
  chemically synthesized
aaattctggtgtattaacta

SEQ ID NO: 357940 - DNA, 20 bp, Artificial Sequence
  chemically synthesized
aaaaattctggtgtattaac

SEQ ID NO: 357941 - DNA, 20 bp, Artificial Sequence
  chemically synthesized
ttctactctagttaatacac

SEQ ID NO: 357942 - DNA, 20 bp, Artificial Sequence
  chemically synthesized
cctaataattgtaaaaattc

SEQ ID NO: 357943 - DNA, 20 bp, Artificial Sequence
  chemically synthesized
accagaatttttacaattat

SEQ ID NO: 357944 - DNA, 20 bp, Artificial Sequence
  chemically synthesized
ccagaatttttacaattatt

SEQ ID NO: 357945 - DNA, 20 bp, Artificial Sequence
  chemically synthesized
ggggtattggaaaatatgga

SEQ ID NO: 357946 - DNA, 20 bp, Artificial Sequence
  chemically synthesized
aggggtattggaaaatatgg

SEQ ID NO: 357947 - DNA, 20 bp, Artificial Sequence
  chemically synthesized
taggggtattggaaaatatg

SEQ ID NO: 357948 - DNA, 20 bp, Artificial Sequence
  chemically synthesized
gttaggggtattggaaaata

SEQ ID NO: 357949 - DNA, 20 bp, Artificial Sequence
  chemically synthesized
ttgttagctgttaggggtat

SEQ ID NO: 357950 - DNA, 20 bp, Artificial Sequence
  chemically synthesized
atattttccaatacccctaa

SEQ ID NO: 357951 - DNA, 20 bp, Artificial Sequence
  chemically synthesized
ataagcttgttagctgttag

SEQ ID NO: 357952 - DNA, 20 bp, Artificial Sequence
  chemically synthesized
cataagcttgttagctgtta

SEQ ID NO: 357953 - DNA, 20 bp, Artificial Sequence
  chemically synthesized
ccataagcttgttagctgtt

SEQ ID NO: 357954 - DNA, 20 bp, Artificial Sequence
  chemically synthesized
tccataagcttgttagctgt

SEQ ID NO: 357955 - DNA, 20 bp, Artificial Sequence
  chemically synthesized
caatacccctaacagctaac

SEQ ID NO: 357956 - DNA, 20 bp, Artificial Sequence
  chemically synthesized
gctagtttccataagcttgt

SEQ ID NO: 357957 - DNA, 20 bp, Artificial Sequence
  chemically synthesized
cctaacagctaacaagctta

SEQ ID NO: 357958 - DNA, 20 bp, Artificial Sequence
  chemically synthesized
gtaaataagctagtttccat

SEQ ID NO: 357959 - DNA, 20 bp, Artificial Sequence
  chemically synthesized
gctaacaagcttatggaaac

SEQ ID NO: 357960 - DNA, 20 bp, Artificial Sequence
  chemically synthesized
tatccaatttgtaaataagc

SEQ ID NO: 357961 - DNA, 20 bp, Artificial Sequence
  chemically synthesized
gcattatccaatttgtaaat

SEQ ID NO: 357962 - DNA, 20 bp, Artificial Sequence
  chemically synthesized
aaactagcttatttacaaat

SEQ ID NO: 357963 - DNA, 20 bp, Artificial Sequence
  chemically synthesized
ttatatatttttcataacaa

SEQ ID NO: 357964 - DNA, 20 bp, Artificial Sequence
  chemically synthesized
tttatatatttttcataaca

SEQ ID NO: 357965 - DNA, 20 bp, Artificial Sequence
  chemically synthesized
ataaaaaaatttaaaaattg

SEQ ID NO: 357966 - DNA, 20 bp, Artificial Sequence
  chemically synthesized
tttaaaaattgtagaatatt

SEQ ID NO: 357967 - DNA, 20 bp, Artificial Sequence
  chemically synthesized
ttaaaaattgtagaatattt

SEQ ID NO: 357968 - DNA, 20 bp, Artificial Sequence
  chemically synthesized
taaaaattgtagaatattta

SEQ ID NO: 357969 - DNA, 20 bp, Artificial Sequence
  chemically synthesized
aaaaattgtagaatatttag

SEQ ID NO: 357970 - DNA, 20 bp, Artificial Sequence
  chemically synthesized
agaatatttaggggactttt

SEQ ID NO: 357971 - DNA, 20 bp, Artificial Sequence
  chemically synthesized
agtgcgcatagtgaacttaa

SEQ ID NO: 357972 - DNA, 20 bp, Artificial Sequence
  chemically synthesized
aagataaggcagagtgcgca

SEQ ID NO: 357973 - DNA, 20 bp, Artificial Sequence
  chemically synthesized
aaaaaaatgaagataaggca

SEQ ID NO: 357974 - DNA, 20 bp, Artificial Sequence
  chemically synthesized
agaaaaaaatgaagataagg

SEQ ID NO: 357975 - DNA, 20 bp, Artificial Sequence
  chemically synthesized
tacagaaaaaaatgaagata

SEQ ID NO: 357976 - DNA, 20 bp, Artificial Sequence
  chemically synthesized
ctacagaaaaaaatgaagat

SEQ ID NO: 357977 - DNA, 20 bp, Artificial Sequence
  chemically synthesized
attgcctacagaaaaaaatg

SEQ ID NO: 357978 - DNA, 20 bp, Artificial Sequence
  chemically synthesized
cttatcttcatttttttctg

SEQ ID NO: 357979 - DNA, 20 bp, Artificial Sequence
  chemically synthesized
ttatcttcatttttttctgt

SEQ ID NO: 357980 - DNA, 20 bp, Artificial Sequence
  chemically synthesized
tcatttttttctgtaggcaa

SEQ ID NO: 357981 - DNA, 20 bp, Artificial Sequence
  chemically synthesized
ttttttactcccattgccta

SEQ ID NO: 357982 - DNA, 20 bp, Artificial Sequence
  chemically synthesized
catttttttctgtaggcaat

SEQ ID NO: 357983 - DNA, 20 bp, Artificial Sequence
  chemically synthesized
tttttttctgtaggcaatgg

SEQ ID NO: 357984 - DNA, 20 bp, Artificial Sequence
  chemically synthesized
gtaggcaatgggagtaaaaa

SEQ ID NO: 357985 - DNA, 20 bp, Artificial Sequence
  chemically synthesized
taggcaatgggagtaaaaaa

SEQ ID NO: 357986 - DNA, 20 bp, Artificial Sequence
  chemically synthesized
atgggagtaaaaaaaggaca

SEQ ID NO: 357987 - DNA, 20 bp, Artificial Sequence
  chemically synthesized
tgggagtaaaaaaaggacat

SEQ ID NO: 357988 - DNA, 20 bp, Artificial Sequence
  chemically synthesized
gagtaaaaaaaggacatagg

SEQ ID NO: 357989 - DNA, 20 bp, Artificial Sequence
  chemically synthesized
agtaaaaaaaggacataggt

SEQ ID NO: 357990 - DNA, 20 bp, Artificial Sequence
  chemically synthesized
ggacataggtgggaacatat

SEQ ID NO: 357991 - DNA, 20 bp, Artificial Sequence
  chemically synthesized
ggtgggaacatatgagaaac

SEQ ID NO: 357992 - DNA, 20 bp, Artificial Sequence
  chemically synthesized
tatgccatagatgagaaaac

SEQ ID NO: 357993 - DNA, 20 bp, Artificial Sequence
  chemically synthesized
gaaactagttttctcatcta

SEQ ID NO: 357994 - DNA, 20 bp, Artificial Sequence
  chemically synthesized
ttgtatactatgccatagat

SEQ ID NO: 357995 - DNA, 20 bp, Artificial Sequence
  chemically synthesized
tagttttctcatctatggca

SEQ ID NO: 357996 - DNA, 20 bp, Artificial Sequence
  chemically synthesized
taaccttgtatactatgcca

SEQ ID NO: 357997 - DNA, 20 bp, Artificial Sequence
  chemically synthesized
tcatctatggcatagtatac

SEQ ID NO: 357998 - DNA, 20 bp, Artificial Sequence
  chemically synthesized
catctatggcatagtataca

SEQ ID NO: 357999 - DNA, 20 bp, Artificial Sequence
  chemically synthesized
atagtatacaaggttaaatt

SEQ ID NO: 358000 - DNA, 20 bp, Artificial Sequence
  chemically synthesized
aaggttaaattgagtatgat

SEQ ID NO: 358001 - DNA, 20 bp, Artificial Sequence
  chemically synthesized
aattgagtatgatgagaaaa

SEQ ID NO: 358002 - DNA, 20 bp, Artificial Sequence
  chemically synthesized
ttgagtatgatgagaaaaaa

SEQ ID NO: 358003 - DNA, 20 bp, Artificial Sequence
  chemically synthesized
ggaatacagcacgaatgcat

SEQ ID NO: 358004 - DNA, 20 bp, Artificial Sequence
  chemically synthesized
gaaggtaagacaagggaata

SEQ ID NO: 358005 - DNA, 20 bp, Artificial Sequence
  chemically synthesized
aaatggggaaggtaagacaa

SEQ ID NO: 358006 - DNA, 20 bp, Artificial Sequence
  chemically synthesized
gaaatggggaaggtaagaca

SEQ ID NO: 358007 - DNA, 20 bp, Artificial Sequence
  chemically synthesized
ggaaatggggaaggtaagac

SEQ ID NO: 358008 - DNA, 20 bp, Artificial Sequence
  chemically synthesized
gccaaggaaatggggaaggt

SEQ ID NO: 358009 - DNA, 20 bp, Artificial Sequence
  chemically synthesized
agtggccaaggaaatgggga

SEQ ID NO: 358010 - DNA, 20 bp, Artificial Sequence
  chemically synthesized
tagtggccaaggaaatgggg

SEQ ID NO: 358011 - DNA, 20 bp, Artificial Sequence
  chemically synthesized
agttagtggccaaggaaatg

SEQ ID NO: 358012 - DNA, 20 bp, Artificial Sequence
  chemically synthesized
tcttaccttccccatttcct

SEQ ID NO: 358013 - DNA, 20 bp, Artificial Sequence
  chemically synthesized
tagttagtggccaaggaaat

SEQ ID NO: 358014 - DNA, 20 bp, Artificial Sequence
  chemically synthesized
ttagttagtggccaaggaaa

SEQ ID NO: 358015 - DNA, 20 bp, Artificial Sequence
  chemically synthesized
agttggttagttagtggcca

SEQ ID NO: 358016 - DNA, 20 bp, Artificial Sequence
  chemically synthesized
cagttggttagttagtggcc

SEQ ID NO: 358017 - DNA, 20 bp, Artificial Sequence
  chemically synthesized
acactcagttggttagttag

SEQ ID NO: 358018 - DNA, 20 bp, Artificial Sequence
  chemically synthesized
cacacactcagttggttagt

SEQ ID NO: 358019 - DNA, 20 bp, Artificial Sequence
  chemically synthesized
tggccactaactaaccaact

SEQ ID NO: 358020 - DNA, 20 bp, Artificial Sequence
  chemically synthesized
tatccacacactcagttggt

SEQ ID NO: 358021 - DNA, 20 bp, Artificial Sequence
  chemically synthesized
aagatatccacacactcagt

SEQ ID NO: 358022 - DNA, 20 bp, Artificial Sequence
  chemically synthesized
taactaaccaactgagtgtg

SEQ ID NO: 358023 - DNA, 20 bp, Artificial Sequence
  chemically synthesized
agataagatatccacacact

SEQ ID NO: 358024 - DNA, 20 bp, Artificial Sequence
  chemically synthesized
agtgtgtggatatcttatct

SEQ ID NO: 358025 - DNA, 20 bp, Artificial Sequence
  chemically synthesized
ataaattatatgacttagat

SEQ ID NO: 358026 - DNA, 20 bp, Artificial Sequence
  chemically synthesized
ctcaaataaattatatgact

SEQ ID NO: 358027 - DNA, 20 bp, Artificial Sequence
  chemically synthesized
ctaagtcatataatttattt

SEQ ID NO: 358028 - DNA, 20 bp, Artificial Sequence
  chemically synthesized
catataatttatttgagctt

SEQ ID NO: 358029 - DNA, 20 bp, Artificial Sequence
  chemically synthesized
ctttttgaatgagaatgcca

SEQ ID NO: 358030 - DNA, 20 bp, Artificial Sequence
  chemically synthesized
ctttggcattctcattcaaa

SEQ ID NO: 358031 - DNA, 20 bp, Artificial Sequence
  chemically synthesized
tggttcaatgctttttgaat

SEQ ID NO: 358032 - DNA, 20 bp, Artificial Sequence
  chemically synthesized
ttcaaaaagcattgaaccaa

SEQ ID NO: 358033 - DNA, 20 bp, Artificial Sequence
  chemically synthesized
tcaaaaagcattgaaccaaa

SEQ ID NO: 358034 - DNA, 20 bp, Artificial Sequence
  chemically synthesized
acgtgacctcaaaggccttt

SEQ ID NO: 358035 - DNA, 20 bp, Artificial Sequence
  chemically synthesized
cattgaaccaaaaggccttt

SEQ ID NO: 358036 - DNA, 20 bp, Artificial Sequence
  chemically synthesized
attgaaccaaaaggcctttg

SEQ ID NO: 358037 - DNA, 20 bp, Artificial Sequence
  chemically synthesized
aatgctagacgtgacctcaa

SEQ ID NO: 358038 - DNA, 20 bp, Artificial Sequence
  chemically synthesized
taatgctagacgtgacctca

SEQ ID NO: 358039 - DNA, 20 bp, Artificial Sequence
  chemically synthesized
aaggcctttgaggtcacgtc

SEQ ID NO: 358040 - DNA, 20 bp, Artificial Sequence
  chemically synthesized
attcaattcatttttaatgc

SEQ ID NO: 358041 - DNA, 20 bp, Artificial Sequence
  chemically synthesized
aattaattttaatagtataa

SEQ ID NO: 358042 - DNA, 20 bp, Artificial Sequence
  chemically synthesized
aaaatgttaattaattttaa

SEQ ID NO: 358043 - DNA, 20 bp, Artificial Sequence
  chemically synthesized
ttttatgcatttgaaagtca

SEQ ID NO: 358044 - DNA, 20 bp, Artificial Sequence
  chemically synthesized
tacaatttttatgcatttga

SEQ ID NO: 358045 - DNA, 20 bp, Artificial Sequence
  chemically synthesized
gggtttccttcatagttggt

SEQ ID NO: 358046 - DNA, 20 bp, Artificial Sequence
  chemically synthesized
tgtaaaactaaccaactatg

SEQ ID NO: 358047 - DNA, 20 bp, Artificial Sequence
  chemically synthesized
gtaaaactaaccaactatga

SEQ ID NO: 358048 - DNA, 20 bp, Artificial Sequence
  chemically synthesized
gtgtgggtttccttcatagt

SEQ ID NO: 358049 - DNA, 20 bp, Artificial Sequence
  chemically synthesized
tgctgtgtgggtttccttca

SEQ ID NO: 358050 - DNA, 20 bp, Artificial Sequence
  chemically synthesized
aactatgaaggaaacccaca

SEQ ID NO: 358051 - DNA, 20 bp, Artificial Sequence
  chemically synthesized
gttaacattaaatgctgtgt

SEQ ID NO: 358052 - DNA, 20 bp, Artificial Sequence
  chemically synthesized
ggttaacattaaatgctgtg

SEQ ID NO: 358053 - DNA, 20 bp, Artificial Sequence
  chemically synthesized
cacagcatttaatgttaacc

SEQ ID NO: 358054 - DNA, 20 bp, Artificial Sequence
  chemically synthesized
aagtcaataaattatggtcc

SEQ ID NO: 358055 - DNA, 20 bp, Artificial Sequence
  chemically synthesized
caagtcaataaattatggtc

SEQ ID NO: 358056 - DNA, 20 bp, Artificial Sequence
  chemically synthesized
ggttgcaagtcaataaatta

SEQ ID NO: 358057 - DNA, 20 bp, Artificial Sequence
  chemically synthesized
taatttattgacttgcaacc

SEQ ID NO: 358058 - DNA, 20 bp, Artificial Sequence
  chemically synthesized
aatttattgacttgcaacca

SEQ ID NO: 358059 - DNA, 20 bp, Artificial Sequence
  chemically synthesized
atctggtgatccttggttgc

SEQ ID NO: 358060 - DNA, 20 bp, Artificial Sequence
  chemically synthesized
attaaaaatctggtgatcct

SEQ ID NO: 358061 - DNA, 20 bp, Artificial Sequence
  chemically synthesized
gacttgcaaccaaggatcac

SEQ ID NO: 358062 - DNA, 20 bp, Artificial Sequence
  chemically synthesized
tgttgatttaattaaaaatc

SEQ ID NO: 358063 - DNA, 20 bp, Artificial Sequence
  chemically synthesized
aattaaatcaacaccatgat

SEQ ID NO: 358064 - DNA, 20 bp, Artificial Sequence
  chemically synthesized
attaaatcaacaccatgatt

SEQ ID NO: 358065 - DNA, 20 bp, Artificial Sequence
  chemically synthesized
aatttacactatcctaatca

SEQ ID NO: 358066 - DNA, 20 bp, Artificial Sequence
  chemically synthesized
aatcaacaccatgattagga

SEQ ID NO: 358067 - DNA, 20 bp, Artificial Sequence
  chemically synthesized
gatagtgtaaatttaaatcc

SEQ ID NO: 358068 - DNA, 20 bp, Artificial Sequence
  chemically synthesized
ggctaacatgtggtagagct

SEQ ID NO: 358069 - DNA, 20 bp, Artificial Sequence
  chemically synthesized
tggctaacatgtggtagagc

SEQ ID NO: 358070 - DNA, 20 bp, Artificial Sequence
  chemically synthesized
tgtttggctaacatgtggta

SEQ ID NO: 358071 - DNA, 20 bp, Artificial Sequence
  chemically synthesized
actgtttggctaacatgtgg

SEQ ID NO: 358072 - DNA, 20 bp, Artificial Sequence
  chemically synthesized
atcctagctctaccacatgt

SEQ ID NO: 358073 - DNA, 20 bp, Artificial Sequence
  chemically synthesized
aaaactgtttggctaacatg

SEQ ID NO: 358074 - DNA, 20 bp, Artificial Sequence
  chemically synthesized
tctaccacatgttagccaaa

SEQ ID NO: 358075 - DNA, 20 bp, Artificial Sequence
  chemically synthesized
gtaatttacctaaaactgtt

SEQ ID NO: 358076 - DNA, 20 bp, Artificial Sequence
  chemically synthesized
acatgttagccaaacagttt

SEQ ID NO: 358077 - DNA, 20 bp, Artificial Sequence
  chemically synthesized
catgttagccaaacagtttt

SEQ ID NO: 358078 - DNA, 20 bp, Artificial Sequence
  chemically synthesized
agataaattgagtcatagag

SEQ ID NO: 358079 - DNA, 20 bp, Artificial Sequence
  chemically synthesized
tagataaattgagtcataga

SEQ ID NO: 358080 - DNA, 20 bp, Artificial Sequence
  chemically synthesized
aatagataaattgagtcata

SEQ ID NO: 358081 - DNA, 20 bp, Artificial Sequence
  chemically synthesized
caaatagataaattgagtca

SEQ ID NO: 358082 - DNA, 20 bp, Artificial Sequence
  chemically synthesized
atctcacaaatagataaatt

SEQ ID NO: 358083 - DNA, 20 bp, Artificial Sequence
  chemically synthesized
gactcaatttatctatttgt

SEQ ID NO: 358084 - DNA, 20 bp, Artificial Sequence
  chemically synthesized
cattttacccatctcacaaa

SEQ ID NO: 358085 - DNA, 20 bp, Artificial Sequence
  chemically synthesized
caatttatctatttgtgaga

SEQ ID NO: 358086 - DNA, 20 bp, Artificial Sequence
  chemically synthesized
aatttatctatttgtgagat

SEQ ID NO: 358087 - DNA, 20 bp, Artificial Sequence
  chemically synthesized
ttgtgagatgggtaaaatga

SEQ ID NO: 358088 - DNA, 20 bp, Artificial Sequence
  chemically synthesized
aaatgacagcatctacgtca

SEQ ID NO: 358089 - DNA, 20 bp, Artificial Sequence
  chemically synthesized
ttcaatcaagttccatgacg

SEQ ID NO: 358090 - DNA, 20 bp, Artificial Sequence
  chemically synthesized
tctaggtaaaatattcaatc

SEQ ID NO: 358091 - DNA, 20 bp, Artificial Sequence
  chemically synthesized
acttgattgaatattttacc

SEQ ID NO: 358092 - DNA, 20 bp, Artificial Sequence
  chemically synthesized
attgaatattttacctagaa

SEQ ID NO: 358093 - DNA, 20 bp, Artificial Sequence
  chemically synthesized
tattttgtagacaccgttct

SEQ ID NO: 358094 - DNA, 20 bp, Artificial Sequence
  chemically synthesized
ttattttgtagacaccgttc

SEQ ID NO: 358095 - DNA, 20 bp, Artificial Sequence
  chemically synthesized
tttaaacaattattattttg

SEQ ID NO: 358096 - DNA, 20 bp, Artificial Sequence
  chemically synthesized
ttaacattacagcaaaataa

SEQ ID NO: 358097 - DNA, 20 bp, Artificial Sequence
  chemically synthesized
tataaatgtaattaacatta

SEQ ID NO: 358098 - DNA, 20 bp, Artificial Sequence
  chemically synthesized
aatgttaattacatttatat

SEQ ID NO: 358099 - DNA, 20 bp, Artificial Sequence
  chemically synthesized
gttaattacatttatataag

SEQ ID NO: 358100 - DNA, 20 bp, Artificial Sequence
  chemically synthesized
taattacatttatataagaa

SEQ ID NO: 358101 - DNA, 20 bp, Artificial Sequence
  chemically synthesized
agtgatgtattttcaattta

SEQ ID NO: 358102 - DNA, 20 bp, Artificial Sequence
  chemically synthesized
tattttcaatttacagactc

SEQ ID NO: 358103 - DNA, 20 bp, Artificial Sequence
  chemically synthesized
aagataggtgtttttggctt

SEQ ID NO: 358104 - DNA, 20 bp, Artificial Sequence
  chemically synthesized
tctgtaaagataggtgtttt

SEQ ID NO: 358105 - DNA, 20 bp, Artificial Sequence
  chemically synthesized
gccaaaaacacctatcttta

SEQ ID NO: 358106 - DNA, 20 bp, Artificial Sequence
  chemically synthesized
tatatcagttctgtaaagat

SEQ ID NO: 358107 - DNA, 20 bp, Artificial Sequence
  chemically synthesized
ttatatcagttctgtaaaga

SEQ ID NO: 358108 - DNA, 20 bp, Artificial Sequence
  chemically synthesized
acatttatatcagttctgta

SEQ ID NO: 358109 - DNA, 20 bp, Artificial Sequence
  chemically synthesized
agtatttgtaacatttatat

SEQ ID NO: 358110 - DNA, 20 bp, Artificial Sequence
  chemically synthesized
ttacattctgtttgcatcag

SEQ ID NO: 358111 - DNA, 20 bp, Artificial Sequence
  chemically synthesized
acaaatactactgatgcaaa

SEQ ID NO: 358112 - DNA, 20 bp, Artificial Sequence
  chemically synthesized
ggattacattctgtttgcat

SEQ ID NO: 358113 - DNA, 20 bp, Artificial Sequence
  chemically synthesized
aaacagaatgtaatccgaaa

SEQ ID NO: 358114 - DNA, 20 bp, Artificial Sequence
  chemically synthesized
aacagaatgtaatccgaaat

SEQ ID NO: 358115 - DNA, 20 bp, Artificial Sequence
  chemically synthesized
cagaatgtaatccgaaatgg

SEQ ID NO: 358116 - DNA, 20 bp, Artificial Sequence
  chemically synthesized
agaatgtaatccgaaatggg

SEQ ID NO: 358117 - DNA, 20 bp, Artificial Sequence
  chemically synthesized
ctcttctccacctcccattt

SEQ ID NO: 358118 - DNA, 20 bp, Artificial Sequence
  chemically synthesized
atgtaatccgaaatgggagg

SEQ ID NO: 358119 - DNA, 20 bp, Artificial Sequence
  chemically synthesized
gtaatccgaaatgggaggtg

SEQ ID NO: 358120 - DNA, 20 bp, Artificial Sequence
  chemically synthesized
atccgaaatgggaggtggag

SEQ ID NO: 358121 - DNA, 20 bp, Artificial Sequence
  chemically synthesized
ccgaaatgggaggtggagaa

SEQ ID NO: 358122 - DNA, 20 bp, Artificial Sequence
  chemically synthesized
cgaaatgggaggtggagaag

SEQ ID NO: 358123 - DNA, 20 bp, Artificial Sequence
  chemically synthesized
atgggaggtggagaagaggc

SEQ ID NO: 358124 - DNA, 20 bp, Artificial Sequence
  chemically synthesized
gggaggtggagaagaggcga

SEQ ID NO: 358125 - DNA, 20 bp, Artificial Sequence
  chemically synthesized
ggtggagaagaggcgagagt

SEQ ID NO: 358126 - DNA, 20 bp, Artificial Sequence
  chemically synthesized
ttttgaccaatatgaaaaac

SEQ ID NO: 358127 - DNA, 20 bp, Artificial Sequence
  chemically synthesized
gattttctcgtttttcatat

SEQ ID NO: 358128 - DNA, 20 bp, Artificial Sequence
  chemically synthesized
tcgtttttcatattggtcaa

SEQ ID NO: 358129 - DNA, 20 bp, Artificial Sequence
  chemically synthesized
aatttttaccaagtttagaa

SEQ ID NO: 358130 - DNA, 20 bp, Artificial Sequence
  chemically synthesized
aaatttttaccaagtttaga

SEQ ID NO: 358131 - DNA, 20 bp, Artificial Sequence
  chemically synthesized
caaaagttcctttctaaact

SEQ ID NO: 358132 - DNA, 20 bp, Artificial Sequence
  chemically synthesized
ttttaaatttttaccaagtt

SEQ ID NO: 358133 - DNA, 20 bp, Artificial Sequence
  chemically synthesized
cctcattttaaatttttacc

SEQ ID NO: 358134 - DNA, 20 bp, Artificial Sequence
  chemically synthesized
acttggtaaaaatttaaaat

SEQ ID NO: 358135 - DNA, 20 bp, Artificial Sequence
  chemically synthesized
cttggtaaaaatttaaaatg

SEQ ID NO: 358136 - DNA, 20 bp, Artificial Sequence
  chemically synthesized
tttattacattaaatggtat

SEQ ID NO: 358137 - DNA, 20 bp, Artificial Sequence
  chemically synthesized
tttgcttttattacattaaa

SEQ ID NO: 358138 - DNA, 20 bp, Artificial Sequence
  chemically synthesized
cataccatttaatgtaataa

SEQ ID NO: 358139 - DNA, 20 bp, Artificial Sequence
  chemically synthesized
tattacttataatcatttta

SEQ ID NO: 358140 - DNA, 20 bp, Artificial Sequence
  chemically synthesized
tacaactataaaatgattat

SEQ ID NO: 358141 - DNA, 20 bp, Artificial Sequence
  chemically synthesized
atgattataagtaataaaat

SEQ ID NO: 358142 - DNA, 20 bp, Artificial Sequence
  chemically synthesized
tgattataagtaataaaatt

SEQ ID NO: 358143 - DNA, 20 bp, Artificial Sequence
  chemically synthesized
taataaaattaggaaatacc

SEQ ID NO: 358144 - DNA, 20 bp, Artificial Sequence
  chemically synthesized
aataaaattaggaaatacct

SEQ ID NO: 358145 - DNA, 20 bp, Artificial Sequence
  chemically synthesized
ataaaattaggaaatacctg

SEQ ID NO: 358146 - DNA, 20 bp, Artificial Sequence
  chemically synthesized
ccatattatgtttcatcccc

SEQ ID NO: 358147 - DNA, 20 bp, Artificial Sequence
  chemically synthesized
gccatattatgtttcatccc

SEQ ID NO: 358148 - DNA, 20 bp, Artificial Sequence
  chemically synthesized
cctggggatgaaacataata

SEQ ID NO: 358149 - DNA, 20 bp, Artificial Sequence
  chemically synthesized
gggatgaaacataatatggc

SEQ ID NO: 358150 - DNA, 20 bp, Artificial Sequence
  chemically synthesized
ttactccatagtatgaaaac

SEQ ID NO: 358151 - DNA, 20 bp, Artificial Sequence
  chemically synthesized
tatggctggttttcatacta

SEQ ID NO: 358152 - DNA, 20 bp, Artificial Sequence
  chemically synthesized
tggctggttttcatactatg

SEQ ID NO: 358153 - DNA, 20 bp, Artificial Sequence
  chemically synthesized
cagtataggtatttactcca

SEQ ID NO: 358154 - DNA, 20 bp, Artificial Sequence
  chemically synthesized
ggagtaaatacctatactgt

SEQ ID NO: 358155 - DNA, 20 bp, Artificial Sequence
  chemically synthesized
aaactaatttctaacagtat

SEQ ID NO: 358156 - DNA, 20 bp, Artificial Sequence
  chemically synthesized
caaactaatttctaacagta

SEQ ID NO: 358157 - DNA, 20 bp, Artificial Sequence
  chemically synthesized
gttgacaaactaatttctaa

SEQ ID NO: 358158 - DNA, 20 bp, Artificial Sequence
  chemically synthesized
atacctatactgttagaaat

SEQ ID NO: 358159 - DNA, 20 bp, Artificial Sequence
  chemically synthesized
ttagaaattagtttgtcaac

SEQ ID NO: 358160 - DNA, 20 bp, Artificial Sequence
  chemically synthesized
gaaattagtttgtcaacaag

SEQ ID NO: 358161 - DNA, 20 bp, Artificial Sequence
  chemically synthesized
atcacacatattattataac

SEQ ID NO: 358162 - DNA, 20 bp, Artificial Sequence
  chemically synthesized
acacatattattataaccag

SEQ ID NO: 358163 - DNA, 20 bp, Artificial Sequence
  chemically synthesized
cacatattattataaccagc

SEQ ID NO: 358164 - DNA, 20 bp, Artificial Sequence
  chemically synthesized
acttgtactttggttcctgc

SEQ ID NO: 358165 - DNA, 20 bp, Artificial Sequence
  chemically synthesized
attataaccagcaggaacca

SEQ ID NO: 358166 - DNA, 20 bp, Artificial Sequence
  chemically synthesized
accagcaggaaccaaagtac

SEQ ID NO: 358167 - DNA, 20 bp, Artificial Sequence
  chemically synthesized
actgtcagctacttgtactt

SEQ ID NO: 358168 - DNA, 20 bp, Artificial Sequence
  chemically synthesized
agcaggaaccaaagtacaag

SEQ ID NO: 358169 - DNA, 20 bp, Artificial Sequence
  chemically synthesized
accaaagtacaagtagctga

SEQ ID NO: 358170 - DNA, 20 bp, Artificial Sequence
  chemically synthesized
ttcttagatgcagtcactgt

SEQ ID NO: 358171 - DNA, 20 bp, Artificial Sequence
  chemically synthesized
agctgacagtgactgcatct

SEQ ID NO: 358172 - DNA, 20 bp, Artificial Sequence
  chemically synthesized
cttatttcaattcttagatg

SEQ ID NO: 358173 - DNA, 20 bp, Artificial Sequence
  chemically synthesized
acttaccttatttcaattct

SEQ ID NO: 358174 - DNA, 20 bp, Artificial Sequence
  chemically synthesized
ctgcatctaagaattgaaat

SEQ ID NO: 358175 - DNA, 20 bp, Artificial Sequence
  chemically synthesized
tgcatctaagaattgaaata

SEQ ID NO: 358176 - DNA, 20 bp, Artificial Sequence
  chemically synthesized
tctaagaattgaaataaggt

SEQ ID NO: 358177 - DNA, 20 bp, Artificial Sequence
  chemically synthesized
gaattgaaataaggtaagtt

SEQ ID NO: 358178 - DNA, 20 bp, Artificial Sequence
  chemically synthesized
gaaataaggtaagttaagat

SEQ ID NO: 358179 - DNA, 20 bp, Artificial Sequence
  chemically synthesized
aaataaggtaagttaagatt

SEQ ID NO: 358180 - DNA, 20 bp, Artificial Sequence
  chemically synthesized
aataaggtaagttaagattg

SEQ ID NO: 358181 - DNA, 20 bp, Artificial Sequence
  chemically synthesized
aagttaagattggggtcatg

SEQ ID NO: 358182 - DNA, 20 bp, Artificial Sequence
  chemically synthesized
aatcaggagcaaagggaaaa

SEQ ID NO: 358183 - DNA, 20 bp, Artificial Sequence
  chemically synthesized
acactagaatcaggagcaaa

SEQ ID NO: 358184 - DNA, 20 bp, Artificial Sequence
  chemically synthesized
aacactagaatcaggagcaa

SEQ ID NO: 358185 - DNA, 20 bp, Artificial Sequence
  chemically synthesized
gaacactagaatcaggagca

SEQ ID NO: 358186 - DNA, 20 bp, Artificial Sequence
  chemically synthesized
tttccctttgctcctgattc

SEQ ID NO: 358187 - DNA, 20 bp, Artificial Sequence
  chemically synthesized
caaatgaacactagaatcag

SEQ ID NO: 358188 - DNA, 20 bp, Artificial Sequence
  chemically synthesized
agcaaatgaacactagaatc

SEQ ID NO: 358189 - DNA, 20 bp, Artificial Sequence
  chemically synthesized
aagcaaatgaacactagaat

SEQ ID NO: 358190 - DNA, 20 bp, Artificial Sequence
  chemically synthesized
aattagaagcaaatgaacac

SEQ ID NO: 358191 - DNA, 20 bp, Artificial Sequence
  chemically synthesized
gtattaccacagcaaattag

SEQ ID NO: 358192 - DNA, 20 bp, Artificial Sequence
  chemically synthesized
agtgtattaccacagcaaat

SEQ ID NO: 358193 - DNA, 20 bp, Artificial Sequence
  chemically synthesized
catttgcttctaatttgctg

SEQ ID NO: 358194 - DNA, 20 bp, Artificial Sequence
  chemically synthesized
cttattttagtgtattacca

SEQ ID NO: 358195 - DNA, 20 bp, Artificial Sequence
  chemically synthesized
ctgtggtaatacactaaaat

SEQ ID NO: 358196 - DNA, 20 bp, Artificial Sequence
  chemically synthesized
tgtggtaatacactaaaata

SEQ ID NO: 358197 - DNA, 20 bp, Artificial Sequence
  chemically synthesized
gtcttcctaaatccttattt

SEQ ID NO: 358198 - DNA, 20 bp, Artificial Sequence
  chemically synthesized
aatacactaaaataaggatt

SEQ ID NO: 358199 - DNA, 20 bp, Artificial Sequence
  chemically synthesized
atacactaaaataaggattt

SEQ ID NO: 358200 - DNA, 20 bp, Artificial Sequence
  chemically synthesized
cactaaaataaggatttagg

SEQ ID NO: 358201 - DNA, 20 bp, Artificial Sequence
  chemically synthesized
ggaagacaattgtaacttta

SEQ ID NO: 358202 - DNA, 20 bp, Artificial Sequence
  chemically synthesized
ataaaattacaataactata

SEQ ID NO: 358203 - DNA, 20 bp, Artificial Sequence
  chemically synthesized
agaaatatgtacaaaagatg

SEQ ID NO: 358204 - DNA, 20 bp, Artificial Sequence
  chemically synthesized
ttgcttagaaatatgtacaa

SEQ ID NO: 358205 - DNA, 20 bp, Artificial Sequence
  chemically synthesized
catcttttgtacatatttct

SEQ ID NO: 358206 - DNA, 20 bp, Artificial Sequence
  chemically synthesized
aaaacccaatgataattgct

SEQ ID NO: 358207 - DNA, 20 bp, Artificial Sequence
  chemically synthesized
tatttctaagcaattatcat

SEQ ID NO: 358208 - DNA, 20 bp, Artificial Sequence
  chemically synthesized
atttctaagcaattatcatt

SEQ ID NO: 358209 - DNA, 20 bp, Artificial Sequence
  chemically synthesized
tcattgggttttaacacaaa

SEQ ID NO: 358210 - DNA, 20 bp, Artificial Sequence
  chemically synthesized
ttgggttttaacacaaaaag

SEQ ID NO: 358211 - DNA, 20 bp, Artificial Sequence
  chemically synthesized
taacacaaaaagtagaaatc

SEQ ID NO: 358212 - DNA, 20 bp, Artificial Sequence
  chemically synthesized
caatacccttcaaaggaagc

SEQ ID NO: 358213 - DNA, 20 bp, Artificial Sequence
  chemically synthesized
tagaaatctggcttcctttg

SEQ ID NO: 358214 - DNA, 20 bp, Artificial Sequence
  chemically synthesized
agaaatctggcttcctttga

SEQ ID NO: 358215 - DNA, 20 bp, Artificial Sequence
  chemically synthesized
actacaatacccttcaaagg

SEQ ID NO: 358216 - DNA, 20 bp, Artificial Sequence
  chemically synthesized
gaaatctggcttcctttgaa

SEQ ID NO: 358217 - DNA, 20 bp, Artificial Sequence
  chemically synthesized
tccactacaatacccttcaa

SEQ ID NO: 358218 - DNA, 20 bp, Artificial Sequence
  chemically synthesized
gtccactacaatacccttca

SEQ ID NO: 358219 - DNA, 20 bp, Artificial Sequence
  chemically synthesized
gcttcctttgaagggtattg

SEQ ID NO: 358220 - DNA, 20 bp, Artificial Sequence
  chemically synthesized
tcctttgaagggtattgtag

SEQ ID NO: 358221 - DNA, 20 bp, Artificial Sequence
  chemically synthesized
aagttgtgtgataaaacgca

SEQ ID NO: 358222 - DNA, 20 bp, Artificial Sequence
  chemically synthesized
ctaagtgtcatggcagttaa

SEQ ID NO: 358223 - DNA, 20 bp, Artificial Sequence
  chemically synthesized
ggattgactaagtgtcatgg

SEQ ID NO: 358224 - DNA, 20 bp, Artificial Sequence
  chemically synthesized
cttttaactgccatgacact

SEQ ID NO: 358225 - DNA, 20 bp, Artificial Sequence
  chemically synthesized
taaggattgactaagtgtca

SEQ ID NO: 358226 - DNA, 20 bp, Artificial Sequence
  chemically synthesized
atagagcataaggattgact

SEQ ID NO: 358227 - DNA, 20 bp, Artificial Sequence
  chemically synthesized
tgtagttaatatagagcata

SEQ ID NO: 358228 - DNA, 20 bp, Artificial Sequence
  chemically synthesized
atgtagttaatatagagcat

SEQ ID NO: 358229 - DNA, 20 bp, Artificial Sequence
  chemically synthesized
aaagacatgtagttaatata

SEQ ID NO: 358230 - DNA, 20 bp, Artificial Sequence
  chemically synthesized
acaaagacatgtagttaata

SEQ ID NO: 358231 - DNA, 20 bp, Artificial Sequence
  chemically synthesized
ctatacagaacaaagacatg

SEQ ID NO: 358232 - DNA, 20 bp, Artificial Sequence
  chemically synthesized
tggttcaactatacagaaca

SEQ ID NO: 358233 - DNA, 20 bp, Artificial Sequence
  chemically synthesized
ctacatgtctttgttctgta

SEQ ID NO: 358234 - DNA, 20 bp, Artificial Sequence
  chemically synthesized
aattgagtggttcaactata

SEQ ID NO: 358235 - DNA, 20 bp, Artificial Sequence
  chemically synthesized
ccctcatttcaataattgag

SEQ ID NO: 358236 - DNA, 20 bp, Artificial Sequence
  chemically synthesized
gtgccctcatttcaataatt

SEQ ID NO: 358237 - DNA, 20 bp, Artificial Sequence
  chemically synthesized
aaccactcaattattgaaat

SEQ ID NO: 358238 - DNA, 20 bp, Artificial Sequence
  chemically synthesized
accactcaattattgaaatg

SEQ ID NO: 358239 - DNA, 20 bp, Artificial Sequence
  chemically synthesized
ccactcaattattgaaatga

SEQ ID NO: 358240 - DNA, 20 bp, Artificial Sequence
  chemically synthesized
gcacaattaggaatgtcatg

SEQ ID NO: 358241 - DNA, 20 bp, Artificial Sequence
  chemically synthesized
ggcacaattaggaatgtcat

SEQ ID NO: 358242 - DNA, 20 bp, Artificial Sequence
  chemically synthesized
cgattgtcgttggcacaatt

SEQ ID NO: 358243 - DNA, 20 bp, Artificial Sequence
  chemically synthesized
gcgattgtcgttggcacaat

SEQ ID NO: 358244 - DNA, 20 bp, Artificial Sequence
  chemically synthesized
tgttccatagcgattgtcgt

SEQ ID NO: 358245 - DNA, 20 bp, Artificial Sequence
  chemically synthesized
tgtgccaacgacaatcgcta

SEQ ID NO: 358246 - DNA, 20 bp, Artificial Sequence
  chemically synthesized
caacgacaatcgctatggaa

SEQ ID NO: 358247 - DNA, 20 bp, Artificial Sequence
  chemically synthesized
acgacaatcgctatggaaca

SEQ ID NO: 358248 - DNA, 20 bp, Artificial Sequence
  chemically synthesized
tggttgaactctctgttcca

SEQ ID NO: 358249 - DNA, 20 bp, Artificial Sequence
  chemically synthesized
gacaatcgctatggaacaga

SEQ ID NO: 358250 - DNA, 20 bp, Artificial Sequence
  chemically synthesized
tctttatctaaagaaaaaaa

SEQ ID NO: 358251 - DNA, 20 bp, Artificial Sequence
  chemically synthesized
agttcaaccatttttttctt

SEQ ID NO: 358252 - DNA, 20 bp, Artificial Sequence
  chemically synthesized
accatttttttctttagata

SEQ ID NO: 358253 - DNA, 20 bp, Artificial Sequence
  chemically synthesized
atgttcatattctttatcta

SEQ ID NO: 358254 - DNA, 20 bp, Artificial Sequence
  chemically synthesized
ccccttctttttgtatttgg

SEQ ID NO: 358255 - DNA, 20 bp, Artificial Sequence
  chemically synthesized
ctcccccttctttttgtatt

SEQ ID NO: 358256 - DNA, 20 bp, Artificial Sequence
  chemically synthesized
gaacatctgccaaatacaaa

SEQ ID NO: 358257 - DNA, 20 bp, Artificial Sequence
  chemically synthesized
catctgccaaatacaaaaag

SEQ ID NO: 358258 - DNA, 20 bp, Artificial Sequence
  chemically synthesized
atctgccaaatacaaaaaga

SEQ ID NO: 358259 - DNA, 20 bp, Artificial Sequence
  chemically synthesized
tctgccaaatacaaaaagaa

SEQ ID NO: 358260 - DNA, 20 bp, Artificial Sequence
  chemically synthesized
ctgccaaatacaaaaagaag

SEQ ID NO: 358261 - DNA, 20 bp, Artificial Sequence
  chemically synthesized
tgccaaatacaaaaagaagg

SEQ ID NO: 358262 - DNA, 20 bp, Artificial Sequence
  chemically synthesized
ccaaatacaaaaagaagggg

SEQ ID NO: 358263 - DNA, 20 bp, Artificial Sequence
  chemically synthesized
aagggggagatgattcatga

SEQ ID NO: 358264 - DNA, 20 bp, Artificial Sequence
  chemically synthesized
aagaacattaaacaactgtg

SEQ ID NO: 358265 - DNA, 20 bp, Artificial Sequence
  chemically synthesized
acttttcaagaggttcttca

SEQ ID NO: 358266 - DNA, 20 bp, Artificial Sequence
  chemically synthesized
actgtgaagaacctcttgaa

SEQ ID NO: 358267 - DNA, 20 bp, Artificial Sequence
  chemically synthesized
ttacatggttacttttcaag

SEQ ID NO: 358268 - DNA, 20 bp, Artificial Sequence
  chemically synthesized
attacatggttacttttcaa

SEQ ID NO: 358269 - DNA, 20 bp, Artificial Sequence
  chemically synthesized
gtattacatggttacttttc

SEQ ID NO: 358270 - DNA, 20 bp, Artificial Sequence
  chemically synthesized
aactctctttatgtattaca

SEQ ID NO: 358271 - DNA, 20 bp, Artificial Sequence
  chemically synthesized
aagtaaccatgtaatacata

SEQ ID NO: 358272 - DNA, 20 bp, Artificial Sequence
  chemically synthesized
gtaaccatgtaatacataaa

SEQ ID NO: 358273 - DNA, 20 bp, Artificial Sequence
  chemically synthesized
aaccatgtaatacataaaga

SEQ ID NO: 358274 - DNA, 20 bp, Artificial Sequence
  chemically synthesized
tgtcatattggatgaatcat

SEQ ID NO: 358275 - DNA, 20 bp, Artificial Sequence
  chemically synthesized
tgatgattcatccaatatga

SEQ ID NO: 358276 - DNA, 20 bp, Artificial Sequence
  chemically synthesized
gatgattcatccaatatgac

SEQ ID NO: 358277 - DNA, 20 bp, Artificial Sequence
  chemically synthesized
tatactctctcctgtcatat

SEQ ID NO: 358278 - DNA, 20 bp, Artificial Sequence
  chemically synthesized
tgattcatccaatatgacag

SEQ ID NO: 358279 - DNA, 20 bp, Artificial Sequence
  chemically synthesized
attcatccaatatgacagga

SEQ ID NO: 358280 - DNA, 20 bp, Artificial Sequence
  chemically synthesized
tcatccaatatgacaggaga

SEQ ID NO: 358281 - DNA, 20 bp, Artificial Sequence
  chemically synthesized
acaggagagagtatataaat

SEQ ID NO: 358282 - DNA, 20 bp, Artificial Sequence
  chemically synthesized
caggagagagtatataaatg

SEQ ID NO: 358283 - DNA, 20 bp, Artificial Sequence
  chemically synthesized
tataaatgaggatattttga

SEQ ID NO: 358284 - DNA, 20 bp, Artificial Sequence
  chemically synthesized
taaatgaggatattttgaca

SEQ ID NO: 358285 - DNA, 20 bp, Artificial Sequence
  chemically synthesized
tgaggatattttgacagaga

SEQ ID NO: 358286 - DNA, 20 bp, Artificial Sequence
  chemically synthesized
aggatattttgacagagaaa

SEQ ID NO: 358287 - DNA, 20 bp, Artificial Sequence
  chemically synthesized
atattttgacagagaaagag

SEQ ID NO: 358288 - DNA, 20 bp, Artificial Sequence
  chemically synthesized
tattttgacagagaaagagt

SEQ ID NO: 358289 - DNA, 20 bp, Artificial Sequence
  chemically synthesized
ttgacagagaaagagtgggt

SEQ ID NO: 358290 - DNA, 20 bp, Artificial Sequence
  chemically synthesized
tgacagagaaagagtgggtc

SEQ ID NO: 358291 - DNA, 20 bp, Artificial Sequence
  chemically synthesized
gacagagaaagagtgggtca

SEQ ID NO: 358292 - DNA, 20 bp, Artificial Sequence
  chemically synthesized
gagaaagagtgggtcaggga

SEQ ID NO: 358293 - DNA, 20 bp, Artificial Sequence
  chemically synthesized
tgggtcagggacagataaaa

SEQ ID NO: 358294 - DNA, 20 bp, Artificial Sequence
  chemically synthesized
gggtcagggacagataaaac

SEQ ID NO: 358295 - DNA, 20 bp, Artificial Sequence
  chemically synthesized
ggtcagggacagataaaaca

SEQ ID NO: 358296 - DNA, 20 bp, Artificial Sequence
  chemically synthesized
acagataaaacagggcaatt

SEQ ID NO: 358297 - DNA, 20 bp, Artificial Sequence
  chemically synthesized
cagataaaacagggcaattt

SEQ ID NO: 358298 - DNA, 20 bp, Artificial Sequence
  chemically synthesized
gaatacatttgtaggtaata

SEQ ID NO: 358299 - DNA, 20 bp, Artificial Sequence
  chemically synthesized
tgatttctgaatacatttgt

SEQ ID NO: 358300 - DNA, 20 bp, Artificial Sequence
  chemically synthesized
atgatttctgaatacatttg

SEQ ID NO: 358301 - DNA, 20 bp, Artificial Sequence
  chemically synthesized
gtattacctacaaatgtatt

SEQ ID NO: 358302 - DNA, 20 bp, Artificial Sequence
  chemically synthesized
tgtattcagaaatcattaaa

SEQ ID NO: 358303 - DNA, 20 bp, Artificial Sequence
  chemically synthesized
aaatagaatattaacaaata

SEQ ID NO: 358304 - DNA, 20 bp, Artificial Sequence
  chemically synthesized
atagaatattaacaaatata

SEQ ID NO: 358305 - DNA, 20 bp, Artificial Sequence
  chemically synthesized
gaatattaacaaatatagag

SEQ ID NO: 358306 - DNA, 20 bp, Artificial Sequence
  chemically synthesized
aatattaacaaatatagagt

SEQ ID NO: 358307 - DNA, 20 bp, Artificial Sequence
  chemically synthesized
atagagtgggaacatgcttg

SEQ ID NO: 358308 - DNA, 20 bp, Artificial Sequence
  chemically synthesized
tagagtgggaacatgcttgc

SEQ ID NO: 358309 - DNA, 20 bp, Artificial Sequence
  chemically synthesized
gtggaagacttcaatcctgc

SEQ ID NO: 358310 - DNA, 20 bp, Artificial Sequence
  chemically synthesized
ggaacatgcttgcaggattg

SEQ ID NO: 358311 - DNA, 20 bp, Artificial Sequence
  chemically synthesized
ggattgaagtcttccacttg

SEQ ID NO: 358312 - DNA, 20 bp, Artificial Sequence
  chemically synthesized
acgtttttcccttcaagtgg

SEQ ID NO: 358313 - DNA, 20 bp, Artificial Sequence
  chemically synthesized
gattgaagtcttccacttga

SEQ ID NO: 358314 - DNA, 20 bp, Artificial Sequence
  chemically synthesized
attgaagtcttccacttgaa

SEQ ID NO: 358315 - DNA, 20 bp, Artificial Sequence
  chemically synthesized
ctaacgtttttcccttcaag

SEQ ID NO: 358316 - DNA, 20 bp, Artificial Sequence
  chemically synthesized
tctctaacgtttttcccttc

SEQ ID NO: 358317 - DNA, 20 bp, Artificial Sequence
  chemically synthesized
ccacttgaagggaaaaacgt

SEQ ID NO: 358318 - DNA, 20 bp, Artificial Sequence
  chemically synthesized
acttgaagggaaaaacgtta

SEQ ID NO: 358319 - DNA, 20 bp, Artificial Sequence
  chemically synthesized
ttgaagggaaaaacgttaga

SEQ ID NO: 358320 - DNA, 20 bp, Artificial Sequence
  chemically synthesized
aaaaacgttagagagccaac

SEQ ID NO: 358321 - DNA, 20 bp, Artificial Sequence
  chemically synthesized
aaaacgttagagagccaaca

SEQ ID NO: 358322 - DNA, 20 bp, Artificial Sequence
  chemically synthesized
tcaggttatgtggtccttgt

SEQ ID NO: 358323 - DNA, 20 bp, Artificial Sequence
  chemically synthesized
atatcaaggatcaggttatg

SEQ ID NO: 358324 - DNA, 20 bp, Artificial Sequence
  chemically synthesized
gaataaaaatatcaaggatc

SEQ ID NO: 358325 - DNA, 20 bp, Artificial Sequence
  chemically synthesized
tgaataaaaatatcaaggat

SEQ ID NO: 358326 - DNA, 20 bp, Artificial Sequence
  chemically synthesized
gcagatgaataaaaatatca

SEQ ID NO: 358327 - DNA, 20 bp, Artificial Sequence
  chemically synthesized
tgcagatgaataaaaatatc

SEQ ID NO: 358328 - DNA, 20 bp, Artificial Sequence
  chemically synthesized
gctgttcatgtacacatttg

SEQ ID NO: 358329 - DNA, 20 bp, Artificial Sequence
  chemically synthesized
tctgcaaatgtgtacatgaa

SEQ ID NO: 358330 - DNA, 20 bp, Artificial Sequence
  chemically synthesized
aacagcaaaatcaatatttt

SEQ ID NO: 358331 - DNA, 20 bp, Artificial Sequence
  chemically synthesized
acagcaaaatcaatattttc

SEQ ID NO: 358332 - DNA, 20 bp, Artificial Sequence
  chemically synthesized
aatcaatattttcgggccct

SEQ ID NO: 358333 - DNA, 20 bp, Artificial Sequence
  chemically synthesized
agccacatgcttaacactaa

SEQ ID NO: 358334 - DNA, 20 bp, Artificial Sequence
  chemically synthesized
attttcgggcccttagtgtt

SEQ ID NO: 358335 - DNA, 20 bp, Artificial Sequence
  chemically synthesized
cagccacatgcttaacacta

SEQ ID NO: 358336 - DNA, 20 bp, Artificial Sequence
  chemically synthesized
gcagccacatgcttaacact

SEQ ID NO: 358337 - DNA, 20 bp, Artificial Sequence
  chemically synthesized
ggcccttagtgttaagcatg

SEQ ID NO: 358338 - DNA, 20 bp, Artificial Sequence
  chemically synthesized
aagcatgtggctgcataaat

SEQ ID NO: 358339 - DNA, 20 bp, Artificial Sequence
  chemically synthesized
taagtcaatgctcatttatg

SEQ ID NO: 358340 - DNA, 20 bp, Artificial Sequence
  chemically synthesized
atgagcattgacttaaaaca

SEQ ID NO: 358341 - DNA, 20 bp, Artificial Sequence
  chemically synthesized
agacattctgtctgtgtttt

SEQ ID NO: 358342 - DNA, 20 bp, Artificial Sequence
  chemically synthesized
gcattgacttaaaacacaga

SEQ ID NO: 358343 - DNA, 20 bp, Artificial Sequence
  chemically synthesized
cagttagatgagaagggata

SEQ ID NO: 358344 - DNA, 20 bp, Artificial Sequence
  chemically synthesized
tacagttagatgagaaggga

SEQ ID NO: 358345 - DNA, 20 bp, Artificial Sequence
  chemically synthesized
tcaatacagttagatgagaa

SEQ ID NO: 358346 - DNA, 20 bp, Artificial Sequence
  chemically synthesized
ctcaatacagttagatgaga

SEQ ID NO: 358347 - DNA, 20 bp, Artificial Sequence
  chemically synthesized
cctcaatacagttagatgag

SEQ ID NO: 358348 - DNA, 20 bp, Artificial Sequence
  chemically synthesized
cagcctcaatacagttagat

SEQ ID NO: 358349 - DNA, 20 bp, Artificial Sequence
  chemically synthesized
ttccacagcctcaatacagt

SEQ ID NO: 358350 - DNA, 20 bp, Artificial Sequence
  chemically synthesized
ccttctcatctaactgtatt

SEQ ID NO: 358351 - DNA, 20 bp, Artificial Sequence
  chemically synthesized
cttctcatctaactgtattg

SEQ ID NO: 358352 - DNA, 20 bp, Artificial Sequence
  chemically synthesized
atgtttccacagcctcaata

SEQ ID NO: 358353 - DNA, 20 bp, Artificial Sequence
  chemically synthesized
atctaactgtattgaggctg

SEQ ID NO: 358354 - DNA, 20 bp, Artificial Sequence
  chemically synthesized
gacagaagaaaatgtttcca

SEQ ID NO: 358355 - DNA, 20 bp, Artificial Sequence
  chemically synthesized
cattgtttctcgtatgacag

SEQ ID NO: 358356 - DNA, 20 bp, Artificial Sequence
  chemically synthesized
aacattttcttctgtcatac

SEQ ID NO: 358357 - DNA, 20 bp, Artificial Sequence
  chemically synthesized
acacattgtttctcgtatga

SEQ ID NO: 358358 - DNA, 20 bp, Artificial Sequence
  chemically synthesized
cattcaaatgtcacgttaag

SEQ ID NO: 358359 - DNA, 20 bp, Artificial Sequence
  chemically synthesized
atgcattcaaatgtcacgtt

SEQ ID NO: 358360 - DNA, 20 bp, Artificial Sequence
  chemically synthesized
aacctgatttagaacagagg

SEQ ID NO: 358361 - DNA, 20 bp, Artificial Sequence
  chemically synthesized
agcaacctgatttagaacag

SEQ ID NO: 358362 - DNA, 20 bp, Artificial Sequence
  chemically synthesized
cagcaacctgatttagaaca

SEQ ID NO: 358363 - DNA, 20 bp, Artificial Sequence
  chemically synthesized
ctcagcaacctgatttagaa

SEQ ID NO: 358364 - DNA, 20 bp, Artificial Sequence
  chemically synthesized
tgtctgcctctgttctaaat

SEQ ID NO: 358365 - DNA, 20 bp, Artificial Sequence
  chemically synthesized
gtctgcctctgttctaaatc

SEQ ID NO: 358366 - DNA, 20 bp, Artificial Sequence
  chemically synthesized
aattactcagcaacctgatt

SEQ ID NO: 358367 - DNA, 20 bp, Artificial Sequence
  chemically synthesized
ctgttctaaatcaggttgct

SEQ ID NO: 358368 - DNA, 20 bp, Artificial Sequence
  chemically synthesized
gggtttccaggtgaattact

SEQ ID NO: 358369 - DNA, 20 bp, Artificial Sequence
  chemically synthesized
aggttgctgagtaattcacc

SEQ ID NO: 358370 - DNA, 20 bp, Artificial Sequence
  chemically synthesized
gagtaattcacctggaaacc

SEQ ID NO: 358371 - DNA, 20 bp, Artificial Sequence
  chemically synthesized
cccatcccgactgggtttcc

SEQ ID NO: 358372 - DNA, 20 bp, Artificial Sequence
  chemically synthesized
ccccatcccgactgggtttc

SEQ ID NO: 358373 - DNA, 20 bp, Artificial Sequence
  chemically synthesized
aattcacctggaaacccagt

SEQ ID NO: 358374 - DNA, 20 bp, Artificial Sequence
  chemically synthesized
attcacctggaaacccagtc

SEQ ID NO: 358375 - DNA, 20 bp, Artificial Sequence
  chemically synthesized
taattaaccccatcccgact

SEQ ID NO: 358376 - DNA, 20 bp, Artificial Sequence
  chemically synthesized
acctggaaacccagtcggga

SEQ ID NO: 358377 - DNA, 20 bp, Artificial Sequence
  chemically synthesized
ttaattaaccccatcccgac

SEQ ID NO: 358378 - DNA, 20 bp, Artificial Sequence
  chemically synthesized
cctggaaacccagtcgggat

SEQ ID NO: 358379 - DNA, 20 bp, Artificial Sequence
  chemically synthesized
ctggaaacccagtcgggatg

SEQ ID NO: 358380 - DNA, 20 bp, Artificial Sequence
  chemically synthesized
gggatggggttaattaaatc

SEQ ID NO: 358381 - DNA, 20 bp, Artificial Sequence
  chemically synthesized
tggggttaattaaatccagc

SEQ ID NO: 358382 - DNA, 20 bp, Artificial Sequence
  chemically synthesized
gggttaattaaatccagctg

SEQ ID NO: 358383 - DNA, 20 bp, Artificial Sequence
  chemically synthesized
gtcaggtgtcttgctccagc

SEQ ID NO: 358384 - DNA, 20 bp, Artificial Sequence
  chemically synthesized
taattaaatccagctggagc

SEQ ID NO: 358385 - DNA, 20 bp, Artificial Sequence
  chemically synthesized
ctttgtcaggtgtcttgctc

SEQ ID NO: 358386 - DNA, 20 bp, Artificial Sequence
  chemically synthesized
ctggagcaagacacctgaca

SEQ ID NO: 358387 - DNA, 20 bp, Artificial Sequence
  chemically synthesized
ttcaaataagcatctttgtc

SEQ ID NO: 358388 - DNA, 20 bp, Artificial Sequence
  chemically synthesized
tttcaaataagcatctttgt

SEQ ID NO: 358389 - DNA, 20 bp, Artificial Sequence
  chemically synthesized
agagcaaacacatttcaaat

SEQ ID NO: 358390 - DNA, 20 bp, Artificial Sequence
  chemically synthesized
atttgaaatgtgtttgctct

SEQ ID NO: 358391 - DNA, 20 bp, Artificial Sequence
  chemically synthesized
aatgtgtttgctcttggact

SEQ ID NO: 358392 - DNA, 20 bp, Artificial Sequence
  chemically synthesized
taaggtaaagctcagtccaa

SEQ ID NO: 358393 - DNA, 20 bp, Artificial Sequence
  chemically synthesized
tctaaggtaaagctcagtcc

SEQ ID NO: 358394 - DNA, 20 bp, Artificial Sequence
  chemically synthesized
attttctctaaggtaaagct

SEQ ID NO: 358395 - DNA, 20 bp, Artificial Sequence
  chemically synthesized
tcttggactgagctttacct

SEQ ID NO: 358396 - DNA, 20 bp, Artificial Sequence
  chemically synthesized
ttggactgagctttacctta

SEQ ID NO: 358397 - DNA, 20 bp, Artificial Sequence
  chemically synthesized
tattaattttctctaaggta

SEQ ID NO: 358398 - DNA, 20 bp, Artificial Sequence
  chemically synthesized
aagaatattaattttctcta

SEQ ID NO: 358399 - DNA, 20 bp, Artificial Sequence
  chemically synthesized
taagaatattaattttctct

SEQ ID NO: 358400 - DNA, 20 bp, Artificial Sequence
  chemically synthesized
ttagagaaaattaatattct

SEQ ID NO: 358401 - DNA, 20 bp, Artificial Sequence
  chemically synthesized
atcctgcttctagaaaagct

SEQ ID NO: 358402 - DNA, 20 bp, Artificial Sequence
  chemically synthesized
attaatattcttagcttttc

SEQ ID NO: 358403 - DNA, 20 bp, Artificial Sequence
  chemically synthesized
aatattcttagcttttctag

SEQ ID NO: 358404 - DNA, 20 bp, Artificial Sequence
  chemically synthesized
tgccaatcctgcttctagaa

SEQ ID NO: 358405 - DNA, 20 bp, Artificial Sequence
  chemically synthesized
attcttagcttttctagaag

SEQ ID NO: 358406 - DNA, 20 bp, Artificial Sequence
  chemically synthesized
ttcttagcttttctagaagc

SEQ ID NO: 358407 - DNA, 20 bp, Artificial Sequence
  chemically synthesized
tcctatgccaatcctgcttc

SEQ ID NO: 358408 - DNA, 20 bp, Artificial Sequence
  chemically synthesized
agcttttctagaagcaggat

SEQ ID NO: 358409 - DNA, 20 bp, Artificial Sequence
  chemically synthesized
ttctagaagcaggattggca

SEQ ID NO: 358410 - DNA, 20 bp, Artificial Sequence
  chemically synthesized
tctagaagcaggattggcat

SEQ ID NO: 358411 - DNA, 20 bp, Artificial Sequence
  chemically synthesized
gcaggattggcataggaaaa

SEQ ID NO: 358412 - DNA, 20 bp, Artificial Sequence
  chemically synthesized
ggattggcataggaaaatgg

SEQ ID NO: 358413 - DNA, 20 bp, Artificial Sequence
  chemically synthesized
attggcataggaaaatggta

SEQ ID NO: 358414 - DNA, 20 bp, Artificial Sequence
  chemically synthesized
ggcataggaaaatggtagag

SEQ ID NO: 358415 - DNA, 20 bp, Artificial Sequence
  chemically synthesized
tcaaaaaaaaaaaaaaatca

SEQ ID NO: 358416 - DNA, 20 bp, Artificial Sequence
  chemically synthesized
aaaaaaaaaaaaatcaaagt

SEQ ID NO: 358417 - DNA, 20 bp, Artificial Sequence
  chemically synthesized
tcttgcctaattttcagtgc

SEQ ID NO: 358418 - DNA, 20 bp, Artificial Sequence
  chemically synthesized
acataacttgcactgaaaat

SEQ ID NO: 358419 - DNA, 20 bp, Artificial Sequence
  chemically synthesized
cataacttgcactgaaaatt

SEQ ID NO: 358420 - DNA, 20 bp, Artificial Sequence
  chemically synthesized
actgcatcttgcctaatttt

SEQ ID NO: 358421 - DNA, 20 bp, Artificial Sequence
  chemically synthesized
acttgcactgaaaattaggc

SEQ ID NO: 358422 - DNA, 20 bp, Artificial Sequence
  chemically synthesized
actgaaaattaggcaagatg

SEQ ID NO: 358423 - DNA, 20 bp, Artificial Sequence
  chemically synthesized
aaattaggcaagatgcagtc

SEQ ID NO: 358424 - DNA, 20 bp, Artificial Sequence
  chemically synthesized
ttaactgtttaaaatgtcac

SEQ ID NO: 358425 - DNA, 20 bp, Artificial Sequence
  chemically synthesized
cagtccagtgacattttaaa

SEQ ID NO: 358426 - DNA, 20 bp, Artificial Sequence
  chemically synthesized
tgacattttaaacagttaat

SEQ ID NO: 358427 - DNA, 20 bp, Artificial Sequence
  chemically synthesized
gacattttaaacagttaatt

SEQ ID NO: 358428 - DNA, 20 bp, Artificial Sequence
  chemically synthesized
agttaattaggcaatgcatt

SEQ ID NO: 358429 - DNA, 20 bp, Artificial Sequence
  chemically synthesized
ttaggcaatgcatttagccc

SEQ ID NO: 358430 - DNA, 20 bp, Artificial Sequence
  chemically synthesized
taggcaatgcatttagccct

SEQ ID NO: 358431 - DNA, 20 bp, Artificial Sequence
  chemically synthesized
caatgcatttagccctgggt

SEQ ID NO: 358432 - DNA, 20 bp, Artificial Sequence
  chemically synthesized
aatgcatttagccctgggtt

SEQ ID NO: 358433 - DNA, 20 bp, Artificial Sequence
  chemically synthesized
cgtttcatttacccaaccca

SEQ ID NO: 358434 - DNA, 20 bp, Artificial Sequence
  chemically synthesized
ccgtttcatttacccaaccc

SEQ ID NO: 358435 - DNA, 20 bp, Artificial Sequence
  chemically synthesized
cccgtttcatttacccaacc

SEQ ID NO: 358436 - DNA, 20 bp, Artificial Sequence
  chemically synthesized
cctgggttgggtaaatgaaa

SEQ ID NO: 358437 - DNA, 20 bp, Artificial Sequence
  chemically synthesized
ctgggttgggtaaatgaaac

SEQ ID NO: 358438 - DNA, 20 bp, Artificial Sequence
  chemically synthesized
tgggtaaatgaaacgggtaa

SEQ ID NO: 358439 - DNA, 20 bp, Artificial Sequence
  chemically synthesized
gggtaaatgaaacgggtaac

SEQ ID NO: 358440 - DNA, 20 bp, Artificial Sequence
  chemically synthesized
taaatgaaacgggtaacagg

SEQ ID NO: 358441 - DNA, 20 bp, Artificial Sequence
  chemically synthesized
gtaacaggaagaccaaaata

SEQ ID NO: 358442 - DNA, 20 bp, Artificial Sequence
  chemically synthesized
ggactacagtcactttattt

SEQ ID NO: 358443 - DNA, 20 bp, Artificial Sequence
  chemically synthesized
agaccaaaataaagtgactg

SEQ ID NO: 358444 - DNA, 20 bp, Artificial Sequence
  chemically synthesized
tatttgagagagagggacta

SEQ ID NO: 358445 - DNA, 20 bp, Artificial Sequence
  chemically synthesized
gtgtgtgtatttgagagaga

SEQ ID NO: 358446 - DNA, 20 bp, Artificial Sequence
  chemically synthesized
tgtgtgtgtatttgagagag

SEQ ID NO: 358447 - DNA, 20 bp, Artificial Sequence
  chemically synthesized
gtgtgtgtgtatttgagaga

SEQ ID NO: 358448 - DNA, 20 bp, Artificial Sequence
  chemically synthesized
ttgtgtgtgtgtatttgaga

SEQ ID NO: 358449 - DNA, 20 bp, Artificial Sequence
  chemically synthesized
gcttgtgtgtgtgtatttga

SEQ ID NO: 358450 - DNA, 20 bp, Artificial Sequence
  chemically synthesized
atgcttgtgtgtgtgtattt

SEQ ID NO: 358451 - DNA, 20 bp, Artificial Sequence
  chemically synthesized
tctctcaaatacacacacac

SEQ ID NO: 358452 - DNA, 20 bp, Artificial Sequence
  chemically synthesized
cacacatatatatacatata

SEQ ID NO: 358453 - DNA, 20 bp, Artificial Sequence
  chemically synthesized
cacatatatatacatatata

SEQ ID NO: 358454 - DNA, 20 bp, Artificial Sequence
  chemically synthesized
atacatatatagagtataaa

SEQ ID NO: 358455 - DNA, 20 bp, Artificial Sequence
  chemically synthesized
tatatagagtataaatggtg

SEQ ID NO: 358456 - DNA, 20 bp, Artificial Sequence
  chemically synthesized
tataaatggtgtagtatata

SEQ ID NO: 358457 - DNA, 20 bp, Artificial Sequence
  chemically synthesized
ggtgtagtatatatggcata

SEQ ID NO: 358458 - DNA, 20 bp, Artificial Sequence
  chemically synthesized
atagtatatattgtatctct

SEQ ID NO: 358459 - DNA, 20 bp, Artificial Sequence
  chemically synthesized
tatatgtacacatacactta

SEQ ID NO: 358460 - DNA, 20 bp, Artificial Sequence
  chemically synthesized
tgtatatgtacacatacact

SEQ ID NO: 358461 - DNA, 20 bp, Artificial Sequence
  chemically synthesized
aagaaaaagcaaagcagtgt

SEQ ID NO: 358462 - DNA, 20 bp, Artificial Sequence
  chemically synthesized
caagaaaaagcaaagcagtg

SEQ ID NO: 358463 - DNA, 20 bp, Artificial Sequence
  chemically synthesized
cagttcaagaaaaagcaaag

SEQ ID NO: 358464 - DNA, 20 bp, Artificial Sequence
  chemically synthesized
taacagttcaagaaaaagca

SEQ ID NO: 358465 - DNA, 20 bp, Artificial Sequence
  chemically synthesized
attaataacagttcaagaaa

SEQ ID NO: 358466 - DNA, 20 bp, Artificial Sequence
  chemically synthesized
aaatgaattaataacagttc

SEQ ID NO: 358467 - DNA, 20 bp, Artificial Sequence
  chemically synthesized
ttcagtaaatgaattaataa

SEQ ID NO: 358468 - DNA, 20 bp, Artificial Sequence
  chemically synthesized
tgcttttcttgtgtaaagtt

SEQ ID NO: 358469 - DNA, 20 bp, Artificial Sequence
  chemically synthesized
tcatttactgaactttacac

SEQ ID NO: 358470 - DNA, 20 bp, Artificial Sequence
  chemically synthesized
ttttttgcttttcttgtgta

SEQ ID NO: 358471 - DNA, 20 bp, Artificial Sequence
  chemically synthesized
tactgaactttacacaagaa

SEQ ID NO: 358472 - DNA, 20 bp, Artificial Sequence
  chemically synthesized
ttatatttcttaagatgaaa

SEQ ID NO: 358473 - DNA, 20 bp, Artificial Sequence
  chemically synthesized
aaaaaaatctttttcatctt

SEQ ID NO: 358474 - DNA, 20 bp, Artificial Sequence
  chemically synthesized
cattcaacattatatttctt

SEQ ID NO: 358475 - DNA, 20 bp, Artificial Sequence
  chemically synthesized
ttaagaaatataatgttgaa

SEQ ID NO: 358476 - DNA, 20 bp, Artificial Sequence
  chemically synthesized
atataatgttgaatggaata

SEQ ID NO: 358477 - DNA, 20 bp, Artificial Sequence
  chemically synthesized
atgttgaatggaatatagtt

SEQ ID NO: 358478 - DNA, 20 bp, Artificial Sequence
  chemically synthesized
tgttgaatggaatatagtta

SEQ ID NO: 358479 - DNA, 20 bp, Artificial Sequence
  chemically synthesized
tggaatatagttaaggactt

SEQ ID NO: 358480 - DNA, 20 bp, Artificial Sequence
  chemically synthesized
cactgtaatacagtgaacca

SEQ ID NO: 358481 - DNA, 20 bp, Artificial Sequence
  chemically synthesized
gactttggttcactgtatta

SEQ ID NO: 358482 - DNA, 20 bp, Artificial Sequence
  chemically synthesized
aaaaagaattcactgtaata

SEQ ID NO: 358483 - DNA, 20 bp, Artificial Sequence
  chemically synthesized
cttttgtggattttaataaa

SEQ ID NO: 358484 - DNA, 20 bp, Artificial Sequence
  chemically synthesized
ctttttattaaaatccacaa

SEQ ID NO: 358485 - DNA, 20 bp, Artificial Sequence
  chemically synthesized
agcaagagagagatcttttg

SEQ ID NO: 358486 - DNA, 20 bp, Artificial Sequence
  chemically synthesized
aattgctataaagcaagaga

SEQ ID NO: 358487 - DNA, 20 bp, Artificial Sequence
  chemically synthesized
tcaattgctataaagcaaga

SEQ ID NO: 358488 - DNA, 20 bp, Artificial Sequence
  chemically synthesized
aatcaattgctataaagcaa

SEQ ID NO: 358489 - DNA, 20 bp, Artificial Sequence
  chemically synthesized
aagatctctctcttgcttta

SEQ ID NO: 358490 - DNA, 20 bp, Artificial Sequence
  chemically synthesized
caaatcaattgctataaagc

SEQ ID NO: 358491 - DNA, 20 bp, Artificial Sequence
  chemically synthesized
acagcaaatcaattgctata

SEQ ID NO: 358492 - DNA, 20 bp, Artificial Sequence
  chemically synthesized
tagcaattgatttgctgttc

SEQ ID NO: 358493 - DNA, 20 bp, Artificial Sequence
  chemically synthesized
cagaaacaattgcactggaa

SEQ ID NO: 358494 - DNA, 20 bp, Artificial Sequence
  chemically synthesized
accaacagaaacaattgcac

SEQ ID NO: 358495 - DNA, 20 bp, Artificial Sequence
  chemically synthesized
tccagtgcaattgtttctgt

SEQ ID NO: 358496 - DNA, 20 bp, Artificial Sequence
  chemically synthesized
cacaatgttttgaataccaa

SEQ ID NO: 358497 - DNA, 20 bp, Artificial Sequence
  chemically synthesized
ttagtaaccaagacaaagag

SEQ ID NO: 358498 - DNA, 20 bp, Artificial Sequence
  chemically synthesized
ttgtgttctgctctttgtct

SEQ ID NO: 358499 - DNA, 20 bp, Artificial Sequence
  chemically synthesized
tttttagtaaccaagacaaa

SEQ ID NO: 358500 - DNA, 20 bp, Artificial Sequence
  chemically synthesized
catttttagtaaccaagaca

SEQ ID NO: 358501 - DNA, 20 bp, Artificial Sequence
  chemically synthesized
tcagagcatttttagtaacc

SEQ ID NO: 358502 - DNA, 20 bp, Artificial Sequence
  chemically synthesized
taagatgctcagagcatttt

SEQ ID NO: 358503 - DNA, 20 bp, Artificial Sequence
  chemically synthesized
ttggttactaaaaatgctct

SEQ ID NO: 358504 - DNA, 20 bp, Artificial Sequence
  chemically synthesized
tcagggtcataagatgctca

SEQ ID NO: 358505 - DNA, 20 bp, Artificial Sequence
  chemically synthesized
gttcagggtcataagatgct

SEQ ID NO: 358506 - DNA, 20 bp, Artificial Sequence
  chemically synthesized
ttgttctagttcagggtcat

SEQ ID NO: 358507 - DNA, 20 bp, Artificial Sequence
  chemically synthesized
agcatcttatgaccctgaac

SEQ ID NO: 358508 - DNA, 20 bp, Artificial Sequence
  chemically synthesized
gtatactttgttctagttca

SEQ ID NO: 358509 - DNA, 20 bp, Artificial Sequence
  chemically synthesized
tgtatactttgttctagttc

SEQ ID NO: 358510 - DNA, 20 bp, Artificial Sequence
  chemically synthesized
ctgtatactttgttctagtt

SEQ ID NO: 358511 - DNA, 20 bp, Artificial Sequence
  chemically synthesized
tatgaccctgaactagaaca

SEQ ID NO: 358512 - DNA, 20 bp, Artificial Sequence
  chemically synthesized
aagccctgtatactttgttc

SEQ ID NO: 358513 - DNA, 20 bp, Artificial Sequence
  chemically synthesized
ctgaactagaacaaagtata

SEQ ID NO: 358514 - DNA, 20 bp, Artificial Sequence
  chemically synthesized
tgaactagaacaaagtatac

SEQ ID NO: 358515 - DNA, 20 bp, Artificial Sequence
  chemically synthesized
gaactagaacaaagtataca

SEQ ID NO: 358516 - DNA, 20 bp, Artificial Sequence
  chemically synthesized
acaaagtatacagggcttta

SEQ ID NO: 358517 - DNA, 20 bp, Artificial Sequence
  chemically synthesized
ctttgatatcaaacaccata

SEQ ID NO: 358518 - DNA, 20 bp, Artificial Sequence
  chemically synthesized
ctttatggtgtttgatatca

SEQ ID NO: 358519 - DNA, 20 bp, Artificial Sequence
  chemically synthesized
tatcaaagtgtgtatctgat

SEQ ID NO: 358520 - DNA, 20 bp, Artificial Sequence
  chemically synthesized
aaagtgtgtatctgataaga

SEQ ID NO: 358521 - DNA, 20 bp, Artificial Sequence
  chemically synthesized
gaaagaaacatctgtcttat

SEQ ID NO: 358522 - DNA, 20 bp, Artificial Sequence
  chemically synthesized
tcagatacgtagtgtggaga

SEQ ID NO: 358523 - DNA, 20 bp, Artificial Sequence
  chemically synthesized
atcatcagatacgtagtgtg

SEQ ID NO: 358524 - DNA, 20 bp, Artificial Sequence
  chemically synthesized
ccatcatcagatacgtagtg

SEQ ID NO: 358525 - DNA, 20 bp, Artificial Sequence
  chemically synthesized
aattaccatcatcagatacg

SEQ ID NO: 358526 - DNA, 20 bp, Artificial Sequence
  chemically synthesized
ccacactacgtatctgatga

SEQ ID NO: 358527 - DNA, 20 bp, Artificial Sequence
  chemically synthesized
gttaaattaattaccatcat

SEQ ID NO: 358528 - DNA, 20 bp, Artificial Sequence
  chemically synthesized
agatctcatgtgagtagttg

SEQ ID NO: 358529 - DNA, 20 bp, Artificial Sequence
  chemically synthesized
ttaactacaactactcacat

SEQ ID NO: 358530 - DNA, 20 bp, Artificial Sequence
  chemically synthesized
gatactagatctcatgtgag

SEQ ID NO: 358531 - DNA, 20 bp, Artificial Sequence
  chemically synthesized
aatgatactagatctcatgt

SEQ ID NO: 358532 - DNA, 20 bp, Artificial Sequence
  chemically synthesized
acaactactcacatgagatc

SEQ ID NO: 358533 - DNA, 20 bp, Artificial Sequence
  chemically synthesized
tatacaggtaaaaatgatac

SEQ ID NO: 358534 - DNA, 20 bp, Artificial Sequence
  chemically synthesized
tagtatcatttttacctgta

SEQ ID NO: 358535 - DNA, 20 bp, Artificial Sequence
  chemically synthesized
tgtataagcctaaactatac

SEQ ID NO: 358536 - DNA, 20 bp, Artificial Sequence
  chemically synthesized
tcatttttacctgtatagtt

SEQ ID NO: 358537 - DNA, 20 bp, Artificial Sequence
  chemically synthesized
ttgtataagcctaaactata

SEQ ID NO: 358538 - DNA, 20 bp, Artificial Sequence
  chemically synthesized
catttttacctgtatagttt

SEQ ID NO: 358539 - DNA, 20 bp, Artificial Sequence
  chemically synthesized
tacagataatgtgtttgtat

SEQ ID NO: 358540 - DNA, 20 bp, Artificial Sequence
  chemically synthesized
aaacacattatctgtataaa

SEQ ID NO: 358541 - DNA, 20 bp, Artificial Sequence
  chemically synthesized
atggtgttggtctttttata

SEQ ID NO: 358542 - DNA, 20 bp, Artificial Sequence
  chemically synthesized
aactttgccgagaatggtgt

SEQ ID NO: 358543 - DNA, 20 bp, Artificial Sequence
  chemically synthesized
aaaaagaccaacaccattct

SEQ ID NO: 358544 - DNA, 20 bp, Artificial Sequence
  chemically synthesized
tattctaactttgccgagaa

SEQ ID NO: 358545 - DNA, 20 bp, Artificial Sequence
  chemically synthesized
gaccaacaccattctcggca

SEQ ID NO: 358546 - DNA, 20 bp, Artificial Sequence
  chemically synthesized
ggttgtattctaactttgcc

SEQ ID NO: 358547 - DNA, 20 bp, Artificial Sequence
  chemically synthesized
aacaccattctcggcaaagt

SEQ ID NO: 358548 - DNA, 20 bp, Artificial Sequence
  chemically synthesized
ggcaaagttagaatacaacc

SEQ ID NO: 358549 - DNA, 20 bp, Artificial Sequence
  chemically synthesized
ctgggaatcccagtaaatcc

SEQ ID NO: 358550 - DNA, 20 bp, Artificial Sequence
  chemically synthesized
agaatacaacctggatttac

SEQ ID NO: 358551 - DNA, 20 bp, Artificial Sequence
  chemically synthesized
actgggaatcccagtaaatc

SEQ ID NO: 358552 - DNA, 20 bp, Artificial Sequence
  chemically synthesized
gaatacaacctggatttact

SEQ ID NO: 358553 - DNA, 20 bp, Artificial Sequence
  chemically synthesized
cctggatttactgggattcc

SEQ ID NO: 358554 - DNA, 20 bp, Artificial Sequence
  chemically synthesized
atgtttgacactgggaatcc

SEQ ID NO: 358555 - DNA, 20 bp, Artificial Sequence
  chemically synthesized
gtatcaatatgtttgacact

SEQ ID NO: 358556 - DNA, 20 bp, Artificial Sequence
  chemically synthesized
agtatcaatatgtttgacac

SEQ ID NO: 358557 - DNA, 20 bp, Artificial Sequence
  chemically synthesized
gtggttatagtggaggggga

SEQ ID NO: 358558 - DNA, 20 bp, Artificial Sequence
  chemically synthesized
aagtggttatagtggagggg

SEQ ID NO: 358559 - DNA, 20 bp, Artificial Sequence
  chemically synthesized
gaaagtggttatagtggagg

SEQ ID NO: 358560 - DNA, 20 bp, Artificial Sequence
  chemically synthesized
tgaaagtggttatagtggag

SEQ ID NO: 358561 - DNA, 20 bp, Artificial Sequence
  chemically synthesized
gtgaaagtggttatagtgga

SEQ ID NO: 358562 - DNA, 20 bp, Artificial Sequence
  chemically synthesized
cgtgaaagtggttatagtgg

SEQ ID NO: 358563 - DNA, 20 bp, Artificial Sequence
  chemically synthesized
gcgtgaaagtggttatagtg

SEQ ID NO: 358564 - DNA, 20 bp, Artificial Sequence
  chemically synthesized
gagcgtgaaagtggttatag

SEQ ID NO: 358565 - DNA, 20 bp, Artificial Sequence
  chemically synthesized
gcggagcgtgaaagtggtta

SEQ ID NO: 358566 - DNA, 20 bp, Artificial Sequence
  chemically synthesized
acattagcggagcgtgaaag

SEQ ID NO: 358567 - DNA, 20 bp, Artificial Sequence
  chemically synthesized
ttaacattagcggagcgtga

SEQ ID NO: 358568 - DNA, 20 bp, Artificial Sequence
  chemically synthesized
ttgaaacattaacattagcg

SEQ ID NO: 358569 - DNA, 20 bp, Artificial Sequence
  chemically synthesized
tgttgaaacattaacattag

SEQ ID NO: 358570 - DNA, 20 bp, Artificial Sequence
  chemically synthesized
agttgttgaaacattaacat

SEQ ID NO: 358571 - DNA, 20 bp, Artificial Sequence
  chemically synthesized
tctatgggatacatataatt

SEQ ID NO: 358572 - DNA, 20 bp, Artificial Sequence
  chemically synthesized
actgaattatatgtatccca

SEQ ID NO: 358573 - DNA, 20 bp, Artificial Sequence
  chemically synthesized
aatattttccagtgttctat

SEQ ID NO: 358574 - DNA, 20 bp, Artificial Sequence
  chemically synthesized
gaatattttccagtgttcta

SEQ ID NO: 358575 - DNA, 20 bp, Artificial Sequence
  chemically synthesized
atatgtatcccatagaacac

SEQ ID NO: 358576 - DNA, 20 bp, Artificial Sequence
  chemically synthesized
aactaattaagaatattttc

SEQ ID NO: 358577 - DNA, 20 bp, Artificial Sequence
  chemically synthesized
cactggaaaatattcttaat

SEQ ID NO: 358578 - DNA, 20 bp, Artificial Sequence
  chemically synthesized
tccattggaatgaactaatt

SEQ ID NO: 358579 - DNA, 20 bp, Artificial Sequence
  chemically synthesized
tcttaattagttcattccaa

SEQ ID NO: 358580 - DNA, 20 bp, Artificial Sequence
  chemically synthesized
acattgatctaacgttccat

SEQ ID NO: 358581 - DNA, 20 bp, Artificial Sequence
  chemically synthesized
agttcattccaatggaacgt

SEQ ID NO: 358582 - DNA, 20 bp, Artificial Sequence
  chemically synthesized
aatggaacgttagatcaatg

SEQ ID NO: 358583 - DNA, 20 bp, Artificial Sequence
  chemically synthesized
aatgtacataacatgttgta

SEQ ID NO: 358584 - DNA, 20 bp, Artificial Sequence
  chemically synthesized
gtacataacatgttgtaaag

SEQ ID NO: 358585 - DNA, 20 bp, Artificial Sequence
  chemically synthesized
tacataacatgttgtaaagt

SEQ ID NO: 358586 - DNA, 20 bp, Artificial Sequence
  chemically synthesized
ttgtaaagtaggacatgatc

SEQ ID NO: 358587 - DNA, 20 bp, Artificial Sequence
  chemically synthesized
atttttccccagtatggttc

SEQ ID NO: 358588 - DNA, 20 bp, Artificial Sequence
  chemically synthesized
gacatgatctggaaccatac

SEQ ID NO: 358589 - DNA, 20 bp, Artificial Sequence
  chemically synthesized
acatgatctggaaccatact

SEQ ID NO: 358590 - DNA, 20 bp, Artificial Sequence
  chemically synthesized
catgatctggaaccatactg

SEQ ID NO: 358591 - DNA, 20 bp, Artificial Sequence
  chemically synthesized
tgacatatttttccccagta

SEQ ID NO: 358592 - DNA, 20 bp, Artificial Sequence
  chemically synthesized
tctgatgacatatttttccc

SEQ ID NO: 358593 - DNA, 20 bp, Artificial Sequence
  chemically synthesized
actggggaaaaatatgtcat

SEQ ID NO: 358594 - DNA, 20 bp, Artificial Sequence
  chemically synthesized
tggggaaaaatatgtcatca

SEQ ID NO: 358595 - DNA, 20 bp, Artificial Sequence
  chemically synthesized
aacttgtaaaagtggtgatt

SEQ ID NO: 358596 - DNA, 20 bp, Artificial Sequence
  chemically synthesized
gtctaaatcaccacttttac

SEQ ID NO: 358597 - DNA, 20 bp, Artificial Sequence
  chemically synthesized
cattaaataacttgtaaaag

SEQ ID NO: 358598 - DNA, 20 bp, Artificial Sequence
  chemically synthesized
agacattaaataacttgtaa

SEQ ID NO: 358599 - DNA, 20 bp, Artificial Sequence
  chemically synthesized
ttacaagttatttaatgtct

SEQ ID NO: 358600 - DNA, 20 bp, Artificial Sequence
  chemically synthesized
tcataggtaagaagattact

SEQ ID NO: 358601 - DNA, 20 bp, Artificial Sequence
  chemically synthesized
catccatagtcataggtaag

SEQ ID NO: 358602 - DNA, 20 bp, Artificial Sequence
  chemically synthesized
tctcatccatagtcataggt

SEQ ID NO: 358603 - DNA, 20 bp, Artificial Sequence
  chemically synthesized
aatcttcttacctatgacta

SEQ ID NO: 358604 - DNA, 20 bp, Artificial Sequence
  chemically synthesized
atgctctcatccatagtcat

SEQ ID NO: 358605 - DNA, 20 bp, Artificial Sequence
  chemically synthesized
aatgctctcatccatagtca

SEQ ID NO: 358606 - DNA, 20 bp, Artificial Sequence
  chemically synthesized
tcttacctatgactatggat

SEQ ID NO: 358607 - DNA, 20 bp, Artificial Sequence
  chemically synthesized
ttacctatgactatggatga

SEQ ID NO: 358608 - DNA, 20 bp, Artificial Sequence
  chemically synthesized
gctttgaatgctctcatcca

SEQ ID NO: 358609 - DNA, 20 bp, Artificial Sequence
  chemically synthesized
actatggatgagagcattca

SEQ ID NO: 358610 - DNA, 20 bp, Artificial Sequence
  chemically synthesized
tggatgagagcattcaaagc

SEQ ID NO: 358611 - DNA, 20 bp, Artificial Sequence
  chemically synthesized
ggatgagagcattcaaagcc

SEQ ID NO: 358612 - DNA, 20 bp, Artificial Sequence
  chemically synthesized
agcattcaaagccaggccat

SEQ ID NO: 358613 - DNA, 20 bp, Artificial Sequence
  chemically synthesized
caccagctggtctgatggcc

SEQ ID NO: 358614 - DNA, 20 bp, Artificial Sequence
  chemically synthesized
tcaaagccaggccatcagac

SEQ ID NO: 358615 - DNA, 20 bp, Artificial Sequence
  chemically synthesized
ttcaccaccagctggtctga

SEQ ID NO: 358616 - DNA, 20 bp, Artificial Sequence
  chemically synthesized
agccaggccatcagaccagc

SEQ ID NO: 358617 - DNA, 20 bp, Artificial Sequence
  chemically synthesized
caggccatcagaccagctgg

SEQ ID NO: 358618 - DNA, 20 bp, Artificial Sequence
  chemically synthesized
taatcaacttcaccaccagc

SEQ ID NO: 358619 - DNA, 20 bp, Artificial Sequence
  chemically synthesized
catcagaccagctggtggtg

SEQ ID NO: 358620 - DNA, 20 bp, Artificial Sequence
  chemically synthesized
aatgtaatcaacttcaccac

SEQ ID NO: 358621 - DNA, 20 bp, Artificial Sequence
  chemically synthesized
aagttgattacattaacctg

SEQ ID NO: 358622 - DNA, 20 bp, Artificial Sequence
  chemically synthesized
atcaactcgtaattatccac

SEQ ID NO: 358623 - DNA, 20 bp, Artificial Sequence
  chemically synthesized
aatcaactcgtaattatcca

SEQ ID NO: 358624 - DNA, 20 bp, Artificial Sequence
  chemically synthesized
attaacctgtggataattac

SEQ ID NO: 358625 - DNA, 20 bp, Artificial Sequence
  chemically synthesized
gataattacgagttgattgt

SEQ ID NO: 358626 - DNA, 20 bp, Artificial Sequence
  chemically synthesized
tacgagttgattgtcggacc

SEQ ID NO: 358627 - DNA, 20 bp, Artificial Sequence
  chemically synthesized
gttgattgtcggacccagct

SEQ ID NO: 358628 - DNA, 20 bp, Artificial Sequence
  chemically synthesized
ttgattgtcggacccagctc

SEQ ID NO: 358629 - DNA, 20 bp, Artificial Sequence
  chemically synthesized
gattgtcggacccagctcag

SEQ ID NO: 358630 - DNA, 20 bp, Artificial Sequence
  chemically synthesized
tgaaaagattctcctgagct

SEQ ID NO: 358631 - DNA, 20 bp, Artificial Sequence
  chemically synthesized
gtgaaaagattctcctgagc

SEQ ID NO: 358632 - DNA, 20 bp, Artificial Sequence
  chemically synthesized
aacagtgaaaagattctcct

SEQ ID NO: 358633 - DNA, 20 bp, Artificial Sequence
  chemically synthesized
tgcaacaaaccaacagtgaa

SEQ ID NO: 358634 - DNA, 20 bp, Artificial Sequence
  chemically synthesized
caggagaatcttttcactgt

SEQ ID NO: 358635 - DNA, 20 bp, Artificial Sequence
  chemically synthesized
gctggattgcaacaaaccaa

SEQ ID NO: 358636 - DNA, 20 bp, Artificial Sequence
  chemically synthesized
actgttggtttgttgcaatc

SEQ ID NO: 358637 - DNA, 20 bp, Artificial Sequence
  chemically synthesized
gtaatgaaaaatatcatggc

SEQ ID NO: 358638 - DNA, 20 bp, Artificial Sequence
  chemically synthesized
aaatgtaatgaaaaatatca

SEQ ID NO: 358639 - DNA, 20 bp, Artificial Sequence
  chemically synthesized
ttacatttttgacctacatg

SEQ ID NO: 358640 - DNA, 20 bp, Artificial Sequence
  chemically synthesized
gaaaatttatttccacatgt

SEQ ID NO: 358641 - DNA, 20 bp, Artificial Sequence
  chemically synthesized
tgaaaatttatttccacatg

SEQ ID NO: 358642 - DNA, 20 bp, Artificial Sequence
  chemically synthesized
atgtggaaataaattttcat

SEQ ID NO: 358643 - DNA, 20 bp, Artificial Sequence
  chemically synthesized
cataagaaaatgcattcctt

SEQ ID NO: 358644 - DNA, 20 bp, Artificial Sequence
  chemically synthesized
agaaaatgcattccttgagc

SEQ ID NO: 358645 - DNA, 20 bp, Artificial Sequence
  chemically synthesized
gtttgcatggttcttgctca

SEQ ID NO: 358646 - DNA, 20 bp, Artificial Sequence
  chemically synthesized
agtttgcatggttcttgctc

SEQ ID NO: 358647 - DNA, 20 bp, Artificial Sequence
  chemically synthesized
cattcatatttaagtttgca

SEQ ID NO: 358648 - DNA, 20 bp, Artificial Sequence
  chemically synthesized
gatcaaggacattcatattt

SEQ ID NO: 358649 - DNA, 20 bp, Artificial Sequence
  chemically synthesized
atatgaatgtccttgatctt

SEQ ID NO: 358650 - DNA, 20 bp, Artificial Sequence
  chemically synthesized
ctatttatcactgaagatca

SEQ ID NO: 358651 - DNA, 20 bp, Artificial Sequence
  chemically synthesized
tctatttatcactgaagatc

SEQ ID NO: 358652 - DNA, 20 bp, Artificial Sequence
  chemically synthesized
aaaatttctatttatcactg

SEQ ID NO: 358653 - DNA, 20 bp, Artificial Sequence
  chemically synthesized
ccttgatcttcagtgataaa

SEQ ID NO: 358654 - DNA, 20 bp, Artificial Sequence
  chemically synthesized
tcagtgataaatagaaattt

SEQ ID NO: 358655 - DNA, 20 bp, Artificial Sequence
  chemically synthesized
cagtgataaatagaaatttt

SEQ ID NO: 358656 - DNA, 20 bp, Artificial Sequence
  chemically synthesized
agtgataaatagaaatttta

SEQ ID NO: 358657 - DNA, 20 bp, Artificial Sequence
  chemically synthesized
atagaaattttagggccaat

SEQ ID NO: 358658 - DNA, 20 bp, Artificial Sequence
  chemically synthesized
tattatgtctcattactaat

SEQ ID NO: 358659 - DNA, 20 bp, Artificial Sequence
  chemically synthesized
ttttagggccaattagtaat

SEQ ID NO: 358660 - DNA, 20 bp, Artificial Sequence
  chemically synthesized
caattagtaatgagacataa

SEQ ID NO: 358661 - DNA, 20 bp, Artificial Sequence
  chemically synthesized
tgagacataatagattctac

SEQ ID NO: 358662 - DNA, 20 bp, Artificial Sequence
  chemically synthesized
gacataatagattctaccag

SEQ ID NO: 358663 - DNA, 20 bp, Artificial Sequence
  chemically synthesized
agaatagacttaacttctgg

SEQ ID NO: 358664 - DNA, 20 bp, Artificial Sequence
  chemically synthesized
aatagattctaccagaagtt

SEQ ID NO: 358665 - DNA, 20 bp, Artificial Sequence
  chemically synthesized
ttgagaatagacttaacttc

SEQ ID NO: 358666 - DNA, 20 bp, Artificial Sequence
  chemically synthesized
agaagttaagtctattctca

SEQ ID NO: 358667 - DNA, 20 bp, Artificial Sequence
  chemically synthesized
gaagttaagtctattctcaa

SEQ ID NO: 358668 - DNA, 20 bp, Artificial Sequence
  chemically synthesized
agactcctagcctttgagaa

SEQ ID NO: 358669 - DNA, 20 bp, Artificial Sequence
  chemically synthesized
ttaagtctattctcaaaggc

SEQ ID NO: 358670 - DNA, 20 bp, Artificial Sequence
  chemically synthesized
taagtctattctcaaaggct

SEQ ID NO: 358671 - DNA, 20 bp, Artificial Sequence
  chemically synthesized
agaatagactcctagccttt

SEQ ID NO: 358672 - DNA, 20 bp, Artificial Sequence
  chemically synthesized
agtctattctcaaaggctag

SEQ ID NO: 358673 - DNA, 20 bp, Artificial Sequence
  chemically synthesized
aatgaatcagaatagactcc

SEQ ID NO: 358674 - DNA, 20 bp, Artificial Sequence
  chemically synthesized
tagataccaatgaatcagaa

SEQ ID NO: 358675 - DNA, 20 bp, Artificial Sequence
  chemically synthesized
aggagtctattctgattcat

SEQ ID NO: 358676 - DNA, 20 bp, Artificial Sequence
  chemically synthesized
tggcatagataccaatgaat

SEQ ID NO: 358677 - DNA, 20 bp, Artificial Sequence
  chemically synthesized
attcagtaaatggtatggca

SEQ ID NO: 358678 - DNA, 20 bp, Artificial Sequence
  chemically synthesized
aacacattcagtaaatggta

SEQ ID NO: 358679 - DNA, 20 bp, Artificial Sequence
  chemically synthesized
tagtgaacacattcagtaaa

SEQ ID NO: 358680 - DNA, 20 bp, Artificial Sequence
  chemically synthesized
ggagtaatagtgaacacatt

SEQ ID NO: 358681 - DNA, 20 bp, Artificial Sequence
  chemically synthesized
aatgtgttcactattactcc

SEQ ID NO: 358682 - DNA, 20 bp, Artificial Sequence
  chemically synthesized
atggcagaatccaggagtaa

SEQ ID NO: 358683 - DNA, 20 bp, Artificial Sequence
  chemically synthesized
tctaatatggcagaatccag

SEQ ID NO: 358684 - DNA, 20 bp, Artificial Sequence
  chemically synthesized
ggtctaatatggcagaatcc

SEQ ID NO: 358685 - DNA, 20 bp, Artificial Sequence
  chemically synthesized
gggtctaatatggcagaatc

SEQ ID NO: 358686 - DNA, 20 bp, Artificial Sequence
  chemically synthesized
actcctggattctgccatat

SEQ ID NO: 358687 - DNA, 20 bp, Artificial Sequence
  chemically synthesized
aaatgttgggtctaatatgg

SEQ ID NO: 358688 - DNA, 20 bp, Artificial Sequence
  chemically synthesized
agtaaatgttgggtctaata

SEQ ID NO: 358689 - DNA, 20 bp, Artificial Sequence
  chemically synthesized
ttctataaacagtaaatgtt

SEQ ID NO: 358690 - DNA, 20 bp, Artificial Sequence
  chemically synthesized
attctataaacagtaaatgt

SEQ ID NO: 358691 - DNA, 20 bp, Artificial Sequence
  chemically synthesized
gacccaacatttactgttta

SEQ ID NO: 358692 - DNA, 20 bp, Artificial Sequence
  chemically synthesized
aaggtgagcaattctataaa

SEQ ID NO: 358693 - DNA, 20 bp, Artificial Sequence
  chemically synthesized
ttatagaattgctcaccttc

SEQ ID NO: 358694 - DNA, 20 bp, Artificial Sequence
  chemically synthesized
ttcattgaaagctagaaggt

SEQ ID NO: 358695 - DNA, 20 bp, Artificial Sequence
  chemically synthesized
cttgttcattgaaagctaga

SEQ ID NO: 358696 - DNA, 20 bp, Artificial Sequence
  chemically synthesized
gcttgttcattgaaagctag

SEQ ID NO: 358697 - DNA, 20 bp, Artificial Sequence
  chemically synthesized
ctagcttgttcattgaaagc

SEQ ID NO: 358698 - DNA, 20 bp, Artificial Sequence
  chemically synthesized
ttctctagcttgttcattga

SEQ ID NO: 358699 - DNA, 20 bp, Artificial Sequence
  chemically synthesized
ccttctagctttcaatgaac

SEQ ID NO: 358700 - DNA, 20 bp, Artificial Sequence
  chemically synthesized
ctagctttcaatgaacaagc

SEQ ID NO: 358701 - DNA, 20 bp, Artificial Sequence
  chemically synthesized
agctttcaatgaacaagcta

SEQ ID NO: 358702 - DNA, 20 bp, Artificial Sequence
  chemically synthesized
tttcaatgaacaagctagag

SEQ ID NO: 358703 - DNA, 20 bp, Artificial Sequence
  chemically synthesized
aatgaacaagctagagaaga

SEQ ID NO: 358704 - DNA, 20 bp, Artificial Sequence
  chemically synthesized
gttttatacactgtcttctc

SEQ ID NO: 358705 - DNA, 20 bp, Artificial Sequence
  chemically synthesized
gaagacagtgtataaaacat

SEQ ID NO: 358706 - DNA, 20 bp, Artificial Sequence
  chemically synthesized
ttaagtccttggttaacaat

SEQ ID NO: 358707 - DNA, 20 bp, Artificial Sequence
  chemically synthesized
cattagacttattgttaacc

SEQ ID NO: 358708 - DNA, 20 bp, Artificial Sequence
  chemically synthesized
attagacttattgttaacca

SEQ ID NO: 358709 - DNA, 20 bp, Artificial Sequence
  chemically synthesized
ttattgttaaccaaggactt

SEQ ID NO: 358710 - DNA, 20 bp, Artificial Sequence
  chemically synthesized
gcttttatatcttaagtcct

SEQ ID NO: 358711 - DNA, 20 bp, Artificial Sequence
  chemically synthesized
aaaaagcgcttttatatctt

SEQ ID NO: 358712 - DNA, 20 bp, Artificial Sequence
  chemically synthesized
accaaggacttaagatataa

SEQ ID NO: 358713 - DNA, 20 bp, Artificial Sequence
  chemically synthesized
taagatataaaagcgctttt

SEQ ID NO: 358714 - DNA, 20 bp, Artificial Sequence
  chemically synthesized
atataaaagcgctttttgga

SEQ ID NO: 358715 - DNA, 20 bp, Artificial Sequence
  chemically synthesized
tataaaagcgctttttggat

SEQ ID NO: 358716 - DNA, 20 bp, Artificial Sequence
  chemically synthesized
tagtattcctcctatccaaa

SEQ ID NO: 358717 - DNA, 20 bp, Artificial Sequence
  chemically synthesized
taaaagcgctttttggatag

SEQ ID NO: 358718 - DNA, 20 bp, Artificial Sequence
  chemically synthesized
aaaagcgctttttggatagg

SEQ ID NO: 358719 - DNA, 20 bp, Artificial Sequence
  chemically synthesized
tttggataggaggaatacta

SEQ ID NO: 358720 - DNA, 20 bp, Artificial Sequence
  chemically synthesized
ctttaaaaaacaattatcta

SEQ ID NO: 358721 - DNA, 20 bp, Artificial Sequence
  chemically synthesized
ctatagataattgtttttta

SEQ ID NO: 358722 - DNA, 20 bp, Artificial Sequence
  chemically synthesized
attaccacaattaatagcaa

SEQ ID NO: 358723 - DNA, 20 bp, Artificial Sequence
  chemically synthesized
aattaccacaattaatagca

SEQ ID NO: 358724 - DNA, 20 bp, Artificial Sequence
  chemically synthesized
tttgcctttgctattaattg

SEQ ID NO: 358725 - DNA, 20 bp, Artificial Sequence
  chemically synthesized
tgtccaattaccacaattaa

SEQ ID NO: 358726 - DNA, 20 bp, Artificial Sequence
  chemically synthesized
ttgctattaattgtggtaat

SEQ ID NO: 358727 - DNA, 20 bp, Artificial Sequence
  chemically synthesized
attaattgtggtaattggac

SEQ ID NO: 358728 - DNA, 20 bp, Artificial Sequence
  chemically synthesized
aatgaggcctagaagaggtt

SEQ ID NO: 358729 - DNA, 20 bp, Artificial Sequence
  chemically synthesized
acaagttgcttaacctcttc

SEQ ID NO: 358730 - DNA, 20 bp, Artificial Sequence
  chemically synthesized
caagttgcttaacctcttct

SEQ ID NO: 358731 - DNA, 20 bp, Artificial Sequence
  chemically synthesized
acagaaatgaggcctagaag

SEQ ID NO: 358732 - DNA, 20 bp, Artificial Sequence
  chemically synthesized
cacagaaatgaggcctagaa

SEQ ID NO: 358733 - DNA, 20 bp, Artificial Sequence
  chemically synthesized
tacacagaaatgaggcctag

SEQ ID NO: 358734 - DNA, 20 bp, Artificial Sequence
  chemically synthesized
agatacacagaaatgaggcc

SEQ ID NO: 358735 - DNA, 20 bp, Artificial Sequence
  chemically synthesized
atgtaagatacacagaaatg

SEQ ID NO: 358736 - DNA, 20 bp, Artificial Sequence
  chemically synthesized
catgtaagatacacagaaat

SEQ ID NO: 358737 - DNA, 20 bp, Artificial Sequence
  chemically synthesized
aaccttgcatgtaagataca

SEQ ID NO: 358738 - DNA, 20 bp, Artificial Sequence
  chemically synthesized
tttctgtgtatcttacatgc

SEQ ID NO: 358739 - DNA, 20 bp, Artificial Sequence
  chemically synthesized
ttctgtgtatcttacatgca

SEQ ID NO: 358740 - DNA, 20 bp, Artificial Sequence
  chemically synthesized
cttacactaaccttgcatgt

SEQ ID NO: 358741 - DNA, 20 bp, Artificial Sequence
  chemically synthesized
gtgtatcttacatgcaaggt

SEQ ID NO: 358742 - DNA, 20 bp, Artificial Sequence
  chemically synthesized
cttacatgcaaggttagtgt

SEQ ID NO: 358743 - DNA, 20 bp, Artificial Sequence
  chemically synthesized
gcaaggttagtgtaagatca

SEQ ID NO: 358744 - DNA, 20 bp, Artificial Sequence
  chemically synthesized
taagatcaaagtacaaaata

SEQ ID NO: 358745 - DNA, 20 bp, Artificial Sequence
  chemically synthesized
atcaaagtacaaaatatggt

SEQ ID NO: 358746 - DNA, 20 bp, Artificial Sequence
  chemically synthesized
aaatgatggtatgaaatcag

SEQ ID NO: 358747 - DNA, 20 bp, Artificial Sequence
  chemically synthesized
taaatgatggtatgaaatca

SEQ ID NO: 358748 - DNA, 20 bp, Artificial Sequence
  chemically synthesized
ttaaatgatggtatgaaatc

SEQ ID NO: 358749 - DNA, 20 bp, Artificial Sequence
  chemically synthesized
gttaaatgatggtatgaaat

SEQ ID NO: 358750 - DNA, 20 bp, Artificial Sequence
  chemically synthesized
atatagcttgcgttaaatga

SEQ ID NO: 358751 - DNA, 20 bp, Artificial Sequence
  chemically synthesized
ttcataccatcatttaacgc

SEQ ID NO: 358752 - DNA, 20 bp, Artificial Sequence
  chemically synthesized
ttaacgcaagctatatttat

SEQ ID NO: 358753 - DNA, 20 bp, Artificial Sequence
  chemically synthesized
ttcagttcagccaataaata

SEQ ID NO: 358754 - DNA, 20 bp, Artificial Sequence
  chemically synthesized
tatttattggctgaactgaa

SEQ ID NO: 358755 - DNA, 20 bp, Artificial Sequence
  chemically synthesized
tttctgtcttcttttcagtt

SEQ ID NO: 358756 - DNA, 20 bp, Artificial Sequence
  chemically synthesized
ttattggctgaactgaaaag

SEQ ID NO: 358757 - DNA, 20 bp, Artificial Sequence
  chemically synthesized
aaacatttctgtcttctttt

SEQ ID NO: 358758 - DNA, 20 bp, Artificial Sequence
  chemically synthesized
tggctgaactgaaaagaaga

SEQ ID NO: 358759 - DNA, 20 bp, Artificial Sequence
  chemically synthesized
tttttttctttattttaggt

SEQ ID NO: 358760 - DNA, 20 bp, Artificial Sequence
  chemically synthesized
ttttttttctttattttagg

SEQ ID NO: 358761 - DNA, 20 bp, Artificial Sequence
  chemically synthesized
atgtttgcctacctaaaata

SEQ ID NO: 358762 - DNA, 20 bp, Artificial Sequence
  chemically synthesized
ttgttttttttctttatttt

SEQ ID NO: 358763 - DNA, 20 bp, Artificial Sequence
  chemically synthesized
gttgttttttttctttattt

SEQ ID NO: 358764 - DNA, 20 bp, Artificial Sequence
  chemically synthesized
aataaagaaaaaaaacaaca

SEQ ID NO: 358765 - DNA, 20 bp, Artificial Sequence
  chemically synthesized
ataaagaaaaaaaacaacaa

SEQ ID NO: 358766 - DNA, 20 bp, Artificial Sequence
  chemically synthesized
aagaaaaaaaacaacaaagg

SEQ ID NO: 358767 - DNA, 20 bp, Artificial Sequence
  chemically synthesized
agaaaaaaaacaacaaagga

SEQ ID NO: 358768 - DNA, 20 bp, Artificial Sequence
  chemically synthesized
ggaaggaaatatttatccct

SEQ ID NO: 358769 - DNA, 20 bp, Artificial Sequence
  chemically synthesized
aaggaaatatttatccctaa

SEQ ID NO: 358770 - DNA, 20 bp, Artificial Sequence
  chemically synthesized
aggaaatatttatccctaag

SEQ ID NO: 358771 - DNA, 20 bp, Artificial Sequence
  chemically synthesized
ctacatatgtacacctctta

SEQ ID NO: 358772 - DNA, 20 bp, Artificial Sequence
  chemically synthesized
gctacatatgtacacctctt

SEQ ID NO: 358773 - DNA, 20 bp, Artificial Sequence
  chemically synthesized
ggctacatatgtacacctct

SEQ ID NO: 358774 - DNA, 20 bp, Artificial Sequence
  chemically synthesized
ccctaagaggtgtacatatg

SEQ ID NO: 358775 - DNA, 20 bp, Artificial Sequence
  chemically synthesized
gaggtgtacatatgtagcct

SEQ ID NO: 358776 - DNA, 20 bp, Artificial Sequence
  chemically synthesized
aagtaatgaaaatagaacca

SEQ ID NO: 358777 - DNA, 20 bp, Artificial Sequence
  chemically synthesized
caagtaatgaaaatagaacc

SEQ ID NO: 358778 - DNA, 20 bp, Artificial Sequence
  chemically synthesized
tggaaaccaagtaatgaaaa

SEQ ID NO: 358779 - DNA, 20 bp, Artificial Sequence
  chemically synthesized
ttggttctattttcattact

SEQ ID NO: 358780 - DNA, 20 bp, Artificial Sequence
  chemically synthesized
caatcaaatacatggaaacc

SEQ ID NO: 358781 - DNA, 20 bp, Artificial Sequence
  chemically synthesized
ctatgagacaatcaaataca

SEQ ID NO: 358782 - DNA, 20 bp, Artificial Sequence
  chemically synthesized
ccatgtatttgattgtctca

SEQ ID NO: 358783 - DNA, 20 bp, Artificial Sequence
  chemically synthesized
catgtatttgattgtctcat

SEQ ID NO: 358784 - DNA, 20 bp, Artificial Sequence
  chemically synthesized
tgcacatgcacgaagcctat

SEQ ID NO: 358785 - DNA, 20 bp, Artificial Sequence
  chemically synthesized
ataacatctgcacatgcacg

SEQ ID NO: 358786 - DNA, 20 bp, Artificial Sequence
  chemically synthesized
tcataggcttcgtgcatgtg

SEQ ID NO: 358787 - DNA, 20 bp, Artificial Sequence
  chemically synthesized
catgtgcagatgttattcaa

SEQ ID NO: 358788 - DNA, 20 bp, Artificial Sequence
  chemically synthesized
atgttattcaacagattatc

SEQ ID NO: 358789 - DNA, 20 bp, Artificial Sequence
  chemically synthesized
ttatcaagtttaattcttct

SEQ ID NO: 358790 - DNA, 20 bp, Artificial Sequence
  chemically synthesized
ttctgcatcagatgactcag

SEQ ID NO: 358791 - DNA, 20 bp, Artificial Sequence
  chemically synthesized
gatttctgcatcagatgact

SEQ ID NO: 358792 - DNA, 20 bp, Artificial Sequence
  chemically synthesized
ttcttctgagtcatctgatg

SEQ ID NO: 358793 - DNA, 20 bp, Artificial Sequence
  chemically synthesized
cttagaatggatttctgcat

SEQ ID NO: 358794 - DNA, 20 bp, Artificial Sequence
  chemically synthesized
ctgatgcagaaatccattct

SEQ ID NO: 358795 - DNA, 20 bp, Artificial Sequence
  chemically synthesized
cttagaaaaaatgcttagaa

SEQ ID NO: 358796 - DNA, 20 bp, Artificial Sequence
  chemically synthesized
tgaaacttagaaaaaatgct

SEQ ID NO: 358797 - DNA, 20 bp, Artificial Sequence
  chemically synthesized
ccattctaagcattttttct

SEQ ID NO: 358798 - DNA, 20 bp, Artificial Sequence
  chemically synthesized
gtcactgcattcatgaaact

SEQ ID NO: 358799 - DNA, 20 bp, Artificial Sequence
  chemically synthesized
ttttctaagtttcatgaatg

SEQ ID NO: 358800 - DNA, 20 bp, Artificial Sequence
  chemically synthesized
atgaatgcagtgacgcttca

SEQ ID NO: 358801 - DNA, 20 bp, Artificial Sequence
  chemically synthesized
tgtagacagttttttctatg

SEQ ID NO: 358802 - DNA, 20 bp, Artificial Sequence
  chemically synthesized
tctttaataaaagatgtaga

SEQ ID NO: 358803 - DNA, 20 bp, Artificial Sequence
  chemically synthesized
taattctttaataaaagatg

SEQ ID NO: 358804 - DNA, 20 bp, Artificial Sequence
  chemically synthesized
actgtctacatcttttatta

SEQ ID NO: 358805 - DNA, 20 bp, Artificial Sequence
  chemically synthesized
aaataataattctttaataa

SEQ ID NO: 358806 - DNA, 20 bp, Artificial Sequence
  chemically synthesized
taaagaattattatttatta

SEQ ID NO: 358807 - DNA, 20 bp, Artificial Sequence
  chemically synthesized
aggggcttatatttaaaaag

SEQ ID NO: 358808 - DNA, 20 bp, Artificial Sequence
  chemically synthesized
ataaggggcttatatttaaa

SEQ ID NO: 358809 - DNA, 20 bp, Artificial Sequence
  chemically synthesized
aaagactgctttttaaatat

SEQ ID NO: 358810 - DNA, 20 bp, Artificial Sequence
  chemically synthesized
tttaaatataagccccttat

SEQ ID NO: 358811 - DNA, 20 bp, Artificial Sequence
  chemically synthesized
ttcttccagcatctcataag

SEQ ID NO: 358812 - DNA, 20 bp, Artificial Sequence
  chemically synthesized
cttcttccagcatctcataa

SEQ ID NO: 358813 - DNA, 20 bp, Artificial Sequence
  chemically synthesized
tcttcttccagcatctcata

SEQ ID NO: 358814 - DNA, 20 bp, Artificial Sequence
  chemically synthesized
gtcttcttccagcatctcat

SEQ ID NO: 358815 - DNA, 20 bp, Artificial Sequence
  chemically synthesized
ataagccccttatgagatgc

SEQ ID NO: 358816 - DNA, 20 bp, Artificial Sequence
  chemically synthesized
agccccttatgagatgctgg

SEQ ID NO: 358817 - DNA, 20 bp, Artificial Sequence
  chemically synthesized
cccttatgagatgctggaag

SEQ ID NO: 358818 - DNA, 20 bp, Artificial Sequence
  chemically synthesized
tttacatagatgtcttcttc

SEQ ID NO: 358819 - DNA, 20 bp, Artificial Sequence
  chemically synthesized
ggaagaagacatctatgtaa

SEQ ID NO: 358820 - DNA, 20 bp, Artificial Sequence
  chemically synthesized
acagactgatcacttttaca

SEQ ID NO: 358821 - DNA, 20 bp, Artificial Sequence
  chemically synthesized
gacatctatgtaaaagtgat

SEQ ID NO: 358822 - DNA, 20 bp, Artificial Sequence
  chemically synthesized
agtgatcagtctgtaccact

SEQ ID NO: 358823 - DNA, 20 bp, Artificial Sequence
  chemically synthesized
aaggaaagtgcttagtggta

SEQ ID NO: 358824 - DNA, 20 bp, Artificial Sequence
  chemically synthesized
cccagaaggaaagtgcttag

SEQ ID NO: 358825 - DNA, 20 bp, Artificial Sequence
  chemically synthesized
cttcccagaaggaaagtgct

SEQ ID NO: 358826 - DNA, 20 bp, Artificial Sequence
  chemically synthesized
accactaagcactttccttc

SEQ ID NO: 358827 - DNA, 20 bp, Artificial Sequence
  chemically synthesized
ccactaagcactttccttct

SEQ ID NO: 358828 - DNA, 20 bp, Artificial Sequence
  chemically synthesized
ccttaaccttcccagaagga

SEQ ID NO: 358829 - DNA, 20 bp, Artificial Sequence
  chemically synthesized
ctaagcactttccttctggg

SEQ ID NO: 358830 - DNA, 20 bp, Artificial Sequence
  chemically synthesized
taagcactttccttctggga

SEQ ID NO: 358831 - DNA, 20 bp, Artificial Sequence
  chemically synthesized
tgaaccttaaccttcccaga

SEQ ID NO: 358832 - DNA, 20 bp, Artificial Sequence
  chemically synthesized
atgaaccttaaccttcccag

SEQ ID NO: 358833 - DNA, 20 bp, Artificial Sequence
  chemically synthesized
tatatgaaccttaaccttcc

SEQ ID NO: 358834 - DNA, 20 bp, Artificial Sequence
  chemically synthesized
actttccttctgggaaggtt

SEQ ID NO: 358835 - DNA, 20 bp, Artificial Sequence
  chemically synthesized
ctttccttctgggaaggtta

SEQ ID NO: 358836 - DNA, 20 bp, Artificial Sequence
  chemically synthesized
atcatctgatcaaatgttga

SEQ ID NO: 358837 - DNA, 20 bp, Artificial Sequence
  chemically synthesized
atatactatcaacatttgat

SEQ ID NO: 358838 - DNA, 20 bp, Artificial Sequence
  chemically synthesized
aaaaataaaattgtcatatt

SEQ ID NO: 358839 - DNA, 20 bp, Artificial Sequence
  chemically synthesized
attttattttttcatccata

SEQ ID NO: 358840 - DNA, 20 bp, Artificial Sequence
  chemically synthesized
ttattttttcatccatatag

SEQ ID NO: 358841 - DNA, 20 bp, Artificial Sequence
  chemically synthesized
ggcatttgttaacttctata

SEQ ID NO: 358842 - DNA, 20 bp, Artificial Sequence
  chemically synthesized
tagaagttaacaaatgcctt

SEQ ID NO: 358843 - DNA, 20 bp, Artificial Sequence
  chemically synthesized
agaagttaacaaatgccttt

SEQ ID NO: 358844 - DNA, 20 bp, Artificial Sequence
  chemically synthesized
gaagttaacaaatgcctttg

SEQ ID NO: 358845 - DNA, 20 bp, Artificial Sequence
  chemically synthesized
aaaatatgcatttaccccaa

SEQ ID NO: 358846 - DNA, 20 bp, Artificial Sequence
  chemically synthesized
taaaatatgcatttacccca

SEQ ID NO: 358847 - DNA, 20 bp, Artificial Sequence
  chemically synthesized
tattttaacatctccaatgt

SEQ ID NO: 358848 - DNA, 20 bp, Artificial Sequence
  chemically synthesized
taaaaagatgactaacattg

SEQ ID NO: 358849 - DNA, 20 bp, Artificial Sequence
  chemically synthesized
aataaaaagatgactaacat

SEQ ID NO: 358850 - DNA, 20 bp, Artificial Sequence
  chemically synthesized
tgcatttactttttaataaa

SEQ ID NO: 358851 - DNA, 20 bp, Artificial Sequence
  chemically synthesized
ttagtcatctttttattaaa

SEQ ID NO: 358852 - DNA, 20 bp, Artificial Sequence
  chemically synthesized
taaaaagtaaatgcaaattt

SEQ ID NO: 358853 - DNA, 20 bp, Artificial Sequence
  chemically synthesized
aaaaagtaaatgcaaatttt

SEQ ID NO: 358854 - DNA, 20 bp, Artificial Sequence
  chemically synthesized
tatgttaaaatgagatttag

SEQ ID NO: 358855 - DNA, 20 bp, Artificial Sequence
  chemically synthesized
aagtatgttaaaatgagatt

SEQ ID NO: 358856 - DNA, 20 bp, Artificial Sequence
  chemically synthesized
ttttaaaagtatgttaaaat

SEQ ID NO: 358857 - DNA, 20 bp, Artificial Sequence
  chemically synthesized
tcattttaacatacttttaa

SEQ ID NO: 358858 - DNA, 20 bp, Artificial Sequence
  chemically synthesized
catcatctcaaatcttttaa

SEQ ID NO: 358859 - DNA, 20 bp, Artificial Sequence
  chemically synthesized
aacatacttttaaaagattt

SEQ ID NO: 358860 - DNA, 20 bp, Artificial Sequence
  chemically synthesized
gaatcgttactgtgtttaca

SEQ ID NO: 358861 - DNA, 20 bp, Artificial Sequence
  chemically synthesized
gagatgatgctttgtaaaca

SEQ ID NO: 358862 - DNA, 20 bp, Artificial Sequence
  chemically synthesized
ttgtaaacacagtaacgatt

SEQ ID NO: 358863 - DNA, 20 bp, Artificial Sequence
  chemically synthesized
gtaaacacagtaacgattcg

SEQ ID NO: 358864 - DNA, 20 bp, Artificial Sequence
  chemically synthesized
gattgtgacagatacatgca

SEQ ID NO: 358865 - DNA, 20 bp, Artificial Sequence
  chemically synthesized
tagttatcaagggattgtga

SEQ ID NO: 358866 - DNA, 20 bp, Artificial Sequence
  chemically synthesized
ataataggcttagttatcaa

SEQ ID NO: 358867 - DNA, 20 bp, Artificial Sequence
  chemically synthesized
aataataggcttagttatca

SEQ ID NO: 358868 - DNA, 20 bp, Artificial Sequence
  chemically synthesized
gtcacaatcccttgataact

SEQ ID NO: 358869 - DNA, 20 bp, Artificial Sequence
  chemically synthesized
aaataataggcttagttatc

SEQ ID NO: 358870 - DNA, 20 bp, Artificial Sequence
  chemically synthesized
ccactcctaaataataggct

SEQ ID NO: 358871 - DNA, 20 bp, Artificial Sequence
  chemically synthesized
tgataactaagcctattatt

SEQ ID NO: 358872 - DNA, 20 bp, Artificial Sequence
  chemically synthesized
gataactaagcctattattt

SEQ ID NO: 358873 - DNA, 20 bp, Artificial Sequence
  chemically synthesized
ataatccactcctaaataat

SEQ ID NO: 358874 - DNA, 20 bp, Artificial Sequence
  chemically synthesized
gataatccactcctaaataa

SEQ ID NO: 358875 - DNA, 20 bp, Artificial Sequence
  chemically synthesized
taactaagcctattatttag

SEQ ID NO: 358876 - DNA, 20 bp, Artificial Sequence
  chemically synthesized
ctaagcctattatttaggag

SEQ ID NO: 358877 - DNA, 20 bp, Artificial Sequence
  chemically synthesized
tatttaggagtggattatcc

SEQ ID NO: 358878 - DNA, 20 bp, Artificial Sequence
  chemically synthesized
aagaaggaattaggaaaact

SEQ ID NO: 358879 - DNA, 20 bp, Artificial Sequence
  chemically synthesized
aagtaggtcaagaaggaatt

SEQ ID NO: 358880 - DNA, 20 bp, Artificial Sequence
  chemically synthesized
taagtaggtcaagaaggaat

SEQ ID NO: 358881 - DNA, 20 bp, Artificial Sequence
  chemically synthesized
actaaataagtaggtcaaga

SEQ ID NO: 358882 - DNA, 20 bp, Artificial Sequence
  chemically synthesized
gactaaataagtaggtcaag

SEQ ID NO: 358883 - DNA, 20 bp, Artificial Sequence
  chemically synthesized
actgactaaataagtaggtc

SEQ ID NO: 358884 - DNA, 20 bp, Artificial Sequence
  chemically synthesized
tccttcttgacctacttatt

SEQ ID NO: 358885 - DNA, 20 bp, Artificial Sequence
  chemically synthesized
gagtaactgactaaataagt

SEQ ID NO: 358886 - DNA, 20 bp, Artificial Sequence
  chemically synthesized
tgagtaactgactaaataag

SEQ ID NO: 358887 - DNA, 20 bp, Artificial Sequence
  chemically synthesized
tcttgacctacttatttagt

SEQ ID NO: 358888 - DNA, 20 bp, Artificial Sequence
  chemically synthesized
cactgagtaactgactaaat

SEQ ID NO: 358889 - DNA, 20 bp, Artificial Sequence
  chemically synthesized
tacttatttagtcagttact

SEQ ID NO: 358890 - DNA, 20 bp, Artificial Sequence
  chemically synthesized
ttatttgacctgtattcact

SEQ ID NO: 358891 - DNA, 20 bp, Artificial Sequence
  chemically synthesized
agtcagttactcagtgaata

SEQ ID NO: 358892 - DNA, 20 bp, Artificial Sequence
  chemically synthesized
gtcagttactcagtgaatac

SEQ ID NO: 358893 - DNA, 20 bp, Artificial Sequence
  chemically synthesized
aatttataattttagaatat

SEQ ID NO: 358894 - DNA, 20 bp, Artificial Sequence
  chemically synthesized
ggttgagcaatttataattt

SEQ ID NO: 358895 - DNA, 20 bp, Artificial Sequence
  chemically synthesized
agtcactgtacataaaggtt

SEQ ID NO: 358896 - DNA, 20 bp, Artificial Sequence
  chemically synthesized
aattgctcaacctttatgta

SEQ ID NO: 358897 - DNA, 20 bp, Artificial Sequence
  chemically synthesized
cctgcagtcactgtacataa

SEQ ID NO: 358898 - DNA, 20 bp, Artificial Sequence
  chemically synthesized
tcctgcagtcactgtacata

SEQ ID NO: 358899 - DNA, 20 bp, Artificial Sequence
  chemically synthesized
acctttatgtacagtgactg

SEQ ID NO: 358900 - DNA, 20 bp, Artificial Sequence
  chemically synthesized
cctttatgtacagtgactgc

SEQ ID NO: 358901 - DNA, 20 bp, Artificial Sequence
  chemically synthesized
tttatgtacagtgactgcag

SEQ ID NO: 358902 - DNA, 20 bp, Artificial Sequence
  chemically synthesized
ttatgtacagtgactgcagg

SEQ ID NO: 358903 - DNA, 20 bp, Artificial Sequence
  chemically synthesized
gacacaaaatacacctcctg

SEQ ID NO: 358904 - DNA, 20 bp, Artificial Sequence
  chemically synthesized
ttccaaccgtaatttagcac

SEQ ID NO: 358905 - DNA, 20 bp, Artificial Sequence
  chemically synthesized
attccaaccgtaatttagca

SEQ ID NO: 358906 - DNA, 20 bp, Artificial Sequence
  chemically synthesized
ttgtgtcctgtgctaaatta

SEQ ID NO: 358907 - DNA, 20 bp, Artificial Sequence
  chemically synthesized
tgctgattccaaccgtaatt

SEQ ID NO: 358908 - DNA, 20 bp, Artificial Sequence
  chemically synthesized
gtcctgtgctaaattacggt

SEQ ID NO: 358909 - DNA, 20 bp, Artificial Sequence
  chemically synthesized
tgctaaattacggttggaat

SEQ ID NO: 358910 - DNA, 20 bp, Artificial Sequence
  chemically synthesized
taaattacggttggaatcag

SEQ ID NO: 358911 - DNA, 20 bp, Artificial Sequence
  chemically synthesized
ttacggttggaatcagcaga

SEQ ID NO: 358912 - DNA, 20 bp, Artificial Sequence
  chemically synthesized
cggttggaatcagcagatag

SEQ ID NO: 358913 - DNA, 20 bp, Artificial Sequence
  chemically synthesized
atcagcagatagtggcttaa

SEQ ID NO: 358914 - DNA, 20 bp, Artificial Sequence
  chemically synthesized
agcagatagtggcttaatgg

SEQ ID NO: 358915 - DNA, 20 bp, Artificial Sequence
  chemically synthesized
gcaaatccattaccaccatt

SEQ ID NO: 358916 - DNA, 20 bp, Artificial Sequence
  chemically synthesized
tagtggcttaatggtggtaa

SEQ ID NO: 358917 - DNA, 20 bp, Artificial Sequence
  chemically synthesized
gtaatggatttgcaataatc

SEQ ID NO: 358918 - DNA, 20 bp, Artificial Sequence
  chemically synthesized
tgaatcacattcatcattgg

SEQ ID NO: 358919 - DNA, 20 bp, Artificial Sequence
  chemically synthesized
atgaatcacattcatcattg

SEQ ID NO: 358920 - DNA, 20 bp, Artificial Sequence
  chemically synthesized
aaatgaatcacattcatcat

SEQ ID NO: 358921 - DNA, 20 bp, Artificial Sequence
  chemically synthesized
tgattcatttgtgaaatgct

SEQ ID NO: 358922 - DNA, 20 bp, Artificial Sequence
  chemically synthesized
tcatttgtgaaatgcttggc

SEQ ID NO: 358923 - DNA, 20 bp, Artificial Sequence
  chemically synthesized
acatagagggcagactggcc

SEQ ID NO: 358924 - DNA, 20 bp, Artificial Sequence
  chemically synthesized
tatgcacatagagggcagac

SEQ ID NO: 358925 - DNA, 20 bp, Artificial Sequence
  chemically synthesized
aacgttatgcacatagaggg

SEQ ID NO: 358926 - DNA, 20 bp, Artificial Sequence
  chemically synthesized
tttaacgttatgcacataga

SEQ ID NO: 358927 - DNA, 20 bp, Artificial Sequence
  chemically synthesized
ctttaacgttatgcacatag

SEQ ID NO: 358928 - DNA, 20 bp, Artificial Sequence
  chemically synthesized
cctttaacgttatgcacata

SEQ ID NO: 358929 - DNA, 20 bp, Artificial Sequence
  chemically synthesized
gtcctttaacgttatgcaca

SEQ ID NO: 358930 - DNA, 20 bp, Artificial Sequence
  chemically synthesized
cctctatgtgcataacgtta

SEQ ID NO: 358931 - DNA, 20 bp, Artificial Sequence
  chemically synthesized
ctctatgtgcataacgttaa

SEQ ID NO: 358932 - DNA, 20 bp, Artificial Sequence
  chemically synthesized
cataacgttaaaggacaaca

SEQ ID NO: 358933 - DNA, 20 bp, Artificial Sequence
  chemically synthesized
atgatgctataaaggagttt

SEQ ID NO: 358934 - DNA, 20 bp, Artificial Sequence
  chemically synthesized
ttcaatccaaaactccttta

SEQ ID NO: 358935 - DNA, 20 bp, Artificial Sequence
  chemically synthesized
gacataatgatgctataaag

SEQ ID NO: 358936 - DNA, 20 bp, Artificial Sequence
  chemically synthesized
gtgacataatgatgctataa

SEQ ID NO: 358937 - DNA, 20 bp, Artificial Sequence
  chemically synthesized
agtgacataatgatgctata

SEQ ID NO: 358938 - DNA, 20 bp, Artificial Sequence
  chemically synthesized
gcatcattatgtcactaatt

SEQ ID NO: 358939 - DNA, 20 bp, Artificial Sequence
  chemically synthesized
ctgaggctgataagctgaat

SEQ ID NO: 358940 - DNA, 20 bp, Artificial Sequence
  chemically synthesized
atgtcactaattcagcttat

SEQ ID NO: 358941 - DNA, 20 bp, Artificial Sequence
  chemically synthesized
acagcgaggctgaggctgat

SEQ ID NO: 358942 - DNA, 20 bp, Artificial Sequence
  chemically synthesized
ctaattcagcttatcagcct

SEQ ID NO: 358943 - DNA, 20 bp, Artificial Sequence
  chemically synthesized
aagcaataacagcgaggctg

SEQ ID NO: 358944 - DNA, 20 bp, Artificial Sequence
  chemically synthesized
gaagcaataacagcgaggct

SEQ ID NO: 358945 - DNA, 20 bp, Artificial Sequence
  chemically synthesized
aagtagaagcaataacagcg

SEQ ID NO: 358946 - DNA, 20 bp, Artificial Sequence
  chemically synthesized
taagtagaagcaataacagc

SEQ ID NO: 358947 - DNA, 20 bp, Artificial Sequence
  chemically synthesized
cacctaagtagaagcaataa

SEQ ID NO: 358948 - DNA, 20 bp, Artificial Sequence
  chemically synthesized
tcgctgttattgcttctact

SEQ ID NO: 358949 - DNA, 20 bp, Artificial Sequence
  chemically synthesized
cgctgttattgcttctactt

SEQ ID NO: 358950 - DNA, 20 bp, Artificial Sequence
  chemically synthesized
caacatttgcacctaagtag

SEQ ID NO: 358951 - DNA, 20 bp, Artificial Sequence
  chemically synthesized
gagcaacatttgcacctaag

SEQ ID NO: 358952 - DNA, 20 bp, Artificial Sequence
  chemically synthesized
tctgagcaacatttgcacct

SEQ ID NO: 358953 - DNA, 20 bp, Artificial Sequence
  chemically synthesized
acttaggtgcaaatgttgct

SEQ ID NO: 358954 - DNA, 20 bp, Artificial Sequence
  chemically synthesized
tttattatttttttttgtct

SEQ ID NO: 358955 - DNA, 20 bp, Artificial Sequence
  chemically synthesized
tcagacaaaaaaaaataata

SEQ ID NO: 358956 - DNA, 20 bp, Artificial Sequence
  chemically synthesized
cagacaaaaaaaaataataa

SEQ ID NO: 358957 - DNA, 20 bp, Artificial Sequence
  chemically synthesized
agacaaaaaaaaataataaa

SEQ ID NO: 358958 - DNA, 20 bp, Artificial Sequence
  chemically synthesized
tgccttttatgtaggaaaag

SEQ ID NO: 358959 - DNA, 20 bp, Artificial Sequence
  chemically synthesized
actgccttttatgtaggaaa

SEQ ID NO: 358960 - DNA, 20 bp, Artificial Sequence
  chemically synthesized
aactgccttttatgtaggaa

SEQ ID NO: 358961 - DNA, 20 bp, Artificial Sequence
  chemically synthesized
tgtctccttttcctacataa

SEQ ID NO: 358962 - DNA, 20 bp, Artificial Sequence
  chemically synthesized
gtctccttttcctacataaa

SEQ ID NO: 358963 - DNA, 20 bp, Artificial Sequence
  chemically synthesized
ttgataactgccttttatgt

SEQ ID NO: 358964 - DNA, 20 bp, Artificial Sequence
  chemically synthesized
tttgataactgccttttatg

SEQ ID NO: 358965 - DNA, 20 bp, Artificial Sequence
  chemically synthesized
tccttttcctacataaaagg

SEQ ID NO: 358966 - DNA, 20 bp, Artificial Sequence
  chemically synthesized
gcagttatcaaaaaatcatt

SEQ ID NO: 358967 - DNA, 20 bp, Artificial Sequence
  chemically synthesized
ttatcaaaaaatcattgagc

SEQ ID NO: 358968 - DNA, 20 bp, Artificial Sequence
  chemically synthesized
aatcattgagctggtcccca

SEQ ID NO: 358969 - DNA, 20 bp, Artificial Sequence
  chemically synthesized
acaggctcacctttggggac

SEQ ID NO: 358970 - DNA, 20 bp, Artificial Sequence
  chemically synthesized
atcattgagctggtccccaa

SEQ ID NO: 358971 - DNA, 20 bp, Artificial Sequence
  chemically synthesized
ttgagctggtccccaaaggt

SEQ ID NO: 358972 - DNA, 20 bp, Artificial Sequence
  chemically synthesized
tgtttacaggctcacctttg

SEQ ID NO: 358973 - DNA, 20 bp, Artificial Sequence
  chemically synthesized
ctgtttacaggctcaccttt

SEQ ID NO: 358974 - DNA, 20 bp, Artificial Sequence
  chemically synthesized
tctgtttacaggctcacctt

SEQ ID NO: 358975 - DNA, 20 bp, Artificial Sequence
  chemically synthesized
cccaaaggtgagcctgtaaa

SEQ ID NO: 358976 - DNA, 20 bp, Artificial Sequence
  chemically synthesized
cgggacagttttctgtttac

SEQ ID NO: 358977 - DNA, 20 bp, Artificial Sequence
  chemically synthesized
acgggacagttttctgttta

SEQ ID NO: 358978 - DNA, 20 bp, Artificial Sequence
  chemically synthesized
agtgagacctgaggacggga

SEQ ID NO: 358979 - DNA, 20 bp, Artificial Sequence
  chemically synthesized
acagaaaactgtcccgtcct

SEQ ID NO: 358980 - DNA, 20 bp, Artificial Sequence
  chemically synthesized
cagaaaactgtcccgtcctc

SEQ ID NO: 358981 - DNA, 20 bp, Artificial Sequence
  chemically synthesized
agacagtgagacctgaggac

SEQ ID NO: 358982 - DNA, 20 bp, Artificial Sequence
  chemically synthesized
gagacagtgagacctgagga

SEQ ID NO: 358983 - DNA, 20 bp, Artificial Sequence
  chemically synthesized
tttagagacagtgagacctg

SEQ ID NO: 358984 - DNA, 20 bp, Artificial Sequence
  chemically synthesized
ctttagagacagtgagacct

SEQ ID NO: 358985 - DNA, 20 bp, Artificial Sequence
  chemically synthesized
gagcctcctttagagacagt

SEQ ID NO: 358986 - DNA, 20 bp, Artificial Sequence
  chemically synthesized
ctcaggtctcactgtctcta

SEQ ID NO: 358987 - DNA, 20 bp, Artificial Sequence
  chemically synthesized
tcaggtctcactgtctctaa

SEQ ID NO: 358988 - DNA, 20 bp, Artificial Sequence
  chemically synthesized
aattgagcctcctttagaga

SEQ ID NO: 358989 - DNA, 20 bp, Artificial Sequence
  chemically synthesized
aggtctcactgtctctaaag

SEQ ID NO: 358990 - DNA, 20 bp, Artificial Sequence
  chemically synthesized
ggtctcactgtctctaaagg

SEQ ID NO: 358991 - DNA, 20 bp, Artificial Sequence
  chemically synthesized
tttaaattgagcctccttta

SEQ ID NO: 358992 - DNA, 20 bp, Artificial Sequence
  chemically synthesized
tgtttaaattgagcctcctt

SEQ ID NO: 358993 - DNA, 20 bp, Artificial Sequence
  chemically synthesized
caaatacatctgtttaaatt

SEQ ID NO: 358994 - DNA, 20 bp, Artificial Sequence
  chemically synthesized
taaaggaggctcaatttaaa

SEQ ID NO: 358995 - DNA, 20 bp, Artificial Sequence
  chemically synthesized
tccttttaaaaattgattta

SEQ ID NO: 358996 - DNA, 20 bp, Artificial Sequence
  chemically synthesized
aactataaatcaatttttaa

SEQ ID NO: 358997 - DNA, 20 bp, Artificial Sequence
  chemically synthesized
actataaatcaatttttaaa

SEQ ID NO: 358998 - DNA, 20 bp, Artificial Sequence
  chemically synthesized
atcaatttttaaaaggaaaa

SEQ ID NO: 358999 - DNA, 20 bp, Artificial Sequence
  chemically synthesized
aaaaaagttgaaatgtcttt

SEQ ID NO: 359000 - DNA, 20 bp, Artificial Sequence
  chemically synthesized
aaagttgaaatgtctttgag

SEQ ID NO: 359001 - DNA, 20 bp, Artificial Sequence
  chemically synthesized
tttttaaaaatcactgctca

SEQ ID NO: 359002 - DNA, 20 bp, Artificial Sequence
  chemically synthesized
cagtgatttttaaaaatgac

SEQ ID NO: 359003 - DNA, 20 bp, Artificial Sequence
  chemically synthesized
agtgatttttaaaaatgact

SEQ ID NO: 359004 - DNA, 20 bp, Artificial Sequence
  chemically synthesized
tgatttttaaaaatgactag

SEQ ID NO: 359005 - DNA, 20 bp, Artificial Sequence
  chemically synthesized
ttcttggcccagttaactcc

SEQ ID NO: 359006 - DNA, 20 bp, Artificial Sequence
  chemically synthesized
aaaaatgactaggagttaac

SEQ ID NO: 359007 - DNA, 20 bp, Artificial Sequence
  chemically synthesized
aaaatgactaggagttaact

SEQ ID NO: 359008 - DNA, 20 bp, Artificial Sequence
  chemically synthesized
gactaggagttaactgggcc

SEQ ID NO: 359009 - DNA, 20 bp, Artificial Sequence
  chemically synthesized
taggagttaactgggccaag

SEQ ID NO: 359010 - DNA, 20 bp, Artificial Sequence
  chemically synthesized
tccatcatgccttcttggcc

SEQ ID NO: 359011 - DNA, 20 bp, Artificial Sequence
  chemically synthesized
aggagttaactgggccaaga

SEQ ID NO: 359012 - DNA, 20 bp, Artificial Sequence
  chemically synthesized
ccatgtccatcatgccttct

SEQ ID NO: 359013 - DNA, 20 bp, Artificial Sequence
  chemically synthesized
actgggccaagaaggcatga

SEQ ID NO: 359014 - DNA, 20 bp, Artificial Sequence
  chemically synthesized
ccaagaaggcatgatggaca

SEQ ID NO: 359015 - DNA, 20 bp, Artificial Sequence
  chemically synthesized
aagaaggcatgatggacatg

SEQ ID NO: 359016 - DNA, 20 bp, Artificial Sequence
  chemically synthesized
agaaggcatgatggacatgg

SEQ ID NO: 359017 - DNA, 20 bp, Artificial Sequence
  chemically synthesized
ggacatggaggtgcaccacc

SEQ ID NO: 359018 - DNA, 20 bp, Artificial Sequence
  chemically synthesized
tccttgaaggtcaatcttgg

SEQ ID NO: 359019 - DNA, 20 bp, Artificial Sequence
  chemically synthesized
ccttccttgaaggtcaatct

SEQ ID NO: 359020 - DNA, 20 bp, Artificial Sequence
  chemically synthesized
caccaccaagattgaccttc

SEQ ID NO: 359021 - DNA, 20 bp, Artificial Sequence
  chemically synthesized
accaccaagattgaccttca

SEQ ID NO: 359022 - DNA, 20 bp, Artificial Sequence
  chemically synthesized
accaagattgaccttcaagg

SEQ ID NO: 359023 - DNA, 20 bp, Artificial Sequence
  chemically synthesized
ccaagattgaccttcaagga

SEQ ID NO: 359024 - DNA, 20 bp, Artificial Sequence
  chemically synthesized
agcaacaagcccttccttga

SEQ ID NO: 359025 - DNA, 20 bp, Artificial Sequence
  chemically synthesized
caagattgaccttcaaggaa

SEQ ID NO: 359026 - DNA, 20 bp, Artificial Sequence
  chemically synthesized
gagcaacaagcccttccttg

SEQ ID NO: 359027 - DNA, 20 bp, Artificial Sequence
  chemically synthesized
caaggaagggcttgttgctc

SEQ ID NO: 359028 - DNA, 20 bp, Artificial Sequence
  chemically synthesized
ctgaccacagctggagcaac

SEQ ID NO: 359029 - DNA, 20 bp, Artificial Sequence
  chemically synthesized
agggcttgttgctccagctg

SEQ ID NO: 359030 - DNA, 20 bp, Artificial Sequence
  chemically synthesized
aagctgcctgaccacagctg

SEQ ID NO: 359031 - DNA, 20 bp, Artificial Sequence
  chemically synthesized
agaagctgcctgaccacagc

SEQ ID NO: 359032 - DNA, 20 bp, Artificial Sequence
  chemically synthesized
cttgttgctccagctgtggt

SEQ ID NO: 359033 - DNA, 20 bp, Artificial Sequence
  chemically synthesized
ttgttgctccagctgtggtc

SEQ ID NO: 359034 - DNA, 20 bp, Artificial Sequence
  chemically synthesized
aactagaagctgcctgacca

SEQ ID NO: 359035 - DNA, 20 bp, Artificial Sequence
  chemically synthesized
ttgctccagctgtggtcagg

SEQ ID NO: 359036 - DNA, 20 bp, Artificial Sequence
  chemically synthesized
agctgtggtcaggcagcttc

SEQ ID NO: 359037 - DNA, 20 bp, Artificial Sequence
  chemically synthesized
ctgagagaactaacaactag

SEQ ID NO: 359038 - DNA, 20 bp, Artificial Sequence
  chemically synthesized
gtcaggcagcttctagttgt

SEQ ID NO: 359039 - DNA, 20 bp, Artificial Sequence
  chemically synthesized
tacctgagagaactaacaac

SEQ ID NO: 359040 - DNA, 20 bp, Artificial Sequence
  chemically synthesized
cttctagttgttagttctct

SEQ ID NO: 359041 - DNA, 20 bp, Artificial Sequence
  chemically synthesized
ttctagttgttagttctctc

SEQ ID NO: 359042 - DNA, 20 bp, Artificial Sequence
  chemically synthesized
gcaactcaggtggtacctga

SEQ ID NO: 359043 - DNA, 20 bp, Artificial Sequence
  chemically synthesized
ctgcaactcaggtggtacct

SEQ ID NO: 359044 - DNA, 20 bp, Artificial Sequence
  chemically synthesized
agttctctcaggtaccacct

SEQ ID NO: 359045 - DNA, 20 bp, Artificial Sequence
  chemically synthesized
gcaggactctgcaactcagg

SEQ ID NO: 359046 - DNA, 20 bp, Artificial Sequence
  chemically synthesized
ctcaggtaccacctgagttg

SEQ ID NO: 359047 - DNA, 20 bp, Artificial Sequence
  chemically synthesized
ctggcaggactctgcaactc

SEQ ID NO: 359048 - DNA, 20 bp, Artificial Sequence
  chemically synthesized
caggtaccacctgagttgca

SEQ ID NO: 359049 - DNA, 20 bp, Artificial Sequence
  chemically synthesized
gctggcaggactctgcaact

SEQ ID NO: 359050 - DNA, 20 bp, Artificial Sequence
  chemically synthesized
cctgagttgcagagtcctgc

SEQ ID NO: 359051 - DNA, 20 bp, Artificial Sequence
  chemically synthesized
agggtgtgacattggctggc

SEQ ID NO: 359052 - DNA, 20 bp, Artificial Sequence
  chemically synthesized
gagggtgtgacattggctgg

SEQ ID NO: 359053 - DNA, 20 bp, Artificial Sequence
  chemically synthesized
agagagggtgtgacattggc

SEQ ID NO: 359054 - DNA, 20 bp, Artificial Sequence
  chemically synthesized
ccctagagagggtgtgacat

SEQ ID NO: 359055 - DNA, 20 bp, Artificial Sequence
  chemically synthesized
agccaatgtcacaccctctc

SEQ ID NO: 359056 - DNA, 20 bp, Artificial Sequence
  chemically synthesized
gccaatgtcacaccctctct

SEQ ID NO: 359057 - DNA, 20 bp, Artificial Sequence
  chemically synthesized
ccaatgtcacaccctctcta

SEQ ID NO: 359058 - DNA, 20 bp, Artificial Sequence
  chemically synthesized
gtagtgggttgccctagaga

SEQ ID NO: 359059 - DNA, 20 bp, Artificial Sequence
  chemically synthesized
agtagtgggttgccctagag

SEQ ID NO: 359060 - DNA, 20 bp, Artificial Sequence
  chemically synthesized
tagtagtgggttgccctaga

SEQ ID NO: 359061 - DNA, 20 bp, Artificial Sequence
  chemically synthesized
aatagtagtgggttgcccta

SEQ ID NO: 359062 - DNA, 20 bp, Artificial Sequence
  chemically synthesized
tcaatagtagtgggttgccc

SEQ ID NO: 359063 - DNA, 20 bp, Artificial Sequence
  chemically synthesized
cttcatcagtcaatagtagt

SEQ ID NO: 359064 - DNA, 20 bp, Artificial Sequence
  chemically synthesized
ccttcatcagtcaatagtag

SEQ ID NO: 359065 - DNA, 20 bp, Artificial Sequence
  chemically synthesized
gccccttcatcagtcaatag

SEQ ID NO: 359066 - DNA, 20 bp, Artificial Sequence
  chemically synthesized
tctgccccttcatcagtcaa

SEQ ID NO: 359067 - DNA, 20 bp, Artificial Sequence
  chemically synthesized
cccactactattgactgatg

SEQ ID NO: 359068 - DNA, 20 bp, Artificial Sequence
  chemically synthesized
ccactactattgactgatga

SEQ ID NO: 359069 - DNA, 20 bp, Artificial Sequence
  chemically synthesized
cactactattgactgatgaa

SEQ ID NO: 359070 - DNA, 20 bp, Artificial Sequence
  chemically synthesized
actactattgactgatgaag

SEQ ID NO: 359071 - DNA, 20 bp, Artificial Sequence
  chemically synthesized
tttatactctgccccttcat

SEQ ID NO: 359072 - DNA, 20 bp, Artificial Sequence
  chemically synthesized
actattgactgatgaagggg

SEQ ID NO: 359073 - DNA, 20 bp, Artificial Sequence
  chemically synthesized
tattgactgatgaaggggca

SEQ ID NO: 359074 - DNA, 20 bp, Artificial Sequence
  chemically synthesized
aggggcagagtataaacact

SEQ ID NO: 359075 - DNA, 20 bp, Artificial Sequence
  chemically synthesized
caaatggggttaaaatggct

SEQ ID NO: 359076 - DNA, 20 bp, Artificial Sequence
  chemically synthesized
tgtctcaaatggggttaaaa

SEQ ID NO: 359077 - DNA, 20 bp, Artificial Sequence
  chemically synthesized
cagccattttaaccccattt

SEQ ID NO: 359078 - DNA, 20 bp, Artificial Sequence
  chemically synthesized
cctcagagttgtctcaaatg

SEQ ID NO: 359079 - DNA, 20 bp, Artificial Sequence
  chemically synthesized
ccctcagagttgtctcaaat

SEQ ID NO: 359080 - DNA, 20 bp, Artificial Sequence
  chemically synthesized
cccctcagagttgtctcaaa

SEQ ID NO: 359081 - DNA, 20 bp, Artificial Sequence
  chemically synthesized
accccatttgagacaactct

SEQ ID NO: 359082 - DNA, 20 bp, Artificial Sequence
  chemically synthesized
ccccatttgagacaactctg

SEQ ID NO: 359083 - DNA, 20 bp, Artificial Sequence
  chemically synthesized
cccatttgagacaactctga

SEQ ID NO: 359084 - DNA, 20 bp, Artificial Sequence
  chemically synthesized
ccatttgagacaactctgag

SEQ ID NO: 359085 - DNA, 20 bp, Artificial Sequence
  chemically synthesized
gcagctaggatgacccctca

SEQ ID NO: 359086 - DNA, 20 bp, Artificial Sequence
  chemically synthesized
ttgcagctaggatgacccct

SEQ ID NO: 359087 - DNA, 20 bp, Artificial Sequence
  chemically synthesized
acaactctgaggggtcatcc

SEQ ID NO: 359088 - DNA, 20 bp, Artificial Sequence
  chemically synthesized
tgaggggtcatcctagctgc

SEQ ID NO: 359089 - DNA, 20 bp, Artificial Sequence
  chemically synthesized
cccatagacaacttgcagct

SEQ ID NO: 359090 - DNA, 20 bp, Artificial Sequence
  chemically synthesized
ccccatagacaacttgcagc

SEQ ID NO: 359091 - DNA, 20 bp, Artificial Sequence
  chemically synthesized
caaaccccatagacaacttg

SEQ ID NO: 359092 - DNA, 20 bp, Artificial Sequence
  chemically synthesized
tcctagctgcaagttgtcta

SEQ ID NO: 359093 - DNA, 20 bp, Artificial Sequence
  chemically synthesized
cctagctgcaagttgtctat

SEQ ID NO: 359094 - DNA, 20 bp, Artificial Sequence
  chemically synthesized
ctagctgcaagttgtctatg

SEQ ID NO: 359095 - DNA, 20 bp, Artificial Sequence
  chemically synthesized
acacgcttattcaaacccca

SEQ ID NO: 359096 - DNA, 20 bp, Artificial Sequence
  chemically synthesized
gttgtctatggggtttgaat

SEQ ID NO: 359097 - DNA, 20 bp, Artificial Sequence
  chemically synthesized
gggtttgaataagcgtgtca

SEQ ID NO: 359098 - DNA, 20 bp, Artificial Sequence
  chemically synthesized
ggtttgaataagcgtgtcat

SEQ ID NO: 359099 - DNA, 20 bp, Artificial Sequence
  chemically synthesized
gtttgaataagcgtgtcata

SEQ ID NO: 359100 - DNA, 20 bp, Artificial Sequence
  chemically synthesized
gtgtcatagggtctacgtca

SEQ ID NO: 359101 - DNA, 20 bp, Artificial Sequence
  chemically synthesized
gaagaactagagctgtgacg

SEQ ID NO: 359102 - DNA, 20 bp, Artificial Sequence
  chemically synthesized
tagggtctacgtcacagctc

SEQ ID NO: 359103 - DNA, 20 bp, Artificial Sequence
  chemically synthesized
agtggaaagaggaagaacta

SEQ ID NO: 359104 - DNA, 20 bp, Artificial Sequence
  chemically synthesized
ggagtggaaagaggaagaac

SEQ ID NO: 359105 - DNA, 20 bp, Artificial Sequence
  chemically synthesized
gtgacaggagtggaaagagg

SEQ ID NO: 359106 - DNA, 20 bp, Artificial Sequence
  chemically synthesized
gaggtgacaggagtggaaag

SEQ ID NO: 359107 - DNA, 20 bp, Artificial Sequence
  chemically synthesized
agaggtgacaggagtggaaa

SEQ ID NO: 359108 - DNA, 20 bp, Artificial Sequence
  chemically synthesized
gcagaggtgacaggagtgga

SEQ ID NO: 359109 - DNA, 20 bp, Artificial Sequence
  chemically synthesized
aagggcagaggtgacaggag

SEQ ID NO: 359110 - DNA, 20 bp, Artificial Sequence
  chemically synthesized
tagaagggcagaggtgacag

SEQ ID NO: 359111 - DNA, 20 bp, Artificial Sequence
  chemically synthesized
tgtagaagggcagaggtgac

SEQ ID NO: 359112 - DNA, 20 bp, Artificial Sequence
  chemically synthesized
ctgtagaagggcagaggtga

SEQ ID NO: 359113 - DNA, 20 bp, Artificial Sequence
  chemically synthesized
aaacacctgtagaagggcag

SEQ ID NO: 359114 - DNA, 20 bp, Artificial Sequence
  chemically synthesized
aaaacacctgtagaagggca

SEQ ID NO: 359115 - DNA, 20 bp, Artificial Sequence
  chemically synthesized
aaaaaacacctgtagaaggg

SEQ ID NO: 359116 - DNA, 20 bp, Artificial Sequence
  chemically synthesized
ctgtcacctctgcccttcta

SEQ ID NO: 359117 - DNA, 20 bp, Artificial Sequence
  chemically synthesized
tgtcacctctgcccttctac

SEQ ID NO: 359118 - DNA, 20 bp, Artificial Sequence
  chemically synthesized
aaaaaaaaacacctgtagaa

SEQ ID NO: 359119 - DNA, 20 bp, Artificial Sequence
  chemically synthesized
aaaaaaaaaacacctgtaga

SEQ ID NO: 359120 - DNA, 20 bp, Artificial Sequence
  chemically synthesized
aaaaaaaaaaacacctgtag

SEQ ID NO: 359121 - DNA, 20 bp, Artificial Sequence
  chemically synthesized
aaaaaaaaaaaaaacacctg

SEQ ID NO: 359122 - DNA, 20 bp, Artificial Sequence
  chemically synthesized
tttttttttttttttttttc

SEQ ID NO: 359123 - DNA, 20 bp, Artificial Sequence
  chemically synthesized
ttttttttttttttttttcc

SEQ ID NO: 359124 - DNA, 20 bp, Artificial Sequence
  chemically synthesized
tttttttttttttttttcca

SEQ ID NO: 359125 - DNA, 20 bp, Artificial Sequence
  chemically synthesized
ttttttttttttccagggca

SEQ ID NO: 359126 - DNA, 20 bp, Artificial Sequence
  chemically synthesized
atgtttattaagccatgccc

SEQ ID NO: 359127 - DNA, 20 bp, Artificial Sequence
  chemically synthesized
tggcaggcagcatgtttatt

SEQ ID NO: 359128 - DNA, 20 bp, Artificial Sequence
  chemically synthesized
tcggagttgagtttggcagg

SEQ ID NO: 359129 - DNA, 20 bp, Artificial Sequence
  chemically synthesized
acttcggagttgagtttggc

SEQ ID NO: 359130 - DNA, 20 bp, Artificial Sequence
  chemically synthesized
gacttcggagttgagtttgg

SEQ ID NO: 359131 - DNA, 20 bp, Artificial Sequence
  chemically synthesized
gtagacttcggagttgagtt

SEQ ID NO: 359132 - DNA, 20 bp, Artificial Sequence
  chemically synthesized
gcctgccaaactcaactccg

SEQ ID NO: 359133 - DNA, 20 bp, Artificial Sequence
  chemically synthesized
ggggagtagacttcggagtt

SEQ ID NO: 359134 - DNA, 20 bp, Artificial Sequence
  chemically synthesized
gttctggggagtagacttcg

SEQ ID NO: 359135 - DNA, 20 bp, Artificial Sequence
  chemically synthesized
gggttctggggagtagactt

SEQ ID NO: 359136 - DNA, 20 bp, Artificial Sequence
  chemically synthesized
caactccgaagtctactccc

SEQ ID NO: 359137 - DNA, 20 bp, Artificial Sequence
  chemically synthesized
acagtctgggttctggggag

SEQ ID NO: 359138 - DNA, 20 bp, Artificial Sequence
  chemically synthesized
atcacagtctgggttctggg

SEQ ID NO: 359139 - DNA, 20 bp, Artificial Sequence
  chemically synthesized
gaagtctactccccagaacc

SEQ ID NO: 359140 - DNA, 20 bp, Artificial Sequence
  chemically synthesized
taatcacagtctgggttctg

SEQ ID NO: 359141 - DNA, 20 bp, Artificial Sequence
  chemically synthesized
ttaatcacagtctgggttct

SEQ ID NO: 359142 - DNA, 20 bp, Artificial Sequence
  chemically synthesized
tttaatcacagtctgggttc

SEQ ID NO: 359143 - DNA, 20 bp, Artificial Sequence
  chemically synthesized
acttcttttaatcacagtct

SEQ ID NO: 359144 - DNA, 20 bp, Artificial Sequence
  chemically synthesized
aacttcttttaatcacagtc

SEQ ID NO: 359145 - DNA, 20 bp, Artificial Sequence
  chemically synthesized
agaacccagactgtgattaa

SEQ ID NO: 359146 - DNA, 20 bp, Artificial Sequence
  chemically synthesized
gctgcaacttcttttaatca

SEQ ID NO: 359147 - DNA, 20 bp, Artificial Sequence
  chemically synthesized
acccagactgtgattaaaag

SEQ ID NO: 359148 - DNA, 20 bp, Artificial Sequence
  chemically synthesized
actgtgattaaaagaagttg

SEQ ID NO: 359149 - DNA, 20 bp, Artificial Sequence
  chemically synthesized
gtgattaaaagaagttgcag

SEQ ID NO: 359150 - DNA, 20 bp, Artificial Sequence
  chemically synthesized
gattaaaagaagttgcagca

SEQ ID NO: 359151 - DNA, 20 bp, Artificial Sequence
  chemically synthesized
attaaaagaagttgcagcag

SEQ ID NO: 359152 - DNA, 20 bp, Artificial Sequence
  chemically synthesized
aagaagttgcagcagaggaa

SEQ ID NO: 359153 - DNA, 20 bp, Artificial Sequence
  chemically synthesized
gcagcagaggaatagaaatg

SEQ ID NO: 359154 - DNA, 20 bp, Artificial Sequence
  chemically synthesized
agcagaggaatagaaatgaa

SEQ ID NO: 359155 - DNA, 20 bp, Artificial Sequence
  chemically synthesized
gcagaggaatagaaatgaag

SEQ ID NO: 359156 - DNA, 20 bp, Artificial Sequence
  chemically synthesized
cagaggaatagaaatgaaga

SEQ ID NO: 359157 - DNA, 20 bp, Artificial Sequence
  chemically synthesized
aggaatagaaatgaagaggg

SEQ ID NO: 359158 - DNA, 20 bp, Artificial Sequence
  chemically synthesized
ggaatagaaatgaagagggt

SEQ ID NO: 359159 - DNA, 20 bp, Artificial Sequence
  chemically synthesized
agggtaggaataatcttata

SEQ ID NO: 359160 - DNA, 20 bp, Artificial Sequence
  chemically synthesized
taggaataatcttatatggt

SEQ ID NO: 359161 - DNA, 20 bp, Artificial Sequence
  chemically synthesized
agaaactatccttaccatat

SEQ ID NO: 359162 - DNA, 20 bp, Artificial Sequence
  chemically synthesized
aggaataatcttatatggta

SEQ ID NO: 359163 - DNA, 20 bp, Artificial Sequence
  chemically synthesized
ataatcttatatggtaagga

SEQ ID NO: 359164 - DNA, 20 bp, Artificial Sequence
  chemically synthesized
tggtaaggatagtttctgtg

SEQ ID NO: 359165 - DNA, 20 bp, Artificial Sequence
  chemically synthesized
tgctcttctgcagagcttca

SEQ ID NO: 359166 - DNA, 20 bp, Artificial Sequence
  chemically synthesized
atagtttctgtgaagctctg

SEQ ID NO: 359167 - DNA, 20 bp, Artificial Sequence
  chemically synthesized
gtttctgtgaagctctgcag

SEQ ID NO: 359168 - DNA, 20 bp, Artificial Sequence
  chemically synthesized
ttctgtgaagctctgcagaa

SEQ ID NO: 359169 - DNA, 20 bp, Artificial Sequence
  chemically synthesized
tcttgctctgctcttctgca

SEQ ID NO: 359170 - DNA, 20 bp, Artificial Sequence
  chemically synthesized
gttcttgctctgctcttctg

SEQ ID NO: 359171 - DNA, 20 bp, Artificial Sequence
  chemically synthesized
tgtgaagctctgcagaagag

SEQ ID NO: 359172 - DNA, 20 bp, Artificial Sequence
  chemically synthesized
tgaagctctgcagaagagca

SEQ ID NO: 359173 - DNA, 20 bp, Artificial Sequence
  chemically synthesized
gctctgcagaagagcagagc

SEQ ID NO: 359174 - DNA, 20 bp, Artificial Sequence
  chemically synthesized
agagcaagaactgtcttgca

SEQ ID NO: 359175 - DNA, 20 bp, Artificial Sequence
  chemically synthesized
caagtcacttctgtgcaaga

SEQ ID NO: 359176 - DNA, 20 bp, Artificial Sequence
  chemically synthesized
gcaagaactgtcttgcacag

SEQ ID NO: 359177 - DNA, 20 bp, Artificial Sequence
  chemically synthesized
ctaccaagtcacttctgtgc

SEQ ID NO: 359178 - DNA, 20 bp, Artificial Sequence
  chemically synthesized
tgtcttgcacagaagtgact

SEQ ID NO: 359179 - DNA, 20 bp, Artificial Sequence
  chemically synthesized
cttgcacagaagtgacttgg

SEQ ID NO: 359180 - DNA, 20 bp, Artificial Sequence
  chemically synthesized
ttgcacagaagtgacttggt

SEQ ID NO: 359181 - DNA, 20 bp, Artificial Sequence
  chemically synthesized
cacagaagtgacttggtagg

SEQ ID NO: 359182 - DNA, 20 bp, Artificial Sequence
  chemically synthesized
acagaagtgacttggtaggc

SEQ ID NO: 359183 - DNA, 20 bp, Artificial Sequence
  chemically synthesized
cctgtaaattcctgcctacc

SEQ ID NO: 359184 - DNA, 20 bp, Artificial Sequence
  chemically synthesized
acttggtaggcaggaattta

SEQ ID NO: 359185 - DNA, 20 bp, Artificial Sequence
  chemically synthesized
cttggtaggcaggaatttac

SEQ ID NO: 359186 - DNA, 20 bp, Artificial Sequence
  chemically synthesized
ttggtaggcaggaatttaca

SEQ ID NO: 359187 - DNA, 20 bp, Artificial Sequence
  chemically synthesized
taggcaggaatttacaggga

SEQ ID NO: 359188 - DNA, 20 bp, Artificial Sequence
  chemically synthesized
gaatttacagggatggcttt

SEQ ID NO: 359189 - DNA, 20 bp, Artificial Sequence
  chemically synthesized
tttacagggatggctttcag

SEQ ID NO: 359190 - DNA, 20 bp, Artificial Sequence
  chemically synthesized
gatgacgttcgcactgctga

SEQ ID NO: 359191 - DNA, 20 bp, Artificial Sequence
  chemically synthesized
gatacaatttgcaattacag

SEQ ID NO: 359192 - DNA, 20 bp, Artificial Sequence
  chemically synthesized
ttgatacaatttgcaattac

SEQ ID NO: 359193 - DNA, 20 bp, Artificial Sequence
  chemically synthesized
attgatacaatttgcaatta

SEQ ID NO: 359194 - DNA, 20 bp, Artificial Sequence
  chemically synthesized
tcaataatatgaacattcta

SEQ ID NO: 359195 - DNA, 20 bp, Artificial Sequence
  chemically synthesized
atggcaacgctaattcactt

SEQ ID NO: 359196 - DNA, 20 bp, Artificial Sequence
  chemically synthesized
atgaacattctaaagtgaat

SEQ ID NO: 359197 - DNA, 20 bp, Artificial Sequence
  chemically synthesized
agtgaattagcgttgccatt

SEQ ID NO: 359198 - DNA, 20 bp, Artificial Sequence
  chemically synthesized
aattcaagggatgtacttaa

SEQ ID NO: 359199 - DNA, 20 bp, Artificial Sequence
  chemically synthesized
acttttactggacaattcaa

SEQ ID NO: 359200 - DNA, 20 bp, Artificial Sequence
  chemically synthesized
tacttttactggacaattca

SEQ ID NO: 359201 - DNA, 20 bp, Artificial Sequence
  chemically synthesized
atacttttactggacaattc

SEQ ID NO: 359202 - DNA, 20 bp, Artificial Sequence
  chemically synthesized
agtacatcccttgaattgtc

SEQ ID NO: 359203 - DNA, 20 bp, Artificial Sequence
  chemically synthesized
tcccttgaattgtccagtaa

SEQ ID NO: 359204 - DNA, 20 bp, Artificial Sequence
  chemically synthesized
agtcaggtccatacttttac

SEQ ID NO: 359205 - DNA, 20 bp, Artificial Sequence
  chemically synthesized
tgaattgtccagtaaaagta

SEQ ID NO: 359206 - DNA, 20 bp, Artificial Sequence
  chemically synthesized
gtggtgagctatcagaagtc

SEQ ID NO: 359207 - DNA, 20 bp, Artificial Sequence
  chemically synthesized
agtggtgagctatcagaagt

SEQ ID NO: 359208 - DNA, 20 bp, Artificial Sequence
  chemically synthesized
agtatggacctgacttctga

SEQ ID NO: 359209 - DNA, 20 bp, Artificial Sequence
  chemically synthesized
taacagtggtgagctatcag

SEQ ID NO: 359210 - DNA, 20 bp, Artificial Sequence
  chemically synthesized
tgctaacagtggtgagctat

SEQ ID NO: 359211 - DNA, 20 bp, Artificial Sequence
  chemically synthesized
caaatcttgctaacagtggt

SEQ ID NO: 359212 - DNA, 20 bp, Artificial Sequence
  chemically synthesized
ttctgatagctcaccactgt

SEQ ID NO: 359213 - DNA, 20 bp, Artificial Sequence
  chemically synthesized
ataacaaatcttgctaacag

SEQ ID NO: 359214 - DNA, 20 bp, Artificial Sequence
  chemically synthesized
gatagctcaccactgttagc

SEQ ID NO: 359215 - DNA, 20 bp, Artificial Sequence
  chemically synthesized
gtaataacaaatcttgctaa

SEQ ID NO: 359216 - DNA, 20 bp, Artificial Sequence
  chemically synthesized
gcaagatttgttattacaac

SEQ ID NO: 359217 - DNA, 20 bp, Artificial Sequence
  chemically synthesized
gatttgttattacaaccagc

SEQ ID NO: 359218 - DNA, 20 bp, Artificial Sequence
  chemically synthesized
acttggctctggcaaccagc

SEQ ID NO: 359219 - DNA, 20 bp, Artificial Sequence
  chemically synthesized
tattacaaccagctggttgc

SEQ ID NO: 359220 - DNA, 20 bp, Artificial Sequence
  chemically synthesized
ttacaaccagctggttgcca

SEQ ID NO: 359221 - DNA, 20 bp, Artificial Sequence
  chemically synthesized
ctaaacttggctctggcaac

SEQ ID NO: 359222 - DNA, 20 bp, Artificial Sequence
  chemically synthesized
accagctggttgccagagcc

SEQ ID NO: 359223 - DNA, 20 bp, Artificial Sequence
  chemically synthesized
cggagtgctaaacttggctc

SEQ ID NO: 359224 - DNA, 20 bp, Artificial Sequence
  chemically synthesized
ctggttgccagagccaagtt

SEQ ID NO: 359225 - DNA, 20 bp, Artificial Sequence
  chemically synthesized
ttttttcggagtgctaaact

SEQ ID NO: 359226 - DNA, 20 bp, Artificial Sequence
  chemically synthesized
gtgcaattctttttttttcg

SEQ ID NO: 359227 - DNA, 20 bp, Artificial Sequence
  chemically synthesized
gtttagcactccgaaaaaaa

SEQ ID NO: 359228 - DNA, 20 bp, Artificial Sequence
  chemically synthesized
aagtgcaattcttttttttt

SEQ ID NO: 359229 - DNA, 20 bp, Artificial Sequence
  chemically synthesized
aaaaaaaaagaattgcactt

SEQ ID NO: 359230 - DNA, 20 bp, Artificial Sequence
  chemically synthesized
aaaaaagaattgcacttaag

SEQ ID NO: 359231 - DNA, 20 bp, Artificial Sequence
  chemically synthesized
aaaaagaattgcacttaaga

SEQ ID NO: 359232 - DNA, 20 bp, Artificial Sequence
  chemically synthesized
aagaattgcacttaagaagg

SEQ ID NO: 359233 - DNA, 20 bp, Artificial Sequence
  chemically synthesized
gcatctttttcttccttctt

SEQ ID NO: 359234 - DNA, 20 bp, Artificial Sequence
  chemically synthesized
tgcacttaagaaggaagaaa

SEQ ID NO: 359235 - DNA, 20 bp, Artificial Sequence
  chemically synthesized
caaagcatataacatgtgtt

SEQ ID NO: 359236 - DNA, 20 bp, Artificial Sequence
  chemically synthesized
caggtttgaacaaaattgca

SEQ ID NO: 359237 - DNA, 20 bp, Artificial Sequence
  chemically synthesized
gcatattttgtaacataggc

SEQ ID NO: 359238 - DNA, 20 bp, Artificial Sequence
  chemically synthesized
cgcatattttgtaacatagg

SEQ ID NO: 359239 - DNA, 20 bp, Artificial Sequence
  chemically synthesized
taacgcatattttgtaacat

SEQ ID NO: 359240 - DNA, 20 bp, Artificial Sequence
  chemically synthesized
gtaacgcatattttgtaaca

SEQ ID NO: 359241 - DNA, 20 bp, Artificial Sequence
  chemically synthesized
caaaatatgcgttactgttt

SEQ ID NO: 359242 - DNA, 20 bp, Artificial Sequence
  chemically synthesized
aaaatatgcgttactgtttt

SEQ ID NO: 359243 - DNA, 20 bp, Artificial Sequence
  chemically synthesized
ataaaattgctagcctaaaa

SEQ ID NO: 359244 - DNA, 20 bp, Artificial Sequence
  chemically synthesized
tatgcgttactgttttaggc

SEQ ID NO: 359245 - DNA, 20 bp, Artificial Sequence
  chemically synthesized
tccatctcaaataaaattgc

SEQ ID NO: 359246 - DNA, 20 bp, Artificial Sequence
  chemically synthesized
ttaggctagcaattttattt

SEQ ID NO: 359247 - DNA, 20 bp, Artificial Sequence
  chemically synthesized
gctagcaattttatttgaga

SEQ ID NO: 359248 - DNA, 20 bp, Artificial Sequence
  chemically synthesized
gcaattttatttgagatgga

SEQ ID NO: 359249 - DNA, 20 bp, Artificial Sequence
  chemically synthesized
attttatttgagatggacag

SEQ ID NO: 359250 - DNA, 20 bp, Artificial Sequence
  chemically synthesized
tgagatggacagtagaaaaa

SEQ ID NO: 359251 - DNA, 20 bp, Artificial Sequence
  chemically synthesized
ggacagtagaaaaacagtaa

SEQ ID NO: 359252 - DNA, 20 bp, Artificial Sequence
  chemically synthesized
gacagtagaaaaacagtaat

SEQ ID NO: 359253 - DNA, 20 bp, Artificial Sequence
  chemically synthesized
gaaaaacagtaataggaaaa

SEQ ID NO: 359254 - DNA, 20 bp, Artificial Sequence
  chemically synthesized
aaaacagtaataggaaaaca

SEQ ID NO: 359255 - DNA, 20 bp, Artificial Sequence
  chemically synthesized
aaaacagagtttgcattcct

SEQ ID NO: 359256 - DNA, 20 bp, Artificial Sequence
  chemically synthesized
cattgaacttgtgaaaactc

SEQ ID NO: 359257 - DNA, 20 bp, Artificial Sequence
  chemically synthesized
tcattgaacttgtgaaaact

SEQ ID NO: 359258 - DNA, 20 bp, Artificial Sequence
  chemically synthesized
ttgcattcctgagttttcac

SEQ ID NO: 359259 - DNA, 20 bp, Artificial Sequence
  chemically synthesized
tgagttttcacaagttcaat

SEQ ID NO: 359260 - DNA, 20 bp, Artificial Sequence
  chemically synthesized
gttttcacaagttcaatgag

SEQ ID NO: 359261 - DNA, 20 bp, Artificial Sequence
  chemically synthesized
gttcaatgagaagtcctcca

SEQ ID NO: 359262 - DNA, 20 bp, Artificial Sequence
  chemically synthesized
tgttattaatagtgccatgg

SEQ ID NO: 359263 - DNA, 20 bp, Artificial Sequence
  chemically synthesized
atgttattaatagtgccatg

SEQ ID NO: 359264 - DNA, 20 bp, Artificial Sequence
  chemically synthesized
ctatgttattaatagtgcca

SEQ ID NO: 359265 - DNA, 20 bp, Artificial Sequence
  chemically synthesized
gcaacatactatgttattaa

SEQ ID NO: 359266 - DNA, 20 bp, Artificial Sequence
  chemically synthesized
ccatggcactattaataaca

SEQ ID NO: 359267 - DNA, 20 bp, Artificial Sequence
  chemically synthesized
aataacatagtatgttgcat

SEQ ID NO: 359268 - DNA, 20 bp, Artificial Sequence
  chemically synthesized
atagtatgttgcattagaaa

SEQ ID NO: 359269 - DNA, 20 bp, Artificial Sequence
  chemically synthesized
tagtatgttgcattagaaaa

SEQ ID NO: 359270 - DNA, 20 bp, Artificial Sequence
  chemically synthesized
agtatgttgcattagaaaaa

SEQ ID NO: 359271 - DNA, 20 bp, Artificial Sequence
  chemically synthesized
gtatgttgcattagaaaaag

SEQ ID NO: 359272 - DNA, 20 bp, Artificial Sequence
  chemically synthesized
attagaaaaaggggccaaca

SEQ ID NO: 359273 - DNA, 20 bp, Artificial Sequence
  chemically synthesized
atttacagatagaaccatgt

SEQ ID NO: 359274 - DNA, 20 bp, Artificial Sequence
  chemically synthesized
taacgagcggcatttacaga

SEQ ID NO: 359275 - DNA, 20 bp, Artificial Sequence
  chemically synthesized
cagataacgagcggcattta

SEQ ID NO: 359276 - DNA, 20 bp, Artificial Sequence
  chemically synthesized
tagatctatcagataacgag

SEQ ID NO: 359277 - DNA, 20 bp, Artificial Sequence
  chemically synthesized
ttctagatctatcagataac

SEQ ID NO: 359278 - DNA, 20 bp, Artificial Sequence
  chemically synthesized
aaatgccgctcgttatctga

SEQ ID NO: 359279 - DNA, 20 bp, Artificial Sequence
  chemically synthesized
cgctcgttatctgatagatc

SEQ ID NO: 359280 - DNA, 20 bp, Artificial Sequence
  chemically synthesized
aatgtacattctagatctat

SEQ ID NO: 359281 - DNA, 20 bp, Artificial Sequence
  chemically synthesized
ggtcaacttaatgtacattc

SEQ ID NO: 359282 - DNA, 20 bp, Artificial Sequence
  chemically synthesized
atagatctagaatgtacatt

SEQ ID NO: 359283 - DNA, 20 bp, Artificial Sequence
  chemically synthesized
gcaaagattaaaggacattt

SEQ ID NO: 359284 - DNA, 20 bp, Artificial Sequence
  chemically synthesized
tgaatttcagcaaagattaa

SEQ ID NO: 359285 - DNA, 20 bp, Artificial Sequence
  chemically synthesized
ttgaatttcagcaaagatta

SEQ ID NO: 359286 - DNA, 20 bp, Artificial Sequence
  chemically synthesized
gaagcccttgaatttcagca

SEQ ID NO: 359287 - DNA, 20 bp, Artificial Sequence
  chemically synthesized
tttaatctttgctgaaattc

SEQ ID NO: 359288 - DNA, 20 bp, Artificial Sequence
  chemically synthesized
ttaatctttgctgaaattca

SEQ ID NO: 359289 - DNA, 20 bp, Artificial Sequence
  chemically synthesized
tggtagaagcccttgaattt

SEQ ID NO: 359290 - DNA, 20 bp, Artificial Sequence
  chemically synthesized
taatctttgctgaaattcaa

SEQ ID NO: 359291 - DNA, 20 bp, Artificial Sequence
  chemically synthesized
ttcttcctattaaatggtag

SEQ ID NO: 359292 - DNA, 20 bp, Artificial Sequence
  chemically synthesized
attttcttcctattaaatgg

SEQ ID NO: 359293 - DNA, 20 bp, Artificial Sequence
  chemically synthesized
caagggcttctaccatttaa

SEQ ID NO: 359294 - DNA, 20 bp, Artificial Sequence
  chemically synthesized
aagggcttctaccatttaat

SEQ ID NO: 359295 - DNA, 20 bp, Artificial Sequence
  chemically synthesized
catattttcttcctattaaa

SEQ ID NO: 359296 - DNA, 20 bp, Artificial Sequence
  chemically synthesized
ggcttctaccatttaatagg

SEQ ID NO: 359297 - DNA, 20 bp, Artificial Sequence
  chemically synthesized
aggaagaaaatatgtaatgt

SEQ ID NO: 359298 - DNA, 20 bp, Artificial Sequence
  chemically synthesized
gtgtaaaaaaaaaaaaaaaa

SEQ ID NO: 359299 - DNA, 20 bp, Artificial Sequence
  chemically synthesized
aaaaaagaaaaacacatttt

SEQ ID NO: 359300 - DNA, 20 bp, Artificial Sequence
  chemically synthesized
aaacacatttttagattcac

SEQ ID NO: 359301 - DNA, 20 bp, Artificial Sequence
  chemically synthesized
gctcagtgttcatcataatc

SEQ ID NO: 359302 - DNA, 20 bp, Artificial Sequence
  chemically synthesized
actggattatgatgaacact

SEQ ID NO: 359303 - DNA, 20 bp, Artificial Sequence
  chemically synthesized
gattatgatgaacactgagc

SEQ ID NO: 359304 - DNA, 20 bp, Artificial Sequence
  chemically synthesized
ctttgaaaaattatcttgct

SEQ ID NO: 359305 - DNA, 20 bp, Artificial Sequence
  chemically synthesized
ctgagcaagataatttttca

SEQ ID NO: 359306 - DNA, 20 bp, Artificial Sequence
  chemically synthesized
atttttcaaagtgtgcttaa

SEQ ID NO: 359307 - DNA, 20 bp, Artificial Sequence
  chemically synthesized
tgccctgttctaaaactatt

SEQ ID NO: 359308 - DNA, 20 bp, Artificial Sequence
  chemically synthesized
caaagtgtgcttaatagttt

SEQ ID NO: 359309 - DNA, 20 bp, Artificial Sequence
  chemically synthesized
tgtgcttaatagttttagaa

SEQ ID NO: 359310 - DNA, 20 bp, Artificial Sequence
  chemically synthesized
gtgcttaatagttttagaac

SEQ ID NO: 359311 - DNA, 20 bp, Artificial Sequence
  chemically synthesized
tgcttaatagttttagaaca

SEQ ID NO: 359312 - DNA, 20 bp, Artificial Sequence
  chemically synthesized
ttaatagttttagaacaggg

SEQ ID NO: 359313 - DNA, 20 bp, Artificial Sequence
  chemically synthesized
agaacagggcagtgtgatat

SEQ ID NO: 359314 - DNA, 20 bp, Artificial Sequence
  chemically synthesized
aacagggcagtgtgatataa

SEQ ID NO: 359315 - DNA, 20 bp, Artificial Sequence
  chemically synthesized
cagggcagtgtgatataaga

SEQ ID NO: 359316 - DNA, 20 bp, Artificial Sequence
  chemically synthesized
cagtgtgatataagagagat

SEQ ID NO: 359317 - DNA, 20 bp, Artificial Sequence
  chemically synthesized
tgatataagagagatgagat

SEQ ID NO: 359318 - DNA, 20 bp, Artificial Sequence
  chemically synthesized
ataagagagatgagataagt

SEQ ID NO: 359319 - DNA, 20 bp, Artificial Sequence
  chemically synthesized
agagagatgagataagtaag

SEQ ID NO: 359320 - DNA, 20 bp, Artificial Sequence
  chemically synthesized
agagatgagataagtaagca

SEQ ID NO: 359321 - DNA, 20 bp, Artificial Sequence
  chemically synthesized
gagatgagataagtaagcag

SEQ ID NO: 359322 - DNA, 20 bp, Artificial Sequence
  chemically synthesized
tgagataagtaagcagaggc

SEQ ID NO: 359323 - DNA, 20 bp, Artificial Sequence
  chemically synthesized
gagataagtaagcagaggct

SEQ ID NO: 359324 - DNA, 20 bp, Artificial Sequence
  chemically synthesized
ataagtaagcagaggctggg

SEQ ID NO: 359325 - DNA, 20 bp, Artificial Sequence
  chemically synthesized
aagtaagcagaggctgggaa

SEQ ID NO: 359326 - DNA, 20 bp, Artificial Sequence
  chemically synthesized
gcaagactgtagactcttcc

SEQ ID NO: 359327 - DNA, 20 bp, Artificial Sequence
  chemically synthesized
cagaggctgggaagagtcta

SEQ ID NO: 359328 - DNA, 20 bp, Artificial Sequence
  chemically synthesized
tccttgagactgcaagactg

SEQ ID NO: 359329 - DNA, 20 bp, Artificial Sequence
  chemically synthesized
gggaagagtctacagtcttg

SEQ ID NO: 359330 - DNA, 20 bp, Artificial Sequence
  chemically synthesized
caccatatccttgagactgc

SEQ ID NO: 359331 - DNA, 20 bp, Artificial Sequence
  chemically synthesized
gtctacagtcttgcagtctc

SEQ ID NO: 359332 - DNA, 20 bp, Artificial Sequence
  chemically synthesized
tctacagtcttgcagtctca

SEQ ID NO: 359333 - DNA, 20 bp, Artificial Sequence
  chemically synthesized
gtcttgcagtctcaaggata

SEQ ID NO: 359334 - DNA, 20 bp, Artificial Sequence
  chemically synthesized
ccttgaatcaccatatcctt

SEQ ID NO: 359335 - DNA, 20 bp, Artificial Sequence
  chemically synthesized
tctcaaggatatggtgattc

SEQ ID NO: 359336 - DNA, 20 bp, Artificial Sequence
  chemically synthesized
ctcaaggatatggtgattca

SEQ ID NO: 359337 - DNA, 20 bp, Artificial Sequence
  chemically synthesized
tcaaggatatggtgattcaa

SEQ ID NO: 359338 - DNA, 20 bp, Artificial Sequence
  chemically synthesized
agggcataaatgaaaaacaa

SEQ ID NO: 359339 - DNA, 20 bp, Artificial Sequence
  chemically synthesized
gggcataaatgaaaaacaac

SEQ ID NO: 359340 - DNA, 20 bp, Artificial Sequence
  chemically synthesized
aatgaaaaacaacaggctat

SEQ ID NO: 359341 - DNA, 20 bp, Artificial Sequence
  chemically synthesized
tgaaaaacaacaggctataa

SEQ ID NO: 359342 - DNA, 20 bp, Artificial Sequence
  chemically synthesized
aaaaacaacaggctataaga

SEQ ID NO: 359343 - DNA, 20 bp, Artificial Sequence
  chemically synthesized
aaaacaacaggctataagag

SEQ ID NO: 359344 - DNA, 20 bp, Artificial Sequence
  chemically synthesized
tttgtctgagacctctctta

SEQ ID NO: 359345 - DNA, 20 bp, Artificial Sequence
  chemically synthesized
acaggctataagagaggtct

SEQ ID NO: 359346 - DNA, 20 bp, Artificial Sequence
  chemically synthesized
tataagagaggtctcagaca

SEQ ID NO: 359347 - DNA, 20 bp, Artificial Sequence
  chemically synthesized
ttttaaatctttctttgtct

SEQ ID NO: 359348 - DNA, 20 bp, Artificial Sequence
  chemically synthesized
agagaggtctcagacaaaga

SEQ ID NO: 359349 - DNA, 20 bp, Artificial Sequence
  chemically synthesized
cagacaaagaaagatttaaa

SEQ ID NO: 359350 - DNA, 20 bp, Artificial Sequence
  chemically synthesized
ttgcaatgaggaatatcaga

SEQ ID NO: 359351 - DNA, 20 bp, Artificial Sequence
  chemically synthesized
tttgcaatgaggaatatcag

SEQ ID NO: 359352 - DNA, 20 bp, Artificial Sequence
  chemically synthesized
gcttttgcaatgaggaatat

SEQ ID NO: 359353 - DNA, 20 bp, Artificial Sequence
  chemically synthesized
gtggaggcgcttttgcaatg

SEQ ID NO: 359354 - DNA, 20 bp, Artificial Sequence
  chemically synthesized
tctgatattcctcattgcaa

SEQ ID NO: 359355 - DNA, 20 bp, Artificial Sequence
  chemically synthesized
tgtggaggcgcttttgcaat

SEQ ID NO: 359356 - DNA, 20 bp, Artificial Sequence
  chemically synthesized
ttttcattattagcatgtgg

SEQ ID NO: 359357 - DNA, 20 bp, Artificial Sequence
  chemically synthesized
tttttcattattagcatgtg

SEQ ID NO: 359358 - DNA, 20 bp, Artificial Sequence
  chemically synthesized
catttttcattattagcatg

SEQ ID NO: 359359 - DNA, 20 bp, Artificial Sequence
  chemically synthesized
cccagcccatttttcattat

SEQ ID NO: 359360 - DNA, 20 bp, Artificial Sequence
  chemically synthesized
cacatgctaataatgaaaaa

SEQ ID NO: 359361 - DNA, 20 bp, Artificial Sequence
  chemically synthesized
acatgctaataatgaaaaat

SEQ ID NO: 359362 - DNA, 20 bp, Artificial Sequence
  chemically synthesized
gctaataatgaaaaatgggc

SEQ ID NO: 359363 - DNA, 20 bp, Artificial Sequence
  chemically synthesized
ctaataatgaaaaatgggct

SEQ ID NO: 359364 - DNA, 20 bp, Artificial Sequence
  chemically synthesized
aatgaaaaatgggctgggtg

SEQ ID NO: 359365 - DNA, 20 bp, Artificial Sequence
  chemically synthesized
gaaaaatgggctgggtgcgg

SEQ ID NO: 359366 - DNA, 20 bp, Artificial Sequence
  chemically synthesized
caggcgtgagccaccgcacc

SEQ ID NO: 359367 - DNA, 20 bp, Artificial Sequence
  chemically synthesized
agtgtttggattacaggcgt

SEQ ID NO: 359368 - DNA, 20 bp, Artificial Sequence
  chemically synthesized
tcccaaagtgtttggattac

SEQ ID NO: 359369 - DNA, 20 bp, Artificial Sequence
  chemically synthesized
ctcccaaagtgtttggatta

SEQ ID NO: 359370 - DNA, 20 bp, Artificial Sequence
  chemically synthesized
cgcctgtaatccaaacactt

SEQ ID NO: 359371 - DNA, 20 bp, Artificial Sequence
  chemically synthesized
tctcggcctcccaaagtgtt

SEQ ID NO: 359372 - DNA, 20 bp, Artificial Sequence
  chemically synthesized
gcctgtaatccaaacacttt

SEQ ID NO: 359373 - DNA, 20 bp, Artificial Sequence
  chemically synthesized
ctgtaatccaaacactttgg

SEQ ID NO: 359374 - DNA, 20 bp, Artificial Sequence
  chemically synthesized
tgtaatccaaacactttggg

SEQ ID NO: 359375 - DNA, 20 bp, Artificial Sequence
  chemically synthesized
ccgcccgtctcggcctccca

SEQ ID NO: 359376 - DNA, 20 bp, Artificial Sequence
  chemically synthesized
tccaaacactttgggaggcc

SEQ ID NO: 359377 - DNA, 20 bp, Artificial Sequence
  chemically synthesized
aacactttgggaggccgaga

SEQ ID NO: 359378 - DNA, 20 bp, Artificial Sequence
  chemically synthesized
acactttgggaggccgagac

SEQ ID NO: 359379 - DNA, 20 bp, Artificial Sequence
  chemically synthesized
ctttgggaggccgagacggg

SEQ ID NO: 359380 - DNA, 20 bp, Artificial Sequence
  chemically synthesized
accttgtgatccgcccgtct

SEQ ID NO: 359381 - DNA, 20 bp, Artificial Sequence
  chemically synthesized
ggccgagacgggcggatcac

SEQ ID NO: 359382 - DNA, 20 bp, Artificial Sequence
  chemically synthesized
gccgagacgggcggatcaca

SEQ ID NO: 359383 - DNA, 20 bp, Artificial Sequence
  chemically synthesized
agacgggcggatcacaaggt

SEQ ID NO: 359384 - DNA, 20 bp, Artificial Sequence
  chemically synthesized
gacgggcggatcacaaggtc

SEQ ID NO: 359385 - DNA, 20 bp, Artificial Sequence
  chemically synthesized
cgggcggatcacaaggtcag

SEQ ID NO: 359386 - DNA, 20 bp, Artificial Sequence
  chemically synthesized
gatcacaaggtcaggagatc

SEQ ID NO: 359387 - DNA, 20 bp, Artificial Sequence
  chemically synthesized
tcaggagatcgagaccatcc

SEQ ID NO: 359388 - DNA, 20 bp, Artificial Sequence
  chemically synthesized
tttcaccgtgttagccagga

SEQ ID NO: 359389 - DNA, 20 bp, Artificial Sequence
  chemically synthesized
ggggtttcaccgtgttagcc

SEQ ID NO: 359390 - DNA, 20 bp, Artificial Sequence
  chemically synthesized
cgagaccatcctggctaaca

SEQ ID NO: 359391 - DNA, 20 bp, Artificial Sequence
  chemically synthesized
tggggtttcaccgtgttagc

SEQ ID NO: 359392 - DNA, 20 bp, Artificial Sequence
  chemically synthesized
gagatggggtttcaccgtgt

SEQ ID NO: 359393 - DNA, 20 bp, Artificial Sequence
  chemically synthesized
tattttgttcagtagagatg

SEQ ID NO: 359394 - DNA, 20 bp, Artificial Sequence
  chemically synthesized
gtattttgttcagtagagat

SEQ ID NO: 359395 - DNA, 20 bp, Artificial Sequence
  chemically synthesized
tgtattttgttcagtagaga

SEQ ID NO: 359396 - DNA, 20 bp, Artificial Sequence
  chemically synthesized
tttttgtattttgttcagta

SEQ ID NO: 359397 - DNA, 20 bp, Artificial Sequence
  chemically synthesized
attttttgtattttgttcag

SEQ ID NO: 359398 - DNA, 20 bp, Artificial Sequence
  chemically synthesized
ctaattttttgtattttgtt

SEQ ID NO: 359399 - DNA, 20 bp, Artificial Sequence
  chemically synthesized
ctgaacaaaatacaaaaaat

SEQ ID NO: 359400 - DNA, 20 bp, Artificial Sequence
  chemically synthesized
acaaaatacaaaaaattagc

SEQ ID NO: 359401 - DNA, 20 bp, Artificial Sequence
  chemically synthesized
caaaatacaaaaaattagcc

SEQ ID NO: 359402 - DNA, 20 bp, Artificial Sequence
  chemically synthesized
tacaaaaaattagccgggcg

SEQ ID NO: 359403 - DNA, 20 bp, Artificial Sequence
  chemically synthesized
aaaaaattagccgggcgtgg

SEQ ID NO: 359404 - DNA, 20 bp, Artificial Sequence
  chemically synthesized
caggcgcccgccaccacgcc

SEQ ID NO: 359405 - DNA, 20 bp, Artificial Sequence
  chemically synthesized
aaattagccgggcgtggtgg

SEQ ID NO: 359406 - DNA, 20 bp, Artificial Sequence
  chemically synthesized
aattagccgggcgtggtggc

SEQ ID NO: 359407 - DNA, 20 bp, Artificial Sequence
  chemically synthesized
ggcgtggtggcgggcgcctg

SEQ ID NO: 359408 - DNA, 20 bp, Artificial Sequence
  chemically synthesized
gtggcgggcgcctgtagtcc

SEQ ID NO: 359409 - DNA, 20 bp, Artificial Sequence
  chemically synthesized
tcccaagtagctgggactac

SEQ ID NO: 359410 - DNA, 20 bp, Artificial Sequence
  chemically synthesized
ctcccaagtagctgggacta

SEQ ID NO: 359411 - DNA, 20 bp, Artificial Sequence
  chemically synthesized
cgcctgtagtcccagctact

SEQ ID NO: 359412 - DNA, 20 bp, Artificial Sequence
  chemically synthesized
cctcagcctcccaagtagct

SEQ ID NO: 359413 - DNA, 20 bp, Artificial Sequence
  chemically synthesized
gcctgtagtcccagctactt

SEQ ID NO: 359414 - DNA, 20 bp, Artificial Sequence
  chemically synthesized
gcctcagcctcccaagtagc

SEQ ID NO: 359415 - DNA, 20 bp, Artificial Sequence
  chemically synthesized
ctgtagtcccagctacttgg

SEQ ID NO: 359416 - DNA, 20 bp, Artificial Sequence
  chemically synthesized
tgtagtcccagctacttggg

SEQ ID NO: 359417 - DNA, 20 bp, Artificial Sequence
  chemically synthesized
tcttgcctcagcctcccaag

SEQ ID NO: 359418 - DNA, 20 bp, Artificial Sequence
  chemically synthesized
ttctcttgcctcagcctccc

SEQ ID NO: 359419 - DNA, 20 bp, Artificial Sequence
  chemically synthesized
tcccagctacttgggaggct

SEQ ID NO: 359420 - DNA, 20 bp, Artificial Sequence
  chemically synthesized
cccagctacttgggaggctg

SEQ ID NO: 359421 - DNA, 20 bp, Artificial Sequence
  chemically synthesized
gctacttgggaggctgaggc

SEQ ID NO: 359422 - DNA, 20 bp, Artificial Sequence
  chemically synthesized
tacttgggaggctgaggcaa

SEQ ID NO: 359423 - DNA, 20 bp, Artificial Sequence
  chemically synthesized
ttcatgccattctcttgcct

SEQ ID NO: 359424 - DNA, 20 bp, Artificial Sequence
  chemically synthesized
gggaggctgaggcaagagaa

SEQ ID NO: 359425 - DNA, 20 bp, Artificial Sequence
  chemically synthesized
gcaagagaatggcatgaacc

SEQ ID NO: 359426 - DNA, 20 bp, Artificial Sequence
  chemically synthesized
caagagaatggcatgaaccc

SEQ ID NO: 359427 - DNA, 20 bp, Artificial Sequence
  chemically synthesized
agagaatggcatgaacccag

SEQ ID NO: 359428 - DNA, 20 bp, Artificial Sequence
  chemically synthesized
gagaatggcatgaacccagg

SEQ ID NO: 359429 - DNA, 20 bp, Artificial Sequence
  chemically synthesized
aatggcatgaacccaggagg

SEQ ID NO: 359430 - DNA, 20 bp, Artificial Sequence
  chemically synthesized
cactgcaagctccgcctcct

SEQ ID NO: 359431 - DNA, 20 bp, Artificial Sequence
  chemically synthesized
tggcatgaacccaggaggcg

SEQ ID NO: 359432 - DNA, 20 bp, Artificial Sequence
  chemically synthesized
tcactgcaagctccgcctcc

SEQ ID NO: 359433 - DNA, 20 bp, Artificial Sequence
  chemically synthesized
aacccaggaggcggagcttg

SEQ ID NO: 359434 - DNA, 20 bp, Artificial Sequence
  chemically synthesized
caggaggcggagcttgcagt

SEQ ID NO: 359435 - DNA, 20 bp, Artificial Sequence
  chemically synthesized
gcgcgatctctgctcactgc

SEQ ID NO: 359436 - DNA, 20 bp, Artificial Sequence
  chemically synthesized
gaggcggagcttgcagtgag

SEQ ID NO: 359437 - DNA, 20 bp, Artificial Sequence
  chemically synthesized
ggcggagcttgcagtgagca

SEQ ID NO: 359438 - DNA, 20 bp, Artificial Sequence
  chemically synthesized
tcacccaggctggagtgcag

SEQ ID NO: 359439 - DNA, 20 bp, Artificial Sequence
  chemically synthesized
gagatcgcgccactgcactc

SEQ ID NO: 359440 - DNA, 20 bp, Artificial Sequence
  chemically synthesized
ctgtcacccaggctggagtg

SEQ ID NO: 359441 - DNA, 20 bp, Artificial Sequence
  chemically synthesized
cgcgccactgcactccagcc

SEQ ID NO: 359442 - DNA, 20 bp, Artificial Sequence
  chemically synthesized
gcgccactgcactccagcct

SEQ ID NO: 359443 - DNA, 20 bp, Artificial Sequence
  chemically synthesized
tcgctctgtcacccaggctg

SEQ ID NO: 359444 - DNA, 20 bp, Artificial Sequence
  chemically synthesized
tctcgctctgtcacccaggc

SEQ ID NO: 359445 - DNA, 20 bp, Artificial Sequence
  chemically synthesized
ctgcactccagcctgggtga

SEQ ID NO: 359446 - DNA, 20 bp, Artificial Sequence
  chemically synthesized
agagtctcgctctgtcaccc

SEQ ID NO: 359447 - DNA, 20 bp, Artificial Sequence
  chemically synthesized
gcactccagcctgggtgaca

SEQ ID NO: 359448 - DNA, 20 bp, Artificial Sequence
  chemically synthesized
cagagtctcgctctgtcacc

SEQ ID NO: 359449 - DNA, 20 bp, Artificial Sequence
  chemically synthesized
tccagcctgggtgacagagc

SEQ ID NO: 359450 - DNA, 20 bp, Artificial Sequence
  chemically synthesized
tattttttatttttgagaca

SEQ ID NO: 359451 - DNA, 20 bp, Artificial Sequence
  chemically synthesized
tttattttttatttttgaga

SEQ ID NO: 359452 - DNA, 20 bp, Artificial Sequence
  chemically synthesized
tttttttattttttattttt

SEQ ID NO: 359453 - DNA, 20 bp, Artificial Sequence
  chemically synthesized
ataataaatgaacaacttgc

SEQ ID NO: 359454 - DNA, 20 bp, Artificial Sequence
  chemically synthesized
taaatgaacaacttgcaagc

SEQ ID NO: 359455 - DNA, 20 bp, Artificial Sequence
  chemically synthesized
taatttcttcacttgcttgc

SEQ ID NO: 359456 - DNA, 20 bp, Artificial Sequence
  chemically synthesized
gaacaacttgcaagcaagtg

SEQ ID NO: 359457 - DNA, 20 bp, Artificial Sequence
  chemically synthesized
caagcaagtgaagaaattat

SEQ ID NO: 359458 - DNA, 20 bp, Artificial Sequence
  chemically synthesized
gaagaaattatcagacataa

SEQ ID NO: 359459 - DNA, 20 bp, Artificial Sequence
  chemically synthesized
atcagacataatagtcttga

SEQ ID NO: 359460 - DNA, 20 bp, Artificial Sequence
  chemically synthesized
ctagtccaagataagctttc

SEQ ID NO: 359461 - DNA, 20 bp, Artificial Sequence
  chemically synthesized
atagtcttgaaagcttatct

SEQ ID NO: 359462 - DNA, 20 bp, Artificial Sequence
  chemically synthesized
catctgaactagtccaagat

SEQ ID NO: 359463 - DNA, 20 bp, Artificial Sequence
  chemically synthesized
cttgaaagcttatcttggac

SEQ ID NO: 359464 - DNA, 20 bp, Artificial Sequence
  chemically synthesized
aactccatctgaactagtcc

SEQ ID NO: 359465 - DNA, 20 bp, Artificial Sequence
  chemically synthesized
aagcttatcttggactagtt

SEQ ID NO: 359466 - DNA, 20 bp, Artificial Sequence
  chemically synthesized
ttatcttggactagttcaga

SEQ ID NO: 359467 - DNA, 20 bp, Artificial Sequence
  chemically synthesized
ctttccaactccatctgaac

SEQ ID NO: 359468 - DNA, 20 bp, Artificial Sequence
  chemically synthesized
atcttggactagttcagatg

SEQ ID NO: 359469 - DNA, 20 bp, Artificial Sequence
  chemically synthesized
tggactagttcagatggagt

SEQ ID NO: 359470 - DNA, 20 bp, Artificial Sequence
  chemically synthesized
ctagttcagatggagttgga

SEQ ID NO: 359471 - DNA, 20 bp, Artificial Sequence
  chemically synthesized
tagttcagatggagttggaa

SEQ ID NO: 359472 - DNA, 20 bp, Artificial Sequence
  chemically synthesized
agttcagatggagttggaaa

SEQ ID NO: 359473 - DNA, 20 bp, Artificial Sequence
  chemically synthesized
gatggagttggaaagggctt

SEQ ID NO: 359474 - DNA, 20 bp, Artificial Sequence
  chemically synthesized
atggagttggaaagggcttc

SEQ ID NO: 359475 - DNA, 20 bp, Artificial Sequence
  chemically synthesized
ccatttttaaaaatatcctg

SEQ ID NO: 359476 - DNA, 20 bp, Artificial Sequence
  chemically synthesized
cttcaggatatttttaaaaa

SEQ ID NO: 359477 - DNA, 20 bp, Artificial Sequence
  chemically synthesized
aggatatttttaaaaatggt

SEQ ID NO: 359478 - DNA, 20 bp, Artificial Sequence
  chemically synthesized
taaaaatggtaagatcatat

SEQ ID NO: 359479 - DNA, 20 bp, Artificial Sequence
  chemically synthesized
aaatggtaagatcatataag

SEQ ID NO: 359480 - DNA, 20 bp, Artificial Sequence
  chemically synthesized
tggtaagatcatataagaag

SEQ ID NO: 359481 - DNA, 20 bp, Artificial Sequence
  chemically synthesized
agtagtataaacaataaata

SEQ ID NO: 359482 - DNA, 20 bp, Artificial Sequence
  chemically synthesized
tataaacaataaatacagtt

SEQ ID NO: 359483 - DNA, 20 bp, Artificial Sequence
  chemically synthesized
taaacaataaatacagttca

SEQ ID NO: 359484 - DNA, 20 bp, Artificial Sequence
  chemically synthesized
atacagttcagagtgccttt

SEQ ID NO: 359485 - DNA, 20 bp, Artificial Sequence
  chemically synthesized
acagttcagagtgccttttg

SEQ ID NO: 359486 - DNA, 20 bp, Artificial Sequence
  chemically synthesized
agcatgcacagagctccaaa

SEQ ID NO: 359487 - DNA, 20 bp, Artificial Sequence
  chemically synthesized
aagcatgcacagagctccaa

SEQ ID NO: 359488 - DNA, 20 bp, Artificial Sequence
  chemically synthesized
gaagaactcaagcatgcaca

SEQ ID NO: 359489 - DNA, 20 bp, Artificial Sequence
  chemically synthesized
cagaagaactcaagcatgca

SEQ ID NO: 359490 - DNA, 20 bp, Artificial Sequence
  chemically synthesized
ttggagctctgtgcatgctt

SEQ ID NO: 359491 - DNA, 20 bp, Artificial Sequence
  chemically synthesized
caaagccagcagaagaactc

SEQ ID NO: 359492 - DNA, 20 bp, Artificial Sequence
  chemically synthesized
gcatgcttgagttcttctgc

SEQ ID NO: 359493 - DNA, 20 bp, Artificial Sequence
  chemically synthesized
agttttgacaaagccagcag

SEQ ID NO: 359494 - DNA, 20 bp, Artificial Sequence
  chemically synthesized
gtaagttttgacaaagccag

SEQ ID NO: 359495 - DNA, 20 bp, Artificial Sequence
  chemically synthesized
gatgtaagttttgacaaagc

SEQ ID NO: 359496 - DNA, 20 bp, Artificial Sequence
  chemically synthesized
gacagatgtaagttttgaca

SEQ ID NO: 359497 - DNA, 20 bp, Artificial Sequence
  chemically synthesized
gctttgcgtaagacagatgt

SEQ ID NO: 359498 - DNA, 20 bp, Artificial Sequence
  chemically synthesized
agatcccgctttgcgtaaga

SEQ ID NO: 359499 - DNA, 20 bp, Artificial Sequence
  chemically synthesized
acttacatctgtcttacgca

SEQ ID NO: 359500 - DNA, 20 bp, Artificial Sequence
  chemically synthesized
ttgcagatcccgctttgcgt

SEQ ID NO: 359501 - DNA, 20 bp, Artificial Sequence
  chemically synthesized
tacatctgtcttacgcaaag

SEQ ID NO: 359502 - DNA, 20 bp, Artificial Sequence
  chemically synthesized
acatctgtcttacgcaaagc

SEQ ID NO: 359503 - DNA, 20 bp, Artificial Sequence
  chemically synthesized
gcaaagcgggatctgcaaac

SEQ ID NO: 359504 - DNA, 20 bp, Artificial Sequence
  chemically synthesized
cctagagtgaatccagtttg

SEQ ID NO: 359505 - DNA, 20 bp, Artificial Sequence
  chemically synthesized
aataattcctagagtgaatc

SEQ ID NO: 359506 - DNA, 20 bp, Artificial Sequence
  chemically synthesized
tctgcaaactggattcactc

SEQ ID NO: 359507 - DNA, 20 bp, Artificial Sequence
  chemically synthesized
ctgcaaactggattcactct

SEQ ID NO: 359508 - DNA, 20 bp, Artificial Sequence
  chemically synthesized
atagtaacaaataattccta

SEQ ID NO: 359509 - DNA, 20 bp, Artificial Sequence
  chemically synthesized
gcatagtaacaaataattcc

SEQ ID NO: 359510 - DNA, 20 bp, Artificial Sequence
  chemically synthesized
attatttgttactatgccat

SEQ ID NO: 359511 - DNA, 20 bp, Artificial Sequence
  chemically synthesized
gttgactttatcttatggca

SEQ ID NO: 359512 - DNA, 20 bp, Artificial Sequence
  chemically synthesized
tgttactatgccataagata

SEQ ID NO: 359513 - DNA, 20 bp, Artificial Sequence
  chemically synthesized
gaattgttgactttatctta

SEQ ID NO: 359514 - DNA, 20 bp, Artificial Sequence
  chemically synthesized
ataagataaagtcaacaatt

SEQ ID NO: 359515 - DNA, 20 bp, Artificial Sequence
  chemically synthesized
aagataaagtcaacaattca

SEQ ID NO: 359516 - DNA, 20 bp, Artificial Sequence
  chemically synthesized
tcaacaattcagagtgcatc

SEQ ID NO: 359517 - DNA, 20 bp, Artificial Sequence
  chemically synthesized
agtgcatcaagaaacttatg

SEQ ID NO: 359518 - DNA, 20 bp, Artificial Sequence
  chemically synthesized
actctgtaaaatcgctacat

SEQ ID NO: 359519 - DNA, 20 bp, Artificial Sequence
  chemically synthesized
aaacttatgtagcgatttta

SEQ ID NO: 359520 - DNA, 20 bp, Artificial Sequence
  chemically synthesized
acttatgtagcgattttaca

SEQ ID NO: 359521 - DNA, 20 bp, Artificial Sequence
  chemically synthesized
ttaaatacattagacataaa

SEQ ID NO: 359522 - DNA, 20 bp, Artificial Sequence
  chemically synthesized
tcctttattattaaatacat

SEQ ID NO: 359523 - DNA, 20 bp, Artificial Sequence
  chemically synthesized
gtctaatgtatttaataata

SEQ ID NO: 359524 - DNA, 20 bp, Artificial Sequence
  chemically synthesized
tctaatgtatttaataataa

SEQ ID NO: 359525 - DNA, 20 bp, Artificial Sequence
  chemically synthesized
taatgtatttaataataaag

SEQ ID NO: 359526 - DNA, 20 bp, Artificial Sequence
  chemically synthesized
aatgtatttaataataaagg

SEQ ID NO: 359527 - DNA, 20 bp, Artificial Sequence
  chemically synthesized
gtatttaataataaaggagg

SEQ ID NO: 359528 - DNA, 20 bp, Artificial Sequence
  chemically synthesized
taataataaaggaggaagca

SEQ ID NO: 359529 - DNA, 20 bp, Artificial Sequence
  chemically synthesized
aataataaaggaggaagcat

SEQ ID NO: 359530 - DNA, 20 bp, Artificial Sequence
  chemically synthesized
aaaggaggaagcatgggtgt

SEQ ID NO: 359531 - DNA, 20 bp, Artificial Sequence
  chemically synthesized
aaggaggaagcatgggtgtt

SEQ ID NO: 359532 - DNA, 20 bp, Artificial Sequence
  chemically synthesized
aaccaaagcgttacaaaaat

SEQ ID NO: 359533 - DNA, 20 bp, Artificial Sequence
  chemically synthesized
atcttatttttgtaacgctt

SEQ ID NO: 359534 - DNA, 20 bp, Artificial Sequence
  chemically synthesized
tgtaagatagaataaaacca

SEQ ID NO: 359535 - DNA, 20 bp, Artificial Sequence
  chemically synthesized
ctaatccattgtatgtaaga

SEQ ID NO: 359536 - DNA, 20 bp, Artificial Sequence
  chemically synthesized
tcccctaatccattgtatgt

SEQ ID NO: 359537 - DNA, 20 bp, Artificial Sequence
  chemically synthesized
ttattctatcttacatacaa

SEQ ID NO: 359538 - DNA, 20 bp, Artificial Sequence
  chemically synthesized
ctatcttacatacaatggat

SEQ ID NO: 359539 - DNA, 20 bp, Artificial Sequence
  chemically synthesized
tatcttacatacaatggatt

SEQ ID NO: 359540 - DNA, 20 bp, Artificial Sequence
  chemically synthesized
atcttacatacaatggatta

SEQ ID NO: 359541 - DNA, 20 bp, Artificial Sequence
  chemically synthesized
tcttacatacaatggattag

SEQ ID NO: 359542 - DNA, 20 bp, Artificial Sequence
  chemically synthesized
catacaatggattaggggaa

SEQ ID NO: 359543 - DNA, 20 bp, Artificial Sequence
  chemically synthesized
gggaaaagtgttccttcctc

SEQ ID NO: 359544 - DNA, 20 bp, Artificial Sequence
  chemically synthesized
ttctcaaaatatcttgagga

SEQ ID NO: 359545 - DNA, 20 bp, Artificial Sequence
  chemically synthesized
cttctcaaaatatcttgagg

SEQ ID NO: 359546 - DNA, 20 bp, Artificial Sequence
  chemically synthesized
gtacttctcaaaatatcttg

SEQ ID NO: 359547 - DNA, 20 bp, Artificial Sequence
  chemically synthesized
agtacttctcaaaatatctt

SEQ ID NO: 359548 - DNA, 20 bp, Artificial Sequence
  chemically synthesized
ttccttcctcaagatatttt

SEQ ID NO: 359549 - DNA, 20 bp, Artificial Sequence
  chemically synthesized
cttcctcaagatattttgag

SEQ ID NO: 359550 - DNA, 20 bp, Artificial Sequence
  chemically synthesized
aagatattttgagaagtact

SEQ ID NO: 359551 - DNA, 20 bp, Artificial Sequence
  chemically synthesized
actgcttttcatatgttgct

SEQ ID NO: 359552 - DNA, 20 bp, Artificial Sequence
  chemically synthesized
agtactgagcaacatatgaa

SEQ ID NO: 359553 - DNA, 20 bp, Artificial Sequence
  chemically synthesized
actgagcaacatatgaaaag

SEQ ID NO: 359554 - DNA, 20 bp, Artificial Sequence
  chemically synthesized
gcaacatatgaaaagcagtt

SEQ ID NO: 359555 - DNA, 20 bp, Artificial Sequence
  chemically synthesized
caacatatgaaaagcagttt

SEQ ID NO: 359556 - DNA, 20 bp, Artificial Sequence
  chemically synthesized
aacatatgaaaagcagtttg

SEQ ID NO: 359557 - DNA, 20 bp, Artificial Sequence
  chemically synthesized
catatgaaaagcagtttggg

SEQ ID NO: 359558 - DNA, 20 bp, Artificial Sequence
  chemically synthesized
tatgaaaagcagtttgggga

SEQ ID NO: 359559 - DNA, 20 bp, Artificial Sequence
  chemically synthesized
aagcagtttggggagagatg

SEQ ID NO: 359560 - DNA, 20 bp, Artificial Sequence
  chemically synthesized
agatgcggtatgttgcttgc

SEQ ID NO: 359561 - DNA, 20 bp, Artificial Sequence
  chemically synthesized
tggtgtcaaatagaaccagc

SEQ ID NO: 359562 - DNA, 20 bp, Artificial Sequence
  chemically synthesized
gtgatggtgtcaaatagaac

SEQ ID NO: 359563 - DNA, 20 bp, Artificial Sequence
  chemically synthesized
catatagtgatggtgtcaaa

SEQ ID NO: 359564 - DNA, 20 bp, Artificial Sequence
  chemically synthesized
cagcccgttccatatagtga

SEQ ID NO: 359565 - DNA, 20 bp, Artificial Sequence
  chemically synthesized
tatttgacaccatcactata

SEQ ID NO: 359566 - DNA, 20 bp, Artificial Sequence
  chemically synthesized
gacaccatcactatatggaa

SEQ ID NO: 359567 - DNA, 20 bp, Artificial Sequence
  chemically synthesized
gattttcagcccgttccata

SEQ ID NO: 359568 - DNA, 20 bp, Artificial Sequence
  chemically synthesized
acaccatcactatatggaac

SEQ ID NO: 359569 - DNA, 20 bp, Artificial Sequence
  chemically synthesized
atatggaacgggctgaaaat

SEQ ID NO: 359570 - DNA, 20 bp, Artificial Sequence
  chemically synthesized
agcccaagttggccgatttt

SEQ ID NO: 359571 - DNA, 20 bp, Artificial Sequence
  chemically synthesized
gggctgaaaatcggccaact

SEQ ID NO: 359572 - DNA, 20 bp, Artificial Sequence
  chemically synthesized
ggctgaaaatcggccaactt

SEQ ID NO: 359573 - DNA, 20 bp, Artificial Sequence
  chemically synthesized
agccttaagtgagcccaagt

SEQ ID NO: 359574 - DNA, 20 bp, Artificial Sequence
  chemically synthesized
taggagccttaagtgagccc

SEQ ID NO: 359575 - DNA, 20 bp, Artificial Sequence
  chemically synthesized
cggccaacttgggctcactt

SEQ ID NO: 359576 - DNA, 20 bp, Artificial Sequence
  chemically synthesized
ggccaacttgggctcactta

SEQ ID NO: 359577 - DNA, 20 bp, Artificial Sequence
  chemically synthesized
agctcataggagccttaagt

SEQ ID NO: 359578 - DNA, 20 bp, Artificial Sequence
  chemically synthesized
gaatagctcataggagcctt

SEQ ID NO: 359579 - DNA, 20 bp, Artificial Sequence
  chemically synthesized
ggctcacttaaggctcctat

SEQ ID NO: 359580 - DNA, 20 bp, Artificial Sequence
  chemically synthesized
caacaaagaatagctcatag

SEQ ID NO: 359581 - DNA, 20 bp, Artificial Sequence
  chemically synthesized
ggcaacaaagaatagctcat

SEQ ID NO: 359582 - DNA, 20 bp, Artificial Sequence
  chemically synthesized
tggcaacaaagaatagctca

SEQ ID NO: 359583 - DNA, 20 bp, Artificial Sequence
  chemically synthesized
tatgtgctggcaacaaagaa

SEQ ID NO: 359584 - DNA, 20 bp, Artificial Sequence
  chemically synthesized
tatgagctattctttgttgc

SEQ ID NO: 359585 - DNA, 20 bp, Artificial Sequence
  chemically synthesized
attaatatgtgctggcaaca

SEQ ID NO: 359586 - DNA, 20 bp, Artificial Sequence
  chemically synthesized
gagcgggaattaatatgtgc

SEQ ID NO: 359587 - DNA, 20 bp, Artificial Sequence
  chemically synthesized
gagaggggaagagaaagagc

SEQ ID NO: 359588 - DNA, 20 bp, Artificial Sequence
  chemically synthesized
ggagaggggaagagaaagag

SEQ ID NO: 359589 - DNA, 20 bp, Artificial Sequence
  chemically synthesized
cggggagaggggaagagaaa

SEQ ID NO: 359590 - DNA, 20 bp, Artificial Sequence
  chemically synthesized
agcggggagaggggaagaga

SEQ ID NO: 359591 - DNA, 20 bp, Artificial Sequence
  chemically synthesized
agtaagcggggagaggggaa

SEQ ID NO: 359592 - DNA, 20 bp, Artificial Sequence
  chemically synthesized
acagtaagcggggagagggg

SEQ ID NO: 359593 - DNA, 20 bp, Artificial Sequence
  chemically synthesized
acaacagtaagcggggagag

SEQ ID NO: 359594 - DNA, 20 bp, Artificial Sequence
  chemically synthesized
cacaacagtaagcggggaga

SEQ ID NO: 359595 - DNA, 20 bp, Artificial Sequence
  chemically synthesized
tcacaacagtaagcggggag

SEQ ID NO: 359596 - DNA, 20 bp, Artificial Sequence
  chemically synthesized
ttcacaacagtaagcgggga

SEQ ID NO: 359597 - DNA, 20 bp, Artificial Sequence
  chemically synthesized
acttcacaacagtaagcggg

SEQ ID NO: 359598 - DNA, 20 bp, Artificial Sequence
  chemically synthesized
ctacttcacaacagtaagcg

SEQ ID NO: 359599 - DNA, 20 bp, Artificial Sequence
  chemically synthesized
gctacttcacaacagtaagc

SEQ ID NO: 359600 - DNA, 20 bp, Artificial Sequence
  chemically synthesized
tgctacttcacaacagtaag

SEQ ID NO: 359601 - DNA, 20 bp, Artificial Sequence
  chemically synthesized
taatgctacttcacaacagt

SEQ ID NO: 359602 - DNA, 20 bp, Artificial Sequence
  chemically synthesized
tctccccgcttactgttgtg

SEQ ID NO: 359603 - DNA, 20 bp, Artificial Sequence
  chemically synthesized
ggcttaatgctacttcacaa

SEQ ID NO: 359604 - DNA, 20 bp, Artificial Sequence
  chemically synthesized
ccccgcttactgttgtgaag

SEQ ID NO: 359605 - DNA, 20 bp, Artificial Sequence
  chemically synthesized
tactgttgtgaagtagcatt

SEQ ID NO: 359606 - DNA, 20 bp, Artificial Sequence
  chemically synthesized
gaagtagcattaagcctgtt

SEQ ID NO: 359607 - DNA, 20 bp, Artificial Sequence
  chemically synthesized
agtagcattaagcctgttca

SEQ ID NO: 359608 - DNA, 20 bp, Artificial Sequence
  chemically synthesized
ttattccaaattctctgaac

SEQ ID NO: 359609 - DNA, 20 bp, Artificial Sequence
  chemically synthesized
tttattccaaattctctgaa

SEQ ID NO: 359610 - DNA, 20 bp, Artificial Sequence
  chemically synthesized
ttaagcctgttcagagaatt

SEQ ID NO: 359611 - DNA, 20 bp, Artificial Sequence
  chemically synthesized
gaatttggaataaaaatata

SEQ ID NO: 359612 - DNA, 20 bp, Artificial Sequence
  chemically synthesized
aatttggaataaaaatatat

SEQ ID NO: 359613 - DNA, 20 bp, Artificial Sequence
  chemically synthesized
atttggaataaaaatatatg

SEQ ID NO: 359614 - DNA, 20 bp, Artificial Sequence
  chemically synthesized
tttggaataaaaatatatgg

SEQ ID NO: 359615 - DNA, 20 bp, Artificial Sequence
  chemically synthesized
aaaaatatatgggggccaat

SEQ ID NO: 359616 - DNA, 20 bp, Artificial Sequence
  chemically synthesized
aaaatatatgggggccaatt

SEQ ID NO: 359617 - DNA, 20 bp, Artificial Sequence
  chemically synthesized
aatatatgggggccaattag

SEQ ID NO: 359618 - DNA, 20 bp, Artificial Sequence
  chemically synthesized
tatatgggggccaattagga

SEQ ID NO: 359619 - DNA, 20 bp, Artificial Sequence
  chemically synthesized
agccatgttgctctcctaat

SEQ ID NO: 359620 - DNA, 20 bp, Artificial Sequence
  chemically synthesized
ggccaattaggagagcaaca

SEQ ID NO: 359621 - DNA, 20 bp, Artificial Sequence
  chemically synthesized
agagtacctattaaattcag

SEQ ID NO: 359622 - DNA, 20 bp, Artificial Sequence
  chemically synthesized
aacatggctgctgaatttaa

SEQ ID NO: 359623 - DNA, 20 bp, Artificial Sequence
  chemically synthesized
caaagagtacctattaaatt

SEQ ID NO: 359624 - DNA, 20 bp, Artificial Sequence
  chemically synthesized
acatggctgctgaatttaat

SEQ ID NO: 359625 - DNA, 20 bp, Artificial Sequence
  chemically synthesized
aaatagtgagtagacacaaa

SEQ ID NO: 359626 - DNA, 20 bp, Artificial Sequence
  chemically synthesized
tcaaatagtgagtagacaca

SEQ ID NO: 359627 - DNA, 20 bp, Artificial Sequence
  chemically synthesized
gctcagagtcaaatagtgag

SEQ ID NO: 359628 - DNA, 20 bp, Artificial Sequence
  chemically synthesized
cttgctcagagtcaaatagt

SEQ ID NO: 359629 - DNA, 20 bp, Artificial Sequence
  chemically synthesized
tgctcttgctcagagtcaaa

SEQ ID NO: 359630 - DNA, 20 bp, Artificial Sequence
  chemically synthesized
tctactcactatttgactct

SEQ ID NO: 359631 - DNA, 20 bp, Artificial Sequence
  chemically synthesized
ctcactatttgactctgagc

SEQ ID NO: 359632 - DNA, 20 bp, Artificial Sequence
  chemically synthesized
cactatttgactctgagcaa

SEQ ID NO: 359633 - DNA, 20 bp, Artificial Sequence
  chemically synthesized
ttgtagattgctcttgctca

SEQ ID NO: 359634 - DNA, 20 bp, Artificial Sequence
  chemically synthesized
aattgtagattgctcttgct

SEQ ID NO: 359635 - DNA, 20 bp, Artificial Sequence
  chemically synthesized
gcaagagcaatctacaattc

SEQ ID NO: 359636 - DNA, 20 bp, Artificial Sequence
  chemically synthesized
ttgaattttaacttgaattg

SEQ ID NO: 359637 - DNA, 20 bp, Artificial Sequence
  chemically synthesized
tacaattcaagttaaaattc

SEQ ID NO: 359638 - DNA, 20 bp, Artificial Sequence
  chemically synthesized
attcaagttaaaattcaagc

SEQ ID NO: 359639 - DNA, 20 bp, Artificial Sequence
  chemically synthesized
ttcaagttaaaattcaagcc

SEQ ID NO: 359640 - DNA, 20 bp, Artificial Sequence
  chemically synthesized
gttaaaattcaagccgggcg

SEQ ID NO: 359641 - DNA, 20 bp, Artificial Sequence
  chemically synthesized
aaaattcaagccgggcgcag

SEQ ID NO: 359642 - DNA, 20 bp, Artificial Sequence
  chemically synthesized
caggcatgagccactgcgcc

SEQ ID NO: 359643 - DNA, 20 bp, Artificial Sequence
  chemically synthesized
agtgctgggattgcaggcat

SEQ ID NO: 359644 - DNA, 20 bp, Artificial Sequence
  chemically synthesized
gtggctcatgcctgcaatcc

SEQ ID NO: 359645 - DNA, 20 bp, Artificial Sequence
  chemically synthesized
tcccaaagtgctgggattgc

SEQ ID NO: 359646 - DNA, 20 bp, Artificial Sequence
  chemically synthesized
ctcccaaagtgctgggattg

SEQ ID NO: 359647 - DNA, 20 bp, Artificial Sequence
  chemically synthesized
tgcctgcaatcccagcactt

SEQ ID NO: 359648 - DNA, 20 bp, Artificial Sequence
  chemically synthesized
cctcggcctcccaaagtgct

SEQ ID NO: 359649 - DNA, 20 bp, Artificial Sequence
  chemically synthesized
gcctgcaatcccagcacttt

SEQ ID NO: 359650 - DNA, 20 bp, Artificial Sequence
  chemically synthesized
gcctcggcctcccaaagtgc

SEQ ID NO: 359651 - DNA, 20 bp, Artificial Sequence
  chemically synthesized
ctgcaatcccagcactttgg

SEQ ID NO: 359652 - DNA, 20 bp, Artificial Sequence
  chemically synthesized
tgcaatcccagcactttggg

SEQ ID NO: 359653 - DNA, 20 bp, Artificial Sequence
  chemically synthesized
cctcctgcctcggcctccca

SEQ ID NO: 359654 - DNA, 20 bp, Artificial Sequence
  chemically synthesized
tcccagcactttgggaggcc

SEQ ID NO: 359655 - DNA, 20 bp, Artificial Sequence
  chemically synthesized
cccagcactttgggaggccg

SEQ ID NO: 359656 - DNA, 20 bp, Artificial Sequence
  chemically synthesized
agcactttgggaggccgagg

SEQ ID NO: 359657 - DNA, 20 bp, Artificial Sequence
  chemically synthesized
gcactttgggaggccgaggc

SEQ ID NO: 359658 - DNA, 20 bp, Artificial Sequence
  chemically synthesized
actttgggaggccgaggcag

SEQ ID NO: 359659 - DNA, 20 bp, Artificial Sequence
  chemically synthesized
ctttgggaggccgaggcagg

SEQ ID NO: 359660 - DNA, 20 bp, Artificial Sequence
  chemically synthesized
acctcgtgatcctcctgcct

SEQ ID NO: 359661 - DNA, 20 bp, Artificial Sequence
  chemically synthesized
ggccgaggcaggaggatcac

SEQ ID NO: 359662 - DNA, 20 bp, Artificial Sequence
  chemically synthesized
gccgaggcaggaggatcacg

SEQ ID NO: 359663 - DNA, 20 bp, Artificial Sequence
  chemically synthesized
aggcaggaggatcacgaggt

SEQ ID NO: 359664 - DNA, 20 bp, Artificial Sequence
  chemically synthesized
ggcaggaggatcacgaggtc

SEQ ID NO: 359665 - DNA, 20 bp, Artificial Sequence
  chemically synthesized
caggaggatcacgaggtcag

SEQ ID NO: 359666 - DNA, 20 bp, Artificial Sequence
  chemically synthesized
gatcacgaggtcaggagatc

SEQ ID NO: 359667 - DNA, 20 bp, Artificial Sequence
  chemically synthesized
tcaggagatcgagaccatcc

SEQ ID NO: 359668 - DNA, 20 bp, Artificial Sequence
  chemically synthesized
tttcaccgtgttagccagga

SEQ ID NO: 359669 - DNA, 20 bp, Artificial Sequence
  chemically synthesized
ggggtttcaccgtgttagcc

SEQ ID NO: 359670 - DNA, 20 bp, Artificial Sequence
  chemically synthesized
cgagaccatcctggctaaca

SEQ ID NO: 359671 - DNA, 20 bp, Artificial Sequence
  chemically synthesized
cggggtttcaccgtgttagc

SEQ ID NO: 359672 - DNA, 20 bp, Artificial Sequence
  chemically synthesized
gagacggggtttcaccgtgt

SEQ ID NO: 359673 - DNA, 20 bp, Artificial Sequence
  chemically synthesized
ttgtatttttagtagagacg

SEQ ID NO: 359674 - DNA, 20 bp, Artificial Sequence
  chemically synthesized
tttgtatttttagtagagac

SEQ ID NO: 359675 - DNA, 20 bp, Artificial Sequence
  chemically synthesized
ttttgtatttttagtagaga

SEQ ID NO: 359676 - DNA, 20 bp, Artificial Sequence
  chemically synthesized
ttttttttgtatttttagta

SEQ ID NO: 359677 - DNA, 20 bp, Artificial Sequence
  chemically synthesized
atttttttttgtatttttag

SEQ ID NO: 359678 - DNA, 20 bp, Artificial Sequence
  chemically synthesized
ctaatttttttttgtatttt

SEQ ID NO: 359679 - DNA, 20 bp, Artificial Sequence
  chemically synthesized
ctaaaaatacaaaaaaaaat

SEQ ID NO: 359680 - DNA, 20 bp, Artificial Sequence
  chemically synthesized
aaatacaaaaaaaaattagc

SEQ ID NO: 359681 - DNA, 20 bp, Artificial Sequence
  chemically synthesized
aatacaaaaaaaaattagcc

SEQ ID NO: 359682 - DNA, 20 bp, Artificial Sequence
  chemically synthesized
aaaaaaaaattagccgggcg

SEQ ID NO: 359683 - DNA, 20 bp, Artificial Sequence
  chemically synthesized
aaaaaattagccgggcgtgg

SEQ ID NO: 359684 - DNA, 20 bp, Artificial Sequence
  chemically synthesized
aggcgcccccccaccacgcc

SEQ ID NO: 359685 - DNA, 20 bp, Artificial Sequence
  chemically synthesized
aaaaattagccgggcgtggt

SEQ ID NO: 359686 - DNA, 20 bp, Artificial Sequence
  chemically synthesized
aaaattagccgggcgtggtg

SEQ ID NO: 359687 - DNA, 20 bp, Artificial Sequence
  chemically synthesized
aaattagccgggcgtggtgg

SEQ ID NO: 359688 - DNA, 20 bp, Artificial Sequence
  chemically synthesized
aattagccgggcgtggtggg

SEQ ID NO: 359689 - DNA, 20 bp, Artificial Sequence
  chemically synthesized
attagccgggcgtggtgggg

SEQ ID NO: 359690 - DNA, 20 bp, Artificial Sequence
  chemically synthesized
gcgtggtgggggggcgcctg

SEQ ID NO: 359691 - DNA, 20 bp, Artificial Sequence
  chemically synthesized
tgggggggcgcctgtagtcc

SEQ ID NO: 359692 - DNA, 20 bp, Artificial Sequence
  chemically synthesized
tcccgagtagctgggactac

SEQ ID NO: 359693 - DNA, 20 bp, Artificial Sequence
  chemically synthesized
ctcccgagtagctgggacta

SEQ ID NO: 359694 - DNA, 20 bp, Artificial Sequence
  chemically synthesized
cgcctgtagtcccagctact

SEQ ID NO: 359695 - DNA, 20 bp, Artificial Sequence
  chemically synthesized
cctcagcctcccgagtagct

SEQ ID NO: 359696 - DNA, 20 bp, Artificial Sequence
  chemically synthesized
gcctgtagtcccagctactc

SEQ ID NO: 359697 - DNA, 20 bp, Artificial Sequence
  chemically synthesized
gcctcagcctcccgagtagc

SEQ ID NO: 359698 - DNA, 20 bp, Artificial Sequence
  chemically synthesized
ctgtagtcccagctactcgg

SEQ ID NO: 359699 - DNA, 20 bp, Artificial Sequence
  chemically synthesized
tgtagtcccagctactcggg

SEQ ID NO: 359700 - DNA, 20 bp, Artificial Sequence
  chemically synthesized
tcctgcctcagcctcccgag

SEQ ID NO: 359701 - DNA, 20 bp, Artificial Sequence
  chemically synthesized
ttctcctgcctcagcctccc

SEQ ID NO: 359702 - DNA, 20 bp, Artificial Sequence
  chemically synthesized
tcccagctactcgggaggct

SEQ ID NO: 359703 - DNA, 20 bp, Artificial Sequence
  chemically synthesized
cccagctactcgggaggctg

SEQ ID NO: 359704 - DNA, 20 bp, Artificial Sequence
  chemically synthesized
agctactcgggaggctgagg

SEQ ID NO: 359705 - DNA, 20 bp, Artificial Sequence
  chemically synthesized
gctactcgggaggctgaggc

SEQ ID NO: 359706 - DNA, 20 bp, Artificial Sequence
  chemically synthesized
tactcgggaggctgaggcag

SEQ ID NO: 359707 - DNA, 20 bp, Artificial Sequence
  chemically synthesized
ttcacgccattctcctgcct

SEQ ID NO: 359708 - DNA, 20 bp, Artificial Sequence
  chemically synthesized
gggaggctgaggcaggagaa

SEQ ID NO: 359709 - DNA, 20 bp, Artificial Sequence
  chemically synthesized
gcaggagaatggcgtgaatc

SEQ ID NO: 359710 - DNA, 20 bp, Artificial Sequence
  chemically synthesized
caggagaatggcgtgaatcc

SEQ ID NO: 359711 - DNA, 20 bp, Artificial Sequence
  chemically synthesized
ggagaatggcgtgaatccgg

SEQ ID NO: 359712 - DNA, 20 bp, Artificial Sequence
  chemically synthesized
gagaatggcgtgaatccggg

SEQ ID NO: 359713 - DNA, 20 bp, Artificial Sequence
  chemically synthesized
aatggcgtgaatccgggagg

SEQ ID NO: 359714 - DNA, 20 bp, Artificial Sequence
  chemically synthesized
tggcgtgaatccgggaggcg

SEQ ID NO: 359715 - DNA, 20 bp, Artificial Sequence
  chemically synthesized
tcactgcaagctccgcctcc

SEQ ID NO: 359716 - DNA, 20 bp, Artificial Sequence
  chemically synthesized
aatccgggaggcggagcttg

SEQ ID NO: 359717 - DNA, 20 bp, Artificial Sequence
  chemically synthesized
cgggaggcggagcttgcagt

SEQ ID NO: 359718 - DNA, 20 bp, Artificial Sequence
  chemically synthesized
gcgcgatctcggctcactgc

SEQ ID NO: 359719 - DNA, 20 bp, Artificial Sequence
  chemically synthesized
ggcggagcttgcagtgagcc

SEQ ID NO: 359720 - DNA, 20 bp, Artificial Sequence
  chemically synthesized
ggagtgcagtggcgcgatct

SEQ ID NO: 359721 - DNA, 20 bp, Artificial Sequence
  chemically synthesized
tcgcccaggctggagtgcag

SEQ ID NO: 359722 - DNA, 20 bp, Artificial Sequence
  chemically synthesized
gagatcgcgccactgcactc

SEQ ID NO: 359723 - DNA, 20 bp, Artificial Sequence
  chemically synthesized
ctgtcgcccaggctggagtg

SEQ ID NO: 359724 - DNA, 20 bp, Artificial Sequence
  chemically synthesized
cgcgccactgcactccagcc

SEQ ID NO: 359725 - DNA, 20 bp, Artificial Sequence
  chemically synthesized
gcgccactgcactccagcct

SEQ ID NO: 359726 - DNA, 20 bp, Artificial Sequence
  chemically synthesized
ttgctctgtcgcccaggctg

SEQ ID NO: 359727 - DNA, 20 bp, Artificial Sequence
  chemically synthesized
tcttgctctgtcgcccaggc

SEQ ID NO: 359728 - DNA, 20 bp, Artificial Sequence
  chemically synthesized
ctgcactccagcctgggcga

SEQ ID NO: 359729 - DNA, 20 bp, Artificial Sequence
  chemically synthesized
agagtcttgctctgtcgccc

SEQ ID NO: 359730 - DNA, 20 bp, Artificial Sequence
  chemically synthesized
gcactccagcctgggcgaca

SEQ ID NO: 359731 - DNA, 20 bp, Artificial Sequence
  chemically synthesized
cagagtcttgctctgtcgcc

SEQ ID NO: 359732 - DNA, 20 bp, Artificial Sequence
  chemically synthesized
tccagcctgggcgacagagc

SEQ ID NO: 359733 - DNA, 20 bp, Artificial Sequence
  chemically synthesized
tttatttttattttgagaca

SEQ ID NO: 359734 - DNA, 20 bp, Artificial Sequence
  chemically synthesized
tttttatttttattttgaga

SEQ ID NO: 359735 - DNA, 20 bp, Artificial Sequence
  chemically synthesized
tttttttttatttttatttt

SEQ ID NO: 359736 - DNA, 20 bp, Artificial Sequence
  chemically synthesized
aataaaaaataaaaaaattc

SEQ ID NO: 359737 - DNA, 20 bp, Artificial Sequence
  chemically synthesized
aaattcaagtttaccgaatg

SEQ ID NO: 359738 - DNA, 20 bp, Artificial Sequence
  chemically synthesized
gcagatatcatggcttcatt

SEQ ID NO: 359739 - DNA, 20 bp, Artificial Sequence
  chemically synthesized
ccctattgtagcagatatca

SEQ ID NO: 359740 - DNA, 20 bp, Artificial Sequence
  chemically synthesized
agccatgatatctgctacaa

SEQ ID NO: 359741 - DNA, 20 bp, Artificial Sequence
  chemically synthesized
gccatgatatctgctacaat

SEQ ID NO: 359742 - DNA, 20 bp, Artificial Sequence
  chemically synthesized
cagatccagccctattgtag

SEQ ID NO: 359743 - DNA, 20 bp, Artificial Sequence
  chemically synthesized
ccatgatatctgctacaata

SEQ ID NO: 359744 - DNA, 20 bp, Artificial Sequence
  chemically synthesized
gttcagatccagccctattg

SEQ ID NO: 359745 - DNA, 20 bp, Artificial Sequence
  chemically synthesized
gatatctgctacaatagggc

SEQ ID NO: 359746 - DNA, 20 bp, Artificial Sequence
  chemically synthesized
tgagggtaatagttcagatc

SEQ ID NO: 359747 - DNA, 20 bp, Artificial Sequence
  chemically synthesized
ttgcaatgagggtaatagtt

SEQ ID NO: 359748 - DNA, 20 bp, Artificial Sequence
  chemically synthesized
gcttcttgcaatgagggtaa

SEQ ID NO: 359749 - DNA, 20 bp, Artificial Sequence
  chemically synthesized
tgaactattaccctcattgc

SEQ ID NO: 359750 - DNA, 20 bp, Artificial Sequence
  chemically synthesized
tgtctggcttcttgcaatga

SEQ ID NO: 359751 - DNA, 20 bp, Artificial Sequence
  chemically synthesized
gtgtctggcttcttgcaatg

SEQ ID NO: 359752 - DNA, 20 bp, Artificial Sequence
  chemically synthesized
tgtgtctggcttcttgcaat

SEQ ID NO: 359753 - DNA, 20 bp, Artificial Sequence
  chemically synthesized
actattaccctcattgcaag

SEQ ID NO: 359754 - DNA, 20 bp, Artificial Sequence
  chemically synthesized
ttaccctcattgcaagaagc

SEQ ID NO: 359755 - DNA, 20 bp, Artificial Sequence
  chemically synthesized
ttgcaagaagccagacacaa

SEQ ID NO: 359756 - DNA, 20 bp, Artificial Sequence
  chemically synthesized
aatacatgttcttttgtgtc

SEQ ID NO: 359757 - DNA, 20 bp, Artificial Sequence
  chemically synthesized
attgatataaaatatccaaa

SEQ ID NO: 359758 - DNA, 20 bp, Artificial Sequence
  chemically synthesized
ttgatataaaatatccaaaa

SEQ ID NO: 359759 - DNA, 20 bp, Artificial Sequence
  chemically synthesized
tccatatgtatttgcctttt

SEQ ID NO: 359760 - DNA, 20 bp, Artificial Sequence
  chemically synthesized
tccaaaaaggcaaatacata

SEQ ID NO: 359761 - DNA, 20 bp, Artificial Sequence
  chemically synthesized
aaaaggcaaatacatatgga

SEQ ID NO: 359762 - DNA, 20 bp, Artificial Sequence
  chemically synthesized
caaatacatatggacagaaa

SEQ ID NO: 359763 - DNA, 20 bp, Artificial Sequence
  chemically synthesized
gaaatagattgacaattgcc

SEQ ID NO: 359764 - DNA, 20 bp, Artificial Sequence
  chemically synthesized
aaatagattgacaattgcct

SEQ ID NO: 359765 - DNA, 20 bp, Artificial Sequence
  chemically synthesized
aatagattgacaattgccta

SEQ ID NO: 359766 - DNA, 20 bp, Artificial Sequence
  chemically synthesized
gattgacaattgcctagggc

SEQ ID NO: 359767 - DNA, 20 bp, Artificial Sequence
  chemically synthesized
attgacaattgcctagggct

SEQ ID NO: 359768 - DNA, 20 bp, Artificial Sequence
  chemically synthesized
ttgacaattgcctagggctg

SEQ ID NO: 359769 - DNA, 20 bp, Artificial Sequence
  chemically synthesized
ttcactcccaccccagccct

SEQ ID NO: 359770 - DNA, 20 bp, Artificial Sequence
  chemically synthesized
tttcactcccaccccagccc

SEQ ID NO: 359771 - DNA, 20 bp, Artificial Sequence
  chemically synthesized
acaattgcctagggctgggg

SEQ ID NO: 359772 - DNA, 20 bp, Artificial Sequence
  chemically synthesized
caattgcctagggctggggt

SEQ ID NO: 359773 - DNA, 20 bp, Artificial Sequence
  chemically synthesized
attgcctagggctggggtgg

SEQ ID NO: 359774 - DNA, 20 bp, Artificial Sequence
  chemically synthesized
gtcatttttcactcccaccc

SEQ ID NO: 359775 - DNA, 20 bp, Artificial Sequence
  chemically synthesized
gagtgaaaaatgactgtaaa

SEQ ID NO: 359776 - DNA, 20 bp, Artificial Sequence
  chemically synthesized
gtgaaaaatgactgtaaatg

SEQ ID NO: 359777 - DNA, 20 bp, Artificial Sequence
  chemically synthesized
agaagtttcttctccattta

SEQ ID NO: 359778 - DNA, 20 bp, Artificial Sequence
  chemically synthesized
aaaaatgactgtaaatggag

SEQ ID NO: 359779 - DNA, 20 bp, Artificial Sequence
  chemically synthesized
tggagaagaaacttcttttt

SEQ ID NO: 359780 - DNA, 20 bp, Artificial Sequence
  chemically synthesized
ggagaagaaacttcttttta

SEQ ID NO: 359781 - DNA, 20 bp, Artificial Sequence
  chemically synthesized
ttttccaccaccttaaaaag

SEQ ID NO: 359782 - DNA, 20 bp, Artificial Sequence
  chemically synthesized
gaagaaacttctttttaagg

SEQ ID NO: 359783 - DNA, 20 bp, Artificial Sequence
  chemically synthesized
cacttttccaccaccttaaa

SEQ ID NO: 359784 - DNA, 20 bp, Artificial Sequence
  chemically synthesized
gaaacttctttttaaggtgg

SEQ ID NO: 359785 - DNA, 20 bp, Artificial Sequence
  chemically synthesized
ttctttttaaggtggtggaa

SEQ ID NO: 359786 - DNA, 20 bp, Artificial Sequence
  chemically synthesized
tggtggaaaagtgccaaaat

SEQ ID NO: 359787 - DNA, 20 bp, Artificial Sequence
  chemically synthesized
ccatcatagcgatctaattt

SEQ ID NO: 359788 - DNA, 20 bp, Artificial Sequence
  chemically synthesized
ccaaaattagatcgctatga

SEQ ID NO: 359789 - DNA, 20 bp, Artificial Sequence
  chemically synthesized
acagagttatatagccatca

SEQ ID NO: 359790 - DNA, 20 bp, Artificial Sequence
  chemically synthesized
aggatatttacagagttata

SEQ ID NO: 359791 - DNA, 20 bp, Artificial Sequence
  chemically synthesized
aaatttgcaggatatttaca

SEQ ID NO: 359792 - DNA, 20 bp, Artificial Sequence
  chemically synthesized
taaaatttgcaggatattta

SEQ ID NO: 359793 - DNA, 20 bp, Artificial Sequence
  chemically synthesized
ccacgttcattaaaatttgc

SEQ ID NO: 359794 - DNA, 20 bp, Artificial Sequence
  chemically synthesized
accacgttcattaaaatttg

SEQ ID NO: 359795 - DNA, 20 bp, Artificial Sequence
  chemically synthesized
cctgcaaattttaatgaacg

SEQ ID NO: 359796 - DNA, 20 bp, Artificial Sequence
  chemically synthesized
gcaaattttaatgaacgtgg

SEQ ID NO: 359797 - DNA, 20 bp, Artificial Sequence
  chemically synthesized
caaattttaatgaacgtggt

SEQ ID NO: 359798 - DNA, 20 bp, Artificial Sequence
  chemically synthesized
aaattttaatgaacgtggtg

SEQ ID NO: 359799 - DNA, 20 bp, Artificial Sequence
  chemically synthesized
aattttaatgaacgtggtgg

SEQ ID NO: 359800 - DNA, 20 bp, Artificial Sequence
  chemically synthesized
attttaatgaacgtggtggg

SEQ ID NO: 359801 - DNA, 20 bp, Artificial Sequence
  chemically synthesized
ttttaatgaacgtggtgggg

SEQ ID NO: 359802 - DNA, 20 bp, Artificial Sequence
  chemically synthesized
ttaatgaacgtggtgggggg

SEQ ID NO: 359803 - DNA, 20 bp, Artificial Sequence
  chemically synthesized
gagttattcatccctcaaaa

SEQ ID NO: 359804 - DNA, 20 bp, Artificial Sequence
  chemically synthesized
agcctctcaaactattttga

SEQ ID NO: 359805 - DNA, 20 bp, Artificial Sequence
  chemically synthesized
tagcctctcaaactattttg

SEQ ID NO: 359806 - DNA, 20 bp, Artificial Sequence
  chemically synthesized
gtagcctctcaaactatttt

SEQ ID NO: 359807 - DNA, 20 bp, Artificial Sequence
  chemically synthesized
ttcatccctcaaaatagttt

SEQ ID NO: 359808 - DNA, 20 bp, Artificial Sequence
  chemically synthesized
catccctcaaaatagtttga

SEQ ID NO: 359809 - DNA, 20 bp, Artificial Sequence
  chemically synthesized
atccctcaaaatagtttgag

SEQ ID NO: 359810 - DNA, 20 bp, Artificial Sequence
  chemically synthesized
aaatagtttgagaggctacc

SEQ ID NO: 359811 - DNA, 20 bp, Artificial Sequence
  chemically synthesized
ggtttagttctggttcttgg

SEQ ID NO: 359812 - DNA, 20 bp, Artificial Sequence
  chemically synthesized
tttgagaggctaccaagaac

SEQ ID NO: 359813 - DNA, 20 bp, Artificial Sequence
  chemically synthesized
tctggtttagttctggttct

SEQ ID NO: 359814 - DNA, 20 bp, Artificial Sequence
  chemically synthesized
gcatcaatctggtttagttc

SEQ ID NO: 359815 - DNA, 20 bp, Artificial Sequence
  chemically synthesized
accaagaaccagaactaaac

SEQ ID NO: 359816 - DNA, 20 bp, Artificial Sequence
  chemically synthesized
caatttgcatcaatctggtt

SEQ ID NO: 359817 - DNA, 20 bp, Artificial Sequence
  chemically synthesized
aaattcaatttgcatcaatc

SEQ ID NO: 359818 - DNA, 20 bp, Artificial Sequence
  chemically synthesized
tgcaaattgaattttacact

SEQ ID NO: 359819 - DNA, 20 bp, Artificial Sequence
  chemically synthesized
ttgaattttacacttagaat

SEQ ID NO: 359820 - DNA, 20 bp, Artificial Sequence
  chemically synthesized
accatcaatgtactcattct

SEQ ID NO: 359821 - DNA, 20 bp, Artificial Sequence
  chemically synthesized
acttagaatgagtacattga

SEQ ID NO: 359822 - DNA, 20 bp, Artificial Sequence
  chemically synthesized
cgtttttgaaatgtaattgt

SEQ ID NO: 359823 - DNA, 20 bp, Artificial Sequence
  chemically synthesized
gggattacttttttataaat

SEQ ID NO: 359824 - DNA, 20 bp, Artificial Sequence
  chemically synthesized
aaaaacgctgatttataaaa

SEQ ID NO: 359825 - DNA, 20 bp, Artificial Sequence
  chemically synthesized
tataaaaaagtaatcccgac

SEQ ID NO: 359826 - DNA, 20 bp, Artificial Sequence
  chemically synthesized
gactgctgtttttactggtc

SEQ ID NO: 359827 - DNA, 20 bp, Artificial Sequence
  chemically synthesized
tgactgctgtttttactggt

SEQ ID NO: 359828 - DNA, 20 bp, Artificial Sequence
  chemically synthesized
gtaatcccgaccagtaaaaa

SEQ ID NO: 359829 - DNA, 20 bp, Artificial Sequence
  chemically synthesized
gaaatgactgctgtttttac

SEQ ID NO: 359830 - DNA, 20 bp, Artificial Sequence
  chemically synthesized
atcccgaccagtaaaaacag

SEQ ID NO: 359831 - DNA, 20 bp, Artificial Sequence
  chemically synthesized
taaaaacagcagtcatttct

SEQ ID NO: 359832 - DNA, 20 bp, Artificial Sequence
  chemically synthesized
atttaaaaaatttggaggct

SEQ ID NO: 359833 - DNA, 20 bp, Artificial Sequence
  chemically synthesized
cactcatttaaaaaatttgg

SEQ ID NO: 359834 - DNA, 20 bp, Artificial Sequence
  chemically synthesized
ccactcatttaaaaaatttg

SEQ ID NO: 359835 - DNA, 20 bp, Artificial Sequence
  chemically synthesized
ttccactcatttaaaaaatt

SEQ ID NO: 359836 - DNA, 20 bp, Artificial Sequence
  chemically synthesized
agcctccaaattttttaaat

SEQ ID NO: 359837 - DNA, 20 bp, Artificial Sequence
  chemically synthesized
ctccaaattttttaaatgag

SEQ ID NO: 359838 - DNA, 20 bp, Artificial Sequence
  chemically synthesized
ttaaatgagtggaaaacttt

SEQ ID NO: 359839 - DNA, 20 bp, Artificial Sequence
  chemically synthesized
tgacttgtattgattgctta

SEQ ID NO: 359840 - DNA, 20 bp, Artificial Sequence
  chemically synthesized
aaactttaagcaatcaatac

SEQ ID NO: 359841 - DNA, 20 bp, Artificial Sequence
  chemically synthesized
atatgatacacctcaaataa

SEQ ID NO: 359842 - DNA, 20 bp, Artificial Sequence
  chemically synthesized
tagtataccacttttatttg

SEQ ID NO: 359843 - DNA, 20 bp, Artificial Sequence
  chemically synthesized
gtagtataccacttttattt

SEQ ID NO: 359844 - DNA, 20 bp, Artificial Sequence
  chemically synthesized
tgatacacctcaaataaaag

SEQ ID NO: 359845 - DNA, 20 bp, Artificial Sequence
  chemically synthesized
taaaagtggtatactacact

SEQ ID NO: 359846 - DNA, 20 bp, Artificial Sequence
  chemically synthesized
tatctgcaaggcactcagtg

SEQ ID NO: 359847 - DNA, 20 bp, Artificial Sequence
  chemically synthesized
gagaatatctgcaaggcact

SEQ ID NO: 359848 - DNA, 20 bp, Artificial Sequence
  chemically synthesized
atactacactgagtgccttg

SEQ ID NO: 359849 - DNA, 20 bp, Artificial Sequence
  chemically synthesized
taagtgggagaatatctgca

SEQ ID NO: 359850 - DNA, 20 bp, Artificial Sequence
  chemically synthesized
ttaagtgggagaatatctgc

SEQ ID NO: 359851 - DNA, 20 bp, Artificial Sequence
  chemically synthesized
ttcttatcacgattaagtgg

SEQ ID NO: 359852 - DNA, 20 bp, Artificial Sequence
  chemically synthesized
atttcttatcacgattaagt

SEQ ID NO: 359853 - DNA, 20 bp, Artificial Sequence
  chemically synthesized
tatttcttatcacgattaag

SEQ ID NO: 359854 - DNA, 20 bp, Artificial Sequence
  chemically synthesized
atgtatttcttatcacgatt

SEQ ID NO: 359855 - DNA, 20 bp, Artificial Sequence
  chemically synthesized
ttctcccacttaatcgtgat

SEQ ID NO: 359856 - DNA, 20 bp, Artificial Sequence
  chemically synthesized
ttttatttttactcttttga

SEQ ID NO: 359857 - DNA, 20 bp, Artificial Sequence
  chemically synthesized
tggtcccttcactatcaaaa

SEQ ID NO: 359858 - DNA, 20 bp, Artificial Sequence
  chemically synthesized
catggtcccttcactatcaa

SEQ ID NO: 359859 - DNA, 20 bp, Artificial Sequence
  chemically synthesized
tttttactcttttgatagtg

SEQ ID NO: 359860 - DNA, 20 bp, Artificial Sequence
  chemically synthesized
ttttactcttttgatagtga

SEQ ID NO: 359861 - DNA, 20 bp, Artificial Sequence
  chemically synthesized
tttactcttttgatagtgaa

SEQ ID NO: 359862 - DNA, 20 bp, Artificial Sequence
  chemically synthesized
ttttgatagtgaagggacca

SEQ ID NO: 359863 - DNA, 20 bp, Artificial Sequence
  chemically synthesized
atagtgaagggaccatggcc

SEQ ID NO: 359864 - DNA, 20 bp, Artificial Sequence
  chemically synthesized
gccacccctgttctgggcca

SEQ ID NO: 359865 - DNA, 20 bp, Artificial Sequence
  chemically synthesized
gaagggaccatggcccagaa

SEQ ID NO: 359866 - DNA, 20 bp, Artificial Sequence
  chemically synthesized
aagggaccatggcccagaac

SEQ ID NO: 359867 - DNA, 20 bp, Artificial Sequence
  chemically synthesized
agggaccatggcccagaaca

SEQ ID NO: 359868 - DNA, 20 bp, Artificial Sequence
  chemically synthesized
gggaccatggcccagaacag

SEQ ID NO: 359869 - DNA, 20 bp, Artificial Sequence
  chemically synthesized
tatattgccacccctgttct

SEQ ID NO: 359870 - DNA, 20 bp, Artificial Sequence
  chemically synthesized
gtatattgccacccctgttc

SEQ ID NO: 359871 - DNA, 20 bp, Artificial Sequence
  chemically synthesized
accatggcccagaacagggg

SEQ ID NO: 359872 - DNA, 20 bp, Artificial Sequence
  chemically synthesized
gttaccatcttagtggcatt

SEQ ID NO: 359873 - DNA, 20 bp, Artificial Sequence
  chemically synthesized
gcaatataccaaatgccact

SEQ ID NO: 359874 - DNA, 20 bp, Artificial Sequence
  chemically synthesized
tataccaaatgccactaaga

SEQ ID NO: 359875 - DNA, 20 bp, Artificial Sequence
  chemically synthesized
ttccacggttaccatcttag

SEQ ID NO: 359876 - DNA, 20 bp, Artificial Sequence
  chemically synthesized
aacttccacggttaccatct

SEQ ID NO: 359877 - DNA, 20 bp, Artificial Sequence
  chemically synthesized
tgccactaagatggtaaccg

SEQ ID NO: 359878 - DNA, 20 bp, Artificial Sequence
  chemically synthesized
cactaagatggtaaccgtgg

SEQ ID NO: 359879 - DNA, 20 bp, Artificial Sequence
  chemically synthesized
aacttgaatttaaacttcca

SEQ ID NO: 359880 - DNA, 20 bp, Artificial Sequence
  chemically synthesized
aaccgtggaagtttaaattc

SEQ ID NO: 359881 - DNA, 20 bp, Artificial Sequence
  chemically synthesized
gtttaaattcaagttcatgt

SEQ ID NO: 359882 - DNA, 20 bp, Artificial Sequence
  chemically synthesized
tttatacatatgtgtataac

SEQ ID NO: 359883 - DNA, 20 bp, Artificial Sequence
  chemically synthesized
cattgtatatatatacgtaa

SEQ ID NO: 359884 - DNA, 20 bp, Artificial Sequence
  chemically synthesized
attacgtatatatatacaat

SEQ ID NO: 359885 - DNA, 20 bp, Artificial Sequence
  chemically synthesized
acgtatatatatacaatgag

SEQ ID NO: 359886 - DNA, 20 bp, Artificial Sequence
  chemically synthesized
atacaatgagtggaaaatat

SEQ ID NO: 359887 - DNA, 20 bp, Artificial Sequence
  chemically synthesized
caatgagtggaaaatattag

SEQ ID NO: 359888 - DNA, 20 bp, Artificial Sequence
  chemically synthesized
tggaaaatattagtggatat

SEQ ID NO: 359889 - DNA, 20 bp, Artificial Sequence
  chemically synthesized
cattgtatacatatacataa

SEQ ID NO: 359890 - DNA, 20 bp, Artificial Sequence
  chemically synthesized
attatgtatatgtatacaat

SEQ ID NO: 359891 - DNA, 20 bp, Artificial Sequence
  chemically synthesized
atgtatatgtatacaatgag

SEQ ID NO: 359892 - DNA, 20 bp, Artificial Sequence
  chemically synthesized
atacaatgagtggataatat

SEQ ID NO: 359893 - DNA, 20 bp, Artificial Sequence
  chemically synthesized
caatgagtggataatattag

SEQ ID NO: 359894 - DNA, 20 bp, Artificial Sequence
  chemically synthesized
tggataatattagtggatat

SEQ ID NO: 359895 - DNA, 20 bp, Artificial Sequence
  chemically synthesized
tagtggatataagttcatgt

SEQ ID NO: 359896 - DNA, 20 bp, Artificial Sequence
  chemically synthesized
cacattatatatgtatatat

SEQ ID NO: 359897 - DNA, 20 bp, Artificial Sequence
  chemically synthesized
atatatacatatataatgtg

SEQ ID NO: 359898 - DNA, 20 bp, Artificial Sequence
  chemically synthesized
catatataatgtgtggatat

SEQ ID NO: 359899 - DNA, 20 bp, Artificial Sequence
  chemically synthesized
atatatacatatataatgtg

SEQ ID NO: 359900 - DNA, 20 bp, Artificial Sequence
  chemically synthesized
catatataatgtgtggatat

SEQ ID NO: 359901 - DNA, 20 bp, Artificial Sequence
  chemically synthesized
tgtatatatgtgtgtatata

SEQ ID NO: 359902 - DNA, 20 bp, Artificial Sequence
  chemically synthesized
cacccgtgtgtgtgtgtgtg

SEQ ID NO: 359903 - DNA, 20 bp, Artificial Sequence
  chemically synthesized
atactacacacacacacaca

SEQ ID NO: 359904 - DNA, 20 bp, Artificial Sequence
  chemically synthesized
tactacacacacacacacac

SEQ ID NO: 359905 - DNA, 20 bp, Artificial Sequence
  chemically synthesized
aaggatttgtggaaaagata

SEQ ID NO: 359906 - DNA, 20 bp, Artificial Sequence
  chemically synthesized
gggttgaaggatttgtggaa

SEQ ID NO: 359907 - DNA, 20 bp, Artificial Sequence
  chemically synthesized
aaaatgggttgaaggatttg

SEQ ID NO: 359908 - DNA, 20 bp, Artificial Sequence
  chemically synthesized
acctctgcaaaatgggttga

SEQ ID NO: 359909 - DNA, 20 bp, Artificial Sequence
  chemically synthesized
gacctctgcaaaatgggttg

SEQ ID NO: 359910 - DNA, 20 bp, Artificial Sequence
  chemically synthesized
aaatccttcaacccattttg

SEQ ID NO: 359911 - DNA, 20 bp, Artificial Sequence
  chemically synthesized
ctatttgacctctgcaaaat

SEQ ID NO: 359912 - DNA, 20 bp, Artificial Sequence
  chemically synthesized
atccttcaacccattttgca

SEQ ID NO: 359913 - DNA, 20 bp, Artificial Sequence
  chemically synthesized
tctatttgacctctgcaaaa

SEQ ID NO: 359914 - DNA, 20 bp, Artificial Sequence
  chemically synthesized
tccttcaacccattttgcag

SEQ ID NO: 359915 - DNA, 20 bp, Artificial Sequence
  chemically synthesized
cccattttgcagaggtcaaa

SEQ ID NO: 359916 - DNA, 20 bp, Artificial Sequence
  chemically synthesized
ttttgcagaggtcaaataga

SEQ ID NO: 359917 - DNA, 20 bp, Artificial Sequence
  chemically synthesized
gcagaggtcaaatagacagt

SEQ ID NO: 359918 - DNA, 20 bp, Artificial Sequence
  chemically synthesized
gaggtcaaatagacagtcgg

SEQ ID NO: 359919 - DNA, 20 bp, Artificial Sequence
  chemically synthesized
cagtcggaagaccctatgct

SEQ ID NO: 359920 - DNA, 20 bp, Artificial Sequence
  chemically synthesized
agtcggaagaccctatgctc

SEQ ID NO: 359921 - DNA, 20 bp, Artificial Sequence
  chemically synthesized
ttttaagtcacctgagcata

SEQ ID NO: 359922 - DNA, 20 bp, Artificial Sequence
  chemically synthesized
tttttaagtcacctgagcat

SEQ ID NO: 359923 - DNA, 20 bp, Artificial Sequence
  chemically synthesized
atttttaagtcacctgagca

SEQ ID NO: 359924 - DNA, 20 bp, Artificial Sequence
  chemically synthesized
aaattatttttaagtcacct

SEQ ID NO: 359925 - DNA, 20 bp, Artificial Sequence
  chemically synthesized
gtgatttggaaattattttt

SEQ ID NO: 359926 - DNA, 20 bp, Artificial Sequence
  chemically synthesized
acaaactccataatgtgatt

SEQ ID NO: 359927 - DNA, 20 bp, Artificial Sequence
  chemically synthesized
ataatttccaaatcacatta

SEQ ID NO: 359928 - DNA, 20 bp, Artificial Sequence
  chemically synthesized
aatttccaaatcacattatg

SEQ ID NO: 359929 - DNA, 20 bp, Artificial Sequence
  chemically synthesized
gtattacacacatttattga

SEQ ID NO: 359930 - DNA, 20 bp, Artificial Sequence
  chemically synthesized
attacacacatttattgata

SEQ ID NO: 359931 - DNA, 20 bp, Artificial Sequence
  chemically synthesized
ataaaagattagtagaatat

SEQ ID NO: 359932 - DNA, 20 bp, Artificial Sequence
  chemically synthesized
aataaaagattagtagaata

SEQ ID NO: 359933 - DNA, 20 bp, Artificial Sequence
  chemically synthesized
tattgccaataaaagattag

SEQ ID NO: 359934 - DNA, 20 bp, Artificial Sequence
  chemically synthesized
aattattgccaataaaagat

SEQ ID NO: 359935 - DNA, 20 bp, Artificial Sequence
  chemically synthesized
atattctactaatcttttat

SEQ ID NO: 359936 - DNA, 20 bp, Artificial Sequence
  chemically synthesized
acataaattattgccaataa

SEQ ID NO: 359937 - DNA, 20 bp, Artificial Sequence
  chemically synthesized
tattggcaataatttatgtt

SEQ ID NO: 359938 - DNA, 20 bp, Artificial Sequence
  chemically synthesized
aatttatgttaagaataccc

SEQ ID NO: 359939 - DNA, 20 bp, Artificial Sequence
  chemically synthesized
tgttaagaatacccaagact

SEQ ID NO: 359940 - DNA, 20 bp, Artificial Sequence
  chemically synthesized
aatgaggctttctcagtctt

SEQ ID NO: 359941 - DNA, 20 bp, Artificial Sequence
  chemically synthesized
gaatgaggctttctcagtct

SEQ ID NO: 359942 - DNA, 20 bp, Artificial Sequence
  chemically synthesized
aagaatacccaagactgaga

SEQ ID NO: 359943 - DNA, 20 bp, Artificial Sequence
  chemically synthesized
ccaaaggaatgaggctttct

SEQ ID NO: 359944 - DNA, 20 bp, Artificial Sequence
  chemically synthesized
taatcactaccaaaggaatg

SEQ ID NO: 359945 - DNA, 20 bp, Artificial Sequence
  chemically synthesized
ctgagaaagcctcattcctt

SEQ ID NO: 359946 - DNA, 20 bp, Artificial Sequence
  chemically synthesized
ttaatcactaccaaaggaat

SEQ ID NO: 359947 - DNA, 20 bp, Artificial Sequence
  chemically synthesized
agaaagcctcattcctttgg

SEQ ID NO: 359948 - DNA, 20 bp, Artificial Sequence
  chemically synthesized
tttattttaatcactaccaa

SEQ ID NO: 359949 - DNA, 20 bp, Artificial Sequence
  chemically synthesized
ttttattttaatcactacca

SEQ ID NO: 359950 - DNA, 20 bp, Artificial Sequence
  chemically synthesized
aacttgtctataagttaatt

SEQ ID NO: 359951 - DNA, 20 bp, Artificial Sequence
  chemically synthesized
aaacatactaaattaactta

SEQ ID NO: 359952 - DNA, 20 bp, Artificial Sequence
  chemically synthesized
tactaaattaacttatagac

SEQ ID NO: 359953 - DNA, 20 bp, Artificial Sequence
  chemically synthesized
atgttctataacttgtctat

SEQ ID NO: 359954 - DNA, 20 bp, Artificial Sequence
  chemically synthesized
attaacttatagacaagtta

SEQ ID NO: 359955 - DNA, 20 bp, Artificial Sequence
  chemically synthesized
acaaagtcccaatcataggt

SEQ ID NO: 359956 - DNA, 20 bp, Artificial Sequence
  chemically synthesized
aaaaattactcacctatgat

SEQ ID NO: 359957 - DNA, 20 bp, Artificial Sequence
  chemically synthesized
aaaattactcacctatgatt

SEQ ID NO: 359958 - DNA, 20 bp, Artificial Sequence
  chemically synthesized
aaatacaaagtcccaatcat

SEQ ID NO: 359959 - DNA, 20 bp, Artificial Sequence
  chemically synthesized
aaaatacaaagtcccaatca

SEQ ID NO: 359960 - DNA, 20 bp, Artificial Sequence
  chemically synthesized
aagtataaggtaaaaataca

SEQ ID NO: 359961 - DNA, 20 bp, Artificial Sequence
  chemically synthesized
tatttcattgagtaagtata

SEQ ID NO: 359962 - DNA, 20 bp, Artificial Sequence
  chemically synthesized
ttatttcattgagtaagtat

SEQ ID NO: 359963 - DNA, 20 bp, Artificial Sequence
  chemically synthesized
aaaattttatttcattgagt

SEQ ID NO: 359964 - DNA, 20 bp, Artificial Sequence
  chemically synthesized
tttcaaaattttatttcatt

SEQ ID NO: 359965 - DNA, 20 bp, Artificial Sequence
  chemically synthesized
ataggttctggtacatttac

SEQ ID NO: 359966 - DNA, 20 bp, Artificial Sequence
  chemically synthesized
aataggttctggtacattta

SEQ ID NO: 359967 - DNA, 20 bp, Artificial Sequence
  chemically synthesized
aaatattcctgtaaatgtac

SEQ ID NO: 359968 - DNA, 20 bp, Artificial Sequence
  chemically synthesized
tcacggtataaaataggttc

SEQ ID NO: 359969 - DNA, 20 bp, Artificial Sequence
  chemically synthesized
ggatcatcacggtataaaat

SEQ ID NO: 359970 - DNA, 20 bp, Artificial Sequence
  chemically synthesized
aggatcatcacggtataaaa

SEQ ID NO: 359971 - DNA, 20 bp, Artificial Sequence
  chemically synthesized
tgaaatgttaaggatcatca

SEQ ID NO: 359972 - DNA, 20 bp, Artificial Sequence
  chemically synthesized
ccatgtcgtctgaaatgtta

SEQ ID NO: 359973 - DNA, 20 bp, Artificial Sequence
  chemically synthesized
cgtgatgatccttaacattt

SEQ ID NO: 359974 - DNA, 20 bp, Artificial Sequence
  chemically synthesized
accatgtcgtctgaaatgtt

SEQ ID NO: 359975 - DNA, 20 bp, Artificial Sequence
  chemically synthesized
ccttaacatttcagacgaca

SEQ ID NO: 359976 - DNA, 20 bp, Artificial Sequence
  chemically synthesized
taacatttcagacgacatgg

SEQ ID NO: 359977 - DNA, 20 bp, Artificial Sequence
  chemically synthesized
catggtagtgtcaatttaaa

SEQ ID NO: 359978 - DNA, 20 bp, Artificial Sequence
  chemically synthesized
ggtagtgtcaatttaaaaag

SEQ ID NO: 359979 - DNA, 20 bp, Artificial Sequence
  chemically synthesized
caatttaaaaagcagcacta

SEQ ID NO: 359980 - DNA, 20 bp, Artificial Sequence
  chemically synthesized
atttaaaaagcagcactatg

SEQ ID NO: 359981 - DNA, 20 bp, Artificial Sequence
  chemically synthesized
taaaaagcagcactatggag

SEQ ID NO: 359982 - DNA, 20 bp, Artificial Sequence
  chemically synthesized
aaaaagcagcactatggagc

SEQ ID NO: 359983 - DNA, 20 bp, Artificial Sequence
  chemically synthesized
aaaagcagcactatggagca

SEQ ID NO: 359984 - DNA, 20 bp, Artificial Sequence
  chemically synthesized
caataacaaaccctgctcca

SEQ ID NO: 359985 - DNA, 20 bp, Artificial Sequence
  chemically synthesized
ggagcagggtttgttattgt

SEQ ID NO: 359986 - DNA, 20 bp, Artificial Sequence
  chemically synthesized
acacatttgtttcacacgtc

SEQ ID NO: 359987 - DNA, 20 bp, Artificial Sequence
  chemically synthesized
cacatttgtttcacacgtca

SEQ ID NO: 359988 - DNA, 20 bp, Artificial Sequence
  chemically synthesized
acatttgtttcacacgtcaa

SEQ ID NO: 359989 - DNA, 20 bp, Artificial Sequence
  chemically synthesized
aagggtaaaaattaaaaaac

SEQ ID NO: 359990 - DNA, 20 bp, Artificial Sequence
  chemically synthesized
acaagattaatgttacccaa

SEQ ID NO: 359991 - DNA, 20 bp, Artificial Sequence
  chemically synthesized
caagattaatgttacccaaa

SEQ ID NO: 359992 - DNA, 20 bp, Artificial Sequence
  chemically synthesized
ctgatgaatggtttcctttt

SEQ ID NO: 359993 - DNA, 20 bp, Artificial Sequence
  chemically synthesized
cctgatgaatggtttccttt

SEQ ID NO: 359994 - DNA, 20 bp, Artificial Sequence
  chemically synthesized
cccaaaaggaaaccattcat

SEQ ID NO: 359995 - DNA, 20 bp, Artificial Sequence
  chemically synthesized
ccaaaaggaaaccattcatc

SEQ ID NO: 359996 - DNA, 20 bp, Artificial Sequence
  chemically synthesized
caggtaagaatcctgatgaa

SEQ ID NO: 359997 - DNA, 20 bp, Artificial Sequence
  chemically synthesized
tcatcaggattcttacctgc

SEQ ID NO: 359998 - DNA, 20 bp, Artificial Sequence
  chemically synthesized
ataatcctccactggcaggt

SEQ ID NO: 359999 - DNA, 20 bp, Artificial Sequence
  chemically synthesized
tcaggattcttacctgccag

SEQ ID NO: 360000 - DNA, 20 bp, Artificial Sequence
  chemically synthesized
aggattcttacctgccagtg

SEQ ID NO: 360001 - DNA, 20 bp, Artificial Sequence
  chemically synthesized
gaatataatcctccactggc

SEQ ID NO: 360002 - DNA, 20 bp, Artificial Sequence
  chemically synthesized
ggattcttacctgccagtgg

SEQ ID NO: 360003 - DNA, 20 bp, Artificial Sequence
  chemically synthesized
ggaatataatcctccactgg

SEQ ID NO: 360004 - DNA, 20 bp, Artificial Sequence
  chemically synthesized
tttggaatataatcctccac

SEQ ID NO: 360005 - DNA, 20 bp, Artificial Sequence
  chemically synthesized
aactgactcttggtttgatt

SEQ ID NO: 360006 - DNA, 20 bp, Artificial Sequence
  chemically synthesized
attatattccaaatcaaacc

SEQ ID NO: 360007 - DNA, 20 bp, Artificial Sequence
  chemically synthesized
tatattccaaatcaaaccaa

SEQ ID NO: 360008 - DNA, 20 bp, Artificial Sequence
  chemically synthesized
ttccaaatcaaaccaagagt

SEQ ID NO: 360009 - DNA, 20 bp, Artificial Sequence
  chemically synthesized
ggaaatcataaactgactct

SEQ ID NO: 360010 - DNA, 20 bp, Artificial Sequence
  chemically synthesized
ggaagtactgacatcgtaga

SEQ ID NO: 360011 - DNA, 20 bp, Artificial Sequence
  chemically synthesized
atgatttccatctacgatgt

SEQ ID NO: 360012 - DNA, 20 bp, Artificial Sequence
  chemically synthesized
tattggaagtactgacatcg

SEQ ID NO: 360013 - DNA, 20 bp, Artificial Sequence
  chemically synthesized
gttgatttagtgaatattgg

SEQ ID NO: 360014 - DNA, 20 bp, Artificial Sequence
  chemically synthesized
caggttgatttagtgaatat

SEQ ID NO: 360015 - DNA, 20 bp, Artificial Sequence
  chemically synthesized
ctttctttaacaggttgatt

SEQ ID NO: 360016 - DNA, 20 bp, Artificial Sequence
  chemically synthesized
ttcactaaatcaacctgtta

SEQ ID NO: 360017 - DNA, 20 bp, Artificial Sequence
  chemically synthesized
gttttacccctttctttaac

SEQ ID NO: 360018 - DNA, 20 bp, Artificial Sequence
  chemically synthesized
ctaaatcaacctgttaaaga

SEQ ID NO: 360019 - DNA, 20 bp, Artificial Sequence
  chemically synthesized
tgttttacccctttctttaa

SEQ ID NO: 360020 - DNA, 20 bp, Artificial Sequence
  chemically synthesized
taaatcaacctgttaaagaa

SEQ ID NO: 360021 - DNA, 20 bp, Artificial Sequence
  chemically synthesized
aaatcaacctgttaaagaaa

SEQ ID NO: 360022 - DNA, 20 bp, Artificial Sequence
  chemically synthesized
aatcaacctgttaaagaaag

SEQ ID NO: 360023 - DNA, 20 bp, Artificial Sequence
  chemically synthesized
agaaaggggtaaaacatttg

SEQ ID NO: 360024 - DNA, 20 bp, Artificial Sequence
  chemically synthesized
gaaaggggtaaaacatttga

SEQ ID NO: 360025 - DNA, 20 bp, Artificial Sequence
  chemically synthesized
ggggtaaaacatttgaaggt

SEQ ID NO: 360026 - DNA, 20 bp, Artificial Sequence
  chemically synthesized
ggtaaaacatttgaaggtaa

SEQ ID NO: 360027 - DNA, 20 bp, Artificial Sequence
  chemically synthesized
aaggtaagagaccaaatgcc

SEQ ID NO: 360028 - DNA, 20 bp, Artificial Sequence
  chemically synthesized
tattattgcaactaggcatt

SEQ ID NO: 360029 - DNA, 20 bp, Artificial Sequence
  chemically synthesized
ttattattattattgcaact

SEQ ID NO: 360030 - DNA, 20 bp, Artificial Sequence
  chemically synthesized
attattattattattgcaac

SEQ ID NO: 360031 - DNA, 20 bp, Artificial Sequence
  chemically synthesized
ataataataataaaaacgtg

SEQ ID NO: 360032 - DNA, 20 bp, Artificial Sequence
  chemically synthesized
taataataataaaaacgtga

SEQ ID NO: 360033 - DNA, 20 bp, Artificial Sequence
  chemically synthesized
aacgtgaaggtaattgcatt

SEQ ID NO: 360034 - DNA, 20 bp, Artificial Sequence
  chemically synthesized
taattgcatttagctatttt

SEQ ID NO: 360035 - DNA, 20 bp, Artificial Sequence
  chemically synthesized
attgcatttagctattttca

SEQ ID NO: 360036 - DNA, 20 bp, Artificial Sequence
  chemically synthesized
caatgctaagtctctgaaaa

SEQ ID NO: 360037 - DNA, 20 bp, Artificial Sequence
  chemically synthesized
tttagctattttcagagact

SEQ ID NO: 360038 - DNA, 20 bp, Artificial Sequence
  chemically synthesized
ttttcagagacttagcattg

SEQ ID NO: 360039 - DNA, 20 bp, Artificial Sequence
  chemically synthesized
tttcaaaaagcttcaatgct

SEQ ID NO: 360040 - DNA, 20 bp, Artificial Sequence
  chemically synthesized
atttttagattattttcaaa

SEQ ID NO: 360041 - DNA, 20 bp, Artificial Sequence
  chemically synthesized
catgcattttgtttaatttt

SEQ ID NO: 360042 - DNA, 20 bp, Artificial Sequence
  chemically synthesized
gggtgcttgtttgttatgga

SEQ ID NO: 360043 - DNA, 20 bp, Artificial Sequence
  chemically synthesized
tttggggtgcttgtttgtta

SEQ ID NO: 360044 - DNA, 20 bp, Artificial Sequence
  chemically synthesized
aatcactttccataacaaac

SEQ ID NO: 360045 - DNA, 20 bp, Artificial Sequence
  chemically synthesized
gctgaaagtaaatatatttg

SEQ ID NO: 360046 - DNA, 20 bp, Artificial Sequence
  chemically synthesized
tgctgaaagtaaatatattt

SEQ ID NO: 360047 - DNA, 20 bp, Artificial Sequence
  chemically synthesized
gtgctgaaagtaaatatatt

SEQ ID NO: 360048 - DNA, 20 bp, Artificial Sequence
  chemically synthesized
accccaaatatatttacttt

SEQ ID NO: 360049 - DNA, 20 bp, Artificial Sequence
  chemically synthesized
gtaatctattcatgtgctga

SEQ ID NO: 360050 - DNA, 20 bp, Artificial Sequence
  chemically synthesized
atttactttcagcacatgaa

SEQ ID NO: 360051 - DNA, 20 bp, Artificial Sequence
  chemically synthesized
agcacatgaatagattactg

SEQ ID NO: 360052 - DNA, 20 bp, Artificial Sequence
  chemically synthesized
gaatagattactgcagatta

SEQ ID NO: 360053 - DNA, 20 bp, Artificial Sequence
  chemically synthesized
cagttgacctctttaatctg

SEQ ID NO: 360054 - DNA, 20 bp, Artificial Sequence
  chemically synthesized
atagattactgcagattaaa

SEQ ID NO: 360055 - DNA, 20 bp, Artificial Sequence
  chemically synthesized
tagattactgcagattaaag

SEQ ID NO: 360056 - DNA, 20 bp, Artificial Sequence
  chemically synthesized
tgcagattaaagaggtcaac

SEQ ID NO: 360057 - DNA, 20 bp, Artificial Sequence
  chemically synthesized
cagattaaagaggtcaactg

SEQ ID NO: 360058 - DNA, 20 bp, Artificial Sequence
  chemically synthesized
cattttatttggagatactc

SEQ ID NO: 360059 - DNA, 20 bp, Artificial Sequence
  chemically synthesized
actttatgacattttatttg

SEQ ID NO: 360060 - DNA, 20 bp, Artificial Sequence
  chemically synthesized
atactttatgacattttatt

SEQ ID NO: 360061 - DNA, 20 bp, Artificial Sequence
  chemically synthesized
tctccaaataaaatgtcata

SEQ ID NO: 360062 - DNA, 20 bp, Artificial Sequence
  chemically synthesized
cataaagtatgtttaaaatt

SEQ ID NO: 360063 - DNA, 20 bp, Artificial Sequence
  chemically synthesized
taaaattaagatatgctttc

SEQ ID NO: 360064 - DNA, 20 bp, Artificial Sequence
  chemically synthesized
ttaagatatgctttctagta

SEQ ID NO: 360065 - DNA, 20 bp, Artificial Sequence
  chemically synthesized
agttgtaattccatactaga

SEQ ID NO: 360066 - DNA, 20 bp, Artificial Sequence
  chemically synthesized
tctgagttgtaattccatac

SEQ ID NO: 360067 - DNA, 20 bp, Artificial Sequence
  chemically synthesized
tctagtatggaattacaact

SEQ ID NO: 360068 - DNA, 20 bp, Artificial Sequence
  chemically synthesized
aagtactggtgaatttttct

SEQ ID NO: 360069 - DNA, 20 bp, Artificial Sequence
  chemically synthesized
tacaactcagaaaaattcac

SEQ ID NO: 360070 - DNA, 20 bp, Artificial Sequence
  chemically synthesized
ttggagctaggtggaagtac

SEQ ID NO: 360071 - DNA, 20 bp, Artificial Sequence
  chemically synthesized
aattcaccagtacttccacc

SEQ ID NO: 360072 - DNA, 20 bp, Artificial Sequence
  chemically synthesized
cactccttggagctaggtgg

SEQ ID NO: 360073 - DNA, 20 bp, Artificial Sequence
  chemically synthesized
tggcactccttggagctagg

SEQ ID NO: 360074 - DNA, 20 bp, Artificial Sequence
  chemically synthesized
cagtacttccacctagctcc

SEQ ID NO: 360075 - DNA, 20 bp, Artificial Sequence
  chemically synthesized
agtacttccacctagctcca

SEQ ID NO: 360076 - DNA, 20 bp, Artificial Sequence
  chemically synthesized
taatggcactccttggagct

SEQ ID NO: 360077 - DNA, 20 bp, Artificial Sequence
  chemically synthesized
ataatggcactccttggagc

SEQ ID NO: 360078 - DNA, 20 bp, Artificial Sequence
  chemically synthesized
tacttccacctagctccaag

SEQ ID NO: 360079 - DNA, 20 bp, Artificial Sequence
  chemically synthesized
aattataatggcactccttg

SEQ ID NO: 360080 - DNA, 20 bp, Artificial Sequence
  chemically synthesized
ttaattataatggcactcct

SEQ ID NO: 360081 - DNA, 20 bp, Artificial Sequence
  chemically synthesized
gcagtcagccttaattataa

SEQ ID NO: 360082 - DNA, 20 bp, Artificial Sequence
  chemically synthesized
caaggagtgccattataatt

SEQ ID NO: 360083 - DNA, 20 bp, Artificial Sequence
  chemically synthesized
aaggagtgccattataatta

SEQ ID NO: 360084 - DNA, 20 bp, Artificial Sequence
  chemically synthesized
gcgttttactaaaatgcagt

SEQ ID NO: 360085 - DNA, 20 bp, Artificial Sequence
  chemically synthesized
aattaaggctgactgcattt

SEQ ID NO: 360086 - DNA, 20 bp, Artificial Sequence
  chemically synthesized
agaggcgttttactaaaatg

SEQ ID NO: 360087 - DNA, 20 bp, Artificial Sequence
  chemically synthesized
ttagtaaaacgcctctgttt

SEQ ID NO: 360088 - DNA, 20 bp, Artificial Sequence
  chemically synthesized
taacattcattctaaaacag

SEQ ID NO: 360089 - DNA, 20 bp, Artificial Sequence
  chemically synthesized
ctaacattcattctaaaaca

SEQ ID NO: 360090 - DNA, 20 bp, Artificial Sequence
  chemically synthesized
acctaacattcattctaaaa

SEQ ID NO: 360091 - DNA, 20 bp, Artificial Sequence
  chemically synthesized
ctctgttttagaatgaatgt

SEQ ID NO: 360092 - DNA, 20 bp, Artificial Sequence
  chemically synthesized
tctgttttagaatgaatgtt

SEQ ID NO: 360093 - DNA, 20 bp, Artificial Sequence
  chemically synthesized
gtttgctccattgtttatta

SEQ ID NO: 360094 - DNA, 20 bp, Artificial Sequence
  chemically synthesized
cagtttgctccattgtttat

SEQ ID NO: 360095 - DNA, 20 bp, Artificial Sequence
  chemically synthesized
gttaggtctctaataaacaa

SEQ ID NO: 360096 - DNA, 20 bp, Artificial Sequence
  chemically synthesized
taggtctctaataaacaatg

SEQ ID NO: 360097 - DNA, 20 bp, Artificial Sequence
  chemically synthesized
taaacaatggagcaaactgc

SEQ ID NO: 360098 - DNA, 20 bp, Artificial Sequence
  chemically synthesized
gacagagataagagagctgg

SEQ ID NO: 360099 - DNA, 20 bp, Artificial Sequence
  chemically synthesized
ctagacagagataagagagc

SEQ ID NO: 360100 - DNA, 20 bp, Artificial Sequence
  chemically synthesized
agtcctagacagagataaga

SEQ ID NO: 360101 - DNA, 20 bp, Artificial Sequence
  chemically synthesized
acagtcctagacagagataa

SEQ ID NO: 360102 - DNA, 20 bp, Artificial Sequence
  chemically synthesized
acacagtcctagacagagat

SEQ ID NO: 360103 - DNA, 20 bp, Artificial Sequence
  chemically synthesized
ccagctctcttatctctgtc

SEQ ID NO: 360104 - DNA, 20 bp, Artificial Sequence
  chemically synthesized
cagctctcttatctctgtct

SEQ ID NO: 360105 - DNA, 20 bp, Artificial Sequence
  chemically synthesized
tccaaacacagtcctagaca

SEQ ID NO: 360106 - DNA, 20 bp, Artificial Sequence
  chemically synthesized
tttccaaacacagtcctaga

SEQ ID NO: 360107 - DNA, 20 bp, Artificial Sequence
  chemically synthesized
ttcatttccaaacacagtcc

SEQ ID NO: 360108 - DNA, 20 bp, Artificial Sequence
  chemically synthesized
tctctgtctaggactgtgtt

SEQ ID NO: 360109 - DNA, 20 bp, Artificial Sequence
  chemically synthesized
cagattttcatttccaaaca

SEQ ID NO: 360110 - DNA, 20 bp, Artificial Sequence
  chemically synthesized
tgtgtttggaaatgaaaatc

SEQ ID NO: 360111 - DNA, 20 bp, Artificial Sequence
  chemically synthesized
gtttggaaatgaaaatctgg

SEQ ID NO: 360112 - DNA, 20 bp, Artificial Sequence
  chemically synthesized
tttggaaatgaaaatctggc

SEQ ID NO: 360113 - DNA, 20 bp, Artificial Sequence
  chemically synthesized
ttggaaatgaaaatctggca

SEQ ID NO: 360114 - DNA, 20 bp, Artificial Sequence
  chemically synthesized
taaggcaaataaaaccctgc

SEQ ID NO: 360115 - DNA, 20 bp, Artificial Sequence
  chemically synthesized
gggttttatttgccttaatc

SEQ ID NO: 360116 - DNA, 20 bp, Artificial Sequence
  chemically synthesized
ggttttatttgccttaatca

SEQ ID NO: 360117 - DNA, 20 bp, Artificial Sequence
  chemically synthesized
acagagatttgccttgatta

SEQ ID NO: 360118 - DNA, 20 bp, Artificial Sequence
  chemically synthesized
cacagagatttgccttgatt

SEQ ID NO: 360119 - DNA, 20 bp, Artificial Sequence
  chemically synthesized
tgtgaaggacaggagacaca

SEQ ID NO: 360120 - DNA, 20 bp, Artificial Sequence
  chemically synthesized
agtgtgaaggacaggagaca

SEQ ID NO: 360121 - DNA, 20 bp, Artificial Sequence
  chemically synthesized
ttgaggagtgtgaaggacag

SEQ ID NO: 360122 - DNA, 20 bp, Artificial Sequence
  chemically synthesized
atttgaggagtgtgaaggac

SEQ ID NO: 360123 - DNA, 20 bp, Artificial Sequence
  chemically synthesized
catttgaggagtgtgaagga

SEQ ID NO: 360124 - DNA, 20 bp, Artificial Sequence
  chemically synthesized
taaacatttgaggagtgtga

SEQ ID NO: 360125 - DNA, 20 bp, Artificial Sequence
  chemically synthesized
ttaaacatttgaggagtgtg

SEQ ID NO: 360126 - DNA, 20 bp, Artificial Sequence
  chemically synthesized
ctccaccttaaacatttgag

SEQ ID NO: 360127 - DNA, 20 bp, Artificial Sequence
  chemically synthesized
tactccaccttaaacatttg

SEQ ID NO: 360128 - DNA, 20 bp, Artificial Sequence
  chemically synthesized
ttactccaccttaaacattt

SEQ ID NO: 360129 - DNA, 20 bp, Artificial Sequence
  chemically synthesized
ttcacactcctcaaatgttt

SEQ ID NO: 360130 - DNA, 20 bp, Artificial Sequence
  chemically synthesized
tcacactcctcaaatgttta

SEQ ID NO: 360131 - DNA, 20 bp, Artificial Sequence
  chemically synthesized
cactcctcaaatgtttaagg

SEQ ID NO: 360132 - DNA, 20 bp, Artificial Sequence
  chemically synthesized
ctcctcaaatgtttaaggtg

SEQ ID NO: 360133 - DNA, 20 bp, Artificial Sequence
  chemically synthesized
caaatgtttaaggtggagta

SEQ ID NO: 360134 - DNA, 20 bp, Artificial Sequence
  chemically synthesized
ggtggagtaaagttaaacac

SEQ ID NO: 360135 - DNA, 20 bp, Artificial Sequence
  chemically synthesized
gttaaacacaagcatctgaa

SEQ ID NO: 360136 - DNA, 20 bp, Artificial Sequence
  chemically synthesized
aacacaagcatctgaaaagc

SEQ ID NO: 360137 - DNA, 20 bp, Artificial Sequence
  chemically synthesized
cttttcatatgcttgctttt

SEQ ID NO: 360138 - DNA, 20 bp, Artificial Sequence
  chemically synthesized
ctgaaaagcaagcatatgaa

SEQ ID NO: 360139 - DNA, 20 bp, Artificial Sequence
  chemically synthesized
gaaaagatgttcaatgtttt

SEQ ID NO: 360140 - DNA, 20 bp, Artificial Sequence
  chemically synthesized
tgttcaatgtttttagccaa

SEQ ID NO: 360141 - DNA, 20 bp, Artificial Sequence
  chemically synthesized
ttcaatgtttttagccaata

SEQ ID NO: 360142 - DNA, 20 bp, Artificial Sequence
  chemically synthesized
tcaatgtttttagccaatag

SEQ ID NO: 360143 - DNA, 20 bp, Artificial Sequence
  chemically synthesized
tacaatttgcattcctctat

SEQ ID NO: 360144 - DNA, 20 bp, Artificial Sequence
  chemically synthesized
tgtgcagtgatacattattg

SEQ ID NO: 360145 - DNA, 20 bp, Artificial Sequence
  chemically synthesized
taaccattatgataaatgtg

SEQ ID NO: 360146 - DNA, 20 bp, Artificial Sequence
  chemically synthesized
tcactgcacatttatcataa

SEQ ID NO: 360147 - DNA, 20 bp, Artificial Sequence
  chemically synthesized
taatggttaaaattaaaaaa

SEQ ID NO: 360148 - DNA, 20 bp, Artificial Sequence
  chemically synthesized
acaccctcaccagcatttta

SEQ ID NO: 360149 - DNA, 20 bp, Artificial Sequence
  chemically synthesized
aaaatagtgccataaaatgc

SEQ ID NO: 360150 - DNA, 20 bp, Artificial Sequence
  chemically synthesized
tagtgccataaaatgctggt

SEQ ID NO: 360151 - DNA, 20 bp, Artificial Sequence
  chemically synthesized
agtgccataaaatgctggtg

SEQ ID NO: 360152 - DNA, 20 bp, Artificial Sequence
  chemically synthesized
gtgccataaaatgctggtga

SEQ ID NO: 360153 - DNA, 20 bp, Artificial Sequence
  chemically synthesized
cagtttctccacaccctcac

SEQ ID NO: 360154 - DNA, 20 bp, Artificial Sequence
  chemically synthesized
ataaaatgctggtgagggtg

SEQ ID NO: 360155 - DNA, 20 bp, Artificial Sequence
  chemically synthesized
aaaatgctggtgagggtgtg

SEQ ID NO: 360156 - DNA, 20 bp, Artificial Sequence
  chemically synthesized
tggtgagggtgtggagaaac

SEQ ID NO: 360157 - DNA, 20 bp, Artificial Sequence
  chemically synthesized
ctagcaggggttgagtcatc

SEQ ID NO: 360158 - DNA, 20 bp, Artificial Sequence
  chemically synthesized
agtttccactagcaggggtt

SEQ ID NO: 360159 - DNA, 20 bp, Artificial Sequence
  chemically synthesized
ctggatgactcaacccctgc

SEQ ID NO: 360160 - DNA, 20 bp, Artificial Sequence
  chemically synthesized
gatgactcaacccctgctag

SEQ ID NO: 360161 - DNA, 20 bp, Artificial Sequence
  chemically synthesized
atttgagtttccactagcag

SEQ ID NO: 360162 - DNA, 20 bp, Artificial Sequence
  chemically synthesized
catttgagtttccactagca

SEQ ID NO: 360163 - DNA, 20 bp, Artificial Sequence
  chemically synthesized
tcatttgagtttccactagc

SEQ ID NO: 360164 - DNA, 20 bp, Artificial Sequence
  chemically synthesized
atcatttgagtttccactag

SEQ ID NO: 360165 - DNA, 20 bp, Artificial Sequence
  chemically synthesized
tatatcatttgagtttccac

SEQ ID NO: 360166 - DNA, 20 bp, Artificial Sequence
  chemically synthesized
ccaaagtggctatatcattt

SEQ ID NO: 360167 - DNA, 20 bp, Artificial Sequence
  chemically synthesized
tagtggaaactcaaatgata

SEQ ID NO: 360168 - DNA, 20 bp, Artificial Sequence
  chemically synthesized
ctcaaatgatatagccactt

SEQ ID NO: 360169 - DNA, 20 bp, Artificial Sequence
  chemically synthesized
tgccagactgttttccaaag

SEQ ID NO: 360170 - DNA, 20 bp, Artificial Sequence
  chemically synthesized
gatatagccactttggaaaa

SEQ ID NO: 360171 - DNA, 20 bp, Artificial Sequence
  chemically synthesized
aactgccagactgttttcca

SEQ ID NO: 360172 - DNA, 20 bp, Artificial Sequence
  chemically synthesized
agccactttggaaaacagtc

SEQ ID NO: 360173 - DNA, 20 bp, Artificial Sequence
  chemically synthesized
cactttggaaaacagtctgg

SEQ ID NO: 360174 - DNA, 20 bp, Artificial Sequence
  chemically synthesized
tcagttttgtgagaaactgc

SEQ ID NO: 360175 - DNA, 20 bp, Artificial Sequence
  chemically synthesized
aagtacatgttcagttttgt

SEQ ID NO: 360176 - DNA, 20 bp, Artificial Sequence
  chemically synthesized
ttgtataataagtacatgtt

SEQ ID NO: 360177 - DNA, 20 bp, Artificial Sequence
  chemically synthesized
caattaccagattgtataat

SEQ ID NO: 360178 - DNA, 20 bp, Artificial Sequence
  chemically synthesized
catgtacttattatacaatc

SEQ ID NO: 360179 - DNA, 20 bp, Artificial Sequence
  chemically synthesized
ttattatacaatctggtaat

SEQ ID NO: 360180 - DNA, 20 bp, Artificial Sequence
  chemically synthesized
tattatacaatctggtaatt

SEQ ID NO: 360181 - DNA, 20 bp, Artificial Sequence
  chemically synthesized
atgctcaagagcccaattac

SEQ ID NO: 360182 - DNA, 20 bp, Artificial Sequence
  chemically synthesized
aatctggtaattgggctctt

SEQ ID NO: 360183 - DNA, 20 bp, Artificial Sequence
  chemically synthesized
tccttgagataaatgctcaa

SEQ ID NO: 360184 - DNA, 20 bp, Artificial Sequence
  chemically synthesized
tttccttgagataaatgctc

SEQ ID NO: 360185 - DNA, 20 bp, Artificial Sequence
  chemically synthesized
ggctcttgagcatttatctc

SEQ ID NO: 360186 - DNA, 20 bp, Artificial Sequence
  chemically synthesized
gctcttgagcatttatctca

SEQ ID NO: 360187 - DNA, 20 bp, Artificial Sequence
  chemically synthesized
acatgtgttttcatttcctt

SEQ ID NO: 360188 - DNA, 20 bp, Artificial Sequence
  chemically synthesized
gtacacaaaaacctgcacct

SEQ ID NO: 360189 - DNA, 20 bp, Artificial Sequence
  chemically synthesized
tagtatgaacacttaggtgc

SEQ ID NO: 360190 - DNA, 20 bp, Artificial Sequence
  chemically synthesized
gtagtatgaacacttaggtg

SEQ ID NO: 360191 - DNA, 20 bp, Artificial Sequence
  chemically synthesized
taaacgtagtatgaacactt

SEQ ID NO: 360192 - DNA, 20 bp, Artificial Sequence
  chemically synthesized
ataaacgtagtatgaacact

SEQ ID NO: 360193 - DNA, 20 bp, Artificial Sequence
  chemically synthesized
ggggctattacaaataaacg

SEQ ID NO: 360194 - DNA, 20 bp, Artificial Sequence
  chemically synthesized
catactacgtttatttgtaa

SEQ ID NO: 360195 - DNA, 20 bp, Artificial Sequence
  chemically synthesized
tatttgtaatagccccaaac

SEQ ID NO: 360196 - DNA, 20 bp, Artificial Sequence
  chemically synthesized
atttgtaatagccccaaact

SEQ ID NO: 360197 - DNA, 20 bp, Artificial Sequence
  chemically synthesized
gcatctgggttcccagtttg

SEQ ID NO: 360198 - DNA, 20 bp, Artificial Sequence
  chemically synthesized
ggcatctgggttcccagttt

SEQ ID NO: 360199 - DNA, 20 bp, Artificial Sequence
  chemically synthesized
gggcatctgggttcccagtt

SEQ ID NO: 360200 - DNA, 20 bp, Artificial Sequence
  chemically synthesized
atagccccaaactgggaacc

SEQ ID NO: 360201 - DNA, 20 bp, Artificial Sequence
  chemically synthesized
cctgagggcatctgggttcc

SEQ ID NO: 360202 - DNA, 20 bp, Artificial Sequence
  chemically synthesized
atctacccctgagggcatct

SEQ ID NO: 360203 - DNA, 20 bp, Artificial Sequence
  chemically synthesized
tatctacccctgagggcatc

SEQ ID NO: 360204 - DNA, 20 bp, Artificial Sequence
  chemically synthesized
actgggaacccagatgccct

SEQ ID NO: 360205 - DNA, 20 bp, Artificial Sequence
  chemically synthesized
ctgggaacccagatgccctc

SEQ ID NO: 360206 - DNA, 20 bp, Artificial Sequence
  chemically synthesized
tgggaacccagatgccctca

SEQ ID NO: 360207 - DNA, 20 bp, Artificial Sequence
  chemically synthesized
gggaacccagatgccctcag

SEQ ID NO: 360208 - DNA, 20 bp, Artificial Sequence
  chemically synthesized
aacccagatgccctcagggg

SEQ ID NO: 360209 - DNA, 20 bp, Artificial Sequence
  chemically synthesized
gtttgtttatctacccctga

SEQ ID NO: 360210 - DNA, 20 bp, Artificial Sequence
  chemically synthesized
ggtttgtttatctacccctg

SEQ ID NO: 360211 - DNA, 20 bp, Artificial Sequence
  chemically synthesized
tggtttgtttatctacccct

SEQ ID NO: 360212 - DNA, 20 bp, Artificial Sequence
  chemically synthesized
aggggtagataaacaaacca

SEQ ID NO: 360213 - DNA, 20 bp, Artificial Sequence
  chemically synthesized
tagataaacaaaccatagta

SEQ ID NO: 360214 - DNA, 20 bp, Artificial Sequence
  chemically synthesized
tccatggtgtggctgtacta

SEQ ID NO: 360215 - DNA, 20 bp, Artificial Sequence
  chemically synthesized
accatagtacagccacacca

SEQ ID NO: 360216 - DNA, 20 bp, Artificial Sequence
  chemically synthesized
atgagtgttattccatggtg

SEQ ID NO: 360217 - DNA, 20 bp, Artificial Sequence
  chemically synthesized
cattgatgagtgttattcca

SEQ ID NO: 360218 - DNA, 20 bp, Artificial Sequence
  chemically synthesized
agtttgttcttttcattgat

SEQ ID NO: 360219 - DNA, 20 bp, Artificial Sequence
  chemically synthesized
gaataacactcatcaatgaa

SEQ ID NO: 360220 - DNA, 20 bp, Artificial Sequence
  chemically synthesized
caatttgctgcatgtatcaa

SEQ ID NO: 360221 - DNA, 20 bp, Artificial Sequence
  chemically synthesized
gaacaaactattgatacatg

SEQ ID NO: 360222 - DNA, 20 bp, Artificial Sequence
  chemically synthesized
tattgatacatgcagcaaat

SEQ ID NO: 360223 - DNA, 20 bp, Artificial Sequence
  chemically synthesized
agcaaattggatgaatttca

SEQ ID NO: 360224 - DNA, 20 bp, Artificial Sequence
  chemically synthesized
gcaaattggatgaatttcat

SEQ ID NO: 360225 - DNA, 20 bp, Artificial Sequence
  chemically synthesized
aatttcatgggcattatgct

SEQ ID NO: 360226 - DNA, 20 bp, Artificial Sequence
  chemically synthesized
ttcatgggcattatgctaag

SEQ ID NO: 360227 - DNA, 20 bp, Artificial Sequence
  chemically synthesized
tcatgggcattatgctaagt

SEQ ID NO: 360228 - DNA, 20 bp, Artificial Sequence
  chemically synthesized
catgggcattatgctaagtg

SEQ ID NO: 360229 - DNA, 20 bp, Artificial Sequence
  chemically synthesized
agaatgactttttccccact

SEQ ID NO: 360230 - DNA, 20 bp, Artificial Sequence
  chemically synthesized
cattatgctaagtggggaaa

SEQ ID NO: 360231 - DNA, 20 bp, Artificial Sequence
  chemically synthesized
tggggaaaaagtcattctga

SEQ ID NO: 360232 - DNA, 20 bp, Artificial Sequence
  chemically synthesized
ggggaaaaagtcattctgaa

SEQ ID NO: 360233 - DNA, 20 bp, Artificial Sequence
  chemically synthesized
gggaaaaagtcattctgaaa

SEQ ID NO: 360234 - DNA, 20 bp, Artificial Sequence
  chemically synthesized
aaaaagtcattctgaaaggg

SEQ ID NO: 360235 - DNA, 20 bp, Artificial Sequence
  chemically synthesized
catacagtatgctacccttt

SEQ ID NO: 360236 - DNA, 20 bp, Artificial Sequence
  chemically synthesized
ctcatagatacggattcata

SEQ ID NO: 360237 - DNA, 20 bp, Artificial Sequence
  chemically synthesized
ctgtatgaatccgtatctat

SEQ ID NO: 360238 - DNA, 20 bp, Artificial Sequence
  chemically synthesized
tttcaagactctcatagata

SEQ ID NO: 360239 - DNA, 20 bp, Artificial Sequence
  chemically synthesized
gtatgaatccgtatctatga

SEQ ID NO: 360240 - DNA, 20 bp, Artificial Sequence
  chemically synthesized
ttgtcttttcaagactctca

SEQ ID NO: 360241 - DNA, 20 bp, Artificial Sequence
  chemically synthesized
gtatctatgagagtcttgaa

SEQ ID NO: 360242 - DNA, 20 bp, Artificial Sequence
  chemically synthesized
ttctgtaactttgtcttttc

SEQ ID NO: 360243 - DNA, 20 bp, Artificial Sequence
  chemically synthesized
atgagagtcttgaaaagaca

SEQ ID NO: 360244 - DNA, 20 bp, Artificial Sequence
  chemically synthesized
gtcttgaaaagacaaagtta

SEQ ID NO: 360245 - DNA, 20 bp, Artificial Sequence
  chemically synthesized
aaaagacaaagttacagaaa

SEQ ID NO: 360246 - DNA, 20 bp, Artificial Sequence
  chemically synthesized
aagacaaagttacagaaata

SEQ ID NO: 360247 - DNA, 20 bp, Artificial Sequence
  chemically synthesized
aaagttacagaaatagagaa

SEQ ID NO: 360248 - DNA, 20 bp, Artificial Sequence
  chemically synthesized
tacagaaatagagaacagaa

SEQ ID NO: 360249 - DNA, 20 bp, Artificial Sequence
  chemically synthesized
agaaatagagaacagaatag

SEQ ID NO: 360250 - DNA, 20 bp, Artificial Sequence
  chemically synthesized
atagagaacagaatagcagt

SEQ ID NO: 360251 - DNA, 20 bp, Artificial Sequence
  chemically synthesized
gagaacagaatagcagttgg

SEQ ID NO: 360252 - DNA, 20 bp, Artificial Sequence
  chemically synthesized
gaacagaatagcagttggca

SEQ ID NO: 360253 - DNA, 20 bp, Artificial Sequence
  chemically synthesized
aacagaatagcagttggcag

SEQ ID NO: 360254 - DNA, 20 bp, Artificial Sequence
  chemically synthesized
gaatagcagttggcagaggt

SEQ ID NO: 360255 - DNA, 20 bp, Artificial Sequence
  chemically synthesized
aatagcagttggcagaggtc

SEQ ID NO: 360256 - DNA, 20 bp, Artificial Sequence
  chemically synthesized
cagttggcagaggtcaggaa

SEQ ID NO: 360257 - DNA, 20 bp, Artificial Sequence
  chemically synthesized
agttggcagaggtcaggaat

SEQ ID NO: 360258 - DNA, 20 bp, Artificial Sequence
  chemically synthesized
ttggcagaggtcaggaatgg

SEQ ID NO: 360259 - DNA, 20 bp, Artificial Sequence
  chemically synthesized
cagaggtcaggaatgggagt

SEQ ID NO: 360260 - DNA, 20 bp, Artificial Sequence
  chemically synthesized
tcaggaatgggagtaagatg

SEQ ID NO: 360261 - DNA, 20 bp, Artificial Sequence
  chemically synthesized
caggaatgggagtaagatgt

SEQ ID NO: 360262 - DNA, 20 bp, Artificial Sequence
  chemically synthesized
aggaatgggagtaagatgtg

SEQ ID NO: 360263 - DNA, 20 bp, Artificial Sequence
  chemically synthesized
aatgggagtaagatgtgggg

SEQ ID NO: 360264 - DNA, 20 bp, Artificial Sequence
  chemically synthesized
tgcccttttataagaacatt

SEQ ID NO: 360265 - DNA, 20 bp, Artificial Sequence
  chemically synthesized
gtagctgaatgttcttataa

SEQ ID NO: 360266 - DNA, 20 bp, Artificial Sequence
  chemically synthesized
tagctgaatgttcttataaa

SEQ ID NO: 360267 - DNA, 20 bp, Artificial Sequence
  chemically synthesized
agctgaatgttcttataaaa

SEQ ID NO: 360268 - DNA, 20 bp, Artificial Sequence
  chemically synthesized
ccctcatattgcccttttat

SEQ ID NO: 360269 - DNA, 20 bp, Artificial Sequence
  chemically synthesized
ttcttataaaagggcaatat

SEQ ID NO: 360270 - DNA, 20 bp, Artificial Sequence
  chemically synthesized
tcttataaaagggcaatatg

SEQ ID NO: 360271 - DNA, 20 bp, Artificial Sequence
  chemically synthesized
cttataaaagggcaatatga

SEQ ID NO: 360272 - DNA, 20 bp, Artificial Sequence
  chemically synthesized
aatatgagggacccttgtaa

SEQ ID NO: 360273 - DNA, 20 bp, Artificial Sequence
  chemically synthesized
gaacagttccaccattacaa

SEQ ID NO: 360274 - DNA, 20 bp, Artificial Sequence
  chemically synthesized
agaacagttccaccattaca

SEQ ID NO: 360275 - DNA, 20 bp, Artificial Sequence
  chemically synthesized
atgagggacccttgtaatgg

SEQ ID NO: 360276 - DNA, 20 bp, Artificial Sequence
  chemically synthesized
cagaacagttccaccattac

SEQ ID NO: 360277 - DNA, 20 bp, Artificial Sequence
  chemically synthesized
atcagagtcaatatgcagaa

SEQ ID NO: 360278 - DNA, 20 bp, Artificial Sequence
  chemically synthesized
ccaccatcagagtcaatatg

SEQ ID NO: 360279 - DNA, 20 bp, Artificial Sequence
  chemically synthesized
gttctgcatattgactctga

SEQ ID NO: 360280 - DNA, 20 bp, Artificial Sequence
  chemically synthesized
ctgcatattgactctgatgg

SEQ ID NO: 360281 - DNA, 20 bp, Artificial Sequence
  chemically synthesized
ggtttgtaaatccaccatca

SEQ ID NO: 360282 - DNA, 20 bp, Artificial Sequence
  chemically synthesized
taggtttgtaaatccaccat

SEQ ID NO: 360283 - DNA, 20 bp, Artificial Sequence
  chemically synthesized
tgcaacattattacgtgtgt

SEQ ID NO: 360284 - DNA, 20 bp, Artificial Sequence
  chemically synthesized
atgcaacattattacgtgtg

SEQ ID NO: 360285 - DNA, 20 bp, Artificial Sequence
  chemically synthesized
acacacgtaataatgttgca

SEQ ID NO: 360286 - DNA, 20 bp, Artificial Sequence
  chemically synthesized
tgcatgcatatgtgtgtatt

SEQ ID NO: 360287 - DNA, 20 bp, Artificial Sequence
  chemically synthesized
gcacacatacacataaatat

SEQ ID NO: 360288 - DNA, 20 bp, Artificial Sequence
  chemically synthesized
catacacataaatatgagta

SEQ ID NO: 360289 - DNA, 20 bp, Artificial Sequence
  chemically synthesized
cacataaatatgagtaaagc

SEQ ID NO: 360290 - DNA, 20 bp, Artificial Sequence
  chemically synthesized
acataaatatgagtaaagct

SEQ ID NO: 360291 - DNA, 20 bp, Artificial Sequence
  chemically synthesized
caatagtattcagattttcc

SEQ ID NO: 360292 - DNA, 20 bp, Artificial Sequence
  chemically synthesized
ataaaaccaccaatagtatt

SEQ ID NO: 360293 - DNA, 20 bp, Artificial Sequence
  chemically synthesized
tgggaaaatctgaatactat

SEQ ID NO: 360294 - DNA, 20 bp, Artificial Sequence
  chemically synthesized
gaaaatctgaatactattgg

SEQ ID NO: 360295 - DNA, 20 bp, Artificial Sequence
  chemically synthesized
aacattcataaaaccaccaa

SEQ ID NO: 360296 - DNA, 20 bp, Artificial Sequence
  chemically synthesized
ttttatgaatgttgacatct

SEQ ID NO: 360297 - DNA, 20 bp, Artificial Sequence
  chemically synthesized
taaaatacgatatcatgacc

SEQ ID NO: 360298 - DNA, 20 bp, Artificial Sequence
  chemically synthesized
ttggtcatgatatcgtattt

SEQ ID NO: 360299 - DNA, 20 bp, Artificial Sequence
  chemically synthesized
atatcgtattttagttttat

SEQ ID NO: 360300 - DNA, 20 bp, Artificial Sequence
  chemically synthesized
tataagatgttactacatcg

SEQ ID NO: 360301 - DNA, 20 bp, Artificial Sequence
  chemically synthesized
ataagatgttactacatcga

SEQ ID NO: 360302 - DNA, 20 bp, Artificial Sequence
  chemically synthesized
taagatgttactacatcgaa

SEQ ID NO: 360303 - DNA, 20 bp, Artificial Sequence
  chemically synthesized
gatcaatctccccttcgatg

SEQ ID NO: 360304 - DNA, 20 bp, Artificial Sequence
  chemically synthesized
aagatgttactacatcgaag

SEQ ID NO: 360305 - DNA, 20 bp, Artificial Sequence
  chemically synthesized
gatgttactacatcgaaggg

SEQ ID NO: 360306 - DNA, 20 bp, Artificial Sequence
  chemically synthesized
gaaggggagattgatcattc

SEQ ID NO: 360307 - DNA, 20 bp, Artificial Sequence
  chemically synthesized
gagattgatcattcaagaat

SEQ ID NO: 360308 - DNA, 20 bp, Artificial Sequence
  chemically synthesized
ttgatcattcaagaataaga

SEQ ID NO: 360309 - DNA, 20 bp, Artificial Sequence
  chemically synthesized
ggaatccccagatgatgatg

SEQ ID NO: 360310 - DNA, 20 bp, Artificial Sequence
  chemically synthesized
tcatcatctgcatcatcatc

SEQ ID NO: 360311 - DNA, 20 bp, Artificial Sequence
  chemically synthesized
catcatctgcatcatcatct

SEQ ID NO: 360312 - DNA, 20 bp, Artificial Sequence
  chemically synthesized
atcatctgcatcatcatctg

SEQ ID NO: 360313 - DNA, 20 bp, Artificial Sequence
  chemically synthesized
actgccatatgaggaatccc

SEQ ID NO: 360314 - DNA, 20 bp, Artificial Sequence
  chemically synthesized
tcatctggggattcctcata

SEQ ID NO: 360315 - DNA, 20 bp, Artificial Sequence
  chemically synthesized
tctggggattcctcatatgg

SEQ ID NO: 360316 - DNA, 20 bp, Artificial Sequence
  chemically synthesized
ctctcctctactgccatatg

SEQ ID NO: 360317 - DNA, 20 bp, Artificial Sequence
  chemically synthesized
tctctcctctactgccatat

SEQ ID NO: 360318 - DNA, 20 bp, Artificial Sequence
  chemically synthesized
ggggattcctcatatggcag

SEQ ID NO: 360319 - DNA, 20 bp, Artificial Sequence
  chemically synthesized
ggattcctcatatggcagta

SEQ ID NO: 360320 - DNA, 20 bp, Artificial Sequence
  chemically synthesized
gattcctcatatggcagtag

SEQ ID NO: 360321 - DNA, 20 bp, Artificial Sequence
  chemically synthesized
ttcctcatatggcagtagag

SEQ ID NO: 360322 - DNA, 20 bp, Artificial Sequence
  chemically synthesized
cctcatatggcagtagagga

SEQ ID NO: 360323 - DNA, 20 bp, Artificial Sequence
  chemically synthesized
gaggagagaaattcctccat

SEQ ID NO: 360324 - DNA, 20 bp, Artificial Sequence
  chemically synthesized
aggagagaaattcctccata

SEQ ID NO: 360325 - DNA, 20 bp, Artificial Sequence
  chemically synthesized
atagtggcttttccttatgg

SEQ ID NO: 360326 - DNA, 20 bp, Artificial Sequence
  chemically synthesized
catagtggcttttccttatg

SEQ ID NO: 360327 - DNA, 20 bp, Artificial Sequence
  chemically synthesized
agaaattcctccataaggaa

SEQ ID NO: 360328 - DNA, 20 bp, Artificial Sequence
  chemically synthesized
ttcatagtggcttttcctta

SEQ ID NO: 360329 - DNA, 20 bp, Artificial Sequence
  chemically synthesized
atcaatagataaattcatag

SEQ ID NO: 360330 - DNA, 20 bp, Artificial Sequence
  chemically synthesized
tgaatcaatagataaattca

SEQ ID NO: 360331 - DNA, 20 bp, Artificial Sequence
  chemically synthesized
ttagtgaatcaatgaatcaa

SEQ ID NO: 360332 - DNA, 20 bp, Artificial Sequence
  chemically synthesized
cattgattcactaactcaac

SEQ ID NO: 360333 - DNA, 20 bp, Artificial Sequence
  chemically synthesized
ccaaaaggtacttgttgagt

SEQ ID NO: 360334 - DNA, 20 bp, Artificial Sequence
  chemically synthesized
atagccaaaaggtacttgtt

SEQ ID NO: 360335 - DNA, 20 bp, Artificial Sequence
  chemically synthesized
ctaactcaacaagtaccttt

SEQ ID NO: 360336 - DNA, 20 bp, Artificial Sequence
  chemically synthesized
ttgcctggcagatagccaaa

SEQ ID NO: 360337 - DNA, 20 bp, Artificial Sequence
  chemically synthesized
attgcctggcagatagccaa

SEQ ID NO: 360338 - DNA, 20 bp, Artificial Sequence
  chemically synthesized
agtaccttttggctatctgc

SEQ ID NO: 360339 - DNA, 20 bp, Artificial Sequence
  chemically synthesized
gtaccttttggctatctgcc

SEQ ID NO: 360340 - DNA, 20 bp, Artificial Sequence
  chemically synthesized
ttacttcattgcctggcaga

SEQ ID NO: 360341 - DNA, 20 bp, Artificial Sequence
  chemically synthesized
cttattacttcattgcctgg

SEQ ID NO: 360342 - DNA, 20 bp, Artificial Sequence
  chemically synthesized
tggctatctgccaggcaatg

SEQ ID NO: 360343 - DNA, 20 bp, Artificial Sequence
  chemically synthesized
gctcttattacttcattgcc

SEQ ID NO: 360344 - DNA, 20 bp, Artificial Sequence
  chemically synthesized
ctgccaggcaatgaagtaat

SEQ ID NO: 360345 - DNA, 20 bp, Artificial Sequence
  chemically synthesized
gccaggcaatgaagtaataa

SEQ ID NO: 360346 - DNA, 20 bp, Artificial Sequence
  chemically synthesized
gaagtaataagagcatgtaa

SEQ ID NO: 360347 - DNA, 20 bp, Artificial Sequence
  chemically synthesized
ttaagtttcatgaaagcaga

SEQ ID NO: 360348 - DNA, 20 bp, Artificial Sequence
  chemically synthesized
attaagtttcatgaaagcag

SEQ ID NO: 360349 - DNA, 20 bp, Artificial Sequence
  chemically synthesized
agaattaagtttcatgaaag

SEQ ID NO: 360350 - DNA, 20 bp, Artificial Sequence
  chemically synthesized
actagaattaagtttcatga

SEQ ID NO: 360351 - DNA, 20 bp, Artificial Sequence
  chemically synthesized
gctttcatgaaacttaattc

SEQ ID NO: 360352 - DNA, 20 bp, Artificial Sequence
  chemically synthesized
ttgtcactatcactagaatt

SEQ ID NO: 360353 - DNA, 20 bp, Artificial Sequence
  chemically synthesized
atgaaacttaattctagtga

SEQ ID NO: 360354 - DNA, 20 bp, Artificial Sequence
  chemically synthesized
catctgattgtcactatcac

SEQ ID NO: 360355 - DNA, 20 bp, Artificial Sequence
  chemically synthesized
attctagtgatagtgacaat

SEQ ID NO: 360356 - DNA, 20 bp, Artificial Sequence
  chemically synthesized
atagtgacaatcagatgata

SEQ ID NO: 360357 - DNA, 20 bp, Artificial Sequence
  chemically synthesized
aatcagatgatatagcacta

SEQ ID NO: 360358 - DNA, 20 bp, Artificial Sequence
  chemically synthesized
tgatatagcactaaagactc

SEQ ID NO: 360359 - DNA, 20 bp, Artificial Sequence
  chemically synthesized
tgcttaactgcttgagtctt

SEQ ID NO: 360360 - DNA, 20 bp, Artificial Sequence
  chemically synthesized
tatagcactaaagactcaag

SEQ ID NO: 360361 - DNA, 20 bp, Artificial Sequence
  chemically synthesized
tattctctgcttaactgctt

SEQ ID NO: 360362 - DNA, 20 bp, Artificial Sequence
  chemically synthesized
cactaaagactcaagcagtt

SEQ ID NO: 360363 - DNA, 20 bp, Artificial Sequence
  chemically synthesized
taaagactcaagcagttaag

SEQ ID NO: 360364 - DNA, 20 bp, Artificial Sequence
  chemically synthesized
aagactcaagcagttaagca

SEQ ID NO: 360365 - DNA, 20 bp, Artificial Sequence
  chemically synthesized
agcagagaatatgctatttt

SEQ ID NO: 360366 - DNA, 20 bp, Artificial Sequence
  chemically synthesized
gcagagaatatgctattttt

SEQ ID NO: 360367 - DNA, 20 bp, Artificial Sequence
  chemically synthesized
gtgagtatgtttcctaaaaa

SEQ ID NO: 360368 - DNA, 20 bp, Artificial Sequence
  chemically synthesized
gtgcttcccgcagtatgagt

SEQ ID NO: 360369 - DNA, 20 bp, Artificial Sequence
  chemically synthesized
aaacatactcactcatactg

SEQ ID NO: 360370 - DNA, 20 bp, Artificial Sequence
  chemically synthesized
aacatactcactcatactgc

SEQ ID NO: 360371 - DNA, 20 bp, Artificial Sequence
  chemically synthesized
agcagtgcttcccgcagtat

SEQ ID NO: 360372 - DNA, 20 bp, Artificial Sequence
  chemically synthesized
atactcactcatactgcggg

SEQ ID NO: 360373 - DNA, 20 bp, Artificial Sequence
  chemically synthesized
tctaccagcagtgcttcccg

SEQ ID NO: 360374 - DNA, 20 bp, Artificial Sequence
  chemically synthesized
catactgcgggaagcactgc

SEQ ID NO: 360375 - DNA, 20 bp, Artificial Sequence
  chemically synthesized
actgcgggaagcactgctgg

SEQ ID NO: 360376 - DNA, 20 bp, Artificial Sequence
  chemically synthesized
acccaaaacgtatctaccag

SEQ ID NO: 360377 - DNA, 20 bp, Artificial Sequence
  chemically synthesized
gcaacccaaaacgtatctac

SEQ ID NO: 360378 - DNA, 20 bp, Artificial Sequence
  chemically synthesized
cactgctggtagatacgttt

SEQ ID NO: 360379 - DNA, 20 bp, Artificial Sequence
  chemically synthesized
actgctggtagatacgtttt

SEQ ID NO: 360380 - DNA, 20 bp, Artificial Sequence
  chemically synthesized
agatacgttttgggttgcca

SEQ ID NO: 360381 - DNA, 20 bp, Artificial Sequence
  chemically synthesized
tctccccagagtcaggtcca

SEQ ID NO: 360382 - DNA, 20 bp, Artificial Sequence
  chemically synthesized
ggttgccatggacctgactc

SEQ ID NO: 360383 - DNA, 20 bp, Artificial Sequence
  chemically synthesized
gttgccatggacctgactct

SEQ ID NO: 360384 - DNA, 20 bp, Artificial Sequence
  chemically synthesized
ttgccatggacctgactctg

SEQ ID NO: 360385 - DNA, 20 bp, Artificial Sequence
  chemically synthesized
atctaagtctccccagagtc

SEQ ID NO: 360386 - DNA, 20 bp, Artificial Sequence
  chemically synthesized
gatctaagtctccccagagt

SEQ ID NO: 360387 - DNA, 20 bp, Artificial Sequence
  chemically synthesized
gccatggacctgactctggg

SEQ ID NO: 360388 - DNA, 20 bp, Artificial Sequence
  chemically synthesized
acttgatctaagtctcccca

SEQ ID NO: 360389 - DNA, 20 bp, Artificial Sequence
  chemically synthesized
ttacttgatctaagtctccc

SEQ ID NO: 360390 - DNA, 20 bp, Artificial Sequence
  chemically synthesized
gacctgactctggggagact

SEQ ID NO: 360391 - DNA, 20 bp, Artificial Sequence
  chemically synthesized
actctggggagacttagatc

SEQ ID NO: 360392 - DNA, 20 bp, Artificial Sequence
  chemically synthesized
aagttcctattacttgatct

SEQ ID NO: 360393 - DNA, 20 bp, Artificial Sequence
  chemically synthesized
gggagacttagatcaagtaa

SEQ ID NO: 360394 - DNA, 20 bp, Artificial Sequence
  chemically synthesized
ggagacttagatcaagtaat

SEQ ID NO: 360395 - DNA, 20 bp, Artificial Sequence
  chemically synthesized
tagatcaagtaataggaact

SEQ ID NO: 360396 - DNA, 20 bp, Artificial Sequence
  chemically synthesized
agtaataggaacttagattc

SEQ ID NO: 360397 - DNA, 20 bp, Artificial Sequence
  chemically synthesized
ataaggggttactggaatct

SEQ ID NO: 360398 - DNA, 20 bp, Artificial Sequence
  chemically synthesized
gacagtggataaggggttac

SEQ ID NO: 360399 - DNA, 20 bp, Artificial Sequence
  chemically synthesized
gtcttatgacagtggataag

SEQ ID NO: 360400 - DNA, 20 bp, Artificial Sequence
  chemically synthesized
agtcttatgacagtggataa

SEQ ID NO: 360401 - DNA, 20 bp, Artificial Sequence
  chemically synthesized
aagtcttatgacagtggata

SEQ ID NO: 360402 - DNA, 20 bp, Artificial Sequence
  chemically synthesized
caagtcttatgacagtggat

SEQ ID NO: 360403 - DNA, 20 bp, Artificial Sequence
  chemically synthesized
aaccccttatccactgtcat

SEQ ID NO: 360404 - DNA, 20 bp, Artificial Sequence
  chemically synthesized
agtgacaagtcttatgacag

SEQ ID NO: 360405 - DNA, 20 bp, Artificial Sequence
  chemically synthesized
cacagtgacaagtcttatga

SEQ ID NO: 360406 - DNA, 20 bp, Artificial Sequence
  chemically synthesized
cttcctgcttacacagtgac

SEQ ID NO: 360407 - DNA, 20 bp, Artificial Sequence
  chemically synthesized
cataagacttgtcactgtgt

SEQ ID NO: 360408 - DNA, 20 bp, Artificial Sequence
  chemically synthesized
aagacttgtcactgtgtaag

SEQ ID NO: 360409 - DNA, 20 bp, Artificial Sequence
  chemically synthesized
agacttgtcactgtgtaagc

SEQ ID NO: 360410 - DNA, 20 bp, Artificial Sequence
  chemically synthesized
gaactatcttcctgcttaca

SEQ ID NO: 360411 - DNA, 20 bp, Artificial Sequence
  chemically synthesized
cttgtcactgtgtaagcagg

SEQ ID NO: 360412 - DNA, 20 bp, Artificial Sequence
  chemically synthesized
tcactgtgtaagcaggaaga

SEQ ID NO: 360413 - DNA, 20 bp, Artificial Sequence
  chemically synthesized
ttatgaggacaaggaaatgg

SEQ ID NO: 360414 - DNA, 20 bp, Artificial Sequence
  chemically synthesized
tttatgaggacaaggaaatg

SEQ ID NO: 360415 - DNA, 20 bp, Artificial Sequence
  chemically synthesized
cttttatgaggacaaggaaa

SEQ ID NO: 360416 - DNA, 20 bp, Artificial Sequence
  chemically synthesized
tgagaccttttatgaggaca

SEQ ID NO: 360417 - DNA, 20 bp, Artificial Sequence
  chemically synthesized
atgagaccttttatgaggac

SEQ ID NO: 360418 - DNA, 20 bp, Artificial Sequence
  chemically synthesized
ccatttccttgtcctcataa

SEQ ID NO: 360419 - DNA, 20 bp, Artificial Sequence
  chemically synthesized
catttccttgtcctcataaa

SEQ ID NO: 360420 - DNA, 20 bp, Artificial Sequence
  chemically synthesized
accttatgagaccttttatg

SEQ ID NO: 360421 - DNA, 20 bp, Artificial Sequence
  chemically synthesized
gaccttatgagaccttttat

SEQ ID NO: 360422 - DNA, 20 bp, Artificial Sequence
  chemically synthesized
gtcctcataaaaggtctcat

SEQ ID NO: 360423 - DNA, 20 bp, Artificial Sequence
  chemically synthesized
tcctcataaaaggtctcata

SEQ ID NO: 360424 - DNA, 20 bp, Artificial Sequence
  chemically synthesized
tagtggaaattggaccttat

SEQ ID NO: 360425 - DNA, 20 bp, Artificial Sequence
  chemically synthesized
tacctgaatatagtggaaat

SEQ ID NO: 360426 - DNA, 20 bp, Artificial Sequence
  chemically synthesized
ggtccaatttccactatatt

SEQ ID NO: 360427 - DNA, 20 bp, Artificial Sequence
  chemically synthesized
agcccagtacctgaatatag

SEQ ID NO: 360428 - DNA, 20 bp, Artificial Sequence
  chemically synthesized
gtccaatttccactatattc

SEQ ID NO: 360429 - DNA, 20 bp, Artificial Sequence
  chemically synthesized
ctgagcccagtacctgaata

SEQ ID NO: 360430 - DNA, 20 bp, Artificial Sequence
  chemically synthesized
tttccactatattcaggtac

SEQ ID NO: 360431 - DNA, 20 bp, Artificial Sequence
  chemically synthesized
ttccactatattcaggtact

SEQ ID NO: 360432 - DNA, 20 bp, Artificial Sequence
  chemically synthesized
ctatattcaggtactgggct

SEQ ID NO: 360433 - DNA, 20 bp, Artificial Sequence
  chemically synthesized
tcctttatcaggtctgagcc

SEQ ID NO: 360434 - DNA, 20 bp, Artificial Sequence
  chemically synthesized
tactttcctttatcaggtct

SEQ ID NO: 360435 - DNA, 20 bp, Artificial Sequence
  chemically synthesized
tactgggctcagacctgata

SEQ ID NO: 360436 - DNA, 20 bp, Artificial Sequence
  chemically synthesized
actgggctcagacctgataa

SEQ ID NO: 360437 - DNA, 20 bp, Artificial Sequence
  chemically synthesized
gtaccttactttcctttatc

SEQ ID NO: 360438 - DNA, 20 bp, Artificial Sequence
  chemically synthesized
agtaccttactttcctttat

SEQ ID NO: 360439 - DNA, 20 bp, Artificial Sequence
  chemically synthesized
ggctcagacctgataaagga

SEQ ID NO: 360440 - DNA, 20 bp, Artificial Sequence
  chemically synthesized
cagacctgataaaggaaagt

SEQ ID NO: 360441 - DNA, 20 bp, Artificial Sequence
  chemically synthesized
agacctgataaaggaaagta

SEQ ID NO: 360442 - DNA, 20 bp, Artificial Sequence
  chemically synthesized
aaagtaaggtactacccccc

SEQ ID NO: 360443 - DNA, 20 bp, Artificial Sequence
  chemically synthesized
actttttgacactggggggg

SEQ ID NO: 360444 - DNA, 20 bp, Artificial Sequence
  chemically synthesized
tgaactttttgacactgggg

SEQ ID NO: 360445 - DNA, 20 bp, Artificial Sequence
  chemically synthesized
gtgaactttttgacactggg

SEQ ID NO: 360446 - DNA, 20 bp, Artificial Sequence
  chemically synthesized
tgtgaactttttgacactgg

SEQ ID NO: 360447 - DNA, 20 bp, Artificial Sequence
  chemically synthesized
ttgtgaactttttgacactg

SEQ ID NO: 360448 - DNA, 20 bp, Artificial Sequence
  chemically synthesized
gttgtgaactttttgacact

SEQ ID NO: 360449 - DNA, 20 bp, Artificial Sequence
  chemically synthesized
tgttgtgaactttttgacac

SEQ ID NO: 360450 - DNA, 20 bp, Artificial Sequence
  chemically synthesized
actacccccccagtgtcaaa

SEQ ID NO: 360451 - DNA, 20 bp, Artificial Sequence
  chemically synthesized
cagtgtcaaaaagttcacaa

SEQ ID NO: 360452 - DNA, 20 bp, Artificial Sequence
  chemically synthesized
tgtcaaaaagttcacaacag

SEQ ID NO: 360453 - DNA, 20 bp, Artificial Sequence
  chemically synthesized
gtcaaaaagttcacaacaga

SEQ ID NO: 360454 - DNA, 20 bp, Artificial Sequence
  chemically synthesized
cagaaggtcacataataaaa

SEQ ID NO: 360455 - DNA, 20 bp, Artificial Sequence
  chemically synthesized
aataaaaaagtatctaccat

SEQ ID NO: 360456 - DNA, 20 bp, Artificial Sequence
  chemically synthesized
ataaaaaagtatctaccatt

SEQ ID NO: 360457 - DNA, 20 bp, Artificial Sequence
  chemically synthesized
gaattgctagagcctaatgg

SEQ ID NO: 360458 - DNA, 20 bp, Artificial Sequence
  chemically synthesized
gtagaattgctagagcctaa

SEQ ID NO: 360459 - DNA, 20 bp, Artificial Sequence
  chemically synthesized
aagtatctaccattaggctc

SEQ ID NO: 360460 - DNA, 20 bp, Artificial Sequence
  chemically synthesized
acatagaggtagaattgcta

SEQ ID NO: 360461 - DNA, 20 bp, Artificial Sequence
  chemically synthesized
aaacatagaggtagaattgc

SEQ ID NO: 360462 - DNA, 20 bp, Artificial Sequence
  chemically synthesized
tttggttataaacatagagg

SEQ ID NO: 360463 - DNA, 20 bp, Artificial Sequence
  chemically synthesized
tattttggttataaacatag

SEQ ID NO: 360464 - DNA, 20 bp, Artificial Sequence
  chemically synthesized
ttattttggttataaacata

SEQ ID NO: 360465 - DNA, 20 bp, Artificial Sequence
  chemically synthesized
aattattttggttataaaca

SEQ ID NO: 360466 - DNA, 20 bp, Artificial Sequence
  chemically synthesized
atctctgtttttaattattt

SEQ ID NO: 360467 - DNA, 20 bp, Artificial Sequence
  chemically synthesized
ataaccaaaataattaaaaa

SEQ ID NO: 360468 - DNA, 20 bp, Artificial Sequence
  chemically synthesized
aaccaaaataattaaaaaca

SEQ ID NO: 360469 - DNA, 20 bp, Artificial Sequence
  chemically synthesized
aataattaaaaacagagatt

SEQ ID NO: 360470 - DNA, 20 bp, Artificial Sequence
  chemically synthesized
aaaaacagagattaagatat

SEQ ID NO: 360471 - DNA, 20 bp, Artificial Sequence
  chemically synthesized
aacagagattaagatattgg

SEQ ID NO: 360472 - DNA, 20 bp, Artificial Sequence
  chemically synthesized
tattggtagaccaattatca

SEQ ID NO: 360473 - DNA, 20 bp, Artificial Sequence
  chemically synthesized
aataatgttactatgataat

SEQ ID NO: 360474 - DNA, 20 bp, Artificial Sequence
  chemically synthesized
catagtaacattattcacaa

SEQ ID NO: 360475 - DNA, 20 bp, Artificial Sequence
  chemically synthesized
attcacaatagccaaaatgt

SEQ ID NO: 360476 - DNA, 20 bp, Artificial Sequence
  chemically synthesized
atttgggtgttctcacattt

SEQ ID NO: 360477 - DNA, 20 bp, Artificial Sequence
  chemically synthesized
ttatctgtagatggacattt

SEQ ID NO: 360478 - DNA, 20 bp, Artificial Sequence
  chemically synthesized
tttatctgtagatggacatt

SEQ ID NO: 360479 - DNA, 20 bp, Artificial Sequence
  chemically synthesized
aacacccaaatgtccatcta

SEQ ID NO: 360480 - DNA, 20 bp, Artificial Sequence
  chemically synthesized
tttatccatttatctgtaga

SEQ ID NO: 360481 - DNA, 20 bp, Artificial Sequence
  chemically synthesized
tttgtttatccatttatctg

SEQ ID NO: 360482 - DNA, 20 bp, Artificial Sequence
  chemically synthesized
aatgtccatctacagataaa

SEQ ID NO: 360483 - DNA, 20 bp, Artificial Sequence
  chemically synthesized
ataaatggataaacaaaatg

SEQ ID NO: 360484 - DNA, 20 bp, Artificial Sequence
  chemically synthesized
aatgtggtatgtacatacaa

SEQ ID NO: 360485 - DNA, 20 bp, Artificial Sequence
  chemically synthesized
tacatacaacggaatatttt

SEQ ID NO: 360486 - DNA, 20 bp, Artificial Sequence
  chemically synthesized
ggaatattttcagccttaaa

SEQ ID NO: 360487 - DNA, 20 bp, Artificial Sequence
  chemically synthesized
gaatattttcagccttaaaa

SEQ ID NO: 360488 - DNA, 20 bp, Artificial Sequence
  chemically synthesized
cagaatttcattccttttta

SEQ ID NO: 360489 - DNA, 20 bp, Artificial Sequence
  chemically synthesized
tcagaatttcattccttttt

SEQ ID NO: 360490 - DNA, 20 bp, Artificial Sequence
  chemically synthesized
atttatgttgtagtttgtat

SEQ ID NO: 360491 - DNA, 20 bp, Artificial Sequence
  chemically synthesized
tccaaggttcatttatgttg

SEQ ID NO: 360492 - DNA, 20 bp, Artificial Sequence
  chemically synthesized
actacaacataaatgaacct

SEQ ID NO: 360493 - DNA, 20 bp, Artificial Sequence
  chemically synthesized
tcacttagcatatgtttcca

SEQ ID NO: 360494 - DNA, 20 bp, Artificial Sequence
  chemically synthesized
ttcacttagcatatgtttcc

SEQ ID NO: 360495 - DNA, 20 bp, Artificial Sequence
  chemically synthesized
gaaccttggaaacatatgct

SEQ ID NO: 360496 - DNA, 20 bp, Artificial Sequence
  chemically synthesized
tatgtcttgcttatttcact

SEQ ID NO: 360497 - DNA, 20 bp, Artificial Sequence
  chemically synthesized
aaacatatgctaagtgaaat

SEQ ID NO: 360498 - DNA, 20 bp, Artificial Sequence
  chemically synthesized
atatgctaagtgaaataagc

SEQ ID NO: 360499 - DNA, 20 bp, Artificial Sequence
  chemically synthesized
ttgtatgattctacttatat

SEQ ID NO: 360500 - DNA, 20 bp, Artificial Sequence
  chemically synthesized
ttttaggtacctcatataag

SEQ ID NO: 360501 - DNA, 20 bp, Artificial Sequence
  chemically synthesized
tgtatgattctacttatatg

SEQ ID NO: 360502 - DNA, 20 bp, Artificial Sequence
  chemically synthesized
ctattttaggtacctcatat

SEQ ID NO: 360503 - DNA, 20 bp, Artificial Sequence
  chemically synthesized
cttatatgaggtacctaaaa

SEQ ID NO: 360504 - DNA, 20 bp, Artificial Sequence
  chemically synthesized
tctatgaatttggctatttt

SEQ ID NO: 360505 - DNA, 20 bp, Artificial Sequence
  chemically synthesized
ctctatgaatttggctattt

SEQ ID NO: 360506 - DNA, 20 bp, Artificial Sequence
  chemically synthesized
acctaaaatagccaaattca

SEQ ID NO: 360507 - DNA, 20 bp, Artificial Sequence
  chemically synthesized
ccattttttctctatgaatt

SEQ ID NO: 360508 - DNA, 20 bp, Artificial Sequence
  chemically synthesized
ctaaaatagccaaattcata

SEQ ID NO: 360509 - DNA, 20 bp, Artificial Sequence
  chemically synthesized
ccaaattcatagagaaaaaa

SEQ ID NO: 360510 - DNA, 20 bp, Artificial Sequence
  chemically synthesized
aattcatagagaaaaaatgg

SEQ ID NO: 360511 - DNA, 20 bp, Artificial Sequence
  chemically synthesized
agaaaaaatggaagttatta

SEQ ID NO: 360512 - DNA, 20 bp, Artificial Sequence
  chemically synthesized
gaaaaaatggaagttattaa

SEQ ID NO: 360513 - DNA, 20 bp, Artificial Sequence
  chemically synthesized
aaatggaagttattaaaggc

SEQ ID NO: 360514 - DNA, 20 bp, Artificial Sequence
  chemically synthesized
aatggaagttattaaaggct

SEQ ID NO: 360515 - DNA, 20 bp, Artificial Sequence
  chemically synthesized
atggaagttattaaaggcta

SEQ ID NO: 360516 - DNA, 20 bp, Artificial Sequence
  chemically synthesized
tggaagttattaaaggctag

SEQ ID NO: 360517 - DNA, 20 bp, Artificial Sequence
  chemically synthesized
gaagttattaaaggctaggg

SEQ ID NO: 360518 - DNA, 20 bp, Artificial Sequence
  chemically synthesized
aagttattaaaggctagggg

SEQ ID NO: 360519 - DNA, 20 bp, Artificial Sequence
  chemically synthesized
ctctccattttcacctcccc

SEQ ID NO: 360520 - DNA, 20 bp, Artificial Sequence
  chemically synthesized
aaggctaggggaggtgaaaa

SEQ ID NO: 360521 - DNA, 20 bp, Artificial Sequence
  chemically synthesized
ggctaggggaggtgaaaatg

SEQ ID NO: 360522 - DNA, 20 bp, Artificial Sequence
  chemically synthesized
ctaggggaggtgaaaatgga

SEQ ID NO: 360523 - DNA, 20 bp, Artificial Sequence
  chemically synthesized
atggagagtaatcgtttaat

SEQ ID NO: 360524 - DNA, 20 bp, Artificial Sequence
  chemically synthesized
taatcagtatgaattcaact

SEQ ID NO: 360525 - DNA, 20 bp, Artificial Sequence
  chemically synthesized
aatcagtatgaattcaactt

SEQ ID NO: 360526 - DNA, 20 bp, Artificial Sequence
  chemically synthesized
tagaatgatttcatcatccc

SEQ ID NO: 360527 - DNA, 20 bp, Artificial Sequence
  chemically synthesized
ttgggatgatgaaatcattc

SEQ ID NO: 360528 - DNA, 20 bp, Artificial Sequence
  chemically synthesized
gggatgatgaaatcattcta

SEQ ID NO: 360529 - DNA, 20 bp, Artificial Sequence
  chemically synthesized
tgatgaaatcattctagaga

SEQ ID NO: 360530 - DNA, 20 bp, Artificial Sequence
  chemically synthesized
tcatcaccgctatccatctc

SEQ ID NO: 360531 - DNA, 20 bp, Artificial Sequence
  chemically synthesized
gaaatcattctagagatgga

SEQ ID NO: 360532 - DNA, 20 bp, Artificial Sequence
  chemically synthesized
atcattctagagatggatag

SEQ ID NO: 360533 - DNA, 20 bp, Artificial Sequence
  chemically synthesized
agtatatttctgttgttggg

SEQ ID NO: 360534 - DNA, 20 bp, Artificial Sequence
  chemically synthesized
cggtgatgactacccaacaa

SEQ ID NO: 360535 - DNA, 20 bp, Artificial Sequence
  chemically synthesized
ttaagtatatttctgttgtt

SEQ ID NO: 360536 - DNA, 20 bp, Artificial Sequence
  chemically synthesized
tttaagtatatttctgttgt

SEQ ID NO: 360537 - DNA, 20 bp, Artificial Sequence
  chemically synthesized
caacaacagaaatatactta

SEQ ID NO: 360538 - DNA, 20 bp, Artificial Sequence
  chemically synthesized
gtgtataattcagtggcttt

SEQ ID NO: 360539 - DNA, 20 bp, Artificial Sequence
  chemically synthesized
ttttttagtgtataattcag

SEQ ID NO: 360540 - DNA, 20 bp, Artificial Sequence
  chemically synthesized
tatttttttagtgtataatt

SEQ ID NO: 360541 - DNA, 20 bp, Artificial Sequence
  chemically synthesized
tgaattatacactaaaaaaa

SEQ ID NO: 360542 - DNA, 20 bp, Artificial Sequence
  chemically synthesized
tatcattttttctatttttt

SEQ ID NO: 360543 - DNA, 20 bp, Artificial Sequence
  chemically synthesized
attgccctagatagggtttg

SEQ ID NO: 360544 - DNA, 20 bp, Artificial Sequence
  chemically synthesized
cattgccctagatagggttt

SEQ ID NO: 360545 - DNA, 20 bp, Artificial Sequence
  chemically synthesized
atgatacctcaaaccctatc

SEQ ID NO: 360546 - DNA, 20 bp, Artificial Sequence
  chemically synthesized
tgatacctcaaaccctatct

SEQ ID NO: 360547 - DNA, 20 bp, Artificial Sequence
  chemically synthesized
gatacctcaaaccctatcta

SEQ ID NO: 360548 - DNA, 20 bp, Artificial Sequence
  chemically synthesized
caggttcattgccctagata

SEQ ID NO: 360549 - DNA, 20 bp, Artificial Sequence
  chemically synthesized
tcaggttcattgccctagat

SEQ ID NO: 360550 - DNA, 20 bp, Artificial Sequence
  chemically synthesized
ttcaggttcattgccctaga

SEQ ID NO: 360551 - DNA, 20 bp, Artificial Sequence
  chemically synthesized
tctattcaggttcattgccc

SEQ ID NO: 360552 - DNA, 20 bp, Artificial Sequence
  chemically synthesized
tctagggcaatgaacctgaa

SEQ ID NO: 360553 - DNA, 20 bp, Artificial Sequence
  chemically synthesized
cttttgagaaatgtctattc

SEQ ID NO: 360554 - DNA, 20 bp, Artificial Sequence
  chemically synthesized
tcttttgagaaatgtctatt

SEQ ID NO: 360555 - DNA, 20 bp, Artificial Sequence
  chemically synthesized
cctgaatagacatttctcaa

SEQ ID NO: 360556 - DNA, 20 bp, Artificial Sequence
  chemically synthesized
gaatagacatttctcaaaag

SEQ ID NO: 360557 - DNA, 20 bp, Artificial Sequence
  chemically synthesized
ccgttggtttgtcttctttt

SEQ ID NO: 360558 - DNA, 20 bp, Artificial Sequence
  chemically synthesized
ctcaaaagaagacaaaccaa

SEQ ID NO: 360559 - DNA, 20 bp, Artificial Sequence
  chemically synthesized
aaagaagacaaaccaacggc

SEQ ID NO: 360560 - DNA, 20 bp, Artificial Sequence
  chemically synthesized
ttcatttatgtgctggccgt

SEQ ID NO: 360561 - DNA, 20 bp, Artificial Sequence
  chemically synthesized
acattatttcatttatgtgc

SEQ ID NO: 360562 - DNA, 20 bp, Artificial Sequence
  chemically synthesized
tgttgaacatcactaatcat

SEQ ID NO: 360563 - DNA, 20 bp, Artificial Sequence
  chemically synthesized
ttgaacatcactaatcatca

SEQ ID NO: 360564 - DNA, 20 bp, Artificial Sequence
  chemically synthesized
atttgcatttctctgatgat

SEQ ID NO: 360565 - DNA, 20 bp, Artificial Sequence
  chemically synthesized
tgtgatgtaatatttcattg

SEQ ID NO: 360566 - DNA, 20 bp, Artificial Sequence
  chemically synthesized
caatgaaatattacatcaca

SEQ ID NO: 360567 - DNA, 20 bp, Artificial Sequence
  chemically synthesized
aaatattacatcacacagaa

SEQ ID NO: 360568 - DNA, 20 bp, Artificial Sequence
  chemically synthesized
accttttgtctttttgataa

SEQ ID NO: 360569 - DNA, 20 bp, Artificial Sequence
  chemically synthesized
acagaatggctattatcaaa

SEQ ID NO: 360570 - DNA, 20 bp, Artificial Sequence
  chemically synthesized
ggctattatcaaaaagacaa

SEQ ID NO: 360571 - DNA, 20 bp, Artificial Sequence
  chemically synthesized
gctattatcaaaaagacaaa

SEQ ID NO: 360572 - DNA, 20 bp, Artificial Sequence
  chemically synthesized
ttatcaaaaagacaaaaggt

SEQ ID NO: 360573 - DNA, 20 bp, Artificial Sequence
  chemically synthesized
aaaagacaaaaggtaagttg

SEQ ID NO: 360574 - DNA, 20 bp, Artificial Sequence
  chemically synthesized
acaaaaggtaagttgtggca

SEQ ID NO: 360575 - DNA, 20 bp, Artificial Sequence
  chemically synthesized
ggtaagttgtggcaaagatg

SEQ ID NO: 360576 - DNA, 20 bp, Artificial Sequence
  chemically synthesized
taagttgtggcaaagatgtg

SEQ ID NO: 360577 - DNA, 20 bp, Artificial Sequence
  chemically synthesized
gtggcaaagatgtggagaaa

SEQ ID NO: 360578 - DNA, 20 bp, Artificial Sequence
  chemically synthesized
tggcaaagatgtggagaaaa

SEQ ID NO: 360579 - DNA, 20 bp, Artificial Sequence
  chemically synthesized
gagaaaaaggaatctttgca

SEQ ID NO: 360580 - DNA, 20 bp, Artificial Sequence
  chemically synthesized
atttccaccaacactgtgca

SEQ ID NO: 360581 - DNA, 20 bp, Artificial Sequence
  chemically synthesized
aaggaatctttgcacagtgt

SEQ ID NO: 360582 - DNA, 20 bp, Artificial Sequence
  chemically synthesized
gaatctttgcacagtgttgg

SEQ ID NO: 360583 - DNA, 20 bp, Artificial Sequence
  chemically synthesized
ggtggaaatgtaaattattg

SEQ ID NO: 360584 - DNA, 20 bp, Artificial Sequence
  chemically synthesized
attattgtagtcatgaaaaa

SEQ ID NO: 360585 - DNA, 20 bp, Artificial Sequence
  chemically synthesized
tgtagtcatgaaaaacagta

SEQ ID NO: 360586 - DNA, 20 bp, Artificial Sequence
  chemically synthesized
tagtcatgaaaaacagtatg

SEQ ID NO: 360587 - DNA, 20 bp, Artificial Sequence
  chemically synthesized
agtcatgaaaaacagtatgg

SEQ ID NO: 360588 - DNA, 20 bp, Artificial Sequence
  chemically synthesized
agttttatttgtaatttttt

SEQ ID NO: 360589 - DNA, 20 bp, Artificial Sequence
  chemically synthesized
agaattcctgaattatatgg

SEQ ID NO: 360590 - DNA, 20 bp, Artificial Sequence
  chemically synthesized
aataaaactaccatataatt

SEQ ID NO: 360591 - DNA, 20 bp, Artificial Sequence
  chemically synthesized
agtagaattcctgaattata

SEQ ID NO: 360592 - DNA, 20 bp, Artificial Sequence
  chemically synthesized
ataaaactaccatataattc

SEQ ID NO: 360593 - DNA, 20 bp, Artificial Sequence
  chemically synthesized
taattcaggaattctactgc

SEQ ID NO: 360594 - DNA, 20 bp, Artificial Sequence
  chemically synthesized
aattcaggaattctactgct

SEQ ID NO: 360595 - DNA, 20 bp, Artificial Sequence
  chemically synthesized
ttggaatatatacccagcag

SEQ ID NO: 360596 - DNA, 20 bp, Artificial Sequence
  chemically synthesized
cctttggaatatatacccag

SEQ ID NO: 360597 - DNA, 20 bp, Artificial Sequence
  chemically synthesized
tttcctttggaatatatacc

SEQ ID NO: 360598 - DNA, 20 bp, Artificial Sequence
  chemically synthesized
actgctgggtatatattcca

SEQ ID NO: 360599 - DNA, 20 bp, Artificial Sequence
  chemically synthesized
ctgctgggtatatattccaa

SEQ ID NO: 360600 - DNA, 20 bp, Artificial Sequence
  chemically synthesized
acatattgatttgtttcctt

SEQ ID NO: 360601 - DNA, 20 bp, Artificial Sequence
  chemically synthesized
ggaaacaaatcaatatgtca

SEQ ID NO: 360602 - DNA, 20 bp, Artificial Sequence
  chemically synthesized
ctacaatatacattgaagtg

SEQ ID NO: 360603 - DNA, 20 bp, Artificial Sequence
  chemically synthesized
tagcactacaatatacattg

SEQ ID NO: 360604 - DNA, 20 bp, Artificial Sequence
  chemically synthesized
ctgcacttcaatgtatattg

SEQ ID NO: 360605 - DNA, 20 bp, Artificial Sequence
  chemically synthesized
tattgtagtgctactcaaaa

SEQ ID NO: 360606 - DNA, 20 bp, Artificial Sequence
  chemically synthesized
cctatcttcgctattttgag

SEQ ID NO: 360607 - DNA, 20 bp, Artificial Sequence
  chemically synthesized
tttcctatcttcgctatttt

SEQ ID NO: 360608 - DNA, 20 bp, Artificial Sequence
  chemically synthesized
tagtgctactcaaaatagcg

SEQ ID NO: 360609 - DNA, 20 bp, Artificial Sequence
  chemically synthesized
gctactcaaaatagcgaaga

SEQ ID NO: 360610 - DNA, 20 bp, Artificial Sequence
  chemically synthesized
ctactcaaaatagcgaagat

SEQ ID NO: 360611 - DNA, 20 bp, Artificial Sequence
  chemically synthesized
cgaagataggaaatcaactt

SEQ ID NO: 360612 - DNA, 20 bp, Artificial Sequence
  chemically synthesized
tcatctactgatggacactt

SEQ ID NO: 360613 - DNA, 20 bp, Artificial Sequence
  chemically synthesized
aaatcaacttaagtgtccat

SEQ ID NO: 360614 - DNA, 20 bp, Artificial Sequence
  chemically synthesized
tcaacttaagtgtccatcag

SEQ ID NO: 360615 - DNA, 20 bp, Artificial Sequence
  chemically synthesized
tttattctttcatctactga

SEQ ID NO: 360616 - DNA, 20 bp, Artificial Sequence
  chemically synthesized
aagtgtccatcagtagatga

SEQ ID NO: 360617 - DNA, 20 bp, Artificial Sequence
  chemically synthesized
catcagtagatgaaagaata

SEQ ID NO: 360618 - DNA, 20 bp, Artificial Sequence
  chemically synthesized
atgaaagaataaagaaaatg

SEQ ID NO: 360619 - DNA, 20 bp, Artificial Sequence
  chemically synthesized
tgaaagaataaagaaaatgc

SEQ ID NO: 360620 - DNA, 20 bp, Artificial Sequence
  chemically synthesized
ataaagaaaatgcaggtata

SEQ ID NO: 360621 - DNA, 20 bp, Artificial Sequence
  chemically synthesized
attccagtgtgtgtgtgtgt

SEQ ID NO: 360622 - DNA, 20 bp, Artificial Sequence
  chemically synthesized
tattccagtgtgtgtgtgtg

SEQ ID NO: 360623 - DNA, 20 bp, Artificial Sequence
  chemically synthesized
agacctacacacacacacac

SEQ ID NO: 360624 - DNA, 20 bp, Artificial Sequence
  chemically synthesized
tttaagtccgagtagtattc

SEQ ID NO: 360625 - DNA, 20 bp, Artificial Sequence
  chemically synthesized
acacacactggaatactact

SEQ ID NO: 360626 - DNA, 20 bp, Artificial Sequence
  chemically synthesized
ctctgctttttaagtccgag

SEQ ID NO: 360627 - DNA, 20 bp, Artificial Sequence
  chemically synthesized
attctctgctttttaagtcc

SEQ ID NO: 360628 - DNA, 20 bp, Artificial Sequence
  chemically synthesized
gaatactactcggacttaaa

SEQ ID NO: 360629 - DNA, 20 bp, Artificial Sequence
  chemically synthesized
tactactcggacttaaaaag

SEQ ID NO: 360630 - DNA, 20 bp, Artificial Sequence
  chemically synthesized
gagaggattctctgcttttt

SEQ ID NO: 360631 - DNA, 20 bp, Artificial Sequence
  chemically synthesized
ctactcggacttaaaaagca

SEQ ID NO: 360632 - DNA, 20 bp, Artificial Sequence
  chemically synthesized
ttaatttcattgcaaatgag

SEQ ID NO: 360633 - DNA, 20 bp, Artificial Sequence
  chemically synthesized
attaatttcattgcaaatga

SEQ ID NO: 360634 - DNA, 20 bp, Artificial Sequence
  chemically synthesized
tcattaatttcattgcaaat

SEQ ID NO: 360635 - DNA, 20 bp, Artificial Sequence
  chemically synthesized
tgcaatgaaattaatgaatc

SEQ ID NO: 360636 - DNA, 20 bp, Artificial Sequence
  chemically synthesized
caatgaaattaatgaatcta

SEQ ID NO: 360637 - DNA, 20 bp, Artificial Sequence
  chemically synthesized
tcatttgacgtaacgtactc

SEQ ID NO: 360638 - DNA, 20 bp, Artificial Sequence
  chemically synthesized
tacgttacgtcaaatgacat

SEQ ID NO: 360639 - DNA, 20 bp, Artificial Sequence
  chemically synthesized
ttacgtcaaatgacataagc

SEQ ID NO: 360640 - DNA, 20 bp, Artificial Sequence
  chemically synthesized
tacgtcaaatgacataagcc

SEQ ID NO: 360641 - DNA, 20 bp, Artificial Sequence
  chemically synthesized
caaatgacataagccaggca

SEQ ID NO: 360642 - DNA, 20 bp, Artificial Sequence
  chemically synthesized
aatgtttgtctttctgtgcc

SEQ ID NO: 360643 - DNA, 20 bp, Artificial Sequence
  chemically synthesized
tgacataagccaggcacaga

SEQ ID NO: 360644 - DNA, 20 bp, Artificial Sequence
  chemically synthesized
cattttaaaatttcatatac

SEQ ID NO: 360645 - DNA, 20 bp, Artificial Sequence
  chemically synthesized
atatgaaattttaaaatgtt

SEQ ID NO: 360646 - DNA, 20 bp, Artificial Sequence
  chemically synthesized
attttaaaatgttgagctca

SEQ ID NO: 360647 - DNA, 20 bp, Artificial Sequence
  chemically synthesized
cattttactctcaattctat

SEQ ID NO: 360648 - DNA, 20 bp, Artificial Sequence
  chemically synthesized
aatgttgagctcatagaatt

SEQ ID NO: 360649 - DNA, 20 bp, Artificial Sequence
  chemically synthesized
tgttgagctcatagaattga

SEQ ID NO: 360650 - DNA, 20 bp, Artificial Sequence
  chemically synthesized
tagaattgagagtaaaatgt

SEQ ID NO: 360651 - DNA, 20 bp, Artificial Sequence
  chemically synthesized
attgagagtaaaatgttggt

SEQ ID NO: 360652 - DNA, 20 bp, Artificial Sequence
  chemically synthesized
gagagtaaaatgttggttag

SEQ ID NO: 360653 - DNA, 20 bp, Artificial Sequence
  chemically synthesized
agagtaaaatgttggttagc

SEQ ID NO: 360654 - DNA, 20 bp, Artificial Sequence
  chemically synthesized
gagtaaaatgttggttagca

SEQ ID NO: 360655 - DNA, 20 bp, Artificial Sequence
  chemically synthesized
agtaaaatgttggttagcag

SEQ ID NO: 360656 - DNA, 20 bp, Artificial Sequence
  chemically synthesized
aaatgttggttagcagggga

SEQ ID NO: 360657 - DNA, 20 bp, Artificial Sequence
  chemically synthesized
atgttggttagcaggggata

SEQ ID NO: 360658 - DNA, 20 bp, Artificial Sequence
  chemically synthesized
ggttagcaggggatagagct

SEQ ID NO: 360659 - DNA, 20 bp, Artificial Sequence
  chemically synthesized
ttagcaggggatagagcttg

SEQ ID NO: 360660 - DNA, 20 bp, Artificial Sequence
  chemically synthesized
tagcaggggatagagcttgg

SEQ ID NO: 360661 - DNA, 20 bp, Artificial Sequence
  chemically synthesized
gcaggggatagagcttggag

SEQ ID NO: 360662 - DNA, 20 bp, Artificial Sequence
  chemically synthesized
caggggatagagcttggagg

SEQ ID NO: 360663 - DNA, 20 bp, Artificial Sequence
  chemically synthesized
ggggatagagcttggaggag

SEQ ID NO: 360664 - DNA, 20 bp, Artificial Sequence
  chemically synthesized
ctgcctaaccctcctcctcc

SEQ ID NO: 360665 - DNA, 20 bp, Artificial Sequence
  chemically synthesized
gggatagagcttggaggagg

SEQ ID NO: 360666 - DNA, 20 bp, Artificial Sequence
  chemically synthesized
ggatagagcttggaggagga

SEQ ID NO: 360667 - DNA, 20 bp, Artificial Sequence
  chemically synthesized
agagcttggaggaggagggt

SEQ ID NO: 360668 - DNA, 20 bp, Artificial Sequence
  chemically synthesized
gagcttggaggaggagggtt

SEQ ID NO: 360669 - DNA, 20 bp, Artificial Sequence
  chemically synthesized
cttggaggaggagggttagg

SEQ ID NO: 360670 - DNA, 20 bp, Artificial Sequence
  chemically synthesized
gaggagggttaggcagatgt

SEQ ID NO: 360671 - DNA, 20 bp, Artificial Sequence
  chemically synthesized
tattcctattaaatgtaatt

SEQ ID NO: 360672 - DNA, 20 bp, Artificial Sequence
  chemically synthesized
tgatactaaattacatttaa

SEQ ID NO: 360673 - DNA, 20 bp, Artificial Sequence
  chemically synthesized
gatactaaattacatttaat

SEQ ID NO: 360674 - DNA, 20 bp, Artificial Sequence
  chemically synthesized
catttaataggaataaattc

SEQ ID NO: 360675 - DNA, 20 bp, Artificial Sequence
  chemically synthesized
tttaataggaataaattcaa

SEQ ID NO: 360676 - DNA, 20 bp, Artificial Sequence
  chemically synthesized
aaagtcagcatgttgtacag

SEQ ID NO: 360677 - DNA, 20 bp, Artificial Sequence
  chemically synthesized
accaaagtcagcatgttgta

SEQ ID NO: 360678 - DNA, 20 bp, Artificial Sequence
  chemically synthesized
actgtacaacatgctgactt

SEQ ID NO: 360679 - DNA, 20 bp, Artificial Sequence
  chemically synthesized
atattgttattaaccaaagt

SEQ ID NO: 360680 - DNA, 20 bp, Artificial Sequence
  chemically synthesized
tacaatattgttattaacca

SEQ ID NO: 360681 - DNA, 20 bp, Artificial Sequence
  chemically synthesized
attgtattttgaaaattgct

SEQ ID NO: 360682 - DNA, 20 bp, Artificial Sequence
  chemically synthesized
tgtattttgaaaattgctaa

SEQ ID NO: 360683 - DNA, 20 bp, Artificial Sequence
  chemically synthesized
tttgaaaattgctaagagaa

SEQ ID NO: 360684 - DNA, 20 bp, Artificial Sequence
  chemically synthesized
acacttaaaatctattctct

SEQ ID NO: 360685 - DNA, 20 bp, Artificial Sequence
  chemically synthesized
ttgctaagagaatagatttt

SEQ ID NO: 360686 - DNA, 20 bp, Artificial Sequence
  chemically synthesized
atgtttatcatttggggttg

SEQ ID NO: 360687 - DNA, 20 bp, Artificial Sequence
  chemically synthesized
tatgtttatcatttggggtt

SEQ ID NO: 360688 - DNA, 20 bp, Artificial Sequence
  chemically synthesized
acttatatgtttatcatttg

SEQ ID NO: 360689 - DNA, 20 bp, Artificial Sequence
  chemically synthesized
aacttatatgtttatcattt

SEQ ID NO: 360690 - DNA, 20 bp, Artificial Sequence
  chemically synthesized
taacttatatgtttatcatt

SEQ ID NO: 360691 - DNA, 20 bp, Artificial Sequence
  chemically synthesized
accccaaatgataaacatat

SEQ ID NO: 360692 - DNA, 20 bp, Artificial Sequence
  chemically synthesized
aagttaatgtatatgtttat

SEQ ID NO: 360693 - DNA, 20 bp, Artificial Sequence
  chemically synthesized
tgtatatgtttattagcttg

SEQ ID NO: 360694 - DNA, 20 bp, Artificial Sequence
  chemically synthesized
tagatgttgtggaatgcttc

SEQ ID NO: 360695 - DNA, 20 bp, Artificial Sequence
  chemically synthesized
ttgaagcattccacaacatc

SEQ ID NO: 360696 - DNA, 20 bp, Artificial Sequence
  chemically synthesized
tttaaaatatctagatgttg

SEQ ID NO: 360697 - DNA, 20 bp, Artificial Sequence
  chemically synthesized
atatgattttttaaaatatc

SEQ ID NO: 360698 - DNA, 20 bp, Artificial Sequence
  chemically synthesized
ttaaaaaatcatatgctaca

SEQ ID NO: 360699 - DNA, 20 bp, Artificial Sequence
  chemically synthesized
aaaaaattgtatataccatg

SEQ ID NO: 360700 - DNA, 20 bp, Artificial Sequence
  chemically synthesized
actattttttattttttaat

SEQ ID NO: 360701 - DNA, 20 bp, Artificial Sequence
  chemically synthesized
gctaattaaaaaataaaaaa

SEQ ID NO: 360702 - DNA, 20 bp, Artificial Sequence
  chemically synthesized
aaaaataaaaaatagttata

SEQ ID NO: 360703 - DNA, 20 bp, Artificial Sequence
  chemically synthesized
caatgacttattttttattg

SEQ ID NO: 360704 - DNA, 20 bp, Artificial Sequence
  chemically synthesized
attttaccacaataaaaaat

SEQ ID NO: 360705 - DNA, 20 bp, Artificial Sequence
  chemically synthesized
cacaataaaaaataagtcat

SEQ ID NO: 360706 - DNA, 20 bp, Artificial Sequence
  chemically synthesized
tgtgtgtgtgtgtggggggg

SEQ ID NO: 360707 - DNA, 20 bp, Artificial Sequence
  chemically synthesized
gtgtgtgtgtgtgtgggggg

SEQ ID NO: 360708 - DNA, 20 bp, Artificial Sequence
  chemically synthesized
tgtgtgtgtgtgtgtggggg

SEQ ID NO: 360709 - DNA, 20 bp, Artificial Sequence
  chemically synthesized
gtgtgtgtgtgtgtgtgggg

SEQ ID NO: 360710 - DNA, 20 bp, Artificial Sequence
  chemically synthesized
tgtgtgtgtgtgtgtgtggg

SEQ ID NO: 360711 - DNA, 20 bp, Artificial Sequence
  chemically synthesized
ctgtgtgtgtgtgtgtgtgg

SEQ ID NO: 360712 - DNA, 20 bp, Artificial Sequence
  chemically synthesized
gctgtgtgtgtgtgtgtgtg

SEQ ID NO: 360713 - DNA, 20 bp, Artificial Sequence
  chemically synthesized
tgctgtgtgtgtgtgtgtgt

SEQ ID NO: 360714 - DNA, 20 bp, Artificial Sequence
  chemically synthesized
ctgctgtgtgtgtgtgtgtg

SEQ ID NO: 360715 - DNA, 20 bp, Artificial Sequence
  chemically synthesized
cccccacacacacacacaca

SEQ ID NO: 360716 - DNA, 20 bp, Artificial Sequence
  chemically synthesized
ccacacacacacacacacag

SEQ ID NO: 360717 - DNA, 20 bp, Artificial Sequence
  chemically synthesized
cacacacacacacacagcag

SEQ ID NO: 360718 - DNA, 20 bp, Artificial Sequence
  chemically synthesized
cacacacacagcagcagcca

SEQ ID NO: 360719 - DNA, 20 bp, Artificial Sequence
  chemically synthesized
atttatttaggtattatctg

SEQ ID NO: 360720 - DNA, 20 bp, Artificial Sequence
  chemically synthesized
aaaaccatgaacatttattt

SEQ ID NO: 360721 - DNA, 20 bp, Artificial Sequence
  chemically synthesized
aaaaaccatgaacatttatt

SEQ ID NO: 360722 - DNA, 20 bp, Artificial Sequence
  chemically synthesized
aatacctaaataaatgttca

SEQ ID NO: 360723 - DNA, 20 bp, Artificial Sequence
  chemically synthesized
tggatatagataaattttat

SEQ ID NO: 360724 - DNA, 20 bp, Artificial Sequence
  chemically synthesized
ataaaatttatctatatcca

SEQ ID NO: 360725 - DNA, 20 bp, Artificial Sequence
  chemically synthesized
taaaatttatctatatccac

SEQ ID NO: 360726 - DNA, 20 bp, Artificial Sequence
  chemically synthesized
aattgtttttcctgtggata

SEQ ID NO: 360727 - DNA, 20 bp, Artificial Sequence
  chemically synthesized
ctacctaattgtttttcctg

SEQ ID NO: 360728 - DNA, 20 bp, Artificial Sequence
  chemically synthesized
atatccacaggaaaaacaat

SEQ ID NO: 360729 - DNA, 20 bp, Artificial Sequence
  chemically synthesized
tatccacaggaaaaacaatt

SEQ ID NO: 360730 - DNA, 20 bp, Artificial Sequence
  chemically synthesized
ccacaggaaaaacaattagg

SEQ ID NO: 360731 - DNA, 20 bp, Artificial Sequence
  chemically synthesized
cacaggaaaaacaattaggt

SEQ ID NO: 360732 - DNA, 20 bp, Artificial Sequence
  chemically synthesized
aggtaggcaactgtgtctca

SEQ ID NO: 360733 - DNA, 20 bp, Artificial Sequence
  chemically synthesized
ccttgggcttccgtgagaca

SEQ ID NO: 360734 - DNA, 20 bp, Artificial Sequence
  chemically synthesized
taggcaactgtgtctcacgg

SEQ ID NO: 360735 - DNA, 20 bp, Artificial Sequence
  chemically synthesized
cttaccccttgggcttccgt

SEQ ID NO: 360736 - DNA, 20 bp, Artificial Sequence
  chemically synthesized
actgtgtctcacggaagccc

SEQ ID NO: 360737 - DNA, 20 bp, Artificial Sequence
  chemically synthesized
ctgtgtctcacggaagccca

SEQ ID NO: 360738 - DNA, 20 bp, Artificial Sequence
  chemically synthesized
tgtgtctcacggaagcccaa

SEQ ID NO: 360739 - DNA, 20 bp, Artificial Sequence
  chemically synthesized
gtgtctcacggaagcccaag

SEQ ID NO: 360740 - DNA, 20 bp, Artificial Sequence
  chemically synthesized
ctcacggaagcccaaggggt

SEQ ID NO: 360741 - DNA, 20 bp, Artificial Sequence
  chemically synthesized
cttcctttttcttacccctt

SEQ ID NO: 360742 - DNA, 20 bp, Artificial Sequence
  chemically synthesized
acttcctttttcttacccct

SEQ ID NO: 360743 - DNA, 20 bp, Artificial Sequence
  chemically synthesized
gaagcccaaggggtaagaaa

SEQ ID NO: 360744 - DNA, 20 bp, Artificial Sequence
  chemically synthesized
aagcccaaggggtaagaaaa

SEQ ID NO: 360745 - DNA, 20 bp, Artificial Sequence
  chemically synthesized
cccaaggggtaagaaaaagg

SEQ ID NO: 360746 - DNA, 20 bp, Artificial Sequence
  chemically synthesized
aaaggaagtaacattgtgaa

SEQ ID NO: 360747 - DNA, 20 bp, Artificial Sequence
  chemically synthesized
aagtaacattgtgaaaagat

SEQ ID NO: 360748 - DNA, 20 bp, Artificial Sequence
  chemically synthesized
cattgtgaaaagataagcaa

SEQ ID NO: 360749 - DNA, 20 bp, Artificial Sequence
  chemically synthesized
aaaagataagcaaaagacat

SEQ ID NO: 360750 - DNA, 20 bp, Artificial Sequence
  chemically synthesized
ataagatatattcatgtact

SEQ ID NO: 360751 - DNA, 20 bp, Artificial Sequence
  chemically synthesized
ttacagatttaatcaatact

SEQ ID NO: 360752 - DNA, 20 bp, Artificial Sequence
  chemically synthesized
cagtattgattaaatctgta

SEQ ID NO: 360753 - DNA, 20 bp, Artificial Sequence
  chemically synthesized
tccaatctattttttcttta

SEQ ID NO: 360754 - DNA, 20 bp, Artificial Sequence
  chemically synthesized
ttaaatctgtaaagaaaaaa

SEQ ID NO: 360755 - DNA, 20 bp, Artificial Sequence
  chemically synthesized
tctgtaaagaaaaaatagat

SEQ ID NO: 360756 - DNA, 20 bp, Artificial Sequence
  chemically synthesized
agaaaaaatagattggaatg

SEQ ID NO: 360757 - DNA, 20 bp, Artificial Sequence
  chemically synthesized
aaatagattggaatgaagaa

SEQ ID NO: 360758 - DNA, 20 bp, Artificial Sequence
  chemically synthesized
attggaatgaagaaaagtat

SEQ ID NO: 360759 - DNA, 20 bp, Artificial Sequence
  chemically synthesized
ttggaatgaagaaaagtatc

SEQ ID NO: 360760 - DNA, 20 bp, Artificial Sequence
  chemically synthesized
gaatgaagaaaagtatcagg

SEQ ID NO: 360761 - DNA, 20 bp, Artificial Sequence
  chemically synthesized
atgaagaaaagtatcaggtg

SEQ ID NO: 360762 - DNA, 20 bp, Artificial Sequence
  chemically synthesized
agaaaagtatcaggtggaga

SEQ ID NO: 360763 - DNA, 20 bp, Artificial Sequence
  chemically synthesized
atcaggtggagaaagcatgc

SEQ ID NO: 360764 - DNA, 20 bp, Artificial Sequence
  chemically synthesized
ggtggagaaagcatgccaga

SEQ ID NO: 360765 - DNA, 20 bp, Artificial Sequence
  chemically synthesized
ctagtgatctgaatgctttc

SEQ ID NO: 360766 - DNA, 20 bp, Artificial Sequence
  chemically synthesized
aaagcatgccagaaagcatt

SEQ ID NO: 360767 - DNA, 20 bp, Artificial Sequence
  chemically synthesized
ccagaaagcattcagatcac

SEQ ID NO: 360768 - DNA, 20 bp, Artificial Sequence
  chemically synthesized
cagaaagcattcagatcact

SEQ ID NO: 360769 - DNA, 20 bp, Artificial Sequence
  chemically synthesized
agaaagcattcagatcacta

SEQ ID NO: 360770 - DNA, 20 bp, Artificial Sequence
  chemically synthesized
gaaagcattcagatcactag

SEQ ID NO: 360771 - DNA, 20 bp, Artificial Sequence
  chemically synthesized
aaagcattcagatcactagg

SEQ ID NO: 360772 - DNA, 20 bp, Artificial Sequence
  chemically synthesized
ccaatcagttaattaccccc

SEQ ID NO: 360773 - DNA, 20 bp, Artificial Sequence
  chemically synthesized
ctagggggtaattaactgat

SEQ ID NO: 360774 - DNA, 20 bp, Artificial Sequence
  chemically synthesized
tagggggtaattaactgatt

SEQ ID NO: 360775 - DNA, 20 bp, Artificial Sequence
  chemically synthesized
taatatctccaattcccaat

SEQ ID NO: 360776 - DNA, 20 bp, Artificial Sequence
  chemically synthesized
gtaattaactgattgggaat

SEQ ID NO: 360777 - DNA, 20 bp, Artificial Sequence
  chemically synthesized
aattaactgattgggaattg

SEQ ID NO: 360778 - DNA, 20 bp, Artificial Sequence
  chemically synthesized
ggaattggagatattatatt

SEQ ID NO: 360779 - DNA, 20 bp, Artificial Sequence
  chemically synthesized
gaattggagatattatattc

SEQ ID NO: 360780 - DNA, 20 bp, Artificial Sequence
  chemically synthesized
aattggagatattatattca

SEQ ID NO: 360781 - DNA, 20 bp, Artificial Sequence
  chemically synthesized
ggagatattatattcaggga

SEQ ID NO: 360782 - DNA, 20 bp, Artificial Sequence
  chemically synthesized
ttcagggacagaattgtatt

SEQ ID NO: 360783 - DNA, 20 bp, Artificial Sequence
  chemically synthesized
agggacagaattgtattcag

SEQ ID NO: 360784 - DNA, 20 bp, Artificial Sequence
  chemically synthesized
gacagaattgtattcagtgg

SEQ ID NO: 360785 - DNA, 20 bp, Artificial Sequence
  chemically synthesized
gaattgtattcagtggcaga

SEQ ID NO: 360786 - DNA, 20 bp, Artificial Sequence
  chemically synthesized
atataaaagttaaaaaagag

SEQ ID NO: 360787 - DNA, 20 bp, Artificial Sequence
  chemically synthesized
ctaatataaaagttaaaaaa

SEQ ID NO: 360788 - DNA, 20 bp, Artificial Sequence
  chemically synthesized
acctaatataaaagttaaaa

SEQ ID NO: 360789 - DNA, 20 bp, Artificial Sequence
  chemically synthesized
ctcttttttaacttttatat

SEQ ID NO: 360790 - DNA, 20 bp, Artificial Sequence
  chemically synthesized
tcttttttaacttttatatt

SEQ ID NO: 360791 - DNA, 20 bp, Artificial Sequence
  chemically synthesized
tactcctgaacctaatataa

SEQ ID NO: 360792 - DNA, 20 bp, Artificial Sequence
  chemically synthesized
tttaacttttatattaggtt

SEQ ID NO: 360793 - DNA, 20 bp, Artificial Sequence
  chemically synthesized
ttaacttttatattaggttc

SEQ ID NO: 360794 - DNA, 20 bp, Artificial Sequence
  chemically synthesized
aacttttatattaggttcag

SEQ ID NO: 360795 - DNA, 20 bp, Artificial Sequence
  chemically synthesized
taggttcaggagtacatgtg

SEQ ID NO: 360796 - DNA, 20 bp, Artificial Sequence
  chemically synthesized
aggttcaggagtacatgtgc

SEQ ID NO: 360797 - DNA, 20 bp, Artificial Sequence
  chemically synthesized
acatgtgcaggtttgttaca

SEQ ID NO: 360798 - DNA, 20 bp, Artificial Sequence
  chemically synthesized
catgtgcaggtttgttacat

SEQ ID NO: 360799 - DNA, 20 bp, Artificial Sequence
  chemically synthesized
cataggtaaattgcgtgtca

SEQ ID NO: 360800 - DNA, 20 bp, Artificial Sequence
  chemically synthesized
ataggtaaattgcgtgtcat

SEQ ID NO: 360801 - DNA, 20 bp, Artificial Sequence
  chemically synthesized
taggtaaattgcgtgtcatg

SEQ ID NO: 360802 - DNA, 20 bp, Artificial Sequence
  chemically synthesized
aggtaaattgcgtgtcatgg

SEQ ID NO: 360803 - DNA, 20 bp, Artificial Sequence
  chemically synthesized
gtacacattatttcatcgcc

SEQ ID NO: 360804 - DNA, 20 bp, Artificial Sequence
  chemically synthesized
tacacattatttcatcgccc

SEQ ID NO: 360805 - DNA, 20 bp, Artificial Sequence
  chemically synthesized
tatttcatcgcccaggtaat

SEQ ID NO: 360806 - DNA, 20 bp, Artificial Sequence
  chemically synthesized
aggcaccatacttattacct

SEQ ID NO: 360807 - DNA, 20 bp, Artificial Sequence
  chemically synthesized
caggcaccatacttattacc

SEQ ID NO: 360808 - DNA, 20 bp, Artificial Sequence
  chemically synthesized
catcgcccaggtaataagta

SEQ ID NO: 360809 - DNA, 20 bp, Artificial Sequence
  chemically synthesized
gtaataagtatggtgcctga

SEQ ID NO: 360810 - DNA, 20 bp, Artificial Sequence
  chemically synthesized
taataagtatggtgcctgat

SEQ ID NO: 360811 - DNA, 20 bp, Artificial Sequence
  chemically synthesized
taagtatggtgcctgatagg

SEQ ID NO: 360812 - DNA, 20 bp, Artificial Sequence
  chemically synthesized
gatcagaaaaactacctatc

SEQ ID NO: 360813 - DNA, 20 bp, Artificial Sequence
  chemically synthesized
ggatcagaaaaactacctat

SEQ ID NO: 360814 - DNA, 20 bp, Artificial Sequence
  chemically synthesized
ggtgggaggagggagaggat

SEQ ID NO: 360815 - DNA, 20 bp, Artificial Sequence
  chemically synthesized
taaaaggtgggaggagggag

SEQ ID NO: 360816 - DNA, 20 bp, Artificial Sequence
  chemically synthesized
gtaaaaggtgggaggaggga

SEQ ID NO: 360817 - DNA, 20 bp, Artificial Sequence
  chemically synthesized
gagtaaaaggtgggaggagg

SEQ ID NO: 360818 - DNA, 20 bp, Artificial Sequence
  chemically synthesized
aagagtaaaaggtgggagga

SEQ ID NO: 360819 - DNA, 20 bp, Artificial Sequence
  chemically synthesized
caagagtaaaaggtgggagg

SEQ ID NO: 360820 - DNA, 20 bp, Artificial Sequence
  chemically synthesized
tcaagagtaaaaggtgggag

SEQ ID NO: 360821 - DNA, 20 bp, Artificial Sequence
  chemically synthesized
actcaagagtaaaaggtggg

SEQ ID NO: 360822 - DNA, 20 bp, Artificial Sequence
  chemically synthesized
tactcaagagtaaaaggtgg

SEQ ID NO: 360823 - DNA, 20 bp, Artificial Sequence
  chemically synthesized
cctactcaagagtaaaaggt

SEQ ID NO: 360824 - DNA, 20 bp, Artificial Sequence
  chemically synthesized
gcctactcaagagtaaaagg

SEQ ID NO: 360825 - DNA, 20 bp, Artificial Sequence
  chemically synthesized
ggagcctactcaagagtaaa

SEQ ID NO: 360826 - DNA, 20 bp, Artificial Sequence
  chemically synthesized
tggagcctactcaagagtaa

SEQ ID NO: 360827 - DNA, 20 bp, Artificial Sequence
  chemically synthesized
tcctcccaccttttactctt

SEQ ID NO: 360828 - DNA, 20 bp, Artificial Sequence
  chemically synthesized
tcccaccttttactcttgag

SEQ ID NO: 360829 - DNA, 20 bp, Artificial Sequence
  chemically synthesized
cccaccttttactcttgagt

SEQ ID NO: 360830 - DNA, 20 bp, Artificial Sequence
  chemically synthesized
agacactggagcctactcaa

SEQ ID NO: 360831 - DNA, 20 bp, Artificial Sequence
  chemically synthesized
acagacactggagcctactc

SEQ ID NO: 360832 - DNA, 20 bp, Artificial Sequence
  chemically synthesized
ttttactcttgagtaggctc

SEQ ID NO: 360833 - DNA, 20 bp, Artificial Sequence
  chemically synthesized
gtggggaacaacagacactg

SEQ ID NO: 360834 - DNA, 20 bp, Artificial Sequence
  chemically synthesized
aagtggggaacaacagacac

SEQ ID NO: 360835 - DNA, 20 bp, Artificial Sequence
  chemically synthesized
ggatataaagtggggaacaa

SEQ ID NO: 360836 - DNA, 20 bp, Artificial Sequence
  chemically synthesized
gaacacatggatataaagtg

SEQ ID NO: 360837 - DNA, 20 bp, Artificial Sequence
  chemically synthesized
agaacacatggatataaagt

SEQ ID NO: 360838 - DNA, 20 bp, Artificial Sequence
  chemically synthesized
aagaacacatggatataaag

SEQ ID NO: 360839 - DNA, 20 bp, Artificial Sequence
  chemically synthesized
aacaagaacacatggatata

SEQ ID NO: 360840 - DNA, 20 bp, Artificial Sequence
  chemically synthesized
gagttaataacaagaacaca

SEQ ID NO: 360841 - DNA, 20 bp, Artificial Sequence
  chemically synthesized
aaaaaaggggagttaataac

SEQ ID NO: 360842 - DNA, 20 bp, Artificial Sequence
  chemically synthesized
aaaaaaaaaaaaaaaaaggg

SEQ ID NO: 360843 - DNA, 20 bp, Artificial Sequence
  chemically synthesized
tcaaaaaaaaaaaaaaaaag

SEQ ID NO: 360844 - DNA, 20 bp, Artificial Sequence
  chemically synthesized
ctcaaaaaaaaaaaaaaaaa

SEQ ID NO: 360845 - DNA, 20 bp, Artificial Sequence
  chemically synthesized
cctcaaaaaaaaaaaaaaaa

SEQ ID NO: 360846 - DNA, 20 bp, Artificial Sequence
  chemically synthesized
acctcaaaaaaaaaaaaaaa

SEQ ID NO: 360847 - DNA, 20 bp, Artificial Sequence
  chemically synthesized
cccttttttttttttttttt

SEQ ID NO: 360848 - DNA, 20 bp, Artificial Sequence
  chemically synthesized
cctttttttttttttttttg

SEQ ID NO: 360849 - DNA, 20 bp, Artificial Sequence
  chemically synthesized
ttttttttttttttttgagg

SEQ ID NO: 360850 - DNA, 20 bp, Artificial Sequence
  chemically synthesized
ttttttttttttttgaggtg

SEQ ID NO: 360851 - DNA, 20 bp, Artificial Sequence
  chemically synthesized
cactccagtctgggcaacaa

SEQ ID NO: 360852 - DNA, 20 bp, Artificial Sequence
  chemically synthesized
ggagtttcgctcttgttgcc

SEQ ID NO: 360853 - DNA, 20 bp, Artificial Sequence
  chemically synthesized
tgcactccagtctgggcaac

SEQ ID NO: 360854 - DNA, 20 bp, Artificial Sequence
  chemically synthesized
ttcgctcttgttgcccagac

SEQ ID NO: 360855 - DNA, 20 bp, Artificial Sequence
  chemically synthesized
cgctcttgttgcccagactg

SEQ ID NO: 360856 - DNA, 20 bp, Artificial Sequence
  chemically synthesized
gtgccactgcactccagtct

SEQ ID NO: 360857 - DNA, 20 bp, Artificial Sequence
  chemically synthesized
cgtgccactgcactccagtc

SEQ ID NO: 360858 - DNA, 20 bp, Artificial Sequence
  chemically synthesized
ttgttgcccagactggagtg

SEQ ID NO: 360859 - DNA, 20 bp, Artificial Sequence
  chemically synthesized
gagatcgtgccactgcactc

SEQ ID NO: 360860 - DNA, 20 bp, Artificial Sequence
  chemically synthesized
ttgcccagactggagtgcag

SEQ ID NO: 360861 - DNA, 20 bp, Artificial Sequence
  chemically synthesized
ggagtgcagtggcacgatct

SEQ ID NO: 360862 - DNA, 20 bp, Artificial Sequence
  chemically synthesized
ggcggaggttgtggtgagcc

SEQ ID NO: 360863 - DNA, 20 bp, Artificial Sequence
  chemically synthesized
cgggaggcggaggttgtggt

SEQ ID NO: 360864 - DNA, 20 bp, Artificial Sequence
  chemically synthesized
aactcgggaggcggaggttg

SEQ ID NO: 360865 - DNA, 20 bp, Artificial Sequence
  chemically synthesized
gcttgaaactcgggaggcgg

SEQ ID NO: 360866 - DNA, 20 bp, Artificial Sequence
  chemically synthesized
cgcttgaaactcgggaggcg

SEQ ID NO: 360867 - DNA, 20 bp, Artificial Sequence
  chemically synthesized
caccacaacctccgcctccc

SEQ ID NO: 360868 - DNA, 20 bp, Artificial Sequence
  chemically synthesized
atcgcttgaaactcgggagg

SEQ ID NO: 360869 - DNA, 20 bp, Artificial Sequence
  chemically synthesized
agaatcgcttgaaactcggg

SEQ ID NO: 360870 - DNA, 20 bp, Artificial Sequence
  chemically synthesized
gagaatcgcttgaaactcgg

SEQ ID NO: 360871 - DNA, 20 bp, Artificial Sequence
  chemically synthesized
acctccgcctcccgagtttc

SEQ ID NO: 360872 - DNA, 20 bp, Artificial Sequence
  chemically synthesized
aggagaatcgcttgaaactc

SEQ ID NO: 360873 - DNA, 20 bp, Artificial Sequence
  chemically synthesized
caggagaatcgcttgaaact

SEQ ID NO: 360874 - DNA, 20 bp, Artificial Sequence
  chemically synthesized
ttcaagcgattctcctgcct

SEQ ID NO: 360875 - DNA, 20 bp, Artificial Sequence
  chemically synthesized
tacttgggaggctgaggcag

SEQ ID NO: 360876 - DNA, 20 bp, Artificial Sequence
  chemically synthesized
gctacttgggaggctgaggc

SEQ ID NO: 360877 - DNA, 20 bp, Artificial Sequence
  chemically synthesized
agctacttgggaggctgagg

SEQ ID NO: 360878 - DNA, 20 bp, Artificial Sequence
  chemically synthesized
cccagctacttgggaggctg

SEQ ID NO: 360879 - DNA, 20 bp, Artificial Sequence
  chemically synthesized
tcccagctacttgggaggct

SEQ ID NO: 360880 - DNA, 20 bp, Artificial Sequence
  chemically synthesized
ttctcctgcctcagcctccc

SEQ ID NO: 360881 - DNA, 20 bp, Artificial Sequence
  chemically synthesized
tcctgcctcagcctcccaag

SEQ ID NO: 360882 - DNA, 20 bp, Artificial Sequence
  chemically synthesized
tgtaatcccagctacttggg

SEQ ID NO: 360883 - DNA, 20 bp, Artificial Sequence
  chemically synthesized
ctgtaatcccagctacttgg

SEQ ID NO: 360884 - DNA, 20 bp, Artificial Sequence
  chemically synthesized
gcctcagcctcccaagtagc

SEQ ID NO: 360885 - DNA, 20 bp, Artificial Sequence
  chemically synthesized
gcctgtaatcccagctactt

SEQ ID NO: 360886 - DNA, 20 bp, Artificial Sequence
  chemically synthesized
cctcagcctcccaagtagct

SEQ ID NO: 360887 - DNA, 20 bp, Artificial Sequence
  chemically synthesized
tgcctgtaatcccagctact

SEQ ID NO: 360888 - DNA, 20 bp, Artificial Sequence
  chemically synthesized
ctcccaagtagctgggatta

SEQ ID NO: 360889 - DNA, 20 bp, Artificial Sequence
  chemically synthesized
tcccaagtagctgggattac

SEQ ID NO: 360890 - DNA, 20 bp, Artificial Sequence
  chemically synthesized
gtggcgcatgcctgtaatcc

SEQ ID NO: 360891 - DNA, 20 bp, Artificial Sequence
  chemically synthesized
caggcatgcgccaccacgcc

SEQ ID NO: 360892 - DNA, 20 bp, Artificial Sequence
  chemically synthesized
acaaaattagccaggcgtgg

SEQ ID NO: 360893 - DNA, 20 bp, Artificial Sequence
  chemically synthesized
aatacaaaattagccaggcg

SEQ ID NO: 360894 - DNA, 20 bp, Artificial Sequence
  chemically synthesized
ctaaaaatacaaaattagcc

SEQ ID NO: 360895 - DNA, 20 bp, Artificial Sequence
  chemically synthesized
actaaaaatacaaaattagc

SEQ ID NO: 360896 - DNA, 20 bp, Artificial Sequence
  chemically synthesized
ctctactaaaaatacaaaat

SEQ ID NO: 360897 - DNA, 20 bp, Artificial Sequence
  chemically synthesized
cctggctaattttgtatttt

SEQ ID NO: 360898 - DNA, 20 bp, Artificial Sequence
  chemically synthesized
ggctaattttgtatttttag

SEQ ID NO: 360899 - DNA, 20 bp, Artificial Sequence
  chemically synthesized
ctaattttgtatttttagta

SEQ ID NO: 360900 - DNA, 20 bp, Artificial Sequence
  chemically synthesized
ttttgtatttttagtagaga

SEQ ID NO: 360901 - DNA, 20 bp, Artificial Sequence
  chemically synthesized
tttgtatttttagtagagac

SEQ ID NO: 360902 - DNA, 20 bp, Artificial Sequence
  chemically synthesized
ttgtatttttagtagagacg

SEQ ID NO: 360903 - DNA, 20 bp, Artificial Sequence
  chemically synthesized
gagacggggtttctccatgt

SEQ ID NO: 360904 - DNA, 20 bp, Artificial Sequence
  chemically synthesized
agaccagcctgaccaacatg

SEQ ID NO: 360905 - DNA, 20 bp, Artificial Sequence
  chemically synthesized
cggggtttctccatgttggt

SEQ ID NO: 360906 - DNA, 20 bp, Artificial Sequence
  chemically synthesized
cgagaccagcctgaccaaca

SEQ ID NO: 360907 - DNA, 20 bp, Artificial Sequence
  chemically synthesized
ggggtttctccatgttggtc

SEQ ID NO: 360908 - DNA, 20 bp, Artificial Sequence
  chemically synthesized
tttctccatgttggtcaggc

SEQ ID NO: 360909 - DNA, 20 bp, Artificial Sequence
  chemically synthesized
tgaggtcgggagttcgagac

SEQ ID NO: 360910 - DNA, 20 bp, Artificial Sequence
  chemically synthesized
tcacctgaggtcgggagttc

SEQ ID NO: 360911 - DNA, 20 bp, Artificial Sequence
  chemically synthesized
tggtctcgaactcccgacct

SEQ ID NO: 360912 - DNA, 20 bp, Artificial Sequence
  chemically synthesized
gcgggatcacctgaggtcgg

SEQ ID NO: 360913 - DNA, 20 bp, Artificial Sequence
  chemically synthesized
ggtctcgaactcccgacctc

SEQ ID NO: 360914 - DNA, 20 bp, Artificial Sequence
  chemically synthesized
gagcgggatcacctgaggtc

SEQ ID NO: 360915 - DNA, 20 bp, Artificial Sequence
  chemically synthesized
cgagcgggatcacctgaggt

SEQ ID NO: 360916 - DNA, 20 bp, Artificial Sequence
  chemically synthesized
gaggcgagcgggatcacctg

SEQ ID NO: 360917 - DNA, 20 bp, Artificial Sequence
  chemically synthesized
cgaggcgagcgggatcacct

SEQ ID NO: 360918 - DNA, 20 bp, Artificial Sequence
  chemically synthesized
tttgggaggccgaggcgagc

SEQ ID NO: 360919 - DNA, 20 bp, Artificial Sequence
  chemically synthesized
tcaggtgatcccgctcgcct

SEQ ID NO: 360920 - DNA, 20 bp, Artificial Sequence
  chemically synthesized
ctttgggaggccgaggcgag

SEQ ID NO: 360921 - DNA, 20 bp, Artificial Sequence
  chemically synthesized
gtactttgggaggccgaggc

SEQ ID NO: 360922 - DNA, 20 bp, Artificial Sequence
  chemically synthesized
cctagtactttgggaggccg

SEQ ID NO: 360923 - DNA, 20 bp, Artificial Sequence
  chemically synthesized
acctagtactttgggaggcc

SEQ ID NO: 360924 - DNA, 20 bp, Artificial Sequence
  chemically synthesized
ccgctcgcctcggcctccca

SEQ ID NO: 360925 - DNA, 20 bp, Artificial Sequence
  chemically synthesized
ctgtaacctagtactttggg

SEQ ID NO: 360926 - DNA, 20 bp, Artificial Sequence
  chemically synthesized
cctgtaacctagtactttgg

SEQ ID NO: 360927 - DNA, 20 bp, Artificial Sequence
  chemically synthesized
gcctcggcctcccaaagtac

SEQ ID NO: 360928 - DNA, 20 bp, Artificial Sequence
  chemically synthesized
tacctgtaacctagtacttt

SEQ ID NO: 360929 - DNA, 20 bp, Artificial Sequence
  chemically synthesized
cctcggcctcccaaagtact

SEQ ID NO: 360930 - DNA, 20 bp, Artificial Sequence
  chemically synthesized
atacctgtaacctagtactt

SEQ ID NO: 360931 - DNA, 20 bp, Artificial Sequence
  chemically synthesized
cctcccaaagtactaggtta

SEQ ID NO: 360932 - DNA, 20 bp, Artificial Sequence
  chemically synthesized
ctcccaaagtactaggttac

SEQ ID NO: 360933 - DNA, 20 bp, Artificial Sequence
  chemically synthesized
agtggcttatacctgtaacc

SEQ ID NO: 360934 - DNA, 20 bp, Artificial Sequence
  chemically synthesized
aagtactaggttacaggtat

SEQ ID NO: 360935 - DNA, 20 bp, Artificial Sequence
  chemically synthesized
caggtataagccactgcgcc

SEQ ID NO: 360936 - DNA, 20 bp, Artificial Sequence
  chemically synthesized
gggagttaggctgggcgcag

SEQ ID NO: 360937 - DNA, 20 bp, Artificial Sequence
  chemically synthesized
agtgggagttaggctgggcg

SEQ ID NO: 360938 - DNA, 20 bp, Artificial Sequence
  chemically synthesized
ttataagtgggagttaggct

SEQ ID NO: 360939 - DNA, 20 bp, Artificial Sequence
  chemically synthesized
cttataagtgggagttaggc

SEQ ID NO: 360940 - DNA, 20 bp, Artificial Sequence
  chemically synthesized
ctcacttataagtgggagtt

SEQ ID NO: 360941 - DNA, 20 bp, Artificial Sequence
  chemically synthesized
tctcacttataagtgggagt

SEQ ID NO: 360942 - DNA, 20 bp, Artificial Sequence
  chemically synthesized
atgttctcacttataagtgg

SEQ ID NO: 360943 - DNA, 20 bp, Artificial Sequence
  chemically synthesized
ccagcctaactcccacttat

SEQ ID NO: 360944 - DNA, 20 bp, Artificial Sequence
  chemically synthesized
acatgttctcacttataagt

SEQ ID NO: 360945 - DNA, 20 bp, Artificial Sequence
  chemically synthesized
cacatgttctcacttataag

SEQ ID NO: 360946 - DNA, 20 bp, Artificial Sequence
  chemically synthesized
cctaactcccacttataagt

SEQ ID NO: 360947 - DNA, 20 bp, Artificial Sequence
  chemically synthesized
tatcacatgttctcacttat

SEQ ID NO: 360948 - DNA, 20 bp, Artificial Sequence
  chemically synthesized
aagtgagaacatgtgatatt

SEQ ID NO: 360949 - DNA, 20 bp, Artificial Sequence
  chemically synthesized
ttagcaaactagtgcatgaa

SEQ ID NO: 360950 - DNA, 20 bp, Artificial Sequence
  chemically synthesized
ttggttttctgttcatgcac

SEQ ID NO: 360951 - DNA, 20 bp, Artificial Sequence
  chemically synthesized
tgttcatgcactagtttgct

SEQ ID NO: 360952 - DNA, 20 bp, Artificial Sequence
  chemically synthesized
agccgttatccttagcaaac

SEQ ID NO: 360953 - DNA, 20 bp, Artificial Sequence
  chemically synthesized
gttcatgcactagtttgcta

SEQ ID NO: 360954 - DNA, 20 bp, Artificial Sequence
  chemically synthesized
cactagtttgctaaggataa

SEQ ID NO: 360955 - DNA, 20 bp, Artificial Sequence
  chemically synthesized
gcagctggagccgttatcct

SEQ ID NO: 360956 - DNA, 20 bp, Artificial Sequence
  chemically synthesized
tttgctaaggataacggctc

SEQ ID NO: 360957 - DNA, 20 bp, Artificial Sequence
  chemically synthesized
tagcaacatggatgcagctg

SEQ ID NO: 360958 - DNA, 20 bp, Artificial Sequence
  chemically synthesized
tgtagcaacatggatgcagc

SEQ ID NO: 360959 - DNA, 20 bp, Artificial Sequence
  chemically synthesized
agattgtagcaacatggatg

SEQ ID NO: 360960 - DNA, 20 bp, Artificial Sequence
  chemically synthesized
aaaataagattgtagcaaca

SEQ ID NO: 360961 - DNA, 20 bp, Artificial Sequence
  chemically synthesized
cccagacaaaaataagattg

SEQ ID NO: 360962 - DNA, 20 bp, Artificial Sequence
  chemically synthesized
aatacaacccagacaaaaat

SEQ ID NO: 360963 - DNA, 20 bp, Artificial Sequence
  chemically synthesized
gctacaatcttatttttgtc

SEQ ID NO: 360964 - DNA, 20 bp, Artificial Sequence
  chemically synthesized
ctacaatcttatttttgtct

SEQ ID NO: 360965 - DNA, 20 bp, Artificial Sequence
  chemically synthesized
atacaccatggaatacaacc

SEQ ID NO: 360966 - DNA, 20 bp, Artificial Sequence
  chemically synthesized
tttgtctgggttgtattcca

SEQ ID NO: 360967 - DNA, 20 bp, Artificial Sequence
  chemically synthesized
aatatgctacatatacacca

SEQ ID NO: 360968 - DNA, 20 bp, Artificial Sequence
  chemically synthesized
tgtattccatggtgtatatg

SEQ ID NO: 360969 - DNA, 20 bp, Artificial Sequence
  chemically synthesized
atgtagcatattttcttaat

SEQ ID NO: 360970 - DNA, 20 bp, Artificial Sequence
  chemically synthesized
ccatcaacagtagactgatt

SEQ ID NO: 360971 - DNA, 20 bp, Artificial Sequence
  chemically synthesized
cttaatcagtctactgttga

SEQ ID NO: 360972 - DNA, 20 bp, Artificial Sequence
  chemically synthesized
acataaatgtccatcaacag

SEQ ID NO: 360973 - DNA, 20 bp, Artificial Sequence
  chemically synthesized
tcaacataaatgtccatcaa

SEQ ID NO: 360974 - DNA, 20 bp, Artificial Sequence
  chemically synthesized
tattcacagtagcaaagatg

SEQ ID NO: 360975 - DNA, 20 bp, Artificial Sequence
  chemically synthesized
ctattcacagtagcaaagat

SEQ ID NO: 360976 - DNA, 20 bp, Artificial Sequence
  chemically synthesized
actattcacagtagcaaaga

SEQ ID NO: 360977 - DNA, 20 bp, Artificial Sequence
  chemically synthesized
cagcactattcacagtagca

SEQ ID NO: 360978 - DNA, 20 bp, Artificial Sequence
  chemically synthesized
cccatctttgctactgtgaa

SEQ ID NO: 360979 - DNA, 20 bp, Artificial Sequence
  chemically synthesized
tattgcagcactattcacag

SEQ ID NO: 360980 - DNA, 20 bp, Artificial Sequence
  chemically synthesized
gtttattgcagcactattca

SEQ ID NO: 360981 - DNA, 20 bp, Artificial Sequence
  chemically synthesized
atgcacatatatgtttattg

SEQ ID NO: 360982 - DNA, 20 bp, Artificial Sequence
  chemically synthesized
atgtgcatgtgtctttatcg

SEQ ID NO: 360983 - DNA, 20 bp, Artificial Sequence
  chemically synthesized
atataaattgttctacgata

SEQ ID NO: 360984 - DNA, 20 bp, Artificial Sequence
  chemically synthesized
tagaacaatttatattcctt

SEQ ID NO: 360985 - DNA, 20 bp, Artificial Sequence
  chemically synthesized
agaacaatttatattccttt

SEQ ID NO: 360986 - DNA, 20 bp, Artificial Sequence
  chemically synthesized
attatttggtatatacccaa

SEQ ID NO: 360987 - DNA, 20 bp, Artificial Sequence
  chemically synthesized
cattatttggtatataccca

SEQ ID NO: 360988 - DNA, 20 bp, Artificial Sequence
  chemically synthesized
ttgggtatataccaaataat

SEQ ID NO: 360989 - DNA, 20 bp, Artificial Sequence
  chemically synthesized
tgggtatataccaaataatg

SEQ ID NO: 360990 - DNA, 20 bp, Artificial Sequence
  chemically synthesized
aacccagcaacctcattatt

SEQ ID NO: 360991 - DNA, 20 bp, Artificial Sequence
  chemically synthesized
ataccaaataatgaggttgc

SEQ ID NO: 360992 - DNA, 20 bp, Artificial Sequence
  chemically synthesized
taccaaataatgaggttgct

SEQ ID NO: 360993 - DNA, 20 bp, Artificial Sequence
  chemically synthesized
aatgaggttgctgggttgaa

SEQ ID NO: 360994 - DNA, 20 bp, Artificial Sequence
  chemically synthesized
aacagaaataccattcaacc

SEQ ID NO: 360995 - DNA, 20 bp, Artificial Sequence
  chemically synthesized
attcctcaaagaagttaaaa

SEQ ID NO: 360996 - DNA, 20 bp, Artificial Sequence
  chemically synthesized
atttctgttttaacttcttt

SEQ ID NO: 360997 - DNA, 20 bp, Artificial Sequence
  chemically synthesized
tttctgttttaacttctttg

SEQ ID NO: 360998 - DNA, 20 bp, Artificial Sequence
  chemically synthesized
agtgtggtgattcctcaaag

SEQ ID NO: 360999 - DNA, 20 bp, Artificial Sequence
  chemically synthesized
agcagtgtggtgattcctca

SEQ ID NO: 361000 - DNA, 20 bp, Artificial Sequence
  chemically synthesized
tgccattgtggaaagcagtg

SEQ ID NO: 361001 - DNA, 20 bp, Artificial Sequence
  chemically synthesized
aattctgccattgtggaaag

SEQ ID NO: 361002 - DNA, 20 bp, Artificial Sequence
  chemically synthesized
caccacactgctttccacaa

SEQ ID NO: 361003 - DNA, 20 bp, Artificial Sequence
  chemically synthesized
atcaattctgccattgtgga

SEQ ID NO: 361004 - DNA, 20 bp, Artificial Sequence
  chemically synthesized
cacactgctttccacaatgg

SEQ ID NO: 361005 - DNA, 20 bp, Artificial Sequence
  chemically synthesized
gttaatcaattctgccattg

SEQ ID NO: 361006 - DNA, 20 bp, Artificial Sequence
  chemically synthesized
gaattgattaacattcccac

SEQ ID NO: 361007 - DNA, 20 bp, Artificial Sequence
  chemically synthesized
ttgattaacattcccaccag

SEQ ID NO: 361008 - DNA, 20 bp, Artificial Sequence
  chemically synthesized
caggtgtggtgactgctggt

SEQ ID NO: 361009 - DNA, 20 bp, Artificial Sequence
  chemically synthesized
ccaggtgtggtgactgctgg

SEQ ID NO: 361010 - DNA, 20 bp, Artificial Sequence
  chemically synthesized
tggccaggtgtggtgactgc

SEQ ID NO: 361011 - DNA, 20 bp, Artificial Sequence
  chemically synthesized
ccaccagcagtcaccacacc

SEQ ID NO: 361012 - DNA, 20 bp, Artificial Sequence
  chemically synthesized
cataagatattggccaggtg

SEQ ID NO: 361013 - DNA, 20 bp, Artificial Sequence
  chemically synthesized
gtatgcataagatattggcc

SEQ ID NO: 361014 - DNA, 20 bp, Artificial Sequence
  chemically synthesized
tgtatgcataagatattggc

SEQ ID NO: 361015 - DNA, 20 bp, Artificial Sequence
  chemically synthesized
aaaatgtatgcataagatat

SEQ ID NO: 361016 - DNA, 20 bp, Artificial Sequence
  chemically synthesized
gtatctgaaaatgtatgcat

SEQ ID NO: 361017 - DNA, 20 bp, Artificial Sequence
  chemically synthesized
atatcttatgcatacatttt

SEQ ID NO: 361018 - DNA, 20 bp, Artificial Sequence
  chemically synthesized
tataataacagtagaagcat

SEQ ID NO: 361019 - DNA, 20 bp, Artificial Sequence
  chemically synthesized
aattgttataataacagtag

SEQ ID NO: 361020 - DNA, 20 bp, Artificial Sequence
  chemically synthesized
gtgaattgttataataacag

SEQ ID NO: 361021 - DNA, 20 bp, Artificial Sequence
  chemically synthesized
cctgtgaattgttataataa

SEQ ID NO: 361022 - DNA, 20 bp, Artificial Sequence
  chemically synthesized
actgttattataacaattca

SEQ ID NO: 361023 - DNA, 20 bp, Artificial Sequence
  chemically synthesized
ctgttattataacaattcac

SEQ ID NO: 361024 - DNA, 20 bp, Artificial Sequence
  chemically synthesized
aattcacaggatgtatatac

SEQ ID NO: 361025 - DNA, 20 bp, Artificial Sequence
  chemically synthesized
acaggatgtatatactggat

SEQ ID NO: 361026 - DNA, 20 bp, Artificial Sequence
  chemically synthesized
aggatgtatatactggatca

SEQ ID NO: 361027 - DNA, 20 bp, Artificial Sequence
  chemically synthesized
tgtatacacacactctgatc

SEQ ID NO: 361028 - DNA, 20 bp, Artificial Sequence
  chemically synthesized
cacacacacacactctgctc

SEQ ID NO: 361029 - DNA, 20 bp, Artificial Sequence
  chemically synthesized
tagatgtatctactagagca

SEQ ID NO: 361030 - DNA, 20 bp, Artificial Sequence
  chemically synthesized
acacacacactctgctctag

SEQ ID NO: 361031 - DNA, 20 bp, Artificial Sequence
  chemically synthesized
tatagatgtatctactagag

SEQ ID NO: 361032 - DNA, 20 bp, Artificial Sequence
  chemically synthesized
atgtatagatgtatctacta

SEQ ID NO: 361033 - DNA, 20 bp, Artificial Sequence
  chemically synthesized
atatgtatagatgtatctac

SEQ ID NO: 361034 - DNA, 20 bp, Artificial Sequence
  chemically synthesized
gatgcgtatatatatatgta

SEQ ID NO: 361035 - DNA, 20 bp, Artificial Sequence
  chemically synthesized
tatatatatacgcatcattt

SEQ ID NO: 361036 - DNA, 20 bp, Artificial Sequence
  chemically synthesized
atatatatacgcatcatttc

SEQ ID NO: 361037 - DNA, 20 bp, Artificial Sequence
  chemically synthesized
tatatatacgcatcatttca

SEQ ID NO: 361038 - DNA, 20 bp, Artificial Sequence
  chemically synthesized
tatatacgcatcatttcagg

SEQ ID NO: 361039 - DNA, 20 bp, Artificial Sequence
  chemically synthesized
cgcatcatttcagggagata

SEQ ID NO: 361040 - DNA, 20 bp, Artificial Sequence
  chemically synthesized
agatatagacatatctatac

SEQ ID NO: 361041 - DNA, 20 bp, Artificial Sequence
  chemically synthesized
tagatacacatatacttgta

SEQ ID NO: 361042 - DNA, 20 bp, Artificial Sequence
  chemically synthesized
gatatatatgtgtatatgtg

SEQ ID NO: 361043 - DNA, 20 bp, Artificial Sequence
  chemically synthesized
tatatatgtgtatagatgta

SEQ ID NO: 361044 - DNA, 20 bp, Artificial Sequence
  chemically synthesized
tacatatgtatatatgtgta

SEQ ID NO: 361045 - DNA, 20 bp, Artificial Sequence
  chemically synthesized
tacatatgtatatatgtgta

SEQ ID NO: 361046 - DNA, 20 bp, Artificial Sequence
  chemically synthesized
tgtgtatgtatatatgtata

SEQ ID NO: 361047 - DNA, 20 bp, Artificial Sequence
  chemically synthesized
tacacatatatatgtaattt

SEQ ID NO: 361048 - DNA, 20 bp, Artificial Sequence
  chemically synthesized
acatatatatgtaattttag

SEQ ID NO: 361049 - DNA, 20 bp, Artificial Sequence
  chemically synthesized
catatatatgtaattttagt

SEQ ID NO: 361050 - DNA, 20 bp, Artificial Sequence
  chemically synthesized
attgtttctaggaaggcagg

SEQ ID NO: 361051 - DNA, 20 bp, Artificial Sequence
  chemically synthesized
ggtgtttccacctgccttcc

SEQ ID NO: 361052 - DNA, 20 bp, Artificial Sequence
  chemically synthesized
taaattgtttctaggaaggc

SEQ ID NO: 361053 - DNA, 20 bp, Artificial Sequence
  chemically synthesized
ctaaattgtttctaggaagg

SEQ ID NO: 361054 - DNA, 20 bp, Artificial Sequence
  chemically synthesized
attctaaattgtttctagga

SEQ ID NO: 361055 - DNA, 20 bp, Artificial Sequence
  chemically synthesized
aattctaaattgtttctagg

SEQ ID NO: 361056 - DNA, 20 bp, Artificial Sequence
  chemically synthesized
tgtaattctaaattgtttct

SEQ ID NO: 361057 - DNA, 20 bp, Artificial Sequence
  chemically synthesized
atgtaattctaaattgtttc

SEQ ID NO: 361058 - DNA, 20 bp, Artificial Sequence
  chemically synthesized
ctgccttcctagaaacaatt

SEQ ID NO: 361059 - DNA, 20 bp, Artificial Sequence
  chemically synthesized
ttagaattacatattttaac

SEQ ID NO: 361060 - DNA, 20 bp, Artificial Sequence
  chemically synthesized
gagcctattcttatacattc

SEQ ID NO: 361061 - DNA, 20 bp, Artificial Sequence
  chemically synthesized
atattttaaccagaatgtat

SEQ ID NO: 361062 - DNA, 20 bp, Artificial Sequence
  chemically synthesized
ttaaccagaatgtataagaa

SEQ ID NO: 361063 - DNA, 20 bp, Artificial Sequence
  chemically synthesized
taaccagaatgtataagaat

SEQ ID NO: 361064 - DNA, 20 bp, Artificial Sequence
  chemically synthesized
aaaatttcctggtgagagaa

SEQ ID NO: 361065 - DNA, 20 bp, Artificial Sequence
  chemically synthesized
agaataggctcttctctcac

SEQ ID NO: 361066 - DNA, 20 bp, Artificial Sequence
  chemically synthesized
caaaaatttcctggtgagag

SEQ ID NO: 361067 - DNA, 20 bp, Artificial Sequence
  chemically synthesized
gaataggctcttctctcacc

SEQ ID NO: 361068 - DNA, 20 bp, Artificial Sequence
  chemically synthesized
aaacaaaaatttcctggtga

SEQ ID NO: 361069 - DNA, 20 bp, Artificial Sequence
  chemically synthesized
caaaacaaaaatttcctggt

SEQ ID NO: 361070 - DNA, 20 bp, Artificial Sequence
  chemically synthesized
aaaacaaaacaaaaatttcc

SEQ ID NO: 361071 - DNA, 20 bp, Artificial Sequence
  chemically synthesized
tgttttgtttttgattcttt

SEQ ID NO: 361072 - DNA, 20 bp, Artificial Sequence
  chemically synthesized
gatcatacaaacaaaactaa

SEQ ID NO: 361073 - DNA, 20 bp, Artificial Sequence
  chemically synthesized
catggaaataaaagttaaca

SEQ ID NO: 361074 - DNA, 20 bp, Artificial Sequence
  chemically synthesized
acaaggaatcatggaaataa

SEQ ID NO: 361075 - DNA, 20 bp, Artificial Sequence
  chemically synthesized
ttcaaatgcacaaggaatca

SEQ ID NO: 361076 - DNA, 20 bp, Artificial Sequence
  chemically synthesized
aaaatatattcaaatgcaca

SEQ ID NO: 361077 - DNA, 20 bp, Artificial Sequence
  chemically synthesized
aaaaatatattcaaatgcac

SEQ ID NO: 361078 - DNA, 20 bp, Artificial Sequence
  chemically synthesized
cacatggaattgtaataggt

SEQ ID NO: 361079 - DNA, 20 bp, Artificial Sequence
  chemically synthesized
ttcacacatggaattgtaat

SEQ ID NO: 361080 - DNA, 20 bp, Artificial Sequence
  chemically synthesized
attcacacatggaattgtaa

SEQ ID NO: 361081 - DNA, 20 bp, Artificial Sequence
  chemically synthesized
attaacagacaattcacaca

SEQ ID NO: 361082 - DNA, 20 bp, Artificial Sequence
  chemically synthesized
taatgagcaaaacatattaa

SEQ ID NO: 361083 - DNA, 20 bp, Artificial Sequence
  chemically synthesized
actaccatatagaaattaat

SEQ ID NO: 361084 - DNA, 20 bp, Artificial Sequence
  chemically synthesized
tttgctcattaatttctata

SEQ ID NO: 361085 - DNA, 20 bp, Artificial Sequence
  chemically synthesized
gctcattaatttctatatgg

SEQ ID NO: 361086 - DNA, 20 bp, Artificial Sequence
  chemically synthesized
aggaaaagaaaactaccata

SEQ ID NO: 361087 - DNA, 20 bp, Artificial Sequence
  chemically synthesized
tcttaaaattcaagaaggaa

SEQ ID NO: 361088 - DNA, 20 bp, Artificial Sequence
  chemically synthesized
agagctcttaaaattcaaga

SEQ ID NO: 361089 - DNA, 20 bp, Artificial Sequence
  chemically synthesized
aagagctcttaaaattcaag

SEQ ID NO: 361090 - DNA, 20 bp, Artificial Sequence
  chemically synthesized
tcttttccttcttgaatttt

SEQ ID NO: 361091 - DNA, 20 bp, Artificial Sequence
  chemically synthesized
accaagagctcttaaaattc

SEQ ID NO: 361092 - DNA, 20 bp, Artificial Sequence
  chemically synthesized
ttttccttcttgaattttaa

SEQ ID NO: 361093 - DNA, 20 bp, Artificial Sequence
  chemically synthesized
tcttgaattttaagagctct

SEQ ID NO: 361094 - DNA, 20 bp, Artificial Sequence
  chemically synthesized
tgttatctcttatttaccaa

SEQ ID NO: 361095 - DNA, 20 bp, Artificial Sequence
  chemically synthesized
tttaagagctcttggtaaat

SEQ ID NO: 361096 - DNA, 20 bp, Artificial Sequence
  chemically synthesized
aatgttatctcttatttacc

SEQ ID NO: 361097 - DNA, 20 bp, Artificial Sequence
  chemically synthesized
taagagctcttggtaaataa

SEQ ID NO: 361098 - DNA, 20 bp, Artificial Sequence
  chemically synthesized
taaataagagataacatttg

SEQ ID NO: 361099 - DNA, 20 bp, Artificial Sequence
  chemically synthesized
aatcacattttgcaagtggt

SEQ ID NO: 361100 - DNA, 20 bp, Artificial Sequence
  chemically synthesized
atataatcacattttgcaag

SEQ ID NO: 361101 - DNA, 20 bp, Artificial Sequence
  chemically synthesized
gaaatataatcacattttgc

SEQ ID NO: 361102 - DNA, 20 bp, Artificial Sequence
  chemically synthesized
acaaaattttgttgaattat

SEQ ID NO: 361103 - DNA, 20 bp, Artificial Sequence
  chemically synthesized
aaattttgtatttcattcaa

SEQ ID NO: 361104 - DNA, 20 bp, Artificial Sequence
  chemically synthesized
tcaaaagtaaaactgtctta

SEQ ID NO: 361105 - DNA, 20 bp, Artificial Sequence
  chemically synthesized
aagatcataaatctgtaaga

SEQ ID NO: 361106 - DNA, 20 bp, Artificial Sequence
  chemically synthesized
agcaaagatcataaatctgt

SEQ ID NO: 361107 - DNA, 20 bp, Artificial Sequence
  chemically synthesized
tacttaacagtcaaaaagca

SEQ ID NO: 361108 - DNA, 20 bp, Artificial Sequence
  chemically synthesized
ctttgtacttaacagtcaaa

SEQ ID NO: 361109 - DNA, 20 bp, Artificial Sequence
  chemically synthesized
atctttgctttttgactgtt

SEQ ID NO: 361110 - DNA, 20 bp, Artificial Sequence
  chemically synthesized
aggttaacctttgtacttaa

SEQ ID NO: 361111 - DNA, 20 bp, Artificial Sequence
  chemically synthesized
ctttttgactgttaagtaca

SEQ ID NO: 361112 - DNA, 20 bp, Artificial Sequence
  chemically synthesized
tttttgactgttaagtacaa

SEQ ID NO: 361113 - DNA, 20 bp, Artificial Sequence
  chemically synthesized
acaattccttttgtgatgtc

SEQ ID NO: 361114 - DNA, 20 bp, Artificial Sequence
  chemically synthesized
cacaattccttttgtgatgt

SEQ ID NO: 361115 - DNA, 20 bp, Artificial Sequence
  chemically synthesized
aggttaacctgacatcacaa

SEQ ID NO: 361116 - DNA, 20 bp, Artificial Sequence
  chemically synthesized
ggttaacctgacatcacaaa

SEQ ID NO: 361117 - DNA, 20 bp, Artificial Sequence
  chemically synthesized
tgacatcacaaaaggaattg

SEQ ID NO: 361118 - DNA, 20 bp, Artificial Sequence
  chemically synthesized
acatcacaaaaggaattgtg

SEQ ID NO: 361119 - DNA, 20 bp, Artificial Sequence
  chemically synthesized
gctattccaaagcatatgaa

SEQ ID NO: 361120 - DNA, 20 bp, Artificial Sequence
  chemically synthesized
ttttttcttttcatatgctt

SEQ ID NO: 361121 - DNA, 20 bp, Artificial Sequence
  chemically synthesized
tcttttcatatgctttggaa

SEQ ID NO: 361122 - DNA, 20 bp, Artificial Sequence
  chemically synthesized
atatactttaagctattcca

SEQ ID NO: 361123 - DNA, 20 bp, Artificial Sequence
  chemically synthesized
atatgctttggaatagctta

SEQ ID NO: 361124 - DNA, 20 bp, Artificial Sequence
  chemically synthesized
aagaataatttatatacttt

SEQ ID NO: 361125 - DNA, 20 bp, Artificial Sequence
  chemically synthesized
aagtatataaattattcttt

SEQ ID NO: 361126 - DNA, 20 bp, Artificial Sequence
  chemically synthesized
agtatataaattattcttta

SEQ ID NO: 361127 - DNA, 20 bp, Artificial Sequence
  chemically synthesized
gtatataaattattctttaa

SEQ ID NO: 361128 - DNA, 20 bp, Artificial Sequence
  chemically synthesized
tgaatttaacgtaaccctta

SEQ ID NO: 361129 - DNA, 20 bp, Artificial Sequence
  chemically synthesized
ttacgttaaattcatttgta

SEQ ID NO: 361130 - DNA, 20 bp, Artificial Sequence
  chemically synthesized
gtactgttgaagagtgtagt

SEQ ID NO: 361131 - DNA, 20 bp, Artificial Sequence
  chemically synthesized
tgtactgttgaagagtgtag

SEQ ID NO: 361132 - DNA, 20 bp, Artificial Sequence
  chemically synthesized
aggtgtactgttgaagagtg

SEQ ID NO: 361133 - DNA, 20 bp, Artificial Sequence
  chemically synthesized
aatcctactacactcttcaa

SEQ ID NO: 361134 - DNA, 20 bp, Artificial Sequence
  chemically synthesized
attaaaggtgtactgttgaa

SEQ ID NO: 361135 - DNA, 20 bp, Artificial Sequence
  chemically synthesized
ttattaaaggtgtactgttg

SEQ ID NO: 361136 - DNA, 20 bp, Artificial Sequence
  chemically synthesized
aacatttagtaggttattaa

SEQ ID NO: 361137 - DNA, 20 bp, Artificial Sequence
  chemically synthesized
aaacatttagtaggttatta

SEQ ID NO: 361138 - DNA, 20 bp, Artificial Sequence
  chemically synthesized
tacttcagaaaacatttagt

SEQ ID NO: 361139 - DNA, 20 bp, Artificial Sequence
  chemically synthesized
ttacttcagaaaacatttag

SEQ ID NO: 361140 - DNA, 20 bp, Artificial Sequence
  chemically synthesized
tgattacttcagaaaacatt

SEQ ID NO: 361141 - DNA, 20 bp, Artificial Sequence
  chemically synthesized
aacctactaaatgttttctg

SEQ ID NO: 361142 - DNA, 20 bp, Artificial Sequence
  chemically synthesized
taaatgttttctgaagtaat

SEQ ID NO: 361143 - DNA, 20 bp, Artificial Sequence
  chemically synthesized
gaaaattagactgattactt

SEQ ID NO: 361144 - DNA, 20 bp, Artificial Sequence
  chemically synthesized
gataagaataagtggaaaat

SEQ ID NO: 361145 - DNA, 20 bp, Artificial Sequence
  chemically synthesized
aaaattgagataagaataag

SEQ ID NO: 361146 - DNA, 20 bp, Artificial Sequence
  chemically synthesized
actaaaattgagataagaat

SEQ ID NO: 361147 - DNA, 20 bp, Artificial Sequence
  chemically synthesized
caaatcactaaaattgagat

SEQ ID NO: 361148 - DNA, 20 bp, Artificial Sequence
  chemically synthesized
acttattcttatctcaattt

SEQ ID NO: 361149 - DNA, 20 bp, Artificial Sequence
  chemically synthesized
caatacaaatcactaaaatt

SEQ ID NO: 361150 - DNA, 20 bp, Artificial Sequence
  chemically synthesized
tttagtgatttgtattgtac

SEQ ID NO: 361151 - DNA, 20 bp, Artificial Sequence
  chemically synthesized
ttgtattgtacgagaaaatc

SEQ ID NO: 361152 - DNA, 20 bp, Artificial Sequence
  chemically synthesized
tacgagaaaatcaagttttc

SEQ ID NO: 361153 - DNA, 20 bp, Artificial Sequence
  chemically synthesized
ataacaattttgcaaaattc

SEQ ID NO: 361154 - DNA, 20 bp, Artificial Sequence
  chemically synthesized
aattgttataaaattgcttt

SEQ ID NO: 361155 - DNA, 20 bp, Artificial Sequence
  chemically synthesized
agaaatgaagtggaaactaa

SEQ ID NO: 361156 - DNA, 20 bp, Artificial Sequence
  chemically synthesized
cagatacagaagaaatgaag

SEQ ID NO: 361157 - DNA, 20 bp, Artificial Sequence
  chemically synthesized
cagcagatacagaagaaatg

SEQ ID NO: 361158 - DNA, 20 bp, Artificial Sequence
  chemically synthesized
acgcatgacagcagatacag

SEQ ID NO: 361159 - DNA, 20 bp, Artificial Sequence
  chemically synthesized
aagacgcatgacagcagata

SEQ ID NO: 361160 - DNA, 20 bp, Artificial Sequence
  chemically synthesized
tgagaaaagacgcatgacag

SEQ ID NO: 361161 - DNA, 20 bp, Artificial Sequence
  chemically synthesized
aaatgagaaaagacgcatga

SEQ ID NO: 361162 - DNA, 20 bp, Artificial Sequence
  chemically synthesized
ctagacgagataaatgagaa

SEQ ID NO: 361163 - DNA, 20 bp, Artificial Sequence
  chemically synthesized
aaaaactagacgagataaat

SEQ ID NO: 361164 - DNA, 20 bp, Artificial Sequence
  chemically synthesized
cttttctcatttatctcgtc

SEQ ID NO: 361165 - DNA, 20 bp, Artificial Sequence
  chemically synthesized
acttagaataaaaactagac

SEQ ID NO: 361166 - DNA, 20 bp, Artificial Sequence
  chemically synthesized
agaaaacttagaataaaaac

SEQ ID NO: 361167 - DNA, 20 bp, Artificial Sequence
  chemically synthesized
tctcgtctagtttttattct

SEQ ID NO: 361168 - DNA, 20 bp, Artificial Sequence
  chemically synthesized
cagtcataacaaagaaaact

SEQ ID NO: 361169 - DNA, 20 bp, Artificial Sequence
  chemically synthesized
aacctatcccagtcataaca

SEQ ID NO: 361170 - DNA, 20 bp, Artificial Sequence
  chemically synthesized
taagttttctttgttatgac

SEQ ID NO: 361171 - DNA, 20 bp, Artificial Sequence
  chemically synthesized
aagttttctttgttatgact

SEQ ID NO: 361172 - DNA, 20 bp, Artificial Sequence
  chemically synthesized
tttctttgttatgactggga

SEQ ID NO: 361173 - DNA, 20 bp, Artificial Sequence
  chemically synthesized
ttctttgttatgactgggat

SEQ ID NO: 361174 - DNA, 20 bp, Artificial Sequence
  chemically synthesized
caaaataggtaaacctatcc

SEQ ID NO: 361175 - DNA, 20 bp, Artificial Sequence
  chemically synthesized
cttgaaaagattaacaaaat

SEQ ID NO: 361176 - DNA, 20 bp, Artificial Sequence
  chemically synthesized
tcttgaaaagattaacaaaa

SEQ ID NO: 361177 - DNA, 20 bp, Artificial Sequence
  chemically synthesized
cctattttgttaatcttttc

SEQ ID NO: 361178 - DNA, 20 bp, Artificial Sequence
  chemically synthesized
tattttgttaatcttttcaa

SEQ ID NO: 361179 - DNA, 20 bp, Artificial Sequence
  chemically synthesized
ttcaaaagtgagctcttgaa

SEQ ID NO: 361180 - DNA, 20 bp, Artificial Sequence
  chemically synthesized
agaataatccattcaaaagt

SEQ ID NO: 361181 - DNA, 20 bp, Artificial Sequence
  chemically synthesized
ttcaagagctcacttttgaa

SEQ ID NO: 361182 - DNA, 20 bp, Artificial Sequence
  chemically synthesized
aataagaataatccattcaa

SEQ ID NO: 361183 - DNA, 20 bp, Artificial Sequence
  chemically synthesized
ttcaacgtagaaaattgaat

SEQ ID NO: 361184 - DNA, 20 bp, Artificial Sequence
  chemically synthesized
aataaaaattgtattcaacg

SEQ ID NO: 361185 - DNA, 20 bp, Artificial Sequence
  chemically synthesized
atcttaagaaattgtaaaaa

SEQ ID NO: 361186 - DNA, 20 bp, Artificial Sequence
  chemically synthesized
ttctatttttacaatttctt

SEQ ID NO: 361187 - DNA, 20 bp, Artificial Sequence
  chemically synthesized
ataaaagaagtatgcatctt

SEQ ID NO: 361188 - DNA, 20 bp, Artificial Sequence
  chemically synthesized
ttaaaagatggaaataaaag

SEQ ID NO: 361189 - DNA, 20 bp, Artificial Sequence
  chemically synthesized
tttttaaaagatggaaataa

SEQ ID NO: 361190 - DNA, 20 bp, Artificial Sequence
  chemically synthesized
gccataagatttttaaaaga

SEQ ID NO: 361191 - DNA, 20 bp, Artificial Sequence
  chemically synthesized
tatagccataagatttttaa

SEQ ID NO: 361192 - DNA, 20 bp, Artificial Sequence
  chemically synthesized
tccatcttttaaaaatctta

SEQ ID NO: 361193 - DNA, 20 bp, Artificial Sequence
  chemically synthesized
agagagaactgtatagccat

SEQ ID NO: 361194 - DNA, 20 bp, Artificial Sequence
  chemically synthesized
ttaaaaatcttatggctata

SEQ ID NO: 361195 - DNA, 20 bp, Artificial Sequence
  chemically synthesized
tgtattcagagagaactgta

SEQ ID NO: 361196 - DNA, 20 bp, Artificial Sequence
  chemically synthesized
tagtgaaatctgtattcaga

SEQ ID NO: 361197 - DNA, 20 bp, Artificial Sequence
  chemically synthesized
tatacagttctctctgaata

SEQ ID NO: 361198 - DNA, 20 bp, Artificial Sequence
  chemically synthesized
catagtgaaatctgtattca

SEQ ID NO: 361199 - DNA, 20 bp, Artificial Sequence
  chemically synthesized
ggcatagtgaaatctgtatt

SEQ ID NO: 361200 - DNA, 20 bp, Artificial Sequence
  chemically synthesized
atactctaatgatgtaggca

SEQ ID NO: 361201 - DNA, 20 bp, Artificial Sequence
  chemically synthesized
tttcactatgcctacatcat

SEQ ID NO: 361202 - DNA, 20 bp, Artificial Sequence
  chemically synthesized
catacatactctaatgatgt

SEQ ID NO: 361203 - DNA, 20 bp, Artificial Sequence
  chemically synthesized
tcatacatactctaatgatg

SEQ ID NO: 361204 - DNA, 20 bp, Artificial Sequence
  chemically synthesized
tcactatgcctacatcatta

SEQ ID NO: 361205 - DNA, 20 bp, Artificial Sequence
  chemically synthesized
tacatcattagagtatgtat

SEQ ID NO: 361206 - DNA, 20 bp, Artificial Sequence
  chemically synthesized
aactcttggtaaaatttata

SEQ ID NO: 361207 - DNA, 20 bp, Artificial Sequence
  chemically synthesized
tgagctatataaattttacc

SEQ ID NO: 361208 - DNA, 20 bp, Artificial Sequence
  chemically synthesized
agctatataaattttaccaa

SEQ ID NO: 361209 - DNA, 20 bp, Artificial Sequence
  chemically synthesized
gtaaaatgttcatgaactct

SEQ ID NO: 361210 - DNA, 20 bp, Artificial Sequence
  chemically synthesized
acatttatgtgcattttacc

SEQ ID NO: 361211 - DNA, 20 bp, Artificial Sequence
  chemically synthesized
atttatgtgcattttaccaa

SEQ ID NO: 361212 - DNA, 20 bp, Artificial Sequence
  chemically synthesized
tttatgtgcattttaccaag

SEQ ID NO: 361213 - DNA, 20 bp, Artificial Sequence
  chemically synthesized
ttatgtgcattttaccaaga

SEQ ID NO: 361214 - DNA, 20 bp, Artificial Sequence
  chemically synthesized
ttgatactctgtttccctct

SEQ ID NO: 361215 - DNA, 20 bp, Artificial Sequence
  chemically synthesized
gcattttaccaagagggaaa

SEQ ID NO: 361216 - DNA, 20 bp, Artificial Sequence
  chemically synthesized
attttaccaagagggaaaca

SEQ ID NO: 361217 - DNA, 20 bp, Artificial Sequence
  chemically synthesized
aagagggaaacagagtatca

SEQ ID NO: 361218 - DNA, 20 bp, Artificial Sequence
  chemically synthesized
cagagtatcaaagataaatg

SEQ ID NO: 361219 - DNA, 20 bp, Artificial Sequence
  chemically synthesized
aagataaatgaagcttccac

SEQ ID NO: 361220 - DNA, 20 bp, Artificial Sequence
  chemically synthesized
agataaatgaagcttccaca

SEQ ID NO: 361221 - DNA, 20 bp, Artificial Sequence
  chemically synthesized
ttttaaatcagaccttgtgg

SEQ ID NO: 361222 - DNA, 20 bp, Artificial Sequence
  chemically synthesized
tagttttaaatcagaccttg

SEQ ID NO: 361223 - DNA, 20 bp, Artificial Sequence
  chemically synthesized
atccagacatagttttaaat

SEQ ID NO: 361224 - DNA, 20 bp, Artificial Sequence
  chemically synthesized
gtctgatttaaaactatgtc

SEQ ID NO: 361225 - DNA, 20 bp, Artificial Sequence
  chemically synthesized
aaatatcttctatccagaca

SEQ ID NO: 361226 - DNA, 20 bp, Artificial Sequence
  chemically synthesized
gatttaaaactatgtctgga

SEQ ID NO: 361227 - DNA, 20 bp, Artificial Sequence
  chemically synthesized
ttaaaactatgtctggatag

SEQ ID NO: 361228 - DNA, 20 bp, Artificial Sequence
  chemically synthesized
ttaatgaaatatcttctatc

SEQ ID NO: 361229 - DNA, 20 bp, Artificial Sequence
  chemically synthesized
gatatttcattaattacatc

SEQ ID NO: 361230 - DNA, 20 bp, Artificial Sequence
  chemically synthesized
gctttttgtggagaattcac

SEQ ID NO: 361231 - DNA, 20 bp, Artificial Sequence
  chemically synthesized
tctagtgaattctccacaaa

SEQ ID NO: 361232 - DNA, 20 bp, Artificial Sequence
  chemically synthesized
gcctcttaaagctttttgtg

SEQ ID NO: 361233 - DNA, 20 bp, Artificial Sequence
  chemically synthesized
gagcctcttaaagctttttg

SEQ ID NO: 361234 - DNA, 20 bp, Artificial Sequence
  chemically synthesized
aattctccacaaaaagcttt

SEQ ID NO: 361235 - DNA, 20 bp, Artificial Sequence
  chemically synthesized
ttctccacaaaaagctttaa

SEQ ID NO: 361236 - DNA, 20 bp, Artificial Sequence
  chemically synthesized
tctccacaaaaagctttaag

SEQ ID NO: 361237 - DNA, 20 bp, Artificial Sequence
  chemically synthesized
cttggagagagagcctctta

SEQ ID NO: 361238 - DNA, 20 bp, Artificial Sequence
  chemically synthesized
ctttaagaggctctctctcc

SEQ ID NO: 361239 - DNA, 20 bp, Artificial Sequence
  chemically synthesized
tgtttattaacttggagaga

SEQ ID NO: 361240 - DNA, 20 bp, Artificial Sequence
  chemically synthesized
aatgtttattaacttggaga

SEQ ID NO: 361241 - DNA, 20 bp, Artificial Sequence
  chemically synthesized
gaaatgtttattaacttgga

SEQ ID NO: 361242 - DNA, 20 bp, Artificial Sequence
  chemically synthesized
gtgaaatgtttattaacttg

SEQ ID NO: 361243 - DNA, 20 bp, Artificial Sequence
  chemically synthesized
gtgtgaaatgtttattaact

SEQ ID NO: 361244 - DNA, 20 bp, Artificial Sequence
  chemically synthesized
aaacatttcacaccatgata

SEQ ID NO: 361245 - DNA, 20 bp, Artificial Sequence
  chemically synthesized
aataatccttgtctgtatca

SEQ ID NO: 361246 - DNA, 20 bp, Artificial Sequence
  chemically synthesized
tttcacaccatgatacagac

SEQ ID NO: 361247 - DNA, 20 bp, Artificial Sequence
  chemically synthesized
ttcacaccatgatacagaca

SEQ ID NO: 361248 - DNA, 20 bp, Artificial Sequence
  chemically synthesized
acaaggattattatttattt

SEQ ID NO: 361249 - DNA, 20 bp, Artificial Sequence
  chemically synthesized
tttgaagaagacatgtacaa

SEQ ID NO: 361250 - DNA, 20 bp, Artificial Sequence
  chemically synthesized
agtttgaagaagacatgtac

SEQ ID NO: 361251 - DNA, 20 bp, Artificial Sequence
  chemically synthesized
cactccttggtagtttgaag

SEQ ID NO: 361252 - DNA, 20 bp, Artificial Sequence
  chemically synthesized
ttacactccttggtagtttg

SEQ ID NO: 361253 - DNA, 20 bp, Artificial Sequence
  chemically synthesized
catgtcttcttcaaactacc

SEQ ID NO: 361254 - DNA, 20 bp, Artificial Sequence
  chemically synthesized
atgtcttcttcaaactacca

SEQ ID NO: 361255 - DNA, 20 bp, Artificial Sequence
  chemically synthesized
gtcttcttcaaactaccaag

SEQ ID NO: 361256 - DNA, 20 bp, Artificial Sequence
  chemically synthesized
gcatttcttacactccttgg

SEQ ID NO: 361257 - DNA, 20 bp, Artificial Sequence
  chemically synthesized
ttagcatttcttacactcct

SEQ ID NO: 361258 - DNA, 20 bp, Artificial Sequence
  chemically synthesized
ttcaaactaccaaggagtgt

SEQ ID NO: 361259 - DNA, 20 bp, Artificial Sequence
  chemically synthesized
gagtcttcatggttatcaat

SEQ ID NO: 361260 - DNA, 20 bp, Artificial Sequence
  chemically synthesized
aatgctaattgataaccatg

SEQ ID NO: 361261 - DNA, 20 bp, Artificial Sequence
  chemically synthesized
tccctcctctagagtcttca

SEQ ID NO: 361262 - DNA, 20 bp, Artificial Sequence
  chemically synthesized
attgataaccatgaagactc

SEQ ID NO: 361263 - DNA, 20 bp, Artificial Sequence
  chemically synthesized
tgataaccatgaagactcta

SEQ ID NO: 361264 - DNA, 20 bp, Artificial Sequence
  chemically synthesized
gataaccatgaagactctag

SEQ ID NO: 361265 - DNA, 20 bp, Artificial Sequence
  chemically synthesized
taaccatgaagactctagag

SEQ ID NO: 361266 - DNA, 20 bp, Artificial Sequence
  chemically synthesized
aaccatgaagactctagagg

SEQ ID NO: 361267 - DNA, 20 bp, Artificial Sequence
  chemically synthesized
accatgaagactctagagga

SEQ ID NO: 361268 - DNA, 20 bp, Artificial Sequence
  chemically synthesized
acaaatacctccctcctcta

SEQ ID NO: 361269 - DNA, 20 bp, Artificial Sequence
  chemically synthesized
catgaagactctagaggagg

SEQ ID NO: 361270 - DNA, 20 bp, Artificial Sequence
  chemically synthesized
tgacaaatacctccctcctc

SEQ ID NO: 361271 - DNA, 20 bp, Artificial Sequence
  chemically synthesized
atgaagactctagaggaggg

SEQ ID NO: 361272 - DNA, 20 bp, Artificial Sequence
  chemically synthesized
gaggtatttgtcatgcctga

SEQ ID NO: 361273 - DNA, 20 bp, Artificial Sequence
  chemically synthesized
aggtatttgtcatgcctgaa

SEQ ID NO: 361274 - DNA, 20 bp, Artificial Sequence
  chemically synthesized
ggtatttgtcatgcctgaaa

SEQ ID NO: 361275 - DNA, 20 bp, Artificial Sequence
  chemically synthesized
gccatgaacaataccctttc

SEQ ID NO: 361276 - DNA, 20 bp, Artificial Sequence
  chemically synthesized
tgccatgaacaatacccttt

SEQ ID NO: 361277 - DNA, 20 bp, Artificial Sequence
  chemically synthesized
gcctgaaagggtattgttca

SEQ ID NO: 361278 - DNA, 20 bp, Artificial Sequence
  chemically synthesized
cgtcaatgtgaggcattgaa

SEQ ID NO: 361279 - DNA, 20 bp, Artificial Sequence
  chemically synthesized
accgtcaatgtgaggcattg

SEQ ID NO: 361280 - DNA, 20 bp, Artificial Sequence
  chemically synthesized
cagaccagaccgtcaatgtg

SEQ ID NO: 361281 - DNA, 20 bp, Artificial Sequence
  chemically synthesized
tcttcaatgcctcacattga

SEQ ID NO: 361282 - DNA, 20 bp, Artificial Sequence
  chemically synthesized
acagaccagaccgtcaatgt

SEQ ID NO: 361283 - DNA, 20 bp, Artificial Sequence
  chemically synthesized
aatgcctcacattgacggtc

SEQ ID NO: 361284 - DNA, 20 bp, Artificial Sequence
  chemically synthesized
aattcatggccaaaacagac

SEQ ID NO: 361285 - DNA, 20 bp, Artificial Sequence
  chemically synthesized
attgacggtctggtctgttt

SEQ ID NO: 361286 - DNA, 20 bp, Artificial Sequence
  chemically synthesized
atgagaattcatggccaaaa

SEQ ID NO: 361287 - DNA, 20 bp, Artificial Sequence
  chemically synthesized
aacaagcttatgagaattca

SEQ ID NO: 361288 - DNA, 20 bp, Artificial Sequence
  chemically synthesized
ttttggccatgaattctcat

SEQ ID NO: 361289 - DNA, 20 bp, Artificial Sequence
  chemically synthesized
tataagagcaacaagcttat

SEQ ID NO: 361290 - DNA, 20 bp, Artificial Sequence
  chemically synthesized
tacagcattataagagcaac

SEQ ID NO: 361291 - DNA, 20 bp, Artificial Sequence
  chemically synthesized
taagaaatacagcattataa

SEQ ID NO: 361292 - DNA, 20 bp, Artificial Sequence
  chemically synthesized
agtaagaaatacagcattat

SEQ ID NO: 361293 - DNA, 20 bp, Artificial Sequence
  chemically synthesized
acagctaatagtaagaaata

SEQ ID NO: 361294 - DNA, 20 bp, Artificial Sequence
  chemically synthesized
aatgctgtatttcttactat

SEQ ID NO: 361295 - DNA, 20 bp, Artificial Sequence
  chemically synthesized
tatgacttacagctaatagt

SEQ ID NO: 361296 - DNA, 20 bp, Artificial Sequence
  chemically synthesized
atgttatgacttacagctaa

SEQ ID NO: 361297 - DNA, 20 bp, Artificial Sequence
  chemically synthesized
tatttcttactattagctgt

SEQ ID NO: 361298 - DNA, 20 bp, Artificial Sequence
  chemically synthesized
cagaaaaatgttatgactta

SEQ ID NO: 361299 - DNA, 20 bp, Artificial Sequence
  chemically synthesized
tcataacatttttctgaatt

SEQ ID NO: 361300 - DNA, 20 bp, Artificial Sequence
  chemically synthesized
agaggaaatagtactgaatt

SEQ ID NO: 361301 - DNA, 20 bp, Artificial Sequence
  chemically synthesized
gatgattatttaagaggaaa

SEQ ID NO: 361302 - DNA, 20 bp, Artificial Sequence
  chemically synthesized
cagggtgatgattatttaag

SEQ ID NO: 361303 - DNA, 20 bp, Artificial Sequence
  chemically synthesized
gcagggtgatgattatttaa

SEQ ID NO: 361304 - DNA, 20 bp, Artificial Sequence
  chemically synthesized
tggcagggtgatgattattt

SEQ ID NO: 361305 - DNA, 20 bp, Artificial Sequence
  chemically synthesized
ataatcatcaccctgccata

SEQ ID NO: 361306 - DNA, 20 bp, Artificial Sequence
  chemically synthesized
agagaagttactgtatggca

SEQ ID NO: 361307 - DNA, 20 bp, Artificial Sequence
  chemically synthesized
aagagaagttactgtatggc

SEQ ID NO: 361308 - DNA, 20 bp, Artificial Sequence
  chemically synthesized
aaagagaagttactgtatgg

SEQ ID NO: 361309 - DNA, 20 bp, Artificial Sequence
  chemically synthesized
ataaaagagaagttactgta

SEQ ID NO: 361310 - DNA, 20 bp, Artificial Sequence
  chemically synthesized
gaaaaaaaaacataaaagag

SEQ ID NO: 361311 - DNA, 20 bp, Artificial Sequence
  chemically synthesized
ttagaaaaaaaaacataaaa

SEQ ID NO: 361312 - DNA, 20 bp, Artificial Sequence
  chemically synthesized
tattagaaaaaaaaacataa

SEQ ID NO: 361313 - DNA, 20 bp, Artificial Sequence
  chemically synthesized
cataattctggaatgtgtat

SEQ ID NO: 361314 - DNA, 20 bp, Artificial Sequence
  chemically synthesized
tttttttctaatacacattc

SEQ ID NO: 361315 - DNA, 20 bp, Artificial Sequence
  chemically synthesized
attcttgaaagacataattc

SEQ ID NO: 361316 - DNA, 20 bp, Artificial Sequence
  chemically synthesized
attccagaattatgtctttc

SEQ ID NO: 361317 - DNA, 20 bp, Artificial Sequence
  chemically synthesized
attagactgataattcttga

SEQ ID NO: 361318 - DNA, 20 bp, Artificial Sequence
  chemically synthesized
ttatgtctttcaagaattat

SEQ ID NO: 361319 - DNA, 20 bp, Artificial Sequence
  chemically synthesized
ccattcagttatttagcaat

SEQ ID NO: 361320 - DNA, 20 bp, Artificial Sequence
  chemically synthesized
atttttaccattcagttatt

SEQ ID NO: 361321 - DNA, 20 bp, Artificial Sequence
  chemically synthesized
ctaattgctaaataactgaa

SEQ ID NO: 361322 - DNA, 20 bp, Artificial Sequence
  chemically synthesized
gttttaatatttttaccatt

SEQ ID NO: 361323 - DNA, 20 bp, Artificial Sequence
  chemically synthesized
cacttcacacagattttaaa

SEQ ID NO: 361324 - DNA, 20 bp, Artificial Sequence
  chemically synthesized
tcacttcacacagattttaa

SEQ ID NO: 361325 - DNA, 20 bp, Artificial Sequence
  chemically synthesized
aaccttttaaaatctgtgtg

SEQ ID NO: 361326 - DNA, 20 bp, Artificial Sequence
  chemically synthesized
atgtaatcattcacttcaca

SEQ ID NO: 361327 - DNA, 20 bp, Artificial Sequence
  chemically synthesized
aatgattacatctgtctact

SEQ ID NO: 361328 - DNA, 20 bp, Artificial Sequence
  chemically synthesized
tttctgttttgcttagtaga

SEQ ID NO: 361329 - DNA, 20 bp, Artificial Sequence
  chemically synthesized
atgttttctgttttgcttag

SEQ ID NO: 361330 - DNA, 20 bp, Artificial Sequence
  chemically synthesized
catctgtctactaagcaaaa

SEQ ID NO: 361331 - DNA, 20 bp, Artificial Sequence
  chemically synthesized
ttaatgttttctgttttgct

SEQ ID NO: 361332 - DNA, 20 bp, Artificial Sequence
  chemically synthesized
tgacatgtatgttaatgtac

SEQ ID NO: 361333 - DNA, 20 bp, Artificial Sequence
  chemically synthesized
acaacactgatacacacagt

SEQ ID NO: 361334 - DNA, 20 bp, Artificial Sequence
  chemically synthesized
cacaacactgatacacacag

SEQ ID NO: 361335 - DNA, 20 bp, Artificial Sequence
  chemically synthesized
tacgagcctactgtgtgtat

SEQ ID NO: 361336 - DNA, 20 bp, Artificial Sequence
  chemically synthesized
tgtcacaacactgatacaca

SEQ ID NO: 361337 - DNA, 20 bp, Artificial Sequence
  chemically synthesized
gtgtgtatcagtgttgtgac

SEQ ID NO: 361338 - DNA, 20 bp, Artificial Sequence
  chemically synthesized
gtgttgtgacaagcactcta

SEQ ID NO: 361339 - DNA, 20 bp, Artificial Sequence
  chemically synthesized
tgtgacaagcactctatggt

SEQ ID NO: 361340 - DNA, 20 bp, Artificial Sequence
  chemically synthesized
ctatttaatttccaaccata

SEQ ID NO: 361341 - DNA, 20 bp, Artificial Sequence
  chemically synthesized
tactatttaatttccaacca

SEQ ID NO: 361342 - DNA, 20 bp, Artificial Sequence
  chemically synthesized
ctctatggttggaaattaaa

SEQ ID NO: 361343 - DNA, 20 bp, Artificial Sequence
  chemically synthesized
tatggttggaaattaaatag

SEQ ID NO: 361344 - DNA, 20 bp, Artificial Sequence
  chemically synthesized
atggttggaaattaaatagt

SEQ ID NO: 361345 - DNA, 20 bp, Artificial Sequence
  chemically synthesized
tggttggaaattaaatagta

SEQ ID NO: 361346 - DNA, 20 bp, Artificial Sequence
  chemically synthesized
attaaatagtagggtcactg

SEQ ID NO: 361347 - DNA, 20 bp, Artificial Sequence
  chemically synthesized
agcagaactttgggtaacca

SEQ ID NO: 361348 - DNA, 20 bp, Artificial Sequence
  chemically synthesized
agggtcactgtggttaccca

SEQ ID NO: 361349 - DNA, 20 bp, Artificial Sequence
  chemically synthesized
aaacaggaaagcagaacttt

SEQ ID NO: 361350 - DNA, 20 bp, Artificial Sequence
  chemically synthesized
aaaacaggaaagcagaactt

SEQ ID NO: 361351 - DNA, 20 bp, Artificial Sequence
  chemically synthesized
cattgtgcaaaacaggaaag

SEQ ID NO: 361352 - DNA, 20 bp, Artificial Sequence
  chemically synthesized
tttcattgtgcaaaacagga

SEQ ID NO: 361353 - DNA, 20 bp, Artificial Sequence
  chemically synthesized
atgttttcattgtgcaaaac

SEQ ID NO: 361354 - DNA, 20 bp, Artificial Sequence
  chemically synthesized
gatgttttcattgtgcaaaa

SEQ ID NO: 361355 - DNA, 20 bp, Artificial Sequence
  chemically synthesized
tttcacacctattttggtat

SEQ ID NO: 361356 - DNA, 20 bp, Artificial Sequence
  chemically synthesized
gaaaacatctgataccaaaa

SEQ ID NO: 361357 - DNA, 20 bp, Artificial Sequence
  chemically synthesized
aaaacatctgataccaaaat

SEQ ID NO: 361358 - DNA, 20 bp, Artificial Sequence
  chemically synthesized
atcaattttcacacctattt

SEQ ID NO: 361359 - DNA, 20 bp, Artificial Sequence
  chemically synthesized
catgttattacattttcaca

SEQ ID NO: 361360 - DNA, 20 bp, Artificial Sequence
  chemically synthesized
aaaatgtaataacatgcctt

SEQ ID NO: 361361 - DNA, 20 bp, Artificial Sequence
  chemically synthesized
cttatttctgcaaaaactca

SEQ ID NO: 361362 - DNA, 20 bp, Artificial Sequence
  chemically synthesized
acttatttctgcaaaaactc

SEQ ID NO: 361363 - DNA, 20 bp, Artificial Sequence
  chemically synthesized
taacatgccttgagtttttg

SEQ ID NO: 361364 - DNA, 20 bp, Artificial Sequence
  chemically synthesized
ccttgagtttttgcagaaat

SEQ ID NO: 361365 - DNA, 20 bp, Artificial Sequence
  chemically synthesized
cagaaataagttaaactacg

SEQ ID NO: 361366 - DNA, 20 bp, Artificial Sequence
  chemically synthesized
caaaagccaattgtgctgcg

SEQ ID NO: 361367 - DNA, 20 bp, Artificial Sequence
  chemically synthesized
gttaaactacgcagcacaat

SEQ ID NO: 361368 - DNA, 20 bp, Artificial Sequence
  chemically synthesized
cgcagcacaattggcttttg

SEQ ID NO: 361369 - DNA, 20 bp, Artificial Sequence
  chemically synthesized
cctgttgacaggaactacaa

SEQ ID NO: 361370 - DNA, 20 bp, Artificial Sequence
  chemically synthesized
gcttttgtagttcctgtcaa

SEQ ID NO: 361371 - DNA, 20 bp, Artificial Sequence
  chemically synthesized
cttttgtagttcctgtcaac

SEQ ID NO: 361372 - DNA, 20 bp, Artificial Sequence
  chemically synthesized
aaaatcttaggcctgttgac

SEQ ID NO: 361373 - DNA, 20 bp, Artificial Sequence
  chemically synthesized
taaaatcttaggcctgttga

SEQ ID NO: 361374 - DNA, 20 bp, Artificial Sequence
  chemically synthesized
tagttcctgtcaacaggcct

SEQ ID NO: 361375 - DNA, 20 bp, Artificial Sequence
  chemically synthesized
tactttatgagtaaaatctt

SEQ ID NO: 361376 - DNA, 20 bp, Artificial Sequence
  chemically synthesized
ttactttatgagtaaaatct

SEQ ID NO: 361377 - DNA, 20 bp, Artificial Sequence
  chemically synthesized
ggcctaagattttactcata

SEQ ID NO: 361378 - DNA, 20 bp, Artificial Sequence
  chemically synthesized
agcatcccatgttactttat

SEQ ID NO: 361379 - DNA, 20 bp, Artificial Sequence
  chemically synthesized
attttactcataaagtaaca

SEQ ID NO: 361380 - DNA, 20 bp, Artificial Sequence
  chemically synthesized
ttttactcataaagtaacat

SEQ ID NO: 361381 - DNA, 20 bp, Artificial Sequence
  chemically synthesized
agtaacatgggatgctgtct

SEQ ID NO: 361382 - DNA, 20 bp, Artificial Sequence
  chemically synthesized
taacatgggatgctgtctca

SEQ ID NO: 361383 - DNA, 20 bp, Artificial Sequence
  chemically synthesized
aacagtgtaaaactctgaga

SEQ ID NO: 361384 - DNA, 20 bp, Artificial Sequence
  chemically synthesized
agataacagtgtaaaactct

SEQ ID NO: 361385 - DNA, 20 bp, Artificial Sequence
  chemically synthesized
gagttttacactgttatctt

SEQ ID NO: 361386 - DNA, 20 bp, Artificial Sequence
  chemically synthesized
aaagcaacttccgaagataa

SEQ ID NO: 361387 - DNA, 20 bp, Artificial Sequence
  chemically synthesized
ttttacactgttatcttcgg

SEQ ID NO: 361388 - DNA, 20 bp, Artificial Sequence
  chemically synthesized
tttgaataaagcaacttccg

SEQ ID NO: 361389 - DNA, 20 bp, Artificial Sequence
  chemically synthesized
tccaaaattacatttgaata

SEQ ID NO: 361390 - DNA, 20 bp, Artificial Sequence
  chemically synthesized
gctttattcaaatgtaattt

SEQ ID NO: 361391 - DNA, 20 bp, Artificial Sequence
  chemically synthesized
tttattcaaatgtaattttg

SEQ ID NO: 361392 - DNA, 20 bp, Artificial Sequence
  chemically synthesized
ttattcaaatgtaattttgg

SEQ ID NO: 361393 - DNA, 20 bp, Artificial Sequence
  chemically synthesized
tcaaatgtaattttggagga

SEQ ID NO: 361394 - DNA, 20 bp, Artificial Sequence
  chemically synthesized
tggaggatagaaaacctcca

SEQ ID NO: 361395 - DNA, 20 bp, Artificial Sequence
  chemically synthesized
tatgtcaaagcaaaccatgg

SEQ ID NO: 361396 - DNA, 20 bp, Artificial Sequence
  chemically synthesized
ttatgtcaaagcaaaccatg

SEQ ID NO: 361397 - DNA, 20 bp, Artificial Sequence
  chemically synthesized
cattatgtcaaagcaaacca

SEQ ID NO: 361398 - DNA, 20 bp, Artificial Sequence
  chemically synthesized
aataagtttccattatgtca

SEQ ID NO: 361399 - DNA, 20 bp, Artificial Sequence
  chemically synthesized
catggtttgctttgacataa

SEQ ID NO: 361400 - DNA, 20 bp, Artificial Sequence
  chemically synthesized
tattctactggagtcacaat

SEQ ID NO: 361401 - DNA, 20 bp, Artificial Sequence
  chemically synthesized
atggaaacttattgtgactc

SEQ ID NO: 361402 - DNA, 20 bp, Artificial Sequence
  chemically synthesized
gaaacttattgtgactccag

SEQ ID NO: 361403 - DNA, 20 bp, Artificial Sequence
  chemically synthesized
cacattttaatattctactg

SEQ ID NO: 361404 - DNA, 20 bp, Artificial Sequence
  chemically synthesized
ttcacattttaatattctac

SEQ ID NO: 361405 - DNA, 20 bp, Artificial Sequence
  chemically synthesized
atattaaaatgtgaactctt

SEQ ID NO: 361406 - DNA, 20 bp, Artificial Sequence
  chemically synthesized
taacttgaggtgtttctaaa

SEQ ID NO: 361407 - DNA, 20 bp, Artificial Sequence
  chemically synthesized
tgtaacttgaggtgtttcta

SEQ ID NO: 361408 - DNA, 20 bp, Artificial Sequence
  chemically synthesized
gaactctttagaaacacctc

SEQ ID NO: 361409 - DNA, 20 bp, Artificial Sequence
  chemically synthesized
agactgcttattgtaacttg

SEQ ID NO: 361410 - DNA, 20 bp, Artificial Sequence
  chemically synthesized
cagactgcttattgtaactt

SEQ ID NO: 361411 - DNA, 20 bp, Artificial Sequence
  chemically synthesized
gaaacacctcaagttacaat

SEQ ID NO: 361412 - DNA, 20 bp, Artificial Sequence
  chemically synthesized
acacctcaagttacaataag

SEQ ID NO: 361413 - DNA, 20 bp, Artificial Sequence
  chemically synthesized
agttacaataagcagtctgt

SEQ ID NO: 361414 - DNA, 20 bp, Artificial Sequence
  chemically synthesized
ttttctatgtgcaattctta

SEQ ID NO: 361415 - DNA, 20 bp, Artificial Sequence
  chemically synthesized
cagtctgtaagaattgcaca

SEQ ID NO: 361416 - DNA, 20 bp, Artificial Sequence
  chemically synthesized
aaagaataatttaatgtatt

SEQ ID NO: 361417 - DNA, 20 bp, Artificial Sequence
  chemically synthesized
taaagaataatttaatgtat

SEQ ID NO: 361418 - DNA, 20 bp, Artificial Sequence
  chemically synthesized
taatacattaaattattctt

SEQ ID NO: 361419 - DNA, 20 bp, Artificial Sequence
  chemically synthesized
cattaaattattctttagta

SEQ ID NO: 361420 - DNA, 20 bp, Artificial Sequence
  chemically synthesized
ttaaattattctttagtatg

SEQ ID NO: 361421 - DNA, 20 bp, Artificial Sequence
  chemically synthesized
caggagactactccatacta

SEQ ID NO: 361422 - DNA, 20 bp, Artificial Sequence
  chemically synthesized
aattattctttagtatggag

SEQ ID NO: 361423 - DNA, 20 bp, Artificial Sequence
  chemically synthesized
gcctttaaaatagacagcag

SEQ ID NO: 361424 - DNA, 20 bp, Artificial Sequence
  chemically synthesized
atgcctttaaaatagacagc

SEQ ID NO: 361425 - DNA, 20 bp, Artificial Sequence
  chemically synthesized
tatgcctttaaaatagacag

SEQ ID NO: 361426 - DNA, 20 bp, Artificial Sequence
  chemically synthesized
tcctatgcctttaaaataga

SEQ ID NO: 361427 - DNA, 20 bp, Artificial Sequence
  chemically synthesized
gtctcctgctgtctatttta

SEQ ID NO: 361428 - DNA, 20 bp, Artificial Sequence
  chemically synthesized
tctcctgctgtctattttaa

SEQ ID NO: 361429 - DNA, 20 bp, Artificial Sequence
  chemically synthesized
cttgtcctatgcctttaaaa

SEQ ID NO: 361430 - DNA, 20 bp, Artificial Sequence
  chemically synthesized
tgctgtctattttaaaggca

SEQ ID NO: 361431 - DNA, 20 bp, Artificial Sequence
  chemically synthesized
gctgtctattttaaaggcat

SEQ ID NO: 361432 - DNA, 20 bp, Artificial Sequence
  chemically synthesized
ctattttaaaggcataggac

SEQ ID NO: 361433 - DNA, 20 bp, Artificial Sequence
  chemically synthesized
aaggcataggacaagaactt

SEQ ID NO: 361434 - DNA, 20 bp, Artificial Sequence
  chemically synthesized
aggcataggacaagaactta

SEQ ID NO: 361435 - DNA, 20 bp, Artificial Sequence
  chemically synthesized
ggcataggacaagaacttaa

SEQ ID NO: 361436 - DNA, 20 bp, Artificial Sequence
  chemically synthesized
gcataggacaagaacttaag

SEQ ID NO: 361437 - DNA, 20 bp, Artificial Sequence
  chemically synthesized
cataggacaagaacttaagg

SEQ ID NO: 361438 - DNA, 20 bp, Artificial Sequence
  chemically synthesized
gatagaagagggaccccctt

SEQ ID NO: 361439 - DNA, 20 bp, Artificial Sequence
  chemically synthesized
actagtctggcgatagaaga

SEQ ID NO: 361440 - DNA, 20 bp, Artificial Sequence
  chemically synthesized
tactagtctggcgatagaag

SEQ ID NO: 361441 - DNA, 20 bp, Artificial Sequence
  chemically synthesized
gtactagtctggcgatagaa

SEQ ID NO: 361442 - DNA, 20 bp, Artificial Sequence
  chemically synthesized
gggggtccctcttctatcgc

SEQ ID NO: 361443 - DNA, 20 bp, Artificial Sequence
  chemically synthesized
aagtactagtctggcgatag

SEQ ID NO: 361444 - DNA, 20 bp, Artificial Sequence
  chemically synthesized
tgtaagtactagtctggcga

SEQ ID NO: 361445 - DNA, 20 bp, Artificial Sequence
  chemically synthesized
tccctcttctatcgccagac

SEQ ID NO: 361446 - DNA, 20 bp, Artificial Sequence
  chemically synthesized
atgtattgtaagtactagtc

SEQ ID NO: 361447 - DNA, 20 bp, Artificial Sequence
  chemically synthesized
aaattatgtattgtaagtac

SEQ ID NO: 361448 - DNA, 20 bp, Artificial Sequence
  chemically synthesized
tatacaaaattatgtattgt

SEQ ID NO: 361449 - DNA, 20 bp, Artificial Sequence
  chemically synthesized
tttgtataacaatatatatt

SEQ ID NO: 361450 - DNA, 20 bp, Artificial Sequence
  chemically synthesized
aatatatatttagtaattct

SEQ ID NO: 361451 - DNA, 20 bp, Artificial Sequence
  chemically synthesized
aaatgattatatattaatct

SEQ ID NO: 361452 - DNA, 20 bp, Artificial Sequence
  chemically synthesized
agattaatatataatcattt

SEQ ID NO: 361453 - DNA, 20 bp, Artificial Sequence
  chemically synthesized
gattaatatataatcatttc

SEQ ID NO: 361454 - DNA, 20 bp, Artificial Sequence
  chemically synthesized
attaatatataatcatttca

SEQ ID NO: 361455 - DNA, 20 bp, Artificial Sequence
  chemically synthesized
taatatataatcatttcagg

SEQ ID NO: 361456 - DNA, 20 bp, Artificial Sequence
  chemically synthesized
tttcagggagcatttacttc

SEQ ID NO: 361457 - DNA, 20 bp, Artificial Sequence
  chemically synthesized
ttcagggagcatttacttcc

SEQ ID NO: 361458 - DNA, 20 bp, Artificial Sequence
  chemically synthesized
ttaggaggtagagtacctgg

SEQ ID NO: 361459 - DNA, 20 bp, Artificial Sequence
  chemically synthesized
catttaggaggtagagtacc

SEQ ID NO: 361460 - DNA, 20 bp, Artificial Sequence
  chemically synthesized
gcccagtcatttaggaggta

SEQ ID NO: 361461 - DNA, 20 bp, Artificial Sequence
  chemically synthesized
tagcccagtcatttaggagg

SEQ ID NO: 361462 - DNA, 20 bp, Artificial Sequence
  chemically synthesized
tcatagcccagtcatttagg

SEQ ID NO: 361463 - DNA, 20 bp, Artificial Sequence
  chemically synthesized
ctcatagcccagtcatttag

SEQ ID NO: 361464 - DNA, 20 bp, Artificial Sequence
  chemically synthesized
tactctacctcctaaatgac

SEQ ID NO: 361465 - DNA, 20 bp, Artificial Sequence
  chemically synthesized
tcctcatagcccagtcattt

SEQ ID NO: 361466 - DNA, 20 bp, Artificial Sequence
  chemically synthesized
actctacctcctaaatgact

SEQ ID NO: 361467 - DNA, 20 bp, Artificial Sequence
  chemically synthesized
ttcctcatagcccagtcatt

SEQ ID NO: 361468 - DNA, 20 bp, Artificial Sequence
  chemically synthesized
ctcctaaatgactgggctat

SEQ ID NO: 361469 - DNA, 20 bp, Artificial Sequence
  chemically synthesized
tcctaaatgactgggctatg

SEQ ID NO: 361470 - DNA, 20 bp, Artificial Sequence
  chemically synthesized
gagaattgttcctcatagcc

SEQ ID NO: 361471 - DNA, 20 bp, Artificial Sequence
  chemically synthesized
atgacgagaattgttcctca

SEQ ID NO: 361472 - DNA, 20 bp, Artificial Sequence
  chemically synthesized
gtctcgaacaagcaaatgac

SEQ ID NO: 361473 - DNA, 20 bp, Artificial Sequence
  chemically synthesized
ttctcgtcatttgcttgttc

SEQ ID NO: 361474 - DNA, 20 bp, Artificial Sequence
  chemically synthesized
gttttttgcctgtctcgaac

SEQ ID NO: 361475 - DNA, 20 bp, Artificial Sequence
  chemically synthesized
cgtcatttgcttgttcgaga

SEQ ID NO: 361476 - DNA, 20 bp, Artificial Sequence
  chemically synthesized
gtcatttgcttgttcgagac

SEQ ID NO: 361477 - DNA, 20 bp, Artificial Sequence
  chemically synthesized
tgggataaaagaaaacagcg

SEQ ID NO: 361478 - DNA, 20 bp, Artificial Sequence
  chemically synthesized
gtgggataaaagaaaacagc

SEQ ID NO: 361479 - DNA, 20 bp, Artificial Sequence
  chemically synthesized
gaaagtgggataaaagaaaa

SEQ ID NO: 361480 - DNA, 20 bp, Artificial Sequence
  chemically synthesized
cctgaaggaaagtgggataa

SEQ ID NO: 361481 - DNA, 20 bp, Artificial Sequence
  chemically synthesized
ccatgttcctgaaggaaagt

SEQ ID NO: 361482 - DNA, 20 bp, Artificial Sequence
  chemically synthesized
tccatgttcctgaaggaaag

SEQ ID NO: 361483 - DNA, 20 bp, Artificial Sequence
  chemically synthesized
tcttttatcccactttcctt

SEQ ID NO: 361484 - DNA, 20 bp, Artificial Sequence
  chemically synthesized
cttttatcccactttccttc

SEQ ID NO: 361485 - DNA, 20 bp, Artificial Sequence
  chemically synthesized
acatccatgttcctgaagga

SEQ ID NO: 361486 - DNA, 20 bp, Artificial Sequence
  chemically synthesized
aattacatccatgttcctga

SEQ ID NO: 361487 - DNA, 20 bp, Artificial Sequence
  chemically synthesized
aaattacatccatgttcctg

SEQ ID NO: 361488 - DNA, 20 bp, Artificial Sequence
  chemically synthesized
cccactttccttcaggaaca

SEQ ID NO: 361489 - DNA, 20 bp, Artificial Sequence
  chemically synthesized
gaataaaatattgacgatgg

SEQ ID NO: 361490 - DNA, 20 bp, Artificial Sequence
  chemically synthesized
cttgaataaaatattgacga

SEQ ID NO: 361491 - DNA, 20 bp, Artificial Sequence
  chemically synthesized
ccatcgtcaatattttattc

SEQ ID NO: 361492 - DNA, 20 bp, Artificial Sequence
  chemically synthesized
gtcaatattttattcaagct

SEQ ID NO: 361493 - DNA, 20 bp, Artificial Sequence
  chemically synthesized
tattttattcaagctaagat

SEQ ID NO: 361494 - DNA, 20 bp, Artificial Sequence
  chemically synthesized
catcatgggatatctaatct

SEQ ID NO: 361495 - DNA, 20 bp, Artificial Sequence
  chemically synthesized
taagattagatatcccatga

SEQ ID NO: 361496 - DNA, 20 bp, Artificial Sequence
  chemically synthesized
cttttactgtaaaccatcat

SEQ ID NO: 361497 - DNA, 20 bp, Artificial Sequence
  chemically synthesized
ccttttactgtaaaccatca

SEQ ID NO: 361498 - DNA, 20 bp, Artificial Sequence
  chemically synthesized
agatatcccatgatggttta

SEQ ID NO: 361499 - DNA, 20 bp, Artificial Sequence
  chemically synthesized
cccatgatggtttacagtaa

SEQ ID NO: 361500 - DNA, 20 bp, Artificial Sequence
  chemically synthesized
ccatgatggtttacagtaaa

SEQ ID NO: 361501 - DNA, 20 bp, Artificial Sequence
  chemically synthesized
cttgaatatatcaatataat

SEQ ID NO: 361502 - DNA, 20 bp, Artificial Sequence
  chemically synthesized
cttattatattgatatattc

SEQ ID NO: 361503 - DNA, 20 bp, Artificial Sequence
  chemically synthesized
tattgatatattcaagattt

SEQ ID NO: 361504 - DNA, 20 bp, Artificial Sequence
  chemically synthesized
ttcaagatttaagaatactt

SEQ ID NO: 361505 - DNA, 20 bp, Artificial Sequence
  chemically synthesized
tttcatcttaagtttttctt

SEQ ID NO: 361506 - DNA, 20 bp, Artificial Sequence
  chemically synthesized
agaatacttaagaaaaactt

SEQ ID NO: 361507 - DNA, 20 bp, Artificial Sequence
  chemically synthesized
ttaagaaaaacttaagatga

SEQ ID NO: 361508 - DNA, 20 bp, Artificial Sequence
  chemically synthesized
ttcaggtttactttcatctt

SEQ ID NO: 361509 - DNA, 20 bp, Artificial Sequence
  chemically synthesized
tcagaaaaccatcatatttc

SEQ ID NO: 361510 - DNA, 20 bp, Artificial Sequence
  chemically synthesized
ttcagaaaaccatcatattt

SEQ ID NO: 361511 - DNA, 20 bp, Artificial Sequence
  chemically synthesized
aaagtaaacctgaaatatga

SEQ ID NO: 361512 - DNA, 20 bp, Artificial Sequence
  chemically synthesized
gaaatatgatggttttctga

SEQ ID NO: 361513 - DNA, 20 bp, Artificial Sequence
  chemically synthesized
tgttcctgtcaataatcttt

SEQ ID NO: 361514 - DNA, 20 bp, Artificial Sequence
  chemically synthesized
gttttctgaaagattattga

SEQ ID NO: 361515 - DNA, 20 bp, Artificial Sequence
  chemically synthesized
ttttctgaaagattattgac

SEQ ID NO: 361516 - DNA, 20 bp, Artificial Sequence
  chemically synthesized
gaaagattattgacaggaac

SEQ ID NO: 361517 - DNA, 20 bp, Artificial Sequence
  chemically synthesized
gattattgacaggaacaagt

SEQ ID NO: 361518 - DNA, 20 bp, Artificial Sequence
  chemically synthesized
gttatttttgatttgcttta

SEQ ID NO: 361519 - DNA, 20 bp, Artificial Sequence
  chemically synthesized
tttttgatttgctttacaga

SEQ ID NO: 361520 - DNA, 20 bp, Artificial Sequence
  chemically synthesized
ctgctattcttctttctgta

SEQ ID NO: 361521 - DNA, 20 bp, Artificial Sequence
  chemically synthesized
ttgatttgctttacagaaag

SEQ ID NO: 361522 - DNA, 20 bp, Artificial Sequence
  chemically synthesized
ttgctttacagaaagaagaa

SEQ ID NO: 361523 - DNA, 20 bp, Artificial Sequence
  chemically synthesized
ctttacagaaagaagaatag

SEQ ID NO: 361524 - DNA, 20 bp, Artificial Sequence
  chemically synthesized
cagaaagaagaatagcagac

SEQ ID NO: 361525 - DNA, 20 bp, Artificial Sequence
  chemically synthesized
agaaagaagaatagcagact

SEQ ID NO: 361526 - DNA, 20 bp, Artificial Sequence
  chemically synthesized
gaaagaagaatagcagacta

SEQ ID NO: 361527 - DNA, 20 bp, Artificial Sequence
  chemically synthesized
attttctgtttgatgaaccc

SEQ ID NO: 361528 - DNA, 20 bp, Artificial Sequence
  chemically synthesized
gcagactagggttcatcaaa

SEQ ID NO: 361529 - DNA, 20 bp, Artificial Sequence
  chemically synthesized
agggttcatcaaacagaaaa

SEQ ID NO: 361530 - DNA, 20 bp, Artificial Sequence
  chemically synthesized
tcaaacagaaaatagtaaat

SEQ ID NO: 361531 - DNA, 20 bp, Artificial Sequence
  chemically synthesized
gaaaatagtaaataagacgt

SEQ ID NO: 361532 - DNA, 20 bp, Artificial Sequence
  chemically synthesized
agtaaataagacgtcagaat

SEQ ID NO: 361533 - DNA, 20 bp, Artificial Sequence
  chemically synthesized
gtaaataagacgtcagaatg

SEQ ID NO: 361534 - DNA, 20 bp, Artificial Sequence
  chemically synthesized
taaataagacgtcagaatga

SEQ ID NO: 361535 - DNA, 20 bp, Artificial Sequence
  chemically synthesized
aaataagacgtcagaatgag

SEQ ID NO: 361536 - DNA, 20 bp, Artificial Sequence
  chemically synthesized
tggttattgaaattattttc

SEQ ID NO: 361537 - DNA, 20 bp, Artificial Sequence
  chemically synthesized
tgaaaataatttcaataacc

SEQ ID NO: 361538 - DNA, 20 bp, Artificial Sequence
  chemically synthesized
tccattttcattatttgact

SEQ ID NO: 361539 - DNA, 20 bp, Artificial Sequence
  chemically synthesized
accaagtcaaataatgaaaa

SEQ ID NO: 361540 - DNA, 20 bp, Artificial Sequence
  chemically synthesized
aagtcaaataatgaaaatgg

SEQ ID NO: 361541 - DNA, 20 bp, Artificial Sequence
  chemically synthesized
ataatgaaaatggaagttct

SEQ ID NO: 361542 - DNA, 20 bp, Artificial Sequence
  chemically synthesized
taatgaaaatggaagttctt

SEQ ID NO: 361543 - DNA, 20 bp, Artificial Sequence
  chemically synthesized
aatgaaaatggaagttctta

SEQ ID NO: 361544 - DNA, 20 bp, Artificial Sequence
  chemically synthesized
gaaaatggaagttcttaggg

SEQ ID NO: 361545 - DNA, 20 bp, Artificial Sequence
  chemically synthesized
aaatggaagttcttagggca

SEQ ID NO: 361546 - DNA, 20 bp, Artificial Sequence
  chemically synthesized
ctctccttctgctctgccct

SEQ ID NO: 361547 - DNA, 20 bp, Artificial Sequence
  chemically synthesized
tggaagttcttagggcagag

SEQ ID NO: 361548 - DNA, 20 bp, Artificial Sequence
  chemically synthesized
aagttcttagggcagagcag

SEQ ID NO: 361549 - DNA, 20 bp, Artificial Sequence
  chemically synthesized
agttcttagggcagagcaga

SEQ ID NO: 361550 - DNA, 20 bp, Artificial Sequence
  chemically synthesized
ttcttagggcagagcagaag

SEQ ID NO: 361551 - DNA, 20 bp, Artificial Sequence
  chemically synthesized
cttagggcagagcagaagga

SEQ ID NO: 361552 - DNA, 20 bp, Artificial Sequence
  chemically synthesized
tagggcagagcagaaggaga

SEQ ID NO: 361553 - DNA, 20 bp, Artificial Sequence
  chemically synthesized
gggcagagcagaaggagaga

SEQ ID NO: 361554 - DNA, 20 bp, Artificial Sequence
  chemically synthesized
cagagcagaaggagagagag

SEQ ID NO: 361555 - DNA, 20 bp, Artificial Sequence
  chemically synthesized
agagcagaaggagagagaga

SEQ ID NO: 361556 - DNA, 20 bp, Artificial Sequence
  chemically synthesized
gagcagaaggagagagagaa

SEQ ID NO: 361557 - DNA, 20 bp, Artificial Sequence
  chemically synthesized
ggaaaatgatgaataaaact

SEQ ID NO: 361558 - DNA, 20 bp, Artificial Sequence
  chemically synthesized
aaaatgatgaataaaactaa

SEQ ID NO: 361559 - DNA, 20 bp, Artificial Sequence
  chemically synthesized
tcttacaggaatgtaactct

SEQ ID NO: 361560 - DNA, 20 bp, Artificial Sequence
  chemically synthesized
actaagagttacattcctgt

SEQ ID NO: 361561 - DNA, 20 bp, Artificial Sequence
  chemically synthesized
cacacacgtaaatatcttac

SEQ ID NO: 361562 - DNA, 20 bp, Artificial Sequence
  chemically synthesized
acacacacgtaaatatctta

SEQ ID NO: 361563 - DNA, 20 bp, Artificial Sequence
  chemically synthesized
gtgtgtgtgtgtgtgatgtg

SEQ ID NO: 361564 - DNA, 20 bp, Artificial Sequence
  chemically synthesized
gtgatgtgtggtttgtgtat

SEQ ID NO: 361565 - DNA, 20 bp, Artificial Sequence
  chemically synthesized
gatgtgtggtttgtgtatga

SEQ ID NO: 361566 - DNA, 20 bp, Artificial Sequence
  chemically synthesized
tgtgtggtttgtgtatgaga

SEQ ID NO: 361567 - DNA, 20 bp, Artificial Sequence
  chemically synthesized
tgtggtttgtgtatgagaga

SEQ ID NO: 361568 - DNA, 20 bp, Artificial Sequence
  chemically synthesized
ttgtgtatgagagagagaaa

SEQ ID NO: 361569 - DNA, 20 bp, Artificial Sequence
  chemically synthesized
gtatgagagagagaaaaaga

SEQ ID NO: 361570 - DNA, 20 bp, Artificial Sequence
  chemically synthesized
tatgagagagagaaaaagac

SEQ ID NO: 361571 - DNA, 20 bp, Artificial Sequence
  chemically synthesized
agagaaaaagacaggtgaca

SEQ ID NO: 361572 - DNA, 20 bp, Artificial Sequence
  chemically synthesized
caggtgacaaagttctgaca

SEQ ID NO: 361573 - DNA, 20 bp, Artificial Sequence
  chemically synthesized
aaaattcattaaagctttgt

SEQ ID NO: 361574 - DNA, 20 bp, Artificial Sequence
  chemically synthesized
ttgtatgaaaaaattcatta

SEQ ID NO: 361575 - DNA, 20 bp, Artificial Sequence
  chemically synthesized
tcatacaattttatttttgt

SEQ ID NO: 361576 - DNA, 20 bp, Artificial Sequence
  chemically synthesized
aattttatttttgttagatg

SEQ ID NO: 361577 - DNA, 20 bp, Artificial Sequence
  chemically synthesized
ttttatttttgttagatgca

SEQ ID NO: 361578 - DNA, 20 bp, Artificial Sequence
  chemically synthesized
ttatttttgttagatgcaga

SEQ ID NO: 361579 - DNA, 20 bp, Artificial Sequence
  chemically synthesized
atttttgttagatgcagaga

SEQ ID NO: 361580 - DNA, 20 bp, Artificial Sequence
  chemically synthesized
ttgttagatgcagagagaga

SEQ ID NO: 361581 - DNA, 20 bp, Artificial Sequence
  chemically synthesized
tgcagagagagatggatgtt

SEQ ID NO: 361582 - DNA, 20 bp, Artificial Sequence
  chemically synthesized
cagagagagatggatgttta

SEQ ID NO: 361583 - DNA, 20 bp, Artificial Sequence
  chemically synthesized
tagagttttgtgtatcattt

SEQ ID NO: 361584 - DNA, 20 bp, Artificial Sequence
  chemically synthesized
gtgtatcatttaagcatttg

SEQ ID NO: 361585 - DNA, 20 bp, Artificial Sequence
  chemically synthesized
aagcatttgcggttttaact

SEQ ID NO: 361586 - DNA, 20 bp, Artificial Sequence
  chemically synthesized
catttgcggttttaacttgg

SEQ ID NO: 361587 - DNA, 20 bp, Artificial Sequence
  chemically synthesized
tataactttctgcaacttcc

SEQ ID NO: 361588 - DNA, 20 bp, Artificial Sequence
  chemically synthesized
cggttttaacttggaagttg

SEQ ID NO: 361589 - DNA, 20 bp, Artificial Sequence
  chemically synthesized
tttaacttggaagttgcaga

SEQ ID NO: 361590 - DNA, 20 bp, Artificial Sequence
  chemically synthesized
agaaagttatatctcattca

SEQ ID NO: 361591 - DNA, 20 bp, Artificial Sequence
  chemically synthesized
gaaagttatatctcattcac

SEQ ID NO: 361592 - DNA, 20 bp, Artificial Sequence
  chemically synthesized
aaagttatatctcattcaca

SEQ ID NO: 361593 - DNA, 20 bp, Artificial Sequence
  chemically synthesized
atgatggttcccctgtgaat

SEQ ID NO: 361594 - DNA, 20 bp, Artificial Sequence
  chemically synthesized
aagttatatctcattcacag

SEQ ID NO: 361595 - DNA, 20 bp, Artificial Sequence
  chemically synthesized
accatatattataaagatga

SEQ ID NO: 361596 - DNA, 20 bp, Artificial Sequence
  chemically synthesized
ggcagacaccatatattata

SEQ ID NO: 361597 - DNA, 20 bp, Artificial Sequence
  chemically synthesized
accatcatctttataatata

SEQ ID NO: 361598 - DNA, 20 bp, Artificial Sequence
  chemically synthesized
tctaaaaaggcaagaagagg

SEQ ID NO: 361599 - DNA, 20 bp, Artificial Sequence
  chemically synthesized
ttgtctaaaaaggcaagaag

SEQ ID NO: 361600 - DNA, 20 bp, Artificial Sequence
  chemically synthesized
gttgtctaaaaaggcaagaa

SEQ ID NO: 361601 - DNA, 20 bp, Artificial Sequence
  chemically synthesized
tggttgtctaaaaaggcaag

SEQ ID NO: 361602 - DNA, 20 bp, Artificial Sequence
  chemically synthesized
tctgcctcttcttgcctttt

SEQ ID NO: 361603 - DNA, 20 bp, Artificial Sequence
  chemically synthesized
cactggttgtctaaaaaggc

SEQ ID NO: 361604 - DNA, 20 bp, Artificial Sequence
  chemically synthesized
ttgtcactggttgtctaaaa

SEQ ID NO: 361605 - DNA, 20 bp, Artificial Sequence
  chemically synthesized
cttgtcactggttgtctaaa

SEQ ID NO: 361606 - DNA, 20 bp, Artificial Sequence
  chemically synthesized
ttcttgcctttttagacaac

SEQ ID NO: 361607 - DNA, 20 bp, Artificial Sequence
  chemically synthesized
ctttttagacaaccagtgac

SEQ ID NO: 361608 - DNA, 20 bp, Artificial Sequence
  chemically synthesized
tttttagacaaccagtgaca

SEQ ID NO: 361609 - DNA, 20 bp, Artificial Sequence
  chemically synthesized
ctctgaaatgtccttgtcac

SEQ ID NO: 361610 - DNA, 20 bp, Artificial Sequence
  chemically synthesized
aaccagtgacaaggacattt

SEQ ID NO: 361611 - DNA, 20 bp, Artificial Sequence
  chemically synthesized
ccagtgacaaggacatttca

SEQ ID NO: 361612 - DNA, 20 bp, Artificial Sequence
  chemically synthesized
acaaggacatttcagagcta

SEQ ID NO: 361613 - DNA, 20 bp, Artificial Sequence
  chemically synthesized
caaggacatttcagagctac

SEQ ID NO: 361614 - DNA, 20 bp, Artificial Sequence
  chemically synthesized
cgtgttttcattagagcctg

SEQ ID NO: 361615 - DNA, 20 bp, Artificial Sequence
  chemically synthesized
cgcaggacgtgttttcatta

SEQ ID NO: 361616 - DNA, 20 bp, Artificial Sequence
  chemically synthesized
gacgcaggacgtgttttcat

SEQ ID NO: 361617 - DNA, 20 bp, Artificial Sequence
  chemically synthesized
ttcaattggctgaatgacgc

SEQ ID NO: 361618 - DNA, 20 bp, Artificial Sequence
  chemically synthesized
aaaacacgtcctgcgtcatt

SEQ ID NO: 361619 - DNA, 20 bp, Artificial Sequence
  chemically synthesized
tttcaattggctgaatgacg

SEQ ID NO: 361620 - DNA, 20 bp, Artificial Sequence
  chemically synthesized
tgctttagtctaatttcaat

SEQ ID NO: 361621 - DNA, 20 bp, Artificial Sequence
  chemically synthesized
gtcattcagccaattgaaat

SEQ ID NO: 361622 - DNA, 20 bp, Artificial Sequence
  chemically synthesized
agccaattgaaattagacta

SEQ ID NO: 361623 - DNA, 20 bp, Artificial Sequence
  chemically synthesized
caattgaaattagactaaag

SEQ ID NO: 361624 - DNA, 20 bp, Artificial Sequence
  chemically synthesized
aattgaaattagactaaagc

SEQ ID NO: 361625 - DNA, 20 bp, Artificial Sequence
  chemically synthesized
atgtgagaaacgacctgctt

SEQ ID NO: 361626 - DNA, 20 bp, Artificial Sequence
  chemically synthesized
aattcctttgaaacaaatgt

SEQ ID NO: 361627 - DNA, 20 bp, Artificial Sequence
  chemically synthesized
cgtttctcacatttgtttca

SEQ ID NO: 361628 - DNA, 20 bp, Artificial Sequence
  chemically synthesized
gtttctcacatttgtttcaa

SEQ ID NO: 361629 - DNA, 20 bp, Artificial Sequence
  chemically synthesized
cacatttgtttcaaaggaat

SEQ ID NO: 361630 - DNA, 20 bp, Artificial Sequence
  chemically synthesized
ttcaaaggaattggttctcc

SEQ ID NO: 361631 - DNA, 20 bp, Artificial Sequence
  chemically synthesized
caaactctgaaatgatctgg

SEQ ID NO: 361632 - DNA, 20 bp, Artificial Sequence
  chemically synthesized
atcaaactctgaaatgatct

SEQ ID NO: 361633 - DNA, 20 bp, Artificial Sequence
  chemically synthesized
tatcaaactctgaaatgatc

SEQ ID NO: 361634 - DNA, 20 bp, Artificial Sequence
  chemically synthesized
ttggttctcccagatcattt

SEQ ID NO: 361635 - DNA, 20 bp, Artificial Sequence
  chemically synthesized
ggttctcccagatcatttca

SEQ ID NO: 361636 - DNA, 20 bp, Artificial Sequence
  chemically synthesized
cagagtttgatatttgtcct

SEQ ID NO: 361637 - DNA, 20 bp, Artificial Sequence
  chemically synthesized
agtttgatatttgtcctaag

SEQ ID NO: 361638 - DNA, 20 bp, Artificial Sequence
  chemically synthesized
gtttgatatttgtcctaaga

SEQ ID NO: 361639 - DNA, 20 bp, Artificial Sequence
  chemically synthesized
ttgatatttgtcctaagaag

SEQ ID NO: 361640 - DNA, 20 bp, Artificial Sequence
  chemically synthesized
aacaaaagtgactccttctt

SEQ ID NO: 361641 - DNA, 20 bp, Artificial Sequence
  chemically synthesized
gaacaaaagtgactccttct

SEQ ID NO: 361642 - DNA, 20 bp, Artificial Sequence
  chemically synthesized
cactgcatatgagggaacaa

SEQ ID NO: 361643 - DNA, 20 bp, Artificial Sequence
  chemically synthesized
cacttttgttccctcatatg

SEQ ID NO: 361644 - DNA, 20 bp, Artificial Sequence
  chemically synthesized
gtattttacactgcatatga

SEQ ID NO: 361645 - DNA, 20 bp, Artificial Sequence
  chemically synthesized
tgtattttacactgcatatg

SEQ ID NO: 361646 - DNA, 20 bp, Artificial Sequence
  chemically synthesized
ttgtattttacactgcatat

SEQ ID NO: 361647 - DNA, 20 bp, Artificial Sequence
  chemically synthesized
tcatatgcagtgtaaaatac

SEQ ID NO: 361648 - DNA, 20 bp, Artificial Sequence
  chemically synthesized
aatacaagcatttttaaaat

SEQ ID NO: 361649 - DNA, 20 bp, Artificial Sequence
  chemically synthesized
aagcatttttaaaattagct

SEQ ID NO: 361650 - DNA, 20 bp, Artificial Sequence
  chemically synthesized
agcatttttaaaattagcta

SEQ ID NO: 361651 - DNA, 20 bp, Artificial Sequence
  chemically synthesized
gcatttttaaaattagctaa

SEQ ID NO: 361652 - DNA, 20 bp, Artificial Sequence
  chemically synthesized
atttttaaaattagctaagg

SEQ ID NO: 361653 - DNA, 20 bp, Artificial Sequence
  chemically synthesized
tttttaaaattagctaaggg

SEQ ID NO: 361654 - DNA, 20 bp, Artificial Sequence
  chemically synthesized
ttttaaaattagctaaggga

SEQ ID NO: 361655 - DNA, 20 bp, Artificial Sequence
  chemically synthesized
tttaaaattagctaagggag

SEQ ID NO: 361656 - DNA, 20 bp, Artificial Sequence
  chemically synthesized
ttaaaattagctaagggagg

SEQ ID NO: 361657 - DNA, 20 bp, Artificial Sequence
  chemically synthesized
ttacccttatccccctccct

SEQ ID NO: 361658 - DNA, 20 bp, Artificial Sequence
  chemically synthesized
attagctaagggagggggat

SEQ ID NO: 361659 - DNA, 20 bp, Artificial Sequence
  chemically synthesized
ttagctaagggagggggata

SEQ ID NO: 361660 - DNA, 20 bp, Artificial Sequence
  chemically synthesized
tagctaagggagggggataa

SEQ ID NO: 361661 - DNA, 20 bp, Artificial Sequence
  chemically synthesized
taagggagggggataagggt

SEQ ID NO: 361662 - DNA, 20 bp, Artificial Sequence
  chemically synthesized
accaagactgagtgaaaagg

SEQ ID NO: 361663 - DNA, 20 bp, Artificial Sequence
  chemically synthesized
gggtaagctaccttttcact

SEQ ID NO: 361664 - DNA, 20 bp, Artificial Sequence
  chemically synthesized
atcaccaagactgagtgaaa

SEQ ID NO: 361665 - DNA, 20 bp, Artificial Sequence
  chemically synthesized
aatcaccaagactgagtgaa

SEQ ID NO: 361666 - DNA, 20 bp, Artificial Sequence
  chemically synthesized
gctaccttttcactcagtct

SEQ ID NO: 361667 - DNA, 20 bp, Artificial Sequence
  chemically synthesized
tagttaaaatcaccaagact

SEQ ID NO: 361668 - DNA, 20 bp, Artificial Sequence
  chemically synthesized
catatctagttaaaatcacc

SEQ ID NO: 361669 - DNA, 20 bp, Artificial Sequence
  chemically synthesized
tcagtcttggtgattttaac

SEQ ID NO: 361670 - DNA, 20 bp, Artificial Sequence
  chemically synthesized
agtttgtaccatttcatatc

SEQ ID NO: 361671 - DNA, 20 bp, Artificial Sequence
  chemically synthesized
gattttaactagatatgaaa

SEQ ID NO: 361672 - DNA, 20 bp, Artificial Sequence
  chemically synthesized
tttgtgaaattattttataa

SEQ ID NO: 361673 - DNA, 20 bp, Artificial Sequence
  chemically synthesized
ttataaaataatttcacaaa

SEQ ID NO: 361674 - DNA, 20 bp, Artificial Sequence
  chemically synthesized
atttcacaaaaagattctga

SEQ ID NO: 361675 - DNA, 20 bp, Artificial Sequence
  chemically synthesized
tttcacaaaaagattctgaa

SEQ ID NO: 361676 - DNA, 20 bp, Artificial Sequence
  chemically synthesized
ggatatttcagggttccttt

SEQ ID NO: 361677 - DNA, 20 bp, Artificial Sequence
  chemically synthesized
aaacttttaaggatatttca

SEQ ID NO: 361678 - DNA, 20 bp, Artificial Sequence
  chemically synthesized
caaacttttaaggatatttc

SEQ ID NO: 361679 - DNA, 20 bp, Artificial Sequence
  chemically synthesized
tcaaacttttaaggatattt

SEQ ID NO: 361680 - DNA, 20 bp, Artificial Sequence
  chemically synthesized
gaaccctgaaatatccttaa

SEQ ID NO: 361681 - DNA, 20 bp, Artificial Sequence
  chemically synthesized
gaaatcaactcaaactttta

SEQ ID NO: 361682 - DNA, 20 bp, Artificial Sequence
  chemically synthesized
ggaaatcaactcaaactttt

SEQ ID NO: 361683 - DNA, 20 bp, Artificial Sequence
  chemically synthesized
tgaaatatccttaaaagttt

SEQ ID NO: 361684 - DNA, 20 bp, Artificial Sequence
  chemically synthesized
tttgagttgatttccttaaa

SEQ ID NO: 361685 - DNA, 20 bp, Artificial Sequence
  chemically synthesized
attgtttaagattctgttta

SEQ ID NO: 361686 - DNA, 20 bp, Artificial Sequence
  chemically synthesized
tattgtttaagattctgttt

SEQ ID NO: 361687 - DNA, 20 bp, Artificial Sequence
  chemically synthesized
ttcccttttagttattgttt

SEQ ID NO: 361688 - DNA, 20 bp, Artificial Sequence
  chemically synthesized
gaatcttaaacaataactaa

SEQ ID NO: 361689 - DNA, 20 bp, Artificial Sequence
  chemically synthesized
aatcttaaacaataactaaa

SEQ ID NO: 361690 - DNA, 20 bp, Artificial Sequence
  chemically synthesized
atcttaaacaataactaaaa

SEQ ID NO: 361691 - DNA, 20 bp, Artificial Sequence
  chemically synthesized
aatgcatgggatttcccttt

SEQ ID NO: 361692 - DNA, 20 bp, Artificial Sequence
  chemically synthesized
cataataattttcaatgcat

SEQ ID NO: 361693 - DNA, 20 bp, Artificial Sequence
  chemically synthesized
acataataattttcaatgca

SEQ ID NO: 361694 - DNA, 20 bp, Artificial Sequence
  chemically synthesized
ttgaggtttcagtgtcagga

SEQ ID NO: 361695 - DNA, 20 bp, Artificial Sequence
  chemically synthesized
cttgaggtttcagtgtcagg

SEQ ID NO: 361696 - DNA, 20 bp, Artificial Sequence
  chemically synthesized
atgcttgaggtttcagtgtc

SEQ ID NO: 361697 - DNA, 20 bp, Artificial Sequence
  chemically synthesized
catgcttgaggtttcagtgt

SEQ ID NO: 361698 - DNA, 20 bp, Artificial Sequence
  chemically synthesized
cttcctgacactgaaacctc

SEQ ID NO: 361699 - DNA, 20 bp, Artificial Sequence
  chemically synthesized
gaagtacatgcttgaggttt

SEQ ID NO: 361700 - DNA, 20 bp, Artificial Sequence
  chemically synthesized
atggtggaagtacatgcttg

SEQ ID NO: 361701 - DNA, 20 bp, Artificial Sequence
  chemically synthesized
gatggtggaagtacatgctt

SEQ ID NO: 361702 - DNA, 20 bp, Artificial Sequence
  chemically synthesized
aagaaccaaatagatggtgg

SEQ ID NO: 361703 - DNA, 20 bp, Artificial Sequence
  chemically synthesized
tgaaagaaccaaatagatgg

SEQ ID NO: 361704 - DNA, 20 bp, Artificial Sequence
  chemically synthesized
atgtacttccaccatctatt

SEQ ID NO: 361705 - DNA, 20 bp, Artificial Sequence
  chemically synthesized
aaatgaaagaaccaaataga

SEQ ID NO: 361706 - DNA, 20 bp, Artificial Sequence
  chemically synthesized
aaagaaatgaaagaaccaaa

SEQ ID NO: 361707 - DNA, 20 bp, Artificial Sequence
  chemically synthesized
aatgaaatgaaaagaaatga

SEQ ID NO: 361708 - DNA, 20 bp, Artificial Sequence
  chemically synthesized
tgagaacgaaatgaaatgaa

SEQ ID NO: 361709 - DNA, 20 bp, Artificial Sequence
  chemically synthesized
tcggtttatatatattttat

SEQ ID NO: 361710 - DNA, 20 bp, Artificial Sequence
  chemically synthesized
tcataaaatatatataaacc

SEQ ID NO: 361711 - DNA, 20 bp, Artificial Sequence
  chemically synthesized
taaaatatatataaaccgag

SEQ ID NO: 361712 - DNA, 20 bp, Artificial Sequence
  chemically synthesized
gaatgttggaaggaacttct

SEQ ID NO: 361713 - DNA, 20 bp, Artificial Sequence
  chemically synthesized
tgtttatctagaatgttgga

SEQ ID NO: 361714 - DNA, 20 bp, Artificial Sequence
  chemically synthesized
ctgtttatctagaatgttgg

SEQ ID NO: 361715 - DNA, 20 bp, Artificial Sequence
  chemically synthesized
agaagttccttccaacattc

SEQ ID NO: 361716 - DNA, 20 bp, Artificial Sequence
  chemically synthesized
attctgtttatctagaatgt

SEQ ID NO: 361717 - DNA, 20 bp, Artificial Sequence
  chemically synthesized
cttccaacattctagataaa

SEQ ID NO: 361718 - DNA, 20 bp, Artificial Sequence
  chemically synthesized
aaaagcaaattctgtttatc

SEQ ID NO: 361719 - DNA, 20 bp, Artificial Sequence
  chemically synthesized
agacatttaacatgtttaaa

SEQ ID NO: 361720 - DNA, 20 bp, Artificial Sequence
  chemically synthesized
acatgttaaatgtcttttat

SEQ ID NO: 361721 - DNA, 20 bp, Artificial Sequence
  chemically synthesized
tgatggcagacatcttataa

SEQ ID NO: 361722 - DNA, 20 bp, Artificial Sequence
  chemically synthesized
ttagcttggctacatgatgg

SEQ ID NO: 361723 - DNA, 20 bp, Artificial Sequence
  chemically synthesized
ataagatgtctgccatcatg

SEQ ID NO: 361724 - DNA, 20 bp, Artificial Sequence
  chemically synthesized
tctttagcttggctacatga

SEQ ID NO: 361725 - DNA, 20 bp, Artificial Sequence
  chemically synthesized
atgtctgccatcatgtagcc

SEQ ID NO: 361726 - DNA, 20 bp, Artificial Sequence
  chemically synthesized
gccatcatgtagccaagcta

SEQ ID NO: 361727 - DNA, 20 bp, Artificial Sequence
  chemically synthesized
atatggagaagtctttagct

SEQ ID NO: 361728 - DNA, 20 bp, Artificial Sequence
  chemically synthesized
cttgaatatggagaagtctt

SEQ ID NO: 361729 - DNA, 20 bp, Artificial Sequence
  chemically synthesized
agtttctcttgaatatggag

SEQ ID NO: 361730 - DNA, 20 bp, Artificial Sequence
  chemically synthesized
ctaaagacttctccatattc

SEQ ID NO: 361731 - DNA, 20 bp, Artificial Sequence
  chemically synthesized
agaagtttctcttgaatatg

SEQ ID NO: 361732 - DNA, 20 bp, Artificial Sequence
  chemically synthesized
aaagacttctccatattcaa

SEQ ID NO: 361733 - DNA, 20 bp, Artificial Sequence
  chemically synthesized
tgagaagtttctcttgaata

SEQ ID NO: 361734 - DNA, 20 bp, Artificial Sequence
  chemically synthesized
atattcaagagaaacttctc

SEQ ID NO: 361735 - DNA, 20 bp, Artificial Sequence
  chemically synthesized
ggattgtatgaatacttgag

SEQ ID NO: 361736 - DNA, 20 bp, Artificial Sequence
  chemically synthesized
gaaggattgtatgaatactt

SEQ ID NO: 361737 - DNA, 20 bp, Artificial Sequence
  chemically synthesized
taaaatgcattatatttaga

SEQ ID NO: 361738 - DNA, 20 bp, Artificial Sequence
  chemically synthesized
ttaaaatgcattatatttag

SEQ ID NO: 361739 - DNA, 20 bp, Artificial Sequence
  chemically synthesized
tttttaaaatgcattatatt

SEQ ID NO: 361740 - DNA, 20 bp, Artificial Sequence
  chemically synthesized
taaatataatgcattttaaa

SEQ ID NO: 361741 - DNA, 20 bp, Artificial Sequence
  chemically synthesized
ttttaaaaagataaaaaata

SEQ ID NO: 361742 - DNA, 20 bp, Artificial Sequence
  chemically synthesized
tttaaaaagataaaaaatac

SEQ ID NO: 361743 - DNA, 20 bp, Artificial Sequence
  chemically synthesized
aaaagataaaaaatacagga

SEQ ID NO: 361744 - DNA, 20 bp, Artificial Sequence
  chemically synthesized
aaagataaaaaatacaggaa

SEQ ID NO: 361745 - DNA, 20 bp, Artificial Sequence
  chemically synthesized
taaaaaatacaggaaaggca

SEQ ID NO: 361746 - DNA, 20 bp, Artificial Sequence
  chemically synthesized
aaaatacaggaaaggcaaag

SEQ ID NO: 361747 - DNA, 20 bp, Artificial Sequence
  chemically synthesized
aaagtagtttcattgccctg

SEQ ID NO: 361748 - DNA, 20 bp, Artificial Sequence
  chemically synthesized
gtgtaaaagcacatgctgca

SEQ ID NO: 361749 - DNA, 20 bp, Artificial Sequence
  chemically synthesized
ggtgtaaaagcacatgctgc

SEQ ID NO: 361750 - DNA, 20 bp, Artificial Sequence
  chemically synthesized
tggtgtaaaagcacatgctg

SEQ ID NO: 361751 - DNA, 20 bp, Artificial Sequence
  chemically synthesized
aaatcttaaatgtggtgtaa

SEQ ID NO: 361752 - DNA, 20 bp, Artificial Sequence
  chemically synthesized
tgtgcttttacaccacattt

SEQ ID NO: 361753 - DNA, 20 bp, Artificial Sequence
  chemically synthesized
aacagtgtaaatcttaaatg

SEQ ID NO: 361754 - DNA, 20 bp, Artificial Sequence
  chemically synthesized
ataagtcttgaaattttaaa

SEQ ID NO: 361755 - DNA, 20 bp, Artificial Sequence
  chemically synthesized
tttacactgtttaaaatttc

SEQ ID NO: 361756 - DNA, 20 bp, Artificial Sequence
  chemically synthesized
gtttaaaatttcaagactta

SEQ ID NO: 361757 - DNA, 20 bp, Artificial Sequence
  chemically synthesized
tttaaaatttcaagacttat

SEQ ID NO: 361758 - DNA, 20 bp, Artificial Sequence
  chemically synthesized
taggtatgatttatgcccat

SEQ ID NO: 361759 - DNA, 20 bp, Artificial Sequence
  chemically synthesized
atctctcaatggaagaaaat

SEQ ID NO: 361760 - DNA, 20 bp, Artificial Sequence
  chemically synthesized
catctctcaatggaagaaaa

SEQ ID NO: 361761 - DNA, 20 bp, Artificial Sequence
  chemically synthesized
catacctattttcttccatt

SEQ ID NO: 361762 - DNA, 20 bp, Artificial Sequence
  chemically synthesized
tacctattttcttccattga

SEQ ID NO: 361763 - DNA, 20 bp, Artificial Sequence
  chemically synthesized
atacatgcatctctcaatgg

SEQ ID NO: 361764 - DNA, 20 bp, Artificial Sequence
  chemically synthesized
tcaatacatgcatctctcaa

SEQ ID NO: 361765 - DNA, 20 bp, Artificial Sequence
  chemically synthesized
atttatgatttaataagaaa

SEQ ID NO: 361766 - DNA, 20 bp, Artificial Sequence
  chemically synthesized
cgacgtatttatgatttaat

SEQ ID NO: 361767 - DNA, 20 bp, Artificial Sequence
  chemically synthesized
gtcgatatatacaacctaaa

SEQ ID NO: 361768 - DNA, 20 bp, Artificial Sequence
  chemically synthesized
gatatatacaacctaaacgg

SEQ ID NO: 361769 - DNA, 20 bp, Artificial Sequence
  chemically synthesized
atatatacaacctaaacggt

SEQ ID NO: 361770 - DNA, 20 bp, Artificial Sequence
  chemically synthesized
ggcaatatggcccaccgttt

SEQ ID NO: 361771 - DNA, 20 bp, Artificial Sequence
  chemically synthesized
tggcaatatggcccaccgtt

SEQ ID NO: 361772 - DNA, 20 bp, Artificial Sequence
  chemically synthesized
ccaggtccacagtggcaata

SEQ ID NO: 361773 - DNA, 20 bp, Artificial Sequence
  chemically synthesized
ggtgggccatattgccactg

SEQ ID NO: 361774 - DNA, 20 bp, Artificial Sequence
  chemically synthesized
ttggaaatccaggtccacag

SEQ ID NO: 361775 - DNA, 20 bp, Artificial Sequence
  chemically synthesized
ccatattgccactgtggacc

SEQ ID NO: 361776 - DNA, 20 bp, Artificial Sequence
  chemically synthesized
tcattggaaatccaggtcca

SEQ ID NO: 361777 - DNA, 20 bp, Artificial Sequence
  chemically synthesized
aaagctgtcattggaaatcc

SEQ ID NO: 361778 - DNA, 20 bp, Artificial Sequence
  chemically synthesized
aaaagctgtcattggaaatc

SEQ ID NO: 361779 - DNA, 20 bp, Artificial Sequence
  chemically synthesized
tggacctggatttccaatga

SEQ ID NO: 361780 - DNA, 20 bp, Artificial Sequence
  chemically synthesized
agggaataaaaagctgtcat

SEQ ID NO: 361781 - DNA, 20 bp, Artificial Sequence
  chemically synthesized
gagataaggaagggaataaa

SEQ ID NO: 361782 - DNA, 20 bp, Artificial Sequence
  chemically synthesized
tgaaatacggagataaggaa

SEQ ID NO: 361783 - DNA, 20 bp, Artificial Sequence
  chemically synthesized
ttgaaatacggagataagga

SEQ ID NO: 361784 - DNA, 20 bp, Artificial Sequence
  chemically synthesized
cttgaaatacggagataagg

SEQ ID NO: 361785 - DNA, 20 bp, Artificial Sequence
  chemically synthesized
attcttgaaatacggagata

SEQ ID NO: 361786 - DNA, 20 bp, Artificial Sequence
  chemically synthesized
aattcttgaaatacggagat

SEQ ID NO: 361787 - DNA, 20 bp, Artificial Sequence
  chemically synthesized
aaaataattcttgaaatacg

SEQ ID NO: 361788 - DNA, 20 bp, Artificial Sequence
  chemically synthesized
cttccttatctccgtatttc

SEQ ID NO: 361789 - DNA, 20 bp, Artificial Sequence
  chemically synthesized
caaaaataattcttgaaata

SEQ ID NO: 361790 - DNA, 20 bp, Artificial Sequence
  chemically synthesized
ttcaagaattatttttgatt

SEQ ID NO: 361791 - DNA, 20 bp, Artificial Sequence
  chemically synthesized
aattatttttgattcagata

SEQ ID NO: 361792 - DNA, 20 bp, Artificial Sequence
  chemically synthesized
tcagatatagaaatttacat

SEQ ID NO: 361793 - DNA, 20 bp, Artificial Sequence
  chemically synthesized
tttacattagataatttttg

SEQ ID NO: 361794 - DNA, 20 bp, Artificial Sequence
  chemically synthesized
taaatcttgtaatatagttg

SEQ ID NO: 361795 - DNA, 20 bp, Artificial Sequence
  chemically synthesized
ttaaatcttgtaatatagtt

SEQ ID NO: 361796 - DNA, 20 bp, Artificial Sequence
  chemically synthesized
tttgacctcaactatattac

SEQ ID NO: 361797 - DNA, 20 bp, Artificial Sequence
  chemically synthesized
cagaattaaatcttgtaata

SEQ ID NO: 361798 - DNA, 20 bp, Artificial Sequence
  chemically synthesized
tatattacaagatttaattc

SEQ ID NO: 361799 - DNA, 20 bp, Artificial Sequence
  chemically synthesized
atattacaagatttaattct

SEQ ID NO: 361800 - DNA, 20 bp, Artificial Sequence
  chemically synthesized
gtatctttgtagtgagtacc

SEQ ID NO: 361801 - DNA, 20 bp, Artificial Sequence
  chemically synthesized
aattctgggtactcactaca

SEQ ID NO: 361802 - DNA, 20 bp, Artificial Sequence
  chemically synthesized
agagatagtatctttgtagt

SEQ ID NO: 361803 - DNA, 20 bp, Artificial Sequence
  chemically synthesized
aggtagagatagtatctttg

SEQ ID NO: 361804 - DNA, 20 bp, Artificial Sequence
  chemically synthesized
ttaatcattgaaggtagaga

SEQ ID NO: 361805 - DNA, 20 bp, Artificial Sequence
  chemically synthesized
aaacttaatcattgaaggta

SEQ ID NO: 361806 - DNA, 20 bp, Artificial Sequence
  chemically synthesized
taaaacttaatcattgaagg

SEQ ID NO: 361807 - DNA, 20 bp, Artificial Sequence
  chemically synthesized
atgtaaaacttaatcattga

SEQ ID NO: 361808 - DNA, 20 bp, Artificial Sequence
  chemically synthesized
tatgtaaaacttaatcattg

SEQ ID NO: 361809 - DNA, 20 bp, Artificial Sequence
  chemically synthesized
tatctctaccttcaatgatt

SEQ ID NO: 361810 - DNA, 20 bp, Artificial Sequence
  chemically synthesized
atgattaagttttacatatt

SEQ ID NO: 361811 - DNA, 20 bp, Artificial Sequence
  chemically synthesized
tgagtggtcaaaaatagtta

SEQ ID NO: 361812 - DNA, 20 bp, Artificial Sequence
  chemically synthesized
atatagtgagtggtcaaaaa

SEQ ID NO: 361813 - DNA, 20 bp, Artificial Sequence
  chemically synthesized
tatgcgtggcatatagtgag

SEQ ID NO: 361814 - DNA, 20 bp, Artificial Sequence
  chemically synthesized
ttctatgcgtggcatatagt

SEQ ID NO: 361815 - DNA, 20 bp, Artificial Sequence
  chemically synthesized
aacattctatgcgtggcata

SEQ ID NO: 361816 - DNA, 20 bp, Artificial Sequence
  chemically synthesized
cactcactatatgccacgca

SEQ ID NO: 361817 - DNA, 20 bp, Artificial Sequence
  chemically synthesized
tattcttaacattctatgcg

SEQ ID NO: 361818 - DNA, 20 bp, Artificial Sequence
  chemically synthesized
tatgccacgcatagaatgtt

SEQ ID NO: 361819 - DNA, 20 bp, Artificial Sequence
  chemically synthesized
ttaagaataaatttaaaaaa

SEQ ID NO: 361820 - DNA, 20 bp, Artificial Sequence
  chemically synthesized
gtccataagcaatttgttga

SEQ ID NO: 361821 - DNA, 20 bp, Artificial Sequence
  chemically synthesized
gactttcaacaaattgctta

SEQ ID NO: 361822 - DNA, 20 bp, Artificial Sequence
  chemically synthesized
tcaacaaattgcttatggac

SEQ ID NO: 361823 - DNA, 20 bp, Artificial Sequence
  chemically synthesized
ttaacatttcacttgtccat

SEQ ID NO: 361824 - DNA, 20 bp, Artificial Sequence
  chemically synthesized
taaacatatctgaaatatag

SEQ ID NO: 361825 - DNA, 20 bp, Artificial Sequence
  chemically synthesized
gttaaatttcctctatattt

SEQ ID NO: 361826 - DNA, 20 bp, Artificial Sequence
  chemically synthesized
ataaacatatctgaaatata

SEQ ID NO: 361827 - DNA, 20 bp, Artificial Sequence
  chemically synthesized
tcataaacatatctgaaata

SEQ ID NO: 361828 - DNA, 20 bp, Artificial Sequence
  chemically synthesized
aattctcctgcaatgtatca

SEQ ID NO: 361829 - DNA, 20 bp, Artificial Sequence
  chemically synthesized
ataattctcctgcaatgtat

SEQ ID NO: 361830 - DNA, 20 bp, Artificial Sequence
  chemically synthesized
atgatcactctgatacattg

SEQ ID NO: 361831 - DNA, 20 bp, Artificial Sequence
  chemically synthesized
tgatcactctgatacattgc

SEQ ID NO: 361832 - DNA, 20 bp, Artificial Sequence
  chemically synthesized
atcactctgatacattgcag

SEQ ID NO: 361833 - DNA, 20 bp, Artificial Sequence
  chemically synthesized
tgcaggagaattatttttaa

SEQ ID NO: 361834 - DNA, 20 bp, Artificial Sequence
  chemically synthesized
caggagaattatttttaatg

SEQ ID NO: 361835 - DNA, 20 bp, Artificial Sequence
  chemically synthesized
attctttattgtcaaagagg

SEQ ID NO: 361836 - DNA, 20 bp, Artificial Sequence
  chemically synthesized
tcaattctttattgtcaaag

SEQ ID NO: 361837 - DNA, 20 bp, Artificial Sequence
  chemically synthesized
ctcaattctttattgtcaaa

SEQ ID NO: 361838 - DNA, 20 bp, Artificial Sequence
  chemically synthesized
gcctcaattctttattgtca

SEQ ID NO: 361839 - DNA, 20 bp, Artificial Sequence
  chemically synthesized
atactgcctctttgacaata

SEQ ID NO: 361840 - DNA, 20 bp, Artificial Sequence
  chemically synthesized
ctctttgacaataaagaatt

SEQ ID NO: 361841 - DNA, 20 bp, Artificial Sequence
  chemically synthesized
tctttgacaataaagaattg

SEQ ID NO: 361842 - DNA, 20 bp, Artificial Sequence
  chemically synthesized
ttgacaataaagaattgagg

SEQ ID NO: 361843 - DNA, 20 bp, Artificial Sequence
  chemically synthesized
agaattgaggcagttaatac

SEQ ID NO: 361844 - DNA, 20 bp, Artificial Sequence
  chemically synthesized
tcatattttcttaggattat

SEQ ID NO: 361845 - DNA, 20 bp, Artificial Sequence
  chemically synthesized
tacaagtgtctcataatcct

SEQ ID NO: 361846 - DNA, 20 bp, Artificial Sequence
  chemically synthesized
ttaaatgttcatattttctt

SEQ ID NO: 361847 - DNA, 20 bp, Artificial Sequence
  chemically synthesized
attaaatgttcatattttct

SEQ ID NO: 361848 - DNA, 20 bp, Artificial Sequence
  chemically synthesized
aagaaaatatgaacatttaa

SEQ ID NO: 361849 - DNA, 20 bp, Artificial Sequence
  chemically synthesized
atgaacatttaatggcatga

SEQ ID NO: 361850 - DNA, 20 bp, Artificial Sequence
  chemically synthesized
ttaaaacaaatttatcaaaa

SEQ ID NO: 361851 - DNA, 20 bp, Artificial Sequence
  chemically synthesized
aaacaaatttatcaaaatag

SEQ ID NO: 361852 - DNA, 20 bp, Artificial Sequence
  chemically synthesized
tcaaaatagaagttttgata

SEQ ID NO: 361853 - DNA, 20 bp, Artificial Sequence
  chemically synthesized
caaaatagaagttttgatac

SEQ ID NO: 361854 - DNA, 20 bp, Artificial Sequence
  chemically synthesized
aagttttgatacaggtaatc

SEQ ID NO: 361855 - DNA, 20 bp, Artificial Sequence
  chemically synthesized
attttattaatacgttcaac

SEQ ID NO: 361856 - DNA, 20 bp, Artificial Sequence
  chemically synthesized
aaaatgcaaactaaactttt

SEQ ID NO: 361857 - DNA, 20 bp, Artificial Sequence
  chemically synthesized
agctactttcccaaaaagtt

SEQ ID NO: 361858 - DNA, 20 bp, Artificial Sequence
  chemically synthesized
aaatgcaaactaaacttttt

SEQ ID NO: 361859 - DNA, 20 bp, Artificial Sequence
  chemically synthesized
gcaaactaaactttttggga

SEQ ID NO: 361860 - DNA, 20 bp, Artificial Sequence
  chemically synthesized
aaaagagctactttcccaaa

SEQ ID NO: 361861 - DNA, 20 bp, Artificial Sequence
  chemically synthesized
aactaaactttttgggaaag

SEQ ID NO: 361862 - DNA, 20 bp, Artificial Sequence
  chemically synthesized
tttgttgagtttagttaaaa

SEQ ID NO: 361863 - DNA, 20 bp, Artificial Sequence
  chemically synthesized
attttgttgagtttagttaa

SEQ ID NO: 361864 - DNA, 20 bp, Artificial Sequence
  chemically synthesized
ataaggaattttgttgagtt

SEQ ID NO: 361865 - DNA, 20 bp, Artificial Sequence
  chemically synthesized
tctatataaggaattttgtt

SEQ ID NO: 361866 - DNA, 20 bp, Artificial Sequence
  chemically synthesized
actcaacaaaattccttata

SEQ ID NO: 361867 - DNA, 20 bp, Artificial Sequence
  chemically synthesized
tctaatatatattctatata

SEQ ID NO: 361868 - DNA, 20 bp, Artificial Sequence
  chemically synthesized
ctctaatatatattctatat

SEQ ID NO: 361869 - DNA, 20 bp, Artificial Sequence
  chemically synthesized
tccttatatagaatatatat

SEQ ID NO: 361870 - DNA, 20 bp, Artificial Sequence
  chemically synthesized
cttatatagaatatatatta

SEQ ID NO: 361871 - DNA, 20 bp, Artificial Sequence
  chemically synthesized
ttatatagaatatatattag

SEQ ID NO: 361872 - DNA, 20 bp, Artificial Sequence
  chemically synthesized
tatatagaatatatattaga

SEQ ID NO: 361873 - DNA, 20 bp, Artificial Sequence
  chemically synthesized
tatattagagggcattgcct

SEQ ID NO: 361874 - DNA, 20 bp, Artificial Sequence
  chemically synthesized
gagggcattgcctgagtaaa

SEQ ID NO: 361875 - DNA, 20 bp, Artificial Sequence
  chemically synthesized
aggacagtgtccatttactc

SEQ ID NO: 361876 - DNA, 20 bp, Artificial Sequence
  chemically synthesized
gaggacagtgtccatttact

SEQ ID NO: 361877 - DNA, 20 bp, Artificial Sequence
  chemically synthesized
aattgtgaaagtattgagga

SEQ ID NO: 361878 - DNA, 20 bp, Artificial Sequence
  chemically synthesized
actaaattgtgaaagtattg

SEQ ID NO: 361879 - DNA, 20 bp, Artificial Sequence
  chemically synthesized
tactaaattgtgaaagtatt

SEQ ID NO: 361880 - DNA, 20 bp, Artificial Sequence
  chemically synthesized
tctttcatactaaattgtga

SEQ ID NO: 361881 - DNA, 20 bp, Artificial Sequence
  chemically synthesized
tcctcaatactttcacaatt

SEQ ID NO: 361882 - DNA, 20 bp, Artificial Sequence
  chemically synthesized
actttcacaatttagtatga

SEQ ID NO: 361883 - DNA, 20 bp, Artificial Sequence
  chemically synthesized
atgaaagatatatatacttt

SEQ ID NO: 361884 - DNA, 20 bp, Artificial Sequence
  chemically synthesized
caaattaaataatatactga

SEQ ID NO: 361885 - DNA, 20 bp, Artificial Sequence
  chemically synthesized
gtaattacgtatcttttatc

SEQ ID NO: 361886 - DNA, 20 bp, Artificial Sequence
  chemically synthesized
catcctatattgccagataa

SEQ ID NO: 361887 - DNA, 20 bp, Artificial Sequence
  chemically synthesized
gtatcttttatctggcaata

SEQ ID NO: 361888 - DNA, 20 bp, Artificial Sequence
  chemically synthesized
tatcttttatctggcaatat

SEQ ID NO: 361889 - DNA, 20 bp, Artificial Sequence
  chemically synthesized
aaagttacatcctatattgc

SEQ ID NO: 361890 - DNA, 20 bp, Artificial Sequence
  chemically synthesized
tgggttgatttttgtcgtta

SEQ ID NO: 361891 - DNA, 20 bp, Artificial Sequence
  chemically synthesized
acgacaaaaatcaacccata

SEQ ID NO: 361892 - DNA, 20 bp, Artificial Sequence
  chemically synthesized
ttaaaaagttggggctatat

SEQ ID NO: 361893 - DNA, 20 bp, Artificial Sequence
  chemically synthesized
cttaaaaagttggggctata

SEQ ID NO: 361894 - DNA, 20 bp, Artificial Sequence
  chemically synthesized
gacttgagcttaaaaagttg

SEQ ID NO: 361895 - DNA, 20 bp, Artificial Sequence
  chemically synthesized
tgacttgagcttaaaaagtt

SEQ ID NO: 361896 - DNA, 20 bp, Artificial Sequence
  chemically synthesized
ccatatagccccaacttttt

SEQ ID NO: 361897 - DNA, 20 bp, Artificial Sequence
  chemically synthesized
gtgacttgagcttaaaaagt

SEQ ID NO: 361898 - DNA, 20 bp, Artificial Sequence
  chemically synthesized
atacgtgacttgagcttaaa

SEQ ID NO: 361899 - DNA, 20 bp, Artificial Sequence
  chemically synthesized
agccccaactttttaagctc

SEQ ID NO: 361900 - DNA, 20 bp, Artificial Sequence
  chemically synthesized
gaaattagtatacgtgactt

SEQ ID NO: 361901 - DNA, 20 bp, Artificial Sequence
  chemically synthesized
aagtcacgtatactaatttc

SEQ ID NO: 361902 - DNA, 20 bp, Artificial Sequence
  chemically synthesized
tttttttttttacttgaaat

SEQ ID NO: 361903 - DNA, 20 bp, Artificial Sequence
  chemically synthesized
aagtaaaaaaaaaaaaaaaa

SEQ ID NO: 361904 - DNA, 20 bp, Artificial Sequence
  chemically synthesized
aaaaaaaaaaaaaaaagcaa

SEQ ID NO: 361905 - DNA, 20 bp, Artificial Sequence
  chemically synthesized
atcttttaagatttttattg

SEQ ID NO: 361906 - DNA, 20 bp, Artificial Sequence
  chemically synthesized
agctacaataaaaatcttaa

SEQ ID NO: 361907 - DNA, 20 bp, Artificial Sequence
  chemically synthesized
atgtcactcaagtatctttt

SEQ ID NO: 361908 - DNA, 20 bp, Artificial Sequence
  chemically synthesized
aaaaatcttaaaagatactt

SEQ ID NO: 361909 - DNA, 20 bp, Artificial Sequence
  chemically synthesized
tatttcttataatgtcactc

SEQ ID NO: 361910 - DNA, 20 bp, Artificial Sequence
  chemically synthesized
agatacttgagtgacattat

SEQ ID NO: 361911 - DNA, 20 bp, Artificial Sequence
  chemically synthesized
ttataagaaatatttttaaa

SEQ ID NO: 361912 - DNA, 20 bp, Artificial Sequence
  chemically synthesized
tttttaaacagtactattta

SEQ ID NO: 361913 - DNA, 20 bp, Artificial Sequence
  chemically synthesized
aataattatataactataaa

SEQ ID NO: 361914 - DNA, 20 bp, Artificial Sequence
  chemically synthesized
tagttatataattattatcc

SEQ ID NO: 361915 - DNA, 20 bp, Artificial Sequence
  chemically synthesized
ttatataattattatcccag

SEQ ID NO: 361916 - DNA, 20 bp, Artificial Sequence
  chemically synthesized
ttcacatatggaggtctgct

SEQ ID NO: 361917 - DNA, 20 bp, Artificial Sequence
  chemically synthesized
gttcacatatggaggtctgc

SEQ ID NO: 361918 - DNA, 20 bp, Artificial Sequence
  chemically synthesized
cctattatgttcacatatgg

SEQ ID NO: 361919 - DNA, 20 bp, Artificial Sequence
  chemically synthesized
acctattatgttcacatatg

SEQ ID NO: 361920 - DNA, 20 bp, Artificial Sequence
  chemically synthesized
ttacctattatgttcacata

SEQ ID NO: 361921 - DNA, 20 bp, Artificial Sequence
  chemically synthesized
acctccatatgtgaacataa

SEQ ID NO: 361922 - DNA, 20 bp, Artificial Sequence
  chemically synthesized
cctccatatgtgaacataat

SEQ ID NO: 361923 - DNA, 20 bp, Artificial Sequence
  chemically synthesized
atgtgaacataataggtaac

SEQ ID NO: 361924 - DNA, 20 bp, Artificial Sequence
  chemically synthesized
caacttcaaattgagatagc

SEQ ID NO: 361925 - DNA, 20 bp, Artificial Sequence
  chemically synthesized
tattcaacttcaaattgaga

SEQ ID NO: 361926 - DNA, 20 bp, Artificial Sequence
  chemically synthesized
taactggctatctcaatttg

SEQ ID NO: 361927 - DNA, 20 bp, Artificial Sequence
  chemically synthesized
tgtatattcaacttcaaatt

SEQ ID NO: 361928 - DNA, 20 bp, Artificial Sequence
  chemically synthesized
caatttgaagttgaatatac

SEQ ID NO: 361929 - DNA, 20 bp, Artificial Sequence
  chemically synthesized
cctcttgctttaagggaaat

SEQ ID NO: 361930 - DNA, 20 bp, Artificial Sequence
  chemically synthesized
gtcaatactaatttccctta

SEQ ID NO: 361931 - DNA, 20 bp, Artificial Sequence
  chemically synthesized
atactaatttcccttaaagc

SEQ ID NO: 361932 - DNA, 20 bp, Artificial Sequence
  chemically synthesized
tagtatacctcttgctttaa

SEQ ID NO: 361933 - DNA, 20 bp, Artificial Sequence
  chemically synthesized
ttagtatacctcttgcttta

SEQ ID NO: 361934 - DNA, 20 bp, Artificial Sequence
  chemically synthesized
actaatttcccttaaagcaa

SEQ ID NO: 361935 - DNA, 20 bp, Artificial Sequence
  chemically synthesized
cttagtatacctcttgcttt

SEQ ID NO: 361936 - DNA, 20 bp, Artificial Sequence
  chemically synthesized
ctaatttcccttaaagcaag

SEQ ID NO: 361937 - DNA, 20 bp, Artificial Sequence
  chemically synthesized
cttaaagcaagaggtatact

SEQ ID NO: 361938 - DNA, 20 bp, Artificial Sequence
  chemically synthesized
ttaaagcaagaggtatacta

SEQ ID NO: 361939 - DNA, 20 bp, Artificial Sequence
  chemically synthesized
taaagcaagaggtatactaa

SEQ ID NO: 361940 - DNA, 20 bp, Artificial Sequence
  chemically synthesized
aaagcaagaggtatactaag

SEQ ID NO: 361941 - DNA, 20 bp, Artificial Sequence
  chemically synthesized
aagcaagaggtatactaagg

SEQ ID NO: 361942 - DNA, 20 bp, Artificial Sequence
  chemically synthesized
aagaggtatactaaggggga

SEQ ID NO: 361943 - DNA, 20 bp, Artificial Sequence
  chemically synthesized
tttattcttcccatccccct

SEQ ID NO: 361944 - DNA, 20 bp, Artificial Sequence
  chemically synthesized
agaggtatactaagggggat

SEQ ID NO: 361945 - DNA, 20 bp, Artificial Sequence
  chemically synthesized
ggtatactaagggggatggg

SEQ ID NO: 361946 - DNA, 20 bp, Artificial Sequence
  chemically synthesized
ggaagaataaacaactcacc

SEQ ID NO: 361947 - DNA, 20 bp, Artificial Sequence
  chemically synthesized
tttaaaataattttctgggt

SEQ ID NO: 361948 - DNA, 20 bp, Artificial Sequence
  chemically synthesized
ctcatttaaaataattttct

SEQ ID NO: 361949 - DNA, 20 bp, Artificial Sequence
  chemically synthesized
tctcatttaaaataattttc

SEQ ID NO: 361950 - DNA, 20 bp, Artificial Sequence
  chemically synthesized
cccagaaaattattttaaat

SEQ ID NO: 361951 - DNA, 20 bp, Artificial Sequence
  chemically synthesized
atgagaacatgctgcaattt

SEQ ID NO: 361952 - DNA, 20 bp, Artificial Sequence
  chemically synthesized
atataactactcttaaattg

SEQ ID NO: 361953 - DNA, 20 bp, Artificial Sequence
  chemically synthesized
gagaacatgctgcaatttaa

SEQ ID NO: 361954 - DNA, 20 bp, Artificial Sequence
  chemically synthesized
aacatgctgcaatttaagag

SEQ ID NO: 361955 - DNA, 20 bp, Artificial Sequence
  chemically synthesized
taaactcacattcagttgca

SEQ ID NO: 361956 - DNA, 20 bp, Artificial Sequence
  chemically synthesized
ttaaactcacattcagttgc

SEQ ID NO: 361957 - DNA, 20 bp, Artificial Sequence
  chemically synthesized
attaccttgcaactgaatgt

SEQ ID NO: 361958 - DNA, 20 bp, Artificial Sequence
  chemically synthesized
gtattcattaaactcacatt

SEQ ID NO: 361959 - DNA, 20 bp, Artificial Sequence
  chemically synthesized
aatgtgagtttaatgaatac

SEQ ID NO: 361960 - DNA, 20 bp, Artificial Sequence
  chemically synthesized
atatttgtatcttccataac

SEQ ID NO: 361961 - DNA, 20 bp, Artificial Sequence
  chemically synthesized
tttcaaaatacttgttatgg

SEQ ID NO: 361962 - DNA, 20 bp, Artificial Sequence
  chemically synthesized
ttctttcaaaatacttgtta

SEQ ID NO: 361963 - DNA, 20 bp, Artificial Sequence
  chemically synthesized
ttccataacaagtattttga

SEQ ID NO: 361964 - DNA, 20 bp, Artificial Sequence
  chemically synthesized
cataacaagtattttgaaag

SEQ ID NO: 361965 - DNA, 20 bp, Artificial Sequence
  chemically synthesized
tcatctgcgaaatgcattaa

SEQ ID NO: 361966 - DNA, 20 bp, Artificial Sequence
  chemically synthesized
tttactattaatgcatttcg

SEQ ID NO: 361967 - DNA, 20 bp, Artificial Sequence
  chemically synthesized
aatgcatttcgcagatgata

SEQ ID NO: 361968 - DNA, 20 bp, Artificial Sequence
  chemically synthesized
catttcgcagatgataaagt

SEQ ID NO: 361969 - DNA, 20 bp, Artificial Sequence
  chemically synthesized
gcagatgataaagtgagtca

SEQ ID NO: 361970 - DNA, 20 bp, Artificial Sequence
  chemically synthesized
gataaagtgagtcaaagtca

SEQ ID NO: 361971 - DNA, 20 bp, Artificial Sequence
  chemically synthesized
gtcaaagtcacggaatcatt

SEQ ID NO: 361972 - DNA, 20 bp, Artificial Sequence
  chemically synthesized
agtcacggaatcatttggca

SEQ ID NO: 361973 - DNA, 20 bp, Artificial Sequence
  chemically synthesized
atcatttggcaaagacccta

SEQ ID NO: 361974 - DNA, 20 bp, Artificial Sequence
  chemically synthesized
tctgtaacttatcaactata

SEQ ID NO: 361975 - DNA, 20 bp, Artificial Sequence
  chemically synthesized
ctctgtaacttatcaactat

SEQ ID NO: 361976 - DNA, 20 bp, Artificial Sequence
  chemically synthesized
actctgtaacttatcaacta

SEQ ID NO: 361977 - DNA, 20 bp, Artificial Sequence
  chemically synthesized
gcaaagaccctatagttgat

SEQ ID NO: 361978 - DNA, 20 bp, Artificial Sequence
  chemically synthesized
accctatagttgataagtta

SEQ ID NO: 361979 - DNA, 20 bp, Artificial Sequence
  chemically synthesized
cctatagttgataagttaca

SEQ ID NO: 361980 - DNA, 20 bp, Artificial Sequence
  chemically synthesized
tgataagttacagagttaac

SEQ ID NO: 361981 - DNA, 20 bp, Artificial Sequence
  chemically synthesized
tctcaagtttgcagaagagg

SEQ ID NO: 361982 - DNA, 20 bp, Artificial Sequence
  chemically synthesized
aattctcaagtttgcagaag

SEQ ID NO: 361983 - DNA, 20 bp, Artificial Sequence
  chemically synthesized
taattctcaagtttgcagaa

SEQ ID NO: 361984 - DNA, 20 bp, Artificial Sequence
  chemically synthesized
attaattctcaagtttgcag

SEQ ID NO: 361985 - DNA, 20 bp, Artificial Sequence
  chemically synthesized
tctacctcttctgcaaactt

SEQ ID NO: 361986 - DNA, 20 bp, Artificial Sequence
  chemically synthesized
tgtattaattctcaagtttg

SEQ ID NO: 361987 - DNA, 20 bp, Artificial Sequence
  chemically synthesized
ctttatatgtattaattctc

SEQ ID NO: 361988 - DNA, 20 bp, Artificial Sequence
  chemically synthesized
cttgagaattaatacatata

SEQ ID NO: 361989 - DNA, 20 bp, Artificial Sequence
  chemically synthesized
tataaagtgcaaatatttta

SEQ ID NO: 361990 - DNA, 20 bp, Artificial Sequence
  chemically synthesized
ataaagtgcaaatattttac

SEQ ID NO: 361991 - DNA, 20 bp, Artificial Sequence
  chemically synthesized
tattttacaggcctattgtg

SEQ ID NO: 361992 - DNA, 20 bp, Artificial Sequence
  chemically synthesized
aaattgtcagtccacacaat

SEQ ID NO: 361993 - DNA, 20 bp, Artificial Sequence
  chemically synthesized
aaaattgtcagtccacacaa

SEQ ID NO: 361994 - DNA, 20 bp, Artificial Sequence
  chemically synthesized
tatttcttacacaaaattgt

SEQ ID NO: 361995 - DNA, 20 bp, Artificial Sequence
  chemically synthesized
gtggactgacaattttgtgt

SEQ ID NO: 361996 - DNA, 20 bp, Artificial Sequence
  chemically synthesized
ccaaatttaatttgttagac

SEQ ID NO: 361997 - DNA, 20 bp, Artificial Sequence
  chemically synthesized
aaattccaaatttaatttgt

SEQ ID NO: 361998 - DNA, 20 bp, Artificial Sequence
  chemically synthesized
cttgtctaacaaattaaatt

SEQ ID NO: 361999 - DNA, 20 bp, Artificial Sequence
  chemically synthesized
tggaatttgtacttaaatac

SEQ ID NO: 362000 - DNA, 20 bp, Artificial Sequence
  chemically synthesized
actcataaaatctagtattt

SEQ ID NO: 362001 - DNA, 20 bp, Artificial Sequence
  chemically synthesized
tatttattactcataaaatc

SEQ ID NO: 362002 - DNA, 20 bp, Artificial Sequence
  chemically synthesized
acttaaatactagattttat

SEQ ID NO: 362003 - DNA, 20 bp, Artificial Sequence
  chemically synthesized
tagattttatgagtaataaa

SEQ ID NO: 362004 - DNA, 20 bp, Artificial Sequence
  chemically synthesized
attttatgagtaataaatag

SEQ ID NO: 362005 - DNA, 20 bp, Artificial Sequence
  chemically synthesized
ttatgagtaataaatagaag

SEQ ID NO: 362006 - DNA, 20 bp, Artificial Sequence
  chemically synthesized
taataaatagaagtagttta

SEQ ID NO: 362007 - DNA, 20 bp, Artificial Sequence
  chemically synthesized
atacatattttggagcatgt

SEQ ID NO: 362008 - DNA, 20 bp, Artificial Sequence
  chemically synthesized
gccatataatacatattttg

SEQ ID NO: 362009 - DNA, 20 bp, Artificial Sequence
  chemically synthesized
tagccatataatacatattt

SEQ ID NO: 362010 - DNA, 20 bp, Artificial Sequence
  chemically synthesized
gctccaaaatatgtattata

SEQ ID NO: 362011 - DNA, 20 bp, Artificial Sequence
  chemically synthesized
tatgtattatatggctattt

SEQ ID NO: 362012 - DNA, 20 bp, Artificial Sequence
  chemically synthesized
taagtattcagaaacttaaa

SEQ ID NO: 362013 - DNA, 20 bp, Artificial Sequence
  chemically synthesized
ttatgtgtcctttaagtatt

SEQ ID NO: 362014 - DNA, 20 bp, Artificial Sequence
  chemically synthesized
tttaagtttctgaatactta

SEQ ID NO: 362015 - DNA, 20 bp, Artificial Sequence
  chemically synthesized
ttaagtttctgaatacttaa

SEQ ID NO: 362016 - DNA, 20 bp, Artificial Sequence
  chemically synthesized
tagtattttatgtgtccttt

SEQ ID NO: 362017 - DNA, 20 bp, Artificial Sequence
  chemically synthesized
ttaaaggacacataaaatac

SEQ ID NO: 362018 - DNA, 20 bp, Artificial Sequence
  chemically synthesized
cacataaaatactagtttta

SEQ ID NO: 362019 - DNA, 20 bp, Artificial Sequence
  chemically synthesized
tctaaaatgttctttaaaac

SEQ ID NO: 362020 - DNA, 20 bp, Artificial Sequence
  chemically synthesized
actagttttaaagaacattt

SEQ ID NO: 362021 - DNA, 20 bp, Artificial Sequence
  chemically synthesized
gcatataatgttagataaag

SEQ ID NO: 362022 - DNA, 20 bp, Artificial Sequence
  chemically synthesized
ggcatataatgttagataaa

SEQ ID NO: 362023 - DNA, 20 bp, Artificial Sequence
  chemically synthesized
ctggcatataatgttagata

SEQ ID NO: 362024 - DNA, 20 bp, Artificial Sequence
  chemically synthesized
cacatgctggcatataatgt

SEQ ID NO: 362025 - DNA, 20 bp, Artificial Sequence
  chemically synthesized
ctttatctaacattatatgc

SEQ ID NO: 362026 - DNA, 20 bp, Artificial Sequence
  chemically synthesized
atgatatactgttcacatgc

SEQ ID NO: 362027 - DNA, 20 bp, Artificial Sequence
  chemically synthesized
attatatgccagcatgtgaa

SEQ ID NO: 362028 - DNA, 20 bp, Artificial Sequence
  chemically synthesized
gtgaacagtatatcattttt

SEQ ID NO: 362029 - DNA, 20 bp, Artificial Sequence
  chemically synthesized
cagtatatcatttttcagat

SEQ ID NO: 362030 - DNA, 20 bp, Artificial Sequence
  chemically synthesized
gaattagattgaatggttgt

SEQ ID NO: 362031 - DNA, 20 bp, Artificial Sequence
  chemically synthesized
agtcactgaattagattgaa

SEQ ID NO: 362032 - DNA, 20 bp, Artificial Sequence
  chemically synthesized
gacaaccattcaatctaatt

SEQ ID NO: 362033 - DNA, 20 bp, Artificial Sequence
  chemically synthesized
attgaaaatagtcactgaat

SEQ ID NO: 362034 - DNA, 20 bp, Artificial Sequence
  chemically synthesized
cttaaccccatcattgaaaa

SEQ ID NO: 362035 - DNA, 20 bp, Artificial Sequence
  chemically synthesized
tcagtgactattttcaatga

SEQ ID NO: 362036 - DNA, 20 bp, Artificial Sequence
  chemically synthesized
cagtgactattttcaatgat

SEQ ID NO: 362037 - DNA, 20 bp, Artificial Sequence
  chemically synthesized
agtgactattttcaatgatg

SEQ ID NO: 362038 - DNA, 20 bp, Artificial Sequence
  chemically synthesized
ctattttcaatgatggggtt

SEQ ID NO: 362039 - DNA, 20 bp, Artificial Sequence
  chemically synthesized
gttaagtgaatatttgaaca

SEQ ID NO: 362040 - DNA, 20 bp, Artificial Sequence
  chemically synthesized
tagggtggaaattcagatga

SEQ ID NO: 362041 - DNA, 20 bp, Artificial Sequence
  chemically synthesized
aaaagcctagggtggaaatt

SEQ ID NO: 362042 - DNA, 20 bp, Artificial Sequence
  chemically synthesized
tgtcatctgaatttccaccc

SEQ ID NO: 362043 - DNA, 20 bp, Artificial Sequence
  chemically synthesized
gtcatctgaatttccaccct

SEQ ID NO: 362044 - DNA, 20 bp, Artificial Sequence
  chemically synthesized
agtatttaaaaagcctaggg

SEQ ID NO: 362045 - DNA, 20 bp, Artificial Sequence
  chemically synthesized
gtgagtatttaaaaagccta

SEQ ID NO: 362046 - DNA, 20 bp, Artificial Sequence
  chemically synthesized
ggtgagtatttaaaaagcct

SEQ ID NO: 362047 - DNA, 20 bp, Artificial Sequence
  chemically synthesized
aggtgagtatttaaaaagcc

SEQ ID NO: 362048 - DNA, 20 bp, Artificial Sequence
  chemically synthesized
atccaaggtgagtatttaaa

SEQ ID NO: 362049 - DNA, 20 bp, Artificial Sequence
  chemically synthesized
ggctttttaaatactcacct

SEQ ID NO: 362050 - DNA, 20 bp, Artificial Sequence
  chemically synthesized
ttaaatcacaaatccaaggt

SEQ ID NO: 362051 - DNA, 20 bp, Artificial Sequence
  chemically synthesized
tacattaaatcacaaatcca

SEQ ID NO: 362052 - DNA, 20 bp, Artificial Sequence
  chemically synthesized
atacattaaatcacaaatcc

SEQ ID NO: 362053 - DNA, 20 bp, Artificial Sequence
  chemically synthesized
tggatttgtgatttaatgta

SEQ ID NO: 362054 - DNA, 20 bp, Artificial Sequence
  chemically synthesized
gtgggatactacaaagcaaa

SEQ ID NO: 362055 - DNA, 20 bp, Artificial Sequence
  chemically synthesized
agcaatgactatttgctttg

SEQ ID NO: 362056 - DNA, 20 bp, Artificial Sequence
  chemically synthesized
ctacaatgtgggatactaca

SEQ ID NO: 362057 - DNA, 20 bp, Artificial Sequence
  chemically synthesized
ctttgtagtatcccacattg

SEQ ID NO: 362058 - DNA, 20 bp, Artificial Sequence
  chemically synthesized
taacttcaaatctacaatgt

SEQ ID NO: 362059 - DNA, 20 bp, Artificial Sequence
  chemically synthesized
gtaacttcaaatctacaatg

SEQ ID NO: 362060 - DNA, 20 bp, Artificial Sequence
  chemically synthesized
tatcccacattgtagatttg

SEQ ID NO: 362061 - DNA, 20 bp, Artificial Sequence
  chemically synthesized
attgtagatttgaagttact

SEQ ID NO: 362062 - DNA, 20 bp, Artificial Sequence
  chemically synthesized
caaggtggtaagtttttacc

SEQ ID NO: 362063 - DNA, 20 bp, Artificial Sequence
  chemically synthesized
attgtctatcacaaggtggt

SEQ ID NO: 362064 - DNA, 20 bp, Artificial Sequence
  chemically synthesized
atcaattgtctatcacaagg

SEQ ID NO: 362065 - DNA, 20 bp, Artificial Sequence
  chemically synthesized
aaaaacttaccaccttgtga

SEQ ID NO: 362066 - DNA, 20 bp, Artificial Sequence
  chemically synthesized
ctcatcaattgtctatcaca

SEQ ID NO: 362067 - DNA, 20 bp, Artificial Sequence
  chemically synthesized
gctcatcaattgtctatcac

SEQ ID NO: 362068 - DNA, 20 bp, Artificial Sequence
  chemically synthesized
ccttgtgatagacaattgat

SEQ ID NO: 362069 - DNA, 20 bp, Artificial Sequence
  chemically synthesized
gtgatagacaattgatgagc

SEQ ID NO: 362070 - DNA, 20 bp, Artificial Sequence
  chemically synthesized
aataattatgttcattgtac

SEQ ID NO: 362071 - DNA, 20 bp, Artificial Sequence
  chemically synthesized
ggtacaatgaacataattat

SEQ ID NO: 362072 - DNA, 20 bp, Artificial Sequence
  chemically synthesized
aatattaactgacacagttg

SEQ ID NO: 362073 - DNA, 20 bp, Artificial Sequence
  chemically synthesized
tattagatctacaactgtgt

SEQ ID NO: 362074 - DNA, 20 bp, Artificial Sequence
  chemically synthesized
taatttaatattaactgaca

SEQ ID NO: 362075 - DNA, 20 bp, Artificial Sequence
  chemically synthesized
agttaatattaaattatatt

SEQ ID NO: 362076 - DNA, 20 bp, Artificial Sequence
  chemically synthesized
aatattaaattatattaagt

SEQ ID NO: 362077 - DNA, 20 bp, Artificial Sequence
  chemically synthesized
taaattatattaagtcagcg

SEQ ID NO: 362078 - DNA, 20 bp, Artificial Sequence
  chemically synthesized
atattaagtcagcgaagtct

SEQ ID NO: 362079 - DNA, 20 bp, Artificial Sequence
  chemically synthesized
tataccctaggaacattacc

SEQ ID NO: 362080 - DNA, 20 bp, Artificial Sequence
  chemically synthesized
cgaagtcttggtaatgttcc

SEQ ID NO: 362081 - DNA, 20 bp, Artificial Sequence
  chemically synthesized
gaagtcttggtaatgttcct

SEQ ID NO: 362082 - DNA, 20 bp, Artificial Sequence
  chemically synthesized
aagtcttggtaatgttccta

SEQ ID NO: 362083 - DNA, 20 bp, Artificial Sequence
  chemically synthesized
atagtgttgaaatataccct

SEQ ID NO: 362084 - DNA, 20 bp, Artificial Sequence
  chemically synthesized
tatagtgttgaaatataccc

SEQ ID NO: 362085 - DNA, 20 bp, Artificial Sequence
  chemically synthesized
aaagattcatacaaaaggta

SEQ ID NO: 362086 - DNA, 20 bp, Artificial Sequence
  chemically synthesized
tttataaagattcatacaaa

SEQ ID NO: 362087 - DNA, 20 bp, Artificial Sequence
  chemically synthesized
ttttataaagattcatacaa

SEQ ID NO: 362088 - DNA, 20 bp, Artificial Sequence
  chemically synthesized
ttttgtatgaatctttataa

SEQ ID NO: 362089 - DNA, 20 bp, Artificial Sequence
  chemically synthesized
tttgtatgaatctttataaa

SEQ ID NO: 362090 - DNA, 20 bp, Artificial Sequence
  chemically synthesized
ttgtatgaatctttataaaa

SEQ ID NO: 362091 - DNA, 20 bp, Artificial Sequence
  chemically synthesized
gaattccgatcccttttata

SEQ ID NO: 362092 - DNA, 20 bp, Artificial Sequence
  chemically synthesized
tgaatctttataaaagggat

SEQ ID NO: 362093 - DNA, 20 bp, Artificial Sequence
  chemically synthesized
gatcggaattcataaaatgt

SEQ ID NO: 362094 - DNA, 20 bp, Artificial Sequence
  chemically synthesized
ggaattcataaaatgtaagc

SEQ ID NO: 362095 - DNA, 20 bp, Artificial Sequence
  chemically synthesized
gaattcataaaatgtaagca

SEQ ID NO: 362096 - DNA, 20 bp, Artificial Sequence
  chemically synthesized
aatgtaagcaaggaaatcat

SEQ ID NO: 362097 - DNA, 20 bp, Artificial Sequence
  chemically synthesized
tgtaagcaaggaaatcataa

SEQ ID NO: 362098 - DNA, 20 bp, Artificial Sequence
  chemically synthesized
gtaagcaaggaaatcataag

SEQ ID NO: 362099 - DNA, 20 bp, Artificial Sequence
  chemically synthesized
taagcaaggaaatcataaga

SEQ ID NO: 362100 - DNA, 20 bp, Artificial Sequence
  chemically synthesized
gcaaggaaatcataagaggg

SEQ ID NO: 362101 - DNA, 20 bp, Artificial Sequence
  chemically synthesized
gaaatcataagagggaagac

SEQ ID NO: 362102 - DNA, 20 bp, Artificial Sequence
  chemically synthesized
aaatcataagagggaagacg

SEQ ID NO: 362103 - DNA, 20 bp, Artificial Sequence
  chemically synthesized
aagagggaagacgaggacac

SEQ ID NO: 362104 - DNA, 20 bp, Artificial Sequence
  chemically synthesized
ggaagacgaggacacaagct

SEQ ID NO: 362105 - DNA, 20 bp, Artificial Sequence
  chemically synthesized
aagacgaggacacaagcttg

SEQ ID NO: 362106 - DNA, 20 bp, Artificial Sequence
  chemically synthesized
cgaggacacaagcttggaga

SEQ ID NO: 362107 - DNA, 20 bp, Artificial Sequence
  chemically synthesized
gaggacacaagcttggagaa

SEQ ID NO: 362108 - DNA, 20 bp, Artificial Sequence
  chemically synthesized
tgatctgtcttcctttctcc

SEQ ID NO: 362109 - DNA, 20 bp, Artificial Sequence
  chemically synthesized
gacacaagcttggagaaagg

SEQ ID NO: 362110 - DNA, 20 bp, Artificial Sequence
  chemically synthesized
caagcttggagaaaggaaga

SEQ ID NO: 362111 - DNA, 20 bp, Artificial Sequence
  chemically synthesized
agacagatcataatacatct

SEQ ID NO: 362112 - DNA, 20 bp, Artificial Sequence
  chemically synthesized
gacagatcataatacatctt

SEQ ID NO: 362113 - DNA, 20 bp, Artificial Sequence
  chemically synthesized
acagatcataatacatcttg

SEQ ID NO: 362114 - DNA, 20 bp, Artificial Sequence
  chemically synthesized
agatcataatacatcttggg

SEQ ID NO: 362115 - DNA, 20 bp, Artificial Sequence
  chemically synthesized
tcataatacatcttggggag

SEQ ID NO: 362116 - DNA, 20 bp, Artificial Sequence
  chemically synthesized
cataatacatcttggggagc

SEQ ID NO: 362117 - DNA, 20 bp, Artificial Sequence
  chemically synthesized
taaactaccccccgctcccc

SEQ ID NO: 362118 - DNA, 20 bp, Artificial Sequence
  chemically synthesized
ataatacatcttggggagcg

SEQ ID NO: 362119 - DNA, 20 bp, Artificial Sequence
  chemically synthesized
taatacatcttggggagcgg

SEQ ID NO: 362120 - DNA, 20 bp, Artificial Sequence
  chemically synthesized
aatacatcttggggagcggg

SEQ ID NO: 362121 - DNA, 20 bp, Artificial Sequence
  chemically synthesized
acatcttggggagcgggggg

SEQ ID NO: 362122 - DNA, 20 bp, Artificial Sequence
  chemically synthesized
ggggagcggggggtagttta

SEQ ID NO: 362123 - DNA, 20 bp, Artificial Sequence
  chemically synthesized
gggggtagtttaaagcacca

SEQ ID NO: 362124 - DNA, 20 bp, Artificial Sequence
  chemically synthesized
atttgatagagatttaactg

SEQ ID NO: 362125 - DNA, 20 bp, Artificial Sequence
  chemically synthesized
tagaaattacaaatttgata

SEQ ID NO: 362126 - DNA, 20 bp, Artificial Sequence
  chemically synthesized
cttagaaattacaaatttga

SEQ ID NO: 362127 - DNA, 20 bp, Artificial Sequence
  chemically synthesized
ctatcaaatttgtaatttct

SEQ ID NO: 362128 - DNA, 20 bp, Artificial Sequence
  chemically synthesized
ttttgtctggtaaaggaact

SEQ ID NO: 362129 - DNA, 20 bp, Artificial Sequence
  chemically synthesized
taatttctaagttcctttac

SEQ ID NO: 362130 - DNA, 20 bp, Artificial Sequence
  chemically synthesized
attaattttttgtctggtaa

SEQ ID NO: 362131 - DNA, 20 bp, Artificial Sequence
  chemically synthesized
gattaattttttgtctggta

SEQ ID NO: 362132 - DNA, 20 bp, Artificial Sequence
  chemically synthesized
ttaatgattaattttttgtc

SEQ ID NO: 362133 - DNA, 20 bp, Artificial Sequence
  chemically synthesized
caaaaaattaatcattaaac

SEQ ID NO: 362134 - DNA, 20 bp, Artificial Sequence
  chemically synthesized
acttttaataattttgtgtc

SEQ ID NO: 362135 - DNA, 20 bp, Artificial Sequence
  chemically synthesized
actagacacaaaattattaa

SEQ ID NO: 362136 - DNA, 20 bp, Artificial Sequence
  chemically synthesized
ttaaaagtgcaaatatctaa

SEQ ID NO: 362137 - DNA, 20 bp, Artificial Sequence
  chemically synthesized
aaaagtgcaaatatctaata

SEQ ID NO: 362138 - DNA, 20 bp, Artificial Sequence
  chemically synthesized
aatcagtgagtattctctat

SEQ ID NO: 362139 - DNA, 20 bp, Artificial Sequence
  chemically synthesized
aatagagaatactcactgat

SEQ ID NO: 362140 - DNA, 20 bp, Artificial Sequence
  chemically synthesized
ataactaagttctaatcagt

SEQ ID NO: 362141 - DNA, 20 bp, Artificial Sequence
  chemically synthesized
ggatataactaagttctaat

SEQ ID NO: 362142 - DNA, 20 bp, Artificial Sequence
  chemically synthesized
aatactcactgattagaact

SEQ ID NO: 362143 - DNA, 20 bp, Artificial Sequence
  chemically synthesized
aactttccttggatataact

SEQ ID NO: 362144 - DNA, 20 bp, Artificial Sequence
  chemically synthesized
attagaacttagttatatcc

SEQ ID NO: 362145 - DNA, 20 bp, Artificial Sequence
  chemically synthesized
ttagaacttagttatatcca

SEQ ID NO: 362146 - DNA, 20 bp, Artificial Sequence
  chemically synthesized
aacttagttatatccaagga

SEQ ID NO: 362147 - DNA, 20 bp, Artificial Sequence
  chemically synthesized
tgggtaatttaaactttcct

SEQ ID NO: 362148 - DNA, 20 bp, Artificial Sequence
  chemically synthesized
ttctctcaaagatatttaat

SEQ ID NO: 362149 - DNA, 20 bp, Artificial Sequence
  chemically synthesized
attctctcaaagatatttaa

SEQ ID NO: 362150 - DNA, 20 bp, Artificial Sequence
  chemically synthesized
attacccattaaatatcttt

SEQ ID NO: 362151 - DNA, 20 bp, Artificial Sequence
  chemically synthesized
tacccattaaatatctttga

SEQ ID NO: 362152 - DNA, 20 bp, Artificial Sequence
  chemically synthesized
cacttaactctattctctca

SEQ ID NO: 362153 - DNA, 20 bp, Artificial Sequence
  chemically synthesized
attaaatatctttgagagaa

SEQ ID NO: 362154 - DNA, 20 bp, Artificial Sequence
  chemically synthesized
taaatatctttgagagaata

SEQ ID NO: 362155 - DNA, 20 bp, Artificial Sequence
  chemically synthesized
atctttgagagaatagagtt

SEQ ID NO: 362156 - DNA, 20 bp, Artificial Sequence
  chemically synthesized
tgagagaatagagttaagtg

SEQ ID NO: 362157 - DNA, 20 bp, Artificial Sequence
  chemically synthesized
ttcattaggcattttaaatt

SEQ ID NO: 362158 - DNA, 20 bp, Artificial Sequence
  chemically synthesized
gaatttaaaatgcctaatga

SEQ ID NO: 362159 - DNA, 20 bp, Artificial Sequence
  chemically synthesized
aatttaaaatgcctaatgaa

SEQ ID NO: 362160 - DNA, 20 bp, Artificial Sequence
  chemically synthesized
tgtaagtagtgcctttcatt

SEQ ID NO: 362161 - DNA, 20 bp, Artificial Sequence
  chemically synthesized
ttgtaagtagtgcctttcat

SEQ ID NO: 362162 - DNA, 20 bp, Artificial Sequence
  chemically synthesized
gtcccacttttgtttgtaag

SEQ ID NO: 362163 - DNA, 20 bp, Artificial Sequence
  chemically synthesized
cctgtcccacttttgtttgt

SEQ ID NO: 362164 - DNA, 20 bp, Artificial Sequence
  chemically synthesized
aaggcactacttacaaacaa

SEQ ID NO: 362165 - DNA, 20 bp, Artificial Sequence
  chemically synthesized
gcactacttacaaacaaaag

SEQ ID NO: 362166 - DNA, 20 bp, Artificial Sequence
  chemically synthesized
cactacttacaaacaaaagt

SEQ ID NO: 362167 - DNA, 20 bp, Artificial Sequence
  chemically synthesized
acttacaaacaaaagtggga

SEQ ID NO: 362168 - DNA, 20 bp, Artificial Sequence
  chemically synthesized
cttacaaacaaaagtgggac

SEQ ID NO: 362169 - DNA, 20 bp, Artificial Sequence
  chemically synthesized
ttacaaacaaaagtgggaca

SEQ ID NO: 362170 - DNA, 20 bp, Artificial Sequence
  chemically synthesized
aacaaaagtgggacagggca

SEQ ID NO: 362171 - DNA, 20 bp, Artificial Sequence
  chemically synthesized
gggacagggcaaagaaataa

SEQ ID NO: 362172 - DNA, 20 bp, Artificial Sequence
  chemically synthesized
agggcaaagaaataatagaa

SEQ ID NO: 362173 - DNA, 20 bp, Artificial Sequence
  chemically synthesized
aaataatagaatggctgtat

SEQ ID NO: 362174 - DNA, 20 bp, Artificial Sequence
  chemically synthesized
ataatagaatggctgtataa

SEQ ID NO: 362175 - DNA, 20 bp, Artificial Sequence
  chemically synthesized
aggatgaaacatctcttata

SEQ ID NO: 362176 - DNA, 20 bp, Artificial Sequence
  chemically synthesized
gtataagagatgtttcatcc

SEQ ID NO: 362177 - DNA, 20 bp, Artificial Sequence
  chemically synthesized
aagagatgtttcatcctagc

SEQ ID NO: 362178 - DNA, 20 bp, Artificial Sequence
  chemically synthesized
agagatgtttcatcctagct

SEQ ID NO: 362179 - DNA, 20 bp, Artificial Sequence
  chemically synthesized
aggtaaagcaaatcccagct

SEQ ID NO: 362180 - DNA, 20 bp, Artificial Sequence
  chemically synthesized
aaggtaaagcaaatcccagc

SEQ ID NO: 362181 - DNA, 20 bp, Artificial Sequence
  chemically synthesized
tttgaaggtaaagcaaatcc

SEQ ID NO: 362182 - DNA, 20 bp, Artificial Sequence
  chemically synthesized
tttacaagtttttgaaggta

SEQ ID NO: 362183 - DNA, 20 bp, Artificial Sequence
  chemically synthesized
ttttatttacaagtttttga

SEQ ID NO: 362184 - DNA, 20 bp, Artificial Sequence
  chemically synthesized
tttttatttacaagtttttg

SEQ ID NO: 362185 - DNA, 20 bp, Artificial Sequence
  chemically synthesized
cacagcttctttttatttac

SEQ ID NO: 362186 - DNA, 20 bp, Artificial Sequence
  chemically synthesized
ttcaaaaacttgtaaataaa

SEQ ID NO: 362187 - DNA, 20 bp, Artificial Sequence
  chemically synthesized
aaaaacttgtaaataaaaag

SEQ ID NO: 362188 - DNA, 20 bp, Artificial Sequence
  chemically synthesized
ttgtaaataaaaagaagctg

SEQ ID NO: 362189 - DNA, 20 bp, Artificial Sequence
  chemically synthesized
tctaggtaaaaatgtatcca

SEQ ID NO: 362190 - DNA, 20 bp, Artificial Sequence
  chemically synthesized
gctgtggatacatttttacc

SEQ ID NO: 362191 - DNA, 20 bp, Artificial Sequence
  chemically synthesized
tgtggatacatttttaccta

SEQ ID NO: 362192 - DNA, 20 bp, Artificial Sequence
  chemically synthesized
cttgtctctacatcagctct

SEQ ID NO: 362193 - DNA, 20 bp, Artificial Sequence
  chemically synthesized
tcttgtctctacatcagctc

SEQ ID NO: 362194 - DNA, 20 bp, Artificial Sequence
  chemically synthesized
atttttacctagagctgatg

SEQ ID NO: 362195 - DNA, 20 bp, Artificial Sequence
  chemically synthesized
ttttacctagagctgatgta

SEQ ID NO: 362196 - DNA, 20 bp, Artificial Sequence
  chemically synthesized
ggttattcttgtctctacat

SEQ ID NO: 362197 - DNA, 20 bp, Artificial Sequence
  chemically synthesized
cctagagctgatgtagagac

SEQ ID NO: 362198 - DNA, 20 bp, Artificial Sequence
  chemically synthesized
tagagacaagaataaccact

SEQ ID NO: 362199 - DNA, 20 bp, Artificial Sequence
  chemically synthesized
agacaagaataaccacttag

SEQ ID NO: 362200 - DNA, 20 bp, Artificial Sequence
  chemically synthesized
tgggagactatgctactaag

SEQ ID NO: 362201 - DNA, 20 bp, Artificial Sequence
  chemically synthesized
agaataaccacttagtagca

SEQ ID NO: 362202 - DNA, 20 bp, Artificial Sequence
  chemically synthesized
aaatgggagactatgctact

SEQ ID NO: 362203 - DNA, 20 bp, Artificial Sequence
  chemically synthesized
tacaaaatcctgagaaatgg

SEQ ID NO: 362204 - DNA, 20 bp, Artificial Sequence
  chemically synthesized
tagcatagtctcccatttct

SEQ ID NO: 362205 - DNA, 20 bp, Artificial Sequence
  chemically synthesized
agcatagtctcccatttctc

SEQ ID NO: 362206 - DNA, 20 bp, Artificial Sequence
  chemically synthesized
aatacaaaatcctgagaaat

SEQ ID NO: 362207 - DNA, 20 bp, Artificial Sequence
  chemically synthesized
aaatacaaaatcctgagaaa

SEQ ID NO: 362208 - DNA, 20 bp, Artificial Sequence
  chemically synthesized
cgaacaaaatacaaaatcct

SEQ ID NO: 362209 - DNA, 20 bp, Artificial Sequence
  chemically synthesized
tagttggttgtgattttaaa

SEQ ID NO: 362210 - DNA, 20 bp, Artificial Sequence
  chemically synthesized
caaagctcatttgtaatagt

SEQ ID NO: 362211 - DNA, 20 bp, Artificial Sequence
  chemically synthesized
agagcaaagctcatttgtaa

SEQ ID NO: 362212 - DNA, 20 bp, Artificial Sequence
  chemically synthesized
cacaaccaactattacaaat

SEQ ID NO: 362213 - DNA, 20 bp, Artificial Sequence
  chemically synthesized
ttacaaatgagctttgctct

SEQ ID NO: 362214 - DNA, 20 bp, Artificial Sequence
  chemically synthesized
tgcggtatttgctgagagca

SEQ ID NO: 362215 - DNA, 20 bp, Artificial Sequence
  chemically synthesized
tttattgcggtatttgctga

SEQ ID NO: 362216 - DNA, 20 bp, Artificial Sequence
  chemically synthesized
actttattgcggtatttgct

SEQ ID NO: 362217 - DNA, 20 bp, Artificial Sequence
  chemically synthesized
tctcagcaaataccgcaata

SEQ ID NO: 362218 - DNA, 20 bp, Artificial Sequence
  chemically synthesized
gtgcagtgataactttattg

SEQ ID NO: 362219 - DNA, 20 bp, Artificial Sequence
  chemically synthesized
aataaagttatcactgcact

SEQ ID NO: 362220 - DNA, 20 bp, Artificial Sequence
  chemically synthesized
aaagttatcactgcacttag

SEQ ID NO: 362221 - DNA, 20 bp, Artificial Sequence
  chemically synthesized
gaagaaagtacttctaagtg

SEQ ID NO: 362222 - DNA, 20 bp, Artificial Sequence
  chemically synthesized
attgagaagaaagtacttct

SEQ ID NO: 362223 - DNA, 20 bp, Artificial Sequence
  chemically synthesized
aaagccacttattgagaaga

SEQ ID NO: 362224 - DNA, 20 bp, Artificial Sequence
  chemically synthesized
agaagtactttcttctcaat

SEQ ID NO: 362225 - DNA, 20 bp, Artificial Sequence
  chemically synthesized
ttggaaagccacttattgag

SEQ ID NO: 362226 - DNA, 20 bp, Artificial Sequence
  chemically synthesized
agtactttcttctcaataag

SEQ ID NO: 362227 - DNA, 20 bp, Artificial Sequence
  chemically synthesized
attttggaaagccacttatt

SEQ ID NO: 362228 - DNA, 20 bp, Artificial Sequence
  chemically synthesized
tgtcaataatgtattttgga

SEQ ID NO: 362229 - DNA, 20 bp, Artificial Sequence
  chemically synthesized
ctgctgtcaataatgtattt

SEQ ID NO: 362230 - DNA, 20 bp, Artificial Sequence
  chemically synthesized
tttccaaaatacattattga

SEQ ID NO: 362231 - DNA, 20 bp, Artificial Sequence
  chemically synthesized
ccaaaatacattattgacag

SEQ ID NO: 362232 - DNA, 20 bp, Artificial Sequence
  chemically synthesized
caaaatacattattgacagc

SEQ ID NO: 362233 - DNA, 20 bp, Artificial Sequence
  chemically synthesized
aaaatacattattgacagca

SEQ ID NO: 362234 - DNA, 20 bp, Artificial Sequence
  chemically synthesized
gtggtggctgttttagcatg

SEQ ID NO: 362235 - DNA, 20 bp, Artificial Sequence
  chemically synthesized
gggataacttcatgctaaaa

SEQ ID NO: 362236 - DNA, 20 bp, Artificial Sequence
  chemically synthesized
attctttgtggtggctgttt

SEQ ID NO: 362237 - DNA, 20 bp, Artificial Sequence
  chemically synthesized
atgctaaaacagccaccaca

SEQ ID NO: 362238 - DNA, 20 bp, Artificial Sequence
  chemically synthesized
ccaatttgcattctttgtgg

SEQ ID NO: 362239 - DNA, 20 bp, Artificial Sequence
  chemically synthesized
gttccaatttgcattctttg

SEQ ID NO: 362240 - DNA, 20 bp, Artificial Sequence
  chemically synthesized
ccaccacaaagaatgcaaat

SEQ ID NO: 362241 - DNA, 20 bp, Artificial Sequence
  chemically synthesized
aaagaatgcaaattggaaca

SEQ ID NO: 362242 - DNA, 20 bp, Artificial Sequence
  chemically synthesized
tgcaaattggaacacagacg

SEQ ID NO: 362243 - DNA, 20 bp, Artificial Sequence
  chemically synthesized
ggaacacagacgtagtgtct

SEQ ID NO: 362244 - DNA, 20 bp, Artificial Sequence
  chemically synthesized
gacgtagtgtctgagctcta

SEQ ID NO: 362245 - DNA, 20 bp, Artificial Sequence
  chemically synthesized
cagcttatatctgtagagct

SEQ ID NO: 362246 - DNA, 20 bp, Artificial Sequence
  chemically synthesized
ccactcagcttatatctgta

SEQ ID NO: 362247 - DNA, 20 bp, Artificial Sequence
  chemically synthesized
tgtctgagctctacagatat

SEQ ID NO: 362248 - DNA, 20 bp, Artificial Sequence
  chemically synthesized
tgccactcagcttatatctg

SEQ ID NO: 362249 - DNA, 20 bp, Artificial Sequence
  chemically synthesized
gagctctacagatataagct

SEQ ID NO: 362250 - DNA, 20 bp, Artificial Sequence
  chemically synthesized
ctctacagatataagctgag

SEQ ID NO: 362251 - DNA, 20 bp, Artificial Sequence
  chemically synthesized
atcctcacttgaatgccact

SEQ ID NO: 362252 - DNA, 20 bp, Artificial Sequence
  chemically synthesized
atataagctgagtggcattc

SEQ ID NO: 362253 - DNA, 20 bp, Artificial Sequence
  chemically synthesized
aagctgagtggcattcaagt

SEQ ID NO: 362254 - DNA, 20 bp, Artificial Sequence
  chemically synthesized
agctgagtggcattcaagtg

SEQ ID NO: 362255 - DNA, 20 bp, Artificial Sequence
  chemically synthesized
tggcattcaagtgaggataa

SEQ ID NO: 362256 - DNA, 20 bp, Artificial Sequence
  chemically synthesized
ggcattcaagtgaggataac

SEQ ID NO: 362257 - DNA, 20 bp, Artificial Sequence
  chemically synthesized
gaggataacaggttaaacgc

SEQ ID NO: 362258 - DNA, 20 bp, Artificial Sequence
  chemically synthesized
aggataacaggttaaacgcc

SEQ ID NO: 362259 - DNA, 20 bp, Artificial Sequence
  chemically synthesized
taacaggttaaacgccagga

SEQ ID NO: 362260 - DNA, 20 bp, Artificial Sequence
  chemically synthesized
aacaggttaaacgccaggac

SEQ ID NO: 362261 - DNA, 20 bp, Artificial Sequence
  chemically synthesized
acaggttaaacgccaggaca

SEQ ID NO: 362262 - DNA, 20 bp, Artificial Sequence
  chemically synthesized
tttctttcctttccctgtcc

SEQ ID NO: 362263 - DNA, 20 bp, Artificial Sequence
  chemically synthesized
gttaaacgccaggacaggga

SEQ ID NO: 362264 - DNA, 20 bp, Artificial Sequence
  chemically synthesized
ttaaacgccaggacagggaa

SEQ ID NO: 362265 - DNA, 20 bp, Artificial Sequence
  chemically synthesized
acgccaggacagggaaagga

SEQ ID NO: 362266 - DNA, 20 bp, Artificial Sequence
  chemically synthesized
acagggaaaggaaagaaact

SEQ ID NO: 362267 - DNA, 20 bp, Artificial Sequence
  chemically synthesized
cagggaaaggaaagaaactg

SEQ ID NO: 362268 - DNA, 20 bp, Artificial Sequence
  chemically synthesized
aaaggaaagaaactgaggaa

SEQ ID NO: 362269 - DNA, 20 bp, Artificial Sequence
  chemically synthesized
aaggaaagaaactgaggaac

SEQ ID NO: 362270 - DNA, 20 bp, Artificial Sequence
  chemically synthesized
aggaaagaaactgaggaaca

SEQ ID NO: 362271 - DNA, 20 bp, Artificial Sequence
  chemically synthesized
ctcagtttaaccctgttcct

SEQ ID NO: 362272 - DNA, 20 bp, Artificial Sequence
  chemically synthesized
ctgaggaacagggttaaact

SEQ ID NO: 362273 - DNA, 20 bp, Artificial Sequence
  chemically synthesized
tgaggaacagggttaaactg

SEQ ID NO: 362274 - DNA, 20 bp, Artificial Sequence
  chemically synthesized
aggaacagggttaaactgag

SEQ ID NO: 362275 - DNA, 20 bp, Artificial Sequence
  chemically synthesized
acagggttaaactgaggagc

SEQ ID NO: 362276 - DNA, 20 bp, Artificial Sequence
  chemically synthesized
gtagttctaaactagctcct

SEQ ID NO: 362277 - DNA, 20 bp, Artificial Sequence
  chemically synthesized
gttaaactgaggagctagtt

SEQ ID NO: 362278 - DNA, 20 bp, Artificial Sequence
  chemically synthesized
catattctgtagttctaaac

SEQ ID NO: 362279 - DNA, 20 bp, Artificial Sequence
  chemically synthesized
gaggagctagtttagaacta

SEQ ID NO: 362280 - DNA, 20 bp, Artificial Sequence
  chemically synthesized
actagttctagcatattctg

SEQ ID NO: 362281 - DNA, 20 bp, Artificial Sequence
  chemically synthesized
tttagaactacagaatatgc

SEQ ID NO: 362282 - DNA, 20 bp, Artificial Sequence
  chemically synthesized
actacagaatatgctagaac

SEQ ID NO: 362283 - DNA, 20 bp, Artificial Sequence
  chemically synthesized
ctgccataaatcactagttc

SEQ ID NO: 362284 - DNA, 20 bp, Artificial Sequence
  chemically synthesized
gtccctctgccataaatcac

SEQ ID NO: 362285 - DNA, 20 bp, Artificial Sequence
  chemically synthesized
atgctagaactagtgattta

SEQ ID NO: 362286 - DNA, 20 bp, Artificial Sequence
  chemically synthesized
ctagaactagtgatttatgg

SEQ ID NO: 362287 - DNA, 20 bp, Artificial Sequence
  chemically synthesized
agaactagtgatttatggca

SEQ ID NO: 362288 - DNA, 20 bp, Artificial Sequence
  chemically synthesized
gaactagtgatttatggcag

SEQ ID NO: 362289 - DNA, 20 bp, Artificial Sequence
  chemically synthesized
aactagtgatttatggcaga

SEQ ID NO: 362290 - DNA, 20 bp, Artificial Sequence
  chemically synthesized
agtgatttatggcagaggga

SEQ ID NO: 362291 - DNA, 20 bp, Artificial Sequence
  chemically synthesized
gtgatttatggcagagggac

SEQ ID NO: 362292 - DNA, 20 bp, Artificial Sequence
  chemically synthesized
ggcagagggacaggctaaaa

SEQ ID NO: 362293 - DNA, 20 bp, Artificial Sequence
  chemically synthesized
cagagggacaggctaaaatg

SEQ ID NO: 362294 - DNA, 20 bp, Artificial Sequence
  chemically synthesized
agagggacaggctaaaatgg

SEQ ID NO: 362295 - DNA, 20 bp, Artificial Sequence
  chemically synthesized
ccttagggtctcctccattt

SEQ ID NO: 362296 - DNA, 20 bp, Artificial Sequence
  chemically synthesized
agggacaggctaaaatggag

SEQ ID NO: 362297 - DNA, 20 bp, Artificial Sequence
  chemically synthesized
gctaaaatggaggagaccct

SEQ ID NO: 362298 - DNA, 20 bp, Artificial Sequence
  chemically synthesized
ctaaaatggaggagacccta

SEQ ID NO: 362299 - DNA, 20 bp, Artificial Sequence
  chemically synthesized
atggaggagaccctaaggaa

SEQ ID NO: 362300 - DNA, 20 bp, Artificial Sequence
  chemically synthesized
tgtcttctctcttttcctta

SEQ ID NO: 362301 - DNA, 20 bp, Artificial Sequence
  chemically synthesized
ttgtcttctctcttttcctt

SEQ ID NO: 362302 - DNA, 20 bp, Artificial Sequence
  chemically synthesized
ggaggagaccctaaggaaaa

SEQ ID NO: 362303 - DNA, 20 bp, Artificial Sequence
  chemically synthesized
tttgtcttctctcttttcct

SEQ ID NO: 362304 - DNA, 20 bp, Artificial Sequence
  chemically synthesized
aggagaccctaaggaaaaga

SEQ ID NO: 362305 - DNA, 20 bp, Artificial Sequence
  chemically synthesized
agaccctaaggaaaagagag

SEQ ID NO: 362306 - DNA, 20 bp, Artificial Sequence
  chemically synthesized
atttctggatcattaagtca

SEQ ID NO: 362307 - DNA, 20 bp, Artificial Sequence
  chemically synthesized
aatttctggatcattaagtc

SEQ ID NO: 362308 - DNA, 20 bp, Artificial Sequence
  chemically synthesized
atgaccttgacttaatgatc

SEQ ID NO: 362309 - DNA, 20 bp, Artificial Sequence
  chemically synthesized
ttggtaatttctggatcatt

SEQ ID NO: 362310 - DNA, 20 bp, Artificial Sequence
  chemically synthesized
tgatactttttggtaatttc

SEQ ID NO: 362311 - DNA, 20 bp, Artificial Sequence
  chemically synthesized
atgatccagaaattaccaaa

SEQ ID NO: 362312 - DNA, 20 bp, Artificial Sequence
  chemically synthesized
cttttcaaaatgatactttt

SEQ ID NO: 362313 - DNA, 20 bp, Artificial Sequence
  chemically synthesized
ccaaaaagtatcattttgaa

SEQ ID NO: 362314 - DNA, 20 bp, Artificial Sequence
  chemically synthesized
gatttttaaaggaatattag

SEQ ID NO: 362315 - DNA, 20 bp, Artificial Sequence
  chemically synthesized
tctgatttttaaaggaatat

SEQ ID NO: 362316 - DNA, 20 bp, Artificial Sequence
  chemically synthesized
tttagccctctgatttttaa

SEQ ID NO: 362317 - DNA, 20 bp, Artificial Sequence
  chemically synthesized
tctaatattcctttaaaaat

SEQ ID NO: 362318 - DNA, 20 bp, Artificial Sequence
  chemically synthesized
atttagccctctgattttta

SEQ ID NO: 362319 - DNA, 20 bp, Artificial Sequence
  chemically synthesized
taatattcctttaaaaatca

SEQ ID NO: 362320 - DNA, 20 bp, Artificial Sequence
  chemically synthesized
aatattcctttaaaaatcag

SEQ ID NO: 362321 - DNA, 20 bp, Artificial Sequence
  chemically synthesized
atattcctttaaaaatcaga

SEQ ID NO: 362322 - DNA, 20 bp, Artificial Sequence
  chemically synthesized
aaatcagagggctaaatttt

SEQ ID NO: 362323 - DNA, 20 bp, Artificial Sequence
  chemically synthesized
taaaaaaatcactcaaaatt

SEQ ID NO: 362324 - DNA, 20 bp, Artificial Sequence
  chemically synthesized
tttgagtgatttttttaaac

SEQ ID NO: 362325 - DNA, 20 bp, Artificial Sequence
  chemically synthesized
ttgagtgatttttttaaacc

SEQ ID NO: 362326 - DNA, 20 bp, Artificial Sequence
  chemically synthesized
tgagtgatttttttaaacca

SEQ ID NO: 362327 - DNA, 20 bp, Artificial Sequence
  chemically synthesized
aaacctatgaaaagaaaccc

SEQ ID NO: 362328 - DNA, 20 bp, Artificial Sequence
  chemically synthesized
taaaccagggtttcttttca

SEQ ID NO: 362329 - DNA, 20 bp, Artificial Sequence
  chemically synthesized
aaaccagggtttcttttcat

SEQ ID NO: 362330 - DNA, 20 bp, Artificial Sequence
  chemically synthesized
taattctataaacctatgaa

SEQ ID NO: 362331 - DNA, 20 bp, Artificial Sequence
  chemically synthesized
ggtttcttttcataggttta

SEQ ID NO: 362332 - DNA, 20 bp, Artificial Sequence
  chemically synthesized
ttttcataggtttatagaat

SEQ ID NO: 362333 - DNA, 20 bp, Artificial Sequence
  chemically synthesized
tttcataggtttatagaatt

SEQ ID NO: 362334 - DNA, 20 bp, Artificial Sequence
  chemically synthesized
tcataggtttatagaattag

SEQ ID NO: 362335 - DNA, 20 bp, Artificial Sequence
  chemically synthesized
cataggtttatagaattagg

SEQ ID NO: 362336 - DNA, 20 bp, Artificial Sequence
  chemically synthesized
ctaatagaaaatcatatgaa

SEQ ID NO: 362337 - DNA, 20 bp, Artificial Sequence
  chemically synthesized
ctgttcatatgattttctat

SEQ ID NO: 362338 - DNA, 20 bp, Artificial Sequence
  chemically synthesized
aagaaattgataattgctaa

SEQ ID NO: 362339 - DNA, 20 bp, Artificial Sequence
  chemically synthesized
attagcaattatcaatttct

SEQ ID NO: 362340 - DNA, 20 bp, Artificial Sequence
  chemically synthesized
attatcaatttcttggtgtg

SEQ ID NO: 362341 - DNA, 20 bp, Artificial Sequence
  chemically synthesized
gataagtttgtccacacacc

SEQ ID NO: 362342 - DNA, 20 bp, Artificial Sequence
  chemically synthesized
tgtgtggacaaacttatcac

SEQ ID NO: 362343 - DNA, 20 bp, Artificial Sequence
  chemically synthesized
tttttttgaataccagtgat

SEQ ID NO: 362344 - DNA, 20 bp, Artificial Sequence
  chemically synthesized
aaaaatttttttttgaatac

SEQ ID NO: 362345 - DNA, 20 bp, Artificial Sequence
  chemically synthesized
caaaaaaaaatttttttttt

SEQ ID NO: 362346 - DNA, 20 bp, Artificial Sequence
  chemically synthesized
aaaaaaaatttttttttttg

SEQ ID NO: 362347 - DNA, 20 bp, Artificial Sequence
  chemically synthesized
aaatttttttttttggagac

SEQ ID NO: 362348 - DNA, 20 bp, Artificial Sequence
  chemically synthesized
tctagtctgggggatcgagc

SEQ ID NO: 362349 - DNA, 20 bp, Artificial Sequence
  chemically synthesized
acaagtcttgctcgatcccc

SEQ ID NO: 362350 - DNA, 20 bp, Artificial Sequence
  chemically synthesized
gcactctagtctgggggatc

SEQ ID NO: 362351 - DNA, 20 bp, Artificial Sequence
  chemically synthesized
tcttgctcgatcccccagac

SEQ ID NO: 362352 - DNA, 20 bp, Artificial Sequence
  chemically synthesized
accactgcactctagtctgg

SEQ ID NO: 362353 - DNA, 20 bp, Artificial Sequence
  chemically synthesized
ttgctcgatcccccagacta

SEQ ID NO: 362354 - DNA, 20 bp, Artificial Sequence
  chemically synthesized
taccactgcactctagtctg

SEQ ID NO: 362355 - DNA, 20 bp, Artificial Sequence
  chemically synthesized
ataccactgcactctagtct

SEQ ID NO: 362356 - DNA, 20 bp, Artificial Sequence
  chemically synthesized
cataccactgcactctagtc

SEQ ID NO: 362357 - DNA, 20 bp, Artificial Sequence
  chemically synthesized
cgatcccccagactagagtg

SEQ ID NO: 362358 - DNA, 20 bp, Artificial Sequence
  chemically synthesized
gtgatcataccactgcactc

SEQ ID NO: 362359 - DNA, 20 bp, Artificial Sequence
  chemically synthesized
tcccccagactagagtgcag

SEQ ID NO: 362360 - DNA, 20 bp, Artificial Sequence
  chemically synthesized
gcagtggtatgatcacctct

SEQ ID NO: 362361 - DNA, 20 bp, Artificial Sequence
  chemically synthesized
gaggcggaggttgcactgag

SEQ ID NO: 362362 - DNA, 20 bp, Artificial Sequence
  chemically synthesized
tgaggcggaggttgcactga

SEQ ID NO: 362363 - DNA, 20 bp, Artificial Sequence
  chemically synthesized
catgaggcggaggttgcact

SEQ ID NO: 362364 - DNA, 20 bp, Artificial Sequence
  chemically synthesized
cacttgaacccatgaggcgg

SEQ ID NO: 362365 - DNA, 20 bp, Artificial Sequence
  chemically synthesized
tcagtgcaacctccgcctca

SEQ ID NO: 362366 - DNA, 20 bp, Artificial Sequence
  chemically synthesized
tcacttgaacccatgaggcg

SEQ ID NO: 362367 - DNA, 20 bp, Artificial Sequence
  chemically synthesized
cagtgcaacctccgcctcat

SEQ ID NO: 362368 - DNA, 20 bp, Artificial Sequence
  chemically synthesized
aatcacttgaacccatgagg

SEQ ID NO: 362369 - DNA, 20 bp, Artificial Sequence
  chemically synthesized
gagaatcacttgaacccatg

SEQ ID NO: 362370 - DNA, 20 bp, Artificial Sequence
  chemically synthesized
tgagaatcacttgaacccat

SEQ ID NO: 362371 - DNA, 20 bp, Artificial Sequence
  chemically synthesized
aacctccgcctcatgggttc

SEQ ID NO: 362372 - DNA, 20 bp, Artificial Sequence
  chemically synthesized
ttcaagtgattctcatgcct

SEQ ID NO: 362373 - DNA, 20 bp, Artificial Sequence
  chemically synthesized
tactggggaggctgaggcat

SEQ ID NO: 362374 - DNA, 20 bp, Artificial Sequence
  chemically synthesized
tccagctactggggaggctg

SEQ ID NO: 362375 - DNA, 20 bp, Artificial Sequence
  chemically synthesized
ttccagctactggggaggct

SEQ ID NO: 362376 - DNA, 20 bp, Artificial Sequence
  chemically synthesized
ttctcatgcctcagcctccc

SEQ ID NO: 362377 - DNA, 20 bp, Artificial Sequence
  chemically synthesized
tcatgcctcagcctccccag

SEQ ID NO: 362378 - DNA, 20 bp, Artificial Sequence
  chemically synthesized
tgtaattccagctactgggg

SEQ ID NO: 362379 - DNA, 20 bp, Artificial Sequence
  chemically synthesized
ctgtaattccagctactggg

SEQ ID NO: 362380 - DNA, 20 bp, Artificial Sequence
  chemically synthesized
gcctcagcctccccagtagc

SEQ ID NO: 362381 - DNA, 20 bp, Artificial Sequence
  chemically synthesized
gcctgtaattccagctactg

SEQ ID NO: 362382 - DNA, 20 bp, Artificial Sequence
  chemically synthesized
cgcctgtaattccagctact

SEQ ID NO: 362383 - DNA, 20 bp, Artificial Sequence
  chemically synthesized
gcgcctgtaattccagctac

SEQ ID NO: 362384 - DNA, 20 bp, Artificial Sequence
  chemically synthesized
ctccccagtagctggaatta

SEQ ID NO: 362385 - DNA, 20 bp, Artificial Sequence
  chemically synthesized
tccccagtagctggaattac

SEQ ID NO: 362386 - DNA, 20 bp, Artificial Sequence
  chemically synthesized
gtggctggcgcctgtaattc

SEQ ID NO: 362387 - DNA, 20 bp, Artificial Sequence
  chemically synthesized
gtagctggaattacaggcgc

SEQ ID NO: 362388 - DNA, 20 bp, Artificial Sequence
  chemically synthesized
aattagacgggtgtggtggc

SEQ ID NO: 362389 - DNA, 20 bp, Artificial Sequence
  chemically synthesized
aaaaaattagacgggtgtgg

SEQ ID NO: 362390 - DNA, 20 bp, Artificial Sequence
  chemically synthesized
aaaaaaaaattagacgggtg

SEQ ID NO: 362391 - DNA, 20 bp, Artificial Sequence
  chemically synthesized
taaaaaaaaaaaaattagac

SEQ ID NO: 362392 - DNA, 20 bp, Artificial Sequence
  chemically synthesized
ctaaaaaaaaaaaaattaga

SEQ ID NO: 362393 - DNA, 20 bp, Artificial Sequence
  chemically synthesized
tctactaaaaaaaaaaaaat

SEQ ID NO: 362394 - DNA, 20 bp, Artificial Sequence
  chemically synthesized
ccgtctaatttttttttttt

SEQ ID NO: 362395 - DNA, 20 bp, Artificial Sequence
  chemically synthesized
tctaatttttttttttttag

SEQ ID NO: 362396 - DNA, 20 bp, Artificial Sequence
  chemically synthesized
taatttttttttttttagta

SEQ ID NO: 362397 - DNA, 20 bp, Artificial Sequence
  chemically synthesized
ttttttttttttagtagaga

SEQ ID NO: 362398 - DNA, 20 bp, Artificial Sequence
  chemically synthesized
tttttttttttagtagagac

SEQ ID NO: 362399 - DNA, 20 bp, Artificial Sequence
  chemically synthesized
ttttttttttagtagagacg

SEQ ID NO: 362400 - DNA, 20 bp, Artificial Sequence
  chemically synthesized
gagacggggttttgccatgt

SEQ ID NO: 362401 - DNA, 20 bp, Artificial Sequence
  chemically synthesized
cggggttttgccatgttggc

SEQ ID NO: 362402 - DNA, 20 bp, Artificial Sequence
  chemically synthesized
cgagaccatcctggccaaca

SEQ ID NO: 362403 - DNA, 20 bp, Artificial Sequence
  chemically synthesized
ggggttttgccatgttggcc

SEQ ID NO: 362404 - DNA, 20 bp, Artificial Sequence
  chemically synthesized
ttttgccatgttggccagga

SEQ ID NO: 362405 - DNA, 20 bp, Artificial Sequence
  chemically synthesized
tcaggagttcgagaccatcc

SEQ ID NO: 362406 - DNA, 20 bp, Artificial Sequence
  chemically synthesized
tcacctgaggtcaggagttc

SEQ ID NO: 362407 - DNA, 20 bp, Artificial Sequence
  chemically synthesized
tggtctcgaactcctgacct

SEQ ID NO: 362408 - DNA, 20 bp, Artificial Sequence
  chemically synthesized
ggcagatcacctgaggtcag

SEQ ID NO: 362409 - DNA, 20 bp, Artificial Sequence
  chemically synthesized
ggtctcgaactcctgacctc

SEQ ID NO: 362410 - DNA, 20 bp, Artificial Sequence
  chemically synthesized
cgggcagatcacctgaggtc

SEQ ID NO: 362411 - DNA, 20 bp, Artificial Sequence
  chemically synthesized
gcgggcagatcacctgaggt

SEQ ID NO: 362412 - DNA, 20 bp, Artificial Sequence
  chemically synthesized
tggggcgggcagatcacctg

SEQ ID NO: 362413 - DNA, 20 bp, Artificial Sequence
  chemically synthesized
ctggggcgggcagatcacct

SEQ ID NO: 362414 - DNA, 20 bp, Artificial Sequence
  chemically synthesized
ctcaggtgatctgcccgccc

SEQ ID NO: 362415 - DNA, 20 bp, Artificial Sequence
  chemically synthesized
ctttgggaggctggggcggg

SEQ ID NO: 362416 - DNA, 20 bp, Artificial Sequence
  chemically synthesized
gcactttgggaggctggggc

SEQ ID NO: 362417 - DNA, 20 bp, Artificial Sequence
  chemically synthesized
agcactttgggaggctgggg

SEQ ID NO: 362418 - DNA, 20 bp, Artificial Sequence
  chemically synthesized
cccagcactttgggaggctg

SEQ ID NO: 362419 - DNA, 20 bp, Artificial Sequence
  chemically synthesized
tcccagcactttgggaggct

SEQ ID NO: 362420 - DNA, 20 bp, Artificial Sequence
  chemically synthesized
atcccagcactttgggaggc

SEQ ID NO: 362421 - DNA, 20 bp, Artificial Sequence
  chemically synthesized
ctgcccgccccagcctccca

SEQ ID NO: 362422 - DNA, 20 bp, Artificial Sequence
  chemically synthesized
tgtaatcccagcactttggg

SEQ ID NO: 362423 - DNA, 20 bp, Artificial Sequence
  chemically synthesized
ctgtaatcccagcactttgg

SEQ ID NO: 362424 - DNA, 20 bp, Artificial Sequence
  chemically synthesized
gccccagcctcccaaagtgc

SEQ ID NO: 362425 - DNA, 20 bp, Artificial Sequence
  chemically synthesized
acctgtaatcccagcacttt

SEQ ID NO: 362426 - DNA, 20 bp, Artificial Sequence
  chemically synthesized
ccccagcctcccaaagtgct

SEQ ID NO: 362427 - DNA, 20 bp, Artificial Sequence
  chemically synthesized
cacctgtaatcccagcactt

SEQ ID NO: 362428 - DNA, 20 bp, Artificial Sequence
  chemically synthesized
ctcccaaagtgctgggatta

SEQ ID NO: 362429 - DNA, 20 bp, Artificial Sequence
  chemically synthesized
tcccaaagtgctgggattac

SEQ ID NO: 362430 - DNA, 20 bp, Artificial Sequence
  chemically synthesized
gtggctcacacctgtaatcc

SEQ ID NO: 362431 - DNA, 20 bp, Artificial Sequence
  chemically synthesized
agtgctgggattacaggtgt

SEQ ID NO: 362432 - DNA, 20 bp, Artificial Sequence
  chemically synthesized
caggtgtgagccaccacgct

SEQ ID NO: 362433 - DNA, 20 bp, Artificial Sequence
  chemically synthesized
gaagttgaggccgagcgtgg

SEQ ID NO: 362434 - DNA, 20 bp, Artificial Sequence
  chemically synthesized
aatgaagttgaggccgagcg

SEQ ID NO: 362435 - DNA, 20 bp, Artificial Sequence
  chemically synthesized
taaaaaatgaagttgaggcc

SEQ ID NO: 362436 - DNA, 20 bp, Artificial Sequence
  chemically synthesized
tattataaaaaatgaagttg

SEQ ID NO: 362437 - DNA, 20 bp, Artificial Sequence
  chemically synthesized
ttattataaaaaatgaagtt

SEQ ID NO: 362438 - DNA, 20 bp, Artificial Sequence
  chemically synthesized
tatgtttattataaaaaatg

SEQ ID NO: 362439 - DNA, 20 bp, Artificial Sequence
  chemically synthesized
aaccaaaaacgggttttaca

SEQ ID NO: 362440 - DNA, 20 bp, Artificial Sequence
  chemically synthesized
ttctgtgtaaaacccgtttt

SEQ ID NO: 362441 - DNA, 20 bp, Artificial Sequence
  chemically synthesized
gagatatagaaaccaaaaac

SEQ ID NO: 362442 - DNA, 20 bp, Artificial Sequence
  chemically synthesized
tgagatatagaaaccaaaaa

SEQ ID NO: 362443 - DNA, 20 bp, Artificial Sequence
  chemically synthesized
gaaatattaagtatgagata

SEQ ID NO: 362444 - DNA, 20 bp, Artificial Sequence
  chemically synthesized
ggaagggaaatattaagtat

SEQ ID NO: 362445 - DNA, 20 bp, Artificial Sequence
  chemically synthesized
aaaaatggaagggaaatatt

SEQ ID NO: 362446 - DNA, 20 bp, Artificial Sequence
  chemically synthesized
tatgcagtttaaaaatggaa

SEQ ID NO: 362447 - DNA, 20 bp, Artificial Sequence
  chemically synthesized
gtatgcagtttaaaaatgga

SEQ ID NO: 362448 - DNA, 20 bp, Artificial Sequence
  chemically synthesized
tgtatgcagtttaaaaatgg

SEQ ID NO: 362449 - DNA, 20 bp, Artificial Sequence
  chemically synthesized
aaatgtatgcagtttaaaaa

SEQ ID NO: 362450 - DNA, 20 bp, Artificial Sequence
  chemically synthesized
gggagaaaaacaaatgtatg

SEQ ID NO: 362451 - DNA, 20 bp, Artificial Sequence
  chemically synthesized
atgtgatccagacaaggagg

SEQ ID NO: 362452 - DNA, 20 bp, Artificial Sequence
  chemically synthesized
gaatgtgatccagacaagga

SEQ ID NO: 362453 - DNA, 20 bp, Artificial Sequence
  chemically synthesized
tgtttttctccctccttgtc

SEQ ID NO: 362454 - DNA, 20 bp, Artificial Sequence
  chemically synthesized
tgaatgtgatccagacaagg

SEQ ID NO: 362455 - DNA, 20 bp, Artificial Sequence
  chemically synthesized
atgaatgtgatccagacaag

SEQ ID NO: 362456 - DNA, 20 bp, Artificial Sequence
  chemically synthesized
ttatgaatgtgatccagaca

SEQ ID NO: 362457 - DNA, 20 bp, Artificial Sequence
  chemically synthesized
cttatgaatgtgatccagac

SEQ ID NO: 362458 - DNA, 20 bp, Artificial Sequence
  chemically synthesized
aatatcttatgaatgtgatc

SEQ ID NO: 362459 - DNA, 20 bp, Artificial Sequence
  chemically synthesized
cttgtctggatcacattcat

SEQ ID NO: 362460 - DNA, 20 bp, Artificial Sequence
  chemically synthesized
tagttccttataatatgaaa

SEQ ID NO: 362461 - DNA, 20 bp, Artificial Sequence
  chemically synthesized
attaatctatttcatattat

SEQ ID NO: 362462 - DNA, 20 bp, Artificial Sequence
  chemically synthesized
ttaatctatttcatattata

SEQ ID NO: 362463 - DNA, 20 bp, Artificial Sequence
  chemically synthesized
tatttcatattataaggaac

SEQ ID NO: 362464 - DNA, 20 bp, Artificial Sequence
  chemically synthesized
cactagataaaatatacagc

SEQ ID NO: 362465 - DNA, 20 bp, Artificial Sequence
  chemically synthesized
gaaacactagataaaatata

SEQ ID NO: 362466 - DNA, 20 bp, Artificial Sequence
  chemically synthesized
aactagctgtatattttatc

SEQ ID NO: 362467 - DNA, 20 bp, Artificial Sequence
  chemically synthesized
taaagaaatagaagaaacac

SEQ ID NO: 362468 - DNA, 20 bp, Artificial Sequence
  chemically synthesized
aactaaagataaagaaatag

SEQ ID NO: 362469 - DNA, 20 bp, Artificial Sequence
  chemically synthesized
aggaactaaagataaagaaa

SEQ ID NO: 362470 - DNA, 20 bp, Artificial Sequence
  chemically synthesized
ttcttctatttctttatctt

SEQ ID NO: 362471 - DNA, 20 bp, Artificial Sequence
  chemically synthesized
gaaagcaggaactaaagata

SEQ ID NO: 362472 - DNA, 20 bp, Artificial Sequence
  chemically synthesized
tttaaggaaagcaggaacta

SEQ ID NO: 362473 - DNA, 20 bp, Artificial Sequence
  chemically synthesized
aaaaatgctttaaggaaagc

SEQ ID NO: 362474 - DNA, 20 bp, Artificial Sequence
  chemically synthesized
caaaaatgctttaaggaaag

SEQ ID NO: 362475 - DNA, 20 bp, Artificial Sequence
  chemically synthesized
tttagttcctgctttcctta

SEQ ID NO: 362476 - DNA, 20 bp, Artificial Sequence
  chemically synthesized
ttacaaaaatgctttaagga

SEQ ID NO: 362477 - DNA, 20 bp, Artificial Sequence
  chemically synthesized
aatgttacaaaaatgcttta

SEQ ID NO: 362478 - DNA, 20 bp, Artificial Sequence
  chemically synthesized
aaatgttacaaaaatgcttt

SEQ ID NO: 362479 - DNA, 20 bp, Artificial Sequence
  chemically synthesized
tttgtaacatttttatttga

SEQ ID NO: 362480 - DNA, 20 bp, Artificial Sequence
  chemically synthesized
ttaaaaagataaattgaatc

SEQ ID NO: 362481 - DNA, 20 bp, Artificial Sequence
  chemically synthesized
ttcaatttatctttttaatg

SEQ ID NO: 362482 - DNA, 20 bp, Artificial Sequence
  chemically synthesized
tgattttgatcttcattaaa

SEQ ID NO: 362483 - DNA, 20 bp, Artificial Sequence
  chemically synthesized
tttaatgaagatcaaaatca

SEQ ID NO: 362484 - DNA, 20 bp, Artificial Sequence
  chemically synthesized
aagacaaaaattcaaactct

SEQ ID NO: 362485 - DNA, 20 bp, Artificial Sequence
  chemically synthesized
aaaaattcaaactctcagta

SEQ ID NO: 362486 - DNA, 20 bp, Artificial Sequence
  chemically synthesized
aatggctcaggctgtactga

SEQ ID NO: 362487 - DNA, 20 bp, Artificial Sequence
  chemically synthesized
gaaatggctcaggctgtact

SEQ ID NO: 362488 - DNA, 20 bp, Artificial Sequence
  chemically synthesized
tcaaactctcagtacagcct

SEQ ID NO: 362489 - DNA, 20 bp, Artificial Sequence
  chemically synthesized
aaacccatgagaaatggctc

SEQ ID NO: 362490 - DNA, 20 bp, Artificial Sequence
  chemically synthesized
aaaacccatgagaaatggct

SEQ ID NO: 362491 - DNA, 20 bp, Artificial Sequence
  chemically synthesized
acagcctgagccatttctca

SEQ ID NO: 362492 - DNA, 20 bp, Artificial Sequence
  chemically synthesized
atatgaaaacccatgagaaa

SEQ ID NO: 362493 - DNA, 20 bp, Artificial Sequence
  chemically synthesized
cagcctgagccatttctcat

SEQ ID NO: 362494 - DNA, 20 bp, Artificial Sequence
  chemically synthesized
cattccatatgaaaacccat

SEQ ID NO: 362495 - DNA, 20 bp, Artificial Sequence
  chemically synthesized
atttctcatgggttttcata

SEQ ID NO: 362496 - DNA, 20 bp, Artificial Sequence
  chemically synthesized
aactacatttgtgaaggaaa

SEQ ID NO: 362497 - DNA, 20 bp, Artificial Sequence
  chemically synthesized
gtataaaactacatttgtga

SEQ ID NO: 362498 - DNA, 20 bp, Artificial Sequence
  chemically synthesized
agtataaaactacatttgtg

SEQ ID NO: 362499 - DNA, 20 bp, Artificial Sequence
  chemically synthesized
tgctttttccttcacaaatg

SEQ ID NO: 362500 - DNA, 20 bp, Artificial Sequence
  chemically synthesized
caaatgtagttttatactct

SEQ ID NO: 362501 - DNA, 20 bp, Artificial Sequence
  chemically synthesized
attaaggtttgttaaaccaa

SEQ ID NO: 362502 - DNA, 20 bp, Artificial Sequence
  chemically synthesized
tgattaaggtttgttaaacc

SEQ ID NO: 362503 - DNA, 20 bp, Artificial Sequence
  chemically synthesized
ttataaattaagtttgatta

SEQ ID NO: 362504 - DNA, 20 bp, Artificial Sequence
  chemically synthesized
cttataaattaagtttgatt

SEQ ID NO: 362505 - DNA, 20 bp, Artificial Sequence
  chemically synthesized
cttaatcaaacttaatttat

SEQ ID NO: 362506 - DNA, 20 bp, Artificial Sequence
  chemically synthesized
taataatatacttataaatt

SEQ ID NO: 362507 - DNA, 20 bp, Artificial Sequence
  chemically synthesized
ttaatttataagtatattat

SEQ ID NO: 362508 - DNA, 20 bp, Artificial Sequence
  chemically synthesized
ttcatgttatttaataacag

SEQ ID NO: 362509 - DNA, 20 bp, Artificial Sequence
  chemically synthesized
aaattcatgttatttaataa

SEQ ID NO: 362510 - DNA, 20 bp, Artificial Sequence
  chemically synthesized
ttaaataacatgaattttga

SEQ ID NO: 362511 - DNA, 20 bp, Artificial Sequence
  chemically synthesized
acgggcaatatatttgaatg

SEQ ID NO: 362512 - DNA, 20 bp, Artificial Sequence
  chemically synthesized
cacatacacaaattataaac

SEQ ID NO: 362513 - DNA, 20 bp, Artificial Sequence
  chemically synthesized
ccacatacacaaattataaa

SEQ ID NO: 362514 - DNA, 20 bp, Artificial Sequence
  chemically synthesized
ccgtttataatttgtgtatg

SEQ ID NO: 362515 - DNA, 20 bp, Artificial Sequence
  chemically synthesized
tttataatttgtgtatgtgg

SEQ ID NO: 362516 - DNA, 20 bp, Artificial Sequence
  chemically synthesized
ttataatttgtgtatgtggc

SEQ ID NO: 362517 - DNA, 20 bp, Artificial Sequence
  chemically synthesized
attttttttactattttcct

SEQ ID NO: 362518 - DNA, 20 bp, Artificial Sequence
  chemically synthesized
ttgttaaaggcttaggaaaa

SEQ ID NO: 362519 - DNA, 20 bp, Artificial Sequence
  chemically synthesized
cgtaaacttgttaaaggctt

SEQ ID NO: 362520 - DNA, 20 bp, Artificial Sequence
  chemically synthesized
tcgtaaacttgttaaaggct

SEQ ID NO: 362521 - DNA, 20 bp, Artificial Sequence
  chemically synthesized
tattttcctaagcctttaac

SEQ ID NO: 362522 - DNA, 20 bp, Artificial Sequence
  chemically synthesized
cttcgtcgtaaacttgttaa

SEQ ID NO: 362523 - DNA, 20 bp, Artificial Sequence
  chemically synthesized
tcttcgtcgtaaacttgtta

SEQ ID NO: 362524 - DNA, 20 bp, Artificial Sequence
  chemically synthesized
cctttaacaagtttacgacg

SEQ ID NO: 362525 - DNA, 20 bp, Artificial Sequence
  chemically synthesized
tttaacaagtttacgacgaa

SEQ ID NO: 362526 - DNA, 20 bp, Artificial Sequence
  chemically synthesized
aacaagtttacgacgaagag

SEQ ID NO: 362527 - DNA, 20 bp, Artificial Sequence
  chemically synthesized
cgacgaagagcagatatccg

SEQ ID NO: 362528 - DNA, 20 bp, Artificial Sequence
  chemically synthesized
agacacgctgagagtcactt

SEQ ID NO: 362529 - DNA, 20 bp, Artificial Sequence
  chemically synthesized
cagatatccgaagtgactct

SEQ ID NO: 362530 - DNA, 20 bp, Artificial Sequence
  chemically synthesized
agaaaagaaagacacgctga

SEQ ID NO: 362531 - DNA, 20 bp, Artificial Sequence
  chemically synthesized
ccagaaaagaaagacacgct

SEQ ID NO: 362532 - DNA, 20 bp, Artificial Sequence
  chemically synthesized
ctcagcgtgtctttcttttc

SEQ ID NO: 362533 - DNA, 20 bp, Artificial Sequence
  chemically synthesized
acaaccagagccagaaaaga

SEQ ID NO: 362534 - DNA, 20 bp, Artificial Sequence
  chemically synthesized
ggagacaaccagagccagaa

SEQ ID NO: 362535 - DNA, 20 bp, Artificial Sequence
  chemically synthesized
gtgtctttcttttctggctc

SEQ ID NO: 362536 - DNA, 20 bp, Artificial Sequence
  chemically synthesized
cttctggagacaaccagagc

SEQ ID NO: 362537 - DNA, 20 bp, Artificial Sequence
  chemically synthesized
tattcttctggagacaacca

SEQ ID NO: 362538 - DNA, 20 bp, Artificial Sequence
  chemically synthesized
cctattcttctggagacaac

SEQ ID NO: 362539 - DNA, 20 bp, Artificial Sequence
  chemically synthesized
tttctggctctggttgtctc

SEQ ID NO: 362540 - DNA, 20 bp, Artificial Sequence
  chemically synthesized
ctggctctggttgtctccag

SEQ ID NO: 362541 - DNA, 20 bp, Artificial Sequence
  chemically synthesized
gactccttcctattcttctg

SEQ ID NO: 362542 - DNA, 20 bp, Artificial Sequence
  chemically synthesized
tctggttgtctccagaagaa

SEQ ID NO: 362543 - DNA, 20 bp, Artificial Sequence
  chemically synthesized
ctggttgtctccagaagaat

SEQ ID NO: 362544 - DNA, 20 bp, Artificial Sequence
  chemically synthesized
aggactccttcctattcttc

SEQ ID NO: 362545 - DNA, 20 bp, Artificial Sequence
  chemically synthesized
gttgtctccagaagaatagg

SEQ ID NO: 362546 - DNA, 20 bp, Artificial Sequence
  chemically synthesized
ttgtctccagaagaatagga

SEQ ID NO: 362547 - DNA, 20 bp, Artificial Sequence
  chemically synthesized
gtctccagaagaataggaag

SEQ ID NO: 362548 - DNA, 20 bp, Artificial Sequence
  chemically synthesized
gaagaataggaaggagtcct

SEQ ID NO: 362549 - DNA, 20 bp, Artificial Sequence
  chemically synthesized
tctggctaatttggggacta

SEQ ID NO: 362550 - DNA, 20 bp, Artificial Sequence
  chemically synthesized
ttctggctaatttggggact

SEQ ID NO: 362551 - DNA, 20 bp, Artificial Sequence
  chemically synthesized
ggagtccttagtccccaaat

SEQ ID NO: 362552 - DNA, 20 bp, Artificial Sequence
  chemically synthesized
cgtggtttctggctaatttg

SEQ ID NO: 362553 - DNA, 20 bp, Artificial Sequence
  chemically synthesized
acgtggtttctggctaattt

SEQ ID NO: 362554 - DNA, 20 bp, Artificial Sequence
  chemically synthesized
tccttagtccccaaattagc

SEQ ID NO: 362555 - DNA, 20 bp, Artificial Sequence
  chemically synthesized
gacgtggtttctggctaatt

SEQ ID NO: 362556 - DNA, 20 bp, Artificial Sequence
  chemically synthesized
cagagagtagacgtggtttc

SEQ ID NO: 362557 - DNA, 20 bp, Artificial Sequence
  chemically synthesized
ttgatgacagagagtagacg

SEQ ID NO: 362558 - DNA, 20 bp, Artificial Sequence
  chemically synthesized
ttctatttgatgacagagag

SEQ ID NO: 362559 - DNA, 20 bp, Artificial Sequence
  chemically synthesized
cacttctatttgatgacaga

SEQ ID NO: 362560 - DNA, 20 bp, Artificial Sequence
  chemically synthesized
accacttctatttgatgaca

SEQ ID NO: 362561 - DNA, 20 bp, Artificial Sequence
  chemically synthesized
ataccacttctatttgatga

SEQ ID NO: 362562 - DNA, 20 bp, Artificial Sequence
  chemically synthesized
gtctactctctgtcatcaaa

SEQ ID NO: 362563 - DNA, 20 bp, Artificial Sequence
  chemically synthesized
tactctctgtcatcaaatag

SEQ ID NO: 362564 - DNA, 20 bp, Artificial Sequence
  chemically synthesized
tctctgtcatcaaatagaag

SEQ ID NO: 362565 - DNA, 20 bp, Artificial Sequence
  chemically synthesized
gtcatcaaatagaagtggta

SEQ ID NO: 362566 - DNA, 20 bp, Artificial Sequence
  chemically synthesized
atagaagtggtatggcctca

SEQ ID NO: 362567 - DNA, 20 bp, Artificial Sequence
  chemically synthesized
tagaagtggtatggcctcaa

SEQ ID NO: 362568 - DNA, 20 bp, Artificial Sequence
  chemically synthesized
caggaagccagtcacctttg

SEQ ID NO: 362569 - DNA, 20 bp, Artificial Sequence
  chemically synthesized
tcaggaagccagtcaccttt

SEQ ID NO: 362570 - DNA, 20 bp, Artificial Sequence
  chemically synthesized
ggtatggcctcaaaggtgac

SEQ ID NO: 362571 - DNA, 20 bp, Artificial Sequence
  chemically synthesized
tgttggatgcatcaggaagc

SEQ ID NO: 362572 - DNA, 20 bp, Artificial Sequence
  chemically synthesized
gtcttgttggatgcatcagg

SEQ ID NO: 362573 - DNA, 20 bp, Artificial Sequence
  chemically synthesized
ccagtcttgttggatgcatc

SEQ ID NO: 362574 - DNA, 20 bp, Artificial Sequence
  chemically synthesized
cccagtcttgttggatgcat

SEQ ID NO: 362575 - DNA, 20 bp, Artificial Sequence
  chemically synthesized
ggcttcctgatgcatccaac

SEQ ID NO: 362576 - DNA, 20 bp, Artificial Sequence
  chemically synthesized
cctgatgcatccaacaagac

SEQ ID NO: 362577 - DNA, 20 bp, Artificial Sequence
  chemically synthesized
tggctagggcccagtcttgt

SEQ ID NO: 362578 - DNA, 20 bp, Artificial Sequence
  chemically synthesized
ctgatgcatccaacaagact

SEQ ID NO: 362579 - DNA, 20 bp, Artificial Sequence
  chemically synthesized
catccaacaagactgggccc

SEQ ID NO: 362580 - DNA, 20 bp, Artificial Sequence
  chemically synthesized
ctctgatgttggctagggcc

SEQ ID NO: 362581 - DNA, 20 bp, Artificial Sequence
  chemically synthesized
gagaactctgatgttggcta

SEQ ID NO: 362582 - DNA, 20 bp, Artificial Sequence
  chemically synthesized
cgagaactctgatgttggct

SEQ ID NO: 362583 - DNA, 20 bp, Artificial Sequence
  chemically synthesized
ccgagaactctgatgttggc

SEQ ID NO: 362584 - DNA, 20 bp, Artificial Sequence
  chemically synthesized
gactgggccctagccaacat

SEQ ID NO: 362585 - DNA, 20 bp, Artificial Sequence
  chemically synthesized
ctgggccctagccaacatca

SEQ ID NO: 362586 - DNA, 20 bp, Artificial Sequence
  chemically synthesized
catgccgagaactctgatgt

SEQ ID NO: 362587 - DNA, 20 bp, Artificial Sequence
  chemically synthesized
ctagccaacatcagagttct

SEQ ID NO: 362588 - DNA, 20 bp, Artificial Sequence
  chemically synthesized
acatcagagttctcggcatg

SEQ ID NO: 362589 - DNA, 20 bp, Artificial Sequence
  chemically synthesized
gacttgagaatctgcatgcc

SEQ ID NO: 362590 - DNA, 20 bp, Artificial Sequence
  chemically synthesized
ttctcggcatgcagattctc

SEQ ID NO: 362591 - DNA, 20 bp, Artificial Sequence
  chemically synthesized
tctgtgcgaaatgaggactt

SEQ ID NO: 362592 - DNA, 20 bp, Artificial Sequence
  chemically synthesized
ttttgtttctgtgcgaaatg

SEQ ID NO: 362593 - DNA, 20 bp, Artificial Sequence
  chemically synthesized
gttttgtttctgtgcgaaat

SEQ ID NO: 362594 - DNA, 20 bp, Artificial Sequence
  chemically synthesized
tctcaagtcctcatttcgca

SEQ ID NO: 362595 - DNA, 20 bp, Artificial Sequence
  chemically synthesized
catttcgcacagaaacaaaa

SEQ ID NO: 362596 - DNA, 20 bp, Artificial Sequence
  chemically synthesized
gcacagaaacaaaacagaac

SEQ ID NO: 362597 - DNA, 20 bp, Artificial Sequence
  chemically synthesized
acaaaacagaactagatacc

SEQ ID NO: 362598 - DNA, 20 bp, Artificial Sequence
  chemically synthesized
taatcggcattccaggtatc

SEQ ID NO: 362599 - DNA, 20 bp, Artificial Sequence
  chemically synthesized
aacggtataatcggcattcc

SEQ ID NO: 362600 - DNA, 20 bp, Artificial Sequence
  chemically synthesized
aaacggtataatcggcattc

SEQ ID NO: 362601 - DNA, 20 bp, Artificial Sequence
  chemically synthesized
ggagtggaaaacggtataat

SEQ ID NO: 362602 - DNA, 20 bp, Artificial Sequence
  chemically synthesized
agtgaagtaggagtggaaaa

SEQ ID NO: 362603 - DNA, 20 bp, Artificial Sequence
  chemically synthesized
gtgggttagtgaagtaggag

SEQ ID NO: 362604 - DNA, 20 bp, Artificial Sequence
  chemically synthesized
ttggtgggttagtgaagtag

SEQ ID NO: 362605 - DNA, 20 bp, Artificial Sequence
  chemically synthesized
gtttggtgggttagtgaagt

SEQ ID NO: 362606 - DNA, 20 bp, Artificial Sequence
  chemically synthesized
agtttggtgggttagtgaag

SEQ ID NO: 362607 - DNA, 20 bp, Artificial Sequence
  chemically synthesized
agaagtttggtgggttagtg

SEQ ID NO: 362608 - DNA, 20 bp, Artificial Sequence
  chemically synthesized
ggtgaagaagtttggtgggt

SEQ ID NO: 362609 - DNA, 20 bp, Artificial Sequence
  chemically synthesized
aagaggtgaagaagtttggt

SEQ ID NO: 362610 - DNA, 20 bp, Artificial Sequence
  chemically synthesized
gaagaggtgaagaagtttgg

SEQ ID NO: 362611 - DNA, 20 bp, Artificial Sequence
  chemically synthesized
aaagaagaggtgaagaagtt

SEQ ID NO: 362612 - DNA, 20 bp, Artificial Sequence
  chemically synthesized
catacaaagaagaggtgaag

SEQ ID NO: 362613 - DNA, 20 bp, Artificial Sequence
  chemically synthesized
tcacatacaaagaagaggtg

SEQ ID NO: 362614 - DNA, 20 bp, Artificial Sequence
  chemically synthesized
agtcatcacatacaaagaag

SEQ ID NO: 362615 - DNA, 20 bp, Artificial Sequence
  chemically synthesized
tagtcatcacatacaaagaa

SEQ ID NO: 362616 - DNA, 20 bp, Artificial Sequence
  chemically synthesized
tgtagtcatcacatacaaag

SEQ ID NO: 362617 - DNA, 20 bp, Artificial Sequence
  chemically synthesized
tgatgtagtcatcacataca

SEQ ID NO: 362618 - DNA, 20 bp, Artificial Sequence
  chemically synthesized
tatgtgatgactacatcacc

SEQ ID NO: 362619 - DNA, 20 bp, Artificial Sequence
  chemically synthesized
ttaagagattccaggtgatg

SEQ ID NO: 362620 - DNA, 20 bp, Artificial Sequence
  chemically synthesized
gtccaaggttaagagattcc

SEQ ID NO: 362621 - DNA, 20 bp, Artificial Sequence
  chemically synthesized
agtccaaggttaagagattc

SEQ ID NO: 362622 - DNA, 20 bp, Artificial Sequence
  chemically synthesized
cacctggaatctcttaacct

SEQ ID NO: 362623 - DNA, 20 bp, Artificial Sequence
  chemically synthesized
aaccagaagtccaaggttaa

SEQ ID NO: 362624 - DNA, 20 bp, Artificial Sequence
  chemically synthesized
ctaaccagaagtccaaggtt

SEQ ID NO: 362625 - DNA, 20 bp, Artificial Sequence
  chemically synthesized
ttagtctaaccagaagtcca

SEQ ID NO: 362626 - DNA, 20 bp, Artificial Sequence
  chemically synthesized
atctcttaaccttggacttc

SEQ ID NO: 362627 - DNA, 20 bp, Artificial Sequence
  chemically synthesized
tttagtctaaccagaagtcc

SEQ ID NO: 362628 - DNA, 20 bp, Artificial Sequence
  chemically synthesized
cttaaccttggacttctggt

SEQ ID NO: 362629 - DNA, 20 bp, Artificial Sequence
  chemically synthesized
ccttagtttagtctaaccag

SEQ ID NO: 362630 - DNA, 20 bp, Artificial Sequence
  chemically synthesized
gctccttagtttagtctaac

SEQ ID NO: 362631 - DNA, 20 bp, Artificial Sequence
  chemically synthesized
acttctggttagactaaact

SEQ ID NO: 362632 - DNA, 20 bp, Artificial Sequence
  chemically synthesized
cttctggttagactaaacta

SEQ ID NO: 362633 - DNA, 20 bp, Artificial Sequence
  chemically synthesized
tctggttagactaaactaag

SEQ ID NO: 362634 - DNA, 20 bp, Artificial Sequence
  chemically synthesized
gccagtgccgctccttagtt

SEQ ID NO: 362635 - DNA, 20 bp, Artificial Sequence
  chemically synthesized
ggttagactaaactaaggag

SEQ ID NO: 362636 - DNA, 20 bp, Artificial Sequence
  chemically synthesized
gttttgccagtgccgctcct

SEQ ID NO: 362637 - DNA, 20 bp, Artificial Sequence
  chemically synthesized
actaaactaaggagcggcac

SEQ ID NO: 362638 - DNA, 20 bp, Artificial Sequence
  chemically synthesized
agaatcctccagtgttttgc

SEQ ID NO: 362639 - DNA, 20 bp, Artificial Sequence
  chemically synthesized
gagcggcactggcaaaacac

SEQ ID NO: 362640 - DNA, 20 bp, Artificial Sequence
  chemically synthesized
gcggcactggcaaaacactg

SEQ ID NO: 362641 - DNA, 20 bp, Artificial Sequence
  chemically synthesized
cggcactggcaaaacactgg

SEQ ID NO: 362642 - DNA, 20 bp, Artificial Sequence
  chemically synthesized
agtctctccatagaatcctc

SEQ ID NO: 362643 - DNA, 20 bp, Artificial Sequence
  chemically synthesized
caaaacactggaggattcta

SEQ ID NO: 362644 - DNA, 20 bp, Artificial Sequence
  chemically synthesized
aaacactggaggattctatg

SEQ ID NO: 362645 - DNA, 20 bp, Artificial Sequence
  chemically synthesized
acactggaggattctatgga

SEQ ID NO: 362646 - DNA, 20 bp, Artificial Sequence
  chemically synthesized
gtgataccttagtctctcca

SEQ ID NO: 362647 - DNA, 20 bp, Artificial Sequence
  chemically synthesized
gaggattctatggagagact

SEQ ID NO: 362648 - DNA, 20 bp, Artificial Sequence
  chemically synthesized
aggattctatggagagacta

SEQ ID NO: 362649 - DNA, 20 bp, Artificial Sequence
  chemically synthesized
agttgagagaagtgatacct

SEQ ID NO: 362650 - DNA, 20 bp, Artificial Sequence
  chemically synthesized
ttgcctggtgaagttgagag

SEQ ID NO: 362651 - DNA, 20 bp, Artificial Sequence
  chemically synthesized
tcattgcctggtgaagttga

SEQ ID NO: 362652 - DNA, 20 bp, Artificial Sequence
  chemically synthesized
aatcattgcctggtgaagtt

SEQ ID NO: 362653 - DNA, 20 bp, Artificial Sequence
  chemically synthesized
atcacttctctcaacttcac

SEQ ID NO: 362654 - DNA, 20 bp, Artificial Sequence
  chemically synthesized
tcacttctctcaacttcacc

SEQ ID NO: 362655 - DNA, 20 bp, Artificial Sequence
  chemically synthesized
tttcaaatcattgcctggtg

SEQ ID NO: 362656 - DNA, 20 bp, Artificial Sequence
  chemically synthesized
gttagtttcaaatcattgcc

SEQ ID NO: 362657 - DNA, 20 bp, Artificial Sequence
  chemically synthesized
aggcaatgatttgaaactaa

SEQ ID NO: 362658 - DNA, 20 bp, Artificial Sequence
  chemically synthesized
aggtatctaaagaatgctgt

SEQ ID NO: 362659 - DNA, 20 bp, Artificial Sequence
  chemically synthesized
ttgaaactaacagcattctt

SEQ ID NO: 362660 - DNA, 20 bp, Artificial Sequence
  chemically synthesized
actgagcccctaggtatcta

SEQ ID NO: 362661 - DNA, 20 bp, Artificial Sequence
  chemically synthesized
aacagcattctttagatacc

SEQ ID NO: 362662 - DNA, 20 bp, Artificial Sequence
  chemically synthesized
acagcattctttagatacct

SEQ ID NO: 362663 - DNA, 20 bp, Artificial Sequence
  chemically synthesized
cagcattctttagataccta

SEQ ID NO: 362664 - DNA, 20 bp, Artificial Sequence
  chemically synthesized
agcattctttagatacctag

SEQ ID NO: 362665 - DNA, 20 bp, Artificial Sequence
  chemically synthesized
tctttagatacctaggggct

SEQ ID NO: 362666 - DNA, 20 bp, Artificial Sequence
  chemically synthesized
caactgtgaactgagcccct

SEQ ID NO: 362667 - DNA, 20 bp, Artificial Sequence
  chemically synthesized
acaactgtgaactgagcccc

SEQ ID NO: 362668 - DNA, 20 bp, Artificial Sequence
  chemically synthesized
atacctaggggctcagttca

SEQ ID NO: 362669 - DNA, 20 bp, Artificial Sequence
  chemically synthesized
actggacacaactgtgaact

SEQ ID NO: 362670 - DNA, 20 bp, Artificial Sequence
  chemically synthesized
gctcagttcacagttgtgtc

SEQ ID NO: 362671 - DNA, 20 bp, Artificial Sequence
  chemically synthesized
cagttcacagttgtgtccag

SEQ ID NO: 362672 - DNA, 20 bp, Artificial Sequence
  chemically synthesized
tcatgttgggagagcgccac

SEQ ID NO: 362673 - DNA, 20 bp, Artificial Sequence
  chemically synthesized
taaaatccctcatgttggga

SEQ ID NO: 362674 - DNA, 20 bp, Artificial Sequence
  chemically synthesized
cagtggcgctctcccaacat

SEQ ID NO: 362675 - DNA, 20 bp, Artificial Sequence
  chemically synthesized
gataaaatccctcatgttgg

SEQ ID NO: 362676 - DNA, 20 bp, Artificial Sequence
  chemically synthesized
agtggcgctctcccaacatg

SEQ ID NO: 362677 - DNA, 20 bp, Artificial Sequence
  chemically synthesized
gtggcgctctcccaacatga

SEQ ID NO: 362678 - DNA, 20 bp, Artificial Sequence
  chemically synthesized
ttgataaaatccctcatgtt

SEQ ID NO: 362679 - DNA, 20 bp, Artificial Sequence
  chemically synthesized
tttgataaaatccctcatgt

SEQ ID NO: 362680 - DNA, 20 bp, Artificial Sequence
  chemically synthesized
gagggattttatcaaattaa

SEQ ID NO: 362681 - DNA, 20 bp, Artificial Sequence
  chemically synthesized
cctaagcagtcaaggggaga

SEQ ID NO: 362682 - DNA, 20 bp, Artificial Sequence
  chemically synthesized
acctaagcagtcaaggggag

SEQ ID NO: 362683 - DNA, 20 bp, Artificial Sequence
  chemically synthesized
aacctaagcagtcaagggga

SEQ ID NO: 362684 - DNA, 20 bp, Artificial Sequence
  chemically synthesized
taaacctaagcagtcaaggg

SEQ ID NO: 362685 - DNA, 20 bp, Artificial Sequence
  chemically synthesized
tctaaacctaagcagtcaag

SEQ ID NO: 362686 - DNA, 20 bp, Artificial Sequence
  chemically synthesized
atctaaacctaagcagtcaa

SEQ ID NO: 362687 - DNA, 20 bp, Artificial Sequence
  chemically synthesized
catctaaacctaagcagtca

SEQ ID NO: 362688 - DNA, 20 bp, Artificial Sequence
  chemically synthesized
gccctctccccttgactgct

SEQ ID NO: 362689 - DNA, 20 bp, Artificial Sequence
  chemically synthesized
acatctaaacctaagcagtc

SEQ ID NO: 362690 - DNA, 20 bp, Artificial Sequence
  chemically synthesized
ccctctccccttgactgctt

SEQ ID NO: 362691 - DNA, 20 bp, Artificial Sequence
  chemically synthesized
ttactacatctaaacctaag

SEQ ID NO: 362692 - DNA, 20 bp, Artificial Sequence
  chemically synthesized
tccccttgactgcttaggtt

SEQ ID NO: 362693 - DNA, 20 bp, Artificial Sequence
  chemically synthesized
cctttactacatctaaacct

SEQ ID NO: 362694 - DNA, 20 bp, Artificial Sequence
  chemically synthesized
tgactgcttaggtttagatg

SEQ ID NO: 362695 - DNA, 20 bp, Artificial Sequence
  chemically synthesized
gcttaggtttagatgtagta

SEQ ID NO: 362696 - DNA, 20 bp, Artificial Sequence
  chemically synthesized
cttaggtttagatgtagtaa

SEQ ID NO: 362697 - DNA, 20 bp, Artificial Sequence
  chemically synthesized
aagaatgcagggattcacat

SEQ ID NO: 362698 - DNA, 20 bp, Artificial Sequence
  chemically synthesized
aaactatggtgaagaatgca

SEQ ID NO: 362699 - DNA, 20 bp, Artificial Sequence
  chemically synthesized
gaaactatggtgaagaatgc

SEQ ID NO: 362700 - DNA, 20 bp, Artificial Sequence
  chemically synthesized
agaaactatggtgaagaatg

SEQ ID NO: 362701 - DNA, 20 bp, Artificial Sequence
  chemically synthesized
aatccctgcattcttcacca

SEQ ID NO: 362702 - DNA, 20 bp, Artificial Sequence
  chemically synthesized
taaaggaagaaactatggtg

SEQ ID NO: 362703 - DNA, 20 bp, Artificial Sequence
  chemically synthesized
aggattaaaggaagaaacta

SEQ ID NO: 362704 - DNA, 20 bp, Artificial Sequence
  chemically synthesized
aacgtggggaggattaaagg

SEQ ID NO: 362705 - DNA, 20 bp, Artificial Sequence
  chemically synthesized
agaaacgtggggaggattaa

SEQ ID NO: 362706 - DNA, 20 bp, Artificial Sequence
  chemically synthesized
tagaaacgtggggaggatta

SEQ ID NO: 362707 - DNA, 20 bp, Artificial Sequence
  chemically synthesized
atatttatagaaacgtgggg

SEQ ID NO: 362708 - DNA, 20 bp, Artificial Sequence
  chemically synthesized
aatatttatagaaacgtggg

SEQ ID NO: 362709 - DNA, 20 bp, Artificial Sequence
  chemically synthesized
ggaatatttatagaaacgtg

SEQ ID NO: 362710 - DNA, 20 bp, Artificial Sequence
  chemically synthesized
gggaatatttatagaaacgt

SEQ ID NO: 362711 - DNA, 20 bp, Artificial Sequence
  chemically synthesized
ggggaatatttatagaaacg

SEQ ID NO: 362712 - DNA, 20 bp, Artificial Sequence
  chemically synthesized
tgtaatcaggggaatattta

SEQ ID NO: 362713 - DNA, 20 bp, Artificial Sequence
  chemically synthesized
gttgaagagagtgtaatcag

SEQ ID NO: 362714 - DNA, 20 bp, Artificial Sequence
  chemically synthesized
agttgaagagagtgtaatca

SEQ ID NO: 362715 - DNA, 20 bp, Artificial Sequence
  chemically synthesized
aagttgaagagagtgtaatc

SEQ ID NO: 362716 - DNA, 20 bp, Artificial Sequence
  chemically synthesized
aaagttgaagagagtgtaat

SEQ ID NO: 362717 - DNA, 20 bp, Artificial Sequence
  chemically synthesized
catacagaaaaagttgaaga

SEQ ID NO: 362718 - DNA, 20 bp, Artificial Sequence
  chemically synthesized
ggcatacagaaaaagttgaa

SEQ ID NO: 362719 - DNA, 20 bp, Artificial Sequence
  chemically synthesized
gtggcatacagaaaaagttg

SEQ ID NO: 362720 - DNA, 20 bp, Artificial Sequence
  chemically synthesized
aaacacgtggcatacagaaa

SEQ ID NO: 362721 - DNA, 20 bp, Artificial Sequence
  chemically synthesized
gatattaaacacgtggcata

SEQ ID NO: 362722 - DNA, 20 bp, Artificial Sequence
  chemically synthesized
ctgtcctgatattaaacacg

SEQ ID NO: 362723 - DNA, 20 bp, Artificial Sequence
  chemically synthesized
gtatgccacgtgtttaatat

SEQ ID NO: 362724 - DNA, 20 bp, Artificial Sequence
  chemically synthesized
tatgccacgtgtttaatatc

SEQ ID NO: 362725 - DNA, 20 bp, Artificial Sequence
  chemically synthesized
ccacgtgtttaatatcagga

SEQ ID NO: 362726 - DNA, 20 bp, Artificial Sequence
  chemically synthesized
ttaaggtatcttgtgaagtc

SEQ ID NO: 362727 - DNA, 20 bp, Artificial Sequence
  chemically synthesized
gttaatacacttgacttcac

SEQ ID NO: 362728 - DNA, 20 bp, Artificial Sequence
  chemically synthesized
caattttaaggtatcttgtg

SEQ ID NO: 362729 - DNA, 20 bp, Artificial Sequence
  chemically synthesized
acattcactatacaatttta

SEQ ID NO: 362730 - DNA, 20 bp, Artificial Sequence
  chemically synthesized
tacattcactatacaatttt

SEQ ID NO: 362731 - DNA, 20 bp, Artificial Sequence
  chemically synthesized
caagataccttaaaattgta

SEQ ID NO: 362732 - DNA, 20 bp, Artificial Sequence
  chemically synthesized
tgtatagtgaatgtatcact

SEQ ID NO: 362733 - DNA, 20 bp, Artificial Sequence
  chemically synthesized
ttcagttcattgaggcaacc

SEQ ID NO: 362734 - DNA, 20 bp, Artificial Sequence
  chemically synthesized
ttttcattttcagttcattg

SEQ ID NO: 362735 - DNA, 20 bp, Artificial Sequence
  chemically synthesized
attttcattttcagttcatt

SEQ ID NO: 362736 - DNA, 20 bp, Artificial Sequence
  chemically synthesized
ggcaaaagcattttcatttt

SEQ ID NO: 362737 - DNA, 20 bp, Artificial Sequence
  chemically synthesized
tggtgtctttcatagggcaa

SEQ ID NO: 362738 - DNA, 20 bp, Artificial Sequence
  chemically synthesized
aaaatgcttttgccctatga

SEQ ID NO: 362739 - DNA, 20 bp, Artificial Sequence
  chemically synthesized
tccacatggtgtctttcata

SEQ ID NO: 362740 - DNA, 20 bp, Artificial Sequence
  chemically synthesized
atccacatggtgtctttcat

SEQ ID NO: 362741 - DNA, 20 bp, Artificial Sequence
  chemically synthesized
gatccacatggtgtctttca

SEQ ID NO: 362742 - DNA, 20 bp, Artificial Sequence
  chemically synthesized
gccctatgaaagacaccatg

SEQ ID NO: 362743 - DNA, 20 bp, Artificial Sequence
  chemically synthesized
cagagctcagtagatccaca

SEQ ID NO: 362744 - DNA, 20 bp, Artificial Sequence
  chemically synthesized
agacaccatgtggatctact

SEQ ID NO: 362745 - DNA, 20 bp, Artificial Sequence
  chemically synthesized
atggaatggccagagctcag

SEQ ID NO: 362746 - DNA, 20 bp, Artificial Sequence
  chemically synthesized
catgtggatctactgagctc

SEQ ID NO: 362747 - DNA, 20 bp, Artificial Sequence
  chemically synthesized
cctatggaatggccagagct

SEQ ID NO: 362748 - DNA, 20 bp, Artificial Sequence
  chemically synthesized
ctgagcctatggaatggcca

SEQ ID NO: 362749 - DNA, 20 bp, Artificial Sequence
  chemically synthesized
ccctgagcctatggaatggc

SEQ ID NO: 362750 - DNA, 20 bp, Artificial Sequence
  chemically synthesized
actgagctctggccattcca

SEQ ID NO: 362751 - DNA, 20 bp, Artificial Sequence
  chemically synthesized
ctgagctctggccattccat

SEQ ID NO: 362752 - DNA, 20 bp, Artificial Sequence
  chemically synthesized
tctcccctgagcctatggaa

SEQ ID NO: 362753 - DNA, 20 bp, Artificial Sequence
  chemically synthesized
ctctggccattccataggct

SEQ ID NO: 362754 - DNA, 20 bp, Artificial Sequence
  chemically synthesized
tctggccattccataggctc

SEQ ID NO: 362755 - DNA, 20 bp, Artificial Sequence
  chemically synthesized
aatgctctcccctgagccta

SEQ ID NO: 362756 - DNA, 20 bp, Artificial Sequence
  chemically synthesized
ctggccattccataggctca

SEQ ID NO: 362757 - DNA, 20 bp, Artificial Sequence
  chemically synthesized
tggccattccataggctcag

SEQ ID NO: 362758 - DNA, 20 bp, Artificial Sequence
  chemically synthesized
gccattccataggctcaggg

SEQ ID NO: 362759 - DNA, 20 bp, Artificial Sequence
  chemically synthesized
cattccataggctcagggga

SEQ ID NO: 362760 - DNA, 20 bp, Artificial Sequence
  chemically synthesized
tattgggaatgctctcccct

SEQ ID NO: 362761 - DNA, 20 bp, Artificial Sequence
  chemically synthesized
atcgtatgtctgtcattatt

SEQ ID NO: 362762 - DNA, 20 bp, Artificial Sequence
  chemically synthesized
gagagcattcccaataatga

SEQ ID NO: 362763 - DNA, 20 bp, Artificial Sequence
  chemically synthesized
aatcgtatgtctgtcattat

SEQ ID NO: 362764 - DNA, 20 bp, Artificial Sequence
  chemically synthesized
tgaactctcaacaaggcatt

SEQ ID NO: 362765 - DNA, 20 bp, Artificial Sequence
  chemically synthesized
gattttctgaatgccttgtt

SEQ ID NO: 362766 - DNA, 20 bp, Artificial Sequence
  chemically synthesized
ttttctgaatgccttgttga

SEQ ID NO: 362767 - DNA, 20 bp, Artificial Sequence
  chemically synthesized
tcaagtctgaactctcaaca

SEQ ID NO: 362768 - DNA, 20 bp, Artificial Sequence
  chemically synthesized
ttcaagtctgaactctcaac

SEQ ID NO: 362769 - DNA, 20 bp, Artificial Sequence
  chemically synthesized
tgaatgccttgttgagagtt

SEQ ID NO: 362770 - DNA, 20 bp, Artificial Sequence
  chemically synthesized
tgagagttcagacttgaatt

SEQ ID NO: 362771 - DNA, 20 bp, Artificial Sequence
  chemically synthesized
cagttacattaactaaattc

SEQ ID NO: 362772 - DNA, 20 bp, Artificial Sequence
  chemically synthesized
gagcaatagtttaaaaattt

SEQ ID NO: 362773 - DNA, 20 bp, Artificial Sequence
  chemically synthesized
tggatgtgcaagaagagcaa

SEQ ID NO: 362774 - DNA, 20 bp, Artificial Sequence
  chemically synthesized
tgaagttggatgtgcaagaa

SEQ ID NO: 362775 - DNA, 20 bp, Artificial Sequence
  chemically synthesized
tatgaagttggatgtgcaag

SEQ ID NO: 362776 - DNA, 20 bp, Artificial Sequence
  chemically synthesized
ccctatgaagttggatgtgc

SEQ ID NO: 362777 - DNA, 20 bp, Artificial Sequence
  chemically synthesized
ttcttgcacatccaacttca

SEQ ID NO: 362778 - DNA, 20 bp, Artificial Sequence
  chemically synthesized
tcttgcacatccaacttcat

SEQ ID NO: 362779 - DNA, 20 bp, Artificial Sequence
  chemically synthesized
aataaatctccctatgaagt

SEQ ID NO: 362780 - DNA, 20 bp, Artificial Sequence
  chemically synthesized
cttgcacatccaacttcata

SEQ ID NO: 362781 - DNA, 20 bp, Artificial Sequence
  chemically synthesized
tgcacatccaacttcatagg

SEQ ID NO: 362782 - DNA, 20 bp, Artificial Sequence
  chemically synthesized
tatcaataaatctccctatg

SEQ ID NO: 362783 - DNA, 20 bp, Artificial Sequence
  chemically synthesized
tagatacttctataaaatat

SEQ ID NO: 362784 - DNA, 20 bp, Artificial Sequence
  chemically synthesized
ttgataatgctcatatttta

SEQ ID NO: 362785 - DNA, 20 bp, Artificial Sequence
  chemically synthesized
ataatgctcatattttatag

SEQ ID NO: 362786 - DNA, 20 bp, Artificial Sequence
  chemically synthesized
atctcaacactaaagcatag

SEQ ID NO: 362787 - DNA, 20 bp, Artificial Sequence
  chemically synthesized
tagaagtatctactatgctt

SEQ ID NO: 362788 - DNA, 20 bp, Artificial Sequence
  chemically synthesized
tgtatctcaacactaaagca

SEQ ID NO: 362789 - DNA, 20 bp, Artificial Sequence
  chemically synthesized
atctactatgctttagtgtt

SEQ ID NO: 362790 - DNA, 20 bp, Artificial Sequence
  chemically synthesized
ttttctgtatctcaacacta

SEQ ID NO: 362791 - DNA, 20 bp, Artificial Sequence
  chemically synthesized
tatgctttagtgttgagata

SEQ ID NO: 362792 - DNA, 20 bp, Artificial Sequence
  chemically synthesized
acaaataactgtaggtttaa

SEQ ID NO: 362793 - DNA, 20 bp, Artificial Sequence
  chemically synthesized
gaaaatcactattaaaccta

SEQ ID NO: 362794 - DNA, 20 bp, Artificial Sequence
  chemically synthesized
ttgagagtacaaataactgt

SEQ ID NO: 362795 - DNA, 20 bp, Artificial Sequence
  chemically synthesized
attgagagtacaaataactg

SEQ ID NO: 362796 - DNA, 20 bp, Artificial Sequence
  chemically synthesized
atttaacagcaaaagattga

SEQ ID NO: 362797 - DNA, 20 bp, Artificial Sequence
  chemically synthesized
atatttaacagcaaaagatt

SEQ ID NO: 362798 - DNA, 20 bp, Artificial Sequence
  chemically synthesized
tatgacatatttaacagcaa

SEQ ID NO: 362799 - DNA, 20 bp, Artificial Sequence
  chemically synthesized
caagtttatgacatatttaa

SEQ ID NO: 362800 - DNA, 20 bp, Artificial Sequence
  chemically synthesized
taaatatgtcataaacttga

SEQ ID NO: 362801 - DNA, 20 bp, Artificial Sequence
  chemically synthesized
atatgtcataaacttgacag

SEQ ID NO: 362802 - DNA, 20 bp, Artificial Sequence
  chemically synthesized
gccattaattcaccactgtc

SEQ ID NO: 362803 - DNA, 20 bp, Artificial Sequence
  chemically synthesized
acttgacagtggtgaattaa

SEQ ID NO: 362804 - DNA, 20 bp, Artificial Sequence
  chemically synthesized
ttgatggaaatatattttta

SEQ ID NO: 362805 - DNA, 20 bp, Artificial Sequence
  chemically synthesized
aattgatggaaatatatttt

SEQ ID NO: 362806 - DNA, 20 bp, Artificial Sequence
  chemically synthesized
aatccatgaagaaaaattga

SEQ ID NO: 362807 - DNA, 20 bp, Artificial Sequence
  chemically synthesized
tttccatcaatttttcttca

SEQ ID NO: 362808 - DNA, 20 bp, Artificial Sequence
  chemically synthesized
gaaatgctgctaaatccatg

SEQ ID NO: 362809 - DNA, 20 bp, Artificial Sequence
  chemically synthesized
tcaatttttcttcatggatt

SEQ ID NO: 362810 - DNA, 20 bp, Artificial Sequence
  chemically synthesized
atttttcttcatggatttag

SEQ ID NO: 362811 - DNA, 20 bp, Artificial Sequence
  chemically synthesized
aacgaaaacgtatcgcacag

SEQ ID NO: 362812 - DNA, 20 bp, Artificial Sequence
  chemically synthesized
aataacgaaaacgtatcgca

SEQ ID NO: 362813 - DNA, 20 bp, Artificial Sequence
  chemically synthesized
cattttattcaagaaagtta

SEQ ID NO: 362814 - DNA, 20 bp, Artificial Sequence
  chemically synthesized
gagtgtcattttattcaaga

SEQ ID NO: 362815 - DNA, 20 bp, Artificial Sequence
  chemically synthesized
cttagagtgtcattttattc

SEQ ID NO: 362816 - DNA, 20 bp, Artificial Sequence
  chemically synthesized
cttgaataaaatgacactct

SEQ ID NO: 362817 - DNA, 20 bp, Artificial Sequence
  chemically synthesized
atagaatactaacaaactta

SEQ ID NO: 362818 - DNA, 20 bp, Artificial Sequence
  chemically synthesized
aaatgacactctaagtttgt

SEQ ID NO: 362819 - DNA, 20 bp, Artificial Sequence
  chemically synthesized
tgatagaatactaacaaact

SEQ ID NO: 362820 - DNA, 20 bp, Artificial Sequence
  chemically synthesized
acaaaatgaaaaatcagtga

SEQ ID NO: 362821 - DNA, 20 bp, Artificial Sequence
  chemically synthesized
aatcagacaaaatgaaaaat

SEQ ID NO: 362822 - DNA, 20 bp, Artificial Sequence
  chemically synthesized
aaatataaaacaggaaaaat

SEQ ID NO: 362823 - DNA, 20 bp, Artificial Sequence
  chemically synthesized
aataataaaaaatataaaac

SEQ ID NO: 362824 - DNA, 20 bp, Artificial Sequence
  chemically synthesized
gaataataaaaaatataaaa

SEQ ID NO: 362825 - DNA, 20 bp, Artificial Sequence
  chemically synthesized
tatattttttattattcttt

SEQ ID NO: 362826 - DNA, 20 bp, Artificial Sequence
  chemically synthesized
ttttattattctttaagttc

SEQ ID NO: 362827 - DNA, 20 bp, Artificial Sequence
  chemically synthesized
cacatgtaccccagaactta

SEQ ID NO: 362828 - DNA, 20 bp, Artificial Sequence
  chemically synthesized
tttattattctttaagttct

SEQ ID NO: 362829 - DNA, 20 bp, Artificial Sequence
  chemically synthesized
ttattattctttaagttctg

SEQ ID NO: 362830 - DNA, 20 bp, Artificial Sequence
  chemically synthesized
acaaacctgcacatgtaccc

SEQ ID NO: 362831 - DNA, 20 bp, Artificial Sequence
  chemically synthesized
taagttctggggtacatgtg

SEQ ID NO: 362832 - DNA, 20 bp, Artificial Sequence
  chemically synthesized
aagttctggggtacatgtgc

SEQ ID NO: 362833 - DNA, 20 bp, Artificial Sequence
  chemically synthesized
acatgtgcaggtttgttaca

SEQ ID NO: 362834 - DNA, 20 bp, Artificial Sequence
  chemically synthesized
acatagttatacacctgcga

SEQ ID NO: 362835 - DNA, 20 bp, Artificial Sequence
  chemically synthesized
tagttatacacctgcgatag

SEQ ID NO: 362836 - DNA, 20 bp, Artificial Sequence
  chemically synthesized
gtacagcaaaccactatcgc

SEQ ID NO: 362837 - DNA, 20 bp, Artificial Sequence
  chemically synthesized
ggtacagcaaaccactatcg

SEQ ID NO: 362838 - DNA, 20 bp, Artificial Sequence
  chemically synthesized
atagtggtttgctgtaccca

SEQ ID NO: 362839 - DNA, 20 bp, Artificial Sequence
  chemically synthesized
aggtgacgggtctatgggta

SEQ ID NO: 362840 - DNA, 20 bp, Artificial Sequence
  chemically synthesized
aatgtaggtgacgggtctat

SEQ ID NO: 362841 - DNA, 20 bp, Artificial Sequence
  chemically synthesized
taatgtaggtgacgggtcta

SEQ ID NO: 362842 - DNA, 20 bp, Artificial Sequence
  chemically synthesized
aaatacctaatgtaggtgac

SEQ ID NO: 362843 - DNA, 20 bp, Artificial Sequence
  chemically synthesized
gaaatacctaatgtaggtga

SEQ ID NO: 362844 - DNA, 20 bp, Artificial Sequence
  chemically synthesized
catagacccgtcacctacat

SEQ ID NO: 362845 - DNA, 20 bp, Artificial Sequence
  chemically synthesized
atagacccgtcacctacatt

SEQ ID NO: 362846 - DNA, 20 bp, Artificial Sequence
  chemically synthesized
ttaggagaaatacctaatgt

SEQ ID NO: 362847 - DNA, 20 bp, Artificial Sequence
  chemically synthesized
attaggagaaatacctaatg

SEQ ID NO: 362848 - DNA, 20 bp, Artificial Sequence
  chemically synthesized
taggggagggatagaattag

SEQ ID NO: 362849 - DNA, 20 bp, Artificial Sequence
  chemically synthesized
gctaggggagggatagaatt

SEQ ID NO: 362850 - DNA, 20 bp, Artificial Sequence
  chemically synthesized
ggctaggggagggatagaat

SEQ ID NO: 362851 - DNA, 20 bp, Artificial Sequence
  chemically synthesized
gtggggggctaggggaggga

SEQ ID NO: 362852 - DNA, 20 bp, Artificial Sequence
  chemically synthesized
tcctaattctatccctcccc

SEQ ID NO: 362853 - DNA, 20 bp, Artificial Sequence
  chemically synthesized
gagggtggggggctagggga

SEQ ID NO: 362854 - DNA, 20 bp, Artificial Sequence
  chemically synthesized
agagggtggggggctagggg

SEQ ID NO: 362855 - DNA, 20 bp, Artificial Sequence
  chemically synthesized
cagagggtggggggctaggg

SEQ ID NO: 362856 - DNA, 20 bp, Artificial Sequence
  chemically synthesized
gtcagagggtggggggctag

SEQ ID NO: 362857 - DNA, 20 bp, Artificial Sequence
  chemically synthesized
tgtcagagggtggggggcta

SEQ ID NO: 362858 - DNA, 20 bp, Artificial Sequence
  chemically synthesized
ctgtcagagggtggggggct

SEQ ID NO: 362859 - DNA, 20 bp, Artificial Sequence
  chemically synthesized
cctgtcagagggtggggggc

SEQ ID NO: 362860 - DNA, 20 bp, Artificial Sequence
  chemically synthesized
atggcctgtcagagggtggg

SEQ ID NO: 362861 - DNA, 20 bp, Artificial Sequence
  chemically synthesized
catggcctgtcagagggtgg

SEQ ID NO: 362862 - DNA, 20 bp, Artificial Sequence
  chemically synthesized
ccatggcctgtcagagggtg

SEQ ID NO: 362863 - DNA, 20 bp, Artificial Sequence
  chemically synthesized
accatggcctgtcagagggt

SEQ ID NO: 362864 - DNA, 20 bp, Artificial Sequence
  chemically synthesized
caccatggcctgtcagaggg

SEQ ID NO: 362865 - DNA, 20 bp, Artificial Sequence
  chemically synthesized
cctagccccccaccctctga

SEQ ID NO: 362866 - DNA, 20 bp, Artificial Sequence
  chemically synthesized
ctagccccccaccctctgac

SEQ ID NO: 362867 - DNA, 20 bp, Artificial Sequence
  chemically synthesized
acacaccatggcctgtcaga

SEQ ID NO: 362868 - DNA, 20 bp, Artificial Sequence
  chemically synthesized
cacacaccatggcctgtcag

SEQ ID NO: 362869 - DNA, 20 bp, Artificial Sequence
  chemically synthesized
tcacacaccatggcctgtca

SEQ ID NO: 362870 - DNA, 20 bp, Artificial Sequence
  chemically synthesized
cgtcacacaccatggcctgt

SEQ ID NO: 362871 - DNA, 20 bp, Artificial Sequence
  chemically synthesized
ccccaccctctgacaggcca

SEQ ID NO: 362872 - DNA, 20 bp, Artificial Sequence
  chemically synthesized
gaggggaacgtcacacacca

SEQ ID NO: 362873 - DNA, 20 bp, Artificial Sequence
  chemically synthesized
gaacatatggacattaggag

SEQ ID NO: 362874 - DNA, 20 bp, Artificial Sequence
  chemically synthesized
agaacatatggacattagga

SEQ ID NO: 362875 - DNA, 20 bp, Artificial Sequence
  chemically synthesized
gagaacatatggacattagg

SEQ ID NO: 362876 - DNA, 20 bp, Artificial Sequence
  chemically synthesized
tgagaacatatggacattag

SEQ ID NO: 362877 - DNA, 20 bp, Artificial Sequence
  chemically synthesized
aatgagaacatatggacatt

SEQ ID NO: 362878 - DNA, 20 bp, Artificial Sequence
  chemically synthesized
caatgagaacatatggacat

SEQ ID NO: 362879 - DNA, 20 bp, Artificial Sequence
  chemically synthesized
agctgaacaatgagaacata

SEQ ID NO: 362880 - DNA, 20 bp, Artificial Sequence
  chemically synthesized
gtccatatgttctcattgtt

SEQ ID NO: 362881 - DNA, 20 bp, Artificial Sequence
  chemically synthesized
ataagtggtagctgaacaat

SEQ ID NO: 362882 - DNA, 20 bp, Artificial Sequence
  chemically synthesized
atgttctgactcataagtgg

SEQ ID NO: 362883 - DNA, 20 bp, Artificial Sequence
  chemically synthesized
attgttcagctaccacttat

SEQ ID NO: 362884 - DNA, 20 bp, Artificial Sequence
  chemically synthesized
cgcatgttctgactcataag

SEQ ID NO: 362885 - DNA, 20 bp, Artificial Sequence
  chemically synthesized
ttcagctaccacttatgagt

SEQ ID NO: 362886 - DNA, 20 bp, Artificial Sequence
  chemically synthesized
caccgcatgttctgactcat

SEQ ID NO: 362887 - DNA, 20 bp, Artificial Sequence
  chemically synthesized
cacttatgagtcagaacatg

SEQ ID NO: 362888 - DNA, 20 bp, Artificial Sequence
  chemically synthesized
gagtcagaacatgcggtgtt

SEQ ID NO: 362889 - DNA, 20 bp, Artificial Sequence
  chemically synthesized
tcagcaaactaacacaagaa

SEQ ID NO: 362890 - DNA, 20 bp, Artificial Sequence
  chemically synthesized
ttggttttctgttcttgtgt

SEQ ID NO: 362891 - DNA, 20 bp, Artificial Sequence
  chemically synthesized
cattctcagcaaactaacac

SEQ ID NO: 362892 - DNA, 20 bp, Artificial Sequence
  chemically synthesized
tgttcttgtgttagtttgct

SEQ ID NO: 362893 - DNA, 20 bp, Artificial Sequence
  chemically synthesized
tgttagtttgctgagaatga

SEQ ID NO: 362894 - DNA, 20 bp, Artificial Sequence
  chemically synthesized
aagctggaaaccatcattct

SEQ ID NO: 362895 - DNA, 20 bp, Artificial Sequence
  chemically synthesized
ttgctgagaatgatggtttc

SEQ ID NO: 362896 - DNA, 20 bp, Artificial Sequence
  chemically synthesized
tgcagggacatggatgaagc

SEQ ID NO: 362897 - DNA, 20 bp, Artificial Sequence
  chemically synthesized
cctttgcagggacatggatg

SEQ ID NO: 362898 - DNA, 20 bp, Artificial Sequence
  chemically synthesized
tcatgtcctttgcagggaca

SEQ ID NO: 362899 - DNA, 20 bp, Artificial Sequence
  chemically synthesized
gcttcatccatgtccctgca

SEQ ID NO: 362900 - DNA, 20 bp, Artificial Sequence
  chemically synthesized
cttcatccatgtccctgcaa

SEQ ID NO: 362901 - DNA, 20 bp, Artificial Sequence
  chemically synthesized
atgagttcatgtcctttgca

SEQ ID NO: 362902 - DNA, 20 bp, Artificial Sequence
  chemically synthesized
aatgagttcatgtcctttgc

SEQ ID NO: 362903 - DNA, 20 bp, Artificial Sequence
  chemically synthesized
gaatgagttcatgtcctttg

SEQ ID NO: 362904 - DNA, 20 bp, Artificial Sequence
  chemically synthesized
tgcagccataaaaaaagaat

SEQ ID NO: 362905 - DNA, 20 bp, Artificial Sequence
  chemically synthesized
atgaactcattcttttttta

SEQ ID NO: 362906 - DNA, 20 bp, Artificial Sequence
  chemically synthesized
atactatgcagccataaaaa

SEQ ID NO: 362907 - DNA, 20 bp, Artificial Sequence
  chemically synthesized
attctttttttatggctgca

SEQ ID NO: 362908 - DNA, 20 bp, Artificial Sequence
  chemically synthesized
atacaccatggaatactatg

SEQ ID NO: 362909 - DNA, 20 bp, Artificial Sequence
  chemically synthesized
tatggctgcatagtattcca

SEQ ID NO: 362910 - DNA, 20 bp, Artificial Sequence
  chemically synthesized
aatgtggtacatatacacca

SEQ ID NO: 362911 - DNA, 20 bp, Artificial Sequence
  chemically synthesized
tagactggattaagaaaatg

SEQ ID NO: 362912 - DNA, 20 bp, Artificial Sequence
  chemically synthesized
tgtaccacattttcttaatc

SEQ ID NO: 362913 - DNA, 20 bp, Artificial Sequence
  chemically synthesized
catcagtgatagactggatt

SEQ ID NO: 362914 - DNA, 20 bp, Artificial Sequence
  chemically synthesized
aatgtccatcagtgatagac

SEQ ID NO: 362915 - DNA, 20 bp, Artificial Sequence
  chemically synthesized
ttaatccagtctatcactga

SEQ ID NO: 362916 - DNA, 20 bp, Artificial Sequence
  chemically synthesized
ggccaaatgtccatcagtga

SEQ ID NO: 362917 - DNA, 20 bp, Artificial Sequence
  chemically synthesized
tatgttggccaaatgtccat

SEQ ID NO: 362918 - DNA, 20 bp, Artificial Sequence
  chemically synthesized
gtctatcactgatggacatt

SEQ ID NO: 362919 - DNA, 20 bp, Artificial Sequence
  chemically synthesized
gcattttttcgtatgtatgt

SEQ ID NO: 362920 - DNA, 20 bp, Artificial Sequence
  chemically synthesized
tttttctaatgacaagtgat

SEQ ID NO: 362921 - DNA, 20 bp, Artificial Sequence
  chemically synthesized
aaatgcttatcacttgtcat

SEQ ID NO: 362922 - DNA, 20 bp, Artificial Sequence
  chemically synthesized
atttgcatttttctaatgac

SEQ ID NO: 362923 - DNA, 20 bp, Artificial Sequence
  chemically synthesized
atgcaaatcaaaaccacaat

SEQ ID NO: 362924 - DNA, 20 bp, Artificial Sequence
  chemically synthesized
tgttaaatggtatctcattg

SEQ ID NO: 362925 - DNA, 20 bp, Artificial Sequence
  chemically synthesized
ccattctaactgttgttaaa

SEQ ID NO: 362926 - DNA, 20 bp, Artificial Sequence
  chemically synthesized
aatgagataccatttaacaa

SEQ ID NO: 362927 - DNA, 20 bp, Artificial Sequence
  chemically synthesized
agataccatttaacaacagt

SEQ ID NO: 362928 - DNA, 20 bp, Artificial Sequence
  chemically synthesized
ccatttaacaacagttagaa

SEQ ID NO: 362929 - DNA, 20 bp, Artificial Sequence
  chemically synthesized
ttagaatggcaatcattaaa

SEQ ID NO: 362930 - DNA, 20 bp, Artificial Sequence
  chemically synthesized
aatggcaatcattaaaaagt

SEQ ID NO: 362931 - DNA, 20 bp, Artificial Sequence
  chemically synthesized
aatcattaaaaagtcagcaa

SEQ ID NO: 362932 - DNA, 20 bp, Artificial Sequence
  chemically synthesized
aaaaagtcagcaaaagatgc

SEQ ID NO: 362933 - DNA, 20 bp, Artificial Sequence
  chemically synthesized
aaagtcagcaaaagatgctg

SEQ ID NO: 362934 - DNA, 20 bp, Artificial Sequence
  chemically synthesized
agtcagcaaaagatgctgga

SEQ ID NO: 362935 - DNA, 20 bp, Artificial Sequence
  chemically synthesized
ctatttctccatattctctc

SEQ ID NO: 362936 - DNA, 20 bp, Artificial Sequence
  chemically synthesized
aaaagatgctggagagaata

SEQ ID NO: 362937 - DNA, 20 bp, Artificial Sequence
  chemically synthesized
aagatgctggagagaatatg

SEQ ID NO: 362938 - DNA, 20 bp, Artificial Sequence
  chemically synthesized
ctggagagaatatggagaaa

SEQ ID NO: 362939 - DNA, 20 bp, Artificial Sequence
  chemically synthesized
tggagagaatatggagaaat

SEQ ID NO: 362940 - DNA, 20 bp, Artificial Sequence
  chemically synthesized
cattcccaccaacagtgtaa

SEQ ID NO: 362941 - DNA, 20 bp, Artificial Sequence
  chemically synthesized
taggaatgcttttacactgt

SEQ ID NO: 362942 - DNA, 20 bp, Artificial Sequence
  chemically synthesized
gaatgcttttacactgttgg

SEQ ID NO: 362943 - DNA, 20 bp, Artificial Sequence
  chemically synthesized
aatgcttttacactgttggt

SEQ ID NO: 362944 - DNA, 20 bp, Artificial Sequence
  chemically synthesized
ctaatttacattcccaccaa

SEQ ID NO: 362945 - DNA, 20 bp, Artificial Sequence
  chemically synthesized
ctgttggtgggaatgtaaat

SEQ ID NO: 362946 - DNA, 20 bp, Artificial Sequence
  chemically synthesized
gtaaattagttcaaccattg

SEQ ID NO: 362947 - DNA, 20 bp, Artificial Sequence
  chemically synthesized
aattagttcaaccattgtgg

SEQ ID NO: 362948 - DNA, 20 bp, Artificial Sequence
  chemically synthesized
caccacactgtcttccacaa

SEQ ID NO: 362949 - DNA, 20 bp, Artificial Sequence
  chemically synthesized
agttcaaccattgtggaaga

SEQ ID NO: 362950 - DNA, 20 bp, Artificial Sequence
  chemically synthesized
aaccattgtggaagacagtg

SEQ ID NO: 362951 - DNA, 20 bp, Artificial Sequence
  chemically synthesized
agacagtgtggtgattcctc

SEQ ID NO: 362952 - DNA, 20 bp, Artificial Sequence
  chemically synthesized
gacagtgtggtgattcctca

SEQ ID NO: 362953 - DNA, 20 bp, Artificial Sequence
  chemically synthesized
tttctagttccagatccttg

SEQ ID NO: 362954 - DNA, 20 bp, Artificial Sequence
  chemically synthesized
gtggtgattcctcaaggatc

SEQ ID NO: 362955 - DNA, 20 bp, Artificial Sequence
  chemically synthesized
atttctagttccagatcctt

SEQ ID NO: 362956 - DNA, 20 bp, Artificial Sequence
  chemically synthesized
attcctcaaggatctggaac

SEQ ID NO: 362957 - DNA, 20 bp, Artificial Sequence
  chemically synthesized
tcaaatggtatttctagttc

SEQ ID NO: 362958 - DNA, 20 bp, Artificial Sequence
  chemically synthesized
gctgggtcaaatggtatttc

SEQ ID NO: 362959 - DNA, 20 bp, Artificial Sequence
  chemically synthesized
actagaaataccatttgacc

SEQ ID NO: 362960 - DNA, 20 bp, Artificial Sequence
  chemically synthesized
aacaggattgctgggtcaaa

SEQ ID NO: 362961 - DNA, 20 bp, Artificial Sequence
  chemically synthesized
tacccagtaacaggattgct

SEQ ID NO: 362962 - DNA, 20 bp, Artificial Sequence
  chemically synthesized
atacccagtaacaggattgc

SEQ ID NO: 362963 - DNA, 20 bp, Artificial Sequence
  chemically synthesized
tgacccagcaatcctgttac

SEQ ID NO: 362964 - DNA, 20 bp, Artificial Sequence
  chemically synthesized
gacccagcaatcctgttact

SEQ ID NO: 362965 - DNA, 20 bp, Artificial Sequence
  chemically synthesized
ttggatatatacccagtaac

SEQ ID NO: 362966 - DNA, 20 bp, Artificial Sequence
  chemically synthesized
tttggatatatacccagtaa

SEQ ID NO: 362967 - DNA, 20 bp, Artificial Sequence
  chemically synthesized
taatcctttggatatatacc

SEQ ID NO: 362968 - DNA, 20 bp, Artificial Sequence
  chemically synthesized
tgttactgggtatatatcca

SEQ ID NO: 362969 - DNA, 20 bp, Artificial Sequence
  chemically synthesized
gttactgggtatatatccaa

SEQ ID NO: 362970 - DNA, 20 bp, Artificial Sequence
  chemically synthesized
tagaatgatttataatcctt

SEQ ID NO: 362971 - DNA, 20 bp, Artificial Sequence
  chemically synthesized
ttataaatcattctactatg

SEQ ID NO: 362972 - DNA, 20 bp, Artificial Sequence
  chemically synthesized
gtgtgcatgtgtcttcatag

SEQ ID NO: 362973 - DNA, 20 bp, Artificial Sequence
  chemically synthesized
gatgtgtgcatgtgtcttca

SEQ ID NO: 362974 - DNA, 20 bp, Artificial Sequence
  chemically synthesized
atgcacacatctgttcattg

SEQ ID NO: 362975 - DNA, 20 bp, Artificial Sequence
  chemically synthesized
gtgaatagtgccacaatgaa

SEQ ID NO: 362976 - DNA, 20 bp, Artificial Sequence
  chemically synthesized
cattgtggcactattcacaa

SEQ ID NO: 362977 - DNA, 20 bp, Artificial Sequence
  chemically synthesized
caagtctttgctattgtgaa

SEQ ID NO: 362978 - DNA, 20 bp, Artificial Sequence
  chemically synthesized
tggcactattcacaatagca

SEQ ID NO: 362979 - DNA, 20 bp, Artificial Sequence
  chemically synthesized
tattcacaatagcaaagact

SEQ ID NO: 362980 - DNA, 20 bp, Artificial Sequence
  chemically synthesized
taaaaatcagtaatagttcc

SEQ ID NO: 362981 - DNA, 20 bp, Artificial Sequence
  chemically synthesized
gttattttaaaaatcagtaa

SEQ ID NO: 362982 - DNA, 20 bp, Artificial Sequence
  chemically synthesized
agtcaggttattttaaaaat

SEQ ID NO: 362983 - DNA, 20 bp, Artificial Sequence
  chemically synthesized
aattaaatgggtcataagtc

SEQ ID NO: 362984 - DNA, 20 bp, Artificial Sequence
  chemically synthesized
aaattaaatgggtcataagt

SEQ ID NO: 362985 - DNA, 20 bp, Artificial Sequence
  chemically synthesized
ctagaaattaaatgggtcat

SEQ ID NO: 362986 - DNA, 20 bp, Artificial Sequence
  chemically synthesized
aacactactagaaattaaat

SEQ ID NO: 362987 - DNA, 20 bp, Artificial Sequence
  chemically synthesized
aaacactactagaaattaaa

SEQ ID NO: 362988 - DNA, 20 bp, Artificial Sequence
  chemically synthesized
cttatgacccatttaatttc

SEQ ID NO: 362989 - DNA, 20 bp, Artificial Sequence
  chemically synthesized
atgacccatttaatttctag

SEQ ID NO: 362990 - DNA, 20 bp, Artificial Sequence
  chemically synthesized
aatgactaaaaaaacactac

SEQ ID NO: 362991 - DNA, 20 bp, Artificial Sequence
  chemically synthesized
aatttctagtagtgtttttt

SEQ ID NO: 362992 - DNA, 20 bp, Artificial Sequence
  chemically synthesized
ttagtcattgtcatctcatt

SEQ ID NO: 362993 - DNA, 20 bp, Artificial Sequence
  chemically synthesized
atttggactcaggtctaaat

SEQ ID NO: 362994 - DNA, 20 bp, Artificial Sequence
  chemically synthesized
ttgtcatctcatttagacct

SEQ ID NO: 362995 - DNA, 20 bp, Artificial Sequence
  chemically synthesized
cattgttggcatttggactc

SEQ ID NO: 362996 - DNA, 20 bp, Artificial Sequence
  chemically synthesized
ccattgttggcatttggact

SEQ ID NO: 362997 - DNA, 20 bp, Artificial Sequence
  chemically synthesized
ggtgagccattgttggcatt

SEQ ID NO: 362998 - DNA, 20 bp, Artificial Sequence
  chemically synthesized
ctgagtccaaatgccaacaa

SEQ ID NO: 362999 - DNA, 20 bp, Artificial Sequence
  chemically synthesized
aaagcatggtgagccattgt

SEQ ID NO: 363000 - DNA, 20 bp, Artificial Sequence
  chemically synthesized
tgagaagaagaaagcatggt

SEQ ID NO: 363001 - DNA, 20 bp, Artificial Sequence
  chemically synthesized
ggggtgagaagaagaaagca

SEQ ID NO: 363002 - DNA, 20 bp, Artificial Sequence
  chemically synthesized
aggtgggggtgagaagaaga

SEQ ID NO: 363003 - DNA, 20 bp, Artificial Sequence
  chemically synthesized
agtaaggtgggggtgagaag

SEQ ID NO: 363004 - DNA, 20 bp, Artificial Sequence
  chemically synthesized
ggtagtaaggtgggggtgag

SEQ ID NO: 363005 - DNA, 20 bp, Artificial Sequence
  chemically synthesized
agaggtagtaaggtgggggt

SEQ ID NO: 363006 - DNA, 20 bp, Artificial Sequence
  chemically synthesized
gcagagaggtagtaaggtgg

SEQ ID NO: 363007 - DNA, 20 bp, Artificial Sequence
  chemically synthesized
agcagagaggtagtaaggtg

SEQ ID NO: 363008 - DNA, 20 bp, Artificial Sequence
  chemically synthesized
gagcagagaggtagtaaggt

SEQ ID NO: 363009 - DNA, 20 bp, Artificial Sequence
  chemically synthesized
ggagcagagaggtagtaagg

SEQ ID NO: 363010 - DNA, 20 bp, Artificial Sequence
  chemically synthesized
aggggagcagagaggtagta

SEQ ID NO: 363011 - DNA, 20 bp, Artificial Sequence
  chemically synthesized
taggggagcagagaggtagt

SEQ ID NO: 363012 - DNA, 20 bp, Artificial Sequence
  chemically synthesized
gagataggggagcagagagg

SEQ ID NO: 363013 - DNA, 20 bp, Artificial Sequence
  chemically synthesized
gcagagataggggagcagag

SEQ ID NO: 363014 - DNA, 20 bp, Artificial Sequence
  chemically synthesized
agcagagataggggagcaga

SEQ ID NO: 363015 - DNA, 20 bp, Artificial Sequence
  chemically synthesized
atagcagagataggggagca

SEQ ID NO: 363016 - DNA, 20 bp, Artificial Sequence
  chemically synthesized
acatagcagagataggggag

SEQ ID NO: 363017 - DNA, 20 bp, Artificial Sequence
  chemically synthesized
gaaacatagcagagataggg

SEQ ID NO: 363018 - DNA, 20 bp, Artificial Sequence
  chemically synthesized
aggaaacatagcagagatag

SEQ ID NO: 363019 - DNA, 20 bp, Artificial Sequence
  chemically synthesized
aaggaaacatagcagagata

SEQ ID NO: 363020 - DNA, 20 bp, Artificial Sequence
  chemically synthesized
aaaggaaacatagcagagat

SEQ ID NO: 363021 - DNA, 20 bp, Artificial Sequence
  chemically synthesized
taaaggaaacatagcagaga

SEQ ID NO: 363022 - DNA, 20 bp, Artificial Sequence
  chemically synthesized
gagataaaggaaacatagca

SEQ ID NO: 363023 - DNA, 20 bp, Artificial Sequence
  chemically synthesized
tagagataaaggaaacatag

SEQ ID NO: 363024 - DNA, 20 bp, Artificial Sequence
  chemically synthesized
gtttagagataaaggaaaca

SEQ ID NO: 363025 - DNA, 20 bp, Artificial Sequence
  chemically synthesized
tagagtgagtttagagataa

SEQ ID NO: 363026 - DNA, 20 bp, Artificial Sequence
  chemically synthesized
gtagagtgagtttagagata

SEQ ID NO: 363027 - DNA, 20 bp, Artificial Sequence
  chemically synthesized
agtggagtagagtgagttta

SEQ ID NO: 363028 - DNA, 20 bp, Artificial Sequence
  chemically synthesized
caagtggagtagagtgagtt

SEQ ID NO: 363029 - DNA, 20 bp, Artificial Sequence
  chemically synthesized
ctcagcaagtggagtagagt

SEQ ID NO: 363030 - DNA, 20 bp, Artificial Sequence
  chemically synthesized
aggcctcagcaagtggagta

SEQ ID NO: 363031 - DNA, 20 bp, Artificial Sequence
  chemically synthesized
tgaggcctcagcaagtggag

SEQ ID NO: 363032 - DNA, 20 bp, Artificial Sequence
  chemically synthesized
gaatgaggcctcagcaagtg

SEQ ID NO: 363033 - DNA, 20 bp, Artificial Sequence
  chemically synthesized
ctcactctactccacttgct

SEQ ID NO: 363034 - DNA, 20 bp, Artificial Sequence
  chemically synthesized
tcactctactccacttgctg

SEQ ID NO: 363035 - DNA, 20 bp, Artificial Sequence
  chemically synthesized
tggaatgaggcctcagcaag

SEQ ID NO: 363036 - DNA, 20 bp, Artificial Sequence
  chemically synthesized
atttggaatgaggcctcagc

SEQ ID NO: 363037 - DNA, 20 bp, Artificial Sequence
  chemically synthesized
aagcatttggaatgaggcct

SEQ ID NO: 363038 - DNA, 20 bp, Artificial Sequence
  chemically synthesized
gtgaaaaagcatttggaatg

SEQ ID NO: 363039 - DNA, 20 bp, Artificial Sequence
  chemically synthesized
ggtgaaaaagcatttggaat

SEQ ID NO: 363040 - DNA, 20 bp, Artificial Sequence
  chemically synthesized
ccttaaggtgaaaaagcatt

SEQ ID NO: 363041 - DNA, 20 bp, Artificial Sequence
  chemically synthesized
ataaagaccttaaggtgaaa

SEQ ID NO: 363042 - DNA, 20 bp, Artificial Sequence
  chemically synthesized
tccaaatgctttttcacctt

SEQ ID NO: 363043 - DNA, 20 bp, Artificial Sequence
  chemically synthesized
ccaaatgctttttcacctta

SEQ ID NO: 363044 - DNA, 20 bp, Artificial Sequence
  chemically synthesized
gcacggtaataaagacctta

SEQ ID NO: 363045 - DNA, 20 bp, Artificial Sequence
  chemically synthesized
ggcacggtaataaagacctt

SEQ ID NO: 363046 - DNA, 20 bp, Artificial Sequence
  chemically synthesized
gtgggttaggcacggtaata

SEQ ID NO: 363047 - DNA, 20 bp, Artificial Sequence
  chemically synthesized
ataggaaggtgggttaggca

SEQ ID NO: 363048 - DNA, 20 bp, Artificial Sequence
  chemically synthesized
tgtctataggaaggtgggtt

SEQ ID NO: 363049 - DNA, 20 bp, Artificial Sequence
  chemically synthesized
ttgtctataggaaggtgggt

SEQ ID NO: 363050 - DNA, 20 bp, Artificial Sequence
  chemically synthesized
ggaattgtctataggaaggt

SEQ ID NO: 363051 - DNA, 20 bp, Artificial Sequence
  chemically synthesized
tggaattgtctataggaagg

SEQ ID NO: 363052 - DNA, 20 bp, Artificial Sequence
  chemically synthesized
gtgcctaacccaccttccta

SEQ ID NO: 363053 - DNA, 20 bp, Artificial Sequence
  chemically synthesized
ccttggaattgtctatagga

SEQ ID NO: 363054 - DNA, 20 bp, Artificial Sequence
  chemically synthesized
gccttggaattgtctatagg

SEQ ID NO: 363055 - DNA, 20 bp, Artificial Sequence
  chemically synthesized
tgagccttggaattgtctat

SEQ ID NO: 363056 - DNA, 20 bp, Artificial Sequence
  chemically synthesized
gtgagccttggaattgtcta

SEQ ID NO: 363057 - DNA, 20 bp, Artificial Sequence
  chemically synthesized
accttcctatagacaattcc

SEQ ID NO: 363058 - DNA, 20 bp, Artificial Sequence
  chemically synthesized
ccttcctatagacaattcca

SEQ ID NO: 363059 - DNA, 20 bp, Artificial Sequence
  chemically synthesized
tggagaaagggagtgagcct

SEQ ID NO: 363060 - DNA, 20 bp, Artificial Sequence
  chemically synthesized
gagacctggagaaagggagt

SEQ ID NO: 363061 - DNA, 20 bp, Artificial Sequence
  chemically synthesized
agcagagacctggagaaagg

SEQ ID NO: 363062 - DNA, 20 bp, Artificial Sequence
  chemically synthesized
caaggctcactccctttctc

SEQ ID NO: 363063 - DNA, 20 bp, Artificial Sequence
  chemically synthesized
aaggctcactccctttctcc

SEQ ID NO: 363064 - DNA, 20 bp, Artificial Sequence
  chemically synthesized
tgagcagagacctggagaaa

SEQ ID NO: 363065 - DNA, 20 bp, Artificial Sequence
  chemically synthesized
atgagcagagacctggagaa

SEQ ID NO: 363066 - DNA, 20 bp, Artificial Sequence
  chemically synthesized
tatgagcagagacctggaga

SEQ ID NO: 363067 - DNA, 20 bp, Artificial Sequence
  chemically synthesized
cctatatgagcagagacctg

SEQ ID NO: 363068 - DNA, 20 bp, Artificial Sequence
  chemically synthesized
ttcctatatgagcagagacc

SEQ ID NO: 363069 - DNA, 20 bp, Artificial Sequence
  chemically synthesized
gttcagttcctatatgagca

SEQ ID NO: 363070 - DNA, 20 bp, Artificial Sequence
  chemically synthesized
tctccaggtctctgctcata

SEQ ID NO: 363071 - DNA, 20 bp, Artificial Sequence
  chemically synthesized
ctccaggtctctgctcatat

SEQ ID NO: 363072 - DNA, 20 bp, Artificial Sequence
  chemically synthesized
tggttcagttcctatatgag

SEQ ID NO: 363073 - DNA, 20 bp, Artificial Sequence
  chemically synthesized
ttttggttcagttcctatat

SEQ ID NO: 363074 - DNA, 20 bp, Artificial Sequence
  chemically synthesized
tcatataggaactgaaccaa

SEQ ID NO: 363075 - DNA, 20 bp, Artificial Sequence
  chemically synthesized
catataggaactgaaccaaa

SEQ ID NO: 363076 - DNA, 20 bp, Artificial Sequence
  chemically synthesized
tctgagaagaccttttggtt

SEQ ID NO: 363077 - DNA, 20 bp, Artificial Sequence
  chemically synthesized
agaggtctgagaagaccttt

SEQ ID NO: 363078 - DNA, 20 bp, Artificial Sequence
  chemically synthesized
actgaaccaaaaggtcttct

SEQ ID NO: 363079 - DNA, 20 bp, Artificial Sequence
  chemically synthesized
catagaataagaggtctgag

SEQ ID NO: 363080 - DNA, 20 bp, Artificial Sequence
  chemically synthesized
atacatagaataagaggtct

SEQ ID NO: 363081 - DNA, 20 bp, Artificial Sequence
  chemically synthesized
aaagagatacatagaataag

SEQ ID NO: 363082 - DNA, 20 bp, Artificial Sequence
  chemically synthesized
aaaagagatacatagaataa

SEQ ID NO: 363083 - DNA, 20 bp, Artificial Sequence
  chemically synthesized
aaaaaagagatacatagaat

SEQ ID NO: 363084 - DNA, 20 bp, Artificial Sequence
  chemically synthesized
gtgaataaaaaagagataca

SEQ ID NO: 363085 - DNA, 20 bp, Artificial Sequence
  chemically synthesized
acagttaagtgaataaaaaa

SEQ ID NO: 363086 - DNA, 20 bp, Artificial Sequence
  chemically synthesized
gaacagttaagtgaataaaa

SEQ ID NO: 363087 - DNA, 20 bp, Artificial Sequence
  chemically synthesized
atatatacttaggaacagtt

SEQ ID NO: 363088 - DNA, 20 bp, Artificial Sequence
  chemically synthesized
ttattcacttaactgttcct

SEQ ID NO: 363089 - DNA, 20 bp, Artificial Sequence
  chemically synthesized
gaagcatatatacttaggaa

SEQ ID NO: 363090 - DNA, 20 bp, Artificial Sequence
  chemically synthesized
aatatgaagcatatatactt

SEQ ID NO: 363091 - DNA, 20 bp, Artificial Sequence
  chemically synthesized
caatatgaagcatatatact

SEQ ID NO: 363092 - DNA, 20 bp, Artificial Sequence
  chemically synthesized
gccacatggtaggcaatatg

SEQ ID NO: 363093 - DNA, 20 bp, Artificial Sequence
  chemically synthesized
gcttcatattgcctaccatg

SEQ ID NO: 363094 - DNA, 20 bp, Artificial Sequence
  chemically synthesized
agagattacagccacatggt

SEQ ID NO: 363095 - DNA, 20 bp, Artificial Sequence
  chemically synthesized
cagagattacagccacatgg

SEQ ID NO: 363096 - DNA, 20 bp, Artificial Sequence
  chemically synthesized
tgtcagagattacagccaca

SEQ ID NO: 363097 - DNA, 20 bp, Artificial Sequence
  chemically synthesized
cctttgtgtgtcagagatta

SEQ ID NO: 363098 - DNA, 20 bp, Artificial Sequence
  chemically synthesized
acacaaccctttgtgtgtca

SEQ ID NO: 363099 - DNA, 20 bp, Artificial Sequence
  chemically synthesized
gctgtaatctctgacacaca

SEQ ID NO: 363100 - DNA, 20 bp, Artificial Sequence
  chemically synthesized
aaacacaaccctttgtgtgt

SEQ ID NO: 363101 - DNA, 20 bp, Artificial Sequence
  chemically synthesized
ctgtaatctctgacacacaa

SEQ ID NO: 363102 - DNA, 20 bp, Artificial Sequence
  chemically synthesized
tgtaatctctgacacacaaa

SEQ ID NO: 363103 - DNA, 20 bp, Artificial Sequence
  chemically synthesized
aagttgattgattggtgtca

SEQ ID NO: 363104 - DNA, 20 bp, Artificial Sequence
  chemically synthesized
ataagttgattgattggtgt

SEQ ID NO: 363105 - DNA, 20 bp, Artificial Sequence
  chemically synthesized
aggtatataagttgattgat

SEQ ID NO: 363106 - DNA, 20 bp, Artificial Sequence
  chemically synthesized
tttaaaattcacaggtatat

SEQ ID NO: 363107 - DNA, 20 bp, Artificial Sequence
  chemically synthesized
aatttccttttaaaattcac

SEQ ID NO: 363108 - DNA, 20 bp, Artificial Sequence
  chemically synthesized
aaatttccttttaaaattca

SEQ ID NO: 363109 - DNA, 20 bp, Artificial Sequence
  chemically synthesized
tatatacctgtgaattttaa

SEQ ID NO: 363110 - DNA, 20 bp, Artificial Sequence
  chemically synthesized
atatacctgtgaattttaaa

SEQ ID NO: 363111 - DNA, 20 bp, Artificial Sequence
  chemically synthesized
gtgaattttaaaaggaaatt

SEQ ID NO: 363112 - DNA, 20 bp, Artificial Sequence
  chemically synthesized
attttaaaaggaaatttgga

SEQ ID NO: 363113 - DNA, 20 bp, Artificial Sequence
  chemically synthesized
ttttaaaaggaaatttggat

SEQ ID NO: 363114 - DNA, 20 bp, Artificial Sequence
  chemically synthesized
tataaataatcacattgaag

SEQ ID NO: 363115 - DNA, 20 bp, Artificial Sequence
  chemically synthesized
ggatataaataatcacattg

SEQ ID NO: 363116 - DNA, 20 bp, Artificial Sequence
  chemically synthesized
gtgattatttatatcctgca

SEQ ID NO: 363117 - DNA, 20 bp, Artificial Sequence
  chemically synthesized
tgattatttatatcctgcac

SEQ ID NO: 363118 - DNA, 20 bp, Artificial Sequence
  chemically synthesized
ctatatcaataagcctgtgc

SEQ ID NO: 363119 - DNA, 20 bp, Artificial Sequence
  chemically synthesized
tctatatcaataagcctgtg

SEQ ID NO: 363120 - DNA, 20 bp, Artificial Sequence
  chemically synthesized
cctgcacaggcttattgata

SEQ ID NO: 363121 - DNA, 20 bp, Artificial Sequence
  chemically synthesized
tgggtgtgttctatatcaat

SEQ ID NO: 363122 - DNA, 20 bp, Artificial Sequence
  chemically synthesized
tattgatatagaacacaccc

SEQ ID NO: 363123 - DNA, 20 bp, Artificial Sequence
  chemically synthesized
ttttttctaaagttgagctt

SEQ ID NO: 363124 - DNA, 20 bp, Artificial Sequence
  chemically synthesized
tttttttctaaagttgagct

SEQ ID NO: 363125 - DNA, 20 bp, Artificial Sequence
  chemically synthesized
aacacacccaagctcaactt

SEQ ID NO: 363126 - DNA, 20 bp, Artificial Sequence
  chemically synthesized
aggattttttttctaaagtt

SEQ ID NO: 363127 - DNA, 20 bp, Artificial Sequence
  chemically synthesized
caagcaggattttttttcta

SEQ ID NO: 363128 - DNA, 20 bp, Artificial Sequence
  chemically synthesized
ttagaaaaaaaatcctgctt

SEQ ID NO: 363129 - DNA, 20 bp, Artificial Sequence
  chemically synthesized
ataaatcaaaatgctcaagc

SEQ ID NO: 363130 - DNA, 20 bp, Artificial Sequence
  chemically synthesized
aataaatcaaaatgctcaag

SEQ ID NO: 363131 - DNA, 20 bp, Artificial Sequence
  chemically synthesized
aagaataaatcaaaatgctc

SEQ ID NO: 363132 - DNA, 20 bp, Artificial Sequence
  chemically synthesized
tttgatttattcttcctaat

SEQ ID NO: 363133 - DNA, 20 bp, Artificial Sequence
  chemically synthesized
actttagtttgcttattagg

SEQ ID NO: 363134 - DNA, 20 bp, Artificial Sequence
  chemically synthesized
acaactttagtttgcttatt

SEQ ID NO: 363135 - DNA, 20 bp, Artificial Sequence
  chemically synthesized
tacaactttagtttgcttat

SEQ ID NO: 363136 - DNA, 20 bp, Artificial Sequence
  chemically synthesized
tcttcctaataagcaaacta

SEQ ID NO: 363137 - DNA, 20 bp, Artificial Sequence
  chemically synthesized
aacatccataagtacaactt

SEQ ID NO: 363138 - DNA, 20 bp, Artificial Sequence
  chemically synthesized
gcaaactaaagttgtactta

SEQ ID NO: 363139 - DNA, 20 bp, Artificial Sequence
  chemically synthesized
caaaaatggaaaacatccat

SEQ ID NO: 363140 - DNA, 20 bp, Artificial Sequence
  chemically synthesized
gtcataagtataaacaaaaa

SEQ ID NO: 363141 - DNA, 20 bp, Artificial Sequence
  chemically synthesized
ataattctccattttgtcat

SEQ ID NO: 363142 - DNA, 20 bp, Artificial Sequence
  chemically synthesized
tgtttatacttatgacaaaa

SEQ ID NO: 363143 - DNA, 20 bp, Artificial Sequence
  chemically synthesized
tttatacttatgacaaaatg

SEQ ID NO: 363144 - DNA, 20 bp, Artificial Sequence
  chemically synthesized
atgacaaaatggagaattat

SEQ ID NO: 363145 - DNA, 20 bp, Artificial Sequence
  chemically synthesized
attttttttttttcactctg

SEQ ID NO: 363146 - DNA, 20 bp, Artificial Sequence
  chemically synthesized
tttttttttcactctgtggc

SEQ ID NO: 363147 - DNA, 20 bp, Artificial Sequence
  chemically synthesized
ttttttttcactctgtggcc

SEQ ID NO: 363148 - DNA, 20 bp, Artificial Sequence
  chemically synthesized
tgcactccagcctggccaca

SEQ ID NO: 363149 - DNA, 20 bp, Artificial Sequence
  chemically synthesized
actgcactccagcctggcca

SEQ ID NO: 363150 - DNA, 20 bp, Artificial Sequence
  chemically synthesized
ttttcactctgtggccaggc

SEQ ID NO: 363151 - DNA, 20 bp, Artificial Sequence
  chemically synthesized
ttcactctgtggccaggctg

SEQ ID NO: 363152 - DNA, 20 bp, Artificial Sequence
  chemically synthesized
cgtgccactgcactccagcc

SEQ ID NO: 363153 - DNA, 20 bp, Artificial Sequence
  chemically synthesized
tctgtggccaggctggagtg

SEQ ID NO: 363154 - DNA, 20 bp, Artificial Sequence
  chemically synthesized
gagatcgtgccactgcactc

SEQ ID NO: 363155 - DNA, 20 bp, Artificial Sequence
  chemically synthesized
gtggccaggctggagtgcag

SEQ ID NO: 363156 - DNA, 20 bp, Artificial Sequence
  chemically synthesized
agcagaggttgcagtgagtg

SEQ ID NO: 363157 - DNA, 20 bp, Artificial Sequence
  chemically synthesized
ggagcagaggttgcagtgag

SEQ ID NO: 363158 - DNA, 20 bp, Artificial Sequence
  chemically synthesized
ctgggagcagaggttgcagt

SEQ ID NO: 363159 - DNA, 20 bp, Artificial Sequence
  chemically synthesized
gaacctgggagcagaggttg

SEQ ID NO: 363160 - DNA, 20 bp, Artificial Sequence
  chemically synthesized
ctcactgcaacctctgctcc

SEQ ID NO: 363161 - DNA, 20 bp, Artificial Sequence
  chemically synthesized
tcacgtgaacctgggagcag

SEQ ID NO: 363162 - DNA, 20 bp, Artificial Sequence
  chemically synthesized
tcactgcaacctctgctccc

SEQ ID NO: 363163 - DNA, 20 bp, Artificial Sequence
  chemically synthesized
atcacgtgaacctgggagca

SEQ ID NO: 363164 - DNA, 20 bp, Artificial Sequence
  chemically synthesized
gaatcacgtgaacctgggag

SEQ ID NO: 363165 - DNA, 20 bp, Artificial Sequence
  chemically synthesized
ggagaatcacgtgaacctgg

SEQ ID NO: 363166 - DNA, 20 bp, Artificial Sequence
  chemically synthesized
caggagaatcacgtgaacct

SEQ ID NO: 363167 - DNA, 20 bp, Artificial Sequence
  chemically synthesized
gcaggagaatcacgtgaacc

SEQ ID NO: 363168 - DNA, 20 bp, Artificial Sequence
  chemically synthesized
ttcacgtgattctcctgcct

SEQ ID NO: 363169 - DNA, 20 bp, Artificial Sequence
  chemically synthesized
tactcatgaggctgaggcag

SEQ ID NO: 363170 - DNA, 20 bp, Artificial Sequence
  chemically synthesized
gctactcatgaggctgaggc

SEQ ID NO: 363171 - DNA, 20 bp, Artificial Sequence
  chemically synthesized
agctactcatgaggctgagg

SEQ ID NO: 363172 - DNA, 20 bp, Artificial Sequence
  chemically synthesized
cccagctactcatgaggctg

SEQ ID NO: 363173 - DNA, 20 bp, Artificial Sequence
  chemically synthesized
tcccagctactcatgaggct

SEQ ID NO: 363174 - DNA, 20 bp, Artificial Sequence
  chemically synthesized
ttctcctgcctcagcctcat

SEQ ID NO: 363175 - DNA, 20 bp, Artificial Sequence
  chemically synthesized
tcctgcctcagcctcatgag

SEQ ID NO: 363176 - DNA, 20 bp, Artificial Sequence
  chemically synthesized
tgtagtcccagctactcatg

SEQ ID NO: 363177 - DNA, 20 bp, Artificial Sequence
  chemically synthesized
ctgtagtcccagctactcat

SEQ ID NO: 363178 - DNA, 20 bp, Artificial Sequence
  chemically synthesized
gcctcagcctcatgagtagc

SEQ ID NO: 363179 - DNA, 20 bp, Artificial Sequence
  chemically synthesized
cctcagcctcatgagtagct

SEQ ID NO: 363180 - DNA, 20 bp, Artificial Sequence
  chemically synthesized
ctcatgagtagctgggacta

SEQ ID NO: 363181 - DNA, 20 bp, Artificial Sequence
  chemically synthesized
gtggtgtgcatctgtagtcc

SEQ ID NO: 363182 - DNA, 20 bp, Artificial Sequence
  chemically synthesized
agcgtggtggtgtgcatctg

SEQ ID NO: 363183 - DNA, 20 bp, Artificial Sequence
  chemically synthesized
cagatgcacaccaccacgct

SEQ ID NO: 363184 - DNA, 20 bp, Artificial Sequence
  chemically synthesized
caaaaattagctgagcgtgg

SEQ ID NO: 363185 - DNA, 20 bp, Artificial Sequence
  chemically synthesized
acacaaaaattagctgagcg

SEQ ID NO: 363186 - DNA, 20 bp, Artificial Sequence
  chemically synthesized
taaaaacacaaaaattagct

SEQ ID NO: 363187 - DNA, 20 bp, Artificial Sequence
  chemically synthesized
tctactaaaaacacaaaaat

SEQ ID NO: 363188 - DNA, 20 bp, Artificial Sequence
  chemically synthesized
tcagctaatttttgtgtttt

SEQ ID NO: 363189 - DNA, 20 bp, Artificial Sequence
  chemically synthesized
gctaatttttgtgtttttag

SEQ ID NO: 363190 - DNA, 20 bp, Artificial Sequence
  chemically synthesized
taatttttgtgtttttagta

SEQ ID NO: 363191 - DNA, 20 bp, Artificial Sequence
  chemically synthesized
ttttgtgtttttagtagaga

SEQ ID NO: 363192 - DNA, 20 bp, Artificial Sequence
  chemically synthesized
tttgtgtttttagtagagat

SEQ ID NO: 363193 - DNA, 20 bp, Artificial Sequence
  chemically synthesized
ttgtgtttttagtagagatg

SEQ ID NO: 363194 - DNA, 20 bp, Artificial Sequence
  chemically synthesized
gagatggggtttcaccatgt

SEQ ID NO: 363195 - DNA, 20 bp, Artificial Sequence
  chemically synthesized
tggggtttcaccatgttggc

SEQ ID NO: 363196 - DNA, 20 bp, Artificial Sequence
  chemically synthesized
tgagaccatcctggccaaca

SEQ ID NO: 363197 - DNA, 20 bp, Artificial Sequence
  chemically synthesized
ggggtttcaccatgttggcc

SEQ ID NO: 363198 - DNA, 20 bp, Artificial Sequence
  chemically synthesized
tttcaccatgttggccagga

SEQ ID NO: 363199 - DNA, 20 bp, Artificial Sequence
  chemically synthesized
tcaagaaattgagaccatcc

SEQ ID NO: 363200 - DNA, 20 bp, Artificial Sequence
  chemically synthesized
gatcatgatgtcaagaaatt

SEQ ID NO: 363201 - DNA, 20 bp, Artificial Sequence
  chemically synthesized
ggcgggtggatcatgatgtc

SEQ ID NO: 363202 - DNA, 20 bp, Artificial Sequence
  chemically synthesized
gacatcatgatccacccgcc

SEQ ID NO: 363203 - DNA, 20 bp, Artificial Sequence
  chemically synthesized
ctttgggtggtccaggcggg

SEQ ID NO: 363204 - DNA, 20 bp, Artificial Sequence
  chemically synthesized
gcactttgggtggtccaggc

SEQ ID NO: 363205 - DNA, 20 bp, Artificial Sequence
  chemically synthesized
agcactttgggtggtccagg

SEQ ID NO: 363206 - DNA, 20 bp, Artificial Sequence
  chemically synthesized
accagcactttgggtggtcc

SEQ ID NO: 363207 - DNA, 20 bp, Artificial Sequence
  chemically synthesized
taccagcactttgggtggtc

SEQ ID NO: 363208 - DNA, 20 bp, Artificial Sequence
  chemically synthesized
ccacccgcctggaccaccca

SEQ ID NO: 363209 - DNA, 20 bp, Artificial Sequence
  chemically synthesized
tgtaataccagcactttggg

SEQ ID NO: 363210 - DNA, 20 bp, Artificial Sequence
  chemically synthesized
gcctggaccacccaaagtgc

SEQ ID NO: 363211 - DNA, 20 bp, Artificial Sequence
  chemically synthesized
gcctgtaataccagcacttt

SEQ ID NO: 363212 - DNA, 20 bp, Artificial Sequence
  chemically synthesized
tgcctgtaataccagcactt

SEQ ID NO: 363213 - DNA, 20 bp, Artificial Sequence
  chemically synthesized
cacccaaagtgctggtatta

SEQ ID NO: 363214 - DNA, 20 bp, Artificial Sequence
  chemically synthesized
acccaaagtgctggtattac

SEQ ID NO: 363215 - DNA, 20 bp, Artificial Sequence
  chemically synthesized
gtggctcatgcctgtaatac

SEQ ID NO: 363216 - DNA, 20 bp, Artificial Sequence
  chemically synthesized
agtgctggtattacaggcat

SEQ ID NO: 363217 - DNA, 20 bp, Artificial Sequence
  chemically synthesized
caggcatgagccaccgcgcc

SEQ ID NO: 363218 - DNA, 20 bp, Artificial Sequence
  chemically synthesized
taaatctaggctgggcgcgg

SEQ ID NO: 363219 - DNA, 20 bp, Artificial Sequence
  chemically synthesized
aagtaaatctaggctgggcg

SEQ ID NO: 363220 - DNA, 20 bp, Artificial Sequence
  chemically synthesized
atgagccaccgcgcccagcc

SEQ ID NO: 363221 - DNA, 20 bp, Artificial Sequence
  chemically synthesized
ttcaaaagtaaatctaggct

SEQ ID NO: 363222 - DNA, 20 bp, Artificial Sequence
  chemically synthesized
tttcaaaagtaaatctaggc

SEQ ID NO: 363223 - DNA, 20 bp, Artificial Sequence
  chemically synthesized
ggattttcaaaagtaaatct

SEQ ID NO: 363224 - DNA, 20 bp, Artificial Sequence
  chemically synthesized
tggattttcaaaagtaaatc

SEQ ID NO: 363225 - DNA, 20 bp, Artificial Sequence
  chemically synthesized
aataacacatggattttcaa

SEQ ID NO: 363226 - DNA, 20 bp, Artificial Sequence
  chemically synthesized
tgtggctgaacaataacaca

SEQ ID NO: 363227 - DNA, 20 bp, Artificial Sequence
  chemically synthesized
aaaatccatgtgttattgtt

SEQ ID NO: 363228 - DNA, 20 bp, Artificial Sequence
  chemically synthesized
catgtgttattgttcagcca

SEQ ID NO: 363229 - DNA, 20 bp, Artificial Sequence
  chemically synthesized
atgtgttattgttcagccac

SEQ ID NO: 363230 - DNA, 20 bp, Artificial Sequence
  chemically synthesized
ttattgttcagccacaggct

SEQ ID NO: 363231 - DNA, 20 bp, Artificial Sequence
  chemically synthesized
tattgttcagccacaggcta

SEQ ID NO: 363232 - DNA, 20 bp, Artificial Sequence
  chemically synthesized
ggaacctttaccttagcctg

SEQ ID NO: 363233 - DNA, 20 bp, Artificial Sequence
  chemically synthesized
ttcagccacaggctaaggta

SEQ ID NO: 363234 - DNA, 20 bp, Artificial Sequence
  chemically synthesized
tcagccacaggctaaggtaa

SEQ ID NO: 363235 - DNA, 20 bp, Artificial Sequence
  chemically synthesized
gaacaaaggaacctttacct

SEQ ID NO: 363236 - DNA, 20 bp, Artificial Sequence
  chemically synthesized
ggtaaaggttcctttgttcc

SEQ ID NO: 363237 - DNA, 20 bp, Artificial Sequence
  chemically synthesized
agaaaccaaacttggaacaa

SEQ ID NO: 363238 - DNA, 20 bp, Artificial Sequence
  chemically synthesized
cagaaaccaaacttggaaca

SEQ ID NO: 363239 - DNA, 20 bp, Artificial Sequence
  chemically synthesized
aggttcctttgttccaagtt

SEQ ID NO: 363240 - DNA, 20 bp, Artificial Sequence
  chemically synthesized
tctcatgcagaaaccaaact

SEQ ID NO: 363241 - DNA, 20 bp, Artificial Sequence
  chemically synthesized
tccaagtttggtttctgcat

SEQ ID NO: 363242 - DNA, 20 bp, Artificial Sequence
  chemically synthesized
aacctcaagacattctcatg

SEQ ID NO: 363243 - DNA, 20 bp, Artificial Sequence
  chemically synthesized
tttctgcatgagaatgtctt

SEQ ID NO: 363244 - DNA, 20 bp, Artificial Sequence
  chemically synthesized
ttctgcatgagaatgtcttg

SEQ ID NO: 363245 - DNA, 20 bp, Artificial Sequence
  chemically synthesized
gcgttagaggacaaaacctc

SEQ ID NO: 363246 - DNA, 20 bp, Artificial Sequence
  chemically synthesized
gatgctggcctatgcgttag

SEQ ID NO: 363247 - DNA, 20 bp, Artificial Sequence
  chemically synthesized
aggttttgtcctctaacgca

SEQ ID NO: 363248 - DNA, 20 bp, Artificial Sequence
  chemically synthesized
agatgctggcctatgcgtta

SEQ ID NO: 363249 - DNA, 20 bp, Artificial Sequence
  chemically synthesized
ggttttgtcctctaacgcat

SEQ ID NO: 363250 - DNA, 20 bp, Artificial Sequence
  chemically synthesized
taagatgctggcctatgcgt

SEQ ID NO: 363251 - DNA, 20 bp, Artificial Sequence
  chemically synthesized
ttgtcctctaacgcataggc

SEQ ID NO: 363252 - DNA, 20 bp, Artificial Sequence
  chemically synthesized
tggggagctgcataagatgc

SEQ ID NO: 363253 - DNA, 20 bp, Artificial Sequence
  chemically synthesized
gcataggccagcatcttatg

SEQ ID NO: 363254 - DNA, 20 bp, Artificial Sequence
  chemically synthesized
gctttaatggggagctgcat

SEQ ID NO: 363255 - DNA, 20 bp, Artificial Sequence
  chemically synthesized
tcttatgcagctccccatta

SEQ ID NO: 363256 - DNA, 20 bp, Artificial Sequence
  chemically synthesized
tgagctagagctttaatggg

SEQ ID NO: 363257 - DNA, 20 bp, Artificial Sequence
  chemically synthesized
tctgagctagagctttaatg

SEQ ID NO: 363258 - DNA, 20 bp, Artificial Sequence
  chemically synthesized
atctgagctagagctttaat

SEQ ID NO: 363259 - DNA, 20 bp, Artificial Sequence
  chemically synthesized
catctgagctagagctttaa

SEQ ID NO: 363260 - DNA, 20 bp, Artificial Sequence
  chemically synthesized
gcagctccccattaaagctc

SEQ ID NO: 363261 - DNA, 20 bp, Artificial Sequence
  chemically synthesized
tccccattaaagctctagct

SEQ ID NO: 363262 - DNA, 20 bp, Artificial Sequence
  chemically synthesized
caatgctttcatctgagcta

SEQ ID NO: 363263 - DNA, 20 bp, Artificial Sequence
  chemically synthesized
aacaatgctttcatctgagc

SEQ ID NO: 363264 - DNA, 20 bp, Artificial Sequence
  chemically synthesized
taaagctctagctcagatga

SEQ ID NO: 363265 - DNA, 20 bp, Artificial Sequence
  chemically synthesized
tattaacaatgctttcatct

SEQ ID NO: 363266 - DNA, 20 bp, Artificial Sequence
  chemically synthesized
gagaaggagttgttcaaaag

SEQ ID NO: 363267 - DNA, 20 bp, Artificial Sequence
  chemically synthesized
tttgagaaggagttgttcaa

SEQ ID NO: 363268 - DNA, 20 bp, Artificial Sequence
  chemically synthesized
aatggcttaaatttgagaag

SEQ ID NO: 363269 - DNA, 20 bp, Artificial Sequence
  chemically synthesized
ataatggcttaaatttgaga

SEQ ID NO: 363270 - DNA, 20 bp, Artificial Sequence
  chemically synthesized
aataatggcttaaatttgag

SEQ ID NO: 363271 - DNA, 20 bp, Artificial Sequence
  chemically synthesized
aacaactccttctcaaattt

SEQ ID NO: 363272 - DNA, 20 bp, Artificial Sequence
  chemically synthesized
caaaataatggcttaaattt

SEQ ID NO: 363273 - DNA, 20 bp, Artificial Sequence
  chemically synthesized
tcaaatttaagccattattt

SEQ ID NO: 363274 - DNA, 20 bp, Artificial Sequence
  chemically synthesized
caaatttaagccattatttt

SEQ ID NO: 363275 - DNA, 20 bp, Artificial Sequence
  chemically synthesized
gggaaaaggccccaaaataa

SEQ ID NO: 363276 - DNA, 20 bp, Artificial Sequence
  chemically synthesized
aaatttaagccattattttg

SEQ ID NO: 363277 - DNA, 20 bp, Artificial Sequence
  chemically synthesized
ctaatgttttagtagggaaa

SEQ ID NO: 363278 - DNA, 20 bp, Artificial Sequence
  chemically synthesized
cctaatgttttagtagggaa

SEQ ID NO: 363279 - DNA, 20 bp, Artificial Sequence
  chemically synthesized
aacctcctaatgttttagta

SEQ ID NO: 363280 - DNA, 20 bp, Artificial Sequence
  chemically synthesized
gaacctcctaatgttttagt

SEQ ID NO: 363281 - DNA, 20 bp, Artificial Sequence
  chemically synthesized
agaacctcctaatgttttag

SEQ ID NO: 363282 - DNA, 20 bp, Artificial Sequence
  chemically synthesized
ccttttccctactaaaacat

SEQ ID NO: 363283 - DNA, 20 bp, Artificial Sequence
  chemically synthesized
cttttccctactaaaacatt

SEQ ID NO: 363284 - DNA, 20 bp, Artificial Sequence
  chemically synthesized
tatagaacctcctaatgttt

SEQ ID NO: 363285 - DNA, 20 bp, Artificial Sequence
  chemically synthesized
tttccctactaaaacattag

SEQ ID NO: 363286 - DNA, 20 bp, Artificial Sequence
  chemically synthesized
ttccctactaaaacattagg

SEQ ID NO: 363287 - DNA, 20 bp, Artificial Sequence
  chemically synthesized
cacatttcttacagaaaata

SEQ ID NO: 363288 - DNA, 20 bp, Artificial Sequence
  chemically synthesized
ggaggttctatattttctgt

SEQ ID NO: 363289 - DNA, 20 bp, Artificial Sequence
  chemically synthesized
agggaaggccacatttctta

SEQ ID NO: 363290 - DNA, 20 bp, Artificial Sequence
  chemically synthesized
tatattttctgtaagaaatg

SEQ ID NO: 363291 - DNA, 20 bp, Artificial Sequence
  chemically synthesized
aagaaatgtggccttccctg

SEQ ID NO: 363292 - DNA, 20 bp, Artificial Sequence
  chemically synthesized
catatgaatctcttcaggga

SEQ ID NO: 363293 - DNA, 20 bp, Artificial Sequence
  chemically synthesized
gaaatgtggccttccctgaa

SEQ ID NO: 363294 - DNA, 20 bp, Artificial Sequence
  chemically synthesized
tcatatgaatctcttcaggg

SEQ ID NO: 363295 - DNA, 20 bp, Artificial Sequence
  chemically synthesized
atgtcatatgaatctcttca

SEQ ID NO: 363296 - DNA, 20 bp, Artificial Sequence
  chemically synthesized
gatgtcatatgaatctcttc

SEQ ID NO: 363297 - DNA, 20 bp, Artificial Sequence
  chemically synthesized
tgatgtcatatgaatctctt

SEQ ID NO: 363298 - DNA, 20 bp, Artificial Sequence
  chemically synthesized
aatataagtgaatataaaat

SEQ ID NO: 363299 - DNA, 20 bp, Artificial Sequence
  chemically synthesized
tgaaattattaaatgaatat

SEQ ID NO: 363300 - DNA, 20 bp, Artificial Sequence
  chemically synthesized
tattcatttaataatttcat

SEQ ID NO: 363301 - DNA, 20 bp, Artificial Sequence
  chemically synthesized
aataatttcattagaaaaca

SEQ ID NO: 363302 - DNA, 20 bp, Artificial Sequence
  chemically synthesized
ataatttcattagaaaacat

SEQ ID NO: 363303 - DNA, 20 bp, Artificial Sequence
  chemically synthesized
taatttcattagaaaacatg

SEQ ID NO: 363304 - DNA, 20 bp, Artificial Sequence
  chemically synthesized
gaaaacatggggtctatgat

SEQ ID NO: 363305 - DNA, 20 bp, Artificial Sequence
  chemically synthesized
catatatagaaatctgatca

SEQ ID NO: 363306 - DNA, 20 bp, Artificial Sequence
  chemically synthesized
tatgatcagatttctatata

SEQ ID NO: 363307 - DNA, 20 bp, Artificial Sequence
  chemically synthesized
gaaactccacgggccatata

SEQ ID NO: 363308 - DNA, 20 bp, Artificial Sequence
  chemically synthesized
agatttctatatatggcccg

SEQ ID NO: 363309 - DNA, 20 bp, Artificial Sequence
  chemically synthesized
atttctatatatggcccgtg

SEQ ID NO: 363310 - DNA, 20 bp, Artificial Sequence
  chemically synthesized
taaaacctccgaaactccac

SEQ ID NO: 363311 - DNA, 20 bp, Artificial Sequence
  chemically synthesized
ttaaaacctccgaaactcca

SEQ ID NO: 363312 - DNA, 20 bp, Artificial Sequence
  chemically synthesized
atatatggcccgtggagttt

SEQ ID NO: 363313 - DNA, 20 bp, Artificial Sequence
  chemically synthesized
atatggcccgtggagtttcg

SEQ ID NO: 363314 - DNA, 20 bp, Artificial Sequence
  chemically synthesized
tatggcccgtggagtttcgg

SEQ ID NO: 363315 - DNA, 20 bp, Artificial Sequence
  chemically synthesized
cgtggagtttcggaggtttt

SEQ ID NO: 363316 - DNA, 20 bp, Artificial Sequence
  chemically synthesized
aggttttaagttcccttcat

SEQ ID NO: 363317 - DNA, 20 bp, Artificial Sequence
  chemically synthesized
ttaaaagaggaacttatgaa

SEQ ID NO: 363318 - DNA, 20 bp, Artificial Sequence
  chemically synthesized
attaaaagaggaacttatga

SEQ ID NO: 363319 - DNA, 20 bp, Artificial Sequence
  chemically synthesized
aattaaaagaggaacttatg

SEQ ID NO: 363320 - DNA, 20 bp, Artificial Sequence
  chemically synthesized
tattccacttcaattaaaag

SEQ ID NO: 363321 - DNA, 20 bp, Artificial Sequence
  chemically synthesized
atattccacttcaattaaaa

SEQ ID NO: 363322 - DNA, 20 bp, Artificial Sequence
  chemically synthesized
ataagttcctcttttaattg

SEQ ID NO: 363323 - DNA, 20 bp, Artificial Sequence
  chemically synthesized
gcatattccacttcaattaa

SEQ ID NO: 363324 - DNA, 20 bp, Artificial Sequence
  chemically synthesized
agttcctcttttaattgaag

SEQ ID NO: 363325 - DNA, 20 bp, Artificial Sequence
  chemically synthesized
attgaagtggaatatgcata

SEQ ID NO: 363326 - DNA, 20 bp, Artificial Sequence
  chemically synthesized
gcatatagaaaaatatacat

SEQ ID NO: 363327 - DNA, 20 bp, Artificial Sequence
  chemically synthesized
ttactgtaagaaaacgcatc

SEQ ID NO: 363328 - DNA, 20 bp, Artificial Sequence
  chemically synthesized
caacttgatgcgttttctta

SEQ ID NO: 363329 - DNA, 20 bp, Artificial Sequence
  chemically synthesized
tacacatgtgtatttactgt

SEQ ID NO: 363330 - DNA, 20 bp, Artificial Sequence
  chemically synthesized
cagtaaatacacatgtgtaa

SEQ ID NO: 363331 - DNA, 20 bp, Artificial Sequence
  chemically synthesized
tacacatgtgtaacagctat

SEQ ID NO: 363332 - DNA, 20 bp, Artificial Sequence
  chemically synthesized
acacatgtgtaacagctatc

SEQ ID NO: 363333 - DNA, 20 bp, Artificial Sequence
  chemically synthesized
tgttccatgttttgacctga

SEQ ID NO: 363334 - DNA, 20 bp, Artificial Sequence
  chemically synthesized
acagctatcaggtcaaaaca

SEQ ID NO: 363335 - DNA, 20 bp, Artificial Sequence
  chemically synthesized
tatcaggtcaaaacatggaa

SEQ ID NO: 363336 - DNA, 20 bp, Artificial Sequence
  chemically synthesized
aggtcaaaacatggaacagt

SEQ ID NO: 363337 - DNA, 20 bp, Artificial Sequence
  chemically synthesized
acatggaacagtgagcaccg

SEQ ID NO: 363338 - DNA, 20 bp, Artificial Sequence
  chemically synthesized
tggaacagtgagcaccgcag

SEQ ID NO: 363339 - DNA, 20 bp, Artificial Sequence
  chemically synthesized
acgcataagagaatcttctg

SEQ ID NO: 363340 - DNA, 20 bp, Artificial Sequence
  chemically synthesized
taagtcagtaaaacgcataa

SEQ ID NO: 363341 - DNA, 20 bp, Artificial Sequence
  chemically synthesized
agtaagtcagtaaaacgcat

SEQ ID NO: 363342 - DNA, 20 bp, Artificial Sequence
  chemically synthesized
aacttttggaaggagtaagt

SEQ ID NO: 363343 - DNA, 20 bp, Artificial Sequence
  chemically synthesized
ggttaacttttggaaggagt

SEQ ID NO: 363344 - DNA, 20 bp, Artificial Sequence
  chemically synthesized
tactgacttactccttccaa

SEQ ID NO: 363345 - DNA, 20 bp, Artificial Sequence
  chemically synthesized
gagtggttaacttttggaag

SEQ ID NO: 363346 - DNA, 20 bp, Artificial Sequence
  chemically synthesized
gagagtggttaacttttgga

SEQ ID NO: 363347 - DNA, 20 bp, Artificial Sequence
  chemically synthesized
agagagtggttaacttttgg

SEQ ID NO: 363348 - DNA, 20 bp, Artificial Sequence
  chemically synthesized
tgaagagagtggttaacttt

SEQ ID NO: 363349 - DNA, 20 bp, Artificial Sequence
  chemically synthesized
gggtttaaaattgaagagag

SEQ ID NO: 363350 - DNA, 20 bp, Artificial Sequence
  chemically synthesized
catgggtttaaaattgaaga

SEQ ID NO: 363351 - DNA, 20 bp, Artificial Sequence
  chemically synthesized
tccatgggtttaaaattgaa

SEQ ID NO: 363352 - DNA, 20 bp, Artificial Sequence
  chemically synthesized
tttccatgggtttaaaattg

SEQ ID NO: 363353 - DNA, 20 bp, Artificial Sequence
  chemically synthesized
tctcttcaattttaaaccca

SEQ ID NO: 363354 - DNA, 20 bp, Artificial Sequence
  chemically synthesized
aacgggcaaaatgtttccat

SEQ ID NO: 363355 - DNA, 20 bp, Artificial Sequence
  chemically synthesized
aaacgggcaaaatgtttcca

SEQ ID NO: 363356 - DNA, 20 bp, Artificial Sequence
  chemically synthesized
ttcaattaaatttcaaaaac

SEQ ID NO: 363357 - DNA, 20 bp, Artificial Sequence
  chemically synthesized
tttcaattaaatttcaaaaa

SEQ ID NO: 363358 - DNA, 20 bp, Artificial Sequence
  chemically synthesized
cgtttttgaaatttaattga

SEQ ID NO: 363359 - DNA, 20 bp, Artificial Sequence
  chemically synthesized
aatttaattgaaagaaatca

SEQ ID NO: 363360 - DNA, 20 bp, Artificial Sequence
  chemically synthesized
ttaattgaaagaaatcatag

SEQ ID NO: 363361 - DNA, 20 bp, Artificial Sequence
  chemically synthesized
taattgaaagaaatcatagt

SEQ ID NO: 363362 - DNA, 20 bp, Artificial Sequence
  chemically synthesized
tgtatttgagtgaaataaat

SEQ ID NO: 363363 - DNA, 20 bp, Artificial Sequence
  chemically synthesized
gaagtcgttaaaatgtattt

SEQ ID NO: 363364 - DNA, 20 bp, Artificial Sequence
  chemically synthesized
tacacacaatatacaagatg

SEQ ID NO: 363365 - DNA, 20 bp, Artificial Sequence
  chemically synthesized
gatagctacacacaatatac

SEQ ID NO: 363366 - DNA, 20 bp, Artificial Sequence
  chemically synthesized
ttcatcttgtatattgtgtg

SEQ ID NO: 363367 - DNA, 20 bp, Artificial Sequence
  chemically synthesized
tattgtgtgtagctatcatt

SEQ ID NO: 363368 - DNA, 20 bp, Artificial Sequence
  chemically synthesized
caatgaaaatgaccaaatga

SEQ ID NO: 363369 - DNA, 20 bp, Artificial Sequence
  chemically synthesized
tctcatgatgggatattaca

SEQ ID NO: 363370 - DNA, 20 bp, Artificial Sequence
  chemically synthesized
attctcatgatgggatatta

SEQ ID NO: 363371 - DNA, 20 bp, Artificial Sequence
  chemically synthesized
gctctgtaatatcccatcat

SEQ ID NO: 363372 - DNA, 20 bp, Artificial Sequence
  chemically synthesized
ctatgatacattctcatgat

SEQ ID NO: 363373 - DNA, 20 bp, Artificial Sequence
  chemically synthesized
actatgatacattctcatga

SEQ ID NO: 363374 - DNA, 20 bp, Artificial Sequence
  chemically synthesized
cccatcatgagaatgtatca

SEQ ID NO: 363375 - DNA, 20 bp, Artificial Sequence
  chemically synthesized
gaatgtatcatagtcacttc

SEQ ID NO: 363376 - DNA, 20 bp, Artificial Sequence
  chemically synthesized
tatcatagtcacttccagtt

SEQ ID NO: 363377 - DNA, 20 bp, Artificial Sequence
  chemically synthesized
atcatagtcacttccagttt

SEQ ID NO: 363378 - DNA, 20 bp, Artificial Sequence
  chemically synthesized
tttgtgatagcccaaactgg

SEQ ID NO: 363379 - DNA, 20 bp, Artificial Sequence
  chemically synthesized
tcatttgtgatagcccaaac

SEQ ID NO: 363380 - DNA, 20 bp, Artificial Sequence
  chemically synthesized
catagcagtttcatttgtga

SEQ ID NO: 363381 - DNA, 20 bp, Artificial Sequence
  chemically synthesized
atatgtgagaatgttcatag

SEQ ID NO: 363382 - DNA, 20 bp, Artificial Sequence
  chemically synthesized
tatatatgtgagaatgttca

SEQ ID NO: 363383 - DNA, 20 bp, Artificial Sequence
  chemically synthesized
ccaaaaacacatatatatgt

SEQ ID NO: 363384 - DNA, 20 bp, Artificial Sequence
  chemically synthesized
ctcacatatatatgtgtttt

SEQ ID NO: 363385 - DNA, 20 bp, Artificial Sequence
  chemically synthesized
tatatgtgtttttggcaaac

SEQ ID NO: 363386 - DNA, 20 bp, Artificial Sequence
  chemically synthesized
atatgtgtttttggcaaact

SEQ ID NO: 363387 - DNA, 20 bp, Artificial Sequence
  chemically synthesized
agttacagaaatacatttcc

SEQ ID NO: 363388 - DNA, 20 bp, Artificial Sequence
  chemically synthesized
tattgtagacatacaagtta

SEQ ID NO: 363389 - DNA, 20 bp, Artificial Sequence
  chemically synthesized
caattctattgtagacatac

SEQ ID NO: 363390 - DNA, 20 bp, Artificial Sequence
  chemically synthesized
tgtaacttgtatgtctacaa

SEQ ID NO: 363391 - DNA, 20 bp, Artificial Sequence
  chemically synthesized
accacccagcaattctattg

SEQ ID NO: 363392 - DNA, 20 bp, Artificial Sequence
  chemically synthesized
tatgtctacaatagaattgc

SEQ ID NO: 363393 - DNA, 20 bp, Artificial Sequence
  chemically synthesized
atgtctacaatagaattgct

SEQ ID NO: 363394 - DNA, 20 bp, Artificial Sequence
  chemically synthesized
tctacaatagaattgctggg

SEQ ID NO: 363395 - DNA, 20 bp, Artificial Sequence
  chemically synthesized
caatagaattgctgggtggt

SEQ ID NO: 363396 - DNA, 20 bp, Artificial Sequence
  chemically synthesized
aatgcacatttcttaccacc

SEQ ID NO: 363397 - DNA, 20 bp, Artificial Sequence
  chemically synthesized
gaaatgtgcattttcacatt

SEQ ID NO: 363398 - DNA, 20 bp, Artificial Sequence
  chemically synthesized
atgtgcattttcacatttag

SEQ ID NO: 363399 - DNA, 20 bp, Artificial Sequence
  chemically synthesized
aggcaactaattaaagagtt

SEQ ID NO: 363400 - DNA, 20 bp, Artificial Sequence
  chemically synthesized
caggcaactaattaaagagt

SEQ ID NO: 363401 - DNA, 20 bp, Artificial Sequence
  chemically synthesized
atcatgcccaactctttaat

SEQ ID NO: 363402 - DNA, 20 bp, Artificial Sequence
  chemically synthesized
aattcaggcaactaattaaa

SEQ ID NO: 363403 - DNA, 20 bp, Artificial Sequence
  chemically synthesized
ataattcaggcaactaatta

SEQ ID NO: 363404 - DNA, 20 bp, Artificial Sequence
  chemically synthesized
aacttctggaaatataattc

SEQ ID NO: 363405 - DNA, 20 bp, Artificial Sequence
  chemically synthesized
taacttctggaaatataatt

SEQ ID NO: 363406 - DNA, 20 bp, Artificial Sequence
  chemically synthesized
agttgcctgaattatatttc

SEQ ID NO: 363407 - DNA, 20 bp, Artificial Sequence
  chemically synthesized
tgcctgaattatatttccag

SEQ ID NO: 363408 - DNA, 20 bp, Artificial Sequence
  chemically synthesized
gaaatctcacaattaacttc

SEQ ID NO: 363409 - DNA, 20 bp, Artificial Sequence
  chemically synthesized
tatttccagaagttaattgt

SEQ ID NO: 363410 - DNA, 20 bp, Artificial Sequence
  chemically synthesized
gaagttaattgtgagatttc

SEQ ID NO: 363411 - DNA, 20 bp, Artificial Sequence
  chemically synthesized
tgatgaggacatggatcaac

SEQ ID NO: 363412 - DNA, 20 bp, Artificial Sequence
  chemically synthesized
gccaaatgttgatgaggaca

SEQ ID NO: 363413 - DNA, 20 bp, Artificial Sequence
  chemically synthesized
actaatgccaaatgttgatg

SEQ ID NO: 363414 - DNA, 20 bp, Artificial Sequence
  chemically synthesized
tactaatgccaaatgttgat

SEQ ID NO: 363415 - DNA, 20 bp, Artificial Sequence
  chemically synthesized
tccatgtcctcatcaacatt

SEQ ID NO: 363416 - DNA, 20 bp, Artificial Sequence
  chemically synthesized
tcctcatcaacatttggcat

SEQ ID NO: 363417 - DNA, 20 bp, Artificial Sequence
  chemically synthesized
tcatcaacatttggcattag

SEQ ID NO: 363418 - DNA, 20 bp, Artificial Sequence
  chemically synthesized
aacatttggcattagtagtc

SEQ ID NO: 363419 - DNA, 20 bp, Artificial Sequence
  chemically synthesized
ttggcattagtagtctagtt

SEQ ID NO: 363420 - DNA, 20 bp, Artificial Sequence
  chemically synthesized
aattaccaaaatgactgaac

SEQ ID NO: 363421 - DNA, 20 bp, Artificial Sequence
  chemically synthesized
gtagtctagttcagtcattt

SEQ ID NO: 363422 - DNA, 20 bp, Artificial Sequence
  chemically synthesized
tcattttggtaattttgtac

SEQ ID NO: 363423 - DNA, 20 bp, Artificial Sequence
  chemically synthesized
ttagagctgtaatgagatac

SEQ ID NO: 363424 - DNA, 20 bp, Artificial Sequence
  chemically synthesized
tttgtactggtatctcatta

SEQ ID NO: 363425 - DNA, 20 bp, Artificial Sequence
  chemically synthesized
atttaaattagagctgtaat

SEQ ID NO: 363426 - DNA, 20 bp, Artificial Sequence
  chemically synthesized
acttgaggaaatttaaatta

SEQ ID NO: 363427 - DNA, 20 bp, Artificial Sequence
  chemically synthesized
taacttgaggaaatttaaat

SEQ ID NO: 363428 - DNA, 20 bp, Artificial Sequence
  chemically synthesized
gctctaatttaaatttcctc

SEQ ID NO: 363429 - DNA, 20 bp, Artificial Sequence
  chemically synthesized
ttaacctcagcagtaacttg

SEQ ID NO: 363430 - DNA, 20 bp, Artificial Sequence
  chemically synthesized
tttaacctcagcagtaactt

SEQ ID NO: 363431 - DNA, 20 bp, Artificial Sequence
  chemically synthesized
aatttcctcaagttactgct

SEQ ID NO: 363432 - DNA, 20 bp, Artificial Sequence
  chemically synthesized
atttcctcaagttactgctg

SEQ ID NO: 363433 - DNA, 20 bp, Artificial Sequence
  chemically synthesized
taagaaatgtttaacctcag

SEQ ID NO: 363434 - DNA, 20 bp, Artificial Sequence
  chemically synthesized
atttaagaaatgtttaacct

SEQ ID NO: 363435 - DNA, 20 bp, Artificial Sequence
  chemically synthesized
caaattcaagaatcatattt

SEQ ID NO: 363436 - DNA, 20 bp, Artificial Sequence
  chemically synthesized
caaaaggtgttcacaaattc

SEQ ID NO: 363437 - DNA, 20 bp, Artificial Sequence
  chemically synthesized
aaattgaacaggaacacaaa

SEQ ID NO: 363438 - DNA, 20 bp, Artificial Sequence
  chemically synthesized
gaaattgaacaggaacacaa

SEQ ID NO: 363439 - DNA, 20 bp, Artificial Sequence
  chemically synthesized
atgagaaactgaaattgaac

SEQ ID NO: 363440 - DNA, 20 bp, Artificial Sequence
  chemically synthesized
aatgagaaactgaaattgaa

SEQ ID NO: 363441 - DNA, 20 bp, Artificial Sequence
  chemically synthesized
tttgtgttcctgttcaattt

SEQ ID NO: 363442 - DNA, 20 bp, Artificial Sequence
  chemically synthesized
tcaatttcagtttctcattc

SEQ ID NO: 363443 - DNA, 20 bp, Artificial Sequence
  chemically synthesized
aattttaggttttctagaat

SEQ ID NO: 363444 - DNA, 20 bp, Artificial Sequence
  chemically synthesized
tttttaaattttaggttttc

SEQ ID NO: 363445 - DNA, 20 bp, Artificial Sequence
  chemically synthesized
tgattttttttttaaatttt

SEQ ID NO: 363446 - DNA, 20 bp, Artificial Sequence
  chemically synthesized
ttgattttttttttaaattt

SEQ ID NO: 363447 - DNA, 20 bp, Artificial Sequence
  chemically synthesized
taaaatttaaaaaaaaaatc

SEQ ID NO: 363448 - DNA, 20 bp, Artificial Sequence
  chemically synthesized
aaaaaaaaaatcaagaaaaa

SEQ ID NO: 363449 - DNA, 20 bp, Artificial Sequence
  chemically synthesized
aaaaaaatcaagaaaaacag

SEQ ID NO: 363450 - DNA, 20 bp, Artificial Sequence
  chemically synthesized
aatcaagaaaaacagaagac

SEQ ID NO: 363451 - DNA, 20 bp, Artificial Sequence
  chemically synthesized
atcaagaaaaacagaagact

SEQ ID NO: 363452 - DNA, 20 bp, Artificial Sequence
  chemically synthesized
catttacatatggagtatcc

SEQ ID NO: 363453 - DNA, 20 bp, Artificial Sequence
  chemically synthesized
aactgacacatttacatatg

SEQ ID NO: 363454 - DNA, 20 bp, Artificial Sequence
  chemically synthesized
ataactgacacatttacata

SEQ ID NO: 363455 - DNA, 20 bp, Artificial Sequence
  chemically synthesized
tactccatatgtaaatgtgt

SEQ ID NO: 363456 - DNA, 20 bp, Artificial Sequence
  chemically synthesized
aatgtgtcagttattctcta

SEQ ID NO: 363457 - DNA, 20 bp, Artificial Sequence
  chemically synthesized
aacattgagttaaatctata

SEQ ID NO: 363458 - DNA, 20 bp, Artificial Sequence
  chemically synthesized
ttaacattgagttaaatcta

SEQ ID NO: 363459 - DNA, 20 bp, Artificial Sequence
  chemically synthesized
ttttaagtatgattaacatt

SEQ ID NO: 363460 - DNA, 20 bp, Artificial Sequence
  chemically synthesized
tttacatgtacattcatttt

SEQ ID NO: 363461 - DNA, 20 bp, Artificial Sequence
  chemically synthesized
aaaatgaatgtacatgtaaa

SEQ ID NO: 363462 - DNA, 20 bp, Artificial Sequence
  chemically synthesized
gaatgtacatgtaaatggaa

SEQ ID NO: 363463 - DNA, 20 bp, Artificial Sequence
  chemically synthesized
ttacaaaacaaatacaaaaa

SEQ ID NO: 363464 - DNA, 20 bp, Artificial Sequence
  chemically synthesized
aaaacaaatacaaaaataga

SEQ ID NO: 363465 - DNA, 20 bp, Artificial Sequence
  chemically synthesized
aaacaaatacaaaaatagaa

SEQ ID NO: 363466 - DNA, 20 bp, Artificial Sequence
  chemically synthesized
aacaaatacaaaaatagaaa

SEQ ID NO: 363467 - DNA, 20 bp, Artificial Sequence
  chemically synthesized
ttcgagattttattggttat

SEQ ID NO: 363468 - DNA, 20 bp, Artificial Sequence
  chemically synthesized
cactttgttcgagattttat

SEQ ID NO: 363469 - DNA, 20 bp, Artificial Sequence
  chemically synthesized
aaccaataaaatctcgaaca

SEQ ID NO: 363470 - DNA, 20 bp, Artificial Sequence
  chemically synthesized
taggttctcccactttgttc

SEQ ID NO: 363471 - DNA, 20 bp, Artificial Sequence
  chemically synthesized
caataaaatctcgaacaaag

SEQ ID NO: 363472 - DNA, 20 bp, Artificial Sequence
  chemically synthesized
aataaaatctcgaacaaagt

SEQ ID NO: 363473 - DNA, 20 bp, Artificial Sequence
  chemically synthesized
taaaatctcgaacaaagtgg

SEQ ID NO: 363474 - DNA, 20 bp, Artificial Sequence
  chemically synthesized
tcgaacaaagtgggagaacc

SEQ ID NO: 363475 - DNA, 20 bp, Artificial Sequence
  chemically synthesized
agtgggagaacctagttcac

SEQ ID NO: 363476 - DNA, 20 bp, Artificial Sequence
  chemically synthesized
agcctagtatctggtgaact

SEQ ID NO: 363477 - DNA, 20 bp, Artificial Sequence
  chemically synthesized
cagcctagtatctggtgaac

SEQ ID NO: 363478 - DNA, 20 bp, Artificial Sequence
  chemically synthesized
gaacctagttcaccagatac

SEQ ID NO: 363479 - DNA, 20 bp, Artificial Sequence
  chemically synthesized
aacctagttcaccagatact

SEQ ID NO: 363480 - DNA, 20 bp, Artificial Sequence
  chemically synthesized
ttataatacagcctagtatc

SEQ ID NO: 363481 - DNA, 20 bp, Artificial Sequence
  chemically synthesized
tgtagttttataatacagcc

SEQ ID NO: 363482 - DNA, 20 bp, Artificial Sequence
  chemically synthesized
agtaatgtagttttataata

SEQ ID NO: 363483 - DNA, 20 bp, Artificial Sequence
  chemically synthesized
tcatgtaatgtggagtaatg

SEQ ID NO: 363484 - DNA, 20 bp, Artificial Sequence
  chemically synthesized
cacaaatatcatgtaatgtg

SEQ ID NO: 363485 - DNA, 20 bp, Artificial Sequence
  chemically synthesized
cacacaaatatcatgtaatg

SEQ ID NO: 363486 - DNA, 20 bp, Artificial Sequence
  chemically synthesized
ttacatgatatttgtgtgtg

SEQ ID NO: 363487 - DNA, 20 bp, Artificial Sequence
  chemically synthesized
acatgatatttgtgtgtgta

SEQ ID NO: 363488 - DNA, 20 bp, Artificial Sequence
  chemically synthesized
atgatatttgtgtgtgtaga

SEQ ID NO: 363489 - DNA, 20 bp, Artificial Sequence
  chemically synthesized
gatatttgtgtgtgtagaga

SEQ ID NO: 363490 - DNA, 20 bp, Artificial Sequence
  chemically synthesized
tatttgtgtgtgtagagaga

SEQ ID NO: 363491 - DNA, 20 bp, Artificial Sequence
  chemically synthesized
tttgtgtgtgtagagagaga

SEQ ID NO: 363492 - DNA, 20 bp, Artificial Sequence
  chemically synthesized
agagagagagagaacaatgc

SEQ ID NO: 363493 - DNA, 20 bp, Artificial Sequence
  chemically synthesized
agagagagagaacaatgcaa

SEQ ID NO: 363494 - DNA, 20 bp, Artificial Sequence
  chemically synthesized
agaacaatgcaagagaattg

SEQ ID NO: 363495 - DNA, 20 bp, Artificial Sequence
  chemically synthesized
agagaattgaagtgcaaaaa

SEQ ID NO: 363496 - DNA, 20 bp, Artificial Sequence
  chemically synthesized
aaatttgtccgtacatatgt

SEQ ID NO: 363497 - DNA, 20 bp, Artificial Sequence
  chemically synthesized
aaaatttgtccgtacatatg

SEQ ID NO: 363498 - DNA, 20 bp, Artificial Sequence
  chemically synthesized
aaaacagacccacatatgta

SEQ ID NO: 363499 - DNA, 20 bp, Artificial Sequence
  chemically synthesized
caaatttttaatgacacact

SEQ ID NO: 363500 - DNA, 20 bp, Artificial Sequence
  chemically synthesized
cctcattgcttcacagtact

SEQ ID NO: 363501 - DNA, 20 bp, Artificial Sequence
  chemically synthesized
atgacacacttagtactgtg

SEQ ID NO: 363502 - DNA, 20 bp, Artificial Sequence
  chemically synthesized
aatgcttcctcattgcttca

SEQ ID NO: 363503 - DNA, 20 bp, Artificial Sequence
  chemically synthesized
acttagtactgtgaagcaat

SEQ ID NO: 363504 - DNA, 20 bp, Artificial Sequence
  chemically synthesized
cttagtactgtgaagcaatg

SEQ ID NO: 363505 - DNA, 20 bp, Artificial Sequence
  chemically synthesized
agtactgtgaagcaatgagg

SEQ ID NO: 363506 - DNA, 20 bp, Artificial Sequence
  chemically synthesized
gaagcattatttttaataaa

SEQ ID NO: 363507 - DNA, 20 bp, Artificial Sequence
  chemically synthesized
ttaataaatggtgtgttaat

SEQ ID NO: 363508 - DNA, 20 bp, Artificial Sequence
  chemically synthesized
ctcagtatttattttatttg

SEQ ID NO: 363509 - DNA, 20 bp, Artificial Sequence
  chemically synthesized
cttcaaataaaataaatact

SEQ ID NO: 363510 - DNA, 20 bp, Artificial Sequence
  chemically synthesized
gtgaggaataggttaagact

SEQ ID NO: 363511 - DNA, 20 bp, Artificial Sequence
  chemically synthesized
tatggtgtgaggaataggtt

SEQ ID NO: 363512 - DNA, 20 bp, Artificial Sequence
  chemically synthesized
ttgcatatggtgtgaggaat

SEQ ID NO: 363513 - DNA, 20 bp, Artificial Sequence
  chemically synthesized
attgcatatggtgtgaggaa

SEQ ID NO: 363514 - DNA, 20 bp, Artificial Sequence
  chemically synthesized
tgattattgcatatggtgtg

SEQ ID NO: 363515 - DNA, 20 bp, Artificial Sequence
  chemically synthesized
ttgattattgcatatggtgt

SEQ ID NO: 363516 - DNA, 20 bp, Artificial Sequence
  chemically synthesized
ctgaaattgattattgcata

SEQ ID NO: 363517 - DNA, 20 bp, Artificial Sequence
  chemically synthesized
ccatatgcaataatcaattt

SEQ ID NO: 363518 - DNA, 20 bp, Artificial Sequence
  chemically synthesized
catatgcaataatcaatttc

SEQ ID NO: 363519 - DNA, 20 bp, Artificial Sequence
  chemically synthesized
ataatcaatttcaggtaaaa

SEQ ID NO: 363520 - DNA, 20 bp, Artificial Sequence
  chemically synthesized
tcgttttaccattttgtttt

SEQ ID NO: 363521 - DNA, 20 bp, Artificial Sequence
  chemically synthesized
aaacagatccaaaaacaaaa

SEQ ID NO: 363522 - DNA, 20 bp, Artificial Sequence
  chemically synthesized
acaaaatggtaaaacgataa

SEQ ID NO: 363523 - DNA, 20 bp, Artificial Sequence
  chemically synthesized
gtaaaacgataatggttcta

SEQ ID NO: 363524 - DNA, 20 bp, Artificial Sequence
  chemically synthesized
ctatattaggttattatcta

SEQ ID NO: 363525 - DNA, 20 bp, Artificial Sequence
  chemically synthesized
ctatagataataacctaata

SEQ ID NO: 363526 - DNA, 20 bp, Artificial Sequence
  chemically synthesized
agccattatgatactatatt

SEQ ID NO: 363527 - DNA, 20 bp, Artificial Sequence
  chemically synthesized
aagccattatgatactatat

SEQ ID NO: 363528 - DNA, 20 bp, Artificial Sequence
  chemically synthesized
aacctaatatagtatcataa

SEQ ID NO: 363529 - DNA, 20 bp, Artificial Sequence
  chemically synthesized
atatagtatcataatggctt

SEQ ID NO: 363530 - DNA, 20 bp, Artificial Sequence
  chemically synthesized
tatagtatcataatggcttt

SEQ ID NO: 363531 - DNA, 20 bp, Artificial Sequence
  chemically synthesized
agtatcataatggctttggg

SEQ ID NO: 363532 - DNA, 20 bp, Artificial Sequence
  chemically synthesized
gtatcataatggctttgggt

SEQ ID NO: 363533 - DNA, 20 bp, Artificial Sequence
  chemically synthesized
aagaaatactggcctaccca

SEQ ID NO: 363534 - DNA, 20 bp, Artificial Sequence
  chemically synthesized
cataatggctttgggtaggc

SEQ ID NO: 363535 - DNA, 20 bp, Artificial Sequence
  chemically synthesized
atgacctgttgaagaaatac

SEQ ID NO: 363536 - DNA, 20 bp, Artificial Sequence
  chemically synthesized
gtaggccagtatttcttcaa

SEQ ID NO: 363537 - DNA, 20 bp, Artificial Sequence
  chemically synthesized
taggccagtatttcttcaac

SEQ ID NO: 363538 - DNA, 20 bp, Artificial Sequence
  chemically synthesized
tatatttttatgacctgttg

SEQ ID NO: 363539 - DNA, 20 bp, Artificial Sequence
  chemically synthesized
caacaggtcataaaaatata

SEQ ID NO: 363540 - DNA, 20 bp, Artificial Sequence
  chemically synthesized
cataaaaatataaagtttta

SEQ ID NO: 363541 - DNA, 20 bp, Artificial Sequence
  chemically synthesized
ttaaagaataaactatatcc

SEQ ID NO: 363542 - DNA, 20 bp, Artificial Sequence
  chemically synthesized
acaagttctccacttggata

SEQ ID NO: 363543 - DNA, 20 bp, Artificial Sequence
  chemically synthesized
aagaataaactatatccaag

SEQ ID NO: 363544 - DNA, 20 bp, Artificial Sequence
  chemically synthesized
gaataaactatatccaagtg

SEQ ID NO: 363545 - DNA, 20 bp, Artificial Sequence
  chemically synthesized
ataaaaacaagttctccact

SEQ ID NO: 363546 - DNA, 20 bp, Artificial Sequence
  chemically synthesized
tggttaatattaataaaaac

SEQ ID NO: 363547 - DNA, 20 bp, Artificial Sequence
  chemically synthesized
tttattaatattaaccattg

SEQ ID NO: 363548 - DNA, 20 bp, Artificial Sequence
  chemically synthesized
ttaatattaaccattgaagt

SEQ ID NO: 363549 - DNA, 20 bp, Artificial Sequence
  chemically synthesized
tacctttttactcacttcaa

SEQ ID NO: 363550 - DNA, 20 bp, Artificial Sequence
  chemically synthesized
taaccattgaagtgagtaaa

SEQ ID NO: 363551 - DNA, 20 bp, Artificial Sequence
  chemically synthesized
aaccattgaagtgagtaaaa

SEQ ID NO: 363552 - DNA, 20 bp, Artificial Sequence
  chemically synthesized
gtgagtaaaaaggtaatcca

SEQ ID NO: 363553 - DNA, 20 bp, Artificial Sequence
  chemically synthesized
taaaaaggtaatccacagaa

SEQ ID NO: 363554 - DNA, 20 bp, Artificial Sequence
  chemically synthesized
aaaaaggtaatccacagaaa

SEQ ID NO: 363555 - DNA, 20 bp, Artificial Sequence
  chemically synthesized
aaatgtattttccttttctg

SEQ ID NO: 363556 - DNA, 20 bp, Artificial Sequence
  chemically synthesized
tacatttgcaactcaaaaca

SEQ ID NO: 363557 - DNA, 20 bp, Artificial Sequence
  chemically synthesized
acatttgcaactcaaaacaa

SEQ ID NO: 363558 - DNA, 20 bp, Artificial Sequence
  chemically synthesized
ggatatgagccctttgtttt

SEQ ID NO: 363559 - DNA, 20 bp, Artificial Sequence
  chemically synthesized
catttgcaactcaaaacaaa

SEQ ID NO: 363560 - DNA, 20 bp, Artificial Sequence
  chemically synthesized
caaaacaaagggctcatatc

SEQ ID NO: 363561 - DNA, 20 bp, Artificial Sequence
  chemically synthesized
tattgctatattctggatat

SEQ ID NO: 363562 - DNA, 20 bp, Artificial Sequence
  chemically synthesized
aagggctcatatccagaata

SEQ ID NO: 363563 - DNA, 20 bp, Artificial Sequence
  chemically synthesized
attgagttattgctatattc

SEQ ID NO: 363564 - DNA, 20 bp, Artificial Sequence
  chemically synthesized
acttggacttcatcaaaatt

SEQ ID NO: 363565 - DNA, 20 bp, Artificial Sequence
  chemically synthesized
gcaataactcaattttgatg

SEQ ID NO: 363566 - DNA, 20 bp, Artificial Sequence
  chemically synthesized
actcaattttgatgaagtcc

SEQ ID NO: 363567 - DNA, 20 bp, Artificial Sequence
  chemically synthesized
caaaaagagaaaagttaact

SEQ ID NO: 363568 - DNA, 20 bp, Artificial Sequence
  chemically synthesized
agcatgtttcaaaaagagaa

SEQ ID NO: 363569 - DNA, 20 bp, Artificial Sequence
  chemically synthesized
tccaaagcatgtttcaaaaa

SEQ ID NO: 363570 - DNA, 20 bp, Artificial Sequence
  chemically synthesized
aatccaaagcatgtttcaaa

SEQ ID NO: 363571 - DNA, 20 bp, Artificial Sequence
  chemically synthesized
tctctttttgaaacatgctt

SEQ ID NO: 363572 - DNA, 20 bp, Artificial Sequence
  chemically synthesized
tttgaaacatgctttggatt

SEQ ID NO: 363573 - DNA, 20 bp, Artificial Sequence
  chemically synthesized
ttgaaacatgctttggattc

SEQ ID NO: 363574 - DNA, 20 bp, Artificial Sequence
  chemically synthesized
atttatgatacctgaatcca

SEQ ID NO: 363575 - DNA, 20 bp, Artificial Sequence
  chemically synthesized
tatatgactttgggataggc

SEQ ID NO: 363576 - DNA, 20 bp, Artificial Sequence
  chemically synthesized
ataaatacttgcctatccca

SEQ ID NO: 363577 - DNA, 20 bp, Artificial Sequence
  chemically synthesized
aatttatatgactttgggat

SEQ ID NO: 363578 - DNA, 20 bp, Artificial Sequence
  chemically synthesized
aaatttatatgactttggga

SEQ ID NO: 363579 - DNA, 20 bp, Artificial Sequence
  chemically synthesized
aaggaaatttatatgacttt

SEQ ID NO: 363580 - DNA, 20 bp, Artificial Sequence
  chemically synthesized
gaaggaaatttatatgactt

SEQ ID NO: 363581 - DNA, 20 bp, Artificial Sequence
  chemically synthesized
ctggcaataaaacatataga

SEQ ID NO: 363582 - DNA, 20 bp, Artificial Sequence
  chemically synthesized
cctggcaataaaacatatag

SEQ ID NO: 363583 - DNA, 20 bp, Artificial Sequence
  chemically synthesized
aatcctggcaataaaacata

SEQ ID NO: 363584 - DNA, 20 bp, Artificial Sequence
  chemically synthesized
ccttctatatgttttattgc

SEQ ID NO: 363585 - DNA, 20 bp, Artificial Sequence
  chemically synthesized
cttctatatgttttattgcc

SEQ ID NO: 363586 - DNA, 20 bp, Artificial Sequence
  chemically synthesized
caagggaaccagaaaaatcc

SEQ ID NO: 363587 - DNA, 20 bp, Artificial Sequence
  chemically synthesized
ttttattgccaggatttttc

SEQ ID NO: 363588 - DNA, 20 bp, Artificial Sequence
  chemically synthesized
caggatttttctggttccct

SEQ ID NO: 363589 - DNA, 20 bp, Artificial Sequence
  chemically synthesized
tctgcctactccaagggaac

SEQ ID NO: 363590 - DNA, 20 bp, Artificial Sequence
  chemically synthesized
ggatttttctggttcccttg

SEQ ID NO: 363591 - DNA, 20 bp, Artificial Sequence
  chemically synthesized
tttttctggttcccttggag

SEQ ID NO: 363592 - DNA, 20 bp, Artificial Sequence
  chemically synthesized
ttttctggttcccttggagt

SEQ ID NO: 363593 - DNA, 20 bp, Artificial Sequence
  chemically synthesized
tggctatctgcctactccaa

SEQ ID NO: 363594 - DNA, 20 bp, Artificial Sequence
  chemically synthesized
ctggctatctgcctactcca

SEQ ID NO: 363595 - DNA, 20 bp, Artificial Sequence
  chemically synthesized
tctggctatctgcctactcc

SEQ ID NO: 363596 - DNA, 20 bp, Artificial Sequence
  chemically synthesized
tctggttcccttggagtagg

SEQ ID NO: 363597 - DNA, 20 bp, Artificial Sequence
  chemically synthesized
gttcccttggagtaggcaga

SEQ ID NO: 363598 - DNA, 20 bp, Artificial Sequence
  chemically synthesized
ccttggagtaggcagatagc

SEQ ID NO: 363599 - DNA, 20 bp, Artificial Sequence
  chemically synthesized
gtaggcagatagccagaaat

SEQ ID NO: 363600 - DNA, 20 bp, Artificial Sequence
  chemically synthesized
ctcccttgcctgctcatttc

SEQ ID NO: 363601 - DNA, 20 bp, Artificial Sequence
  chemically synthesized
ggcagatagccagaaatgag

SEQ ID NO: 363602 - DNA, 20 bp, Artificial Sequence
  chemically synthesized
gcagatagccagaaatgagc

SEQ ID NO: 363603 - DNA, 20 bp, Artificial Sequence
  chemically synthesized
atagccagaaatgagcaggc

SEQ ID NO: 363604 - DNA, 20 bp, Artificial Sequence
  chemically synthesized
tagccagaaatgagcaggca

SEQ ID NO: 363605 - DNA, 20 bp, Artificial Sequence
  chemically synthesized
agccagaaatgagcaggcaa

SEQ ID NO: 363606 - DNA, 20 bp, Artificial Sequence
  chemically synthesized
ccagaaatgagcaggcaagg

SEQ ID NO: 363607 - DNA, 20 bp, Artificial Sequence
  chemically synthesized
gcaggcaagggagccccatt

SEQ ID NO: 363608 - DNA, 20 bp, Artificial Sequence
  chemically synthesized
caggacttcttttctcaatg

SEQ ID NO: 363609 - DNA, 20 bp, Artificial Sequence
  chemically synthesized
tcaggacttcttttctcaat

SEQ ID NO: 363610 - DNA, 20 bp, Artificial Sequence
  chemically synthesized
caagggagccccattgagaa

SEQ ID NO: 363611 - DNA, 20 bp, Artificial Sequence
  chemically synthesized
ttcaggacttcttttctcaa

SEQ ID NO: 363612 - DNA, 20 bp, Artificial Sequence
  chemically synthesized
gggagccccattgagaaaag

SEQ ID NO: 363613 - DNA, 20 bp, Artificial Sequence
  chemically synthesized
cattgagaaaagaagtcctg

SEQ ID NO: 363614 - DNA, 20 bp, Artificial Sequence
  chemically synthesized
ctcagtgaaacagcatcttc

SEQ ID NO: 363615 - DNA, 20 bp, Artificial Sequence
  chemically synthesized
actcagtgaaacagcatctt

SEQ ID NO: 363616 - DNA, 20 bp, Artificial Sequence
  chemically synthesized
cctgaagatgctgtttcact

SEQ ID NO: 363617 - DNA, 20 bp, Artificial Sequence
  chemically synthesized
gcagcactgactcagtgaaa

SEQ ID NO: 363618 - DNA, 20 bp, Artificial Sequence
  chemically synthesized
aagatgctgtttcactgagt

SEQ ID NO: 363619 - DNA, 20 bp, Artificial Sequence
  chemically synthesized
gtcaacaggcagcactgact

SEQ ID NO: 363620 - DNA, 20 bp, Artificial Sequence
  chemically synthesized
tttcgctgattgtcaacagg

SEQ ID NO: 363621 - DNA, 20 bp, Artificial Sequence
  chemically synthesized
ccgtttcgctgattgtcaac

SEQ ID NO: 363622 - DNA, 20 bp, Artificial Sequence
  chemically synthesized
tccgtttcgctgattgtcaa

SEQ ID NO: 363623 - DNA, 20 bp, Artificial Sequence
  chemically synthesized
cagtgctgcctgttgacaat

SEQ ID NO: 363624 - DNA, 20 bp, Artificial Sequence
  chemically synthesized
cctgttgacaatcagcgaaa

SEQ ID NO: 363625 - DNA, 20 bp, Artificial Sequence
  chemically synthesized
ctagacataatcagtgtgga

SEQ ID NO: 363626 - DNA, 20 bp, Artificial Sequence
  chemically synthesized
aaggctagacataatcagtg

SEQ ID NO: 363627 - DNA, 20 bp, Artificial Sequence
  chemically synthesized
accacaaggctagacataat

SEQ ID NO: 363628 - DNA, 20 bp, Artificial Sequence
  chemically synthesized
ctgtccacactgattatgtc

SEQ ID NO: 363629 - DNA, 20 bp, Artificial Sequence
  chemically synthesized
actgattatgtctagccttg

SEQ ID NO: 363630 - DNA, 20 bp, Artificial Sequence
  chemically synthesized
gaggagcccaaccacaaggc

SEQ ID NO: 363631 - DNA, 20 bp, Artificial Sequence
  chemically synthesized
attatgtctagccttgtggt

SEQ ID NO: 363632 - DNA, 20 bp, Artificial Sequence
  chemically synthesized
ttatgtctagccttgtggtt

SEQ ID NO: 363633 - DNA, 20 bp, Artificial Sequence
  chemically synthesized
gctagaggagcccaaccaca

SEQ ID NO: 363634 - DNA, 20 bp, Artificial Sequence
  chemically synthesized
ggctagaggagcccaaccac

SEQ ID NO: 363635 - DNA, 20 bp, Artificial Sequence
  chemically synthesized
gccttgtggttgggctcctc

SEQ ID NO: 363636 - DNA, 20 bp, Artificial Sequence
  chemically synthesized
agtcccctttggggctagag

SEQ ID NO: 363637 - DNA, 20 bp, Artificial Sequence
  chemically synthesized
gaagtcccctttggggctag

SEQ ID NO: 363638 - DNA, 20 bp, Artificial Sequence
  chemically synthesized
agaagtcccctttggggcta

SEQ ID NO: 363639 - DNA, 20 bp, Artificial Sequence
  chemically synthesized
gttgggctcctctagcccca

SEQ ID NO: 363640 - DNA, 20 bp, Artificial Sequence
  chemically synthesized
ttgggctcctctagccccaa

SEQ ID NO: 363641 - DNA, 20 bp, Artificial Sequence
  chemically synthesized
tgagaagtcccctttggggc

SEQ ID NO: 363642 - DNA, 20 bp, Artificial Sequence
  chemically synthesized
tgggctcctctagccccaaa

SEQ ID NO: 363643 - DNA, 20 bp, Artificial Sequence
  chemically synthesized
gggctcctctagccccaaag

SEQ ID NO: 363644 - DNA, 20 bp, Artificial Sequence
  chemically synthesized
ggcctgagaagtcccctttg

SEQ ID NO: 363645 - DNA, 20 bp, Artificial Sequence
  chemically synthesized
gggcctgagaagtccccttt

SEQ ID NO: 363646 - DNA, 20 bp, Artificial Sequence
  chemically synthesized
agggcctgagaagtcccctt

SEQ ID NO: 363647 - DNA, 20 bp, Artificial Sequence
  chemically synthesized
tagccccaaaggggacttct

SEQ ID NO: 363648 - DNA, 20 bp, Artificial Sequence
  chemically synthesized
agccccaaaggggacttctc

SEQ ID NO: 363649 - DNA, 20 bp, Artificial Sequence
  chemically synthesized
atctctggcgagggcctgag

SEQ ID NO: 363650 - DNA, 20 bp, Artificial Sequence
  chemically synthesized
gttatctctggcgagggcct

SEQ ID NO: 363651 - DNA, 20 bp, Artificial Sequence
  chemically synthesized
gggacttctcaggccctcgc

SEQ ID NO: 363652 - DNA, 20 bp, Artificial Sequence
  chemically synthesized
gacttctcaggccctcgcca

SEQ ID NO: 363653 - DNA, 20 bp, Artificial Sequence
  chemically synthesized
agcgtggttatctctggcga

SEQ ID NO: 363654 - DNA, 20 bp, Artificial Sequence
  chemically synthesized
tagcgtggttatctctggcg

SEQ ID NO: 363655 - DNA, 20 bp, Artificial Sequence
  chemically synthesized
ctagcgtggttatctctggc

SEQ ID NO: 363656 - DNA, 20 bp, Artificial Sequence
  chemically synthesized
atccctagcgtggttatctc

SEQ ID NO: 363657 - DNA, 20 bp, Artificial Sequence
  chemically synthesized
ctcgccagagataaccacgc

SEQ ID NO: 363658 - DNA, 20 bp, Artificial Sequence
  chemically synthesized
tcgccagagataaccacgct

SEQ ID NO: 363659 - DNA, 20 bp, Artificial Sequence
  chemically synthesized
cgccagagataaccacgcta

SEQ ID NO: 363660 - DNA, 20 bp, Artificial Sequence
  chemically synthesized
agtggggaaaatccctagcg

SEQ ID NO: 363661 - DNA, 20 bp, Artificial Sequence
  chemically synthesized
ttgtcagtggggaaaatccc

SEQ ID NO: 363662 - DNA, 20 bp, Artificial Sequence
  chemically synthesized
tagggattttccccactgac

SEQ ID NO: 363663 - DNA, 20 bp, Artificial Sequence
  chemically synthesized
tgtgtgcatgcttgtcagtg

SEQ ID NO: 363664 - DNA, 20 bp, Artificial Sequence
  chemically synthesized
gtgtgtgcatgcttgtcagt

SEQ ID NO: 363665 - DNA, 20 bp, Artificial Sequence
  chemically synthesized
agtgtgtgcatgcttgtcag

SEQ ID NO: 363666 - DNA, 20 bp, Artificial Sequence
  chemically synthesized
aggagtgtgtgcatgcttgt

SEQ ID NO: 363667 - DNA, 20 bp, Artificial Sequence
  chemically synthesized
aatagggcaagtttttggag

SEQ ID NO: 363668 - DNA, 20 bp, Artificial Sequence
  chemically synthesized
agaatagggcaagtttttgg

SEQ ID NO: 363669 - DNA, 20 bp, Artificial Sequence
  chemically synthesized
aagaatagggcaagtttttg

SEQ ID NO: 363670 - DNA, 20 bp, Artificial Sequence
  chemically synthesized
aaaagaatagggcaagtttt

SEQ ID NO: 363671 - DNA, 20 bp, Artificial Sequence
  chemically synthesized
aatgagcaaaagaatagggc

SEQ ID NO: 363672 - DNA, 20 bp, Artificial Sequence
  chemically synthesized
ttacaatgagcaaaagaata

SEQ ID NO: 363673 - DNA, 20 bp, Artificial Sequence
  chemically synthesized
attacaatgagcaaaagaat

SEQ ID NO: 363674 - DNA, 20 bp, Artificial Sequence
  chemically synthesized
tattacaatgagcaaaagaa

SEQ ID NO: 363675 - DNA, 20 bp, Artificial Sequence
  chemically synthesized
tacactattacaatgagcaa

SEQ ID NO: 363676 - DNA, 20 bp, Artificial Sequence
  chemically synthesized
tattcttttgctcattgtaa

SEQ ID NO: 363677 - DNA, 20 bp, Artificial Sequence
  chemically synthesized
tttgtttacactattacaat

SEQ ID NO: 363678 - DNA, 20 bp, Artificial Sequence
  chemically synthesized
atctccacccaggggtgtgt

SEQ ID NO: 363679 - DNA, 20 bp, Artificial Sequence
  chemically synthesized
aatctccacccaggggtgtg

SEQ ID NO: 363680 - DNA, 20 bp, Artificial Sequence
  chemically synthesized
caaaaaaacccacacacccc

SEQ ID NO: 363681 - DNA, 20 bp, Artificial Sequence
  chemically synthesized
aaaaaaacccacacacccct

SEQ ID NO: 363682 - DNA, 20 bp, Artificial Sequence
  chemically synthesized
aaaacccacacacccctggg

SEQ ID NO: 363683 - DNA, 20 bp, Artificial Sequence
  chemically synthesized
aacccacacacccctgggtg

SEQ ID NO: 363684 - DNA, 20 bp, Artificial Sequence
  chemically synthesized
catctaaaatctccacccag

SEQ ID NO: 363685 - DNA, 20 bp, Artificial Sequence
  chemically synthesized
gcatctaaaatctccaccca

SEQ ID NO: 363686 - DNA, 20 bp, Artificial Sequence
  chemically synthesized
ggcatctaaaatctccaccc

SEQ ID NO: 363687 - DNA, 20 bp, Artificial Sequence
  chemically synthesized
tggcatctaaaatctccacc

SEQ ID NO: 363688 - DNA, 20 bp, Artificial Sequence
  chemically synthesized
acacccctgggtggagattt

SEQ ID NO: 363689 - DNA, 20 bp, Artificial Sequence
  chemically synthesized
tggagattttagatgccaat

SEQ ID NO: 363690 - DNA, 20 bp, Artificial Sequence
  chemically synthesized
gcacacataccacatctcat

SEQ ID NO: 363691 - DNA, 20 bp, Artificial Sequence
  chemically synthesized
ttttagatgccaatgagatg

SEQ ID NO: 363692 - DNA, 20 bp, Artificial Sequence
  chemically synthesized
atgagatgtggtatgtgtgc

SEQ ID NO: 363693 - DNA, 20 bp, Artificial Sequence
  chemically synthesized
catgctctggttgtacatgc

SEQ ID NO: 363694 - DNA, 20 bp, Artificial Sequence
  chemically synthesized
tgtgtgctagcatgtacaac

SEQ ID NO: 363695 - DNA, 20 bp, Artificial Sequence
  chemically synthesized
tgtgctagcatgtacaacca

SEQ ID NO: 363696 - DNA, 20 bp, Artificial Sequence
  chemically synthesized
ttttttgggcacacatgctc

SEQ ID NO: 363697 - DNA, 20 bp, Artificial Sequence
  chemically synthesized
tatgttttgggaggtttttt

SEQ ID NO: 363698 - DNA, 20 bp, Artificial Sequence
  chemically synthesized
gtatgttttgggaggttttt

SEQ ID NO: 363699 - DNA, 20 bp, Artificial Sequence
  chemically synthesized
acttgcaagtatgttttggg

SEQ ID NO: 363700 - DNA, 20 bp, Artificial Sequence
  chemically synthesized
tacttgcaagtatgttttgg

SEQ ID NO: 363701 - DNA, 20 bp, Artificial Sequence
  chemically synthesized
cttacttgcaagtatgtttt

SEQ ID NO: 363702 - DNA, 20 bp, Artificial Sequence
  chemically synthesized
tcttacttgcaagtatgttt

SEQ ID NO: 363703 - DNA, 20 bp, Artificial Sequence
  chemically synthesized
acctcccaaaacatacttgc

SEQ ID NO: 363704 - DNA, 20 bp, Artificial Sequence
  chemically synthesized
cccaaaacatacttgcaagt

SEQ ID NO: 363705 - DNA, 20 bp, Artificial Sequence
  chemically synthesized
atggggggggtcttacttgc

SEQ ID NO: 363706 - DNA, 20 bp, Artificial Sequence
  chemically synthesized
catgaaagggtgtatggggg

SEQ ID NO: 363707 - DNA, 20 bp, Artificial Sequence
  chemically synthesized
tcatgaaagggtgtatgggg

SEQ ID NO: 363708 - DNA, 20 bp, Artificial Sequence
  chemically synthesized
atcatgaaagggtgtatggg

SEQ ID NO: 363709 - DNA, 20 bp, Artificial Sequence
  chemically synthesized
aatcatgaaagggtgtatgg

SEQ ID NO: 363710 - DNA, 20 bp, Artificial Sequence
  chemically synthesized
aaatcatgaaagggtgtatg

SEQ ID NO: 363711 - DNA, 20 bp, Artificial Sequence
  chemically synthesized
taaatcatgaaagggtgtat

SEQ ID NO: 363712 - DNA, 20 bp, Artificial Sequence
  chemically synthesized
ataaatcatgaaagggtgta

SEQ ID NO: 363713 - DNA, 20 bp, Artificial Sequence
  chemically synthesized
ctacgtgataaatcatgaaa

SEQ ID NO: 363714 - DNA, 20 bp, Artificial Sequence
  chemically synthesized
cctacgtgataaatcatgaa

SEQ ID NO: 363715 - DNA, 20 bp, Artificial Sequence
  chemically synthesized
tcctacgtgataaatcatga

SEQ ID NO: 363716 - DNA, 20 bp, Artificial Sequence
  chemically synthesized
ccctttcatgatttatcacg

SEQ ID NO: 363717 - DNA, 20 bp, Artificial Sequence
  chemically synthesized
cctttcatgatttatcacgt

SEQ ID NO: 363718 - DNA, 20 bp, Artificial Sequence
  chemically synthesized
tttcatgatttatcacgtag

SEQ ID NO: 363719 - DNA, 20 bp, Artificial Sequence
  chemically synthesized
tttatcacgtaggagtctca

SEQ ID NO: 363720 - DNA, 20 bp, Artificial Sequence
  chemically synthesized
agctagtgctggggaacttt

SEQ ID NO: 363721 - DNA, 20 bp, Artificial Sequence
  chemically synthesized
gtaggagtctcaaagttccc

SEQ ID NO: 363722 - DNA, 20 bp, Artificial Sequence
  chemically synthesized
gtctcaaagttccccagcac

SEQ ID NO: 363723 - DNA, 20 bp, Artificial Sequence
  chemically synthesized
gccagcagcagctagtgctg

SEQ ID NO: 363724 - DNA, 20 bp, Artificial Sequence
  chemically synthesized
agccagcagcagctagtgct

SEQ ID NO: 363725 - DNA, 20 bp, Artificial Sequence
  chemically synthesized
gagccagcagcagctagtgc

SEQ ID NO: 363726 - DNA, 20 bp, Artificial Sequence
  chemically synthesized
aacaaagagccagcagcagc

SEQ ID NO: 363727 - DNA, 20 bp, Artificial Sequence
  chemically synthesized
tccccagcactagctgctgc

SEQ ID NO: 363728 - DNA, 20 bp, Artificial Sequence
  chemically synthesized
agggaacaaagagccagcag

SEQ ID NO: 363729 - DNA, 20 bp, Artificial Sequence
  chemically synthesized
acaagggaacaaagagccag

SEQ ID NO: 363730 - DNA, 20 bp, Artificial Sequence
  chemically synthesized
aacacaagggaacaaagagc

SEQ ID NO: 363731 - DNA, 20 bp, Artificial Sequence
  chemically synthesized
cacgaacacaagggaacaaa

SEQ ID NO: 363732 - DNA, 20 bp, Artificial Sequence
  chemically synthesized
cacacgaacacaagggaaca

SEQ ID NO: 363733 - DNA, 20 bp, Artificial Sequence
  chemically synthesized
ctgaatgcacacgaacacaa

SEQ ID NO: 363734 - DNA, 20 bp, Artificial Sequence
  chemically synthesized
actgaatgcacacgaacaca

SEQ ID NO: 363735 - DNA, 20 bp, Artificial Sequence
  chemically synthesized
cactgaatgcacacgaacac

SEQ ID NO: 363736 - DNA, 20 bp, Artificial Sequence
  chemically synthesized
cccttgtgttcgtgtgcatt

SEQ ID NO: 363737 - DNA, 20 bp, Artificial Sequence
  chemically synthesized
gttcgtgtgcattcagtgtt

SEQ ID NO: 363738 - DNA, 20 bp, Artificial Sequence
  chemically synthesized
cacatattctcaataagtac

SEQ ID NO: 363739 - DNA, 20 bp, Artificial Sequence
  chemically synthesized
gtgtttagctcgtacttatt

SEQ ID NO: 363740 - DNA, 20 bp, Artificial Sequence
  chemically synthesized
gaataacacatattctcaat

SEQ ID NO: 363741 - DNA, 20 bp, Artificial Sequence
  chemically synthesized
tattgagaatatgtgttatt

SEQ ID NO: 363742 - DNA, 20 bp, Artificial Sequence
  chemically synthesized
taagtaaactaacacagaaa

SEQ ID NO: 363743 - DNA, 20 bp, Artificial Sequence
  chemically synthesized
tcggttttctgtttctgtgt

SEQ ID NO: 363744 - DNA, 20 bp, Artificial Sequence
  chemically synthesized
ttatcctaagtaaactaaca

SEQ ID NO: 363745 - DNA, 20 bp, Artificial Sequence
  chemically synthesized
tgtttctgtgttagtttact

SEQ ID NO: 363746 - DNA, 20 bp, Artificial Sequence
  chemically synthesized
gtttctgtgttagtttactt

SEQ ID NO: 363747 - DNA, 20 bp, Artificial Sequence
  chemically synthesized
agtctggaggtcattatcct

SEQ ID NO: 363748 - DNA, 20 bp, Artificial Sequence
  chemically synthesized
ttacttaggataatgacctc

SEQ ID NO: 363749 - DNA, 20 bp, Artificial Sequence
  chemically synthesized
agcaacatggatgagtctgg

SEQ ID NO: 363750 - DNA, 20 bp, Artificial Sequence
  chemically synthesized
cagcaacatggatgagtctg

SEQ ID NO: 363751 - DNA, 20 bp, Artificial Sequence
  chemically synthesized
tgcagcaacatggatgagtc

SEQ ID NO: 363752 - DNA, 20 bp, Artificial Sequence
  chemically synthesized
tcctttgcagcaacatggat

SEQ ID NO: 363753 - DNA, 20 bp, Artificial Sequence
  chemically synthesized
tcatgtcctttgcagcaaca

SEQ ID NO: 363754 - DNA, 20 bp, Artificial Sequence
  chemically synthesized
gactcatccatgttgctgca

SEQ ID NO: 363755 - DNA, 20 bp, Artificial Sequence
  chemically synthesized
actcatccatgttgctgcaa

SEQ ID NO: 363756 - DNA, 20 bp, Artificial Sequence
  chemically synthesized
gaattagatcatgtcctttg

SEQ ID NO: 363757 - DNA, 20 bp, Artificial Sequence
  chemically synthesized
atgcagccacagaaaagaat

SEQ ID NO: 363758 - DNA, 20 bp, Artificial Sequence
  chemically synthesized
catgatctaattcttttctg

SEQ ID NO: 363759 - DNA, 20 bp, Artificial Sequence
  chemically synthesized
aatactatgcagccacagaa

SEQ ID NO: 363760 - DNA, 20 bp, Artificial Sequence
  chemically synthesized
aatacaatactatgcagcca

SEQ ID NO: 363761 - DNA, 20 bp, Artificial Sequence
  chemically synthesized
aattcttttctgtggctgca

SEQ ID NO: 363762 - DNA, 20 bp, Artificial Sequence
  chemically synthesized
gcatgaaatacaatactatg

SEQ ID NO: 363763 - DNA, 20 bp, Artificial Sequence
  chemically synthesized
ataataatttggtacatata

SEQ ID NO: 363764 - DNA, 20 bp, Artificial Sequence
  chemically synthesized
aaaaaaaaataataataatt

SEQ ID NO: 363765 - DNA, 20 bp, Artificial Sequence
  chemically synthesized
tattatttttttttttgata

SEQ ID NO: 363766 - DNA, 20 bp, Artificial Sequence
  chemically synthesized
tccagcctgggaggcagagc

SEQ ID NO: 363767 - DNA, 20 bp, Artificial Sequence
  chemically synthesized
tggaatctcgctctgcctcc

SEQ ID NO: 363768 - DNA, 20 bp, Artificial Sequence
  chemically synthesized
gcactccagcctgggaggca

SEQ ID NO: 363769 - DNA, 20 bp, Artificial Sequence
  chemically synthesized
ggaatctcgctctgcctccc

SEQ ID NO: 363770 - DNA, 20 bp, Artificial Sequence
  chemically synthesized
ctgcactccagcctgggagg

SEQ ID NO: 363771 - DNA, 20 bp, Artificial Sequence
  chemically synthesized
tctcgctctgcctcccaggc

SEQ ID NO: 363772 - DNA, 20 bp, Artificial Sequence
  chemically synthesized
ccactgcactccagcctggg

SEQ ID NO: 363773 - DNA, 20 bp, Artificial Sequence
  chemically synthesized
gccactgcactccagcctgg

SEQ ID NO: 363774 - DNA, 20 bp, Artificial Sequence
  chemically synthesized
tcgctctgcctcccaggctg

SEQ ID NO: 363775 - DNA, 20 bp, Artificial Sequence
  chemically synthesized
gtgccactgcactccagcct

SEQ ID NO: 363776 - DNA, 20 bp, Artificial Sequence
  chemically synthesized
cgtgccactgcactccagcc

SEQ ID NO: 363777 - DNA, 20 bp, Artificial Sequence
  chemically synthesized
ctgcctcccaggctggagtg

SEQ ID NO: 363778 - DNA, 20 bp, Artificial Sequence
  chemically synthesized
gagatcgtgccactgcactc

SEQ ID NO: 363779 - DNA, 20 bp, Artificial Sequence
  chemically synthesized
cctcccaggctggagtgcag

SEQ ID NO: 363780 - DNA, 20 bp, Artificial Sequence
  chemically synthesized
ggctgaggttgcagtgagtg

SEQ ID NO: 363781 - DNA, 20 bp, Artificial Sequence
  chemically synthesized
gaggctgaggttgcagtgag

SEQ ID NO: 363782 - DNA, 20 bp, Artificial Sequence
  chemically synthesized
ccagaggctgaggttgcagt

SEQ ID NO: 363783 - DNA, 20 bp, Artificial Sequence
  chemically synthesized
atctccactcactgcaacct

SEQ ID NO: 363784 - DNA, 20 bp, Artificial Sequence
  chemically synthesized
gaacccagaggctgaggttg

SEQ ID NO: 363785 - DNA, 20 bp, Artificial Sequence
  chemically synthesized
ctcactgcaacctcagcctc

SEQ ID NO: 363786 - DNA, 20 bp, Artificial Sequence
  chemically synthesized
ttgcttgaacccagaggctg

SEQ ID NO: 363787 - DNA, 20 bp, Artificial Sequence
  chemically synthesized
tcactgcaacctcagcctct

SEQ ID NO: 363788 - DNA, 20 bp, Artificial Sequence
  chemically synthesized
attgcttgaacccagaggct

SEQ ID NO: 363789 - DNA, 20 bp, Artificial Sequence
  chemically synthesized
ggagaattgcttgaacccag

SEQ ID NO: 363790 - DNA, 20 bp, Artificial Sequence
  chemically synthesized
caacctcagcctctgggttc

SEQ ID NO: 363791 - DNA, 20 bp, Artificial Sequence
  chemically synthesized
aggagaattgcttgaaccca

SEQ ID NO: 363792 - DNA, 20 bp, Artificial Sequence
  chemically synthesized
gtaggagaattgcttgaacc

SEQ ID NO: 363793 - DNA, 20 bp, Artificial Sequence
  chemically synthesized
ttcaagcaattctcctacct

SEQ ID NO: 363794 - DNA, 20 bp, Artificial Sequence
  chemically synthesized
tactcgggaggctgaggtag

SEQ ID NO: 363795 - DNA, 20 bp, Artificial Sequence
  chemically synthesized
gctactcgggaggctgaggt

SEQ ID NO: 363796 - DNA, 20 bp, Artificial Sequence
  chemically synthesized
agctactcgggaggctgagg

SEQ ID NO: 363797 - DNA, 20 bp, Artificial Sequence
  chemically synthesized
cccagctactcgggaggctg

SEQ ID NO: 363798 - DNA, 20 bp, Artificial Sequence
  chemically synthesized
tcccagctactcgggaggct

SEQ ID NO: 363799 - DNA, 20 bp, Artificial Sequence
  chemically synthesized
ttctcctacctcagcctccc

SEQ ID NO: 363800 - DNA, 20 bp, Artificial Sequence
  chemically synthesized
tcctacctcagcctcccgag

SEQ ID NO: 363801 - DNA, 20 bp, Artificial Sequence
  chemically synthesized
tgtaatcccagctactcggg

SEQ ID NO: 363802 - DNA, 20 bp, Artificial Sequence
  chemically synthesized
ctgtaatcccagctactcgg

SEQ ID NO: 363803 - DNA, 20 bp, Artificial Sequence
  chemically synthesized
acctcagcctcccgagtagc

SEQ ID NO: 363804 - DNA, 20 bp, Artificial Sequence
  chemically synthesized
gcctgtaatcccagctactc

SEQ ID NO: 363805 - DNA, 20 bp, Artificial Sequence
  chemically synthesized
cctcagcctcccgagtagct

SEQ ID NO: 363806 - DNA, 20 bp, Artificial Sequence
  chemically synthesized
tgcctgtaatcccagctact

SEQ ID NO: 363807 - DNA, 20 bp, Artificial Sequence
  chemically synthesized
ctcccgagtagctgggatta

SEQ ID NO: 363808 - DNA, 20 bp, Artificial Sequence
  chemically synthesized
tcccgagtagctgggattac

SEQ ID NO: 363809 - DNA, 20 bp, Artificial Sequence
  chemically synthesized
ctggtgcatgcctgtaatcc

SEQ ID NO: 363810 - DNA, 20 bp, Artificial Sequence
  chemically synthesized
ctgggattacaggcatgcac

SEQ ID NO: 363811 - DNA, 20 bp, Artificial Sequence
  chemically synthesized
caggcatgcaccagcatact

SEQ ID NO: 363812 - DNA, 20 bp, Artificial Sequence
  chemically synthesized
caaaaattagctgagtatgc

SEQ ID NO: 363813 - DNA, 20 bp, Artificial Sequence
  chemically synthesized
aaaaaatacaaaaattagct

SEQ ID NO: 363814 - DNA, 20 bp, Artificial Sequence
  chemically synthesized
ctactaaaaaatacaaaaat

SEQ ID NO: 363815 - DNA, 20 bp, Artificial Sequence
  chemically synthesized
cagctaatttttgtattttt

SEQ ID NO: 363816 - DNA, 20 bp, Artificial Sequence
  chemically synthesized
ctaatttttgtattttttag

SEQ ID NO: 363817 - DNA, 20 bp, Artificial Sequence
  chemically synthesized
aatttttgtattttttagta

SEQ ID NO: 363818 - DNA, 20 bp, Artificial Sequence
  chemically synthesized
tttgtattttttagtagaga

SEQ ID NO: 363819 - DNA, 20 bp, Artificial Sequence
  chemically synthesized
ttgtattttttagtagagac

SEQ ID NO: 363820 - DNA, 20 bp, Artificial Sequence
  chemically synthesized
tgtattttttagtagagacg

SEQ ID NO: 363821 - DNA, 20 bp, Artificial Sequence
  chemically synthesized
gtagagacggggtttcgcca

SEQ ID NO: 363822 - DNA, 20 bp, Artificial Sequence
  chemically synthesized
gagacggggtttcgccatgg

SEQ ID NO: 363823 - DNA, 20 bp, Artificial Sequence
  chemically synthesized
cggggtttcgccatggtggc

SEQ ID NO: 363824 - DNA, 20 bp, Artificial Sequence
  chemically synthesized
cgagaccagcctggccacca

SEQ ID NO: 363825 - DNA, 20 bp, Artificial Sequence
  chemically synthesized
ggggtttcgccatggtggcc

SEQ ID NO: 363826 - DNA, 20 bp, Artificial Sequence
  chemically synthesized
tttcgccatggtggccaggc

SEQ ID NO: 363827 - DNA, 20 bp, Artificial Sequence
  chemically synthesized
tcaggagttcgagaccagcc

SEQ ID NO: 363828 - DNA, 20 bp, Artificial Sequence
  chemically synthesized
agaggtcaggagttcgagac

SEQ ID NO: 363829 - DNA, 20 bp, Artificial Sequence
  chemically synthesized
tcaccagaggtcaggagttc

SEQ ID NO: 363830 - DNA, 20 bp, Artificial Sequence
  chemically synthesized
ggcagatcaccagaggtcag

SEQ ID NO: 363831 - DNA, 20 bp, Artificial Sequence
  chemically synthesized
ggtctcgaactcctgacctc

SEQ ID NO: 363832 - DNA, 20 bp, Artificial Sequence
  chemically synthesized
ctggcagatcaccagaggtc

SEQ ID NO: 363833 - DNA, 20 bp, Artificial Sequence
  chemically synthesized
gctggcagatcaccagaggt

SEQ ID NO: 363834 - DNA, 20 bp, Artificial Sequence
  chemically synthesized
cgaggctggcagatcaccag

SEQ ID NO: 363835 - DNA, 20 bp, Artificial Sequence
  chemically synthesized
ccgaggctggcagatcacca

SEQ ID NO: 363836 - DNA, 20 bp, Artificial Sequence
  chemically synthesized
ggccgaggctggcagatcac

SEQ ID NO: 363837 - DNA, 20 bp, Artificial Sequence
  chemically synthesized
cctgacctctggtgatctgc

SEQ ID NO: 363838 - DNA, 20 bp, Artificial Sequence
  chemically synthesized
ctctggtgatctgccagcct

SEQ ID NO: 363839 - DNA, 20 bp, Artificial Sequence
  chemically synthesized
ctgtgggaggccgaggctgg

SEQ ID NO: 363840 - DNA, 20 bp, Artificial Sequence
  chemically synthesized
gcactgtgggaggccgaggc

SEQ ID NO: 363841 - DNA, 20 bp, Artificial Sequence
  chemically synthesized
cccagcactgtgggaggccg

SEQ ID NO: 363842 - DNA, 20 bp, Artificial Sequence
  chemically synthesized
tcccagcactgtgggaggcc

SEQ ID NO: 363843 - DNA, 20 bp, Artificial Sequence
  chemically synthesized
ctgccagcctcggcctccca

SEQ ID NO: 363844 - DNA, 20 bp, Artificial Sequence
  chemically synthesized
tgtaatcccagcactgtggg

SEQ ID NO: 363845 - DNA, 20 bp, Artificial Sequence
  chemically synthesized
ctgtaatcccagcactgtgg

SEQ ID NO: 363846 - DNA, 20 bp, Artificial Sequence
  chemically synthesized
gcctcggcctcccacagtgc

SEQ ID NO: 363847 - DNA, 20 bp, Artificial Sequence
  chemically synthesized
gcctgtaatcccagcactgt

SEQ ID NO: 363848 - DNA, 20 bp, Artificial Sequence
  chemically synthesized
cctcggcctcccacagtgct

SEQ ID NO: 363849 - DNA, 20 bp, Artificial Sequence
  chemically synthesized
tgcctgtaatcccagcactg

SEQ ID NO: 363850 - DNA, 20 bp, Artificial Sequence
  chemically synthesized
ctcccacagtgctgggatta

SEQ ID NO: 363851 - DNA, 20 bp, Artificial Sequence
  chemically synthesized
tcccacagtgctgggattac

SEQ ID NO: 363852 - DNA, 20 bp, Artificial Sequence
  chemically synthesized
ggtgctcatgcctgtaatcc

SEQ ID NO: 363853 - DNA, 20 bp, Artificial Sequence
  chemically synthesized
agtgctgggattacaggcat

SEQ ID NO: 363854 - DNA, 20 bp, Artificial Sequence
  chemically synthesized
aatgcggtacaggtcgggcg

SEQ ID NO: 363855 - DNA, 20 bp, Artificial Sequence
  chemically synthesized
aagaaaatgcggtacaggtc

SEQ ID NO: 363856 - DNA, 20 bp, Artificial Sequence
  chemically synthesized
aaagaaaatgcggtacaggt

SEQ ID NO: 363857 - DNA, 20 bp, Artificial Sequence
  chemically synthesized
gcataaagaaaatgcggtac

SEQ ID NO: 363858 - DNA, 20 bp, Artificial Sequence
  chemically synthesized
tgcataaagaaaatgcggta

SEQ ID NO: 363859 - DNA, 20 bp, Artificial Sequence
  chemically synthesized
aatcctgcataaagaaaatg

SEQ ID NO: 363860 - DNA, 20 bp, Artificial Sequence
  chemically synthesized
tgtaccgcattttctttatg

SEQ ID NO: 363861 - DNA, 20 bp, Artificial Sequence
  chemically synthesized
gtaccgcattttctttatgc

SEQ ID NO: 363862 - DNA, 20 bp, Artificial Sequence
  chemically synthesized
gtaaaactcaatcctgcata

SEQ ID NO: 363863 - DNA, 20 bp, Artificial Sequence
  chemically synthesized
cattttctttatgcaggatt

SEQ ID NO: 363864 - DNA, 20 bp, Artificial Sequence
  chemically synthesized
ttatgcaggattgagtttta

SEQ ID NO: 363865 - DNA, 20 bp, Artificial Sequence
  chemically synthesized
tatgcaggattgagttttac

SEQ ID NO: 363866 - DNA, 20 bp, Artificial Sequence
  chemically synthesized
gagttttacaggatatccca

SEQ ID NO: 363867 - DNA, 20 bp, Artificial Sequence
  chemically synthesized
catttaaaaaaacaaacttt

SEQ ID NO: 363868 - DNA, 20 bp, Artificial Sequence
  chemically synthesized
tcatttaaaaaaacaaactt

SEQ ID NO: 363869 - DNA, 20 bp, Artificial Sequence
  chemically synthesized
tttaaatgacattttcttgc

SEQ ID NO: 363870 - DNA, 20 bp, Artificial Sequence
  chemically synthesized
ttaaatgacattttcttgct

SEQ ID NO: 363871 - DNA, 20 bp, Artificial Sequence
  chemically synthesized
taaatgacattttcttgctg

SEQ ID NO: 363872 - DNA, 20 bp, Artificial Sequence
  chemically synthesized
gtagcttgactgtccccagc

SEQ ID NO: 363873 - DNA, 20 bp, Artificial Sequence
  chemically synthesized
tgacattttcttgctgggga

SEQ ID NO: 363874 - DNA, 20 bp, Artificial Sequence
  chemically synthesized
atttgtagcttgactgtccc

SEQ ID NO: 363875 - DNA, 20 bp, Artificial Sequence
  chemically synthesized
ttttcttgctggggacagtc

SEQ ID NO: 363876 - DNA, 20 bp, Artificial Sequence
  chemically synthesized
tattagatttaatttatttg

SEQ ID NO: 363877 - DNA, 20 bp, Artificial Sequence
  chemically synthesized
agagcggaacacagaattat

SEQ ID NO: 363878 - DNA, 20 bp, Artificial Sequence
  chemically synthesized
gtgaagaaaagagcggaaca

SEQ ID NO: 363879 - DNA, 20 bp, Artificial Sequence
  chemically synthesized
tgtagcagtgaagaaaagag

SEQ ID NO: 363880 - DNA, 20 bp, Artificial Sequence
  chemically synthesized
aaatgtagcagtgaagaaaa

SEQ ID NO: 363881 - DNA, 20 bp, Artificial Sequence
  chemically synthesized
caaaatgtagcagtgaagaa

SEQ ID NO: 363882 - DNA, 20 bp, Artificial Sequence
  chemically synthesized
tgtttcaaaatgtagcagtg

SEQ ID NO: 363883 - DNA, 20 bp, Artificial Sequence
  chemically synthesized
tattctgtttcaaaatgtag

SEQ ID NO: 363884 - DNA, 20 bp, Artificial Sequence
  chemically synthesized
tcatattctgtttcaaaatg

SEQ ID NO: 363885 - DNA, 20 bp, Artificial Sequence
  chemically synthesized
ttcactgctacattttgaaa

SEQ ID NO: 363886 - DNA, 20 bp, Artificial Sequence
  chemically synthesized
tatgatattttgatatttca

SEQ ID NO: 363887 - DNA, 20 bp, Artificial Sequence
  chemically synthesized
aacaatattaaagttacaca

SEQ ID NO: 363888 - DNA, 20 bp, Artificial Sequence
  chemically synthesized
gagaattgttaacaatatta

SEQ ID NO: 363889 - DNA, 20 bp, Artificial Sequence
  chemically synthesized
atcagtgtcattgacattat

SEQ ID NO: 363890 - DNA, 20 bp, Artificial Sequence
  chemically synthesized
gatggactctttggaaatat

SEQ ID NO: 363891 - DNA, 20 bp, Artificial Sequence
  chemically synthesized
caatgacactgatatttcca

SEQ ID NO: 363892 - DNA, 20 bp, Artificial Sequence
  chemically synthesized
atgacactgatatttccaaa

SEQ ID NO: 363893 - DNA, 20 bp, Artificial Sequence
  chemically synthesized
tattagtccgatggactctt

SEQ ID NO: 363894 - DNA, 20 bp, Artificial Sequence
  chemically synthesized
gatatttccaaagagtccat

SEQ ID NO: 363895 - DNA, 20 bp, Artificial Sequence
  chemically synthesized
tttcttgtttattagtccga

SEQ ID NO: 363896 - DNA, 20 bp, Artificial Sequence
  chemically synthesized
agtccatcggactaataaac

SEQ ID NO: 363897 - DNA, 20 bp, Artificial Sequence
  chemically synthesized
gagctgattttcttgtttat

SEQ ID NO: 363898 - DNA, 20 bp, Artificial Sequence
  chemically synthesized
ggactaataaacaagaaaat

SEQ ID NO: 363899 - DNA, 20 bp, Artificial Sequence
  chemically synthesized
taaacaagaaaatcagctca

SEQ ID NO: 363900 - DNA, 20 bp, Artificial Sequence
  chemically synthesized
ccgcagccagaataatctat

SEQ ID NO: 363901 - DNA, 20 bp, Artificial Sequence
  chemically synthesized
aatcagctcatagattattc

SEQ ID NO: 363902 - DNA, 20 bp, Artificial Sequence
  chemically synthesized
ctcatagattattctggctg

SEQ ID NO: 363903 - DNA, 20 bp, Artificial Sequence
  chemically synthesized
catagattattctggctgcg

SEQ ID NO: 363904 - DNA, 20 bp, Artificial Sequence
  chemically synthesized
tagatttttcactccgcagc

SEQ ID NO: 363905 - DNA, 20 bp, Artificial Sequence
  chemically synthesized
taactagatttttcactccg

SEQ ID NO: 363906 - DNA, 20 bp, Artificial Sequence
  chemically synthesized
tggctgcggagtgaaaaatc

SEQ ID NO: 363907 - DNA, 20 bp, Artificial Sequence
  chemically synthesized
tgtcttaggaagaaattaac

SEQ ID NO: 363908 - DNA, 20 bp, Artificial Sequence
  chemically synthesized
aatctagttaatttcttcct

SEQ ID NO: 363909 - DNA, 20 bp, Artificial Sequence
  chemically synthesized
acagagatgtttgtcttagg

SEQ ID NO: 363910 - DNA, 20 bp, Artificial Sequence
  chemically synthesized
tttacagagatgtttgtctt

SEQ ID NO: 363911 - DNA, 20 bp, Artificial Sequence
  chemically synthesized
ttttacagagatgtttgtct

SEQ ID NO: 363912 - DNA, 20 bp, Artificial Sequence
  chemically synthesized
cctatgaaagttattttaca

SEQ ID NO: 363913 - DNA, 20 bp, Artificial Sequence
  chemically synthesized
aacctatgaaagttatttta

SEQ ID NO: 363914 - DNA, 20 bp, Artificial Sequence
  chemically synthesized
tctctgtaaaataactttca

SEQ ID NO: 363915 - DNA, 20 bp, Artificial Sequence
  chemically synthesized
ctctgtaaaataactttcat

SEQ ID NO: 363916 - DNA, 20 bp, Artificial Sequence
  chemically synthesized
ttgtcacctttaacctatga

SEQ ID NO: 363917 - DNA, 20 bp, Artificial Sequence
  chemically synthesized
aaaataactttcataggtta

SEQ ID NO: 363918 - DNA, 20 bp, Artificial Sequence
  chemically synthesized
aaataactttcataggttaa

SEQ ID NO: 363919 - DNA, 20 bp, Artificial Sequence
  chemically synthesized
tggctgattttatgaattca

SEQ ID NO: 363920 - DNA, 20 bp, Artificial Sequence
  chemically synthesized
ttggctgattttatgaattc

SEQ ID NO: 363921 - DNA, 20 bp, Artificial Sequence
  chemically synthesized
attggctgattttatgaatt

SEQ ID NO: 363922 - DNA, 20 bp, Artificial Sequence
  chemically synthesized
tgaccctgaattcataaaat

SEQ ID NO: 363923 - DNA, 20 bp, Artificial Sequence
  chemically synthesized
gaaactgtgcagcaattaat

SEQ ID NO: 363924 - DNA, 20 bp, Artificial Sequence
  chemically synthesized
tcagccaattaattgctgca

SEQ ID NO: 363925 - DNA, 20 bp, Artificial Sequence
  chemically synthesized
atatggaaatggaaactgtg

SEQ ID NO: 363926 - DNA, 20 bp, Artificial Sequence
  chemically synthesized
cattacataagatatggaaa

SEQ ID NO: 363927 - DNA, 20 bp, Artificial Sequence
  chemically synthesized
agatgacattacataagata

SEQ ID NO: 363928 - DNA, 20 bp, Artificial Sequence
  chemically synthesized
gcagggagatgacattacat

SEQ ID NO: 363929 - DNA, 20 bp, Artificial Sequence
  chemically synthesized
atgtaatgtcatctccctgc

SEQ ID NO: 363930 - DNA, 20 bp, Artificial Sequence
  chemically synthesized
tgctcagcttatctggcagg

SEQ ID NO: 363931 - DNA, 20 bp, Artificial Sequence
  chemically synthesized
gttgctcagcttatctggca

SEQ ID NO: 363932 - DNA, 20 bp, Artificial Sequence
  chemically synthesized
atgtcatctccctgccagat

SEQ ID NO: 363933 - DNA, 20 bp, Artificial Sequence
  chemically synthesized
tgttgctcagcttatctggc

SEQ ID NO: 363934 - DNA, 20 bp, Artificial Sequence
  chemically synthesized
atgttgctcagcttatctgg

SEQ ID NO: 363935 - DNA, 20 bp, Artificial Sequence
  chemically synthesized
caaatgttgctcagcttatc

SEQ ID NO: 363936 - DNA, 20 bp, Artificial Sequence
  chemically synthesized
atctccctgccagataagct

SEQ ID NO: 363937 - DNA, 20 bp, Artificial Sequence
  chemically synthesized
gtactcccccaaatgttgct

SEQ ID NO: 363938 - DNA, 20 bp, Artificial Sequence
  chemically synthesized
cagataagctgagcaacatt

SEQ ID NO: 363939 - DNA, 20 bp, Artificial Sequence
  chemically synthesized
agataagctgagcaacattt

SEQ ID NO: 363940 - DNA, 20 bp, Artificial Sequence
  chemically synthesized
gataagctgagcaacatttg

SEQ ID NO: 363941 - DNA, 20 bp, Artificial Sequence
  chemically synthesized
ataagctgagcaacatttgg

SEQ ID NO: 363942 - DNA, 20 bp, Artificial Sequence
  chemically synthesized
aagctgagcaacatttgggg

SEQ ID NO: 363943 - DNA, 20 bp, Artificial Sequence
  chemically synthesized
aaaataaccataagcaggga

SEQ ID NO: 363944 - DNA, 20 bp, Artificial Sequence
  chemically synthesized
tattaatctatccctgctta

SEQ ID NO: 363945 - DNA, 20 bp, Artificial Sequence
  chemically synthesized
tcttaaaataaccataagca

SEQ ID NO: 363946 - DNA, 20 bp, Artificial Sequence
  chemically synthesized
ctcttaaaataaccataagc

SEQ ID NO: 363947 - DNA, 20 bp, Artificial Sequence
  chemically synthesized
actcttaaaataaccataag

SEQ ID NO: 363948 - DNA, 20 bp, Artificial Sequence
  chemically synthesized
cttactcttaaaataaccat

SEQ ID NO: 363949 - DNA, 20 bp, Artificial Sequence
  chemically synthesized
tccctgcttatggttatttt

SEQ ID NO: 363950 - DNA, 20 bp, Artificial Sequence
  chemically synthesized
cctgcttatggttattttaa

SEQ ID NO: 363951 - DNA, 20 bp, Artificial Sequence
  chemically synthesized
cttatggttattttaagagt

SEQ ID NO: 363952 - DNA, 20 bp, Artificial Sequence
  chemically synthesized
aagataaactcaagtacatt

SEQ ID NO: 363953 - DNA, 20 bp, Artificial Sequence
  chemically synthesized
tcaacgtactcaatgtactt

SEQ ID NO: 363954 - DNA, 20 bp, Artificial Sequence
  chemically synthesized
tctctttcaaagataaactc

SEQ ID NO: 363955 - DNA, 20 bp, Artificial Sequence
  chemically synthesized
gtacttgagtttatctttga

SEQ ID NO: 363956 - DNA, 20 bp, Artificial Sequence
  chemically synthesized
acttgagtttatctttgaaa

SEQ ID NO: 363957 - DNA, 20 bp, Artificial Sequence
  chemically synthesized
ttgagtttatctttgaaaga

SEQ ID NO: 363958 - DNA, 20 bp, Artificial Sequence
  chemically synthesized
tacattacctctctctttca

SEQ ID NO: 363959 - DNA, 20 bp, Artificial Sequence
  chemically synthesized
gagtttatctttgaaagaga

SEQ ID NO: 363960 - DNA, 20 bp, Artificial Sequence
  chemically synthesized
agtttatctttgaaagagag

SEQ ID NO: 363961 - DNA, 20 bp, Artificial Sequence
  chemically synthesized
aaagagagaggtaatgtaat

SEQ ID NO: 363962 - DNA, 20 bp, Artificial Sequence
  chemically synthesized
aagagagaggtaatgtaatt

SEQ ID NO: 363963 - DNA, 20 bp, Artificial Sequence
  chemically synthesized
agagagaggtaatgtaatta

SEQ ID NO: 363964 - DNA, 20 bp, Artificial Sequence
  chemically synthesized
agagaggtaatgtaattagg

SEQ ID NO: 363965 - DNA, 20 bp, Artificial Sequence
  chemically synthesized
aatgtaattagggagctact

SEQ ID NO: 363966 - DNA, 20 bp, Artificial Sequence
  chemically synthesized
acatttcaccaggcacttag

SEQ ID NO: 363967 - DNA, 20 bp, Artificial Sequence
  chemically synthesized
ttagggagctactaagtgcc

SEQ ID NO: 363968 - DNA, 20 bp, Artificial Sequence
  chemically synthesized
aatacatttcaccaggcact

SEQ ID NO: 363969 - DNA, 20 bp, Artificial Sequence
  chemically synthesized
atcgaccaatacatttcacc

SEQ ID NO: 363970 - DNA, 20 bp, Artificial Sequence
  chemically synthesized
aatcgaccaatacatttcac

SEQ ID NO: 363971 - DNA, 20 bp, Artificial Sequence
  chemically synthesized
aagtgcctggtgaaatgtat

SEQ ID NO: 363972 - DNA, 20 bp, Artificial Sequence
  chemically synthesized
ggtgaaatgtattggtcgat

SEQ ID NO: 363973 - DNA, 20 bp, Artificial Sequence
  chemically synthesized
aaatgtattggtcgattaga

SEQ ID NO: 363974 - DNA, 20 bp, Artificial Sequence
  chemically synthesized
ttggtcgattagacagattt

SEQ ID NO: 363975 - DNA, 20 bp, Artificial Sequence
  chemically synthesized
tggtcgattagacagatttt

SEQ ID NO: 363976 - DNA, 20 bp, Artificial Sequence
  chemically synthesized
acagattttaggatgttaat

SEQ ID NO: 363977 - DNA, 20 bp, Artificial Sequence
  chemically synthesized
attttaggatgttaataaga

SEQ ID NO: 363978 - DNA, 20 bp, Artificial Sequence
  chemically synthesized
ttttaggatgttaataagaa

SEQ ID NO: 363979 - DNA, 20 bp, Artificial Sequence
  chemically synthesized
taggatgttaataagaaagg

SEQ ID NO: 363980 - DNA, 20 bp, Artificial Sequence
  chemically synthesized
aggatgttaataagaaagga

SEQ ID NO: 363981 - DNA, 20 bp, Artificial Sequence
  chemically synthesized
ctgtgtcatggcattggagg

SEQ ID NO: 363982 - DNA, 20 bp, Artificial Sequence
  chemically synthesized
cccctgtgtcatggcattgg

SEQ ID NO: 363983 - DNA, 20 bp, Artificial Sequence
  chemically synthesized
tcccctgtgtcatggcattg

SEQ ID NO: 363984 - DNA, 20 bp, Artificial Sequence
  chemically synthesized
cttcccctgtgtcatggcat

SEQ ID NO: 363985 - DNA, 20 bp, Artificial Sequence
  chemically synthesized
ctgcctccaatgccatgaca

SEQ ID NO: 363986 - DNA, 20 bp, Artificial Sequence
  chemically synthesized
tgcctccaatgccatgacac

SEQ ID NO: 363987 - DNA, 20 bp, Artificial Sequence
  chemically synthesized
gcctccaatgccatgacaca

SEQ ID NO: 363988 - DNA, 20 bp, Artificial Sequence
  chemically synthesized
gtgactcttcccctgtgtca

SEQ ID NO: 363989 - DNA, 20 bp, Artificial Sequence
  chemically synthesized
cctccaatgccatgacacag

SEQ ID NO: 363990 - DNA, 20 bp, Artificial Sequence
  chemically synthesized
ccaatgccatgacacagggg

SEQ ID NO: 363991 - DNA, 20 bp, Artificial Sequence
  chemically synthesized
aatgccatgacacaggggaa

SEQ ID NO: 363992 - DNA, 20 bp, Artificial Sequence
  chemically synthesized
gacacaggggaagagtcacc

SEQ ID NO: 363993 - DNA, 20 bp, Artificial Sequence
  chemically synthesized
acaggggaagagtcaccaag

SEQ ID NO: 363994 - DNA, 20 bp, Artificial Sequence
  chemically synthesized
ggaagagtcaccaagtggtt

SEQ ID NO: 363995 - DNA, 20 bp, Artificial Sequence
  chemically synthesized
ctaatctcctctgaaccact

SEQ ID NO: 363996 - DNA, 20 bp, Artificial Sequence
  chemically synthesized
aagagtcaccaagtggttca

SEQ ID NO: 363997 - DNA, 20 bp, Artificial Sequence
  chemically synthesized
agagtcaccaagtggttcag

SEQ ID NO: 363998 - DNA, 20 bp, Artificial Sequence
  chemically synthesized
agtcaccaagtggttcagag

SEQ ID NO: 363999 - DNA, 20 bp, Artificial Sequence
  chemically synthesized
ccaagtggttcagaggagat

SEQ ID NO: 364000 - DNA, 20 bp, Artificial Sequence
  chemically synthesized
aaaccaagtaggcaggtcag

SEQ ID NO: 364001 - DNA, 20 bp, Artificial Sequence
  chemically synthesized
taaaccaagtaggcaggtca

SEQ ID NO: 364002 - DNA, 20 bp, Artificial Sequence
  chemically synthesized
gctaaaccaagtaggcaggt

SEQ ID NO: 364003 - DNA, 20 bp, Artificial Sequence
  chemically synthesized
attcctctgacctgcctact

SEQ ID NO: 364004 - DNA, 20 bp, Artificial Sequence
  chemically synthesized
cacagctaaaccaagtaggc

SEQ ID NO: 364005 - DNA, 20 bp, Artificial Sequence
  chemically synthesized
tcacagctaaaccaagtagg

SEQ ID NO: 364006 - DNA, 20 bp, Artificial Sequence
  chemically synthesized
cagtcacagctaaaccaagt

SEQ ID NO: 364007 - DNA, 20 bp, Artificial Sequence
  chemically synthesized
tctgacctgcctacttggtt

SEQ ID NO: 364008 - DNA, 20 bp, Artificial Sequence
  chemically synthesized
acagtcacagctaaaccaag

SEQ ID NO: 364009 - DNA, 20 bp, Artificial Sequence
  chemically synthesized
taaacagtcacagctaaacc

SEQ ID NO: 364010 - DNA, 20 bp, Artificial Sequence
  chemically synthesized
ttagaagaagtaaacagtca

SEQ ID NO: 364011 - DNA, 20 bp, Artificial Sequence
  chemically synthesized
gttgcattagaagaagtaaa

SEQ ID NO: 364012 - DNA, 20 bp, Artificial Sequence
  chemically synthesized
tacgtgtgttgcattagaag

SEQ ID NO: 364013 - DNA, 20 bp, Artificial Sequence
  chemically synthesized
aaatacgtgtgttgcattag

SEQ ID NO: 364014 - DNA, 20 bp, Artificial Sequence
  chemically synthesized
ttaaaatacgtgtgttgcat

SEQ ID NO: 364015 - DNA, 20 bp, Artificial Sequence
  chemically synthesized
gcaacacacgtattttaatc

SEQ ID NO: 364016 - DNA, 20 bp, Artificial Sequence
  chemically synthesized
ttttttggtttagatttaac

SEQ ID NO: 364017 - DNA, 20 bp, Artificial Sequence
  chemically synthesized
gcagatttgtttttttggtt

SEQ ID NO: 364018 - DNA, 20 bp, Artificial Sequence
  chemically synthesized
gaatggcagatttgtttttt

SEQ ID NO: 364019 - DNA, 20 bp, Artificial Sequence
  chemically synthesized
tttacttggggtatgaatgg

SEQ ID NO: 364020 - DNA, 20 bp, Artificial Sequence
  chemically synthesized
atttttacttggggtatgaa

SEQ ID NO: 364021 - DNA, 20 bp, Artificial Sequence
  chemically synthesized
aaatctgccattcatacccc

SEQ ID NO: 364022 - DNA, 20 bp, Artificial Sequence
  chemically synthesized
aacatcactatttttacttg

SEQ ID NO: 364023 - DNA, 20 bp, Artificial Sequence
  chemically synthesized
aaacatcactatttttactt

SEQ ID NO: 364024 - DNA, 20 bp, Artificial Sequence
  chemically synthesized
gaaacatcactatttttact

SEQ ID NO: 364025 - DNA, 20 bp, Artificial Sequence
  chemically synthesized
attcataccccaagtaaaaa

SEQ ID NO: 364026 - DNA, 20 bp, Artificial Sequence
  chemically synthesized
ctccaagcatataaattata

SEQ ID NO: 364027 - DNA, 20 bp, Artificial Sequence
  chemically synthesized
ttctgtataatttatatgct

SEQ ID NO: 364028 - DNA, 20 bp, Artificial Sequence
  chemically synthesized
ctgtataatttatatgcttg

SEQ ID NO: 364029 - DNA, 20 bp, Artificial Sequence
  chemically synthesized
ataatttatatgcttggaga

SEQ ID NO: 364030 - DNA, 20 bp, Artificial Sequence
  chemically synthesized
acttattaaacgctgtctcc

SEQ ID NO: 364031 - DNA, 20 bp, Artificial Sequence
  chemically synthesized
gcttggagacagcgtttaat

SEQ ID NO: 364032 - DNA, 20 bp, Artificial Sequence
  chemically synthesized
agacagcgtttaataagtgt

SEQ ID NO: 364033 - DNA, 20 bp, Artificial Sequence
  chemically synthesized
taatgatgtttgtttaaatc

SEQ ID NO: 364034 - DNA, 20 bp, Artificial Sequence
  chemically synthesized
atttaaacaaacatcattat

SEQ ID NO: 364035 - DNA, 20 bp, Artificial Sequence
  chemically synthesized
tttaaacaaacatcattatc

SEQ ID NO: 364036 - DNA, 20 bp, Artificial Sequence
  chemically synthesized
ttatcaggtttgaacacatt

SEQ ID NO: 364037 - DNA, 20 bp, Artificial Sequence
  chemically synthesized
acatttagtacataaatatt

SEQ ID NO: 364038 - DNA, 20 bp, Artificial Sequence
  chemically synthesized
tagtacataaatatttggta

SEQ ID NO: 364039 - DNA, 20 bp, Artificial Sequence
  chemically synthesized
gcagtgttttgtgcaacaaa

SEQ ID NO: 364040 - DNA, 20 bp, Artificial Sequence
  chemically synthesized
gttgcacaaaacactgccgt

SEQ ID NO: 364041 - DNA, 20 bp, Artificial Sequence
  chemically synthesized
gtgaactctgtttcttacgg

SEQ ID NO: 364042 - DNA, 20 bp, Artificial Sequence
  chemically synthesized
caaaacactgccgtaagaaa

SEQ ID NO: 364043 - DNA, 20 bp, Artificial Sequence
  chemically synthesized
ccggtgaactctgtttctta

SEQ ID NO: 364044 - DNA, 20 bp, Artificial Sequence
  chemically synthesized
aaacactgccgtaagaaaca

SEQ ID NO: 364045 - DNA, 20 bp, Artificial Sequence
  chemically synthesized
ccgtaagaaacagagttcac

SEQ ID NO: 364046 - DNA, 20 bp, Artificial Sequence
  chemically synthesized
cgtaagaaacagagttcacc

SEQ ID NO: 364047 - DNA, 20 bp, Artificial Sequence
  chemically synthesized
gaaacagagttcaccgggca

SEQ ID NO: 364048 - DNA, 20 bp, Artificial Sequence
  chemically synthesized
acagagttcaccgggcacgg

SEQ ID NO: 364049 - DNA, 20 bp, Artificial Sequence
  chemically synthesized
caggcgtgagccaccgtgcc

SEQ ID NO: 364050 - DNA, 20 bp, Artificial Sequence
  chemically synthesized
agtgctgagattacaggcgt

SEQ ID NO: 364051 - DNA, 20 bp, Artificial Sequence
  chemically synthesized
gtggctcacgcctgtaatct

SEQ ID NO: 364052 - DNA, 20 bp, Artificial Sequence
  chemically synthesized
tcccgaagtgctgagattac

SEQ ID NO: 364053 - DNA, 20 bp, Artificial Sequence
  chemically synthesized
ctcccgaagtgctgagatta

SEQ ID NO: 364054 - DNA, 20 bp, Artificial Sequence
  chemically synthesized
cgcctgtaatctcagcactt

SEQ ID NO: 364055 - DNA, 20 bp, Artificial Sequence
  chemically synthesized
cctcagcctcccgaagtgct

SEQ ID NO: 364056 - DNA, 20 bp, Artificial Sequence
  chemically synthesized
gcctgtaatctcagcacttc

SEQ ID NO: 364057 - DNA, 20 bp, Artificial Sequence
  chemically synthesized
ctgtaatctcagcacttcgg

SEQ ID NO: 364058 - DNA, 20 bp, Artificial Sequence
  chemically synthesized
tgtaatctcagcacttcggg

SEQ ID NO: 364059 - DNA, 20 bp, Artificial Sequence
  chemically synthesized
ccacctgcctcagcctcccg

SEQ ID NO: 364060 - DNA, 20 bp, Artificial Sequence
  chemically synthesized
tctcagcacttcgggaggct

SEQ ID NO: 364061 - DNA, 20 bp, Artificial Sequence
  chemically synthesized
ctcagcacttcgggaggctg

SEQ ID NO: 364062 - DNA, 20 bp, Artificial Sequence
  chemically synthesized
agcacttcgggaggctgagg

SEQ ID NO: 364063 - DNA, 20 bp, Artificial Sequence
  chemically synthesized
gcacttcgggaggctgaggc

SEQ ID NO: 364064 - DNA, 20 bp, Artificial Sequence
  chemically synthesized
cttcgggaggctgaggcagg

SEQ ID NO: 364065 - DNA, 20 bp, Artificial Sequence
  chemically synthesized
ctcaggtgatccacctgcct

SEQ ID NO: 364066 - DNA, 20 bp, Artificial Sequence
  chemically synthesized
ctgaggcaggtggatcacct

SEQ ID NO: 364067 - DNA, 20 bp, Artificial Sequence
  chemically synthesized
tgaggcaggtggatcacctg

SEQ ID NO: 364068 - DNA, 20 bp, Artificial Sequence
  chemically synthesized
gcaggtggatcacctgaggt

SEQ ID NO: 364069 - DNA, 20 bp, Artificial Sequence
  chemically synthesized
caggtggatcacctgaggtc

SEQ ID NO: 364070 - DNA, 20 bp, Artificial Sequence
  chemically synthesized
agtctcgaactcctgacctc

SEQ ID NO: 364071 - DNA, 20 bp, Artificial Sequence
  chemically synthesized
ggtggatcacctgaggtcag

SEQ ID NO: 364072 - DNA, 20 bp, Artificial Sequence
  chemically synthesized
tagtctcgaactcctgacct

SEQ ID NO: 364073 - DNA, 20 bp, Artificial Sequence
  chemically synthesized
tcacctgaggtcaggagttc

SEQ ID NO: 364074 - DNA, 20 bp, Artificial Sequence
  chemically synthesized
tgaggtcaggagttcgagac

SEQ ID NO: 364075 - DNA, 20 bp, Artificial Sequence
  chemically synthesized
caggagttcgagactagcct

SEQ ID NO: 364076 - DNA, 20 bp, Artificial Sequence
  chemically synthesized
ttcaccatgttggccaaggc

SEQ ID NO: 364077 - DNA, 20 bp, Artificial Sequence
  chemically synthesized
gggtttcaccatgttggcca

SEQ ID NO: 364078 - DNA, 20 bp, Artificial Sequence
  chemically synthesized
agggtttcaccatgttggcc

SEQ ID NO: 364079 - DNA, 20 bp, Artificial Sequence
  chemically synthesized
gagactagccttggccaaca

SEQ ID NO: 364080 - DNA, 20 bp, Artificial Sequence
  chemically synthesized
gagacagggtttcaccatgt

SEQ ID NO: 364081 - DNA, 20 bp, Artificial Sequence
  chemically synthesized
ttgtatttttagtagagaca

SEQ ID NO: 364082 - DNA, 20 bp, Artificial Sequence
  chemically synthesized
tttgtatttttagtagagac

SEQ ID NO: 364083 - DNA, 20 bp, Artificial Sequence
  chemically synthesized
ttttgtatttttagtagaga

SEQ ID NO: 364084 - DNA, 20 bp, Artificial Sequence
  chemically synthesized
taatttttgtatttttagta

SEQ ID NO: 364085 - DNA, 20 bp, Artificial Sequence
  chemically synthesized
gctaatttttgtatttttag

SEQ ID NO: 364086 - DNA, 20 bp, Artificial Sequence
  chemically synthesized
ccagctaatttttgtatttt

SEQ ID NO: 364087 - DNA, 20 bp, Artificial Sequence
  chemically synthesized
tctactaaaaatacaaaaat

SEQ ID NO: 364088 - DNA, 20 bp, Artificial Sequence
  chemically synthesized
ctaaaaatacaaaaattagc

SEQ ID NO: 364089 - DNA, 20 bp, Artificial Sequence
  chemically synthesized
atacaaaaattagctggcca

SEQ ID NO: 364090 - DNA, 20 bp, Artificial Sequence
  chemically synthesized
caaaaattagctggccatag

SEQ ID NO: 364091 - DNA, 20 bp, Artificial Sequence
  chemically synthesized
caggcacatgccactatggc

SEQ ID NO: 364092 - DNA, 20 bp, Artificial Sequence
  chemically synthesized
attacaggcacatgccacta

SEQ ID NO: 364093 - DNA, 20 bp, Artificial Sequence
  chemically synthesized
gtggcatgtgcctgtaatcc

SEQ ID NO: 364094 - DNA, 20 bp, Artificial Sequence
  chemically synthesized
tcccgagtagctgggattac

SEQ ID NO: 364095 - DNA, 20 bp, Artificial Sequence
  chemically synthesized
ctcccgagtagctgggatta

SEQ ID NO: 364096 - DNA, 20 bp, Artificial Sequence
  chemically synthesized
tgcctgtaatcccagctact

SEQ ID NO: 364097 - DNA, 20 bp, Artificial Sequence
  chemically synthesized
tctcagcctcccgagtagct

SEQ ID NO: 364098 - DNA, 20 bp, Artificial Sequence
  chemically synthesized
gcctgtaatcccagctactc

SEQ ID NO: 364099 - DNA, 20 bp, Artificial Sequence
  chemically synthesized
gtctcagcctcccgagtagc

SEQ ID NO: 364100 - DNA, 20 bp, Artificial Sequence
  chemically synthesized
ctgtaatcccagctactcgg

SEQ ID NO: 364101 - DNA, 20 bp, Artificial Sequence
  chemically synthesized
tgtaatcccagctactcggg

SEQ ID NO: 364102 - DNA, 20 bp, Artificial Sequence
  chemically synthesized
tcctgtctcagcctcccgag

SEQ ID NO: 364103 - DNA, 20 bp, Artificial Sequence
  chemically synthesized
ttctcctgtctcagcctccc

SEQ ID NO: 364104 - DNA, 20 bp, Artificial Sequence
  chemically synthesized
tcccagctactcgggaggct

SEQ ID NO: 364105 - DNA, 20 bp, Artificial Sequence
  chemically synthesized
agctactcgggaggctgaga

SEQ ID NO: 364106 - DNA, 20 bp, Artificial Sequence
  chemically synthesized
gctactcgggaggctgagac

SEQ ID NO: 364107 - DNA, 20 bp, Artificial Sequence
  chemically synthesized
tactcgggaggctgagacag

SEQ ID NO: 364108 - DNA, 20 bp, Artificial Sequence
  chemically synthesized
tttaagctattctcctgtct

SEQ ID NO: 364109 - DNA, 20 bp, Artificial Sequence
  chemically synthesized
gggaggctgagacaggagaa

SEQ ID NO: 364110 - DNA, 20 bp, Artificial Sequence
  chemically synthesized
acaggagaatagcttaaacc

SEQ ID NO: 364111 - DNA, 20 bp, Artificial Sequence
  chemically synthesized
aaactctgccttccaggttt

SEQ ID NO: 364112 - DNA, 20 bp, Artificial Sequence
  chemically synthesized
ggagaatagcttaaacctgg

SEQ ID NO: 364113 - DNA, 20 bp, Artificial Sequence
  chemically synthesized
gagaatagcttaaacctgga

SEQ ID NO: 364114 - DNA, 20 bp, Artificial Sequence
  chemically synthesized
aatagcttaaacctggaagg

SEQ ID NO: 364115 - DNA, 20 bp, Artificial Sequence
  chemically synthesized
cactgcaaactctgccttcc

SEQ ID NO: 364116 - DNA, 20 bp, Artificial Sequence
  chemically synthesized
tagcttaaacctggaaggca

SEQ ID NO: 364117 - DNA, 20 bp, Artificial Sequence
  chemically synthesized
tcactgcaaactctgccttc

SEQ ID NO: 364118 - DNA, 20 bp, Artificial Sequence
  chemically synthesized
aacctggaaggcagagtttg

SEQ ID NO: 364119 - DNA, 20 bp, Artificial Sequence
  chemically synthesized
tggaaggcagagtttgcagt

SEQ ID NO: 364120 - DNA, 20 bp, Artificial Sequence
  chemically synthesized
ggcagagtttgcagtgagcc

SEQ ID NO: 364121 - DNA, 20 bp, Artificial Sequence
  chemically synthesized
ggagtgcagtggcgtgatct

SEQ ID NO: 364122 - DNA, 20 bp, Artificial Sequence
  chemically synthesized
tgtcccaggctggagtgcag

SEQ ID NO: 364123 - DNA, 20 bp, Artificial Sequence
  chemically synthesized
gagatcacgccactgcactc

SEQ ID NO: 364124 - DNA, 20 bp, Artificial Sequence
  chemically synthesized
ttctgtcccaggctggagtg

SEQ ID NO: 364125 - DNA, 20 bp, Artificial Sequence
  chemically synthesized
cacgccactgcactccagcc

SEQ ID NO: 364126 - DNA, 20 bp, Artificial Sequence
  chemically synthesized
acgccactgcactccagcct

SEQ ID NO: 364127 - DNA, 20 bp, Artificial Sequence
  chemically synthesized
cgctcttctgtcccaggctg

SEQ ID NO: 364128 - DNA, 20 bp, Artificial Sequence
  chemically synthesized
ctcgctcttctgtcccaggc

SEQ ID NO: 364129 - DNA, 20 bp, Artificial Sequence
  chemically synthesized
cactgcactccagcctggga

SEQ ID NO: 364130 - DNA, 20 bp, Artificial Sequence
  chemically synthesized
tgcactccagcctgggacag

SEQ ID NO: 364131 - DNA, 20 bp, Artificial Sequence
  chemically synthesized
gagtctcgctcttctgtccc

SEQ ID NO: 364132 - DNA, 20 bp, Artificial Sequence
  chemically synthesized
ggagtctcgctcttctgtcc

SEQ ID NO: 364133 - DNA, 20 bp, Artificial Sequence
  chemically synthesized
cactccagcctgggacagaa

SEQ ID NO: 364134 - DNA, 20 bp, Artificial Sequence
  chemically synthesized
ccagcctgggacagaagagc

SEQ ID NO: 364135 - DNA, 20 bp, Artificial Sequence
  chemically synthesized
ttttttttttttttgagatg

SEQ ID NO: 364136 - DNA, 20 bp, Artificial Sequence
  chemically synthesized
ctttttttttttttttgaga

SEQ ID NO: 364137 - DNA, 20 bp, Artificial Sequence
  chemically synthesized
ttttcttttttttttttttt

SEQ ID NO: 364138 - DNA, 20 bp, Artificial Sequence
  chemically synthesized
ccatctcaaaaaaaaaaaaa

SEQ ID NO: 364139 - DNA, 20 bp, Artificial Sequence
  chemically synthesized
tcaaaaaaaaaaaaaaagaa

SEQ ID NO: 364140 - DNA, 20 bp, Artificial Sequence
  chemically synthesized
aaaaaaaaaaaagaaaagaa

SEQ ID NO: 364141 - DNA, 20 bp, Artificial Sequence
  chemically synthesized
aaaaaaagaaaagaaaagaa

SEQ ID NO: 364142 - DNA, 20 bp, Artificial Sequence
  chemically synthesized
aagaaaagaaaagaaaagaa

SEQ ID NO: 364143 - DNA, 20 bp, Artificial Sequence
  chemically synthesized
gaaaagaaaagaaaagaaaa

SEQ ID NO: 364144 - DNA, 20 bp, Artificial Sequence
  chemically synthesized
aaaagaaaagaaaaaagaaa

SEQ ID NO: 364145 - DNA, 20 bp, Artificial Sequence
  chemically synthesized
aaaagaaaaaagaaaaagaa

SEQ ID NO: 364146 - DNA, 20 bp, Artificial Sequence
  chemically synthesized
aaaaaagaaaaagaaaagca

SEQ ID NO: 364147 - DNA, 20 bp, Artificial Sequence
  chemically synthesized
aagaaaaagaaaagcaaagt

SEQ ID NO: 364148 - DNA, 20 bp, Artificial Sequence
  chemically synthesized
aaagaaaagcaaagtaagaa

SEQ ID NO: 364149 - DNA, 20 bp, Artificial Sequence
  chemically synthesized
gcaaagtaagaaaagaaacc

SEQ ID NO: 364150 - DNA, 20 bp, Artificial Sequence
  chemically synthesized
acaaagtcctgcagtcaact

SEQ ID NO: 364151 - DNA, 20 bp, Artificial Sequence
  chemically synthesized
aaaagaaaccgagttgactg

SEQ ID NO: 364152 - DNA, 20 bp, Artificial Sequence
  chemically synthesized
aaagaaaccgagttgactgc

SEQ ID NO: 364153 - DNA, 20 bp, Artificial Sequence
  chemically synthesized
gtttggtggacaaagtcctg

SEQ ID NO: 364154 - DNA, 20 bp, Artificial Sequence
  chemically synthesized
gaagctgtgtttggtggaca

SEQ ID NO: 364155 - DNA, 20 bp, Artificial Sequence
  chemically synthesized
aggactttgtccaccaaaca

SEQ ID NO: 364156 - DNA, 20 bp, Artificial Sequence
  chemically synthesized
cttcatgaagctgtgtttgg

SEQ ID NO: 364157 - DNA, 20 bp, Artificial Sequence
  chemically synthesized
ttacttcatgaagctgtgtt

SEQ ID NO: 364158 - DNA, 20 bp, Artificial Sequence
  chemically synthesized
ccaccaaacacagcttcatg

SEQ ID NO: 364159 - DNA, 20 bp, Artificial Sequence
  chemically synthesized
ttttcagattttacttcatg

SEQ ID NO: 364160 - DNA, 20 bp, Artificial Sequence
  chemically synthesized
catgaagtaaaatctgaaaa

SEQ ID NO: 364161 - DNA, 20 bp, Artificial Sequence
  chemically synthesized
atgaagtaaaatctgaaaac

SEQ ID NO: 364162 - DNA, 20 bp, Artificial Sequence
  chemically synthesized
tgaagtaaaatctgaaaaca

SEQ ID NO: 364163 - DNA, 20 bp, Artificial Sequence
  chemically synthesized
gataggctgctccctgtttt

SEQ ID NO: 364164 - DNA, 20 bp, Artificial Sequence
  chemically synthesized
aagtaaaatctgaaaacagg

SEQ ID NO: 364165 - DNA, 20 bp, Artificial Sequence
  chemically synthesized
taaaatctgaaaacagggag

SEQ ID NO: 364166 - DNA, 20 bp, Artificial Sequence
  chemically synthesized
gaaaacagggagcagcctat

SEQ ID NO: 364167 - DNA, 20 bp, Artificial Sequence
  chemically synthesized
aaaacagggagcagcctatc

SEQ ID NO: 364168 - DNA, 20 bp, Artificial Sequence
  chemically synthesized
cagggagcagcctatcaggt

SEQ ID NO: 364169 - DNA, 20 bp, Artificial Sequence
  chemically synthesized
agacatagacctgacctgat

SEQ ID NO: 364170 - DNA, 20 bp, Artificial Sequence
  chemically synthesized
agggagcagcctatcaggtc

SEQ ID NO: 364171 - DNA, 20 bp, Artificial Sequence
  chemically synthesized
aagacatagacctgacctga

SEQ ID NO: 364172 - DNA, 20 bp, Artificial Sequence
  chemically synthesized
cagagggaagggaaaagaca

SEQ ID NO: 364173 - DNA, 20 bp, Artificial Sequence
  chemically synthesized
ctgccacagagggaagggaa

SEQ ID NO: 364174 - DNA, 20 bp, Artificial Sequence
  chemically synthesized
gcatgctgccacagagggaa

SEQ ID NO: 364175 - DNA, 20 bp, Artificial Sequence
  chemically synthesized
tgcatgctgccacagaggga

SEQ ID NO: 364176 - DNA, 20 bp, Artificial Sequence
  chemically synthesized
tgtcttttcccttccctctg

SEQ ID NO: 364177 - DNA, 20 bp, Artificial Sequence
  chemically synthesized
atgcatgctgccacagaggg

SEQ ID NO: 364178 - DNA, 20 bp, Artificial Sequence
  chemically synthesized
cttttcccttccctctgtgg

SEQ ID NO: 364179 - DNA, 20 bp, Artificial Sequence
  chemically synthesized
caaatgcatgctgccacaga

SEQ ID NO: 364180 - DNA, 20 bp, Artificial Sequence
  chemically synthesized
gcaaatgcatgctgccacag

SEQ ID NO: 364181 - DNA, 20 bp, Artificial Sequence
  chemically synthesized
agcaaatgcatgctgccaca

SEQ ID NO: 364182 - DNA, 20 bp, Artificial Sequence
  chemically synthesized
gaagcaaatgcatgctgcca

SEQ ID NO: 364183 - DNA, 20 bp, Artificial Sequence
  chemically synthesized
tgtggctaatataattcagg

SEQ ID NO: 364184 - DNA, 20 bp, Artificial Sequence
  chemically synthesized
gattgtggctaatataattc

SEQ ID NO: 364185 - DNA, 20 bp, Artificial Sequence
  chemically synthesized
tgattgtggctaatataatt

SEQ ID NO: 364186 - DNA, 20 bp, Artificial Sequence
  chemically synthesized
atttgcttcctgaattatat

SEQ ID NO: 364187 - DNA, 20 bp, Artificial Sequence
  chemically synthesized
tgaattatattagccacaat

SEQ ID NO: 364188 - DNA, 20 bp, Artificial Sequence
  chemically synthesized
gaattatattagccacaatc

SEQ ID NO: 364189 - DNA, 20 bp, Artificial Sequence
  chemically synthesized
aattcgtgtatgcctgattg

SEQ ID NO: 364190 - DNA, 20 bp, Artificial Sequence
  chemically synthesized
cgaattacaacatgtgctct

SEQ ID NO: 364191 - DNA, 20 bp, Artificial Sequence
  chemically synthesized
ttacaacatgtgctctcagt

SEQ ID NO: 364192 - DNA, 20 bp, Artificial Sequence
  chemically synthesized
atcagaccagttcttactga

SEQ ID NO: 364193 - DNA, 20 bp, Artificial Sequence
  chemically synthesized
aaatcagaccagttcttact

SEQ ID NO: 364194 - DNA, 20 bp, Artificial Sequence
  chemically synthesized
catgtgctctcagtaagaac

SEQ ID NO: 364195 - DNA, 20 bp, Artificial Sequence
  chemically synthesized
aattctcttgtaaatcagac

SEQ ID NO: 364196 - DNA, 20 bp, Artificial Sequence
  chemically synthesized
taagaactggtctgatttac

SEQ ID NO: 364197 - DNA, 20 bp, Artificial Sequence
  chemically synthesized
tttcaaattctcttgtaaat

SEQ ID NO: 364198 - DNA, 20 bp, Artificial Sequence
  chemically synthesized
agaactggtctgatttacaa

SEQ ID NO: 364199 - DNA, 20 bp, Artificial Sequence
  chemically synthesized
tttggccccaaatgcagaga

SEQ ID NO: 364200 - DNA, 20 bp, Artificial Sequence
  chemically synthesized
tgaaatactttctctgcatt

SEQ ID NO: 364201 - DNA, 20 bp, Artificial Sequence
  chemically synthesized
gaaatactttctctgcattt

SEQ ID NO: 364202 - DNA, 20 bp, Artificial Sequence
  chemically synthesized
gggctttggccccaaatgca

SEQ ID NO: 364203 - DNA, 20 bp, Artificial Sequence
  chemically synthesized
aaatactttctctgcatttg

SEQ ID NO: 364204 - DNA, 20 bp, Artificial Sequence
  chemically synthesized
gagggctttggccccaaatg

SEQ ID NO: 364205 - DNA, 20 bp, Artificial Sequence
  chemically synthesized
tttctctgcatttggggcca

SEQ ID NO: 364206 - DNA, 20 bp, Artificial Sequence
  chemically synthesized
tcatgtttgagtgagggctt

SEQ ID NO: 364207 - DNA, 20 bp, Artificial Sequence
  chemically synthesized
catgcttcatgtttgagtga

SEQ ID NO: 364208 - DNA, 20 bp, Artificial Sequence
  chemically synthesized
gcatgcttcatgtttgagtg

SEQ ID NO: 364209 - DNA, 20 bp, Artificial Sequence
  chemically synthesized
agcatgcttcatgtttgagt

SEQ ID NO: 364210 - DNA, 20 bp, Artificial Sequence
  chemically synthesized
aaagccctcactcaaacatg

SEQ ID NO: 364211 - DNA, 20 bp, Artificial Sequence
  chemically synthesized
acacagcatgcttcatgttt

SEQ ID NO: 364212 - DNA, 20 bp, Artificial Sequence
  chemically synthesized
acatgaagcatgctgtgtca

SEQ ID NO: 364213 - DNA, 20 bp, Artificial Sequence
  chemically synthesized
aaggtctggatgctgtgaca

SEQ ID NO: 364214 - DNA, 20 bp, Artificial Sequence
  chemically synthesized
gcatgctgtgtcacagcatc

SEQ ID NO: 364215 - DNA, 20 bp, Artificial Sequence
  chemically synthesized
gtagtaccctggacaaggtc

SEQ ID NO: 364216 - DNA, 20 bp, Artificial Sequence
  chemically synthesized
cacagcatccagaccttgtc

SEQ ID NO: 364217 - DNA, 20 bp, Artificial Sequence
  chemically synthesized
acagcatccagaccttgtcc

SEQ ID NO: 364218 - DNA, 20 bp, Artificial Sequence
  chemically synthesized
cagcatccagaccttgtcca

SEQ ID NO: 364219 - DNA, 20 bp, Artificial Sequence
  chemically synthesized
tgtaagtagtaccctggaca

SEQ ID NO: 364220 - DNA, 20 bp, Artificial Sequence
  chemically synthesized
atgtaagtagtaccctggac

SEQ ID NO: 364221 - DNA, 20 bp, Artificial Sequence
  chemically synthesized
caataatgtaagtagtaccc

SEQ ID NO: 364222 - DNA, 20 bp, Artificial Sequence
  chemically synthesized
ttgcagaacaataatgtaag

SEQ ID NO: 364223 - DNA, 20 bp, Artificial Sequence
  chemically synthesized
gttttgcagaacaataatgt

SEQ ID NO: 364224 - DNA, 20 bp, Artificial Sequence
  chemically synthesized
acaaggcactgcgggttttg

SEQ ID NO: 364225 - DNA, 20 bp, Artificial Sequence
  chemically synthesized
ttattgttctgcaaaacccg

SEQ ID NO: 364226 - DNA, 20 bp, Artificial Sequence
  chemically synthesized
caatgtcaacaaggcactgc

SEQ ID NO: 364227 - DNA, 20 bp, Artificial Sequence
  chemically synthesized
acaatgtcaacaaggcactg

SEQ ID NO: 364228 - DNA, 20 bp, Artificial Sequence
  chemically synthesized
tgccctgaacaatgtcaaca

SEQ ID NO: 364229 - DNA, 20 bp, Artificial Sequence
  chemically synthesized
atgccctgaacaatgtcaac

SEQ ID NO: 364230 - DNA, 20 bp, Artificial Sequence
  chemically synthesized
agtgccttgttgacattgtt

SEQ ID NO: 364231 - DNA, 20 bp, Artificial Sequence
  chemically synthesized
gtgccttgttgacattgttc

SEQ ID NO: 364232 - DNA, 20 bp, Artificial Sequence
  chemically synthesized
tgccttgttgacattgttca

SEQ ID NO: 364233 - DNA, 20 bp, Artificial Sequence
  chemically synthesized
gttcagggcatgaactcttg

SEQ ID NO: 364234 - DNA, 20 bp, Artificial Sequence
  chemically synthesized
aaaagaaaaaggatccacaa

SEQ ID NO: 364235 - DNA, 20 bp, Artificial Sequence
  chemically synthesized
ccaaaagaaaaaggatccac

SEQ ID NO: 364236 - DNA, 20 bp, Artificial Sequence
  chemically synthesized
tgttctcagccaaaagaaaa

SEQ ID NO: 364237 - DNA, 20 bp, Artificial Sequence
  chemically synthesized
cttgtggatcctttttcttt

SEQ ID NO: 364238 - DNA, 20 bp, Artificial Sequence
  chemically synthesized
ttgttctcagccaaaagaaa

SEQ ID NO: 364239 - DNA, 20 bp, Artificial Sequence
  chemically synthesized
ggatcctttttcttttggct

SEQ ID NO: 364240 - DNA, 20 bp, Artificial Sequence
  chemically synthesized
tttgttttgttctcagccaa

SEQ ID NO: 364241 - DNA, 20 bp, Artificial Sequence
  chemically synthesized
acactcttttgttttgttct

SEQ ID NO: 364242 - DNA, 20 bp, Artificial Sequence
  chemically synthesized
tttggctgagaacaaaacaa

SEQ ID NO: 364243 - DNA, 20 bp, Artificial Sequence
  chemically synthesized
tggctgagaacaaaacaaaa

SEQ ID NO: 364244 - DNA, 20 bp, Artificial Sequence
  chemically synthesized
acaaaagagtgttcactgac

SEQ ID NO: 364245 - DNA, 20 bp, Artificial Sequence
  chemically synthesized
aaagagtgttcactgaccag

SEQ ID NO: 364246 - DNA, 20 bp, Artificial Sequence
  chemically synthesized
agagtgttcactgaccagca

SEQ ID NO: 364247 - DNA, 20 bp, Artificial Sequence
  chemically synthesized
ttgtcggtctctctgctggt

SEQ ID NO: 364248 - DNA, 20 bp, Artificial Sequence
  chemically synthesized
agtgttcactgaccagcaga

SEQ ID NO: 364249 - DNA, 20 bp, Artificial Sequence
  chemically synthesized
tagattgtcggtctctctgc

SEQ ID NO: 364250 - DNA, 20 bp, Artificial Sequence
  chemically synthesized
tttcatttctagtagattgt

SEQ ID NO: 364251 - DNA, 20 bp, Artificial Sequence
  chemically synthesized
cagagagaccgacaatctac

SEQ ID NO: 364252 - DNA, 20 bp, Artificial Sequence
  chemically synthesized
ataaatggtttcatttctag

SEQ ID NO: 364253 - DNA, 20 bp, Artificial Sequence
  chemically synthesized
attataaatggtttcatttc

SEQ ID NO: 364254 - DNA, 20 bp, Artificial Sequence
  chemically synthesized
cttaatagtgaaattataaa

SEQ ID NO: 364255 - DNA, 20 bp, Artificial Sequence
  chemically synthesized
ccatttataatttcactatt

SEQ ID NO: 364256 - DNA, 20 bp, Artificial Sequence
  chemically synthesized
tttacaatattcaagcttaa

SEQ ID NO: 364257 - DNA, 20 bp, Artificial Sequence
  chemically synthesized
tctgttcgtttacaatattc

SEQ ID NO: 364258 - DNA, 20 bp, Artificial Sequence
  chemically synthesized
gcttgaatattgtaaacgaa

SEQ ID NO: 364259 - DNA, 20 bp, Artificial Sequence
  chemically synthesized
ttgaatattgtaaacgaaca

SEQ ID NO: 364260 - DNA, 20 bp, Artificial Sequence
  chemically synthesized
tgtaaacgaacagagcctgt

SEQ ID NO: 364261 - DNA, 20 bp, Artificial Sequence
  chemically synthesized
gtaaacgaacagagcctgtg

SEQ ID NO: 364262 - DNA, 20 bp, Artificial Sequence
  chemically synthesized
tcattatattaatgcctcac

SEQ ID NO: 364263 - DNA, 20 bp, Artificial Sequence
  chemically synthesized
ttcattatattaatgcctca

SEQ ID NO: 364264 - DNA, 20 bp, Artificial Sequence
  chemically synthesized
gacaattagcgcaaagtatt

SEQ ID NO: 364265 - DNA, 20 bp, Artificial Sequence
  chemically synthesized
ggccaaggacaattagcgca

SEQ ID NO: 364266 - DNA, 20 bp, Artificial Sequence
  chemically synthesized
cgtaccaggccaaggacaat

SEQ ID NO: 364267 - DNA, 20 bp, Artificial Sequence
  chemically synthesized
tactttgcgctaattgtcct

SEQ ID NO: 364268 - DNA, 20 bp, Artificial Sequence
  chemically synthesized
tgcgctaattgtccttggcc

SEQ ID NO: 364269 - DNA, 20 bp, Artificial Sequence
  chemically synthesized
gctaaaaacgtaccaggcca

SEQ ID NO: 364270 - DNA, 20 bp, Artificial Sequence
  chemically synthesized
tgctaaaaacgtaccaggcc

SEQ ID NO: 364271 - DNA, 20 bp, Artificial Sequence
  chemically synthesized
gtttatgctaaaaacgtacc

SEQ ID NO: 364272 - DNA, 20 bp, Artificial Sequence
  chemically synthesized
ggtttatgctaaaaacgtac

SEQ ID NO: 364273 - DNA, 20 bp, Artificial Sequence
  chemically synthesized
tccttggcctggtacgtttt

SEQ ID NO: 364274 - DNA, 20 bp, Artificial Sequence
  chemically synthesized
gttgccattcttagagtggt

SEQ ID NO: 364275 - DNA, 20 bp, Artificial Sequence
  chemically synthesized
tagcataaaccaaccactct

SEQ ID NO: 364276 - DNA, 20 bp, Artificial Sequence
  chemically synthesized
aagtgttgccattcttagag

SEQ ID NO: 364277 - DNA, 20 bp, Artificial Sequence
  chemically synthesized
taaaccaaccactctaagaa

SEQ ID NO: 364278 - DNA, 20 bp, Artificial Sequence
  chemically synthesized
aaaaagtgttgccattctta

SEQ ID NO: 364279 - DNA, 20 bp, Artificial Sequence
  chemically synthesized
agaaaaagtgttgccattct

SEQ ID NO: 364280 - DNA, 20 bp, Artificial Sequence
  chemically synthesized
aaataggctttgtaaagaaa

SEQ ID NO: 364281 - DNA, 20 bp, Artificial Sequence
  chemically synthesized
ggcaacactttttctttaca

SEQ ID NO: 364282 - DNA, 20 bp, Artificial Sequence
  chemically synthesized
ataccaaaataggctttgta

SEQ ID NO: 364283 - DNA, 20 bp, Artificial Sequence
  chemically synthesized
tttctttacaaagcctattt

SEQ ID NO: 364284 - DNA, 20 bp, Artificial Sequence
  chemically synthesized
agaaacaatcataccaaaat

SEQ ID NO: 364285 - DNA, 20 bp, Artificial Sequence
  chemically synthesized
aagaaacaatcataccaaaa

SEQ ID NO: 364286 - DNA, 20 bp, Artificial Sequence
  chemically synthesized
atgattgtttcttcattcta

SEQ ID NO: 364287 - DNA, 20 bp, Artificial Sequence
  chemically synthesized
cccaactgggctatagaatg

SEQ ID NO: 364288 - DNA, 20 bp, Artificial Sequence
  chemically synthesized
tgtttcttcattctatagcc

SEQ ID NO: 364289 - DNA, 20 bp, Artificial Sequence
  chemically synthesized
agtaatccccaactgggcta

SEQ ID NO: 364290 - DNA, 20 bp, Artificial Sequence
  chemically synthesized
tcttcattctatagcccagt

SEQ ID NO: 364291 - DNA, 20 bp, Artificial Sequence
  chemically synthesized
cttcattctatagcccagtt

SEQ ID NO: 364292 - DNA, 20 bp, Artificial Sequence
  chemically synthesized
ttcattctatagcccagttg

SEQ ID NO: 364293 - DNA, 20 bp, Artificial Sequence
  chemically synthesized
tcatgcagtaatccccaact

SEQ ID NO: 364294 - DNA, 20 bp, Artificial Sequence
  chemically synthesized
gtcatgcagtaatccccaac

SEQ ID NO: 364295 - DNA, 20 bp, Artificial Sequence
  chemically synthesized
ttctgtcattggtggtcatg

SEQ ID NO: 364296 - DNA, 20 bp, Artificial Sequence
  chemically synthesized
tactgcatgaccaccaatga

SEQ ID NO: 364297 - DNA, 20 bp, Artificial Sequence
  chemically synthesized
gctgatgtttctgtcattgg

SEQ ID NO: 364298 - DNA, 20 bp, Artificial Sequence
  chemically synthesized
catgctgatgtttctgtcat

SEQ ID NO: 364299 - DNA, 20 bp, Artificial Sequence
  chemically synthesized
accaccaatgacagaaacat

SEQ ID NO: 364300 - DNA, 20 bp, Artificial Sequence
  chemically synthesized
gcatgcataaaaacattttc

SEQ ID NO: 364301 - DNA, 20 bp, Artificial Sequence
  chemically synthesized
gcataaaaacattttctagt

SEQ ID NO: 364302 - DNA, 20 bp, Artificial Sequence
  chemically synthesized
aaaaacattttctagtaaga

SEQ ID NO: 364303 - DNA, 20 bp, Artificial Sequence
  chemically synthesized
gaattgtttttctatcttac

SEQ ID NO: 364304 - DNA, 20 bp, Artificial Sequence
  chemically synthesized
tagatttttctaaaaagttt

SEQ ID NO: 364305 - DNA, 20 bp, Artificial Sequence
  chemically synthesized
aaaacaattcccaaactttt

SEQ ID NO: 364306 - DNA, 20 bp, Artificial Sequence
  chemically synthesized
ttagatttttctaaaaagtt

SEQ ID NO: 364307 - DNA, 20 bp, Artificial Sequence
  chemically synthesized
ctcctttagatttttctaaa

SEQ ID NO: 364308 - DNA, 20 bp, Artificial Sequence
  chemically synthesized
aaactttttagaaaaatcta

SEQ ID NO: 364309 - DNA, 20 bp, Artificial Sequence
  chemically synthesized
aactttttagaaaaatctaa

SEQ ID NO: 364310 - DNA, 20 bp, Artificial Sequence
  chemically synthesized
ctttttagaaaaatctaaag

SEQ ID NO: 364311 - DNA, 20 bp, Artificial Sequence
  chemically synthesized
tgctagagtcaaatctcctt

SEQ ID NO: 364312 - DNA, 20 bp, Artificial Sequence
  chemically synthesized
atctaaaggagatttgactc

SEQ ID NO: 364313 - DNA, 20 bp, Artificial Sequence
  chemically synthesized
ggcattatataattttgcta

SEQ ID NO: 364314 - DNA, 20 bp, Artificial Sequence
  chemically synthesized
ttggcattatataattttgc

SEQ ID NO: 364315 - DNA, 20 bp, Artificial Sequence
  chemically synthesized
caaaattatataatgccaaa

SEQ ID NO: 364316 - DNA, 20 bp, Artificial Sequence
  chemically synthesized
aaaattatataatgccaaat

SEQ ID NO: 364317 - DNA, 20 bp, Artificial Sequence
  chemically synthesized
aaattatataatgccaaata

SEQ ID NO: 364318 - DNA, 20 bp, Artificial Sequence
  chemically synthesized
aggtttcctttaaccctatt

SEQ ID NO: 364319 - DNA, 20 bp, Artificial Sequence
  chemically synthesized
tataatgccaaatagggtta

SEQ ID NO: 364320 - DNA, 20 bp, Artificial Sequence
  chemically synthesized
ataatgccaaatagggttaa

SEQ ID NO: 364321 - DNA, 20 bp, Artificial Sequence
  chemically synthesized
taaggtaatcttcacagaaa

SEQ ID NO: 364322 - DNA, 20 bp, Artificial Sequence
  chemically synthesized
taaaggaaaccttttctgtg

SEQ ID NO: 364323 - DNA, 20 bp, Artificial Sequence
  chemically synthesized
ttaaggtaatcttcacagaa

SEQ ID NO: 364324 - DNA, 20 bp, Artificial Sequence
  chemically synthesized
gacaattaaggtaatcttca

SEQ ID NO: 364325 - DNA, 20 bp, Artificial Sequence
  chemically synthesized
ttcagtgacaaggacaatta

SEQ ID NO: 364326 - DNA, 20 bp, Artificial Sequence
  chemically synthesized
cttcagtgacaaggacaatt

SEQ ID NO: 364327 - DNA, 20 bp, Artificial Sequence
  chemically synthesized
ggtttagagcttcagtgaca

SEQ ID NO: 364328 - DNA, 20 bp, Artificial Sequence
  chemically synthesized
cttaattgtccttgtcactg

SEQ ID NO: 364329 - DNA, 20 bp, Artificial Sequence
  chemically synthesized
aggtttagagcttcagtgac

SEQ ID NO: 364330 - DNA, 20 bp, Artificial Sequence
  chemically synthesized
gtgattgaggtttagagctt

SEQ ID NO: 364331 - DNA, 20 bp, Artificial Sequence
  chemically synthesized
accaaagtgattgaggttta

SEQ ID NO: 364332 - DNA, 20 bp, Artificial Sequence
  chemically synthesized
gaaccaaagtgattgaggtt

SEQ ID NO: 364333 - DNA, 20 bp, Artificial Sequence
  chemically synthesized
ttagggaaccaaagtgattg

SEQ ID NO: 364334 - DNA, 20 bp, Artificial Sequence
  chemically synthesized
attagggaaccaaagtgatt

SEQ ID NO: 364335 - DNA, 20 bp, Artificial Sequence
  chemically synthesized
gctctaaacctcaatcactt

SEQ ID NO: 364336 - DNA, 20 bp, Artificial Sequence
  chemically synthesized
agaataaaattagggaacca

SEQ ID NO: 364337 - DNA, 20 bp, Artificial Sequence
  chemically synthesized
tgggattgagaataaaatta

SEQ ID NO: 364338 - DNA, 20 bp, Artificial Sequence
  chemically synthesized
ttgggattgagaataaaatt

SEQ ID NO: 364339 - DNA, 20 bp, Artificial Sequence
  chemically synthesized
tttgggattgagaataaaat

SEQ ID NO: 364340 - DNA, 20 bp, Artificial Sequence
  chemically synthesized
aagatacaacttttgggatt

SEQ ID NO: 364341 - DNA, 20 bp, Artificial Sequence
  chemically synthesized
aattttattctcaatcccaa

SEQ ID NO: 364342 - DNA, 20 bp, Artificial Sequence
  chemically synthesized
caggataagatacaactttt

SEQ ID NO: 364343 - DNA, 20 bp, Artificial Sequence
  chemically synthesized
acaggataagatacaacttt

SEQ ID NO: 364344 - DNA, 20 bp, Artificial Sequence
  chemically synthesized
tggtttaaaaattacaggat

SEQ ID NO: 364345 - DNA, 20 bp, Artificial Sequence
  chemically synthesized
gatgttggtttaaaaattac

SEQ ID NO: 364346 - DNA, 20 bp, Artificial Sequence
  chemically synthesized
agatgttggtttaaaaatta

SEQ ID NO: 364347 - DNA, 20 bp, Artificial Sequence
  chemically synthesized
acaatgaactatgcagatgt

SEQ ID NO: 364348 - DNA, 20 bp, Artificial Sequence
  chemically synthesized
tttttaaaccaacatctgca

SEQ ID NO: 364349 - DNA, 20 bp, Artificial Sequence
  chemically synthesized
gtatattacaatgaactatg

SEQ ID NO: 364350 - DNA, 20 bp, Artificial Sequence
  chemically synthesized
tacaaattaactcatttatt

SEQ ID NO: 364351 - DNA, 20 bp, Artificial Sequence
  chemically synthesized
aactctacaacttaataaat

SEQ ID NO: 364352 - DNA, 20 bp, Artificial Sequence
  chemically synthesized
ttaactcatttattaagttg

SEQ ID NO: 364353 - DNA, 20 bp, Artificial Sequence
  chemically synthesized
aactcatttattaagttgta

SEQ ID NO: 364354 - DNA, 20 bp, Artificial Sequence
  chemically synthesized
tttattaagttgtagagttt

SEQ ID NO: 364355 - DNA, 20 bp, Artificial Sequence
  chemically synthesized
aaaacaggttatcataatgg

SEQ ID NO: 364356 - DNA, 20 bp, Artificial Sequence
  chemically synthesized
aataaaacaggttatcataa

SEQ ID NO: 364357 - DNA, 20 bp, Artificial Sequence
  chemically synthesized
aaaatgagagtaaataaaac

SEQ ID NO: 364358 - DNA, 20 bp, Artificial Sequence
  chemically synthesized
gaaaatgagagtaaataaaa

SEQ ID NO: 364359 - DNA, 20 bp, Artificial Sequence
  chemically synthesized
ggtaaaagaaatgaaaatga

SEQ ID NO: 364360 - DNA, 20 bp, Artificial Sequence
  chemically synthesized
aaggtaaaagaaatgaaaat

SEQ ID NO: 364361 - DNA, 20 bp, Artificial Sequence
  chemically synthesized
aagggcttgtagtaaggtaa

SEQ ID NO: 364362 - DNA, 20 bp, Artificial Sequence
  chemically synthesized
catttcttttaccttactac

SEQ ID NO: 364363 - DNA, 20 bp, Artificial Sequence
  chemically synthesized
gctaataagggcttgtagta

SEQ ID NO: 364364 - DNA, 20 bp, Artificial Sequence
  chemically synthesized
agctaataagggcttgtagt

SEQ ID NO: 364365 - DNA, 20 bp, Artificial Sequence
  chemically synthesized
caatagctaataagggcttg

SEQ ID NO: 364366 - DNA, 20 bp, Artificial Sequence
  chemically synthesized
accttactacaagcccttat

SEQ ID NO: 364367 - DNA, 20 bp, Artificial Sequence
  chemically synthesized
ctctgggcaatagctaataa

SEQ ID NO: 364368 - DNA, 20 bp, Artificial Sequence
  chemically synthesized
tctctgggcaatagctaata

SEQ ID NO: 364369 - DNA, 20 bp, Artificial Sequence
  chemically synthesized
ttctctgggcaatagctaat

SEQ ID NO: 364370 - DNA, 20 bp, Artificial Sequence
  chemically synthesized
agcccttattagctattgcc

SEQ ID NO: 364371 - DNA, 20 bp, Artificial Sequence
  chemically synthesized
cccttattagctattgccca

SEQ ID NO: 364372 - DNA, 20 bp, Artificial Sequence
  chemically synthesized
ggttagatttctctgggcaa

SEQ ID NO: 364373 - DNA, 20 bp, Artificial Sequence
  chemically synthesized
gaaagaggttagatttctct

SEQ ID NO: 364374 - DNA, 20 bp, Artificial Sequence
  chemically synthesized
ggaaagaggttagatttctc

SEQ ID NO: 364375 - DNA, 20 bp, Artificial Sequence
  chemically synthesized
agtggagaagggaaagaggt

SEQ ID NO: 364376 - DNA, 20 bp, Artificial Sequence
  chemically synthesized
agtgagtggagaagggaaag

SEQ ID NO: 364377 - DNA, 20 bp, Artificial Sequence
  chemically synthesized
gagtgagtggagaagggaaa

SEQ ID NO: 364378 - DNA, 20 bp, Artificial Sequence
  chemically synthesized
gtgagtgagtggagaaggga

SEQ ID NO: 364379 - DNA, 20 bp, Artificial Sequence
  chemically synthesized
aatggtgagtgagtggagaa

SEQ ID NO: 364380 - DNA, 20 bp, Artificial Sequence
  chemically synthesized
aaatggtgagtgagtggaga

SEQ ID NO: 364381 - DNA, 20 bp, Artificial Sequence
  chemically synthesized
aaaatggtgagtgagtggag

SEQ ID NO: 364382 - DNA, 20 bp, Artificial Sequence
  chemically synthesized
aaaaaaatggtgagtgagtg

SEQ ID NO: 364383 - DNA, 20 bp, Artificial Sequence
  chemically synthesized
tgaaaaaaatggtgagtgag

SEQ ID NO: 364384 - DNA, 20 bp, Artificial Sequence
  chemically synthesized
ggatgaaaaaaatggtgagt

SEQ ID NO: 364385 - DNA, 20 bp, Artificial Sequence
  chemically synthesized
ggaaggatgaaaaaaatggt

SEQ ID NO: 364386 - DNA, 20 bp, Artificial Sequence
  chemically synthesized
tgaaggaaggatgaaaaaaa

SEQ ID NO: 364387 - DNA, 20 bp, Artificial Sequence
  chemically synthesized
attgttgatggtatgaagga

SEQ ID NO: 364388 - DNA, 20 bp, Artificial Sequence
  chemically synthesized
cattgttgatggtatgaagg

SEQ ID NO: 364389 - DNA, 20 bp, Artificial Sequence
  chemically synthesized
cgtcattgttgatggtatga

SEQ ID NO: 364390 - DNA, 20 bp, Artificial Sequence
  chemically synthesized
acgtcattgttgatggtatg

SEQ ID NO: 364391 - DNA, 20 bp, Artificial Sequence
  chemically synthesized
ttcaggaacgtcattgttga

SEQ ID NO: 364392 - DNA, 20 bp, Artificial Sequence
  chemically synthesized
catcaacaatgacgttcctg

SEQ ID NO: 364393 - DNA, 20 bp, Artificial Sequence
  chemically synthesized
aacaatgacgttcctgaagt

SEQ ID NO: 364394 - DNA, 20 bp, Artificial Sequence
  chemically synthesized
attggcagtgggcttacttc

SEQ ID NO: 364395 - DNA, 20 bp, Artificial Sequence
  chemically synthesized
cattggcagtgggcttactt

SEQ ID NO: 364396 - DNA, 20 bp, Artificial Sequence
  chemically synthesized
aagtggtttgcattggcagt

SEQ ID NO: 364397 - DNA, 20 bp, Artificial Sequence
  chemically synthesized
caagtggtttgcattggcag

SEQ ID NO: 364398 - DNA, 20 bp, Artificial Sequence
  chemically synthesized
ttgcaagtggtttgcattgg

SEQ ID NO: 364399 - DNA, 20 bp, Artificial Sequence
  chemically synthesized
actttgcaagtggtttgcat

SEQ ID NO: 364400 - DNA, 20 bp, Artificial Sequence
  chemically synthesized
gccaatgcaaaccacttgca

SEQ ID NO: 364401 - DNA, 20 bp, Artificial Sequence
  chemically synthesized
ttaggtgagaactttgcaag

SEQ ID NO: 364402 - DNA, 20 bp, Artificial Sequence
  chemically synthesized
tgtttaggtgagaactttgc

SEQ ID NO: 364403 - DNA, 20 bp, Artificial Sequence
  chemically synthesized
aatcacccaaatgtttaggt

SEQ ID NO: 364404 - DNA, 20 bp, Artificial Sequence
  chemically synthesized
aaagttctcacctaaacatt

SEQ ID NO: 364405 - DNA, 20 bp, Artificial Sequence
  chemically synthesized
ctataatcacccaaatgttt

SEQ ID NO: 364406 - DNA, 20 bp, Artificial Sequence
  chemically synthesized
aagttctcacctaaacattt

SEQ ID NO: 364407 - DNA, 20 bp, Artificial Sequence
  chemically synthesized
cctataatcacccaaatgtt

SEQ ID NO: 364408 - DNA, 20 bp, Artificial Sequence
  chemically synthesized
cctaaacatttgggtgatta

SEQ ID NO: 364409 - DNA, 20 bp, Artificial Sequence
  chemically synthesized
ctaaacatttgggtgattat

SEQ ID NO: 364410 - DNA, 20 bp, Artificial Sequence
  chemically synthesized
atttgggtgattataggtaa

SEQ ID NO: 364411 - DNA, 20 bp, Artificial Sequence
  chemically synthesized
ggtgattataggtaacagtt

SEQ ID NO: 364412 - DNA, 20 bp, Artificial Sequence
  chemically synthesized
gtgattataggtaacagtta

SEQ ID NO: 364413 - DNA, 20 bp, Artificial Sequence
  chemically synthesized
tgattataggtaacagttaa

SEQ ID NO: 364414 - DNA, 20 bp, Artificial Sequence
  chemically synthesized
tataggtaacagttaagggc

SEQ ID NO: 364415 - DNA, 20 bp, Artificial Sequence
  chemically synthesized
taggtaacagttaagggcaa

SEQ ID NO: 364416 - DNA, 20 bp, Artificial Sequence
  chemically synthesized
agttaagggcaagagctaca

SEQ ID NO: 364417 - DNA, 20 bp, Artificial Sequence
  chemically synthesized
aacccaggcagtcagctttg

SEQ ID NO: 364418 - DNA, 20 bp, Artificial Sequence
  chemically synthesized
gagctacaaagctgactgcc

SEQ ID NO: 364419 - DNA, 20 bp, Artificial Sequence
  chemically synthesized
agctacaaagctgactgcct

SEQ ID NO: 364420 - DNA, 20 bp, Artificial Sequence
  chemically synthesized
gacaattgaacccaggcagt

SEQ ID NO: 364421 - DNA, 20 bp, Artificial Sequence
  chemically synthesized
agctgacaattgaacccagg

SEQ ID NO: 364422 - DNA, 20 bp, Artificial Sequence
  chemically synthesized
cagagctgacaattgaaccc

SEQ ID NO: 364423 - DNA, 20 bp, Artificial Sequence
  chemically synthesized
gcagagctgacaattgaacc

SEQ ID NO: 364424 - DNA, 20 bp, Artificial Sequence
  chemically synthesized
gactgcctgggttcaattgt

SEQ ID NO: 364425 - DNA, 20 bp, Artificial Sequence
  chemically synthesized
cagacagcacaaaaacagca

SEQ ID NO: 364426 - DNA, 20 bp, Artificial Sequence
  chemically synthesized
gccagacagcacaaaaacag

SEQ ID NO: 364427 - DNA, 20 bp, Artificial Sequence
  chemically synthesized
taggccagacagcacaaaaa

SEQ ID NO: 364428 - DNA, 20 bp, Artificial Sequence
  chemically synthesized
tctgctgtttttgtgctgtc

SEQ ID NO: 364429 - DNA, 20 bp, Artificial Sequence
  chemically synthesized
aattttttatgtaggccaga

SEQ ID NO: 364430 - DNA, 20 bp, Artificial Sequence
  chemically synthesized
attaaattttttatgtaggc

SEQ ID NO: 364431 - DNA, 20 bp, Artificial Sequence
  chemically synthesized
ggagattaaattttttatgt

SEQ ID NO: 364432 - DNA, 20 bp, Artificial Sequence
  chemically synthesized
gggagattaaattttttatg

SEQ ID NO: 364433 - DNA, 20 bp, Artificial Sequence
  chemically synthesized
tgagaaaactggtatacagg

SEQ ID NO: 364434 - DNA, 20 bp, Artificial Sequence
  chemically synthesized
aatttaatctccctgtatac

SEQ ID NO: 364435 - DNA, 20 bp, Artificial Sequence
  chemically synthesized
gatgagaaaactggtataca

SEQ ID NO: 364436 - DNA, 20 bp, Artificial Sequence
  chemically synthesized
agatgagaaaactggtatac

SEQ ID NO: 364437 - DNA, 20 bp, Artificial Sequence
  chemically synthesized
cagatgagaaaactggtata

SEQ ID NO: 364438 - DNA, 20 bp, Artificial Sequence
  chemically synthesized
tttttaacagatgagaaaac

SEQ ID NO: 364439 - DNA, 20 bp, Artificial Sequence
  chemically synthesized
taagtccatttttaacagat

SEQ ID NO: 364440 - DNA, 20 bp, Artificial Sequence
  chemically synthesized
gttttctcatctgttaaaaa

SEQ ID NO: 364441 - DNA, 20 bp, Artificial Sequence
  chemically synthesized
ttcattaagtccatttttaa

SEQ ID NO: 364442 - DNA, 20 bp, Artificial Sequence
  chemically synthesized
ctcttgctaatattttcatt

SEQ ID NO: 364443 - DNA, 20 bp, Artificial Sequence
  chemically synthesized
aatggacttaatgaaaatat

SEQ ID NO: 364444 - DNA, 20 bp, Artificial Sequence
  chemically synthesized
gacttaatgaaaatattagc

SEQ ID NO: 364445 - DNA, 20 bp, Artificial Sequence
  chemically synthesized
cttaatgaaaatattagcaa

SEQ ID NO: 364446 - DNA, 20 bp, Artificial Sequence
  chemically synthesized
ttaatgaaaatattagcaag

SEQ ID NO: 364447 - DNA, 20 bp, Artificial Sequence
  chemically synthesized
tattagcaagaggcatacac

SEQ ID NO: 364448 - DNA, 20 bp, Artificial Sequence
  chemically synthesized
atcagagcagttgttattga

SEQ ID NO: 364449 - DNA, 20 bp, Artificial Sequence
  chemically synthesized
aaatcagagcagttgttatt

SEQ ID NO: 364450 - DNA, 20 bp, Artificial Sequence
  chemically synthesized
aattctcttgtaaatcagag

SEQ ID NO: 364451 - DNA, 20 bp, Artificial Sequence
  chemically synthesized
tcgaattctcttgtaaatca

SEQ ID NO: 364452 - DNA, 20 bp, Artificial Sequence
  chemically synthesized
taacaactgctctgatttac

SEQ ID NO: 364453 - DNA, 20 bp, Artificial Sequence
  chemically synthesized
tgtcgaattctcttgtaaat

SEQ ID NO: 364454 - DNA, 20 bp, Artificial Sequence
  chemically synthesized
acaactgctctgatttacaa

SEQ ID NO: 364455 - DNA, 20 bp, Artificial Sequence
  chemically synthesized
gacctcaaatgcagagaaga

SEQ ID NO: 364456 - DNA, 20 bp, Artificial Sequence
  chemically synthesized
ctttgacctcaaatgcagag

SEQ ID NO: 364457 - DNA, 20 bp, Artificial Sequence
  chemically synthesized
atactttcttctctgcattt

SEQ ID NO: 364458 - DNA, 20 bp, Artificial Sequence
  chemically synthesized
gggctttgacctcaaatgca

SEQ ID NO: 364459 - DNA, 20 bp, Artificial Sequence
  chemically synthesized
tactttcttctctgcatttg

SEQ ID NO: 364460 - DNA, 20 bp, Artificial Sequence
  chemically synthesized
gagggctttgacctcaaatg

SEQ ID NO: 364461 - DNA, 20 bp, Artificial Sequence
  chemically synthesized
cttctctgcatttgaggtca

SEQ ID NO: 364462 - DNA, 20 bp, Artificial Sequence
  chemically synthesized
catgcttcatgtttgagtga

SEQ ID NO: 364463 - DNA, 20 bp, Artificial Sequence
  chemically synthesized
gcatgcttcatgtttgagtg

SEQ ID NO: 364464 - DNA, 20 bp, Artificial Sequence
  chemically synthesized
agcatgcttcatgtttgagt

SEQ ID NO: 364465 - DNA, 20 bp, Artificial Sequence
  chemically synthesized
aaagccctcactcaaacatg

SEQ ID NO: 364466 - DNA, 20 bp, Artificial Sequence
  chemically synthesized
agacagcatgcttcatgttt

SEQ ID NO: 364467 - DNA, 20 bp, Artificial Sequence
  chemically synthesized
acatgaagcatgctgtctca

SEQ ID NO: 364468 - DNA, 20 bp, Artificial Sequence
  chemically synthesized
catgaagcatgctgtctcac

SEQ ID NO: 364469 - DNA, 20 bp, Artificial Sequence
  chemically synthesized
aaggtctggatcctgtgaga

SEQ ID NO: 364470 - DNA, 20 bp, Artificial Sequence
  chemically synthesized
ggacaaggtctggatcctgt

SEQ ID NO: 364471 - DNA, 20 bp, Artificial Sequence
  chemically synthesized
gcatgctgtctcacaggatc

SEQ ID NO: 364472 - DNA, 20 bp, Artificial Sequence
  chemically synthesized
gtagtgccctggacaaggtc

SEQ ID NO: 364473 - DNA, 20 bp, Artificial Sequence
  chemically synthesized
cacaggatccagaccttgtc

SEQ ID NO: 364474 - DNA, 20 bp, Artificial Sequence
  chemically synthesized
acaggatccagaccttgtcc

SEQ ID NO: 364475 - DNA, 20 bp, Artificial Sequence
  chemically synthesized
caggatccagaccttgtcca

SEQ ID NO: 364476 - DNA, 20 bp, Artificial Sequence
  chemically synthesized
aataagtagtgccctggaca

SEQ ID NO: 364477 - DNA, 20 bp, Artificial Sequence
  chemically synthesized
caataagtagtgccctggac

SEQ ID NO: 364478 - DNA, 20 bp, Artificial Sequence
  chemically synthesized
atgaacaataagtagtgccc

SEQ ID NO: 364479 - DNA, 20 bp, Artificial Sequence
  chemically synthesized
tgagcaatatgaacaataag

SEQ ID NO: 364480 - DNA, 20 bp, Artificial Sequence
  chemically synthesized
gtttgagcaatatgaacaat

SEQ ID NO: 364481 - DNA, 20 bp, Artificial Sequence
  chemically synthesized
aaccatatgtacaatggttt

SEQ ID NO: 364482 - DNA, 20 bp, Artificial Sequence
  chemically synthesized
gccagaaaccatatgtacaa

SEQ ID NO: 364483 - DNA, 20 bp, Artificial Sequence
  chemically synthesized
tgctcaaaccattgtacata

SEQ ID NO: 364484 - DNA, 20 bp, Artificial Sequence
  chemically synthesized
accattgtacatatggtttc

SEQ ID NO: 364485 - DNA, 20 bp, Artificial Sequence
  chemically synthesized
attgtacatatggtttctgg

SEQ ID NO: 364486 - DNA, 20 bp, Artificial Sequence
  chemically synthesized
atcgacacactgaattctgc

SEQ ID NO: 364487 - DNA, 20 bp, Artificial Sequence
  chemically synthesized
atatggtttctggcagaatt

SEQ ID NO: 364488 - DNA, 20 bp, Artificial Sequence
  chemically synthesized
tcagtgtgtcgatatgcata

SEQ ID NO: 364489 - DNA, 20 bp, Artificial Sequence
  chemically synthesized
gtcgatatgcataaagcact

SEQ ID NO: 364490 - DNA, 20 bp, Artificial Sequence
  chemically synthesized
tatgcataaagcactaagat

SEQ ID NO: 364491 - DNA, 20 bp, Artificial Sequence
  chemically synthesized
tatgtgacaagcaccaatct

SEQ ID NO: 364492 - DNA, 20 bp, Artificial Sequence
  chemically synthesized
taagattggtgcttgtcaca

SEQ ID NO: 364493 - DNA, 20 bp, Artificial Sequence
  chemically synthesized
tgttggaccaactatgtgac

SEQ ID NO: 364494 - DNA, 20 bp, Artificial Sequence
  chemically synthesized
attggtgcttgtcacatagt

SEQ ID NO: 364495 - DNA, 20 bp, Artificial Sequence
  chemically synthesized
gaagtcaataatatttatgt

SEQ ID NO: 364496 - DNA, 20 bp, Artificial Sequence
  chemically synthesized
cataaatattattgacttcg

SEQ ID NO: 364497 - DNA, 20 bp, Artificial Sequence
  chemically synthesized
agtacttggcacatactacg

SEQ ID NO: 364498 - DNA, 20 bp, Artificial Sequence
  chemically synthesized
ttgacttcgtagtatgtgcc

SEQ ID NO: 364499 - DNA, 20 bp, Artificial Sequence
  chemically synthesized
ggtagtgcattcaaagtact

SEQ ID NO: 364500 - DNA, 20 bp, Artificial Sequence
  chemically synthesized
gattaaaggtagtgcattca

SEQ ID NO: 364501 - DNA, 20 bp, Artificial Sequence
  chemically synthesized
tgcaaggcggggattaaagg

SEQ ID NO: 364502 - DNA, 20 bp, Artificial Sequence
  chemically synthesized
ccttgcaaggcggggattaa

SEQ ID NO: 364503 - DNA, 20 bp, Artificial Sequence
  chemically synthesized
gccttgcaaggcggggatta

SEQ ID NO: 364504 - DNA, 20 bp, Artificial Sequence
  chemically synthesized
actaactgccttgcaaggcg

SEQ ID NO: 364505 - DNA, 20 bp, Artificial Sequence
  chemically synthesized
acctttaatccccgccttgc

SEQ ID NO: 364506 - DNA, 20 bp, Artificial Sequence
  chemically synthesized
aactaactgccttgcaaggc

SEQ ID NO: 364507 - DNA, 20 bp, Artificial Sequence
  chemically synthesized
cctttaatccccgccttgca

SEQ ID NO: 364508 - DNA, 20 bp, Artificial Sequence
  chemically synthesized
aaactaactgccttgcaagg

SEQ ID NO: 364509 - DNA, 20 bp, Artificial Sequence
  chemically synthesized
ttaatccccgccttgcaagg

SEQ ID NO: 364510 - DNA, 20 bp, Artificial Sequence
  chemically synthesized
atgaaactaactgccttgca

SEQ ID NO: 364511 - DNA, 20 bp, Artificial Sequence
  chemically synthesized
gatgaaactaactgccttgc

SEQ ID NO: 364512 - DNA, 20 bp, Artificial Sequence
  chemically synthesized
tccccgccttgcaaggcagt

SEQ ID NO: 364513 - DNA, 20 bp, Artificial Sequence
  chemically synthesized
ttagtttcatccctattgta

SEQ ID NO: 364514 - DNA, 20 bp, Artificial Sequence
  chemically synthesized
aggttcacttctgtacaata

SEQ ID NO: 364515 - DNA, 20 bp, Artificial Sequence
  chemically synthesized
gaggttcacttctgtacaat

SEQ ID NO: 364516 - DNA, 20 bp, Artificial Sequence
  chemically synthesized
tgaggttcacttctgtacaa

SEQ ID NO: 364517 - DNA, 20 bp, Artificial Sequence
  chemically synthesized
gtttcatccctattgtacag

SEQ ID NO: 364518 - DNA, 20 bp, Artificial Sequence
  chemically synthesized
tattgtacagaagtgaacct

SEQ ID NO: 364519 - DNA, 20 bp, Artificial Sequence
  chemically synthesized
attgtacagaagtgaacctc

SEQ ID NO: 364520 - DNA, 20 bp, Artificial Sequence
  chemically synthesized
atattagatattttaacctg

SEQ ID NO: 364521 - DNA, 20 bp, Artificial Sequence
  chemically synthesized
tatattagatattttaacct

SEQ ID NO: 364522 - DNA, 20 bp, Artificial Sequence
  chemically synthesized
aggttaaaatatctaatata

SEQ ID NO: 364523 - DNA, 20 bp, Artificial Sequence
  chemically synthesized
ttatatggtaatctatatat

SEQ ID NO: 364524 - DNA, 20 bp, Artificial Sequence
  chemically synthesized
tccaccaattattagttata

SEQ ID NO: 364525 - DNA, 20 bp, Artificial Sequence
  chemically synthesized
attaccatataactaataat

SEQ ID NO: 364526 - DNA, 20 bp, Artificial Sequence
  chemically synthesized
gtcctggctccaccaattat

SEQ ID NO: 364527 - DNA, 20 bp, Artificial Sequence
  chemically synthesized
accatataactaataattgg

SEQ ID NO: 364528 - DNA, 20 bp, Artificial Sequence
  chemically synthesized
catataactaataattggtg

SEQ ID NO: 364529 - DNA, 20 bp, Artificial Sequence
  chemically synthesized
taactaataattggtggagc

SEQ ID NO: 364530 - DNA, 20 bp, Artificial Sequence
  chemically synthesized
aactaataattggtggagcc

SEQ ID NO: 364531 - DNA, 20 bp, Artificial Sequence
  chemically synthesized
acagacaaaagtttgggtcc

SEQ ID NO: 364532 - DNA, 20 bp, Artificial Sequence
  chemically synthesized
acagacacagacaaaagttt

SEQ ID NO: 364533 - DNA, 20 bp, Artificial Sequence
  chemically synthesized
tacagacacagacaaaagtt

SEQ ID NO: 364534 - DNA, 20 bp, Artificial Sequence
  chemically synthesized
ggctctacagacacagacaa

SEQ ID NO: 364535 - DNA, 20 bp, Artificial Sequence
  chemically synthesized
caaacttttgtctgtgtctg

SEQ ID NO: 364536 - DNA, 20 bp, Artificial Sequence
  chemically synthesized
agactggggctctacagaca

SEQ ID NO: 364537 - DNA, 20 bp, Artificial Sequence
  chemically synthesized
aacttttgtctgtgtctgta

SEQ ID NO: 364538 - DNA, 20 bp, Artificial Sequence
  chemically synthesized
tttgcaagactggggctcta

SEQ ID NO: 364539 - DNA, 20 bp, Artificial Sequence
  chemically synthesized
tgtctgtgtctgtagagccc

SEQ ID NO: 364540 - DNA, 20 bp, Artificial Sequence
  chemically synthesized
gaaataaatttgcaagactg

SEQ ID NO: 364541 - DNA, 20 bp, Artificial Sequence
  chemically synthesized
ggaaataaatttgcaagact

SEQ ID NO: 364542 - DNA, 20 bp, Artificial Sequence
  chemically synthesized
aggaaataaatttgcaagac

SEQ ID NO: 364543 - DNA, 20 bp, Artificial Sequence
  chemically synthesized
gaagaaggaaataaatttgc

SEQ ID NO: 364544 - DNA, 20 bp, Artificial Sequence
  chemically synthesized
cacaaggtagttagagaaga

SEQ ID NO: 364545 - DNA, 20 bp, Artificial Sequence
  chemically synthesized
gcacaaggtagttagagaag

SEQ ID NO: 364546 - DNA, 20 bp, Artificial Sequence
  chemically synthesized
catgcacaaggtagttagag

SEQ ID NO: 364547 - DNA, 20 bp, Artificial Sequence
  chemically synthesized
gtgcatgcacaaggtagtta

SEQ ID NO: 364548 - DNA, 20 bp, Artificial Sequence
  chemically synthesized
tggtgcatgcacaaggtagt

SEQ ID NO: 364549 - DNA, 20 bp, Artificial Sequence
  chemically synthesized
tgtttggtgcatgcacaagg

SEQ ID NO: 364550 - DNA, 20 bp, Artificial Sequence
  chemically synthesized
atttgtttggtgcatgcaca

SEQ ID NO: 364551 - DNA, 20 bp, Artificial Sequence
  chemically synthesized
tatttgtttggtgcatgcac

SEQ ID NO: 364552 - DNA, 20 bp, Artificial Sequence
  chemically synthesized
cagaaatatagatatttgtt

SEQ ID NO: 364553 - DNA, 20 bp, Artificial Sequence
  chemically synthesized
aaatgcaagacacagaaata

SEQ ID NO: 364554 - DNA, 20 bp, Artificial Sequence
  chemically synthesized
taggagttaaatgcaagaca

SEQ ID NO: 364555 - DNA, 20 bp, Artificial Sequence
  chemically synthesized
aaagtataggagttaaatgc

SEQ ID NO: 364556 - DNA, 20 bp, Artificial Sequence
  chemically synthesized
agctttgctggaaagtatag

SEQ ID NO: 364557 - DNA, 20 bp, Artificial Sequence
  chemically synthesized
ggagctttgctggaaagtat

SEQ ID NO: 364558 - DNA, 20 bp, Artificial Sequence
  chemically synthesized
catttaactcctatactttc

SEQ ID NO: 364559 - DNA, 20 bp, Artificial Sequence
  chemically synthesized
aggagctttgctggaaagta

SEQ ID NO: 364560 - DNA, 20 bp, Artificial Sequence
  chemically synthesized
aactcctatactttccagca

SEQ ID NO: 364561 - DNA, 20 bp, Artificial Sequence
  chemically synthesized
agaccaggagctttgctgga

SEQ ID NO: 364562 - DNA, 20 bp, Artificial Sequence
  chemically synthesized
agaaagaccaggagctttgc

SEQ ID NO: 364563 - DNA, 20 bp, Artificial Sequence
  chemically synthesized
atactttccagcaaagctcc

SEQ ID NO: 364564 - DNA, 20 bp, Artificial Sequence
  chemically synthesized
aactacttgagaaagaccag

SEQ ID NO: 364565 - DNA, 20 bp, Artificial Sequence
  chemically synthesized
ggaactacttgagaaagacc

SEQ ID NO: 364566 - DNA, 20 bp, Artificial Sequence
  chemically synthesized
aggaactacttgagaaagac

SEQ ID NO: 364567 - DNA, 20 bp, Artificial Sequence
  chemically synthesized
caaagctcctggtctttctc

SEQ ID NO: 364568 - DNA, 20 bp, Artificial Sequence
  chemically synthesized
agctcctggtctttctcaag

SEQ ID NO: 364569 - DNA, 20 bp, Artificial Sequence
  chemically synthesized
gggtgaggaactacttgaga

SEQ ID NO: 364570 - DNA, 20 bp, Artificial Sequence
  chemically synthesized
tctagggtgaggaactactt

SEQ ID NO: 364571 - DNA, 20 bp, Artificial Sequence
  chemically synthesized
tctcaagtagttcctcaccc

SEQ ID NO: 364572 - DNA, 20 bp, Artificial Sequence
  chemically synthesized
tgataaggagttctagggtg

SEQ ID NO: 364573 - DNA, 20 bp, Artificial Sequence
  chemically synthesized
atgataaggagttctagggt

SEQ ID NO: 364574 - DNA, 20 bp, Artificial Sequence
  chemically synthesized
gcaaatgataaggagttcta

SEQ ID NO: 364575 - DNA, 20 bp, Artificial Sequence
  chemically synthesized
tgcaaatgataaggagttct

SEQ ID NO: 364576 - DNA, 20 bp, Artificial Sequence
  chemically synthesized
gtgcaaatgataaggagttc

SEQ ID NO: 364577 - DNA, 20 bp, Artificial Sequence
  chemically synthesized
caggcagtgcaaatgataag

SEQ ID NO: 364578 - DNA, 20 bp, Artificial Sequence
  chemically synthesized
agcaggcagtgcaaatgata

SEQ ID NO: 364579 - DNA, 20 bp, Artificial Sequence
  chemically synthesized
cagcaggcagtgcaaatgat

SEQ ID NO: 364580 - DNA, 20 bp, Artificial Sequence
  chemically synthesized
aatttgggttgttcagcagg

SEQ ID NO: 364581 - DNA, 20 bp, Artificial Sequence
  chemically synthesized
cttaatttgggttgttcagc

SEQ ID NO: 364582 - DNA, 20 bp, Artificial Sequence
  chemically synthesized
gcttaatttgggttgttcag

SEQ ID NO: 364583 - DNA, 20 bp, Artificial Sequence
  chemically synthesized
ttagcttaatttgggttgtt

SEQ ID NO: 364584 - DNA, 20 bp, Artificial Sequence
  chemically synthesized
cctgctgaacaacccaaatt

SEQ ID NO: 364585 - DNA, 20 bp, Artificial Sequence
  chemically synthesized
agatggctttagcttaattt

SEQ ID NO: 364586 - DNA, 20 bp, Artificial Sequence
  chemically synthesized
aagatggctttagcttaatt

SEQ ID NO: 364587 - DNA, 20 bp, Artificial Sequence
  chemically synthesized
gaacaacccaaattaagcta

SEQ ID NO: 364588 - DNA, 20 bp, Artificial Sequence
  chemically synthesized
cttggagagtaagatggctt

SEQ ID NO: 364589 - DNA, 20 bp, Artificial Sequence
  chemically synthesized
agttaccttggagagtaaga

SEQ ID NO: 364590 - DNA, 20 bp, Artificial Sequence
  chemically synthesized
ctaaagccatcttactctcc

SEQ ID NO: 364591 - DNA, 20 bp, Artificial Sequence
  chemically synthesized
ggcaagttaccttggagagt

SEQ ID NO: 364592 - DNA, 20 bp, Artificial Sequence
  chemically synthesized
taaagccatcttactctcca

SEQ ID NO: 364593 - DNA, 20 bp, Artificial Sequence
  chemically synthesized
atcaggcaagttaccttgga

SEQ ID NO: 364594 - DNA, 20 bp, Artificial Sequence
  chemically synthesized
atatcaggcaagttaccttg

SEQ ID NO: 364595 - DNA, 20 bp, Artificial Sequence
  chemically synthesized
ggatatcaggcaagttacct

SEQ ID NO: 364596 - DNA, 20 bp, Artificial Sequence
  chemically synthesized
tgttataaaggatatcaggc

SEQ ID NO: 364597 - DNA, 20 bp, Artificial Sequence
  chemically synthesized
actgtgttataaaggatatc

SEQ ID NO: 364598 - DNA, 20 bp, Artificial Sequence
  chemically synthesized
tactgtgttataaaggatat

SEQ ID NO: 364599 - DNA, 20 bp, Artificial Sequence
  chemically synthesized
atgtcaatactgtgttataa

SEQ ID NO: 364600 - DNA, 20 bp, Artificial Sequence
  chemically synthesized
gcctgatatcctttataaca

SEQ ID NO: 364601 - DNA, 20 bp, Artificial Sequence
  chemically synthesized
gatgtcaatactgtgttata

SEQ ID NO: 364602 - DNA, 20 bp, Artificial Sequence
  chemically synthesized
ttttgtgaaatcaaaggaac

SEQ ID NO: 364603 - DNA, 20 bp, Artificial Sequence
  chemically synthesized
ttaatgttttgtgaaatcaa

SEQ ID NO: 364604 - DNA, 20 bp, Artificial Sequence
  chemically synthesized
cttaatgttttgtgaaatca

SEQ ID NO: 364605 - DNA, 20 bp, Artificial Sequence
  chemically synthesized
ctttgatttcacaaaacatt

SEQ ID NO: 364606 - DNA, 20 bp, Artificial Sequence
  chemically synthesized
tttgatttcacaaaacatta

SEQ ID NO: 364607 - DNA, 20 bp, Artificial Sequence
  chemically synthesized
gagattctggttcataaggt

SEQ ID NO: 364608 - DNA, 20 bp, Artificial Sequence
  chemically synthesized
ttaaggctaaccttatgaac

SEQ ID NO: 364609 - DNA, 20 bp, Artificial Sequence
  chemically synthesized
aatggagattctggttcata

SEQ ID NO: 364610 - DNA, 20 bp, Artificial Sequence
  chemically synthesized
aaatggagattctggttcat

SEQ ID NO: 364611 - DNA, 20 bp, Artificial Sequence
  chemically synthesized
agaggtaaaaatggagattc

SEQ ID NO: 364612 - DNA, 20 bp, Artificial Sequence
  chemically synthesized
aaatctaagaggtaaaaatg

SEQ ID NO: 364613 - DNA, 20 bp, Artificial Sequence
  chemically synthesized
gaaaatctaagaggtaaaaa

SEQ ID NO: 364614 - DNA, 20 bp, Artificial Sequence
  chemically synthesized
gaatctccatttttacctct

SEQ ID NO: 364615 - DNA, 20 bp, Artificial Sequence
  chemically synthesized
ttcttggaggaaaatctaag

SEQ ID NO: 364616 - DNA, 20 bp, Artificial Sequence
  chemically synthesized
attcttggaggaaaatctaa

SEQ ID NO: 364617 - DNA, 20 bp, Artificial Sequence
  chemically synthesized
acattcttggaggaaaatct

SEQ ID NO: 364618 - DNA, 20 bp, Artificial Sequence
  chemically synthesized
tacctcttagattttcctcc

SEQ ID NO: 364619 - DNA, 20 bp, Artificial Sequence
  chemically synthesized
catcattctgacattcttgg

SEQ ID NO: 364620 - DNA, 20 bp, Artificial Sequence
  chemically synthesized
acatcattctgacattcttg

SEQ ID NO: 364621 - DNA, 20 bp, Artificial Sequence
  chemically synthesized
agattttcctccaagaatgt

SEQ ID NO: 364622 - DNA, 20 bp, Artificial Sequence
  chemically synthesized
caacatcattctgacattct

SEQ ID NO: 364623 - DNA, 20 bp, Artificial Sequence
  chemically synthesized
caagaatgtcagaatgatgt

SEQ ID NO: 364624 - DNA, 20 bp, Artificial Sequence
  chemically synthesized
gtggaaagtgggagaaatat

SEQ ID NO: 364625 - DNA, 20 bp, Artificial Sequence
  chemically synthesized
ctctttttggtggaaagtgg

SEQ ID NO: 364626 - DNA, 20 bp, Artificial Sequence
  chemically synthesized
tcctctttttggtggaaagt

SEQ ID NO: 364627 - DNA, 20 bp, Artificial Sequence
  chemically synthesized
ttcctctttttggtggaaag

SEQ ID NO: 364628 - DNA, 20 bp, Artificial Sequence
  chemically synthesized
tttttcctctttttggtgga

SEQ ID NO: 364629 - DNA, 20 bp, Artificial Sequence
  chemically synthesized
ttctcccactttccaccaaa

SEQ ID NO: 364630 - DNA, 20 bp, Artificial Sequence
  chemically synthesized
ctcccactttccaccaaaaa

SEQ ID NO: 364631 - DNA, 20 bp, Artificial Sequence
  chemically synthesized
tatttttttcctctttttgg

SEQ ID NO: 364632 - DNA, 20 bp, Artificial Sequence
  chemically synthesized
tcccactttccaccaaaaag

SEQ ID NO: 364633 - DNA, 20 bp, Artificial Sequence
  chemically synthesized
tcttatttttttcctctttt

SEQ ID NO: 364634 - DNA, 20 bp, Artificial Sequence
  chemically synthesized
accaaaaagaggaaaaaaat

SEQ ID NO: 364635 - DNA, 20 bp, Artificial Sequence
  chemically synthesized
agaggaaaaaaataagactt

SEQ ID NO: 364636 - DNA, 20 bp, Artificial Sequence
  chemically synthesized
tttttttttttttaaatcta

SEQ ID NO: 364637 - DNA, 20 bp, Artificial Sequence
  chemically synthesized
aaaaaaaaaaaaaaaaaaaa

SEQ ID NO: 364638 - DNA, 20 bp, Artificial Sequence
  chemically synthesized
aaaaaaaaaaaaaaaagcaa

SEQ ID NO: 364639 - DNA, 20 bp, Artificial Sequence
  chemically synthesized
aaaaaaaaaaaagcaacagc

SEQ ID NO: 364640 - DNA, 20 bp, Artificial Sequence
  chemically synthesized
aaaagcaacagccagacatt

SEQ ID NO: 364641 - DNA, 20 bp, Artificial Sequence
  chemically synthesized
aaagcaacagccagacattt

SEQ ID NO: 364642 - DNA, 20 bp, Artificial Sequence
  chemically synthesized
cctcagcctccccaaatgtc

SEQ ID NO: 364643 - DNA, 20 bp, Artificial Sequence
  chemically synthesized
aagcaacagccagacatttg

SEQ ID NO: 364644 - DNA, 20 bp, Artificial Sequence
  chemically synthesized
gcaacagccagacatttggg

SEQ ID NO: 364645 - DNA, 20 bp, Artificial Sequence
  chemically synthesized
caacagccagacatttgggg

SEQ ID NO: 364646 - DNA, 20 bp, Artificial Sequence
  chemically synthesized
gccagacatttggggaggct

SEQ ID NO: 364647 - DNA, 20 bp, Artificial Sequence
  chemically synthesized
ccagacatttggggaggctg

SEQ ID NO: 364648 - DNA, 20 bp, Artificial Sequence
  chemically synthesized
gacatttggggaggctgagg

SEQ ID NO: 364649 - DNA, 20 bp, Artificial Sequence
  chemically synthesized
acatttggggaggctgaggc

SEQ ID NO: 364650 - DNA, 20 bp, Artificial Sequence
  chemically synthesized
tttggggaggctgaggcagg

SEQ ID NO: 364651 - DNA, 20 bp, Artificial Sequence
  chemically synthesized
tctcaatgagccacctgcct

SEQ ID NO: 364652 - DNA, 20 bp, Artificial Sequence
  chemically synthesized
gctgaggcaggtggctcatt

SEQ ID NO: 364653 - DNA, 20 bp, Artificial Sequence
  chemically synthesized
cttgagctcctgatctcaat

SEQ ID NO: 364654 - DNA, 20 bp, Artificial Sequence
  chemically synthesized
ggcaggtggctcattgagat

SEQ ID NO: 364655 - DNA, 20 bp, Artificial Sequence
  chemically synthesized
gcaggtggctcattgagatc

SEQ ID NO: 364656 - DNA, 20 bp, Artificial Sequence
  chemically synthesized
aggtggctcattgagatcag

SEQ ID NO: 364657 - DNA, 20 bp, Artificial Sequence
  chemically synthesized
ctcattgagatcaggagctc

SEQ ID NO: 364658 - DNA, 20 bp, Artificial Sequence
  chemically synthesized
tgagatcaggagctcaagac

SEQ ID NO: 364659 - DNA, 20 bp, Artificial Sequence
  chemically synthesized
atgttggccaggctggtctt

SEQ ID NO: 364660 - DNA, 20 bp, Artificial Sequence
  chemically synthesized
tcaggagctcaagaccagcc

SEQ ID NO: 364661 - DNA, 20 bp, Artificial Sequence
  chemically synthesized
tttcaccatgttggccaggc

SEQ ID NO: 364662 - DNA, 20 bp, Artificial Sequence
  chemically synthesized
ggggtttcaccatgttggcc

SEQ ID NO: 364663 - DNA, 20 bp, Artificial Sequence
  chemically synthesized
caagaccagcctggccaaca

SEQ ID NO: 364664 - DNA, 20 bp, Artificial Sequence
  chemically synthesized
tggggtttcaccatgttggc

SEQ ID NO: 364665 - DNA, 20 bp, Artificial Sequence
  chemically synthesized
gacatggggtttcaccatgt

SEQ ID NO: 364666 - DNA, 20 bp, Artificial Sequence
  chemically synthesized
ttgtatttttagtagacatg

SEQ ID NO: 364667 - DNA, 20 bp, Artificial Sequence
  chemically synthesized
tttgtatttttagtagacat

SEQ ID NO: 364668 - DNA, 20 bp, Artificial Sequence
  chemically synthesized
ttttgtatttttagtagaca

SEQ ID NO: 364669 - DNA, 20 bp, Artificial Sequence
  chemically synthesized
gctaagttttgtatttttag

SEQ ID NO: 364670 - DNA, 20 bp, Artificial Sequence
  chemically synthesized
ctggctaagttttgtatttt

SEQ ID NO: 364671 - DNA, 20 bp, Artificial Sequence
  chemically synthesized
tctactaaaaatacaaaact

SEQ ID NO: 364672 - DNA, 20 bp, Artificial Sequence
  chemically synthesized
ctaaaaatacaaaacttagc

SEQ ID NO: 364673 - DNA, 20 bp, Artificial Sequence
  chemically synthesized
taaaaatacaaaacttagcc

SEQ ID NO: 364674 - DNA, 20 bp, Artificial Sequence
  chemically synthesized
atgttccatcatgcctggct

SEQ ID NO: 364675 - DNA, 20 bp, Artificial Sequence
  chemically synthesized
caaaacttagccaggcatga

SEQ ID NO: 364676 - DNA, 20 bp, Artificial Sequence
  chemically synthesized
caggcatgttccatcatgcc

SEQ ID NO: 364677 - DNA, 20 bp, Artificial Sequence
  chemically synthesized
ggcatgatggaacatgcctg

SEQ ID NO: 364678 - DNA, 20 bp, Artificial Sequence
  chemically synthesized
atggaacatgcctgtagtct

SEQ ID NO: 364679 - DNA, 20 bp, Artificial Sequence
  chemically synthesized
tcccaagtagctgagactac

SEQ ID NO: 364680 - DNA, 20 bp, Artificial Sequence
  chemically synthesized
ctcccaagtagctgagacta

SEQ ID NO: 364681 - DNA, 20 bp, Artificial Sequence
  chemically synthesized
tgcctgtagtctcagctact

SEQ ID NO: 364682 - DNA, 20 bp, Artificial Sequence
  chemically synthesized
cctcggcctcccaagtagct

SEQ ID NO: 364683 - DNA, 20 bp, Artificial Sequence
  chemically synthesized
gcctgtagtctcagctactt

SEQ ID NO: 364684 - DNA, 20 bp, Artificial Sequence
  chemically synthesized
ctgtagtctcagctacttgg

SEQ ID NO: 364685 - DNA, 20 bp, Artificial Sequence
  chemically synthesized
tgtagtctcagctacttggg

SEQ ID NO: 364686 - DNA, 20 bp, Artificial Sequence
  chemically synthesized
tcctgcctcggcctcccaag

SEQ ID NO: 364687 - DNA, 20 bp, Artificial Sequence
  chemically synthesized
ttttcctgcctcggcctccc

SEQ ID NO: 364688 - DNA, 20 bp, Artificial Sequence
  chemically synthesized
tctcagctacttgggaggcc

SEQ ID NO: 364689 - DNA, 20 bp, Artificial Sequence
  chemically synthesized
ctcagctacttgggaggccg

SEQ ID NO: 364690 - DNA, 20 bp, Artificial Sequence
  chemically synthesized
agctacttgggaggccgagg

SEQ ID NO: 364691 - DNA, 20 bp, Artificial Sequence
  chemically synthesized
gctacttgggaggccgaggc

SEQ ID NO: 364692 - DNA, 20 bp, Artificial Sequence
  chemically synthesized
ttcaagcaattttcctgcct

SEQ ID NO: 364693 - DNA, 20 bp, Artificial Sequence
  chemically synthesized
gcaggaaaattgcttgaacc

SEQ ID NO: 364694 - DNA, 20 bp, Artificial Sequence
  chemically synthesized
caggaaaattgcttgaaccc

SEQ ID NO: 364695 - DNA, 20 bp, Artificial Sequence
  chemically synthesized
aacctctgcctcctgggttc

SEQ ID NO: 364696 - DNA, 20 bp, Artificial Sequence
  chemically synthesized
ggaaaattgcttgaacccag

SEQ ID NO: 364697 - DNA, 20 bp, Artificial Sequence
  chemically synthesized
gaaaattgcttgaacccagg

SEQ ID NO: 364698 - DNA, 20 bp, Artificial Sequence
  chemically synthesized
aattgcttgaacccaggagg

SEQ ID NO: 364699 - DNA, 20 bp, Artificial Sequence
  chemically synthesized
cactgcaacctctgcctcct

SEQ ID NO: 364700 - DNA, 20 bp, Artificial Sequence
  chemically synthesized
ttgcttgaacccaggaggca

SEQ ID NO: 364701 - DNA, 20 bp, Artificial Sequence
  chemically synthesized
tcactgcaacctctgcctcc

SEQ ID NO: 364702 - DNA, 20 bp, Artificial Sequence
  chemically synthesized
tgcttgaacccaggaggcag

SEQ ID NO: 364703 - DNA, 20 bp, Artificial Sequence
  chemically synthesized
aacccaggaggcagaggttg

SEQ ID NO: 364704 - DNA, 20 bp, Artificial Sequence
  chemically synthesized
caggaggcagaggttgcagt

SEQ ID NO: 364705 - DNA, 20 bp, Artificial Sequence
  chemically synthesized
ggcagaggttgcagtgagcc

SEQ ID NO: 364706 - DNA, 20 bp, Artificial Sequence
  chemically synthesized
tggagtcagcgacatgatct

SEQ ID NO: 364707 - DNA, 20 bp, Artificial Sequence
  chemically synthesized
caagatcatgtcgctgactc

SEQ ID NO: 364708 - DNA, 20 bp, Artificial Sequence
  chemically synthesized
tctgtcgcccaggctggagt

SEQ ID NO: 364709 - DNA, 20 bp, Artificial Sequence
  chemically synthesized
tcatgtcgctgactccagcc

SEQ ID NO: 364710 - DNA, 20 bp, Artificial Sequence
  chemically synthesized
catgtcgctgactccagcct

SEQ ID NO: 364711 - DNA, 20 bp, Artificial Sequence
  chemically synthesized
ttactctgtcgcccaggctg

SEQ ID NO: 364712 - DNA, 20 bp, Artificial Sequence
  chemically synthesized
tcttactctgtcgcccaggc

SEQ ID NO: 364713 - DNA, 20 bp, Artificial Sequence
  chemically synthesized
gctgactccagcctgggcga

SEQ ID NO: 364714 - DNA, 20 bp, Artificial Sequence
  chemically synthesized
ggaatcttactctgtcgccc

SEQ ID NO: 364715 - DNA, 20 bp, Artificial Sequence
  chemically synthesized
tgactccagcctgggcgaca

SEQ ID NO: 364716 - DNA, 20 bp, Artificial Sequence
  chemically synthesized
tggaatcttactctgtcgcc

SEQ ID NO: 364717 - DNA, 20 bp, Artificial Sequence
  chemically synthesized
tccagcctgggcgacagagt

SEQ ID NO: 364718 - DNA, 20 bp, Artificial Sequence
  chemically synthesized
gtattttttttttattttga

SEQ ID NO: 364719 - DNA, 20 bp, Artificial Sequence
  chemically synthesized
aataaaaaaaaaatacatga

SEQ ID NO: 364720 - DNA, 20 bp, Artificial Sequence
  chemically synthesized
aaaaatacatgaaagaaaaa

SEQ ID NO: 364721 - DNA, 20 bp, Artificial Sequence
  chemically synthesized
ctatatatacacaagaagat

SEQ ID NO: 364722 - DNA, 20 bp, Artificial Sequence
  chemically synthesized
tcaatctatatatacacaag

SEQ ID NO: 364723 - DNA, 20 bp, Artificial Sequence
  chemically synthesized
ctgtcaatctatatatacac

SEQ ID NO: 364724 - DNA, 20 bp, Artificial Sequence
  chemically synthesized
ccaatcttcttgtgtatata

SEQ ID NO: 364725 - DNA, 20 bp, Artificial Sequence
  chemically synthesized
cttgtgtatatatagattga

SEQ ID NO: 364726 - DNA, 20 bp, Artificial Sequence
  chemically synthesized
tatatagattgacagtatac

SEQ ID NO: 364727 - DNA, 20 bp, Artificial Sequence
  chemically synthesized
ttgacagtatacaagtttaa

SEQ ID NO: 364728 - DNA, 20 bp, Artificial Sequence
  chemically synthesized
tacaagtttaatggtaatta

SEQ ID NO: 364729 - DNA, 20 bp, Artificial Sequence
  chemically synthesized
acaagtttaatggtaattat

SEQ ID NO: 364730 - DNA, 20 bp, Artificial Sequence
  chemically synthesized
atggtaattataggacttta

SEQ ID NO: 364731 - DNA, 20 bp, Artificial Sequence
  chemically synthesized
taattattttcaaaacttta

SEQ ID NO: 364732 - DNA, 20 bp, Artificial Sequence
  chemically synthesized
ttgaaaataattactcaaat

SEQ ID NO: 364733 - DNA, 20 bp, Artificial Sequence
  chemically synthesized
actaggcagagaactgattt

SEQ ID NO: 364734 - DNA, 20 bp, Artificial Sequence
  chemically synthesized
actcaaatcagttctctgcc

SEQ ID NO: 364735 - DNA, 20 bp, Artificial Sequence
  chemically synthesized
caaatcagttctctgcctag

SEQ ID NO: 364736 - DNA, 20 bp, Artificial Sequence
  chemically synthesized
tttggtctaactactaggca

SEQ ID NO: 364737 - DNA, 20 bp, Artificial Sequence
  chemically synthesized
gctttggtctaactactagg

SEQ ID NO: 364738 - DNA, 20 bp, Artificial Sequence
  chemically synthesized
tcagttctctgcctagtagt

SEQ ID NO: 364739 - DNA, 20 bp, Artificial Sequence
  chemically synthesized
gtggctttggtctaactact

SEQ ID NO: 364740 - DNA, 20 bp, Artificial Sequence
  chemically synthesized
tgtggctttggtctaactac

SEQ ID NO: 364741 - DNA, 20 bp, Artificial Sequence
  chemically synthesized
tctgcctagtagttagacca

SEQ ID NO: 364742 - DNA, 20 bp, Artificial Sequence
  chemically synthesized
tgaaaggaaatatgtggctt

SEQ ID NO: 364743 - DNA, 20 bp, Artificial Sequence
  chemically synthesized
cataattgaaaggaaatatg

SEQ ID NO: 364744 - DNA, 20 bp, Artificial Sequence
  chemically synthesized
tatataattacataattgaa

SEQ ID NO: 364745 - DNA, 20 bp, Artificial Sequence
  chemically synthesized
ctatataattacataattga

SEQ ID NO: 364746 - DNA, 20 bp, Artificial Sequence
  chemically synthesized
ctttcaattatgtaattata

SEQ ID NO: 364747 - DNA, 20 bp, Artificial Sequence
  chemically synthesized
ttatgtaattatatagtcac

SEQ ID NO: 364748 - DNA, 20 bp, Artificial Sequence
  chemically synthesized
aattatatagtcacaagatt

SEQ ID NO: 364749 - DNA, 20 bp, Artificial Sequence
  chemically synthesized
aatgtttgaatatgatacaa

SEQ ID NO: 364750 - DNA, 20 bp, Artificial Sequence
  chemically synthesized
taatgtttgaatatgataca

SEQ ID NO: 364751 - DNA, 20 bp, Artificial Sequence
  chemically synthesized
gtacacatgtgcatatgtat

SEQ ID NO: 364752 - DNA, 20 bp, Artificial Sequence
  chemically synthesized
atatgtattagaaccaaaca

SEQ ID NO: 364753 - DNA, 20 bp, Artificial Sequence
  chemically synthesized
ttaaaagagtagactatgtt

SEQ ID NO: 364754 - DNA, 20 bp, Artificial Sequence
  chemically synthesized
actgcagctttttaaaagag

SEQ ID NO: 364755 - DNA, 20 bp, Artificial Sequence
  chemically synthesized
acatagtctactcttttaaa

SEQ ID NO: 364756 - DNA, 20 bp, Artificial Sequence
  chemically synthesized
gaaactgcagctttttaaaa

SEQ ID NO: 364757 - DNA, 20 bp, Artificial Sequence
  chemically synthesized
cagaaactgcagctttttaa

SEQ ID NO: 364758 - DNA, 20 bp, Artificial Sequence
  chemically synthesized
tctactcttttaaaaagctg

SEQ ID NO: 364759 - DNA, 20 bp, Artificial Sequence
  chemically synthesized
cacttcaggatcagaaactg

SEQ ID NO: 364760 - DNA, 20 bp, Artificial Sequence
  chemically synthesized
agctgcagtttctgatcctg

SEQ ID NO: 364761 - DNA, 20 bp, Artificial Sequence
  chemically synthesized
ttaagttcccacttcaggat

SEQ ID NO: 364762 - DNA, 20 bp, Artificial Sequence
  chemically synthesized
tgcagtttctgatcctgaag

SEQ ID NO: 364763 - DNA, 20 bp, Artificial Sequence
  chemically synthesized
gcagtttctgatcctgaagt

SEQ ID NO: 364764 - DNA, 20 bp, Artificial Sequence
  chemically synthesized
agattttaagttcccacttc

SEQ ID NO: 364765 - DNA, 20 bp, Artificial Sequence
  chemically synthesized
cagattttaagttcccactt

SEQ ID NO: 364766 - DNA, 20 bp, Artificial Sequence
  chemically synthesized
ctctaataggggcagatttt

SEQ ID NO: 364767 - DNA, 20 bp, Artificial Sequence
  chemically synthesized
aacttaaaatctgcccctat

SEQ ID NO: 364768 - DNA, 20 bp, Artificial Sequence
  chemically synthesized
caaggagactctaatagggg

SEQ ID NO: 364769 - DNA, 20 bp, Artificial Sequence
  chemically synthesized
cttaaaatctgcccctatta

SEQ ID NO: 364770 - DNA, 20 bp, Artificial Sequence
  chemically synthesized
ccccaaggagactctaatag

SEQ ID NO: 364771 - DNA, 20 bp, Artificial Sequence
  chemically synthesized
tccccaaggagactctaata

SEQ ID NO: 364772 - DNA, 20 bp, Artificial Sequence
  chemically synthesized
ctccccaaggagactctaat

SEQ ID NO: 364773 - DNA, 20 bp, Artificial Sequence
  chemically synthesized
actccccaaggagactctaa

SEQ ID NO: 364774 - DNA, 20 bp, Artificial Sequence
  chemically synthesized
tgcccctattagagtctcct

SEQ ID NO: 364775 - DNA, 20 bp, Artificial Sequence
  chemically synthesized
gcccctattagagtctcctt

SEQ ID NO: 364776 - DNA, 20 bp, Artificial Sequence
  chemically synthesized
cccctattagagtctccttg

SEQ ID NO: 364777 - DNA, 20 bp, Artificial Sequence
  chemically synthesized
cctattagagtctccttggg

SEQ ID NO: 364778 - DNA, 20 bp, Artificial Sequence
  chemically synthesized
aataagaaatactccccaag

SEQ ID NO: 364779 - DNA, 20 bp, Artificial Sequence
  chemically synthesized
aaaataagaaatactcccca

SEQ ID NO: 364780 - DNA, 20 bp, Artificial Sequence
  chemically synthesized
taaaataagaaatactcccc

SEQ ID NO: 364781 - DNA, 20 bp, Artificial Sequence
  chemically synthesized
ttgccttacaatcataaaat

SEQ ID NO: 364782 - DNA, 20 bp, Artificial Sequence
  chemically synthesized
atttcttattttatgattgt

SEQ ID NO: 364783 - DNA, 20 bp, Artificial Sequence
  chemically synthesized
tttcttattttatgattgta

SEQ ID NO: 364784 - DNA, 20 bp, Artificial Sequence
  chemically synthesized
ttattttatgattgtaaggc

SEQ ID NO: 364785 - DNA, 20 bp, Artificial Sequence
  chemically synthesized
catccccagggttaaaagga

SEQ ID NO: 364786 - DNA, 20 bp, Artificial Sequence
  chemically synthesized
acatccccagggttaaaagg

SEQ ID NO: 364787 - DNA, 20 bp, Artificial Sequence
  chemically synthesized
aggacatccccagggttaaa

SEQ ID NO: 364788 - DNA, 20 bp, Artificial Sequence
  chemically synthesized
aagtaccttccttttaaccc

SEQ ID NO: 364789 - DNA, 20 bp, Artificial Sequence
  chemically synthesized
caggacatccccagggttaa

SEQ ID NO: 364790 - DNA, 20 bp, Artificial Sequence
  chemically synthesized
agtaccttccttttaaccct

SEQ ID NO: 364791 - DNA, 20 bp, Artificial Sequence
  chemically synthesized
gtaccttccttttaaccctg

SEQ ID NO: 364792 - DNA, 20 bp, Artificial Sequence
  chemically synthesized
attggctcaggacatcccca

SEQ ID NO: 364793 - DNA, 20 bp, Artificial Sequence
  chemically synthesized
tattggctcaggacatcccc

SEQ ID NO: 364794 - DNA, 20 bp, Artificial Sequence
  chemically synthesized
ttattggctcaggacatccc

SEQ ID NO: 364795 - DNA, 20 bp, Artificial Sequence
  chemically synthesized
tttaaccctggggatgtcct

SEQ ID NO: 364796 - DNA, 20 bp, Artificial Sequence
  chemically synthesized
tgcatttggattattggctc

SEQ ID NO: 364797 - DNA, 20 bp, Artificial Sequence
  chemically synthesized
ctgcatttggattattggct

SEQ ID NO: 364798 - DNA, 20 bp, Artificial Sequence
  chemically synthesized
agcatctgcatttggattat

SEQ ID NO: 364799 - DNA, 20 bp, Artificial Sequence
  chemically synthesized
ctgagccaataatccaaatg

SEQ ID NO: 364800 - DNA, 20 bp, Artificial Sequence
  chemically synthesized
tactcagaagcatctgcatt

SEQ ID NO: 364801 - DNA, 20 bp, Artificial Sequence
  chemically synthesized
atccaaatgcagatgcttct

SEQ ID NO: 364802 - DNA, 20 bp, Artificial Sequence
  chemically synthesized
caaatgcagatgcttctgag

SEQ ID NO: 364803 - DNA, 20 bp, Artificial Sequence
  chemically synthesized
aattttagtattctactcag

SEQ ID NO: 364804 - DNA, 20 bp, Artificial Sequence
  chemically synthesized
agaaattttagtattctact

SEQ ID NO: 364805 - DNA, 20 bp, Artificial Sequence
  chemically synthesized
atactatagaacagaaattt

SEQ ID NO: 364806 - DNA, 20 bp, Artificial Sequence
  chemically synthesized
atactaaaatttctgttcta

SEQ ID NO: 364807 - DNA, 20 bp, Artificial Sequence
  chemically synthesized
gaggcatgtatactatagaa

SEQ ID NO: 364808 - DNA, 20 bp, Artificial Sequence
  chemically synthesized
aatgggaggcatgtatacta

SEQ ID NO: 364809 - DNA, 20 bp, Artificial Sequence
  chemically synthesized
atagtatacatgcctcccat

SEQ ID NO: 364810 - DNA, 20 bp, Artificial Sequence
  chemically synthesized
tagtatacatgcctcccatt

SEQ ID NO: 364811 - DNA, 20 bp, Artificial Sequence
  chemically synthesized
tatcttctactcctaatggg

SEQ ID NO: 364812 - DNA, 20 bp, Artificial Sequence
  chemically synthesized
gtatacatgcctcccattag

SEQ ID NO: 364813 - DNA, 20 bp, Artificial Sequence
  chemically synthesized
atatcttctactcctaatgg

SEQ ID NO: 364814 - DNA, 20 bp, Artificial Sequence
  chemically synthesized
atatatcttctactcctaat

SEQ ID NO: 364815 - DNA, 20 bp, Artificial Sequence
  chemically synthesized
tacatgcctcccattaggag

SEQ ID NO: 364816 - DNA, 20 bp, Artificial Sequence
  chemically synthesized
gatatatcttctactcctaa

SEQ ID NO: 364817 - DNA, 20 bp, Artificial Sequence
  chemically synthesized
atgcctcccattaggagtag

SEQ ID NO: 364818 - DNA, 20 bp, Artificial Sequence
  chemically synthesized
gagtagaagatatatctcta

SEQ ID NO: 364819 - DNA, 20 bp, Artificial Sequence
  chemically synthesized
gaattctaatagtttctgta

SEQ ID NO: 364820 - DNA, 20 bp, Artificial Sequence
  chemically synthesized
ttgaattctaatagtttctg

SEQ ID NO: 364821 - DNA, 20 bp, Artificial Sequence
  chemically synthesized
tatatctctacagaaactat

SEQ ID NO: 364822 - DNA, 20 bp, Artificial Sequence
  chemically synthesized
tgccttgtcttgaattctaa

SEQ ID NO: 364823 - DNA, 20 bp, Artificial Sequence
  chemically synthesized
tacagaaactattagaattc

SEQ ID NO: 364824 - DNA, 20 bp, Artificial Sequence
  chemically synthesized
aaactattagaattcaagac

SEQ ID NO: 364825 - DNA, 20 bp, Artificial Sequence
  chemically synthesized
aactattagaattcaagaca

SEQ ID NO: 364826 - DNA, 20 bp, Artificial Sequence
  chemically synthesized
ttagaattcaagacaaggca

SEQ ID NO: 364827 - DNA, 20 bp, Artificial Sequence
  chemically synthesized
caagacaaggcatagcgaat

SEQ ID NO: 364828 - DNA, 20 bp, Artificial Sequence
  chemically synthesized
agacaaggcatagcgaattg

SEQ ID NO: 364829 - DNA, 20 bp, Artificial Sequence
  chemically synthesized
ggcatagcgaattggagttc

SEQ ID NO: 364830 - DNA, 20 bp, Artificial Sequence
  chemically synthesized
gcatagcgaattggagttct

SEQ ID NO: 364831 - DNA, 20 bp, Artificial Sequence
  chemically synthesized
gcgaattggagttctgggat

SEQ ID NO: 364832 - DNA, 20 bp, Artificial Sequence
  chemically synthesized
cgaattggagttctgggatc

SEQ ID NO: 364833 - DNA, 20 bp, Artificial Sequence
  chemically synthesized
aattggagttctgggatcgg

SEQ ID NO: 364834 - DNA, 20 bp, Artificial Sequence
  chemically synthesized
ctaacaaatgctcccgatcc

SEQ ID NO: 364835 - DNA, 20 bp, Artificial Sequence
  chemically synthesized
ctgggatcgggagcatttgt

SEQ ID NO: 364836 - DNA, 20 bp, Artificial Sequence
  chemically synthesized
gggatcgggagcatttgtta

SEQ ID NO: 364837 - DNA, 20 bp, Artificial Sequence
  chemically synthesized
ggatcgggagcatttgttag

SEQ ID NO: 364838 - DNA, 20 bp, Artificial Sequence
  chemically synthesized
tagaggtgattctgctttat

SEQ ID NO: 364839 - DNA, 20 bp, Artificial Sequence
  chemically synthesized
attttgcctttctcataaag

SEQ ID NO: 364840 - DNA, 20 bp, Artificial Sequence
  chemically synthesized
ggtgattctgctttatgaga

SEQ ID NO: 364841 - DNA, 20 bp, Artificial Sequence
  chemically synthesized
aggattttgcctttctcata

SEQ ID NO: 364842 - DNA, 20 bp, Artificial Sequence
  chemically synthesized
gtgattctgctttatgagaa

SEQ ID NO: 364843 - DNA, 20 bp, Artificial Sequence
  chemically synthesized
tatgagaaaggcaaaatcct

SEQ ID NO: 364844 - DNA, 20 bp, Artificial Sequence
  chemically synthesized
gaaaggcaaaatcctcagac

SEQ ID NO: 364845 - DNA, 20 bp, Artificial Sequence
  chemically synthesized
aaaggcaaaatcctcagacc

SEQ ID NO: 364846 - DNA, 20 bp, Artificial Sequence
  chemically synthesized
aaggcaaaatcctcagacca

SEQ ID NO: 364847 - DNA, 20 bp, Artificial Sequence
  chemically synthesized
gatctgtcagccctggtctg

SEQ ID NO: 364848 - DNA, 20 bp, Artificial Sequence
  chemically synthesized
agatctgtcagccctggtct

SEQ ID NO: 364849 - DNA, 20 bp, Artificial Sequence
  chemically synthesized
aatcctcagaccagggctga

SEQ ID NO: 364850 - DNA, 20 bp, Artificial Sequence
  chemically synthesized
aatcacagatctgtcagccc

SEQ ID NO: 364851 - DNA, 20 bp, Artificial Sequence
  chemically synthesized
tgtcctaatcacagatctgt

SEQ ID NO: 364852 - DNA, 20 bp, Artificial Sequence
  chemically synthesized
agggctgacagatctgtgat

SEQ ID NO: 364853 - DNA, 20 bp, Artificial Sequence
  chemically synthesized
gggctgacagatctgtgatt

SEQ ID NO: 364854 - DNA, 20 bp, Artificial Sequence
  chemically synthesized
accattgtttgtcctaatca

SEQ ID NO: 364855 - DNA, 20 bp, Artificial Sequence
  chemically synthesized
tctgtgattaggacaaacaa

SEQ ID NO: 364856 - DNA, 20 bp, Artificial Sequence
  chemically synthesized
ttaggacaaacaatggtgaa

SEQ ID NO: 364857 - DNA, 20 bp, Artificial Sequence
  chemically synthesized
caatggtgaatggattctgt

SEQ ID NO: 364858 - DNA, 20 bp, Artificial Sequence
  chemically synthesized
tggtgaatggattctgttag

SEQ ID NO: 364859 - DNA, 20 bp, Artificial Sequence
  chemically synthesized
tgaatggattctgttagtag

SEQ ID NO: 364860 - DNA, 20 bp, Artificial Sequence
  chemically synthesized
atttcagatactgctactaa

SEQ ID NO: 364861 - DNA, 20 bp, Artificial Sequence
  chemically synthesized
cagtgtagattacataattt

SEQ ID NO: 364862 - DNA, 20 bp, Artificial Sequence
  chemically synthesized
aacatttacacatggcagtg

SEQ ID NO: 364863 - DNA, 20 bp, Artificial Sequence
  chemically synthesized
caccaaacatttacacatgg

SEQ ID NO: 364864 - DNA, 20 bp, Artificial Sequence
  chemically synthesized
aatcaccaaacatttacaca

SEQ ID NO: 364865 - DNA, 20 bp, Artificial Sequence
  chemically synthesized
cactgccatgtgtaaatgtt

SEQ ID NO: 364866 - DNA, 20 bp, Artificial Sequence
  chemically synthesized
tggtgatttttccctaccac

SEQ ID NO: 364867 - DNA, 20 bp, Artificial Sequence
  chemically synthesized
tataaggtaagctagtggta

SEQ ID NO: 364868 - DNA, 20 bp, Artificial Sequence
  chemically synthesized
gtataaggtaagctagtggt

SEQ ID NO: 364869 - DNA, 20 bp, Artificial Sequence
  chemically synthesized
agtataaggtaagctagtgg

SEQ ID NO: 364870 - DNA, 20 bp, Artificial Sequence
  chemically synthesized
gccagtataaggtaagctag

SEQ ID NO: 364871 - DNA, 20 bp, Artificial Sequence
  chemically synthesized
ttggccagtataaggtaagc

SEQ ID NO: 364872 - DNA, 20 bp, Artificial Sequence
  chemically synthesized
gagattggccagtataaggt

SEQ ID NO: 364873 - DNA, 20 bp, Artificial Sequence
  chemically synthesized
accactagcttaccttatac

SEQ ID NO: 364874 - DNA, 20 bp, Artificial Sequence
  chemically synthesized
ccatgagattggccagtata

SEQ ID NO: 364875 - DNA, 20 bp, Artificial Sequence
  chemically synthesized
tccatgagattggccagtat

SEQ ID NO: 364876 - DNA, 20 bp, Artificial Sequence
  chemically synthesized
aaaatatccatgagattggc

SEQ ID NO: 364877 - DNA, 20 bp, Artificial Sequence
  chemically synthesized
ccttatactggccaatctca

SEQ ID NO: 364878 - DNA, 20 bp, Artificial Sequence
  chemically synthesized
aaacaaaatatccatgagat

SEQ ID NO: 364879 - DNA, 20 bp, Artificial Sequence
  chemically synthesized
atatcaaacaaaatatccat

SEQ ID NO: 364880 - DNA, 20 bp, Artificial Sequence
  chemically synthesized
cctaattagtaatagcatta

SEQ ID NO: 364881 - DNA, 20 bp, Artificial Sequence
  chemically synthesized
aaaatgaacctaattagtaa

SEQ ID NO: 364882 - DNA, 20 bp, Artificial Sequence
  chemically synthesized
tctttaatgctattactaat

SEQ ID NO: 364883 - DNA, 20 bp, Artificial Sequence
  chemically synthesized
ctttaatgctattactaatt

SEQ ID NO: 364884 - DNA, 20 bp, Artificial Sequence
  chemically synthesized
taagacaaaatgaacctaat

SEQ ID NO: 364885 - DNA, 20 bp, Artificial Sequence
  chemically synthesized
taattaggttcattttgtct

SEQ ID NO: 364886 - DNA, 20 bp, Artificial Sequence
  chemically synthesized
catatacatacatagacgct

SEQ ID NO: 364887 - DNA, 20 bp, Artificial Sequence
  chemically synthesized
catttatgcatatacataca

SEQ ID NO: 364888 - DNA, 20 bp, Artificial Sequence
  chemically synthesized
atgcataaatgcaaatcatg

SEQ ID NO: 364889 - DNA, 20 bp, Artificial Sequence
  chemically synthesized
ttttttaattttgccgaaat

SEQ ID NO: 364890 - DNA, 20 bp, Artificial Sequence
  chemically synthesized
tttaattttgccgaaattag

SEQ ID NO: 364891 - DNA, 20 bp, Artificial Sequence
  chemically synthesized
aaagaaaaaaccactaattt

SEQ ID NO: 364892 - DNA, 20 bp, Artificial Sequence
  chemically synthesized
cacactacccatttgatata

SEQ ID NO: 364893 - DNA, 20 bp, Artificial Sequence
  chemically synthesized
ggttttttctttatatcaaa

SEQ ID NO: 364894 - DNA, 20 bp, Artificial Sequence
  chemically synthesized
gttttttctttatatcaaat

SEQ ID NO: 364895 - DNA, 20 bp, Artificial Sequence
  chemically synthesized
ttttctttatatcaaatggg

SEQ ID NO: 364896 - DNA, 20 bp, Artificial Sequence
  chemically synthesized
gggtagtgtgccaacatcat

SEQ ID NO: 364897 - DNA, 20 bp, Artificial Sequence
  chemically synthesized
tttctctaaacttatgatgt

SEQ ID NO: 364898 - DNA, 20 bp, Artificial Sequence
  chemically synthesized
gtgtgccaacatcataagtt

SEQ ID NO: 364899 - DNA, 20 bp, Artificial Sequence
  chemically synthesized
gtgccaacatcataagttta

SEQ ID NO: 364900 - DNA, 20 bp, Artificial Sequence
  chemically synthesized
caacatcataagtttagaga

SEQ ID NO: 364901 - DNA, 20 bp, Artificial Sequence
  chemically synthesized
aacatcataagtttagagaa

SEQ ID NO: 364902 - DNA, 20 bp, Artificial Sequence
  chemically synthesized
tttatactcagatatgagat

SEQ ID NO: 364903 - DNA, 20 bp, Artificial Sequence
  chemically synthesized
gaaaggcttatctcatatct

SEQ ID NO: 364904 - DNA, 20 bp, Artificial Sequence
  chemically synthesized
gggtgtttatactcagatat

SEQ ID NO: 364905 - DNA, 20 bp, Artificial Sequence
  chemically synthesized
atgatttgggtgtttatact

SEQ ID NO: 364906 - DNA, 20 bp, Artificial Sequence
  chemically synthesized
gtaattcataagcatgattt

SEQ ID NO: 364907 - DNA, 20 bp, Artificial Sequence
  chemically synthesized
cgtaattcataagcatgatt

SEQ ID NO: 364908 - DNA, 20 bp, Artificial Sequence
  chemically synthesized
cagatcctttcgtaattcat

SEQ ID NO: 364909 - DNA, 20 bp, Artificial Sequence
  chemically synthesized
atcatgcttatgaattacga

SEQ ID NO: 364910 - DNA, 20 bp, Artificial Sequence
  chemically synthesized
tcatgcttatgaattacgaa

SEQ ID NO: 364911 - DNA, 20 bp, Artificial Sequence
  chemically synthesized
atgtttaagataatgaattt

SEQ ID NO: 364912 - DNA, 20 bp, Artificial Sequence
  chemically synthesized
aaatttcatacataatgttt

SEQ ID NO: 364913 - DNA, 20 bp, Artificial Sequence
  chemically synthesized
cacccaaagcaatttagtca

SEQ ID NO: 364914 - DNA, 20 bp, Artificial Sequence
  chemically synthesized
tcacccaaagcaatttagtc

SEQ ID NO: 364915 - DNA, 20 bp, Artificial Sequence
  chemically synthesized
atcacccaaagcaatttagt

SEQ ID NO: 364916 - DNA, 20 bp, Artificial Sequence
  chemically synthesized
atctatcacccaaagcaatt

SEQ ID NO: 364917 - DNA, 20 bp, Artificial Sequence
  chemically synthesized
taaccctgactaaattgctt

SEQ ID NO: 364918 - DNA, 20 bp, Artificial Sequence
  chemically synthesized
aaccctgactaaattgcttt

SEQ ID NO: 364919 - DNA, 20 bp, Artificial Sequence
  chemically synthesized
gactaaattgctttgggtga

SEQ ID NO: 364920 - DNA, 20 bp, Artificial Sequence
  chemically synthesized
gtcaatccatctatcaccca

SEQ ID NO: 364921 - DNA, 20 bp, Artificial Sequence
  chemically synthesized
aaattgctttgggtgataga

SEQ ID NO: 364922 - DNA, 20 bp, Artificial Sequence
  chemically synthesized
gggtgatagatggattgact

SEQ ID NO: 364923 - DNA, 20 bp, Artificial Sequence
  chemically synthesized
gatagatggattgactcagt

SEQ ID NO: 364924 - DNA, 20 bp, Artificial Sequence
  chemically synthesized
atagatggattgactcagtc

SEQ ID NO: 364925 - DNA, 20 bp, Artificial Sequence
  chemically synthesized
tagatggattgactcagtca

SEQ ID NO: 364926 - DNA, 20 bp, Artificial Sequence
  chemically synthesized
ctctggtcatttccctgact

SEQ ID NO: 364927 - DNA, 20 bp, Artificial Sequence
  chemically synthesized
gactcagtcagggaaatgac

SEQ ID NO: 364928 - DNA, 20 bp, Artificial Sequence
  chemically synthesized
ctcagtcagggaaatgacca

SEQ ID NO: 364929 - DNA, 20 bp, Artificial Sequence
  chemically synthesized
tcagtcagggaaatgaccag

SEQ ID NO: 364930 - DNA, 20 bp, Artificial Sequence
  chemically synthesized
tctcctgtgttgcaatcctc

SEQ ID NO: 364931 - DNA, 20 bp, Artificial Sequence
  chemically synthesized
atgaccagaggattgcaaca

SEQ ID NO: 364932 - DNA, 20 bp, Artificial Sequence
  chemically synthesized
tgaccagaggattgcaacac

SEQ ID NO: 364933 - DNA, 20 bp, Artificial Sequence
  chemically synthesized
accagaggattgcaacacag

SEQ ID NO: 364934 - DNA, 20 bp, Artificial Sequence
  chemically synthesized
agaggattgcaacacaggag

SEQ ID NO: 364935 - DNA, 20 bp, Artificial Sequence
  chemically synthesized
acacaggagaagtgatcacg

SEQ ID NO: 364936 - DNA, 20 bp, Artificial Sequence
  chemically synthesized
gaagtgatcacgcagatacc

SEQ ID NO: 364937 - DNA, 20 bp, Artificial Sequence
  chemically synthesized
gtgatcacgcagatacctgg

SEQ ID NO: 364938 - DNA, 20 bp, Artificial Sequence
  chemically synthesized
cacgcagatacctggaagtg

SEQ ID NO: 364939 - DNA, 20 bp, Artificial Sequence
  chemically synthesized
gctgttgtctcttcacttcc

SEQ ID NO: 364940 - DNA, 20 bp, Artificial Sequence
  chemically synthesized
ggctgttgtctcttcacttc

SEQ ID NO: 364941 - DNA, 20 bp, Artificial Sequence
  chemically synthesized
cgcagatacctggaagtgaa

SEQ ID NO: 364942 - DNA, 20 bp, Artificial Sequence
  chemically synthesized
acctggaagtgaagagacaa

SEQ ID NO: 364943 - DNA, 20 bp, Artificial Sequence
  chemically synthesized
aagagacaacagcctcctaa

SEQ ID NO: 364944 - DNA, 20 bp, Artificial Sequence
  chemically synthesized
gagacaacagcctcctaaca

SEQ ID NO: 364945 - DNA, 20 bp, Artificial Sequence
  chemically synthesized
tgtcctggccctctgttagg

SEQ ID NO: 364946 - DNA, 20 bp, Artificial Sequence
  chemically synthesized
agacaacagcctcctaacag

SEQ ID NO: 364947 - DNA, 20 bp, Artificial Sequence
  chemically synthesized
ttgtcctggccctctgttag

SEQ ID NO: 364948 - DNA, 20 bp, Artificial Sequence
  chemically synthesized
gacaacagcctcctaacaga

SEQ ID NO: 364949 - DNA, 20 bp, Artificial Sequence
  chemically synthesized
tcttgtcctggccctctgtt

SEQ ID NO: 364950 - DNA, 20 bp, Artificial Sequence
  chemically synthesized
atcttgtcctggccctctgt

SEQ ID NO: 364951 - DNA, 20 bp, Artificial Sequence
  chemically synthesized
acagcctcctaacagagggc

SEQ ID NO: 364952 - DNA, 20 bp, Artificial Sequence
  chemically synthesized
cagcctcctaacagagggcc

SEQ ID NO: 364953 - DNA, 20 bp, Artificial Sequence
  chemically synthesized
tcctaacagagggccaggac

SEQ ID NO: 364954 - DNA, 20 bp, Artificial Sequence
  chemically synthesized
atggcttactcatcttgtcc

SEQ ID NO: 364955 - DNA, 20 bp, Artificial Sequence
  chemically synthesized
acagagggccaggacaagat

SEQ ID NO: 364956 - DNA, 20 bp, Artificial Sequence
  chemically synthesized
agggccaggacaagatgagt

SEQ ID NO: 364957 - DNA, 20 bp, Artificial Sequence
  chemically synthesized
gaaaaatctttcaaagatta

SEQ ID NO: 364958 - DNA, 20 bp, Artificial Sequence
  chemically synthesized
gagtaagccataatctttga

SEQ ID NO: 364959 - DNA, 20 bp, Artificial Sequence
  chemically synthesized
tgttcgtgaaaaatctttca

SEQ ID NO: 364960 - DNA, 20 bp, Artificial Sequence
  chemically synthesized
aaagatttttcacgaacatt

SEQ ID NO: 364961 - DNA, 20 bp, Artificial Sequence
  chemically synthesized
gatttttcacgaacatttgg

SEQ ID NO: 364962 - DNA, 20 bp, Artificial Sequence
  chemically synthesized
cacgaacatttggaagacac

SEQ ID NO: 364963 - DNA, 20 bp, Artificial Sequence
  chemically synthesized
acgaacatttggaagacact

SEQ ID NO: 364964 - DNA, 20 bp, Artificial Sequence
  chemically synthesized
gttaccgaatacagaagtcc

SEQ ID NO: 364965 - DNA, 20 bp, Artificial Sequence
  chemically synthesized
gacactgggacttctgtatt

SEQ ID NO: 364966 - DNA, 20 bp, Artificial Sequence
  chemically synthesized
tactttgttaccgaatacag

SEQ ID NO: 364967 - DNA, 20 bp, Artificial Sequence
  chemically synthesized
tcctactttgttaccgaata

SEQ ID NO: 364968 - DNA, 20 bp, Artificial Sequence
  chemically synthesized
gacttctgtattcggtaaca

SEQ ID NO: 364969 - DNA, 20 bp, Artificial Sequence
  chemically synthesized
ttctgtattcggtaacaaag

SEQ ID NO: 364970 - DNA, 20 bp, Artificial Sequence
  chemically synthesized
tctgtattcggtaacaaagt

SEQ ID NO: 364971 - DNA, 20 bp, Artificial Sequence
  chemically synthesized
taacaaagtaggactgactt

SEQ ID NO: 364972 - DNA, 20 bp, Artificial Sequence
  chemically synthesized
tttctcctgtattctgaagt

SEQ ID NO: 364973 - DNA, 20 bp, Artificial Sequence
  chemically synthesized
gtaggactgacttcagaata

SEQ ID NO: 364974 - DNA, 20 bp, Artificial Sequence
  chemically synthesized
ctcgtttctcctgtattctg

SEQ ID NO: 364975 - DNA, 20 bp, Artificial Sequence
  chemically synthesized
taggactgacttcagaatac

SEQ ID NO: 364976 - DNA, 20 bp, Artificial Sequence
  chemically synthesized
ggactgacttcagaatacag

SEQ ID NO: 364977 - DNA, 20 bp, Artificial Sequence
  chemically synthesized
cttcagaatacaggagaaac

SEQ ID NO: 364978 - DNA, 20 bp, Artificial Sequence
  chemically synthesized
tacaggagaaacgagataca

SEQ ID NO: 364979 - DNA, 20 bp, Artificial Sequence
  chemically synthesized
cgtagcatatgtacagaaat

SEQ ID NO: 364980 - DNA, 20 bp, Artificial Sequence
  chemically synthesized
atggatacgtagcatatgta

SEQ ID NO: 364981 - DNA, 20 bp, Artificial Sequence
  chemically synthesized
tttacatatatatggatacg

SEQ ID NO: 364982 - DNA, 20 bp, Artificial Sequence
  chemically synthesized
gtgaacaatttacatatata

SEQ ID NO: 364983 - DNA, 20 bp, Artificial Sequence
  chemically synthesized
atatatatgtaaattgttca

SEQ ID NO: 364984 - DNA, 20 bp, Artificial Sequence
  chemically synthesized
atgtaaattgttcacagtca

SEQ ID NO: 364985 - DNA, 20 bp, Artificial Sequence
  chemically synthesized
tgtaaattgttcacagtcat

SEQ ID NO: 364986 - DNA, 20 bp, Artificial Sequence
  chemically synthesized
taaattgttcacagtcatag

SEQ ID NO: 364987 - DNA, 20 bp, Artificial Sequence
  chemically synthesized
ttaatttcactagttagaga

SEQ ID NO: 364988 - DNA, 20 bp, Artificial Sequence
  chemically synthesized
cacacaaatctatctctaac

SEQ ID NO: 364989 - DNA, 20 bp, Artificial Sequence
  chemically synthesized
ggtcttaatttcactagtta

SEQ ID NO: 364990 - DNA, 20 bp, Artificial Sequence
  chemically synthesized
ttggtcttaatttcactagt

SEQ ID NO: 364991 - DNA, 20 bp, Artificial Sequence
  chemically synthesized
aaacttggtcttaatttcac

SEQ ID NO: 364992 - DNA, 20 bp, Artificial Sequence
  chemically synthesized
tatctctaactagtgaaatt

SEQ ID NO: 364993 - DNA, 20 bp, Artificial Sequence
  chemically synthesized
taactagtgaaattaagacc

SEQ ID NO: 364994 - DNA, 20 bp, Artificial Sequence
  chemically synthesized
ttgaggtcatcatgtaaact

SEQ ID NO: 364995 - DNA, 20 bp, Artificial Sequence
  chemically synthesized
tttacatgatgacctcaaat

SEQ ID NO: 364996 - DNA, 20 bp, Artificial Sequence
  chemically synthesized
gtttgctgggcgccaatttg

SEQ ID NO: 364997 - DNA, 20 bp, Artificial Sequence
  chemically synthesized
tgtttgctgggcgccaattt

SEQ ID NO: 364998 - DNA, 20 bp, Artificial Sequence
  chemically synthesized
gatgacctcaaattggcgcc

SEQ ID NO: 364999 - DNA, 20 bp, Artificial Sequence
  chemically synthesized
tcaaattggcgcccagcaaa

SEQ ID NO: 365000 - DNA, 20 bp, Artificial Sequence
  chemically synthesized
ttatagctgaactgtttgct

SEQ ID NO: 365001 - DNA, 20 bp, Artificial Sequence
  chemically synthesized
cttatagctgaactgtttgc

SEQ ID NO: 365002 - DNA, 20 bp, Artificial Sequence
  chemically synthesized
ttggcgcccagcaaacagtt

SEQ ID NO: 365003 - DNA, 20 bp, Artificial Sequence
  chemically synthesized
ccagcaaacagttcagctat

SEQ ID NO: 365004 - DNA, 20 bp, Artificial Sequence
  chemically synthesized
cagcaaacagttcagctata

SEQ ID NO: 365005 - DNA, 20 bp, Artificial Sequence
  chemically synthesized
aaatcagatttaatacctta

SEQ ID NO: 365006 - DNA, 20 bp, Artificial Sequence
  chemically synthesized
ctttagtcaagggggaaaat

SEQ ID NO: 365007 - DNA, 20 bp, Artificial Sequence
  chemically synthesized
aataataactttagtcaagg

SEQ ID NO: 365008 - DNA, 20 bp, Artificial Sequence
  chemically synthesized
aaataataactttagtcaag

SEQ ID NO: 365009 - DNA, 20 bp, Artificial Sequence
  chemically synthesized
ctgattttcccccttgacta

SEQ ID NO: 365010 - DNA, 20 bp, Artificial Sequence
  chemically synthesized
gaaataataactttagtcaa

SEQ ID NO: 365011 - DNA, 20 bp, Artificial Sequence
  chemically synthesized
tgaaataataactttagtca

SEQ ID NO: 365012 - DNA, 20 bp, Artificial Sequence
  chemically synthesized
ttgaaataataactttagtc

SEQ ID NO: 365013 - DNA, 20 bp, Artificial Sequence
  chemically synthesized
acatattgaaataataactt

SEQ ID NO: 365014 - DNA, 20 bp, Artificial Sequence
  chemically synthesized
tattatttcaatatgtcatc

SEQ ID NO: 365015 - DNA, 20 bp, Artificial Sequence
  chemically synthesized
tcatcaagttgttcttctat

SEQ ID NO: 365016 - DNA, 20 bp, Artificial Sequence
  chemically synthesized
gtctgaacttgtactaatag

SEQ ID NO: 365017 - DNA, 20 bp, Artificial Sequence
  chemically synthesized
agttgttcttctattagtac

SEQ ID NO: 365018 - DNA, 20 bp, Artificial Sequence
  chemically synthesized
gaagtctgaacttgtactaa

SEQ ID NO: 365019 - DNA, 20 bp, Artificial Sequence
  chemically synthesized
ttcttctattagtacaagtt

SEQ ID NO: 365020 - DNA, 20 bp, Artificial Sequence
  chemically synthesized
acggatccatttttttcaag

SEQ ID NO: 365021 - DNA, 20 bp, Artificial Sequence
  chemically synthesized
aaaacggatccatttttttc

SEQ ID NO: 365022 - DNA, 20 bp, Artificial Sequence
  chemically synthesized
ttcagacttcttgaaaaaaa

SEQ ID NO: 365023 - DNA, 20 bp, Artificial Sequence
  chemically synthesized
tgaaaaaaatggatccgttt

SEQ ID NO: 365024 - DNA, 20 bp, Artificial Sequence
  chemically synthesized
atgtgagattaatactaaaa

SEQ ID NO: 365025 - DNA, 20 bp, Artificial Sequence
  chemically synthesized
gttttagtattaatctcaca

SEQ ID NO: 365026 - DNA, 20 bp, Artificial Sequence
  chemically synthesized
ttttttatcttcagctatgt

SEQ ID NO: 365027 - DNA, 20 bp, Artificial Sequence
  chemically synthesized
gtattaatctcacatagctg

SEQ ID NO: 365028 - DNA, 20 bp, Artificial Sequence
  chemically synthesized
atgctttcattttttatctt

SEQ ID NO: 365029 - DNA, 20 bp, Artificial Sequence
  chemically synthesized
tagctgaagataaaaaatga

SEQ ID NO: 365030 - DNA, 20 bp, Artificial Sequence
  chemically synthesized
gaagataaaaaatgaaagca

SEQ ID NO: 365031 - DNA, 20 bp, Artificial Sequence
  chemically synthesized
aagataaaaaatgaaagcat

SEQ ID NO: 365032 - DNA, 20 bp, Artificial Sequence
  chemically synthesized
ataggtatgtctcttctgta

SEQ ID NO: 365033 - DNA, 20 bp, Artificial Sequence
  chemically synthesized
ttctgaagtcctatacagaa

SEQ ID NO: 365034 - DNA, 20 bp, Artificial Sequence
  chemically synthesized
taggtatgtctcttctgtat

SEQ ID NO: 365035 - DNA, 20 bp, Artificial Sequence
  chemically synthesized
aattctgaagtcctatacag

SEQ ID NO: 365036 - DNA, 20 bp, Artificial Sequence
  chemically synthesized
ttaaattctgaagtcctata

SEQ ID NO: 365037 - DNA, 20 bp, Artificial Sequence
  chemically synthesized
gtctcttctgtataggactt

SEQ ID NO: 365038 - DNA, 20 bp, Artificial Sequence
  chemically synthesized
ccctcctcaattaaattctg

SEQ ID NO: 365039 - DNA, 20 bp, Artificial Sequence
  chemically synthesized
taggacttcagaatttaatt

SEQ ID NO: 365040 - DNA, 20 bp, Artificial Sequence
  chemically synthesized
aggacttcagaatttaattg

SEQ ID NO: 365041 - DNA, 20 bp, Artificial Sequence
  chemically synthesized
gacttcagaatttaattgag

SEQ ID NO: 365042 - DNA, 20 bp, Artificial Sequence
  chemically synthesized
acttcagaatttaattgagg

SEQ ID NO: 365043 - DNA, 20 bp, Artificial Sequence
  chemically synthesized
cttcagaatttaattgagga

SEQ ID NO: 365044 - DNA, 20 bp, Artificial Sequence
  chemically synthesized
atttaattgaggagggatgt

SEQ ID NO: 365045 - DNA, 20 bp, Artificial Sequence
  chemically synthesized
gtcatacatacactaaaaac

SEQ ID NO: 365046 - DNA, 20 bp, Artificial Sequence
  chemically synthesized
gcccatttttgtcttgtttt

SEQ ID NO: 365047 - DNA, 20 bp, Artificial Sequence
  chemically synthesized
cactaaaaacaagacaaaaa

SEQ ID NO: 365048 - DNA, 20 bp, Artificial Sequence
  chemically synthesized
actaaaaacaagacaaaaat

SEQ ID NO: 365049 - DNA, 20 bp, Artificial Sequence
  chemically synthesized
agacaaaaatgggccttctg

SEQ ID NO: 365050 - DNA, 20 bp, Artificial Sequence
  chemically synthesized
tccctcccaaattccacaga

SEQ ID NO: 365051 - DNA, 20 bp, Artificial Sequence
  chemically synthesized
ttccctcccaaattccacag

SEQ ID NO: 365052 - DNA, 20 bp, Artificial Sequence
  chemically synthesized
aatgggccttctgtggaatt

SEQ ID NO: 365053 - DNA, 20 bp, Artificial Sequence
  chemically synthesized
tttttccctcccaaattcca

SEQ ID NO: 365054 - DNA, 20 bp, Artificial Sequence
  chemically synthesized
atgggccttctgtggaattt

SEQ ID NO: 365055 - DNA, 20 bp, Artificial Sequence
  chemically synthesized
gggccttctgtggaatttgg

SEQ ID NO: 365056 - DNA, 20 bp, Artificial Sequence
  chemically synthesized
ggccttctgtggaatttggg

SEQ ID NO: 365057 - DNA, 20 bp, Artificial Sequence
  chemically synthesized
gccttctgtggaatttggga

SEQ ID NO: 365058 - DNA, 20 bp, Artificial Sequence
  chemically synthesized
ggaatttgggagggaaaaat

SEQ ID NO: 365059 - DNA, 20 bp, Artificial Sequence
  chemically synthesized
ttgggagggaaaaattagca

SEQ ID NO: 365060 - DNA, 20 bp, Artificial Sequence
  chemically synthesized
tgggagggaaaaattagcaa

SEQ ID NO: 365061 - DNA, 20 bp, Artificial Sequence
  chemically synthesized
aaaaattagcaaaggtaatt

SEQ ID NO: 365062 - DNA, 20 bp, Artificial Sequence
  chemically synthesized
aaaattagcaaaggtaattt

SEQ ID NO: 365063 - DNA, 20 bp, Artificial Sequence
  chemically synthesized
tagcaaaggtaatttgggaa

SEQ ID NO: 365064 - DNA, 20 bp, Artificial Sequence
  chemically synthesized
aatttgggaaaagctttact

SEQ ID NO: 365065 - DNA, 20 bp, Artificial Sequence
  chemically synthesized
atttgggaaaagctttactg

SEQ ID NO: 365066 - DNA, 20 bp, Artificial Sequence
  chemically synthesized
accttgatttcacctcagta

SEQ ID NO: 365067 - DNA, 20 bp, Artificial Sequence
  chemically synthesized
cagaaaccttgatttcacct

SEQ ID NO: 365068 - DNA, 20 bp, Artificial Sequence
  chemically synthesized
agctttactgaggtgaaatc

SEQ ID NO: 365069 - DNA, 20 bp, Artificial Sequence
  chemically synthesized
gctttactgaggtgaaatca

SEQ ID NO: 365070 - DNA, 20 bp, Artificial Sequence
  chemically synthesized
tgaggtgaaatcaaggtttc

SEQ ID NO: 365071 - DNA, 20 bp, Artificial Sequence
  chemically synthesized
ggtgaaatcaaggtttctgg

SEQ ID NO: 365072 - DNA, 20 bp, Artificial Sequence
  chemically synthesized
aaatcaaggtttctggcaga

SEQ ID NO: 365073 - DNA, 20 bp, Artificial Sequence
  chemically synthesized
tgtctaccccaactgtctgc

SEQ ID NO: 365074 - DNA, 20 bp, Artificial Sequence
  chemically synthesized
caaggtttctggcagacagt

SEQ ID NO: 365075 - DNA, 20 bp, Artificial Sequence
  chemically synthesized
aaggtttctggcagacagtt

SEQ ID NO: 365076 - DNA, 20 bp, Artificial Sequence
  chemically synthesized
aggtttctggcagacagttg

SEQ ID NO: 365077 - DNA, 20 bp, Artificial Sequence
  chemically synthesized
tttctggcagacagttgggg

SEQ ID NO: 365078 - DNA, 20 bp, Artificial Sequence
  chemically synthesized
tggcagacagttggggtaga

SEQ ID NO: 365079 - DNA, 20 bp, Artificial Sequence
  chemically synthesized
cagacagttggggtagacag

SEQ ID NO: 365080 - DNA, 20 bp, Artificial Sequence
  chemically synthesized
ggggtagacagaagtacaaa

SEQ ID NO: 365081 - DNA, 20 bp, Artificial Sequence
  chemically synthesized
cagaagtacaaaaagaaata

SEQ ID NO: 365082 - DNA, 20 bp, Artificial Sequence
  chemically synthesized
agaagtacaaaaagaaatac

SEQ ID NO: 365083 - DNA, 20 bp, Artificial Sequence
  chemically synthesized
gtacaaaaagaaatacaggc

SEQ ID NO: 365084 - DNA, 20 bp, Artificial Sequence
  chemically synthesized
tacaggcaagtaaaataata

SEQ ID NO: 365085 - DNA, 20 bp, Artificial Sequence
  chemically synthesized
acaggcaagtaaaataatac

SEQ ID NO: 365086 - DNA, 20 bp, Artificial Sequence
  chemically synthesized
aaataatacaggcaaaaacc

SEQ ID NO: 365087 - DNA, 20 bp, Artificial Sequence
  chemically synthesized
ataatacaggcaaaaaccca

SEQ ID NO: 365088 - DNA, 20 bp, Artificial Sequence
  chemically synthesized
atatattgtcagatatctct

SEQ ID NO: 365089 - DNA, 20 bp, Artificial Sequence
  chemically synthesized
tatatattgtcagatatctc

SEQ ID NO: 365090 - DNA, 20 bp, Artificial Sequence
  chemically synthesized
cttttctcggtatatattgt

SEQ ID NO: 365091 - DNA, 20 bp, Artificial Sequence
  chemically synthesized
gatatctgacaatatatacc

SEQ ID NO: 365092 - DNA, 20 bp, Artificial Sequence
  chemically synthesized
ctgacaatatataccgagaa

SEQ ID NO: 365093 - DNA, 20 bp, Artificial Sequence
  chemically synthesized
gacaatatataccgagaaaa

SEQ ID NO: 365094 - DNA, 20 bp, Artificial Sequence
  chemically synthesized
acgctaagccactcttttct

SEQ ID NO: 365095 - DNA, 20 bp, Artificial Sequence
  chemically synthesized
aatatataccgagaaaagag

SEQ ID NO: 365096 - DNA, 20 bp, Artificial Sequence
  chemically synthesized
ataccgagaaaagagtggct

SEQ ID NO: 365097 - DNA, 20 bp, Artificial Sequence
  chemically synthesized
gaaaagagtggcttagcgtt

SEQ ID NO: 365098 - DNA, 20 bp, Artificial Sequence
  chemically synthesized
ctcctgtaacacttaacgct

SEQ ID NO: 365099 - DNA, 20 bp, Artificial Sequence
  chemically synthesized
tggcttagcgttaagtgtta

SEQ ID NO: 365100 - DNA, 20 bp, Artificial Sequence
  chemically synthesized
ggcttagcgttaagtgttac

SEQ ID NO: 365101 - DNA, 20 bp, Artificial Sequence
  chemically synthesized
cttagcgttaagtgttacag

SEQ ID NO: 365102 - DNA, 20 bp, Artificial Sequence
  chemically synthesized
ttagcgttaagtgttacagg

SEQ ID NO: 365103 - DNA, 20 bp, Artificial Sequence
  chemically synthesized
gcgttaagtgttacaggagg

SEQ ID NO: 365104 - DNA, 20 bp, Artificial Sequence
  chemically synthesized
cgttaagtgttacaggaggc

SEQ ID NO: 365105 - DNA, 20 bp, Artificial Sequence
  chemically synthesized
aagtgttacaggaggcaggc

SEQ ID NO: 365106 - DNA, 20 bp, Artificial Sequence
  chemically synthesized
agtgttacaggaggcaggct

SEQ ID NO: 365107 - DNA, 20 bp, Artificial Sequence
  chemically synthesized
gtgttacaggaggcaggctg

SEQ ID NO: 365108 - DNA, 20 bp, Artificial Sequence
  chemically synthesized
ttacaggaggcaggctgggg

SEQ ID NO: 365109 - DNA, 20 bp, Artificial Sequence
  chemically synthesized
aggaggcaggctggggtaga

SEQ ID NO: 365110 - DNA, 20 bp, Artificial Sequence
  chemically synthesized
agcaaaaatcctatctaccc

SEQ ID NO: 365111 - DNA, 20 bp, Artificial Sequence
  chemically synthesized
ggaggcaggctggggtagat

SEQ ID NO: 365112 - DNA, 20 bp, Artificial Sequence
  chemically synthesized
agctgtcgttcaaagtcagt

SEQ ID NO: 365113 - DNA, 20 bp, Artificial Sequence
  chemically synthesized
ctgaagctgtcgttcaaagt

SEQ ID NO: 365114 - DNA, 20 bp, Artificial Sequence
  chemically synthesized
tgctaactgactttgaacga

SEQ ID NO: 365115 - DNA, 20 bp, Artificial Sequence
  chemically synthesized
caaactgaagctgtcgttca

SEQ ID NO: 365116 - DNA, 20 bp, Artificial Sequence
  chemically synthesized
ctgactttgaacgacagctt

SEQ ID NO: 365117 - DNA, 20 bp, Artificial Sequence
  chemically synthesized
ttgtcatattatacaaactg

SEQ ID NO: 365118 - DNA, 20 bp, Artificial Sequence
  chemically synthesized
catacacacacagacacaca

SEQ ID NO: 365119 - DNA, 20 bp, Artificial Sequence
  chemically synthesized
agcacatgcacatacacaca

SEQ ID NO: 365120 - DNA, 20 bp, Artificial Sequence
  chemically synthesized
gtgtgtgtatgtgcatgtgc

SEQ ID NO: 365121 - DNA, 20 bp, Artificial Sequence
  chemically synthesized
tgtgtgtatgtgcatgtgct

SEQ ID NO: 365122 - DNA, 20 bp, Artificial Sequence
  chemically synthesized
gtgtgtatgtgcatgtgctg

SEQ ID NO: 365123 - DNA, 20 bp, Artificial Sequence
  chemically synthesized
gtgtatgtgcatgtgctggg

SEQ ID NO: 365124 - DNA, 20 bp, Artificial Sequence
  chemically synthesized
tgcccttcattacaactccc

SEQ ID NO: 365125 - DNA, 20 bp, Artificial Sequence
  chemically synthesized
tgtgctggggagttgtaatg

SEQ ID NO: 365126 - DNA, 20 bp, Artificial Sequence
  chemically synthesized
gtgctggggagttgtaatga

SEQ ID NO: 365127 - DNA, 20 bp, Artificial Sequence
  chemically synthesized
tgctggggagttgtaatgaa

SEQ ID NO: 365128 - DNA, 20 bp, Artificial Sequence
  chemically synthesized
gggagttgtaatgaagggca

SEQ ID NO: 365129 - DNA, 20 bp, Artificial Sequence
  chemically synthesized
ttgtaatgaagggcaaagat

SEQ ID NO: 365130 - DNA, 20 bp, Artificial Sequence
  chemically synthesized
gtaatgaagggcaaagataa

SEQ ID NO: 365131 - DNA, 20 bp, Artificial Sequence
  chemically synthesized
aagggcaaagataagagacg

SEQ ID NO: 365132 - DNA, 20 bp, Artificial Sequence
  chemically synthesized
agggcaaagataagagacga

SEQ ID NO: 365133 - DNA, 20 bp, Artificial Sequence
  chemically synthesized
aagagacgaaggctatgatt

SEQ ID NO: 365134 - DNA, 20 bp, Artificial Sequence
  chemically synthesized
tatcaaattctgctaaatca

SEQ ID NO: 365135 - DNA, 20 bp, Artificial Sequence
  chemically synthesized
agacgaaggctatgatttag

SEQ ID NO: 365136 - DNA, 20 bp, Artificial Sequence
  chemically synthesized
tatgatttagcagaatttga

SEQ ID NO: 365137 - DNA, 20 bp, Artificial Sequence
  chemically synthesized
atgatttagcagaatttgat

SEQ ID NO: 365138 - DNA, 20 bp, Artificial Sequence
  chemically synthesized
atttagcagaatttgatagg

SEQ ID NO: 365139 - DNA, 20 bp, Artificial Sequence
  chemically synthesized
gcagaatttgataggtagaa

SEQ ID NO: 365140 - DNA, 20 bp, Artificial Sequence
  chemically synthesized
agaacagttatttatgacta

SEQ ID NO: 365141 - DNA, 20 bp, Artificial Sequence
  chemically synthesized
agttatttatgactatagac

SEQ ID NO: 365142 - DNA, 20 bp, Artificial Sequence
  chemically synthesized
gttatttatgactatagact

SEQ ID NO: 365143 - DNA, 20 bp, Artificial Sequence
  chemically synthesized
ttatttatgactatagactg

SEQ ID NO: 365144 - DNA, 20 bp, Artificial Sequence
  chemically synthesized
gagtttaagcccccagtcta

SEQ ID NO: 365145 - DNA, 20 bp, Artificial Sequence
  chemically synthesized
tatttatgactatagactgg

SEQ ID NO: 365146 - DNA, 20 bp, Artificial Sequence
  chemically synthesized
aaaagtagagtttaagcccc

SEQ ID NO: 365147 - DNA, 20 bp, Artificial Sequence
  chemically synthesized
tattctaaaaagtagagttt

SEQ ID NO: 365148 - DNA, 20 bp, Artificial Sequence
  chemically synthesized
ggggcttaaactctactttt

SEQ ID NO: 365149 - DNA, 20 bp, Artificial Sequence
  chemically synthesized
gattgctattctaaaaagta

SEQ ID NO: 365150 - DNA, 20 bp, Artificial Sequence
  chemically synthesized
tagattgctattctaaaaag

SEQ ID NO: 365151 - DNA, 20 bp, Artificial Sequence
  chemically synthesized
ttaaactctactttttagaa

SEQ ID NO: 365152 - DNA, 20 bp, Artificial Sequence
  chemically synthesized
tcttagattgctattctaaa

SEQ ID NO: 365153 - DNA, 20 bp, Artificial Sequence
  chemically synthesized
actttttagaatagcaatct

SEQ ID NO: 365154 - DNA, 20 bp, Artificial Sequence
  chemically synthesized
cctgactgaaataatcgtct

SEQ ID NO: 365155 - DNA, 20 bp, Artificial Sequence
  chemically synthesized
gcaatctaagacgattattt

SEQ ID NO: 365156 - DNA, 20 bp, Artificial Sequence
  chemically synthesized
tctaagacgattatttcagt

SEQ ID NO: 365157 - DNA, 20 bp, Artificial Sequence
  chemically synthesized
ctaagacgattatttcagtc

SEQ ID NO: 365158 - DNA, 20 bp, Artificial Sequence
  chemically synthesized
taagacgattatttcagtca

SEQ ID NO: 365159 - DNA, 20 bp, Artificial Sequence
  chemically synthesized
aagacgattatttcagtcag

SEQ ID NO: 365160 - DNA, 20 bp, Artificial Sequence
  chemically synthesized
cagtcaggggatttcaattt

SEQ ID NO: 365161 - DNA, 20 bp, Artificial Sequence
  chemically synthesized
ggtcttacactgggggggga

SEQ ID NO: 365162 - DNA, 20 bp, Artificial Sequence
  chemically synthesized
atttgagttctttccccccc

SEQ ID NO: 365163 - DNA, 20 bp, Artificial Sequence
  chemically synthesized
tcaaggtcttacactggggg

SEQ ID NO: 365164 - DNA, 20 bp, Artificial Sequence
  chemically synthesized
atcaaggtcttacactgggg

SEQ ID NO: 365165 - DNA, 20 bp, Artificial Sequence
  chemically synthesized
gatcaaggtcttacactggg

SEQ ID NO: 365166 - DNA, 20 bp, Artificial Sequence
  chemically synthesized
gttctttccccccccagtgt

SEQ ID NO: 365167 - DNA, 20 bp, Artificial Sequence
  chemically synthesized
tgatcaaggtcttacactgg

SEQ ID NO: 365168 - DNA, 20 bp, Artificial Sequence
  chemically synthesized
ttgatcaaggtcttacactg

SEQ ID NO: 365169 - DNA, 20 bp, Artificial Sequence
  chemically synthesized
gttgatcaaggtcttacact

SEQ ID NO: 365170 - DNA, 20 bp, Artificial Sequence
  chemically synthesized
tgttgatcaaggtcttacac

SEQ ID NO: 365171 - DNA, 20 bp, Artificial Sequence
  chemically synthesized
cagtgaagtcatgttgatca

SEQ ID NO: 365172 - DNA, 20 bp, Artificial Sequence
  chemically synthesized
tcagtgaagtcatgttgatc

SEQ ID NO: 365173 - DNA, 20 bp, Artificial Sequence
  chemically synthesized
tacatgattacagatcagtg

SEQ ID NO: 365174 - DNA, 20 bp, Artificial Sequence
  chemically synthesized
tgatatacatgattacagat

SEQ ID NO: 365175 - DNA, 20 bp, Artificial Sequence
  chemically synthesized
atgattgatatacatgatta

SEQ ID NO: 365176 - DNA, 20 bp, Artificial Sequence
  chemically synthesized
atatcaatcatgtatcttca

SEQ ID NO: 365177 - DNA, 20 bp, Artificial Sequence
  chemically synthesized
tatcaatcatgtatcttcac

SEQ ID NO: 365178 - DNA, 20 bp, Artificial Sequence
  chemically synthesized
aacttcagagcattcctgtg

SEQ ID NO: 365179 - DNA, 20 bp, Artificial Sequence
  chemically synthesized
atcttcacaggaatgctctg

SEQ ID NO: 365180 - DNA, 20 bp, Artificial Sequence
  chemically synthesized
tcacaggaatgctctgaagt

SEQ ID NO: 365181 - DNA, 20 bp, Artificial Sequence
  chemically synthesized
tattatcttgtctaacttca

SEQ ID NO: 365182 - DNA, 20 bp, Artificial Sequence
  chemically synthesized
actattatcttgtctaactt

SEQ ID NO: 365183 - DNA, 20 bp, Artificial Sequence
  chemically synthesized
ggaatgctctgaagttagac

SEQ ID NO: 365184 - DNA, 20 bp, Artificial Sequence
  chemically synthesized
tctgaagttagacaagataa

SEQ ID NO: 365185 - DNA, 20 bp, Artificial Sequence
  chemically synthesized
gttagacaagataatagttc

SEQ ID NO: 365186 - DNA, 20 bp, Artificial Sequence
  chemically synthesized
tagacaagataatagttcaa

SEQ ID NO: 365187 - DNA, 20 bp, Artificial Sequence
  chemically synthesized
agacaagataatagttcaag

SEQ ID NO: 365188 - DNA, 20 bp, Artificial Sequence
  chemically synthesized
caagataatagttcaagagg

SEQ ID NO: 365189 - DNA, 20 bp, Artificial Sequence
  chemically synthesized
cattatagtgtaatacgtga

SEQ ID NO: 365190 - DNA, 20 bp, Artificial Sequence
  chemically synthesized
aaaataaggtacaggcatta

SEQ ID NO: 365191 - DNA, 20 bp, Artificial Sequence
  chemically synthesized
gggatagcaaaataaggtac

SEQ ID NO: 365192 - DNA, 20 bp, Artificial Sequence
  chemically synthesized
tgggatagcaaaataaggta

SEQ ID NO: 365193 - DNA, 20 bp, Artificial Sequence
  chemically synthesized
acatgtgggatagcaaaata

SEQ ID NO: 365194 - DNA, 20 bp, Artificial Sequence
  chemically synthesized
tacatgtgggatagcaaaat

SEQ ID NO: 365195 - DNA, 20 bp, Artificial Sequence
  chemically synthesized
atgagtttatacatgtggga

SEQ ID NO: 365196 - DNA, 20 bp, Artificial Sequence
  chemically synthesized
ctgtatgagtttatacatgt

SEQ ID NO: 365197 - DNA, 20 bp, Artificial Sequence
  chemically synthesized
cctgtatgagtttatacatg

SEQ ID NO: 365198 - DNA, 20 bp, Artificial Sequence
  chemically synthesized
cccacatgtataaactcata

SEQ ID NO: 365199 - DNA, 20 bp, Artificial Sequence
  chemically synthesized
ccacatgtataaactcatac

SEQ ID NO: 365200 - DNA, 20 bp, Artificial Sequence
  chemically synthesized
attttacaaggaacctgtat

SEQ ID NO: 365201 - DNA, 20 bp, Artificial Sequence
  chemically synthesized
atttttgaagttattttaca

SEQ ID NO: 365202 - DNA, 20 bp, Artificial Sequence
  chemically synthesized
tatttttgaagttattttac

SEQ ID NO: 365203 - DNA, 20 bp, Artificial Sequence
  chemically synthesized
tgtacttttgtgtatttttg

SEQ ID NO: 365204 - DNA, 20 bp, Artificial Sequence
  chemically synthesized
ataacttcaaaaatacacaa

SEQ ID NO: 365205 - DNA, 20 bp, Artificial Sequence
  chemically synthesized
caaaaatacacaaaagtaca

SEQ ID NO: 365206 - DNA, 20 bp, Artificial Sequence
  chemically synthesized
aagtacaaagataatttctc

SEQ ID NO: 365207 - DNA, 20 bp, Artificial Sequence
  chemically synthesized
gcttttatacataatgactt

SEQ ID NO: 365208 - DNA, 20 bp, Artificial Sequence
  chemically synthesized
tctcaagtcattatgtataa

SEQ ID NO: 365209 - DNA, 20 bp, Artificial Sequence
  chemically synthesized
tatgtataaaagccttcatt

SEQ ID NO: 365210 - DNA, 20 bp, Artificial Sequence
  chemically synthesized
cttatcaaatatcttaatga

SEQ ID NO: 365211 - DNA, 20 bp, Artificial Sequence
  chemically synthesized
tcttatcaaatatcttaatg

SEQ ID NO: 365212 - DNA, 20 bp, Artificial Sequence
  chemically synthesized
ccttcattaagatatttgat

SEQ ID NO: 365213 - DNA, 20 bp, Artificial Sequence
  chemically synthesized
cattaagatatttgataaga

SEQ ID NO: 365214 - DNA, 20 bp, Artificial Sequence
  chemically synthesized
tatttgataagatagatacc

SEQ ID NO: 365215 - DNA, 20 bp, Artificial Sequence
  chemically synthesized
ttgataagatagataccaag

SEQ ID NO: 365216 - DNA, 20 bp, Artificial Sequence
  chemically synthesized
tattattcagttttactact

SEQ ID NO: 365217 - DNA, 20 bp, Artificial Sequence
  chemically synthesized
ttatattaatagatattatt

SEQ ID NO: 365218 - DNA, 20 bp, Artificial Sequence
  chemically synthesized
agtaatacaatttatattaa

SEQ ID NO: 365219 - DNA, 20 bp, Artificial Sequence
  chemically synthesized
tgcagaaaaagtaaaaattt

SEQ ID NO: 365220 - DNA, 20 bp, Artificial Sequence
  chemically synthesized
tgaaatttttactttttctg

SEQ ID NO: 365221 - DNA, 20 bp, Artificial Sequence
  chemically synthesized
gaaatttttactttttctgc

SEQ ID NO: 365222 - DNA, 20 bp, Artificial Sequence
  chemically synthesized
tactctaccgcctgcagaaa

SEQ ID NO: 365223 - DNA, 20 bp, Artificial Sequence
  chemically synthesized
atttttactttttctgcagg

SEQ ID NO: 365224 - DNA, 20 bp, Artificial Sequence
  chemically synthesized
tttactttttctgcaggcgg

SEQ ID NO: 365225 - DNA, 20 bp, Artificial Sequence
  chemically synthesized
ttggcatactctaccgcctg

SEQ ID NO: 365226 - DNA, 20 bp, Artificial Sequence
  chemically synthesized
tactttttctgcaggcggta

SEQ ID NO: 365227 - DNA, 20 bp, Artificial Sequence
  chemically synthesized
aacctcgtatgattttcatt

SEQ ID NO: 365228 - DNA, 20 bp, Artificial Sequence
  chemically synthesized
atgccaaatgaaaatcatac

SEQ ID NO: 365229 - DNA, 20 bp, Artificial Sequence
  chemically synthesized
tgccaaatgaaaatcatacg

SEQ ID NO: 365230 - DNA, 20 bp, Artificial Sequence
  chemically synthesized
tcatacgaggttgctttact

SEQ ID NO: 365231 - DNA, 20 bp, Artificial Sequence
  chemically synthesized
catacgaggttgctttacta

SEQ ID NO: 365232 - DNA, 20 bp, Artificial Sequence
  chemically synthesized
gcaatacctattccttagta

SEQ ID NO: 365233 - DNA, 20 bp, Artificial Sequence
  chemically synthesized
gaggttgctttactaaggaa

SEQ ID NO: 365234 - DNA, 20 bp, Artificial Sequence
  chemically synthesized
aggttgctttactaaggaat

SEQ ID NO: 365235 - DNA, 20 bp, Artificial Sequence
  chemically synthesized
aaacagcaatacctattcct

SEQ ID NO: 365236 - DNA, 20 bp, Artificial Sequence
  chemically synthesized
ataggtattgctgtttcaat

SEQ ID NO: 365237 - DNA, 20 bp, Artificial Sequence
  chemically synthesized
tgactaggtactgattgaaa

SEQ ID NO: 365238 - DNA, 20 bp, Artificial Sequence
  chemically synthesized
ttgctgtttcaatcagtacc

SEQ ID NO: 365239 - DNA, 20 bp, Artificial Sequence
  chemically synthesized
tgacatctagtagaatgact

SEQ ID NO: 365240 - DNA, 20 bp, Artificial Sequence
  chemically synthesized
atgacatctagtagaatgac

SEQ ID NO: 365241 - DNA, 20 bp, Artificial Sequence
  chemically synthesized
tcagtacctagtcattctac

SEQ ID NO: 365242 - DNA, 20 bp, Artificial Sequence
  chemically synthesized
catagttttatgacatctag

SEQ ID NO: 365243 - DNA, 20 bp, Artificial Sequence
  chemically synthesized
caacatagttttatgacatc

SEQ ID NO: 365244 - DNA, 20 bp, Artificial Sequence
  chemically synthesized
atgtcataaaactatgttgt

SEQ ID NO: 365245 - DNA, 20 bp, Artificial Sequence
  chemically synthesized
cagaccagaaactgacaaca

SEQ ID NO: 365246 - DNA, 20 bp, Artificial Sequence
  chemically synthesized
aaaactatgttgtcagtttc

SEQ ID NO: 365247 - DNA, 20 bp, Artificial Sequence
  chemically synthesized
aacttagtagaatttcagac

SEQ ID NO: 365248 - DNA, 20 bp, Artificial Sequence
  chemically synthesized
ctttaaacttagtagaattt

SEQ ID NO: 365249 - DNA, 20 bp, Artificial Sequence
  chemically synthesized
ttctggtctgaaattctact

SEQ ID NO: 365250 - DNA, 20 bp, Artificial Sequence
  chemically synthesized
aaagttaactttaaacttag

SEQ ID NO: 365251 - DNA, 20 bp, Artificial Sequence
  chemically synthesized
ctgaaattctactaagttta

SEQ ID NO: 365252 - DNA, 20 bp, Artificial Sequence
  chemically synthesized
aagaaagttaactttaaact

SEQ ID NO: 365253 - DNA, 20 bp, Artificial Sequence
  chemically synthesized
tatgtgacttatttttaaga

SEQ ID NO: 365254 - DNA, 20 bp, Artificial Sequence
  chemically synthesized
aagttaactttcttaaaaat

SEQ ID NO: 365255 - DNA, 20 bp, Artificial Sequence
  chemically synthesized
ctggtatgtgacttattttt

SEQ ID NO: 365256 - DNA, 20 bp, Artificial Sequence
  chemically synthesized
cttaaaaataagtcacatac

SEQ ID NO: 365257 - DNA, 20 bp, Artificial Sequence
  chemically synthesized
aggcctgacagggcaaaaac

SEQ ID NO: 365258 - DNA, 20 bp, Artificial Sequence
  chemically synthesized
cataccagtttttgccctgt

SEQ ID NO: 365259 - DNA, 20 bp, Artificial Sequence
  chemically synthesized
ataccagtttttgccctgtc

SEQ ID NO: 365260 - DNA, 20 bp, Artificial Sequence
  chemically synthesized
acctcctcgaaggcctgaca

SEQ ID NO: 365261 - DNA, 20 bp, Artificial Sequence
  chemically synthesized
gacctcctcgaaggcctgac

SEQ ID NO: 365262 - DNA, 20 bp, Artificial Sequence
  chemically synthesized
agacctcctcgaaggcctga

SEQ ID NO: 365263 - DNA, 20 bp, Artificial Sequence
  chemically synthesized
ttttgccctgtcaggccttc

SEQ ID NO: 365264 - DNA, 20 bp, Artificial Sequence
  chemically synthesized
tttgccctgtcaggccttcg

SEQ ID NO: 365265 - DNA, 20 bp, Artificial Sequence
  chemically synthesized
tgccctgtcaggccttcgag

SEQ ID NO: 365266 - DNA, 20 bp, Artificial Sequence
  chemically synthesized
gccctgtcaggccttcgagg

SEQ ID NO: 365267 - DNA, 20 bp, Artificial Sequence
  chemically synthesized
cgcctcctagacctcctcga

SEQ ID NO: 365268 - DNA, 20 bp, Artificial Sequence
  chemically synthesized
gcgcctcctagacctcctcg

SEQ ID NO: 365269 - DNA, 20 bp, Artificial Sequence
  chemically synthesized
gtcaggccttcgaggaggtc

SEQ ID NO: 365270 - DNA, 20 bp, Artificial Sequence
  chemically synthesized
tcaggccttcgaggaggtct

SEQ ID NO: 365271 - DNA, 20 bp, Artificial Sequence
  chemically synthesized
aggccttcgaggaggtctag

SEQ ID NO: 365272 - DNA, 20 bp, Artificial Sequence
  chemically synthesized
ggccttcgaggaggtctagg

SEQ ID NO: 365273 - DNA, 20 bp, Artificial Sequence
  chemically synthesized
acaggatgggaggcgcctcc

SEQ ID NO: 365274 - DNA, 20 bp, Artificial Sequence
  chemically synthesized
tcagtgacctacaggatggg

SEQ ID NO: 365275 - DNA, 20 bp, Artificial Sequence
  chemically synthesized
ttcagtgacctacaggatgg

SEQ ID NO: 365276 - DNA, 20 bp, Artificial Sequence
  chemically synthesized
aggaggcgcctcccatcctg

SEQ ID NO: 365277 - DNA, 20 bp, Artificial Sequence
  chemically synthesized
ggaggcgcctcccatcctgt

SEQ ID NO: 365278 - DNA, 20 bp, Artificial Sequence
  chemically synthesized
tcttcagtgacctacaggat

SEQ ID NO: 365279 - DNA, 20 bp, Artificial Sequence
  chemically synthesized
ctcttcagtgacctacagga

SEQ ID NO: 365280 - DNA, 20 bp, Artificial Sequence
  chemically synthesized
gaacctcttcagtgacctac

SEQ ID NO: 365281 - DNA, 20 bp, Artificial Sequence
  chemically synthesized
agaacctcttcagtgaccta

SEQ ID NO: 365282 - DNA, 20 bp, Artificial Sequence
  chemically synthesized
tcccatcctgtaggtcactg

SEQ ID NO: 365283 - DNA, 20 bp, Artificial Sequence
  chemically synthesized
ccatcctgtaggtcactgaa

SEQ ID NO: 365284 - DNA, 20 bp, Artificial Sequence
  chemically synthesized
catcctgtaggtcactgaag

SEQ ID NO: 365285 - DNA, 20 bp, Artificial Sequence
  chemically synthesized
cagcatattgagaacctctt

SEQ ID NO: 365286 - DNA, 20 bp, Artificial Sequence
  chemically synthesized
agtttgggaagcagcatatt

SEQ ID NO: 365287 - DNA, 20 bp, Artificial Sequence
  chemically synthesized
tttaatttcagtttgggaag

SEQ ID NO: 365288 - DNA, 20 bp, Artificial Sequence
  chemically synthesized
ttttttaatttcagtttggg

SEQ ID NO: 365289 - DNA, 20 bp, Artificial Sequence
  chemically synthesized
attttttttaatttcagttt

SEQ ID NO: 365290 - DNA, 20 bp, Artificial Sequence
  chemically synthesized
tattttttttaatttcagtt

SEQ ID NO: 365291 - DNA, 20 bp, Artificial Sequence
  chemically synthesized
gagtgtattttttttaattt

SEQ ID NO: 365292 - DNA, 20 bp, Artificial Sequence
  chemically synthesized
gaagtgtgctttgttaaatt

SEQ ID NO: 365293 - DNA, 20 bp, Artificial Sequence
  chemically synthesized
aaaatacactcaatttaaca

SEQ ID NO: 365294 - DNA, 20 bp, Artificial Sequence
  chemically synthesized
tcgtgaaaatgtatcattgg

SEQ ID NO: 365295 - DNA, 20 bp, Artificial Sequence
  chemically synthesized
taatcgtgaaaatgtatcat

SEQ ID NO: 365296 - DNA, 20 bp, Artificial Sequence
  chemically synthesized
atagctttagttttcaaaag

SEQ ID NO: 365297 - DNA, 20 bp, Artificial Sequence
  chemically synthesized
tatagctttagttttcaaaa

SEQ ID NO: 365298 - DNA, 20 bp, Artificial Sequence
  chemically synthesized
atatagctttagttttcaaa

SEQ ID NO: 365299 - DNA, 20 bp, Artificial Sequence
  chemically synthesized
aatatagctttagttttcaa

SEQ ID NO: 365300 - DNA, 20 bp, Artificial Sequence
  chemically synthesized
ttatccccttttgaaaacta

SEQ ID NO: 365301 - DNA, 20 bp, Artificial Sequence
  chemically synthesized
attatccttaaatatagctt

SEQ ID NO: 365302 - DNA, 20 bp, Artificial Sequence
  chemically synthesized
tgaaaactaaagctatattt

SEQ ID NO: 365303 - DNA, 20 bp, Artificial Sequence
  chemically synthesized
gaaaactaaagctatattta

SEQ ID NO: 365304 - DNA, 20 bp, Artificial Sequence
  chemically synthesized
acactaattatccttaaata

SEQ ID NO: 365305 - DNA, 20 bp, Artificial Sequence
  chemically synthesized
aagctatatttaaggataat

SEQ ID NO: 365306 - DNA, 20 bp, Artificial Sequence
  chemically synthesized
tgtgcataattaatctgccg

SEQ ID NO: 365307 - DNA, 20 bp, Artificial Sequence
  chemically synthesized
ttttcatccgtcatcttcgg

SEQ ID NO: 365308 - DNA, 20 bp, Artificial Sequence
  chemically synthesized
aattaatctgccgaagatga

SEQ ID NO: 365309 - DNA, 20 bp, Artificial Sequence
  chemically synthesized
cttttttcatccgtcatctt

SEQ ID NO: 365310 - DNA, 20 bp, Artificial Sequence
  chemically synthesized
ccgaagatgacggatgaaaa

SEQ ID NO: 365311 - DNA, 20 bp, Artificial Sequence
  chemically synthesized
cgaagatgacggatgaaaaa

SEQ ID NO: 365312 - DNA, 20 bp, Artificial Sequence
  chemically synthesized
gatgacggatgaaaaaagga

SEQ ID NO: 365313 - DNA, 20 bp, Artificial Sequence
  chemically synthesized
aaaatttaaaaattttatca

SEQ ID NO: 365314 - DNA, 20 bp, Artificial Sequence
  chemically synthesized
aaatttaaaaattttatcat

SEQ ID NO: 365315 - DNA, 20 bp, Artificial Sequence
  chemically synthesized
taaaaattttatcataggtc

SEQ ID NO: 365316 - DNA, 20 bp, Artificial Sequence
  chemically synthesized
taggtcaagtctatttgaat

SEQ ID NO: 365317 - DNA, 20 bp, Artificial Sequence
  chemically synthesized
gctattcaaactaattcaaa

SEQ ID NO: 365318 - DNA, 20 bp, Artificial Sequence
  chemically synthesized
tctatttgaattagtttgaa

SEQ ID NO: 365319 - DNA, 20 bp, Artificial Sequence
  chemically synthesized
tttgaattagtttgaatagc

SEQ ID NO: 365320 - DNA, 20 bp, Artificial Sequence
  chemically synthesized
tgaattagtttgaatagcaa

SEQ ID NO: 365321 - DNA, 20 bp, Artificial Sequence
  chemically synthesized
ttagtttgaatagcaagagt

SEQ ID NO: 365322 - DNA, 20 bp, Artificial Sequence
  chemically synthesized
agtttgaatagcaagagtaa

SEQ ID NO: 365323 - DNA, 20 bp, Artificial Sequence
  chemically synthesized
tgaattaattagatcattta

SEQ ID NO: 365324 - DNA, 20 bp, Artificial Sequence
  chemically synthesized
gtgaattaattagatcattt

SEQ ID NO: 365325 - DNA, 20 bp, Artificial Sequence
  chemically synthesized
agtgaattaattagatcatt

SEQ ID NO: 365326 - DNA, 20 bp, Artificial Sequence
  chemically synthesized
attcatttcagtgaattaat

SEQ ID NO: 365327 - DNA, 20 bp, Artificial Sequence
  chemically synthesized
catagaatctatattcattt

SEQ ID NO: 365328 - DNA, 20 bp, Artificial Sequence
  chemically synthesized
ttaattcactgaaatgaata

SEQ ID NO: 365329 - DNA, 20 bp, Artificial Sequence
  chemically synthesized
aaatgaatatagattctatg

SEQ ID NO: 365330 - DNA, 20 bp, Artificial Sequence
  chemically synthesized
aatgaatatagattctatga

SEQ ID NO: 365331 - DNA, 20 bp, Artificial Sequence
  chemically synthesized
tgaatatagattctatgaag

SEQ ID NO: 365332 - DNA, 20 bp, Artificial Sequence
  chemically synthesized
aatatagattctatgaagga

SEQ ID NO: 365333 - DNA, 20 bp, Artificial Sequence
  chemically synthesized
tgtattttttctctccttca

SEQ ID NO: 365334 - DNA, 20 bp, Artificial Sequence
  chemically synthesized
tatgaaggagagaaaaaata

SEQ ID NO: 365335 - DNA, 20 bp, Artificial Sequence
  chemically synthesized
atgaaggagagaaaaaatac

SEQ ID NO: 365336 - DNA, 20 bp, Artificial Sequence
  chemically synthesized
gaaaaaatacaggcatgatc

SEQ ID NO: 365337 - DNA, 20 bp, Artificial Sequence
  chemically synthesized
aaaaaatacaggcatgatca

SEQ ID NO: 365338 - DNA, 20 bp, Artificial Sequence
  chemically synthesized
aaatacaggcatgatcaagg

SEQ ID NO: 365339 - DNA, 20 bp, Artificial Sequence
  chemically synthesized
aggcatgatcaaggcagtta

SEQ ID NO: 365340 - DNA, 20 bp, Artificial Sequence
  chemically synthesized
ggcatgatcaaggcagttac

SEQ ID NO: 365341 - DNA, 20 bp, Artificial Sequence
  chemically synthesized
gatcaaggcagttacgggta

SEQ ID NO: 365342 - DNA, 20 bp, Artificial Sequence
  chemically synthesized
atcaaggcagttacgggtaa

SEQ ID NO: 365343 - DNA, 20 bp, Artificial Sequence
  chemically synthesized
tcaaggcagttacgggtaaa

SEQ ID NO: 365344 - DNA, 20 bp, Artificial Sequence
  chemically synthesized
gcagttacgggtaaagggaa

SEQ ID NO: 365345 - DNA, 20 bp, Artificial Sequence
  chemically synthesized
aagggaaaagtaaatacaca

SEQ ID NO: 365346 - DNA, 20 bp, Artificial Sequence
  chemically synthesized
ggaaaagtaaatacacaaag

SEQ ID NO: 365347 - DNA, 20 bp, Artificial Sequence
  chemically synthesized
gtaaatacacaaagaagcaa

SEQ ID NO: 365348 - DNA, 20 bp, Artificial Sequence
  chemically synthesized
gtacccacccaggtagattg

SEQ ID NO: 365349 - DNA, 20 bp, Artificial Sequence
  chemically synthesized
gcaaaagaccacaatctacc

SEQ ID NO: 365350 - DNA, 20 bp, Artificial Sequence
  chemically synthesized
caaaagaccacaatctacct

SEQ ID NO: 365351 - DNA, 20 bp, Artificial Sequence
  chemically synthesized
aagaccacaatctacctggg

SEQ ID NO: 365352 - DNA, 20 bp, Artificial Sequence
  chemically synthesized
agaccacaatctacctgggt

SEQ ID NO: 365353 - DNA, 20 bp, Artificial Sequence
  chemically synthesized
actttatgtacccacccagg

SEQ ID NO: 365354 - DNA, 20 bp, Artificial Sequence
  chemically synthesized
taaactttatgtacccaccc

SEQ ID NO: 365355 - DNA, 20 bp, Artificial Sequence
  chemically synthesized
ttaaactttatgtacccacc

SEQ ID NO: 365356 - DNA, 20 bp, Artificial Sequence
  chemically synthesized
tctacctgggtgggtacata

SEQ ID NO: 365357 - DNA, 20 bp, Artificial Sequence
  chemically synthesized
acataaagtttaaccattct

SEQ ID NO: 365358 - DNA, 20 bp, Artificial Sequence
  chemically synthesized
tgactggtatattccaagaa

SEQ ID NO: 365359 - DNA, 20 bp, Artificial Sequence
  chemically synthesized
cactctgactggtatattcc

SEQ ID NO: 365360 - DNA, 20 bp, Artificial Sequence
  chemically synthesized
taaccattcttggaatatac

SEQ ID NO: 365361 - DNA, 20 bp, Artificial Sequence
  chemically synthesized
cattcttggaatataccagt

SEQ ID NO: 365362 - DNA, 20 bp, Artificial Sequence
  chemically synthesized
ttcttggaatataccagtca

SEQ ID NO: 365363 - DNA, 20 bp, Artificial Sequence
  chemically synthesized
ttggaatataccagtcagag

SEQ ID NO: 365364 - DNA, 20 bp, Artificial Sequence
  chemically synthesized
ggatgtcgaaccactctgac

SEQ ID NO: 365365 - DNA, 20 bp, Artificial Sequence
  chemically synthesized
caagcatgttttgagtgata

SEQ ID NO: 365366 - DNA, 20 bp, Artificial Sequence
  chemically synthesized
gcaagcatgttttgagtgat

SEQ ID NO: 365367 - DNA, 20 bp, Artificial Sequence
  chemically synthesized
atgcacagcaagcatgtttt

SEQ ID NO: 365368 - DNA, 20 bp, Artificial Sequence
  chemically synthesized
gcaaaatgtgtatgcacagc

SEQ ID NO: 365369 - DNA, 20 bp, Artificial Sequence
  chemically synthesized
gcatgcaaaatgtgtatgca

SEQ ID NO: 365370 - DNA, 20 bp, Artificial Sequence
  chemically synthesized
tccagtatgagaataggtca

SEQ ID NO: 365371 - DNA, 20 bp, Artificial Sequence
  chemically synthesized
gagttatccagtatgagaat

SEQ ID NO: 365372 - DNA, 20 bp, Artificial Sequence
  chemically synthesized
tgagttatccagtatgagaa

SEQ ID NO: 365373 - DNA, 20 bp, Artificial Sequence
  chemically synthesized
gctatgacctattctcatac

SEQ ID NO: 365374 - DNA, 20 bp, Artificial Sequence
  chemically synthesized
aaatttgagttatccagtat

SEQ ID NO: 365375 - DNA, 20 bp, Artificial Sequence
  chemically synthesized
ttcctaaaatttgagttatc

SEQ ID NO: 365376 - DNA, 20 bp, Artificial Sequence
  chemically synthesized
atactggataactcaaattt

SEQ ID NO: 365377 - DNA, 20 bp, Artificial Sequence
  chemically synthesized
tactggataactcaaatttt

SEQ ID NO: 365378 - DNA, 20 bp, Artificial Sequence
  chemically synthesized
acccgatattcctaaaattt

SEQ ID NO: 365379 - DNA, 20 bp, Artificial Sequence
  chemically synthesized
aactcaaattttaggaatat

SEQ ID NO: 365380 - DNA, 20 bp, Artificial Sequence
  chemically synthesized
actcaaattttaggaatatc

SEQ ID NO: 365381 - DNA, 20 bp, Artificial Sequence
  chemically synthesized
ttaggaatatcgggtttaat

SEQ ID NO: 365382 - DNA, 20 bp, Artificial Sequence
  chemically synthesized
taggaatatcgggtttaatt

SEQ ID NO: 365383 - DNA, 20 bp, Artificial Sequence
  chemically synthesized
taggtttgaaacaaccctgt

SEQ ID NO: 365384 - DNA, 20 bp, Artificial Sequence
  chemically synthesized
ggtttgaaacaaccctgtga

SEQ ID NO: 365385 - DNA, 20 bp, Artificial Sequence
  chemically synthesized
atagatgaaaagctctcaca

SEQ ID NO: 365386 - DNA, 20 bp, Artificial Sequence
  chemically synthesized
aatagatgaaaagctctcac

SEQ ID NO: 365387 - DNA, 20 bp, Artificial Sequence
  chemically synthesized
aaatagatgaaaagctctca

SEQ ID NO: 365388 - DNA, 20 bp, Artificial Sequence
  chemically synthesized
aactgagtaaaatagatgaa

SEQ ID NO: 365389 - DNA, 20 bp, Artificial Sequence
  chemically synthesized
agcttttcatctattttact

SEQ ID NO: 365390 - DNA, 20 bp, Artificial Sequence
  chemically synthesized
gagcaaagaactgagtaaaa

SEQ ID NO: 365391 - DNA, 20 bp, Artificial Sequence
  chemically synthesized
taattcctgagcaaagaact

SEQ ID NO: 365392 - DNA, 20 bp, Artificial Sequence
  chemically synthesized
attttactcagttctttgct

SEQ ID NO: 365393 - DNA, 20 bp, Artificial Sequence
  chemically synthesized
ttttactcagttctttgctc

SEQ ID NO: 365394 - DNA, 20 bp, Artificial Sequence
  chemically synthesized
cttagtataattcctgagca

SEQ ID NO: 365395 - DNA, 20 bp, Artificial Sequence
  chemically synthesized
ttttccttagtataattcct

SEQ ID NO: 365396 - DNA, 20 bp, Artificial Sequence
  chemically synthesized
ctttgctcaggaattatact

SEQ ID NO: 365397 - DNA, 20 bp, Artificial Sequence
  chemically synthesized
tttgctcaggaattatacta

SEQ ID NO: 365398 - DNA, 20 bp, Artificial Sequence
  chemically synthesized
tattgactattatttttcct

SEQ ID NO: 365399 - DNA, 20 bp, Artificial Sequence
  chemically synthesized
attatactaaggaaaaataa

SEQ ID NO: 365400 - DNA, 20 bp, Artificial Sequence
  chemically synthesized
tttttaacgtaaatactcat

SEQ ID NO: 365401 - DNA, 20 bp, Artificial Sequence
  chemically synthesized
catttaatagtgtgtctcat

SEQ ID NO: 365402 - DNA, 20 bp, Artificial Sequence
  chemically synthesized
catgagacacactattaaat

SEQ ID NO: 365403 - DNA, 20 bp, Artificial Sequence
  chemically synthesized
tatgaaatccactcatttaa

SEQ ID NO: 365404 - DNA, 20 bp, Artificial Sequence
  chemically synthesized
gagacacactattaaatgag

SEQ ID NO: 365405 - DNA, 20 bp, Artificial Sequence
  chemically synthesized
agtggatttcataaccgttg

SEQ ID NO: 365406 - DNA, 20 bp, Artificial Sequence
  chemically synthesized
taatctcagaaatgccacaa

SEQ ID NO: 365407 - DNA, 20 bp, Artificial Sequence
  chemically synthesized
ataaccgttgtggcatttct

SEQ ID NO: 365408 - DNA, 20 bp, Artificial Sequence
  chemically synthesized
cgttgtggcatttctgagat

SEQ ID NO: 365409 - DNA, 20 bp, Artificial Sequence
  chemically synthesized
tgtggcatttctgagattag

SEQ ID NO: 365410 - DNA, 20 bp, Artificial Sequence
  chemically synthesized
aagtatgttactgctaatct

SEQ ID NO: 365411 - DNA, 20 bp, Artificial Sequence
  chemically synthesized
cagtaacatacttaacctct

SEQ ID NO: 365412 - DNA, 20 bp, Artificial Sequence
  chemically synthesized
acatgagatacttagaggtt

SEQ ID NO: 365413 - DNA, 20 bp, Artificial Sequence
  chemically synthesized
atcttacatgagatacttag

SEQ ID NO: 365414 - DNA, 20 bp, Artificial Sequence
  chemically synthesized
catcttacatgagatactta

SEQ ID NO: 365415 - DNA, 20 bp, Artificial Sequence
  chemically synthesized
ctcatcttacatgagatact

SEQ ID NO: 365416 - DNA, 20 bp, Artificial Sequence
  chemically synthesized
aacctctaagtatctcatgt

SEQ ID NO: 365417 - DNA, 20 bp, Artificial Sequence
  chemically synthesized
gccacatactcatcttacat

SEQ ID NO: 365418 - DNA, 20 bp, Artificial Sequence
  chemically synthesized
ctaagtatctcatgtaagat

SEQ ID NO: 365419 - DNA, 20 bp, Artificial Sequence
  chemically synthesized
tctcatgtaagatgagtatg

SEQ ID NO: 365420 - DNA, 20 bp, Artificial Sequence
  chemically synthesized
cattctagtttcatgacaaa

SEQ ID NO: 365421 - DNA, 20 bp, Artificial Sequence
  chemically synthesized
cccattctagtttcatgaca

SEQ ID NO: 365422 - DNA, 20 bp, Artificial Sequence
  chemically synthesized
gtggctctttgtcatgaaac

SEQ ID NO: 365423 - DNA, 20 bp, Artificial Sequence
  chemically synthesized
tctttgtcatgaaactagaa

SEQ ID NO: 365424 - DNA, 20 bp, Artificial Sequence
  chemically synthesized
ctttgtcatgaaactagaat

SEQ ID NO: 365425 - DNA, 20 bp, Artificial Sequence
  chemically synthesized
tttgtcatgaaactagaatg

SEQ ID NO: 365426 - DNA, 20 bp, Artificial Sequence
  chemically synthesized
attttggctttaccccattc

SEQ ID NO: 365427 - DNA, 20 bp, Artificial Sequence
  chemically synthesized
catgaaactagaatggggta

SEQ ID NO: 365428 - DNA, 20 bp, Artificial Sequence
  chemically synthesized
atggggtaaagccaaaatta

SEQ ID NO: 365429 - DNA, 20 bp, Artificial Sequence
  chemically synthesized
acagatctgagccataattt

SEQ ID NO: 365430 - DNA, 20 bp, Artificial Sequence
  chemically synthesized
gtaaagccaaaattatggct

SEQ ID NO: 365431 - DNA, 20 bp, Artificial Sequence
  chemically synthesized
acccagaattagacagatct

SEQ ID NO: 365432 - DNA, 20 bp, Artificial Sequence
  chemically synthesized
aacaagaacccagaattaga

SEQ ID NO: 365433 - DNA, 20 bp, Artificial Sequence
  chemically synthesized
ggctcagatctgtctaattc

SEQ ID NO: 365434 - DNA, 20 bp, Artificial Sequence
  chemically synthesized
gctcagatctgtctaattct

SEQ ID NO: 365435 - DNA, 20 bp, Artificial Sequence
  chemically synthesized
aaagaacaagaacccagaat

SEQ ID NO: 365436 - DNA, 20 bp, Artificial Sequence
  chemically synthesized
agattgaaagaacaagaacc

SEQ ID NO: 365437 - DNA, 20 bp, Artificial Sequence
  chemically synthesized
caacataagattgaaagaac

SEQ ID NO: 365438 - DNA, 20 bp, Artificial Sequence
  chemically synthesized
aggaagcaacataagattga

SEQ ID NO: 365439 - DNA, 20 bp, Artificial Sequence
  chemically synthesized
aaaggacaaggaagcaacat

SEQ ID NO: 365440 - DNA, 20 bp, Artificial Sequence
  chemically synthesized
taggttataaaaggacaagg

SEQ ID NO: 365441 - DNA, 20 bp, Artificial Sequence
  chemically synthesized
tagtaggttataaaaggaca

SEQ ID NO: 365442 - DNA, 20 bp, Artificial Sequence
  chemically synthesized
atagtaggttataaaaggac

SEQ ID NO: 365443 - DNA, 20 bp, Artificial Sequence
  chemically synthesized
atcaaatagtaggttataaa

SEQ ID NO: 365444 - DNA, 20 bp, Artificial Sequence
  chemically synthesized
aatcaaatagtaggttataa

SEQ ID NO: 365445 - DNA, 20 bp, Artificial Sequence
  chemically synthesized
tagaaagataatcaaatagt

SEQ ID NO: 365446 - DNA, 20 bp, Artificial Sequence
  chemically synthesized
ttagaaagataatcaaatag

SEQ ID NO: 365447 - DNA, 20 bp, Artificial Sequence
  chemically synthesized
atgttagaaagataatcaaa

SEQ ID NO: 365448 - DNA, 20 bp, Artificial Sequence
  chemically synthesized
aaagaaagacaaatgttaga

SEQ ID NO: 365449 - DNA, 20 bp, Artificial Sequence
  chemically synthesized
gacaaaagaaagacaaatgt

SEQ ID NO: 365450 - DNA, 20 bp, Artificial Sequence
  chemically synthesized
tggtgaagtatgacaaaaga

SEQ ID NO: 365451 - DNA, 20 bp, Artificial Sequence
  chemically synthesized
gatttggtgaagtatgacaa

SEQ ID NO: 365452 - DNA, 20 bp, Artificial Sequence
  chemically synthesized
aagcagaaaacgatttggtg

SEQ ID NO: 365453 - DNA, 20 bp, Artificial Sequence
  chemically synthesized
gttttaagcagaaaacgatt

SEQ ID NO: 365454 - DNA, 20 bp, Artificial Sequence
  chemically synthesized
ggggattgtagggttttaag

SEQ ID NO: 365455 - DNA, 20 bp, Artificial Sequence
  chemically synthesized
tgaggggattgtagggtttt

SEQ ID NO: 365456 - DNA, 20 bp, Artificial Sequence
  chemically synthesized
tacctcatgaggggattgta

SEQ ID NO: 365457 - DNA, 20 bp, Artificial Sequence
  chemically synthesized
ttacctcatgaggggattgt

SEQ ID NO: 365458 - DNA, 20 bp, Artificial Sequence
  chemically synthesized
attacctcatgaggggattg

SEQ ID NO: 365459 - DNA, 20 bp, Artificial Sequence
  chemically synthesized
aaaccctacaatcccctcat

SEQ ID NO: 365460 - DNA, 20 bp, Artificial Sequence
  chemically synthesized
aaccctacaatcccctcatg

SEQ ID NO: 365461 - DNA, 20 bp, Artificial Sequence
  chemically synthesized
gctgggaattacctcatgag

SEQ ID NO: 365462 - DNA, 20 bp, Artificial Sequence
  chemically synthesized
agctgggaattacctcatga

SEQ ID NO: 365463 - DNA, 20 bp, Artificial Sequence
  chemically synthesized
aagctgggaattacctcatg

SEQ ID NO: 365464 - DNA, 20 bp, Artificial Sequence
  chemically synthesized
aaagctgggaattacctcat

SEQ ID NO: 365465 - DNA, 20 bp, Artificial Sequence
  chemically synthesized
tcccctcatgaggtaattcc

SEQ ID NO: 365466 - DNA, 20 bp, Artificial Sequence
  chemically synthesized
agataggtgatgaaaaagct

SEQ ID NO: 365467 - DNA, 20 bp, Artificial Sequence
  chemically synthesized
cagataggtgatgaaaaagc

SEQ ID NO: 365468 - DNA, 20 bp, Artificial Sequence
  chemically synthesized
tttccagataggtgatgaaa

SEQ ID NO: 365469 - DNA, 20 bp, Artificial Sequence
  chemically synthesized
cagctttttcatcacctatc

SEQ ID NO: 365470 - DNA, 20 bp, Artificial Sequence
  chemically synthesized
taaattagggatttccagat

SEQ ID NO: 365471 - DNA, 20 bp, Artificial Sequence
  chemically synthesized
ttaaattagggatttccaga

SEQ ID NO: 365472 - DNA, 20 bp, Artificial Sequence
  chemically synthesized
ctgattaaattagggatttc

SEQ ID NO: 365473 - DNA, 20 bp, Artificial Sequence
  chemically synthesized
gtctttgactgattaaatta

SEQ ID NO: 365474 - DNA, 20 bp, Artificial Sequence
  chemically synthesized
tgtctttgactgattaaatt

SEQ ID NO: 365475 - DNA, 20 bp, Artificial Sequence
  chemically synthesized
ctggaaatccctaatttaat

SEQ ID NO: 365476 - DNA, 20 bp, Artificial Sequence
  chemically synthesized
atgtctttgactgattaaat

SEQ ID NO: 365477 - DNA, 20 bp, Artificial Sequence
  chemically synthesized
atccctaatttaatcagtca

SEQ ID NO: 365478 - DNA, 20 bp, Artificial Sequence
  chemically synthesized
taatcagtcaaagacatatt

SEQ ID NO: 365479 - DNA, 20 bp, Artificial Sequence
  chemically synthesized
tattgagcatgaataaacct

SEQ ID NO: 365480 - DNA, 20 bp, Artificial Sequence
  chemically synthesized
gagcatgaataaacctgagc

SEQ ID NO: 365481 - DNA, 20 bp, Artificial Sequence
  chemically synthesized
agcatgaataaacctgagct

SEQ ID NO: 365482 - DNA, 20 bp, Artificial Sequence
  chemically synthesized
tatgattcagtacctagctc

SEQ ID NO: 365483 - DNA, 20 bp, Artificial Sequence
  chemically synthesized
atatgattcagtacctagct

SEQ ID NO: 365484 - DNA, 20 bp, Artificial Sequence
  chemically synthesized
ctagcatatgattcagtacc

SEQ ID NO: 365485 - DNA, 20 bp, Artificial Sequence
  chemically synthesized
tgatgtactagcatatgatt

SEQ ID NO: 365486 - DNA, 20 bp, Artificial Sequence
  chemically synthesized
ctaggtactgaatcatatgc

SEQ ID NO: 365487 - DNA, 20 bp, Artificial Sequence
  chemically synthesized
tgaatcatatgctagtacat

SEQ ID NO: 365488 - DNA, 20 bp, Artificial Sequence
  chemically synthesized
tgggcctatgtctgatgtac

SEQ ID NO: 365489 - DNA, 20 bp, Artificial Sequence
  chemically synthesized
atatgctagtacatcagaca

SEQ ID NO: 365490 - DNA, 20 bp, Artificial Sequence
  chemically synthesized
tatgctagtacatcagacat

SEQ ID NO: 365491 - DNA, 20 bp, Artificial Sequence
  chemically synthesized
tagtacatcagacataggcc

SEQ ID NO: 365492 - DNA, 20 bp, Artificial Sequence
  chemically synthesized
ctctaagttctatagggtct

SEQ ID NO: 365493 - DNA, 20 bp, Artificial Sequence
  chemically synthesized
agacataggcccagacccta

SEQ ID NO: 365494 - DNA, 20 bp, Artificial Sequence
  chemically synthesized
actctaagttctatagggtc

SEQ ID NO: 365495 - DNA, 20 bp, Artificial Sequence
  chemically synthesized
gctggactctaagttctata

SEQ ID NO: 365496 - DNA, 20 bp, Artificial Sequence
  chemically synthesized
tgctggactctaagttctat

SEQ ID NO: 365497 - DNA, 20 bp, Artificial Sequence
  chemically synthesized
ggcccagaccctatagaact

SEQ ID NO: 365498 - DNA, 20 bp, Artificial Sequence
  chemically synthesized
ttgctggactctaagttcta

SEQ ID NO: 365499 - DNA, 20 bp, Artificial Sequence
  chemically synthesized
cccagaccctatagaactta

SEQ ID NO: 365500 - DNA, 20 bp, Artificial Sequence
  chemically synthesized
accctatagaacttagagtc

SEQ ID NO: 365501 - DNA, 20 bp, Artificial Sequence
  chemically synthesized
tattttctttgctggactct

SEQ ID NO: 365502 - DNA, 20 bp, Artificial Sequence
  chemically synthesized
atagaacttagagtccagca

SEQ ID NO: 365503 - DNA, 20 bp, Artificial Sequence
  chemically synthesized
tttaggaatattttctttgc

SEQ ID NO: 365504 - DNA, 20 bp, Artificial Sequence
  chemically synthesized
agcaaagaaaatattcctaa

SEQ ID NO: 365505 - DNA, 20 bp, Artificial Sequence
  chemically synthesized
gcaaagaaaatattcctaaa

SEQ ID NO: 365506 - DNA, 20 bp, Artificial Sequence
  chemically synthesized
tctatgtaatagtacctttt

SEQ ID NO: 365507 - DNA, 20 bp, Artificial Sequence
  chemically synthesized
ttctatgtaatagtaccttt

SEQ ID NO: 365508 - DNA, 20 bp, Artificial Sequence
  chemically synthesized
tcctaaaaggtactattaca

SEQ ID NO: 365509 - DNA, 20 bp, Artificial Sequence
  chemically synthesized
tttctaatgcttctatgtaa

SEQ ID NO: 365510 - DNA, 20 bp, Artificial Sequence
  chemically synthesized
taaaaggtactattacatag

SEQ ID NO: 365511 - DNA, 20 bp, Artificial Sequence
  chemically synthesized
gtactattacatagaagcat

SEQ ID NO: 365512 - DNA, 20 bp, Artificial Sequence
  chemically synthesized
tattacatagaagcattaga

SEQ ID NO: 365513 - DNA, 20 bp, Artificial Sequence
  chemically synthesized
attacatagaagcattagaa

SEQ ID NO: 365514 - DNA, 20 bp, Artificial Sequence
  chemically synthesized
agaagcattagaaaggacta

SEQ ID NO: 365515 - DNA, 20 bp, Artificial Sequence
  chemically synthesized
tcccactgttacatgttctt

SEQ ID NO: 365516 - DNA, 20 bp, Artificial Sequence
  chemically synthesized
aaggactaaagaacatgtaa

SEQ ID NO: 365517 - DNA, 20 bp, Artificial Sequence
  chemically synthesized
gactaaagaacatgtaacag

SEQ ID NO: 365518 - DNA, 20 bp, Artificial Sequence
  chemically synthesized
actaaagaacatgtaacagt

SEQ ID NO: 365519 - DNA, 20 bp, Artificial Sequence
  chemically synthesized
taaagaacatgtaacagtgg

SEQ ID NO: 365520 - DNA, 20 bp, Artificial Sequence
  chemically synthesized
gtaacagtgggagctctcac

SEQ ID NO: 365521 - DNA, 20 bp, Artificial Sequence
  chemically synthesized
gttgatcccaaggcttgtga

SEQ ID NO: 365522 - DNA, 20 bp, Artificial Sequence
  chemically synthesized
ttgttgatcccaaggcttgt

SEQ ID NO: 365523 - DNA, 20 bp, Artificial Sequence
  chemically synthesized
gtgggagctctcacaagcct

SEQ ID NO: 365524 - DNA, 20 bp, Artificial Sequence
  chemically synthesized
tgggagctctcacaagcctt

SEQ ID NO: 365525 - DNA, 20 bp, Artificial Sequence
  chemically synthesized
gaaagtatttgttgatccca

SEQ ID NO: 365526 - DNA, 20 bp, Artificial Sequence
  chemically synthesized
ggaaagtatttgttgatccc

SEQ ID NO: 365527 - DNA, 20 bp, Artificial Sequence
  chemically synthesized
atcacctgacgttttttgga

SEQ ID NO: 365528 - DNA, 20 bp, Artificial Sequence
  chemically synthesized
acccatcacctgacgttttt

SEQ ID NO: 365529 - DNA, 20 bp, Artificial Sequence
  chemically synthesized
aaatactttccaaaaaacgt

SEQ ID NO: 365530 - DNA, 20 bp, Artificial Sequence
  chemically synthesized
aatactttccaaaaaacgtc

SEQ ID NO: 365531 - DNA, 20 bp, Artificial Sequence
  chemically synthesized
ttccaaaaaacgtcaggtga

SEQ ID NO: 365532 - DNA, 20 bp, Artificial Sequence
  chemically synthesized
tccaaaaaacgtcaggtgat

SEQ ID NO: 365533 - DNA, 20 bp, Artificial Sequence
  chemically synthesized
tcaggtgatgggtctaacat

SEQ ID NO: 365534 - DNA, 20 bp, Artificial Sequence
  chemically synthesized
agtcacccaaaggctaatgt

SEQ ID NO: 365535 - DNA, 20 bp, Artificial Sequence
  chemically synthesized
atgggtctaacattagcctt

SEQ ID NO: 365536 - DNA, 20 bp, Artificial Sequence
  chemically synthesized
tgggtctaacattagccttt

SEQ ID NO: 365537 - DNA, 20 bp, Artificial Sequence
  chemically synthesized
taaagagcacagtcacccaa

SEQ ID NO: 365538 - DNA, 20 bp, Artificial Sequence
  chemically synthesized
gtaaagagcacagtcaccca

SEQ ID NO: 365539 - DNA, 20 bp, Artificial Sequence
  chemically synthesized
aggagtgtatgtaaagagca

SEQ ID NO: 365540 - DNA, 20 bp, Artificial Sequence
  chemically synthesized
atccaaggagtgtatgtaaa

SEQ ID NO: 365541 - DNA, 20 bp, Artificial Sequence
  chemically synthesized
tgatccaaggagtgtatgta

SEQ ID NO: 365542 - DNA, 20 bp, Artificial Sequence
  chemically synthesized
tgctctttacatacactcct

SEQ ID NO: 365543 - DNA, 20 bp, Artificial Sequence
  chemically synthesized
aagtttatatgtgatccaag

SEQ ID NO: 365544 - DNA, 20 bp, Artificial Sequence
  chemically synthesized
caaagtttatatgtgatcca

SEQ ID NO: 365545 - DNA, 20 bp, Artificial Sequence
  chemically synthesized
tcaaagtttatatgtgatcc

SEQ ID NO: 365546 - DNA, 20 bp, Artificial Sequence
  chemically synthesized
cttgacttgtgtgaaattca

SEQ ID NO: 365547 - DNA, 20 bp, Artificial Sequence
  chemically synthesized
ataaactttgaatttcacac

SEQ ID NO: 365548 - DNA, 20 bp, Artificial Sequence
  chemically synthesized
ctttgaatttcacacaagtc

SEQ ID NO: 365549 - DNA, 20 bp, Artificial Sequence
  chemically synthesized
acacaagtcaagaaaatccc

SEQ ID NO: 365550 - DNA, 20 bp, Artificial Sequence
  chemically synthesized
tcaagaaaatccctggtttc

SEQ ID NO: 365551 - DNA, 20 bp, Artificial Sequence
  chemically synthesized
tgtcttttgcctggaaacca

SEQ ID NO: 365552 - DNA, 20 bp, Artificial Sequence
  chemically synthesized
caagaaaatccctggtttcc

SEQ ID NO: 365553 - DNA, 20 bp, Artificial Sequence
  chemically synthesized
atgtcttttgcctggaaacc

SEQ ID NO: 365554 - DNA, 20 bp, Artificial Sequence
  chemically synthesized
gatgtcttttgcctggaaac

SEQ ID NO: 365555 - DNA, 20 bp, Artificial Sequence
  chemically synthesized
aatccctggtttccaggcaa

SEQ ID NO: 365556 - DNA, 20 bp, Artificial Sequence
  chemically synthesized
tttaagggatgtcttttgcc

SEQ ID NO: 365557 - DNA, 20 bp, Artificial Sequence
  chemically synthesized
ttttaatcgtggaagtttaa

SEQ ID NO: 365558 - DNA, 20 bp, Artificial Sequence
  chemically synthesized
tttttaatcgtggaagttta

SEQ ID NO: 365559 - DNA, 20 bp, Artificial Sequence
  chemically synthesized
gtttttaatcgtggaagttt

SEQ ID NO: 365560 - DNA, 20 bp, Artificial Sequence
  chemically synthesized
tcctatgtttttaatcgtgg

SEQ ID NO: 365561 - DNA, 20 bp, Artificial Sequence
  chemically synthesized
aaatcctatgtttttaatcg

SEQ ID NO: 365562 - DNA, 20 bp, Artificial Sequence
  chemically synthesized
aacttccacgattaaaaaca

SEQ ID NO: 365563 - DNA, 20 bp, Artificial Sequence
  chemically synthesized
acttccacgattaaaaacat

SEQ ID NO: 365564 - DNA, 20 bp, Artificial Sequence
  chemically synthesized
acgattaaaaacataggatt

SEQ ID NO: 365565 - DNA, 20 bp, Artificial Sequence
  chemically synthesized
tggctacctggttgtaggaa

SEQ ID NO: 365566 - DNA, 20 bp, Artificial Sequence
  chemically synthesized
atttagactattcctacaac

SEQ ID NO: 365567 - DNA, 20 bp, Artificial Sequence
  chemically synthesized
tttagactattcctacaacc

SEQ ID NO: 365568 - DNA, 20 bp, Artificial Sequence
  chemically synthesized
tgacatggctacctggttgt

SEQ ID NO: 365569 - DNA, 20 bp, Artificial Sequence
  chemically synthesized
ttgacatggctacctggttg

SEQ ID NO: 365570 - DNA, 20 bp, Artificial Sequence
  chemically synthesized
agactattcctacaaccagg

SEQ ID NO: 365571 - DNA, 20 bp, Artificial Sequence
  chemically synthesized
ttgtcattgacatggctacc

SEQ ID NO: 365572 - DNA, 20 bp, Artificial Sequence
  chemically synthesized
tacaggtcttgtcattgaca

SEQ ID NO: 365573 - DNA, 20 bp, Artificial Sequence
  chemically synthesized
caggtagccatgtcaatgac

SEQ ID NO: 365574 - DNA, 20 bp, Artificial Sequence
  chemically synthesized
tgaagtacccgggcatttac

SEQ ID NO: 365575 - DNA, 20 bp, Artificial Sequence
  chemically synthesized
ttgaagtacccgggcattta

SEQ ID NO: 365576 - DNA, 20 bp, Artificial Sequence
  chemically synthesized
tgacaagacctgtaaatgcc

SEQ ID NO: 365577 - DNA, 20 bp, Artificial Sequence
  chemically synthesized
gacaagacctgtaaatgccc

SEQ ID NO: 365578 - DNA, 20 bp, Artificial Sequence
  chemically synthesized
gttccctgcttgaagtaccc

SEQ ID NO: 365579 - DNA, 20 bp, Artificial Sequence
  chemically synthesized
tgttccctgcttgaagtacc

SEQ ID NO: 365580 - DNA, 20 bp, Artificial Sequence
  chemically synthesized
tgtaaatgcccgggtacttc

SEQ ID NO: 365581 - DNA, 20 bp, Artificial Sequence
  chemically synthesized
aaatgcccgggtacttcaag

SEQ ID NO: 365582 - DNA, 20 bp, Artificial Sequence
  chemically synthesized
aatgcccgggtacttcaagc

SEQ ID NO: 365583 - DNA, 20 bp, Artificial Sequence
  chemically synthesized
atgcccgggtacttcaagca

SEQ ID NO: 365584 - DNA, 20 bp, Artificial Sequence
  chemically synthesized
gtatcattgttccctgcttg

SEQ ID NO: 365585 - DNA, 20 bp, Artificial Sequence
  chemically synthesized
gcagggaacaatgatacctg

SEQ ID NO: 365586 - DNA, 20 bp, Artificial Sequence
  chemically synthesized
agggactggttggttgccgc

SEQ ID NO: 365587 - DNA, 20 bp, Artificial Sequence
  chemically synthesized
cagggactggttggttgccg

SEQ ID NO: 365588 - DNA, 20 bp, Artificial Sequence
  chemically synthesized
tgatacctgcggcaaccaac

SEQ ID NO: 365589 - DNA, 20 bp, Artificial Sequence
  chemically synthesized
ctgggcacacagggactggt

SEQ ID NO: 365590 - DNA, 20 bp, Artificial Sequence
  chemically synthesized
aaagctgggcacacagggac

SEQ ID NO: 365591 - DNA, 20 bp, Artificial Sequence
  chemically synthesized
ttcacaaagctgggcacaca

SEQ ID NO: 365592 - DNA, 20 bp, Artificial Sequence
  chemically synthesized
ccaaccagtccctgtgtgcc

SEQ ID NO: 365593 - DNA, 20 bp, Artificial Sequence
  chemically synthesized
attcacaaagctgggcacac

SEQ ID NO: 365594 - DNA, 20 bp, Artificial Sequence
  chemically synthesized
gattcacaaagctgggcaca

SEQ ID NO: 365595 - DNA, 20 bp, Artificial Sequence
  chemically synthesized
gtggctggattcacaaagct

SEQ ID NO: 365596 - DNA, 20 bp, Artificial Sequence
  chemically synthesized
tgtggctggattcacaaagc

SEQ ID NO: 365597 - DNA, 20 bp, Artificial Sequence
  chemically synthesized
tatatgtggctggattcaca

SEQ ID NO: 365598 - DNA, 20 bp, Artificial Sequence
  chemically synthesized
tgtgcccagctttgtgaatc

SEQ ID NO: 365599 - DNA, 20 bp, Artificial Sequence
  chemically synthesized
tgtctaagtatatatgtggc

SEQ ID NO: 365600 - DNA, 20 bp, Artificial Sequence
  chemically synthesized
tttttgtctaagtatatatg

SEQ ID NO: 365601 - DNA, 20 bp, Artificial Sequence
  chemically synthesized
aatccagccacatatatact

SEQ ID NO: 365602 - DNA, 20 bp, Artificial Sequence
  chemically synthesized
ataactcataatttttgtct

SEQ ID NO: 365603 - DNA, 20 bp, Artificial Sequence
  chemically synthesized
tatacttagacaaaaattat

SEQ ID NO: 365604 - DNA, 20 bp, Artificial Sequence
  chemically synthesized
ctatttgagtagaatttcaa

SEQ ID NO: 365605 - DNA, 20 bp, Artificial Sequence
  chemically synthesized
cttttgaaattctactcaaa

SEQ ID NO: 365606 - DNA, 20 bp, Artificial Sequence
  chemically synthesized
tgaaaatggatctatttgag

SEQ ID NO: 365607 - DNA, 20 bp, Artificial Sequence
  chemically synthesized
atttgaaaatggatctattt

SEQ ID NO: 365608 - DNA, 20 bp, Artificial Sequence
  chemically synthesized
tttcccatggaatttgaaaa

SEQ ID NO: 365609 - DNA, 20 bp, Artificial Sequence
  chemically synthesized
agatccattttcaaattcca

SEQ ID NO: 365610 - DNA, 20 bp, Artificial Sequence
  chemically synthesized
gatccattttcaaattccat

SEQ ID NO: 365611 - DNA, 20 bp, Artificial Sequence
  chemically synthesized
ttttcaaattccatgggaaa

SEQ ID NO: 365612 - DNA, 20 bp, Artificial Sequence
  chemically synthesized
gtgttatgttctttttccca

SEQ ID NO: 365613 - DNA, 20 bp, Artificial Sequence
  chemically synthesized
ttaaaaattctagcatgtta

SEQ ID NO: 365614 - DNA, 20 bp, Artificial Sequence
  chemically synthesized
aacacaaaaccctaacatgc

SEQ ID NO: 365615 - DNA, 20 bp, Artificial Sequence
  chemically synthesized
tttaaaaattctagcatgtt

SEQ ID NO: 365616 - DNA, 20 bp, Artificial Sequence
  chemically synthesized
ctttaaaaattctagcatgt

SEQ ID NO: 365617 - DNA, 20 bp, Artificial Sequence
  chemically synthesized
aagctattctttaaaaattc

SEQ ID NO: 365618 - DNA, 20 bp, Artificial Sequence
  chemically synthesized
ctaacatgctagaattttta

SEQ ID NO: 365619 - DNA, 20 bp, Artificial Sequence
  chemically synthesized
atgctagaatttttaaagaa

SEQ ID NO: 365620 - DNA, 20 bp, Artificial Sequence
  chemically synthesized
tttttaaagaatagctttac

SEQ ID NO: 365621 - DNA, 20 bp, Artificial Sequence
  chemically synthesized
ttttaaagaatagctttact

SEQ ID NO: 365622 - DNA, 20 bp, Artificial Sequence
  chemically synthesized
ttaaagaatagctttactag

SEQ ID NO: 365623 - DNA, 20 bp, Artificial Sequence
  chemically synthesized
taaagaatagctttactagg

SEQ ID NO: 365624 - DNA, 20 bp, Artificial Sequence
  chemically synthesized
gttctgcctccctcctagta

SEQ ID NO: 365625 - DNA, 20 bp, Artificial Sequence
  chemically synthesized
aaagaatagctttactagga

SEQ ID NO: 365626 - DNA, 20 bp, Artificial Sequence
  chemically synthesized
agaatagctttactaggagg

SEQ ID NO: 365627 - DNA, 20 bp, Artificial Sequence
  chemically synthesized
gaatagctttactaggaggg

SEQ ID NO: 365628 - DNA, 20 bp, Artificial Sequence
  chemically synthesized
gtcttgttctgcctccctcc

SEQ ID NO: 365629 - DNA, 20 bp, Artificial Sequence
  chemically synthesized
tagctttactaggagggagg

SEQ ID NO: 365630 - DNA, 20 bp, Artificial Sequence
  chemically synthesized
tactaggagggaggcagaac

SEQ ID NO: 365631 - DNA, 20 bp, Artificial Sequence
  chemically synthesized
aggagggaggcagaacaaga

SEQ ID NO: 365632 - DNA, 20 bp, Artificial Sequence
  chemically synthesized
gaacaagacggtcaaataca

SEQ ID NO: 365633 - DNA, 20 bp, Artificial Sequence
  chemically synthesized
gtcaaatacatggaaccttc

SEQ ID NO: 365634 - DNA, 20 bp, Artificial Sequence
  chemically synthesized
cgggaaagatgattgctgga

SEQ ID NO: 365635 - DNA, 20 bp, Artificial Sequence
  chemically synthesized
gcgggaaagatgattgctgg

SEQ ID NO: 365636 - DNA, 20 bp, Artificial Sequence
  chemically synthesized
gtagcgggaaagatgattgc

SEQ ID NO: 365637 - DNA, 20 bp, Artificial Sequence
  chemically synthesized
ctatagcagcggtagcggga

SEQ ID NO: 365638 - DNA, 20 bp, Artificial Sequence
  chemically synthesized
gtttctatagcagcggtagc

SEQ ID NO: 365639 - DNA, 20 bp, Artificial Sequence
  chemically synthesized
tgtttctatagcagcggtag

SEQ ID NO: 365640 - DNA, 20 bp, Artificial Sequence
  chemically synthesized
tggtgtttctatagcagcgg

SEQ ID NO: 365641 - DNA, 20 bp, Artificial Sequence
  chemically synthesized
ctttcccgctaccgctgcta

SEQ ID NO: 365642 - DNA, 20 bp, Artificial Sequence
  chemically synthesized
gtttggtgtttctatagcag

SEQ ID NO: 365643 - DNA, 20 bp, Artificial Sequence
  chemically synthesized
tcagtttggtgtttctatag

SEQ ID NO: 365644 - DNA, 20 bp, Artificial Sequence
  chemically synthesized
tgttcagtttggtgtttcta

SEQ ID NO: 365645 - DNA, 20 bp, Artificial Sequence
  chemically synthesized
tatagaaacaccaaactgaa

SEQ ID NO: 365646 - DNA, 20 bp, Artificial Sequence
  chemically synthesized
gtgtggctatctgttcagtt

SEQ ID NO: 365647 - DNA, 20 bp, Artificial Sequence
  chemically synthesized
gaaacaccaaactgaacaga

SEQ ID NO: 365648 - DNA, 20 bp, Artificial Sequence
  chemically synthesized
tgcttgtgtggctatctgtt

SEQ ID NO: 365649 - DNA, 20 bp, Artificial Sequence
  chemically synthesized
aactgaacagatagccacac

SEQ ID NO: 365650 - DNA, 20 bp, Artificial Sequence
  chemically synthesized
gaacagatagccacacaagc

SEQ ID NO: 365651 - DNA, 20 bp, Artificial Sequence
  chemically synthesized
tatgtaggtgcttgcttgtg

SEQ ID NO: 365652 - DNA, 20 bp, Artificial Sequence
  chemically synthesized
ttgatttttggtttttatgt

SEQ ID NO: 365653 - DNA, 20 bp, Artificial Sequence
  chemically synthesized
cttgatttttggtttttatg

SEQ ID NO: 365654 - DNA, 20 bp, Artificial Sequence
  chemically synthesized
ctacataaaaaccaaaaatc

SEQ ID NO: 365655 - DNA, 20 bp, Artificial Sequence
  chemically synthesized
gtgattgctcacttgatttt

SEQ ID NO: 365656 - DNA, 20 bp, Artificial Sequence
  chemically synthesized
ataaaaaccaaaaatcaagt

SEQ ID NO: 365657 - DNA, 20 bp, Artificial Sequence
  chemically synthesized
aaaaatcaagtgagcaatca

SEQ ID NO: 365658 - DNA, 20 bp, Artificial Sequence
  chemically synthesized
cttgatatgatattaaaatc

SEQ ID NO: 365659 - DNA, 20 bp, Artificial Sequence
  chemically synthesized
cttgattttaatatcatatc

SEQ ID NO: 365660 - DNA, 20 bp, Artificial Sequence
  chemically synthesized
ttgattttaatatcatatca

SEQ ID NO: 365661 - DNA, 20 bp, Artificial Sequence
  chemically synthesized
ttttaatatcatatcaagga

SEQ ID NO: 365662 - DNA, 20 bp, Artificial Sequence
  chemically synthesized
ttaatatcatatcaaggaaa

SEQ ID NO: 365663 - DNA, 20 bp, Artificial Sequence
  chemically synthesized
taatatcatatcaaggaaag

SEQ ID NO: 365664 - DNA, 20 bp, Artificial Sequence
  chemically synthesized
tatcaaggaaagaggcactg

SEQ ID NO: 365665 - DNA, 20 bp, Artificial Sequence
  chemically synthesized
aaggaaagaggcactgaaga

SEQ ID NO: 365666 - DNA, 20 bp, Artificial Sequence
  chemically synthesized
gaaagaggcactgaagatgg

SEQ ID NO: 365667 - DNA, 20 bp, Artificial Sequence
  chemically synthesized
actgtctttcctaccatctt

SEQ ID NO: 365668 - DNA, 20 bp, Artificial Sequence
  chemically synthesized
aaagaggcactgaagatggt

SEQ ID NO: 365669 - DNA, 20 bp, Artificial Sequence
  chemically synthesized
aggcactgaagatggtagga

SEQ ID NO: 365670 - DNA, 20 bp, Artificial Sequence
  chemically synthesized
actgaagatggtaggaaaga

SEQ ID NO: 365671 - DNA, 20 bp, Artificial Sequence
  chemically synthesized
ggatgggggaggggtggtgt

SEQ ID NO: 365672 - DNA, 20 bp, Artificial Sequence
  chemically synthesized
gccaggggatgggggagggg

SEQ ID NO: 365673 - DNA, 20 bp, Artificial Sequence
  chemically synthesized
tctgccaggggatgggggag

SEQ ID NO: 365674 - DNA, 20 bp, Artificial Sequence
  chemically synthesized
ctctgccaggggatggggga

SEQ ID NO: 365675 - DNA, 20 bp, Artificial Sequence
  chemically synthesized
cctctgccaggggatggggg

SEQ ID NO: 365676 - DNA, 20 bp, Artificial Sequence
  chemically synthesized
gcctctgccaggggatgggg

SEQ ID NO: 365677 - DNA, 20 bp, Artificial Sequence
  chemically synthesized
tggcctctgccaggggatgg

SEQ ID NO: 365678 - DNA, 20 bp, Artificial Sequence
  chemically synthesized
accacccctcccccatcccc

SEQ ID NO: 365679 - DNA, 20 bp, Artificial Sequence
  chemically synthesized
atggcctctgccaggggatg

SEQ ID NO: 365680 - DNA, 20 bp, Artificial Sequence
  chemically synthesized
catggcctctgccaggggat

SEQ ID NO: 365681 - DNA, 20 bp, Artificial Sequence
  chemically synthesized
acatggcctctgccagggga

SEQ ID NO: 365682 - DNA, 20 bp, Artificial Sequence
  chemically synthesized
acccctcccccatcccctgg

SEQ ID NO: 365683 - DNA, 20 bp, Artificial Sequence
  chemically synthesized
ccctcccccatcccctggca

SEQ ID NO: 365684 - DNA, 20 bp, Artificial Sequence
  chemically synthesized
cctcccccatcccctggcag

SEQ ID NO: 365685 - DNA, 20 bp, Artificial Sequence
  chemically synthesized
tgagacatggcctctgccag

SEQ ID NO: 365686 - DNA, 20 bp, Artificial Sequence
  chemically synthesized
atgagacatggcctctgcca

SEQ ID NO: 365687 - DNA, 20 bp, Artificial Sequence
  chemically synthesized
catgagacatggcctctgcc

SEQ ID NO: 365688 - DNA, 20 bp, Artificial Sequence
  chemically synthesized
acatgagacatggcctctgc

SEQ ID NO: 365689 - DNA, 20 bp, Artificial Sequence
  chemically synthesized
cagatcgtctacatgagaca

SEQ ID NO: 365690 - DNA, 20 bp, Artificial Sequence
  chemically synthesized
ggcagaggccatgtctcatg

SEQ ID NO: 365691 - DNA, 20 bp, Artificial Sequence
  chemically synthesized
agcacacagatcgtctacat

SEQ ID NO: 365692 - DNA, 20 bp, Artificial Sequence
  chemically synthesized
ccctccctcctgcaagcaca

SEQ ID NO: 365693 - DNA, 20 bp, Artificial Sequence
  chemically synthesized
gtagacgatctgtgtgcttg

SEQ ID NO: 365694 - DNA, 20 bp, Artificial Sequence
  chemically synthesized
tagacgatctgtgtgcttgc

SEQ ID NO: 365695 - DNA, 20 bp, Artificial Sequence
  chemically synthesized
gacgatctgtgtgcttgcag

SEQ ID NO: 365696 - DNA, 20 bp, Artificial Sequence
  chemically synthesized
acgatctgtgtgcttgcagg

SEQ ID NO: 365697 - DNA, 20 bp, Artificial Sequence
  chemically synthesized
cgatctgtgtgcttgcagga

SEQ ID NO: 365698 - DNA, 20 bp, Artificial Sequence
  chemically synthesized
tcctgcgccctccctcctgc

SEQ ID NO: 365699 - DNA, 20 bp, Artificial Sequence
  chemically synthesized
atctgtgtgcttgcaggagg

SEQ ID NO: 365700 - DNA, 20 bp, Artificial Sequence
  chemically synthesized
tctgtgtgcttgcaggaggg

SEQ ID NO: 365701 - DNA, 20 bp, Artificial Sequence
  chemically synthesized
ctgtgtgcttgcaggaggga

SEQ ID NO: 365702 - DNA, 20 bp, Artificial Sequence
  chemically synthesized
tgcttgcaggagggagggcg

SEQ ID NO: 365703 - DNA, 20 bp, Artificial Sequence
  chemically synthesized
gcttgcaggagggagggcgc

SEQ ID NO: 365704 - DNA, 20 bp, Artificial Sequence
  chemically synthesized
aggattgtgaaacgttgcat

SEQ ID NO: 365705 - DNA, 20 bp, Artificial Sequence
  chemically synthesized
tgaaacgttgcattggaacc

SEQ ID NO: 365706 - DNA, 20 bp, Artificial Sequence
  chemically synthesized
cactgtgacagggcagcact

SEQ ID NO: 365707 - DNA, 20 bp, Artificial Sequence
  chemically synthesized
ccactgtgacagggcagcac

SEQ ID NO: 365708 - DNA, 20 bp, Artificial Sequence
  chemically synthesized
tgcttcccactgtgacaggg

SEQ ID NO: 365709 - DNA, 20 bp, Artificial Sequence
  chemically synthesized
aacccagtgctgccctgtca

SEQ ID NO: 365710 - DNA, 20 bp, Artificial Sequence
  chemically synthesized
tgttgcttcccactgtgaca

SEQ ID NO: 365711 - DNA, 20 bp, Artificial Sequence
  chemically synthesized
ccagtgctgccctgtcacag

SEQ ID NO: 365712 - DNA, 20 bp, Artificial Sequence
  chemically synthesized
gtgttgcttcccactgtgac

SEQ ID NO: 365713 - DNA, 20 bp, Artificial Sequence
  chemically synthesized
cagtgctgccctgtcacagt

SEQ ID NO: 365714 - DNA, 20 bp, Artificial Sequence
  chemically synthesized
tgtgttgcttcccactgtga

SEQ ID NO: 365715 - DNA, 20 bp, Artificial Sequence
  chemically synthesized
tgctgccctgtcacagtggg

SEQ ID NO: 365716 - DNA, 20 bp, Artificial Sequence
  chemically synthesized
tgtcacagtgggaagcaaca

SEQ ID NO: 365717 - DNA, 20 bp, Artificial Sequence
  chemically synthesized
gtcacagtgggaagcaacac

SEQ ID NO: 365718 - DNA, 20 bp, Artificial Sequence
  chemically synthesized
tcacagtgggaagcaacaca

SEQ ID NO: 365719 - DNA, 20 bp, Artificial Sequence
  chemically synthesized
cagtgggaagcaacacaggg

SEQ ID NO: 365720 - DNA, 20 bp, Artificial Sequence
  chemically synthesized
aacacagggcagaattcatc

SEQ ID NO: 365721 - DNA, 20 bp, Artificial Sequence
  chemically synthesized
cagaattcatcaagcgcaca

SEQ ID NO: 365722 - DNA, 20 bp, Artificial Sequence
  chemically synthesized
gaattcatcaagcgcacata

SEQ ID NO: 365723 - DNA, 20 bp, Artificial Sequence
  chemically synthesized
aattcatcaagcgcacatag

SEQ ID NO: 365724 - DNA, 20 bp, Artificial Sequence
  chemically synthesized
attcatcaagcgcacataga

SEQ ID NO: 365725 - DNA, 20 bp, Artificial Sequence
  chemically synthesized
gcgcacatagagggcacatt

SEQ ID NO: 365726 - DNA, 20 bp, Artificial Sequence
  chemically synthesized
catagagggcacatttagac

SEQ ID NO: 365727 - DNA, 20 bp, Artificial Sequence
  chemically synthesized
gatacctccctggatagggc

SEQ ID NO: 365728 - DNA, 20 bp, Artificial Sequence
  chemically synthesized
acatttagaccagccctatc

SEQ ID NO: 365729 - DNA, 20 bp, Artificial Sequence
  chemically synthesized
catttagaccagccctatcc

SEQ ID NO: 365730 - DNA, 20 bp, Artificial Sequence
  chemically synthesized
atttagaccagccctatcca

SEQ ID NO: 365731 - DNA, 20 bp, Artificial Sequence
  chemically synthesized
gggtgatacctccctggata

SEQ ID NO: 365732 - DNA, 20 bp, Artificial Sequence
  chemically synthesized
ttagaccagccctatccagg

SEQ ID NO: 365733 - DNA, 20 bp, Artificial Sequence
  chemically synthesized
tgggtgatacctccctggat

SEQ ID NO: 365734 - DNA, 20 bp, Artificial Sequence
  chemically synthesized
tagaccagccctatccaggg

SEQ ID NO: 365735 - DNA, 20 bp, Artificial Sequence
  chemically synthesized
atgggtgatacctccctgga

SEQ ID NO: 365736 - DNA, 20 bp, Artificial Sequence
  chemically synthesized
tgagatgggtgatacctccc

SEQ ID NO: 365737 - DNA, 20 bp, Artificial Sequence
  chemically synthesized
cagggaggtatcacccatct

SEQ ID NO: 365738 - DNA, 20 bp, Artificial Sequence
  chemically synthesized
ggaggtatcacccatctcag

SEQ ID NO: 365739 - DNA, 20 bp, Artificial Sequence
  chemically synthesized
cagcttctaactgctgagat

SEQ ID NO: 365740 - DNA, 20 bp, Artificial Sequence
  chemically synthesized
tcagcttctaactgctgaga

SEQ ID NO: 365741 - DNA, 20 bp, Artificial Sequence
  chemically synthesized
gtatcacccatctcagcagt

SEQ ID NO: 365742 - DNA, 20 bp, Artificial Sequence
  chemically synthesized
gaactcagcttctaactgct

SEQ ID NO: 365743 - DNA, 20 bp, Artificial Sequence
  chemically synthesized
tcacccatctcagcagttag

SEQ ID NO: 365744 - DNA, 20 bp, Artificial Sequence
  chemically synthesized
catctcagcagttagaagct

SEQ ID NO: 365745 - DNA, 20 bp, Artificial Sequence
  chemically synthesized
agcagttagaagctgagttc

SEQ ID NO: 365746 - DNA, 20 bp, Artificial Sequence
  chemically synthesized
tggtgagactagctggaact

SEQ ID NO: 365747 - DNA, 20 bp, Artificial Sequence
  chemically synthesized
gttagaagctgagttccagc

SEQ ID NO: 365748 - DNA, 20 bp, Artificial Sequence
  chemically synthesized
ctcacactggtgagactagc

SEQ ID NO: 365749 - DNA, 20 bp, Artificial Sequence
  chemically synthesized
tgagttccagctagtctcac

SEQ ID NO: 365750 - DNA, 20 bp, Artificial Sequence
  chemically synthesized
tgagctcacactggtgagac

SEQ ID NO: 365751 - DNA, 20 bp, Artificial Sequence
  chemically synthesized
gtgcttgagctcacactggt

SEQ ID NO: 365752 - DNA, 20 bp, Artificial Sequence
  chemically synthesized
ccagctagtctcaccagtgt

SEQ ID NO: 365753 - DNA, 20 bp, Artificial Sequence
  chemically synthesized
caaagtgcttgagctcacac

SEQ ID NO: 365754 - DNA, 20 bp, Artificial Sequence
  chemically synthesized
agtctcaccagtgtgagctc

SEQ ID NO: 365755 - DNA, 20 bp, Artificial Sequence
  chemically synthesized
tttaggaccccaaagtgctt

SEQ ID NO: 365756 - DNA, 20 bp, Artificial Sequence
  chemically synthesized
cagtgtgagctcaagcactt

SEQ ID NO: 365757 - DNA, 20 bp, Artificial Sequence
  chemically synthesized
agtgtgagctcaagcacttt

SEQ ID NO: 365758 - DNA, 20 bp, Artificial Sequence
  chemically synthesized
gtgtgagctcaagcactttg

SEQ ID NO: 365759 - DNA, 20 bp, Artificial Sequence
  chemically synthesized
gaagtttatttaggacccca

SEQ ID NO: 365760 - DNA, 20 bp, Artificial Sequence
  chemically synthesized
actccctttgaagtttattt

SEQ ID NO: 365761 - DNA, 20 bp, Artificial Sequence
  chemically synthesized
gactccctttgaagtttatt

SEQ ID NO: 365762 - DNA, 20 bp, Artificial Sequence
  chemically synthesized
ggggtcctaaataaacttca

SEQ ID NO: 365763 - DNA, 20 bp, Artificial Sequence
  chemically synthesized
gggtcctaaataaacttcaa

SEQ ID NO: 365764 - DNA, 20 bp, Artificial Sequence
  chemically synthesized
ggtcctaaataaacttcaaa

SEQ ID NO: 365765 - DNA, 20 bp, Artificial Sequence
  chemically synthesized
tcctaaataaacttcaaagg

SEQ ID NO: 365766 - DNA, 20 bp, Artificial Sequence
  chemically synthesized
tgtagcctagactccctttg

SEQ ID NO: 365767 - DNA, 20 bp, Artificial Sequence
  chemically synthesized
aataaacttcaaagggagtc

SEQ ID NO: 365768 - DNA, 20 bp, Artificial Sequence
  chemically synthesized
ataaacttcaaagggagtct

SEQ ID NO: 365769 - DNA, 20 bp, Artificial Sequence
  chemically synthesized
gaattgcagtttttgtagcc

SEQ ID NO: 365770 - DNA, 20 bp, Artificial Sequence
  chemically synthesized
cccaggaattgcagtttttg

SEQ ID NO: 365771 - DNA, 20 bp, Artificial Sequence
  chemically synthesized
gctacaaaaactgcaattcc

SEQ ID NO: 365772 - DNA, 20 bp, Artificial Sequence
  chemically synthesized
caagacttgcccaggaattg

SEQ ID NO: 365773 - DNA, 20 bp, Artificial Sequence
  chemically synthesized
ctacaaaaactgcaattcct

SEQ ID NO: 365774 - DNA, 20 bp, Artificial Sequence
  chemically synthesized
aaaaactgcaattcctgggc

SEQ ID NO: 365775 - DNA, 20 bp, Artificial Sequence
  chemically synthesized
cacgacaccaagacttgccc

SEQ ID NO: 365776 - DNA, 20 bp, Artificial Sequence
  chemically synthesized
gcacgacaccaagacttgcc

SEQ ID NO: 365777 - DNA, 20 bp, Artificial Sequence
  chemically synthesized
tgcaattcctgggcaagtct

SEQ ID NO: 365778 - DNA, 20 bp, Artificial Sequence
  chemically synthesized
ttcgagtccagcacgacacc

SEQ ID NO: 365779 - DNA, 20 bp, Artificial Sequence
  chemically synthesized
ggcaagtcttggtgtcgtgc

SEQ ID NO: 365780 - DNA, 20 bp, Artificial Sequence
  chemically synthesized
ttggtgtcgtgctggactcg

SEQ ID NO: 365781 - DNA, 20 bp, Artificial Sequence
  chemically synthesized
aagtcccctgacttcgagtc

SEQ ID NO: 365782 - DNA, 20 bp, Artificial Sequence
  chemically synthesized
tgtcgtgctggactcgaagt

SEQ ID NO: 365783 - DNA, 20 bp, Artificial Sequence
  chemically synthesized
gtcgtgctggactcgaagtc

SEQ ID NO: 365784 - DNA, 20 bp, Artificial Sequence
  chemically synthesized
tcgtgctggactcgaagtca

SEQ ID NO: 365785 - DNA, 20 bp, Artificial Sequence
  chemically synthesized
ccaccaagtcccctgacttc

SEQ ID NO: 365786 - DNA, 20 bp, Artificial Sequence
  chemically synthesized
cgtgctggactcgaagtcag

SEQ ID NO: 365787 - DNA, 20 bp, Artificial Sequence
  chemically synthesized
ggactcgaagtcaggggact

SEQ ID NO: 365788 - DNA, 20 bp, Artificial Sequence
  chemically synthesized
ctcgaagtcaggggacttgg

SEQ ID NO: 365789 - DNA, 20 bp, Artificial Sequence
  chemically synthesized
tcgaagtcaggggacttggt

SEQ ID NO: 365790 - DNA, 20 bp, Artificial Sequence
  chemically synthesized
tactgggttgtgtgcccacc

SEQ ID NO: 365791 - DNA, 20 bp, Artificial Sequence
  chemically synthesized
gacttggtgggcacacaacc

SEQ ID NO: 365792 - DNA, 20 bp, Artificial Sequence
  chemically synthesized
tggtgggcacacaacccagt

SEQ ID NO: 365793 - DNA, 20 bp, Artificial Sequence
  chemically synthesized
acaagcactggtgtcttact

SEQ ID NO: 365794 - DNA, 20 bp, Artificial Sequence
  chemically synthesized
tacaagcactggtgtcttac

SEQ ID NO: 365795 - DNA, 20 bp, Artificial Sequence
  chemically synthesized
cacacaacccagtaagacac

SEQ ID NO: 365796 - DNA, 20 bp, Artificial Sequence
  chemically synthesized
ggatggggtggtacaagcac

SEQ ID NO: 365797 - DNA, 20 bp, Artificial Sequence
  chemically synthesized
gttagaggatggggtggtac

SEQ ID NO: 365798 - DNA, 20 bp, Artificial Sequence
  chemically synthesized
ttaggggttagaggatgggg

SEQ ID NO: 365799 - DNA, 20 bp, Artificial Sequence
  chemically synthesized
ctgttaggggttagaggatg

SEQ ID NO: 365800 - DNA, 20 bp, Artificial Sequence
  chemically synthesized
actgttaggggttagaggat

SEQ ID NO: 365801 - DNA, 20 bp, Artificial Sequence
  chemically synthesized
cactgttaggggttagagga

SEQ ID NO: 365802 - DNA, 20 bp, Artificial Sequence
  chemically synthesized
gctgcactgttaggggttag

SEQ ID NO: 365803 - DNA, 20 bp, Artificial Sequence
  chemically synthesized
agctgcactgttaggggtta

SEQ ID NO: 365804 - DNA, 20 bp, Artificial Sequence
  chemically synthesized
tcagctgcactgttaggggt

SEQ ID NO: 365805 - DNA, 20 bp, Artificial Sequence
  chemically synthesized
ccccatcctctaacccctaa

SEQ ID NO: 365806 - DNA, 20 bp, Artificial Sequence
  chemically synthesized
gctgtcagctgcactgttag

SEQ ID NO: 365807 - DNA, 20 bp, Artificial Sequence
  chemically synthesized
agctgtcagctgcactgtta

SEQ ID NO: 365808 - DNA, 20 bp, Artificial Sequence
  chemically synthesized
tcctctaacccctaacagtg

SEQ ID NO: 365809 - DNA, 20 bp, Artificial Sequence
  chemically synthesized
aagctgtcagctgcactgtt

SEQ ID NO: 365810 - DNA, 20 bp, Artificial Sequence
  chemically synthesized
aaagctgtcagctgcactgt

SEQ ID NO: 365811 - DNA, 20 bp, Artificial Sequence
  chemically synthesized
acccctaacagtgcagctga

SEQ ID NO: 365812 - DNA, 20 bp, Artificial Sequence
  chemically synthesized
gcagtctctctcaaagctgt

SEQ ID NO: 365813 - DNA, 20 bp, Artificial Sequence
  chemically synthesized
acagtgcagctgacagcttt

SEQ ID NO: 365814 - DNA, 20 bp, Artificial Sequence
  chemically synthesized
agtgcagctgacagctttga

SEQ ID NO: 365815 - DNA, 20 bp, Artificial Sequence
  chemically synthesized
tgcagctgacagctttgaga

SEQ ID NO: 365816 - DNA, 20 bp, Artificial Sequence
  chemically synthesized
ggaagaagcagtctctctca

SEQ ID NO: 365817 - DNA, 20 bp, Artificial Sequence
  chemically synthesized
ctctcctcaagtggaagaag

SEQ ID NO: 365818 - DNA, 20 bp, Artificial Sequence
  chemically synthesized
atcctctcctcaagtggaag

SEQ ID NO: 365819 - DNA, 20 bp, Artificial Sequence
  chemically synthesized
agagactgcttcttccactt

SEQ ID NO: 365820 - DNA, 20 bp, Artificial Sequence
  chemically synthesized
gagactgcttcttccacttg

SEQ ID NO: 365821 - DNA, 20 bp, Artificial Sequence
  chemically synthesized
cctatcctctcctcaagtgg

SEQ ID NO: 365822 - DNA, 20 bp, Artificial Sequence
  chemically synthesized
gactgcttcttccacttgag

SEQ ID NO: 365823 - DNA, 20 bp, Artificial Sequence
  chemically synthesized
gtccctatcctctcctcaag

SEQ ID NO: 365824 - DNA, 20 bp, Artificial Sequence
  chemically synthesized
ctgcttcttccacttgagga

SEQ ID NO: 365825 - DNA, 20 bp, Artificial Sequence
  chemically synthesized
tgcttcttccacttgaggag

SEQ ID NO: 365826 - DNA, 20 bp, Artificial Sequence
  chemically synthesized
actgtccctatcctctcctc

SEQ ID NO: 365827 - DNA, 20 bp, Artificial Sequence
  chemically synthesized
tcttccacttgaggagagga

SEQ ID NO: 365828 - DNA, 20 bp, Artificial Sequence
  chemically synthesized
cttccacttgaggagaggat

SEQ ID NO: 365829 - DNA, 20 bp, Artificial Sequence
  chemically synthesized
ttccacttgaggagaggata

SEQ ID NO: 365830 - DNA, 20 bp, Artificial Sequence
  chemically synthesized
acttgaggagaggataggga

SEQ ID NO: 365831 - DNA, 20 bp, Artificial Sequence
  chemically synthesized
aggagaggatagggacagta

SEQ ID NO: 365832 - DNA, 20 bp, Artificial Sequence
  chemically synthesized
gatgacattgtcttgcaact

SEQ ID NO: 365833 - DNA, 20 bp, Artificial Sequence
  chemically synthesized
tgagcttgtgtccaagttgc

SEQ ID NO: 365834 - DNA, 20 bp, Artificial Sequence
  chemically synthesized
ttgtcttgcaacttggacac

SEQ ID NO: 365835 - DNA, 20 bp, Artificial Sequence
  chemically synthesized
ctgtggttgagcttgtgtcc

SEQ ID NO: 365836 - DNA, 20 bp, Artificial Sequence
  chemically synthesized
cttggacacaagctcaacca

SEQ ID NO: 365837 - DNA, 20 bp, Artificial Sequence
  chemically synthesized
tgccttatcctactgtggtt

SEQ ID NO: 365838 - DNA, 20 bp, Artificial Sequence
  chemically synthesized
ggacacaagctcaaccacag

SEQ ID NO: 365839 - DNA, 20 bp, Artificial Sequence
  chemically synthesized
gacacaagctcaaccacagt

SEQ ID NO: 365840 - DNA, 20 bp, Artificial Sequence
  chemically synthesized
cctgatgccttatcctactg

SEQ ID NO: 365841 - DNA, 20 bp, Artificial Sequence
  chemically synthesized
aagctcaaccacagtaggat

SEQ ID NO: 365842 - DNA, 20 bp, Artificial Sequence
  chemically synthesized
agctcaaccacagtaggata

SEQ ID NO: 365843 - DNA, 20 bp, Artificial Sequence
  chemically synthesized
accacagtaggataaggcat

SEQ ID NO: 365844 - DNA, 20 bp, Artificial Sequence
  chemically synthesized
ccacagtaggataaggcatc

SEQ ID NO: 365845 - DNA, 20 bp, Artificial Sequence
  chemically synthesized
cagtaggataaggcatcagg

SEQ ID NO: 365846 - DNA, 20 bp, Artificial Sequence
  chemically synthesized
gtaggataaggcatcaggca

SEQ ID NO: 365847 - DNA, 20 bp, Artificial Sequence
  chemically synthesized
aaggcatcaggcagagtcct

SEQ ID NO: 365848 - DNA, 20 bp, Artificial Sequence
  chemically synthesized
ggcctggaatggggggtctc

SEQ ID NO: 365849 - DNA, 20 bp, Artificial Sequence
  chemically synthesized
gggcctggaatggggggtct

SEQ ID NO: 365850 - DNA, 20 bp, Artificial Sequence
  chemically synthesized
agtcctgagaccccccattc

SEQ ID NO: 365851 - DNA, 20 bp, Artificial Sequence
  chemically synthesized
gagccagggcctggaatggg

SEQ ID NO: 365852 - DNA, 20 bp, Artificial Sequence
  chemically synthesized
gtcctgagaccccccattcc

SEQ ID NO: 365853 - DNA, 20 bp, Artificial Sequence
  chemically synthesized
ggagccagggcctggaatgg

SEQ ID NO: 365854 - DNA, 20 bp, Artificial Sequence
  chemically synthesized
aggagccagggcctggaatg

SEQ ID NO: 365855 - DNA, 20 bp, Artificial Sequence
  chemically synthesized
caggagccagggcctggaat

SEQ ID NO: 365856 - DNA, 20 bp, Artificial Sequence
  chemically synthesized
tcaggagccagggcctggaa

SEQ ID NO: 365857 - DNA, 20 bp, Artificial Sequence
  chemically synthesized
agaccccccattccaggccc

SEQ ID NO: 365858 - DNA, 20 bp, Artificial Sequence
  chemically synthesized
gtcactcaggagccagggcc

SEQ ID NO: 365859 - DNA, 20 bp, Artificial Sequence
  chemically synthesized
agaatgtcactcaggagcca

SEQ ID NO: 365860 - DNA, 20 bp, Artificial Sequence
  chemically synthesized
cattccaggccctggctcct

SEQ ID NO: 365861 - DNA, 20 bp, Artificial Sequence
  chemically synthesized
aagaatgtcactcaggagcc

SEQ ID NO: 365862 - DNA, 20 bp, Artificial Sequence
  chemically synthesized
taagaatgtcactcaggagc

SEQ ID NO: 365863 - DNA, 20 bp, Artificial Sequence
  chemically synthesized
tatttaagaatgtcactcag

SEQ ID NO: 365864 - DNA, 20 bp, Artificial Sequence
  chemically synthesized
tgtatttaagaatgtcactc

SEQ ID NO: 365865 - DNA, 20 bp, Artificial Sequence
  chemically synthesized
gtgtatttaagaatgtcact

SEQ ID NO: 365866 - DNA, 20 bp, Artificial Sequence
  chemically synthesized
ttctggccctgggtgtattt

SEQ ID NO: 365867 - DNA, 20 bp, Artificial Sequence
  chemically synthesized
gtgacattcttaaatacacc

SEQ ID NO: 365868 - DNA, 20 bp, Artificial Sequence
  chemically synthesized
tgacattcttaaatacaccc

SEQ ID NO: 365869 - DNA, 20 bp, Artificial Sequence
  chemically synthesized
gacattcttaaatacaccca

SEQ ID NO: 365870 - DNA, 20 bp, Artificial Sequence
  chemically synthesized
ttcttaaatacacccagggc

SEQ ID NO: 365871 - DNA, 20 bp, Artificial Sequence
  chemically synthesized
gcaagttcccttctggccct

SEQ ID NO: 365872 - DNA, 20 bp, Artificial Sequence
  chemically synthesized
ttaaatacacccagggccag

SEQ ID NO: 365873 - DNA, 20 bp, Artificial Sequence
  chemically synthesized
agcaagttcccttctggccc

SEQ ID NO: 365874 - DNA, 20 bp, Artificial Sequence
  chemically synthesized
taaatacacccagggccaga

SEQ ID NO: 365875 - DNA, 20 bp, Artificial Sequence
  chemically synthesized
aaatacacccagggccagaa

SEQ ID NO: 365876 - DNA, 20 bp, Artificial Sequence
  chemically synthesized
caaggtagcaagttcccttc

SEQ ID NO: 365877 - DNA, 20 bp, Artificial Sequence
  chemically synthesized
attcttctcttcaaggtagc

SEQ ID NO: 365878 - DNA, 20 bp, Artificial Sequence
  chemically synthesized
gaagggaacttgctaccttg

SEQ ID NO: 365879 - DNA, 20 bp, Artificial Sequence
  chemically synthesized
agggaacttgctaccttgaa

SEQ ID NO: 365880 - DNA, 20 bp, Artificial Sequence
  chemically synthesized
ctggattcttctcttcaagg

SEQ ID NO: 365881 - DNA, 20 bp, Artificial Sequence
  chemically synthesized
gaacttgctaccttgaagag

SEQ ID NO: 365882 - DNA, 20 bp, Artificial Sequence
  chemically synthesized
ggactggattcttctcttca

SEQ ID NO: 365883 - DNA, 20 bp, Artificial Sequence
  chemically synthesized
aggactggattcttctcttc

SEQ ID NO: 365884 - DNA, 20 bp, Artificial Sequence
  chemically synthesized
ctaccttgaagagaagaatc

SEQ ID NO: 365885 - DNA, 20 bp, Artificial Sequence
  chemically synthesized
tgaagagaagaatccagtcc

SEQ ID NO: 365886 - DNA, 20 bp, Artificial Sequence
  chemically synthesized
agagaagaatccagtcctgg

SEQ ID NO: 365887 - DNA, 20 bp, Artificial Sequence
  chemically synthesized
gtgacgaattctaccaggac

SEQ ID NO: 365888 - DNA, 20 bp, Artificial Sequence
  chemically synthesized
agcaggtgacgaattctacc

SEQ ID NO: 365889 - DNA, 20 bp, Artificial Sequence
  chemically synthesized
cagcaggtgacgaattctac

SEQ ID NO: 365890 - DNA, 20 bp, Artificial Sequence
  chemically synthesized
ccagggactctttagtcagc

SEQ ID NO: 365891 - DNA, 20 bp, Artificial Sequence
  chemically synthesized
aattcgtcacctgctgacta

SEQ ID NO: 365892 - DNA, 20 bp, Artificial Sequence
  chemically synthesized
cccagggactctttagtcag

SEQ ID NO: 365893 - DNA, 20 bp, Artificial Sequence
  chemically synthesized
ttcgtcacctgctgactaaa

SEQ ID NO: 365894 - DNA, 20 bp, Artificial Sequence
  chemically synthesized
ggacccagggactctttagt

SEQ ID NO: 365895 - DNA, 20 bp, Artificial Sequence
  chemically synthesized
ttcaggacccagggactctt

SEQ ID NO: 365896 - DNA, 20 bp, Artificial Sequence
  chemically synthesized
cctgctgactaaagagtccc

SEQ ID NO: 365897 - DNA, 20 bp, Artificial Sequence
  chemically synthesized
ctgctgactaaagagtccct

SEQ ID NO: 365898 - DNA, 20 bp, Artificial Sequence
  chemically synthesized
tgctgcttattcaggaccca

SEQ ID NO: 365899 - DNA, 20 bp, Artificial Sequence
  chemically synthesized
ctgctgcttattcaggaccc

SEQ ID NO: 365900 - DNA, 20 bp, Artificial Sequence
  chemically synthesized
actgctgcttattcaggacc

SEQ ID NO: 365901 - DNA, 20 bp, Artificial Sequence
  chemically synthesized
agagtccctgggtcctgaat

SEQ ID NO: 365902 - DNA, 20 bp, Artificial Sequence
  chemically synthesized
gtccctgggtcctgaataag

SEQ ID NO: 365903 - DNA, 20 bp, Artificial Sequence
  chemically synthesized
gctactactgctgcttattc

SEQ ID NO: 365904 - DNA, 20 bp, Artificial Sequence
  chemically synthesized
ggctactactgctgcttatt

SEQ ID NO: 365905 - DNA, 20 bp, Artificial Sequence
  chemically synthesized
cctgggtcctgaataagcag

SEQ ID NO: 365906 - DNA, 20 bp, Artificial Sequence
  chemically synthesized
gggtcctgaataagcagcag

SEQ ID NO: 365907 - DNA, 20 bp, Artificial Sequence
  chemically synthesized
tcctgaataagcagcagtag

SEQ ID NO: 365908 - DNA, 20 bp, Artificial Sequence
  chemically synthesized
gaataagcagcagtagtagc

SEQ ID NO: 365909 - DNA, 20 bp, Artificial Sequence
  chemically synthesized
aataagcagcagtagtagcc

SEQ ID NO: 365910 - DNA, 20 bp, Artificial Sequence
  chemically synthesized
aagcagcagtagtagccagg

SEQ ID NO: 365911 - DNA, 20 bp, Artificial Sequence
  chemically synthesized
aagacttggtgaatactgcc

SEQ ID NO: 365912 - DNA, 20 bp, Artificial Sequence
  chemically synthesized
gtagccaggcagtattcacc

SEQ ID NO: 365913 - DNA, 20 bp, Artificial Sequence
  chemically synthesized
aggcagtattcaccaagtct

SEQ ID NO: 365914 - DNA, 20 bp, Artificial Sequence
  chemically synthesized
ggcagtattcaccaagtctt

SEQ ID NO: 365915 - DNA, 20 bp, Artificial Sequence
  chemically synthesized
tctgagtcttacccaagact

SEQ ID NO: 365916 - DNA, 20 bp, Artificial Sequence
  chemically synthesized
gtattcaccaagtcttgggt

SEQ ID NO: 365917 - DNA, 20 bp, Artificial Sequence
  chemically synthesized
catggctctgagtcttaccc

SEQ ID NO: 365918 - DNA, 20 bp, Artificial Sequence
  chemically synthesized
accaagtcttgggtaagact

SEQ ID NO: 365919 - DNA, 20 bp, Artificial Sequence
  chemically synthesized
caagtcttgggtaagactca

SEQ ID NO: 365920 - DNA, 20 bp, Artificial Sequence
  chemically synthesized
cccaaagacagcatggctct

SEQ ID NO: 365921 - DNA, 20 bp, Artificial Sequence
  chemically synthesized
ggccacacccaaagacagca

SEQ ID NO: 365922 - DNA, 20 bp, Artificial Sequence
  chemically synthesized
actcagagccatgctgtctt

SEQ ID NO: 365923 - DNA, 20 bp, Artificial Sequence
  chemically synthesized
ctcagagccatgctgtcttt

SEQ ID NO: 365924 - DNA, 20 bp, Artificial Sequence
  chemically synthesized
cattgggccacacccaaaga

SEQ ID NO: 365925 - DNA, 20 bp, Artificial Sequence
  chemically synthesized
agccatgctgtctttgggtg

SEQ ID NO: 365926 - DNA, 20 bp, Artificial Sequence
  chemically synthesized
aatgcattgggccacaccca

SEQ ID NO: 365927 - DNA, 20 bp, Artificial Sequence
  chemically synthesized
accacacttgggaatgcatt

SEQ ID NO: 365928 - DNA, 20 bp, Artificial Sequence
  chemically synthesized
caccacacttgggaatgcat

SEQ ID NO: 365929 - DNA, 20 bp, Artificial Sequence
  chemically synthesized
gtgtggcccaatgcattccc

SEQ ID NO: 365930 - DNA, 20 bp, Artificial Sequence
  chemically synthesized
gcccaatgcattcccaagtg

SEQ ID NO: 365931 - DNA, 20 bp, Artificial Sequence
  chemically synthesized
tccccatggccaccacactt

SEQ ID NO: 365932 - DNA, 20 bp, Artificial Sequence
  chemically synthesized
caatgcattcccaagtgtgg

SEQ ID NO: 365933 - DNA, 20 bp, Artificial Sequence
  chemically synthesized
atccccatggccaccacact

SEQ ID NO: 365934 - DNA, 20 bp, Artificial Sequence
  chemically synthesized
attcccaagtgtggtggcca

SEQ ID NO: 365935 - DNA, 20 bp, Artificial Sequence
  chemically synthesized
ttcccaagtgtggtggccat

SEQ ID NO: 365936 - DNA, 20 bp, Artificial Sequence
  chemically synthesized
tcccaagtgtggtggccatg

SEQ ID NO: 365937 - DNA, 20 bp, Artificial Sequence
  chemically synthesized
gcacaaggagtatatcccca

SEQ ID NO: 365938 - DNA, 20 bp, Artificial Sequence
  chemically synthesized
ctcctttccaaaagcacaag

SEQ ID NO: 365939 - DNA, 20 bp, Artificial Sequence
  chemically synthesized
ctctcctttccaaaagcaca

SEQ ID NO: 365940 - DNA, 20 bp, Artificial Sequence
  chemically synthesized
ggatatactccttgtgcttt

SEQ ID NO: 365941 - DNA, 20 bp, Artificial Sequence
  chemically synthesized
cctctcctttccaaaagcac

SEQ ID NO: 365942 - DNA, 20 bp, Artificial Sequence
  chemically synthesized
atactccttgtgcttttgga

SEQ ID NO: 365943 - DNA, 20 bp, Artificial Sequence
  chemically synthesized
tactccttgtgcttttggaa

SEQ ID NO: 365944 - DNA, 20 bp, Artificial Sequence
  chemically synthesized
ctattgcctctcctttccaa

SEQ ID NO: 365945 - DNA, 20 bp, Artificial Sequence
  chemically synthesized
ctccttgtgcttttggaaag

SEQ ID NO: 365946 - DNA, 20 bp, Artificial Sequence
  chemically synthesized
ccttgtgcttttggaaagga

SEQ ID NO: 365947 - DNA, 20 bp, Artificial Sequence
  chemically synthesized
cttgtgcttttggaaaggag

SEQ ID NO: 365948 - DNA, 20 bp, Artificial Sequence
  chemically synthesized
cttttggaaaggagaggcaa

SEQ ID NO: 365949 - DNA, 20 bp, Artificial Sequence
  chemically synthesized
tttggaaaggagaggcaata

SEQ ID NO: 365950 - DNA, 20 bp, Artificial Sequence
  chemically synthesized
ggaaaggagaggcaatagag

SEQ ID NO: 365951 - DNA, 20 bp, Artificial Sequence
  chemically synthesized
atagagtggactttgtcttg

SEQ ID NO: 365952 - DNA, 20 bp, Artificial Sequence
  chemically synthesized
agtacccaagctgcaagaca

SEQ ID NO: 365953 - DNA, 20 bp, Artificial Sequence
  chemically synthesized
gtggactttgtcttgcagct

SEQ ID NO: 365954 - DNA, 20 bp, Artificial Sequence
  chemically synthesized
tggactttgtcttgcagctt

SEQ ID NO: 365955 - DNA, 20 bp, Artificial Sequence
  chemically synthesized
tgagctagtacccaagctgc

SEQ ID NO: 365956 - DNA, 20 bp, Artificial Sequence
  chemically synthesized
ttgtcttgcagcttgggtac

SEQ ID NO: 365957 - DNA, 20 bp, Artificial Sequence
  chemically synthesized
ctgtggttgagctagtaccc

SEQ ID NO: 365958 - DNA, 20 bp, Artificial Sequence
  chemically synthesized
ctacctgactgtggttgagc

SEQ ID NO: 365959 - DNA, 20 bp, Artificial Sequence
  chemically synthesized
cttgggtactagctcaacca

SEQ ID NO: 365960 - DNA, 20 bp, Artificial Sequence
  chemically synthesized
tggtctacctgactgtggtt

SEQ ID NO: 365961 - DNA, 20 bp, Artificial Sequence
  chemically synthesized
ggtactagctcaaccacagt

SEQ ID NO: 365962 - DNA, 20 bp, Artificial Sequence
  chemically synthesized
gtactagctcaaccacagtc

SEQ ID NO: 365963 - DNA, 20 bp, Artificial Sequence
  chemically synthesized
cttgatggtctacctgactg

SEQ ID NO: 365964 - DNA, 20 bp, Artificial Sequence
  chemically synthesized
ctagctcaaccacagtcagg

SEQ ID NO: 365965 - DNA, 20 bp, Artificial Sequence
  chemically synthesized
ccacagtcaggtagaccatc

SEQ ID NO: 365966 - DNA, 20 bp, Artificial Sequence
  chemically synthesized
agtcaggtagaccatcaagc

SEQ ID NO: 365967 - DNA, 20 bp, Artificial Sequence
  chemically synthesized
gaacccaggagcttgcttga

SEQ ID NO: 365968 - DNA, 20 bp, Artificial Sequence
  chemically synthesized
tagaccatcaagcaagctcc

SEQ ID NO: 365969 - DNA, 20 bp, Artificial Sequence
  chemically synthesized
agaccatcaagcaagctcct

SEQ ID NO: 365970 - DNA, 20 bp, Artificial Sequence
  chemically synthesized
cctgcaatcagagaacccag

SEQ ID NO: 365971 - DNA, 20 bp, Artificial Sequence
  chemically synthesized
ggcctgcaatcagagaaccc

SEQ ID NO: 365972 - DNA, 20 bp, Artificial Sequence
  chemically synthesized
aggcctgcaatcagagaacc

SEQ ID NO: 365973 - DNA, 20 bp, Artificial Sequence
  chemically synthesized
gctcctgggttctctgattg

SEQ ID NO: 365974 - DNA, 20 bp, Artificial Sequence
  chemically synthesized
ctcctgggttctctgattgc

SEQ ID NO: 365975 - DNA, 20 bp, Artificial Sequence
  chemically synthesized
ggagccaaggcctgcaatca

SEQ ID NO: 365976 - DNA, 20 bp, Artificial Sequence
  chemically synthesized
caggagccaaggcctgcaat

SEQ ID NO: 365977 - DNA, 20 bp, Artificial Sequence
  chemically synthesized
ggttctctgattgcaggcct

SEQ ID NO: 365978 - DNA, 20 bp, Artificial Sequence
  chemically synthesized
tgattgcaggccttggctcc

SEQ ID NO: 365979 - DNA, 20 bp, Artificial Sequence
  chemically synthesized
gaaatgccatccaggagcca

SEQ ID NO: 365980 - DNA, 20 bp, Artificial Sequence
  chemically synthesized
agaaatgccatccaggagcc

SEQ ID NO: 365981 - DNA, 20 bp, Artificial Sequence
  chemically synthesized
tgcaggccttggctcctgga

SEQ ID NO: 365982 - DNA, 20 bp, Artificial Sequence
  chemically synthesized
agtccagaaatgccatccag

SEQ ID NO: 365983 - DNA, 20 bp, Artificial Sequence
  chemically synthesized
tgagtccagaaatgccatcc

SEQ ID NO: 365984 - DNA, 20 bp, Artificial Sequence
  chemically synthesized
gtgagtccagaaatgccatc

SEQ ID NO: 365985 - DNA, 20 bp, Artificial Sequence
  chemically synthesized
tggctcctggatggcatttc

SEQ ID NO: 365986 - DNA, 20 bp, Artificial Sequence
  chemically synthesized
cctcaggccccaggtgagtc

SEQ ID NO: 365987 - DNA, 20 bp, Artificial Sequence
  chemically synthesized
atggcatttctggactcacc

SEQ ID NO: 365988 - DNA, 20 bp, Artificial Sequence
  chemically synthesized
tggcatttctggactcacct

SEQ ID NO: 365989 - DNA, 20 bp, Artificial Sequence
  chemically synthesized
ggcatttctggactcacctg

SEQ ID NO: 365990 - DNA, 20 bp, Artificial Sequence
  chemically synthesized
gttctcctcaggccccaggt

SEQ ID NO: 365991 - DNA, 20 bp, Artificial Sequence
  chemically synthesized
tctggactcacctggggcct

SEQ ID NO: 365992 - DNA, 20 bp, Artificial Sequence
  chemically synthesized
gtgggttctcctcaggcccc

SEQ ID NO: 365993 - DNA, 20 bp, Artificial Sequence
  chemically synthesized
ctggactcacctggggcctg

SEQ ID NO: 365994 - DNA, 20 bp, Artificial Sequence
  chemically synthesized
agtgggttctcctcaggccc

SEQ ID NO: 365995 - DNA, 20 bp, Artificial Sequence
  chemically synthesized
ggactcacctggggcctgag

SEQ ID NO: 365996 - DNA, 20 bp, Artificial Sequence
  chemically synthesized
ctgtgcagtgggttctcctc

SEQ ID NO: 365997 - DNA, 20 bp, Artificial Sequence
  chemically synthesized
tctgtgcagtgggttctcct

SEQ ID NO: 365998 - DNA, 20 bp, Artificial Sequence
  chemically synthesized
cctgaggagaacccactgca

SEQ ID NO: 365999 - DNA, 20 bp, Artificial Sequence
  chemically synthesized
gtctctccgttctgtgcagt

SEQ ID NO: 366000 - DNA, 20 bp, Artificial Sequence
  chemically synthesized
ggtctctccgttctgtgcag

SEQ ID NO: 366001 - DNA, 20 bp, Artificial Sequence
  chemically synthesized
ggagaacccactgcacagaa

SEQ ID NO: 366002 - DNA, 20 bp, Artificial Sequence
  chemically synthesized
ctgggtctctccgttctgtg

SEQ ID NO: 366003 - DNA, 20 bp, Artificial Sequence
  chemically synthesized
agaacccactgcacagaacg

SEQ ID NO: 366004 - DNA, 20 bp, Artificial Sequence
  chemically synthesized
aacccactgcacagaacgga

SEQ ID NO: 366005 - DNA, 20 bp, Artificial Sequence
  chemically synthesized
ctgcacagaacggagagacc

SEQ ID NO: 366006 - DNA, 20 bp, Artificial Sequence
  chemically synthesized
tgcacagaacggagagaccc

SEQ ID NO: 366007 - DNA, 20 bp, Artificial Sequence
  chemically synthesized
gagtaaacgctgcgaggcct

SEQ ID NO: 366008 - DNA, 20 bp, Artificial Sequence
  chemically synthesized
acggagagacccaggcctcg

SEQ ID NO: 366009 - DNA, 20 bp, Artificial Sequence
  chemically synthesized
ggagtaaacgctgcgaggcc

SEQ ID NO: 366010 - DNA, 20 bp, Artificial Sequence
  chemically synthesized
aactaggagtaaacgctgcg

SEQ ID NO: 366011 - DNA, 20 bp, Artificial Sequence
  chemically synthesized
taactaggagtaaacgctgc

SEQ ID NO: 366012 - DNA, 20 bp, Artificial Sequence
  chemically synthesized
ggcctcgcagcgtttactcc

SEQ ID NO: 366013 - DNA, 20 bp, Artificial Sequence
  chemically synthesized
agagctttttagttaactag

SEQ ID NO: 366014 - DNA, 20 bp, Artificial Sequence
  chemically synthesized
caagagctttttagttaact

SEQ ID NO: 366015 - DNA, 20 bp, Artificial Sequence
  chemically synthesized
ccaagagctttttagttaac

SEQ ID NO: 366016 - DNA, 20 bp, Artificial Sequence
  chemically synthesized
tttactcctagttaactaaa

SEQ ID NO: 366017 - DNA, 20 bp, Artificial Sequence
  chemically synthesized
ctcaaggcccaagagctttt

SEQ ID NO: 366018 - DNA, 20 bp, Artificial Sequence
  chemically synthesized
ctagttaactaaaaagctct

SEQ ID NO: 366019 - DNA, 20 bp, Artificial Sequence
  chemically synthesized
tagttaactaaaaagctctt

SEQ ID NO: 366020 - DNA, 20 bp, Artificial Sequence
  chemically synthesized
gatgttcactcaaggcccaa

SEQ ID NO: 366021 - DNA, 20 bp, Artificial Sequence
  chemically synthesized
ctaaaaagctcttgggcctt

SEQ ID NO: 366022 - DNA, 20 bp, Artificial Sequence
  chemically synthesized
ctgatgttcactcaaggccc

SEQ ID NO: 366023 - DNA, 20 bp, Artificial Sequence
  chemically synthesized
ctaccactgatgttcactca

SEQ ID NO: 366024 - DNA, 20 bp, Artificial Sequence
  chemically synthesized
gctaccactgatgttcactc

SEQ ID NO: 366025 - DNA, 20 bp, Artificial Sequence
  chemically synthesized
cttgggccttgagtgaacat

SEQ ID NO: 366026 - DNA, 20 bp, Artificial Sequence
  chemically synthesized
gggccttgagtgaacatcag

SEQ ID NO: 366027 - DNA, 20 bp, Artificial Sequence
  chemically synthesized
ccttgagtgaacatcagtgg

SEQ ID NO: 366028 - DNA, 20 bp, Artificial Sequence
  chemically synthesized
gagtgaacatcagtggtagc

SEQ ID NO: 366029 - DNA, 20 bp, Artificial Sequence
  chemically synthesized
agtgaacatcagtggtagcc

SEQ ID NO: 366030 - DNA, 20 bp, Artificial Sequence
  chemically synthesized
gaacatcagtggtagccagg

SEQ ID NO: 366031 - DNA, 20 bp, Artificial Sequence
  chemically synthesized
ggctcatggtgagtactgcc

SEQ ID NO: 366032 - DNA, 20 bp, Artificial Sequence
  chemically synthesized
agccaggcagtactcaccat

SEQ ID NO: 366033 - DNA, 20 bp, Artificial Sequence
  chemically synthesized
cactgcctcaggctcatggt

SEQ ID NO: 366034 - DNA, 20 bp, Artificial Sequence
  chemically synthesized
gcagtactcaccatgagcct

SEQ ID NO: 366035 - DNA, 20 bp, Artificial Sequence
  chemically synthesized
ctaccactgcctcaggctca

SEQ ID NO: 366036 - DNA, 20 bp, Artificial Sequence
  chemically synthesized
cagtactcaccatgagcctg

SEQ ID NO: 366037 - DNA, 20 bp, Artificial Sequence
  chemically synthesized
tactcaccatgagcctgagg

SEQ ID NO: 366038 - DNA, 20 bp, Artificial Sequence
  chemically synthesized
tcaccatgagcctgaggcag

SEQ ID NO: 366039 - DNA, 20 bp, Artificial Sequence
  chemically synthesized
cccatggctaccactgcctc

SEQ ID NO: 366040 - DNA, 20 bp, Artificial Sequence
  chemically synthesized
ccccatggctaccactgcct

SEQ ID NO: 366041 - DNA, 20 bp, Artificial Sequence
  chemically synthesized
ccatgagcctgaggcagtgg

SEQ ID NO: 366042 - DNA, 20 bp, Artificial Sequence
  chemically synthesized
gcctgaggcagtggtagcca

SEQ ID NO: 366043 - DNA, 20 bp, Artificial Sequence
  chemically synthesized
cctgaggcagtggtagccat

SEQ ID NO: 366044 - DNA, 20 bp, Artificial Sequence
  chemically synthesized
ctgaggcagtggtagccatg

SEQ ID NO: 366045 - DNA, 20 bp, Artificial Sequence
  chemically synthesized
agcagaggaatttttcccca

SEQ ID NO: 366046 - DNA, 20 bp, Artificial Sequence
  chemically synthesized
ctttcccatttcataagcag

SEQ ID NO: 366047 - DNA, 20 bp, Artificial Sequence
  chemically synthesized
cctttcccatttcataagca

SEQ ID NO: 366048 - DNA, 20 bp, Artificial Sequence
  chemically synthesized
ttcctttcccatttcataag

SEQ ID NO: 366049 - DNA, 20 bp, Artificial Sequence
  chemically synthesized
aaattcctctgcttatgaaa

SEQ ID NO: 366050 - DNA, 20 bp, Artificial Sequence
  chemically synthesized
aattcctctgcttatgaaat

SEQ ID NO: 366051 - DNA, 20 bp, Artificial Sequence
  chemically synthesized
ttcttcctttcccatttcat

SEQ ID NO: 366052 - DNA, 20 bp, Artificial Sequence
  chemically synthesized
cctctgcttatgaaatggga

SEQ ID NO: 366053 - DNA, 20 bp, Artificial Sequence
  chemically synthesized
ctctgcttatgaaatgggaa

SEQ ID NO: 366054 - DNA, 20 bp, Artificial Sequence
  chemically synthesized
tgcttatgaaatgggaaagg

SEQ ID NO: 366055 - DNA, 20 bp, Artificial Sequence
  chemically synthesized
atgaaatgggaaaggaagaa

SEQ ID NO: 366056 - DNA, 20 bp, Artificial Sequence
  chemically synthesized
tgaaatgggaaaggaagaat

SEQ ID NO: 366057 - DNA, 20 bp, Artificial Sequence
  chemically synthesized
atgggacaaactttgtattg

SEQ ID NO: 366058 - DNA, 20 bp, Artificial Sequence
  chemically synthesized
ggcacccaagccacaataca

SEQ ID NO: 366059 - DNA, 20 bp, Artificial Sequence
  chemically synthesized
acaaactttgtattgtggct

SEQ ID NO: 366060 - DNA, 20 bp, Artificial Sequence
  chemically synthesized
caaactttgtattgtggctt

SEQ ID NO: 366061 - DNA, 20 bp, Artificial Sequence
  chemically synthesized
ttgtattgtggcttgggtgc

SEQ ID NO: 366062 - DNA, 20 bp, Artificial Sequence
  chemically synthesized
ttgtggcagagctggcaccc

SEQ ID NO: 366063 - DNA, 20 bp, Artificial Sequence
  chemically synthesized
ctcttctattgtggcagagc

SEQ ID NO: 366064 - DNA, 20 bp, Artificial Sequence
  chemically synthesized
tgctctcttctattgtggca

SEQ ID NO: 366065 - DNA, 20 bp, Artificial Sequence
  chemically synthesized
gggtgccagctctgccacaa

SEQ ID NO: 366066 - DNA, 20 bp, Artificial Sequence
  chemically synthesized
ggtgctctcttctattgtgg

SEQ ID NO: 366067 - DNA, 20 bp, Artificial Sequence
  chemically synthesized
tgccagctctgccacaatag

SEQ ID NO: 366068 - DNA, 20 bp, Artificial Sequence
  chemically synthesized
tctggtgctctcttctattg

SEQ ID NO: 366069 - DNA, 20 bp, Artificial Sequence
  chemically synthesized
ccagctctgccacaatagaa

SEQ ID NO: 366070 - DNA, 20 bp, Artificial Sequence
  chemically synthesized
agctctgccacaatagaaga

SEQ ID NO: 366071 - DNA, 20 bp, Artificial Sequence
  chemically synthesized
gccacaatagaagagagcac

SEQ ID NO: 366072 - DNA, 20 bp, Artificial Sequence
  chemically synthesized
caatagaagagagcaccaga

SEQ ID NO: 366073 - DNA, 20 bp, Artificial Sequence
  chemically synthesized
tgcatctttatgaatctatc

SEQ ID NO: 366074 - DNA, 20 bp, Artificial Sequence
  chemically synthesized
gagcaccagatagattcata

SEQ ID NO: 366075 - DNA, 20 bp, Artificial Sequence
  chemically synthesized
gattcataaagatgcaactt

SEQ ID NO: 366076 - DNA, 20 bp, Artificial Sequence
  chemically synthesized
attcataaagatgcaacttc

SEQ ID NO: 366077 - DNA, 20 bp, Artificial Sequence
  chemically synthesized
aaagatgcaacttcaggcct

SEQ ID NO: 366078 - DNA, 20 bp, Artificial Sequence
  chemically synthesized
catctaggagccaaggcctg

SEQ ID NO: 366079 - DNA, 20 bp, Artificial Sequence
  chemically synthesized
caacttcaggccttggctcc

SEQ ID NO: 366080 - DNA, 20 bp, Artificial Sequence
  chemically synthesized
tgcttgccatctaggagcca

SEQ ID NO: 366081 - DNA, 20 bp, Artificial Sequence
  chemically synthesized
atgcttgccatctaggagcc

SEQ ID NO: 366082 - DNA, 20 bp, Artificial Sequence
  chemically synthesized
ttcaggccttggctcctaga

SEQ ID NO: 366083 - DNA, 20 bp, Artificial Sequence
  chemically synthesized
ttttgatgcttgccatctag

SEQ ID NO: 366084 - DNA, 20 bp, Artificial Sequence
  chemically synthesized
ggccttggctcctagatggc

SEQ ID NO: 366085 - DNA, 20 bp, Artificial Sequence
  chemically synthesized
acttttgatgcttgccatct

SEQ ID NO: 366086 - DNA, 20 bp, Artificial Sequence
  chemically synthesized
gacttttgatgcttgccatc

SEQ ID NO: 366087 - DNA, 20 bp, Artificial Sequence
  chemically synthesized
tcctagatggcaagcatcaa

SEQ ID NO: 366088 - DNA, 20 bp, Artificial Sequence
  chemically synthesized
gatggcaagcatcaaaagtc

SEQ ID NO: 366089 - DNA, 20 bp, Artificial Sequence
  chemically synthesized
atggcaagcatcaaaagtca

SEQ ID NO: 366090 - DNA, 20 bp, Artificial Sequence
  chemically synthesized
agcatcaaaagtcaaggata

SEQ ID NO: 366091 - DNA, 20 bp, Artificial Sequence
  chemically synthesized
tcaaaagtcaaggataaaga

SEQ ID NO: 366092 - DNA, 20 bp, Artificial Sequence
  chemically synthesized
caaaagtcaaggataaagac

SEQ ID NO: 366093 - DNA, 20 bp, Artificial Sequence
  chemically synthesized
ggataaagacaggatcctaa

SEQ ID NO: 366094 - DNA, 20 bp, Artificial Sequence
  chemically synthesized
taaagacaggatcctaaaag

SEQ ID NO: 366095 - DNA, 20 bp, Artificial Sequence
  chemically synthesized
tcttttctcttgctgctttt

SEQ ID NO: 366096 - DNA, 20 bp, Artificial Sequence
  chemically synthesized
atcttttctcttgctgcttt

SEQ ID NO: 366097 - DNA, 20 bp, Artificial Sequence
  chemically synthesized
gacaggatcctaaaagcagc

SEQ ID NO: 366098 - DNA, 20 bp, Artificial Sequence
  chemically synthesized
caggatcctaaaagcagcaa

SEQ ID NO: 366099 - DNA, 20 bp, Artificial Sequence
  chemically synthesized
tcctaaaagcagcaagagaa

SEQ ID NO: 366100 - DNA, 20 bp, Artificial Sequence
  chemically synthesized
gagaaaagatacattccaaa

SEQ ID NO: 366101 - DNA, 20 bp, Artificial Sequence
  chemically synthesized
ctagttgttgttaagctttt

SEQ ID NO: 366102 - DNA, 20 bp, Artificial Sequence
  chemically synthesized
gcctgttactagttgttgtt

SEQ ID NO: 366103 - DNA, 20 bp, Artificial Sequence
  chemically synthesized
ccaaaaagcttaacaacaac

SEQ ID NO: 366104 - DNA, 20 bp, Artificial Sequence
  chemically synthesized
agcttaacaacaactagtaa

SEQ ID NO: 366105 - DNA, 20 bp, Artificial Sequence
  chemically synthesized
gcttaacaacaactagtaac

SEQ ID NO: 366106 - DNA, 20 bp, Artificial Sequence
  chemically synthesized
tctgctgagaagcctgttac

SEQ ID NO: 366107 - DNA, 20 bp, Artificial Sequence
  chemically synthesized
acaactagtaacaggcttct

SEQ ID NO: 366108 - DNA, 20 bp, Artificial Sequence
  chemically synthesized
actagtaacaggcttctcag

SEQ ID NO: 366109 - DNA, 20 bp, Artificial Sequence
  chemically synthesized
cctgtaagttttctgctgag

SEQ ID NO: 366110 - DNA, 20 bp, Artificial Sequence
  chemically synthesized
tagcctgtaagttttctgct

SEQ ID NO: 366111 - DNA, 20 bp, Artificial Sequence
  chemically synthesized
gcttctcagcagaaaactta

SEQ ID NO: 366112 - DNA, 20 bp, Artificial Sequence
  chemically synthesized
cttctcagcagaaaacttac

SEQ ID NO: 366113 - DNA, 20 bp, Artificial Sequence
  chemically synthesized
cagcagaaaacttacaggct

SEQ ID NO: 366114 - DNA, 20 bp, Artificial Sequence
  chemically synthesized
catgacatgtcttagcctgt

SEQ ID NO: 366115 - DNA, 20 bp, Artificial Sequence
  chemically synthesized
aaatatggcatgacatgtct

SEQ ID NO: 366116 - DNA, 20 bp, Artificial Sequence
  chemically synthesized
gacatgtcatgccatattta

SEQ ID NO: 366117 - DNA, 20 bp, Artificial Sequence
  chemically synthesized
ttccttcagcactttaaata

SEQ ID NO: 366118 - DNA, 20 bp, Artificial Sequence
  chemically synthesized
atgccatatttaaagtgctg

SEQ ID NO: 366119 - DNA, 20 bp, Artificial Sequence
  chemically synthesized
tgccatatttaaagtgctga

SEQ ID NO: 366120 - DNA, 20 bp, Artificial Sequence
  chemically synthesized
tatttaaagtgctgaaggaa

SEQ ID NO: 366121 - DNA, 20 bp, Artificial Sequence
  chemically synthesized
gcataaagggtcttttcctt

SEQ ID NO: 366122 - DNA, 20 bp, Artificial Sequence
  chemically synthesized
aaggaaaagaccctttatgc

SEQ ID NO: 366123 - DNA, 20 bp, Artificial Sequence
  chemically synthesized
atgcactatcctagcataaa

SEQ ID NO: 366124 - DNA, 20 bp, Artificial Sequence
  chemically synthesized
aggaaaagaccctttatgct

SEQ ID NO: 366125 - DNA, 20 bp, Artificial Sequence
  chemically synthesized
gatgcactatcctagcataa

SEQ ID NO: 366126 - DNA, 20 bp, Artificial Sequence
  chemically synthesized
ggatgcactatcctagcata

SEQ ID NO: 366127 - DNA, 20 bp, Artificial Sequence
  chemically synthesized
aaagaccctttatgctagga

SEQ ID NO: 366128 - DNA, 20 bp, Artificial Sequence
  chemically synthesized
tttcactggatgcactatcc

SEQ ID NO: 366129 - DNA, 20 bp, Artificial Sequence
  chemically synthesized
ttatgctaggatagtgcatc

SEQ ID NO: 366130 - DNA, 20 bp, Artificial Sequence
  chemically synthesized
tgttggaaggagattttcac

SEQ ID NO: 366131 - DNA, 20 bp, Artificial Sequence
  chemically synthesized
tttatctttcttgttggaag

SEQ ID NO: 366132 - DNA, 20 bp, Artificial Sequence
  chemically synthesized
agtgaaaatctccttccaac

SEQ ID NO: 366133 - DNA, 20 bp, Artificial Sequence
  chemically synthesized
tctttatctttcttgttgga

SEQ ID NO: 366134 - DNA, 20 bp, Artificial Sequence
  chemically synthesized
gtctttatctttcttgttgg

SEQ ID NO: 366135 - DNA, 20 bp, Artificial Sequence
  chemically synthesized
aaaatctccttccaacaaga

SEQ ID NO: 366136 - DNA, 20 bp, Artificial Sequence
  chemically synthesized
aaggtctttatctttcttgt

SEQ ID NO: 366137 - DNA, 20 bp, Artificial Sequence
  chemically synthesized
tccttccaacaagaaagata

SEQ ID NO: 366138 - DNA, 20 bp, Artificial Sequence
  chemically synthesized
aagaaagataaagaccttcc

SEQ ID NO: 366139 - DNA, 20 bp, Artificial Sequence
  chemically synthesized
aagataaagaccttccaaga

SEQ ID NO: 366140 - DNA, 20 bp, Artificial Sequence
  chemically synthesized
cccacagcttctgtcttgga

SEQ ID NO: 366141 - DNA, 20 bp, Artificial Sequence
  chemically synthesized
tcccacagcttctgtcttgg

SEQ ID NO: 366142 - DNA, 20 bp, Artificial Sequence
  chemically synthesized
ataaagaccttccaagacag

SEQ ID NO: 366143 - DNA, 20 bp, Artificial Sequence
  chemically synthesized
aaatcccacagcttctgtct

SEQ ID NO: 366144 - DNA, 20 bp, Artificial Sequence
  chemically synthesized
accttccaagacagaagctg

SEQ ID NO: 366145 - DNA, 20 bp, Artificial Sequence
  chemically synthesized
ccttccaagacagaagctgt

SEQ ID NO: 366146 - DNA, 20 bp, Artificial Sequence
  chemically synthesized
ctggtgttgatgaaatccca

SEQ ID NO: 366147 - DNA, 20 bp, Artificial Sequence
  chemically synthesized
ctgtgggatttcatcaacac

SEQ ID NO: 366148 - DNA, 20 bp, Artificial Sequence
  chemically synthesized
catttcttgtagaacaggtc

SEQ ID NO: 366149 - DNA, 20 bp, Artificial Sequence
  chemically synthesized
caacaccagacctgttctac

SEQ ID NO: 366150 - DNA, 20 bp, Artificial Sequence
  chemically synthesized
tttagcatttcttgtagaac

SEQ ID NO: 366151 - DNA, 20 bp, Artificial Sequence
  chemically synthesized
ctttagcatttcttgtagaa

SEQ ID NO: 366152 - DNA, 20 bp, Artificial Sequence
  chemically synthesized
attctctttagcatttcttg

SEQ ID NO: 366153 - DNA, 20 bp, Artificial Sequence
  chemically synthesized
ctgttctacaagaaatgcta

SEQ ID NO: 366154 - DNA, 20 bp, Artificial Sequence
  chemically synthesized
gttctacaagaaatgctaaa

SEQ ID NO: 366155 - DNA, 20 bp, Artificial Sequence
  chemically synthesized
tccagttgataaattctctt

SEQ ID NO: 366156 - DNA, 20 bp, Artificial Sequence
  chemically synthesized
gctaaagagaatttatcaac

SEQ ID NO: 366157 - DNA, 20 bp, Artificial Sequence
  chemically synthesized
aagagaatttatcaactgga

SEQ ID NO: 366158 - DNA, 20 bp, Artificial Sequence
  chemically synthesized
agaatttatcaactggaaag

SEQ ID NO: 366159 - DNA, 20 bp, Artificial Sequence
  chemically synthesized
aatttatcaactggaaagaa

SEQ ID NO: 366160 - DNA, 20 bp, Artificial Sequence
  chemically synthesized
agttaaggtcctcttctttc

SEQ ID NO: 366161 - DNA, 20 bp, Artificial Sequence
  chemically synthesized
atttatcaactggaaagaag

SEQ ID NO: 366162 - DNA, 20 bp, Artificial Sequence
  chemically synthesized
ggaaagaagaggaccttaac

SEQ ID NO: 366163 - DNA, 20 bp, Artificial Sequence
  chemically synthesized
atggtttttctggctagtta

SEQ ID NO: 366164 - DNA, 20 bp, Artificial Sequence
  chemically synthesized
agaagaggaccttaactagc

SEQ ID NO: 366165 - DNA, 20 bp, Artificial Sequence
  chemically synthesized
gatggtttttctggctagtt

SEQ ID NO: 366166 - DNA, 20 bp, Artificial Sequence
  chemically synthesized
cttcagatggtttttctggc

SEQ ID NO: 366167 - DNA, 20 bp, Artificial Sequence
  chemically synthesized
gtgccttcagatggtttttc

SEQ ID NO: 366168 - DNA, 20 bp, Artificial Sequence
  chemically synthesized
ctagccagaaaaaccatctg

SEQ ID NO: 366169 - DNA, 20 bp, Artificial Sequence
  chemically synthesized
tagccagaaaaaccatctga

SEQ ID NO: 366170 - DNA, 20 bp, Artificial Sequence
  chemically synthesized
ctgagttttgtgccttcaga

SEQ ID NO: 366171 - DNA, 20 bp, Artificial Sequence
  chemically synthesized
cttactgagttttgtgcctt

SEQ ID NO: 366172 - DNA, 20 bp, Artificial Sequence
  chemically synthesized
ccatctgaaggcacaaaact

SEQ ID NO: 366173 - DNA, 20 bp, Artificial Sequence
  chemically synthesized
ctgaaggcacaaaactcagt

SEQ ID NO: 366174 - DNA, 20 bp, Artificial Sequence
  chemically synthesized
tgtgtttgtctgtacttact

SEQ ID NO: 366175 - DNA, 20 bp, Artificial Sequence
  chemically synthesized
ggcacaaaactcagtaagta

SEQ ID NO: 366176 - DNA, 20 bp, Artificial Sequence
  chemically synthesized
tcacaattacagtattacaa

SEQ ID NO: 366177 - DNA, 20 bp, Artificial Sequence
  chemically synthesized
tagttcatacatcacaatta

SEQ ID NO: 366178 - DNA, 20 bp, Artificial Sequence
  chemically synthesized
cttcttattcaagatatgag

SEQ ID NO: 366179 - DNA, 20 bp, Artificial Sequence
  chemically synthesized
actcttcttattcaagatat

SEQ ID NO: 366180 - DNA, 20 bp, Artificial Sequence
  chemically synthesized
gaactactcatatcttgaat

SEQ ID NO: 366181 - DNA, 20 bp, Artificial Sequence
  chemically synthesized
ctactcatatcttgaataag

SEQ ID NO: 366182 - DNA, 20 bp, Artificial Sequence
  chemically synthesized
tttttttactcttcttattc

SEQ ID NO: 366183 - DNA, 20 bp, Artificial Sequence
  chemically synthesized
actcatatcttgaataagaa

SEQ ID NO: 366184 - DNA, 20 bp, Artificial Sequence
  chemically synthesized
ttgaataagaagagtaaaaa

SEQ ID NO: 366185 - DNA, 20 bp, Artificial Sequence
  chemically synthesized
tgaataagaagagtaaaaaa

SEQ ID NO: 366186 - DNA, 20 bp, Artificial Sequence
  chemically synthesized
ataagaagagtaaaaaaagg

SEQ ID NO: 366187 - DNA, 20 bp, Artificial Sequence
  chemically synthesized
gagtaaaaaaaggaagcttt

SEQ ID NO: 366188 - DNA, 20 bp, Artificial Sequence
  chemically synthesized
tagagttatttgttaactga

SEQ ID NO: 366189 - DNA, 20 bp, Artificial Sequence
  chemically synthesized
tctatgtcttaaagttatta

SEQ ID NO: 366190 - DNA, 20 bp, Artificial Sequence
  chemically synthesized
tgtctatgtcttaaagttat

SEQ ID NO: 366191 - DNA, 20 bp, Artificial Sequence
  chemically synthesized
caaataactctaataacttt

SEQ ID NO: 366192 - DNA, 20 bp, Artificial Sequence
  chemically synthesized
actctaataactttaagaca

SEQ ID NO: 366193 - DNA, 20 bp, Artificial Sequence
  chemically synthesized
attatactgtctatgtctta

SEQ ID NO: 366194 - DNA, 20 bp, Artificial Sequence
  chemically synthesized
taataactttaagacataga

SEQ ID NO: 366195 - DNA, 20 bp, Artificial Sequence
  chemically synthesized
taagacatagacagtataat

SEQ ID NO: 366196 - DNA, 20 bp, Artificial Sequence
  chemically synthesized
agatataaacaaacaacaaa

SEQ ID NO: 366197 - DNA, 20 bp, Artificial Sequence
  chemically synthesized
acaaacaacaaaaagattaa

SEQ ID NO: 366198 - DNA, 20 bp, Artificial Sequence
  chemically synthesized
aaacaacaaaaagattaaaa

SEQ ID NO: 366199 - DNA, 20 bp, Artificial Sequence
  chemically synthesized
caaaaagattaaaagagacg

SEQ ID NO: 366200 - DNA, 20 bp, Artificial Sequence
  chemically synthesized
gattaaaagagacgaagttt

SEQ ID NO: 366201 - DNA, 20 bp, Artificial Sequence
  chemically synthesized
acgaagtttgagtttttaat

SEQ ID NO: 366202 - DNA, 20 bp, Artificial Sequence
  chemically synthesized
tgcataaacaagaaagcaaa

SEQ ID NO: 366203 - DNA, 20 bp, Artificial Sequence
  chemically synthesized
gttgcataaacaagaaagca

SEQ ID NO: 366204 - DNA, 20 bp, Artificial Sequence
  chemically synthesized
cactggttgcataaacaaga

SEQ ID NO: 366205 - DNA, 20 bp, Artificial Sequence
  chemically synthesized
acaacactggttgcataaac

SEQ ID NO: 366206 - DNA, 20 bp, Artificial Sequence
  chemically synthesized
tgctttcttgtttatgcaac

SEQ ID NO: 366207 - DNA, 20 bp, Artificial Sequence
  chemically synthesized
ttatttcaaacagacaacac

SEQ ID NO: 366208 - DNA, 20 bp, Artificial Sequence
  chemically synthesized
ctataacccattatttcaaa

SEQ ID NO: 366209 - DNA, 20 bp, Artificial Sequence
  chemically synthesized
gtgttgtctgtttgaaataa

SEQ ID NO: 366210 - DNA, 20 bp, Artificial Sequence
  chemically synthesized
tgttgtctgtttgaaataat

SEQ ID NO: 366211 - DNA, 20 bp, Artificial Sequence
  chemically synthesized
ctgtttgaaataatgggtta

SEQ ID NO: 366212 - DNA, 20 bp, Artificial Sequence
  chemically synthesized
tatagtgtttgtaaacctca

SEQ ID NO: 366213 - DNA, 20 bp, Artificial Sequence
  chemically synthesized
agtgtttgtaaacctcatgg

SEQ ID NO: 366214 - DNA, 20 bp, Artificial Sequence
  chemically synthesized
tcttatttgaggctaccatg

SEQ ID NO: 366215 - DNA, 20 bp, Artificial Sequence
  chemically synthesized
ttcttatttgaggctaccat

SEQ ID NO: 366216 - DNA, 20 bp, Artificial Sequence
  chemically synthesized
acctcatggtagcctcaaat

SEQ ID NO: 366217 - DNA, 20 bp, Artificial Sequence
  chemically synthesized
ttagtatatcttcttatttg

SEQ ID NO: 366218 - DNA, 20 bp, Artificial Sequence
  chemically synthesized
tcatggtagcctcaaataag

SEQ ID NO: 366219 - DNA, 20 bp, Artificial Sequence
  chemically synthesized
cttagtatatcttcttattt

SEQ ID NO: 366220 - DNA, 20 bp, Artificial Sequence
  chemically synthesized
ctcaaataagaagatatact

SEQ ID NO: 366221 - DNA, 20 bp, Artificial Sequence
  chemically synthesized
tttttaaattttgtgaatct

SEQ ID NO: 366222 - DNA, 20 bp, Artificial Sequence
  chemically synthesized
taagattcacaaaatttaaa

SEQ ID NO: 366223 - DNA, 20 bp, Artificial Sequence
  chemically synthesized
attcacaaaatttaaaaagc

SEQ ID NO: 366224 - DNA, 20 bp, Artificial Sequence
  chemically synthesized
atttaaaaagcaagaaataa

SEQ ID NO: 366225 - DNA, 20 bp, Artificial Sequence
  chemically synthesized
aagaaataaaagcatgccac

SEQ ID NO: 366226 - DNA, 20 bp, Artificial Sequence
  chemically synthesized
gaaataaaagcatgccacta

SEQ ID NO: 366227 - DNA, 20 bp, Artificial Sequence
  chemically synthesized
tgaaggcgatttttctctag

SEQ ID NO: 366228 - DNA, 20 bp, Artificial Sequence
  chemically synthesized
tagtgaaggcgatttttctc

SEQ ID NO: 366229 - DNA, 20 bp, Artificial Sequence
  chemically synthesized
cctgtcttcctttttagtga

SEQ ID NO: 366230 - DNA, 20 bp, Artificial Sequence
  chemically synthesized
gaaaaatcgccttcactaaa

SEQ ID NO: 366231 - DNA, 20 bp, Artificial Sequence
  chemically synthesized
tcctgtcttcctttttagtg

SEQ ID NO: 366232 - DNA, 20 bp, Artificial Sequence
  chemically synthesized
aaaaatcgccttcactaaaa

SEQ ID NO: 366233 - DNA, 20 bp, Artificial Sequence
  chemically synthesized
aatcgccttcactaaaaagg

SEQ ID NO: 366234 - DNA, 20 bp, Artificial Sequence
  chemically synthesized
ttccatcctgtcttcctttt

SEQ ID NO: 366235 - DNA, 20 bp, Artificial Sequence
  chemically synthesized
gccttcactaaaaaggaaga

SEQ ID NO: 366236 - DNA, 20 bp, Artificial Sequence
  chemically synthesized
ccttcactaaaaaggaagac

SEQ ID NO: 366237 - DNA, 20 bp, Artificial Sequence
  chemically synthesized
cactaaaaaggaagacagga

SEQ ID NO: 366238 - DNA, 20 bp, Artificial Sequence
  chemically synthesized
taaaaaggaagacaggatgg

SEQ ID NO: 366239 - DNA, 20 bp, Artificial Sequence
  chemically synthesized
aaaaggaagacaggatggaa

SEQ ID NO: 366240 - DNA, 20 bp, Artificial Sequence
  chemically synthesized
ggaagacaggatggaagaga

SEQ ID NO: 366241 - DNA, 20 bp, Artificial Sequence
  chemically synthesized
tttgttttctggttgttttg

SEQ ID NO: 366242 - DNA, 20 bp, Artificial Sequence
  chemically synthesized
agagaaagccacaaaacaac

SEQ ID NO: 366243 - DNA, 20 bp, Artificial Sequence
  chemically synthesized
attcctaccattttgttttc

SEQ ID NO: 366244 - DNA, 20 bp, Artificial Sequence
  chemically synthesized
aaaacaaccagaaaacaaaa

SEQ ID NO: 366245 - DNA, 20 bp, Artificial Sequence
  chemically synthesized
acaaccagaaaacaaaatgg

SEQ ID NO: 366246 - DNA, 20 bp, Artificial Sequence
  chemically synthesized
caaccagaaaacaaaatggt

SEQ ID NO: 366247 - DNA, 20 bp, Artificial Sequence
  chemically synthesized
gaaaacaaaatggtaggaat

SEQ ID NO: 366248 - DNA, 20 bp, Artificial Sequence
  chemically synthesized
ttatgttcagttttattatt

SEQ ID NO: 366249 - DNA, 20 bp, Artificial Sequence
  chemically synthesized
gagtttatttcatttatgtt

SEQ ID NO: 366250 - DNA, 20 bp, Artificial Sequence
  chemically synthesized
gtcactgtgttttgattgga

SEQ ID NO: 366251 - DNA, 20 bp, Artificial Sequence
  chemically synthesized
ctgtcactgtgttttgattg

SEQ ID NO: 366252 - DNA, 20 bp, Artificial Sequence
  chemically synthesized
ttctgtcactgtgttttgat

SEQ ID NO: 366253 - DNA, 20 bp, Artificial Sequence
  chemically synthesized
taaactctccaatcaaaaca

SEQ ID NO: 366254 - DNA, 20 bp, Artificial Sequence
  chemically synthesized
ctccaatcaaaacacagtga

SEQ ID NO: 366255 - DNA, 20 bp, Artificial Sequence
  chemically synthesized
caacaacaacaacaaacacc

SEQ ID NO: 366256 - DNA, 20 bp, Artificial Sequence
  chemically synthesized
gtaggcaacagattgagtct

SEQ ID NO: 366257 - DNA, 20 bp, Artificial Sequence
  chemically synthesized
tttcttgtaggcaacagatt

SEQ ID NO: 366258 - DNA, 20 bp, Artificial Sequence
  chemically synthesized
agcgtgtttcttgtaggcaa

SEQ ID NO: 366259 - DNA, 20 bp, Artificial Sequence
  chemically synthesized
agactcaatctgttgcctac

SEQ ID NO: 366260 - DNA, 20 bp, Artificial Sequence
  chemically synthesized
aggtgaagcgtgtttcttgt

SEQ ID NO: 366261 - DNA, 20 bp, Artificial Sequence
  chemically synthesized
taggtgaagcgtgtttcttg

SEQ ID NO: 366262 - DNA, 20 bp, Artificial Sequence
  chemically synthesized
taagtctggctttgtaggtg

SEQ ID NO: 366263 - DNA, 20 bp, Artificial Sequence
  chemically synthesized
agaaacacgcttcacctaca

SEQ ID NO: 366264 - DNA, 20 bp, Artificial Sequence
  chemically synthesized
acacgcttcacctacaaagc

SEQ ID NO: 366265 - DNA, 20 bp, Artificial Sequence
  chemically synthesized
aattttaagtctggctttgt

SEQ ID NO: 366266 - DNA, 20 bp, Artificial Sequence
  chemically synthesized
taattttaagtctggctttg

SEQ ID NO: 366267 - DNA, 20 bp, Artificial Sequence
  chemically synthesized
acatcccttaattttaagtc

SEQ ID NO: 366268 - DNA, 20 bp, Artificial Sequence
  chemically synthesized
acaaagccagacttaaaatt

SEQ ID NO: 366269 - DNA, 20 bp, Artificial Sequence
  chemically synthesized
caaagccagacttaaaatta

SEQ ID NO: 366270 - DNA, 20 bp, Artificial Sequence
  chemically synthesized
tttttacatcccttaatttt

SEQ ID NO: 366271 - DNA, 20 bp, Artificial Sequence
  chemically synthesized
aaagccagacttaaaattaa

SEQ ID NO: 366272 - DNA, 20 bp, Artificial Sequence
  chemically synthesized
ttaaaattaagggatgtaaa

SEQ ID NO: 366273 - DNA, 20 bp, Artificial Sequence
  chemically synthesized
aaaaagatattccatgtcga

SEQ ID NO: 366274 - DNA, 20 bp, Artificial Sequence
  chemically synthesized
ttttttggttgctatcgaca

SEQ ID NO: 366275 - DNA, 20 bp, Artificial Sequence
  chemically synthesized
catgtcgatagcaaccaaaa

SEQ ID NO: 366276 - DNA, 20 bp, Artificial Sequence
  chemically synthesized
tagctactcctgttcttttt

SEQ ID NO: 366277 - DNA, 20 bp, Artificial Sequence
  chemically synthesized
cgatagcaaccaaaaaagaa

SEQ ID NO: 366278 - DNA, 20 bp, Artificial Sequence
  chemically synthesized
gatagcaaccaaaaaagaac

SEQ ID NO: 366279 - DNA, 20 bp, Artificial Sequence
  chemically synthesized
tagcaaccaaaaaagaacag

SEQ ID NO: 366280 - DNA, 20 bp, Artificial Sequence
  chemically synthesized
caaccaaaaaagaacaggag

SEQ ID NO: 366281 - DNA, 20 bp, Artificial Sequence
  chemically synthesized
tattttgtttgatgtaagaa

SEQ ID NO: 366282 - DNA, 20 bp, Artificial Sequence
  chemically synthesized
aaatatattttgtttgatgt

SEQ ID NO: 366283 - DNA, 20 bp, Artificial Sequence
  chemically synthesized
catcaaacaaaatatatttc

SEQ ID NO: 366284 - DNA, 20 bp, Artificial Sequence
  chemically synthesized
tatatttcaagacaaactgt

SEQ ID NO: 366285 - DNA, 20 bp, Artificial Sequence
  chemically synthesized
atttcaagacaaactgtaag

SEQ ID NO: 366286 - DNA, 20 bp, Artificial Sequence
  chemically synthesized
ttcaagacaaactgtaagaa

SEQ ID NO: 366287 - DNA, 20 bp, Artificial Sequence
  chemically synthesized
ttgatctttgtctcttctta

SEQ ID NO: 366288 - DNA, 20 bp, Artificial Sequence
  chemically synthesized
acaaactgtaagaagagaca

SEQ ID NO: 366289 - DNA, 20 bp, Artificial Sequence
  chemically synthesized
acaaagatcaacatataata

SEQ ID NO: 366290 - DNA, 20 bp, Artificial Sequence
  chemically synthesized
caaagatcaacatataataa

SEQ ID NO: 366291 - DNA, 20 bp, Artificial Sequence
  chemically synthesized
atataataaaggaatcattt

SEQ ID NO: 366292 - DNA, 20 bp, Artificial Sequence
  chemically synthesized
aaaggaatcatttcagcaat

SEQ ID NO: 366293 - DNA, 20 bp, Artificial Sequence
  chemically synthesized
ggtacgtatatatttacaat

SEQ ID NO: 366294 - DNA, 20 bp, Artificial Sequence
  chemically synthesized
aatatatacgtaccgaacac

SEQ ID NO: 366295 - DNA, 20 bp, Artificial Sequence
  chemically synthesized
tatatacgtaccgaacaccg

SEQ ID NO: 366296 - DNA, 20 bp, Artificial Sequence
  chemically synthesized
tatctgggtgctccggtgtt

SEQ ID NO: 366297 - DNA, 20 bp, Artificial Sequence
  chemically synthesized
gtaccgaacaccggagcacc

SEQ ID NO: 366298 - DNA, 20 bp, Artificial Sequence
  chemically synthesized
ctttatatatctgggtgctc

SEQ ID NO: 366299 - DNA, 20 bp, Artificial Sequence
  chemically synthesized
taatgttgctttatatatct

SEQ ID NO: 366300 - DNA, 20 bp, Artificial Sequence
  chemically synthesized
ataatgttgctttatatatc

SEQ ID NO: 366301 - DNA, 20 bp, Artificial Sequence
  chemically synthesized
ccggagcacccagatatata

SEQ ID NO: 366302 - DNA, 20 bp, Artificial Sequence
  chemically synthesized
gatatataaagcaacattat

SEQ ID NO: 366303 - DNA, 20 bp, Artificial Sequence
  chemically synthesized
aagcaacattattagaccta

SEQ ID NO: 366304 - DNA, 20 bp, Artificial Sequence
  chemically synthesized
gcaacattattagacctaaa

SEQ ID NO: 366305 - DNA, 20 bp, Artificial Sequence
  chemically synthesized
aacattattagacctaaaga

SEQ ID NO: 366306 - DNA, 20 bp, Artificial Sequence
  chemically synthesized
tgaggtttccagctctcttt

SEQ ID NO: 366307 - DNA, 20 bp, Artificial Sequence
  chemically synthesized
ttgaggtttccagctctctt

SEQ ID NO: 366308 - DNA, 20 bp, Artificial Sequence
  chemically synthesized
ttattagacctaaagagagc

SEQ ID NO: 366309 - DNA, 20 bp, Artificial Sequence
  chemically synthesized
aagtggggtattgaggtttc

SEQ ID NO: 366310 - DNA, 20 bp, Artificial Sequence
  chemically synthesized
aggctgaaagtggggtattg

SEQ ID NO: 366311 - DNA, 20 bp, Artificial Sequence
  chemically synthesized
aaggctgaaagtggggtatt

SEQ ID NO: 366312 - DNA, 20 bp, Artificial Sequence
  chemically synthesized
aaacctcaataccccacttt

SEQ ID NO: 366313 - DNA, 20 bp, Artificial Sequence
  chemically synthesized
gacgtccaaggctgaaagtg

SEQ ID NO: 366314 - DNA, 20 bp, Artificial Sequence
  chemically synthesized
tgacgtccaaggctgaaagt

SEQ ID NO: 366315 - DNA, 20 bp, Artificial Sequence
  chemically synthesized
atgacgtccaaggctgaaag

SEQ ID NO: 366316 - DNA, 20 bp, Artificial Sequence
  chemically synthesized
caataccccactttcagcct

SEQ ID NO: 366317 - DNA, 20 bp, Artificial Sequence
  chemically synthesized
ctgatgacgtccaaggctga

SEQ ID NO: 366318 - DNA, 20 bp, Artificial Sequence
  chemically synthesized
tttttgcctgatgacgtcca

SEQ ID NO: 366319 - DNA, 20 bp, Artificial Sequence
  chemically synthesized
ctttttgcctgatgacgtcc

SEQ ID NO: 366320 - DNA, 20 bp, Artificial Sequence
  chemically synthesized
ctttcagccttggacgtcat

SEQ ID NO: 366321 - DNA, 20 bp, Artificial Sequence
  chemically synthesized
tttcagccttggacgtcatc

SEQ ID NO: 366322 - DNA, 20 bp, Artificial Sequence
  chemically synthesized
cttggacgtcatcaggcaaa

SEQ ID NO: 366323 - DNA, 20 bp, Artificial Sequence
  chemically synthesized
tcatcaggcaaaaagtcaac

SEQ ID NO: 366324 - DNA, 20 bp, Artificial Sequence
  chemically synthesized
catcaggcaaaaagtcaact

SEQ ID NO: 366325 - DNA, 20 bp, Artificial Sequence
  chemically synthesized
agattaagttcaatgtttcc

SEQ ID NO: 366326 - DNA, 20 bp, Artificial Sequence
  chemically synthesized
tttagtctgtagtacagatt

SEQ ID NO: 366327 - DNA, 20 bp, Artificial Sequence
  chemically synthesized
attgaacttaatctgtacta

SEQ ID NO: 366328 - DNA, 20 bp, Artificial Sequence
  chemically synthesized
ggtacatttagtctgtagta

SEQ ID NO: 366329 - DNA, 20 bp, Artificial Sequence
  chemically synthesized
tattaggtacatttagtctg

SEQ ID NO: 366330 - DNA, 20 bp, Artificial Sequence
  chemically synthesized
aaatatttattaggtacatt

SEQ ID NO: 366331 - DNA, 20 bp, Artificial Sequence
  chemically synthesized
atgttctgtaaatatttatt

SEQ ID NO: 366332 - DNA, 20 bp, Artificial Sequence
  chemically synthesized
aatgttctgtaaatatttat

SEQ ID NO: 366333 - DNA, 20 bp, Artificial Sequence
  chemically synthesized
atgtacctaataaatattta

SEQ ID NO: 366334 - DNA, 20 bp, Artificial Sequence
  chemically synthesized
ttacagaacatttcaaccaa

SEQ ID NO: 366335 - DNA, 20 bp, Artificial Sequence
  chemically synthesized
aacatttcaaccaacagctg

SEQ ID NO: 366336 - DNA, 20 bp, Artificial Sequence
  chemically synthesized
aatgtacactctgcagctgt

SEQ ID NO: 366337 - DNA, 20 bp, Artificial Sequence
  chemically synthesized
catttcaaccaacagctgca

SEQ ID NO: 366338 - DNA, 20 bp, Artificial Sequence
  chemically synthesized
tgagaggaatgtacactctg

SEQ ID NO: 366339 - DNA, 20 bp, Artificial Sequence
  chemically synthesized
atcctccatgtggtgatgag

SEQ ID NO: 366340 - DNA, 20 bp, Artificial Sequence
  chemically synthesized
aatcctccatgtggtgatga

SEQ ID NO: 366341 - DNA, 20 bp, Artificial Sequence
  chemically synthesized
agaatcctccatgtggtgat

SEQ ID NO: 366342 - DNA, 20 bp, Artificial Sequence
  chemically synthesized
acattcctctcatcaccaca

SEQ ID NO: 366343 - DNA, 20 bp, Artificial Sequence
  chemically synthesized
attcctctcatcaccacatg

SEQ ID NO: 366344 - DNA, 20 bp, Artificial Sequence
  chemically synthesized
ttcctctcatcaccacatgg

SEQ ID NO: 366345 - DNA, 20 bp, Artificial Sequence
  chemically synthesized
atccttgagaatcctccatg

SEQ ID NO: 366346 - DNA, 20 bp, Artificial Sequence
  chemically synthesized
tcaccacatggaggattctc

SEQ ID NO: 366347 - DNA, 20 bp, Artificial Sequence
  chemically synthesized
caccacatggaggattctca

SEQ ID NO: 366348 - DNA, 20 bp, Artificial Sequence
  chemically synthesized
acatggaggattctcaagga

SEQ ID NO: 366349 - DNA, 20 bp, Artificial Sequence
  chemically synthesized
catggaggattctcaaggat

SEQ ID NO: 366350 - DNA, 20 bp, Artificial Sequence
  chemically synthesized
ctaacatatggcccatcctt

SEQ ID NO: 366351 - DNA, 20 bp, Artificial Sequence
  chemically synthesized
ctcaaggatgggccatatgt

SEQ ID NO: 366352 - DNA, 20 bp, Artificial Sequence
  chemically synthesized
tcaaggatgggccatatgtt

SEQ ID NO: 366353 - DNA, 20 bp, Artificial Sequence
  chemically synthesized
ttgttttgtggcctaacata

SEQ ID NO: 366354 - DNA, 20 bp, Artificial Sequence
  chemically synthesized
catatgttaggccacaaaac

SEQ ID NO: 366355 - DNA, 20 bp, Artificial Sequence
  chemically synthesized
tgaatttaaggcttgttttg

SEQ ID NO: 366356 - DNA, 20 bp, Artificial Sequence
  chemically synthesized
atttcaattttttgaattta

SEQ ID NO: 366357 - DNA, 20 bp, Artificial Sequence
  chemically synthesized
tatttcaattttttgaattt

SEQ ID NO: 366358 - DNA, 20 bp, Artificial Sequence
  chemically synthesized
attcaaaaaattgaaatata

SEQ ID NO: 366359 - DNA, 20 bp, Artificial Sequence
  chemically synthesized
tcattcaactgtggtcagat

SEQ ID NO: 366360 - DNA, 20 bp, Artificial Sequence
  chemically synthesized
taaagtatcttatctgacca

SEQ ID NO: 366361 - DNA, 20 bp, Artificial Sequence
  chemically synthesized
tcagttcattcaactgtggt

SEQ ID NO: 366362 - DNA, 20 bp, Artificial Sequence
  chemically synthesized
tttctcagttcattcaactg

SEQ ID NO: 366363 - DNA, 20 bp, Artificial Sequence
  chemically synthesized
tgaccacagttgaatgaact

SEQ ID NO: 366364 - DNA, 20 bp, Artificial Sequence
  chemically synthesized
agttgaatgaactgagaaat

SEQ ID NO: 366365 - DNA, 20 bp, Artificial Sequence
  chemically synthesized
attcctcattactgatttct

SEQ ID NO: 366366 - DNA, 20 bp, Artificial Sequence
  chemically synthesized
tgaactgagaaatcagtaat

SEQ ID NO: 366367 - DNA, 20 bp, Artificial Sequence
  chemically synthesized
gaactgagaaatcagtaatg

SEQ ID NO: 366368 - DNA, 20 bp, Artificial Sequence
  chemically synthesized
ttgaaaattatacaaaacac

SEQ ID NO: 366369 - DNA, 20 bp, Artificial Sequence
  chemically synthesized
tgaaaattatacaaaacaca

SEQ ID NO: 366370 - DNA, 20 bp, Artificial Sequence
  chemically synthesized
gaaaattatacaaaacacaa

SEQ ID NO: 366371 - DNA, 20 bp, Artificial Sequence
  chemically synthesized
actgatcattcaagagaata

SEQ ID NO: 366372 - DNA, 20 bp, Artificial Sequence
  chemically synthesized
ttgacccactgatcattcaa

SEQ ID NO: 366373 - DNA, 20 bp, Artificial Sequence
  chemically synthesized
tctatattctcttgaatgat

SEQ ID NO: 366374 - DNA, 20 bp, Artificial Sequence
  chemically synthesized
cattgacccactgatcattc

SEQ ID NO: 366375 - DNA, 20 bp, Artificial Sequence
  chemically synthesized
atattctcttgaatgatcag

SEQ ID NO: 366376 - DNA, 20 bp, Artificial Sequence
  chemically synthesized
tattctcttgaatgatcagt

SEQ ID NO: 366377 - DNA, 20 bp, Artificial Sequence
  chemically synthesized
gaatgatcagtgggtcaatg

SEQ ID NO: 366378 - DNA, 20 bp, Artificial Sequence
  chemically synthesized
gggtcaatgaagaaattcat

SEQ ID NO: 366379 - DNA, 20 bp, Artificial Sequence
  chemically synthesized
ggtcaatgaagaaattcata

SEQ ID NO: 366380 - DNA, 20 bp, Artificial Sequence
  chemically synthesized
caatgaagaaattcataagg

SEQ ID NO: 366381 - DNA, 20 bp, Artificial Sequence
  chemically synthesized
tgtgtttacagttttgtttc

SEQ ID NO: 366382 - DNA, 20 bp, Artificial Sequence
  chemically synthesized
ttgaaacaaaactgtaaaca

SEQ ID NO: 366383 - DNA, 20 bp, Artificial Sequence
  chemically synthesized
gttttagtatgctgtgttta

SEQ ID NO: 366384 - DNA, 20 bp, Artificial Sequence
  chemically synthesized
acacagcatactaaaacttg

SEQ ID NO: 366385 - DNA, 20 bp, Artificial Sequence
  chemically synthesized
tatctgtagcccacaagttt

SEQ ID NO: 366386 - DNA, 20 bp, Artificial Sequence
  chemically synthesized
cacagcatactaaaacttgt

SEQ ID NO: 366387 - DNA, 20 bp, Artificial Sequence
  chemically synthesized
ctgatttatctgtagcccac

SEQ ID NO: 366388 - DNA, 20 bp, Artificial Sequence
  chemically synthesized
atactaaaacttgtgggcta

SEQ ID NO: 366389 - DNA, 20 bp, Artificial Sequence
  chemically synthesized
tgctagtactgatttatctg

SEQ ID NO: 366390 - DNA, 20 bp, Artificial Sequence
  chemically synthesized
cttgtgggctacagataaat

SEQ ID NO: 366391 - DNA, 20 bp, Artificial Sequence
  chemically synthesized
ggctacagataaatcagtac

SEQ ID NO: 366392 - DNA, 20 bp, Artificial Sequence
  chemically synthesized
cagataaatcagtactagca

SEQ ID NO: 366393 - DNA, 20 bp, Artificial Sequence
  chemically synthesized
cttattgctgtaaactttgc

SEQ ID NO: 366394 - DNA, 20 bp, Artificial Sequence
  chemically synthesized
atcagtactagcaaagttta

SEQ ID NO: 366395 - DNA, 20 bp, Artificial Sequence
  chemically synthesized
ctagcaaagtttacagcaat

SEQ ID NO: 366396 - DNA, 20 bp, Artificial Sequence
  chemically synthesized
tttttttttttttttgatac

SEQ ID NO: 366397 - DNA, 20 bp, Artificial Sequence
  chemically synthesized
tgtatcaaaaaaaaaaaaaa

SEQ ID NO: 366398 - DNA, 20 bp, Artificial Sequence
  chemically synthesized
tatcaaaaaaaaaaaaaaaa

SEQ ID NO: 366399 - DNA, 20 bp, Artificial Sequence
  chemically synthesized
aagagaaacaatacatctta

SEQ ID NO: 366400 - DNA, 20 bp, Artificial Sequence
  chemically synthesized
aacaatacatcttaaagaac

SEQ ID NO: 366401 - DNA, 20 bp, Artificial Sequence
  chemically synthesized
gtttgctattctagttcttt

SEQ ID NO: 366402 - DNA, 20 bp, Artificial Sequence
  chemically synthesized
tacatcttaaagaactagaa

SEQ ID NO: 366403 - DNA, 20 bp, Artificial Sequence
  chemically synthesized
ttgagtttggtttgctattc

SEQ ID NO: 366404 - DNA, 20 bp, Artificial Sequence
  chemically synthesized
acacaatctaattttgagtt

SEQ ID NO: 366405 - DNA, 20 bp, Artificial Sequence
  chemically synthesized
tagcaaaccaaactcaaaat

SEQ ID NO: 366406 - DNA, 20 bp, Artificial Sequence
  chemically synthesized
tcatgacacaatctaatttt

SEQ ID NO: 366407 - DNA, 20 bp, Artificial Sequence
  chemically synthesized
caaaattagattgtgtcatg

SEQ ID NO: 366408 - DNA, 20 bp, Artificial Sequence
  chemically synthesized
gaagacatgcaaaacccgaa

SEQ ID NO: 366409 - DNA, 20 bp, Artificial Sequence
  chemically synthesized
tacttgttgttggtctgttc

SEQ ID NO: 366410 - DNA, 20 bp, Artificial Sequence
  chemically synthesized
ttacttgttgttggtctgtt

SEQ ID NO: 366411 - DNA, 20 bp, Artificial Sequence
  chemically synthesized
aacccgaacagaccaacaac

SEQ ID NO: 366412 - DNA, 20 bp, Artificial Sequence
  chemically synthesized
ttgatctcattacttgttgt

SEQ ID NO: 366413 - DNA, 20 bp, Artificial Sequence
  chemically synthesized
acagaccaacaacaagtaat

SEQ ID NO: 366414 - DNA, 20 bp, Artificial Sequence
  chemically synthesized
aacaacaagtaatgagatca

SEQ ID NO: 366415 - DNA, 20 bp, Artificial Sequence
  chemically synthesized
aatgagatcaaagatgtaaa

SEQ ID NO: 366416 - DNA, 20 bp, Artificial Sequence
  chemically synthesized
caaagatgtaaaaagtctcc

SEQ ID NO: 366417 - DNA, 20 bp, Artificial Sequence
  chemically synthesized
atgtaaaaagtctcccagtg

SEQ ID NO: 366418 - DNA, 20 bp, Artificial Sequence
  chemically synthesized
ctcgggcttttcttcactgg

SEQ ID NO: 366419 - DNA, 20 bp, Artificial Sequence
  chemically synthesized
gtctcgggcttttcttcact

SEQ ID NO: 366420 - DNA, 20 bp, Artificial Sequence
  chemically synthesized
ggtctcgggcttttcttcac

SEQ ID NO: 366421 - DNA, 20 bp, Artificial Sequence
  chemically synthesized
aaaagtctcccagtgaagaa

SEQ ID NO: 366422 - DNA, 20 bp, Artificial Sequence
  chemically synthesized
ctcccagtgaagaaaagccc

SEQ ID NO: 366423 - DNA, 20 bp, Artificial Sequence
  chemically synthesized
cagtgaagccatcaggtctc

SEQ ID NO: 366424 - DNA, 20 bp, Artificial Sequence
  chemically synthesized
gcagtgaagccatcaggtct

SEQ ID NO: 366425 - DNA, 20 bp, Artificial Sequence
  chemically synthesized
aagaaaagcccgagacctga

SEQ ID NO: 366426 - DNA, 20 bp, Artificial Sequence
  chemically synthesized
cattcagcagtgaagccatc

SEQ ID NO: 366427 - DNA, 20 bp, Artificial Sequence
  chemically synthesized
acattcagcagtgaagccat

SEQ ID NO: 366428 - DNA, 20 bp, Artificial Sequence
  chemically synthesized
tttggtaacattcagcagtg

SEQ ID NO: 366429 - DNA, 20 bp, Artificial Sequence
  chemically synthesized
caatgtttggtaacattcag

SEQ ID NO: 366430 - DNA, 20 bp, Artificial Sequence
  chemically synthesized
tttcaatgtttggtaacatt

SEQ ID NO: 366431 - DNA, 20 bp, Artificial Sequence
  chemically synthesized
gtattaggtgtttcaatgtt

SEQ ID NO: 366432 - DNA, 20 bp, Artificial Sequence
  chemically synthesized
ttcacaatagtttgagtatt

SEQ ID NO: 366433 - DNA, 20 bp, Artificial Sequence
  chemically synthesized
tttcacaatagtttgagtat

SEQ ID NO: 366434 - DNA, 20 bp, Artificial Sequence
  chemically synthesized
cctctttttcacaatagttt

SEQ ID NO: 366435 - DNA, 20 bp, Artificial Sequence
  chemically synthesized
cctcctcctctttttcacaa

SEQ ID NO: 366436 - DNA, 20 bp, Artificial Sequence
  chemically synthesized
atactcaaactattgtgaaa

SEQ ID NO: 366437 - DNA, 20 bp, Artificial Sequence
  chemically synthesized
actcaaactattgtgaaaaa

SEQ ID NO: 366438 - DNA, 20 bp, Artificial Sequence
  chemically synthesized
ctcaaactattgtgaaaaag

SEQ ID NO: 366439 - DNA, 20 bp, Artificial Sequence
  chemically synthesized
caaactattgtgaaaaagag

SEQ ID NO: 366440 - DNA, 20 bp, Artificial Sequence
  chemically synthesized
aaactattgtgaaaaagagg

SEQ ID NO: 366441 - DNA, 20 bp, Artificial Sequence
  chemically synthesized
actattgtgaaaaagaggag

SEQ ID NO: 366442 - DNA, 20 bp, Artificial Sequence
  chemically synthesized
ctattgtgaaaaagaggagg

SEQ ID NO: 366443 - DNA, 20 bp, Artificial Sequence
  chemically synthesized
ttgtgaaaaagaggaggagg

SEQ ID NO: 366444 - DNA, 20 bp, Artificial Sequence
  chemically synthesized
gcctcacagaatgagttcag

SEQ ID NO: 366445 - DNA, 20 bp, Artificial Sequence
  chemically synthesized
ttggcctcacagaatgagtt

SEQ ID NO: 366446 - DNA, 20 bp, Artificial Sequence
  chemically synthesized
tacttctgaactcattctgt

SEQ ID NO: 366447 - DNA, 20 bp, Artificial Sequence
  chemically synthesized
taatattggcctcacagaat

SEQ ID NO: 366448 - DNA, 20 bp, Artificial Sequence
  chemically synthesized
acttctgaactcattctgtg

SEQ ID NO: 366449 - DNA, 20 bp, Artificial Sequence
  chemically synthesized
tcaggctaatattggcctca

SEQ ID NO: 366450 - DNA, 20 bp, Artificial Sequence
  chemically synthesized
tcattctgtgaggccaatat

SEQ ID NO: 366451 - DNA, 20 bp, Artificial Sequence
  chemically synthesized
ttttcgtgtcaggctaatat

SEQ ID NO: 366452 - DNA, 20 bp, Artificial Sequence
  chemically synthesized
atctgtctggttttcgtgtc

SEQ ID NO: 366453 - DNA, 20 bp, Artificial Sequence
  chemically synthesized
tatctgtctggttttcgtgt

SEQ ID NO: 366454 - DNA, 20 bp, Artificial Sequence
  chemically synthesized
tattagcctgacacgaaaac

SEQ ID NO: 366455 - DNA, 20 bp, Artificial Sequence
  chemically synthesized
agcctgacacgaaaaccaga

SEQ ID NO: 366456 - DNA, 20 bp, Artificial Sequence
  chemically synthesized
ttgttttctggatatctgtc

SEQ ID NO: 366457 - DNA, 20 bp, Artificial Sequence
  chemically synthesized
acgaaaaccagacagatatc

SEQ ID NO: 366458 - DNA, 20 bp, Artificial Sequence
  chemically synthesized
tagcctgcagttttgttttc

SEQ ID NO: 366459 - DNA, 20 bp, Artificial Sequence
  chemically synthesized
atatccagaaaacaaaactg

SEQ ID NO: 366460 - DNA, 20 bp, Artificial Sequence
  chemically synthesized
tatccagaaaacaaaactgc

SEQ ID NO: 366461 - DNA, 20 bp, Artificial Sequence
  chemically synthesized
ttgtcagagataatagcctg

SEQ ID NO: 366462 - DNA, 20 bp, Artificial Sequence
  chemically synthesized
tcagtatttgtcagagataa

SEQ ID NO: 366463 - DNA, 20 bp, Artificial Sequence
  chemically synthesized
ttttgtatcagtatttgtca

SEQ ID NO: 366464 - DNA, 20 bp, Artificial Sequence
  chemically synthesized
atttttgtatcagtatttgt

SEQ ID NO: 366465 - DNA, 20 bp, Artificial Sequence
  chemically synthesized
tttgttgaggatttttgtat

SEQ ID NO: 366466 - DNA, 20 bp, Artificial Sequence
  chemically synthesized
ggtttgctagtattttgttg

SEQ ID NO: 366467 - DNA, 20 bp, Artificial Sequence
  chemically synthesized
tggtttgctagtattttgtt

SEQ ID NO: 366468 - DNA, 20 bp, Artificial Sequence
  chemically synthesized
aaaaatcctcaacaaaatac

SEQ ID NO: 366469 - DNA, 20 bp, Artificial Sequence
  chemically synthesized
ttgtgttgaatttggtttgc

SEQ ID NO: 366470 - DNA, 20 bp, Artificial Sequence
  chemically synthesized
ttttaatgttgtgttgaatt

SEQ ID NO: 366471 - DNA, 20 bp, Artificial Sequence
  chemically synthesized
aaattcaacacaacattaaa

SEQ ID NO: 366472 - DNA, 20 bp, Artificial Sequence
  chemically synthesized
aattcaacacaacattaaaa

SEQ ID NO: 366473 - DNA, 20 bp, Artificial Sequence
  chemically synthesized
aaaggtcattcgttataacc

SEQ ID NO: 366474 - DNA, 20 bp, Artificial Sequence
  chemically synthesized
ggtcattcgttataaccaag

SEQ ID NO: 366475 - DNA, 20 bp, Artificial Sequence
  chemically synthesized
tccctaggacaaataccact

SEQ ID NO: 366476 - DNA, 20 bp, Artificial Sequence
  chemically synthesized
taaccaagtggtatttgtcc

SEQ ID NO: 366477 - DNA, 20 bp, Artificial Sequence
  chemically synthesized
aaccaagtggtatttgtcct

SEQ ID NO: 366478 - DNA, 20 bp, Artificial Sequence
  chemically synthesized
accaagtggtatttgtccta

SEQ ID NO: 366479 - DNA, 20 bp, Artificial Sequence
  chemically synthesized
tgacccatcttggcatccct

SEQ ID NO: 366480 - DNA, 20 bp, Artificial Sequence
  chemically synthesized
gtgacccatcttggcatccc

SEQ ID NO: 366481 - DNA, 20 bp, Artificial Sequence
  chemically synthesized
gtatttgtcctagggatgcc

SEQ ID NO: 366482 - DNA, 20 bp, Artificial Sequence
  chemically synthesized
ttgtcctagggatgccaaga

SEQ ID NO: 366483 - DNA, 20 bp, Artificial Sequence
  chemically synthesized
tgtcctagggatgccaagat

SEQ ID NO: 366484 - DNA, 20 bp, Artificial Sequence
  chemically synthesized
ttgcatatggtgacccatct

SEQ ID NO: 366485 - DNA, 20 bp, Artificial Sequence
  chemically synthesized
tcacattgattttttgcata

SEQ ID NO: 366486 - DNA, 20 bp, Artificial Sequence
  chemically synthesized
tatgcaaaaaatcaatgtga

SEQ ID NO: 366487 - DNA, 20 bp, Artificial Sequence
  chemically synthesized
aatgtgatagatcgtatgaa

SEQ ID NO: 366488 - DNA, 20 bp, Artificial Sequence
  chemically synthesized
tagatcgtatgaacagaatg

SEQ ID NO: 366489 - DNA, 20 bp, Artificial Sequence
  chemically synthesized
agatcgtatgaacagaatga

SEQ ID NO: 366490 - DNA, 20 bp, Artificial Sequence
  chemically synthesized
cagcatctattgaaatgata

SEQ ID NO: 366491 - DNA, 20 bp, Artificial Sequence
  chemically synthesized
caaaaaccatatcatttcaa

SEQ ID NO: 366492 - DNA, 20 bp, Artificial Sequence
  chemically synthesized
catttcaatagatgctgaaa

SEQ ID NO: 366493 - DNA, 20 bp, Artificial Sequence
  chemically synthesized
atttttatcaaatgcttttt

SEQ ID NO: 366494 - DNA, 20 bp, Artificial Sequence
  chemically synthesized
tttgagagtttttatcatga

SEQ ID NO: 366495 - DNA, 20 bp, Artificial Sequence
  chemically synthesized
ttttgagagtttttatcatg

SEQ ID NO: 366496 - DNA, 20 bp, Artificial Sequence
  chemically synthesized
atgataaaaactctcaaaac

SEQ ID NO: 366497 - DNA, 20 bp, Artificial Sequence
  chemically synthesized
gcttctatacccagttttga

SEQ ID NO: 366498 - DNA, 20 bp, Artificial Sequence
  chemically synthesized
tgataaaaactctcaaaact

SEQ ID NO: 366499 - DNA, 20 bp, Artificial Sequence
  chemically synthesized
ctgcttctatacccagtttt

SEQ ID NO: 366500 - DNA, 20 bp, Artificial Sequence
  chemically synthesized
aaaactctcaaaactgggta

SEQ ID NO: 366501 - DNA, 20 bp, Artificial Sequence
  chemically synthesized
actctcaaaactgggtatag

SEQ ID NO: 366502 - DNA, 20 bp, Artificial Sequence
  chemically synthesized
aggtatgctgcttctatacc

SEQ ID NO: 366503 - DNA, 20 bp, Artificial Sequence
  chemically synthesized
ctcaaaactgggtatagaag

SEQ ID NO: 366504 - DNA, 20 bp, Artificial Sequence
  chemically synthesized
agaagcagcataccttaaca

SEQ ID NO: 366505 - DNA, 20 bp, Artificial Sequence
  chemically synthesized
atgtggcttttactgtgtta

SEQ ID NO: 366506 - DNA, 20 bp, Artificial Sequence
  chemically synthesized
tatgtggcttttactgtgtt

SEQ ID NO: 366507 - DNA, 20 bp, Artificial Sequence
  chemically synthesized
agcataccttaacacagtaa

SEQ ID NO: 366508 - DNA, 20 bp, Artificial Sequence
  chemically synthesized
acacagtaaaagccacatat

SEQ ID NO: 366509 - DNA, 20 bp, Artificial Sequence
  chemically synthesized
agctgtgggtttctcatatg

SEQ ID NO: 366510 - DNA, 20 bp, Artificial Sequence
  chemically synthesized
agccacatatgagaaaccca

SEQ ID NO: 366511 - DNA, 20 bp, Artificial Sequence
  chemically synthesized
ttcagtatgaaattagctgt

SEQ ID NO: 366512 - DNA, 20 bp, Artificial Sequence
  chemically synthesized
attcagtatgaaattagctg

SEQ ID NO: 366513 - DNA, 20 bp, Artificial Sequence
  chemically synthesized
ttccccattcagtatgaaat

SEQ ID NO: 366514 - DNA, 20 bp, Artificial Sequence
  chemically synthesized
acagctaatttcatactgaa

SEQ ID NO: 366515 - DNA, 20 bp, Artificial Sequence
  chemically synthesized
cagctaatttcatactgaat

SEQ ID NO: 366516 - DNA, 20 bp, Artificial Sequence
  chemically synthesized
agctaatttcatactgaatg

SEQ ID NO: 366517 - DNA, 20 bp, Artificial Sequence
  chemically synthesized
tcttgtagtttttccccatt

SEQ ID NO: 366518 - DNA, 20 bp, Artificial Sequence
  chemically synthesized
actgaatggggaaaaactac

SEQ ID NO: 366519 - DNA, 20 bp, Artificial Sequence
  chemically synthesized
gatcttagagaaaagtcttg

SEQ ID NO: 366520 - DNA, 20 bp, Artificial Sequence
  chemically synthesized
aaactacaagacttttctct

SEQ ID NO: 366521 - DNA, 20 bp, Artificial Sequence
  chemically synthesized
ttgttacagatcttagagaa

SEQ ID NO: 366522 - DNA, 20 bp, Artificial Sequence
  chemically synthesized
catccttgttacagatctta

SEQ ID NO: 366523 - DNA, 20 bp, Artificial Sequence
  chemically synthesized
ggcatccttgttacagatct

SEQ ID NO: 366524 - DNA, 20 bp, Artificial Sequence
  chemically synthesized
ttttctctaagatctgtaac

SEQ ID NO: 366525 - DNA, 20 bp, Artificial Sequence
  chemically synthesized
tttctctaagatctgtaaca

SEQ ID NO: 366526 - DNA, 20 bp, Artificial Sequence
  chemically synthesized
gaaagtgggcatccttgtta

SEQ ID NO: 366527 - DNA, 20 bp, Artificial Sequence
  chemically synthesized
taaacaacagtagtgaaagt

SEQ ID NO: 366528 - DNA, 20 bp, Artificial Sequence
  chemically synthesized
ttaaacaacagtagtgaaag

SEQ ID NO: 366529 - DNA, 20 bp, Artificial Sequence
  chemically synthesized
atgttaaacaacagtagtga

SEQ ID NO: 366530 - DNA, 20 bp, Artificial Sequence
  chemically synthesized
agtaatatgttaaacaacag

SEQ ID NO: 366531 - DNA, 20 bp, Artificial Sequence
  chemically synthesized
tgtagtaatatgttaaacaa

SEQ ID NO: 366532 - DNA, 20 bp, Artificial Sequence
  chemically synthesized
gttgtttaacatattactac

SEQ ID NO: 366533 - DNA, 20 bp, Artificial Sequence
  chemically synthesized
taacatattactacaagtcc

SEQ ID NO: 366534 - DNA, 20 bp, Artificial Sequence
  chemically synthesized
tttgatctagctaggacttg

SEQ ID NO: 366535 - DNA, 20 bp, Artificial Sequence
  chemically synthesized
atattactacaagtcctagc

SEQ ID NO: 366536 - DNA, 20 bp, Artificial Sequence
  chemically synthesized
tttctttctttgatctagct

SEQ ID NO: 366537 - DNA, 20 bp, Artificial Sequence
  chemically synthesized
gtttctttctttgatctagc

SEQ ID NO: 366538 - DNA, 20 bp, Artificial Sequence
  chemically synthesized
tacaagtcctagctagatca

SEQ ID NO: 366539 - DNA, 20 bp, Artificial Sequence
  chemically synthesized
ctttgtttctttctttgatc

SEQ ID NO: 366540 - DNA, 20 bp, Artificial Sequence
  chemically synthesized
agtcctagctagatcaaaga

SEQ ID NO: 366541 - DNA, 20 bp, Artificial Sequence
  chemically synthesized
ctagatcaaagaaagaaaca

SEQ ID NO: 366542 - DNA, 20 bp, Artificial Sequence
  chemically synthesized
tagatcaaagaaagaaacaa

SEQ ID NO: 366543 - DNA, 20 bp, Artificial Sequence
  chemically synthesized
agatcaaagaaagaaacaaa

SEQ ID NO: 366544 - DNA, 20 bp, Artificial Sequence
  chemically synthesized
agaaagaaacaaagggcatc

SEQ ID NO: 366545 - DNA, 20 bp, Artificial Sequence
  chemically synthesized
caaagggcatccagattgaa

SEQ ID NO: 366546 - DNA, 20 bp, Artificial Sequence
  chemically synthesized
ttgattcttccttttcaatc

SEQ ID NO: 366547 - DNA, 20 bp, Artificial Sequence
  chemically synthesized
aaagggcatccagattgaaa

SEQ ID NO: 366548 - DNA, 20 bp, Artificial Sequence
  chemically synthesized
gggcatccagattgaaaagg

SEQ ID NO: 366549 - DNA, 20 bp, Artificial Sequence
  chemically synthesized
gattcctagttttgtaaaca

SEQ ID NO: 366550 - DNA, 20 bp, Artificial Sequence
  chemically synthesized
ggattcctagttttgtaaac

SEQ ID NO: 366551 - DNA, 20 bp, Artificial Sequence
  chemically synthesized
atgatccttgtttacaaaac

SEQ ID NO: 366552 - DNA, 20 bp, Artificial Sequence
  chemically synthesized
tgatccttgtttacaaaact

SEQ ID NO: 366553 - DNA, 20 bp, Artificial Sequence
  chemically synthesized
aagtcaggtaatgggattcc

SEQ ID NO: 366554 - DNA, 20 bp, Artificial Sequence
  chemically synthesized
ataatttgaagtcaggtaat

SEQ ID NO: 366555 - DNA, 20 bp, Artificial Sequence
  chemically synthesized
tataatttgaagtcaggtaa

SEQ ID NO: 366556 - DNA, 20 bp, Artificial Sequence
  chemically synthesized
ctgtagtataatttgaagtc

SEQ ID NO: 366557 - DNA, 20 bp, Artificial Sequence
  chemically synthesized
tctgtagtataatttgaagt

SEQ ID NO: 366558 - DNA, 20 bp, Artificial Sequence
  chemically synthesized
tagctctgtagtataatttg

SEQ ID NO: 366559 - DNA, 20 bp, Artificial Sequence
  chemically synthesized
cctgacttcaaattatacta

SEQ ID NO: 366560 - DNA, 20 bp, Artificial Sequence
  chemically synthesized
tgacttcaaattatactaca

SEQ ID NO: 366561 - DNA, 20 bp, Artificial Sequence
  chemically synthesized
ttttggttagtatagctctg

SEQ ID NO: 366562 - DNA, 20 bp, Artificial Sequence
  chemically synthesized
gcatgcatttttggttagta

SEQ ID NO: 366563 - DNA, 20 bp, Artificial Sequence
  chemically synthesized
cattagcatgcatttttggt

SEQ ID NO: 366564 - DNA, 20 bp, Artificial Sequence
  chemically synthesized
atgccattagcatgcatttt

SEQ ID NO: 366565 - DNA, 20 bp, Artificial Sequence
  chemically synthesized
taaccaaaaatgcatgctaa

SEQ ID NO: 366566 - DNA, 20 bp, Artificial Sequence
  chemically synthesized
tgtgtctgtttttatgccat

SEQ ID NO: 366567 - DNA, 20 bp, Artificial Sequence
  chemically synthesized
gcatgctaatggcataaaaa

SEQ ID NO: 366568 - DNA, 20 bp, Artificial Sequence
  chemically synthesized
atggcataaaaacagacaca

SEQ ID NO: 366569 - DNA, 20 bp, Artificial Sequence
  chemically synthesized
aaaacagacacatagaccaa

SEQ ID NO: 366570 - DNA, 20 bp, Artificial Sequence
  chemically synthesized
agacacatagaccaatggaa

SEQ ID NO: 366571 - DNA, 20 bp, Artificial Sequence
  chemically synthesized
tgggctctattctgttccat

SEQ ID NO: 366572 - DNA, 20 bp, Artificial Sequence
  chemically synthesized
catagaccaatggaacagaa

SEQ ID NO: 366573 - DNA, 20 bp, Artificial Sequence
  chemically synthesized
tagaccaatggaacagaata

SEQ ID NO: 366574 - DNA, 20 bp, Artificial Sequence
  chemically synthesized
caatggaacagaatagagcc

SEQ ID NO: 366575 - DNA, 20 bp, Artificial Sequence
  chemically synthesized
aggtctgtggagttgtgtct

SEQ ID NO: 366576 - DNA, 20 bp, Artificial Sequence
  chemically synthesized
taggtctgtggagttgtgtc

SEQ ID NO: 366577 - DNA, 20 bp, Artificial Sequence
  chemically synthesized
agagcccagacacaactcca

SEQ ID NO: 366578 - DNA, 20 bp, Artificial Sequence
  chemically synthesized
gagtttactttaggtctgtg

SEQ ID NO: 366579 - DNA, 20 bp, Artificial Sequence
  chemically synthesized
atgagtttactttaggtctg

SEQ ID NO: 366580 - DNA, 20 bp, Artificial Sequence
  chemically synthesized
gacacaactccacagaccta

SEQ ID NO: 366581 - DNA, 20 bp, Artificial Sequence
  chemically synthesized
gttaaaaatgagtttacttt

SEQ ID NO: 366582 - DNA, 20 bp, Artificial Sequence
  chemically synthesized
tgttaaaaatgagtttactt

SEQ ID NO: 366583 - DNA, 20 bp, Artificial Sequence
  chemically synthesized
ttggcacctttgttaaaaat

SEQ ID NO: 366584 - DNA, 20 bp, Artificial Sequence
  chemically synthesized
aagtaaactcatttttaaca

SEQ ID NO: 366585 - DNA, 20 bp, Artificial Sequence
  chemically synthesized
agtaaactcatttttaacaa

SEQ ID NO: 366586 - DNA, 20 bp, Artificial Sequence
  chemically synthesized
tcatttttaacaaaggtgcc

SEQ ID NO: 366587 - DNA, 20 bp, Artificial Sequence
  chemically synthesized
ttttcttcagtgtatgttct

SEQ ID NO: 366588 - DNA, 20 bp, Artificial Sequence
  chemically synthesized
ggtgccaagaacatacactg

SEQ ID NO: 366589 - DNA, 20 bp, Artificial Sequence
  chemically synthesized
caagaacatacactgaagaa

SEQ ID NO: 366590 - DNA, 20 bp, Artificial Sequence
  chemically synthesized
tgaaaagatggtcttttctt

SEQ ID NO: 366591 - DNA, 20 bp, Artificial Sequence
  chemically synthesized
agcaccatttattgaaaaga

SEQ ID NO: 366592 - DNA, 20 bp, Artificial Sequence
  chemically synthesized
tctcagcaccatttattgaa

SEQ ID NO: 366593 - DNA, 20 bp, Artificial Sequence
  chemically synthesized
aagaccatcttttcaataaa

SEQ ID NO: 366594 - DNA, 20 bp, Artificial Sequence
  chemically synthesized
tcttttcaataaatggtgct

SEQ ID NO: 366595 - DNA, 20 bp, Artificial Sequence
  chemically synthesized
ataaatggtgctgagaaaac

SEQ ID NO: 366596 - DNA, 20 bp, Artificial Sequence
  chemically synthesized
atatccatatccagttttct

SEQ ID NO: 366597 - DNA, 20 bp, Artificial Sequence
  chemically synthesized
ggtgctgagaaaactggata

SEQ ID NO: 366598 - DNA, 20 bp, Artificial Sequence
  chemically synthesized
ttcttttgcatatccatatc

SEQ ID NO: 366599 - DNA, 20 bp, Artificial Sequence
  chemically synthesized
aactggatatggatatgcaa

SEQ ID NO: 366600 - DNA, 20 bp, Artificial Sequence
  chemically synthesized
gatatgcaaaagaatgaaat

SEQ ID NO: 366601 - DNA, 20 bp, Artificial Sequence
  chemically synthesized
ttgtatatggcgagagataa

SEQ ID NO: 366602 - DNA, 20 bp, Artificial Sequence
  chemically synthesized
tttgtatatggcgagagata

SEQ ID NO: 366603 - DNA, 20 bp, Artificial Sequence
  chemically synthesized
ttttgtatatggcgagagat

SEQ ID NO: 366604 - DNA, 20 bp, Artificial Sequence
  chemically synthesized
gatacttttgtatatggcga

SEQ ID NO: 366605 - DNA, 20 bp, Artificial Sequence
  chemically synthesized
ttgatacttttgtatatggc

SEQ ID NO: 366606 - DNA, 20 bp, Artificial Sequence
  chemically synthesized
ttatctctcgccatatacaa

SEQ ID NO: 366607 - DNA, 20 bp, Artificial Sequence
  chemically synthesized
tagattgatacttttgtata

SEQ ID NO: 366608 - DNA, 20 bp, Artificial Sequence
  chemically synthesized
atatacaaaagtatcaatct

SEQ ID NO: 366609 - DNA, 20 bp, Artificial Sequence
  chemically synthesized
tacaaaagtatcaatctaag

SEQ ID NO: 366610 - DNA, 20 bp, Artificial Sequence
  chemically synthesized
atttaagtctttgttccact

SEQ ID NO: 366611 - DNA, 20 bp, Artificial Sequence
  chemically synthesized
gtatcaatctaagtggaaca

SEQ ID NO: 366612 - DNA, 20 bp, Artificial Sequence
  chemically synthesized
tggaacaaagacttaaatct

SEQ ID NO: 366613 - DNA, 20 bp, Artificial Sequence
  chemically synthesized
ggaacaaagacttaaatcta

SEQ ID NO: 366614 - DNA, 20 bp, Artificial Sequence
  chemically synthesized
tagtttgaggccttagattt

SEQ ID NO: 366615 - DNA, 20 bp, Artificial Sequence
  chemically synthesized
agtttcatagtttgaggcct

SEQ ID NO: 366616 - DNA, 20 bp, Artificial Sequence
  chemically synthesized
tgtagtagtttcatagtttg

SEQ ID NO: 366617 - DNA, 20 bp, Artificial Sequence
  chemically synthesized
ttgtagtagtttcatagttt

SEQ ID NO: 366618 - DNA, 20 bp, Artificial Sequence
  chemically synthesized
gatttcttgtagtagtttca

SEQ ID NO: 366619 - DNA, 20 bp, Artificial Sequence
  chemically synthesized
tcaaactatgaaactactac

SEQ ID NO: 366620 - DNA, 20 bp, Artificial Sequence
  chemically synthesized
atcccaatgatttcttgtag

SEQ ID NO: 366621 - DNA, 20 bp, Artificial Sequence
  chemically synthesized
tttatcccaatgatttcttg

SEQ ID NO: 366622 - DNA, 20 bp, Artificial Sequence
  chemically synthesized
aaactactacaagaaatcat

SEQ ID NO: 366623 - DNA, 20 bp, Artificial Sequence
  chemically synthesized
aactactacaagaaatcatt

SEQ ID NO: 366624 - DNA, 20 bp, Artificial Sequence
  chemically synthesized
atcattgggataaaatctcc

SEQ ID NO: 366625 - DNA, 20 bp, Artificial Sequence
  chemically synthesized
ttgcctagaccagtgtcttg

SEQ ID NO: 366626 - DNA, 20 bp, Artificial Sequence
  chemically synthesized
ggataaaatctccaagacac

SEQ ID NO: 366627 - DNA, 20 bp, Artificial Sequence
  chemically synthesized
atttgcctagaccagtgtct

SEQ ID NO: 366628 - DNA, 20 bp, Artificial Sequence
  chemically synthesized
aaatctccaagacactggtc

SEQ ID NO: 366629 - DNA, 20 bp, Artificial Sequence
  chemically synthesized
aatctccaagacactggtct

SEQ ID NO: 366630 - DNA, 20 bp, Artificial Sequence
  chemically synthesized
caagaaatatttgcctagac

SEQ ID NO: 366631 - DNA, 20 bp, Artificial Sequence
  chemically synthesized
ttgctcaagaaatatttgcc

SEQ ID NO: 366632 - DNA, 20 bp, Artificial Sequence
  chemically synthesized
ggtctaggcaaatatttctt

SEQ ID NO: 366633 - DNA, 20 bp, Artificial Sequence
  chemically synthesized
tgcttggtagggtattgctc

SEQ ID NO: 366634 - DNA, 20 bp, Artificial Sequence
  chemically synthesized
ttcttgagcaataccctacc

SEQ ID NO: 366635 - DNA, 20 bp, Artificial Sequence
  chemically synthesized
ttgattgcttgtgcttggta

SEQ ID NO: 366636 - DNA, 20 bp, Artificial Sequence
  chemically synthesized
tttgattgcttgtgcttggt

SEQ ID NO: 366637 - DNA, 20 bp, Artificial Sequence
  chemically synthesized
ctttgattgcttgtgcttgg

SEQ ID NO: 366638 - DNA, 20 bp, Artificial Sequence
  chemically synthesized
agcaataccctaccaagcac

SEQ ID NO: 366639 - DNA, 20 bp, Artificial Sequence
  chemically synthesized
ttgctttgattgcttgtgct

SEQ ID NO: 366640 - DNA, 20 bp, Artificial Sequence
  chemically synthesized
ctaccaagcacaagcaatca

SEQ ID NO: 366641 - DNA, 20 bp, Artificial Sequence
  chemically synthesized
caaagcaaacatgcacaaat

SEQ ID NO: 366642 - DNA, 20 bp, Artificial Sequence
  chemically synthesized
acatgcacaaatgagacatc

SEQ ID NO: 366643 - DNA, 20 bp, Artificial Sequence
  chemically synthesized
aaatgagacatcaagttaaa

SEQ ID NO: 366644 - DNA, 20 bp, Artificial Sequence
  chemically synthesized
caagttaaaaagcttctaca

SEQ ID NO: 366645 - DNA, 20 bp, Artificial Sequence
  chemically synthesized
ttgtattccttgctgtgtag

SEQ ID NO: 366646 - DNA, 20 bp, Artificial Sequence
  chemically synthesized
ttaaaaagcttctacacagc

SEQ ID NO: 366647 - DNA, 20 bp, Artificial Sequence
  chemically synthesized
taaaaagcttctacacagca

SEQ ID NO: 366648 - DNA, 20 bp, Artificial Sequence
  chemically synthesized
tgattgtattccttgctgtg

SEQ ID NO: 366649 - DNA, 20 bp, Artificial Sequence
  chemically synthesized
agcaaggaatacaatcaaca

SEQ ID NO: 366650 - DNA, 20 bp, Artificial Sequence
  chemically synthesized
ggaatacaatcaacaaagtg

SEQ ID NO: 366651 - DNA, 20 bp, Artificial Sequence
  chemically synthesized
caaagtgaagacacaacaca

SEQ ID NO: 366652 - DNA, 20 bp, Artificial Sequence
  chemically synthesized
aagtgaagacacaacacaca

SEQ ID NO: 366653 - DNA, 20 bp, Artificial Sequence
  chemically synthesized
tgaagacacaacacacagag

SEQ ID NO: 366654 - DNA, 20 bp, Artificial Sequence
  chemically synthesized
gaagacacaacacacagagt

SEQ ID NO: 366655 - DNA, 20 bp, Artificial Sequence
  chemically synthesized
agacacaacacacagagtag

SEQ ID NO: 366656 - DNA, 20 bp, Artificial Sequence
  chemically synthesized
acacaacacacagagtagga

SEQ ID NO: 366657 - DNA, 20 bp, Artificial Sequence
  chemically synthesized
cacagagtaggagagaatac

SEQ ID NO: 366658 - DNA, 20 bp, Artificial Sequence
  chemically synthesized
ttgtcaggtgggtagttggc

SEQ ID NO: 366659 - DNA, 20 bp, Artificial Sequence
  chemically synthesized
ttccttgtcaggtgggtagt

SEQ ID NO: 366660 - DNA, 20 bp, Artificial Sequence
  chemically synthesized
gttattccttgtcaggtggg

SEQ ID NO: 366661 - DNA, 20 bp, Artificial Sequence
  chemically synthesized
tggccaactacccacctgac

SEQ ID NO: 366662 - DNA, 20 bp, Artificial Sequence
  chemically synthesized
ttggttattccttgtcaggt

SEQ ID NO: 366663 - DNA, 20 bp, Artificial Sequence
  chemically synthesized
ggccaactacccacctgaca

SEQ ID NO: 366664 - DNA, 20 bp, Artificial Sequence
  chemically synthesized
tttggttattccttgtcagg

SEQ ID NO: 366665 - DNA, 20 bp, Artificial Sequence
  chemically synthesized
gattttggttattccttgtc

SEQ ID NO: 366666 - DNA, 20 bp, Artificial Sequence
  chemically synthesized
agattttggttattccttgt

SEQ ID NO: 366667 - DNA, 20 bp, Artificial Sequence
  chemically synthesized
tttgagccccttatagattt

SEQ ID NO: 366668 - DNA, 20 bp, Artificial Sequence
  chemically synthesized
aaggaataaccaaaatctat

SEQ ID NO: 366669 - DNA, 20 bp, Artificial Sequence
  chemically synthesized
aggaataaccaaaatctata

SEQ ID NO: 366670 - DNA, 20 bp, Artificial Sequence
  chemically synthesized
ggaataaccaaaatctataa

SEQ ID NO: 366671 - DNA, 20 bp, Artificial Sequence
  chemically synthesized
gaataaccaaaatctataag

SEQ ID NO: 366672 - DNA, 20 bp, Artificial Sequence
  chemically synthesized
ggagttgtttgagcccctta

SEQ ID NO: 366673 - DNA, 20 bp, Artificial Sequence
  chemically synthesized
ttttttctatggagttgttt

SEQ ID NO: 366674 - DNA, 20 bp, Artificial Sequence
  chemically synthesized
aaggggctcaaacaactcca

SEQ ID NO: 366675 - DNA, 20 bp, Artificial Sequence
  chemically synthesized
tatatatatttttttctatg

SEQ ID NO: 366676 - DNA, 20 bp, Artificial Sequence
  chemically synthesized
attatatatatttttttcta

SEQ ID NO: 366677 - DNA, 20 bp, Artificial Sequence
  chemically synthesized
atatataatcatctgattga

SEQ ID NO: 366678 - DNA, 20 bp, Artificial Sequence
  chemically synthesized
atttttgcccttctttcaat

SEQ ID NO: 366679 - DNA, 20 bp, Artificial Sequence
  chemically synthesized
tataatcatctgattgaaag

SEQ ID NO: 366680 - DNA, 20 bp, Artificial Sequence
  chemically synthesized
ataatcatctgattgaaaga

SEQ ID NO: 366681 - DNA, 20 bp, Artificial Sequence
  chemically synthesized
taatcatctgattgaaagaa

SEQ ID NO: 366682 - DNA, 20 bp, Artificial Sequence
  chemically synthesized
aagaagggcaaaaatttgaa

SEQ ID NO: 366683 - DNA, 20 bp, Artificial Sequence
  chemically synthesized
gaagggcaaaaatttgaata

SEQ ID NO: 366684 - DNA, 20 bp, Artificial Sequence
  chemically synthesized
aatttgaatagagatttctc

SEQ ID NO: 366685 - DNA, 20 bp, Artificial Sequence
  chemically synthesized
tttgaatagagatttctcaa

SEQ ID NO: 366686 - DNA, 20 bp, Artificial Sequence
  chemically synthesized
tgacatttgtgtcatctctt

SEQ ID NO: 366687 - DNA, 20 bp, Artificial Sequence
  chemically synthesized
aagagatgacacaaatgtca

SEQ ID NO: 366688 - DNA, 20 bp, Artificial Sequence
  chemically synthesized
gagatgacacaaatgtcaaa

SEQ ID NO: 366689 - DNA, 20 bp, Artificial Sequence
  chemically synthesized
agatgacacaaatgtcaaag

SEQ ID NO: 366690 - DNA, 20 bp, Artificial Sequence
  chemically synthesized
atgtcaaagaggaatatgaa

SEQ ID NO: 366691 - DNA, 20 bp, Artificial Sequence
  chemically synthesized
tgtcaaagaggaatatgaaa

SEQ ID NO: 366692 - DNA, 20 bp, Artificial Sequence
  chemically synthesized
tacatttctctgatcaatga

SEQ ID NO: 366693 - DNA, 20 bp, Artificial Sequence
  chemically synthesized
aggttgtcactatcattgat

SEQ ID NO: 366694 - DNA, 20 bp, Artificial Sequence
  chemically synthesized
gttgtcactatcattgatca

SEQ ID NO: 366695 - DNA, 20 bp, Artificial Sequence
  chemically synthesized
atgtaaatcaaaactacaat

SEQ ID NO: 366696 - DNA, 20 bp, Artificial Sequence
  chemically synthesized
tgtaaatcaaaactacaatg

SEQ ID NO: 366697 - DNA, 20 bp, Artificial Sequence
  chemically synthesized
ggtgagatgatacctcattg

SEQ ID NO: 366698 - DNA, 20 bp, Artificial Sequence
  chemically synthesized
aatgaggtatcatctcaccc

SEQ ID NO: 366699 - DNA, 20 bp, Artificial Sequence
  chemically synthesized
taagccattttaactggggt

SEQ ID NO: 366700 - DNA, 20 bp, Artificial Sequence
  chemically synthesized
gatataagccattttaactg

SEQ ID NO: 366701 - DNA, 20 bp, Artificial Sequence
  chemically synthesized
ggatataagccattttaact

SEQ ID NO: 366702 - DNA, 20 bp, Artificial Sequence
  chemically synthesized
tcatctcaccccagttaaaa

SEQ ID NO: 366703 - DNA, 20 bp, Artificial Sequence
  chemically synthesized
tggatataagccattttaac

SEQ ID NO: 366704 - DNA, 20 bp, Artificial Sequence
  chemically synthesized
gttgcctgtctgttggatat

SEQ ID NO: 366705 - DNA, 20 bp, Artificial Sequence
  chemically synthesized
ttaaaatggcttatatccaa

SEQ ID NO: 366706 - DNA, 20 bp, Artificial Sequence
  chemically synthesized
aatggcttatatccaacaga

SEQ ID NO: 366707 - DNA, 20 bp, Artificial Sequence
  chemically synthesized
atggcttatatccaacagac

SEQ ID NO: 366708 - DNA, 20 bp, Artificial Sequence
  chemically synthesized
cattgatgttgcctgtctgt

SEQ ID NO: 366709 - DNA, 20 bp, Artificial Sequence
  chemically synthesized
aggcaacatcaatgctgatg

SEQ ID NO: 366710 - DNA, 20 bp, Artificial Sequence
  chemically synthesized
ccttttccacacagccgcat

SEQ ID NO: 366711 - DNA, 20 bp, Artificial Sequence
  chemically synthesized
tcaatgctgatgcggctgtg

SEQ ID NO: 366712 - DNA, 20 bp, Artificial Sequence
  chemically synthesized
gctgatgcggctgtgtggaa

SEQ ID NO: 366713 - DNA, 20 bp, Artificial Sequence
  chemically synthesized
ccaaggttcccttttccaca

SEQ ID NO: 366714 - DNA, 20 bp, Artificial Sequence
  chemically synthesized
ctgatgcggctgtgtggaaa

SEQ ID NO: 366715 - DNA, 20 bp, Artificial Sequence
  chemically synthesized
tgatgcggctgtgtggaaaa

SEQ ID NO: 366716 - DNA, 20 bp, Artificial Sequence
  chemically synthesized
ctgtgtggaaaagggaacct

SEQ ID NO: 366717 - DNA, 20 bp, Artificial Sequence
  chemically synthesized
tccccaacaacgatgtacca

SEQ ID NO: 366718 - DNA, 20 bp, Artificial Sequence
  chemically synthesized
atccccaacaacgatgtacc

SEQ ID NO: 366719 - DNA, 20 bp, Artificial Sequence
  chemically synthesized
gaaccttggtacatcgttgt

SEQ ID NO: 366720 - DNA, 20 bp, Artificial Sequence
  chemically synthesized
aaccttggtacatcgttgtt

SEQ ID NO: 366721 - DNA, 20 bp, Artificial Sequence
  chemically synthesized
accttggtacatcgttgttg

SEQ ID NO: 366722 - DNA, 20 bp, Artificial Sequence
  chemically synthesized
acatcgttgttggggatgta

SEQ ID NO: 366723 - DNA, 20 bp, Artificial Sequence
  chemically synthesized
tcgttgttggggatgtaaag

SEQ ID NO: 366724 - DNA, 20 bp, Artificial Sequence
  chemically synthesized
ttgttggggatgtaaagtag

SEQ ID NO: 366725 - DNA, 20 bp, Artificial Sequence
  chemically synthesized
aaagtagtagaaccactgtg

SEQ ID NO: 366726 - DNA, 20 bp, Artificial Sequence
  chemically synthesized
cctcaaacagttcttcacag

SEQ ID NO: 366727 - DNA, 20 bp, Artificial Sequence
  chemically synthesized
gaacctcaaacagttcttca

SEQ ID NO: 366728 - DNA, 20 bp, Artificial Sequence
  chemically synthesized
accactgtgaagaactgttt

SEQ ID NO: 366729 - DNA, 20 bp, Artificial Sequence
  chemically synthesized
ccactgtgaagaactgtttg

SEQ ID NO: 366730 - DNA, 20 bp, Artificial Sequence
  chemically synthesized
tttttttgaagaacctcaaa

SEQ ID NO: 366731 - DNA, 20 bp, Artificial Sequence
  chemically synthesized
ttctgttttcagtttttttg

SEQ ID NO: 366732 - DNA, 20 bp, Artificial Sequence
  chemically synthesized
ttcttcaaaaaaactgaaaa

SEQ ID NO: 366733 - DNA, 20 bp, Artificial Sequence
  chemically synthesized
ttatatggtagttctgtttt

SEQ ID NO: 366734 - DNA, 20 bp, Artificial Sequence
  chemically synthesized
aggattgctggattatatgg

SEQ ID NO: 366735 - DNA, 20 bp, Artificial Sequence
  chemically synthesized
aacagaactaccatataatc

SEQ ID NO: 366736 - DNA, 20 bp, Artificial Sequence
  chemically synthesized
agtaggattgctggattata

SEQ ID NO: 366737 - DNA, 20 bp, Artificial Sequence
  chemically synthesized
atacccggcagtaggattgc

SEQ ID NO: 366738 - DNA, 20 bp, Artificial Sequence
  chemically synthesized
taatccagcaatcctactgc

SEQ ID NO: 366739 - DNA, 20 bp, Artificial Sequence
  chemically synthesized
aatccagcaatcctactgcc

SEQ ID NO: 366740 - DNA, 20 bp, Artificial Sequence
  chemically synthesized
ttgggtatatacccggcagt

SEQ ID NO: 366741 - DNA, 20 bp, Artificial Sequence
  chemically synthesized
tttgggtatatacccggcag

SEQ ID NO: 366742 - DNA, 20 bp, Artificial Sequence
  chemically synthesized
tcttttgggtatatacccgg

SEQ ID NO: 366743 - DNA, 20 bp, Artificial Sequence
  chemically synthesized
ctttcttttgggtatatacc

SEQ ID NO: 366744 - DNA, 20 bp, Artificial Sequence
  chemically synthesized
actgccgggtatatacccaa

SEQ ID NO: 366745 - DNA, 20 bp, Artificial Sequence
  chemically synthesized
ccgggtatatacccaaaaga

SEQ ID NO: 366746 - DNA, 20 bp, Artificial Sequence
  chemically synthesized
cgggtatatacccaaaagaa

SEQ ID NO: 366747 - DNA, 20 bp, Artificial Sequence
  chemically synthesized
aaactgatttcctttctttt

SEQ ID NO: 366748 - DNA, 20 bp, Artificial Sequence
  chemically synthesized
caaactgatttcctttcttt

SEQ ID NO: 366749 - DNA, 20 bp, Artificial Sequence
  chemically synthesized
atacccaaaagaaaggaaat

SEQ ID NO: 366750 - DNA, 20 bp, Artificial Sequence
  chemically synthesized
gaaaggaaatcagtttgtca

SEQ ID NO: 366751 - DNA, 20 bp, Artificial Sequence
  chemically synthesized
ttgcaataaacatgagggtg

SEQ ID NO: 366752 - DNA, 20 bp, Artificial Sequence
  chemically synthesized
tagggttgcaataaacatga

SEQ ID NO: 366753 - DNA, 20 bp, Artificial Sequence
  chemically synthesized
atagggttgcaataaacatg

SEQ ID NO: 366754 - DNA, 20 bp, Artificial Sequence
  chemically synthesized
aatagggttgcaataaacat

SEQ ID NO: 366755 - DNA, 20 bp, Artificial Sequence
  chemically synthesized
aatcttggctattgtgaata

SEQ ID NO: 366756 - DNA, 20 bp, Artificial Sequence
  chemically synthesized
aaatcttggctattgtgaat

SEQ ID NO: 366757 - DNA, 20 bp, Artificial Sequence
  chemically synthesized
tattgcaaccctattcacaa

SEQ ID NO: 366758 - DNA, 20 bp, Artificial Sequence
  chemically synthesized
caaatcttggctattgtgaa

SEQ ID NO: 366759 - DNA, 20 bp, Artificial Sequence
  chemically synthesized
caaccctattcacaatagcc

SEQ ID NO: 366760 - DNA, 20 bp, Artificial Sequence
  chemically synthesized
tattcacaatagccaagatt

SEQ ID NO: 366761 - DNA, 20 bp, Artificial Sequence
  chemically synthesized
cttggattgcttccaaatct

SEQ ID NO: 366762 - DNA, 20 bp, Artificial Sequence
  chemically synthesized
tcacaatagccaagatttgg

SEQ ID NO: 366763 - DNA, 20 bp, Artificial Sequence
  chemically synthesized
ccaagatttggaagcaatcc

SEQ ID NO: 366764 - DNA, 20 bp, Artificial Sequence
  chemically synthesized
ttcatttgttaatggatact

SEQ ID NO: 366765 - DNA, 20 bp, Artificial Sequence
  chemically synthesized
tttatccattcatttgttaa

SEQ ID NO: 366766 - DNA, 20 bp, Artificial Sequence
  chemically synthesized
agtatccattaacaaatgaa

SEQ ID NO: 366767 - DNA, 20 bp, Artificial Sequence
  chemically synthesized
cattaacaaatgaatggata

SEQ ID NO: 366768 - DNA, 20 bp, Artificial Sequence
  chemically synthesized
atgaatggataaagaaaatg

SEQ ID NO: 366769 - DNA, 20 bp, Artificial Sequence
  chemically synthesized
aaatgtggtacatatatacg

SEQ ID NO: 366770 - DNA, 20 bp, Artificial Sequence
  chemically synthesized
tgtggtacatatatacgtag

SEQ ID NO: 366771 - DNA, 20 bp, Artificial Sequence
  chemically synthesized
tggtacatatatacgtagtg

SEQ ID NO: 366772 - DNA, 20 bp, Artificial Sequence
  chemically synthesized
atacgtagtggagtactact

SEQ ID NO: 366773 - DNA, 20 bp, Artificial Sequence
  chemically synthesized
catttttttttatgactgag

SEQ ID NO: 366774 - DNA, 20 bp, Artificial Sequence
  chemically synthesized
tctcatttttttttatgact

SEQ ID NO: 366775 - DNA, 20 bp, Artificial Sequence
  chemically synthesized
actcagtcataaaaaaaaat

SEQ ID NO: 366776 - DNA, 20 bp, Artificial Sequence
  chemically synthesized
atccacgttgttgcaaatga

SEQ ID NO: 366777 - DNA, 20 bp, Artificial Sequence
  chemically synthesized
cgctgtcatttgcaacaacg

SEQ ID NO: 366778 - DNA, 20 bp, Artificial Sequence
  chemically synthesized
gtcatttgcaacaacgtgga

SEQ ID NO: 366779 - DNA, 20 bp, Artificial Sequence
  chemically synthesized
tgcaacaacgtggatggaac

SEQ ID NO: 366780 - DNA, 20 bp, Artificial Sequence
  chemically synthesized
tcacttaatacaatgtattc

SEQ ID NO: 366781 - DNA, 20 bp, Artificial Sequence
  chemically synthesized
gaactggaatacattgtatt

SEQ ID NO: 366782 - DNA, 20 bp, Artificial Sequence
  chemically synthesized
tacattgtattaagtgaaat

SEQ ID NO: 366783 - DNA, 20 bp, Artificial Sequence
  chemically synthesized
ttgtattaagtgaaataagc

SEQ ID NO: 366784 - DNA, 20 bp, Artificial Sequence
  chemically synthesized
tgtattaagtgaaataagcc

SEQ ID NO: 366785 - DNA, 20 bp, Artificial Sequence
  chemically synthesized
gcaaagtttgtttttgtgcc

SEQ ID NO: 366786 - DNA, 20 bp, Artificial Sequence
  chemically synthesized
gcacaaaaacaaactttgca

SEQ ID NO: 366787 - DNA, 20 bp, Artificial Sequence
  chemically synthesized
cacaaaaacaaactttgcat

SEQ ID NO: 366788 - DNA, 20 bp, Artificial Sequence
  chemically synthesized
catatgagtgagcccatgca

SEQ ID NO: 366789 - DNA, 20 bp, Artificial Sequence
  chemically synthesized
tttagttactgcatatgagt

SEQ ID NO: 366790 - DNA, 20 bp, Artificial Sequence
  chemically synthesized
tgcatgggctcactcatatg

SEQ ID NO: 366791 - DNA, 20 bp, Artificial Sequence
  chemically synthesized
aatttttagttactgcatat

SEQ ID NO: 366792 - DNA, 20 bp, Artificial Sequence
  chemically synthesized
tatgcagtaactaaaaatta

SEQ ID NO: 366793 - DNA, 20 bp, Artificial Sequence
  chemically synthesized
agttcaattgctttaatttt

SEQ ID NO: 366794 - DNA, 20 bp, Artificial Sequence
  chemically synthesized
aattaaagcaattgaactca

SEQ ID NO: 366795 - DNA, 20 bp, Artificial Sequence
  chemically synthesized
ttaaagcaattgaactcatg

SEQ ID NO: 366796 - DNA, 20 bp, Artificial Sequence
  chemically synthesized
agcaattgaactcatggaga

SEQ ID NO: 366797 - DNA, 20 bp, Artificial Sequence
  chemically synthesized
attctactctctgtctccat

SEQ ID NO: 366798 - DNA, 20 bp, Artificial Sequence
  chemically synthesized
caattgaactcatggagaca

SEQ ID NO: 366799 - DNA, 20 bp, Artificial Sequence
  chemically synthesized
attgaactcatggagacaga

SEQ ID NO: 366800 - DNA, 20 bp, Artificial Sequence
  chemically synthesized
gaactcatggagacagagag

SEQ ID NO: 366801 - DNA, 20 bp, Artificial Sequence
  chemically synthesized
gagagtagaatgatgtttac

SEQ ID NO: 366802 - DNA, 20 bp, Artificial Sequence
  chemically synthesized
gagtagaatgatgtttacca

SEQ ID NO: 366803 - DNA, 20 bp, Artificial Sequence
  chemically synthesized
gaatgatgtttaccagagtg

SEQ ID NO: 366804 - DNA, 20 bp, Artificial Sequence
  chemically synthesized
caactacccatactacactc

SEQ ID NO: 366805 - DNA, 20 bp, Artificial Sequence
  chemically synthesized
atgtttaccagagtgtagta

SEQ ID NO: 366806 - DNA, 20 bp, Artificial Sequence
  chemically synthesized
tgtttaccagagtgtagtat

SEQ ID NO: 366807 - DNA, 20 bp, Artificial Sequence
  chemically synthesized
ttaccagagtgtagtatggg

SEQ ID NO: 366808 - DNA, 20 bp, Artificial Sequence
  chemically synthesized
cagagtgtagtatgggtagt

SEQ ID NO: 366809 - DNA, 20 bp, Artificial Sequence
  chemically synthesized
agagtgtagtatgggtagtt

SEQ ID NO: 366810 - DNA, 20 bp, Artificial Sequence
  chemically synthesized
gagtgtagtatgggtagttg

SEQ ID NO: 366811 - DNA, 20 bp, Artificial Sequence
  chemically synthesized
gtagtatgggtagttgggga

SEQ ID NO: 366812 - DNA, 20 bp, Artificial Sequence
  chemically synthesized
tagtatgggtagttggggac

SEQ ID NO: 366813 - DNA, 20 bp, Artificial Sequence
  chemically synthesized
gtatgggtagttggggacag

SEQ ID NO: 366814 - DNA, 20 bp, Artificial Sequence
  chemically synthesized
tatgggtagttggggacagg

SEQ ID NO: 366815 - DNA, 20 bp, Artificial Sequence
  chemically synthesized
tgggtagttggggacaggag

SEQ ID NO: 366816 - DNA, 20 bp, Artificial Sequence
  chemically synthesized
gtagttggggacaggaggag

SEQ ID NO: 366817 - DNA, 20 bp, Artificial Sequence
  chemically synthesized
tagttggggacaggaggagt

SEQ ID NO: 366818 - DNA, 20 bp, Artificial Sequence
  chemically synthesized
acaggaggagtgggaatgtt

SEQ ID NO: 366819 - DNA, 20 bp, Artificial Sequence
  chemically synthesized
ggaggagtgggaatgtttag

SEQ ID NO: 366820 - DNA, 20 bp, Artificial Sequence
  chemically synthesized
gaggagtgggaatgtttagt

SEQ ID NO: 366821 - DNA, 20 bp, Artificial Sequence
  chemically synthesized
gtttagtgggtacaaaaatc

SEQ ID NO: 366822 - DNA, 20 bp, Artificial Sequence
  chemically synthesized
agtgggtacaaaaatctagt

SEQ ID NO: 366823 - DNA, 20 bp, Artificial Sequence
  chemically synthesized
tagatcttactcattctaac

SEQ ID NO: 366824 - DNA, 20 bp, Artificial Sequence
  chemically synthesized
tacaaaaatctagttagaat

SEQ ID NO: 366825 - DNA, 20 bp, Artificial Sequence
  chemically synthesized
aaaatctagttagaatgagt

SEQ ID NO: 366826 - DNA, 20 bp, Artificial Sequence
  chemically synthesized
tagaatgagtaagatctatt

SEQ ID NO: 366827 - DNA, 20 bp, Artificial Sequence
  chemically synthesized
caccctcttgtgttgccaaa

SEQ ID NO: 366828 - DNA, 20 bp, Artificial Sequence
  chemically synthesized
taagatctatttggcaacac

SEQ ID NO: 366829 - DNA, 20 bp, Artificial Sequence
  chemically synthesized
agatctatttggcaacacaa

SEQ ID NO: 366830 - DNA, 20 bp, Artificial Sequence
  chemically synthesized
gatctatttggcaacacaag

SEQ ID NO: 366831 - DNA, 20 bp, Artificial Sequence
  chemically synthesized
atctatttggcaacacaaga

SEQ ID NO: 366832 - DNA, 20 bp, Artificial Sequence
  chemically synthesized
gcaacacaagagggtgatta

SEQ ID NO: 366833 - DNA, 20 bp, Artificial Sequence
  chemically synthesized
caacaatttactgtacattt

SEQ ID NO: 366834 - DNA, 20 bp, Artificial Sequence
  chemically synthesized
ggcccaaattcttaaatgta

SEQ ID NO: 366835 - DNA, 20 bp, Artificial Sequence
  chemically synthesized
ttactgtacatttaagaatt

SEQ ID NO: 366836 - DNA, 20 bp, Artificial Sequence
  chemically synthesized
tactgtacatttaagaattt

SEQ ID NO: 366837 - DNA, 20 bp, Artificial Sequence
  chemically synthesized
gtacatttaagaatttgggc

SEQ ID NO: 366838 - DNA, 20 bp, Artificial Sequence
  chemically synthesized
tacatttaagaatttgggcc

SEQ ID NO: 366839 - DNA, 20 bp, Artificial Sequence
  chemically synthesized
ttaagaatttgggccaggca

SEQ ID NO: 366840 - DNA, 20 bp, Artificial Sequence
  chemically synthesized
agaatttgggccaggcacgg

SEQ ID NO: 366841 - DNA, 20 bp, Artificial Sequence
  chemically synthesized
caggcgtgagccaccgtgcc

SEQ ID NO: 366842 - DNA, 20 bp, Artificial Sequence
  chemically synthesized
agtgttgggattacaggcgt

SEQ ID NO: 366843 - DNA, 20 bp, Artificial Sequence
  chemically synthesized
tcccaaagtgttgggattac

SEQ ID NO: 366844 - DNA, 20 bp, Artificial Sequence
  chemically synthesized
ctcccaaagtgttgggatta

SEQ ID NO: 366845 - DNA, 20 bp, Artificial Sequence
  chemically synthesized
cgcctgtaatcccaacactt

SEQ ID NO: 366846 - DNA, 20 bp, Artificial Sequence
  chemically synthesized
cctcggcctcccaaagtgtt

SEQ ID NO: 366847 - DNA, 20 bp, Artificial Sequence
  chemically synthesized
gcctgtaatcccaacacttt

SEQ ID NO: 366848 - DNA, 20 bp, Artificial Sequence
  chemically synthesized
gcctcggcctcccaaagtgt

SEQ ID NO: 366849 - DNA, 20 bp, Artificial Sequence
  chemically synthesized
ctgtaatcccaacactttgg

SEQ ID NO: 366850 - DNA, 20 bp, Artificial Sequence
  chemically synthesized
tgtaatcccaacactttggg

SEQ ID NO: 366851 - DNA, 20 bp, Artificial Sequence
  chemically synthesized
ccgcctgcctcggcctccca

SEQ ID NO: 366852 - DNA, 20 bp, Artificial Sequence
  chemically synthesized
tcccaacactttgggaggcc

SEQ ID NO: 366853 - DNA, 20 bp, Artificial Sequence
  chemically synthesized
cccaacactttgggaggccg

SEQ ID NO: 366854 - DNA, 20 bp, Artificial Sequence
  chemically synthesized
aacactttgggaggccgagg

SEQ ID NO: 366855 - DNA, 20 bp, Artificial Sequence
  chemically synthesized
acactttgggaggccgaggc

SEQ ID NO: 366856 - DNA, 20 bp, Artificial Sequence
  chemically synthesized
ctttgggaggccgaggcagg

SEQ ID NO: 366857 - DNA, 20 bp, Artificial Sequence
  chemically synthesized
acctcatgatccgcctgcct

SEQ ID NO: 366858 - DNA, 20 bp, Artificial Sequence
  chemically synthesized
ggccgaggcaggcggatcat

SEQ ID NO: 366859 - DNA, 20 bp, Artificial Sequence
  chemically synthesized
gccgaggcaggcggatcatg

SEQ ID NO: 366860 - DNA, 20 bp, Artificial Sequence
  chemically synthesized
aggcaggcggatcatgaggt

SEQ ID NO: 366861 - DNA, 20 bp, Artificial Sequence
  chemically synthesized
ggcaggcggatcatgaggtc

SEQ ID NO: 366862 - DNA, 20 bp, Artificial Sequence
  chemically synthesized
caggcggatcatgaggtcag

SEQ ID NO: 366863 - DNA, 20 bp, Artificial Sequence
  chemically synthesized
gatcatgaggtcaggagatc

SEQ ID NO: 366864 - DNA, 20 bp, Artificial Sequence
  chemically synthesized
tcaggagatcgagaccatcc

SEQ ID NO: 366865 - DNA, 20 bp, Artificial Sequence
  chemically synthesized
tttcactgtgttagccagga

SEQ ID NO: 366866 - DNA, 20 bp, Artificial Sequence
  chemically synthesized
ggggtttcactgtgttagcc

SEQ ID NO: 366867 - DNA, 20 bp, Artificial Sequence
  chemically synthesized
cgagaccatcctggctaaca

SEQ ID NO: 366868 - DNA, 20 bp, Artificial Sequence
  chemically synthesized
cggggtttcactgtgttagc

SEQ ID NO: 366869 - DNA, 20 bp, Artificial Sequence
  chemically synthesized
gagacggggtttcactgtgt

SEQ ID NO: 366870 - DNA, 20 bp, Artificial Sequence
  chemically synthesized
ttgtatttttagtagagacg

SEQ ID NO: 366871 - DNA, 20 bp, Artificial Sequence
  chemically synthesized
tttgtatttttagtagagac

SEQ ID NO: 366872 - DNA, 20 bp, Artificial Sequence
  chemically synthesized
ttttgtatttttagtagaga

SEQ ID NO: 366873 - DNA, 20 bp, Artificial Sequence
  chemically synthesized
aattttttgtatttttagta

SEQ ID NO: 366874 - DNA, 20 bp, Artificial Sequence
  chemically synthesized
ctaattttttgtatttttag

SEQ ID NO: 366875 - DNA, 20 bp, Artificial Sequence
  chemically synthesized
cacctaattttttgtatttt

SEQ ID NO: 366876 - DNA, 20 bp, Artificial Sequence
  chemically synthesized
ctactaaaaatacaaaaaat

SEQ ID NO: 366877 - DNA, 20 bp, Artificial Sequence
  chemically synthesized
tactaaaaatacaaaaaatt

SEQ ID NO: 366878 - DNA, 20 bp, Artificial Sequence
  chemically synthesized
taaaaatacaaaaaattagg

SEQ ID NO: 366879 - DNA, 20 bp, Artificial Sequence
  chemically synthesized
aaaaatacaaaaaattaggt

SEQ ID NO: 366880 - DNA, 20 bp, Artificial Sequence
  chemically synthesized
tacaaaaaattaggtgggct

SEQ ID NO: 366881 - DNA, 20 bp, Artificial Sequence
  chemically synthesized
aaaaaattaggtgggcttgg

SEQ ID NO: 366882 - DNA, 20 bp, Artificial Sequence
  chemically synthesized
aaattaggtgggcttggtgg

SEQ ID NO: 366883 - DNA, 20 bp, Artificial Sequence
  chemically synthesized
aattaggtgggcttggtggc

SEQ ID NO: 366884 - DNA, 20 bp, Artificial Sequence
  chemically synthesized
gactgcaggtgcccgccacc

SEQ ID NO: 366885 - DNA, 20 bp, Artificial Sequence
  chemically synthesized
ggcttggtggcgggcacctg

SEQ ID NO: 366886 - DNA, 20 bp, Artificial Sequence
  chemically synthesized
gtggcgggcacctgcagtcc

SEQ ID NO: 366887 - DNA, 20 bp, Artificial Sequence
  chemically synthesized
tcccaagtagctgggactgc

SEQ ID NO: 366888 - DNA, 20 bp, Artificial Sequence
  chemically synthesized
ctcccaagtagctgggactg

SEQ ID NO: 366889 - DNA, 20 bp, Artificial Sequence
  chemically synthesized
cacctgcagtcccagctact

SEQ ID NO: 366890 - DNA, 20 bp, Artificial Sequence
  chemically synthesized
cctcagcctcccaagtagct

SEQ ID NO: 366891 - DNA, 20 bp, Artificial Sequence
  chemically synthesized
acctgcagtcccagctactt

SEQ ID NO: 366892 - DNA, 20 bp, Artificial Sequence
  chemically synthesized
gcctcagcctcccaagtagc

SEQ ID NO: 366893 - DNA, 20 bp, Artificial Sequence
  chemically synthesized
ctgcagtcccagctacttgg

SEQ ID NO: 366894 - DNA, 20 bp, Artificial Sequence
  chemically synthesized
tgcagtcccagctacttggg

SEQ ID NO: 366895 - DNA, 20 bp, Artificial Sequence
  chemically synthesized
tcctgcctcagcctcccaag

SEQ ID NO: 366896 - DNA, 20 bp, Artificial Sequence
  chemically synthesized
ttctcctgcctcagcctccc

SEQ ID NO: 366897 - DNA, 20 bp, Artificial Sequence
  chemically synthesized
tcccagctacttgggaggct

SEQ ID NO: 366898 - DNA, 20 bp, Artificial Sequence
  chemically synthesized
cccagctacttgggaggctg

SEQ ID NO: 366899 - DNA, 20 bp, Artificial Sequence
  chemically synthesized
agctacttgggaggctgagg

SEQ ID NO: 366900 - DNA, 20 bp, Artificial Sequence
  chemically synthesized
gctacttgggaggctgaggc

SEQ ID NO: 366901 - DNA, 20 bp, Artificial Sequence
  chemically synthesized
tacttgggaggctgaggcag

SEQ ID NO: 366902 - DNA, 20 bp, Artificial Sequence
  chemically synthesized
ttcacgccgttctcctgcct

SEQ ID NO: 366903 - DNA, 20 bp, Artificial Sequence
  chemically synthesized
gggaggctgaggcaggagaa

SEQ ID NO: 366904 - DNA, 20 bp, Artificial Sequence
  chemically synthesized
gcaggagaacggcgtgaacc

SEQ ID NO: 366905 - DNA, 20 bp, Artificial Sequence
  chemically synthesized
caggagaacggcgtgaaccc

SEQ ID NO: 366906 - DNA, 20 bp, Artificial Sequence
  chemically synthesized
ggagaacggcgtgaacccgg

SEQ ID NO: 366907 - DNA, 20 bp, Artificial Sequence
  chemically synthesized
gagaacggcgtgaacccggg

SEQ ID NO: 366908 - DNA, 20 bp, Artificial Sequence
  chemically synthesized
aacggcgtgaacccgggagg

SEQ ID NO: 366909 - DNA, 20 bp, Artificial Sequence
  chemically synthesized
cattgcaagctccgcctccc

SEQ ID NO: 366910 - DNA, 20 bp, Artificial Sequence
  chemically synthesized
cggcgtgaacccgggaggcg

SEQ ID NO: 366911 - DNA, 20 bp, Artificial Sequence
  chemically synthesized
tcattgcaagctccgcctcc

SEQ ID NO: 366912 - DNA, 20 bp, Artificial Sequence
  chemically synthesized
cgggaggcggagcttgcaat

SEQ ID NO: 366913 - DNA, 20 bp, Artificial Sequence
  chemically synthesized
atgctatctgggctcattgc

SEQ ID NO: 366914 - DNA, 20 bp, Artificial Sequence
  chemically synthesized
ggcggagcttgcaatgagcc

SEQ ID NO: 366915 - DNA, 20 bp, Artificial Sequence
  chemically synthesized
gagcttgcaatgagcccaga

SEQ ID NO: 366916 - DNA, 20 bp, Artificial Sequence
  chemically synthesized
ggagtgcagtgatgctatct

SEQ ID NO: 366917 - DNA, 20 bp, Artificial Sequence
  chemically synthesized
tggagtgcagtgatgctatc

SEQ ID NO: 366918 - DNA, 20 bp, Artificial Sequence
  chemically synthesized
ctgtcacccagggtggagtg

SEQ ID NO: 366919 - DNA, 20 bp, Artificial Sequence
  chemically synthesized
agcatcactgcactccaccc

SEQ ID NO: 366920 - DNA, 20 bp, Artificial Sequence
  chemically synthesized
gcatcactgcactccaccct

SEQ ID NO: 366921 - DNA, 20 bp, Artificial Sequence
  chemically synthesized
ttgctctgtcacccagggtg

SEQ ID NO: 366922 - DNA, 20 bp, Artificial Sequence
  chemically synthesized
tcttgctctgtcacccaggg

SEQ ID NO: 366923 - DNA, 20 bp, Artificial Sequence
  chemically synthesized
ctgcactccaccctgggtga

SEQ ID NO: 366924 - DNA, 20 bp, Artificial Sequence
  chemically synthesized
cagtcttgctctgtcaccca

SEQ ID NO: 366925 - DNA, 20 bp, Artificial Sequence
  chemically synthesized
gcagtcttgctctgtcaccc

SEQ ID NO: 366926 - DNA, 20 bp, Artificial Sequence
  chemically synthesized
gcactccaccctgggtgaca

SEQ ID NO: 366927 - DNA, 20 bp, Artificial Sequence
  chemically synthesized
cgcagtcttgctctgtcacc

SEQ ID NO: 366928 - DNA, 20 bp, Artificial Sequence
  chemically synthesized
tccaccctgggtgacagagc

SEQ ID NO: 366929 - DNA, 20 bp, Artificial Sequence
  chemically synthesized
ttttttttttttttgagacg

SEQ ID NO: 366930 - DNA, 20 bp, Artificial Sequence
  chemically synthesized
tcaaattttttttttttttt

SEQ ID NO: 366931 - DNA, 20 bp, Artificial Sequence
  chemically synthesized
caaaaaaaaaaaaaaatttg

SEQ ID NO: 366932 - DNA, 20 bp, Artificial Sequence
  chemically synthesized
aaaaaaaaaaaaatttgaag

SEQ ID NO: 366933 - DNA, 20 bp, Artificial Sequence
  chemically synthesized
aatttgaagtggaatgtttg

SEQ ID NO: 366934 - DNA, 20 bp, Artificial Sequence
  chemically synthesized
agtggaatgtttgtggcaca

SEQ ID NO: 366935 - DNA, 20 bp, Artificial Sequence
  chemically synthesized
gaatgtttgtggcacaaaga

SEQ ID NO: 366936 - DNA, 20 bp, Artificial Sequence
  chemically synthesized
aatgtttgtggcacaaagaa

SEQ ID NO: 366937 - DNA, 20 bp, Artificial Sequence
  chemically synthesized
caaagaaaggatacattctt

SEQ ID NO: 366938 - DNA, 20 bp, Artificial Sequence
  chemically synthesized
aaagaaaggatacattcttg

SEQ ID NO: 366939 - DNA, 20 bp, Artificial Sequence
  chemically synthesized
aggatacattcttgaggtga

SEQ ID NO: 366940 - DNA, 20 bp, Artificial Sequence
  chemically synthesized
agtgaagtatctgtcacctc

SEQ ID NO: 366941 - DNA, 20 bp, Artificial Sequence
  chemically synthesized
taatcatatcagggtaagtg

SEQ ID NO: 366942 - DNA, 20 bp, Artificial Sequence
  chemically synthesized
aagcataatcatatcagggt

SEQ ID NO: 366943 - DNA, 20 bp, Artificial Sequence
  chemically synthesized
tgcgaagcataatcatatca

SEQ ID NO: 366944 - DNA, 20 bp, Artificial Sequence
  chemically synthesized
atgcgaagcataatcatatc

SEQ ID NO: 366945 - DNA, 20 bp, Artificial Sequence
  chemically synthesized
catgcgaagcataatcatat

SEQ ID NO: 366946 - DNA, 20 bp, Artificial Sequence
  chemically synthesized
tatattgatacaggcatgcg

SEQ ID NO: 366947 - DNA, 20 bp, Artificial Sequence
  chemically synthesized
gtaaatagatatattgatac

SEQ ID NO: 366948 - DNA, 20 bp, Artificial Sequence
  chemically synthesized
ggtaaatagatatattgata

SEQ ID NO: 366949 - DNA, 20 bp, Artificial Sequence
  chemically synthesized
tagtatatttagggggtaaa

SEQ ID NO: 366950 - DNA, 20 bp, Artificial Sequence
  chemically synthesized
ggatacatagtatatttagg

SEQ ID NO: 366951 - DNA, 20 bp, Artificial Sequence
  chemically synthesized
tggatacatagtatatttag

SEQ ID NO: 366952 - DNA, 20 bp, Artificial Sequence
  chemically synthesized
atggatacatagtatattta

SEQ ID NO: 366953 - DNA, 20 bp, Artificial Sequence
  chemically synthesized
tatggatacatagtatattt

SEQ ID NO: 366954 - DNA, 20 bp, Artificial Sequence
  chemically synthesized
ttatggatacatagtatatt

SEQ ID NO: 366955 - DNA, 20 bp, Artificial Sequence
  chemically synthesized
agattaaatttatggataca

SEQ ID NO: 366956 - DNA, 20 bp, Artificial Sequence
  chemically synthesized
tttgttttagattaaattta

SEQ ID NO: 366957 - DNA, 20 bp, Artificial Sequence
  chemically synthesized
cataaatttaatctaaaaca

SEQ ID NO: 366958 - DNA, 20 bp, Artificial Sequence
  chemically synthesized
atagtaaagttgctttgttt

SEQ ID NO: 366959 - DNA, 20 bp, Artificial Sequence
  chemically synthesized
tgtgtatattatgtatagta

SEQ ID NO: 366960 - DNA, 20 bp, Artificial Sequence
  chemically synthesized
atttatgtgtatattatgta

SEQ ID NO: 366961 - DNA, 20 bp, Artificial Sequence
  chemically synthesized
tatacacataaatcttaaaa

SEQ ID NO: 366962 - DNA, 20 bp, Artificial Sequence
  chemically synthesized
cattaaaatggcactgtttt

SEQ ID NO: 366963 - DNA, 20 bp, Artificial Sequence
  chemically synthesized
tccttaaagtttcattaaaa

SEQ ID NO: 366964 - DNA, 20 bp, Artificial Sequence
  chemically synthesized
tgccattttaatgaaacttt

SEQ ID NO: 366965 - DNA, 20 bp, Artificial Sequence
  chemically synthesized
gccattttaatgaaacttta

SEQ ID NO: 366966 - DNA, 20 bp, Artificial Sequence
  chemically synthesized
ttttaatgaaactttaagga

SEQ ID NO: 366967 - DNA, 20 bp, Artificial Sequence
  chemically synthesized
ttactagagagctttcctta

SEQ ID NO: 366968 - DNA, 20 bp, Artificial Sequence
  chemically synthesized
aaactttaaggaaagctctc

SEQ ID NO: 366969 - DNA, 20 bp, Artificial Sequence
  chemically synthesized
tttattttcttattactaga

SEQ ID NO: 366970 - DNA, 20 bp, Artificial Sequence
  chemically synthesized
aaggaaagctctctagtaat

SEQ ID NO: 366971 - DNA, 20 bp, Artificial Sequence
  chemically synthesized
aatttattttcttattacta

SEQ ID NO: 366972 - DNA, 20 bp, Artificial Sequence
  chemically synthesized
taaatttattttcttattac

SEQ ID NO: 366973 - DNA, 20 bp, Artificial Sequence
  chemically synthesized
aataaatttacactttctaa

SEQ ID NO: 366974 - DNA, 20 bp, Artificial Sequence
  chemically synthesized
ttcttggcagcactattaga

SEQ ID NO: 366975 - DNA, 20 bp, Artificial Sequence
  chemically synthesized
gaagttcttggcagcactat

SEQ ID NO: 366976 - DNA, 20 bp, Artificial Sequence
  chemically synthesized
cactttctaatagtgctgcc

SEQ ID NO: 366977 - DNA, 20 bp, Artificial Sequence
  chemically synthesized
gttagatatgaagttcttgg

SEQ ID NO: 366978 - DNA, 20 bp, Artificial Sequence
  chemically synthesized
caggttagatatgaagttct

SEQ ID NO: 366979 - DNA, 20 bp, Artificial Sequence
  chemically synthesized
attattccaggttagatatg

SEQ ID NO: 366980 - DNA, 20 bp, Artificial Sequence
  chemically synthesized
caagaacttcatatctaacc

SEQ ID NO: 366981 - DNA, 20 bp, Artificial Sequence
  chemically synthesized
aataccaaattattccaggt

SEQ ID NO: 366982 - DNA, 20 bp, Artificial Sequence
  chemically synthesized
tcaaaataccaaattattcc

SEQ ID NO: 366983 - DNA, 20 bp, Artificial Sequence
  chemically synthesized
ctcaaaataccaaattattc

SEQ ID NO: 366984 - DNA, 20 bp, Artificial Sequence
  chemically synthesized
atatctaacctggaataatt

SEQ ID NO: 366985 - DNA, 20 bp, Artificial Sequence
  chemically synthesized
ctggaataatttggtatttt

SEQ ID NO: 366986 - DNA, 20 bp, Artificial Sequence
  chemically synthesized
tttgtttttcaaattgaatg

SEQ ID NO: 366987 - DNA, 20 bp, Artificial Sequence
  chemically synthesized
ttgtttttcaaattgaatga

SEQ ID NO: 366988 - DNA, 20 bp, Artificial Sequence
  chemically synthesized
aaaaaaacacatcattttaa

SEQ ID NO: 366989 - DNA, 20 bp, Artificial Sequence
  chemically synthesized
atgtgtttttttccctcctt

SEQ ID NO: 366990 - DNA, 20 bp, Artificial Sequence
  chemically synthesized
ttttgctcctggccaaagga

SEQ ID NO: 366991 - DNA, 20 bp, Artificial Sequence
  chemically synthesized
attttgctcctggccaaagg

SEQ ID NO: 366992 - DNA, 20 bp, Artificial Sequence
  chemically synthesized
gtttttttccctcctttggc

SEQ ID NO: 366993 - DNA, 20 bp, Artificial Sequence
  chemically synthesized
aattttgctcctggccaaag

SEQ ID NO: 366994 - DNA, 20 bp, Artificial Sequence
  chemically synthesized
tttttttccctcctttggcc

SEQ ID NO: 366995 - DNA, 20 bp, Artificial Sequence
  chemically synthesized
gaaattttgctcctggccaa

SEQ ID NO: 366996 - DNA, 20 bp, Artificial Sequence
  chemically synthesized
tttttccctcctttggccag

SEQ ID NO: 366997 - DNA, 20 bp, Artificial Sequence
  chemically synthesized
tgaaattttgctcctggcca

SEQ ID NO: 366998 - DNA, 20 bp, Artificial Sequence
  chemically synthesized
taagtgtgaaattttgctcc

SEQ ID NO: 366999 - DNA, 20 bp, Artificial Sequence
  chemically synthesized
gcaaaatttcacacttatct

SEQ ID NO: 367000 - DNA, 20 bp, Artificial Sequence
  chemically synthesized
aagtcatgctttgctcagat

SEQ ID NO: 367001 - DNA, 20 bp, Artificial Sequence
  chemically synthesized
atttcacacttatctgagca

SEQ ID NO: 367002 - DNA, 20 bp, Artificial Sequence
  chemically synthesized
tttaaaagtcatgctttgct

SEQ ID NO: 367003 - DNA, 20 bp, Artificial Sequence
  chemically synthesized
ttattttttgatgagtttaa

SEQ ID NO: 367004 - DNA, 20 bp, Artificial Sequence
  chemically synthesized
gcataagattattttttgat

SEQ ID NO: 367005 - DNA, 20 bp, Artificial Sequence
  chemically synthesized
atggacacattgcagtgcat

SEQ ID NO: 367006 - DNA, 20 bp, Artificial Sequence
  chemically synthesized
cttcaacaatggacacattg

SEQ ID NO: 367007 - DNA, 20 bp, Artificial Sequence
  chemically synthesized
ctgcaatgtgtccattgttg

SEQ ID NO: 367008 - DNA, 20 bp, Artificial Sequence
  chemically synthesized
aactatattttcttcaacaa

SEQ ID NO: 367009 - DNA, 20 bp, Artificial Sequence
  chemically synthesized
gtccattgttgaagaaaata

SEQ ID NO: 367010 - DNA, 20 bp, Artificial Sequence
  chemically synthesized
caagtatctctgtcagttaa

SEQ ID NO: 367011 - DNA, 20 bp, Artificial Sequence
  chemically synthesized
tatagttaactgttaactga

SEQ ID NO: 367012 - DNA, 20 bp, Artificial Sequence
  chemically synthesized
tagttaactgttaactgaca

SEQ ID NO: 367013 - DNA, 20 bp, Artificial Sequence
  chemically synthesized
ataaaaacaagtatctctgt

SEQ ID NO: 367014 - DNA, 20 bp, Artificial Sequence
  chemically synthesized
ttttttcttttcataaaaac

SEQ ID NO: 367015 - DNA, 20 bp, Artificial Sequence
  chemically synthesized
gagatacttgtttttatgaa

SEQ ID NO: 367016 - DNA, 20 bp, Artificial Sequence
  chemically synthesized
ttttatgaaaagaaaaaatc

SEQ ID NO: 367017 - DNA, 20 bp, Artificial Sequence
  chemically synthesized
tttatgaaaagaaaaaatcc

SEQ ID NO: 367018 - DNA, 20 bp, Artificial Sequence
  chemically synthesized
ttatgaaaagaaaaaatcca

SEQ ID NO: 367019 - DNA, 20 bp, Artificial Sequence
  chemically synthesized
tgaaaagaaaaaatccaggg

SEQ ID NO: 367020 - DNA, 20 bp, Artificial Sequence
  chemically synthesized
aagaaaaaatccagggtaga

SEQ ID NO: 367021 - DNA, 20 bp, Artificial Sequence
  chemically synthesized
cagacttcaactttctaccc

SEQ ID NO: 367022 - DNA, 20 bp, Artificial Sequence
  chemically synthesized
aaatccagggtagaaagttg

SEQ ID NO: 367023 - DNA, 20 bp, Artificial Sequence
  chemically synthesized
ggtagaaagttgaagtctgt

SEQ ID NO: 367024 - DNA, 20 bp, Artificial Sequence
  chemically synthesized
aagttgaagtctgtcagacc

SEQ ID NO: 367025 - DNA, 20 bp, Artificial Sequence
  chemically synthesized
gcacatacttcttggtctga

SEQ ID NO: 367026 - DNA, 20 bp, Artificial Sequence
  chemically synthesized
ttgaagtctgtcagaccaag

SEQ ID NO: 367027 - DNA, 20 bp, Artificial Sequence
  chemically synthesized
tttatcacgcacatacttct

SEQ ID NO: 367028 - DNA, 20 bp, Artificial Sequence
  chemically synthesized
tcctctttttgaataaacag

SEQ ID NO: 367029 - DNA, 20 bp, Artificial Sequence
  chemically synthesized
tgctcctctttttgaataaa

SEQ ID NO: 367030 - DNA, 20 bp, Artificial Sequence
  chemically synthesized
taaactgctgtttattcaaa

SEQ ID NO: 367031 - DNA, 20 bp, Artificial Sequence
  chemically synthesized
aactgctgtttattcaaaaa

SEQ ID NO: 367032 - DNA, 20 bp, Artificial Sequence
  chemically synthesized
actgctgtttattcaaaaag

SEQ ID NO: 367033 - DNA, 20 bp, Artificial Sequence
  chemically synthesized
tgctgtttattcaaaaagag

SEQ ID NO: 367034 - DNA, 20 bp, Artificial Sequence
  chemically synthesized
tgtttattcaaaaagaggag

SEQ ID NO: 367035 - DNA, 20 bp, Artificial Sequence
  chemically synthesized
tttattcaaaaagaggagca

SEQ ID NO: 367036 - DNA, 20 bp, Artificial Sequence
  chemically synthesized
tcaaaaagaggagcagagac

SEQ ID NO: 367037 - DNA, 20 bp, Artificial Sequence
  chemically synthesized
caaaaagaggagcagagact

SEQ ID NO: 367038 - DNA, 20 bp, Artificial Sequence
  chemically synthesized
aagaggagcagagactggga

SEQ ID NO: 367039 - DNA, 20 bp, Artificial Sequence
  chemically synthesized
agaggagcagagactgggaa

SEQ ID NO: 367040 - DNA, 20 bp, Artificial Sequence
  chemically synthesized
aagacttctctcacctttcc

SEQ ID NO: 367041 - DNA, 20 bp, Artificial Sequence
  chemically synthesized
gagcagagactgggaaaggt

SEQ ID NO: 367042 - DNA, 20 bp, Artificial Sequence
  chemically synthesized
gcagagactgggaaaggtga

SEQ ID NO: 367043 - DNA, 20 bp, Artificial Sequence
  chemically synthesized
gagactgggaaaggtgagag

SEQ ID NO: 367044 - DNA, 20 bp, Artificial Sequence
  chemically synthesized
gggaaaggtgagagaagtct

SEQ ID NO: 367045 - DNA, 20 bp, Artificial Sequence
  chemically synthesized
gaaaggtgagagaagtcttg

SEQ ID NO: 367046 - DNA, 20 bp, Artificial Sequence
  chemically synthesized
gtgagagaagtcttggagta

SEQ ID NO: 367047 - DNA, 20 bp, Artificial Sequence
  chemically synthesized
catgttttattctgtactcc

SEQ ID NO: 367048 - DNA, 20 bp, Artificial Sequence
  chemically synthesized
agaataaaacatgaatccca

SEQ ID NO: 367049 - DNA, 20 bp, Artificial Sequence
  chemically synthesized
tatatgatcctgatggcttt

SEQ ID NO: 367050 - DNA, 20 bp, Artificial Sequence
  chemically synthesized
aacatgaatcccaaagccat

SEQ ID NO: 367051 - DNA, 20 bp, Artificial Sequence
  chemically synthesized
ctatatgatcctgatggctt

SEQ ID NO: 367052 - DNA, 20 bp, Artificial Sequence
  chemically synthesized
acatgaatcccaaagccatc

SEQ ID NO: 367053 - DNA, 20 bp, Artificial Sequence
  chemically synthesized
tggatgctatatgatcctga

SEQ ID NO: 367054 - DNA, 20 bp, Artificial Sequence
  chemically synthesized
ccaaagccatcaggatcata

SEQ ID NO: 367055 - DNA, 20 bp, Artificial Sequence
  chemically synthesized
atcaggatcatatagcatcc

SEQ ID NO: 367056 - DNA, 20 bp, Artificial Sequence
  chemically synthesized
tcatatagcatccaagacac

SEQ ID NO: 367057 - DNA, 20 bp, Artificial Sequence
  chemically synthesized
catatagcatccaagacaca

SEQ ID NO: 367058 - DNA, 20 bp, Artificial Sequence
  chemically synthesized
caaacgtagtccttgtgtct

SEQ ID NO: 367059 - DNA, 20 bp, Artificial Sequence
  chemically synthesized
caagacacaaggactacgtt

SEQ ID NO: 367060 - DNA, 20 bp, Artificial Sequence
  chemically synthesized
aagacacaaggactacgttt

SEQ ID NO: 367061 - DNA, 20 bp, Artificial Sequence
  chemically synthesized
tttgtctccaaacccaaacg

SEQ ID NO: 367062 - DNA, 20 bp, Artificial Sequence
  chemically synthesized
acaaggactacgtttgggtt

SEQ ID NO: 367063 - DNA, 20 bp, Artificial Sequence
  chemically synthesized
aaggactacgtttgggtttg

SEQ ID NO: 367064 - DNA, 20 bp, Artificial Sequence
  chemically synthesized
tacgtttgggtttggagaca

SEQ ID NO: 367065 - DNA, 20 bp, Artificial Sequence
  chemically synthesized
ttgggtttggagacaaagtc

SEQ ID NO: 367066 - DNA, 20 bp, Artificial Sequence
  chemically synthesized
tgggtttggagacaaagtct

SEQ ID NO: 367067 - DNA, 20 bp, Artificial Sequence
  chemically synthesized
ttggagacaaagtctaggca

SEQ ID NO: 367068 - DNA, 20 bp, Artificial Sequence
  chemically synthesized
tggagacaaagtctaggcaa

SEQ ID NO: 367069 - DNA, 20 bp, Artificial Sequence
  chemically synthesized
ctgcgtttttgacctttgcc

SEQ ID NO: 367070 - DNA, 20 bp, Artificial Sequence
  chemically synthesized
ctaggcaaaggtcaaaaacg

SEQ ID NO: 367071 - DNA, 20 bp, Artificial Sequence
  chemically synthesized
gcaaaggtcaaaaacgcaga

SEQ ID NO: 367072 - DNA, 20 bp, Artificial Sequence
  chemically synthesized
gcagacagaatcttgctttg

SEQ ID NO: 367073 - DNA, 20 bp, Artificial Sequence
  chemically synthesized
cagacagaatcttgctttgt

SEQ ID NO: 367074 - DNA, 20 bp, Artificial Sequence
  chemically synthesized
ttaagtttggcccacaaagc

SEQ ID NO: 367075 - DNA, 20 bp, Artificial Sequence
  chemically synthesized
gtatttaagtttggcccaca

SEQ ID NO: 367076 - DNA, 20 bp, Artificial Sequence
  chemically synthesized
ttggtctatgtatttaagtt

SEQ ID NO: 367077 - DNA, 20 bp, Artificial Sequence
  chemically synthesized
gtgggccaaacttaaataca

SEQ ID NO: 367078 - DNA, 20 bp, Artificial Sequence
  chemically synthesized
agaccttggtctatgtattt

SEQ ID NO: 367079 - DNA, 20 bp, Artificial Sequence
  chemically synthesized
caaacttaaatacatagacc

SEQ ID NO: 367080 - DNA, 20 bp, Artificial Sequence
  chemically synthesized
aaacttaaatacatagacca

SEQ ID NO: 367081 - DNA, 20 bp, Artificial Sequence
  chemically synthesized
agaagacttataaaagacct

SEQ ID NO: 367082 - DNA, 20 bp, Artificial Sequence
  chemically synthesized
catagaccaaggtcttttat

SEQ ID NO: 367083 - DNA, 20 bp, Artificial Sequence
  chemically synthesized
ttttaaaagaagacttataa

SEQ ID NO: 367084 - DNA, 20 bp, Artificial Sequence
  chemically synthesized
gttacctccagttttaaaag

SEQ ID NO: 367085 - DNA, 20 bp, Artificial Sequence
  chemically synthesized
tataagtcttcttttaaaac

SEQ ID NO: 367086 - DNA, 20 bp, Artificial Sequence
  chemically synthesized
ttggttacctccagttttaa

SEQ ID NO: 367087 - DNA, 20 bp, Artificial Sequence
  chemically synthesized
taagtcttcttttaaaactg

SEQ ID NO: 367088 - DNA, 20 bp, Artificial Sequence
  chemically synthesized
aagtcttcttttaaaactgg

SEQ ID NO: 367089 - DNA, 20 bp, Artificial Sequence
  chemically synthesized
ctctccattttggttacctc

SEQ ID NO: 367090 - DNA, 20 bp, Artificial Sequence
  chemically synthesized
aaaactggaggtaaccaaaa

SEQ ID NO: 367091 - DNA, 20 bp, Artificial Sequence
  chemically synthesized
aactggaggtaaccaaaatg

SEQ ID NO: 367092 - DNA, 20 bp, Artificial Sequence
  chemically synthesized
ctggaggtaaccaaaatgga

SEQ ID NO: 367093 - DNA, 20 bp, Artificial Sequence
  chemically synthesized
cctttactccctctccattt

SEQ ID NO: 367094 - DNA, 20 bp, Artificial Sequence
  chemically synthesized
tggaggtaaccaaaatggag

SEQ ID NO: 367095 - DNA, 20 bp, Artificial Sequence
  chemically synthesized
ggaggtaaccaaaatggaga

SEQ ID NO: 367096 - DNA, 20 bp, Artificial Sequence
  chemically synthesized
aggtaaccaaaatggagagg

SEQ ID NO: 367097 - DNA, 20 bp, Artificial Sequence
  chemically synthesized
accaaaatggagagggagta

SEQ ID NO: 367098 - DNA, 20 bp, Artificial Sequence
  chemically synthesized
ccaaaatggagagggagtaa

SEQ ID NO: 367099 - DNA, 20 bp, Artificial Sequence
  chemically synthesized
ggagagggagtaaaggatta

SEQ ID NO: 367100 - DNA, 20 bp, Artificial Sequence
  chemically synthesized
gagagggagtaaaggattat

SEQ ID NO: 367101 - DNA, 20 bp, Artificial Sequence
  chemically synthesized
gggagtaaaggattataggt

SEQ ID NO: 367102 - DNA, 20 bp, Artificial Sequence
  chemically synthesized
ggagtaaaggattataggtc

SEQ ID NO: 367103 - DNA, 20 bp, Artificial Sequence
  chemically synthesized
gtaaaggattataggtcagg

SEQ ID NO: 367104 - DNA, 20 bp, Artificial Sequence
  chemically synthesized
taaaggattataggtcaggt

SEQ ID NO: 367105 - DNA, 20 bp, Artificial Sequence
  chemically synthesized
aaaggattataggtcaggta

SEQ ID NO: 367106 - DNA, 20 bp, Artificial Sequence
  chemically synthesized
aaggattataggtcaggtag

SEQ ID NO: 367107 - DNA, 20 bp, Artificial Sequence
  chemically synthesized
gtgccccagctaggtgtaca

SEQ ID NO: 367108 - DNA, 20 bp, Artificial Sequence
  chemically synthesized
taggggattccatgtacacc

SEQ ID NO: 367109 - DNA, 20 bp, Artificial Sequence
  chemically synthesized
ggattccatgtacacctagc

SEQ ID NO: 367110 - DNA, 20 bp, Artificial Sequence
  chemically synthesized
gattccatgtacacctagct

SEQ ID NO: 367111 - DNA, 20 bp, Artificial Sequence
  chemically synthesized
attccatgtacacctagctg

SEQ ID NO: 367112 - DNA, 20 bp, Artificial Sequence
  chemically synthesized
tctctctcggtgccccagct

SEQ ID NO: 367113 - DNA, 20 bp, Artificial Sequence
  chemically synthesized
ctctctctcggtgccccagc

SEQ ID NO: 367114 - DNA, 20 bp, Artificial Sequence
  chemically synthesized
gtacacctagctggggcacc

SEQ ID NO: 367115 - DNA, 20 bp, Artificial Sequence
  chemically synthesized
ctttctctctctcggtgccc

SEQ ID NO: 367116 - DNA, 20 bp, Artificial Sequence
  chemically synthesized
acacctagctggggcaccga

SEQ ID NO: 367117 - DNA, 20 bp, Artificial Sequence
  chemically synthesized
acctagctggggcaccgaga

SEQ ID NO: 367118 - DNA, 20 bp, Artificial Sequence
  chemically synthesized
ctagctggggcaccgagaga

SEQ ID NO: 367119 - DNA, 20 bp, Artificial Sequence
  chemically synthesized
cctcactgctttctctctct

SEQ ID NO: 367120 - DNA, 20 bp, Artificial Sequence
  chemically synthesized
ctggggcaccgagagagaga

SEQ ID NO: 367121 - DNA, 20 bp, Artificial Sequence
  chemically synthesized
gggcaccgagagagagaaag

SEQ ID NO: 367122 - DNA, 20 bp, Artificial Sequence
  chemically synthesized
accgagagagagaaagcagt

SEQ ID NO: 367123 - DNA, 20 bp, Artificial Sequence
  chemically synthesized
ccgagagagagaaagcagtg

SEQ ID NO: 367124 - DNA, 20 bp, Artificial Sequence
  chemically synthesized
gagagaaagcagtgaggtga

SEQ ID NO: 367125 - DNA, 20 bp, Artificial Sequence
  chemically synthesized
gagaaagcagtgaggtgata

SEQ ID NO: 367126 - DNA, 20 bp, Artificial Sequence
  chemically synthesized
gcagtgaggtgatagagaaa

SEQ ID NO: 367127 - DNA, 20 bp, Artificial Sequence
  chemically synthesized
ttcgaaaataatacgatagc

SEQ ID NO: 367128 - DNA, 20 bp, Artificial Sequence
  chemically synthesized
tttcgaaaataatacgatag

SEQ ID NO: 367129 - DNA, 20 bp, Artificial Sequence
  chemically synthesized
gagtttcgaaaataatacga

SEQ ID NO: 367130 - DNA, 20 bp, Artificial Sequence
  chemically synthesized
cgtattattttcgaaactca

SEQ ID NO: 367131 - DNA, 20 bp, Artificial Sequence
  chemically synthesized
tattattttcgaaactcaca

SEQ ID NO: 367132 - DNA, 20 bp, Artificial Sequence
  chemically synthesized
taatatatcattgactctgt

SEQ ID NO: 367133 - DNA, 20 bp, Artificial Sequence
  chemically synthesized
acagagtcaatgatatatta

SEQ ID NO: 367134 - DNA, 20 bp, Artificial Sequence
  chemically synthesized
tgaatatgactaatagaaat

SEQ ID NO: 367135 - DNA, 20 bp, Artificial Sequence
  chemically synthesized
aattgaaatccaatttctat

SEQ ID NO: 367136 - DNA, 20 bp, Artificial Sequence
  chemically synthesized
aatatggtgaatatgactaa

SEQ ID NO: 367137 - DNA, 20 bp, Artificial Sequence
  chemically synthesized
aagcactctattagagaata

SEQ ID NO: 367138 - DNA, 20 bp, Artificial Sequence
  chemically synthesized
atattcaccatattctctaa

SEQ ID NO: 367139 - DNA, 20 bp, Artificial Sequence
  chemically synthesized
attcaccatattctctaata

SEQ ID NO: 367140 - DNA, 20 bp, Artificial Sequence
  chemically synthesized
ttctgagaagcactctatta

SEQ ID NO: 367141 - DNA, 20 bp, Artificial Sequence
  chemically synthesized
tattctgagaagcactctat

SEQ ID NO: 367142 - DNA, 20 bp, Artificial Sequence
  chemically synthesized
ttctctaatagagtgcttct

SEQ ID NO: 367143 - DNA, 20 bp, Artificial Sequence
  chemically synthesized
ctctggtagaatattctgag

SEQ ID NO: 367144 - DNA, 20 bp, Artificial Sequence
  chemically synthesized
atgctctggtagaatattct

SEQ ID NO: 367145 - DNA, 20 bp, Artificial Sequence
  chemically synthesized
tgcttctcagaatattctac

SEQ ID NO: 367146 - DNA, 20 bp, Artificial Sequence
  chemically synthesized
cttctcagaatattctacca

SEQ ID NO: 367147 - DNA, 20 bp, Artificial Sequence
  chemically synthesized
ttcctggaaggatgctctgg

SEQ ID NO: 367148 - DNA, 20 bp, Artificial Sequence
  chemically synthesized
catttcctggaaggatgctc

SEQ ID NO: 367149 - DNA, 20 bp, Artificial Sequence
  chemically synthesized
attctaccagagcatccttc

SEQ ID NO: 367150 - DNA, 20 bp, Artificial Sequence
  chemically synthesized
ttctaccagagcatccttcc

SEQ ID NO: 367151 - DNA, 20 bp, Artificial Sequence
  chemically synthesized
cttcaatttcatttcctgga

SEQ ID NO: 367152 - DNA, 20 bp, Artificial Sequence
  chemically synthesized
ccttcaatttcatttcctgg

SEQ ID NO: 367153 - DNA, 20 bp, Artificial Sequence
  chemically synthesized
attccttcaatttcatttcc

SEQ ID NO: 367154 - DNA, 20 bp, Artificial Sequence
  chemically synthesized
ccttccaggaaatgaaattg

SEQ ID NO: 367155 - DNA, 20 bp, Artificial Sequence
  chemically synthesized
cttccaggaaatgaaattga

SEQ ID NO: 367156 - DNA, 20 bp, Artificial Sequence
  chemically synthesized
gaaattgaaggaatttaccc

SEQ ID NO: 367157 - DNA, 20 bp, Artificial Sequence
  chemically synthesized
aattgaaggaatttaccctg

SEQ ID NO: 367158 - DNA, 20 bp, Artificial Sequence
  chemically synthesized
aaggaatttaccctggagtc

SEQ ID NO: 367159 - DNA, 20 bp, Artificial Sequence
  chemically synthesized
atttatactgccagactcca

SEQ ID NO: 367160 - DNA, 20 bp, Artificial Sequence
  chemically synthesized
aatttatactgccagactcc

SEQ ID NO: 367161 - DNA, 20 bp, Artificial Sequence
  chemically synthesized
taatttatactgccagactc

SEQ ID NO: 367162 - DNA, 20 bp, Artificial Sequence
  chemically synthesized
gaatttaccctggagtctgg

SEQ ID NO: 367163 - DNA, 20 bp, Artificial Sequence
  chemically synthesized
cactgtgtaatttatactgc

SEQ ID NO: 367164 - DNA, 20 bp, Artificial Sequence
  chemically synthesized
gtctggcagtataaattaca

SEQ ID NO: 367165 - DNA, 20 bp, Artificial Sequence
  chemically synthesized
tataaattacacagtgcctg

SEQ ID NO: 367166 - DNA, 20 bp, Artificial Sequence
  chemically synthesized
ataaattacacagtgcctgc

SEQ ID NO: 367167 - DNA, 20 bp, Artificial Sequence
  chemically synthesized
caaagaaatttaaaacctgc

SEQ ID NO: 367168 - DNA, 20 bp, Artificial Sequence
  chemically synthesized
tcaaagaaatttaaaacctg

SEQ ID NO: 367169 - DNA, 20 bp, Artificial Sequence
  chemically synthesized
caggttttaaatttctttga

SEQ ID NO: 367170 - DNA, 20 bp, Artificial Sequence
  chemically synthesized
gcataaagtatatgctttca

SEQ ID NO: 367171 - DNA, 20 bp, Artificial Sequence
  chemically synthesized
ctctaggaatttttagcata

SEQ ID NO: 367172 - DNA, 20 bp, Artificial Sequence
  chemically synthesized
gcaaaatctctaggaatttt

SEQ ID NO: 367173 - DNA, 20 bp, Artificial Sequence
  chemically synthesized
tactttatgctaaaaattcc

SEQ ID NO: 367174 - DNA, 20 bp, Artificial Sequence
  chemically synthesized
ctttatgctaaaaattccta

SEQ ID NO: 367175 - DNA, 20 bp, Artificial Sequence
  chemically synthesized
aagaagaaggcaaaatctct

SEQ ID NO: 367176 - DNA, 20 bp, Artificial Sequence
  chemically synthesized
aaagaagaaggcaaaatctc

SEQ ID NO: 367177 - DNA, 20 bp, Artificial Sequence
  chemically synthesized
aagcatatattaaaagaaga

SEQ ID NO: 367178 - DNA, 20 bp, Artificial Sequence
  chemically synthesized
caagcatatattaaaagaag

SEQ ID NO: 367179 - DNA, 20 bp, Artificial Sequence
  chemically synthesized
aaacaagcatatattaaaag

SEQ ID NO: 367180 - DNA, 20 bp, Artificial Sequence
  chemically synthesized
ttgaaacaagcatatattaa

SEQ ID NO: 367181 - DNA, 20 bp, Artificial Sequence
  chemically synthesized
aaatagttttacgttgaaac

SEQ ID NO: 367182 - DNA, 20 bp, Artificial Sequence
  chemically synthesized
aaaaataaatgataaataaa

SEQ ID NO: 367183 - DNA, 20 bp, Artificial Sequence
  chemically synthesized
ttatttatcatttatttttt

SEQ ID NO: 367184 - DNA, 20 bp, Artificial Sequence
  chemically synthesized
ttatcatttattttttgaga

SEQ ID NO: 367185 - DNA, 20 bp, Artificial Sequence
  chemically synthesized
atcatttattttttgagaca

SEQ ID NO: 367186 - DNA, 20 bp, Artificial Sequence
  chemically synthesized
ctccagcctggcaacagagc

SEQ ID NO: 367187 - DNA, 20 bp, Artificial Sequence
  chemically synthesized
acagagtctcgctctgttgc

SEQ ID NO: 367188 - DNA, 20 bp, Artificial Sequence
  chemically synthesized
cagagtctcgctctgttgcc

SEQ ID NO: 367189 - DNA, 20 bp, Artificial Sequence
  chemically synthesized
tgcactccagcctggcaaca

SEQ ID NO: 367190 - DNA, 20 bp, Artificial Sequence
  chemically synthesized
actgcactccagcctggcaa

SEQ ID NO: 367191 - DNA, 20 bp, Artificial Sequence
  chemically synthesized
gtctcgctctgttgccaggc

SEQ ID NO: 367192 - DNA, 20 bp, Artificial Sequence
  chemically synthesized
ctcgctctgttgccaggctg

SEQ ID NO: 367193 - DNA, 20 bp, Artificial Sequence
  chemically synthesized
tgcgccactgcactccagcc

SEQ ID NO: 367194 - DNA, 20 bp, Artificial Sequence
  chemically synthesized
tctgttgccaggctggagtg

SEQ ID NO: 367195 - DNA, 20 bp, Artificial Sequence
  chemically synthesized
aagattgcgccactgcactc

SEQ ID NO: 367196 - DNA, 20 bp, Artificial Sequence
  chemically synthesized
gttgccaggctggagtgcag

SEQ ID NO: 367197 - DNA, 20 bp, Artificial Sequence
  chemically synthesized
ggagtgcagtggcgcaatct

SEQ ID NO: 367198 - DNA, 20 bp, Artificial Sequence
  chemically synthesized
ggcggaggttgcagtgagcc

SEQ ID NO: 367199 - DNA, 20 bp, Artificial Sequence
  chemically synthesized
tgggaggcggaggttgcagt

SEQ ID NO: 367200 - DNA, 20 bp, Artificial Sequence
  chemically synthesized
aacctgggaggcggaggttg

SEQ ID NO: 367201 - DNA, 20 bp, Artificial Sequence
  chemically synthesized
cacttgaacctgggaggcgg

SEQ ID NO: 367202 - DNA, 20 bp, Artificial Sequence
  chemically synthesized
tcactgcaacctccgcctcc

SEQ ID NO: 367203 - DNA, 20 bp, Artificial Sequence
  chemically synthesized
tcacttgaacctgggaggcg

SEQ ID NO: 367204 - DNA, 20 bp, Artificial Sequence
  chemically synthesized
cactgcaacctccgcctccc

SEQ ID NO: 367205 - DNA, 20 bp, Artificial Sequence
  chemically synthesized
aatcacttgaacctgggagg

SEQ ID NO: 367206 - DNA, 20 bp, Artificial Sequence
  chemically synthesized
gagaatcacttgaacctggg

SEQ ID NO: 367207 - DNA, 20 bp, Artificial Sequence
  chemically synthesized
ggagaatcacttgaacctgg

SEQ ID NO: 367208 - DNA, 20 bp, Artificial Sequence
  chemically synthesized
aacctccgcctcccaggttc

SEQ ID NO: 367209 - DNA, 20 bp, Artificial Sequence
  chemically synthesized
caggagaatcacttgaacct

SEQ ID NO: 367210 - DNA, 20 bp, Artificial Sequence
  chemically synthesized
gcaggagaatcacttgaacc

SEQ ID NO: 367211 - DNA, 20 bp, Artificial Sequence
  chemically synthesized
ttcaagtgattctcctgcct

SEQ ID NO: 367212 - DNA, 20 bp, Artificial Sequence
  chemically synthesized
tacttgggaggctgaggcag

SEQ ID NO: 367213 - DNA, 20 bp, Artificial Sequence
  chemically synthesized
gctacttgggaggctgaggc

SEQ ID NO: 367214 - DNA, 20 bp, Artificial Sequence
  chemically synthesized
agctacttgggaggctgagg

SEQ ID NO: 367215 - DNA, 20 bp, Artificial Sequence
  chemically synthesized
cccagctacttgggaggctg

SEQ ID NO: 367216 - DNA, 20 bp, Artificial Sequence
  chemically synthesized
tcccagctacttgggaggct

SEQ ID NO: 367217 - DNA, 20 bp, Artificial Sequence
  chemically synthesized
ttctcctgcctcagcctccc

SEQ ID NO: 367218 - DNA, 20 bp, Artificial Sequence
  chemically synthesized
tcctgcctcagcctcccaag

SEQ ID NO: 367219 - DNA, 20 bp, Artificial Sequence
  chemically synthesized
tgtagtcccagctacttggg

SEQ ID NO: 367220 - DNA, 20 bp, Artificial Sequence
  chemically synthesized
ctgtagtcccagctacttgg

SEQ ID NO: 367221 - DNA, 20 bp, Artificial Sequence
  chemically synthesized
gcctcagcctcccaagtagc

SEQ ID NO: 367222 - DNA, 20 bp, Artificial Sequence
  chemically synthesized
gcctgtagtcccagctactt

SEQ ID NO: 367223 - DNA, 20 bp, Artificial Sequence
  chemically synthesized
cctcagcctcccaagtagct

SEQ ID NO: 367224 - DNA, 20 bp, Artificial Sequence
  chemically synthesized
tgcctgtagtcccagctact

SEQ ID NO: 367225 - DNA, 20 bp, Artificial Sequence
  chemically synthesized
ctcccaagtagctgggacta

SEQ ID NO: 367226 - DNA, 20 bp, Artificial Sequence
  chemically synthesized
tcccaagtagctgggactac

SEQ ID NO: 367227 - DNA, 20 bp, Artificial Sequence
  chemically synthesized
atgacacatgcctgtagtcc

SEQ ID NO: 367228 - DNA, 20 bp, Artificial Sequence
  chemically synthesized
gacgtgatgacacatgcctg

SEQ ID NO: 367229 - DNA, 20 bp, Artificial Sequence
  chemically synthesized
caggcatgtgtcatcacgtc

SEQ ID NO: 367230 - DNA, 20 bp, Artificial Sequence
  chemically synthesized
atgtgtcatcacgtccagct

SEQ ID NO: 367231 - DNA, 20 bp, Artificial Sequence
  chemically synthesized
ctaaaaatacaaaactgagc

SEQ ID NO: 367232 - DNA, 20 bp, Artificial Sequence
  chemically synthesized
tctactaaaaatacaaaact

SEQ ID NO: 367233 - DNA, 20 bp, Artificial Sequence
  chemically synthesized
ccagctcagttttgtatttt

SEQ ID NO: 367234 - DNA, 20 bp, Artificial Sequence
  chemically synthesized
gctcagttttgtatttttag

SEQ ID NO: 367235 - DNA, 20 bp, Artificial Sequence
  chemically synthesized
tcagttttgtatttttagta

SEQ ID NO: 367236 - DNA, 20 bp, Artificial Sequence
  chemically synthesized
ttttgtatttttagtagaga

SEQ ID NO: 367237 - DNA, 20 bp, Artificial Sequence
  chemically synthesized
tttgtatttttagtagagac

SEQ ID NO: 367238 - DNA, 20 bp, Artificial Sequence
  chemically synthesized
ttgtatttttagtagagacg

SEQ ID NO: 367239 - DNA, 20 bp, Artificial Sequence
  chemically synthesized
gagacggggtttcactatgt

SEQ ID NO: 367240 - DNA, 20 bp, Artificial Sequence
  chemically synthesized
cggggtttcactatgttggt

SEQ ID NO: 367241 - DNA, 20 bp, Artificial Sequence
  chemically synthesized
ggagacaagcctgaccaaca

SEQ ID NO: 367242 - DNA, 20 bp, Artificial Sequence
  chemically synthesized
ggggtttcactatgttggtc

SEQ ID NO: 367243 - DNA, 20 bp, Artificial Sequence
  chemically synthesized
caaggtcaagagatggagac

SEQ ID NO: 367244 - DNA, 20 bp, Artificial Sequence
  chemically synthesized
gatcacaaggtcaagagatg

SEQ ID NO: 367245 - DNA, 20 bp, Artificial Sequence
  chemically synthesized
cggatcacaaggtcaagaga

SEQ ID NO: 367246 - DNA, 20 bp, Artificial Sequence
  chemically synthesized
gaggcggatcacaaggtcaa

SEQ ID NO: 367247 - DNA, 20 bp, Artificial Sequence
  chemically synthesized
gggaggcggatcacaaggtc

SEQ ID NO: 367248 - DNA, 20 bp, Artificial Sequence
  chemically synthesized
gctgagggaggcggatcaca

SEQ ID NO: 367249 - DNA, 20 bp, Artificial Sequence
  chemically synthesized
agctgagggaggcggatcac

SEQ ID NO: 367250 - DNA, 20 bp, Artificial Sequence
  chemically synthesized
accttgtgatccgcctccct

SEQ ID NO: 367251 - DNA, 20 bp, Artificial Sequence
  chemically synthesized
ctttgggaagctgagggagg

SEQ ID NO: 367252 - DNA, 20 bp, Artificial Sequence
  chemically synthesized
gtactttgggaagctgaggg

SEQ ID NO: 367253 - DNA, 20 bp, Artificial Sequence
  chemically synthesized
agtactttgggaagctgagg

SEQ ID NO: 367254 - DNA, 20 bp, Artificial Sequence
  chemically synthesized
ccagtactttgggaagctga

SEQ ID NO: 367255 - DNA, 20 bp, Artificial Sequence
  chemically synthesized
cccagtactttgggaagctg

SEQ ID NO: 367256 - DNA, 20 bp, Artificial Sequence
  chemically synthesized
tcccagtactttgggaagct

SEQ ID NO: 367257 - DNA, 20 bp, Artificial Sequence
  chemically synthesized
ccgcctccctcagcttccca

SEQ ID NO: 367258 - DNA, 20 bp, Artificial Sequence
  chemically synthesized
tgtaatcccagtactttggg

SEQ ID NO: 367259 - DNA, 20 bp, Artificial Sequence
  chemically synthesized
ccctcagcttcccaaagtac

SEQ ID NO: 367260 - DNA, 20 bp, Artificial Sequence
  chemically synthesized
gcctgtaatcccagtacttt

SEQ ID NO: 367261 - DNA, 20 bp, Artificial Sequence
  chemically synthesized
cctcagcttcccaaagtact

SEQ ID NO: 367262 - DNA, 20 bp, Artificial Sequence
  chemically synthesized
tgcctgtaatcccagtactt

SEQ ID NO: 367263 - DNA, 20 bp, Artificial Sequence
  chemically synthesized
ttcccaaagtactgggatta

SEQ ID NO: 367264 - DNA, 20 bp, Artificial Sequence
  chemically synthesized
tcccaaagtactgggattac

SEQ ID NO: 367265 - DNA, 20 bp, Artificial Sequence
  chemically synthesized
atggctcatgcctgtaatcc

SEQ ID NO: 367266 - DNA, 20 bp, Artificial Sequence
  chemically synthesized
agtactgggattacaggcat

SEQ ID NO: 367267 - DNA, 20 bp, Artificial Sequence
  chemically synthesized
caggcatgagccatcacacc

SEQ ID NO: 367268 - DNA, 20 bp, Artificial Sequence
  chemically synthesized
ttacataagtccaggtgtga

SEQ ID NO: 367269 - DNA, 20 bp, Artificial Sequence
  chemically synthesized
aattacttttacataagtcc

SEQ ID NO: 367270 - DNA, 20 bp, Artificial Sequence
  chemically synthesized
aaattacttttacataagtc

SEQ ID NO: 367271 - DNA, 20 bp, Artificial Sequence
  chemically synthesized
tcacacctggacttatgtaa

SEQ ID NO: 367272 - DNA, 20 bp, Artificial Sequence
  chemically synthesized
acttaaaattacttttacat

SEQ ID NO: 367273 - DNA, 20 bp, Artificial Sequence
  chemically synthesized
acttatgtaaaagtaatttt

SEQ ID NO: 367274 - DNA, 20 bp, Artificial Sequence
  chemically synthesized
aagtaattttaagtactttt

SEQ ID NO: 367275 - DNA, 20 bp, Artificial Sequence
  chemically synthesized
tgggggagatttttactcaa

SEQ ID NO: 367276 - DNA, 20 bp, Artificial Sequence
  chemically synthesized
ccgtgggaacgggggtgggg

SEQ ID NO: 367277 - DNA, 20 bp, Artificial Sequence
  chemically synthesized
gaccgtgggaacgggggtgg

SEQ ID NO: 367278 - DNA, 20 bp, Artificial Sequence
  chemically synthesized
agaccgtgggaacgggggtg

SEQ ID NO: 367279 - DNA, 20 bp, Artificial Sequence
  chemically synthesized
cagaccgtgggaacgggggt

SEQ ID NO: 367280 - DNA, 20 bp, Artificial Sequence
  chemically synthesized
tcagaccgtgggaacggggg

SEQ ID NO: 367281 - DNA, 20 bp, Artificial Sequence
  chemically synthesized
acatcagaccgtgggaacgg

SEQ ID NO: 367282 - DNA, 20 bp, Artificial Sequence
  chemically synthesized
cacatcagaccgtgggaacg

SEQ ID NO: 367283 - DNA, 20 bp, Artificial Sequence
  chemically synthesized
ctcccccacccccgttccca

SEQ ID NO: 367284 - DNA, 20 bp, Artificial Sequence
  chemically synthesized
ccacatcagaccgtgggaac

SEQ ID NO: 367285 - DNA, 20 bp, Artificial Sequence
  chemically synthesized
accacatcagaccgtgggaa

SEQ ID NO: 367286 - DNA, 20 bp, Artificial Sequence
  chemically synthesized
aaaaaaccacatcagaccgt

SEQ ID NO: 367287 - DNA, 20 bp, Artificial Sequence
  chemically synthesized
aaaaaaaccacatcagaccg

SEQ ID NO: 367288 - DNA, 20 bp, Artificial Sequence
  chemically synthesized
cccgttcccacggtctgatg

SEQ ID NO: 367289 - DNA, 20 bp, Artificial Sequence
  chemically synthesized
cactaaaaaaaaaaccacat

SEQ ID NO: 367290 - DNA, 20 bp, Artificial Sequence
  chemically synthesized
gtctgatgtggttttttttt

SEQ ID NO: 367291 - DNA, 20 bp, Artificial Sequence
  chemically synthesized
ttagtgaaatgtgctacatt

SEQ ID NO: 367292 - DNA, 20 bp, Artificial Sequence
  chemically synthesized
ataaagttacaggctaaatg

SEQ ID NO: 367293 - DNA, 20 bp, Artificial Sequence
  chemically synthesized
cgaaaggtctataaagttac

SEQ ID NO: 367294 - DNA, 20 bp, Artificial Sequence
  chemically synthesized
ccgaaaggtctataaagtta

SEQ ID NO: 367295 - DNA, 20 bp, Artificial Sequence
  chemically synthesized
acatttagcctgtaacttta

SEQ ID NO: 367296 - DNA, 20 bp, Artificial Sequence
  chemically synthesized
tgagcaccgaaaggtctata

SEQ ID NO: 367297 - DNA, 20 bp, Artificial Sequence
  chemically synthesized
ctgtaactttatagaccttt

SEQ ID NO: 367298 - DNA, 20 bp, Artificial Sequence
  chemically synthesized
gaataaaactgagcaccgaa

SEQ ID NO: 367299 - DNA, 20 bp, Artificial Sequence
  chemically synthesized
agaataaaactgagcaccga

SEQ ID NO: 367300 - DNA, 20 bp, Artificial Sequence
  chemically synthesized
tttatagacctttcggtgct

SEQ ID NO: 367301 - DNA, 20 bp, Artificial Sequence
  chemically synthesized
actacagggagaataaaact

SEQ ID NO: 367302 - DNA, 20 bp, Artificial Sequence
  chemically synthesized
gctcagttttattctccctg

SEQ ID NO: 367303 - DNA, 20 bp, Artificial Sequence
  chemically synthesized
tggggtattcatactacagg

SEQ ID NO: 367304 - DNA, 20 bp, Artificial Sequence
  chemically synthesized
cctggggtattcatactaca

SEQ ID NO: 367305 - DNA, 20 bp, Artificial Sequence
  chemically synthesized
acctggggtattcatactac

SEQ ID NO: 367306 - DNA, 20 bp, Artificial Sequence
  chemically synthesized
tacctggggtattcatacta

SEQ ID NO: 367307 - DNA, 20 bp, Artificial Sequence
  chemically synthesized
tccctgtagtatgaataccc

SEQ ID NO: 367308 - DNA, 20 bp, Artificial Sequence
  chemically synthesized
ccctgtagtatgaatacccc

SEQ ID NO: 367309 - DNA, 20 bp, Artificial Sequence
  chemically synthesized
agtatgttagattttacctg

SEQ ID NO: 367310 - DNA, 20 bp, Artificial Sequence
  chemically synthesized
tagtatgttagattttacct

SEQ ID NO: 367311 - DNA, 20 bp, Artificial Sequence
  chemically synthesized
atagtatgttagattttacc

SEQ ID NO: 367312 - DNA, 20 bp, Artificial Sequence
  chemically synthesized
atccaagagaaatagtatgt

SEQ ID NO: 367313 - DNA, 20 bp, Artificial Sequence
  chemically synthesized
atctaacatactatttctct

SEQ ID NO: 367314 - DNA, 20 bp, Artificial Sequence
  chemically synthesized
ttagaaccatccaagagaaa

SEQ ID NO: 367315 - DNA, 20 bp, Artificial Sequence
  chemically synthesized
aacatactatttctcttgga

SEQ ID NO: 367316 - DNA, 20 bp, Artificial Sequence
  chemically synthesized
ggaaaattagaaccatccaa

SEQ ID NO: 367317 - DNA, 20 bp, Artificial Sequence
  chemically synthesized
caggaaaattagaaccatcc

SEQ ID NO: 367318 - DNA, 20 bp, Artificial Sequence
  chemically synthesized
taagttgcaggcaggaaaat

SEQ ID NO: 367319 - DNA, 20 bp, Artificial Sequence
  chemically synthesized
ctatagagtaagttgcaggc

SEQ ID NO: 367320 - DNA, 20 bp, Artificial Sequence
  chemically synthesized
tctatagagtaagttgcagg

SEQ ID NO: 367321 - DNA, 20 bp, Artificial Sequence
  chemically synthesized
aattctatagagtaagttgc

SEQ ID NO: 367322 - DNA, 20 bp, Artificial Sequence
  chemically synthesized
taattctatagagtaagttg

SEQ ID NO: 367323 - DNA, 20 bp, Artificial Sequence
  chemically synthesized
cctgcctgcaacttactcta

SEQ ID NO: 367324 - DNA, 20 bp, Artificial Sequence
  chemically synthesized
tatctataattctatagagt

SEQ ID NO: 367325 - DNA, 20 bp, Artificial Sequence
  chemically synthesized
atagtatctataattctata

SEQ ID NO: 367326 - DNA, 20 bp, Artificial Sequence
  chemically synthesized
ctatagtatctataattcta

SEQ ID NO: 367327 - DNA, 20 bp, Artificial Sequence
  chemically synthesized
caacttactctatagaatta

SEQ ID NO: 367328 - DNA, 20 bp, Artificial Sequence
  chemically synthesized
ctatagaattatagatacta

SEQ ID NO: 367329 - DNA, 20 bp, Artificial Sequence
  chemically synthesized
aattatagatactatagcaa

SEQ ID NO: 367330 - DNA, 20 bp, Artificial Sequence
  chemically synthesized
aacttgggttacttttgcta

SEQ ID NO: 367331 - DNA, 20 bp, Artificial Sequence
  chemically synthesized
tactatagcaaaagtaaccc

SEQ ID NO: 367332 - DNA, 20 bp, Artificial Sequence
  chemically synthesized
agcaaaagtaacccaagttt

SEQ ID NO: 367333 - DNA, 20 bp, Artificial Sequence
  chemically synthesized
tatttctgcttctgaaactt

SEQ ID NO: 367334 - DNA, 20 bp, Artificial Sequence
  chemically synthesized
ctatttctgcttctgaaact

SEQ ID NO: 367335 - DNA, 20 bp, Artificial Sequence
  chemically synthesized
aaaagtaacccaagtttcag

SEQ ID NO: 367336 - DNA, 20 bp, Artificial Sequence
  chemically synthesized
agtaacccaagtttcagaag

SEQ ID NO: 367337 - DNA, 20 bp, Artificial Sequence
  chemically synthesized
ccaagtttcagaagcagaaa

SEQ ID NO: 367338 - DNA, 20 bp, Artificial Sequence
  chemically synthesized
agagacctgagttcagaagt

SEQ ID NO: 367339 - DNA, 20 bp, Artificial Sequence
  chemically synthesized
aaatagctaacttctgaact

SEQ ID NO: 367340 - DNA, 20 bp, Artificial Sequence
  chemically synthesized
agtgagagacctgagttcag

SEQ ID NO: 367341 - DNA, 20 bp, Artificial Sequence
  chemically synthesized
aatagctaacttctgaactc

SEQ ID NO: 367342 - DNA, 20 bp, Artificial Sequence
  chemically synthesized
gtgagtgagagacctgagtt

SEQ ID NO: 367343 - DNA, 20 bp, Artificial Sequence
  chemically synthesized
agtgagtgagtgagagacct

SEQ ID NO: 367344 - DNA, 20 bp, Artificial Sequence
  chemically synthesized
cacagctagtgagtgagtga

SEQ ID NO: 367345 - DNA, 20 bp, Artificial Sequence
  chemically synthesized
aacacagctagtgagtgagt

SEQ ID NO: 367346 - DNA, 20 bp, Artificial Sequence
  chemically synthesized
caggtctctcactcactcac

SEQ ID NO: 367347 - DNA, 20 bp, Artificial Sequence
  chemically synthesized
agataacacagctagtgagt

SEQ ID NO: 367348 - DNA, 20 bp, Artificial Sequence
  chemically synthesized
cccaagataacacagctagt

SEQ ID NO: 367349 - DNA, 20 bp, Artificial Sequence
  chemically synthesized
cttgcccaagataacacagc

SEQ ID NO: 367350 - DNA, 20 bp, Artificial Sequence
  chemically synthesized
gtcacttgcccaagataaca

SEQ ID NO: 367351 - DNA, 20 bp, Artificial Sequence
  chemically synthesized
actcactagctgtgttatct

SEQ ID NO: 367352 - DNA, 20 bp, Artificial Sequence
  chemically synthesized
ctcactagctgtgttatctt

SEQ ID NO: 367353 - DNA, 20 bp, Artificial Sequence
  chemically synthesized
ctagctgtgttatcttgggc

SEQ ID NO: 367354 - DNA, 20 bp, Artificial Sequence
  chemically synthesized
agaaaggctgtcacttgccc

SEQ ID NO: 367355 - DNA, 20 bp, Artificial Sequence
  chemically synthesized
gtgttatcttgggcaagtga

SEQ ID NO: 367356 - DNA, 20 bp, Artificial Sequence
  chemically synthesized
gggcaagtgacagcctttct

SEQ ID NO: 367357 - DNA, 20 bp, Artificial Sequence
  chemically synthesized
ggcaagtgacagcctttctg

SEQ ID NO: 367358 - DNA, 20 bp, Artificial Sequence
  chemically synthesized
gaataaattgtgcctcagaa

SEQ ID NO: 367359 - DNA, 20 bp, Artificial Sequence
  chemically synthesized
tgaataaattgtgcctcaga

SEQ ID NO: 367360 - DNA, 20 bp, Artificial Sequence
  chemically synthesized
atagtgaataaattgtgcct

SEQ ID NO: 367361 - DNA, 20 bp, Artificial Sequence
  chemically synthesized
aggcacaatttattcactat

SEQ ID NO: 367362 - DNA, 20 bp, Artificial Sequence
  chemically synthesized
caatttattcactattagaa

SEQ ID NO: 367363 - DNA, 20 bp, Artificial Sequence
  chemically synthesized
aatttattcactattagaat

SEQ ID NO: 367364 - DNA, 20 bp, Artificial Sequence
  chemically synthesized
taatttgagccccattctaa

SEQ ID NO: 367365 - DNA, 20 bp, Artificial Sequence
  chemically synthesized
atttattcactattagaatg

SEQ ID NO: 367366 - DNA, 20 bp, Artificial Sequence
  chemically synthesized
gtgctctggagtaataattt

SEQ ID NO: 367367 - DNA, 20 bp, Artificial Sequence
  chemically synthesized
tggggctcaaattattactc

SEQ ID NO: 367368 - DNA, 20 bp, Artificial Sequence
  chemically synthesized
gggctcaaattattactcca

SEQ ID NO: 367369 - DNA, 20 bp, Artificial Sequence
  chemically synthesized
aacctcacgggagtgctctg

SEQ ID NO: 367370 - DNA, 20 bp, Artificial Sequence
  chemically synthesized
tgaacctcacgggagtgctc

SEQ ID NO: 367371 - DNA, 20 bp, Artificial Sequence
  chemically synthesized
ttactccagagcactcccgt

SEQ ID NO: 367372 - DNA, 20 bp, Artificial Sequence
  chemically synthesized
tactccagagcactcccgtg

SEQ ID NO: 367373 - DNA, 20 bp, Artificial Sequence
  chemically synthesized
gttgcagttgaacctcacgg

SEQ ID NO: 367374 - DNA, 20 bp, Artificial Sequence
  chemically synthesized
gtgttgcagttgaacctcac

SEQ ID NO: 367375 - DNA, 20 bp, Artificial Sequence
  chemically synthesized
tgtgttgcagttgaacctca

SEQ ID NO: 367376 - DNA, 20 bp, Artificial Sequence
  chemically synthesized
tgaggttcaactgcaacaca

SEQ ID NO: 367377 - DNA, 20 bp, Artificial Sequence
  chemically synthesized
tataacgttcctatgtgttg

SEQ ID NO: 367378 - DNA, 20 bp, Artificial Sequence
  chemically synthesized
gaggttcaactgcaacacat

SEQ ID NO: 367379 - DNA, 20 bp, Artificial Sequence
  chemically synthesized
caacacataggaacgttata

SEQ ID NO: 367380 - DNA, 20 bp, Artificial Sequence
  chemically synthesized
ataggaacgttatacagatt

SEQ ID NO: 367381 - DNA, 20 bp, Artificial Sequence
  chemically synthesized
aaaatcaatctatatttatt

SEQ ID NO: 367382 - DNA, 20 bp, Artificial Sequence
  chemically synthesized
tcgtatgcactcaataaata

SEQ ID NO: 367383 - DNA, 20 bp, Artificial Sequence
  chemically synthesized
aagaaagagatgcagacaaa

SEQ ID NO: 367384 - DNA, 20 bp, Artificial Sequence
  chemically synthesized
tttggtcaaagaaagagatg

SEQ ID NO: 367385 - DNA, 20 bp, Artificial Sequence
  chemically synthesized
ctagaatttggtcaaagaaa

SEQ ID NO: 367386 - DNA, 20 bp, Artificial Sequence
  chemically synthesized
acctagaatttggtcaaaga

SEQ ID NO: 367387 - DNA, 20 bp, Artificial Sequence
  chemically synthesized
ttacacctagaatttggtca

SEQ ID NO: 367388 - DNA, 20 bp, Artificial Sequence
  chemically synthesized
ctctttctttgaccaaattc

SEQ ID NO: 367389 - DNA, 20 bp, Artificial Sequence
  chemically synthesized
tctttctttgaccaaattct

SEQ ID NO: 367390 - DNA, 20 bp, Artificial Sequence
  chemically synthesized
acgtttttacacctagaatt

SEQ ID NO: 367391 - DNA, 20 bp, Artificial Sequence
  chemically synthesized
gagttaaacgtttttacacc

SEQ ID NO: 367392 - DNA, 20 bp, Artificial Sequence
  chemically synthesized
aggtgtaaaaacgtttaact

SEQ ID NO: 367393 - DNA, 20 bp, Artificial Sequence
  chemically synthesized
gtaaaaacgtttaactcggc

SEQ ID NO: 367394 - DNA, 20 bp, Artificial Sequence
  chemically synthesized
taaaaacgtttaactcggcc

SEQ ID NO: 367395 - DNA, 20 bp, Artificial Sequence
  chemically synthesized
gtgagccactgcacctggcc

SEQ ID NO: 367396 - DNA, 20 bp, Artificial Sequence
  chemically synthesized
acgtttaactcggccaggtg

SEQ ID NO: 367397 - DNA, 20 bp, Artificial Sequence
  chemically synthesized
tttaactcggccaggtgcag

SEQ ID NO: 367398 - DNA, 20 bp, Artificial Sequence
  chemically synthesized
caggtgtgagccactgcacc

SEQ ID NO: 367399 - DNA, 20 bp, Artificial Sequence
  chemically synthesized
agtgctaggattacaggtgt

SEQ ID NO: 367400 - DNA, 20 bp, Artificial Sequence
  chemically synthesized
gtggctcacacctgtaatcc

SEQ ID NO: 367401 - DNA, 20 bp, Artificial Sequence
  chemically synthesized
tcccaaagtgctaggattac

SEQ ID NO: 367402 - DNA, 20 bp, Artificial Sequence
  chemically synthesized
gtcccaaagtgctaggatta

SEQ ID NO: 367403 - DNA, 20 bp, Artificial Sequence
  chemically synthesized
cacctgtaatcctagcactt

SEQ ID NO: 367404 - DNA, 20 bp, Artificial Sequence
  chemically synthesized
cctcagcgtcccaaagtgct

SEQ ID NO: 367405 - DNA, 20 bp, Artificial Sequence
  chemically synthesized
acctgtaatcctagcacttt

SEQ ID NO: 367406 - DNA, 20 bp, Artificial Sequence
  chemically synthesized
gcctcagcgtcccaaagtgc

SEQ ID NO: 367407 - DNA, 20 bp, Artificial Sequence
  chemically synthesized
ccacctgcctcagcgtccca

SEQ ID NO: 367408 - DNA, 20 bp, Artificial Sequence
  chemically synthesized
tcctagcactttgggacgct

SEQ ID NO: 367409 - DNA, 20 bp, Artificial Sequence
  chemically synthesized
cctagcactttgggacgctg

SEQ ID NO: 367410 - DNA, 20 bp, Artificial Sequence
  chemically synthesized
agcactttgggacgctgagg

SEQ ID NO: 367411 - DNA, 20 bp, Artificial Sequence
  chemically synthesized
gcactttgggacgctgaggc

SEQ ID NO: 367412 - DNA, 20 bp, Artificial Sequence
  chemically synthesized
ctttgggacgctgaggcagg

SEQ ID NO: 367413 - DNA, 20 bp, Artificial Sequence
  chemically synthesized
cttaagtgagccacctgcct

SEQ ID NO: 367414 - DNA, 20 bp, Artificial Sequence
  chemically synthesized
ctgaggcaggtggctcactt

SEQ ID NO: 367415 - DNA, 20 bp, Artificial Sequence
  chemically synthesized
tgaggcaggtggctcactta

SEQ ID NO: 367416 - DNA, 20 bp, Artificial Sequence
  chemically synthesized
tcgaactcctgaccttaagt

SEQ ID NO: 367417 - DNA, 20 bp, Artificial Sequence
  chemically synthesized
gcaggtggctcacttaaggt

SEQ ID NO: 367418 - DNA, 20 bp, Artificial Sequence
  chemically synthesized
caggtggctcacttaaggtc

SEQ ID NO: 367419 - DNA, 20 bp, Artificial Sequence
  chemically synthesized
ggtctcgaactcctgacctt

SEQ ID NO: 367420 - DNA, 20 bp, Artificial Sequence
  chemically synthesized
ggtggctcacttaaggtcag

SEQ ID NO: 367421 - DNA, 20 bp, Artificial Sequence
  chemically synthesized
tcacttaaggtcaggagttc

SEQ ID NO: 367422 - DNA, 20 bp, Artificial Sequence
  chemically synthesized
taaggtcaggagttcgagac

SEQ ID NO: 367423 - DNA, 20 bp, Artificial Sequence
  chemically synthesized
tcaggagttcgagaccagcc

SEQ ID NO: 367424 - DNA, 20 bp, Artificial Sequence
  chemically synthesized
tttgaccatgttggccaggc

SEQ ID NO: 367425 - DNA, 20 bp, Artificial Sequence
  chemically synthesized
atggtttgaccatgttggcc

SEQ ID NO: 367426 - DNA, 20 bp, Artificial Sequence
  chemically synthesized
cgagaccagcctggccaaca

SEQ ID NO: 367427 - DNA, 20 bp, Artificial Sequence
  chemically synthesized
catggtttgaccatgttggc

SEQ ID NO: 367428 - DNA, 20 bp, Artificial Sequence
  chemically synthesized
gagacatggtttgaccatgt

SEQ ID NO: 367429 - DNA, 20 bp, Artificial Sequence
  chemically synthesized
ttgtatttttagtagagaca

SEQ ID NO: 367430 - DNA, 20 bp, Artificial Sequence
  chemically synthesized
taattcttgtatttttagta

SEQ ID NO: 367431 - DNA, 20 bp, Artificial Sequence
  chemically synthesized
gctaattcttgtatttttag

SEQ ID NO: 367432 - DNA, 20 bp, Artificial Sequence
  chemically synthesized
catgtctctactaaaaatac

SEQ ID NO: 367433 - DNA, 20 bp, Artificial Sequence
  chemically synthesized
ccagctaattcttgtatttt

SEQ ID NO: 367434 - DNA, 20 bp, Artificial Sequence
  chemically synthesized
tctactaaaaatacaagaat

SEQ ID NO: 367435 - DNA, 20 bp, Artificial Sequence
  chemically synthesized
ctaaaaatacaagaattagc

SEQ ID NO: 367436 - DNA, 20 bp, Artificial Sequence
  chemically synthesized
taaaaatacaagaattagct

SEQ ID NO: 367437 - DNA, 20 bp, Artificial Sequence
  chemically synthesized
atacaagaattagctgggcg

SEQ ID NO: 367438 - DNA, 20 bp, Artificial Sequence
  chemically synthesized
caagaattagctgggcgtgg

SEQ ID NO: 367439 - DNA, 20 bp, Artificial Sequence
  chemically synthesized
caggtgtgtgccaccacgcc

SEQ ID NO: 367440 - DNA, 20 bp, Artificial Sequence
  chemically synthesized
tctcgagtagttgggatcac

SEQ ID NO: 367441 - DNA, 20 bp, Artificial Sequence
  chemically synthesized
ctctcgagtagttgggatca

SEQ ID NO: 367442 - DNA, 20 bp, Artificial Sequence
  chemically synthesized
cctcagcctctcgagtagtt

SEQ ID NO: 367443 - DNA, 20 bp, Artificial Sequence
  chemically synthesized
acctgtgatcccaactactc

SEQ ID NO: 367444 - DNA, 20 bp, Artificial Sequence
  chemically synthesized
gcctcagcctctcgagtagt

SEQ ID NO: 367445 - DNA, 20 bp, Artificial Sequence
  chemically synthesized
ctgtgatcccaactactcga

SEQ ID NO: 367446 - DNA, 20 bp, Artificial Sequence
  chemically synthesized
tgtgatcccaactactcgag

SEQ ID NO: 367447 - DNA, 20 bp, Artificial Sequence
  chemically synthesized
tcctgcctcagcctctcgag

SEQ ID NO: 367448 - DNA, 20 bp, Artificial Sequence
  chemically synthesized
ttctcctgcctcagcctctc

SEQ ID NO: 367449 - DNA, 20 bp, Artificial Sequence
  chemically synthesized
tcccaactactcgagaggct

SEQ ID NO: 367450 - DNA, 20 bp, Artificial Sequence
  chemically synthesized
cccaactactcgagaggctg

SEQ ID NO: 367451 - DNA, 20 bp, Artificial Sequence
  chemically synthesized
aactactcgagaggctgagg

SEQ ID NO: 367452 - DNA, 20 bp, Artificial Sequence
  chemically synthesized
actactcgagaggctgaggc

SEQ ID NO: 367453 - DNA, 20 bp, Artificial Sequence
  chemically synthesized
tactcgagaggctgaggcag

SEQ ID NO: 367454 - DNA, 20 bp, Artificial Sequence
  chemically synthesized
ttctagcgattctcctgcct

SEQ ID NO: 367455 - DNA, 20 bp, Artificial Sequence
  chemically synthesized
ggctgaggcaggagaatcgc

SEQ ID NO: 367456 - DNA, 20 bp, Artificial Sequence
  chemically synthesized
ggcaggagaatcgctagaac

SEQ ID NO: 367457 - DNA, 20 bp, Artificial Sequence
  chemically synthesized
gcaggagaatcgctagaact

SEQ ID NO: 367458 - DNA, 20 bp, Artificial Sequence
  chemically synthesized
aacctccaccttcctagttc

SEQ ID NO: 367459 - DNA, 20 bp, Artificial Sequence
  chemically synthesized
ggagaatcgctagaactagg

SEQ ID NO: 367460 - DNA, 20 bp, Artificial Sequence
  chemically synthesized
gagaatcgctagaactagga

SEQ ID NO: 367461 - DNA, 20 bp, Artificial Sequence
  chemically synthesized
aatcgctagaactaggaagg

SEQ ID NO: 367462 - DNA, 20 bp, Artificial Sequence
  chemically synthesized
cactgcaacctccaccttcc

SEQ ID NO: 367463 - DNA, 20 bp, Artificial Sequence
  chemically synthesized
tcgctagaactaggaaggtg

SEQ ID NO: 367464 - DNA, 20 bp, Artificial Sequence
  chemically synthesized
cgctagaactaggaaggtgg

SEQ ID NO: 367465 - DNA, 20 bp, Artificial Sequence
  chemically synthesized
aactaggaaggtggaggttg

SEQ ID NO: 367466 - DNA, 20 bp, Artificial Sequence
  chemically synthesized
aggaaggtggaggttgcagt

SEQ ID NO: 367467 - DNA, 20 bp, Artificial Sequence
  chemically synthesized
ggtggaggttgcagtgagcc

SEQ ID NO: 367468 - DNA, 20 bp, Artificial Sequence
  chemically synthesized
ggagtgcagtggcacgatct

SEQ ID NO: 367469 - DNA, 20 bp, Artificial Sequence
  chemically synthesized
tcacaaaggccggagtgcag

SEQ ID NO: 367470 - DNA, 20 bp, Artificial Sequence
  chemically synthesized
gagatcgtgccactgcactc

SEQ ID NO: 367471 - DNA, 20 bp, Artificial Sequence
  chemically synthesized
tcgtcacaaaggccggagtg

SEQ ID NO: 367472 - DNA, 20 bp, Artificial Sequence
  chemically synthesized
ttgcttcgtcacaaaggccg

SEQ ID NO: 367473 - DNA, 20 bp, Artificial Sequence
  chemically synthesized
tcttgcttcgtcacaaaggc

SEQ ID NO: 367474 - DNA, 20 bp, Artificial Sequence
  chemically synthesized
gagatcttgcttcgtcacaa

SEQ ID NO: 367475 - DNA, 20 bp, Artificial Sequence
  chemically synthesized
gcactccggcctttgtgacg

SEQ ID NO: 367476 - DNA, 20 bp, Artificial Sequence
  chemically synthesized
tgagatcttgcttcgtcaca

SEQ ID NO: 367477 - DNA, 20 bp, Artificial Sequence
  chemically synthesized
tccggcctttgtgacgaagc

SEQ ID NO: 367478 - DNA, 20 bp, Artificial Sequence
  chemically synthesized
gtgtgtgtgtgtgtgtgtgt

SEQ ID NO: 367479 - DNA, 20 bp, Artificial Sequence
  chemically synthesized
acacacacacacacacacac

SEQ ID NO: 367480 - DNA, 20 bp, Artificial Sequence
  chemically synthesized
acacacacacacacaagtta

SEQ ID NO: 367481 - DNA, 20 bp, Artificial Sequence
  chemically synthesized
aatatttttatattatcgaa

SEQ ID NO: 367482 - DNA, 20 bp, Artificial Sequence
  chemically synthesized
ataatataaaaatattatat

SEQ ID NO: 367483 - DNA, 20 bp, Artificial Sequence
  chemically synthesized
tataaaaatattatattaga

SEQ ID NO: 367484 - DNA, 20 bp, Artificial Sequence
  chemically synthesized
aaatattatattagaaagtg

SEQ ID NO: 367485 - DNA, 20 bp, Artificial Sequence
  chemically synthesized
acatgtaaaatgttttctat

SEQ ID NO: 367486 - DNA, 20 bp, Artificial Sequence
  chemically synthesized
taaaatgttttctattagtt

SEQ ID NO: 367487 - DNA, 20 bp, Artificial Sequence
  chemically synthesized
ccacagggatgccaaactaa

SEQ ID NO: 367488 - DNA, 20 bp, Artificial Sequence
  chemically synthesized
ctattagtttggcatccctg

SEQ ID NO: 367489 - DNA, 20 bp, Artificial Sequence
  chemically synthesized
tattagtttggcatccctgt

SEQ ID NO: 367490 - DNA, 20 bp, Artificial Sequence
  chemically synthesized
ttagtttggcatccctgtgg

SEQ ID NO: 367491 - DNA, 20 bp, Artificial Sequence
  chemically synthesized
tattgacttgcactcccaca

SEQ ID NO: 367492 - DNA, 20 bp, Artificial Sequence
  chemically synthesized
ctattgacttgcactcccac

SEQ ID NO: 367493 - DNA, 20 bp, Artificial Sequence
  chemically synthesized
cctattgacttgcactccca

SEQ ID NO: 367494 - DNA, 20 bp, Artificial Sequence
  chemically synthesized
tggcatccctgtgggagtgc

SEQ ID NO: 367495 - DNA, 20 bp, Artificial Sequence
  chemically synthesized
cctgtgggagtgcaagtcaa

SEQ ID NO: 367496 - DNA, 20 bp, Artificial Sequence
  chemically synthesized
ctgtgggagtgcaagtcaat

SEQ ID NO: 367497 - DNA, 20 bp, Artificial Sequence
  chemically synthesized
tgtgggagtgcaagtcaata

SEQ ID NO: 367498 - DNA, 20 bp, Artificial Sequence
  chemically synthesized
gtgggagtgcaagtcaatag

SEQ ID NO: 367499 - DNA, 20 bp, Artificial Sequence
  chemically synthesized
ggagtgcaagtcaatagggg

SEQ ID NO: 367500 - DNA, 20 bp, Artificial Sequence
  chemically synthesized
gagtgcaagtcaatagggga

SEQ ID NO: 367501 - DNA, 20 bp, Artificial Sequence
  chemically synthesized
ccagttttagtaattgtata

SEQ ID NO: 367502 - DNA, 20 bp, Artificial Sequence
  chemically synthesized
accagttttagtaattgtat

SEQ ID NO: 367503 - DNA, 20 bp, Artificial Sequence
  chemically synthesized
caccagttttagtaattgta

SEQ ID NO: 367504 - DNA, 20 bp, Artificial Sequence
  chemically synthesized
ccctatacaattactaaaac

SEQ ID NO: 367505 - DNA, 20 bp, Artificial Sequence
  chemically synthesized
ccatctgcattcaccagttt

SEQ ID NO: 367506 - DNA, 20 bp, Artificial Sequence
  chemically synthesized
attactaaaactggtgaatg

SEQ ID NO: 367507 - DNA, 20 bp, Artificial Sequence
  chemically synthesized
tctgtaccatctgcattcac

SEQ ID NO: 367508 - DNA, 20 bp, Artificial Sequence
  chemically synthesized
ctaaaactggtgaatgcaga

SEQ ID NO: 367509 - DNA, 20 bp, Artificial Sequence
  chemically synthesized
actggtgaatgcagatggta

SEQ ID NO: 367510 - DNA, 20 bp, Artificial Sequence
  chemically synthesized
tggtgaatgcagatggtaca

SEQ ID NO: 367511 - DNA, 20 bp, Artificial Sequence
  chemically synthesized
ggtgaatgcagatggtacag

SEQ ID NO: 367512 - DNA, 20 bp, Artificial Sequence
  chemically synthesized
gatggtacagaggatgcact

SEQ ID NO: 367513 - DNA, 20 bp, Artificial Sequence
  chemically synthesized
ggaggaaaaagcaagtttct

SEQ ID NO: 367514 - DNA, 20 bp, Artificial Sequence
  chemically synthesized
aagaaaagggaggaaaaagc

SEQ ID NO: 367515 - DNA, 20 bp, Artificial Sequence
  chemically synthesized
gaacaagaaaagggaggaaa

SEQ ID NO: 367516 - DNA, 20 bp, Artificial Sequence
  chemically synthesized
tcaaaagaacaagaaaaggg

SEQ ID NO: 367517 - DNA, 20 bp, Artificial Sequence
  chemically synthesized
gtcaaaagaacaagaaaagg

SEQ ID NO: 367518 - DNA, 20 bp, Artificial Sequence
  chemically synthesized
tagtcaaaagaacaagaaaa

SEQ ID NO: 367519 - DNA, 20 bp, Artificial Sequence
  chemically synthesized
atagtcaaaagaacaagaaa

SEQ ID NO: 367520 - DNA, 20 bp, Artificial Sequence
  chemically synthesized
aatagtcaaaagaacaagaa

SEQ ID NO: 367521 - DNA, 20 bp, Artificial Sequence
  chemically synthesized
ttaaaaatagtcaaaagaac

SEQ ID NO: 367522 - DNA, 20 bp, Artificial Sequence
  chemically synthesized
gaatacttaaaaatagtcaa

SEQ ID NO: 367523 - DNA, 20 bp, Artificial Sequence
  chemically synthesized
ttgttcttttgactattttt

SEQ ID NO: 367524 - DNA, 20 bp, Artificial Sequence
  chemically synthesized
aacaaaagaatacttaaaaa

SEQ ID NO: 367525 - DNA, 20 bp, Artificial Sequence
  chemically synthesized
atgaaaggggagaacaacaa

SEQ ID NO: 367526 - DNA, 20 bp, Artificial Sequence
  chemically synthesized
gtatgttgaagatgaaaggg

SEQ ID NO: 367527 - DNA, 20 bp, Artificial Sequence
  chemically synthesized
gtgtatgttgaagatgaaag

SEQ ID NO: 367528 - DNA, 20 bp, Artificial Sequence
  chemically synthesized
ggtgtatgttgaagatgaaa

SEQ ID NO: 367529 - DNA, 20 bp, Artificial Sequence
  chemically synthesized
tggtgtatgttgaagatgaa

SEQ ID NO: 367530 - DNA, 20 bp, Artificial Sequence
  chemically synthesized
atggtgtatgttgaagatga

SEQ ID NO: 367531 - DNA, 20 bp, Artificial Sequence
  chemically synthesized
caaagacatggtgtatgttg

SEQ ID NO: 367532 - DNA, 20 bp, Artificial Sequence
  chemically synthesized
tgccacctgcaacaaagaca

SEQ ID NO: 367533 - DNA, 20 bp, Artificial Sequence
  chemically synthesized
catacaccatgtctttgttg

SEQ ID NO: 367534 - DNA, 20 bp, Artificial Sequence
  chemically synthesized
atacaccatgtctttgttgc

SEQ ID NO: 367535 - DNA, 20 bp, Artificial Sequence
  chemically synthesized
ataaaatgccacctgcaaca

SEQ ID NO: 367536 - DNA, 20 bp, Artificial Sequence
  chemically synthesized
caccatgtctttgttgcagg

SEQ ID NO: 367537 - DNA, 20 bp, Artificial Sequence
  chemically synthesized
caggtggcattttatatcct

SEQ ID NO: 367538 - DNA, 20 bp, Artificial Sequence
  chemically synthesized
aaagaaaaaatattgttctt

SEQ ID NO: 367539 - DNA, 20 bp, Artificial Sequence
  chemically synthesized
taaagaaaaaatattgttct

SEQ ID NO: 367540 - DNA, 20 bp, Artificial Sequence
  chemically synthesized
ccattaaaggttgaatttta

SEQ ID NO: 367541 - DNA, 20 bp, Artificial Sequence
  chemically synthesized
ctttaaaattcaacctttaa

SEQ ID NO: 367542 - DNA, 20 bp, Artificial Sequence
  chemically synthesized
cttgaaaaggaagccattaa

SEQ ID NO: 367543 - DNA, 20 bp, Artificial Sequence
  chemically synthesized
acttgaaaaggaagccatta

SEQ ID NO: 367544 - DNA, 20 bp, Artificial Sequence
  chemically synthesized
cctttaatggcttccttttc

SEQ ID NO: 367545 - DNA, 20 bp, Artificial Sequence
  chemically synthesized
ttctcatacacttgaaaagg

SEQ ID NO: 367546 - DNA, 20 bp, Artificial Sequence
  chemically synthesized
tagttctcatacacttgaaa

SEQ ID NO: 367547 - DNA, 20 bp, Artificial Sequence
  chemically synthesized
atagttctcatacacttgaa

SEQ ID NO: 367548 - DNA, 20 bp, Artificial Sequence
  chemically synthesized
ggcttccttttcaagtgtat

SEQ ID NO: 367549 - DNA, 20 bp, Artificial Sequence
  chemically synthesized
tgtatgagaactattttgtg

SEQ ID NO: 367550 - DNA, 20 bp, Artificial Sequence
  chemically synthesized
gttttgtgtgcttcacaaaa

SEQ ID NO: 367551 - DNA, 20 bp, Artificial Sequence
  chemically synthesized
acaaaacatgaattcctcct

SEQ ID NO: 367552 - DNA, 20 bp, Artificial Sequence
  chemically synthesized
caaaacatgaattcctcctt

SEQ ID NO: 367553 - DNA, 20 bp, Artificial Sequence
  chemically synthesized
cagggtcgcctggcccaagg

SEQ ID NO: 367554 - DNA, 20 bp, Artificial Sequence
  chemically synthesized
acatgaattcctccttgggc

SEQ ID NO: 367555 - DNA, 20 bp, Artificial Sequence
  chemically synthesized
acagggtcgcctggcccaag

SEQ ID NO: 367556 - DNA, 20 bp, Artificial Sequence
  chemically synthesized
catgaattcctccttgggcc

SEQ ID NO: 367557 - DNA, 20 bp, Artificial Sequence
  chemically synthesized
ctacagggtcgcctggccca

SEQ ID NO: 367558 - DNA, 20 bp, Artificial Sequence
  chemically synthesized
gctacagggtcgcctggccc

SEQ ID NO: 367559 - DNA, 20 bp, Artificial Sequence
  chemically synthesized
cagagagctacagggtcgcc

SEQ ID NO: 367560 - DNA, 20 bp, Artificial Sequence
  chemically synthesized
ccttgggccaggcgaccctg

SEQ ID NO: 367561 - DNA, 20 bp, Artificial Sequence
  chemically synthesized
actgaagacagagagctaca

SEQ ID NO: 367562 - DNA, 20 bp, Artificial Sequence
  chemically synthesized
aactgaagacagagagctac

SEQ ID NO: 367563 - DNA, 20 bp, Artificial Sequence
  chemically synthesized
gaactgaagacagagagcta

SEQ ID NO: 367564 - DNA, 20 bp, Artificial Sequence
  chemically synthesized
taaaatgaactgaagacaga

SEQ ID NO: 367565 - DNA, 20 bp, Artificial Sequence
  chemically synthesized
accctgtagctctctgtctt

SEQ ID NO: 367566 - DNA, 20 bp, Artificial Sequence
  chemically synthesized
cataaaatgaactgaagaca

SEQ ID NO: 367567 - DNA, 20 bp, Artificial Sequence
  chemically synthesized
gtcataaaatgaactgaaga

SEQ ID NO: 367568 - DNA, 20 bp, Artificial Sequence
  chemically synthesized
cttagtcataaaatgaactg

SEQ ID NO: 367569 - DNA, 20 bp, Artificial Sequence
  chemically synthesized
cttcagttcattttatgact

SEQ ID NO: 367570 - DNA, 20 bp, Artificial Sequence
  chemically synthesized
tcacttgataagggaaatct

SEQ ID NO: 367571 - DNA, 20 bp, Artificial Sequence
  chemically synthesized
tgactaagatttcccttatc

SEQ ID NO: 367572 - DNA, 20 bp, Artificial Sequence
  chemically synthesized
ccactcagttcacttgataa

SEQ ID NO: 367573 - DNA, 20 bp, Artificial Sequence
  chemically synthesized
tccactcagttcacttgata

SEQ ID NO: 367574 - DNA, 20 bp, Artificial Sequence
  chemically synthesized
atccactcagttcacttgat

SEQ ID NO: 367575 - DNA, 20 bp, Artificial Sequence
  chemically synthesized
tttcccttatcaagtgaact

SEQ ID NO: 367576 - DNA, 20 bp, Artificial Sequence
  chemically synthesized
cccttatcaagtgaactgag

SEQ ID NO: 367577 - DNA, 20 bp, Artificial Sequence
  chemically synthesized
agtaatatcagatatccact

SEQ ID NO: 367578 - DNA, 20 bp, Artificial Sequence
  chemically synthesized
tacattaaactgagtaatat

SEQ ID NO: 367579 - DNA, 20 bp, Artificial Sequence
  chemically synthesized
agtggatatctgatattact

SEQ ID NO: 367580 - DNA, 20 bp, Artificial Sequence
  chemically synthesized
atatgcagatacattaaact

SEQ ID NO: 367581 - DNA, 20 bp, Artificial Sequence
  chemically synthesized
taacaaagacaatatatatg

SEQ ID NO: 367582 - DNA, 20 bp, Artificial Sequence
  chemically synthesized
tgttgtggtttgggttaaca

SEQ ID NO: 367583 - DNA, 20 bp, Artificial Sequence
  chemically synthesized
gtcctttcgtgttgtggttt

SEQ ID NO: 367584 - DNA, 20 bp, Artificial Sequence
  chemically synthesized
ggtcctttcgtgttgtggtt

SEQ ID NO: 367585 - DNA, 20 bp, Artificial Sequence
  chemically synthesized
ttttaggtcctttcgtgttg

SEQ ID NO: 367586 - DNA, 20 bp, Artificial Sequence
  chemically synthesized
taacccaaaccacaacacga

SEQ ID NO: 367587 - DNA, 20 bp, Artificial Sequence
  chemically synthesized
aacccaaaccacaacacgaa

SEQ ID NO: 367588 - DNA, 20 bp, Artificial Sequence
  chemically synthesized
acacgaaaggacctaaaaac

SEQ ID NO: 367589 - DNA, 20 bp, Artificial Sequence
  chemically synthesized
aggaatactgtctcgttttt

SEQ ID NO: 367590 - DNA, 20 bp, Artificial Sequence
  chemically synthesized
aaggaatactgtctcgtttt

SEQ ID NO: 367591 - DNA, 20 bp, Artificial Sequence
  chemically synthesized
gaaaggacctaaaaacgaga

SEQ ID NO: 367592 - DNA, 20 bp, Artificial Sequence
  chemically synthesized
catactaaaaaggatttgga

SEQ ID NO: 367593 - DNA, 20 bp, Artificial Sequence
  chemically synthesized
tcatactaaaaaggatttgg

SEQ ID NO: 367594 - DNA, 20 bp, Artificial Sequence
  chemically synthesized
atttcatactaaaaaggatt

SEQ ID NO: 367595 - DNA, 20 bp, Artificial Sequence
  chemically synthesized
tattccttccaaatcctttt

SEQ ID NO: 367596 - DNA, 20 bp, Artificial Sequence
  chemically synthesized
ttctttatttcatactaaaa

SEQ ID NO: 367597 - DNA, 20 bp, Artificial Sequence
  chemically synthesized
tttctttatttcatactaaa

SEQ ID NO: 367598 - DNA, 20 bp, Artificial Sequence
  chemically synthesized
atcctttttagtatgaaata

SEQ ID NO: 367599 - DNA, 20 bp, Artificial Sequence
  chemically synthesized
tagtatgaaataaagaaata

SEQ ID NO: 367600 - DNA, 20 bp, Artificial Sequence
  chemically synthesized
tatgaaataaagaaatacgg

SEQ ID NO: 367601 - DNA, 20 bp, Artificial Sequence
  chemically synthesized
aagaaatacggaagcacaaa

SEQ ID NO: 367602 - DNA, 20 bp, Artificial Sequence
  chemically synthesized
aagcacaaacagtgttcaaa

SEQ ID NO: 367603 - DNA, 20 bp, Artificial Sequence
  chemically synthesized
acagtgttcaaaaagaaaca

SEQ ID NO: 367604 - DNA, 20 bp, Artificial Sequence
  chemically synthesized
tgttcaaaaagaaacacaga

SEQ ID NO: 367605 - DNA, 20 bp, Artificial Sequence
  chemically synthesized
gttcaaaaagaaacacagat

SEQ ID NO: 367606 - DNA, 20 bp, Artificial Sequence
  chemically synthesized
caaaaagaaacacagatagg

SEQ ID NO: 367607 - DNA, 20 bp, Artificial Sequence
  chemically synthesized
aaaaagaaacacagataggt

SEQ ID NO: 367608 - DNA, 20 bp, Artificial Sequence
  chemically synthesized
acacagataggtaggttgac

SEQ ID NO: 367609 - DNA, 20 bp, Artificial Sequence
  chemically synthesized
cagataggtaggttgacaag

SEQ ID NO: 367610 - DNA, 20 bp, Artificial Sequence
  chemically synthesized
gttgacaagtggcataaata

SEQ ID NO: 367611 - DNA, 20 bp, Artificial Sequence
  chemically synthesized
aaataaagtgaaccaaatca

SEQ ID NO: 367612 - DNA, 20 bp, Artificial Sequence
  chemically synthesized
tgatttgttccactttgatt

SEQ ID NO: 367613 - DNA, 20 bp, Artificial Sequence
  chemically synthesized
taaagtgaaccaaatcaaag

SEQ ID NO: 367614 - DNA, 20 bp, Artificial Sequence
  chemically synthesized
aatcaaagtggaacaaatca

SEQ ID NO: 367615 - DNA, 20 bp, Artificial Sequence
  chemically synthesized
aaatcaaagtaaaaaaattt

SEQ ID NO: 367616 - DNA, 20 bp, Artificial Sequence
  chemically synthesized
caaagtaaaaaaatttgaga

SEQ ID NO: 367617 - DNA, 20 bp, Artificial Sequence
  chemically synthesized
aaagtaaaaaaatttgagaa

SEQ ID NO: 367618 - DNA, 20 bp, Artificial Sequence
  chemically synthesized
agaaaggaaatgcatttgtg

SEQ ID NO: 367619 - DNA, 20 bp, Artificial Sequence
  chemically synthesized
gaaaggaaatgcatttgtga

SEQ ID NO: 367620 - DNA, 20 bp, Artificial Sequence
  chemically synthesized
atgcatttgtgaaggtgttt

SEQ ID NO: 367621 - DNA, 20 bp, Artificial Sequence
  chemically synthesized
catttgtgaaggtgtttaag

SEQ ID NO: 367622 - DNA, 20 bp, Artificial Sequence
  chemically synthesized
ttaagtggtttctgattctt

SEQ ID NO: 367623 - DNA, 20 bp, Artificial Sequence
  chemically synthesized
ccaatacaactctgaagaat

SEQ ID NO: 367624 - DNA, 20 bp, Artificial Sequence
  chemically synthesized
aagtggtttctgattcttca

SEQ ID NO: 367625 - DNA, 20 bp, Artificial Sequence
  chemically synthesized
aaaagaccaatacaactctg

SEQ ID NO: 367626 - DNA, 20 bp, Artificial Sequence
  chemically synthesized
ctgattcttcagagttgtat

SEQ ID NO: 367627 - DNA, 20 bp, Artificial Sequence
  chemically synthesized
cctttggattttcaggttaa

SEQ ID NO: 367628 - DNA, 20 bp, Artificial Sequence
  chemically synthesized
attgatccctttggattttc

SEQ ID NO: 367629 - DNA, 20 bp, Artificial Sequence
  chemically synthesized
tattgatccctttggatttt

SEQ ID NO: 367630 - DNA, 20 bp, Artificial Sequence
  chemically synthesized
tcttttaacctgaaaatcca

SEQ ID NO: 367631 - DNA, 20 bp, Artificial Sequence
  chemically synthesized
cttttaacctgaaaatccaa

SEQ ID NO: 367632 - DNA, 20 bp, Artificial Sequence
  chemically synthesized
ttttaacctgaaaatccaaa

SEQ ID NO: 367633 - DNA, 20 bp, Artificial Sequence
  chemically synthesized
ctgaaacgtattgatccctt

SEQ ID NO: 367634 - DNA, 20 bp, Artificial Sequence
  chemically synthesized
ccaaagggatcaatacgttt

SEQ ID NO: 367635 - DNA, 20 bp, Artificial Sequence
  chemically synthesized
aagggatcaatacgtttcag

SEQ ID NO: 367636 - DNA, 20 bp, Artificial Sequence
  chemically synthesized
gatcaatacgtttcagtaga

SEQ ID NO: 367637 - DNA, 20 bp, Artificial Sequence
  chemically synthesized
atacgtttcagtagaaagta

SEQ ID NO: 367638 - DNA, 20 bp, Artificial Sequence
  chemically synthesized
tcagtagaaagtaaagaaca

SEQ ID NO: 367639 - DNA, 20 bp, Artificial Sequence
  chemically synthesized
cagtagaaagtaaagaacac

SEQ ID NO: 367640 - DNA, 20 bp, Artificial Sequence
  chemically synthesized
agtagaaagtaaagaacaca

SEQ ID NO: 367641 - DNA, 20 bp, Artificial Sequence
  chemically synthesized
taaagaacacagggataatt

SEQ ID NO: 367642 - DNA, 20 bp, Artificial Sequence
  chemically synthesized
ttgtcctttttgtaatcaga

SEQ ID NO: 367643 - DNA, 20 bp, Artificial Sequence
  chemically synthesized
cttgtcctttttgtaatcag

SEQ ID NO: 367644 - DNA, 20 bp, Artificial Sequence
  chemically synthesized
tggcttgtcctttttgtaat

SEQ ID NO: 367645 - DNA, 20 bp, Artificial Sequence
  chemically synthesized
catgaccttctgattacaaa

SEQ ID NO: 367646 - DNA, 20 bp, Artificial Sequence
  chemically synthesized
atgaccttctgattacaaaa

SEQ ID NO: 367647 - DNA, 20 bp, Artificial Sequence
  chemically synthesized
cttctgattacaaaaaggac

SEQ ID NO: 367648 - DNA, 20 bp, Artificial Sequence
  chemically synthesized
attacaaaaaggacaagcca

SEQ ID NO: 367649 - DNA, 20 bp, Artificial Sequence
  chemically synthesized
cttagcgacagttatgtcca

SEQ ID NO: 367650 - DNA, 20 bp, Artificial Sequence
  chemically synthesized
ccatggacataactgtcgct

SEQ ID NO: 367651 - DNA, 20 bp, Artificial Sequence
  chemically synthesized
tatcttgactttcttagcga

SEQ ID NO: 367652 - DNA, 20 bp, Artificial Sequence
  chemically synthesized
ggacataactgtcgctaaga

SEQ ID NO: 367653 - DNA, 20 bp, Artificial Sequence
  chemically synthesized
cagaagtatcttgactttct

SEQ ID NO: 367654 - DNA, 20 bp, Artificial Sequence
  chemically synthesized
taactgtcgctaagaaagtc

SEQ ID NO: 367655 - DNA, 20 bp, Artificial Sequence
  chemically synthesized
ctagggatttgtaattgcag

SEQ ID NO: 367656 - DNA, 20 bp, Artificial Sequence
  chemically synthesized
tgtctagggatttgtaattg

SEQ ID NO: 367657 - DNA, 20 bp, Artificial Sequence
  chemically synthesized
cttctgcaattacaaatccc

SEQ ID NO: 367658 - DNA, 20 bp, Artificial Sequence
  chemically synthesized
aattacaaatccctagacat

SEQ ID NO: 367659 - DNA, 20 bp, Artificial Sequence
  chemically synthesized
tttggtgtttccaatgtcta

SEQ ID NO: 367660 - DNA, 20 bp, Artificial Sequence
  chemically synthesized
ttttggtgtttccaatgtct

SEQ ID NO: 367661 - DNA, 20 bp, Artificial Sequence
  chemically synthesized
tttttggtgtttccaatgtc

SEQ ID NO: 367662 - DNA, 20 bp, Artificial Sequence
  chemically synthesized
tgtggtatttgcgatatttt

SEQ ID NO: 367663 - DNA, 20 bp, Artificial Sequence
  chemically synthesized
aaaatatcgcaaataccaca

SEQ ID NO: 367664 - DNA, 20 bp, Artificial Sequence
  chemically synthesized
cccagttttgcaattctttg

SEQ ID NO: 367665 - DNA, 20 bp, Artificial Sequence
  chemically synthesized
accacaaagaattgcaaaac

SEQ ID NO: 367666 - DNA, 20 bp, Artificial Sequence
  chemically synthesized
ccacaaagaattgcaaaact

SEQ ID NO: 367667 - DNA, 20 bp, Artificial Sequence
  chemically synthesized
cacaaagaattgcaaaactg

SEQ ID NO: 367668 - DNA, 20 bp, Artificial Sequence
  chemically synthesized
ttcagtaagttttgaatccc

SEQ ID NO: 367669 - DNA, 20 bp, Artificial Sequence
  chemically synthesized
tggggattcaaaacttactg

SEQ ID NO: 367670 - DNA, 20 bp, Artificial Sequence
  chemically synthesized
ggtcagcagcgttcttcagt

SEQ ID NO: 367671 - DNA, 20 bp, Artificial Sequence
  chemically synthesized
agctggtcagcagcgttctt

SEQ ID NO: 367672 - DNA, 20 bp, Artificial Sequence
  chemically synthesized
tactgaagaacgctgctgac

SEQ ID NO: 367673 - DNA, 20 bp, Artificial Sequence
  chemically synthesized
tttttctgggagctggtcag

SEQ ID NO: 367674 - DNA, 20 bp, Artificial Sequence
  chemically synthesized
ttatttttctgggagctggt

SEQ ID NO: 367675 - DNA, 20 bp, Artificial Sequence
  chemically synthesized
gaacgctgctgaccagctcc

SEQ ID NO: 367676 - DNA, 20 bp, Artificial Sequence
  chemically synthesized
tgccttatttttctgggagc

SEQ ID NO: 367677 - DNA, 20 bp, Artificial Sequence
  chemically synthesized
gggttgccttatttttctgg

SEQ ID NO: 367678 - DNA, 20 bp, Artificial Sequence
  chemically synthesized
atgggttgccttatttttct

SEQ ID NO: 367679 - DNA, 20 bp, Artificial Sequence
  chemically synthesized
tgaccagctcccagaaaaat

SEQ ID NO: 367680 - DNA, 20 bp, Artificial Sequence
  chemically synthesized
aatgggttgccttatttttc

SEQ ID NO: 367681 - DNA, 20 bp, Artificial Sequence
  chemically synthesized
gaccagctcccagaaaaata

SEQ ID NO: 367682 - DNA, 20 bp, Artificial Sequence
  chemically synthesized
cttcctatttacatgaaaat

SEQ ID NO: 367683 - DNA, 20 bp, Artificial Sequence
  chemically synthesized
gcttcctatttacatgaaaa

SEQ ID NO: 367684 - DNA, 20 bp, Artificial Sequence
  chemically synthesized
gcaacccattttcatgtaaa

SEQ ID NO: 367685 - DNA, 20 bp, Artificial Sequence
  chemically synthesized
caacccattttcatgtaaat

SEQ ID NO: 367686 - DNA, 20 bp, Artificial Sequence
  chemically synthesized
cccattttcatgtaaatagg

SEQ ID NO: 367687 - DNA, 20 bp, Artificial Sequence
  chemically synthesized
atgtaaataggaagctttcc

SEQ ID NO: 367688 - DNA, 20 bp, Artificial Sequence
  chemically synthesized
aaaaaaaaaatcaactcgga

SEQ ID NO: 367689 - DNA, 20 bp, Artificial Sequence
  chemically synthesized
aaacaaaaaaaaaatcaact

SEQ ID NO: 367690 - DNA, 20 bp, Artificial Sequence
  chemically synthesized
ttttttgttttcttaaatat

SEQ ID NO: 367691 - DNA, 20 bp, Artificial Sequence
  chemically synthesized
accttttccaactcatattt

SEQ ID NO: 367692 - DNA, 20 bp, Artificial Sequence
  chemically synthesized
ttgttttcttaaatatgagt

SEQ ID NO: 367693 - DNA, 20 bp, Artificial Sequence
  chemically synthesized
ttcttaaatatgagttggaa

SEQ ID NO: 367694 - DNA, 20 bp, Artificial Sequence
  chemically synthesized
tcttaaatatgagttggaaa

SEQ ID NO: 367695 - DNA, 20 bp, Artificial Sequence
  chemically synthesized
ggaaaaggtattgtataata

SEQ ID NO: 367696 - DNA, 20 bp, Artificial Sequence
  chemically synthesized
aaaggtattgtataataaag

SEQ ID NO: 367697 - DNA, 20 bp, Artificial Sequence
  chemically synthesized
aataaagcagtattctgttg

SEQ ID NO: 367698 - DNA, 20 bp, Artificial Sequence
  chemically synthesized
ctatgtatattattccgcaa

SEQ ID NO: 367699 - DNA, 20 bp, Artificial Sequence
  chemically synthesized
ctgttgcggaataatataca

SEQ ID NO: 367700 - DNA, 20 bp, Artificial Sequence
  chemically synthesized
gttgcggaataatatacata

SEQ ID NO: 367701 - DNA, 20 bp, Artificial Sequence
  chemically synthesized
ttgcggaataatatacatag

SEQ ID NO: 367702 - DNA, 20 bp, Artificial Sequence
  chemically synthesized
ggaataatatacatagagga

SEQ ID NO: 367703 - DNA, 20 bp, Artificial Sequence
  chemically synthesized
tagaggaaagtacacgtctt

SEQ ID NO: 367704 - DNA, 20 bp, Artificial Sequence
  chemically synthesized
aagtacacgtcttaagtgta

SEQ ID NO: 367705 - DNA, 20 bp, Artificial Sequence
  chemically synthesized
attcattgagctgtacactt

SEQ ID NO: 367706 - DNA, 20 bp, Artificial Sequence
  chemically synthesized
tcggtttgtgacaattcatt

SEQ ID NO: 367707 - DNA, 20 bp, Artificial Sequence
  chemically synthesized
gctggtaatataaatatgtt

SEQ ID NO: 367708 - DNA, 20 bp, Artificial Sequence
  chemically synthesized
accgaacatatttatattac

SEQ ID NO: 367709 - DNA, 20 bp, Artificial Sequence
  chemically synthesized
atatttatattaccagcatc

SEQ ID NO: 367710 - DNA, 20 bp, Artificial Sequence
  chemically synthesized
tgtttcttaaatctcgatgc

SEQ ID NO: 367711 - DNA, 20 bp, Artificial Sequence
  chemically synthesized
tattaccagcatcgagattt

SEQ ID NO: 367712 - DNA, 20 bp, Artificial Sequence
  chemically synthesized
cagcatcgagatttaagaaa

SEQ ID NO: 367713 - DNA, 20 bp, Artificial Sequence
  chemically synthesized
acagaatatgatcaacaccc

SEQ ID NO: 367714 - DNA, 20 bp, Artificial Sequence
  chemically synthesized
gaatatgatcaacaccctag

SEQ ID NO: 367715 - DNA, 20 bp, Artificial Sequence
  chemically synthesized
ggggtgtgaggaagctgcta

SEQ ID NO: 367716 - DNA, 20 bp, Artificial Sequence
  chemically synthesized
gggggtgtgaggaagctgct

SEQ ID NO: 367717 - DNA, 20 bp, Artificial Sequence
  chemically synthesized
agggggtgtgaggaagctgc

SEQ ID NO: 367718 - DNA, 20 bp, Artificial Sequence
  chemically synthesized
tccacatagggggtgtgagg

SEQ ID NO: 367719 - DNA, 20 bp, Artificial Sequence
  chemically synthesized
gcttccacatagggggtgtg

SEQ ID NO: 367720 - DNA, 20 bp, Artificial Sequence
  chemically synthesized
agcttccacatagggggtgt

SEQ ID NO: 367721 - DNA, 20 bp, Artificial Sequence
  chemically synthesized
gcttcctcacaccccctatg

SEQ ID NO: 367722 - DNA, 20 bp, Artificial Sequence
  chemically synthesized
gaggggagcttccacatagg

SEQ ID NO: 367723 - DNA, 20 bp, Artificial Sequence
  chemically synthesized
tgaggggagcttccacatag

SEQ ID NO: 367724 - DNA, 20 bp, Artificial Sequence
  chemically synthesized
tcctcacaccccctatgtgg

SEQ ID NO: 367725 - DNA, 20 bp, Artificial Sequence
  chemically synthesized
ttgaggggagcttccacata

SEQ ID NO: 367726 - DNA, 20 bp, Artificial Sequence
  chemically synthesized
cttgaggggagcttccacat

SEQ ID NO: 367727 - DNA, 20 bp, Artificial Sequence
  chemically synthesized
tcttgaggggagcttccaca

SEQ ID NO: 367728 - DNA, 20 bp, Artificial Sequence
  chemically synthesized
cctatgtggaagctcccctc

SEQ ID NO: 367729 - DNA, 20 bp, Artificial Sequence
  chemically synthesized
atagtggccattcttgaggg

SEQ ID NO: 367730 - DNA, 20 bp, Artificial Sequence
  chemically synthesized
tcatagtggccattcttgag

SEQ ID NO: 367731 - DNA, 20 bp, Artificial Sequence
  chemically synthesized
gtggaagctcccctcaagaa

SEQ ID NO: 367732 - DNA, 20 bp, Artificial Sequence
  chemically synthesized
gtcatagtggccattcttga

SEQ ID NO: 367733 - DNA, 20 bp, Artificial Sequence
  chemically synthesized
cgtcatagtggccattcttg

SEQ ID NO: 367734 - DNA, 20 bp, Artificial Sequence
  chemically synthesized
tcgtcatagtggccattctt

SEQ ID NO: 367735 - DNA, 20 bp, Artificial Sequence
  chemically synthesized
gatgccacaagtcgtcatag

SEQ ID NO: 367736 - DNA, 20 bp, Artificial Sequence
  chemically synthesized
tatgatgccacaagtcgtca

SEQ ID NO: 367737 - DNA, 20 bp, Artificial Sequence
  chemically synthesized
atggccactatgacgacttg

SEQ ID NO: 367738 - DNA, 20 bp, Artificial Sequence
  chemically synthesized
aaactaacctatgatgccac

SEQ ID NO: 367739 - DNA, 20 bp, Artificial Sequence
  chemically synthesized
tatgacgacttgtggcatca

SEQ ID NO: 367740 - DNA, 20 bp, Artificial Sequence
  chemically synthesized
atgacgacttgtggcatcat

SEQ ID NO: 367741 - DNA, 20 bp, Artificial Sequence
  chemically synthesized
cgacttgtggcatcataggt

SEQ ID NO: 367742 - DNA, 20 bp, Artificial Sequence
  chemically synthesized
ataggttagttttctcttga

SEQ ID NO: 367743 - DNA, 20 bp, Artificial Sequence
  chemically synthesized
taggttagttttctcttgaa

SEQ ID NO: 367744 - DNA, 20 bp, Artificial Sequence
  chemically synthesized
ggttagttttctcttgaaag

SEQ ID NO: 367745 - DNA, 20 bp, Artificial Sequence
  chemically synthesized
ctttaggtgactcctttcaa

SEQ ID NO: 367746 - DNA, 20 bp, Artificial Sequence
  chemically synthesized
atctttaggtgactcctttc

SEQ ID NO: 367747 - DNA, 20 bp, Artificial Sequence
  chemically synthesized
ctcttgaaaggagtcaccta

SEQ ID NO: 367748 - DNA, 20 bp, Artificial Sequence
  chemically synthesized
tgaaaggagtcacctaaaga

SEQ ID NO: 367749 - DNA, 20 bp, Artificial Sequence
  chemically synthesized
accagcatttttctatcttt

SEQ ID NO: 367750 - DNA, 20 bp, Artificial Sequence
  chemically synthesized
aaccagcatttttctatctt

SEQ ID NO: 367751 - DNA, 20 bp, Artificial Sequence
  chemically synthesized
acctaaagatagaaaaatgc

SEQ ID NO: 367752 - DNA, 20 bp, Artificial Sequence
  chemically synthesized
tctaactcaaaatacaaaac

SEQ ID NO: 367753 - DNA, 20 bp, Artificial Sequence
  chemically synthesized
aaatgctggttttgtatttt

SEQ ID NO: 367754 - DNA, 20 bp, Artificial Sequence
  chemically synthesized
gctggttttgtattttgagt

SEQ ID NO: 367755 - DNA, 20 bp, Artificial Sequence
  chemically synthesized
tgtattttgagttagaatac

SEQ ID NO: 367756 - DNA, 20 bp, Artificial Sequence
  chemically synthesized
atctaatgtatttcagtcac

SEQ ID NO: 367757 - DNA, 20 bp, Artificial Sequence
  chemically synthesized
tgcataaatctaatgtattt

SEQ ID NO: 367758 - DNA, 20 bp, Artificial Sequence
  chemically synthesized
tactagtgactgaaatacat

SEQ ID NO: 367759 - DNA, 20 bp, Artificial Sequence
  chemically synthesized
tgaaatacattagatttatg

SEQ ID NO: 367760 - DNA, 20 bp, Artificial Sequence
  chemically synthesized
aaatacattagatttatgca

SEQ ID NO: 367761 - DNA, 20 bp, Artificial Sequence
  chemically synthesized
aatacattagatttatgcag

SEQ ID NO: 367762 - DNA, 20 bp, Artificial Sequence
  chemically synthesized
atacattagatttatgcaga

SEQ ID NO: 367763 - DNA, 20 bp, Artificial Sequence
  chemically synthesized
agatttatgcagagggaatt

SEQ ID NO: 367764 - DNA, 20 bp, Artificial Sequence
  chemically synthesized
tgcagagggaatttagaaaa

SEQ ID NO: 367765 - DNA, 20 bp, Artificial Sequence
  chemically synthesized
ttttccaaagcatattttat

SEQ ID NO: 367766 - DNA, 20 bp, Artificial Sequence
  chemically synthesized
cacactgataaaatatgctt

SEQ ID NO: 367767 - DNA, 20 bp, Artificial Sequence
  chemically synthesized
ccattcccccgtgttttcca

SEQ ID NO: 367768 - DNA, 20 bp, Artificial Sequence
  chemically synthesized
aaaatatgctttggaaaaca

SEQ ID NO: 367769 - DNA, 20 bp, Artificial Sequence
  chemically synthesized
aaatatgctttggaaaacac

SEQ ID NO: 367770 - DNA, 20 bp, Artificial Sequence
  chemically synthesized
aatatgctttggaaaacacg

SEQ ID NO: 367771 - DNA, 20 bp, Artificial Sequence
  chemically synthesized
atatgctttggaaaacacgg

SEQ ID NO: 367772 - DNA, 20 bp, Artificial Sequence
  chemically synthesized
ctttggaaaacacgggggaa

SEQ ID NO: 367773 - DNA, 20 bp, Artificial Sequence
  chemically synthesized
aatggtatgatgccatgaat

SEQ ID NO: 367774 - DNA, 20 bp, Artificial Sequence
  chemically synthesized
acagtcaacattcttattca

SEQ ID NO: 367775 - DNA, 20 bp, Artificial Sequence
  chemically synthesized
aagaatgttgactgtacacc

SEQ ID NO: 367776 - DNA, 20 bp, Artificial Sequence
  chemically synthesized
cccaaggcattctgggtgta

SEQ ID NO: 367777 - DNA, 20 bp, Artificial Sequence
  chemically synthesized
agttgaacccaaggcattct

SEQ ID NO: 367778 - DNA, 20 bp, Artificial Sequence
  chemically synthesized
gagttgaacccaaggcattc

SEQ ID NO: 367779 - DNA, 20 bp, Artificial Sequence
  chemically synthesized
actgtacacccagaatgcct

SEQ ID NO: 367780 - DNA, 20 bp, Artificial Sequence
  chemically synthesized
ctgtacacccagaatgcctt

SEQ ID NO: 367781 - DNA, 20 bp, Artificial Sequence
  chemically synthesized
agagctgggagttgaaccca

SEQ ID NO: 367782 - DNA, 20 bp, Artificial Sequence
  chemically synthesized
cagagctgggagttgaaccc

SEQ ID NO: 367783 - DNA, 20 bp, Artificial Sequence
  chemically synthesized
aatgccttgggttcaactcc

SEQ ID NO: 367784 - DNA, 20 bp, Artificial Sequence
  chemically synthesized
agatcacactgcagagctgg

SEQ ID NO: 367785 - DNA, 20 bp, Artificial Sequence
  chemically synthesized
gggttcaactcccagctctg

SEQ ID NO: 367786 - DNA, 20 bp, Artificial Sequence
  chemically synthesized
caagatcacactgcagagct

SEQ ID NO: 367787 - DNA, 20 bp, Artificial Sequence
  chemically synthesized
ccaagatcacactgcagagc

SEQ ID NO: 367788 - DNA, 20 bp, Artificial Sequence
  chemically synthesized
ttgcccaagatcacactgca

SEQ ID NO: 367789 - DNA, 20 bp, Artificial Sequence
  chemically synthesized
acttgcccaagatcacactg

SEQ ID NO: 367790 - DNA, 20 bp, Artificial Sequence
  chemically synthesized
ccagctctgcagtgtgatct

SEQ ID NO: 367791 - DNA, 20 bp, Artificial Sequence
  chemically synthesized
cagctctgcagtgtgatctt

SEQ ID NO: 367792 - DNA, 20 bp, Artificial Sequence
  chemically synthesized
tctgcagtgtgatcttgggc

SEQ ID NO: 367793 - DNA, 20 bp, Artificial Sequence
  chemically synthesized
cacggagaagttacttgccc

SEQ ID NO: 367794 - DNA, 20 bp, Artificial Sequence
  chemically synthesized
gaaaagagtaaggcacggag

SEQ ID NO: 367795 - DNA, 20 bp, Artificial Sequence
  chemically synthesized
gatgaaaagagtaaggcacg

SEQ ID NO: 367796 - DNA, 20 bp, Artificial Sequence
  chemically synthesized
tagatgaaaagagtaaggca

SEQ ID NO: 367797 - DNA, 20 bp, Artificial Sequence
  chemically synthesized
ttctatagatgaaaagagta

SEQ ID NO: 367798 - DNA, 20 bp, Artificial Sequence
  chemically synthesized
tttctatagatgaaaagagt

SEQ ID NO: 367799 - DNA, 20 bp, Artificial Sequence
  chemically synthesized
gctctttctatagatgaaaa

SEQ ID NO: 367800 - DNA, 20 bp, Artificial Sequence
  chemically synthesized
atgctctttctatagatgaa

SEQ ID NO: 367801 - DNA, 20 bp, Artificial Sequence
  chemically synthesized
tgccttactcttttcatcta

SEQ ID NO: 367802 - DNA, 20 bp, Artificial Sequence
  chemically synthesized
ttactcttttcatctataga

SEQ ID NO: 367803 - DNA, 20 bp, Artificial Sequence
  chemically synthesized
actcttttcatctatagaaa

SEQ ID NO: 367804 - DNA, 20 bp, Artificial Sequence
  chemically synthesized
aatgatacatgctctttcta

SEQ ID NO: 367805 - DNA, 20 bp, Artificial Sequence
  chemically synthesized
atgtatcattacctatgttg

SEQ ID NO: 367806 - DNA, 20 bp, Artificial Sequence
  chemically synthesized
ttgcaatatcaccacaacat

SEQ ID NO: 367807 - DNA, 20 bp, Artificial Sequence
  chemically synthesized
tttgcaatatcaccacaaca

SEQ ID NO: 367808 - DNA, 20 bp, Artificial Sequence
  chemically synthesized
tatgttgtggtgatattgca

SEQ ID NO: 367809 - DNA, 20 bp, Artificial Sequence
  chemically synthesized
tggtgatattgcaaagattt

SEQ ID NO: 367810 - DNA, 20 bp, Artificial Sequence
  chemically synthesized
tgcaaagatttaagtgaact

SEQ ID NO: 367811 - DNA, 20 bp, Artificial Sequence
  chemically synthesized
agatttaagtgaacttagta

SEQ ID NO: 367812 - DNA, 20 bp, Artificial Sequence
  chemically synthesized
atcttacaaagtgccatact

SEQ ID NO: 367813 - DNA, 20 bp, Artificial Sequence
  chemically synthesized
aacttagtatggcactttgt

SEQ ID NO: 367814 - DNA, 20 bp, Artificial Sequence
  chemically synthesized
cttacagaatatatcttaca

SEQ ID NO: 367815 - DNA, 20 bp, Artificial Sequence
  chemically synthesized
ctttgtaagatatattctgt

SEQ ID NO: 367816 - DNA, 20 bp, Artificial Sequence
  chemically synthesized
aagatatattctgtaagtgt

SEQ ID NO: 367817 - DNA, 20 bp, Artificial Sequence
  chemically synthesized
cgtgtgatagctaacactta

SEQ ID NO: 367818 - DNA, 20 bp, Artificial Sequence
  chemically synthesized
agtttggaataaacgtgtga

SEQ ID NO: 367819 - DNA, 20 bp, Artificial Sequence
  chemically synthesized
attatttggcttagaaagtt

SEQ ID NO: 367820 - DNA, 20 bp, Artificial Sequence
  chemically synthesized
acgtttattccaaactttct

SEQ ID NO: 367821 - DNA, 20 bp, Artificial Sequence
  chemically synthesized
tatggattatttggcttaga

SEQ ID NO: 367822 - DNA, 20 bp, Artificial Sequence
  chemically synthesized
acgatatggattatttggct

SEQ ID NO: 367823 - DNA, 20 bp, Artificial Sequence
  chemically synthesized
tatagacgatatggattatt

SEQ ID NO: 367824 - DNA, 20 bp, Artificial Sequence
  chemically synthesized
aaggaaagttatagacgata

SEQ ID NO: 367825 - DNA, 20 bp, Artificial Sequence
  chemically synthesized
caacattacaaggaaagtta

SEQ ID NO: 367826 - DNA, 20 bp, Artificial Sequence
  chemically synthesized
tgaggccaacattacaagga

SEQ ID NO: 367827 - DNA, 20 bp, Artificial Sequence
  chemically synthesized
actttgaggccaacattaca

SEQ ID NO: 367828 - DNA, 20 bp, Artificial Sequence
  chemically synthesized
tataactttccttgtaatgt

SEQ ID NO: 367829 - DNA, 20 bp, Artificial Sequence
  chemically synthesized
tactttgaggccaacattac

SEQ ID NO: 367830 - DNA, 20 bp, Artificial Sequence
  chemically synthesized
tccttgtaatgttggcctca

SEQ ID NO: 367831 - DNA, 20 bp, Artificial Sequence
  chemically synthesized
tggtcccttctgttactttg

SEQ ID NO: 367832 - DNA, 20 bp, Artificial Sequence
  chemically synthesized
taatgttggcctcaaagtaa

SEQ ID NO: 367833 - DNA, 20 bp, Artificial Sequence
  chemically synthesized
ttggtcccttctgttacttt

SEQ ID NO: 367834 - DNA, 20 bp, Artificial Sequence
  chemically synthesized
tgttggcctcaaagtaacag

SEQ ID NO: 367835 - DNA, 20 bp, Artificial Sequence
  chemically synthesized
gttggcctcaaagtaacaga

SEQ ID NO: 367836 - DNA, 20 bp, Artificial Sequence
  chemically synthesized
ttggcctcaaagtaacagaa

SEQ ID NO: 367837 - DNA, 20 bp, Artificial Sequence
  chemically synthesized
taattctcatattttgaagt

SEQ ID NO: 367838 - DNA, 20 bp, Artificial Sequence
  chemically synthesized
cttttaattctcatattttg

SEQ ID NO: 367839 - DNA, 20 bp, Artificial Sequence
  chemically synthesized
agggaccaacttcaaaatat

SEQ ID NO: 367840 - DNA, 20 bp, Artificial Sequence
  chemically synthesized
cttcaaaatatgagaattaa

SEQ ID NO: 367841 - DNA, 20 bp, Artificial Sequence
  chemically synthesized
ttcaaaatatgagaattaaa

SEQ ID NO: 367842 - DNA, 20 bp, Artificial Sequence
  chemically synthesized
tcaaaatatgagaattaaaa

SEQ ID NO: 367843 - DNA, 20 bp, Artificial Sequence
  chemically synthesized
ttaaaagggttaataaatgt

SEQ ID NO: 367844 - DNA, 20 bp, Artificial Sequence
  chemically synthesized
gttaataaatgtaagatgtc

SEQ ID NO: 367845 - DNA, 20 bp, Artificial Sequence
  chemically synthesized
taaatgtaagatgtctggta

SEQ ID NO: 367846 - DNA, 20 bp, Artificial Sequence
  chemically synthesized
ttctatgctaggtaccatac

SEQ ID NO: 367847 - DNA, 20 bp, Artificial Sequence
  chemically synthesized
aagatgtctggtatggtacc

SEQ ID NO: 367848 - DNA, 20 bp, Artificial Sequence
  chemically synthesized
gtctggtatggtacctagca

SEQ ID NO: 367849 - DNA, 20 bp, Artificial Sequence
  chemically synthesized
tattgagcattttctatgct

SEQ ID NO: 367850 - DNA, 20 bp, Artificial Sequence
  chemically synthesized
ttattgagcattttctatgc

SEQ ID NO: 367851 - DNA, 20 bp, Artificial Sequence
  chemically synthesized
atttatttaatgtttttatt

SEQ ID NO: 367852 - DNA, 20 bp, Artificial Sequence
  chemically synthesized
ggtgataacatttaacagga

SEQ ID NO: 367853 - DNA, 20 bp, Artificial Sequence
  chemically synthesized
aggtgataacatttaacagg

SEQ ID NO: 367854 - DNA, 20 bp, Artificial Sequence
  chemically synthesized
caggtgataacatttaacag

SEQ ID NO: 367855 - DNA, 20 bp, Artificial Sequence
  chemically synthesized
tccaggtgataacatttaac

SEQ ID NO: 367856 - DNA, 20 bp, Artificial Sequence
  chemically synthesized
ctccaggtgataacatttaa

SEQ ID NO: 367857 - DNA, 20 bp, Artificial Sequence
  chemically synthesized
tcctgttaaatgttatcacc

SEQ ID NO: 367858 - DNA, 20 bp, Artificial Sequence
  chemically synthesized
ctgttaaatgttatcacctg

SEQ ID NO: 367859 - DNA, 20 bp, Artificial Sequence
  chemically synthesized
tgttaaatgttatcacctgg

SEQ ID NO: 367860 - DNA, 20 bp, Artificial Sequence
  chemically synthesized
taaatgttatcacctggagg

SEQ ID NO: 367861 - DNA, 20 bp, Artificial Sequence
  chemically synthesized
aatgttatcacctggaggtg

SEQ ID NO: 367862 - DNA, 20 bp, Artificial Sequence
  chemically synthesized
gagtgtcattctccacctcc

SEQ ID NO: 367863 - DNA, 20 bp, Artificial Sequence
  chemically synthesized
agagtgtcattctccacctc

SEQ ID NO: 367864 - DNA, 20 bp, Artificial Sequence
  chemically synthesized
gccatataaatttcaaagga

SEQ ID NO: 367865 - DNA, 20 bp, Artificial Sequence
  chemically synthesized
tggccatataaatttcaaag

SEQ ID NO: 367866 - DNA, 20 bp, Artificial Sequence
  chemically synthesized
tatggccatataaatttcaa

SEQ ID NO: 367867 - DNA, 20 bp, Artificial Sequence
  chemically synthesized
ctatggccatataaatttca

SEQ ID NO: 367868 - DNA, 20 bp, Artificial Sequence
  chemically synthesized
actctcctttgaaatttata

SEQ ID NO: 367869 - DNA, 20 bp, Artificial Sequence
  chemically synthesized
ctttgaaatttatatggcca

SEQ ID NO: 367870 - DNA, 20 bp, Artificial Sequence
  chemically synthesized
tgaaatttatatggccatag

SEQ ID NO: 367871 - DNA, 20 bp, Artificial Sequence
  chemically synthesized
gaaatttatatggccatagc

SEQ ID NO: 367872 - DNA, 20 bp, Artificial Sequence
  chemically synthesized
agattaccaaagtcctgcta

SEQ ID NO: 367873 - DNA, 20 bp, Artificial Sequence
  chemically synthesized
atatggccatagcaggactt

SEQ ID NO: 367874 - DNA, 20 bp, Artificial Sequence
  chemically synthesized
aaactcttctcagattacca

SEQ ID NO: 367875 - DNA, 20 bp, Artificial Sequence
  chemically synthesized
tagcaggactttggtaatct

SEQ ID NO: 367876 - DNA, 20 bp, Artificial Sequence
  chemically synthesized
caggactttggtaatctgag

SEQ ID NO: 367877 - DNA, 20 bp, Artificial Sequence
  chemically synthesized
ggactttggtaatctgagaa

SEQ ID NO: 367878 - DNA, 20 bp, Artificial Sequence
  chemically synthesized
gtcccttattaaactcttct

SEQ ID NO: 367879 - DNA, 20 bp, Artificial Sequence
  chemically synthesized
taatctgagaagagtttaat

SEQ ID NO: 367880 - DNA, 20 bp, Artificial Sequence
  chemically synthesized
aatctgagaagagtttaata

SEQ ID NO: 367881 - DNA, 20 bp, Artificial Sequence
  chemically synthesized
atctgagaagagtttaataa

SEQ ID NO: 367882 - DNA, 20 bp, Artificial Sequence
  chemically synthesized
ccttccctcatttttataaa

SEQ ID NO: 367883 - DNA, 20 bp, Artificial Sequence
  chemically synthesized
aagggactgtttataaaaat

SEQ ID NO: 367884 - DNA, 20 bp, Artificial Sequence
  chemically synthesized
agggactgtttataaaaatg

SEQ ID NO: 367885 - DNA, 20 bp, Artificial Sequence
  chemically synthesized
gggactgtttataaaaatga

SEQ ID NO: 367886 - DNA, 20 bp, Artificial Sequence
  chemically synthesized
actgtttataaaaatgaggg

SEQ ID NO: 367887 - DNA, 20 bp, Artificial Sequence
  chemically synthesized
ctgtttataaaaatgaggga

SEQ ID NO: 367888 - DNA, 20 bp, Artificial Sequence
  chemically synthesized
ggaaggtataatgaaaccac

SEQ ID NO: 367889 - DNA, 20 bp, Artificial Sequence
  chemically synthesized
tataatgaaaccactggaac

SEQ ID NO: 367890 - DNA, 20 bp, Artificial Sequence
  chemically synthesized
ttctctattactagttccag

SEQ ID NO: 367891 - DNA, 20 bp, Artificial Sequence
  chemically synthesized
cacttctctattactagttc

SEQ ID NO: 367892 - DNA, 20 bp, Artificial Sequence
  chemically synthesized
gaaaccactggaactagtaa

SEQ ID NO: 367893 - DNA, 20 bp, Artificial Sequence
  chemically synthesized
aaccactggaactagtaata

SEQ ID NO: 367894 - DNA, 20 bp, Artificial Sequence
  chemically synthesized
tagtgacacttctctattac

SEQ ID NO: 367895 - DNA, 20 bp, Artificial Sequence
  chemically synthesized
cactggaactagtaatagag

SEQ ID NO: 367896 - DNA, 20 bp, Artificial Sequence
  chemically synthesized
agaagtgtcactactactct

SEQ ID NO: 367897 - DNA, 20 bp, Artificial Sequence
  chemically synthesized
tcttaggagtctaagagtag

SEQ ID NO: 367898 - DNA, 20 bp, Artificial Sequence
  chemically synthesized
cattcttaggagtctaagag

SEQ ID NO: 367899 - DNA, 20 bp, Artificial Sequence
  chemically synthesized
tttcattcttaggagtctaa

SEQ ID NO: 367900 - DNA, 20 bp, Artificial Sequence
  chemically synthesized
cttttcattcttaggagtct

SEQ ID NO: 367901 - DNA, 20 bp, Artificial Sequence
  chemically synthesized
actactactcttagactcct

SEQ ID NO: 367902 - DNA, 20 bp, Artificial Sequence
  chemically synthesized
ctccttcttttcattcttag

SEQ ID NO: 367903 - DNA, 20 bp, Artificial Sequence
  chemically synthesized
ctctccttcttttcattctt

SEQ ID NO: 367904 - DNA, 20 bp, Artificial Sequence
  chemically synthesized
actctccttcttttcattct

SEQ ID NO: 367905 - DNA, 20 bp, Artificial Sequence
  chemically synthesized
cttagactcctaagaatgaa

SEQ ID NO: 367906 - DNA, 20 bp, Artificial Sequence
  chemically synthesized
agactcctaagaatgaaaag

SEQ ID NO: 367907 - DNA, 20 bp, Artificial Sequence
  chemically synthesized
gactcctaagaatgaaaaga

SEQ ID NO: 367908 - DNA, 20 bp, Artificial Sequence
  chemically synthesized
ctcctaagaatgaaaagaag

SEQ ID NO: 367909 - DNA, 20 bp, Artificial Sequence
  chemically synthesized
cctaagaatgaaaagaagga

SEQ ID NO: 367910 - DNA, 20 bp, Artificial Sequence
  chemically synthesized
aagaatgaaaagaaggagag

SEQ ID NO: 367911 - DNA, 20 bp, Artificial Sequence
  chemically synthesized
aaaagaaggagagtggtttc

SEQ ID NO: 367912 - DNA, 20 bp, Artificial Sequence
  chemically synthesized
ttctctctctatgtagtaac

SEQ ID NO: 367913 - DNA, 20 bp, Artificial Sequence
  chemically synthesized
agtggtttctagttactaca

SEQ ID NO: 367914 - DNA, 20 bp, Artificial Sequence
  chemically synthesized
tggtttctagttactacata

SEQ ID NO: 367915 - DNA, 20 bp, Artificial Sequence
  chemically synthesized
gtttctagttactacataga

SEQ ID NO: 367916 - DNA, 20 bp, Artificial Sequence
  chemically synthesized
ttctcagttctctctctatg

SEQ ID NO: 367917 - DNA, 20 bp, Artificial Sequence
  chemically synthesized
ttctagttactacatagaga

SEQ ID NO: 367918 - DNA, 20 bp, Artificial Sequence
  chemically synthesized
tactacatagagagagaact

SEQ ID NO: 367919 - DNA, 20 bp, Artificial Sequence
  chemically synthesized
tacatagagagagaactgag

SEQ ID NO: 367920 - DNA, 20 bp, Artificial Sequence
  chemically synthesized
catagagagagaactgagaa

SEQ ID NO: 367921 - DNA, 20 bp, Artificial Sequence
  chemically synthesized
agagagagaactgagaagag

SEQ ID NO: 367922 - DNA, 20 bp, Artificial Sequence
  chemically synthesized
gtcagataatcttctcttct

SEQ ID NO: 367923 - DNA, 20 bp, Artificial Sequence
  chemically synthesized
gagaagagaagattatctga

SEQ ID NO: 367924 - DNA, 20 bp, Artificial Sequence
  chemically synthesized
agaagagaagattatctgac

SEQ ID NO: 367925 - DNA, 20 bp, Artificial Sequence
  chemically synthesized
aagagaagattatctgacag

SEQ ID NO: 367926 - DNA, 20 bp, Artificial Sequence
  chemically synthesized
cccaatatcaaagctcctgt

SEQ ID NO: 367927 - DNA, 20 bp, Artificial Sequence
  chemically synthesized
tctgacaggagctttgatat

SEQ ID NO: 367928 - DNA, 20 bp, Artificial Sequence
  chemically synthesized
ctgacaggagctttgatatt

SEQ ID NO: 367929 - DNA, 20 bp, Artificial Sequence
  chemically synthesized
aattccatcacccaatatca

SEQ ID NO: 367930 - DNA, 20 bp, Artificial Sequence
  chemically synthesized
ggagctttgatattgggtga

SEQ ID NO: 367931 - DNA, 20 bp, Artificial Sequence
  chemically synthesized
ggtaagagagggagagagga

SEQ ID NO: 367932 - DNA, 20 bp, Artificial Sequence
  chemically synthesized
ccttggtaagagagggagag

SEQ ID NO: 367933 - DNA, 20 bp, Artificial Sequence
  chemically synthesized
gccttggtaagagagggaga

SEQ ID NO: 367934 - DNA, 20 bp, Artificial Sequence
  chemically synthesized
gagccttggtaagagaggga

SEQ ID NO: 367935 - DNA, 20 bp, Artificial Sequence
  chemically synthesized
gagagccttggtaagagagg

SEQ ID NO: 367936 - DNA, 20 bp, Artificial Sequence
  chemically synthesized
atgagagccttggtaagaga

SEQ ID NO: 367937 - DNA, 20 bp, Artificial Sequence
  chemically synthesized
aatgagagccttggtaagag

SEQ ID NO: 367938 - DNA, 20 bp, Artificial Sequence
  chemically synthesized
tcctctctccctctcttacc

SEQ ID NO: 367939 - DNA, 20 bp, Artificial Sequence
  chemically synthesized
caatgagagccttggtaaga

SEQ ID NO: 367940 - DNA, 20 bp, Artificial Sequence
  chemically synthesized
cctctctccctctcttacca

SEQ ID NO: 367941 - DNA, 20 bp, Artificial Sequence
  chemically synthesized
gccaatgagagccttggtaa

SEQ ID NO: 367942 - DNA, 20 bp, Artificial Sequence
  chemically synthesized
tggccaatgagagccttggt

SEQ ID NO: 367943 - DNA, 20 bp, Artificial Sequence
  chemically synthesized
gatttggccaatgagagcct

SEQ ID NO: 367944 - DNA, 20 bp, Artificial Sequence
  chemically synthesized
tctcttaccaaggctctcat

SEQ ID NO: 367945 - DNA, 20 bp, Artificial Sequence
  chemically synthesized
tagttggatttggccaatga

SEQ ID NO: 367946 - DNA, 20 bp, Artificial Sequence
  chemically synthesized
actagttggatttggccaat

SEQ ID NO: 367947 - DNA, 20 bp, Artificial Sequence
  chemically synthesized
ctctggctactagttggatt

SEQ ID NO: 367948 - DNA, 20 bp, Artificial Sequence
  chemically synthesized
tctcattggccaaatccaac

SEQ ID NO: 367949 - DNA, 20 bp, Artificial Sequence
  chemically synthesized
cattggccaaatccaactag

SEQ ID NO: 367950 - DNA, 20 bp, Artificial Sequence
  chemically synthesized
tttgccctctggctactagt

SEQ ID NO: 367951 - DNA, 20 bp, Artificial Sequence
  chemically synthesized
ggccaaatccaactagtagc

SEQ ID NO: 367952 - DNA, 20 bp, Artificial Sequence
  chemically synthesized
ccaaatccaactagtagcca

SEQ ID NO: 367953 - DNA, 20 bp, Artificial Sequence
  chemically synthesized
ctcctttgccctctggctac

SEQ ID NO: 367954 - DNA, 20 bp, Artificial Sequence
  chemically synthesized
caaatccaactagtagccag

SEQ ID NO: 367955 - DNA, 20 bp, Artificial Sequence
  chemically synthesized
aaatccaactagtagccaga

SEQ ID NO: 367956 - DNA, 20 bp, Artificial Sequence
  chemically synthesized
caactagtagccagagggca

SEQ ID NO: 367957 - DNA, 20 bp, Artificial Sequence
  chemically synthesized
caacaggctcctttgccctc

SEQ ID NO: 367958 - DNA, 20 bp, Artificial Sequence
  chemically synthesized
aactagtagccagagggcaa

SEQ ID NO: 367959 - DNA, 20 bp, Artificial Sequence
  chemically synthesized
ctagtagccagagggcaaag

SEQ ID NO: 367960 - DNA, 20 bp, Artificial Sequence
  chemically synthesized
ggcaaaggagcctgttgatg

SEQ ID NO: 367961 - DNA, 20 bp, Artificial Sequence
  chemically synthesized
tgtctgtggactacatcaac

SEQ ID NO: 367962 - DNA, 20 bp, Artificial Sequence
  chemically synthesized
atgtctgtggactacatcaa

SEQ ID NO: 367963 - DNA, 20 bp, Artificial Sequence
  chemically synthesized
gagcctgttgatgtagtcca

SEQ ID NO: 367964 - DNA, 20 bp, Artificial Sequence
  chemically synthesized
ttgatgtagtccacagacat

SEQ ID NO: 367965 - DNA, 20 bp, Artificial Sequence
  chemically synthesized
ccttgggaggctgatgtctg

SEQ ID NO: 367966 - DNA, 20 bp, Artificial Sequence
  chemically synthesized
tccacagacatcagcctccc

SEQ ID NO: 367967 - DNA, 20 bp, Artificial Sequence
  chemically synthesized
ccacagacatcagcctccca

SEQ ID NO: 367968 - DNA, 20 bp, Artificial Sequence
  chemically synthesized
cagacatcagcctcccaagg

SEQ ID NO: 367969 - DNA, 20 bp, Artificial Sequence
  chemically synthesized
ccacttttgtcttccttggg

SEQ ID NO: 367970 - DNA, 20 bp, Artificial Sequence
  chemically synthesized
tccacttttgtcttccttgg

SEQ ID NO: 367971 - DNA, 20 bp, Artificial Sequence
  chemically synthesized
tctccacttttgtcttcctt

SEQ ID NO: 367972 - DNA, 20 bp, Artificial Sequence
  chemically synthesized
ctctccacttttgtcttcct

SEQ ID NO: 367973 - DNA, 20 bp, Artificial Sequence
  chemically synthesized
cagcctcccaaggaagacaa

SEQ ID NO: 367974 - DNA, 20 bp, Artificial Sequence
  chemically synthesized
cctcccaaggaagacaaaag

SEQ ID NO: 367975 - DNA, 20 bp, Artificial Sequence
  chemically synthesized
tcccaaggaagacaaaagtg

SEQ ID NO: 367976 - DNA, 20 bp, Artificial Sequence
  chemically synthesized
ccaaggaagacaaaagtgga

SEQ ID NO: 367977 - DNA, 20 bp, Artificial Sequence
  chemically synthesized
aggaagacaaaagtggagag

SEQ ID NO: 367978 - DNA, 20 bp, Artificial Sequence
  chemically synthesized
ggaagacaaaagtggagagt

SEQ ID NO: 367979 - DNA, 20 bp, Artificial Sequence
  chemically synthesized
gaagacaaaagtggagagta

SEQ ID NO: 367980 - DNA, 20 bp, Artificial Sequence
  chemically synthesized
aaaagtggagagtagggcca

SEQ ID NO: 367981 - DNA, 20 bp, Artificial Sequence
  chemically synthesized
gagagtagggccaaagaaat

SEQ ID NO: 367982 - DNA, 20 bp, Artificial Sequence
  chemically synthesized
atgtctttggcttatttctt

SEQ ID NO: 367983 - DNA, 20 bp, Artificial Sequence
  chemically synthesized
agggccaaagaaataagcca

SEQ ID NO: 367984 - DNA, 20 bp, Artificial Sequence
  chemically synthesized
tctagggtggtgaatgtctt

SEQ ID NO: 367985 - DNA, 20 bp, Artificial Sequence
  chemically synthesized
gccaaagacattcaccaccc

SEQ ID NO: 367986 - DNA, 20 bp, Artificial Sequence
  chemically synthesized
atttgcttccatgtctaggg

SEQ ID NO: 367987 - DNA, 20 bp, Artificial Sequence
  chemically synthesized
gacattcaccaccctagaca

SEQ ID NO: 367988 - DNA, 20 bp, Artificial Sequence
  chemically synthesized
gaaatttgcttccatgtcta

SEQ ID NO: 367989 - DNA, 20 bp, Artificial Sequence
  chemically synthesized
ggaaatttgcttccatgtct

SEQ ID NO: 367990 - DNA, 20 bp, Artificial Sequence
  chemically synthesized
attcaccaccctagacatgg

SEQ ID NO: 367991 - DNA, 20 bp, Artificial Sequence
  chemically synthesized
aggaaatttgcttccatgtc

SEQ ID NO: 367992 - DNA, 20 bp, Artificial Sequence
  chemically synthesized
catggaagcaaatttccttt

SEQ ID NO: 367993 - DNA, 20 bp, Artificial Sequence
  chemically synthesized
aagcaaatttcctttgagcc

SEQ ID NO: 367994 - DNA, 20 bp, Artificial Sequence
  chemically synthesized
cattgatctccttggctcaa

SEQ ID NO: 367995 - DNA, 20 bp, Artificial Sequence
  chemically synthesized
agcaaatttcctttgagcca

SEQ ID NO: 367996 - DNA, 20 bp, Artificial Sequence
  chemically synthesized
gcattgatctccttggctca

SEQ ID NO: 367997 - DNA, 20 bp, Artificial Sequence
  chemically synthesized
caaatttcctttgagccaag

SEQ ID NO: 367998 - DNA, 20 bp, Artificial Sequence
  chemically synthesized
atccctggcattgatctcct

SEQ ID NO: 367999 - DNA, 20 bp, Artificial Sequence
  chemically synthesized
tgagccaaggagatcaatgc

SEQ ID NO: 368000 - DNA, 20 bp, Artificial Sequence
  chemically synthesized
gagccaaggagatcaatgcc

SEQ ID NO: 368001 - DNA, 20 bp, Artificial Sequence
  chemically synthesized
agccaaggagatcaatgcca

SEQ ID NO: 368002 - DNA, 20 bp, Artificial Sequence
  chemically synthesized
ttttctgatatggacatccc

SEQ ID NO: 368003 - DNA, 20 bp, Artificial Sequence
  chemically synthesized
aatgccagggatgtccatat

SEQ ID NO: 368004 - DNA, 20 bp, Artificial Sequence
  chemically synthesized
ccttcatttattttctgata

SEQ ID NO: 368005 - DNA, 20 bp, Artificial Sequence
  chemically synthesized
tccatatcagaaaataaatg

SEQ ID NO: 368006 - DNA, 20 bp, Artificial Sequence
  chemically synthesized
ccatatcagaaaataaatga

SEQ ID NO: 368007 - DNA, 20 bp, Artificial Sequence
  chemically synthesized
aggcatgggaagtaacacgt

SEQ ID NO: 368008 - DNA, 20 bp, Artificial Sequence
  chemically synthesized
gaggcatgggaagtaacacg

SEQ ID NO: 368009 - DNA, 20 bp, Artificial Sequence
  chemically synthesized
atagaaatatgaggcatggg

SEQ ID NO: 368010 - DNA, 20 bp, Artificial Sequence
  chemically synthesized
gagatagaaatatgaggcat

SEQ ID NO: 368011 - DNA, 20 bp, Artificial Sequence
  chemically synthesized
agagatagaaatatgaggca

SEQ ID NO: 368012 - DNA, 20 bp, Artificial Sequence
  chemically synthesized
tcaccagagatagaaatatg

SEQ ID NO: 368013 - DNA, 20 bp, Artificial Sequence
  chemically synthesized
atcaccagagatagaaatat

SEQ ID NO: 368014 - DNA, 20 bp, Artificial Sequence
  chemically synthesized
atgcctcatatttctatctc

SEQ ID NO: 368015 - DNA, 20 bp, Artificial Sequence
  chemically synthesized
tacaatgacatcaccagaga

SEQ ID NO: 368016 - DNA, 20 bp, Artificial Sequence
  chemically synthesized
tccttacaatgacatcacca

SEQ ID NO: 368017 - DNA, 20 bp, Artificial Sequence
  chemically synthesized
attccttacaatgacatcac

SEQ ID NO: 368018 - DNA, 20 bp, Artificial Sequence
  chemically synthesized
atctctggtgatgtcattgt

SEQ ID NO: 368019 - DNA, 20 bp, Artificial Sequence
  chemically synthesized
tctctggtgatgtcattgta

SEQ ID NO: 368020 - DNA, 20 bp, Artificial Sequence
  chemically synthesized
taaggaatcatatgtatcac

SEQ ID NO: 368021 - DNA, 20 bp, Artificial Sequence
  chemically synthesized
taaagaagacgacggtgttc

SEQ ID NO: 368022 - DNA, 20 bp, Artificial Sequence
  chemically synthesized
atcactattaaagaagacga

SEQ ID NO: 368023 - DNA, 20 bp, Artificial Sequence
  chemically synthesized
aacaccgtcgtcttctttaa

SEQ ID NO: 368024 - DNA, 20 bp, Artificial Sequence
  chemically synthesized
ttttgatatcactattaaag

SEQ ID NO: 368025 - DNA, 20 bp, Artificial Sequence
  chemically synthesized
gtattttgatatcactatta

SEQ ID NO: 368026 - DNA, 20 bp, Artificial Sequence
  chemically synthesized
taatagtgatatcaaaatac

SEQ ID NO: 368027 - DNA, 20 bp, Artificial Sequence
  chemically synthesized
ctaaggtccacaaaacattc

SEQ ID NO: 368028 - DNA, 20 bp, Artificial Sequence
  chemically synthesized
caaaatactggaatgttttg

SEQ ID NO: 368029 - DNA, 20 bp, Artificial Sequence
  chemically synthesized
ctggaatgttttgtggacct

SEQ ID NO: 368030 - DNA, 20 bp, Artificial Sequence
  chemically synthesized
gaatgttttgtggaccttag

SEQ ID NO: 368031 - DNA, 20 bp, Artificial Sequence
  chemically synthesized
cctactgattttatctgcta

SEQ ID NO: 368032 - DNA, 20 bp, Artificial Sequence
  chemically synthesized
acctactgattttatctgct

SEQ ID NO: 368033 - DNA, 20 bp, Artificial Sequence
  chemically synthesized
tggaccttagcagataaaat

SEQ ID NO: 368034 - DNA, 20 bp, Artificial Sequence
  chemically synthesized
accttagcagataaaatcag

SEQ ID NO: 368035 - DNA, 20 bp, Artificial Sequence
  chemically synthesized
ccttagcagataaaatcagt

SEQ ID NO: 368036 - DNA, 20 bp, Artificial Sequence
  chemically synthesized
ggtatttattcattattcct

SEQ ID NO: 368037 - DNA, 20 bp, Artificial Sequence
  chemically synthesized
tctacaagtatttgacgcta

SEQ ID NO: 368038 - DNA, 20 bp, Artificial Sequence
  chemically synthesized
ctctacaagtatttgacgct

SEQ ID NO: 368039 - DNA, 20 bp, Artificial Sequence
  chemically synthesized
tccttagcgtcaaatacttg

SEQ ID NO: 368040 - DNA, 20 bp, Artificial Sequence
  chemically synthesized
cttagcgtcaaatacttgta

SEQ ID NO: 368041 - DNA, 20 bp, Artificial Sequence
  chemically synthesized
tggtagagagaagtctctac

SEQ ID NO: 368042 - DNA, 20 bp, Artificial Sequence
  chemically synthesized
gtgctttttttggtagagag

SEQ ID NO: 368043 - DNA, 20 bp, Artificial Sequence
  chemically synthesized
ttcgtgctttttttggtaga

SEQ ID NO: 368044 - DNA, 20 bp, Artificial Sequence
  chemically synthesized
ttttcgtgctttttttggta

SEQ ID NO: 368045 - DNA, 20 bp, Artificial Sequence
  chemically synthesized
agacttctctctaccaaaaa

SEQ ID NO: 368046 - DNA, 20 bp, Artificial Sequence
  chemically synthesized
gattttcgtgctttttttgg

SEQ ID NO: 368047 - DNA, 20 bp, Artificial Sequence
  chemically synthesized
ccagattttcgtgctttttt

SEQ ID NO: 368048 - DNA, 20 bp, Artificial Sequence
  chemically synthesized
ccaaaaaaagcacgaaaatc

SEQ ID NO: 368049 - DNA, 20 bp, Artificial Sequence
  chemically synthesized
agcacgaaaatctggctatg

SEQ ID NO: 368050 - DNA, 20 bp, Artificial Sequence
  chemically synthesized
ttcttgatgatcttcatagc

SEQ ID NO: 368051 - DNA, 20 bp, Artificial Sequence
  chemically synthesized
ctttttcttgatgatcttca

SEQ ID NO: 368052 - DNA, 20 bp, Artificial Sequence
  chemically synthesized
atctggctatgaagatcatc

SEQ ID NO: 368053 - DNA, 20 bp, Artificial Sequence
  chemically synthesized
ctatgaagatcatcaagaaa

SEQ ID NO: 368054 - DNA, 20 bp, Artificial Sequence
  chemically synthesized
aagatcatcaagaaaaagcc

SEQ ID NO: 368055 - DNA, 20 bp, Artificial Sequence
  chemically synthesized
gctagctgcaaggaataact

SEQ ID NO: 368056 - DNA, 20 bp, Artificial Sequence
  chemically synthesized
aaaagccaagttattccttg

SEQ ID NO: 368057 - DNA, 20 bp, Artificial Sequence
  chemically synthesized
gccaagttattccttgcagc

SEQ ID NO: 368058 - DNA, 20 bp, Artificial Sequence
  chemically synthesized
ttgaacacttgctagctgca

SEQ ID NO: 368059 - DNA, 20 bp, Artificial Sequence
  chemically synthesized
cttgaacacttgctagctgc

SEQ ID NO: 368060 - DNA, 20 bp, Artificial Sequence
  chemically synthesized
agttattccttgcagctagc

SEQ ID NO: 368061 - DNA, 20 bp, Artificial Sequence
  chemically synthesized
ctttgctcttgaacacttgc

SEQ ID NO: 368062 - DNA, 20 bp, Artificial Sequence
  chemically synthesized
cttgcagctagcaagtgttc

SEQ ID NO: 368063 - DNA, 20 bp, Artificial Sequence
  chemically synthesized
tgcagctagcaagtgttcaa

SEQ ID NO: 368064 - DNA, 20 bp, Artificial Sequence
  chemically synthesized
ctagcaagtgttcaagagca

SEQ ID NO: 368065 - DNA, 20 bp, Artificial Sequence
  chemically synthesized
ttataaaaacttgtattttg

SEQ ID NO: 368066 - DNA, 20 bp, Artificial Sequence
  chemically synthesized
agagcaaagctacaaaatac

SEQ ID NO: 368067 - DNA, 20 bp, Artificial Sequence
  chemically synthesized
acaagtttttataatctctc

SEQ ID NO: 368068 - DNA, 20 bp, Artificial Sequence
  chemically synthesized
aataacattttatatctgga

SEQ ID NO: 368069 - DNA, 20 bp, Artificial Sequence
  chemically synthesized
caaataacattttatatctg

SEQ ID NO: 368070 - DNA, 20 bp, Artificial Sequence
  chemically synthesized
gccaaataacattttatatc

SEQ ID NO: 368071 - DNA, 20 bp, Artificial Sequence
  chemically synthesized
tccagatataaaatgttatt

SEQ ID NO: 368072 - DNA, 20 bp, Artificial Sequence
  chemically synthesized
atgttatttggcattttata

SEQ ID NO: 368073 - DNA, 20 bp, Artificial Sequence
  chemically synthesized
attttataaagcatcttaac

SEQ ID NO: 368074 - DNA, 20 bp, Artificial Sequence
  chemically synthesized
atacatattgggttctagtt

SEQ ID NO: 368075 - DNA, 20 bp, Artificial Sequence
  chemically synthesized
gtaacatacatattgggttc

SEQ ID NO: 368076 - DNA, 20 bp, Artificial Sequence
  chemically synthesized
aatagagtaacatacatatt

SEQ ID NO: 368077 - DNA, 20 bp, Artificial Sequence
  chemically synthesized
taatagagtaacatacatat

SEQ ID NO: 368078 - DNA, 20 bp, Artificial Sequence
  chemically synthesized
aatatgtatgttactctatt

SEQ ID NO: 368079 - DNA, 20 bp, Artificial Sequence
  chemically synthesized
catttctagtgtacttaata

SEQ ID NO: 368080 - DNA, 20 bp, Artificial Sequence
  chemically synthesized
atcatttctagtgtacttaa

SEQ ID NO: 368081 - DNA, 20 bp, Artificial Sequence
  chemically synthesized
tgttactctattaagtacac

SEQ ID NO: 368082 - DNA, 20 bp, Artificial Sequence
  chemically synthesized
acatctgtttgaatcatttc

SEQ ID NO: 368083 - DNA, 20 bp, Artificial Sequence
  chemically synthesized
tacactagaaatgattcaaa

SEQ ID NO: 368084 - DNA, 20 bp, Artificial Sequence
  chemically synthesized
atgtgcattcgaactttaaa

SEQ ID NO: 368085 - DNA, 20 bp, Artificial Sequence
  chemically synthesized
tgtgcattcgaactttaaat

SEQ ID NO: 368086 - DNA, 20 bp, Artificial Sequence
  chemically synthesized
atggtgtggtttcctattta

SEQ ID NO: 368087 - DNA, 20 bp, Artificial Sequence
  chemically synthesized
gatttccattaacgatggtg

SEQ ID NO: 368088 - DNA, 20 bp, Artificial Sequence
  chemically synthesized
ggaaaccacaccatcgttaa

SEQ ID NO: 368089 - DNA, 20 bp, Artificial Sequence
  chemically synthesized
aacttgatttccattaacga

SEQ ID NO: 368090 - DNA, 20 bp, Artificial Sequence
  chemically synthesized
caccatcgttaatggaaatc

SEQ ID NO: 368091 - DNA, 20 bp, Artificial Sequence
  chemically synthesized
gaaatcaagttgttatatgt

SEQ ID NO: 368092 - DNA, 20 bp, Artificial Sequence
  chemically synthesized
atcaagttgttatatgtaag

SEQ ID NO: 368093 - DNA, 20 bp, Artificial Sequence
  chemically synthesized
tcaagttgttatatgtaagt

SEQ ID NO: 368094 - DNA, 20 bp, Artificial Sequence
  chemically synthesized
taagtgggatgttatgaacc

SEQ ID NO: 368095 - DNA, 20 bp, Artificial Sequence
  chemically synthesized
gtgggatgttatgaacccag

SEQ ID NO: 368096 - DNA, 20 bp, Artificial Sequence
  chemically synthesized
tttttgttaagcatacttct

SEQ ID NO: 368097 - DNA, 20 bp, Artificial Sequence
  chemically synthesized
ctttttgttaagcatacttc

SEQ ID NO: 368098 - DNA, 20 bp, Artificial Sequence
  chemically synthesized
ccagaagtatgcttaacaaa

SEQ ID NO: 368099 - DNA, 20 bp, Artificial Sequence
  chemically synthesized
aatcatgctgactttttgtt

SEQ ID NO: 368100 - DNA, 20 bp, Artificial Sequence
  chemically synthesized
aagtatgcttaacaaaaagt

SEQ ID NO: 368101 - DNA, 20 bp, Artificial Sequence
  chemically synthesized
agcatgattcattgtctgat

SEQ ID NO: 368102 - DNA, 20 bp, Artificial Sequence
  chemically synthesized
gcatgattcattgtctgatc

SEQ ID NO: 368103 - DNA, 20 bp, Artificial Sequence
  chemically synthesized
atgttaaggatagacctgat

SEQ ID NO: 368104 - DNA, 20 bp, Artificial Sequence
  chemically synthesized
attacaaaacatgttaagga

SEQ ID NO: 368105 - DNA, 20 bp, Artificial Sequence
  chemically synthesized
ttttattacaaaacatgtta

SEQ ID NO: 368106 - DNA, 20 bp, Artificial Sequence
  chemically synthesized
gttttattacaaaacatgtt

SEQ ID NO: 368107 - DNA, 20 bp, Artificial Sequence
  chemically synthesized
tgtaataaaactaacttcta

SEQ ID NO: 368108 - DNA, 20 bp, Artificial Sequence
  chemically synthesized
tgagacctagctttagaagt

SEQ ID NO: 368109 - DNA, 20 bp, Artificial Sequence
  chemically synthesized
ataaaactaacttctaaagc

SEQ ID NO: 368110 - DNA, 20 bp, Artificial Sequence
  chemically synthesized
caattgagacctagctttag

SEQ ID NO: 368111 - DNA, 20 bp, Artificial Sequence
  chemically synthesized
taaaactaacttctaaagct

SEQ ID NO: 368112 - DNA, 20 bp, Artificial Sequence
  chemically synthesized
aaacaattgagacctagctt

SEQ ID NO: 368113 - DNA, 20 bp, Artificial Sequence
  chemically synthesized
aagataaaacaattgagacc

SEQ ID NO: 368114 - DNA, 20 bp, Artificial Sequence
  chemically synthesized
aacttaaagataaaacaatt

SEQ ID NO: 368115 - DNA, 20 bp, Artificial Sequence
  chemically synthesized
gtctcaattgttttatcttt

SEQ ID NO: 368116 - DNA, 20 bp, Artificial Sequence
  chemically synthesized
caattgttttatctttaagt

SEQ ID NO: 368117 - DNA, 20 bp, Artificial Sequence
  chemically synthesized
aattgttttatctttaagtt

SEQ ID NO: 368118 - DNA, 20 bp, Artificial Sequence
  chemically synthesized
atgagtactgacctaactta

SEQ ID NO: 368119 - DNA, 20 bp, Artificial Sequence
  chemically synthesized
gttttatctttaagttaggt

SEQ ID NO: 368120 - DNA, 20 bp, Artificial Sequence
  chemically synthesized
gaatacctggtaaaatgaat

SEQ ID NO: 368121 - DNA, 20 bp, Artificial Sequence
  chemically synthesized
tcagtactcattcattttac

SEQ ID NO: 368122 - DNA, 20 bp, Artificial Sequence
  chemically synthesized
cagtactcattcattttacc

SEQ ID NO: 368123 - DNA, 20 bp, Artificial Sequence
  chemically synthesized
aatatttcctttagaatacc

SEQ ID NO: 368124 - DNA, 20 bp, Artificial Sequence
  chemically synthesized
tcattttaccaggtattcta

SEQ ID NO: 368125 - DNA, 20 bp, Artificial Sequence
  chemically synthesized
cattttaccaggtattctaa

SEQ ID NO: 368126 - DNA, 20 bp, Artificial Sequence
  chemically synthesized
aattttattaatatttcctt

SEQ ID NO: 368127 - DNA, 20 bp, Artificial Sequence
  chemically synthesized
aggaaatattaataaaatta

SEQ ID NO: 368128 - DNA, 20 bp, Artificial Sequence
  chemically synthesized
atacataaaaatataagata

SEQ ID NO: 368129 - DNA, 20 bp, Artificial Sequence
  chemically synthesized
acattaatacataaaaatat

SEQ ID NO: 368130 - DNA, 20 bp, Artificial Sequence
  chemically synthesized
atgtattaatgtaattcaca

SEQ ID NO: 368131 - DNA, 20 bp, Artificial Sequence
  chemically synthesized
caaagttattttaaaatttg

SEQ ID NO: 368132 - DNA, 20 bp, Artificial Sequence
  chemically synthesized
tggtgtaattagtataatca

SEQ ID NO: 368133 - DNA, 20 bp, Artificial Sequence
  chemically synthesized
atatttaaaggtggtgtaat

SEQ ID NO: 368134 - DNA, 20 bp, Artificial Sequence
  chemically synthesized
ttataggggatatttaaagg

SEQ ID NO: 368135 - DNA, 20 bp, Artificial Sequence
  chemically synthesized
attttataggggatatttaa

SEQ ID NO: 368136 - DNA, 20 bp, Artificial Sequence
  chemically synthesized
aattttataggggatattta

SEQ ID NO: 368137 - DNA, 20 bp, Artificial Sequence
  chemically synthesized
cagaatgttcaattttatag

SEQ ID NO: 368138 - DNA, 20 bp, Artificial Sequence
  chemically synthesized
tcagaatgttcaattttata

SEQ ID NO: 368139 - DNA, 20 bp, Artificial Sequence
  chemically synthesized
ttcagaatgttcaattttat

SEQ ID NO: 368140 - DNA, 20 bp, Artificial Sequence
  chemically synthesized
tttcagaatgttcaatttta

SEQ ID NO: 368141 - DNA, 20 bp, Artificial Sequence
  chemically synthesized
tataaaattgaacattctga

SEQ ID NO: 368142 - DNA, 20 bp, Artificial Sequence
  chemically synthesized
aaaaaactgggtttaacttt

SEQ ID NO: 368143 - DNA, 20 bp, Artificial Sequence
  chemically synthesized
aacattctgaaagttaaacc

SEQ ID NO: 368144 - DNA, 20 bp, Artificial Sequence
  chemically synthesized
ctcaacaacaacaaaaaact

SEQ ID NO: 368145 - DNA, 20 bp, Artificial Sequence
  chemically synthesized
tctcaacaacaacaaaaaac

SEQ ID NO: 368146 - DNA, 20 bp, Artificial Sequence
  chemically synthesized
cccagttttttgttgttgtt

SEQ ID NO: 368147 - DNA, 20 bp, Artificial Sequence
  chemically synthesized
acactccagccaaggtgaca

SEQ ID NO: 368148 - DNA, 20 bp, Artificial Sequence
  chemically synthesized
ttgttgagactctgtcacct

SEQ ID NO: 368149 - DNA, 20 bp, Artificial Sequence
  chemically synthesized
ctacactccagccaaggtga

SEQ ID NO: 368150 - DNA, 20 bp, Artificial Sequence
  chemically synthesized
tgagactctgtcaccttggc

SEQ ID NO: 368151 - DNA, 20 bp, Artificial Sequence
  chemically synthesized
agactctgtcaccttggctg

SEQ ID NO: 368152 - DNA, 20 bp, Artificial Sequence
  chemically synthesized
acgccactacactccagcca

SEQ ID NO: 368153 - DNA, 20 bp, Artificial Sequence
  chemically synthesized
cacgccactacactccagcc

SEQ ID NO: 368154 - DNA, 20 bp, Artificial Sequence
  chemically synthesized
ctgtcaccttggctggagtg

SEQ ID NO: 368155 - DNA, 20 bp, Artificial Sequence
  chemically synthesized
aagatcacgccactacactc

SEQ ID NO: 368156 - DNA, 20 bp, Artificial Sequence
  chemically synthesized
tcaccttggctggagtgtag

SEQ ID NO: 368157 - DNA, 20 bp, Artificial Sequence
  chemically synthesized
ggagtgtagtggcgtgatct

SEQ ID NO: 368158 - DNA, 20 bp, Artificial Sequence
  chemically synthesized
ggcggaggttgcagtgagcc

SEQ ID NO: 368159 - DNA, 20 bp, Artificial Sequence
  chemically synthesized
tgggaggcggaggttgcagt

SEQ ID NO: 368160 - DNA, 20 bp, Artificial Sequence
  chemically synthesized
aacctgggaggcggaggttg

SEQ ID NO: 368161 - DNA, 20 bp, Artificial Sequence
  chemically synthesized
cgcttgaacctgggaggcgg

SEQ ID NO: 368162 - DNA, 20 bp, Artificial Sequence
  chemically synthesized
tcactgcaacctccgcctcc

SEQ ID NO: 368163 - DNA, 20 bp, Artificial Sequence
  chemically synthesized
tcgcttgaacctgggaggcg

SEQ ID NO: 368164 - DNA, 20 bp, Artificial Sequence
  chemically synthesized
cactgcaacctccgcctccc

SEQ ID NO: 368165 - DNA, 20 bp, Artificial Sequence
  chemically synthesized
aatcgcttgaacctgggagg

SEQ ID NO: 368166 - DNA, 20 bp, Artificial Sequence
  chemically synthesized
gagaatcgcttgaacctggg

SEQ ID NO: 368167 - DNA, 20 bp, Artificial Sequence
  chemically synthesized
ggagaatcgcttgaacctgg

SEQ ID NO: 368168 - DNA, 20 bp, Artificial Sequence
  chemically synthesized
aacctccgcctcccaggttc

SEQ ID NO: 368169 - DNA, 20 bp, Artificial Sequence
  chemically synthesized
caggagaatcgcttgaacct

SEQ ID NO: 368170 - DNA, 20 bp, Artificial Sequence
  chemically synthesized
gcaggagaatcgcttgaacc

SEQ ID NO: 368171 - DNA, 20 bp, Artificial Sequence
  chemically synthesized
tactagggacgcggaggcag

SEQ ID NO: 368172 - DNA, 20 bp, Artificial Sequence
  chemically synthesized
gctactagggacgcggaggc

SEQ ID NO: 368173 - DNA, 20 bp, Artificial Sequence
  chemically synthesized
agctactagggacgcggagg

SEQ ID NO: 368174 - DNA, 20 bp, Artificial Sequence
  chemically synthesized
cccagctactagggacgcgg

SEQ ID NO: 368175 - DNA, 20 bp, Artificial Sequence
  chemically synthesized
tcccagctactagggacgcg

SEQ ID NO: 368176 - DNA, 20 bp, Artificial Sequence
  chemically synthesized
ttctcctgcctccgcgtccc

SEQ ID NO: 368177 - DNA, 20 bp, Artificial Sequence
  chemically synthesized
aatcccagctactagggacg

SEQ ID NO: 368178 - DNA, 20 bp, Artificial Sequence
  chemically synthesized
tcctgcctccgcgtccctag

SEQ ID NO: 368179 - DNA, 20 bp, Artificial Sequence
  chemically synthesized
gcctccgcgtccctagtagc

SEQ ID NO: 368180 - DNA, 20 bp, Artificial Sequence
  chemically synthesized
gcctgtaatcccagctacta

SEQ ID NO: 368181 - DNA, 20 bp, Artificial Sequence
  chemically synthesized
cctccgcgtccctagtagct

SEQ ID NO: 368182 - DNA, 20 bp, Artificial Sequence
  chemically synthesized
cgcctgtaatcccagctact

SEQ ID NO: 368183 - DNA, 20 bp, Artificial Sequence
  chemically synthesized
gcgcctgtaatcccagctac

SEQ ID NO: 368184 - DNA, 20 bp, Artificial Sequence
  chemically synthesized
gtccctagtagctgggatta

SEQ ID NO: 368185 - DNA, 20 bp, Artificial Sequence
  chemically synthesized
tccctagtagctgggattac

SEQ ID NO: 368186 - DNA, 20 bp, Artificial Sequence
  chemically synthesized
gtggctcgcgcctgtaatcc

SEQ ID NO: 368187 - DNA, 20 bp, Artificial Sequence
  chemically synthesized
gtagctgggattacaggcgc

SEQ ID NO: 368188 - DNA, 20 bp, Artificial Sequence
  chemically synthesized
caggcgcgagccactacgct

SEQ ID NO: 368189 - DNA, 20 bp, Artificial Sequence
  chemically synthesized
aaaaaattagccaagcgtag

SEQ ID NO: 368190 - DNA, 20 bp, Artificial Sequence
  chemically synthesized
ataaaaaaattagccaagcg

SEQ ID NO: 368191 - DNA, 20 bp, Artificial Sequence
  chemically synthesized
aaaatataaaaaaattagcc

SEQ ID NO: 368192 - DNA, 20 bp, Artificial Sequence
  chemically synthesized
tactaaaaatataaaaaaat

SEQ ID NO: 368193 - DNA, 20 bp, Artificial Sequence
  chemically synthesized
ggctaatttttttatatttt

SEQ ID NO: 368194 - DNA, 20 bp, Artificial Sequence
  chemically synthesized
taatttttttatatttttag

SEQ ID NO: 368195 - DNA, 20 bp, Artificial Sequence
  chemically synthesized
atttttttatatttttagta

SEQ ID NO: 368196 - DNA, 20 bp, Artificial Sequence
  chemically synthesized
ttttatatttttagtagaga

SEQ ID NO: 368197 - DNA, 20 bp, Artificial Sequence
  chemically synthesized
tttatatttttagtagagac

SEQ ID NO: 368198 - DNA, 20 bp, Artificial Sequence
  chemically synthesized
ttatatttttagtagagacg

SEQ ID NO: 368199 - DNA, 20 bp, Artificial Sequence
  chemically synthesized
gagacggggtttcaccttgt

SEQ ID NO: 368200 - DNA, 20 bp, Artificial Sequence
  chemically synthesized
cggggtttcaccttgttagc

SEQ ID NO: 368201 - DNA, 20 bp, Artificial Sequence
  chemically synthesized
cgagaccagcctggctaaca

SEQ ID NO: 368202 - DNA, 20 bp, Artificial Sequence
  chemically synthesized
ggggtttcaccttgttagcc

SEQ ID NO: 368203 - DNA, 20 bp, Artificial Sequence
  chemically synthesized
tcgagaccagcctggctaac

SEQ ID NO: 368204 - DNA, 20 bp, Artificial Sequence
  chemically synthesized
tttcaccttgttagccaggc

SEQ ID NO: 368205 - DNA, 20 bp, Artificial Sequence
  chemically synthesized
tcaggaggtcgagaccagcc

SEQ ID NO: 368206 - DNA, 20 bp, Artificial Sequence
  chemically synthesized
cgaggtcaggaggtcgagac

SEQ ID NO: 368207 - DNA, 20 bp, Artificial Sequence
  chemically synthesized
gatcacgaggtcaggaggtc

SEQ ID NO: 368208 - DNA, 20 bp, Artificial Sequence
  chemically synthesized
aggtggatcacgaggtcagg

SEQ ID NO: 368209 - DNA, 20 bp, Artificial Sequence
  chemically synthesized
caggtggatcacgaggtcag

SEQ ID NO: 368210 - DNA, 20 bp, Artificial Sequence
  chemically synthesized
ggcaggtggatcacgaggtc

SEQ ID NO: 368211 - DNA, 20 bp, Artificial Sequence
  chemically synthesized
aggcaggtggatcacgaggt

SEQ ID NO: 368212 - DNA, 20 bp, Artificial Sequence
  chemically synthesized
gctgaggcaggtggatcacg

SEQ ID NO: 368213 - DNA, 20 bp, Artificial Sequence
  chemically synthesized
ggctgaggcaggtggatcac

SEQ ID NO: 368214 - DNA, 20 bp, Artificial Sequence
  chemically synthesized
acctcgtgatccacctgcct

SEQ ID NO: 368215 - DNA, 20 bp, Artificial Sequence
  chemically synthesized
ctttgggaggctgaggcagg

SEQ ID NO: 368216 - DNA, 20 bp, Artificial Sequence
  chemically synthesized
gcactttgggaggctgaggc

SEQ ID NO: 368217 - DNA, 20 bp, Artificial Sequence
  chemically synthesized
agcactttgggaggctgagg

SEQ ID NO: 368218 - DNA, 20 bp, Artificial Sequence
  chemically synthesized
ctcagcactttgggaggctg

SEQ ID NO: 368219 - DNA, 20 bp, Artificial Sequence
  chemically synthesized
tctcagcactttgggaggct

SEQ ID NO: 368220 - DNA, 20 bp, Artificial Sequence
  chemically synthesized
ccacctgcctcagcctccca

SEQ ID NO: 368221 - DNA, 20 bp, Artificial Sequence
  chemically synthesized
gtaaatctcagcactttggg

SEQ ID NO: 368222 - DNA, 20 bp, Artificial Sequence
  chemically synthesized
tgtaaatctcagcactttgg

SEQ ID NO: 368223 - DNA, 20 bp, Artificial Sequence
  chemically synthesized
cctgtaaatctcagcacttt

SEQ ID NO: 368224 - DNA, 20 bp, Artificial Sequence
  chemically synthesized
cctcagcctcccaaagtgct

SEQ ID NO: 368225 - DNA, 20 bp, Artificial Sequence
  chemically synthesized
gcctgtaaatctcagcactt

SEQ ID NO: 368226 - DNA, 20 bp, Artificial Sequence
  chemically synthesized
tcccaaagtgctgagattta

SEQ ID NO: 368227 - DNA, 20 bp, Artificial Sequence
  chemically synthesized
tggctcatgcctgtaaatct

SEQ ID NO: 368228 - DNA, 20 bp, Artificial Sequence
  chemically synthesized
cccaaagtgctgagatttac

SEQ ID NO: 368229 - DNA, 20 bp, Artificial Sequence
  chemically synthesized
gtgctgagatttacaggcat

SEQ ID NO: 368230 - DNA, 20 bp, Artificial Sequence
  chemically synthesized
acaggcatgagccactgcac

SEQ ID NO: 368231 - DNA, 20 bp, Artificial Sequence
  chemically synthesized
caggcatgagccactgcacc

SEQ ID NO: 368232 - DNA, 20 bp, Artificial Sequence
  chemically synthesized
tggatttaggcctggtgcag

SEQ ID NO: 368233 - DNA, 20 bp, Artificial Sequence
  chemically synthesized
aactggatttaggcctggtg

SEQ ID NO: 368234 - DNA, 20 bp, Artificial Sequence
  chemically synthesized
agaaaaactggatttaggcc

SEQ ID NO: 368235 - DNA, 20 bp, Artificial Sequence
  chemically synthesized
cactgcaccaggcctaaatc

SEQ ID NO: 368236 - DNA, 20 bp, Artificial Sequence
  chemically synthesized
tcaaaagaaaaactggattt

SEQ ID NO: 368237 - DNA, 20 bp, Artificial Sequence
  chemically synthesized
atcaaaagaaaaactggatt

SEQ ID NO: 368238 - DNA, 20 bp, Artificial Sequence
  chemically synthesized
atgtgaatcaaaagaaaaac

SEQ ID NO: 368239 - DNA, 20 bp, Artificial Sequence
  chemically synthesized
catgtatctatgtgaatcaa

SEQ ID NO: 368240 - DNA, 20 bp, Artificial Sequence
  chemically synthesized
agtttttcttttgattcaca

SEQ ID NO: 368241 - DNA, 20 bp, Artificial Sequence
  chemically synthesized
tagatacatgatttgcattt

SEQ ID NO: 368242 - DNA, 20 bp, Artificial Sequence
  chemically synthesized
tacatgatttgcatttgaga

SEQ ID NO: 368243 - DNA, 20 bp, Artificial Sequence
  chemically synthesized
tgatttgcatttgagatagc

SEQ ID NO: 368244 - DNA, 20 bp, Artificial Sequence
  chemically synthesized
gcatttgagatagccagtga

SEQ ID NO: 368245 - DNA, 20 bp, Artificial Sequence
  chemically synthesized
ttagccttcatttccatcac

SEQ ID NO: 368246 - DNA, 20 bp, Artificial Sequence
  chemically synthesized
gatagccagtgatggaaatg

SEQ ID NO: 368247 - DNA, 20 bp, Artificial Sequence
  chemically synthesized
atagccagtgatggaaatga

SEQ ID NO: 368248 - DNA, 20 bp, Artificial Sequence
  chemically synthesized
ccattgggatagattgtaat

SEQ ID NO: 368249 - DNA, 20 bp, Artificial Sequence
  chemically synthesized
ctaattacaatctatcccaa

SEQ ID NO: 368250 - DNA, 20 bp, Artificial Sequence
  chemically synthesized
cagaaaagcaaccattggga

SEQ ID NO: 368251 - DNA, 20 bp, Artificial Sequence
  chemically synthesized
ctgtcagaaaagcaaccatt

SEQ ID NO: 368252 - DNA, 20 bp, Artificial Sequence
  chemically synthesized
tctgtcagaaaagcaaccat

SEQ ID NO: 368253 - DNA, 20 bp, Artificial Sequence
  chemically synthesized
cccaatggttgcttttctga

SEQ ID NO: 368254 - DNA, 20 bp, Artificial Sequence
  chemically synthesized
ccataccgtttctgtcagaa

SEQ ID NO: 368255 - DNA, 20 bp, Artificial Sequence
  chemically synthesized
ggttgcttttctgacagaaa

SEQ ID NO: 368256 - DNA, 20 bp, Artificial Sequence
  chemically synthesized
ttgtaccataccgtttctgt

SEQ ID NO: 368257 - DNA, 20 bp, Artificial Sequence
  chemically synthesized
cttttctgacagaaacggta

SEQ ID NO: 368258 - DNA, 20 bp, Artificial Sequence
  chemically synthesized
tgacagaaacggtatggtac

SEQ ID NO: 368259 - DNA, 20 bp, Artificial Sequence
  chemically synthesized
gacagaaacggtatggtaca

SEQ ID NO: 368260 - DNA, 20 bp, Artificial Sequence
  chemically synthesized
gaaacggtatggtacaaggt

SEQ ID NO: 368261 - DNA, 20 bp, Artificial Sequence
  chemically synthesized
cggtatggtacaaggttggc

SEQ ID NO: 368262 - DNA, 20 bp, Artificial Sequence
  chemically synthesized
ggtacaaggttggcaagatg

SEQ ID NO: 368263 - DNA, 20 bp, Artificial Sequence
  chemically synthesized
agatgaagcactttgtttca

SEQ ID NO: 368264 - DNA, 20 bp, Artificial Sequence
  chemically synthesized
tatttgcatgctttgaaaca

SEQ ID NO: 368265 - DNA, 20 bp, Artificial Sequence
  chemically synthesized
agatttcttttttgaagaat

SEQ ID NO: 368266 - DNA, 20 bp, Artificial Sequence
  chemically synthesized
ataacactgattcttcaaaa

SEQ ID NO: 368267 - DNA, 20 bp, Artificial Sequence
  chemically synthesized
gcctatagatttcttttttg

SEQ ID NO: 368268 - DNA, 20 bp, Artificial Sequence
  chemically synthesized
ttcttcaaaaaagaaatcta

SEQ ID NO: 368269 - DNA, 20 bp, Artificial Sequence
  chemically synthesized
tcttcaaaaaagaaatctat

SEQ ID NO: 368270 - DNA, 20 bp, Artificial Sequence
  chemically synthesized
caaaaaagaaatctataggc

SEQ ID NO: 368271 - DNA, 20 bp, Artificial Sequence
  chemically synthesized
aaaaaagaaatctataggct

SEQ ID NO: 368272 - DNA, 20 bp, Artificial Sequence
  chemically synthesized
gagccactgcgcctagccta

SEQ ID NO: 368273 - DNA, 20 bp, Artificial Sequence
  chemically synthesized
agaaatctataggctaggcg

SEQ ID NO: 368274 - DNA, 20 bp, Artificial Sequence
  chemically synthesized
aatctataggctaggcgcag

SEQ ID NO: 368275 - DNA, 20 bp, Artificial Sequence
  chemically synthesized
caggcatgagccactgcgcc

SEQ ID NO: 368276 - DNA, 20 bp, Artificial Sequence
  chemically synthesized
agtactggggttacaggcat

SEQ ID NO: 368277 - DNA, 20 bp, Artificial Sequence
  chemically synthesized
gtggctcatgcctgtaaccc

SEQ ID NO: 368278 - DNA, 20 bp, Artificial Sequence
  chemically synthesized
tcccaaagtactggggttac

SEQ ID NO: 368279 - DNA, 20 bp, Artificial Sequence
  chemically synthesized
ctcccaaagtactggggtta

SEQ ID NO: 368280 - DNA, 20 bp, Artificial Sequence
  chemically synthesized
ctcggcctcccaaagtactg

SEQ ID NO: 368281 - DNA, 20 bp, Artificial Sequence
  chemically synthesized
tgcctgtaaccccagtactt

SEQ ID NO: 368282 - DNA, 20 bp, Artificial Sequence
  chemically synthesized
tctcggcctcccaaagtact

SEQ ID NO: 368283 - DNA, 20 bp, Artificial Sequence
  chemically synthesized
gcctgtaaccccagtacttt

SEQ ID NO: 368284 - DNA, 20 bp, Artificial Sequence
  chemically synthesized
ttctcggcctcccaaagtac

SEQ ID NO: 368285 - DNA, 20 bp, Artificial Sequence
  chemically synthesized
ctgtaaccccagtactttgg

SEQ ID NO: 368286 - DNA, 20 bp, Artificial Sequence
  chemically synthesized
tgtaaccccagtactttggg

SEQ ID NO: 368287 - DNA, 20 bp, Artificial Sequence
  chemically synthesized
ctgcccttctcggcctccca

SEQ ID NO: 368288 - DNA, 20 bp, Artificial Sequence
  chemically synthesized
ccccagtactttgggaggcc

SEQ ID NO: 368289 - DNA, 20 bp, Artificial Sequence
  chemically synthesized
cagtactttgggaggccgag

SEQ ID NO: 368290 - DNA, 20 bp, Artificial Sequence
  chemically synthesized
agtactttgggaggccgaga

SEQ ID NO: 368291 - DNA, 20 bp, Artificial Sequence
  chemically synthesized
gtactttgggaggccgagaa

SEQ ID NO: 368292 - DNA, 20 bp, Artificial Sequence
  chemically synthesized
ctttgggaggccgagaaggg

SEQ ID NO: 368293 - DNA, 20 bp, Artificial Sequence
  chemically synthesized
ttcaagtgatctgcccttct

SEQ ID NO: 368294 - DNA, 20 bp, Artificial Sequence
  chemically synthesized
cgagaagggcagatcacttg

SEQ ID NO: 368295 - DNA, 20 bp, Artificial Sequence
  chemically synthesized
aagggcagatcacttgaagc

SEQ ID NO: 368296 - DNA, 20 bp, Artificial Sequence
  chemically synthesized
agggcagatcacttgaagcc

SEQ ID NO: 368297 - DNA, 20 bp, Artificial Sequence
  chemically synthesized
ggtctcaaactcctggcttc

SEQ ID NO: 368298 - DNA, 20 bp, Artificial Sequence
  chemically synthesized
ggcagatcacttgaagccag

SEQ ID NO: 368299 - DNA, 20 bp, Artificial Sequence
  chemically synthesized
tcacttgaagccaggagttt

SEQ ID NO: 368300 - DNA, 20 bp, Artificial Sequence
  chemically synthesized
ccaggctggtctcaaactcc

SEQ ID NO: 368301 - DNA, 20 bp, Artificial Sequence
  chemically synthesized
tgaagccaggagtttgagac

SEQ ID NO: 368302 - DNA, 20 bp, Artificial Sequence
  chemically synthesized
ccaggagtttgagaccagcc

SEQ ID NO: 368303 - DNA, 20 bp, Artificial Sequence
  chemically synthesized
tttcgccacgttggccaggc

SEQ ID NO: 368304 - DNA, 20 bp, Artificial Sequence
  chemically synthesized
ggagtttcgccacgttggcc

SEQ ID NO: 368305 - DNA, 20 bp, Artificial Sequence
  chemically synthesized
tgagaccagcctggccaacg

SEQ ID NO: 368306 - DNA, 20 bp, Artificial Sequence
  chemically synthesized
tggagtttcgccacgttggc

SEQ ID NO: 368307 - DNA, 20 bp, Artificial Sequence
  chemically synthesized
aaggtggagtttcgccacgt

SEQ ID NO: 368308 - DNA, 20 bp, Artificial Sequence
  chemically synthesized
ttgtatttttagtaaaggtg

SEQ ID NO: 368309 - DNA, 20 bp, Artificial Sequence
  chemically synthesized
ttttgtatttttagtaaagg

SEQ ID NO: 368310 - DNA, 20 bp, Artificial Sequence
  chemically synthesized
aacttttgtatttttagtaa

SEQ ID NO: 368311 - DNA, 20 bp, Artificial Sequence
  chemically synthesized
taacttttgtatttttagta

SEQ ID NO: 368312 - DNA, 20 bp, Artificial Sequence
  chemically synthesized
ccagctaacttttgtatttt

SEQ ID NO: 368313 - DNA, 20 bp, Artificial Sequence
  chemically synthesized
cacctttactaaaaatacaa

SEQ ID NO: 368314 - DNA, 20 bp, Artificial Sequence
  chemically synthesized
tttactaaaaatacaaaagt

SEQ ID NO: 368315 - DNA, 20 bp, Artificial Sequence
  chemically synthesized
ctaaaaatacaaaagttagc

SEQ ID NO: 368316 - DNA, 20 bp, Artificial Sequence
  chemically synthesized
taaaaatacaaaagttagct

SEQ ID NO: 368317 - DNA, 20 bp, Artificial Sequence
  chemically synthesized
atacaaaagttagctgggca

SEQ ID NO: 368318 - DNA, 20 bp, Artificial Sequence
  chemically synthesized
caaaagttagctgggcatgg

SEQ ID NO: 368319 - DNA, 20 bp, Artificial Sequence
  chemically synthesized
caggcgcgtgccaccatgcc

SEQ ID NO: 368320 - DNA, 20 bp, Artificial Sequence
  chemically synthesized
ggcatggtggcacgcgcctg

SEQ ID NO: 368321 - DNA, 20 bp, Artificial Sequence
  chemically synthesized
gtggcacgcgcctgaagtcc

SEQ ID NO: 368322 - DNA, 20 bp, Artificial Sequence
  chemically synthesized
tcccaagtagctgggacttc

SEQ ID NO: 368323 - DNA, 20 bp, Artificial Sequence
  chemically synthesized
ctcccaagtagctgggactt

SEQ ID NO: 368324 - DNA, 20 bp, Artificial Sequence
  chemically synthesized
cgcctgaagtcccagctact

SEQ ID NO: 368325 - DNA, 20 bp, Artificial Sequence
  chemically synthesized
ccttagcctcccaagtagct

SEQ ID NO: 368326 - DNA, 20 bp, Artificial Sequence
  chemically synthesized
gcctgaagtcccagctactt

SEQ ID NO: 368327 - DNA, 20 bp, Artificial Sequence
  chemically synthesized
accttagcctcccaagtagc

SEQ ID NO: 368328 - DNA, 20 bp, Artificial Sequence
  chemically synthesized
ctgaagtcccagctacttgg

SEQ ID NO: 368329 - DNA, 20 bp, Artificial Sequence
  chemically synthesized
tgaagtcccagctacttggg

SEQ ID NO: 368330 - DNA, 20 bp, Artificial Sequence
  chemically synthesized
tcccaccttagcctcccaag

SEQ ID NO: 368331 - DNA, 20 bp, Artificial Sequence
  chemically synthesized
ctctcccaccttagcctccc

SEQ ID NO: 368332 - DNA, 20 bp, Artificial Sequence
  chemically synthesized
tcccagctacttgggaggct

SEQ ID NO: 368333 - DNA, 20 bp, Artificial Sequence
  chemically synthesized
cccagctacttgggaggcta

SEQ ID NO: 368334 - DNA, 20 bp, Artificial Sequence
  chemically synthesized
agctacttgggaggctaagg

SEQ ID NO: 368335 - DNA, 20 bp, Artificial Sequence
  chemically synthesized
gctacttgggaggctaaggt

SEQ ID NO: 368336 - DNA, 20 bp, Artificial Sequence
  chemically synthesized
tacttgggaggctaaggtgg

SEQ ID NO: 368337 - DNA, 20 bp, Artificial Sequence
  chemically synthesized
tcccagattctctcccacct

SEQ ID NO: 368338 - DNA, 20 bp, Artificial Sequence
  chemically synthesized
cttgggaggctaaggtggga

SEQ ID NO: 368339 - DNA, 20 bp, Artificial Sequence
  chemically synthesized
ggctaaggtgggagagaatc

SEQ ID NO: 368340 - DNA, 20 bp, Artificial Sequence
  chemically synthesized
gctaaggtgggagagaatct

SEQ ID NO: 368341 - DNA, 20 bp, Artificial Sequence
  chemically synthesized
taaggtgggagagaatctgg

SEQ ID NO: 368342 - DNA, 20 bp, Artificial Sequence
  chemically synthesized
aaggtgggagagaatctggg

SEQ ID NO: 368343 - DNA, 20 bp, Artificial Sequence
  chemically synthesized
gtgggagagaatctgggagg

SEQ ID NO: 368344 - DNA, 20 bp, Artificial Sequence
  chemically synthesized
gggagagaatctgggaggca

SEQ ID NO: 368345 - DNA, 20 bp, Artificial Sequence
  chemically synthesized
tcactgcaacctctgcctcc

SEQ ID NO: 368346 - DNA, 20 bp, Artificial Sequence
  chemically synthesized
ggagagaatctgggaggcag

SEQ ID NO: 368347 - DNA, 20 bp, Artificial Sequence
  chemically synthesized
aatctgggaggcagaggttg

SEQ ID NO: 368348 - DNA, 20 bp, Artificial Sequence
  chemically synthesized
tgggaggcagaggttgcagt

SEQ ID NO: 368349 - DNA, 20 bp, Artificial Sequence
  chemically synthesized
ggcagaggttgcagtgagcc

SEQ ID NO: 368350 - DNA, 20 bp, Artificial Sequence
  chemically synthesized
ggagtgcagtggtgcaatct

SEQ ID NO: 368351 - DNA, 20 bp, Artificial Sequence
  chemically synthesized
ccacccaggctggagtgcag

SEQ ID NO: 368352 - DNA, 20 bp, Artificial Sequence
  chemically synthesized
aagattgcaccactgcactc

SEQ ID NO: 368353 - DNA, 20 bp, Artificial Sequence
  chemically synthesized
ctgccacccaggctggagtg

SEQ ID NO: 368354 - DNA, 20 bp, Artificial Sequence
  chemically synthesized
tgcaccactgcactccagcc

SEQ ID NO: 368355 - DNA, 20 bp, Artificial Sequence
  chemically synthesized
gcaccactgcactccagcct

SEQ ID NO: 368356 - DNA, 20 bp, Artificial Sequence
  chemically synthesized
tcactctgccacccaggctg

SEQ ID NO: 368357 - DNA, 20 bp, Artificial Sequence
  chemically synthesized
ccactgcactccagcctggg

SEQ ID NO: 368358 - DNA, 20 bp, Artificial Sequence
  chemically synthesized
tctcactctgccacccaggc

SEQ ID NO: 368359 - DNA, 20 bp, Artificial Sequence
  chemically synthesized
ctgcactccagcctgggtgg

SEQ ID NO: 368360 - DNA, 20 bp, Artificial Sequence
  chemically synthesized
ggagtctcactctgccaccc

SEQ ID NO: 368361 - DNA, 20 bp, Artificial Sequence
  chemically synthesized
gcactccagcctgggtggca

SEQ ID NO: 368362 - DNA, 20 bp, Artificial Sequence
  chemically synthesized
cggagtctcactctgccacc

SEQ ID NO: 368363 - DNA, 20 bp, Artificial Sequence
  chemically synthesized
tccagcctgggtggcagagt

SEQ ID NO: 368364 - DNA, 20 bp, Artificial Sequence
  chemically synthesized
ttttttttttttttgagacg

SEQ ID NO: 368365 - DNA, 20 bp, Artificial Sequence
  chemically synthesized
ttttttttttttttttgaga

SEQ ID NO: 368366 - DNA, 20 bp, Artificial Sequence
  chemically synthesized
aatctttttttttttttttt

SEQ ID NO: 368367 - DNA, 20 bp, Artificial Sequence
  chemically synthesized
cgtctcaaaaaaaaaaaaaa

SEQ ID NO: 368368 - DNA, 20 bp, Artificial Sequence
  chemically synthesized
tgagccattccattatgtca

SEQ ID NO: 368369 - DNA, 20 bp, Artificial Sequence
  chemically synthesized
acacatataccatgacataa

SEQ ID NO: 368370 - DNA, 20 bp, Artificial Sequence
  chemically synthesized
tataccatgacataatggaa

SEQ ID NO: 368371 - DNA, 20 bp, Artificial Sequence
  chemically synthesized
gacataatggaatggctcac

SEQ ID NO: 368372 - DNA, 20 bp, Artificial Sequence
  chemically synthesized
ctcatagatgtttgtctagt

SEQ ID NO: 368373 - DNA, 20 bp, Artificial Sequence
  chemically synthesized
agtactcatagatgtttgtc

SEQ ID NO: 368374 - DNA, 20 bp, Artificial Sequence
  chemically synthesized
ctcactagacaaacatctat

SEQ ID NO: 368375 - DNA, 20 bp, Artificial Sequence
  chemically synthesized
tccctggaactgagtactca

SEQ ID NO: 368376 - DNA, 20 bp, Artificial Sequence
  chemically synthesized
gacaaacatctatgagtact

SEQ ID NO: 368377 - DNA, 20 bp, Artificial Sequence
  chemically synthesized
catctatgagtactcagttc

SEQ ID NO: 368378 - DNA, 20 bp, Artificial Sequence
  chemically synthesized
atctatgagtactcagttcc

SEQ ID NO: 368379 - DNA, 20 bp, Artificial Sequence
  chemically synthesized
tctatgagtactcagttcca

SEQ ID NO: 368380 - DNA, 20 bp, Artificial Sequence
  chemically synthesized
tctgcaatttccctggaact

SEQ ID NO: 368381 - DNA, 20 bp, Artificial Sequence
  chemically synthesized
tttcttctctgcaatttccc

SEQ ID NO: 368382 - DNA, 20 bp, Artificial Sequence
  chemically synthesized
actcagttccagggaaattg

SEQ ID NO: 368383 - DNA, 20 bp, Artificial Sequence
  chemically synthesized
tcagttccagggaaattgca

SEQ ID NO: 368384 - DNA, 20 bp, Artificial Sequence
  chemically synthesized
gttccagggaaattgcagag

SEQ ID NO: 368385 - DNA, 20 bp, Artificial Sequence
  chemically synthesized
agggaaattgcagagaagaa

SEQ ID NO: 368386 - DNA, 20 bp, Artificial Sequence
  chemically synthesized
cagagaagaaaagtgatatt

SEQ ID NO: 368387 - DNA, 20 bp, Artificial Sequence
  chemically synthesized
agagaagaaaagtgatattt

SEQ ID NO: 368388 - DNA, 20 bp, Artificial Sequence
  chemically synthesized
gaaaagtgatatttaggctt

SEQ ID NO: 368389 - DNA, 20 bp, Artificial Sequence
  chemically synthesized
tgatatttaggcttcagatc

SEQ ID NO: 368390 - DNA, 20 bp, Artificial Sequence
  chemically synthesized
tgtttcctctactagatctg

SEQ ID NO: 368391 - DNA, 20 bp, Artificial Sequence
  chemically synthesized
tatttaggcttcagatctag

SEQ ID NO: 368392 - DNA, 20 bp, Artificial Sequence
  chemically synthesized
tttaggcttcagatctagta

SEQ ID NO: 368393 - DNA, 20 bp, Artificial Sequence
  chemically synthesized
ttaggcttcagatctagtag

SEQ ID NO: 368394 - DNA, 20 bp, Artificial Sequence
  chemically synthesized
gtccataatgtttcctctac

SEQ ID NO: 368395 - DNA, 20 bp, Artificial Sequence
  chemically synthesized
atctagtagaggaaacatta

SEQ ID NO: 368396 - DNA, 20 bp, Artificial Sequence
  chemically synthesized
tagaggaaacattatggaca

SEQ ID NO: 368397 - DNA, 20 bp, Artificial Sequence
  chemically synthesized
agaggaaacattatggacaa

SEQ ID NO: 368398 - DNA, 20 bp, Artificial Sequence
  chemically synthesized
gaggaaacattatggacaaa

SEQ ID NO: 368399 - DNA, 20 bp, Artificial Sequence
  chemically synthesized
ttatggacaaagggcatcca

SEQ ID NO: 368400 - DNA, 20 bp, Artificial Sequence
  chemically synthesized
tcattaattaaagtcatctt

SEQ ID NO: 368401 - DNA, 20 bp, Artificial Sequence
  chemically synthesized
cgttttacattcattaatta

SEQ ID NO: 368402 - DNA, 20 bp, Artificial Sequence
  chemically synthesized
taattgagaaattataagaa

SEQ ID NO: 368403 - DNA, 20 bp, Artificial Sequence
  chemically synthesized
tagggtaattgagaaattat

SEQ ID NO: 368404 - DNA, 20 bp, Artificial Sequence
  chemically synthesized
aactgcaccgtagggtaatt

SEQ ID NO: 368405 - DNA, 20 bp, Artificial Sequence
  chemically synthesized
ataatttctcaattacccta

SEQ ID NO: 368406 - DNA, 20 bp, Artificial Sequence
  chemically synthesized
ttctcaattaccctacggtg

SEQ ID NO: 368407 - DNA, 20 bp, Artificial Sequence
  chemically synthesized
ccatacacaactgcaccgta

SEQ ID NO: 368408 - DNA, 20 bp, Artificial Sequence
  chemically synthesized
tccatacacaactgcaccgt

SEQ ID NO: 368409 - DNA, 20 bp, Artificial Sequence
  chemically synthesized
gtccatacacaactgcaccg

SEQ ID NO: 368410 - DNA, 20 bp, Artificial Sequence
  chemically synthesized
ccctacggtgcagttgtgta

SEQ ID NO: 368411 - DNA, 20 bp, Artificial Sequence
  chemically synthesized
gcagttgtgtatggacaata

SEQ ID NO: 368412 - DNA, 20 bp, Artificial Sequence
  chemically synthesized
cagttgtgtatggacaatat

SEQ ID NO: 368413 - DNA, 20 bp, Artificial Sequence
  chemically synthesized
gtatggacaatataggtgac

SEQ ID NO: 368414 - DNA, 20 bp, Artificial Sequence
  chemically synthesized
acaatataggtgacaagaca

SEQ ID NO: 368415 - DNA, 20 bp, Artificial Sequence
  chemically synthesized
ggatgggaataattaggaag

SEQ ID NO: 368416 - DNA, 20 bp, Artificial Sequence
  chemically synthesized
ggaggatgggaataattagg

SEQ ID NO: 368417 - DNA, 20 bp, Artificial Sequence
  chemically synthesized
ggtggaggatgggaataatt

SEQ ID NO: 368418 - DNA, 20 bp, Artificial Sequence
  chemically synthesized
aggtggaggatgggaataat

SEQ ID NO: 368419 - DNA, 20 bp, Artificial Sequence
  chemically synthesized
cttcccagtaggtggaggat

SEQ ID NO: 368420 - DNA, 20 bp, Artificial Sequence
  chemically synthesized
acttcccagtaggtggagga

SEQ ID NO: 368421 - DNA, 20 bp, Artificial Sequence
  chemically synthesized
gatgacttcccagtaggtgg

SEQ ID NO: 368422 - DNA, 20 bp, Artificial Sequence
  chemically synthesized
tattcccatcctccacctac

SEQ ID NO: 368423 - DNA, 20 bp, Artificial Sequence
  chemically synthesized
ggatgacttcccagtaggtg

SEQ ID NO: 368424 - DNA, 20 bp, Artificial Sequence
  chemically synthesized
attcccatcctccacctact

SEQ ID NO: 368425 - DNA, 20 bp, Artificial Sequence
  chemically synthesized
aaggatgacttcccagtagg

SEQ ID NO: 368426 - DNA, 20 bp, Artificial Sequence
  chemically synthesized
cccatcctccacctactggg

SEQ ID NO: 368427 - DNA, 20 bp, Artificial Sequence
  chemically synthesized
accaaggatgacttcccagt

SEQ ID NO: 368428 - DNA, 20 bp, Artificial Sequence
  chemically synthesized
aaccaaggatgacttcccag

SEQ ID NO: 368429 - DNA, 20 bp, Artificial Sequence
  chemically synthesized
ataaaccaaggatgacttcc

SEQ ID NO: 368430 - DNA, 20 bp, Artificial Sequence
  chemically synthesized
acctactgggaagtcatcct

SEQ ID NO: 368431 - DNA, 20 bp, Artificial Sequence
  chemically synthesized
aagaaagaatgaataaacca

SEQ ID NO: 368432 - DNA, 20 bp, Artificial Sequence
  chemically synthesized
gaagaaagaatgaataaacc

SEQ ID NO: 368433 - DNA, 20 bp, Artificial Sequence
  chemically synthesized
cttacaggcatggaagaaga

SEQ ID NO: 368434 - DNA, 20 bp, Artificial Sequence
  chemically synthesized
gacccttacaggcatggaag

SEQ ID NO: 368435 - DNA, 20 bp, Artificial Sequence
  chemically synthesized
acagacccttacaggcatgg

SEQ ID NO: 368436 - DNA, 20 bp, Artificial Sequence
  chemically synthesized
ctttcttcttccatgcctgt

SEQ ID NO: 368437 - DNA, 20 bp, Artificial Sequence
  chemically synthesized
tagacagacccttacaggca

SEQ ID NO: 368438 - DNA, 20 bp, Artificial Sequence
  chemically synthesized
tttcttcttccatgcctgta

SEQ ID NO: 368439 - DNA, 20 bp, Artificial Sequence
  chemically synthesized
ttcttcttccatgcctgtaa

SEQ ID NO: 368440 - DNA, 20 bp, Artificial Sequence
  chemically synthesized
tcctgtagacagacccttac

SEQ ID NO: 368441 - DNA, 20 bp, Artificial Sequence
  chemically synthesized
ttcctgtagacagaccctta

SEQ ID NO: 368442 - DNA, 20 bp, Artificial Sequence
  chemically synthesized
tgcctgtaagggtctgtcta

SEQ ID NO: 368443 - DNA, 20 bp, Artificial Sequence
  chemically synthesized
gcctgtaagggtctgtctac

SEQ ID NO: 368444 - DNA, 20 bp, Artificial Sequence
  chemically synthesized
gatttggaacttcctgtaga

SEQ ID NO: 368445 - DNA, 20 bp, Artificial Sequence
  chemically synthesized
tgtaagggtctgtctacagg

SEQ ID NO: 368446 - DNA, 20 bp, Artificial Sequence
  chemically synthesized
ctttgatttggaacttcctg

SEQ ID NO: 368447 - DNA, 20 bp, Artificial Sequence
  chemically synthesized
ctacaggaagttccaaatca

SEQ ID NO: 368448 - DNA, 20 bp, Artificial Sequence
  chemically synthesized
tgtttccaatttctttgatt

SEQ ID NO: 368449 - DNA, 20 bp, Artificial Sequence
  chemically synthesized
aagttccaaatcaaagaaat

SEQ ID NO: 368450 - DNA, 20 bp, Artificial Sequence
  chemically synthesized
aatcaaagaaattggaaaca

SEQ ID NO: 368451 - DNA, 20 bp, Artificial Sequence
  chemically synthesized
aagaaattggaaacacagaa

SEQ ID NO: 368452 - DNA, 20 bp, Artificial Sequence
  chemically synthesized
cagaaaagataaatgtcaca

SEQ ID NO: 368453 - DNA, 20 bp, Artificial Sequence
  chemically synthesized
agaaaagataaatgtcacat

SEQ ID NO: 368454 - DNA, 20 bp, Artificial Sequence
  chemically synthesized
cacataggatacaatattta

SEQ ID NO: 368455 - DNA, 20 bp, Artificial Sequence
  chemically synthesized
ataggatacaatatttaaag

SEQ ID NO: 368456 - DNA, 20 bp, Artificial Sequence
  chemically synthesized
taaagaagatcttctgtcaa

SEQ ID NO: 368457 - DNA, 20 bp, Artificial Sequence
  chemically synthesized
tcctctgtgacttttgacag

SEQ ID NO: 368458 - DNA, 20 bp, Artificial Sequence
  chemically synthesized
ttatcctctgtgacttttga

SEQ ID NO: 368459 - DNA, 20 bp, Artificial Sequence
  chemically synthesized
agatcttctgtcaaaagtca

SEQ ID NO: 368460 - DNA, 20 bp, Artificial Sequence
  chemically synthesized
atcttctgtcaaaagtcaca

SEQ ID NO: 368461 - DNA, 20 bp, Artificial Sequence
  chemically synthesized
tcttctgtcaaaagtcacag

SEQ ID NO: 368462 - DNA, 20 bp, Artificial Sequence
  chemically synthesized
cacagaggataaaatattta

SEQ ID NO: 368463 - DNA, 20 bp, Artificial Sequence
  chemically synthesized
acagaggataaaatatttaa

SEQ ID NO: 368464 - DNA, 20 bp, Artificial Sequence
  chemically synthesized
agaggataaaatatttaaag

SEQ ID NO: 368465 - DNA, 20 bp, Artificial Sequence
  chemically synthesized
gaaataaagcatagcagtga

SEQ ID NO: 368466 - DNA, 20 bp, Artificial Sequence
  chemically synthesized
taaaaggaaataaagcatag

SEQ ID NO: 368467 - DNA, 20 bp, Artificial Sequence
  chemically synthesized
cactaaaaggaaataaagca

SEQ ID NO: 368468 - DNA, 20 bp, Artificial Sequence
  chemically synthesized
tggaccactaaaaggaaata

SEQ ID NO: 368469 - DNA, 20 bp, Artificial Sequence
  chemically synthesized
tgctatgctttatttccttt

SEQ ID NO: 368470 - DNA, 20 bp, Artificial Sequence
  chemically synthesized
tatgctttatttccttttag

SEQ ID NO: 368471 - DNA, 20 bp, Artificial Sequence
  chemically synthesized
cataaagttggaccactaaa

SEQ ID NO: 368472 - DNA, 20 bp, Artificial Sequence
  chemically synthesized
gcataaagttggaccactaa

SEQ ID NO: 368473 - DNA, 20 bp, Artificial Sequence
  chemically synthesized
aattggaaattgcataaagt

SEQ ID NO: 368474 - DNA, 20 bp, Artificial Sequence
  chemically synthesized
tcagaattggaaattgcata

SEQ ID NO: 368475 - DNA, 20 bp, Artificial Sequence
  chemically synthesized
ttatgcaatttccaattctg

SEQ ID NO: 368476 - DNA, 20 bp, Artificial Sequence
  chemically synthesized
acaatatttgacttcagaat

SEQ ID NO: 368477 - DNA, 20 bp, Artificial Sequence
  chemically synthesized
tatttgacaatatttgactt

SEQ ID NO: 368478 - DNA, 20 bp, Artificial Sequence
  chemically synthesized
tctttctgatacatgaggta

SEQ ID NO: 368479 - DNA, 20 bp, Artificial Sequence
  chemically synthesized
catctttctgatacatgagg

SEQ ID NO: 368480 - DNA, 20 bp, Artificial Sequence
  chemically synthesized
tatgactctacctcatgtat

SEQ ID NO: 368481 - DNA, 20 bp, Artificial Sequence
  chemically synthesized
tcgcatctttctgatacatg

SEQ ID NO: 368482 - DNA, 20 bp, Artificial Sequence
  chemically synthesized
ctcgcatctttctgatacat

SEQ ID NO: 368483 - DNA, 20 bp, Artificial Sequence
  chemically synthesized
actctacctcatgtatcaga

SEQ ID NO: 368484 - DNA, 20 bp, Artificial Sequence
  chemically synthesized
ctcatgtatcagaaagatgc

SEQ ID NO: 368485 - DNA, 20 bp, Artificial Sequence
  chemically synthesized
tgcgagttacacacatcgac

SEQ ID NO: 368486 - DNA, 20 bp, Artificial Sequence
  chemically synthesized
gaagtagcgctgacataaac

SEQ ID NO: 368487 - DNA, 20 bp, Artificial Sequence
  chemically synthesized
acacatcgactggtttatgt

SEQ ID NO: 368488 - DNA, 20 bp, Artificial Sequence
  chemically synthesized
ccacaaaaagtacacagaag

SEQ ID NO: 368489 - DNA, 20 bp, Artificial Sequence
  chemically synthesized
aacccacaaaaagtacacag

SEQ ID NO: 368490 - DNA, 20 bp, Artificial Sequence
  chemically synthesized
aacaacccacaaaaagtaca

SEQ ID NO: 368491 - DNA, 20 bp, Artificial Sequence
  chemically synthesized
ctacttctgtgtactttttg

SEQ ID NO: 368492 - DNA, 20 bp, Artificial Sequence
  chemically synthesized
tacttctgtgtactttttgt

SEQ ID NO: 368493 - DNA, 20 bp, Artificial Sequence
  chemically synthesized
acattaaaacaacccacaaa

SEQ ID NO: 368494 - DNA, 20 bp, Artificial Sequence
  chemically synthesized
gtgggttgttttaatgttca

SEQ ID NO: 368495 - DNA, 20 bp, Artificial Sequence
  chemically synthesized
tttcatcagttgtaaaatgg

SEQ ID NO: 368496 - DNA, 20 bp, Artificial Sequence
  chemically synthesized
gtttcatcagttgtaaaatg

SEQ ID NO: 368497 - DNA, 20 bp, Artificial Sequence
  chemically synthesized
tgtttcatcagttgtaaaat

SEQ ID NO: 368498 - DNA, 20 bp, Artificial Sequence
  chemically synthesized
ctgtttcatcagttgtaaaa

SEQ ID NO: 368499 - DNA, 20 bp, Artificial Sequence
  chemically synthesized
ccattttacaactgatgaaa

SEQ ID NO: 368500 - DNA, 20 bp, Artificial Sequence
  chemically synthesized
ttatattgtgtctgtttcat

SEQ ID NO: 368501 - DNA, 20 bp, Artificial Sequence
  chemically synthesized
tgatgaaacagacacaatat

SEQ ID NO: 368502 - DNA, 20 bp, Artificial Sequence
  chemically synthesized
acaatataagtaacttgaat

SEQ ID NO: 368503 - DNA, 20 bp, Artificial Sequence
  chemically synthesized
caatataagtaacttgaata

SEQ ID NO: 368504 - DNA, 20 bp, Artificial Sequence
  chemically synthesized
cttgctgtgtgaccttattc

SEQ ID NO: 368505 - DNA, 20 bp, Artificial Sequence
  chemically synthesized
gtaacttgaataaggtcaca

SEQ ID NO: 368506 - DNA, 20 bp, Artificial Sequence
  chemically synthesized
cttgaataaggtcacacagc

SEQ ID NO: 368507 - DNA, 20 bp, Artificial Sequence
  chemically synthesized
aataaggtcacacagcaagt

SEQ ID NO: 368508 - DNA, 20 bp, Artificial Sequence
  chemically synthesized
gtcacacagcaagtaagtgc

SEQ ID NO: 368509 - DNA, 20 bp, Artificial Sequence
  chemically synthesized
cctaagtccaaattagtatc

SEQ ID NO: 368510 - DNA, 20 bp, Artificial Sequence
  chemically synthesized
gtaagtgctagatactaatt

SEQ ID NO: 368511 - DNA, 20 bp, Artificial Sequence
  chemically synthesized
tacactgcctaagtccaaat

SEQ ID NO: 368512 - DNA, 20 bp, Artificial Sequence
  chemically synthesized
gctagatactaatttggact

SEQ ID NO: 368513 - DNA, 20 bp, Artificial Sequence
  chemically synthesized
ctagatactaatttggactt

SEQ ID NO: 368514 - DNA, 20 bp, Artificial Sequence
  chemically synthesized
gatactaatttggacttagg

SEQ ID NO: 368515 - DNA, 20 bp, Artificial Sequence
  chemically synthesized
gatctgtagatacactgcct

SEQ ID NO: 368516 - DNA, 20 bp, Artificial Sequence
  chemically synthesized
ggacttaggcagtgtatcta

SEQ ID NO: 368517 - DNA, 20 bp, Artificial Sequence
  chemically synthesized
aagaatggtgtagagatctg

SEQ ID NO: 368518 - DNA, 20 bp, Artificial Sequence
  chemically synthesized
gcaaagtaaagaatggtgta

SEQ ID NO: 368519 - DNA, 20 bp, Artificial Sequence
  chemically synthesized
ttgcaaagtaaagaatggtg

SEQ ID NO: 368520 - DNA, 20 bp, Artificial Sequence
  chemically synthesized
agcagttgcaaagtaaagaa

SEQ ID NO: 368521 - DNA, 20 bp, Artificial Sequence
  chemically synthesized
taaacagcagttgcaaagta

SEQ ID NO: 368522 - DNA, 20 bp, Artificial Sequence
  chemically synthesized
cagcttaaacagcagttgca

SEQ ID NO: 368523 - DNA, 20 bp, Artificial Sequence
  chemically synthesized
ttactttgcaactgctgttt

SEQ ID NO: 368524 - DNA, 20 bp, Artificial Sequence
  chemically synthesized
gtcaagcccagcttaaacag

SEQ ID NO: 368525 - DNA, 20 bp, Artificial Sequence
  chemically synthesized
tttgcaactgctgtttaagc

SEQ ID NO: 368526 - DNA, 20 bp, Artificial Sequence
  chemically synthesized
atagtcaagcccagcttaaa

SEQ ID NO: 368527 - DNA, 20 bp, Artificial Sequence
  chemically synthesized
ttgcaactgctgtttaagct

SEQ ID NO: 368528 - DNA, 20 bp, Artificial Sequence
  chemically synthesized
aatgtgatgatagtcaagcc

SEQ ID NO: 368529 - DNA, 20 bp, Artificial Sequence
  chemically synthesized
ccctgaatgtgatgatagtc

SEQ ID NO: 368530 - DNA, 20 bp, Artificial Sequence
  chemically synthesized
cttgcccctgaatgtgatga

SEQ ID NO: 368531 - DNA, 20 bp, Artificial Sequence
  chemically synthesized
ggcttgactatcatcacatt

SEQ ID NO: 368532 - DNA, 20 bp, Artificial Sequence
  chemically synthesized
gcttgactatcatcacattc

SEQ ID NO: 368533 - DNA, 20 bp, Artificial Sequence
  chemically synthesized
cttgactatcatcacattca

SEQ ID NO: 368534 - DNA, 20 bp, Artificial Sequence
  chemically synthesized
ttgactatcatcacattcag

SEQ ID NO: 368535 - DNA, 20 bp, Artificial Sequence
  chemically synthesized
ctatcatcacattcaggggc

SEQ ID NO: 368536 - DNA, 20 bp, Artificial Sequence
  chemically synthesized
tatcatcacattcaggggca

SEQ ID NO: 368537 - DNA, 20 bp, Artificial Sequence
  chemically synthesized
atcatcacattcaggggcaa

SEQ ID NO: 368538 - DNA, 20 bp, Artificial Sequence
  chemically synthesized
tcacattcaggggcaagggt

SEQ ID NO: 368539 - DNA, 20 bp, Artificial Sequence
  chemically synthesized
cacattcaggggcaagggtt

SEQ ID NO: 368540 - DNA, 20 bp, Artificial Sequence
  chemically synthesized
ttcaggggcaagggttaggt

SEQ ID NO: 368541 - DNA, 20 bp, Artificial Sequence
  chemically synthesized
gggttaggtgagttttactt

SEQ ID NO: 368542 - DNA, 20 bp, Artificial Sequence
  chemically synthesized
aaaagatgacgtaaaggctc

SEQ ID NO: 368543 - DNA, 20 bp, Artificial Sequence
  chemically synthesized
ttgtagaaaagatgacgtaa

SEQ ID NO: 368544 - DNA, 20 bp, Artificial Sequence
  chemically synthesized
tttgtagaaaagatgacgta

SEQ ID NO: 368545 - DNA, 20 bp, Artificial Sequence
  chemically synthesized
tttacgtcatcttttctaca

SEQ ID NO: 368546 - DNA, 20 bp, Artificial Sequence
  chemically synthesized
attaaactatctttgtagaa

SEQ ID NO: 368547 - DNA, 20 bp, Artificial Sequence
  chemically synthesized
cgtcatcttttctacaaaga

SEQ ID NO: 368548 - DNA, 20 bp, Artificial Sequence
  chemically synthesized
gatatattaaactatctttg

SEQ ID NO: 368549 - DNA, 20 bp, Artificial Sequence
  chemically synthesized
ggaaatgatagaagaaagaa

SEQ ID NO: 368550 - DNA, 20 bp, Artificial Sequence
  chemically synthesized
cttttggaaatgatagaaga

SEQ ID NO: 368551 - DNA, 20 bp, Artificial Sequence
  chemically synthesized
tgaccttttggaaatgatag

SEQ ID NO: 368552 - DNA, 20 bp, Artificial Sequence
  chemically synthesized
atctgaccttttggaaatga

SEQ ID NO: 368553 - DNA, 20 bp, Artificial Sequence
  chemically synthesized
ctttcttctatcatttccaa

SEQ ID NO: 368554 - DNA, 20 bp, Artificial Sequence
  chemically synthesized
tttcttctatcatttccaaa

SEQ ID NO: 368555 - DNA, 20 bp, Artificial Sequence
  chemically synthesized
ttctatcatttccaaaaggt

SEQ ID NO: 368556 - DNA, 20 bp, Artificial Sequence
  chemically synthesized
tataactgtatctgaccttt

SEQ ID NO: 368557 - DNA, 20 bp, Artificial Sequence
  chemically synthesized
catttccaaaaggtcagata

SEQ ID NO: 368558 - DNA, 20 bp, Artificial Sequence
  chemically synthesized
aaaggtcagatacagttata

SEQ ID NO: 368559 - DNA, 20 bp, Artificial Sequence
  chemically synthesized
ttaggagcaattttattggc

SEQ ID NO: 368560 - DNA, 20 bp, Artificial Sequence
  chemically synthesized
attaggagcaattttattgg

SEQ ID NO: 368561 - DNA, 20 bp, Artificial Sequence
  chemically synthesized
acaattaggagcaattttat

SEQ ID NO: 368562 - DNA, 20 bp, Artificial Sequence
  chemically synthesized
aataaaattgctcctaattg

SEQ ID NO: 368563 - DNA, 20 bp, Artificial Sequence
  chemically synthesized
caaatgggacctacaattag

SEQ ID NO: 368564 - DNA, 20 bp, Artificial Sequence
  chemically synthesized
ataaaattgctcctaattgt

SEQ ID NO: 368565 - DNA, 20 bp, Artificial Sequence
  chemically synthesized
tacaaatgggacctacaatt

SEQ ID NO: 368566 - DNA, 20 bp, Artificial Sequence
  chemically synthesized
ttacaaatgggacctacaat

SEQ ID NO: 368567 - DNA, 20 bp, Artificial Sequence
  chemically synthesized
actatctttccattacaaat

SEQ ID NO: 368568 - DNA, 20 bp, Artificial Sequence
  chemically synthesized
attgtaggtcccatttgtaa

SEQ ID NO: 368569 - DNA, 20 bp, Artificial Sequence
  chemically synthesized
tactatctttccattacaaa

SEQ ID NO: 368570 - DNA, 20 bp, Artificial Sequence
  chemically synthesized
taggtcccatttgtaatgga

SEQ ID NO: 368571 - DNA, 20 bp, Artificial Sequence
  chemically synthesized
tcccatttgtaatggaaaga

SEQ ID NO: 368572 - DNA, 20 bp, Artificial Sequence
  chemically synthesized
ttgtaatggaaagatagtaa

SEQ ID NO: 368573 - DNA, 20 bp, Artificial Sequence
  chemically synthesized
attttcctaatgtatatatg

SEQ ID NO: 368574 - DNA, 20 bp, Artificial Sequence
  chemically synthesized
ataattctacatatatacat

SEQ ID NO: 368575 - DNA, 20 bp, Artificial Sequence
  chemically synthesized
taattctacatatatacatt

SEQ ID NO: 368576 - DNA, 20 bp, Artificial Sequence
  chemically synthesized
tacattaggaaaattcttca

SEQ ID NO: 368577 - DNA, 20 bp, Artificial Sequence
  chemically synthesized
aataggaatttgggactttg

SEQ ID NO: 368578 - DNA, 20 bp, Artificial Sequence
  chemically synthesized
tgatataacaataggaattt

SEQ ID NO: 368579 - DNA, 20 bp, Artificial Sequence
  chemically synthesized
atgatataacaataggaatt

SEQ ID NO: 368580 - DNA, 20 bp, Artificial Sequence
  chemically synthesized
atgtcaaatgatataacaat

SEQ ID NO: 368581 - DNA, 20 bp, Artificial Sequence
  chemically synthesized
gatgtcaaatgatataacaa

SEQ ID NO: 368582 - DNA, 20 bp, Artificial Sequence
  chemically synthesized
attgttatatcatttgacat

SEQ ID NO: 368583 - DNA, 20 bp, Artificial Sequence
  chemically synthesized
ttgttatatcatttgacatc

SEQ ID NO: 368584 - DNA, 20 bp, Artificial Sequence
  chemically synthesized
tgttatatcatttgacatcg

SEQ ID NO: 368585 - DNA, 20 bp, Artificial Sequence
  chemically synthesized
gttatatcatttgacatcgg

SEQ ID NO: 368586 - DNA, 20 bp, Artificial Sequence
  chemically synthesized
cgggggtttcattaactcct

SEQ ID NO: 368587 - DNA, 20 bp, Artificial Sequence
  chemically synthesized
gggggtttcattaactcctc

SEQ ID NO: 368588 - DNA, 20 bp, Artificial Sequence
  chemically synthesized
gagcacactggagtcctgag

SEQ ID NO: 368589 - DNA, 20 bp, Artificial Sequence
  chemically synthesized
ctgagcacactggagtcctg

SEQ ID NO: 368590 - DNA, 20 bp, Artificial Sequence
  chemically synthesized
tcattaactcctcaggactc

SEQ ID NO: 368591 - DNA, 20 bp, Artificial Sequence
  chemically synthesized
gctgagcacactggagtcct

SEQ ID NO: 368592 - DNA, 20 bp, Artificial Sequence
  chemically synthesized
tgagtctgctgagcacactg

SEQ ID NO: 368593 - DNA, 20 bp, Artificial Sequence
  chemically synthesized
cctcaggactccagtgtgct

SEQ ID NO: 368594 - DNA, 20 bp, Artificial Sequence
  chemically synthesized
attgagtctgctgagcacac

SEQ ID NO: 368595 - DNA, 20 bp, Artificial Sequence
  chemically synthesized
caggactccagtgtgctcag

SEQ ID NO: 368596 - DNA, 20 bp, Artificial Sequence
  chemically synthesized
atttagtaattgagtctgct

SEQ ID NO: 368597 - DNA, 20 bp, Artificial Sequence
  chemically synthesized
taaaatagtatttagtaatt

SEQ ID NO: 368598 - DNA, 20 bp, Artificial Sequence
  chemically synthesized
gtgtgctctaaaatagtatt

SEQ ID NO: 368599 - DNA, 20 bp, Artificial Sequence
  chemically synthesized
tcaattactaaatactattt

SEQ ID NO: 368600 - DNA, 20 bp, Artificial Sequence
  chemically synthesized
aattactaaatactatttta

SEQ ID NO: 368601 - DNA, 20 bp, Artificial Sequence
  chemically synthesized
atttgcagtgtgctctaaaa

SEQ ID NO: 368602 - DNA, 20 bp, Artificial Sequence
  chemically synthesized
ttatacattcgaacaatttg

SEQ ID NO: 368603 - DNA, 20 bp, Artificial Sequence
  chemically synthesized
cacatttttcaaatacatta

SEQ ID NO: 368604 - DNA, 20 bp, Artificial Sequence
  chemically synthesized
gccacatttttcaaatacat

SEQ ID NO: 368605 - DNA, 20 bp, Artificial Sequence
  chemically synthesized
tctaatgtatttgaaaaatg

SEQ ID NO: 368606 - DNA, 20 bp, Artificial Sequence
  chemically synthesized
tcttctttagttaatataaa

SEQ ID NO: 368607 - DNA, 20 bp, Artificial Sequence
  chemically synthesized
gtggctttttatattaacta

SEQ ID NO: 368608 - DNA, 20 bp, Artificial Sequence
  chemically synthesized
gctttttatattaactaaag

SEQ ID NO: 368609 - DNA, 20 bp, Artificial Sequence
  chemically synthesized
gttgaatgatatttcttctt

SEQ ID NO: 368610 - DNA, 20 bp, Artificial Sequence
  chemically synthesized
atatcattcaacaaaaactt

SEQ ID NO: 368611 - DNA, 20 bp, Artificial Sequence
  chemically synthesized
tatcattcaacaaaaactta

SEQ ID NO: 368612 - DNA, 20 bp, Artificial Sequence
  chemically synthesized
attttgatttatatagcctt

SEQ ID NO: 368613 - DNA, 20 bp, Artificial Sequence
  chemically synthesized
ttcttatattttgatttata

SEQ ID NO: 368614 - DNA, 20 bp, Artificial Sequence
  chemically synthesized
ggctatataaatcaaaatat

SEQ ID NO: 368615 - DNA, 20 bp, Artificial Sequence
  chemically synthesized
tataagaaatataatccttg

SEQ ID NO: 368616 - DNA, 20 bp, Artificial Sequence
  chemically synthesized
tttaatccttatcaacttca

SEQ ID NO: 368617 - DNA, 20 bp, Artificial Sequence
  chemically synthesized
atttaatccttatcaacttc

SEQ ID NO: 368618 - DNA, 20 bp, Artificial Sequence
  chemically synthesized
atataatccttgaagttgat

SEQ ID NO: 368619 - DNA, 20 bp, Artificial Sequence
  chemically synthesized
tataatccttgaagttgata

SEQ ID NO: 368620 - DNA, 20 bp, Artificial Sequence
  chemically synthesized
gaagttgataaggattaaat

SEQ ID NO: 368621 - DNA, 20 bp, Artificial Sequence
  chemically synthesized
aagttgataaggattaaatg

SEQ ID NO: 368622 - DNA, 20 bp, Artificial Sequence
  chemically synthesized
ttgataaggattaaatgagg

SEQ ID NO: 368623 - DNA, 20 bp, Artificial Sequence
  chemically synthesized
ataaggattaaatgaggtag

SEQ ID NO: 368624 - DNA, 20 bp, Artificial Sequence
  chemically synthesized
ttaaatgaggtagtagtaaa

SEQ ID NO: 368625 - DNA, 20 bp, Artificial Sequence
  chemically synthesized
aatgaggtagtagtaaacag

SEQ ID NO: 368626 - DNA, 20 bp, Artificial Sequence
  chemically synthesized
gtagtagtaaacagaagaaa

SEQ ID NO: 368627 - DNA, 20 bp, Artificial Sequence
  chemically synthesized
aacagaagaaaaagtttaac

SEQ ID NO: 368628 - DNA, 20 bp, Artificial Sequence
  chemically synthesized
acagaagaaaaagtttaact

SEQ ID NO: 368629 - DNA, 20 bp, Artificial Sequence
  chemically synthesized
cagaagaaaaagtttaacta

SEQ ID NO: 368630 - DNA, 20 bp, Artificial Sequence
  chemically synthesized
aaaagtttaactagggcatt

SEQ ID NO: 368631 - DNA, 20 bp, Artificial Sequence
  chemically synthesized
aatggctacactaaatgccc

SEQ ID NO: 368632 - DNA, 20 bp, Artificial Sequence
  chemically synthesized
tttaactagggcatttagtg

SEQ ID NO: 368633 - DNA, 20 bp, Artificial Sequence
  chemically synthesized
atttagtgtagccatttctt

SEQ ID NO: 368634 - DNA, 20 bp, Artificial Sequence
  chemically synthesized
tttcagtggatcttaagaaa

SEQ ID NO: 368635 - DNA, 20 bp, Artificial Sequence
  chemically synthesized
ggcacttttcagtggatctt

SEQ ID NO: 368636 - DNA, 20 bp, Artificial Sequence
  chemically synthesized
atttcttaagatccactgaa

SEQ ID NO: 368637 - DNA, 20 bp, Artificial Sequence
  chemically synthesized
aaggaactggcacttttcag

SEQ ID NO: 368638 - DNA, 20 bp, Artificial Sequence
  chemically synthesized
agtaaggaactggcactttt

SEQ ID NO: 368639 - DNA, 20 bp, Artificial Sequence
  chemically synthesized
taagatccactgaaaagtgc

SEQ ID NO: 368640 - DNA, 20 bp, Artificial Sequence
  chemically synthesized
aagactttcaagtaaggaac

SEQ ID NO: 368641 - DNA, 20 bp, Artificial Sequence
  chemically synthesized
agtgccagttccttacttga

SEQ ID NO: 368642 - DNA, 20 bp, Artificial Sequence
  chemically synthesized
acatggaagactttcaagta

SEQ ID NO: 368643 - DNA, 20 bp, Artificial Sequence
  chemically synthesized
cacatggaagactttcaagt

SEQ ID NO: 368644 - DNA, 20 bp, Artificial Sequence
  chemically synthesized
atctcacatggaagactttc

SEQ ID NO: 368645 - DNA, 20 bp, Artificial Sequence
  chemically synthesized
tacttgaaagtcttccatgt

SEQ ID NO: 368646 - DNA, 20 bp, Artificial Sequence
  chemically synthesized
ctacaccgaatctcacatgg

SEQ ID NO: 368647 - DNA, 20 bp, Artificial Sequence
  chemically synthesized
caactacaccgaatctcaca

SEQ ID NO: 368648 - DNA, 20 bp, Artificial Sequence
  chemically synthesized
aaagtcttccatgtgagatt

SEQ ID NO: 368649 - DNA, 20 bp, Artificial Sequence
  chemically synthesized
cttccatgtgagattcggtg

SEQ ID NO: 368650 - DNA, 20 bp, Artificial Sequence
  chemically synthesized
gtgagattcggtgtagttgt

SEQ ID NO: 368651 - DNA, 20 bp, Artificial Sequence
  chemically synthesized
tagttgtaagttaaataata

SEQ ID NO: 368652 - DNA, 20 bp, Artificial Sequence
  chemically synthesized
aagttaaataatatagtatc

SEQ ID NO: 368653 - DNA, 20 bp, Artificial Sequence
  chemically synthesized
ttaaataatatagtatctgg

SEQ ID NO: 368654 - DNA, 20 bp, Artificial Sequence
  chemically synthesized
aataaaggcctatttgcttc

SEQ ID NO: 368655 - DNA, 20 bp, Artificial Sequence
  chemically synthesized
atatagtatctggaagcaaa

SEQ ID NO: 368656 - DNA, 20 bp, Artificial Sequence
  chemically synthesized
tatagtatctggaagcaaat

SEQ ID NO: 368657 - DNA, 20 bp, Artificial Sequence
  chemically synthesized
tatagaactgtaataaataa

SEQ ID NO: 368658 - DNA, 20 bp, Artificial Sequence
  chemically synthesized
ttatagaactgtaataaata

SEQ ID NO: 368659 - DNA, 20 bp, Artificial Sequence
  chemically synthesized
aaataggcctttatttatta

SEQ ID NO: 368660 - DNA, 20 bp, Artificial Sequence
  chemically synthesized
aactggcaaaatttaaatta

SEQ ID NO: 368661 - DNA, 20 bp, Artificial Sequence
  chemically synthesized
ttctataatttaaattttgc

SEQ ID NO: 368662 - DNA, 20 bp, Artificial Sequence
  chemically synthesized
tttatcagtgttcacacaac

SEQ ID NO: 368663 - DNA, 20 bp, Artificial Sequence
  chemically synthesized
ccaagtgctatgtaatttat

SEQ ID NO: 368664 - DNA, 20 bp, Artificial Sequence
  chemically synthesized
gtgaacactgataaattaca

SEQ ID NO: 368665 - DNA, 20 bp, Artificial Sequence
  chemically synthesized
ctgataaattacatagcact

SEQ ID NO: 368666 - DNA, 20 bp, Artificial Sequence
  chemically synthesized
acacataaggaaaataagcc

SEQ ID NO: 368667 - DNA, 20 bp, Artificial Sequence
  chemically synthesized
gtctgacacataaggaaaat

SEQ ID NO: 368668 - DNA, 20 bp, Artificial Sequence
  chemically synthesized
ggcttattttccttatgtgt

SEQ ID NO: 368669 - DNA, 20 bp, Artificial Sequence
  chemically synthesized
tccccctcgtctgacacata

SEQ ID NO: 368670 - DNA, 20 bp, Artificial Sequence
  chemically synthesized
atccccctcgtctgacacat

SEQ ID NO: 368671 - DNA, 20 bp, Artificial Sequence
  chemically synthesized
attttccttatgtgtcagac

SEQ ID NO: 368672 - DNA, 20 bp, Artificial Sequence
  chemically synthesized
ttttccttatgtgtcagacg

SEQ ID NO: 368673 - DNA, 20 bp, Artificial Sequence
  chemically synthesized
tttccttatgtgtcagacga

SEQ ID NO: 368674 - DNA, 20 bp, Artificial Sequence
  chemically synthesized
ttccttatgtgtcagacgag

SEQ ID NO: 368675 - DNA, 20 bp, Artificial Sequence
  chemically synthesized
tccttatgtgtcagacgagg

SEQ ID NO: 368676 - DNA, 20 bp, Artificial Sequence
  chemically synthesized
tatgtgtcagacgaggggga

SEQ ID NO: 368677 - DNA, 20 bp, Artificial Sequence
  chemically synthesized
tgcataatactggttacatt

SEQ ID NO: 368678 - DNA, 20 bp, Artificial Sequence
  chemically synthesized
gtcattcaactaaatgtaac

SEQ ID NO: 368679 - DNA, 20 bp, Artificial Sequence
  chemically synthesized
gacagtatgatgcataatac

SEQ ID NO: 368680 - DNA, 20 bp, Artificial Sequence
  chemically synthesized
attatgcatcatactgtcct

SEQ ID NO: 368681 - DNA, 20 bp, Artificial Sequence
  chemically synthesized
tcttcccatttttcttagga

SEQ ID NO: 368682 - DNA, 20 bp, Artificial Sequence
  chemically synthesized
tttatcttcccatttttctt

SEQ ID NO: 368683 - DNA, 20 bp, Artificial Sequence
  chemically synthesized
tcatactgtcctaagaaaaa

SEQ ID NO: 368684 - DNA, 20 bp, Artificial Sequence
  chemically synthesized
ttttatcttcccatttttct

SEQ ID NO: 368685 - DNA, 20 bp, Artificial Sequence
  chemically synthesized
catactgtcctaagaaaaat

SEQ ID NO: 368686 - DNA, 20 bp, Artificial Sequence
  chemically synthesized
actgtcctaagaaaaatggg

SEQ ID NO: 368687 - DNA, 20 bp, Artificial Sequence
  chemically synthesized
taagaaaaatgggaagataa

SEQ ID NO: 368688 - DNA, 20 bp, Artificial Sequence
  chemically synthesized
aaaagctgtgaaaacagtgg

SEQ ID NO: 368689 - DNA, 20 bp, Artificial Sequence
  chemically synthesized
tacaaaagctgtgaaaacag

SEQ ID NO: 368690 - DNA, 20 bp, Artificial Sequence
  chemically synthesized
acatactgccactgttttca

SEQ ID NO: 368691 - DNA, 20 bp, Artificial Sequence
  chemically synthesized
tattacaaaagctgtgaaaa

SEQ ID NO: 368692 - DNA, 20 bp, Artificial Sequence
  chemically synthesized
tgttttcacagcttttgtaa

SEQ ID NO: 368693 - DNA, 20 bp, Artificial Sequence
  chemically synthesized
tccttcctaggctattacaa

SEQ ID NO: 368694 - DNA, 20 bp, Artificial Sequence
  chemically synthesized
tcacagcttttgtaatagcc

SEQ ID NO: 368695 - DNA, 20 bp, Artificial Sequence
  chemically synthesized
cacagcttttgtaatagcct

SEQ ID NO: 368696 - DNA, 20 bp, Artificial Sequence
  chemically synthesized
agcttttgtaatagcctagg

SEQ ID NO: 368697 - DNA, 20 bp, Artificial Sequence
  chemically synthesized
gcttttgtaatagcctagga

SEQ ID NO: 368698 - DNA, 20 bp, Artificial Sequence
  chemically synthesized
taaatgtatatttccttcct

SEQ ID NO: 368699 - DNA, 20 bp, Artificial Sequence
  chemically synthesized
ttaaatgtatatttccttcc

SEQ ID NO: 368700 - DNA, 20 bp, Artificial Sequence
  chemically synthesized
taggaaggaaatatacattt

SEQ ID NO: 368701 - DNA, 20 bp, Artificial Sequence
  chemically synthesized
catttaagcgaatataatta

SEQ ID NO: 368702 - DNA, 20 bp, Artificial Sequence
  chemically synthesized
aagcgaatataattatagca

SEQ ID NO: 368703 - DNA, 20 bp, Artificial Sequence
  chemically synthesized
tggtgttataatcctattaa

SEQ ID NO: 368704 - DNA, 20 bp, Artificial Sequence
  chemically synthesized
acaaaaaaatcactattaat

SEQ ID NO: 368705 - DNA, 20 bp, Artificial Sequence
  chemically synthesized
gacaaaaaaatcactattaa

SEQ ID NO: 368706 - DNA, 20 bp, Artificial Sequence
  chemically synthesized
aatagtgatttttttgtcgt

SEQ ID NO: 368707 - DNA, 20 bp, Artificial Sequence
  chemically synthesized
tgatttttttgtcgtaagta

SEQ ID NO: 368708 - DNA, 20 bp, Artificial Sequence
  chemically synthesized
ttttgtcgtaagtatggtgc

SEQ ID NO: 368709 - DNA, 20 bp, Artificial Sequence
  chemically synthesized
aagatatcttttatttgtgc

SEQ ID NO: 368710 - DNA, 20 bp, Artificial Sequence
  chemically synthesized
tatggtgctggcacaaataa

SEQ ID NO: 368711 - DNA, 20 bp, Artificial Sequence
  chemically synthesized
caaataaaagatatcttcac

SEQ ID NO: 368712 - DNA, 20 bp, Artificial Sequence
  chemically synthesized
aataaaagatatcttcactg

SEQ ID NO: 368713 - DNA, 20 bp, Artificial Sequence
  chemically synthesized
taaaagatatcttcactgga

SEQ ID NO: 368714 - DNA, 20 bp, Artificial Sequence
  chemically synthesized
ctctgttgttctctccagtg

SEQ ID NO: 368715 - DNA, 20 bp, Artificial Sequence
  chemically synthesized
tttcactctgttgttctctc

SEQ ID NO: 368716 - DNA, 20 bp, Artificial Sequence
  chemically synthesized
atcttcactggagagaacaa

SEQ ID NO: 368717 - DNA, 20 bp, Artificial Sequence
  chemically synthesized
cttcactggagagaacaaca

SEQ ID NO: 368718 - DNA, 20 bp, Artificial Sequence
  chemically synthesized
acagagtgaaaatccctgaa

SEQ ID NO: 368719 - DNA, 20 bp, Artificial Sequence
  chemically synthesized
aaccttgtatattctattca

SEQ ID NO: 368720 - DNA, 20 bp, Artificial Sequence
  chemically synthesized
caaccttgtatattctattc

SEQ ID NO: 368721 - DNA, 20 bp, Artificial Sequence
  chemically synthesized
tcaaccttgtatattctatt

SEQ ID NO: 368722 - DNA, 20 bp, Artificial Sequence
  chemically synthesized
aatccctgaatagaatatac

SEQ ID NO: 368723 - DNA, 20 bp, Artificial Sequence
  chemically synthesized
atccctgaatagaatataca

SEQ ID NO: 368724 - DNA, 20 bp, Artificial Sequence
  chemically synthesized
atagaatatacaaggttgaa

SEQ ID NO: 368725 - DNA, 20 bp, Artificial Sequence
  chemically synthesized
tagaatatacaaggttgaac

SEQ ID NO: 368726 - DNA, 20 bp, Artificial Sequence
  chemically synthesized
aaggttgaacaggttatcaa

SEQ ID NO: 368727 - DNA, 20 bp, Artificial Sequence
  chemically synthesized
aggttgaacaggttatcaac

SEQ ID NO: 368728 - DNA, 20 bp, Artificial Sequence
  chemically synthesized
ttgaacaggttatcaacagg

SEQ ID NO: 368729 - DNA, 20 bp, Artificial Sequence
  chemically synthesized
aacaggttatcaacaggtag

SEQ ID NO: 368730 - DNA, 20 bp, Artificial Sequence
  chemically synthesized
tatcaacaggtagaagtgta

SEQ ID NO: 368731 - DNA, 20 bp, Artificial Sequence
  chemically synthesized
atcaacaggtagaagtgtaa

SEQ ID NO: 368732 - DNA, 20 bp, Artificial Sequence
  chemically synthesized
tcaacaggtagaagtgtaaa

SEQ ID NO: 368733 - DNA, 20 bp, Artificial Sequence
  chemically synthesized
acaggtagaagtgtaaaggg

SEQ ID NO: 368734 - DNA, 20 bp, Artificial Sequence
  chemically synthesized
agaagtgtaaagggaagata

SEQ ID NO: 368735 - DNA, 20 bp, Artificial Sequence
  chemically synthesized
tgtaaagggaagataaagtc

SEQ ID NO: 368736 - DNA, 20 bp, Artificial Sequence
  chemically synthesized
aaagggaagataaagtcaag

SEQ ID NO: 368737 - DNA, 20 bp, Artificial Sequence
  chemically synthesized
agggaagataaagtcaagca

SEQ ID NO: 368738 - DNA, 20 bp, Artificial Sequence
  chemically synthesized
gggaagataaagtcaagcag

SEQ ID NO: 368739 - DNA, 20 bp, Artificial Sequence
  chemically synthesized
catctgatccttagcatgtg

SEQ ID NO: 368740 - DNA, 20 bp, Artificial Sequence
  chemically synthesized
cagaggaaacttcacatgct

SEQ ID NO: 368741 - DNA, 20 bp, Artificial Sequence
  chemically synthesized
agaggaaacttcacatgcta

SEQ ID NO: 368742 - DNA, 20 bp, Artificial Sequence
  chemically synthesized
aaacttcacatgctaaggat

SEQ ID NO: 368743 - DNA, 20 bp, Artificial Sequence
  chemically synthesized
cgtctatttcatctgatcct

SEQ ID NO: 368744 - DNA, 20 bp, Artificial Sequence
  chemically synthesized
atgctaaggatcagatgaaa

SEQ ID NO: 368745 - DNA, 20 bp, Artificial Sequence
  chemically synthesized
atgaaatagacgcactgttc

SEQ ID NO: 368746 - DNA, 20 bp, Artificial Sequence
  chemically synthesized
tgaaatagacgcactgttca

SEQ ID NO: 368747 - DNA, 20 bp, Artificial Sequence
  chemically synthesized
gtggcttatagttccttgaa

SEQ ID NO: 368748 - DNA, 20 bp, Artificial Sequence
  chemically synthesized
cgcactgttcaaggaactat

SEQ ID NO: 368749 - DNA, 20 bp, Artificial Sequence
  chemically synthesized
acgttccaagaagtggctta

SEQ ID NO: 368750 - DNA, 20 bp, Artificial Sequence
  chemically synthesized
aggaactataagccacttct

SEQ ID NO: 368751 - DNA, 20 bp, Artificial Sequence
  chemically synthesized
tccacttacgttccaagaag

SEQ ID NO: 368752 - DNA, 20 bp, Artificial Sequence
  chemically synthesized
ccgtccacttacgttccaag

SEQ ID NO: 368753 - DNA, 20 bp, Artificial Sequence
  chemically synthesized
taagccacttcttggaacgt

SEQ ID NO: 368754 - DNA, 20 bp, Artificial Sequence
  chemically synthesized
catccgtccacttacgttcc

SEQ ID NO: 368755 - DNA, 20 bp, Artificial Sequence
  chemically synthesized
gccacttcttggaacgtaag

SEQ ID NO: 368756 - DNA, 20 bp, Artificial Sequence
  chemically synthesized
cttcttggaacgtaagtgga

SEQ ID NO: 368757 - DNA, 20 bp, Artificial Sequence
  chemically synthesized
ttggaacgtaagtggacgga

SEQ ID NO: 368758 - DNA, 20 bp, Artificial Sequence
  chemically synthesized
taagtggacggatggaacat

SEQ ID NO: 368759 - DNA, 20 bp, Artificial Sequence
  chemically synthesized
ggacggatggaacatgagac

SEQ ID NO: 368760 - DNA, 20 bp, Artificial Sequence
  chemically synthesized
acggatggaacatgagacta

SEQ ID NO: 368761 - DNA, 20 bp, Artificial Sequence
  chemically synthesized
ggatggaacatgagactaga

SEQ ID NO: 368762 - DNA, 20 bp, Artificial Sequence
  chemically synthesized
gatggaacatgagactagag

SEQ ID NO: 368763 - DNA, 20 bp, Artificial Sequence
  chemically synthesized
tggggtgtcttgtacctctc

SEQ ID NO: 368764 - DNA, 20 bp, Artificial Sequence
  chemically synthesized
acatgagactagagaggtac

SEQ ID NO: 368765 - DNA, 20 bp, Artificial Sequence
  chemically synthesized
aggtacaagacaccccatcc

SEQ ID NO: 368766 - DNA, 20 bp, Artificial Sequence
  chemically synthesized
caagtcggtacactcggatg

SEQ ID NO: 368767 - DNA, 20 bp, Artificial Sequence
  chemically synthesized
tcaagtcggtacactcggat

SEQ ID NO: 368768 - DNA, 20 bp, Artificial Sequence
  chemically synthesized
atcaagtcggtacactcgga

SEQ ID NO: 368769 - DNA, 20 bp, Artificial Sequence
  chemically synthesized
gttaatcaagtcggtacact

SEQ ID NO: 368770 - DNA, 20 bp, Artificial Sequence
  chemically synthesized
ctttgggtggttaatcaagt

SEQ ID NO: 368771 - DNA, 20 bp, Artificial Sequence
  chemically synthesized
gcagctttgggtggttaatc

SEQ ID NO: 368772 - DNA, 20 bp, Artificial Sequence
  chemically synthesized
ccgacttgattaaccaccca

SEQ ID NO: 368773 - DNA, 20 bp, Artificial Sequence
  chemically synthesized
tttgcctaagcagctttggg

SEQ ID NO: 368774 - DNA, 20 bp, Artificial Sequence
  chemically synthesized
acatttgcctaagcagcttt

SEQ ID NO: 368775 - DNA, 20 bp, Artificial Sequence
  chemically synthesized
gacatttgcctaagcagctt

SEQ ID NO: 368776 - DNA, 20 bp, Artificial Sequence
  chemically synthesized
attaaccacccaaagctgct

SEQ ID NO: 368777 - DNA, 20 bp, Artificial Sequence
  chemically synthesized
ttaaccacccaaagctgctt

SEQ ID NO: 368778 - DNA, 20 bp, Artificial Sequence
  chemically synthesized
caagcagacatttgcctaag

SEQ ID NO: 368779 - DNA, 20 bp, Artificial Sequence
  chemically synthesized
agacaagcagacatttgcct

SEQ ID NO: 368780 - DNA, 20 bp, Artificial Sequence
  chemically synthesized
gggtgaaaagaaaagacaag

SEQ ID NO: 368781 - DNA, 20 bp, Artificial Sequence
  chemically synthesized
aaagggtgaaaagaaaagac

SEQ ID NO: 368782 - DNA, 20 bp, Artificial Sequence
  chemically synthesized
gtttgaaagggtgaaaagaa

SEQ ID NO: 368783 - DNA, 20 bp, Artificial Sequence
  chemically synthesized
gttatgtttgaaagggtgaa

SEQ ID NO: 368784 - DNA, 20 bp, Artificial Sequence
  chemically synthesized
aaaattagttatgtttgaaa

SEQ ID NO: 368785 - DNA, 20 bp, Artificial Sequence
  chemically synthesized
caaaattagttatgtttgaa

SEQ ID NO: 368786 - DNA, 20 bp, Artificial Sequence
  chemically synthesized
tcaaaattagttatgtttga

SEQ ID NO: 368787 - DNA, 20 bp, Artificial Sequence
  chemically synthesized
tttcaaacataactaatttt

SEQ ID NO: 368788 - DNA, 20 bp, Artificial Sequence
  chemically synthesized
tggtaagagcttctcaaaat

SEQ ID NO: 368789 - DNA, 20 bp, Artificial Sequence
  chemically synthesized
caaacataactaattttgag

SEQ ID NO: 368790 - DNA, 20 bp, Artificial Sequence
  chemically synthesized
aaaaatgcaaaacatggtaa

SEQ ID NO: 368791 - DNA, 20 bp, Artificial Sequence
  chemically synthesized
taaaaaatgcaaaacatggt

SEQ ID NO: 368792 - DNA, 20 bp, Artificial Sequence
  chemically synthesized
gaattaaaaaatgcaaaaca

SEQ ID NO: 368793 - DNA, 20 bp, Artificial Sequence
  chemically synthesized
acaatactatgttaaagtgt

SEQ ID NO: 368794 - DNA, 20 bp, Artificial Sequence
  chemically synthesized
ttttgactgacactttaaca

SEQ ID NO: 368795 - DNA, 20 bp, Artificial Sequence
  chemically synthesized
tcctaaacaatactatgtta

SEQ ID NO: 368796 - DNA, 20 bp, Artificial Sequence
  chemically synthesized
cactttaacatagtattgtt

SEQ ID NO: 368797 - DNA, 20 bp, Artificial Sequence
  chemically synthesized
actttaacatagtattgttt

SEQ ID NO: 368798 - DNA, 20 bp, Artificial Sequence
  chemically synthesized
tgtttaggaaaaaccaatat

SEQ ID NO: 368799 - DNA, 20 bp, Artificial Sequence
  chemically synthesized
ttggtaaacagtgccaatat

SEQ ID NO: 368800 - DNA, 20 bp, Artificial Sequence
  chemically synthesized
gcatgcaaataattggtaaa

SEQ ID NO: 368801 - DNA, 20 bp, Artificial Sequence
  chemically synthesized
tatttttgcatgcaaataat

SEQ ID NO: 368802 - DNA, 20 bp, Artificial Sequence
  chemically synthesized
tatttgcatgcaaaaatatt

SEQ ID NO: 368803 - DNA, 20 bp, Artificial Sequence
  chemically synthesized
tgcatgcaaaaatatttggc

SEQ ID NO: 368804 - DNA, 20 bp, Artificial Sequence
  chemically synthesized
gcatgcaaaaatatttggca

SEQ ID NO: 368805 - DNA, 20 bp, Artificial Sequence
  chemically synthesized
tgcaaaaatatttggcaagg

SEQ ID NO: 368806 - DNA, 20 bp, Artificial Sequence
  chemically synthesized
ggcaaggaagccatactgtc

SEQ ID NO: 368807 - DNA, 20 bp, Artificial Sequence
  chemically synthesized
gcagttgctcctggacagta

SEQ ID NO: 368808 - DNA, 20 bp, Artificial Sequence
  chemically synthesized
gcaaggaagccatactgtcc

SEQ ID NO: 368809 - DNA, 20 bp, Artificial Sequence
  chemically synthesized
aaggaagccatactgtccag

SEQ ID NO: 368810 - DNA, 20 bp, Artificial Sequence
  chemically synthesized
ttacagcagttgctcctgga

SEQ ID NO: 368811 - DNA, 20 bp, Artificial Sequence
  chemically synthesized
ccatttacagcagttgctcc

SEQ ID NO: 368812 - DNA, 20 bp, Artificial Sequence
  chemically synthesized
ccaggagcaactgctgtaaa

SEQ ID NO: 368813 - DNA, 20 bp, Artificial Sequence
  chemically synthesized
agttaacttaccatttacag

SEQ ID NO: 368814 - DNA, 20 bp, Artificial Sequence
  chemically synthesized
tgtagttaacttaccattta

SEQ ID NO: 368815 - DNA, 20 bp, Artificial Sequence
  chemically synthesized
gagcaactgctgtaaatggt

SEQ ID NO: 368816 - DNA, 20 bp, Artificial Sequence
  chemically synthesized
tggtaagttaactacaaaat

SEQ ID NO: 368817 - DNA, 20 bp, Artificial Sequence
  chemically synthesized
ggtaagttaactacaaaatt

SEQ ID NO: 368818 - DNA, 20 bp, Artificial Sequence
  chemically synthesized
aaatactaggcccaattttg

SEQ ID NO: 368819 - DNA, 20 bp, Artificial Sequence
  chemically synthesized
gttaactacaaaattgggcc

SEQ ID NO: 368820 - DNA, 20 bp, Artificial Sequence
  chemically synthesized
tcaggaaaggatgaaatact

SEQ ID NO: 368821 - DNA, 20 bp, Artificial Sequence
  chemically synthesized
ttcaggaaaggatgaaatac

SEQ ID NO: 368822 - DNA, 20 bp, Artificial Sequence
  chemically synthesized
aaagggtatggattcaggaa

SEQ ID NO: 368823 - DNA, 20 bp, Artificial Sequence
  chemically synthesized
caaagggtatggattcagga

SEQ ID NO: 368824 - DNA, 20 bp, Artificial Sequence
  chemically synthesized
attgcaaagggtatggattc

SEQ ID NO: 368825 - DNA, 20 bp, Artificial Sequence
  chemically synthesized
cattgcaaagggtatggatt

SEQ ID NO: 368826 - DNA, 20 bp, Artificial Sequence
  chemically synthesized
atgctacattgcaaagggta

SEQ ID NO: 368827 - DNA, 20 bp, Artificial Sequence
  chemically synthesized
cagcaatgctacattgcaaa

SEQ ID NO: 368828 - DNA, 20 bp, Artificial Sequence
  chemically synthesized
acagcaatgctacattgcaa

SEQ ID NO: 368829 - DNA, 20 bp, Artificial Sequence
  chemically synthesized
aatccataccctttgcaatg

SEQ ID NO: 368830 - DNA, 20 bp, Artificial Sequence
  chemically synthesized
aacagcaatgctacattgca

SEQ ID NO: 368831 - DNA, 20 bp, Artificial Sequence
  chemically synthesized
ccaacttttcatgagaagaa

SEQ ID NO: 368832 - DNA, 20 bp, Artificial Sequence
  chemically synthesized
agataccaacttttcatgag

SEQ ID NO: 368833 - DNA, 20 bp, Artificial Sequence
  chemically synthesized
attgctgttcttctcatgaa

SEQ ID NO: 368834 - DNA, 20 bp, Artificial Sequence
  chemically synthesized
aatagataccaacttttcat

SEQ ID NO: 368835 - DNA, 20 bp, Artificial Sequence
  chemically synthesized
ctgttcttctcatgaaaagt

SEQ ID NO: 368836 - DNA, 20 bp, Artificial Sequence
  chemically synthesized
agatttaagaagcagggaaa

SEQ ID NO: 368837 - DNA, 20 bp, Artificial Sequence
  chemically synthesized
caacccagatttaagaagca

SEQ ID NO: 368838 - DNA, 20 bp, Artificial Sequence
  chemically synthesized
ccaacccagatttaagaagc

SEQ ID NO: 368839 - DNA, 20 bp, Artificial Sequence
  chemically synthesized
gccaacccagatttaagaag

SEQ ID NO: 368840 - DNA, 20 bp, Artificial Sequence
  chemically synthesized
aatgccaacccagatttaag

SEQ ID NO: 368841 - DNA, 20 bp, Artificial Sequence
  chemically synthesized
atttccctgcttcttaaatc

SEQ ID NO: 368842 - DNA, 20 bp, Artificial Sequence
  chemically synthesized
tttccctgcttcttaaatct

SEQ ID NO: 368843 - DNA, 20 bp, Artificial Sequence
  chemically synthesized
tcaaatgccaacccagattt

SEQ ID NO: 368844 - DNA, 20 bp, Artificial Sequence
  chemically synthesized
cctgcttcttaaatctgggt

SEQ ID NO: 368845 - DNA, 20 bp, Artificial Sequence
  chemically synthesized
aaatgagtcaaatgccaacc

SEQ ID NO: 368846 - DNA, 20 bp, Artificial Sequence
  chemically synthesized
tgcactctgttggtcaaaat

SEQ ID NO: 368847 - DNA, 20 bp, Artificial Sequence
  chemically synthesized
atttgactcattttgaccaa

SEQ ID NO: 368848 - DNA, 20 bp, Artificial Sequence
  chemically synthesized
ttgactcattttgaccaaca

SEQ ID NO: 368849 - DNA, 20 bp, Artificial Sequence
  chemically synthesized
gcacttcaattgcactctgt

SEQ ID NO: 368850 - DNA, 20 bp, Artificial Sequence
  chemically synthesized
tgaccaacagagtgcaattg

SEQ ID NO: 368851 - DNA, 20 bp, Artificial Sequence
  chemically synthesized
acagagtgcaattgaagtgc

SEQ ID NO: 368852 - DNA, 20 bp, Artificial Sequence
  chemically synthesized
acatttgggagaggaaatgc

SEQ ID NO: 368853 - DNA, 20 bp, Artificial Sequence
  chemically synthesized
ttgaggtctacatttgggag

SEQ ID NO: 368854 - DNA, 20 bp, Artificial Sequence
  chemically synthesized
tttgaggtctacatttggga

SEQ ID NO: 368855 - DNA, 20 bp, Artificial Sequence
  chemically synthesized
ggcatttcctctcccaaatg

SEQ ID NO: 368856 - DNA, 20 bp, Artificial Sequence
  chemically synthesized
cttttgaggtctacatttgg

SEQ ID NO: 368857 - DNA, 20 bp, Artificial Sequence
  chemically synthesized
cccttttgaggtctacattt

SEQ ID NO: 368858 - DNA, 20 bp, Artificial Sequence
  chemically synthesized
gcccttttgaggtctacatt

SEQ ID NO: 368859 - DNA, 20 bp, Artificial Sequence
  chemically synthesized
ctcccaaatgtagacctcaa

SEQ ID NO: 368860 - DNA, 20 bp, Artificial Sequence
  chemically synthesized
tcccaaatgtagacctcaaa

SEQ ID NO: 368861 - DNA, 20 bp, Artificial Sequence
  chemically synthesized
cccaaatgtagacctcaaaa

SEQ ID NO: 368862 - DNA, 20 bp, Artificial Sequence
  chemically synthesized
aaagtgttcaagcccttttg

SEQ ID NO: 368863 - DNA, 20 bp, Artificial Sequence
  chemically synthesized
aaaagtgttcaagccctttt

SEQ ID NO: 368864 - DNA, 20 bp, Artificial Sequence
  chemically synthesized
acaagagagcaaaagtgttc

SEQ ID NO: 368865 - DNA, 20 bp, Artificial Sequence
  chemically synthesized
aggcatgaacaagagagcaa

SEQ ID NO: 368866 - DNA, 20 bp, Artificial Sequence
  chemically synthesized
atgcagaggcatgaacaaga

SEQ ID NO: 368867 - DNA, 20 bp, Artificial Sequence
  chemically synthesized
aaatgcagaggcatgaacaa

SEQ ID NO: 368868 - DNA, 20 bp, Artificial Sequence
  chemically synthesized
gtaaatgcagaggcatgaac

SEQ ID NO: 368869 - DNA, 20 bp, Artificial Sequence
  chemically synthesized
tgctcttacggtaaatgcag

SEQ ID NO: 368870 - DNA, 20 bp, Artificial Sequence
  chemically synthesized
gtgctcttacggtaaatgca

SEQ ID NO: 368871 - DNA, 20 bp, Artificial Sequence
  chemically synthesized
atgtgctcttacggtaaatg

SEQ ID NO: 368872 - DNA, 20 bp, Artificial Sequence
  chemically synthesized
catgcctctgcatttaccgt

SEQ ID NO: 368873 - DNA, 20 bp, Artificial Sequence
  chemically synthesized
tgcctctgcatttaccgtaa

SEQ ID NO: 368874 - DNA, 20 bp, Artificial Sequence
  chemically synthesized
ctagctctgatgtgctctta

SEQ ID NO: 368875 - DNA, 20 bp, Artificial Sequence
  chemically synthesized
catttaccgtaagagcacat

SEQ ID NO: 368876 - DNA, 20 bp, Artificial Sequence
  chemically synthesized
tttaccgtaagagcacatca

SEQ ID NO: 368877 - DNA, 20 bp, Artificial Sequence
  chemically synthesized
ccgtaagagcacatcagagc

SEQ ID NO: 368878 - DNA, 20 bp, Artificial Sequence
  chemically synthesized
aagagcacatcagagctaga

SEQ ID NO: 368879 - DNA, 20 bp, Artificial Sequence
  chemically synthesized
agcacatcagagctagacag

SEQ ID NO: 368880 - DNA, 20 bp, Artificial Sequence
  chemically synthesized
gcacatcagagctagacagc

SEQ ID NO: 368881 - DNA, 20 bp, Artificial Sequence
  chemically synthesized
tgtctcatcctcctgctgtc

SEQ ID NO: 368882 - DNA, 20 bp, Artificial Sequence
  chemically synthesized
acatcagagctagacagcag

SEQ ID NO: 368883 - DNA, 20 bp, Artificial Sequence
  chemically synthesized
catcagagctagacagcagg

SEQ ID NO: 368884 - DNA, 20 bp, Artificial Sequence
  chemically synthesized
gagctagacagcaggaggat

SEQ ID NO: 368885 - DNA, 20 bp, Artificial Sequence
  chemically synthesized
agacagcaggaggatgagac

SEQ ID NO: 368886 - DNA, 20 bp, Artificial Sequence
  chemically synthesized
cagcaggaggatgagacaag

SEQ ID NO: 368887 - DNA, 20 bp, Artificial Sequence
  chemically synthesized
aggatgagacaagtggaacc

SEQ ID NO: 368888 - DNA, 20 bp, Artificial Sequence
  chemically synthesized
gagacaagtggaaccgagtc

SEQ ID NO: 368889 - DNA, 20 bp, Artificial Sequence
  chemically synthesized
acaactagggcaacttgact

SEQ ID NO: 368890 - DNA, 20 bp, Artificial Sequence
  chemically synthesized
ggaaccgagtcaagttgccc

SEQ ID NO: 368891 - DNA, 20 bp, Artificial Sequence
  chemically synthesized
aacttcatctgggacaacta

SEQ ID NO: 368892 - DNA, 20 bp, Artificial Sequence
  chemically synthesized
aaacttcatctgggacaact

SEQ ID NO: 368893 - DNA, 20 bp, Artificial Sequence
  chemically synthesized
tcaagttgccctagttgtcc

SEQ ID NO: 368894 - DNA, 20 bp, Artificial Sequence
  chemically synthesized
aaaacttcatctgggacaac

SEQ ID NO: 368895 - DNA, 20 bp, Artificial Sequence
  chemically synthesized
tgccctagttgtcccagatg

SEQ ID NO: 368896 - DNA, 20 bp, Artificial Sequence
  chemically synthesized
agtctgggaaaacttcatct

SEQ ID NO: 368897 - DNA, 20 bp, Artificial Sequence
  chemically synthesized
tagtctgggaaaacttcatc

SEQ ID NO: 368898 - DNA, 20 bp, Artificial Sequence
  chemically synthesized
tgtcccagatgaagttttcc

SEQ ID NO: 368899 - DNA, 20 bp, Artificial Sequence
  chemically synthesized
cagatgaagttttcccagac

SEQ ID NO: 368900 - DNA, 20 bp, Artificial Sequence
  chemically synthesized
atgaagttttcccagactag

SEQ ID NO: 368901 - DNA, 20 bp, Artificial Sequence
  chemically synthesized
gtctggctgtctgctagtct

SEQ ID NO: 368902 - DNA, 20 bp, Artificial Sequence
  chemically synthesized
tgtctggctgtctgctagtc

SEQ ID NO: 368903 - DNA, 20 bp, Artificial Sequence
  chemically synthesized
agttttcccagactagcaga

SEQ ID NO: 368904 - DNA, 20 bp, Artificial Sequence
  chemically synthesized
cgaaatgtctggctgtctgc

SEQ ID NO: 368905 - DNA, 20 bp, Artificial Sequence
  chemically synthesized
ttcccagactagcagacagc

SEQ ID NO: 368906 - DNA, 20 bp, Artificial Sequence
  chemically synthesized
gctcagctctgcgaaatgtc

SEQ ID NO: 368907 - DNA, 20 bp, Artificial Sequence
  chemically synthesized
gcagacagccagacatttcg

SEQ ID NO: 368908 - DNA, 20 bp, Artificial Sequence
  chemically synthesized
agacagccagacatttcgca

SEQ ID NO: 368909 - DNA, 20 bp, Artificial Sequence
  chemically synthesized
gccagacatttcgcagagct

SEQ ID NO: 368910 - DNA, 20 bp, Artificial Sequence
  chemically synthesized
acatttcgcagagctgagct

SEQ ID NO: 368911 - DNA, 20 bp, Artificial Sequence
  chemically synthesized
gggctttgctgatctcagct

SEQ ID NO: 368912 - DNA, 20 bp, Artificial Sequence
  chemically synthesized
tcgcagagctgagctgagat

SEQ ID NO: 368913 - DNA, 20 bp, Artificial Sequence
  chemically synthesized
ctaaggggctttgctgatct

SEQ ID NO: 368914 - DNA, 20 bp, Artificial Sequence
  chemically synthesized
gagctgagctgagatcagca

SEQ ID NO: 368915 - DNA, 20 bp, Artificial Sequence
  chemically synthesized
ctgagatcagcaaagcccct

SEQ ID NO: 368916 - DNA, 20 bp, Artificial Sequence
  chemically synthesized
ttagctgggggttggctaag

SEQ ID NO: 368917 - DNA, 20 bp, Artificial Sequence
  chemically synthesized
gttagctgggggttggctaa

SEQ ID NO: 368918 - DNA, 20 bp, Artificial Sequence
  chemically synthesized
agttagctgggggttggcta

SEQ ID NO: 368919 - DNA, 20 bp, Artificial Sequence
  chemically synthesized
tagttagctgggggttggct

SEQ ID NO: 368920 - DNA, 20 bp, Artificial Sequence
  chemically synthesized
aaagccccttagccaacccc

SEQ ID NO: 368921 - DNA, 20 bp, Artificial Sequence
  chemically synthesized
gtctctagttagctgggggt

SEQ ID NO: 368922 - DNA, 20 bp, Artificial Sequence
  chemically synthesized
gtgtgtctctagttagctgg

SEQ ID NO: 368923 - DNA, 20 bp, Artificial Sequence
  chemically synthesized
cgtgtgtctctagttagctg

SEQ ID NO: 368924 - DNA, 20 bp, Artificial Sequence
  chemically synthesized
ttagccaacccccagctaac

SEQ ID NO: 368925 - DNA, 20 bp, Artificial Sequence
  chemically synthesized
tcgtgtgtctctagttagct

SEQ ID NO: 368926 - DNA, 20 bp, Artificial Sequence
  chemically synthesized
ctcgtgtgtctctagttagc

SEQ ID NO: 368927 - DNA, 20 bp, Artificial Sequence
  chemically synthesized
agccaacccccagctaacta

SEQ ID NO: 368928 - DNA, 20 bp, Artificial Sequence
  chemically synthesized
attactcgtgtgtctctagt

SEQ ID NO: 368929 - DNA, 20 bp, Artificial Sequence
  chemically synthesized
taggattactcgtgtgtctc

SEQ ID NO: 368930 - DNA, 20 bp, Artificial Sequence
  chemically synthesized
ccagctaactagagacacac

SEQ ID NO: 368931 - DNA, 20 bp, Artificial Sequence
  chemically synthesized
tagagacacacgagtaatcc

SEQ ID NO: 368932 - DNA, 20 bp, Artificial Sequence
  chemically synthesized
agacacacgagtaatcctag

SEQ ID NO: 368933 - DNA, 20 bp, Artificial Sequence
  chemically synthesized
acacgagtaatcctagcagt

SEQ ID NO: 368934 - DNA, 20 bp, Artificial Sequence
  chemically synthesized
cacgagtaatcctagcagta

SEQ ID NO: 368935 - DNA, 20 bp, Artificial Sequence
  chemically synthesized
aagttcttcaccttactgct

SEQ ID NO: 368936 - DNA, 20 bp, Artificial Sequence
  chemically synthesized
gaagttcttcaccttactgc

SEQ ID NO: 368937 - DNA, 20 bp, Artificial Sequence
  chemically synthesized
gtaatcctagcagtaaggtg

SEQ ID NO: 368938 - DNA, 20 bp, Artificial Sequence
  chemically synthesized
cagtaaggtgaagaacttcc

SEQ ID NO: 368939 - DNA, 20 bp, Artificial Sequence
  chemically synthesized
aaatacatatgttagccagg

SEQ ID NO: 368940 - DNA, 20 bp, Artificial Sequence
  chemically synthesized
ttcaaatacatatgttagcc

SEQ ID NO: 368941 - DNA, 20 bp, Artificial Sequence
  chemically synthesized
tttcaaatacatatgttagc

SEQ ID NO: 368942 - DNA, 20 bp, Artificial Sequence
  chemically synthesized
actatttcaaatacatatgt

SEQ ID NO: 368943 - DNA, 20 bp, Artificial Sequence
  chemically synthesized
gctaacatatgtatttgaaa

SEQ ID NO: 368944 - DNA, 20 bp, Artificial Sequence
  chemically synthesized
atgtatttgaaatagtatgt

SEQ ID NO: 368945 - DNA, 20 bp, Artificial Sequence
  chemically synthesized
gttggttgttttaacctact

SEQ ID NO: 368946 - DNA, 20 bp, Artificial Sequence
  chemically synthesized
aagccaccttgaaactcagt

SEQ ID NO: 368947 - DNA, 20 bp, Artificial Sequence
  chemically synthesized
taagccaccttgaaactcag

SEQ ID NO: 368948 - DNA, 20 bp, Artificial Sequence
  chemically synthesized
gttttaacctactgagtttc

SEQ ID NO: 368949 - DNA, 20 bp, Artificial Sequence
  chemically synthesized
ttttaacctactgagtttca

SEQ ID NO: 368950 - DNA, 20 bp, Artificial Sequence
  chemically synthesized
taataagccaccttgaaact

SEQ ID NO: 368951 - DNA, 20 bp, Artificial Sequence
  chemically synthesized
taacctactgagtttcaagg

SEQ ID NO: 368952 - DNA, 20 bp, Artificial Sequence
  chemically synthesized
tttcaaggtggcttattaca

SEQ ID NO: 368953 - DNA, 20 bp, Artificial Sequence
  chemically synthesized
attagctattgctgtgtaat

SEQ ID NO: 368954 - DNA, 20 bp, Artificial Sequence
  chemically synthesized
ggtggcttattacacagcaa

SEQ ID NO: 368955 - DNA, 20 bp, Artificial Sequence
  chemically synthesized
tcatatgtatgtacacatat

SEQ ID NO: 368956 - DNA, 20 bp, Artificial Sequence
  chemically synthesized
tatgaatatttgtttctaca

SEQ ID NO: 368957 - DNA, 20 bp, Artificial Sequence
  chemically synthesized
gaatatttgtttctacacag

SEQ ID NO: 368958 - DNA, 20 bp, Artificial Sequence
  chemically synthesized
tttttcagacatcttctgtg

SEQ ID NO: 368959 - DNA, 20 bp, Artificial Sequence
  chemically synthesized
cagaagatgtctgaaaaatt

SEQ ID NO: 368960 - DNA, 20 bp, Artificial Sequence
  chemically synthesized
tataatgtggcttaattttt

SEQ ID NO: 368961 - DNA, 20 bp, Artificial Sequence
  chemically synthesized
aaaaattaagccacattata

SEQ ID NO: 368962 - DNA, 20 bp, Artificial Sequence
  chemically synthesized
ttataaatatctttataatg

SEQ ID NO: 368963 - DNA, 20 bp, Artificial Sequence
  chemically synthesized
tatttataaaatatttttaa

SEQ ID NO: 368964 - DNA, 20 bp, Artificial Sequence
  chemically synthesized
tttataaaatatttttaaaa

SEQ ID NO: 368965 - DNA, 20 bp, Artificial Sequence
  chemically synthesized
aaatatttttaaaagagccc

SEQ ID NO: 368966 - DNA, 20 bp, Artificial Sequence
  chemically synthesized
aatatttttaaaagagccct

SEQ ID NO: 368967 - DNA, 20 bp, Artificial Sequence
  chemically synthesized
tatttttaaaagagccctag

SEQ ID NO: 368968 - DNA, 20 bp, Artificial Sequence
  chemically synthesized
atttctcataaaaactccta

SEQ ID NO: 368969 - DNA, 20 bp, Artificial Sequence
  chemically synthesized
tatttctcataaaaactcct

SEQ ID NO: 368970 - DNA, 20 bp, Artificial Sequence
  chemically synthesized
atatttctcataaaaactcc

SEQ ID NO: 368971 - DNA, 20 bp, Artificial Sequence
  chemically synthesized
agagccctaggagtttttat

SEQ ID NO: 368972 - DNA, 20 bp, Artificial Sequence
  chemically synthesized
gagtttttatgagaaatatc

SEQ ID NO: 368973 - DNA, 20 bp, Artificial Sequence
  chemically synthesized
ttttatgagaaatatcaagc

SEQ ID NO: 368974 - DNA, 20 bp, Artificial Sequence
  chemically synthesized
ttcagcagtaaaataatttc

SEQ ID NO: 368975 - DNA, 20 bp, Artificial Sequence
  chemically synthesized
ttgcccatattcaatttcag

SEQ ID NO: 368976 - DNA, 20 bp, Artificial Sequence
  chemically synthesized
cttttgcccatattcaattt

SEQ ID NO: 368977 - DNA, 20 bp, Artificial Sequence
  chemically synthesized
tttactgctgaaattgaata

SEQ ID NO: 368978 - DNA, 20 bp, Artificial Sequence
  chemically synthesized
ttactgctgaaattgaatat

SEQ ID NO: 368979 - DNA, 20 bp, Artificial Sequence
  chemically synthesized
ctgaaattgaatatgggcaa

SEQ ID NO: 368980 - DNA, 20 bp, Artificial Sequence
  chemically synthesized
aattgaatatgggcaaaagt

SEQ ID NO: 368981 - DNA, 20 bp, Artificial Sequence
  chemically synthesized
tatgggcaaaagtcagtttc

SEQ ID NO: 368982 - DNA, 20 bp, Artificial Sequence
  chemically synthesized
tgggcaaaagtcagtttcta

SEQ ID NO: 368983 - DNA, 20 bp, Artificial Sequence
  chemically synthesized
tagcacatgagtcagatctc

SEQ ID NO: 368984 - DNA, 20 bp, Artificial Sequence
  chemically synthesized
ttttctaatagcacatgagt

SEQ ID NO: 368985 - DNA, 20 bp, Artificial Sequence
  chemically synthesized
gttcttttctaatagcacat

SEQ ID NO: 368986 - DNA, 20 bp, Artificial Sequence
  chemically synthesized
agatctgactcatgtgctat

SEQ ID NO: 368987 - DNA, 20 bp, Artificial Sequence
  chemically synthesized
tgactcatgtgctattagaa

SEQ ID NO: 368988 - DNA, 20 bp, Artificial Sequence
  chemically synthesized
atgactgtgttcttttctaa

SEQ ID NO: 368989 - DNA, 20 bp, Artificial Sequence
  chemically synthesized
tgtgctattagaaaagaaca

SEQ ID NO: 368990 - DNA, 20 bp, Artificial Sequence
  chemically synthesized
cacagtcattatattccatg

SEQ ID NO: 368991 - DNA, 20 bp, Artificial Sequence
  chemically synthesized
attgcattggaggaactgca

SEQ ID NO: 368992 - DNA, 20 bp, Artificial Sequence
  chemically synthesized
tttttgcaagattgcattgg

SEQ ID NO: 368993 - DNA, 20 bp, Artificial Sequence
  chemically synthesized
ttttttgcaagattgcattg

SEQ ID NO: 368994 - DNA, 20 bp, Artificial Sequence
  chemically synthesized
tcttttttgcaagattgcat

SEQ ID NO: 368995 - DNA, 20 bp, Artificial Sequence
  chemically synthesized
tccaatgcaatcttgcaaaa

SEQ ID NO: 368996 - DNA, 20 bp, Artificial Sequence
  chemically synthesized
cttcgttaattcttttttgc

SEQ ID NO: 368997 - DNA, 20 bp, Artificial Sequence
  chemically synthesized
cttgcaaaaaagaattaacg

SEQ ID NO: 368998 - DNA, 20 bp, Artificial Sequence
  chemically synthesized
aaaaagaattaacgaagcaa

SEQ ID NO: 368999 - DNA, 20 bp, Artificial Sequence
  chemically synthesized
taacgaagcaatagttttgt

SEQ ID NO: 369000 - DNA, 20 bp, Artificial Sequence
  chemically synthesized
caatagttttgtcagtttca

SEQ ID NO: 369001 - DNA, 20 bp, Artificial Sequence
  chemically synthesized
tcatagaaattttttaaata

SEQ ID NO: 369002 - DNA, 20 bp, Artificial Sequence
  chemically synthesized
gtgtgtgtatgtatatatta

SEQ ID NO: 369003 - DNA, 20 bp, Artificial Sequence
  chemically synthesized
agtgtgtgtatgtatatatt

SEQ ID NO: 369004 - DNA, 20 bp, Artificial Sequence
  chemically synthesized
tacatacacacacttttttt

SEQ ID NO: 369005 - DNA, 20 bp, Artificial Sequence
  chemically synthesized
acatacacacactttttttt

SEQ ID NO: 369006 - DNA, 20 bp, Artificial Sequence
  chemically synthesized
catacacacacttttttttg

SEQ ID NO: 369007 - DNA, 20 bp, Artificial Sequence
  chemically synthesized
ccccacccccccccaaaaaa

SEQ ID NO: 369008 - DNA, 20 bp, Artificial Sequence
  chemically synthesized
atacacacacttttttttgg

SEQ ID NO: 369009 - DNA, 20 bp, Artificial Sequence
  chemically synthesized
tacacacacttttttttggg

SEQ ID NO: 369010 - DNA, 20 bp, Artificial Sequence
  chemically synthesized
acacacacttttttttgggg

SEQ ID NO: 369011 - DNA, 20 bp, Artificial Sequence
  chemically synthesized
cacacacttttttttggggg

SEQ ID NO: 369012 - DNA, 20 bp, Artificial Sequence
  chemically synthesized
acacacttttttttgggggg

SEQ ID NO: 369013 - DNA, 20 bp, Artificial Sequence
  chemically synthesized
cacttttttttggggggggg

SEQ ID NO: 369014 - DNA, 20 bp, Artificial Sequence
  chemically synthesized
acttttttttgggggggggt

SEQ ID NO: 369015 - DNA, 20 bp, Artificial Sequence
  chemically synthesized
cttttttttgggggggggtg

SEQ ID NO: 369016 - DNA, 20 bp, Artificial Sequence
  chemically synthesized
ttttttttgggggggggtgg

SEQ ID NO: 369017 - DNA, 20 bp, Artificial Sequence
  chemically synthesized
tttttttgggggggggtggg

SEQ ID NO: 369018 - DNA, 20 bp, Artificial Sequence
  chemically synthesized
ttttttgggggggggtgggg

SEQ ID NO: 369019 - DNA, 20 bp, Artificial Sequence
  chemically synthesized
tttgggggggggtggggggg

SEQ ID NO: 369020 - DNA, 20 bp, Artificial Sequence
  chemically synthesized
ttgggggggggtgggggggt

SEQ ID NO: 369021 - DNA, 20 bp, Artificial Sequence
  chemically synthesized
tgggggggggtgggggggtg

SEQ ID NO: 369022 - DNA, 20 bp, Artificial Sequence
  chemically synthesized
gggggggggtgggggggtgg

SEQ ID NO: 369023 - DNA, 20 bp, Artificial Sequence
  chemically synthesized
ggggggggtgggggggtggg

SEQ ID NO: 369024 - DNA, 20 bp, Artificial Sequence
  chemically synthesized
gggggggtgggggggtgggg

SEQ ID NO: 369025 - DNA, 20 bp, Artificial Sequence
  chemically synthesized
ggggggtgggggggtggggg

SEQ ID NO: 369026 - DNA, 20 bp, Artificial Sequence
  chemically synthesized
gggggtgggggggtgggggg

SEQ ID NO: 369027 - DNA, 20 bp, Artificial Sequence
  chemically synthesized
ggggtgggggggtggggggg

SEQ ID NO: 369028 - DNA, 20 bp, Artificial Sequence
  chemically synthesized
gggtgggggggtgggggggg

SEQ ID NO: 369029 - DNA, 20 bp, Artificial Sequence
  chemically synthesized
ggtgggggggtggggggggg

SEQ ID NO: 369030 - DNA, 20 bp, Artificial Sequence
  chemically synthesized
ggggggtgggggggggggga

SEQ ID NO: 369031 - DNA, 20 bp, Artificial Sequence
  chemically synthesized
ggggtggggggggggggaca

SEQ ID NO: 369032 - DNA, 20 bp, Artificial Sequence
  chemically synthesized
cagagtttcactctttcgcc

SEQ ID NO: 369033 - DNA, 20 bp, Artificial Sequence
  chemically synthesized
gcgctgcaggctgggcgaaa

SEQ ID NO: 369034 - DNA, 20 bp, Artificial Sequence
  chemically synthesized
ctgcgctgcaggctgggcga

SEQ ID NO: 369035 - DNA, 20 bp, Artificial Sequence
  chemically synthesized
tcactctttcgcccagcctg

SEQ ID NO: 369036 - DNA, 20 bp, Artificial Sequence
  chemically synthesized
acaccactgcgctgcaggct

SEQ ID NO: 369037 - DNA, 20 bp, Artificial Sequence
  chemically synthesized
cacaccactgcgctgcaggc

SEQ ID NO: 369038 - DNA, 20 bp, Artificial Sequence
  chemically synthesized
ctttcgcccagcctgcagcg

SEQ ID NO: 369039 - DNA, 20 bp, Artificial Sequence
  chemically synthesized
agaccacaccactgcgctgc

SEQ ID NO: 369040 - DNA, 20 bp, Artificial Sequence
  chemically synthesized
gagaccacaccactgcgctg

SEQ ID NO: 369041 - DNA, 20 bp, Artificial Sequence
  chemically synthesized
tcgcccagcctgcagcgcag

SEQ ID NO: 369042 - DNA, 20 bp, Artificial Sequence
  chemically synthesized
cagcctgcagcgcagtggtg

SEQ ID NO: 369043 - DNA, 20 bp, Artificial Sequence
  chemically synthesized
gcagcgcagtggtgtggtct

SEQ ID NO: 369044 - DNA, 20 bp, Artificial Sequence
  chemically synthesized
gacggaggttgcagtgagct

SEQ ID NO: 369045 - DNA, 20 bp, Artificial Sequence
  chemically synthesized
tgggagacggaggttgcagt

SEQ ID NO: 369046 - DNA, 20 bp, Artificial Sequence
  chemically synthesized
acactgggagacggaggttg

SEQ ID NO: 369047 - DNA, 20 bp, Artificial Sequence
  chemically synthesized
cgcttgacactgggagacgg

SEQ ID NO: 369048 - DNA, 20 bp, Artificial Sequence
  chemically synthesized
tcactgcaacctccgtctcc

SEQ ID NO: 369049 - DNA, 20 bp, Artificial Sequence
  chemically synthesized
tcgcttgacactgggagacg

SEQ ID NO: 369050 - DNA, 20 bp, Artificial Sequence
  chemically synthesized
aatcgcttgacactgggaga

SEQ ID NO: 369051 - DNA, 20 bp, Artificial Sequence
  chemically synthesized
ggagaatcgcttgacactgg

SEQ ID NO: 369052 - DNA, 20 bp, Artificial Sequence
  chemically synthesized
aacctccgtctcccagtgtc

SEQ ID NO: 369053 - DNA, 20 bp, Artificial Sequence
  chemically synthesized
caggagaatcgcttgacact

SEQ ID NO: 369054 - DNA, 20 bp, Artificial Sequence
  chemically synthesized
gcaggagaatcgcttgacac

SEQ ID NO: 369055 - DNA, 20 bp, Artificial Sequence
  chemically synthesized
gtcaagcgattctcctgcct

SEQ ID NO: 369056 - DNA, 20 bp, Artificial Sequence
  chemically synthesized
tacttggaaggctgaggcag

SEQ ID NO: 369057 - DNA, 20 bp, Artificial Sequence
  chemically synthesized
gctacttggaaggctgaggc

SEQ ID NO: 369058 - DNA, 20 bp, Artificial Sequence
  chemically synthesized
agctacttggaaggctgagg

SEQ ID NO: 369059 - DNA, 20 bp, Artificial Sequence
  chemically synthesized
cccagctacttggaaggctg

SEQ ID NO: 369060 - DNA, 20 bp, Artificial Sequence
  chemically synthesized
tcccagctacttggaaggct

SEQ ID NO: 369061 - DNA, 20 bp, Artificial Sequence
  chemically synthesized
ttctcctgcctcagccttcc

SEQ ID NO: 369062 - DNA, 20 bp, Artificial Sequence
  chemically synthesized
tcctgcctcagccttccaag

SEQ ID NO: 369063 - DNA, 20 bp, Artificial Sequence
  chemically synthesized
tgtaatcccagctacttgga

SEQ ID NO: 369064 - DNA, 20 bp, Artificial Sequence
  chemically synthesized
ctgtaatcccagctacttgg

SEQ ID NO: 369065 - DNA, 20 bp, Artificial Sequence
  chemically synthesized
gcctcagccttccaagtagc

SEQ ID NO: 369066 - DNA, 20 bp, Artificial Sequence
  chemically synthesized
cctcagccttccaagtagct

SEQ ID NO: 369067 - DNA, 20 bp, Artificial Sequence
  chemically synthesized
cgcctgtaatcccagctact

SEQ ID NO: 369068 - DNA, 20 bp, Artificial Sequence
  chemically synthesized
cttccaagtagctgggatta

SEQ ID NO: 369069 - DNA, 20 bp, Artificial Sequence
  chemically synthesized
ttccaagtagctgggattac

SEQ ID NO: 369070 - DNA, 20 bp, Artificial Sequence
  chemically synthesized
gtggcatgcgcctgtaatcc

SEQ ID NO: 369071 - DNA, 20 bp, Artificial Sequence
  chemically synthesized
caggcgcatgccaccacgcc

SEQ ID NO: 369072 - DNA, 20 bp, Artificial Sequence
  chemically synthesized
caaaaatcagctgggcgtgg

SEQ ID NO: 369073 - DNA, 20 bp, Artificial Sequence
  chemically synthesized
atacaaaaatcagctgggcg

SEQ ID NO: 369074 - DNA, 20 bp, Artificial Sequence
  chemically synthesized
aaaaaatacaaaaatcagct

SEQ ID NO: 369075 - DNA, 20 bp, Artificial Sequence
  chemically synthesized
aaaaaaatacaaaaatcagc

SEQ ID NO: 369076 - DNA, 20 bp, Artificial Sequence
  chemically synthesized
tactaaaaaaatacaaaaat

SEQ ID NO: 369077 - DNA, 20 bp, Artificial Sequence
  chemically synthesized
agctgatttttgtatttttt

SEQ ID NO: 369078 - DNA, 20 bp, Artificial Sequence
  chemically synthesized
tgatttttgtatttttttag

SEQ ID NO: 369079 - DNA, 20 bp, Artificial Sequence
  chemically synthesized
ttgtatttttttagtagaaa

SEQ ID NO: 369080 - DNA, 20 bp, Artificial Sequence
  chemically synthesized
tgtatttttttagtagaaac

SEQ ID NO: 369081 - DNA, 20 bp, Artificial Sequence
  chemically synthesized
gtatttttttagtagaaaca

SEQ ID NO: 369082 - DNA, 20 bp, Artificial Sequence
  chemically synthesized
gaaacagggtttcaccacat

SEQ ID NO: 369083 - DNA, 20 bp, Artificial Sequence
  chemically synthesized
cagggtttcaccacattggc

SEQ ID NO: 369084 - DNA, 20 bp, Artificial Sequence
  chemically synthesized
tgagactggcctggccaatg

SEQ ID NO: 369085 - DNA, 20 bp, Artificial Sequence
  chemically synthesized
agggtttcaccacattggcc

SEQ ID NO: 369086 - DNA, 20 bp, Artificial Sequence
  chemically synthesized
tttcaccacattggccaggc

SEQ ID NO: 369087 - DNA, 20 bp, Artificial Sequence
  chemically synthesized
tcaggagtttgagactggcc

SEQ ID NO: 369088 - DNA, 20 bp, Artificial Sequence
  chemically synthesized
cgaggtcaggagtttgagac

SEQ ID NO: 369089 - DNA, 20 bp, Artificial Sequence
  chemically synthesized
gatcacgaggtcaggagttt

SEQ ID NO: 369090 - DNA, 20 bp, Artificial Sequence
  chemically synthesized
tgggcggatcacgaggtcag

SEQ ID NO: 369091 - DNA, 20 bp, Artificial Sequence
  chemically synthesized
ggtgggcggatcacgaggtc

SEQ ID NO: 369092 - DNA, 20 bp, Artificial Sequence
  chemically synthesized
aggtgggcggatcacgaggt

SEQ ID NO: 369093 - DNA, 20 bp, Artificial Sequence
  chemically synthesized
gccgaggtgggcggatcacg

SEQ ID NO: 369094 - DNA, 20 bp, Artificial Sequence
  chemically synthesized
ggccgaggtgggcggatcac

SEQ ID NO: 369095 - DNA, 20 bp, Artificial Sequence
  chemically synthesized
acctcgtgatccgcccacct

SEQ ID NO: 369096 - DNA, 20 bp, Artificial Sequence
  chemically synthesized
ctttgggaggccgaggtggg

SEQ ID NO: 369097 - DNA, 20 bp, Artificial Sequence
  chemically synthesized
gcactttgggaggccgaggt

SEQ ID NO: 369098 - DNA, 20 bp, Artificial Sequence
  chemically synthesized
agcactttgggaggccgagg

SEQ ID NO: 369099 - DNA, 20 bp, Artificial Sequence
  chemically synthesized
cccagcactttgggaggccg

SEQ ID NO: 369100 - DNA, 20 bp, Artificial Sequence
  chemically synthesized
tcccagcactttgggaggcc

SEQ ID NO: 369101 - DNA, 20 bp, Artificial Sequence
  chemically synthesized
ccgcccacctcggcctccca

SEQ ID NO: 369102 - DNA, 20 bp, Artificial Sequence
  chemically synthesized
tataatcccagcactttggg

SEQ ID NO: 369103 - DNA, 20 bp, Artificial Sequence
  chemically synthesized
ctataatcccagcactttgg

SEQ ID NO: 369104 - DNA, 20 bp, Artificial Sequence
  chemically synthesized
acctcggcctcccaaagtgc

SEQ ID NO: 369105 - DNA, 20 bp, Artificial Sequence
  chemically synthesized
gcctataatcccagcacttt

SEQ ID NO: 369106 - DNA, 20 bp, Artificial Sequence
  chemically synthesized
cctcggcctcccaaagtgct

SEQ ID NO: 369107 - DNA, 20 bp, Artificial Sequence
  chemically synthesized
ggcctataatcccagcactt

SEQ ID NO: 369108 - DNA, 20 bp, Artificial Sequence
  chemically synthesized
ctcccaaagtgctgggatta

SEQ ID NO: 369109 - DNA, 20 bp, Artificial Sequence
  chemically synthesized
tcccaaagtgctgggattat

SEQ ID NO: 369110 - DNA, 20 bp, Artificial Sequence
  chemically synthesized
gtggttcaggcctataatcc

SEQ ID NO: 369111 - DNA, 20 bp, Artificial Sequence
  chemically synthesized
ttggccgggtacggtggttc

SEQ ID NO: 369112 - DNA, 20 bp, Artificial Sequence
  chemically synthesized
gttggccgggtacggtggtt

SEQ ID NO: 369113 - DNA, 20 bp, Artificial Sequence
  chemically synthesized
taggcctgaaccaccgtacc

SEQ ID NO: 369114 - DNA, 20 bp, Artificial Sequence
  chemically synthesized
tgaaagttggccgggtacgg

SEQ ID NO: 369115 - DNA, 20 bp, Artificial Sequence
  chemically synthesized
atttgaaagttggccgggta

SEQ ID NO: 369116 - DNA, 20 bp, Artificial Sequence
  chemically synthesized
gaaatatttgaaagttggcc

SEQ ID NO: 369117 - DNA, 20 bp, Artificial Sequence
  chemically synthesized
agaaatatttgaaagttggc

SEQ ID NO: 369118 - DNA, 20 bp, Artificial Sequence
  chemically synthesized
ctttagaaatatttgaaagt

SEQ ID NO: 369119 - DNA, 20 bp, Artificial Sequence
  chemically synthesized
gtagctttagaaatatttga

SEQ ID NO: 369120 - DNA, 20 bp, Artificial Sequence
  chemically synthesized
ccaactttcaaatatttcta

SEQ ID NO: 369121 - DNA, 20 bp, Artificial Sequence
  chemically synthesized
agtcttacgaaaggtagctt

SEQ ID NO: 369122 - DNA, 20 bp, Artificial Sequence
  chemically synthesized
acactaagtcttacgaaagg

SEQ ID NO: 369123 - DNA, 20 bp, Artificial Sequence
  chemically synthesized
tttctaaagctacctttcgt

SEQ ID NO: 369124 - DNA, 20 bp, Artificial Sequence
  chemically synthesized
taaacactaagtcttacgaa

SEQ ID NO: 369125 - DNA, 20 bp, Artificial Sequence
  chemically synthesized
ttaaacactaagtcttacga

SEQ ID NO: 369126 - DNA, 20 bp, Artificial Sequence
  chemically synthesized
aagctacctttcgtaagact

SEQ ID NO: 369127 - DNA, 20 bp, Artificial Sequence
  chemically synthesized
caacagaagagttaaacact

SEQ ID NO: 369128 - DNA, 20 bp, Artificial Sequence
  chemically synthesized
atacagtggctacaacagaa

SEQ ID NO: 369129 - DNA, 20 bp, Artificial Sequence
  chemically synthesized
agtgtttaactcttctgttg

SEQ ID NO: 369130 - DNA, 20 bp, Artificial Sequence
  chemically synthesized
caatacagtggctacaacag

SEQ ID NO: 369131 - DNA, 20 bp, Artificial Sequence
  chemically synthesized
ttacaatacagtggctacaa

SEQ ID NO: 369132 - DNA, 20 bp, Artificial Sequence
  chemically synthesized
tagttgcatttacaatacag

SEQ ID NO: 369133 - DNA, 20 bp, Artificial Sequence
  chemically synthesized
ccttagttgcatttacaata

SEQ ID NO: 369134 - DNA, 20 bp, Artificial Sequence
  chemically synthesized
actgtattgtaaatgcaact

SEQ ID NO: 369135 - DNA, 20 bp, Artificial Sequence
  chemically synthesized
ctgtattgtaaatgcaacta

SEQ ID NO: 369136 - DNA, 20 bp, Artificial Sequence
  chemically synthesized
ttgggcaaggaatacaacct

SEQ ID NO: 369137 - DNA, 20 bp, Artificial Sequence
  chemically synthesized
tcaaatgaacatattgggca

SEQ ID NO: 369138 - DNA, 20 bp, Artificial Sequence
  chemically synthesized
gtcaaatgaacatattgggc

SEQ ID NO: 369139 - DNA, 20 bp, Artificial Sequence
  chemically synthesized
gaacgtcaaatgaacatatt

SEQ ID NO: 369140 - DNA, 20 bp, Artificial Sequence
  chemically synthesized
tgaacgtcaaatgaacatat

SEQ ID NO: 369141 - DNA, 20 bp, Artificial Sequence
  chemically synthesized
atgttcatttgacgttcaat

SEQ ID NO: 369142 - DNA, 20 bp, Artificial Sequence
  chemically synthesized
gttcatttgacgttcaattg

SEQ ID NO: 369143 - DNA, 20 bp, Artificial Sequence
  chemically synthesized
catttgacgttcaattggag

SEQ ID NO: 369144 - DNA, 20 bp, Artificial Sequence
  chemically synthesized
gagaagttaaaaaaaaaaaa

SEQ ID NO: 369145 - DNA, 20 bp, Artificial Sequence
  chemically synthesized
tagcaaatgggagaaaaata

SEQ ID NO: 369146 - DNA, 20 bp, Artificial Sequence
  chemically synthesized
agtaaaaatctagcaaatgg

SEQ ID NO: 369147 - DNA, 20 bp, Artificial Sequence
  chemically synthesized
tttatttttctcccatttgc

SEQ ID NO: 369148 - DNA, 20 bp, Artificial Sequence
  chemically synthesized
acagtaaaaatctagcaaat

SEQ ID NO: 369149 - DNA, 20 bp, Artificial Sequence
  chemically synthesized
gacagtaaaaatctagcaaa

SEQ ID NO: 369150 - DNA, 20 bp, Artificial Sequence
  chemically synthesized
ctaaagtgacagtaaaaatc

SEQ ID NO: 369151 - DNA, 20 bp, Artificial Sequence
  chemically synthesized
ctagatttttactgtcactt

SEQ ID NO: 369152 - DNA, 20 bp, Artificial Sequence
  chemically synthesized
acactttttatctaaagtga

SEQ ID NO: 369153 - DNA, 20 bp, Artificial Sequence
  chemically synthesized
ataaacacactttttatcta

SEQ ID NO: 369154 - DNA, 20 bp, Artificial Sequence
  chemically synthesized
ttactgtcactttagataaa

SEQ ID NO: 369155 - DNA, 20 bp, Artificial Sequence
  chemically synthesized
tagcttataatgaagaaaac

SEQ ID NO: 369156 - DNA, 20 bp, Artificial Sequence
  chemically synthesized
tatcttgttttcttcattat

SEQ ID NO: 369157 - DNA, 20 bp, Artificial Sequence
  chemically synthesized
ggaaattatagcttataatg

SEQ ID NO: 369158 - DNA, 20 bp, Artificial Sequence
  chemically synthesized
tcattataagctataatttc

SEQ ID NO: 369159 - DNA, 20 bp, Artificial Sequence
  chemically synthesized
gaataaaccactggaaatta

SEQ ID NO: 369160 - DNA, 20 bp, Artificial Sequence
  chemically synthesized
ttataagctataatttccag

SEQ ID NO: 369161 - DNA, 20 bp, Artificial Sequence
  chemically synthesized
gaaatgtctgaataaaccac

SEQ ID NO: 369162 - DNA, 20 bp, Artificial Sequence
  chemically synthesized
ataatttccagtggtttatt

SEQ ID NO: 369163 - DNA, 20 bp, Artificial Sequence
  chemically synthesized
ttgatttactatttttgttt

SEQ ID NO: 369164 - DNA, 20 bp, Artificial Sequence
  chemically synthesized
agacatttccaaaacaaaaa

SEQ ID NO: 369165 - DNA, 20 bp, Artificial Sequence
  chemically synthesized
caaaaatagtaaatcaaaaa

SEQ ID NO: 369166 - DNA, 20 bp, Artificial Sequence
  chemically synthesized
ggtgacagttttagttcaca

SEQ ID NO: 369167 - DNA, 20 bp, Artificial Sequence
  chemically synthesized
aggtgacagttttagttcac

SEQ ID NO: 369168 - DNA, 20 bp, Artificial Sequence
  chemically synthesized
aaggtgacagttttagttca

SEQ ID NO: 369169 - DNA, 20 bp, Artificial Sequence
  chemically synthesized
ctaactaaaggtgacagttt

SEQ ID NO: 369170 - DNA, 20 bp, Artificial Sequence
  chemically synthesized
tgaactaaaactgtcacctt

SEQ ID NO: 369171 - DNA, 20 bp, Artificial Sequence
  chemically synthesized
gaaacactaactaaaggtga

SEQ ID NO: 369172 - DNA, 20 bp, Artificial Sequence
  chemically synthesized
ctaaaactgtcacctttagt

SEQ ID NO: 369173 - DNA, 20 bp, Artificial Sequence
  chemically synthesized
tttctagaaacactaactaa

SEQ ID NO: 369174 - DNA, 20 bp, Artificial Sequence
  chemically synthesized
ttttctagaaacactaacta

SEQ ID NO: 369175 - DNA, 20 bp, Artificial Sequence
  chemically synthesized
tcacctttagttagtgtttc

SEQ ID NO: 369176 - DNA, 20 bp, Artificial Sequence
  chemically synthesized
tattttaaaatgcatttttc

SEQ ID NO: 369177 - DNA, 20 bp, Artificial Sequence
  chemically synthesized
gaaaaatgcattttaaaata

SEQ ID NO: 369178 - DNA, 20 bp, Artificial Sequence
  chemically synthesized
attttaaaataaagttgaat

SEQ ID NO: 369179 - DNA, 20 bp, Artificial Sequence
  chemically synthesized
tttaaaataaagttgaataa

SEQ ID NO: 369180 - DNA, 20 bp, Artificial Sequence
  chemically synthesized
ataaagttgaataagagcca

SEQ ID NO: 369181 - DNA, 20 bp, Artificial Sequence
  chemically synthesized
taaagttgaataagagccaa

SEQ ID NO: 369182 - DNA, 20 bp, Artificial Sequence
  chemically synthesized
gttgaataagagccaaagga

SEQ ID NO: 369183 - DNA, 20 bp, Artificial Sequence
  chemically synthesized
ttgtcaactctactttcctt

SEQ ID NO: 369184 - DNA, 20 bp, Artificial Sequence
  chemically synthesized
gaataagagccaaaggaaag

SEQ ID NO: 369185 - DNA, 20 bp, Artificial Sequence
  chemically synthesized
ataagagccaaaggaaagta

SEQ ID NO: 369186 - DNA, 20 bp, Artificial Sequence
  chemically synthesized
ttgacaatttttttcttaca

SEQ ID NO: 369187 - DNA, 20 bp, Artificial Sequence
  chemically synthesized
attttttctttgagctttgt

SEQ ID NO: 369188 - DNA, 20 bp, Artificial Sequence
  chemically synthesized
tttttttcttacaaagctca

SEQ ID NO: 369189 - DNA, 20 bp, Artificial Sequence
  chemically synthesized
caattttaaattttttcttt

SEQ ID NO: 369190 - DNA, 20 bp, Artificial Sequence
  chemically synthesized
aaaatttaaaattgccctat

SEQ ID NO: 369191 - DNA, 20 bp, Artificial Sequence
  chemically synthesized
cctattaagattttctcata

SEQ ID NO: 369192 - DNA, 20 bp, Artificial Sequence
  chemically synthesized
acctattaagattttctcat

SEQ ID NO: 369193 - DNA, 20 bp, Artificial Sequence
  chemically synthesized
tacctattaagattttctca

SEQ ID NO: 369194 - DNA, 20 bp, Artificial Sequence
  chemically synthesized
gccctatgagaaaatcttaa

SEQ ID NO: 369195 - DNA, 20 bp, Artificial Sequence
  chemically synthesized
ccctatgagaaaatcttaat

SEQ ID NO: 369196 - DNA, 20 bp, Artificial Sequence
  chemically synthesized
tgaaatgtcaggtacctatt

SEQ ID NO: 369197 - DNA, 20 bp, Artificial Sequence
  chemically synthesized
atttttcctattgaaatgtc

SEQ ID NO: 369198 - DNA, 20 bp, Artificial Sequence
  chemically synthesized
aatttttcctattgaaatgt

SEQ ID NO: 369199 - DNA, 20 bp, Artificial Sequence
  chemically synthesized
ataggtacctgacatttcaa

SEQ ID NO: 369200 - DNA, 20 bp, Artificial Sequence
  chemically synthesized
taggtacctgacatttcaat

SEQ ID NO: 369201 - DNA, 20 bp, Artificial Sequence
  chemically synthesized
gacatttcaataggaaaaat

SEQ ID NO: 369202 - DNA, 20 bp, Artificial Sequence
  chemically synthesized
attagttataactgcttaaa

SEQ ID NO: 369203 - DNA, 20 bp, Artificial Sequence
  chemically synthesized
ggtaaaaacttctatttaag

SEQ ID NO: 369204 - DNA, 20 bp, Artificial Sequence
  chemically synthesized
agttataactgcttaaatag

SEQ ID NO: 369205 - DNA, 20 bp, Artificial Sequence
  chemically synthesized
cttggtaaaaacttctattt

SEQ ID NO: 369206 - DNA, 20 bp, Artificial Sequence
  chemically synthesized
cttaaatagaagtttttacc

SEQ ID NO: 369207 - DNA, 20 bp, Artificial Sequence
  chemically synthesized
taaatagaagtttttaccaa

SEQ ID NO: 369208 - DNA, 20 bp, Artificial Sequence
  chemically synthesized
tagttatgtaataaagctct

SEQ ID NO: 369209 - DNA, 20 bp, Artificial Sequence
  chemically synthesized
ccttttgtagttatgtaata

SEQ ID NO: 369210 - DNA, 20 bp, Artificial Sequence
  chemically synthesized
gctttattacataactacaa

SEQ ID NO: 369211 - DNA, 20 bp, Artificial Sequence
  chemically synthesized
ctttattacataactacaaa

SEQ ID NO: 369212 - DNA, 20 bp, Artificial Sequence
  chemically synthesized
actgaattaggtaccttttg

SEQ ID NO: 369213 - DNA, 20 bp, Artificial Sequence
  chemically synthesized
actacaaaaggtacctaatt

SEQ ID NO: 369214 - DNA, 20 bp, Artificial Sequence
  chemically synthesized
taaagatgaatcactgaatt

SEQ ID NO: 369215 - DNA, 20 bp, Artificial Sequence
  chemically synthesized
ataaagatgaatcactgaat

SEQ ID NO: 369216 - DNA, 20 bp, Artificial Sequence
  chemically synthesized
attcagtgattcatctttat

SEQ ID NO: 369217 - DNA, 20 bp, Artificial Sequence
  chemically synthesized
ttagcaaatgtttgctgata

SEQ ID NO: 369218 - DNA, 20 bp, Artificial Sequence
  chemically synthesized
tgtacaggattgtttacaat

SEQ ID NO: 369219 - DNA, 20 bp, Artificial Sequence
  chemically synthesized
gaaataaaaatattttgtac

SEQ ID NO: 369220 - DNA, 20 bp, Artificial Sequence
  chemically synthesized
tgaaataaaaatattttgta

SEQ ID NO: 369221 - DNA, 20 bp, Artificial Sequence
  chemically synthesized
tacaaaatatttttatttca

SEQ ID NO: 369222 - DNA, 20 bp, Artificial Sequence
  chemically synthesized
caaaatatttttatttcaaa

SEQ ID NO: 369223 - DNA, 20 bp, Artificial Sequence
  chemically synthesized
aaaatatttttatttcaaag

SEQ ID NO: 369224 - DNA, 20 bp, Artificial Sequence
  chemically synthesized
atatttttatttcaaagagg

SEQ ID NO: 369225 - DNA, 20 bp, Artificial Sequence
  chemically synthesized
tttggttcaatatttttgga

SEQ ID NO: 369226 - DNA, 20 bp, Artificial Sequence
  chemically synthesized
tccttttggttcaatatttt

SEQ ID NO: 369227 - DNA, 20 bp, Artificial Sequence
  chemically synthesized
ttccaaaaatattgaaccaa

SEQ ID NO: 369228 - DNA, 20 bp, Artificial Sequence
  chemically synthesized
tccaaaaatattgaaccaaa

SEQ ID NO: 369229 - DNA, 20 bp, Artificial Sequence
  chemically synthesized
aggtcatttcaatttccttt

SEQ ID NO: 369230 - DNA, 20 bp, Artificial Sequence
  chemically synthesized
aaaggaaattgaaatgacct

SEQ ID NO: 369231 - DNA, 20 bp, Artificial Sequence
  chemically synthesized
gataatgatattttaaacca

SEQ ID NO: 369232 - DNA, 20 bp, Artificial Sequence
  chemically synthesized
tgataatgatattttaaacc

SEQ ID NO: 369233 - DNA, 20 bp, Artificial Sequence
  chemically synthesized
ttggtttaaaatatcattat

SEQ ID NO: 369234 - DNA, 20 bp, Artificial Sequence
  chemically synthesized
aatatcattatcagcttgaa

SEQ ID NO: 369235 - DNA, 20 bp, Artificial Sequence
  chemically synthesized
atcattatcagcttgaaaag

SEQ ID NO: 369236 - DNA, 20 bp, Artificial Sequence
  chemically synthesized
tttgatagtttccacttttc

SEQ ID NO: 369237 - DNA, 20 bp, Artificial Sequence
  chemically synthesized
gaaaagtggaaactatcaaa

SEQ ID NO: 369238 - DNA, 20 bp, Artificial Sequence
  chemically synthesized
aaagttggttaactatttga

SEQ ID NO: 369239 - DNA, 20 bp, Artificial Sequence
  chemically synthesized
gcaccaatcttttaaaaagt

SEQ ID NO: 369240 - DNA, 20 bp, Artificial Sequence
  chemically synthesized
atagttaaccaactttttaa

SEQ ID NO: 369241 - DNA, 20 bp, Artificial Sequence
  chemically synthesized
gtgagcaccaatcttttaaa

SEQ ID NO: 369242 - DNA, 20 bp, Artificial Sequence
  chemically synthesized
taaccaactttttaaaagat

SEQ ID NO: 369243 - DNA, 20 bp, Artificial Sequence
  chemically synthesized
aagattggtgctcactcacc

SEQ ID NO: 369244 - DNA, 20 bp, Artificial Sequence
  chemically synthesized
ggtcattcagccaggtgagt

SEQ ID NO: 369245 - DNA, 20 bp, Artificial Sequence
  chemically synthesized
ggtaggtcattcagccaggt

SEQ ID NO: 369246 - DNA, 20 bp, Artificial Sequence
  chemically synthesized
aagaggtaggtcattcagcc

SEQ ID NO: 369247 - DNA, 20 bp, Artificial Sequence
  chemically synthesized
aaagaggtaggtcattcagc

SEQ ID NO: 369248 - DNA, 20 bp, Artificial Sequence
  chemically synthesized
gttcaaagaggtaggtcatt

SEQ ID NO: 369249 - DNA, 20 bp, Artificial Sequence
  chemically synthesized
aatttaaggttcaaagaggt

SEQ ID NO: 369250 - DNA, 20 bp, Artificial Sequence
  chemically synthesized
aaatttaaggttcaaagagg

SEQ ID NO: 369251 - DNA, 20 bp, Artificial Sequence
  chemically synthesized
tttaaatttaaggttcaaag

SEQ ID NO: 369252 - DNA, 20 bp, Artificial Sequence
  chemically synthesized
atttaaatttaaggttcaaa

SEQ ID NO: 369253 - DNA, 20 bp, Artificial Sequence
  chemically synthesized
ttatttaaatttaaggttca

SEQ ID NO: 369254 - DNA, 20 bp, Artificial Sequence
  chemically synthesized
cgagccattatttaaattta

SEQ ID NO: 369255 - DNA, 20 bp, Artificial Sequence
  chemically synthesized
ccgagccattatttaaattt

SEQ ID NO: 369256 - DNA, 20 bp, Artificial Sequence
  chemically synthesized
tgaaccttaaatttaaataa

SEQ ID NO: 369257 - DNA, 20 bp, Artificial Sequence
  chemically synthesized
cttaaatttaaataatggct

SEQ ID NO: 369258 - DNA, 20 bp, Artificial Sequence
  chemically synthesized
agagaaggttaatgtggacc

SEQ ID NO: 369259 - DNA, 20 bp, Artificial Sequence
  chemically synthesized
aaatcaagagaaggttaatg

SEQ ID NO: 369260 - DNA, 20 bp, Artificial Sequence
  chemically synthesized
tacagtctaaaatcaagaga

SEQ ID NO: 369261 - DNA, 20 bp, Artificial Sequence
  chemically synthesized
ttacagtctaaaatcaagag

SEQ ID NO: 369262 - DNA, 20 bp, Artificial Sequence
  chemically synthesized
cattaaccttctcttgattt

SEQ ID NO: 369263 - DNA, 20 bp, Artificial Sequence
  chemically synthesized
atattacagtctaaaatcaa

SEQ ID NO: 369264 - DNA, 20 bp, Artificial Sequence
  chemically synthesized
ggatattacagtctaaaatc

SEQ ID NO: 369265 - DNA, 20 bp, Artificial Sequence
  chemically synthesized
aattcccatattggatatta

SEQ ID NO: 369266 - DNA, 20 bp, Artificial Sequence
  chemically synthesized
ttagactgtaatatccaata

SEQ ID NO: 369267 - DNA, 20 bp, Artificial Sequence
  chemically synthesized
tagactgtaatatccaatat

SEQ ID NO: 369268 - DNA, 20 bp, Artificial Sequence
  chemically synthesized
ttttgcttaaattcccatat

SEQ ID NO: 369269 - DNA, 20 bp, Artificial Sequence
  chemically synthesized
aatatccaatatgggaattt

SEQ ID NO: 369270 - DNA, 20 bp, Artificial Sequence
  chemically synthesized
ggaatttaagcaaaaactta

SEQ ID NO: 369271 - DNA, 20 bp, Artificial Sequence
  chemically synthesized
tccatttttgatgtaacttt

SEQ ID NO: 369272 - DNA, 20 bp, Artificial Sequence
  chemically synthesized
acttaaagttacatcaaaaa

SEQ ID NO: 369273 - DNA, 20 bp, Artificial Sequence
  chemically synthesized
acatcaaaaatggaaaaata

SEQ ID NO: 369274 - DNA, 20 bp, Artificial Sequence
  chemically synthesized
atcaaaaatggaaaaatatg

SEQ ID NO: 369275 - DNA, 20 bp, Artificial Sequence
  chemically synthesized
caaaaatggaaaaatatgga

SEQ ID NO: 369276 - DNA, 20 bp, Artificial Sequence
  chemically synthesized
aaaatggaaaaatatggaga

SEQ ID NO: 369277 - DNA, 20 bp, Artificial Sequence
  chemically synthesized
aaatggaaaaatatggagag

SEQ ID NO: 369278 - DNA, 20 bp, Artificial Sequence
  chemically synthesized
gaaaaatatggagagaggcc

SEQ ID NO: 369279 - DNA, 20 bp, Artificial Sequence
  chemically synthesized
ctgttcctagttggtcatct

SEQ ID NO: 369280 - DNA, 20 bp, Artificial Sequence
  chemically synthesized
gagaggccaagatgaccaac

SEQ ID NO: 369281 - DNA, 20 bp, Artificial Sequence
  chemically synthesized
agaggccaagatgaccaact

SEQ ID NO: 369282 - DNA, 20 bp, Artificial Sequence
  chemically synthesized
tgactgcagctgttcctagt

SEQ ID NO: 369283 - DNA, 20 bp, Artificial Sequence
  chemically synthesized
ccaagatgaccaactaggaa

SEQ ID NO: 369284 - DNA, 20 bp, Artificial Sequence
  chemically synthesized
cctctgactgcagctgttcc

SEQ ID NO: 369285 - DNA, 20 bp, Artificial Sequence
  chemically synthesized
tgaccaactaggaacagctg

SEQ ID NO: 369286 - DNA, 20 bp, Artificial Sequence
  chemically synthesized
caactaggaacagctgcagt

SEQ ID NO: 369287 - DNA, 20 bp, Artificial Sequence
  chemically synthesized
actaggaacagctgcagtca

SEQ ID NO: 369288 - DNA, 20 bp, Artificial Sequence
  chemically synthesized
ctaggaacagctgcagtcag

SEQ ID NO: 369289 - DNA, 20 bp, Artificial Sequence
  chemically synthesized
tcagtgggagcctctgactg

SEQ ID NO: 369290 - DNA, 20 bp, Artificial Sequence
  chemically synthesized
tgcagtcagaggctcccact

SEQ ID NO: 369291 - DNA, 20 bp, Artificial Sequence
  chemically synthesized
gttttggttcttctcagtgg

SEQ ID NO: 369292 - DNA, 20 bp, Artificial Sequence
  chemically synthesized
agtcagaggctcccactgag

SEQ ID NO: 369293 - DNA, 20 bp, Artificial Sequence
  chemically synthesized
cggttttggttcttctcagt

SEQ ID NO: 369294 - DNA, 20 bp, Artificial Sequence
  chemically synthesized
acggttttggttcttctcag

SEQ ID NO: 369295 - DNA, 20 bp, Artificial Sequence
  chemically synthesized
ctcacggttttggttcttct

SEQ ID NO: 369296 - DNA, 20 bp, Artificial Sequence
  chemically synthesized
ctgagaagaaccaaaaccgt

SEQ ID NO: 369297 - DNA, 20 bp, Artificial Sequence
  chemically synthesized
gcaggattcactcacggttt

SEQ ID NO: 369298 - DNA, 20 bp, Artificial Sequence
  chemically synthesized
gctggtgcaggattcactca

SEQ ID NO: 369299 - DNA, 20 bp, Artificial Sequence
  chemically synthesized
accgtgagtgaatcctgcac

SEQ ID NO: 369300 - DNA, 20 bp, Artificial Sequence
  chemically synthesized
gacacctctgttgctggtgc

SEQ ID NO: 369301 - DNA, 20 bp, Artificial Sequence
  chemically synthesized
ggacacctctgttgctggtg

SEQ ID NO: 369302 - DNA, 20 bp, Artificial Sequence
  chemically synthesized
agtgaatcctgcaccagcaa

SEQ ID NO: 369303 - DNA, 20 bp, Artificial Sequence
  chemically synthesized
tgaatcctgcaccagcaaca

SEQ ID NO: 369304 - DNA, 20 bp, Artificial Sequence
  chemically synthesized
gaatcctgcaccagcaacag

SEQ ID NO: 369305 - DNA, 20 bp, Artificial Sequence
  chemically synthesized
aacctggacacctctgttgc

SEQ ID NO: 369306 - DNA, 20 bp, Artificial Sequence
  chemically synthesized
gcaccagcaacagaggtgtc

SEQ ID NO: 369307 - DNA, 20 bp, Artificial Sequence
  chemically synthesized
caccagcaacagaggtgtcc

SEQ ID NO: 369308 - DNA, 20 bp, Artificial Sequence
  chemically synthesized
tcagtcccagtgagagaacc

SEQ ID NO: 369309 - DNA, 20 bp, Artificial Sequence
  chemically synthesized
aggtgtccaggttctctcac

SEQ ID NO: 369310 - DNA, 20 bp, Artificial Sequence
  chemically synthesized
ggtgtccaggttctctcact

SEQ ID NO: 369311 - DNA, 20 bp, Artificial Sequence
  chemically synthesized
tgcctagtcagtcccagtga

SEQ ID NO: 369312 - DNA, 20 bp, Artificial Sequence
  chemically synthesized
actgcctagtcagtcccagt

SEQ ID NO: 369313 - DNA, 20 bp, Artificial Sequence
  chemically synthesized
gccaactgcctagtcagtcc

SEQ ID NO: 369314 - DNA, 20 bp, Artificial Sequence
  chemically synthesized
gttctctcactgggactgac

SEQ ID NO: 369315 - DNA, 20 bp, Artificial Sequence
  chemically synthesized
ttctctcactgggactgact

SEQ ID NO: 369316 - DNA, 20 bp, Artificial Sequence
  chemically synthesized
tctcactgggactgactagg

SEQ ID NO: 369317 - DNA, 20 bp, Artificial Sequence
  chemically synthesized
tctcatgccaactgcctagt

SEQ ID NO: 369318 - DNA, 20 bp, Artificial Sequence
  chemically synthesized
actgggactgactaggcagt

SEQ ID NO: 369319 - DNA, 20 bp, Artificial Sequence
  chemically synthesized
gcgctctcatgccaactgcc

SEQ ID NO: 369320 - DNA, 20 bp, Artificial Sequence
  chemically synthesized
actgactaggcagttggcat

SEQ ID NO: 369321 - DNA, 20 bp, Artificial Sequence
  chemically synthesized
tgactaggcagttggcatga

SEQ ID NO: 369322 - DNA, 20 bp, Artificial Sequence
  chemically synthesized
ggcagttggcatgagagcgc

SEQ ID NO: 369323 - DNA, 20 bp, Artificial Sequence
  chemically synthesized
gcagttggcatgagagcgca

SEQ ID NO: 369324 - DNA, 20 bp, Artificial Sequence
  chemically synthesized
tggcatgagagcgcaaggaa

SEQ ID NO: 369325 - DNA, 20 bp, Artificial Sequence
  chemically synthesized
catgagagcgcaaggaaaag

SEQ ID NO: 369326 - DNA, 20 bp, Artificial Sequence
  chemically synthesized
atgagagcgcaaggaaaagc

SEQ ID NO: 369327 - DNA, 20 bp, Artificial Sequence
  chemically synthesized
tgagagcgcaaggaaaagca

SEQ ID NO: 369328 - DNA, 20 bp, Artificial Sequence
  chemically synthesized
gagcgcaaggaaaagcaggg

SEQ ID NO: 369329 - DNA, 20 bp, Artificial Sequence
  chemically synthesized
ggaaaagcagggtggtgcca

SEQ ID NO: 369330 - DNA, 20 bp, Artificial Sequence
  chemically synthesized
tttggctcccaggtgggcca

SEQ ID NO: 369331 - DNA, 20 bp, Artificial Sequence
  chemically synthesized
gggtggtgccatggcccacc

SEQ ID NO: 369332 - DNA, 20 bp, Artificial Sequence
  chemically synthesized
ggtggtgccatggcccacct

SEQ ID NO: 369333 - DNA, 20 bp, Artificial Sequence
  chemically synthesized
tggtgccatggcccacctgg

SEQ ID NO: 369334 - DNA, 20 bp, Artificial Sequence
  chemically synthesized
gtcgcgtttggctcccaggt

SEQ ID NO: 369335 - DNA, 20 bp, Artificial Sequence
  chemically synthesized
tgtcgcgtttggctcccagg

SEQ ID NO: 369336 - DNA, 20 bp, Artificial Sequence
  chemically synthesized
ccttgtcgcgtttggctccc

SEQ ID NO: 369337 - DNA, 20 bp, Artificial Sequence
  chemically synthesized
cccttgtcgcgtttggctcc

SEQ ID NO: 369338 - DNA, 20 bp, Artificial Sequence
  chemically synthesized
ggagcttcccttgtcgcgtt

SEQ ID NO: 369339 - DNA, 20 bp, Artificial Sequence
  chemically synthesized
acctgggagccaaacgcgac

SEQ ID NO: 369340 - DNA, 20 bp, Artificial Sequence
  chemically synthesized
cctgggagccaaacgcgaca

SEQ ID NO: 369341 - DNA, 20 bp, Artificial Sequence
  chemically synthesized
ctgggagccaaacgcgacaa

SEQ ID NO: 369342 - DNA, 20 bp, Artificial Sequence
  chemically synthesized
ggagccaaacgcgacaaggg

SEQ ID NO: 369343 - DNA, 20 bp, Artificial Sequence
  chemically synthesized
acaagggaagctcccactcc

SEQ ID NO: 369344 - DNA, 20 bp, Artificial Sequence
  chemically synthesized
cctcccttggctgggagtgg

SEQ ID NO: 369345 - DNA, 20 bp, Artificial Sequence
  chemically synthesized
tacctcccttggctgggagt

SEQ ID NO: 369346 - DNA, 20 bp, Artificial Sequence
  chemically synthesized
ctacctcccttggctgggag

SEQ ID NO: 369347 - DNA, 20 bp, Artificial Sequence
  chemically synthesized
ggaagctcccactcccagcc

SEQ ID NO: 369348 - DNA, 20 bp, Artificial Sequence
  chemically synthesized
gaagctcccactcccagcca

SEQ ID NO: 369349 - DNA, 20 bp, Artificial Sequence
  chemically synthesized
tcactacctcccttggctgg

SEQ ID NO: 369350 - DNA, 20 bp, Artificial Sequence
  chemically synthesized
aagctcccactcccagccaa

SEQ ID NO: 369351 - DNA, 20 bp, Artificial Sequence
  chemically synthesized
actcactacctcccttggct

SEQ ID NO: 369352 - DNA, 20 bp, Artificial Sequence
  chemically synthesized
gctcccactcccagccaagg

SEQ ID NO: 369353 - DNA, 20 bp, Artificial Sequence
  chemically synthesized
cactcactacctcccttggc

SEQ ID NO: 369354 - DNA, 20 bp, Artificial Sequence
  chemically synthesized
ctcccactcccagccaaggg

SEQ ID NO: 369355 - DNA, 20 bp, Artificial Sequence
  chemically synthesized
ccactcccagccaagggagg

SEQ ID NO: 369356 - DNA, 20 bp, Artificial Sequence
  chemically synthesized
caatcactcactacctccct

SEQ ID NO: 369357 - DNA, 20 bp, Artificial Sequence
  chemically synthesized
tcccagccaagggaggtagt

SEQ ID NO: 369358 - DNA, 20 bp, Artificial Sequence
  chemically synthesized
aaagatttcccaggcagggt

SEQ ID NO: 369359 - DNA, 20 bp, Artificial Sequence
  chemically synthesized
agtgattgtcctaccctgcc

SEQ ID NO: 369360 - DNA, 20 bp, Artificial Sequence
  chemically synthesized
gaaagatttcccaggcaggg

SEQ ID NO: 369361 - DNA, 20 bp, Artificial Sequence
  chemically synthesized
gtgattgtcctaccctgcct

SEQ ID NO: 369362 - DNA, 20 bp, Artificial Sequence
  chemically synthesized
aaagaaagatttcccaggca

SEQ ID NO: 369363 - DNA, 20 bp, Artificial Sequence
  chemically synthesized
aaaagaaagatttcccaggc

SEQ ID NO: 369364 - DNA, 20 bp, Artificial Sequence
  chemically synthesized
aaaaagaaagatttcccagg

SEQ ID NO: 369365 - DNA, 20 bp, Artificial Sequence
  chemically synthesized
tggaaaaagaaagatttccc

SEQ ID NO: 369366 - DNA, 20 bp, Artificial Sequence
  chemically synthesized
gtggaaaaagaaagatttcc

SEQ ID NO: 369367 - DNA, 20 bp, Artificial Sequence
  chemically synthesized
cacagatctgtggaaaaaga

SEQ ID NO: 369368 - DNA, 20 bp, Artificial Sequence
  chemically synthesized
gggaaatctttctttttcca

SEQ ID NO: 369369 - DNA, 20 bp, Artificial Sequence
  chemically synthesized
gttgcacagatctgtggaaa

SEQ ID NO: 369370 - DNA, 20 bp, Artificial Sequence
  chemically synthesized
ctgcgggttgcacagatctg

SEQ ID NO: 369371 - DNA, 20 bp, Artificial Sequence
  chemically synthesized
ctcctgatctgcgggttgca

SEQ ID NO: 369372 - DNA, 20 bp, Artificial Sequence
  chemically synthesized
ccacagatctgtgcaacccg

SEQ ID NO: 369373 - DNA, 20 bp, Artificial Sequence
  chemically synthesized
gatctgtgcaacccgcagat

SEQ ID NO: 369374 - DNA, 20 bp, Artificial Sequence
  chemically synthesized
atctgtgcaacccgcagatc

SEQ ID NO: 369375 - DNA, 20 bp, Artificial Sequence
  chemically synthesized
agtgggatctcctgatctgc

SEQ ID NO: 369376 - DNA, 20 bp, Artificial Sequence
  chemically synthesized
aagtgggatctcctgatctg

SEQ ID NO: 369377 - DNA, 20 bp, Artificial Sequence
  chemically synthesized
ctgtgcaacccgcagatcag

SEQ ID NO: 369378 - DNA, 20 bp, Artificial Sequence
  chemically synthesized
gatcaggagatcccacttgc

SEQ ID NO: 369379 - DNA, 20 bp, Artificial Sequence
  chemically synthesized
gttggcatgggctcgcaagt

SEQ ID NO: 369380 - DNA, 20 bp, Artificial Sequence
  chemically synthesized
tgttggcatgggctcgcaag

SEQ ID NO: 369381 - DNA, 20 bp, Artificial Sequence
  chemically synthesized
ccctgttggcatgggctcgc

SEQ ID NO: 369382 - DNA, 20 bp, Artificial Sequence
  chemically synthesized
cacttgcgagcccatgccaa

SEQ ID NO: 369383 - DNA, 20 bp, Artificial Sequence
  chemically synthesized
acccaaggccctgttggcat

SEQ ID NO: 369384 - DNA, 20 bp, Artificial Sequence
  chemically synthesized
acttgcgagcccatgccaac

SEQ ID NO: 369385 - DNA, 20 bp, Artificial Sequence
  chemically synthesized
gacccaaggccctgttggca

SEQ ID NO: 369386 - DNA, 20 bp, Artificial Sequence
  chemically synthesized
cttgcgagcccatgccaaca

SEQ ID NO: 369387 - DNA, 20 bp, Artificial Sequence
  chemically synthesized
tttgagacccaaggccctgt

SEQ ID NO: 369388 - DNA, 20 bp, Artificial Sequence
  chemically synthesized
agcccatgccaacagggcct

SEQ ID NO: 369389 - DNA, 20 bp, Artificial Sequence
  chemically synthesized
gcccatgccaacagggcctt

SEQ ID NO: 369390 - DNA, 20 bp, Artificial Sequence
  chemically synthesized
cagctgtgttttgagaccca

SEQ ID NO: 369391 - DNA, 20 bp, Artificial Sequence
  chemically synthesized
acagctgtgttttgagaccc

SEQ ID NO: 369392 - DNA, 20 bp, Artificial Sequence
  chemically synthesized
gggccttgggtctcaaaaca

SEQ ID NO: 369393 - DNA, 20 bp, Artificial Sequence
  chemically synthesized
aatctgcacagctgtgtttt

SEQ ID NO: 369394 - DNA, 20 bp, Artificial Sequence
  chemically synthesized
ggtctcaaaacacagctgtg

SEQ ID NO: 369395 - DNA, 20 bp, Artificial Sequence
  chemically synthesized
gtggcctgcgagaatctgca

SEQ ID NO: 369396 - DNA, 20 bp, Artificial Sequence
  chemically synthesized
cacagctgtgcagattctcg

SEQ ID NO: 369397 - DNA, 20 bp, Artificial Sequence
  chemically synthesized
acagctgtgcagattctcgc

SEQ ID NO: 369398 - DNA, 20 bp, Artificial Sequence
  chemically synthesized
tctccatccgagtggcctgc

SEQ ID NO: 369399 - DNA, 20 bp, Artificial Sequence
  chemically synthesized
gcagattctcgcaggccact

SEQ ID NO: 369400 - DNA, 20 bp, Artificial Sequence
  chemically synthesized
attctcgcaggccactcgga

SEQ ID NO: 369401 - DNA, 20 bp, Artificial Sequence
  chemically synthesized
aggagtcgtctccatccgag

SEQ ID NO: 369402 - DNA, 20 bp, Artificial Sequence
  chemically synthesized
tctcgcaggccactcggatg

SEQ ID NO: 369403 - DNA, 20 bp, Artificial Sequence
  chemically synthesized
ttaaggagtcgtctccatcc

SEQ ID NO: 369404 - DNA, 20 bp, Artificial Sequence
  chemically synthesized
tcggatggagacgactcctt

SEQ ID NO: 369405 - DNA, 20 bp, Artificial Sequence
  chemically synthesized
ggaaactgagcagtcttaag

SEQ ID NO: 369406 - DNA, 20 bp, Artificial Sequence
  chemically synthesized
ccggaaactgagcagtctta

SEQ ID NO: 369407 - DNA, 20 bp, Artificial Sequence
  chemically synthesized
cccggaaactgagcagtctt

SEQ ID NO: 369408 - DNA, 20 bp, Artificial Sequence
  chemically synthesized
gacgactccttaagactgct

SEQ ID NO: 369409 - DNA, 20 bp, Artificial Sequence
  chemically synthesized
ccccgcccccggaaactgag

SEQ ID NO: 369410 - DNA, 20 bp, Artificial Sequence
  chemically synthesized
ccttaagactgctcagtttc

SEQ ID NO: 369411 - DNA, 20 bp, Artificial Sequence
  chemically synthesized
cttaagactgctcagtttcc

SEQ ID NO: 369412 - DNA, 20 bp, Artificial Sequence
  chemically synthesized
cgcccccgcccccggaaact

SEQ ID NO: 369413 - DNA, 20 bp, Artificial Sequence
  chemically synthesized
ttaagactgctcagtttccg

SEQ ID NO: 369414 - DNA, 20 bp, Artificial Sequence
  chemically synthesized
taagactgctcagtttccgg

SEQ ID NO: 369415 - DNA, 20 bp, Artificial Sequence
  chemically synthesized
gactgctcagtttccggggg

SEQ ID NO: 369416 - DNA, 20 bp, Artificial Sequence
  chemically synthesized
actgctcagtttccgggggc

SEQ ID NO: 369417 - DNA, 20 bp, Artificial Sequence
  chemically synthesized
ctgctcagtttccgggggcg

SEQ ID NO: 369418 - DNA, 20 bp, Artificial Sequence
  chemically synthesized
tgctcagtttccgggggcgg

SEQ ID NO: 369419 - DNA, 20 bp, Artificial Sequence
  chemically synthesized
atgatggccgcccccgcccc

SEQ ID NO: 369420 - DNA, 20 bp, Artificial Sequence
  chemically synthesized
tcagtttccgggggcggggg

SEQ ID NO: 369421 - DNA, 20 bp, Artificial Sequence
  chemically synthesized
acaggcagctgcagtgatga

SEQ ID NO: 369422 - DNA, 20 bp, Artificial Sequence
  chemically synthesized
gggggcggccatcatcactg

SEQ ID NO: 369423 - DNA, 20 bp, Artificial Sequence
  chemically synthesized
tttgctgtaacaggcagctg

SEQ ID NO: 369424 - DNA, 20 bp, Artificial Sequence
  chemically synthesized
atcactgcagctgcctgtta

SEQ ID NO: 369425 - DNA, 20 bp, Artificial Sequence
  chemically synthesized
cagtcatttgctgtaacagg

SEQ ID NO: 369426 - DNA, 20 bp, Artificial Sequence
  chemically synthesized
gctcagtcatttgctgtaac

SEQ ID NO: 369427 - DNA, 20 bp, Artificial Sequence
  chemically synthesized
agctcagtcatttgctgtaa

SEQ ID NO: 369428 - DNA, 20 bp, Artificial Sequence
  chemically synthesized
gcctgttacagcaaatgact

SEQ ID NO: 369429 - DNA, 20 bp, Artificial Sequence
  chemically synthesized
cgcccctccccgggagagct

SEQ ID NO: 369430 - DNA, 20 bp, Artificial Sequence
  chemically synthesized
agcaaatgactgagctctcc

SEQ ID NO: 369431 - DNA, 20 bp, Artificial Sequence
  chemically synthesized
gcaaatgactgagctctccc

SEQ ID NO: 369432 - DNA, 20 bp, Artificial Sequence
  chemically synthesized
caaatgactgagctctcccg

SEQ ID NO: 369433 - DNA, 20 bp, Artificial Sequence
  chemically synthesized
aatgactgagctctcccggg

SEQ ID NO: 369434 - DNA, 20 bp, Artificial Sequence
  chemically synthesized
gatgccgcccctccccggga

SEQ ID NO: 369435 - DNA, 20 bp, Artificial Sequence
  chemically synthesized
atgactgagctctcccgggg

SEQ ID NO: 369436 - DNA, 20 bp, Artificial Sequence
  chemically synthesized
tgactgagctctcccgggga

SEQ ID NO: 369437 - DNA, 20 bp, Artificial Sequence
  chemically synthesized
tagatgccgcccctccccgg

SEQ ID NO: 369438 - DNA, 20 bp, Artificial Sequence
  chemically synthesized
gactgagctctcccggggag

SEQ ID NO: 369439 - DNA, 20 bp, Artificial Sequence
  chemically synthesized
cttagatgccgcccctcccc

SEQ ID NO: 369440 - DNA, 20 bp, Artificial Sequence
  chemically synthesized
tcttagatgccgcccctccc

SEQ ID NO: 369441 - DNA, 20 bp, Artificial Sequence
  chemically synthesized
tgagctctcccggggagggg

SEQ ID NO: 369442 - DNA, 20 bp, Artificial Sequence
  chemically synthesized
cccggggaggggcggcatct

SEQ ID NO: 369443 - DNA, 20 bp, Artificial Sequence
  chemically synthesized
cggggaggggcggcatctaa

SEQ ID NO: 369444 - DNA, 20 bp, Artificial Sequence
  chemically synthesized
ctcttaggtggcagttctct

SEQ ID NO: 369445 - DNA, 20 bp, Artificial Sequence
  chemically synthesized
atctaagagaactgccacct

SEQ ID NO: 369446 - DNA, 20 bp, Artificial Sequence
  chemically synthesized
agctcagttctcttaggtgg

SEQ ID NO: 369447 - DNA, 20 bp, Artificial Sequence
  chemically synthesized
ctaagagaactgccacctaa

SEQ ID NO: 369448 - DNA, 20 bp, Artificial Sequence
  chemically synthesized
agcagctcagttctcttagg

SEQ ID NO: 369449 - DNA, 20 bp, Artificial Sequence
  chemically synthesized
cacagcagctcagttctctt

SEQ ID NO: 369450 - DNA, 20 bp, Artificial Sequence
  chemically synthesized
ccacagcagctcagttctct

SEQ ID NO: 369451 - DNA, 20 bp, Artificial Sequence
  chemically synthesized
aactgccacctaagagaact

SEQ ID NO: 369452 - DNA, 20 bp, Artificial Sequence
  chemically synthesized
tgcccctccccacagcagct

SEQ ID NO: 369453 - DNA, 20 bp, Artificial Sequence
  chemically synthesized
ctaagagaactgagctgctg

SEQ ID NO: 369454 - DNA, 20 bp, Artificial Sequence
  chemically synthesized
taagagaactgagctgctgt

SEQ ID NO: 369455 - DNA, 20 bp, Artificial Sequence
  chemically synthesized
aagagaactgagctgctgtg

SEQ ID NO: 369456 - DNA, 20 bp, Artificial Sequence
  chemically synthesized
gagaactgagctgctgtggg

SEQ ID NO: 369457 - DNA, 20 bp, Artificial Sequence
  chemically synthesized
gctgctgcccctccccacag

SEQ ID NO: 369458 - DNA, 20 bp, Artificial Sequence
  chemically synthesized
agaactgagctgctgtgggg

SEQ ID NO: 369459 - DNA, 20 bp, Artificial Sequence
  chemically synthesized
gaactgagctgctgtgggga

SEQ ID NO: 369460 - DNA, 20 bp, Artificial Sequence
  chemically synthesized
aactgagctgctgtggggag

SEQ ID NO: 369461 - DNA, 20 bp, Artificial Sequence
  chemically synthesized
atggctgctgcccctcccca

SEQ ID NO: 369462 - DNA, 20 bp, Artificial Sequence
  chemically synthesized
tgagctgctgtggggagggg

SEQ ID NO: 369463 - DNA, 20 bp, Artificial Sequence
  chemically synthesized
gctgctgtggggaggggcag

SEQ ID NO: 369464 - DNA, 20 bp, Artificial Sequence
  chemically synthesized
gggaggggcagcagccatca

SEQ ID NO: 369465 - DNA, 20 bp, Artificial Sequence
  chemically synthesized
aggggcagcagccatcacgg

SEQ ID NO: 369466 - DNA, 20 bp, Artificial Sequence
  chemically synthesized
taagccggtagccaccgtga

SEQ ID NO: 369467 - DNA, 20 bp, Artificial Sequence
  chemically synthesized
gcagccatcacggtggctac

SEQ ID NO: 369468 - DNA, 20 bp, Artificial Sequence
  chemically synthesized
cagtcctctcagtaagccgg

SEQ ID NO: 369469 - DNA, 20 bp, Artificial Sequence
  chemically synthesized
acggtggctaccggcttact

SEQ ID NO: 369470 - DNA, 20 bp, Artificial Sequence
  chemically synthesized
gctcagtcctctcagtaagc

SEQ ID NO: 369471 - DNA, 20 bp, Artificial Sequence
  chemically synthesized
ggtggctaccggcttactga

SEQ ID NO: 369472 - DNA, 20 bp, Artificial Sequence
  chemically synthesized
gtggctaccggcttactgag

SEQ ID NO: 369473 - DNA, 20 bp, Artificial Sequence
  chemically synthesized
aggagctcagtcctctcagt

SEQ ID NO: 369474 - DNA, 20 bp, Artificial Sequence
  chemically synthesized
ctacaggagctcagtcctct

SEQ ID NO: 369475 - DNA, 20 bp, Artificial Sequence
  chemically synthesized
accggcttactgagaggact

SEQ ID NO: 369476 - DNA, 20 bp, Artificial Sequence
  chemically synthesized
ctgccctccctacaggagct

SEQ ID NO: 369477 - DNA, 20 bp, Artificial Sequence
  chemically synthesized
ctgagaggactgagctcctg

SEQ ID NO: 369478 - DNA, 20 bp, Artificial Sequence
  chemically synthesized
tgagaggactgagctcctgt

SEQ ID NO: 369479 - DNA, 20 bp, Artificial Sequence
  chemically synthesized
gagaggactgagctcctgta

SEQ ID NO: 369480 - DNA, 20 bp, Artificial Sequence
  chemically synthesized
gaggactgagctcctgtagg

SEQ ID NO: 369481 - DNA, 20 bp, Artificial Sequence
  chemically synthesized
ggctgctgccctccctacag

SEQ ID NO: 369482 - DNA, 20 bp, Artificial Sequence
  chemically synthesized
aggactgagctcctgtaggg

SEQ ID NO: 369483 - DNA, 20 bp, Artificial Sequence
  chemically synthesized
ggactgagctcctgtaggga

SEQ ID NO: 369484 - DNA, 20 bp, Artificial Sequence
  chemically synthesized
atggctgctgccctccctac

SEQ ID NO: 369485 - DNA, 20 bp, Artificial Sequence
  chemically synthesized
gatggctgctgccctcccta

SEQ ID NO: 369486 - DNA, 20 bp, Artificial Sequence
  chemically synthesized
ctgagctcctgtagggaggg

SEQ ID NO: 369487 - DNA, 20 bp, Artificial Sequence
  chemically synthesized
agctcctgtagggagggcag

SEQ ID NO: 369488 - DNA, 20 bp, Artificial Sequence
  chemically synthesized
gagggcagcagccatcactg

SEQ ID NO: 369489 - DNA, 20 bp, Artificial Sequence
  chemically synthesized
gtggactggagctgcagtga

SEQ ID NO: 369490 - DNA, 20 bp, Artificial Sequence
  chemically synthesized
agcagccatcactgcagctc

SEQ ID NO: 369491 - DNA, 20 bp, Artificial Sequence
  chemically synthesized
aaaatggtggactggagctg

SEQ ID NO: 369492 - DNA, 20 bp, Artificial Sequence
  chemically synthesized
aggggaaaaatggtggactg

SEQ ID NO: 369493 - DNA, 20 bp, Artificial Sequence
  chemically synthesized
gaaggggaaaaatggtggac

SEQ ID NO: 369494 - DNA, 20 bp, Artificial Sequence
  chemically synthesized
aacctgaaggggaaaaatgg

SEQ ID NO: 369495 - DNA, 20 bp, Artificial Sequence
  chemically synthesized
tcaaacctgaaggggaaaaa

SEQ ID NO: 369496 - DNA, 20 bp, Artificial Sequence
  chemically synthesized
agtccaccatttttcccctt

SEQ ID NO: 369497 - DNA, 20 bp, Artificial Sequence
  chemically synthesized
gtccaccatttttccccttc

SEQ ID NO: 369498 - DNA, 20 bp, Artificial Sequence
  chemically synthesized
agtctccctcaaacctgaag

SEQ ID NO: 369499 - DNA, 20 bp, Artificial Sequence
  chemically synthesized
cagtctccctcaaacctgaa

SEQ ID NO: 369500 - DNA, 20 bp, Artificial Sequence
  chemically synthesized
ccagtctccctcaaacctga

SEQ ID NO: 369501 - DNA, 20 bp, Artificial Sequence
  chemically synthesized
catttttccccttcaggttt

SEQ ID NO: 369502 - DNA, 20 bp, Artificial Sequence
  chemically synthesized
tccagtctccctcaaacctg

SEQ ID NO: 369503 - DNA, 20 bp, Artificial Sequence
  chemically synthesized
atttttccccttcaggtttg

SEQ ID NO: 369504 - DNA, 20 bp, Artificial Sequence
  chemically synthesized
tttttccccttcaggtttga

SEQ ID NO: 369505 - DNA, 20 bp, Artificial Sequence
  chemically synthesized
tttccccttcaggtttgagg

SEQ ID NO: 369506 - DNA, 20 bp, Artificial Sequence
  chemically synthesized
ccttcaggtttgagggagac

SEQ ID NO: 369507 - DNA, 20 bp, Artificial Sequence
  chemically synthesized
caggtttgagggagactgga

SEQ ID NO: 369508 - DNA, 20 bp, Artificial Sequence
  chemically synthesized
cctcctgggttcaaactgtc

SEQ ID NO: 369509 - DNA, 20 bp, Artificial Sequence
  chemically synthesized
gagactggacagtttgaacc

SEQ ID NO: 369510 - DNA, 20 bp, Artificial Sequence
  chemically synthesized
agactggacagtttgaaccc

SEQ ID NO: 369511 - DNA, 20 bp, Artificial Sequence
  chemically synthesized
actggacagtttgaacccag

SEQ ID NO: 369512 - DNA, 20 bp, Artificial Sequence
  chemically synthesized
ctggacagtttgaacccagg

SEQ ID NO: 369513 - DNA, 20 bp, Artificial Sequence
  chemically synthesized
tactgcagggaattcctcct

SEQ ID NO: 369514 - DNA, 20 bp, Artificial Sequence
  chemically synthesized
gtactgcagggaattcctcc

SEQ ID NO: 369515 - DNA, 20 bp, Artificial Sequence
  chemically synthesized
aacccaggaggaattccctg

SEQ ID NO: 369516 - DNA, 20 bp, Artificial Sequence
  chemically synthesized
aggaggaattccctgcagta

SEQ ID NO: 369517 - DNA, 20 bp, Artificial Sequence
  chemically synthesized
agctggtgtgctgtactgca

SEQ ID NO: 369518 - DNA, 20 bp, Artificial Sequence
  chemically synthesized
tagctggtgtgctgtactgc

SEQ ID NO: 369519 - DNA, 20 bp, Artificial Sequence
  chemically synthesized
atagctggtgtgctgtactg

SEQ ID NO: 369520 - DNA, 20 bp, Artificial Sequence
  chemically synthesized
ttccctgcagtacagcacac

SEQ ID NO: 369521 - DNA, 20 bp, Artificial Sequence
  chemically synthesized
gcagtacagcacaccagcta

SEQ ID NO: 369522 - DNA, 20 bp, Artificial Sequence
  chemically synthesized
tggccattatttgccatagc

SEQ ID NO: 369523 - DNA, 20 bp, Artificial Sequence
  chemically synthesized
aatctggccattatttgcca

SEQ ID NO: 369524 - DNA, 20 bp, Artificial Sequence
  chemically synthesized
acaccagctatggcaaataa

SEQ ID NO: 369525 - DNA, 20 bp, Artificial Sequence
  chemically synthesized
cagctatggcaaataatggc

SEQ ID NO: 369526 - DNA, 20 bp, Artificial Sequence
  chemically synthesized
tccggcctaatgaggcaatc

SEQ ID NO: 369527 - DNA, 20 bp, Artificial Sequence
  chemically synthesized
taatggccagattgcctcat

SEQ ID NO: 369528 - DNA, 20 bp, Artificial Sequence
  chemically synthesized
aatggccagattgcctcatt

SEQ ID NO: 369529 - DNA, 20 bp, Artificial Sequence
  chemically synthesized
ggtcagagtccggcctaatg

SEQ ID NO: 369530 - DNA, 20 bp, Artificial Sequence
  chemically synthesized
gccagattgcctcattaggc

SEQ ID NO: 369531 - DNA, 20 bp, Artificial Sequence
  chemically synthesized
gggtcagagtccggcctaat

SEQ ID NO: 369532 - DNA, 20 bp, Artificial Sequence
  chemically synthesized
aggagggatgggtcagagtc

SEQ ID NO: 369533 - DNA, 20 bp, Artificial Sequence
  chemically synthesized
cagtgaggagggatgggtca

SEQ ID NO: 369534 - DNA, 20 bp, Artificial Sequence
  chemically synthesized
cccagtgaggagggatgggt

SEQ ID NO: 369535 - DNA, 20 bp, Artificial Sequence
  chemically synthesized
cctgcccagtgaggagggat

SEQ ID NO: 369536 - DNA, 20 bp, Artificial Sequence
  chemically synthesized
ccctgcccagtgaggaggga

SEQ ID NO: 369537 - DNA, 20 bp, Artificial Sequence
  chemically synthesized
tctgacccatccctcctcac

SEQ ID NO: 369538 - DNA, 20 bp, Artificial Sequence
  chemically synthesized
caggccctgcccagtgagga

SEQ ID NO: 369539 - DNA, 20 bp, Artificial Sequence
  chemically synthesized
ctgacccatccctcctcact

SEQ ID NO: 369540 - DNA, 20 bp, Artificial Sequence
  chemically synthesized
gcaggccctgcccagtgagg

SEQ ID NO: 369541 - DNA, 20 bp, Artificial Sequence
  chemically synthesized
agcaggccctgcccagtgag

SEQ ID NO: 369542 - DNA, 20 bp, Artificial Sequence
  chemically synthesized
acccatccctcctcactggg

SEQ ID NO: 369543 - DNA, 20 bp, Artificial Sequence
  chemically synthesized
caagcaggccctgcccagtg

SEQ ID NO: 369544 - DNA, 20 bp, Artificial Sequence
  chemically synthesized
cccatccctcctcactgggc

SEQ ID NO: 369545 - DNA, 20 bp, Artificial Sequence
  chemically synthesized
gcaagcaggccctgcccagt

SEQ ID NO: 369546 - DNA, 20 bp, Artificial Sequence
  chemically synthesized
ccatccctcctcactgggca

SEQ ID NO: 369547 - DNA, 20 bp, Artificial Sequence
  chemically synthesized
tcctgcaagcaggccctgcc

SEQ ID NO: 369548 - DNA, 20 bp, Artificial Sequence
  chemically synthesized
cactgggcagggcctgcttg

SEQ ID NO: 369549 - DNA, 20 bp, Artificial Sequence
  chemically synthesized
actgggcagggcctgcttgc

SEQ ID NO: 369550 - DNA, 20 bp, Artificial Sequence
  chemically synthesized
ttactggaattcctgcaagc

SEQ ID NO: 369551 - DNA, 20 bp, Artificial Sequence
  chemically synthesized
gttactggaattcctgcaag

SEQ ID NO: 369552 - DNA, 20 bp, Artificial Sequence
  chemically synthesized
ggagttactggaattcctgc

SEQ ID NO: 369553 - DNA, 20 bp, Artificial Sequence
  chemically synthesized
gggcctgcttgcaggaattc

SEQ ID NO: 369554 - DNA, 20 bp, Artificial Sequence
  chemically synthesized
tgcaggaattccagtaactc

SEQ ID NO: 369555 - DNA, 20 bp, Artificial Sequence
  chemically synthesized
aaacccctggctggagttac

SEQ ID NO: 369556 - DNA, 20 bp, Artificial Sequence
  chemically synthesized
ggaattccagtaactccagc

SEQ ID NO: 369557 - DNA, 20 bp, Artificial Sequence
  chemically synthesized
gaattccagtaactccagcc

SEQ ID NO: 369558 - DNA, 20 bp, Artificial Sequence
  chemically synthesized
aattccagtaactccagcca

SEQ ID NO: 369559 - DNA, 20 bp, Artificial Sequence
  chemically synthesized
attccagtaactccagccag

SEQ ID NO: 369560 - DNA, 20 bp, Artificial Sequence
  chemically synthesized
tttccctaaacccctggctg

SEQ ID NO: 369561 - DNA, 20 bp, Artificial Sequence
  chemically synthesized
tctttccctaaacccctggc

SEQ ID NO: 369562 - DNA, 20 bp, Artificial Sequence
  chemically synthesized
agtaactccagccaggggtt

SEQ ID NO: 369563 - DNA, 20 bp, Artificial Sequence
  chemically synthesized
gtaactccagccaggggttt

SEQ ID NO: 369564 - DNA, 20 bp, Artificial Sequence
  chemically synthesized
gagttctttccctaaacccc

SEQ ID NO: 369565 - DNA, 20 bp, Artificial Sequence
  chemically synthesized
taactccagccaggggttta

SEQ ID NO: 369566 - DNA, 20 bp, Artificial Sequence
  chemically synthesized
tccagccaggggtttaggga

SEQ ID NO: 369567 - DNA, 20 bp, Artificial Sequence
  chemically synthesized
gctcaggtccaggggaatcg

SEQ ID NO: 369568 - DNA, 20 bp, Artificial Sequence
  chemically synthesized
ggaaagaactccgattcccc

SEQ ID NO: 369569 - DNA, 20 bp, Artificial Sequence
  chemically synthesized
gggctcaggtccaggggaat

SEQ ID NO: 369570 - DNA, 20 bp, Artificial Sequence
  chemically synthesized
ccctaggggctcaggtccag

SEQ ID NO: 369571 - DNA, 20 bp, Artificial Sequence
  chemically synthesized
actccgattcccctggacct

SEQ ID NO: 369572 - DNA, 20 bp, Artificial Sequence
  chemically synthesized
cccctaggggctcaggtcca

SEQ ID NO: 369573 - DNA, 20 bp, Artificial Sequence
  chemically synthesized
ccccctaggggctcaggtcc

SEQ ID NO: 369574 - DNA, 20 bp, Artificial Sequence
  chemically synthesized
tccccctaggggctcaggtc

SEQ ID NO: 369575 - DNA, 20 bp, Artificial Sequence
  chemically synthesized
ttcccctggacctgagcccc

SEQ ID NO: 369576 - DNA, 20 bp, Artificial Sequence
  chemically synthesized
acccctccccctaggggctc

SEQ ID NO: 369577 - DNA, 20 bp, Artificial Sequence
  chemically synthesized
tcccctggacctgagcccct

SEQ ID NO: 369578 - DNA, 20 bp, Artificial Sequence
  chemically synthesized
cacccctccccctaggggct

SEQ ID NO: 369579 - DNA, 20 bp, Artificial Sequence
  chemically synthesized
cccctggacctgagccccta

SEQ ID NO: 369580 - DNA, 20 bp, Artificial Sequence
  chemically synthesized
ccctggacctgagcccctag

SEQ ID NO: 369581 - DNA, 20 bp, Artificial Sequence
  chemically synthesized
cctggacctgagcccctagg

SEQ ID NO: 369582 - DNA, 20 bp, Artificial Sequence
  chemically synthesized
tggacctgagcccctagggg

SEQ ID NO: 369583 - DNA, 20 bp, Artificial Sequence
  chemically synthesized
atggccacccctccccctag

SEQ ID NO: 369584 - DNA, 20 bp, Artificial Sequence
  chemically synthesized
ggacctgagcccctaggggg

SEQ ID NO: 369585 - DNA, 20 bp, Artificial Sequence
  chemically synthesized
catggccacccctcccccta

SEQ ID NO: 369586 - DNA, 20 bp, Artificial Sequence
  chemically synthesized
gacctgagcccctaggggga

SEQ ID NO: 369587 - DNA, 20 bp, Artificial Sequence
  chemically synthesized
ccatggccacccctccccct

SEQ ID NO: 369588 - DNA, 20 bp, Artificial Sequence
  chemically synthesized
acctgagcccctagggggag

SEQ ID NO: 369589 - DNA, 20 bp, Artificial Sequence
  chemically synthesized
accatggccacccctccccc

SEQ ID NO: 369590 - DNA, 20 bp, Artificial Sequence
  chemically synthesized
tgagcccctagggggagggg

SEQ ID NO: 369591 - DNA, 20 bp, Artificial Sequence
  chemically synthesized
cctagggggaggggtggcca

SEQ ID NO: 369592 - DNA, 20 bp, Artificial Sequence
  chemically synthesized
ccgctgatctgcggagacca

SEQ ID NO: 369593 - DNA, 20 bp, Artificial Sequence
  chemically synthesized
aggggtggccatggtctccg

SEQ ID NO: 369594 - DNA, 20 bp, Artificial Sequence
  chemically synthesized
tggccatggtctccgcagat

SEQ ID NO: 369595 - DNA, 20 bp, Artificial Sequence
  chemically synthesized
actaagtccgctgatctgcg

SEQ ID NO: 369596 - DNA, 20 bp, Artificial Sequence
  chemically synthesized
agactaagtccgctgatctg

SEQ ID NO: 369597 - DNA, 20 bp, Artificial Sequence
  chemically synthesized
ccatggtctccgcagatcag

SEQ ID NO: 369598 - DNA, 20 bp, Artificial Sequence
  chemically synthesized
tctccgcagatcagcggact

SEQ ID NO: 369599 - DNA, 20 bp, Artificial Sequence
  chemically synthesized
gagccagcagggtaaagact

SEQ ID NO: 369600 - DNA, 20 bp, Artificial Sequence
  chemically synthesized
tctttagagccagcagggta

SEQ ID NO: 369601 - DNA, 20 bp, Artificial Sequence
  chemically synthesized
ggacttagtctttaccctgc

SEQ ID NO: 369602 - DNA, 20 bp, Artificial Sequence
  chemically synthesized
cggattctttagagccagca

SEQ ID NO: 369603 - DNA, 20 bp, Artificial Sequence
  chemically synthesized
ccggattctttagagccagc

SEQ ID NO: 369604 - DNA, 20 bp, Artificial Sequence
  chemically synthesized
cccggattctttagagccag

SEQ ID NO: 369605 - DNA, 20 bp, Artificial Sequence
  chemically synthesized
tctttaccctgctggctcta

SEQ ID NO: 369606 - DNA, 20 bp, Artificial Sequence
  chemically synthesized
cttcccggattctttagagc

SEQ ID NO: 369607 - DNA, 20 bp, Artificial Sequence
  chemically synthesized
tgggcttcccggattcttta

SEQ ID NO: 369608 - DNA, 20 bp, Artificial Sequence
  chemically synthesized
cctgctggctctaaagaatc

SEQ ID NO: 369609 - DNA, 20 bp, Artificial Sequence
  chemically synthesized
tctgggcttcccggattctt

SEQ ID NO: 369610 - DNA, 20 bp, Artificial Sequence
  chemically synthesized
ctgctggctctaaagaatcc

SEQ ID NO: 369611 - DNA, 20 bp, Artificial Sequence
  chemically synthesized
ctggctctaaagaatccggg

SEQ ID NO: 369612 - DNA, 20 bp, Artificial Sequence
  chemically synthesized
tctaaagaatccgggaagcc

SEQ ID NO: 369613 - DNA, 20 bp, Artificial Sequence
  chemically synthesized
tcccacttgtctgggcttcc

SEQ ID NO: 369614 - DNA, 20 bp, Artificial Sequence
  chemically synthesized
agaatccgggaagcccagac

SEQ ID NO: 369615 - DNA, 20 bp, Artificial Sequence
  chemically synthesized
atccgggaagcccagacaag

SEQ ID NO: 369616 - DNA, 20 bp, Artificial Sequence
  chemically synthesized
tgggggaatcccacttgtct

SEQ ID NO: 369617 - DNA, 20 bp, Artificial Sequence
  chemically synthesized
tccgggaagcccagacaagt

SEQ ID NO: 369618 - DNA, 20 bp, Artificial Sequence
  chemically synthesized
ctgggggaatcccacttgtc

SEQ ID NO: 369619 - DNA, 20 bp, Artificial Sequence
  chemically synthesized
ccagacaagtgggattcccc

SEQ ID NO: 369620 - DNA, 20 bp, Artificial Sequence
  chemically synthesized
cagacaagtgggattccccc

SEQ ID NO: 369621 - DNA, 20 bp, Artificial Sequence
  chemically synthesized
caagtgggattcccccagga

SEQ ID NO: 369622 - DNA, 20 bp, Artificial Sequence
  chemically synthesized
gagggggtttgctgtcctgg

SEQ ID NO: 369623 - DNA, 20 bp, Artificial Sequence
  chemically synthesized
cgagggggtttgctgtcctg

SEQ ID NO: 369624 - DNA, 20 bp, Artificial Sequence
  chemically synthesized
tcgagggggtttgctgtcct

SEQ ID NO: 369625 - DNA, 20 bp, Artificial Sequence
  chemically synthesized
gtcgagggggtttgctgtcc

SEQ ID NO: 369626 - DNA, 20 bp, Artificial Sequence
  chemically synthesized
tggctgccccttggtcgagg

SEQ ID NO: 369627 - DNA, 20 bp, Artificial Sequence
  chemically synthesized
gacagcaaaccccctcgacc

SEQ ID NO: 369628 - DNA, 20 bp, Artificial Sequence
  chemically synthesized
ctggctgccccttggtcgag

SEQ ID NO: 369629 - DNA, 20 bp, Artificial Sequence
  chemically synthesized
acagcaaaccccctcgacca

SEQ ID NO: 369630 - DNA, 20 bp, Artificial Sequence
  chemically synthesized
tctggctgccccttggtcga

SEQ ID NO: 369631 - DNA, 20 bp, Artificial Sequence
  chemically synthesized
cagcaaaccccctcgaccaa

SEQ ID NO: 369632 - DNA, 20 bp, Artificial Sequence
  chemically synthesized
ctctggctgccccttggtcg

SEQ ID NO: 369633 - DNA, 20 bp, Artificial Sequence
  chemically synthesized
agcaaaccccctcgaccaag

SEQ ID NO: 369634 - DNA, 20 bp, Artificial Sequence
  chemically synthesized
actctggctgccccttggtc

SEQ ID NO: 369635 - DNA, 20 bp, Artificial Sequence
  chemically synthesized
aaaccccctcgaccaagggg

SEQ ID NO: 369636 - DNA, 20 bp, Artificial Sequence
  chemically synthesized
gaagcactctggctgcccct

SEQ ID NO: 369637 - DNA, 20 bp, Artificial Sequence
  chemically synthesized
cccctcgaccaaggggcagc

SEQ ID NO: 369638 - DNA, 20 bp, Artificial Sequence
  chemically synthesized
cctcgaccaaggggcagcca

SEQ ID NO: 369639 - DNA, 20 bp, Artificial Sequence
  chemically synthesized
acccacttaaggaagcactc

SEQ ID NO: 369640 - DNA, 20 bp, Artificial Sequence
  chemically synthesized
ggcagccagagtgcttcctt

SEQ ID NO: 369641 - DNA, 20 bp, Artificial Sequence
  chemically synthesized
agccagagtgcttccttaag

SEQ ID NO: 369642 - DNA, 20 bp, Artificial Sequence
  chemically synthesized
gatccaggacccacttaagg

SEQ ID NO: 369643 - DNA, 20 bp, Artificial Sequence
  chemically synthesized
gccagagtgcttccttaagt

SEQ ID NO: 369644 - DNA, 20 bp, Artificial Sequence
  chemically synthesized
cgggatccaggacccactta

SEQ ID NO: 369645 - DNA, 20 bp, Artificial Sequence
  chemically synthesized
acgggatccaggacccactt

SEQ ID NO: 369646 - DNA, 20 bp, Artificial Sequence
  chemically synthesized
gtgcttccttaagtgggtcc

SEQ ID NO: 369647 - DNA, 20 bp, Artificial Sequence
  chemically synthesized
agtcagggtgcacgggatcc

SEQ ID NO: 369648 - DNA, 20 bp, Artificial Sequence
  chemically synthesized
cagtcagggtgcacgggatc

SEQ ID NO: 369649 - DNA, 20 bp, Artificial Sequence
  chemically synthesized
ctcacccagtcagggtgcac

SEQ ID NO: 369650 - DNA, 20 bp, Artificial Sequence
  chemically synthesized
tctcacccagtcagggtgca

SEQ ID NO: 369651 - DNA, 20 bp, Artificial Sequence
  chemically synthesized
tggatcccgtgcaccctgac

SEQ ID NO: 369652 - DNA, 20 bp, Artificial Sequence
  chemically synthesized
ggatcccgtgcaccctgact

SEQ ID NO: 369653 - DNA, 20 bp, Artificial Sequence
  chemically synthesized
gggtgggtctcacccagtca

SEQ ID NO: 369654 - DNA, 20 bp, Artificial Sequence
  chemically synthesized
ggggtgggtctcacccagtc

SEQ ID NO: 369655 - DNA, 20 bp, Artificial Sequence
  chemically synthesized
cccgtgcaccctgactgggt

SEQ ID NO: 369656 - DNA, 20 bp, Artificial Sequence
  chemically synthesized
gggggtgggtctcacccagt

SEQ ID NO: 369657 - DNA, 20 bp, Artificial Sequence
  chemically synthesized
tgttgggggtgggtctcacc

SEQ ID NO: 369658 - DNA, 20 bp, Artificial Sequence
  chemically synthesized
tagcgactgctgttgggggt

SEQ ID NO: 369659 - DNA, 20 bp, Artificial Sequence
  chemically synthesized
tgggtgagacccacccccaa

SEQ ID NO: 369660 - DNA, 20 bp, Artificial Sequence
  chemically synthesized
ctagcgactgctgttggggg

SEQ ID NO: 369661 - DNA, 20 bp, Artificial Sequence
  chemically synthesized
gtgagacccacccccaacag

SEQ ID NO: 369662 - DNA, 20 bp, Artificial Sequence
  chemically synthesized
tgtctagcgactgctgttgg

SEQ ID NO: 369663 - DNA, 20 bp, Artificial Sequence
  chemically synthesized
gtgtctagcgactgctgttg

SEQ ID NO: 369664 - DNA, 20 bp, Artificial Sequence
  chemically synthesized
ggtgtctagcgactgctgtt

SEQ ID NO: 369665 - DNA, 20 bp, Artificial Sequence
  chemically synthesized
aggtgtctagcgactgctgt

SEQ ID NO: 369666 - DNA, 20 bp, Artificial Sequence
  chemically synthesized
ccacccccaacagcagtcgc

SEQ ID NO: 369667 - DNA, 20 bp, Artificial Sequence
  chemically synthesized
accttcctgtataaggtgtc

SEQ ID NO: 369668 - DNA, 20 bp, Artificial Sequence
  chemically synthesized
cagtcgctagacaccttata

SEQ ID NO: 369669 - DNA, 20 bp, Artificial Sequence
  chemically synthesized
agtcgctagacaccttatac

SEQ ID NO: 369670 - DNA, 20 bp, Artificial Sequence
  chemically synthesized
agcaggaaccttcctgtata

SEQ ID NO: 369671 - DNA, 20 bp, Artificial Sequence
  chemically synthesized
cgctagacaccttatacagg

SEQ ID NO: 369672 - DNA, 20 bp, Artificial Sequence
  chemically synthesized
cagcaggaaccttcctgtat

SEQ ID NO: 369673 - DNA, 20 bp, Artificial Sequence
  chemically synthesized
gctagacaccttatacagga

SEQ ID NO: 369674 - DNA, 20 bp, Artificial Sequence
  chemically synthesized
ttatacaggaaggttcctgc

SEQ ID NO: 369675 - DNA, 20 bp, Artificial Sequence
  chemically synthesized
gtcactgaccagatgccagc

SEQ ID NO: 369676 - DNA, 20 bp, Artificial Sequence
  chemically synthesized
ggtcactgaccagatgccag

SEQ ID NO: 369677 - DNA, 20 bp, Artificial Sequence
  chemically synthesized
ggaaggttcctgctggcatc

SEQ ID NO: 369678 - DNA, 20 bp, Artificial Sequence
  chemically synthesized
gagggtcactgaccagatgc

SEQ ID NO: 369679 - DNA, 20 bp, Artificial Sequence
  chemically synthesized
ggttcctgctggcatctggt

SEQ ID NO: 369680 - DNA, 20 bp, Artificial Sequence
  chemically synthesized
tgtccctgagggtcactgac

SEQ ID NO: 369681 - DNA, 20 bp, Artificial Sequence
  chemically synthesized
ggcatctggtcagtgaccct

SEQ ID NO: 369682 - DNA, 20 bp, Artificial Sequence
  chemically synthesized
gcatctggtcagtgaccctc

SEQ ID NO: 369683 - DNA, 20 bp, Artificial Sequence
  chemically synthesized
catctggtcagtgaccctca

SEQ ID NO: 369684 - DNA, 20 bp, Artificial Sequence
  chemically synthesized
tggtcagtgaccctcaggga

SEQ ID NO: 369685 - DNA, 20 bp, Artificial Sequence
  chemically synthesized
tctagtatctctgtccctga

SEQ ID NO: 369686 - DNA, 20 bp, Artificial Sequence
  chemically synthesized
ctctagtatctctgtccctg

SEQ ID NO: 369687 - DNA, 20 bp, Artificial Sequence
  chemically synthesized
gtcagtgaccctcagggaca

SEQ ID NO: 369688 - DNA, 20 bp, Artificial Sequence
  chemically synthesized
cctctagtatctctgtccct

SEQ ID NO: 369689 - DNA, 20 bp, Artificial Sequence
  chemically synthesized
accctcagggacagagatac

SEQ ID NO: 369690 - DNA, 20 bp, Artificial Sequence
  chemically synthesized
cctcagggacagagatacta

SEQ ID NO: 369691 - DNA, 20 bp, Artificial Sequence
  chemically synthesized
ctcagggacagagatactag

SEQ ID NO: 369692 - DNA, 20 bp, Artificial Sequence
  chemically synthesized
agggacagagatactagagg

SEQ ID NO: 369693 - DNA, 20 bp, Artificial Sequence
  chemically synthesized
gggacagagatactagagga

SEQ ID NO: 369694 - DNA, 20 bp, Artificial Sequence
  chemically synthesized
gacagagatactagaggaag

SEQ ID NO: 369695 - DNA, 20 bp, Artificial Sequence
  chemically synthesized
tggctgcctgctccttcctc

SEQ ID NO: 369696 - DNA, 20 bp, Artificial Sequence
  chemically synthesized
agagatactagaggaaggag

SEQ ID NO: 369697 - DNA, 20 bp, Artificial Sequence
  chemically synthesized
gagatactagaggaaggagc

SEQ ID NO: 369698 - DNA, 20 bp, Artificial Sequence
  chemically synthesized
atactagaggaaggagcagg

SEQ ID NO: 369699 - DNA, 20 bp, Artificial Sequence
  chemically synthesized
aggctgcagaacagcaaaga

SEQ ID NO: 369700 - DNA, 20 bp, Artificial Sequence
  chemically synthesized
aaggaggctgcagaacagca

SEQ ID NO: 369701 - DNA, 20 bp, Artificial Sequence
  chemically synthesized
cagccatctttgctgttctg

SEQ ID NO: 369702 - DNA, 20 bp, Artificial Sequence
  chemically synthesized
cacctaaggaggctgcagaa

SEQ ID NO: 369703 - DNA, 20 bp, Artificial Sequence
  chemically synthesized
aatgtcacctaaggaggctg

SEQ ID NO: 369704 - DNA, 20 bp, Artificial Sequence
  chemically synthesized
ttgctgttctgcagcctcct

SEQ ID NO: 369705 - DNA, 20 bp, Artificial Sequence
  chemically synthesized
tgctgttctgcagcctcctt

SEQ ID NO: 369706 - DNA, 20 bp, Artificial Sequence
  chemically synthesized
cttggaaatgtcacctaagg

SEQ ID NO: 369707 - DNA, 20 bp, Artificial Sequence
  chemically synthesized
acttggaaatgtcacctaag

SEQ ID NO: 369708 - DNA, 20 bp, Artificial Sequence
  chemically synthesized
gcacttggaaatgtcaccta

SEQ ID NO: 369709 - DNA, 20 bp, Artificial Sequence
  chemically synthesized
tgcacttggaaatgtcacct

SEQ ID NO: 369710 - DNA, 20 bp, Artificial Sequence
  chemically synthesized
cctccttaggtgacatttcc

SEQ ID NO: 369711 - DNA, 20 bp, Artificial Sequence
  chemically synthesized
ttaggtgacatttccaagtg

SEQ ID NO: 369712 - DNA, 20 bp, Artificial Sequence
  chemically synthesized
ggtgacatttccaagtgcag

SEQ ID NO: 369713 - DNA, 20 bp, Artificial Sequence
  chemically synthesized
acctgggtcccttctgcact

SEQ ID NO: 369714 - DNA, 20 bp, Artificial Sequence
  chemically synthesized
gtgacatttccaagtgcaga

SEQ ID NO: 369715 - DNA, 20 bp, Artificial Sequence
  chemically synthesized
tgacatttccaagtgcagaa

SEQ ID NO: 369716 - DNA, 20 bp, Artificial Sequence
  chemically synthesized
ttccaagtgcagaagggacc

SEQ ID NO: 369717 - DNA, 20 bp, Artificial Sequence
  chemically synthesized
tccaagtgcagaagggaccc

SEQ ID NO: 369718 - DNA, 20 bp, Artificial Sequence
  chemically synthesized
gcagaagggacccaggtgaa

SEQ ID NO: 369719 - DNA, 20 bp, Artificial Sequence
  chemically synthesized
gctccagaccccattcacct

SEQ ID NO: 369720 - DNA, 20 bp, Artificial Sequence
  chemically synthesized
cagaagggacccaggtgaat

SEQ ID NO: 369721 - DNA, 20 bp, Artificial Sequence
  chemically synthesized
cgctccagaccccattcacc

SEQ ID NO: 369722 - DNA, 20 bp, Artificial Sequence
  chemically synthesized
agaagggacccaggtgaatg

SEQ ID NO: 369723 - DNA, 20 bp, Artificial Sequence
  chemically synthesized
ggacccaggtgaatggggtc

SEQ ID NO: 369724 - DNA, 20 bp, Artificial Sequence
  chemically synthesized
acccaggtgaatggggtctg

SEQ ID NO: 369725 - DNA, 20 bp, Artificial Sequence
  chemically synthesized
agtttgttgggggttcgctc

SEQ ID NO: 369726 - DNA, 20 bp, Artificial Sequence
  chemically synthesized
gggctgctgcagtttgttgg

SEQ ID NO: 369727 - DNA, 20 bp, Artificial Sequence
  chemically synthesized
agggctgctgcagtttgttg

SEQ ID NO: 369728 - DNA, 20 bp, Artificial Sequence
  chemically synthesized
tagggctgctgcagtttgtt

SEQ ID NO: 369729 - DNA, 20 bp, Artificial Sequence
  chemically synthesized
atagggctgctgcagtttgt

SEQ ID NO: 369730 - DNA, 20 bp, Artificial Sequence
  chemically synthesized
agcgaacccccaacaaactg

SEQ ID NO: 369731 - DNA, 20 bp, Artificial Sequence
  chemically synthesized
gaacccccaacaaactgcag

SEQ ID NO: 369732 - DNA, 20 bp, Artificial Sequence
  chemically synthesized
cctcttctatagggctgctg

SEQ ID NO: 369733 - DNA, 20 bp, Artificial Sequence
  chemically synthesized
aacaaactgcagcagcccta

SEQ ID NO: 369734 - DNA, 20 bp, Artificial Sequence
  chemically synthesized
aaactgcagcagccctatag

SEQ ID NO: 369735 - DNA, 20 bp, Artificial Sequence
  chemically synthesized
actgcagcagccctatagaa

SEQ ID NO: 369736 - DNA, 20 bp, Artificial Sequence
  chemically synthesized
taacaggtccctcttctata

SEQ ID NO: 369737 - DNA, 20 bp, Artificial Sequence
  chemically synthesized
ctgcagcagccctatagaag

SEQ ID NO: 369738 - DNA, 20 bp, Artificial Sequence
  chemically synthesized
ttaacaggtccctcttctat

SEQ ID NO: 369739 - DNA, 20 bp, Artificial Sequence
  chemically synthesized
tgcagcagccctatagaaga

SEQ ID NO: 369740 - DNA, 20 bp, Artificial Sequence
  chemically synthesized
tttaacaggtccctcttcta

SEQ ID NO: 369741 - DNA, 20 bp, Artificial Sequence
  chemically synthesized
agaagagggacctgttaaaa

SEQ ID NO: 369742 - DNA, 20 bp, Artificial Sequence
  chemically synthesized
tttctgtttgcttttttaac

SEQ ID NO: 369743 - DNA, 20 bp, Artificial Sequence
  chemically synthesized
ctttctgtttgcttttttaa

SEQ ID NO: 369744 - DNA, 20 bp, Artificial Sequence
  chemically synthesized
ggacctgttaaaaaagcaaa

SEQ ID NO: 369745 - DNA, 20 bp, Artificial Sequence
  chemically synthesized
ctgttaaaaaagcaaacaga

SEQ ID NO: 369746 - DNA, 20 bp, Artificial Sequence
  chemically synthesized
caaacagaaagcaacaacaa

SEQ ID NO: 369747 - DNA, 20 bp, Artificial Sequence
  chemically synthesized
ctttggatggggttttaatt

SEQ ID NO: 369748 - DNA, 20 bp, Artificial Sequence
  chemically synthesized
cctttggatggggttttaat

SEQ ID NO: 369749 - DNA, 20 bp, Artificial Sequence
  chemically synthesized
cccaattaaaaccccatcca

SEQ ID NO: 369750 - DNA, 20 bp, Artificial Sequence
  chemically synthesized
ccaattaaaaccccatccaa

SEQ ID NO: 369751 - DNA, 20 bp, Artificial Sequence
  chemically synthesized
aggctgctgacctttggatg

SEQ ID NO: 369752 - DNA, 20 bp, Artificial Sequence
  chemically synthesized
gaggctgctgacctttggat

SEQ ID NO: 369753 - DNA, 20 bp, Artificial Sequence
  chemically synthesized
ggaggctgctgacctttgga

SEQ ID NO: 369754 - DNA, 20 bp, Artificial Sequence
  chemically synthesized
ttaaaaccccatccaaaggt

SEQ ID NO: 369755 - DNA, 20 bp, Artificial Sequence
  chemically synthesized
tcttggaggctgctgacctt

SEQ ID NO: 369756 - DNA, 20 bp, Artificial Sequence
  chemically synthesized
aaaccccatccaaaggtcag

SEQ ID NO: 369757 - DNA, 20 bp, Artificial Sequence
  chemically synthesized
tccaaaggtcagcagcctcc

SEQ ID NO: 369758 - DNA, 20 bp, Artificial Sequence
  chemically synthesized
ttgtctagtttcaatcttgg

SEQ ID NO: 369759 - DNA, 20 bp, Artificial Sequence
  chemically synthesized
tttgtctagtttcaatcttg

SEQ ID NO: 369760 - DNA, 20 bp, Artificial Sequence
  chemically synthesized
agtttgtctagtttcaatct

SEQ ID NO: 369761 - DNA, 20 bp, Artificial Sequence
  chemically synthesized
gcagcctccaagattgaaac

SEQ ID NO: 369762 - DNA, 20 bp, Artificial Sequence
  chemically synthesized
ctcatcttcatgagtttgtc

SEQ ID NO: 369763 - DNA, 20 bp, Artificial Sequence
  chemically synthesized
tgaaactagacaaactcatg

SEQ ID NO: 369764 - DNA, 20 bp, Artificial Sequence
  chemically synthesized
tttttgattctcatcttcat

SEQ ID NO: 369765 - DNA, 20 bp, Artificial Sequence
  chemically synthesized
ctagacaaactcatgaagat

SEQ ID NO: 369766 - DNA, 20 bp, Artificial Sequence
  chemically synthesized
actctggctttttgagtttt

SEQ ID NO: 369767 - DNA, 20 bp, Artificial Sequence
  chemically synthesized
aaaaacactgaaaactcaaa

SEQ ID NO: 369768 - DNA, 20 bp, Artificial Sequence
  chemically synthesized
acactgaaaactcaaaaagc

SEQ ID NO: 369769 - DNA, 20 bp, Artificial Sequence
  chemically synthesized
aagaggcactctggcttttt

SEQ ID NO: 369770 - DNA, 20 bp, Artificial Sequence
  chemically synthesized
actgaaaactcaaaaagcca

SEQ ID NO: 369771 - DNA, 20 bp, Artificial Sequence
  chemically synthesized
ttgcaggagaagaggcactc

SEQ ID NO: 369772 - DNA, 20 bp, Artificial Sequence
  chemically synthesized
gcaatcacttgcaggagaag

SEQ ID NO: 369773 - DNA, 20 bp, Artificial Sequence
  chemically synthesized
tgcaatcacttgcaggagaa

SEQ ID NO: 369774 - DNA, 20 bp, Artificial Sequence
  chemically synthesized
cagagtgcctcttctcctgc

SEQ ID NO: 369775 - DNA, 20 bp, Artificial Sequence
  chemically synthesized
gttgcaatcacttgcaggag

SEQ ID NO: 369776 - DNA, 20 bp, Artificial Sequence
  chemically synthesized
ggagttgcaatcacttgcag

SEQ ID NO: 369777 - DNA, 20 bp, Artificial Sequence
  chemically synthesized
gaggagttgcaatcacttgc

SEQ ID NO: 369778 - DNA, 20 bp, Artificial Sequence
  chemically synthesized
agaggagttgcaatcacttg

SEQ ID NO: 369779 - DNA, 20 bp, Artificial Sequence
  chemically synthesized
aagtgattgcaactcctctc

SEQ ID NO: 369780 - DNA, 20 bp, Artificial Sequence
  chemically synthesized
tctgtgcccttgctggagag

SEQ ID NO: 369781 - DNA, 20 bp, Artificial Sequence
  chemically synthesized
gattgcaactcctctccagc

SEQ ID NO: 369782 - DNA, 20 bp, Artificial Sequence
  chemically synthesized
cttctgtgcccttgctggag

SEQ ID NO: 369783 - DNA, 20 bp, Artificial Sequence
  chemically synthesized
attgcaactcctctccagca

SEQ ID NO: 369784 - DNA, 20 bp, Artificial Sequence
  chemically synthesized
acttctgtgcccttgctgga

SEQ ID NO: 369785 - DNA, 20 bp, Artificial Sequence
  chemically synthesized
ttgcaactcctctccagcaa

SEQ ID NO: 369786 - DNA, 20 bp, Artificial Sequence
  chemically synthesized
ccacttctgtgcccttgctg

SEQ ID NO: 369787 - DNA, 20 bp, Artificial Sequence
  chemically synthesized
gtccacttctgtgcccttgc

SEQ ID NO: 369788 - DNA, 20 bp, Artificial Sequence
  chemically synthesized
actcctctccagcaagggca

SEQ ID NO: 369789 - DNA, 20 bp, Artificial Sequence
  chemically synthesized
cctctccagcaagggcacag

SEQ ID NO: 369790 - DNA, 20 bp, Artificial Sequence
  chemically synthesized
ctccagcaagggcacagaag

SEQ ID NO: 369791 - DNA, 20 bp, Artificial Sequence
  chemically synthesized
agcaagggcacagaagtgga

SEQ ID NO: 369792 - DNA, 20 bp, Artificial Sequence
  chemically synthesized
caagggcacagaagtggaca

SEQ ID NO: 369793 - DNA, 20 bp, Artificial Sequence
  chemically synthesized
aagggcacagaagtggacag

SEQ ID NO: 369794 - DNA, 20 bp, Artificial Sequence
  chemically synthesized
cacagaagtggacagaggct

SEQ ID NO: 369795 - DNA, 20 bp, Artificial Sequence
  chemically synthesized
gaagtggacagaggctgaga

SEQ ID NO: 369796 - DNA, 20 bp, Artificial Sequence
  chemically synthesized
ttctgtcaattcagccgtct

SEQ ID NO: 369797 - DNA, 20 bp, Artificial Sequence
  chemically synthesized
ggctgagacggctgaattga

SEQ ID NO: 369798 - DNA, 20 bp, Artificial Sequence
  chemically synthesized
gaagcctacttctgtcaatt

SEQ ID NO: 369799 - DNA, 20 bp, Artificial Sequence
  chemically synthesized
tgagacggctgaattgacag

SEQ ID NO: 369800 - DNA, 20 bp, Artificial Sequence
  chemically synthesized
gacggctgaattgacagaag

SEQ ID NO: 369801 - DNA, 20 bp, Artificial Sequence
  chemically synthesized
acggctgaattgacagaagt

SEQ ID NO: 369802 - DNA, 20 bp, Artificial Sequence
  chemically synthesized
gaattgacagaagtaggctt

SEQ ID NO: 369803 - DNA, 20 bp, Artificial Sequence
  chemically synthesized
ttgacagaagtaggcttcag

SEQ ID NO: 369804 - DNA, 20 bp, Artificial Sequence
  chemically synthesized
tcgttattactcatcttctg

SEQ ID NO: 369805 - DNA, 20 bp, Artificial Sequence
  chemically synthesized
agaagtaggcttcagaagat

SEQ ID NO: 369806 - DNA, 20 bp, Artificial Sequence
  chemically synthesized
gagtaataacgaactttact

SEQ ID NO: 369807 - DNA, 20 bp, Artificial Sequence
  chemically synthesized
catgctcctttagctcagta

SEQ ID NO: 369808 - DNA, 20 bp, Artificial Sequence
  chemically synthesized
taacgaactttactgagcta

SEQ ID NO: 369809 - DNA, 20 bp, Artificial Sequence
  chemically synthesized
aacgaactttactgagctaa

SEQ ID NO: 369810 - DNA, 20 bp, Artificial Sequence
  chemically synthesized
tagaccatgctcctttagct

SEQ ID NO: 369811 - DNA, 20 bp, Artificial Sequence
  chemically synthesized
cgaactttactgagctaaag

SEQ ID NO: 369812 - DNA, 20 bp, Artificial Sequence
  chemically synthesized
tgggttagaccatgctcctt

SEQ ID NO: 369813 - DNA, 20 bp, Artificial Sequence
  chemically synthesized
tttactgagctaaaggagca

SEQ ID NO: 369814 - DNA, 20 bp, Artificial Sequence
  chemically synthesized
ttaacttctttgcattgggt

SEQ ID NO: 369815 - DNA, 20 bp, Artificial Sequence
  chemically synthesized
gcatggtctaacccaatgca

SEQ ID NO: 369816 - DNA, 20 bp, Artificial Sequence
  chemically synthesized
gctcttaacttctttgcatt

SEQ ID NO: 369817 - DNA, 20 bp, Artificial Sequence
  chemically synthesized
ggctcttaacttctttgcat

SEQ ID NO: 369818 - DNA, 20 bp, Artificial Sequence
  chemically synthesized
tggtctaacccaatgcaaag

SEQ ID NO: 369819 - DNA, 20 bp, Artificial Sequence
  chemically synthesized
taacccaatgcaaagaagtt

SEQ ID NO: 369820 - DNA, 20 bp, Artificial Sequence
  chemically synthesized
acccaatgcaaagaagttaa

SEQ ID NO: 369821 - DNA, 20 bp, Artificial Sequence
  chemically synthesized
gctcctgtaatgttttatca

SEQ ID NO: 369822 - DNA, 20 bp, Artificial Sequence
  chemically synthesized
agagccatgataaaacatta

SEQ ID NO: 369823 - DNA, 20 bp, Artificial Sequence
  chemically synthesized
gagccatgataaaacattac

SEQ ID NO: 369824 - DNA, 20 bp, Artificial Sequence
  chemically synthesized
gccatgataaaacattacag

SEQ ID NO: 369825 - DNA, 20 bp, Artificial Sequence
  chemically synthesized
acattacaggagctgttaac

SEQ ID NO: 369826 - DNA, 20 bp, Artificial Sequence
  chemically synthesized
agactgataattcttgttaa

SEQ ID NO: 369827 - DNA, 20 bp, Artificial Sequence
  chemically synthesized
gagctgttaacaagaattat

SEQ ID NO: 369828 - DNA, 20 bp, Artificial Sequence
  chemically synthesized
gttaacaagaattatcagtc

SEQ ID NO: 369829 - DNA, 20 bp, Artificial Sequence
  chemically synthesized
taacaagaattatcagtcta

SEQ ID NO: 369830 - DNA, 20 bp, Artificial Sequence
  chemically synthesized
acaagaattatcagtctaga

SEQ ID NO: 369831 - DNA, 20 bp, Artificial Sequence
  chemically synthesized
gggtcatttatgttactctc

SEQ ID NO: 369832 - DNA, 20 bp, Artificial Sequence
  chemically synthesized
gagagtaacataaatgaccc

SEQ ID NO: 369833 - DNA, 20 bp, Artificial Sequence
  chemically synthesized
agagtaacataaatgaccca

SEQ ID NO: 369834 - DNA, 20 bp, Artificial Sequence
  chemically synthesized
gagtaacataaatgacccaa

SEQ ID NO: 369835 - DNA, 20 bp, Artificial Sequence
  chemically synthesized
gtaacataaatgacccaagg

SEQ ID NO: 369836 - DNA, 20 bp, Artificial Sequence
  chemically synthesized
tgtgttttttcagctccctt

SEQ ID NO: 369837 - DNA, 20 bp, Artificial Sequence
  chemically synthesized
ttgtgttttttcagctccct

SEQ ID NO: 369838 - DNA, 20 bp, Artificial Sequence
  chemically synthesized
gtgaagttcttgtgtttttt

SEQ ID NO: 369839 - DNA, 20 bp, Artificial Sequence
  chemically synthesized
caagggagctgaaaaaacac

SEQ ID NO: 369840 - DNA, 20 bp, Artificial Sequence
  chemically synthesized
atacttgcggtagcattgtg

SEQ ID NO: 369841 - DNA, 20 bp, Artificial Sequence
  chemically synthesized
gaacttcacaatgctaccgc

SEQ ID NO: 369842 - DNA, 20 bp, Artificial Sequence
  chemically synthesized
ttggttattgatacttgcgg

SEQ ID NO: 369843 - DNA, 20 bp, Artificial Sequence
  chemically synthesized
tatttggttattgatacttg

SEQ ID NO: 369844 - DNA, 20 bp, Artificial Sequence
  chemically synthesized
cgcaagtatcaataaccaaa

SEQ ID NO: 369845 - DNA, 20 bp, Artificial Sequence
  chemically synthesized
attcttctgcttggtctatt

SEQ ID NO: 369846 - DNA, 20 bp, Artificial Sequence
  chemically synthesized
tatcaataaccaaatagacc

SEQ ID NO: 369847 - DNA, 20 bp, Artificial Sequence
  chemically synthesized
caataaccaaatagaccaag

SEQ ID NO: 369848 - DNA, 20 bp, Artificial Sequence
  chemically synthesized
taaccaaatagaccaagcag

SEQ ID NO: 369849 - DNA, 20 bp, Artificial Sequence
  chemically synthesized
ctgaaattcattcttctgct

SEQ ID NO: 369850 - DNA, 20 bp, Artificial Sequence
  chemically synthesized
ccaagcagaagaatgaattt

SEQ ID NO: 369851 - DNA, 20 bp, Artificial Sequence
  chemically synthesized
aagcagaagaatgaatttca

SEQ ID NO: 369852 - DNA, 20 bp, Artificial Sequence
  chemically synthesized
agaatgaatttcagagcttg

SEQ ID NO: 369853 - DNA, 20 bp, Artificial Sequence
  chemically synthesized
atttcagcaagataatcttc

SEQ ID NO: 369854 - DNA, 20 bp, Artificial Sequence
  chemically synthesized
tctgctggtgttatttcagc

SEQ ID NO: 369855 - DNA, 20 bp, Artificial Sequence
  chemically synthesized
cttgtctgctggtgttattt

SEQ ID NO: 369856 - DNA, 20 bp, Artificial Sequence
  chemically synthesized
ttatcttgctgaaataacac

SEQ ID NO: 369857 - DNA, 20 bp, Artificial Sequence
  chemically synthesized
tcttgctgaaataacaccag

SEQ ID NO: 369858 - DNA, 20 bp, Artificial Sequence
  chemically synthesized
ctgaaataacaccagcagac

SEQ ID NO: 369859 - DNA, 20 bp, Artificial Sequence
  chemically synthesized
ttttctctaatcttgtctgc

SEQ ID NO: 369860 - DNA, 20 bp, Artificial Sequence
  chemically synthesized
ataacaccagcagacaagat

SEQ ID NO: 369861 - DNA, 20 bp, Artificial Sequence
  chemically synthesized
aacaccagcagacaagatta

SEQ ID NO: 369862 - DNA, 20 bp, Artificial Sequence
  chemically synthesized
gcagacaagattagagaaaa

SEQ ID NO: 369863 - DNA, 20 bp, Artificial Sequence
  chemically synthesized
attagagaaaaaagaatgca

SEQ ID NO: 369864 - DNA, 20 bp, Artificial Sequence
  chemically synthesized
ttagagaaaaaagaatgcaa

SEQ ID NO: 369865 - DNA, 20 bp, Artificial Sequence
  chemically synthesized
aaagaatgcaaaggaatgaa

SEQ ID NO: 369866 - DNA, 20 bp, Artificial Sequence
  chemically synthesized
tgcaaaggaatgaatagacg

SEQ ID NO: 369867 - DNA, 20 bp, Artificial Sequence
  chemically synthesized
aggaatgaatagacgcagaa

SEQ ID NO: 369868 - DNA, 20 bp, Artificial Sequence
  chemically synthesized
aaaggatgttgaattttatc

SEQ ID NO: 369869 - DNA, 20 bp, Artificial Sequence
  chemically synthesized
ctgaaggtttttaacatgaa

SEQ ID NO: 369870 - DNA, 20 bp, Artificial Sequence
  chemically synthesized
actgaaggtttttaacatga

SEQ ID NO: 369871 - DNA, 20 bp, Artificial Sequence
  chemically synthesized
cctttcatgttaaaaacctt

SEQ ID NO: 369872 - DNA, 20 bp, Artificial Sequence
  chemically synthesized
ttcatgttaaaaaccttcag

SEQ ID NO: 369873 - DNA, 20 bp, Artificial Sequence
  chemically synthesized
atcaatacctaatctactga

SEQ ID NO: 369874 - DNA, 20 bp, Artificial Sequence
  chemically synthesized
catcaatacctaatctactg

SEQ ID NO: 369875 - DNA, 20 bp, Artificial Sequence
  chemically synthesized
gttaaaaaccttcagtagat

SEQ ID NO: 369876 - DNA, 20 bp, Artificial Sequence
  chemically synthesized
ttaaaaaccttcagtagatt

SEQ ID NO: 369877 - DNA, 20 bp, Artificial Sequence
  chemically synthesized
ttcagtagattaggtattga

SEQ ID NO: 369878 - DNA, 20 bp, Artificial Sequence
  chemically synthesized
gatggaacatgtctctaaat

SEQ ID NO: 369879 - DNA, 20 bp, Artificial Sequence
  chemically synthesized
tggaacatgtctctaaataa

SEQ ID NO: 369880 - DNA, 20 bp, Artificial Sequence
  chemically synthesized
tcataaatagctcttattta

SEQ ID NO: 369881 - DNA, 20 bp, Artificial Sequence
  chemically synthesized
tgtcataaatagctcttatt

SEQ ID NO: 369882 - DNA, 20 bp, Artificial Sequence
  chemically synthesized
ggctgtaggtttgtcataaa

SEQ ID NO: 369883 - DNA, 20 bp, Artificial Sequence
  chemically synthesized
agctatttatgacaaaccta

SEQ ID NO: 369884 - DNA, 20 bp, Artificial Sequence
  chemically synthesized
tctagtatgatattggctgt

SEQ ID NO: 369885 - DNA, 20 bp, Artificial Sequence
  chemically synthesized
atctagtatgatattggctg

SEQ ID NO: 369886 - DNA, 20 bp, Artificial Sequence
  chemically synthesized
ttgcccatctagtatgatat

SEQ ID NO: 369887 - DNA, 20 bp, Artificial Sequence
  chemically synthesized
acctacagccaatatcatac

SEQ ID NO: 369888 - DNA, 20 bp, Artificial Sequence
  chemically synthesized
acagccaatatcatactaga

SEQ ID NO: 369889 - DNA, 20 bp, Artificial Sequence
  chemically synthesized
cagccaatatcatactagat

SEQ ID NO: 369890 - DNA, 20 bp, Artificial Sequence
  chemically synthesized
acagccagtttttgcccatc

SEQ ID NO: 369891 - DNA, 20 bp, Artificial Sequence
  chemically synthesized
catactagatgggcaaaaac

SEQ ID NO: 369892 - DNA, 20 bp, Artificial Sequence
  chemically synthesized
agatgggcaaaaactggctg

SEQ ID NO: 369893 - DNA, 20 bp, Artificial Sequence
  chemically synthesized
gatgggcaaaaactggctgt

SEQ ID NO: 369894 - DNA, 20 bp, Artificial Sequence
  chemically synthesized
gtcataccaaaacctacagc

SEQ ID NO: 369895 - DNA, 20 bp, Artificial Sequence
  chemically synthesized
caaaaactggctgtaggttt

SEQ ID NO: 369896 - DNA, 20 bp, Artificial Sequence
  chemically synthesized
gtttgtcataccaaaaccta

SEQ ID NO: 369897 - DNA, 20 bp, Artificial Sequence
  chemically synthesized
tgtcttgtgctggttttcaa

SEQ ID NO: 369898 - DNA, 20 bp, Artificial Sequence
  chemically synthesized
tatgacaaacccttgaaaac

SEQ ID NO: 369899 - DNA, 20 bp, Artificial Sequence
  chemically synthesized
ttgtcttgtgctggttttca

SEQ ID NO: 369900 - DNA, 20 bp, Artificial Sequence
  chemically synthesized
cttgtcttgtgctggttttc

SEQ ID NO: 369901 - DNA, 20 bp, Artificial Sequence
  chemically synthesized
aaacccttgaaaaccagcac

SEQ ID NO: 369902 - DNA, 20 bp, Artificial Sequence
  chemically synthesized
agggcatccttgtcttgtgc

SEQ ID NO: 369903 - DNA, 20 bp, Artificial Sequence
  chemically synthesized
cttgaaaaccagcacaagac

SEQ ID NO: 369904 - DNA, 20 bp, Artificial Sequence
  chemically synthesized
ttgaaaaccagcacaagaca

SEQ ID NO: 369905 - DNA, 20 bp, Artificial Sequence
  chemically synthesized
tgaataggaatggtaagaga

SEQ ID NO: 369906 - DNA, 20 bp, Artificial Sequence
  chemically synthesized
ttgaataggaatggtaagag

SEQ ID NO: 369907 - DNA, 20 bp, Artificial Sequence
  chemically synthesized
gttgaataggaatggtaaga

SEQ ID NO: 369908 - DNA, 20 bp, Artificial Sequence
  chemically synthesized
gtgttgaataggaatggtaa

SEQ ID NO: 369909 - DNA, 20 bp, Artificial Sequence
  chemically synthesized
cagtgttgaataggaatggt

SEQ ID NO: 369910 - DNA, 20 bp, Artificial Sequence
  chemically synthesized
aatacagtgttgaataggaa

SEQ ID NO: 369911 - DNA, 20 bp, Artificial Sequence
  chemically synthesized
attccaatacagtgttgaat

SEQ ID NO: 369912 - DNA, 20 bp, Artificial Sequence
  chemically synthesized
aattccaatacagtgttgaa

SEQ ID NO: 369913 - DNA, 20 bp, Artificial Sequence
  chemically synthesized
attcctattcaacactgtat

SEQ ID NO: 369914 - DNA, 20 bp, Artificial Sequence
  chemically synthesized
cctggccagaaattccaata

SEQ ID NO: 369915 - DNA, 20 bp, Artificial Sequence
  chemically synthesized
caacactgtattggaatttc

SEQ ID NO: 369916 - DNA, 20 bp, Artificial Sequence
  chemically synthesized
actgtattggaatttctggc

SEQ ID NO: 369917 - DNA, 20 bp, Artificial Sequence
  chemically synthesized
ctgtattggaatttctggcc

SEQ ID NO: 369918 - DNA, 20 bp, Artificial Sequence
  chemically synthesized
tgtattggaatttctggcca

SEQ ID NO: 369919 - DNA, 20 bp, Artificial Sequence
  chemically synthesized
tcttgcctgattgccctggc

SEQ ID NO: 369920 - DNA, 20 bp, Artificial Sequence
  chemically synthesized
gaatttctggccagggcaat

SEQ ID NO: 369921 - DNA, 20 bp, Artificial Sequence
  chemically synthesized
tttctcttgcctgattgccc

SEQ ID NO: 369922 - DNA, 20 bp, Artificial Sequence
  chemically synthesized
aatttctggccagggcaatc

SEQ ID NO: 369923 - DNA, 20 bp, Artificial Sequence
  chemically synthesized
tctggccagggcaatcaggc

SEQ ID NO: 369924 - DNA, 20 bp, Artificial Sequence
  chemically synthesized
tggccagggcaatcaggcaa

SEQ ID NO: 369925 - DNA, 20 bp, Artificial Sequence
  chemically synthesized
cagggcaatcaggcaagaga

SEQ ID NO: 369926 - DNA, 20 bp, Artificial Sequence
  chemically synthesized
tcaggcaagagaaagaaatc

SEQ ID NO: 369927 - DNA, 20 bp, Artificial Sequence
  chemically synthesized
caggcaagagaaagaaatca

SEQ ID NO: 369928 - DNA, 20 bp, Artificial Sequence
  chemically synthesized
agaaagaaatcaaggataaa

SEQ ID NO: 369929 - DNA, 20 bp, Artificial Sequence
  chemically synthesized
gaaagaaatcaaggataaat

SEQ ID NO: 369930 - DNA, 20 bp, Artificial Sequence
  chemically synthesized
agaaatcaaggataaatagg

SEQ ID NO: 369931 - DNA, 20 bp, Artificial Sequence
  chemically synthesized
aaatcaaggataaataggaa

SEQ ID NO: 369932 - DNA, 20 bp, Artificial Sequence
  chemically synthesized
atcaaggataaataggaaga

SEQ ID NO: 369933 - DNA, 20 bp, Artificial Sequence
  chemically synthesized
tcaaggataaataggaagag

SEQ ID NO: 369934 - DNA, 20 bp, Artificial Sequence
  chemically synthesized
aggataaataggaagagagg

SEQ ID NO: 369935 - DNA, 20 bp, Artificial Sequence
  chemically synthesized
ttctagatacacagaagaga

SEQ ID NO: 369936 - DNA, 20 bp, Artificial Sequence
  chemically synthesized
agttttctagatacacagaa

SEQ ID NO: 369937 - DNA, 20 bp, Artificial Sequence
  chemically synthesized
ggagttttctagatacacag

SEQ ID NO: 369938 - DNA, 20 bp, Artificial Sequence
  chemically synthesized
aactgtctcttctgtgtatc

SEQ ID NO: 369939 - DNA, 20 bp, Artificial Sequence
  chemically synthesized
gatggagttttctagataca

SEQ ID NO: 369940 - DNA, 20 bp, Artificial Sequence
  chemically synthesized
ggtgagacgatggagttttc

SEQ ID NO: 369941 - DNA, 20 bp, Artificial Sequence
  chemically synthesized
gattttggggtgagacgatg

SEQ ID NO: 369942 - DNA, 20 bp, Artificial Sequence
  chemically synthesized
gagattttggggtgagacga

SEQ ID NO: 369943 - DNA, 20 bp, Artificial Sequence
  chemically synthesized
gcttaaggagattttggggt

SEQ ID NO: 369944 - DNA, 20 bp, Artificial Sequence
  chemically synthesized
gccagcttaaggagattttg

SEQ ID NO: 369945 - DNA, 20 bp, Artificial Sequence
  chemically synthesized
tgccagcttaaggagatttt

SEQ ID NO: 369946 - DNA, 20 bp, Artificial Sequence
  chemically synthesized
ttgccagcttaaggagattt

SEQ ID NO: 369947 - DNA, 20 bp, Artificial Sequence
  chemically synthesized
tctcaccccaaaatctcctt

SEQ ID NO: 369948 - DNA, 20 bp, Artificial Sequence
  chemically synthesized
accccaaaatctccttaagc

SEQ ID NO: 369949 - DNA, 20 bp, Artificial Sequence
  chemically synthesized
aatttgcttgccagcttaag

SEQ ID NO: 369950 - DNA, 20 bp, Artificial Sequence
  chemically synthesized
tgaatttgcttgccagctta

SEQ ID NO: 369951 - DNA, 20 bp, Artificial Sequence
  chemically synthesized
ctgaatttgcttgccagctt

SEQ ID NO: 369952 - DNA, 20 bp, Artificial Sequence
  chemically synthesized
caaaatctccttaagctggc

SEQ ID NO: 369953 - DNA, 20 bp, Artificial Sequence
  chemically synthesized
actttgctgaatttgcttgc

SEQ ID NO: 369954 - DNA, 20 bp, Artificial Sequence
  chemically synthesized
cttaagctggcaagcaaatt

SEQ ID NO: 369955 - DNA, 20 bp, Artificial Sequence
  chemically synthesized
gctggcaagcaaattcagca

SEQ ID NO: 369956 - DNA, 20 bp, Artificial Sequence
  chemically synthesized
aagcaaattcagcaaagtct

SEQ ID NO: 369957 - DNA, 20 bp, Artificial Sequence
  chemically synthesized
agcaaattcagcaaagtctc

SEQ ID NO: 369958 - DNA, 20 bp, Artificial Sequence
  chemically synthesized
cacattgatttttgtatcct

SEQ ID NO: 369959 - DNA, 20 bp, Artificial Sequence
  chemically synthesized
aatcaatgtgtaaaaatcac

SEQ ID NO: 369960 - DNA, 20 bp, Artificial Sequence
  chemically synthesized
cacaagcattcctacaacaa

SEQ ID NO: 369961 - DNA, 20 bp, Artificial Sequence
  chemically synthesized
ggctctctgtctattgttgt

SEQ ID NO: 369962 - DNA, 20 bp, Artificial Sequence
  chemically synthesized
tggctctctgtctattgttg

SEQ ID NO: 369963 - DNA, 20 bp, Artificial Sequence
  chemically synthesized
agcattcctacaacaataga

SEQ ID NO: 369964 - DNA, 20 bp, Artificial Sequence
  chemically synthesized
cattcctacaacaatagaca

SEQ ID NO: 369965 - DNA, 20 bp, Artificial Sequence
  chemically synthesized
ttcctacaacaatagacaga

SEQ ID NO: 369966 - DNA, 20 bp, Artificial Sequence
  chemically synthesized
atgggagttcatacatgatt

SEQ ID NO: 369967 - DNA, 20 bp, Artificial Sequence
  chemically synthesized
tttgtagccattgtaaatgg

SEQ ID NO: 369968 - DNA, 20 bp, Artificial Sequence
  chemically synthesized
tctttgtagccattgtaaat

SEQ ID NO: 369969 - DNA, 20 bp, Artificial Sequence
  chemically synthesized
gtatgaactcccatttacaa

SEQ ID NO: 369970 - DNA, 20 bp, Artificial Sequence
  chemically synthesized
ctctttgtagccattgtaaa

SEQ ID NO: 369971 - DNA, 20 bp, Artificial Sequence
  chemically synthesized
tcccatttacaatggctaca

SEQ ID NO: 369972 - DNA, 20 bp, Artificial Sequence
  chemically synthesized
ccatttacaatggctacaaa

SEQ ID NO: 369973 - DNA, 20 bp, Artificial Sequence
  chemically synthesized
tacttactttattctctttg

SEQ ID NO: 369974 - DNA, 20 bp, Artificial Sequence
  chemically synthesized
caatggctacaaagagaata

SEQ ID NO: 369975 - DNA, 20 bp, Artificial Sequence
  chemically synthesized
ggctacaaagagaataaagt

SEQ ID NO: 369976 - DNA, 20 bp, Artificial Sequence
  chemically synthesized
tacaaagagaataaagtaag

SEQ ID NO: 369977 - DNA, 20 bp, Artificial Sequence
  chemically synthesized
acaaagagaataaagtaagt

SEQ ID NO: 369978 - DNA, 20 bp, Artificial Sequence
  chemically synthesized
gaataaagtaagtaggaata

SEQ ID NO: 369979 - DNA, 20 bp, Artificial Sequence
  chemically synthesized
gtaagtaggaatacagctaa

SEQ ID NO: 369980 - DNA, 20 bp, Artificial Sequence
  chemically synthesized
taagtaggaatacagctaac

SEQ ID NO: 369981 - DNA, 20 bp, Artificial Sequence
  chemically synthesized
aggaatacagctaacaggct

SEQ ID NO: 369982 - DNA, 20 bp, Artificial Sequence
  chemically synthesized
aggtggtgcacttagcctgt

SEQ ID NO: 369983 - DNA, 20 bp, Artificial Sequence
  chemically synthesized
ccttgaagaggtggtgcact

SEQ ID NO: 369984 - DNA, 20 bp, Artificial Sequence
  chemically synthesized
gctaagtgcaccacctcttc

SEQ ID NO: 369985 - DNA, 20 bp, Artificial Sequence
  chemically synthesized
tgtagctctccttgaagagg

SEQ ID NO: 369986 - DNA, 20 bp, Artificial Sequence
  chemically synthesized
ctaagtgcaccacctcttca

SEQ ID NO: 369987 - DNA, 20 bp, Artificial Sequence
  chemically synthesized
aagtgcaccacctcttcaag

SEQ ID NO: 369988 - DNA, 20 bp, Artificial Sequence
  chemically synthesized
gtttgtagctctccttgaag

SEQ ID NO: 369989 - DNA, 20 bp, Artificial Sequence
  chemically synthesized
ggtttgtagctctccttgaa

SEQ ID NO: 369990 - DNA, 20 bp, Artificial Sequence
  chemically synthesized
gtgcaccacctcttcaagga

SEQ ID NO: 369991 - DNA, 20 bp, Artificial Sequence
  chemically synthesized
gtggtttgtagctctccttg

SEQ ID NO: 369992 - DNA, 20 bp, Artificial Sequence
  chemically synthesized
gttccttgagcagtggtttg

SEQ ID NO: 369993 - DNA, 20 bp, Artificial Sequence
  chemically synthesized
agagctacaaaccactgctc

SEQ ID NO: 369994 - DNA, 20 bp, Artificial Sequence
  chemically synthesized
gagctacaaaccactgctca

SEQ ID NO: 369995 - DNA, 20 bp, Artificial Sequence
  chemically synthesized
cctcttagttccttgagcag

SEQ ID NO: 369996 - DNA, 20 bp, Artificial Sequence
  chemically synthesized
tgtcctcttagttccttgag

SEQ ID NO: 369997 - DNA, 20 bp, Artificial Sequence
  chemically synthesized
ttgtgtcctcttagttcctt

SEQ ID NO: 369998 - DNA, 20 bp, Artificial Sequence
  chemically synthesized
aaaccactgctcaaggaact

SEQ ID NO: 369999 - DNA, 20 bp, Artificial Sequence
  chemically synthesized
accactgctcaaggaactaa

SEQ ID NO: 370000 - DNA, 20 bp, Artificial Sequence
  chemically synthesized
ccactgctcaaggaactaag

SEQ ID NO: 370001 - DNA, 20 bp, Artificial Sequence
  chemically synthesized
tccatttgtttgtgtcctct

SEQ ID NO: 370002 - DNA, 20 bp, Artificial Sequence
  chemically synthesized
actaagaggacacaaacaaa

SEQ ID NO: 370003 - DNA, 20 bp, Artificial Sequence
  chemically synthesized
aagaggacacaaacaaatgg

SEQ ID NO: 370004 - DNA, 20 bp, Artificial Sequence
  chemically synthesized
ggaagaacattccatgctca

SEQ ID NO: 370005 - DNA, 20 bp, Artificial Sequence
  chemically synthesized
attgattctatccatgagca

SEQ ID NO: 370006 - DNA, 20 bp, Artificial Sequence
  chemically synthesized
gaacattccatgctcatgga

SEQ ID NO: 370007 - DNA, 20 bp, Artificial Sequence
  chemically synthesized
acagtattgattctatccat

SEQ ID NO: 370008 - DNA, 20 bp, Artificial Sequence
  chemically synthesized
tagaatcaatactgtgaaaa

SEQ ID NO: 370009 - DNA, 20 bp, Artificial Sequence
  chemically synthesized
atacagtatggccattttca

SEQ ID NO: 370010 - DNA, 20 bp, Artificial Sequence
  chemically synthesized
aatctataaattatacagta

SEQ ID NO: 370011 - DNA, 20 bp, Artificial Sequence
  chemically synthesized
cattgaatctataaattata

SEQ ID NO: 370012 - DNA, 20 bp, Artificial Sequence
  chemically synthesized
tggccatactgtataattta

SEQ ID NO: 370013 - DNA, 20 bp, Artificial Sequence
  chemically synthesized
caatggtagataaatgggaa

SEQ ID NO: 370014 - DNA, 20 bp, Artificial Sequence
  chemically synthesized
aatgtcaatggtagataaat

SEQ ID NO: 370015 - DNA, 20 bp, Artificial Sequence
  chemically synthesized
taatgtcaatggtagataaa

SEQ ID NO: 370016 - DNA, 20 bp, Artificial Sequence
  chemically synthesized
tctgtgaataatgtcaatgg

SEQ ID NO: 370017 - DNA, 20 bp, Artificial Sequence
  chemically synthesized
aattctgtgaataatgtcaa

SEQ ID NO: 370018 - DNA, 20 bp, Artificial Sequence
  chemically synthesized
tctaccattgacattattca

SEQ ID NO: 370019 - DNA, 20 bp, Artificial Sequence
  chemically synthesized
attgacattattcacagaat

SEQ ID NO: 370020 - DNA, 20 bp, Artificial Sequence
  chemically synthesized
tattcacagaattagaaaaa

SEQ ID NO: 370021 - DNA, 20 bp, Artificial Sequence
  chemically synthesized
gttctgtatgaattttaaaa

SEQ ID NO: 370022 - DNA, 20 bp, Artificial Sequence
  chemically synthesized
aaactgttttaaaattcata

SEQ ID NO: 370023 - DNA, 20 bp, Artificial Sequence
  chemically synthesized
aaaattcatacagaaccaaa

SEQ ID NO: 370024 - DNA, 20 bp, Artificial Sequence
  chemically synthesized
aaattcatacagaaccaaaa

SEQ ID NO: 370025 - DNA, 20 bp, Artificial Sequence
  chemically synthesized
attcatacagaaccaaaaag

SEQ ID NO: 370026 - DNA, 20 bp, Artificial Sequence
  chemically synthesized
tggctatatgggctcctttt

SEQ ID NO: 370027 - DNA, 20 bp, Artificial Sequence
  chemically synthesized
gaaccaaaaaggagcccata

SEQ ID NO: 370028 - DNA, 20 bp, Artificial Sequence
  chemically synthesized
taggattgtcttggctatat

SEQ ID NO: 370029 - DNA, 20 bp, Artificial Sequence
  chemically synthesized
aaaaaggagcccatatagcc

SEQ ID NO: 370030 - DNA, 20 bp, Artificial Sequence
  chemically synthesized
ttaggattgtcttggctata

SEQ ID NO: 370031 - DNA, 20 bp, Artificial Sequence
  chemically synthesized
atttttgcttaggattgtct

SEQ ID NO: 370032 - DNA, 20 bp, Artificial Sequence
  chemically synthesized
catatagccaagacaatcct

SEQ ID NO: 370033 - DNA, 20 bp, Artificial Sequence
  chemically synthesized
tagctttgttatttttgctt

SEQ ID NO: 370034 - DNA, 20 bp, Artificial Sequence
  chemically synthesized
ctagctttgttatttttgct

SEQ ID NO: 370035 - DNA, 20 bp, Artificial Sequence
  chemically synthesized
aatcctaagcaaaaataaca

SEQ ID NO: 370036 - DNA, 20 bp, Artificial Sequence
  chemically synthesized
ctaagcaaaaataacaaagc

SEQ ID NO: 370037 - DNA, 20 bp, Artificial Sequence
  chemically synthesized
agcaaaaataacaaagctag

SEQ ID NO: 370038 - DNA, 20 bp, Artificial Sequence
  chemically synthesized
gtcaggtagcattaggcttc

SEQ ID NO: 370039 - DNA, 20 bp, Artificial Sequence
  chemically synthesized
gtctgaagtcaggtagcatt

SEQ ID NO: 370040 - DNA, 20 bp, Artificial Sequence
  chemically synthesized
agtctgaagtcaggtagcat

SEQ ID NO: 370041 - DNA, 20 bp, Artificial Sequence
  chemically synthesized
tagtatagtctgaagtcagg

SEQ ID NO: 370042 - DNA, 20 bp, Artificial Sequence
  chemically synthesized
agcctaatgctacctgactt

SEQ ID NO: 370043 - DNA, 20 bp, Artificial Sequence
  chemically synthesized
gggtagtatagtctgaagtc

SEQ ID NO: 370044 - DNA, 20 bp, Artificial Sequence
  chemically synthesized
tgggtagtatagtctgaagt

SEQ ID NO: 370045 - DNA, 20 bp, Artificial Sequence
  chemically synthesized
gttttgggtagtatagtctg

SEQ ID NO: 370046 - DNA, 20 bp, Artificial Sequence
  chemically synthesized
ccatgatgttttgggtagta

SEQ ID NO: 370047 - DNA, 20 bp, Artificial Sequence
  chemically synthesized
cagtaccatgatgttttggg

SEQ ID NO: 370048 - DNA, 20 bp, Artificial Sequence
  chemically synthesized
taccagtaccatgatgtttt

SEQ ID NO: 370049 - DNA, 20 bp, Artificial Sequence
  chemically synthesized
ctaccagtaccatgatgttt

SEQ ID NO: 370050 - DNA, 20 bp, Artificial Sequence
  chemically synthesized
ctatactacccaaaacatca

SEQ ID NO: 370051 - DNA, 20 bp, Artificial Sequence
  chemically synthesized
tacccaaaacatcatggtac

SEQ ID NO: 370052 - DNA, 20 bp, Artificial Sequence
  chemically synthesized
ccaaaacatcatggtactgg

SEQ ID NO: 370053 - DNA, 20 bp, Artificial Sequence
  chemically synthesized
ctatgtgtctgtttttctac

SEQ ID NO: 370054 - DNA, 20 bp, Artificial Sequence
  chemically synthesized
tcatggtactggtagaaaaa

SEQ ID NO: 370055 - DNA, 20 bp, Artificial Sequence
  chemically synthesized
ctggtagaaaaacagacaca

SEQ ID NO: 370056 - DNA, 20 bp, Artificial Sequence
  chemically synthesized
aaaacagacacatagaccaa

SEQ ID NO: 370057 - DNA, 20 bp, Artificial Sequence
  chemically synthesized
agacacatagaccaatggaa

SEQ ID NO: 370058 - DNA, 20 bp, Artificial Sequence
  chemically synthesized
agatgttggttctgttccat

SEQ ID NO: 370059 - DNA, 20 bp, Artificial Sequence
  chemically synthesized
atggaacagaaccaacatct

SEQ ID NO: 370060 - DNA, 20 bp, Artificial Sequence
  chemically synthesized
tgatcttatttccaagatgt

SEQ ID NO: 370061 - DNA, 20 bp, Artificial Sequence
  chemically synthesized
agaaccaacatcttggaaat

SEQ ID NO: 370062 - DNA, 20 bp, Artificial Sequence
  chemically synthesized
agatgtgtgatcttatttcc

SEQ ID NO: 370063 - DNA, 20 bp, Artificial Sequence
  chemically synthesized
aacatcagttggttgggtat

SEQ ID NO: 370064 - DNA, 20 bp, Artificial Sequence
  chemically synthesized
ttgtcaaacatcagttggtt

SEQ ID NO: 370065 - DNA, 20 bp, Artificial Sequence
  chemically synthesized
tttgtcaaacatcagttggt

SEQ ID NO: 370066 - DNA, 20 bp, Artificial Sequence
  chemically synthesized
caggtttgtcaaacatcagt

SEQ ID NO: 370067 - DNA, 20 bp, Artificial Sequence
  chemically synthesized
ttgtcaggtttgtcaaacat

SEQ ID NO: 370068 - DNA, 20 bp, Artificial Sequence
  chemically synthesized
ccccattgcttgtttttgtc

SEQ ID NO: 370069 - DNA, 20 bp, Artificial Sequence
  chemically synthesized
tccccattgcttgtttttgt

SEQ ID NO: 370070 - DNA, 20 bp, Artificial Sequence
  chemically synthesized
ttgacaaacctgacaaaaac

SEQ ID NO: 370071 - DNA, 20 bp, Artificial Sequence
  chemically synthesized
aacctgacaaaaacaagcaa

SEQ ID NO: 370072 - DNA, 20 bp, Artificial Sequence
  chemically synthesized
acctgacaaaaacaagcaat

SEQ ID NO: 370073 - DNA, 20 bp, Artificial Sequence
  chemically synthesized
cctgacaaaaacaagcaatg

SEQ ID NO: 370074 - DNA, 20 bp, Artificial Sequence
  chemically synthesized
acaaaaacaagcaatgggga

SEQ ID NO: 370075 - DNA, 20 bp, Artificial Sequence
  chemically synthesized
caaaaacaagcaatggggaa

SEQ ID NO: 370076 - DNA, 20 bp, Artificial Sequence
  chemically synthesized
ccagcaccatttattaaata

SEQ ID NO: 370077 - DNA, 20 bp, Artificial Sequence
  chemically synthesized
cccagcaccatttattaaat

SEQ ID NO: 370078 - DNA, 20 bp, Artificial Sequence
  chemically synthesized
tcccagcaccatttattaaa

SEQ ID NO: 370079 - DNA, 20 bp, Artificial Sequence
  chemically synthesized
aggattccctatttaataaa

SEQ ID NO: 370080 - DNA, 20 bp, Artificial Sequence
  chemically synthesized
ccctatttaataaatggtgc

SEQ ID NO: 370081 - DNA, 20 bp, Artificial Sequence
  chemically synthesized
cctatttaataaatggtgct

SEQ ID NO: 370082 - DNA, 20 bp, Artificial Sequence
  chemically synthesized
atttaataaatggtgctggg

SEQ ID NO: 370083 - DNA, 20 bp, Artificial Sequence
  chemically synthesized
ataaatggtgctgggaagac

SEQ ID NO: 370084 - DNA, 20 bp, Artificial Sequence
  chemically synthesized
atatggctagccagtcttcc

SEQ ID NO: 370085 - DNA, 20 bp, Artificial Sequence
  chemically synthesized
atggtgctgggaagactggc

SEQ ID NO: 370086 - DNA, 20 bp, Artificial Sequence
  chemically synthesized
gttttctgaatatggctagc

SEQ ID NO: 370087 - DNA, 20 bp, Artificial Sequence
  chemically synthesized
ttcagttttctgaatatggc

SEQ ID NO: 370088 - DNA, 20 bp, Artificial Sequence
  chemically synthesized
gaagactggctagccatatt

SEQ ID NO: 370089 - DNA, 20 bp, Artificial Sequence
  chemically synthesized
cagtttcagttttctgaata

SEQ ID NO: 370090 - DNA, 20 bp, Artificial Sequence
  chemically synthesized
catattcagaaaactgaaac

SEQ ID NO: 370091 - DNA, 20 bp, Artificial Sequence
  chemically synthesized
gtaaggaaggtgtccagttt

SEQ ID NO: 370092 - DNA, 20 bp, Artificial Sequence
  chemically synthesized
taaggtgtaaggaaggtgtc

SEQ ID NO: 370093 - DNA, 20 bp, Artificial Sequence
  chemically synthesized
ttttgtataaggtgtaagga

SEQ ID NO: 370094 - DNA, 20 bp, Artificial Sequence
  chemically synthesized
tttttgtataaggtgtaagg

SEQ ID NO: 370095 - DNA, 20 bp, Artificial Sequence
  chemically synthesized
taatttttgtataaggtgta

SEQ ID NO: 370096 - DNA, 20 bp, Artificial Sequence
  chemically synthesized
ttaatttttgtataaggtgt

SEQ ID NO: 370097 - DNA, 20 bp, Artificial Sequence
  chemically synthesized
cttgagttaatttttgtata

SEQ ID NO: 370098 - DNA, 20 bp, Artificial Sequence
  chemically synthesized
tcttgagttaatttttgtat

SEQ ID NO: 370099 - DNA, 20 bp, Artificial Sequence
  chemically synthesized
ccttatacaaaaattaactc

SEQ ID NO: 370100 - DNA, 20 bp, Artificial Sequence
  chemically synthesized
atacaaaaattaactcaaga

SEQ ID NO: 370101 - DNA, 20 bp, Artificial Sequence
  chemically synthesized
ttaagtctttaatccatctt

SEQ ID NO: 370102 - DNA, 20 bp, Artificial Sequence
  chemically synthesized
aattaactcaagatggatta

SEQ ID NO: 370103 - DNA, 20 bp, Artificial Sequence
  chemically synthesized
agttagtgggttttgtgttt

SEQ ID NO: 370104 - DNA, 20 bp, Artificial Sequence
  chemically synthesized
acagggtttttatagttagt

SEQ ID NO: 370105 - DNA, 20 bp, Artificial Sequence
  chemically synthesized
tacagggtttttatagttag

SEQ ID NO: 370106 - DNA, 20 bp, Artificial Sequence
  chemically synthesized
tcttacagggtttttatagt

SEQ ID NO: 370107 - DNA, 20 bp, Artificial Sequence
  chemically synthesized
attttcttacagggttttta

SEQ ID NO: 370108 - DNA, 20 bp, Artificial Sequence
  chemically synthesized
actaactataaaaaccctgt

SEQ ID NO: 370109 - DNA, 20 bp, Artificial Sequence
  chemically synthesized
attgcttagattttcttaca

SEQ ID NO: 370110 - DNA, 20 bp, Artificial Sequence
  chemically synthesized
tattgcttagattttcttac

SEQ ID NO: 370111 - DNA, 20 bp, Artificial Sequence
  chemically synthesized
gtattgcttagattttctta

SEQ ID NO: 370112 - DNA, 20 bp, Artificial Sequence
  chemically synthesized
aaaaccctgtaagaaaatct

SEQ ID NO: 370113 - DNA, 20 bp, Artificial Sequence
  chemically synthesized
atatcctgaatggtattgct

SEQ ID NO: 370114 - DNA, 20 bp, Artificial Sequence
  chemically synthesized
aaaatctaagcaataccatt

SEQ ID NO: 370115 - DNA, 20 bp, Artificial Sequence
  chemically synthesized
aaatctaagcaataccattc

SEQ ID NO: 370116 - DNA, 20 bp, Artificial Sequence
  chemically synthesized
gcctgtgcatatatcctgaa

SEQ ID NO: 370117 - DNA, 20 bp, Artificial Sequence
  chemically synthesized
taccattcaggatatatgca

SEQ ID NO: 370118 - DNA, 20 bp, Artificial Sequence
  chemically synthesized
accattcaggatatatgcac

SEQ ID NO: 370119 - DNA, 20 bp, Artificial Sequence
  chemically synthesized
tcaggatatatgcacaggca

SEQ ID NO: 370120 - DNA, 20 bp, Artificial Sequence
  chemically synthesized
aattgactgatgtttttgtc

SEQ ID NO: 370121 - DNA, 20 bp, Artificial Sequence
  chemically synthesized
caattgactgatgtttttgt

SEQ ID NO: 370122 - DNA, 20 bp, Artificial Sequence
  chemically synthesized
tgatttcctgacaaaaacat

SEQ ID NO: 370123 - DNA, 20 bp, Artificial Sequence
  chemically synthesized
ctatctcagttgttaatttt

SEQ ID NO: 370124 - DNA, 20 bp, Artificial Sequence
  chemically synthesized
aaaactaaaaattaacaact

SEQ ID NO: 370125 - DNA, 20 bp, Artificial Sequence
  chemically synthesized
ctaaaaattaacaactgaga

SEQ ID NO: 370126 - DNA, 20 bp, Artificial Sequence
  chemically synthesized
gaagccttttagttctatct

SEQ ID NO: 370127 - DNA, 20 bp, Artificial Sequence
  chemically synthesized
aacaactgagatagaactaa

SEQ ID NO: 370128 - DNA, 20 bp, Artificial Sequence
  chemically synthesized
acaactgagatagaactaaa

SEQ ID NO: 370129 - DNA, 20 bp, Artificial Sequence
  chemically synthesized
tttgctgtacagaagccttt

SEQ ID NO: 370130 - DNA, 20 bp, Artificial Sequence
  chemically synthesized
agaactaaaaggcttctgta

SEQ ID NO: 370131 - DNA, 20 bp, Artificial Sequence
  chemically synthesized
tttttttttttgctgtacag

SEQ ID NO: 370132 - DNA, 20 bp, Artificial Sequence
  chemically synthesized
ttttttttttttttgctgta

SEQ ID NO: 370133 - DNA, 20 bp, Artificial Sequence
  chemically synthesized
cattctgatgatgggttttg

SEQ ID NO: 370134 - DNA, 20 bp, Artificial Sequence
  chemically synthesized
aaaaccacaaaacccatcat

SEQ ID NO: 370135 - DNA, 20 bp, Artificial Sequence
  chemically synthesized
tgcctgttcattctgatgat

SEQ ID NO: 370136 - DNA, 20 bp, Artificial Sequence
  chemically synthesized
ttgcctgttcattctgatga

SEQ ID NO: 370137 - DNA, 20 bp, Artificial Sequence
  chemically synthesized
aaacccatcatcagaatgaa

SEQ ID NO: 370138 - DNA, 20 bp, Artificial Sequence
  chemically synthesized
aacccatcatcagaatgaac

SEQ ID NO: 370139 - DNA, 20 bp, Artificial Sequence
  chemically synthesized
cagaatgaacaggcaaacta

SEQ ID NO: 370140 - DNA, 20 bp, Artificial Sequence
  chemically synthesized
aatagattgcaaaaattctg

SEQ ID NO: 370141 - DNA, 20 bp, Artificial Sequence
  chemically synthesized
aatgttttgttaatggtaaa

SEQ ID NO: 370142 - DNA, 20 bp, Artificial Sequence
  chemically synthesized
ggggaagaatgttttgttaa

SEQ ID NO: 370143 - DNA, 20 bp, Artificial Sequence
  chemically synthesized
ttacggcaaggatgcagggg

SEQ ID NO: 370144 - DNA, 20 bp, Artificial Sequence
  chemically synthesized
agcttacggcaaggatgcag

SEQ ID NO: 370145 - DNA, 20 bp, Artificial Sequence
  chemically synthesized
aagcttacggcaaggatgca

SEQ ID NO: 370146 - DNA, 20 bp, Artificial Sequence
  chemically synthesized
gaagcttacggcaaggatgc

SEQ ID NO: 370147 - DNA, 20 bp, Artificial Sequence
  chemically synthesized
cgaagcttacggcaaggatg

SEQ ID NO: 370148 - DNA, 20 bp, Artificial Sequence
  chemically synthesized
ttcccctgcatccttgccgt

SEQ ID NO: 370149 - DNA, 20 bp, Artificial Sequence
  chemically synthesized
tgaggtcgaagcttacggca

SEQ ID NO: 370150 - DNA, 20 bp, Artificial Sequence
  chemically synthesized
ctgaggtcgaagcttacggc

SEQ ID NO: 370151 - DNA, 20 bp, Artificial Sequence
  chemically synthesized
aaggctgaggtcgaagctta

SEQ ID NO: 370152 - DNA, 20 bp, Artificial Sequence
  chemically synthesized
cttgccgtaagcttcgacct

SEQ ID NO: 370153 - DNA, 20 bp, Artificial Sequence
  chemically synthesized
tctatccaaggctgaggtcg

SEQ ID NO: 370154 - DNA, 20 bp, Artificial Sequence
  chemically synthesized
gtaagcttcgacctcagcct

SEQ ID NO: 370155 - DNA, 20 bp, Artificial Sequence
  chemically synthesized
ggtgggtctatccaaggctg

SEQ ID NO: 370156 - DNA, 20 bp, Artificial Sequence
  chemically synthesized
gggtgggtctatccaaggct

SEQ ID NO: 370157 - DNA, 20 bp, Artificial Sequence
  chemically synthesized
gcttcgacctcagccttgga

SEQ ID NO: 370158 - DNA, 20 bp, Artificial Sequence
  chemically synthesized
gaggagggtgggtctatcca

SEQ ID NO: 370159 - DNA, 20 bp, Artificial Sequence
  chemically synthesized
ggaggagggtgggtctatcc

SEQ ID NO: 370160 - DNA, 20 bp, Artificial Sequence
  chemically synthesized
attgcaggttggaggagggt

SEQ ID NO: 370161 - DNA, 20 bp, Artificial Sequence
  chemically synthesized
gattgcaggttggaggaggg

SEQ ID NO: 370162 - DNA, 20 bp, Artificial Sequence
  chemically synthesized
aaagattgcaggttggagga

SEQ ID NO: 370163 - DNA, 20 bp, Artificial Sequence
  chemically synthesized
aaaagattgcaggttggagg

SEQ ID NO: 370164 - DNA, 20 bp, Artificial Sequence
  chemically synthesized
gaaaagattgcaggttggag

SEQ ID NO: 370165 - DNA, 20 bp, Artificial Sequence
  chemically synthesized
gggaaaagattgcaggttgg

SEQ ID NO: 370166 - DNA, 20 bp, Artificial Sequence
  chemically synthesized
cgggaaaagattgcaggttg

SEQ ID NO: 370167 - DNA, 20 bp, Artificial Sequence
  chemically synthesized
cacgggaaaagattgcaggt

SEQ ID NO: 370168 - DNA, 20 bp, Artificial Sequence
  chemically synthesized
aaaacacgggaaaagattgc

SEQ ID NO: 370169 - DNA, 20 bp, Artificial Sequence
  chemically synthesized
aaaaacacgggaaaagattg

SEQ ID NO: 370170 - DNA, 20 bp, Artificial Sequence
  chemically synthesized
agagaaaaaaaacacgggaa

SEQ ID NO: 370171 - DNA, 20 bp, Artificial Sequence
  chemically synthesized
gattaagagaaaaaaaacac

SEQ ID NO: 370172 - DNA, 20 bp, Artificial Sequence
  chemically synthesized
agattaagagaaaaaaaaca

SEQ ID NO: 370173 - DNA, 20 bp, Artificial Sequence
  chemically synthesized
tgttttttttctcttaatct

SEQ ID NO: 370174 - DNA, 20 bp, Artificial Sequence
  chemically synthesized
gaaaaatagaccaagattaa

SEQ ID NO: 370175 - DNA, 20 bp, Artificial Sequence
  chemically synthesized
aggaaaaatagaccaagatt

SEQ ID NO: 370176 - DNA, 20 bp, Artificial Sequence
  chemically synthesized
gcagagaggaaaaatagacc

SEQ ID NO: 370177 - DNA, 20 bp, Artificial Sequence
  chemically synthesized
ggtgaagcagagaggaaaaa

SEQ ID NO: 370178 - DNA, 20 bp, Artificial Sequence
  chemically synthesized
gaactgttggtgaagcagag

SEQ ID NO: 370179 - DNA, 20 bp, Artificial Sequence
  chemically synthesized
tgaactgttggtgaagcaga

SEQ ID NO: 370180 - DNA, 20 bp, Artificial Sequence
  chemically synthesized
gatgaactgttggtgaagca

SEQ ID NO: 370181 - DNA, 20 bp, Artificial Sequence
  chemically synthesized
gagatgaactgttggtgaag

SEQ ID NO: 370182 - DNA, 20 bp, Artificial Sequence
  chemically synthesized
tttcctctctgcttcaccaa

SEQ ID NO: 370183 - DNA, 20 bp, Artificial Sequence
  chemically synthesized
agggagatgaactgttggtg

SEQ ID NO: 370184 - DNA, 20 bp, Artificial Sequence
  chemically synthesized
agaatagggagatgaactgt

SEQ ID NO: 370185 - DNA, 20 bp, Artificial Sequence
  chemically synthesized
gacactgaagaaagaatagg

SEQ ID NO: 370186 - DNA, 20 bp, Artificial Sequence
  chemically synthesized
aagacactgaagaaagaata

SEQ ID NO: 370187 - DNA, 20 bp, Artificial Sequence
  chemically synthesized
gaagacactgaagaaagaat

SEQ ID NO: 370188 - DNA, 20 bp, Artificial Sequence
  chemically synthesized
agaagacactgaagaaagaa

SEQ ID NO: 370189 - DNA, 20 bp, Artificial Sequence
  chemically synthesized
tcatctccctattctttctt

SEQ ID NO: 370190 - DNA, 20 bp, Artificial Sequence
  chemically synthesized
gtttcagaagacactgaaga

SEQ ID NO: 370191 - DNA, 20 bp, Artificial Sequence
  chemically synthesized
tagggtttcagaagacactg

SEQ ID NO: 370192 - DNA, 20 bp, Artificial Sequence
  chemically synthesized
aaattattctagggtttcag

SEQ ID NO: 370193 - DNA, 20 bp, Artificial Sequence
  chemically synthesized
ttcagtgtcttctgaaaccc

SEQ ID NO: 370194 - DNA, 20 bp, Artificial Sequence
  chemically synthesized
ttcaaattattctagggttt

SEQ ID NO: 370195 - DNA, 20 bp, Artificial Sequence
  chemically synthesized
caaccattcaaattattcta

SEQ ID NO: 370196 - DNA, 20 bp, Artificial Sequence
  chemically synthesized
acaaccattcaaattattct

SEQ ID NO: 370197 - DNA, 20 bp, Artificial Sequence
  chemically synthesized
gacaaccattcaaattattc

SEQ ID NO: 370198 - DNA, 20 bp, Artificial Sequence
  chemically synthesized
aaaccctagaataatttgaa

SEQ ID NO: 370199 - DNA, 20 bp, Artificial Sequence
  chemically synthesized
tagctgagactgagggcata

SEQ ID NO: 370200 - DNA, 20 bp, Artificial Sequence
  chemically synthesized
aatggttgtctttatgccct

SEQ ID NO: 370201 - DNA, 20 bp, Artificial Sequence
  chemically synthesized
tgtctttatgccctcagtct

SEQ ID NO: 370202 - DNA, 20 bp, Artificial Sequence
  chemically synthesized
tatggaatagctgagactga

SEQ ID NO: 370203 - DNA, 20 bp, Artificial Sequence
  chemically synthesized
ttatggaatagctgagactg

SEQ ID NO: 370204 - DNA, 20 bp, Artificial Sequence
  chemically synthesized
gttatggaatagctgagact

SEQ ID NO: 370205 - DNA, 20 bp, Artificial Sequence
  chemically synthesized
gagtttgttatggaatagct

SEQ ID NO: 370206 - DNA, 20 bp, Artificial Sequence
  chemically synthesized
aaggagagtttgttatggaa

SEQ ID NO: 370207 - DNA, 20 bp, Artificial Sequence
  chemically synthesized
taagtaaggagagtttgtta

SEQ ID NO: 370208 - DNA, 20 bp, Artificial Sequence
  chemically synthesized
gatcaaattctaagtaagga

SEQ ID NO: 370209 - DNA, 20 bp, Artificial Sequence
  chemically synthesized
cataacaaactctccttact

SEQ ID NO: 370210 - DNA, 20 bp, Artificial Sequence
  chemically synthesized
aagatcaaattctaagtaag

SEQ ID NO: 370211 - DNA, 20 bp, Artificial Sequence
  chemically synthesized
tgaagatcaaattctaagta

SEQ ID NO: 370212 - DNA, 20 bp, Artificial Sequence
  chemically synthesized
atgaagatcaaattctaagt

SEQ ID NO: 370213 - DNA, 20 bp, Artificial Sequence
  chemically synthesized
aaacatgaagatcaaattct

SEQ ID NO: 370214 - DNA, 20 bp, Artificial Sequence
  chemically synthesized
attgcaggtaaacaaacatg

SEQ ID NO: 370215 - DNA, 20 bp, Artificial Sequence
  chemically synthesized
tcatgtttgtttacctgcaa

SEQ ID NO: 370216 - DNA, 20 bp, Artificial Sequence
  chemically synthesized
ttaagcctgtttaccattgc

SEQ ID NO: 370217 - DNA, 20 bp, Artificial Sequence
  chemically synthesized
cttaagcctgtttaccattg

SEQ ID NO: 370218 - DNA, 20 bp, Artificial Sequence
  chemically synthesized
tgtttacctgcaatggtaaa

SEQ ID NO: 370219 - DNA, 20 bp, Artificial Sequence
  chemically synthesized
gtttacctgcaatggtaaac

SEQ ID NO: 370220 - DNA, 20 bp, Artificial Sequence
  chemically synthesized
ctgcaatggtaaacaggctt

SEQ ID NO: 370221 - DNA, 20 bp, Artificial Sequence
  chemically synthesized
tgcaatggtaaacaggctta

SEQ ID NO: 370222 - DNA, 20 bp, Artificial Sequence
  chemically synthesized
gggggaaggagacaagcctt

SEQ ID NO: 370223 - DNA, 20 bp, Artificial Sequence
  chemically synthesized
ggagggcgggggaaggagac

SEQ ID NO: 370224 - DNA, 20 bp, Artificial Sequence
  chemically synthesized
tatggggagggcgggggaag

SEQ ID NO: 370225 - DNA, 20 bp, Artificial Sequence
  chemically synthesized
agtatggggagggcggggga

SEQ ID NO: 370226 - DNA, 20 bp, Artificial Sequence
  chemically synthesized
aagtatggggagggcggggg

SEQ ID NO: 370227 - DNA, 20 bp, Artificial Sequence
  chemically synthesized
cttaagtatggggagggcgg

SEQ ID NO: 370228 - DNA, 20 bp, Artificial Sequence
  chemically synthesized
tcttaagtatggggagggcg

SEQ ID NO: 370229 - DNA, 20 bp, Artificial Sequence
  chemically synthesized
atcttaagtatggggagggc

SEQ ID NO: 370230 - DNA, 20 bp, Artificial Sequence
  chemically synthesized
gatcttaagtatggggaggg

SEQ ID NO: 370231 - DNA, 20 bp, Artificial Sequence
  chemically synthesized
cttgatcttaagtatgggga

SEQ ID NO: 370232 - DNA, 20 bp, Artificial Sequence
  chemically synthesized
acttgatcttaagtatgggg

SEQ ID NO: 370233 - DNA, 20 bp, Artificial Sequence
  chemically synthesized
cacttgatcttaagtatggg

SEQ ID NO: 370234 - DNA, 20 bp, Artificial Sequence
  chemically synthesized
cccccgccctccccatactt

SEQ ID NO: 370235 - DNA, 20 bp, Artificial Sequence
  chemically synthesized
cccacttgatcttaagtatg

SEQ ID NO: 370236 - DNA, 20 bp, Artificial Sequence
  chemically synthesized
tcccacttgatcttaagtat

SEQ ID NO: 370237 - DNA, 20 bp, Artificial Sequence
  chemically synthesized
ctcccacttgatcttaagta

SEQ ID NO: 370238 - DNA, 20 bp, Artificial Sequence
  chemically synthesized
ccctccccatacttaagatc

SEQ ID NO: 370239 - DNA, 20 bp, Artificial Sequence
  chemically synthesized
gaaacctcccacttgatctt

SEQ ID NO: 370240 - DNA, 20 bp, Artificial Sequence
  chemically synthesized
tccccatacttaagatcaag

SEQ ID NO: 370241 - DNA, 20 bp, Artificial Sequence
  chemically synthesized
ccccatacttaagatcaagt

SEQ ID NO: 370242 - DNA, 20 bp, Artificial Sequence
  chemically synthesized
ccatacttaagatcaagtgg

SEQ ID NO: 370243 - DNA, 20 bp, Artificial Sequence
  chemically synthesized
catacttaagatcaagtggg

SEQ ID NO: 370244 - DNA, 20 bp, Artificial Sequence
  chemically synthesized
catcagttaatatgttaaaa

SEQ ID NO: 370245 - DNA, 20 bp, Artificial Sequence
  chemically synthesized
ccaagaatgagggaaggcat

SEQ ID NO: 370246 - DNA, 20 bp, Artificial Sequence
  chemically synthesized
tagcttccaagaatgaggga

SEQ ID NO: 370247 - DNA, 20 bp, Artificial Sequence
  chemically synthesized
atagcttccaagaatgaggg

SEQ ID NO: 370248 - DNA, 20 bp, Artificial Sequence
  chemically synthesized
ctgatgccttccctcattct

SEQ ID NO: 370249 - DNA, 20 bp, Artificial Sequence
  chemically synthesized
tatatagcttccaagaatga

SEQ ID NO: 370250 - DNA, 20 bp, Artificial Sequence
  chemically synthesized
atatatagcttccaagaatg

SEQ ID NO: 370251 - DNA, 20 bp, Artificial Sequence
  chemically synthesized
catatatagcttccaagaat

SEQ ID NO: 370252 - DNA, 20 bp, Artificial Sequence
  chemically synthesized
atgccttccctcattcttgg

SEQ ID NO: 370253 - DNA, 20 bp, Artificial Sequence
  chemically synthesized
agtacacatatatagcttcc

SEQ ID NO: 370254 - DNA, 20 bp, Artificial Sequence
  chemically synthesized
cttgaggaagtacacatata

SEQ ID NO: 370255 - DNA, 20 bp, Artificial Sequence
  chemically synthesized
ctatatatgtgtacttcctc

SEQ ID NO: 370256 - DNA, 20 bp, Artificial Sequence
  chemically synthesized
ttatagtagcacgcttgagg

SEQ ID NO: 370257 - DNA, 20 bp, Artificial Sequence
  chemically synthesized
tttttatagtagcacgcttg

SEQ ID NO: 370258 - DNA, 20 bp, Artificial Sequence
  chemically synthesized
atttttatagtagcacgctt

SEQ ID NO: 370259 - DNA, 20 bp, Artificial Sequence
  chemically synthesized
ctttccttgtatttttatag

SEQ ID NO: 370260 - DNA, 20 bp, Artificial Sequence
  chemically synthesized
tctctttccttgtattttta

SEQ ID NO: 370261 - DNA, 20 bp, Artificial Sequence
  chemically synthesized
gcgtgctactataaaaatac

SEQ ID NO: 370262 - DNA, 20 bp, Artificial Sequence
  chemically synthesized
cgtgctactataaaaataca

SEQ ID NO: 370263 - DNA, 20 bp, Artificial Sequence
  chemically synthesized
ctactataaaaatacaagga

SEQ ID NO: 370264 - DNA, 20 bp, Artificial Sequence
  chemically synthesized
actataaaaatacaaggaaa

SEQ ID NO: 370265 - DNA, 20 bp, Artificial Sequence
  chemically synthesized
aatacaaggaaagagacatc

SEQ ID NO: 370266 - DNA, 20 bp, Artificial Sequence
  chemically synthesized
atacaaggaaagagacatca

SEQ ID NO: 370267 - DNA, 20 bp, Artificial Sequence
  chemically synthesized
ggatcaaataatgtgtttct

SEQ ID NO: 370268 - DNA, 20 bp, Artificial Sequence
  chemically synthesized
atagattccagggaattact

SEQ ID NO: 370269 - DNA, 20 bp, Artificial Sequence
  chemically synthesized
tgtgtttctcagtaattccc

SEQ ID NO: 370270 - DNA, 20 bp, Artificial Sequence
  chemically synthesized
aatcttatcaatagattcca

SEQ ID NO: 370271 - DNA, 20 bp, Artificial Sequence
  chemically synthesized
taatcttatcaatagattcc

SEQ ID NO: 370272 - DNA, 20 bp, Artificial Sequence
  chemically synthesized
ctaatcttatcaatagattc

SEQ ID NO: 370273 - DNA, 20 bp, Artificial Sequence
  chemically synthesized
attccctggaatctattgat

SEQ ID NO: 370274 - DNA, 20 bp, Artificial Sequence
  chemically synthesized
cagggctctaatcttatcaa

SEQ ID NO: 370275 - DNA, 20 bp, Artificial Sequence
  chemically synthesized
ctggaatctattgataagat

SEQ ID NO: 370276 - DNA, 20 bp, Artificial Sequence
  chemically synthesized
ggaatctattgataagatta

SEQ ID NO: 370277 - DNA, 20 bp, Artificial Sequence
  chemically synthesized
actaaggatttttcaatgca

SEQ ID NO: 370278 - DNA, 20 bp, Artificial Sequence
  chemically synthesized
tactaaggatttttcaatgc

SEQ ID NO: 370279 - DNA, 20 bp, Artificial Sequence
  chemically synthesized
atactaaggatttttcaatg

SEQ ID NO: 370280 - DNA, 20 bp, Artificial Sequence
  chemically synthesized
gccctgcattgaaaaatcct

SEQ ID NO: 370281 - DNA, 20 bp, Artificial Sequence
  chemically synthesized
cattggtgctcaatatacta

SEQ ID NO: 370282 - DNA, 20 bp, Artificial Sequence
  chemically synthesized
tcattggtgctcaatatact

SEQ ID NO: 370283 - DNA, 20 bp, Artificial Sequence
  chemically synthesized
tgaaaaatccttagtatatt

SEQ ID NO: 370284 - DNA, 20 bp, Artificial Sequence
  chemically synthesized
tacgagatagataatgtcat

SEQ ID NO: 370285 - DNA, 20 bp, Artificial Sequence
  chemically synthesized
cccagctcttatttacgaga

SEQ ID NO: 370286 - DNA, 20 bp, Artificial Sequence
  chemically synthesized
acattatctatctcgtaaat

SEQ ID NO: 370287 - DNA, 20 bp, Artificial Sequence
  chemically synthesized
tcttcccagctcttatttac

SEQ ID NO: 370288 - DNA, 20 bp, Artificial Sequence
  chemically synthesized
attatctatctcgtaaataa

SEQ ID NO: 370289 - DNA, 20 bp, Artificial Sequence
  chemically synthesized
tctatctcgtaaataagagc

SEQ ID NO: 370290 - DNA, 20 bp, Artificial Sequence
  chemically synthesized
ctatctcgtaaataagagct

SEQ ID NO: 370291 - DNA, 20 bp, Artificial Sequence
  chemically synthesized
tctcgtaaataagagctggg

SEQ ID NO: 370292 - DNA, 20 bp, Artificial Sequence
  chemically synthesized
tgtatcttacacaatcttcc

SEQ ID NO: 370293 - DNA, 20 bp, Artificial Sequence
  chemically synthesized
aagagctgggaagattgtgt

SEQ ID NO: 370294 - DNA, 20 bp, Artificial Sequence
  chemically synthesized
tgggaagattgtgtaagata

SEQ ID NO: 370295 - DNA, 20 bp, Artificial Sequence
  chemically synthesized
atacagtttgactcattcca

SEQ ID NO: 370296 - DNA, 20 bp, Artificial Sequence
  chemically synthesized
tacagtttgactcattccaa

SEQ ID NO: 370297 - DNA, 20 bp, Artificial Sequence
  chemically synthesized
aaaaacatttcctttggaat

SEQ ID NO: 370298 - DNA, 20 bp, Artificial Sequence
  chemically synthesized
aagttgaaaaacatttcctt

SEQ ID NO: 370299 - DNA, 20 bp, Artificial Sequence
  chemically synthesized
aggaaatgtttttcaacttc

SEQ ID NO: 370300 - DNA, 20 bp, Artificial Sequence
  chemically synthesized
tgttccagttgaacagctgg

SEQ ID NO: 370301 - DNA, 20 bp, Artificial Sequence
  chemically synthesized
tcttgttccagttgaacagc

SEQ ID NO: 370302 - DNA, 20 bp, Artificial Sequence
  chemically synthesized
tcaacttccagctgttcaac

SEQ ID NO: 370303 - DNA, 20 bp, Artificial Sequence
  chemically synthesized
ctgttcttgttccagttgaa

SEQ ID NO: 370304 - DNA, 20 bp, Artificial Sequence
  chemically synthesized
tccagctgttcaactggaac

SEQ ID NO: 370305 - DNA, 20 bp, Artificial Sequence
  chemically synthesized
ttacaatactgttcttgttc

SEQ ID NO: 370306 - DNA, 20 bp, Artificial Sequence
  chemically synthesized
ctgttcaactggaacaagaa

SEQ ID NO: 370307 - DNA, 20 bp, Artificial Sequence
  chemically synthesized
gaacaagaacagtattgtaa

SEQ ID NO: 370308 - DNA, 20 bp, Artificial Sequence
  chemically synthesized
aacagtattgtaatggatta

SEQ ID NO: 370309 - DNA, 20 bp, Artificial Sequence
  chemically synthesized
gtattgtaatggattatggt

SEQ ID NO: 370310 - DNA, 20 bp, Artificial Sequence
  chemically synthesized
taatggattatggtaagaca

SEQ ID NO: 370311 - DNA, 20 bp, Artificial Sequence
  chemically synthesized
taagacacagtcgttgttat

SEQ ID NO: 370312 - DNA, 20 bp, Artificial Sequence
  chemically synthesized
gttgttatgagcttctgaca

SEQ ID NO: 370313 - DNA, 20 bp, Artificial Sequence
  chemically synthesized
atgatacagtactttgtcag

SEQ ID NO: 370314 - DNA, 20 bp, Artificial Sequence
  chemically synthesized
ggaatgatacagtactttgt

SEQ ID NO: 370315 - DNA, 20 bp, Artificial Sequence
  chemically synthesized
agagtgggagtggaatgata

SEQ ID NO: 370316 - DNA, 20 bp, Artificial Sequence
  chemically synthesized
acttagtctcagagtgggag

SEQ ID NO: 370317 - DNA, 20 bp, Artificial Sequence
  chemically synthesized
tatcattccactcccactct

SEQ ID NO: 370318 - DNA, 20 bp, Artificial Sequence
  chemically synthesized
gaaacttagtctcagagtgg

SEQ ID NO: 370319 - DNA, 20 bp, Artificial Sequence
  chemically synthesized
ctgaaacttagtctcagagt

SEQ ID NO: 370320 - DNA, 20 bp, Artificial Sequence
  chemically synthesized
tctgaaacttagtctcagag

SEQ ID NO: 370321 - DNA, 20 bp, Artificial Sequence
  chemically synthesized
tccactcccactctgagact

SEQ ID NO: 370322 - DNA, 20 bp, Artificial Sequence
  chemically synthesized
gtttctgaaacttagtctca

SEQ ID NO: 370323 - DNA, 20 bp, Artificial Sequence
  chemically synthesized
gggtttctgaaacttagtct

SEQ ID NO: 370324 - DNA, 20 bp, Artificial Sequence
  chemically synthesized
cccactctgagactaagttt

SEQ ID NO: 370325 - DNA, 20 bp, Artificial Sequence
  chemically synthesized
tatatagggtttctgaaact

SEQ ID NO: 370326 - DNA, 20 bp, Artificial Sequence
  chemically synthesized
taagtttcagaaaccctata

SEQ ID NO: 370327 - DNA, 20 bp, Artificial Sequence
  chemically synthesized
aagtttcagaaaccctatat

SEQ ID NO: 370328 - DNA, 20 bp, Artificial Sequence
  chemically synthesized
aattcttctaaacctatata

SEQ ID NO: 370329 - DNA, 20 bp, Artificial Sequence
  chemically synthesized
gaattcttctaaacctatat

SEQ ID NO: 370330 - DNA, 20 bp, Artificial Sequence
  chemically synthesized
ggaattcttctaaacctata

SEQ ID NO: 370331 - DNA, 20 bp, Artificial Sequence
  chemically synthesized
tcagaaaccctatataggtt

SEQ ID NO: 370332 - DNA, 20 bp, Artificial Sequence
  chemically synthesized
gaaaccctatataggtttag

SEQ ID NO: 370333 - DNA, 20 bp, Artificial Sequence
  chemically synthesized
atataggtttagaagaattc

SEQ ID NO: 370334 - DNA, 20 bp, Artificial Sequence
  chemically synthesized
ataggtttagaagaattcca

SEQ ID NO: 370335 - DNA, 20 bp, Artificial Sequence
  chemically synthesized
tttagaagaattccagagtt

SEQ ID NO: 370336 - DNA, 20 bp, Artificial Sequence
  chemically synthesized
agcaaggtacatcttaactc

SEQ ID NO: 370337 - DNA, 20 bp, Artificial Sequence
  chemically synthesized
ttaagatgtaccttgcttgc

SEQ ID NO: 370338 - DNA, 20 bp, Artificial Sequence
  chemically synthesized
aaaccatattctagcaagca

SEQ ID NO: 370339 - DNA, 20 bp, Artificial Sequence
  chemically synthesized
caaaccatattctagcaagc

SEQ ID NO: 370340 - DNA, 20 bp, Artificial Sequence
  chemically synthesized
ctcccaaaccatattctagc

SEQ ID NO: 370341 - DNA, 20 bp, Artificial Sequence
  chemically synthesized
gtaccttgcttgctagaata

SEQ ID NO: 370342 - DNA, 20 bp, Artificial Sequence
  chemically synthesized
tgacctcccaaaccatattc

SEQ ID NO: 370343 - DNA, 20 bp, Artificial Sequence
  chemically synthesized
ttgcttgctagaatatggtt

SEQ ID NO: 370344 - DNA, 20 bp, Artificial Sequence
  chemically synthesized
tgcttgctagaatatggttt

SEQ ID NO: 370345 - DNA, 20 bp, Artificial Sequence
  chemically synthesized
cttgctagaatatggtttgg

SEQ ID NO: 370346 - DNA, 20 bp, Artificial Sequence
  chemically synthesized
ttgctagaatatggtttggg

SEQ ID NO: 370347 - DNA, 20 bp, Artificial Sequence
  chemically synthesized
tttgggaggtcaaatccact

SEQ ID NO: 370348 - DNA, 20 bp, Artificial Sequence
  chemically synthesized
ggagggagggggtgactgag

SEQ ID NO: 370349 - DNA, 20 bp, Artificial Sequence
  chemically synthesized
tggggagggagggggtgact

SEQ ID NO: 370350 - DNA, 20 bp, Artificial Sequence
  chemically synthesized
tgttatgatggggagggagg

SEQ ID NO: 370351 - DNA, 20 bp, Artificial Sequence
  chemically synthesized
gtgttatgatggggagggag

SEQ ID NO: 370352 - DNA, 20 bp, Artificial Sequence
  chemically synthesized
agtgttatgatggggaggga

SEQ ID NO: 370353 - DNA, 20 bp, Artificial Sequence
  chemically synthesized
tagtgttatgatggggaggg

SEQ ID NO: 370354 - DNA, 20 bp, Artificial Sequence
  chemically synthesized
ctagtgttatgatggggagg

SEQ ID NO: 370355 - DNA, 20 bp, Artificial Sequence
  chemically synthesized
tgctagtgttatgatgggga

SEQ ID NO: 370356 - DNA, 20 bp, Artificial Sequence
  chemically synthesized
gtgctagtgttatgatgggg

SEQ ID NO: 370357 - DNA, 20 bp, Artificial Sequence
  chemically synthesized
tgtgctagtgttatgatggg

SEQ ID NO: 370358 - DNA, 20 bp, Artificial Sequence
  chemically synthesized
actgtgctagtgttatgatg

SEQ ID NO: 370359 - DNA, 20 bp, Artificial Sequence
  chemically synthesized
tactgtgctagtgttatgat

SEQ ID NO: 370360 - DNA, 20 bp, Artificial Sequence
  chemically synthesized
ctactgtgctagtgttatga

SEQ ID NO: 370361 - DNA, 20 bp, Artificial Sequence
  chemically synthesized
ctccctccccatcataacac

SEQ ID NO: 370362 - DNA, 20 bp, Artificial Sequence
  chemically synthesized
tccccatcataacactagca

SEQ ID NO: 370363 - DNA, 20 bp, Artificial Sequence
  chemically synthesized
ccatcataacactagcacag

SEQ ID NO: 370364 - DNA, 20 bp, Artificial Sequence
  chemically synthesized
catcataacactagcacagt

SEQ ID NO: 370365 - DNA, 20 bp, Artificial Sequence
  chemically synthesized
catgccttaacctactgtgc

SEQ ID NO: 370366 - DNA, 20 bp, Artificial Sequence
  chemically synthesized
taacactagcacagtaggtt

SEQ ID NO: 370367 - DNA, 20 bp, Artificial Sequence
  chemically synthesized
aacactagcacagtaggtta

SEQ ID NO: 370368 - DNA, 20 bp, Artificial Sequence
  chemically synthesized
cagtaggttaaggcatgaat

SEQ ID NO: 370369 - DNA, 20 bp, Artificial Sequence
  chemically synthesized
aggttaaggcatgaatgagt

SEQ ID NO: 370370 - DNA, 20 bp, Artificial Sequence
  chemically synthesized
ggttaaggcatgaatgagtc

SEQ ID NO: 370371 - DNA, 20 bp, Artificial Sequence
  chemically synthesized
catgaatgagtcaggtgtca

SEQ ID NO: 370372 - DNA, 20 bp, Artificial Sequence
  chemically synthesized
gaatgagtcaggtgtcaaag

SEQ ID NO: 370373 - DNA, 20 bp, Artificial Sequence
  chemically synthesized
aatgagtcaggtgtcaaagc

SEQ ID NO: 370374 - DNA, 20 bp, Artificial Sequence
  chemically synthesized
agtcaggtgtcaaagcaggc

SEQ ID NO: 370375 - DNA, 20 bp, Artificial Sequence
  chemically synthesized
gtcaaagcaggcgagactga

SEQ ID NO: 370376 - DNA, 20 bp, Artificial Sequence
  chemically synthesized
agtgcccagaagcatacttt

SEQ ID NO: 370377 - DNA, 20 bp, Artificial Sequence
  chemically synthesized
cgagactgaaagtatgcttc

SEQ ID NO: 370378 - DNA, 20 bp, Artificial Sequence
  chemically synthesized
gagactgaaagtatgcttct

SEQ ID NO: 370379 - DNA, 20 bp, Artificial Sequence
  chemically synthesized
atcatgcctggagtgcccag

SEQ ID NO: 370380 - DNA, 20 bp, Artificial Sequence
  chemically synthesized
aagtatgcttctgggcactc

SEQ ID NO: 370381 - DNA, 20 bp, Artificial Sequence
  chemically synthesized
ttaatcatgcctggagtgcc

SEQ ID NO: 370382 - DNA, 20 bp, Artificial Sequence
  chemically synthesized
agtatgcttctgggcactcc

SEQ ID NO: 370383 - DNA, 20 bp, Artificial Sequence
  chemically synthesized
taccaatttaatcatgcctg

SEQ ID NO: 370384 - DNA, 20 bp, Artificial Sequence
  chemically synthesized
cataccaatttaatcatgcc

SEQ ID NO: 370385 - DNA, 20 bp, Artificial Sequence
  chemically synthesized
cactccaggcatgattaaat

SEQ ID NO: 370386 - DNA, 20 bp, Artificial Sequence
  chemically synthesized
catgattaaattggtatgaa

SEQ ID NO: 370387 - DNA, 20 bp, Artificial Sequence
  chemically synthesized
atgattaaattggtatgaaa

SEQ ID NO: 370388 - DNA, 20 bp, Artificial Sequence
  chemically synthesized
aattggtatgaaaaggacac

SEQ ID NO: 370389 - DNA, 20 bp, Artificial Sequence
  chemically synthesized
ttggtatgaaaaggacacga

SEQ ID NO: 370390 - DNA, 20 bp, Artificial Sequence
  chemically synthesized
ggtatgaaaaggacacgaga

SEQ ID NO: 370391 - DNA, 20 bp, Artificial Sequence
  chemically synthesized
gtatgaaaaggacacgagag

SEQ ID NO: 370392 - DNA, 20 bp, Artificial Sequence
  chemically synthesized
cgagagaggacatgatatcc

SEQ ID NO: 370393 - DNA, 20 bp, Artificial Sequence
  chemically synthesized
gagagaggacatgatatcca

SEQ ID NO: 370394 - DNA, 20 bp, Artificial Sequence
  chemically synthesized
agagaggacatgatatccaa

SEQ ID NO: 370395 - DNA, 20 bp, Artificial Sequence
  chemically synthesized
ctgggatccagtcaagccct

SEQ ID NO: 370396 - DNA, 20 bp, Artificial Sequence
  chemically synthesized
atgatatccaagggcttgac

SEQ ID NO: 370397 - DNA, 20 bp, Artificial Sequence
  chemically synthesized
acgatgactgggatccagtc

SEQ ID NO: 370398 - DNA, 20 bp, Artificial Sequence
  chemically synthesized
ccaagggcttgactggatcc

SEQ ID NO: 370399 - DNA, 20 bp, Artificial Sequence
  chemically synthesized
caccaacgatgactgggatc

SEQ ID NO: 370400 - DNA, 20 bp, Artificial Sequence
  chemically synthesized
tgtcaccaccaacgatgact

SEQ ID NO: 370401 - DNA, 20 bp, Artificial Sequence
  chemically synthesized
atgtcaccaccaacgatgac

SEQ ID NO: 370402 - DNA, 20 bp, Artificial Sequence
  chemically synthesized
gactggatcccagtcatcgt

SEQ ID NO: 370403 - DNA, 20 bp, Artificial Sequence
  chemically synthesized
tggatcccagtcatcgttgg

SEQ ID NO: 370404 - DNA, 20 bp, Artificial Sequence
  chemically synthesized
agtcatcgttggtggtgaca

SEQ ID NO: 370405 - DNA, 20 bp, Artificial Sequence
  chemically synthesized
gtcatcgttggtggtgacat

SEQ ID NO: 370406 - DNA, 20 bp, Artificial Sequence
  chemically synthesized
tcatcgttggtggtgacatg

SEQ ID NO: 370407 - DNA, 20 bp, Artificial Sequence
  chemically synthesized
cgttggtggtgacatgggga

SEQ ID NO: 370408 - DNA, 20 bp, Artificial Sequence
  chemically synthesized
ttggtggtgacatggggata

SEQ ID NO: 370409 - DNA, 20 bp, Artificial Sequence
  chemically synthesized
gacatggggatagagaccaa

SEQ ID NO: 370410 - DNA, 20 bp, Artificial Sequence
  chemically synthesized
caagtaatcattcagtctgt

SEQ ID NO: 370411 - DNA, 20 bp, Artificial Sequence
  chemically synthesized
tgctgatacaagtaatcatt

SEQ ID NO: 370412 - DNA, 20 bp, Artificial Sequence
  chemically synthesized
gactgaatgattacttgtat

SEQ ID NO: 370413 - DNA, 20 bp, Artificial Sequence
  chemically synthesized
tgaatgattacttgtatcag

SEQ ID NO: 370414 - DNA, 20 bp, Artificial Sequence
  chemically synthesized
ttgaagtcttctgctgatac

SEQ ID NO: 370415 - DNA, 20 bp, Artificial Sequence
  chemically synthesized
atgattacttgtatcagcag

SEQ ID NO: 370416 - DNA, 20 bp, Artificial Sequence
  chemically synthesized
ttgtatcagcagaagacttc

SEQ ID NO: 370417 - DNA, 20 bp, Artificial Sequence
  chemically synthesized
gtatcagcagaagacttcaa

SEQ ID NO: 370418 - DNA, 20 bp, Artificial Sequence
  chemically synthesized
atcagcagaagacttcaaga

SEQ ID NO: 370419 - DNA, 20 bp, Artificial Sequence
  chemically synthesized
tcagcagaagacttcaagag

SEQ ID NO: 370420 - DNA, 20 bp, Artificial Sequence
  chemically synthesized
cctatagtcatcctctcttg

SEQ ID NO: 370421 - DNA, 20 bp, Artificial Sequence
  chemically synthesized
acttcaagagaggatgacta

SEQ ID NO: 370422 - DNA, 20 bp, Artificial Sequence
  chemically synthesized
cttcaagagaggatgactat

SEQ ID NO: 370423 - DNA, 20 bp, Artificial Sequence
  chemically synthesized
aatcggggatgacaagccta

SEQ ID NO: 370424 - DNA, 20 bp, Artificial Sequence
  chemically synthesized
atccagaaatcggggatgac

SEQ ID NO: 370425 - DNA, 20 bp, Artificial Sequence
  chemically synthesized
ggcttgtcatccccgatttc

SEQ ID NO: 370426 - DNA, 20 bp, Artificial Sequence
  chemically synthesized
taagtcacatccagaaatcg

SEQ ID NO: 370427 - DNA, 20 bp, Artificial Sequence
  chemically synthesized
ttaagtcacatccagaaatc

SEQ ID NO: 370428 - DNA, 20 bp, Artificial Sequence
  chemically synthesized
cttaagtcacatccagaaat

SEQ ID NO: 370429 - DNA, 20 bp, Artificial Sequence
  chemically synthesized
aaagggacttaagtcacatc

SEQ ID NO: 370430 - DNA, 20 bp, Artificial Sequence
  chemically synthesized
ccgatttctggatgtgactt

SEQ ID NO: 370431 - DNA, 20 bp, Artificial Sequence
  chemically synthesized
ctttaaatttaaagggactt

SEQ ID NO: 370432 - DNA, 20 bp, Artificial Sequence
  chemically synthesized
tagcaacctttaaatttaaa

SEQ ID NO: 370433 - DNA, 20 bp, Artificial Sequence
  chemically synthesized
ttagcaacctttaaatttaa

SEQ ID NO: 370434 - DNA, 20 bp, Artificial Sequence
  chemically synthesized
attagcaacctttaaattta

SEQ ID NO: 370435 - DNA, 20 bp, Artificial Sequence
  chemically synthesized
cttaagtccctttaaattta

SEQ ID NO: 370436 - DNA, 20 bp, Artificial Sequence
  chemically synthesized
ttaagtccctttaaatttaa

SEQ ID NO: 370437 - DNA, 20 bp, Artificial Sequence
  chemically synthesized
gtagttggtcatgatggcat

SEQ ID NO: 370438 - DNA, 20 bp, Artificial Sequence
  chemically synthesized
tcaatggtagttggtcatga

SEQ ID NO: 370439 - DNA, 20 bp, Artificial Sequence
  chemically synthesized
ttaaaatgttcaatggtagt

SEQ ID NO: 370440 - DNA, 20 bp, Artificial Sequence
  chemically synthesized
tcagttaaaatgttcaatgg

SEQ ID NO: 370441 - DNA, 20 bp, Artificial Sequence
  chemically synthesized
gcatcagttaaaatgttcaa

SEQ ID NO: 370442 - DNA, 20 bp, Artificial Sequence
  chemically synthesized
aagctgtgaggtcagagcat

SEQ ID NO: 370443 - DNA, 20 bp, Artificial Sequence
  chemically synthesized
gtcaaaaagctgtgaggtca

SEQ ID NO: 370444 - DNA, 20 bp, Artificial Sequence
  chemically synthesized
taactgatgctctgacctca

SEQ ID NO: 370445 - DNA, 20 bp, Artificial Sequence
  chemically synthesized
aggtcaaaaagctgtgaggt

SEQ ID NO: 370446 - DNA, 20 bp, Artificial Sequence
  chemically synthesized
tagcaggtcaaaaagctgtg

SEQ ID NO: 370447 - DNA, 20 bp, Artificial Sequence
  chemically synthesized
ttagcaggtcaaaaagctgt

SEQ ID NO: 370448 - DNA, 20 bp, Artificial Sequence
  chemically synthesized
ttgcagcttagcaggtcaaa

SEQ ID NO: 370449 - DNA, 20 bp, Artificial Sequence
  chemically synthesized
tcacagctttttgacctgct

SEQ ID NO: 370450 - DNA, 20 bp, Artificial Sequence
  chemically synthesized
caaagtcattgcagcttagc

SEQ ID NO: 370451 - DNA, 20 bp, Artificial Sequence
  chemically synthesized
tcaaagtcattgcagcttag

SEQ ID NO: 370452 - DNA, 20 bp, Artificial Sequence
  chemically synthesized
tgatcaaagtcattgcagct

SEQ ID NO: 370453 - DNA, 20 bp, Artificial Sequence
  chemically synthesized
caaattgatcaaagtcattg

SEQ ID NO: 370454 - DNA, 20 bp, Artificial Sequence
  chemically synthesized
acatggacgcaaattgatca

SEQ ID NO: 370455 - DNA, 20 bp, Artificial Sequence
  chemically synthesized
tcaatttgcgtccatgttca

SEQ ID NO: 370456 - DNA, 20 bp, Artificial Sequence
  chemically synthesized
gcatgaactggccatgaaca

SEQ ID NO: 370457 - DNA, 20 bp, Artificial Sequence
  chemically synthesized
tttgcgtccatgttcatggc

SEQ ID NO: 370458 - DNA, 20 bp, Artificial Sequence
  chemically synthesized
gtaggtgagaaagcatgaac

SEQ ID NO: 370459 - DNA, 20 bp, Artificial Sequence
  chemically synthesized
atggttcgaggtaggtgaga

SEQ ID NO: 370460 - DNA, 20 bp, Artificial Sequence
  chemically synthesized
taggatggttcgaggtaggt

SEQ ID NO: 370461 - DNA, 20 bp, Artificial Sequence
  chemically synthesized
ggggtaggatggttcgaggt

SEQ ID NO: 370462 - DNA, 20 bp, Artificial Sequence
  chemically synthesized
tggggtaggatggttcgagg

SEQ ID NO: 370463 - DNA, 20 bp, Artificial Sequence
  chemically synthesized
ccatggggtaggatggttcg

SEQ ID NO: 370464 - DNA, 20 bp, Artificial Sequence
  chemically synthesized
tccatggggtaggatggttc

SEQ ID NO: 370465 - DNA, 20 bp, Artificial Sequence
  chemically synthesized
gtgtgatccatggggtagga

SEQ ID NO: 370466 - DNA, 20 bp, Artificial Sequence
  chemically synthesized
cctcgaaccatcctacccca

SEQ ID NO: 370467 - DNA, 20 bp, Artificial Sequence
  chemically synthesized
ctgtgtgtgatccatggggt

SEQ ID NO: 370468 - DNA, 20 bp, Artificial Sequence
  chemically synthesized
actgtgtgtgatccatgggg

SEQ ID NO: 370469 - DNA, 20 bp, Artificial Sequence
  chemically synthesized
ttcactgtgtgtgatccatg

SEQ ID NO: 370470 - DNA, 20 bp, Artificial Sequence
  chemically synthesized
attcactgtgtgtgatccat

SEQ ID NO: 370471 - DNA, 20 bp, Artificial Sequence
  chemically synthesized
aattcactgtgtgtgatcca

SEQ ID NO: 370472 - DNA, 20 bp, Artificial Sequence
  chemically synthesized
cctaccccatggatcacaca

SEQ ID NO: 370473 - DNA, 20 bp, Artificial Sequence
  chemically synthesized
cagtatactgtggtttaagt

SEQ ID NO: 370474 - DNA, 20 bp, Artificial Sequence
  chemically synthesized
tgaattgctcacttaaacca

SEQ ID NO: 370475 - DNA, 20 bp, Artificial Sequence
  chemically synthesized
agaacagtatactgtggttt

SEQ ID NO: 370476 - DNA, 20 bp, Artificial Sequence
  chemically synthesized
gtttcaagaacagtatactg

SEQ ID NO: 370477 - DNA, 20 bp, Artificial Sequence
  chemically synthesized
ggggacagaagtttcaagaa

SEQ ID NO: 370478 - DNA, 20 bp, Artificial Sequence
  chemically synthesized
aaaaaggggacagaagtttc

SEQ ID NO: 370479 - DNA, 20 bp, Artificial Sequence
  chemically synthesized
gaattttaaaaaggggacag

SEQ ID NO: 370480 - DNA, 20 bp, Artificial Sequence
  chemically synthesized
cttgaattttaaaaagggga

SEQ ID NO: 370481 - DNA, 20 bp, Artificial Sequence
  chemically synthesized
aatacttgaattttaaaaag

SEQ ID NO: 370482 - DNA, 20 bp, Artificial Sequence
  chemically synthesized
taatacttgaattttaaaaa

SEQ ID NO: 370483 - DNA, 20 bp, Artificial Sequence
  chemically synthesized
ataatacttgaattttaaaa

SEQ ID NO: 370484 - DNA, 20 bp, Artificial Sequence
  chemically synthesized
gataatacttgaattttaaa

SEQ ID NO: 370485 - DNA, 20 bp, Artificial Sequence
  chemically synthesized
ctgtcccctttttaaaattc

SEQ ID NO: 370486 - DNA, 20 bp, Artificial Sequence
  chemically synthesized
atgtgatatctgtcacattg

SEQ ID NO: 370487 - DNA, 20 bp, Artificial Sequence
  chemically synthesized
aagtattatctacaatgtga

SEQ ID NO: 370488 - DNA, 20 bp, Artificial Sequence
  chemically synthesized
caatgtgacagatatcacat

SEQ ID NO: 370489 - DNA, 20 bp, Artificial Sequence
  chemically synthesized
aatgtgacagatatcacatg

SEQ ID NO: 370490 - DNA, 20 bp, Artificial Sequence
  chemically synthesized
tgacagatatcacatgaggt

SEQ ID NO: 370491 - DNA, 20 bp, Artificial Sequence
  chemically synthesized
ggttagattgaataatgatt

SEQ ID NO: 370492 - DNA, 20 bp, Artificial Sequence
  chemically synthesized
tgatttagtttctgcatttc

SEQ ID NO: 370493 - DNA, 20 bp, Artificial Sequence
  chemically synthesized
gacagtaagctccagaaatg

SEQ ID NO: 370494 - DNA, 20 bp, Artificial Sequence
  chemically synthesized
atttagtttctgcatttctg

SEQ ID NO: 370495 - DNA, 20 bp, Artificial Sequence
  chemically synthesized
cttcttgagacagtaagctc

SEQ ID NO: 370496 - DNA, 20 bp, Artificial Sequence
  chemically synthesized
gttcatcttcttgagacagt

SEQ ID NO: 370497 - DNA, 20 bp, Artificial Sequence
  chemically synthesized
tttctggagcttactgtctc

SEQ ID NO: 370498 - DNA, 20 bp, Artificial Sequence
  chemically synthesized
ctggagcttactgtctcaag

SEQ ID NO: 370499 - DNA, 20 bp, Artificial Sequence
  chemically synthesized
tgttgttcatcttcttgaga

SEQ ID NO: 370500 - DNA, 20 bp, Artificial Sequence
  chemically synthesized
tatttgttgttcatcttctt

SEQ ID NO: 370501 - DNA, 20 bp, Artificial Sequence
  chemically synthesized
caagaagatgaacaacaaat

SEQ ID NO: 370502 - DNA, 20 bp, Artificial Sequence
  chemically synthesized
agaagatgaacaacaaataa

SEQ ID NO: 370503 - DNA, 20 bp, Artificial Sequence
  chemically synthesized
atgacaacattttacatgct

SEQ ID NO: 370504 - DNA, 20 bp, Artificial Sequence
  chemically synthesized
tgacaacattttacatgcta

SEQ ID NO: 370505 - DNA, 20 bp, Artificial Sequence
  chemically synthesized
caacattttacatgctaagg

SEQ ID NO: 370506 - DNA, 20 bp, Artificial Sequence
  chemically synthesized
agttgactttatttctacct

SEQ ID NO: 370507 - DNA, 20 bp, Artificial Sequence
  chemically synthesized
tacatgctaaggtagaaata

SEQ ID NO: 370508 - DNA, 20 bp, Artificial Sequence
  chemically synthesized
agaaataaagtcaactgaaa

SEQ ID NO: 370509 - DNA, 20 bp, Artificial Sequence
  chemically synthesized
ttagccttaaaattcttttt

SEQ ID NO: 370510 - DNA, 20 bp, Artificial Sequence
  chemically synthesized
gtcaactgaaaaagaatttt

SEQ ID NO: 370511 - DNA, 20 bp, Artificial Sequence
  chemically synthesized
tcaactgaaaaagaatttta

SEQ ID NO: 370512 - DNA, 20 bp, Artificial Sequence
  chemically synthesized
tgaaaaagaattttaaggct

SEQ ID NO: 370513 - DNA, 20 bp, Artificial Sequence
  chemically synthesized
agaattttaaggctaagcta

SEQ ID NO: 370514 - DNA, 20 bp, Artificial Sequence
  chemically synthesized
gaattttaaggctaagctat

SEQ ID NO: 370515 - DNA, 20 bp, Artificial Sequence
  chemically synthesized
agaaagggcttcctatagct

SEQ ID NO: 370516 - DNA, 20 bp, Artificial Sequence
  chemically synthesized
ttttaaggctaagctatagg

SEQ ID NO: 370517 - DNA, 20 bp, Artificial Sequence
  chemically synthesized
tcttcagaaagggcttccta

SEQ ID NO: 370518 - DNA, 20 bp, Artificial Sequence
  chemically synthesized
gctataggaagccctttctg

SEQ ID NO: 370519 - DNA, 20 bp, Artificial Sequence
  chemically synthesized
gaattgtatctcttcagaaa

SEQ ID NO: 370520 - DNA, 20 bp, Artificial Sequence
  chemically synthesized
tataggaagccctttctgaa

SEQ ID NO: 370521 - DNA, 20 bp, Artificial Sequence
  chemically synthesized
tgaattgtatctcttcagaa

SEQ ID NO: 370522 - DNA, 20 bp, Artificial Sequence
  chemically synthesized
ttgaattgtatctcttcaga

SEQ ID NO: 370523 - DNA, 20 bp, Artificial Sequence
  chemically synthesized
taccttgaattgtatctctt

SEQ ID NO: 370524 - DNA, 20 bp, Artificial Sequence
  chemically synthesized
tttctgaagagatacaattc

SEQ ID NO: 370525 - DNA, 20 bp, Artificial Sequence
  chemically synthesized
ttctgaagagatacaattca

SEQ ID NO: 370526 - DNA, 20 bp, Artificial Sequence
  chemically synthesized
attcaaggtatgatcttaaa

SEQ ID NO: 370527 - DNA, 20 bp, Artificial Sequence
  chemically synthesized
ttcaaggtatgatcttaaaa

SEQ ID NO: 370528 - DNA, 20 bp, Artificial Sequence
  chemically synthesized
caaggtatgatcttaaaaag

SEQ ID NO: 370529 - DNA, 20 bp, Artificial Sequence
  chemically synthesized
ttttataaaatctccttttt

SEQ ID NO: 370530 - DNA, 20 bp, Artificial Sequence
  chemically synthesized
taaaaaggagattttataaa

SEQ ID NO: 370531 - DNA, 20 bp, Artificial Sequence
  chemically synthesized
aaaaaggagattttataaaa

SEQ ID NO: 370532 - DNA, 20 bp, Artificial Sequence
  chemically synthesized
aaaaggagattttataaaaa

SEQ ID NO: 370533 - DNA, 20 bp, Artificial Sequence
  chemically synthesized
aggagattttataaaaaggg

SEQ ID NO: 370534 - DNA, 20 bp, Artificial Sequence
  chemically synthesized
ttataaaaagggaagaatta

SEQ ID NO: 370535 - DNA, 20 bp, Artificial Sequence
  chemically synthesized
aaaaagggaagaattacaga

SEQ ID NO: 370536 - DNA, 20 bp, Artificial Sequence
  chemically synthesized
aagggaagaattacagatag

SEQ ID NO: 370537 - DNA, 20 bp, Artificial Sequence
  chemically synthesized
agggaagaattacagatagc

SEQ ID NO: 370538 - DNA, 20 bp, Artificial Sequence
  chemically synthesized
gaattacagatagcaggcac

SEQ ID NO: 370539 - DNA, 20 bp, Artificial Sequence
  chemically synthesized
tagcaggcacaagatgcaca

SEQ ID NO: 370540 - DNA, 20 bp, Artificial Sequence
  chemically synthesized
agcaggcacaagatgcacaa

SEQ ID NO: 370541 - DNA, 20 bp, Artificial Sequence
  chemically synthesized
gcaggcacaagatgcacaaa

SEQ ID NO: 370542 - DNA, 20 bp, Artificial Sequence
  chemically synthesized
ggcacaagatgcacaaaggg

SEQ ID NO: 370543 - DNA, 20 bp, Artificial Sequence
  chemically synthesized
acaagatgcacaaagggaag

SEQ ID NO: 370544 - DNA, 20 bp, Artificial Sequence
  chemically synthesized
caagatgcacaaagggaagt

SEQ ID NO: 370545 - DNA, 20 bp, Artificial Sequence
  chemically synthesized
aagatgcacaaagggaagta

SEQ ID NO: 370546 - DNA, 20 bp, Artificial Sequence
  chemically synthesized
agatgcacaaagggaagtag

SEQ ID NO: 370547 - DNA, 20 bp, Artificial Sequence
  chemically synthesized
tgcacaaagggaagtagggg

SEQ ID NO: 370548 - DNA, 20 bp, Artificial Sequence
  chemically synthesized
acaaagggaagtaggggaag

SEQ ID NO: 370549 - DNA, 20 bp, Artificial Sequence
  chemically synthesized
ggggaagtggatgctaaatg

SEQ ID NO: 370550 - DNA, 20 bp, Artificial Sequence
  chemically synthesized
ctttgcccactaacttcatt

SEQ ID NO: 370551 - DNA, 20 bp, Artificial Sequence
  chemically synthesized
aagtggatgctaaatgaagt

SEQ ID NO: 370552 - DNA, 20 bp, Artificial Sequence
  chemically synthesized
tggatgctaaatgaagttag

SEQ ID NO: 370553 - DNA, 20 bp, Artificial Sequence
  chemically synthesized
ggatgctaaatgaagttagt

SEQ ID NO: 370554 - DNA, 20 bp, Artificial Sequence
  chemically synthesized
ctaaatgaagttagtgggca

SEQ ID NO: 370555 - DNA, 20 bp, Artificial Sequence
  chemically synthesized
aatgaagttagtgggcaaag

SEQ ID NO: 370556 - DNA, 20 bp, Artificial Sequence
  chemically synthesized
atgaagttagtgggcaaaga

SEQ ID NO: 370557 - DNA, 20 bp, Artificial Sequence
  chemically synthesized
gttagtgggcaaagaaggat

SEQ ID NO: 370558 - DNA, 20 bp, Artificial Sequence
  chemically synthesized
ttagtgggcaaagaaggata

SEQ ID NO: 370559 - DNA, 20 bp, Artificial Sequence
  chemically synthesized
tagtgggcaaagaaggataa

SEQ ID NO: 370560 - DNA, 20 bp, Artificial Sequence
  chemically synthesized
agtgggcaaagaaggataag

SEQ ID NO: 370561 - DNA, 20 bp, Artificial Sequence
  chemically synthesized
ggcaaagaaggataaggggt

SEQ ID NO: 370562 - DNA, 20 bp, Artificial Sequence
  chemically synthesized
gaaggataaggggtaagcca

SEQ ID NO: 370563 - DNA, 20 bp, Artificial Sequence
  chemically synthesized
ggataaggggtaagccacag

SEQ ID NO: 370564 - DNA, 20 bp, Artificial Sequence
  chemically synthesized
ataaggggtaagccacagta

SEQ ID NO: 370565 - DNA, 20 bp, Artificial Sequence
  chemically synthesized
ttagtttaacatctctactg

SEQ ID NO: 370566 - DNA, 20 bp, Artificial Sequence
  chemically synthesized
agatgttaaactaaatgtaa

SEQ ID NO: 370567 - DNA, 20 bp, Artificial Sequence
  chemically synthesized
aaaagcatctctattacatt

SEQ ID NO: 370568 - DNA, 20 bp, Artificial Sequence
  chemically synthesized
atgttaaactaaatgtaata

SEQ ID NO: 370569 - DNA, 20 bp, Artificial Sequence
  chemically synthesized
atgtaatagagatgctttta

SEQ ID NO: 370570 - DNA, 20 bp, Artificial Sequence
  chemically synthesized
tgtaatagagatgcttttac

SEQ ID NO: 370571 - DNA, 20 bp, Artificial Sequence
  chemically synthesized
ctcctacccaaagcctgtaa

SEQ ID NO: 370572 - DNA, 20 bp, Artificial Sequence
  chemically synthesized
agagatgcttttacaggctt

SEQ ID NO: 370573 - DNA, 20 bp, Artificial Sequence
  chemically synthesized
gagatgcttttacaggcttt

SEQ ID NO: 370574 - DNA, 20 bp, Artificial Sequence
  chemically synthesized
atgcttttacaggctttggg

SEQ ID NO: 370575 - DNA, 20 bp, Artificial Sequence
  chemically synthesized
tgcttttacaggctttgggt

SEQ ID NO: 370576 - DNA, 20 bp, Artificial Sequence
  chemically synthesized
cttttacaggctttgggtag

SEQ ID NO: 370577 - DNA, 20 bp, Artificial Sequence
  chemically synthesized
gatcatatctctcctaccca

SEQ ID NO: 370578 - DNA, 20 bp, Artificial Sequence
  chemically synthesized
tttacaggctttgggtagga

SEQ ID NO: 370579 - DNA, 20 bp, Artificial Sequence
  chemically synthesized
tgggtaggagagatatgatc

SEQ ID NO: 370580 - DNA, 20 bp, Artificial Sequence
  chemically synthesized
gatctttataaaacacaaac

SEQ ID NO: 370581 - DNA, 20 bp, Artificial Sequence
  chemically synthesized
gatctagtttgtgttttata

SEQ ID NO: 370582 - DNA, 20 bp, Artificial Sequence
  chemically synthesized
gtgttttataaagatctcta

SEQ ID NO: 370583 - DNA, 20 bp, Artificial Sequence
  chemically synthesized
gtcttctgacaggagccata

SEQ ID NO: 370584 - DNA, 20 bp, Artificial Sequence
  chemically synthesized
atgtcttctgacaggagcca

SEQ ID NO: 370585 - DNA, 20 bp, Artificial Sequence
  chemically synthesized
aagatctctatggctcctgt

SEQ ID NO: 370586 - DNA, 20 bp, Artificial Sequence
  chemically synthesized
atctctatggctcctgtcag

SEQ ID NO: 370587 - DNA, 20 bp, Artificial Sequence
  chemically synthesized
tccttgatgtcttctgacag

SEQ ID NO: 370588 - DNA, 20 bp, Artificial Sequence
  chemically synthesized
cctccttgatgtcttctgac

SEQ ID NO: 370589 - DNA, 20 bp, Artificial Sequence
  chemically synthesized
ccctccttgatgtcttctga

SEQ ID NO: 370590 - DNA, 20 bp, Artificial Sequence
  chemically synthesized
ggctcctgtcagaagacatc

SEQ ID NO: 370591 - DNA, 20 bp, Artificial Sequence
  chemically synthesized
gctcctgtcagaagacatca

SEQ ID NO: 370592 - DNA, 20 bp, Artificial Sequence
  chemically synthesized
tcctgtcagaagacatcaag

SEQ ID NO: 370593 - DNA, 20 bp, Artificial Sequence
  chemically synthesized
cctgtcagaagacatcaagg

SEQ ID NO: 370594 - DNA, 20 bp, Artificial Sequence
  chemically synthesized
ctgtcagaagacatcaagga

SEQ ID NO: 370595 - DNA, 20 bp, Artificial Sequence
  chemically synthesized
cagaagacatcaaggagggc

SEQ ID NO: 370596 - DNA, 20 bp, Artificial Sequence
  chemically synthesized
gaagacatcaaggagggcaa

SEQ ID NO: 370597 - DNA, 20 bp, Artificial Sequence
  chemically synthesized
gacatcaaggagggcaagag

SEQ ID NO: 370598 - DNA, 20 bp, Artificial Sequence
  chemically synthesized
aaggagggcaagagaagcaa

SEQ ID NO: 370599 - DNA, 20 bp, Artificial Sequence
  chemically synthesized
gagggcaagagaagcaatgg

SEQ ID NO: 370600 - DNA, 20 bp, Artificial Sequence
  chemically synthesized
agagaagcaatggaagactc

SEQ ID NO: 370601 - DNA, 20 bp, Artificial Sequence
  chemically synthesized
aatgaatgcatgaggcactg

SEQ ID NO: 370602 - DNA, 20 bp, Artificial Sequence
  chemically synthesized
aaaatgaatgcatgaggcac

SEQ ID NO: 370603 - DNA, 20 bp, Artificial Sequence
  chemically synthesized
agttttaaaatgaatgcatg

SEQ ID NO: 370604 - DNA, 20 bp, Artificial Sequence
  chemically synthesized
gagttttaaaatgaatgcat

SEQ ID NO: 370605 - DNA, 20 bp, Artificial Sequence
  chemically synthesized
tgcattcattttaaaactct

SEQ ID NO: 370606 - DNA, 20 bp, Artificial Sequence
  chemically synthesized
attcattttaaaactcttag

SEQ ID NO: 370607 - DNA, 20 bp, Artificial Sequence
  chemically synthesized
cattttaaaactcttagtgg

SEQ ID NO: 370608 - DNA, 20 bp, Artificial Sequence
  chemically synthesized
ataagattagccaccactaa

SEQ ID NO: 370609 - DNA, 20 bp, Artificial Sequence
  chemically synthesized
aaataagattagccaccact

SEQ ID NO: 370610 - DNA, 20 bp, Artificial Sequence
  chemically synthesized
aagattagtttaaataagat

SEQ ID NO: 370611 - DNA, 20 bp, Artificial Sequence
  chemically synthesized
ccactaagattagtttaaat

SEQ ID NO: 370612 - DNA, 20 bp, Artificial Sequence
  chemically synthesized
aatcttatttaaactaatct

SEQ ID NO: 370613 - DNA, 20 bp, Artificial Sequence
  chemically synthesized
cttatttaaactaatcttag

SEQ ID NO: 370614 - DNA, 20 bp, Artificial Sequence
  chemically synthesized
gtggtagccaccactaagat

SEQ ID NO: 370615 - DNA, 20 bp, Artificial Sequence
  chemically synthesized
atttaaactaatcttagtgg

SEQ ID NO: 370616 - DNA, 20 bp, Artificial Sequence
  chemically synthesized
gtgaggtggtagccaccact

SEQ ID NO: 370617 - DNA, 20 bp, Artificial Sequence
  chemically synthesized
tttacctgatggtgaggtgg

SEQ ID NO: 370618 - DNA, 20 bp, Artificial Sequence
  chemically synthesized
agatttacctgatggtgagg

SEQ ID NO: 370619 - DNA, 20 bp, Artificial Sequence
  chemically synthesized
ggtggctaccacctcaccat

SEQ ID NO: 370620 - DNA, 20 bp, Artificial Sequence
  chemically synthesized
gtggctaccacctcaccatc

SEQ ID NO: 370621 - DNA, 20 bp, Artificial Sequence
  chemically synthesized
aggagatttacctgatggtg

SEQ ID NO: 370622 - DNA, 20 bp, Artificial Sequence
  chemically synthesized
aaggagatttacctgatggt

SEQ ID NO: 370623 - DNA, 20 bp, Artificial Sequence
  chemically synthesized
agagaaggagatttacctga

SEQ ID NO: 370624 - DNA, 20 bp, Artificial Sequence
  chemically synthesized
tcaacagtgagtgagagaag

SEQ ID NO: 370625 - DNA, 20 bp, Artificial Sequence
  chemically synthesized
gatcaacagtgagtgagaga

SEQ ID NO: 370626 - DNA, 20 bp, Artificial Sequence
  chemically synthesized
tgatcaacagtgagtgagag

SEQ ID NO: 370627 - DNA, 20 bp, Artificial Sequence
  chemically synthesized
ttatgatcaacagtgagtga

SEQ ID NO: 370628 - DNA, 20 bp, Artificial Sequence
  chemically synthesized
aattatgatcaacagtgagt

SEQ ID NO: 370629 - DNA, 20 bp, Artificial Sequence
  chemically synthesized
aagcaattatgatcaacagt

SEQ ID NO: 370630 - DNA, 20 bp, Artificial Sequence
  chemically synthesized
gataaagcaattatgatcaa

SEQ ID NO: 370631 - DNA, 20 bp, Artificial Sequence
  chemically synthesized
atcaggactaacaattgata

SEQ ID NO: 370632 - DNA, 20 bp, Artificial Sequence
  chemically synthesized
ataattgctttatcaattgt

SEQ ID NO: 370633 - DNA, 20 bp, Artificial Sequence
  chemically synthesized
atcggaggctgggtaaaatc

SEQ ID NO: 370634 - DNA, 20 bp, Artificial Sequence
  chemically synthesized
aatcggaggctgggtaaaat

SEQ ID NO: 370635 - DNA, 20 bp, Artificial Sequence
  chemically synthesized
ttgttagtcctgattttacc

SEQ ID NO: 370636 - DNA, 20 bp, Artificial Sequence
  chemically synthesized
aactaaaagaatcggaggct

SEQ ID NO: 370637 - DNA, 20 bp, Artificial Sequence
  chemically synthesized
gaactaaaagaatcggaggc

SEQ ID NO: 370638 - DNA, 20 bp, Artificial Sequence
  chemically synthesized
aagggaactaaaagaatcgg

SEQ ID NO: 370639 - DNA, 20 bp, Artificial Sequence
  chemically synthesized
aaagggaactaaaagaatcg

SEQ ID NO: 370640 - DNA, 20 bp, Artificial Sequence
  chemically synthesized
tacccagcctccgattcttt

SEQ ID NO: 370641 - DNA, 20 bp, Artificial Sequence
  chemically synthesized
aaaaagggaactaaaagaat

SEQ ID NO: 370642 - DNA, 20 bp, Artificial Sequence
  chemically synthesized
gcaatcaaaaagggaactaa

SEQ ID NO: 370643 - DNA, 20 bp, Artificial Sequence
  chemically synthesized
aattgcatagcaatcaaaaa

SEQ ID NO: 370644 - DNA, 20 bp, Artificial Sequence
  chemically synthesized
gaattgcatagcaatcaaaa

SEQ ID NO: 370645 - DNA, 20 bp, Artificial Sequence
  chemically synthesized
ggaattgcatagcaatcaaa

SEQ ID NO: 370646 - DNA, 20 bp, Artificial Sequence
  chemically synthesized
tgaccacttcaggaattgca

SEQ ID NO: 370647 - DNA, 20 bp, Artificial Sequence
  chemically synthesized
tgattgctatgcaattcctg

SEQ ID NO: 370648 - DNA, 20 bp, Artificial Sequence
  chemically synthesized
ttgctatgcaattcctgaag

SEQ ID NO: 370649 - DNA, 20 bp, Artificial Sequence
  chemically synthesized
ctgggttatatgaccacttc

SEQ ID NO: 370650 - DNA, 20 bp, Artificial Sequence
  chemically synthesized
cctgggttatatgaccactt

SEQ ID NO: 370651 - DNA, 20 bp, Artificial Sequence
  chemically synthesized
cctgaagtggtcatataacc

SEQ ID NO: 370652 - DNA, 20 bp, Artificial Sequence
  chemically synthesized
ctgaagtggtcatataaccc

SEQ ID NO: 370653 - DNA, 20 bp, Artificial Sequence
  chemically synthesized
ggtcatataacccaggcctg

SEQ ID NO: 370654 - DNA, 20 bp, Artificial Sequence
  chemically synthesized
tcctgaggacctacaggcct

SEQ ID NO: 370655 - DNA, 20 bp, Artificial Sequence
  chemically synthesized
gtcatataacccaggcctgt

SEQ ID NO: 370656 - DNA, 20 bp, Artificial Sequence
  chemically synthesized
gtcctgaggacctacaggcc

SEQ ID NO: 370657 - DNA, 20 bp, Artificial Sequence
  chemically synthesized
catgtgtcctgaggacctac

SEQ ID NO: 370658 - DNA, 20 bp, Artificial Sequence
  chemically synthesized
ccatgtgtcctgaggaccta

SEQ ID NO: 370659 - DNA, 20 bp, Artificial Sequence
  chemically synthesized
aacccaggcctgtaggtcct

SEQ ID NO: 370660 - DNA, 20 bp, Artificial Sequence
  chemically synthesized
acccaggcctgtaggtcctc

SEQ ID NO: 370661 - DNA, 20 bp, Artificial Sequence
  chemically synthesized
atgaaatgccatgtgtcctg

SEQ ID NO: 370662 - DNA, 20 bp, Artificial Sequence
  chemically synthesized
gatgaaatgccatgtgtcct

SEQ ID NO: 370663 - DNA, 20 bp, Artificial Sequence
  chemically synthesized
ctgtaggtcctcaggacaca

SEQ ID NO: 370664 - DNA, 20 bp, Artificial Sequence
  chemically synthesized
tgagcaaagcaggaaagggt

SEQ ID NO: 370665 - DNA, 20 bp, Artificial Sequence
  chemically synthesized
catttgagcaaagcaggaaa

SEQ ID NO: 370666 - DNA, 20 bp, Artificial Sequence
  chemically synthesized
acatttgagcaaagcaggaa

SEQ ID NO: 370667 - DNA, 20 bp, Artificial Sequence
  chemically synthesized
gacatttgagcaaagcagga

SEQ ID NO: 370668 - DNA, 20 bp, Artificial Sequence
  chemically synthesized
ccctgacatttgagcaaagc

SEQ ID NO: 370669 - DNA, 20 bp, Artificial Sequence
  chemically synthesized
cccctgacatttgagcaaag

SEQ ID NO: 370670 - DNA, 20 bp, Artificial Sequence
  chemically synthesized
attcccctgacatttgagca

SEQ ID NO: 370671 - DNA, 20 bp, Artificial Sequence
  chemically synthesized
ttcctgctttgctcaaatgt

SEQ ID NO: 370672 - DNA, 20 bp, Artificial Sequence
  chemically synthesized
tcctgctttgctcaaatgtc

SEQ ID NO: 370673 - DNA, 20 bp, Artificial Sequence
  chemically synthesized
ggcttattcccctgacattt

SEQ ID NO: 370674 - DNA, 20 bp, Artificial Sequence
  chemically synthesized
cctgctttgctcaaatgtca

SEQ ID NO: 370675 - DNA, 20 bp, Artificial Sequence
  chemically synthesized
ctgctttgctcaaatgtcag

SEQ ID NO: 370676 - DNA, 20 bp, Artificial Sequence
  chemically synthesized
tgctcaaatgtcaggggaat

SEQ ID NO: 370677 - DNA, 20 bp, Artificial Sequence
  chemically synthesized
agcttttaaaaggaggaggg

SEQ ID NO: 370678 - DNA, 20 bp, Artificial Sequence
  chemically synthesized
cagcttttaaaaggaggagg

SEQ ID NO: 370679 - DNA, 20 bp, Artificial Sequence
  chemically synthesized
tcagcttttaaaaggaggag

SEQ ID NO: 370680 - DNA, 20 bp, Artificial Sequence
  chemically synthesized
gtcagcttttaaaaggagga

SEQ ID NO: 370681 - DNA, 20 bp, Artificial Sequence
  chemically synthesized
ggtcagcttttaaaaggagg

SEQ ID NO: 370682 - DNA, 20 bp, Artificial Sequence
  chemically synthesized
gggtcagcttttaaaaggag

SEQ ID NO: 370683 - DNA, 20 bp, Artificial Sequence
  chemically synthesized
aggggtcagcttttaaaagg

SEQ ID NO: 370684 - DNA, 20 bp, Artificial Sequence
  chemically synthesized
agcccccctcctccttttaa

SEQ ID NO: 370685 - DNA, 20 bp, Artificial Sequence
  chemically synthesized
taggggtcagcttttaaaag

SEQ ID NO: 370686 - DNA, 20 bp, Artificial Sequence
  chemically synthesized
tttaggggtcagcttttaaa

SEQ ID NO: 370687 - DNA, 20 bp, Artificial Sequence
  chemically synthesized
atttaggggtcagcttttaa

SEQ ID NO: 370688 - DNA, 20 bp, Artificial Sequence
  chemically synthesized
aaaagcacatatttaggggt

SEQ ID NO: 370689 - DNA, 20 bp, Artificial Sequence
  chemically synthesized
tctcaaaagcacatatttag

SEQ ID NO: 370690 - DNA, 20 bp, Artificial Sequence
  chemically synthesized
atctcaaaagcacatattta

SEQ ID NO: 370691 - DNA, 20 bp, Artificial Sequence
  chemically synthesized
tatctcaaaagcacatattt

SEQ ID NO: 370692 - DNA, 20 bp, Artificial Sequence
  chemically synthesized
ttatctcaaaagcacatatt

SEQ ID NO: 370693 - DNA, 20 bp, Artificial Sequence
  chemically synthesized
acccctaaatatgtgctttt

SEQ ID NO: 370694 - DNA, 20 bp, Artificial Sequence
  chemically synthesized
ttggtagccaattatctcaa

SEQ ID NO: 370695 - DNA, 20 bp, Artificial Sequence
  chemically synthesized
atatgtgcttttgagataat

SEQ ID NO: 370696 - DNA, 20 bp, Artificial Sequence
  chemically synthesized
ttaaatcctagagatgttgg

SEQ ID NO: 370697 - DNA, 20 bp, Artificial Sequence
  chemically synthesized
taattggctaccaacatctc

SEQ ID NO: 370698 - DNA, 20 bp, Artificial Sequence
  chemically synthesized
gaattaaatcctagagatgt

SEQ ID NO: 370699 - DNA, 20 bp, Artificial Sequence
  chemically synthesized
aattggctaccaacatctct

SEQ ID NO: 370700 - DNA, 20 bp, Artificial Sequence
  chemically synthesized
gggaagagaattaaatccta

SEQ ID NO: 370701 - DNA, 20 bp, Artificial Sequence
  chemically synthesized
gagggaagagaattaaatcc

SEQ ID NO: 370702 - DNA, 20 bp, Artificial Sequence
  chemically synthesized
gtatgtgaacgaggagggaa

SEQ ID NO: 370703 - DNA, 20 bp, Artificial Sequence
  chemically synthesized
gtgtatgtgaacgaggaggg

SEQ ID NO: 370704 - DNA, 20 bp, Artificial Sequence
  chemically synthesized
tgtgtgtatgtgaacgagga

SEQ ID NO: 370705 - DNA, 20 bp, Artificial Sequence
  chemically synthesized
ctgtgtgtatgtgaacgagg

SEQ ID NO: 370706 - DNA, 20 bp, Artificial Sequence
  chemically synthesized
cctgtgtgtatgtgaacgag

SEQ ID NO: 370707 - DNA, 20 bp, Artificial Sequence
  chemically synthesized
tgcctgtgtgtatgtgaacg

SEQ ID NO: 370708 - DNA, 20 bp, Artificial Sequence
  chemically synthesized
atgcctgtgtgtatgtgaac

SEQ ID NO: 370709 - DNA, 20 bp, Artificial Sequence
  chemically synthesized
cctcctcgttcacatacaca

SEQ ID NO: 370710 - DNA, 20 bp, Artificial Sequence
  chemically synthesized
ctcctcgttcacatacacac

SEQ ID NO: 370711 - DNA, 20 bp, Artificial Sequence
  chemically synthesized
ttcacatacacacaggcatc

SEQ ID NO: 370712 - DNA, 20 bp, Artificial Sequence
  chemically synthesized
tacacacaggcatctagata

SEQ ID NO: 370713 - DNA, 20 bp, Artificial Sequence
  chemically synthesized
acacaggcatctagatatgg

SEQ ID NO: 370714 - DNA, 20 bp, Artificial Sequence
  chemically synthesized
tgcctactgcctgccatatc

SEQ ID NO: 370715 - DNA, 20 bp, Artificial Sequence
  chemically synthesized
cacaggcatctagatatggc

SEQ ID NO: 370716 - DNA, 20 bp, Artificial Sequence
  chemically synthesized
aggcatctagatatggcagg

SEQ ID NO: 370717 - DNA, 20 bp, Artificial Sequence
  chemically synthesized
catctagatatggcaggcag

SEQ ID NO: 370718 - DNA, 20 bp, Artificial Sequence
  chemically synthesized
atctagatatggcaggcagt

SEQ ID NO: 370719 - DNA, 20 bp, Artificial Sequence
  chemically synthesized
atatggcaggcagtaggcat

SEQ ID NO: 370720 - DNA, 20 bp, Artificial Sequence
  chemically synthesized
atggcaggcagtaggcatta

SEQ ID NO: 370721 - DNA, 20 bp, Artificial Sequence
  chemically synthesized
caggcagtaggcattagagt

SEQ ID NO: 370722 - DNA, 20 bp, Artificial Sequence
  chemically synthesized
ggcagtaggcattagagtga

SEQ ID NO: 370723 - DNA, 20 bp, Artificial Sequence
  chemically synthesized
cagtaggcattagagtgaga

SEQ ID NO: 370724 - DNA, 20 bp, Artificial Sequence
  chemically synthesized
taggcattagagtgagagag

SEQ ID NO: 370725 - DNA, 20 bp, Artificial Sequence
  chemically synthesized
gagtgagagagcagacattg

SEQ ID NO: 370726 - DNA, 20 bp, Artificial Sequence
  chemically synthesized
gcagacattgaagctacact

SEQ ID NO: 370727 - DNA, 20 bp, Artificial Sequence
  chemically synthesized
cagacattgaagctacactc

SEQ ID NO: 370728 - DNA, 20 bp, Artificial Sequence
  chemically synthesized
ctgagaaacaggcctgagtg

SEQ ID NO: 370729 - DNA, 20 bp, Artificial Sequence
  chemically synthesized
aaagtctgagaaacaggcct

SEQ ID NO: 370730 - DNA, 20 bp, Artificial Sequence
  chemically synthesized
ctacactcaggcctgtttct

SEQ ID NO: 370731 - DNA, 20 bp, Artificial Sequence
  chemically synthesized
tatactaaagtctgagaaac

SEQ ID NO: 370732 - DNA, 20 bp, Artificial Sequence
  chemically synthesized
atatactaaagtctgagaaa

SEQ ID NO: 370733 - DNA, 20 bp, Artificial Sequence
  chemically synthesized
caggcctgtttctcagactt

SEQ ID NO: 370734 - DNA, 20 bp, Artificial Sequence
  chemically synthesized
tctaatatatactaaagtct

SEQ ID NO: 370735 - DNA, 20 bp, Artificial Sequence
  chemically synthesized
ggtggttctaatatatacta

SEQ ID NO: 370736 - DNA, 20 bp, Artificial Sequence
  chemically synthesized
tctcagactttagtatatat

SEQ ID NO: 370737 - DNA, 20 bp, Artificial Sequence
  chemically synthesized
tagtatatattagaaccacc

SEQ ID NO: 370738 - DNA, 20 bp, Artificial Sequence
  chemically synthesized
tatattagaaccacctggat

SEQ ID NO: 370739 - DNA, 20 bp, Artificial Sequence
  chemically synthesized
tcataacgggctcatccagg

SEQ ID NO: 370740 - DNA, 20 bp, Artificial Sequence
  chemically synthesized
atgtcataacgggctcatcc

SEQ ID NO: 370741 - DNA, 20 bp, Artificial Sequence
  chemically synthesized
catgtcataacgggctcatc

SEQ ID NO: 370742 - DNA, 20 bp, Artificial Sequence
  chemically synthesized
caggcaatgcatgtcataac

SEQ ID NO: 370743 - DNA, 20 bp, Artificial Sequence
  chemically synthesized
acaggcaatgcatgtcataa

SEQ ID NO: 370744 - DNA, 20 bp, Artificial Sequence
  chemically synthesized
acacttggatcagaattaac

SEQ ID NO: 370745 - DNA, 20 bp, Artificial Sequence
  chemically synthesized
tacacttggatcagaattaa

SEQ ID NO: 370746 - DNA, 20 bp, Artificial Sequence
  chemically synthesized
ttgcctgttaattctgatcc

SEQ ID NO: 370747 - DNA, 20 bp, Artificial Sequence
  chemically synthesized
agtcctctgtacacttggat

SEQ ID NO: 370748 - DNA, 20 bp, Artificial Sequence
  chemically synthesized
ttaattctgatccaagtgta

SEQ ID NO: 370749 - DNA, 20 bp, Artificial Sequence
  chemically synthesized
attgtagtcctctgtacact

SEQ ID NO: 370750 - DNA, 20 bp, Artificial Sequence
  chemically synthesized
aattctgatccaagtgtaca

SEQ ID NO: 370751 - DNA, 20 bp, Artificial Sequence
  chemically synthesized
attctgatccaagtgtacag

SEQ ID NO: 370752 - DNA, 20 bp, Artificial Sequence
  chemically synthesized
gtacagaggactacaatttt

SEQ ID NO: 370753 - DNA, 20 bp, Artificial Sequence
  chemically synthesized
gaattatttcctcaaaattg

SEQ ID NO: 370754 - DNA, 20 bp, Artificial Sequence
  chemically synthesized
tacagaggactacaattttg

SEQ ID NO: 370755 - DNA, 20 bp, Artificial Sequence
  chemically synthesized
caattttgaggaaataattc

SEQ ID NO: 370756 - DNA, 20 bp, Artificial Sequence
  chemically synthesized
aattttgaggaaataattct

SEQ ID NO: 370757 - DNA, 20 bp, Artificial Sequence
  chemically synthesized
tgaggaaataattctaggct

SEQ ID NO: 370758 - DNA, 20 bp, Artificial Sequence
  chemically synthesized
atcagtggtaaagctgagcc

SEQ ID NO: 370759 - DNA, 20 bp, Artificial Sequence
  chemically synthesized
acttaatcagtggtaaagct

SEQ ID NO: 370760 - DNA, 20 bp, Artificial Sequence
  chemically synthesized
tggctacttaatcagtggta

SEQ ID NO: 370761 - DNA, 20 bp, Artificial Sequence
  chemically synthesized
gctcagctttaccactgatt

SEQ ID NO: 370762 - DNA, 20 bp, Artificial Sequence
  chemically synthesized
actcatggctacttaatcag

SEQ ID NO: 370763 - DNA, 20 bp, Artificial Sequence
  chemically synthesized
cagctttaccactgattaag

SEQ ID NO: 370764 - DNA, 20 bp, Artificial Sequence
  chemically synthesized
tgtactcatggctacttaat

SEQ ID NO: 370765 - DNA, 20 bp, Artificial Sequence
  chemically synthesized
accactgattaagtagccat

SEQ ID NO: 370766 - DNA, 20 bp, Artificial Sequence
  chemically synthesized
aatgtgccttgatgtactca

SEQ ID NO: 370767 - DNA, 20 bp, Artificial Sequence
  chemically synthesized
taagtagccatgagtacatc

SEQ ID NO: 370768 - DNA, 20 bp, Artificial Sequence
  chemically synthesized
aagtagccatgagtacatca

SEQ ID NO: 370769 - DNA, 20 bp, Artificial Sequence
  chemically synthesized
gtacatcaaggcacatttct

SEQ ID NO: 370770 - DNA, 20 bp, Artificial Sequence
  chemically synthesized
tcatataagaaatgaatgct

SEQ ID NO: 370771 - DNA, 20 bp, Artificial Sequence
  chemically synthesized
aacctacttcattttcatat

SEQ ID NO: 370772 - DNA, 20 bp, Artificial Sequence
  chemically synthesized
tcatttcttatatgaaaatg

SEQ ID NO: 370773 - DNA, 20 bp, Artificial Sequence
  chemically synthesized
tttcttatatgaaaatgaag

SEQ ID NO: 370774 - DNA, 20 bp, Artificial Sequence
  chemically synthesized
ttcttatatgaaaatgaagt

SEQ ID NO: 370775 - DNA, 20 bp, Artificial Sequence
  chemically synthesized
tatgaaaatgaagtaggtta

SEQ ID NO: 370776 - DNA, 20 bp, Artificial Sequence
  chemically synthesized
gaaaatgaagtaggttacag

SEQ ID NO: 370777 - DNA, 20 bp, Artificial Sequence
  chemically synthesized
ggttacagtggttattctct

SEQ ID NO: 370778 - DNA, 20 bp, Artificial Sequence
  chemically synthesized
gttacagtggttattctcta

SEQ ID NO: 370779 - DNA, 20 bp, Artificial Sequence
  chemically synthesized
gagtgctgagagtatcctta

SEQ ID NO: 370780 - DNA, 20 bp, Artificial Sequence
  chemically synthesized
gtgagtgctgagagtatcct

SEQ ID NO: 370781 - DNA, 20 bp, Artificial Sequence
  chemically synthesized
ttattctctaaggatactct

SEQ ID NO: 370782 - DNA, 20 bp, Artificial Sequence
  chemically synthesized
taggggactgtgagtgctga

SEQ ID NO: 370783 - DNA, 20 bp, Artificial Sequence
  chemically synthesized
aataggggactgtgagtgct

SEQ ID NO: 370784 - DNA, 20 bp, Artificial Sequence
  chemically synthesized
aaggatactctcagcactca

SEQ ID NO: 370785 - DNA, 20 bp, Artificial Sequence
  chemically synthesized
gacacagaataggggactgt

SEQ ID NO: 370786 - DNA, 20 bp, Artificial Sequence
  chemically synthesized
agattctagacacagaatag

SEQ ID NO: 370787 - DNA, 20 bp, Artificial Sequence
  chemically synthesized
tagattctagacacagaata

SEQ ID NO: 370788 - DNA, 20 bp, Artificial Sequence
  chemically synthesized
ttagattctagacacagaat

SEQ ID NO: 370789 - DNA, 20 bp, Artificial Sequence
  chemically synthesized
tttagattctagacacagaa

SEQ ID NO: 370790 - DNA, 20 bp, Artificial Sequence
  chemically synthesized
acagtcccctattctgtgtc

SEQ ID NO: 370791 - DNA, 20 bp, Artificial Sequence
  chemically synthesized
ccttatttagattctagaca

SEQ ID NO: 370792 - DNA, 20 bp, Artificial Sequence
  chemically synthesized
tcctagccttatttagattc

SEQ ID NO: 370793 - DNA, 20 bp, Artificial Sequence
  chemically synthesized
tctgtgtctagaatctaaat

SEQ ID NO: 370794 - DNA, 20 bp, Artificial Sequence
  chemically synthesized
ctgtgtctagaatctaaata

SEQ ID NO: 370795 - DNA, 20 bp, Artificial Sequence
  chemically synthesized
cattttttcctagccttatt

SEQ ID NO: 370796 - DNA, 20 bp, Artificial Sequence
  chemically synthesized
gtctagaatctaaataaggc

SEQ ID NO: 370797 - DNA, 20 bp, Artificial Sequence
  chemically synthesized
tctagaatctaaataaggct

SEQ ID NO: 370798 - DNA, 20 bp, Artificial Sequence
  chemically synthesized
tttatgtttgcattttttcc

SEQ ID NO: 370799 - DNA, 20 bp, Artificial Sequence
  chemically synthesized
ataaaatgataacattgtaa

SEQ ID NO: 370800 - DNA, 20 bp, Artificial Sequence
  chemically synthesized
atgataacattgtaaaagct

SEQ ID NO: 370801 - DNA, 20 bp, Artificial Sequence
  chemically synthesized
aacattgtaaaagctaagaa

SEQ ID NO: 370802 - DNA, 20 bp, Artificial Sequence
  chemically synthesized
taatttttagtaactattct

SEQ ID NO: 370803 - DNA, 20 bp, Artificial Sequence
  chemically synthesized
taagaatagttactaaaaat

SEQ ID NO: 370804 - DNA, 20 bp, Artificial Sequence
  chemically synthesized
aaagggttttggctaatttt

SEQ ID NO: 370805 - DNA, 20 bp, Artificial Sequence
  chemically synthesized
tttggagaagcaaagggttt

SEQ ID NO: 370806 - DNA, 20 bp, Artificial Sequence
  chemically synthesized
ttcgactttggagaagcaaa

SEQ ID NO: 370807 - DNA, 20 bp, Artificial Sequence
  chemically synthesized
attcgactttggagaagcaa

SEQ ID NO: 370808 - DNA, 20 bp, Artificial Sequence
  chemically synthesized
tattcgactttggagaagca

SEQ ID NO: 370809 - DNA, 20 bp, Artificial Sequence
  chemically synthesized
caaaaccctttgcttctcca

SEQ ID NO: 370810 - DNA, 20 bp, Artificial Sequence
  chemically synthesized
atttttattcgactttggag

SEQ ID NO: 370811 - DNA, 20 bp, Artificial Sequence
  chemically synthesized
ttgatttttattcgactttg

SEQ ID NO: 370812 - DNA, 20 bp, Artificial Sequence
  chemically synthesized
acttgatttttattcgactt

SEQ ID NO: 370813 - DNA, 20 bp, Artificial Sequence
  chemically synthesized
tccaaagtcgaataaaaatc

SEQ ID NO: 370814 - DNA, 20 bp, Artificial Sequence
  chemically synthesized
attcctttccttttatttga

SEQ ID NO: 370815 - DNA, 20 bp, Artificial Sequence
  chemically synthesized
gtataattgccatcaaataa

SEQ ID NO: 370816 - DNA, 20 bp, Artificial Sequence
  chemically synthesized
tataattgccatcaaataaa

SEQ ID NO: 370817 - DNA, 20 bp, Artificial Sequence
  chemically synthesized
attgccatcaaataaaagga

SEQ ID NO: 370818 - DNA, 20 bp, Artificial Sequence
  chemically synthesized
ttgccatcaaataaaaggaa

SEQ ID NO: 370819 - DNA, 20 bp, Artificial Sequence
  chemically synthesized
aaaggaaaggaattttatct

SEQ ID NO: 370820 - DNA, 20 bp, Artificial Sequence
  chemically synthesized
aaggaattttatcttagcct

SEQ ID NO: 370821 - DNA, 20 bp, Artificial Sequence
  chemically synthesized
tcttacccttagcttaggct

SEQ ID NO: 370822 - DNA, 20 bp, Artificial Sequence
  chemically synthesized
attttatcttagcctaagct

SEQ ID NO: 370823 - DNA, 20 bp, Artificial Sequence
  chemically synthesized
ttttatcttagcctaagcta

SEQ ID NO: 370824 - DNA, 20 bp, Artificial Sequence
  chemically synthesized
tttatcttagcctaagctaa

SEQ ID NO: 370825 - DNA, 20 bp, Artificial Sequence
  chemically synthesized
gaaaatcttacccttagctt

SEQ ID NO: 370826 - DNA, 20 bp, Artificial Sequence
  chemically synthesized
tgaaaatcttacccttagct

SEQ ID NO: 370827 - DNA, 20 bp, Artificial Sequence
  chemically synthesized
tcttagcctaagctaagggt

SEQ ID NO: 370828 - DNA, 20 bp, Artificial Sequence
  chemically synthesized
cagattgaaaatcttaccct

SEQ ID NO: 370829 - DNA, 20 bp, Artificial Sequence
  chemically synthesized
agggtaagattttcaatctg

SEQ ID NO: 370830 - DNA, 20 bp, Artificial Sequence
  chemically synthesized
gattttcaatctgaagtcca

SEQ ID NO: 370831 - DNA, 20 bp, Artificial Sequence
  chemically synthesized
ggtcttgtccctgtggactt

SEQ ID NO: 370832 - DNA, 20 bp, Artificial Sequence
  chemically synthesized
attttcaatctgaagtccac

SEQ ID NO: 370833 - DNA, 20 bp, Artificial Sequence
  chemically synthesized
ttttcaatctgaagtccaca

SEQ ID NO: 370834 - DNA, 20 bp, Artificial Sequence
  chemically synthesized
aatctgaagtccacagggac

SEQ ID NO: 370835 - DNA, 20 bp, Artificial Sequence
  chemically synthesized
tgttcttggtcttgtccctg

SEQ ID NO: 370836 - DNA, 20 bp, Artificial Sequence
  chemically synthesized
aagtccacagggacaagacc

SEQ ID NO: 370837 - DNA, 20 bp, Artificial Sequence
  chemically synthesized
cacagggacaagaccaagaa

SEQ ID NO: 370838 - DNA, 20 bp, Artificial Sequence
  chemically synthesized
acagggacaagaccaagaac

SEQ ID NO: 370839 - DNA, 20 bp, Artificial Sequence
  chemically synthesized
acttgttaggttcctgttct

SEQ ID NO: 370840 - DNA, 20 bp, Artificial Sequence
  chemically synthesized
accaagaacaggaacctaac

SEQ ID NO: 370841 - DNA, 20 bp, Artificial Sequence
  chemically synthesized
atcattgcaaaggacttgtt

SEQ ID NO: 370842 - DNA, 20 bp, Artificial Sequence
  chemically synthesized
gatcattgcaaaggacttgt

SEQ ID NO: 370843 - DNA, 20 bp, Artificial Sequence
  chemically synthesized
cattattcagatcattgcaa

SEQ ID NO: 370844 - DNA, 20 bp, Artificial Sequence
  chemically synthesized
tcattattcagatcattgca

SEQ ID NO: 370845 - DNA, 20 bp, Artificial Sequence
  chemically synthesized
ctaagggatgtttcattatt

SEQ ID NO: 370846 - DNA, 20 bp, Artificial Sequence
  chemically synthesized
ctgaataatgaaacatccct

SEQ ID NO: 370847 - DNA, 20 bp, Artificial Sequence
  chemically synthesized
taatgaaacatcccttagat

SEQ ID NO: 370848 - DNA, 20 bp, Artificial Sequence
  chemically synthesized
gttgagaaactctgatctaa

SEQ ID NO: 370849 - DNA, 20 bp, Artificial Sequence
  chemically synthesized
atgaaacatcccttagatca

SEQ ID NO: 370850 - DNA, 20 bp, Artificial Sequence
  chemically synthesized
tgttgagaaactctgatcta

SEQ ID NO: 370851 - DNA, 20 bp, Artificial Sequence
  chemically synthesized
atgttgagaaactctgatct

SEQ ID NO: 370852 - DNA, 20 bp, Artificial Sequence
  chemically synthesized
ttcatgtgcaaacaaatgtt

SEQ ID NO: 370853 - DNA, 20 bp, Artificial Sequence
  chemically synthesized
gtttgcacatgaaacctctg

SEQ ID NO: 370854 - DNA, 20 bp, Artificial Sequence
  chemically synthesized
cacttgactaacatcttcag

SEQ ID NO: 370855 - DNA, 20 bp, Artificial Sequence
  chemically synthesized
gcacttgactaacatcttca

SEQ ID NO: 370856 - DNA, 20 bp, Artificial Sequence
  chemically synthesized
catgaaacctctgaagatgt

SEQ ID NO: 370857 - DNA, 20 bp, Artificial Sequence
  chemically synthesized
ctgcacttgactaacatctt

SEQ ID NO: 370858 - DNA, 20 bp, Artificial Sequence
  chemically synthesized
aacctctgaagatgttagtc

SEQ ID NO: 370859 - DNA, 20 bp, Artificial Sequence
  chemically synthesized
ctgaagatgttagtcaagtg

SEQ ID NO: 370860 - DNA, 20 bp, Artificial Sequence
  chemically synthesized
agtcaagtgcagactcgtgt

SEQ ID NO: 370861 - DNA, 20 bp, Artificial Sequence
  chemically synthesized
gtcaagtgcagactcgtgtg

SEQ ID NO: 370862 - DNA, 20 bp, Artificial Sequence
  chemically synthesized
cgctatcctagacctcacac

SEQ ID NO: 370863 - DNA, 20 bp, Artificial Sequence
  chemically synthesized
gtgcagactcgtgtgaggtc

SEQ ID NO: 370864 - DNA, 20 bp, Artificial Sequence
  chemically synthesized
tgcagactcgtgtgaggtct

SEQ ID NO: 370865 - DNA, 20 bp, Artificial Sequence
  chemically synthesized
gactcgtgtgaggtctagga

SEQ ID NO: 370866 - DNA, 20 bp, Artificial Sequence
  chemically synthesized
tacattttcaggcgctatcc

SEQ ID NO: 370867 - DNA, 20 bp, Artificial Sequence
  chemically synthesized
tgttagaaatgtacattttc

SEQ ID NO: 370868 - DNA, 20 bp, Artificial Sequence
  chemically synthesized
ttgttagaaatgtacatttt

SEQ ID NO: 370869 - DNA, 20 bp, Artificial Sequence
  chemically synthesized
agcaccagttgaggttttgt

SEQ ID NO: 370870 - DNA, 20 bp, Artificial Sequence
  chemically synthesized
atttctaacaaaacctcaac

SEQ ID NO: 370871 - DNA, 20 bp, Artificial Sequence
  chemically synthesized
caatctaggagcaccagttg

SEQ ID NO: 370872 - DNA, 20 bp, Artificial Sequence
  chemically synthesized
gcaatctaggagcaccagtt

SEQ ID NO: 370873 - DNA, 20 bp, Artificial Sequence
  chemically synthesized
aaaacctcaactggtgctcc

SEQ ID NO: 370874 - DNA, 20 bp, Artificial Sequence
  chemically synthesized
ggtctgcaatctaggagcac

SEQ ID NO: 370875 - DNA, 20 bp, Artificial Sequence
  chemically synthesized
aattatggtctgcaatctag

SEQ ID NO: 370876 - DNA, 20 bp, Artificial Sequence
  chemically synthesized
caactggtgctcctagattg

SEQ ID NO: 370877 - DNA, 20 bp, Artificial Sequence
  chemically synthesized
caaattatggtctgcaatct

SEQ ID NO: 370878 - DNA, 20 bp, Artificial Sequence
  chemically synthesized
tcaaattatggtctgcaatc

SEQ ID NO: 370879 - DNA, 20 bp, Artificial Sequence
  chemically synthesized
tagattgcagaccataattt

SEQ ID NO: 370880 - DNA, 20 bp, Artificial Sequence
  chemically synthesized
aggccttgcaactcaaatta

SEQ ID NO: 370881 - DNA, 20 bp, Artificial Sequence
  chemically synthesized
cagaccataatttgagttgc

SEQ ID NO: 370882 - DNA, 20 bp, Artificial Sequence
  chemically synthesized
agaccataatttgagttgca

SEQ ID NO: 370883 - DNA, 20 bp, Artificial Sequence
  chemically synthesized
aatttgagttgcaaggcctt

SEQ ID NO: 370884 - DNA, 20 bp, Artificial Sequence
  chemically synthesized
tgctgtgagggatagactta

SEQ ID NO: 370885 - DNA, 20 bp, Artificial Sequence
  chemically synthesized
ctgctgtgagggatagactt

SEQ ID NO: 370886 - DNA, 20 bp, Artificial Sequence
  chemically synthesized
ggccttaagtctatccctca

SEQ ID NO: 370887 - DNA, 20 bp, Artificial Sequence
  chemically synthesized
atgacagctgctgtgaggga

SEQ ID NO: 370888 - DNA, 20 bp, Artificial Sequence
  chemically synthesized
cttaagtctatccctcacag

SEQ ID NO: 370889 - DNA, 20 bp, Artificial Sequence
  chemically synthesized
tggtatgacagctgctgtga

SEQ ID NO: 370890 - DNA, 20 bp, Artificial Sequence
  chemically synthesized
ttggtatgacagctgctgtg

SEQ ID NO: 370891 - DNA, 20 bp, Artificial Sequence
  chemically synthesized
tttggtatgacagctgctgt

SEQ ID NO: 370892 - DNA, 20 bp, Artificial Sequence
  chemically synthesized
aaagtgaaaatttggtatga

SEQ ID NO: 370893 - DNA, 20 bp, Artificial Sequence
  chemically synthesized
ttgttgttaaagtgaaaatt

SEQ ID NO: 370894 - DNA, 20 bp, Artificial Sequence
  chemically synthesized
taaggttttcattgttgtta

SEQ ID NO: 370895 - DNA, 20 bp, Artificial Sequence
  chemically synthesized
aacaacaatgaaaaccttaa

SEQ ID NO: 370896 - DNA, 20 bp, Artificial Sequence
  chemically synthesized
acaatgaaaaccttaacaga

SEQ ID NO: 370897 - DNA, 20 bp, Artificial Sequence
  chemically synthesized
gtgccaaacactttctgtta

SEQ ID NO: 370898 - DNA, 20 bp, Artificial Sequence
  chemically synthesized
agtgccaaacactttctgtt

SEQ ID NO: 370899 - DNA, 20 bp, Artificial Sequence
  chemically synthesized
aaaccttaacagaaagtgtt

SEQ ID NO: 370900 - DNA, 20 bp, Artificial Sequence
  chemically synthesized
agtgtttggcactttcacaa

SEQ ID NO: 370901 - DNA, 20 bp, Artificial Sequence
  chemically synthesized
gcttatctgttcttttgtga

SEQ ID NO: 370902 - DNA, 20 bp, Artificial Sequence
  chemically synthesized
ttggcactttcacaaaagaa

SEQ ID NO: 370903 - DNA, 20 bp, Artificial Sequence
  chemically synthesized
actttcacaaaagaacagat

SEQ ID NO: 370904 - DNA, 20 bp, Artificial Sequence
  chemically synthesized
atttaagaaaaagacatgaa

SEQ ID NO: 370905 - DNA, 20 bp, Artificial Sequence
  chemically synthesized
gtgaacacagatttaagaaa

SEQ ID NO: 370906 - DNA, 20 bp, Artificial Sequence
  chemically synthesized
caatgggtgaacacagattt

SEQ ID NO: 370907 - DNA, 20 bp, Artificial Sequence
  chemically synthesized
ccctcaacaatgggtgaaca

SEQ ID NO: 370908 - DNA, 20 bp, Artificial Sequence
  chemically synthesized
atctgtgttcacccattgtt

SEQ ID NO: 370909 - DNA, 20 bp, Artificial Sequence
  chemically synthesized
tctgtgttcacccattgttg

SEQ ID NO: 370910 - DNA, 20 bp, Artificial Sequence
  chemically synthesized
aatgttctaccctcaacaat

SEQ ID NO: 370911 - DNA, 20 bp, Artificial Sequence
  chemically synthesized
ctgtgttcacccattgttga

SEQ ID NO: 370912 - DNA, 20 bp, Artificial Sequence
  chemically synthesized
caatgttctaccctcaacaa

SEQ ID NO: 370913 - DNA, 20 bp, Artificial Sequence
  chemically synthesized
tgttcacccattgttgaggg

SEQ ID NO: 370914 - DNA, 20 bp, Artificial Sequence
  chemically synthesized
tgagggtagaacattgcgac

SEQ ID NO: 370915 - DNA, 20 bp, Artificial Sequence
  chemically synthesized
ttgcgacaagttcattttta

SEQ ID NO: 370916 - DNA, 20 bp, Artificial Sequence
  chemically synthesized
gcgacaagttcatttttaca

SEQ ID NO: 370917 - DNA, 20 bp, Artificial Sequence
  chemically synthesized
gacaagttcatttttacaga

SEQ ID NO: 370918 - DNA, 20 bp, Artificial Sequence
  chemically synthesized
ttcatttttacagagagcca

SEQ ID NO: 370919 - DNA, 20 bp, Artificial Sequence
  chemically synthesized
tttttacagagagccaaagt

SEQ ID NO: 370920 - DNA, 20 bp, Artificial Sequence
  chemically synthesized
ttccttggggaatcttactt

SEQ ID NO: 370921 - DNA, 20 bp, Artificial Sequence
  chemically synthesized
gagccaaagtaagattcccc

SEQ ID NO: 370922 - DNA, 20 bp, Artificial Sequence
  chemically synthesized
agccaaagtaagattcccca

SEQ ID NO: 370923 - DNA, 20 bp, Artificial Sequence
  chemically synthesized
caaagtaagattccccaagg

SEQ ID NO: 370924 - DNA, 20 bp, Artificial Sequence
  chemically synthesized
aatatcagaaaacttccttg

SEQ ID NO: 370925 - DNA, 20 bp, Artificial Sequence
  chemically synthesized
gaatatcagaaaacttcctt

SEQ ID NO: 370926 - DNA, 20 bp, Artificial Sequence
  chemically synthesized
agaatatcagaaaacttcct

SEQ ID NO: 370927 - DNA, 20 bp, Artificial Sequence
  chemically synthesized
tttgtatcaatagagaatat

SEQ ID NO: 370928 - DNA, 20 bp, Artificial Sequence
  chemically synthesized
gctcaatctttgtatcaata

SEQ ID NO: 370929 - DNA, 20 bp, Artificial Sequence
  chemically synthesized
aagctcaatctttgtatcaa

SEQ ID NO: 370930 - DNA, 20 bp, Artificial Sequence
  chemically synthesized
tgatattctctattgataca

SEQ ID NO: 370931 - DNA, 20 bp, Artificial Sequence
  chemically synthesized
tctctattgatacaaagatt

SEQ ID NO: 370932 - DNA, 20 bp, Artificial Sequence
  chemically synthesized
attgatacaaagattgagct

SEQ ID NO: 370933 - DNA, 20 bp, Artificial Sequence
  chemically synthesized
ttcattcttctacattttct

SEQ ID NO: 370934 - DNA, 20 bp, Artificial Sequence
  chemically synthesized
aagattgagcttagaaaatg

SEQ ID NO: 370935 - DNA, 20 bp, Artificial Sequence
  chemically synthesized
attgagcttagaaaatgtag

SEQ ID NO: 370936 - DNA, 20 bp, Artificial Sequence
  chemically synthesized
agaaaatgtagaagaatgaa

SEQ ID NO: 370937 - DNA, 20 bp, Artificial Sequence
  chemically synthesized
aatgtagaagaatgaacggt

SEQ ID NO: 370938 - DNA, 20 bp, Artificial Sequence
  chemically synthesized
gaagaatgaacggtcagcat

SEQ ID NO: 370939 - DNA, 20 bp, Artificial Sequence
  chemically synthesized
tcagcatgagccttgaactc

SEQ ID NO: 370940 - DNA, 20 bp, Artificial Sequence
  chemically synthesized
ttgatggtagccagagttca

SEQ ID NO: 370941 - DNA, 20 bp, Artificial Sequence
  chemically synthesized
attgatggtagccagagttc

SEQ ID NO: 370942 - DNA, 20 bp, Artificial Sequence
  chemically synthesized
gaaacaattgatggtagcca

SEQ ID NO: 370943 - DNA, 20 bp, Artificial Sequence
  chemically synthesized
aggaaacaattgatggtagc

SEQ ID NO: 370944 - DNA, 20 bp, Artificial Sequence
  chemically synthesized
tggcaggaaacaattgatgg

SEQ ID NO: 370945 - DNA, 20 bp, Artificial Sequence
  chemically synthesized
tcttggcaggaaacaattga

SEQ ID NO: 370946 - DNA, 20 bp, Artificial Sequence
  chemically synthesized
accatcaattgtttcctgcc

SEQ ID NO: 370947 - DNA, 20 bp, Artificial Sequence
  chemically synthesized
gaaaagagatgcatcttggc

SEQ ID NO: 370948 - DNA, 20 bp, Artificial Sequence
  chemically synthesized
agaaaagagatgcatcttgg

SEQ ID NO: 370949 - DNA, 20 bp, Artificial Sequence
  chemically synthesized
gaaagaaaagagatgcatct

SEQ ID NO: 370950 - DNA, 20 bp, Artificial Sequence
  chemically synthesized
gcagtttttaggaaagaaaa

SEQ ID NO: 370951 - DNA, 20 bp, Artificial Sequence
  chemically synthesized
tggcagtttttaggaaagaa

SEQ ID NO: 370952 - DNA, 20 bp, Artificial Sequence
  chemically synthesized
aaaactggcagtttttagga

SEQ ID NO: 370953 - DNA, 20 bp, Artificial Sequence
  chemically synthesized
agagaaaactggcagttttt

SEQ ID NO: 370954 - DNA, 20 bp, Artificial Sequence
  chemically synthesized
gagagaaaactggcagtttt

SEQ ID NO: 370955 - DNA, 20 bp, Artificial Sequence
  chemically synthesized
ttttctttcctaaaaactgc

SEQ ID NO: 370956 - DNA, 20 bp, Artificial Sequence
  chemically synthesized
caggcgagagagaaaactgg

SEQ ID NO: 370957 - DNA, 20 bp, Artificial Sequence
  chemically synthesized
agccaggcgagagagaaaac

SEQ ID NO: 370958 - DNA, 20 bp, Artificial Sequence
  chemically synthesized
tgccagttttctctctcgcc

SEQ ID NO: 370959 - DNA, 20 bp, Artificial Sequence
  chemically synthesized
cacaaacaagccaggcgaga

SEQ ID NO: 370960 - DNA, 20 bp, Artificial Sequence
  chemically synthesized
tgcacaaacaagccaggcga

SEQ ID NO: 370961 - DNA, 20 bp, Artificial Sequence
  chemically synthesized
cttgcacaaacaagccaggc

SEQ ID NO: 370962 - DNA, 20 bp, Artificial Sequence
  chemically synthesized
gatccttgcacaaacaagcc

SEQ ID NO: 370963 - DNA, 20 bp, Artificial Sequence
  chemically synthesized
agatccttgcacaaacaagc

SEQ ID NO: 370964 - DNA, 20 bp, Artificial Sequence
  chemically synthesized
aagaagatccttgcacaaac

SEQ ID NO: 370965 - DNA, 20 bp, Artificial Sequence
  chemically synthesized
ctcgcctggcttgtttgtgc

SEQ ID NO: 370966 - DNA, 20 bp, Artificial Sequence
  chemically synthesized
tcgcctggcttgtttgtgca

SEQ ID NO: 370967 - DNA, 20 bp, Artificial Sequence
  chemically synthesized
ctgagaagggcagaagaaag

SEQ ID NO: 370968 - DNA, 20 bp, Artificial Sequence
  chemically synthesized
tagctgagaagggcagaaga

SEQ ID NO: 370969 - DNA, 20 bp, Artificial Sequence
  chemically synthesized
actctagctgagaagggcag

SEQ ID NO: 370970 - DNA, 20 bp, Artificial Sequence
  chemically synthesized
cttctttcttctgcccttct

SEQ ID NO: 370971 - DNA, 20 bp, Artificial Sequence
  chemically synthesized
gtgactctagctgagaaggg

SEQ ID NO: 370972 - DNA, 20 bp, Artificial Sequence
  chemically synthesized
tcagtgactctagctgagaa

SEQ ID NO: 370973 - DNA, 20 bp, Artificial Sequence
  chemically synthesized
tttcttctgcccttctcagc

SEQ ID NO: 370974 - DNA, 20 bp, Artificial Sequence
  chemically synthesized
gtcagtgactctagctgaga

SEQ ID NO: 370975 - DNA, 20 bp, Artificial Sequence
  chemically synthesized
tgtcagtgactctagctgag

SEQ ID NO: 370976 - DNA, 20 bp, Artificial Sequence
  chemically synthesized
tcttctgcccttctcagcta

SEQ ID NO: 370977 - DNA, 20 bp, Artificial Sequence
  chemically synthesized
gtgtgtcagtgactctagct

SEQ ID NO: 370978 - DNA, 20 bp, Artificial Sequence
  chemically synthesized
ggagagtgtgtcagtgactc

SEQ ID NO: 370979 - DNA, 20 bp, Artificial Sequence
  chemically synthesized
ctcacaggaggagagtgtgt

SEQ ID NO: 370980 - DNA, 20 bp, Artificial Sequence
  chemically synthesized
atgcatatctcacaggagga

SEQ ID NO: 370981 - DNA, 20 bp, Artificial Sequence
  chemically synthesized
ctgacacactctcctcctgt

SEQ ID NO: 370982 - DNA, 20 bp, Artificial Sequence
  chemically synthesized
tgatgcatatctcacaggag

SEQ ID NO: 370983 - DNA, 20 bp, Artificial Sequence
  chemically synthesized
agtgatgcatatctcacagg

SEQ ID NO: 370984 - DNA, 20 bp, Artificial Sequence
  chemically synthesized
gagtgatgcatatctcacag

SEQ ID NO: 370985 - DNA, 20 bp, Artificial Sequence
  chemically synthesized
ttgagtgatgcatatctcac

SEQ ID NO: 370986 - DNA, 20 bp, Artificial Sequence
  chemically synthesized
attgagtgatgcatatctca

SEQ ID NO: 370987 - DNA, 20 bp, Artificial Sequence
  chemically synthesized
atatgcatcactcaatacca

SEQ ID NO: 370988 - DNA, 20 bp, Artificial Sequence
  chemically synthesized
cctcctcctaccatggtatt

SEQ ID NO: 370989 - DNA, 20 bp, Artificial Sequence
  chemically synthesized
tgcatcactcaataccatgg

SEQ ID NO: 370990 - DNA, 20 bp, Artificial Sequence
  chemically synthesized
gcatcactcaataccatggt

SEQ ID NO: 370991 - DNA, 20 bp, Artificial Sequence
  chemically synthesized
atcactcaataccatggtag

SEQ ID NO: 370992 - DNA, 20 bp, Artificial Sequence
  chemically synthesized
tcactcaataccatggtagg

SEQ ID NO: 370993 - DNA, 20 bp, Artificial Sequence
  chemically synthesized
taaatttcctcctcctacca

SEQ ID NO: 370994 - DNA, 20 bp, Artificial Sequence
  chemically synthesized
actcaataccatggtaggag

SEQ ID NO: 370995 - DNA, 20 bp, Artificial Sequence
  chemically synthesized
ctcaataccatggtaggagg

SEQ ID NO: 370996 - DNA, 20 bp, Artificial Sequence
  chemically synthesized
tggtaggaggaggaaattta

SEQ ID NO: 370997 - DNA, 20 bp, Artificial Sequence
  chemically synthesized
taggaggaggaaatttacag

SEQ ID NO: 370998 - DNA, 20 bp, Artificial Sequence
  chemically synthesized
gaaatttacagcagttatga

SEQ ID NO: 370999 - DNA, 20 bp, Artificial Sequence
  chemically synthesized
ttacagcagttatgatggac

SEQ ID NO: 371000 - DNA, 20 bp, Artificial Sequence
  chemically synthesized
cagttatgatggactagaaa

SEQ ID NO: 371001 - DNA, 20 bp, Artificial Sequence
  chemically synthesized
aataattttgtggccatttc

SEQ ID NO: 371002 - DNA, 20 bp, Artificial Sequence
  chemically synthesized
agaagtgtcaaataattttg

SEQ ID NO: 371003 - DNA, 20 bp, Artificial Sequence
  chemically synthesized
atgctgcctcttgatgaaag

SEQ ID NO: 371004 - DNA, 20 bp, Artificial Sequence
  chemically synthesized
tatttgacacttctttcatc

SEQ ID NO: 371005 - DNA, 20 bp, Artificial Sequence
  chemically synthesized
tttgacacttctttcatcaa

SEQ ID NO: 371006 - DNA, 20 bp, Artificial Sequence
  chemically synthesized
tagatgctgcctcttgatga

SEQ ID NO: 371007 - DNA, 20 bp, Artificial Sequence
  chemically synthesized
ttgacacttctttcatcaag

SEQ ID NO: 371008 - DNA, 20 bp, Artificial Sequence
  chemically synthesized
acacttctttcatcaagagg

SEQ ID NO: 371009 - DNA, 20 bp, Artificial Sequence
  chemically synthesized
ccgagctttaaggggagaat

SEQ ID NO: 371010 - DNA, 20 bp, Artificial Sequence
  chemically synthesized
agcatctaattctcccctta

SEQ ID NO: 371011 - DNA, 20 bp, Artificial Sequence
  chemically synthesized
acaaatccgagctttaaggg

SEQ ID NO: 371012 - DNA, 20 bp, Artificial Sequence
  chemically synthesized
agacaaatccgagctttaag

SEQ ID NO: 371013 - DNA, 20 bp, Artificial Sequence
  chemically synthesized
aagacaaatccgagctttaa

SEQ ID NO: 371014 - DNA, 20 bp, Artificial Sequence
  chemically synthesized
ctaattctccccttaaagct

SEQ ID NO: 371015 - DNA, 20 bp, Artificial Sequence
  chemically synthesized
taagacaaatccgagcttta

SEQ ID NO: 371016 - DNA, 20 bp, Artificial Sequence
  chemically synthesized
ctaagacaaatccgagcttt

SEQ ID NO: 371017 - DNA, 20 bp, Artificial Sequence
  chemically synthesized
caagttgctaagacaaatcc

SEQ ID NO: 371018 - DNA, 20 bp, Artificial Sequence
  chemically synthesized
cttaaagctcggatttgtct

SEQ ID NO: 371019 - DNA, 20 bp, Artificial Sequence
  chemically synthesized
tacttggcagacaagttgct

SEQ ID NO: 371020 - DNA, 20 bp, Artificial Sequence
  chemically synthesized
gtcttagcaacttgtctgcc

SEQ ID NO: 371021 - DNA, 20 bp, Artificial Sequence
  chemically synthesized
ttgcattctacttggcagac

SEQ ID NO: 371022 - DNA, 20 bp, Artificial Sequence
  chemically synthesized
ttagcaacttgtctgccaag

SEQ ID NO: 371023 - DNA, 20 bp, Artificial Sequence
  chemically synthesized
attcgttgcattctacttgg

SEQ ID NO: 371024 - DNA, 20 bp, Artificial Sequence
  chemically synthesized
catattcgttgcattctact

SEQ ID NO: 371025 - DNA, 20 bp, Artificial Sequence
  chemically synthesized
atgcaacgaatatgatgtta

SEQ ID NO: 371026 - DNA, 20 bp, Artificial Sequence
  chemically synthesized
tgcaacgaatatgatgttat

SEQ ID NO: 371027 - DNA, 20 bp, Artificial Sequence
  chemically synthesized
tatgatgttataggtcttcc

SEQ ID NO: 371028 - DNA, 20 bp, Artificial Sequence
  chemically synthesized
tgttataggtcttccaagat

SEQ ID NO: 371029 - DNA, 20 bp, Artificial Sequence
  chemically synthesized
taataatgatctaatcttgg

SEQ ID NO: 371030 - DNA, 20 bp, Artificial Sequence
  chemically synthesized
tactaataatgatctaatct

SEQ ID NO: 371031 - DNA, 20 bp, Artificial Sequence
  chemically synthesized
ttccaagattagatcattat

SEQ ID NO: 371032 - DNA, 20 bp, Artificial Sequence
  chemically synthesized
agatcattattagtaacttt

SEQ ID NO: 371033 - DNA, 20 bp, Artificial Sequence
  chemically synthesized
gaaacccataaagaggctaa

SEQ ID NO: 371034 - DNA, 20 bp, Artificial Sequence
  chemically synthesized
agtaacttttagcctcttta

SEQ ID NO: 371035 - DNA, 20 bp, Artificial Sequence
  chemically synthesized
gtaacttttagcctctttat

SEQ ID NO: 371036 - DNA, 20 bp, Artificial Sequence
  chemically synthesized
attctaagaaacccataaag

SEQ ID NO: 371037 - DNA, 20 bp, Artificial Sequence
  chemically synthesized
tattctaagaaacccataaa

SEQ ID NO: 371038 - DNA, 20 bp, Artificial Sequence
  chemically synthesized
agtattctaagaaacccata

SEQ ID NO: 371039 - DNA, 20 bp, Artificial Sequence
  chemically synthesized
tagcctctttatgggtttct

SEQ ID NO: 371040 - DNA, 20 bp, Artificial Sequence
  chemically synthesized
gctcccagagtgagtattct

SEQ ID NO: 371041 - DNA, 20 bp, Artificial Sequence
  chemically synthesized
gtttcttagaatactcactc

SEQ ID NO: 371042 - DNA, 20 bp, Artificial Sequence
  chemically synthesized
tttcttagaatactcactct

SEQ ID NO: 371043 - DNA, 20 bp, Artificial Sequence
  chemically synthesized
tcttagaatactcactctgg

SEQ ID NO: 371044 - DNA, 20 bp, Artificial Sequence
  chemically synthesized
catcttagggctcccagagt

SEQ ID NO: 371045 - DNA, 20 bp, Artificial Sequence
  chemically synthesized
atggcatcttagggctccca

SEQ ID NO: 371046 - DNA, 20 bp, Artificial Sequence
  chemically synthesized
gcatggcatcttagggctcc

SEQ ID NO: 371047 - DNA, 20 bp, Artificial Sequence
  chemically synthesized
atactcactctgggagccct

SEQ ID NO: 371048 - DNA, 20 bp, Artificial Sequence
  chemically synthesized
tttttatgcatggcatctta

SEQ ID NO: 371049 - DNA, 20 bp, Artificial Sequence
  chemically synthesized
gtttttatgcatggcatctt

SEQ ID NO: 371050 - DNA, 20 bp, Artificial Sequence
  chemically synthesized
agtttttatgcatggcatct

SEQ ID NO: 371051 - DNA, 20 bp, Artificial Sequence
  chemically synthesized
gggtagtcagtttttatgca

SEQ ID NO: 371052 - DNA, 20 bp, Artificial Sequence
  chemically synthesized
catggtggtttcagggtagt

SEQ ID NO: 371053 - DNA, 20 bp, Artificial Sequence
  chemically synthesized
acagcatggtggtttcaggg

SEQ ID NO: 371054 - DNA, 20 bp, Artificial Sequence
  chemically synthesized
tctacagcatggtggtttca

SEQ ID NO: 371055 - DNA, 20 bp, Artificial Sequence
  chemically synthesized
ttctacagcatggtggtttc

SEQ ID NO: 371056 - DNA, 20 bp, Artificial Sequence
  chemically synthesized
cttctacagcatggtggttt

SEQ ID NO: 371057 - DNA, 20 bp, Artificial Sequence
  chemically synthesized
agatgtcttctacagcatgg

SEQ ID NO: 371058 - DNA, 20 bp, Artificial Sequence
  chemically synthesized
accctgaaaccaccatgctg

SEQ ID NO: 371059 - DNA, 20 bp, Artificial Sequence
  chemically synthesized
tgtagatgtcttctacagca

SEQ ID NO: 371060 - DNA, 20 bp, Artificial Sequence
  chemically synthesized
ctgaaaccaccatgctgtag

SEQ ID NO: 371061 - DNA, 20 bp, Artificial Sequence
  chemically synthesized
ggacttgtagatgtcttcta

SEQ ID NO: 371062 - DNA, 20 bp, Artificial Sequence
  chemically synthesized
atgctgtagaagacatctac

SEQ ID NO: 371063 - DNA, 20 bp, Artificial Sequence
  chemically synthesized
actgtcaaccagaggacttg

SEQ ID NO: 371064 - DNA, 20 bp, Artificial Sequence
  chemically synthesized
gaagacatctacaagtcctc

SEQ ID NO: 371065 - DNA, 20 bp, Artificial Sequence
  chemically synthesized
cagcagggactgtcaaccag

SEQ ID NO: 371066 - DNA, 20 bp, Artificial Sequence
  chemically synthesized
tctacaagtcctctggttga

SEQ ID NO: 371067 - DNA, 20 bp, Artificial Sequence
  chemically synthesized
tcagcagggactgtcaacca

SEQ ID NO: 371068 - DNA, 20 bp, Artificial Sequence
  chemically synthesized
gttcagcagggactgtcaac

SEQ ID NO: 371069 - DNA, 20 bp, Artificial Sequence
  chemically synthesized
ctgaaaggctcagttcagca

SEQ ID NO: 371070 - DNA, 20 bp, Artificial Sequence
  chemically synthesized
gctgaaaggctcagttcagc

SEQ ID NO: 371071 - DNA, 20 bp, Artificial Sequence
  chemically synthesized
ttgacagtccctgctgaact

SEQ ID NO: 371072 - DNA, 20 bp, Artificial Sequence
  chemically synthesized
ggctgaaaggctcagttcag

SEQ ID NO: 371073 - DNA, 20 bp, Artificial Sequence
  chemically synthesized
aatggctgaaaggctcagtt

SEQ ID NO: 371074 - DNA, 20 bp, Artificial Sequence
  chemically synthesized
ccctgctgaactgagccttt

SEQ ID NO: 371075 - DNA, 20 bp, Artificial Sequence
  chemically synthesized
gtgagaatggctgaaaggct

SEQ ID NO: 371076 - DNA, 20 bp, Artificial Sequence
  chemically synthesized
ccattgtgagaatggctgaa

SEQ ID NO: 371077 - DNA, 20 bp, Artificial Sequence
  chemically synthesized
gccattgtgagaatggctga

SEQ ID NO: 371078 - DNA, 20 bp, Artificial Sequence
  chemically synthesized
gcttaatgccattgtgagaa

SEQ ID NO: 371079 - DNA, 20 bp, Artificial Sequence
  chemically synthesized
cctttcagccattctcacaa

SEQ ID NO: 371080 - DNA, 20 bp, Artificial Sequence
  chemically synthesized
ttaatgcttaatgccattgt

SEQ ID NO: 371081 - DNA, 20 bp, Artificial Sequence
  chemically synthesized
gccattctcacaatggcatt

SEQ ID NO: 371082 - DNA, 20 bp, Artificial Sequence
  chemically synthesized
tcacaatggcattaagcatt

SEQ ID NO: 371083 - DNA, 20 bp, Artificial Sequence
  chemically synthesized
ctggtctggagggttcaaga

SEQ ID NO: 371084 - DNA, 20 bp, Artificial Sequence
  chemically synthesized
tgtgctggtctggagggttc

SEQ ID NO: 371085 - DNA, 20 bp, Artificial Sequence
  chemically synthesized
tgaatctgtcttgaaccctc

SEQ ID NO: 371086 - DNA, 20 bp, Artificial Sequence
  chemically synthesized
ctgtcttgaaccctccagac

SEQ ID NO: 371087 - DNA, 20 bp, Artificial Sequence
  chemically synthesized
agtggatgtgctggtctgga

SEQ ID NO: 371088 - DNA, 20 bp, Artificial Sequence
  chemically synthesized
tagtggatgtgctggtctgg

SEQ ID NO: 371089 - DNA, 20 bp, Artificial Sequence
  chemically synthesized
ctagtggatgtgctggtctg

SEQ ID NO: 371090 - DNA, 20 bp, Artificial Sequence
  chemically synthesized
agctagtggatgtgctggtc

SEQ ID NO: 371091 - DNA, 20 bp, Artificial Sequence
  chemically synthesized
aattcagctagtggatgtgc

SEQ ID NO: 371092 - DNA, 20 bp, Artificial Sequence
  chemically synthesized
ctccagaccagcacatccac

SEQ ID NO: 371093 - DNA, 20 bp, Artificial Sequence
  chemically synthesized
acttggcagaattcagctag

SEQ ID NO: 371094 - DNA, 20 bp, Artificial Sequence
  chemically synthesized
atcacttggcagaattcagc

SEQ ID NO: 371095 - DNA, 20 bp, Artificial Sequence
  chemically synthesized
tgacatcacttggcagaatt

SEQ ID NO: 371096 - DNA, 20 bp, Artificial Sequence
  chemically synthesized
tccactagctgaattctgcc

SEQ ID NO: 371097 - DNA, 20 bp, Artificial Sequence
  chemically synthesized
tgtcagttgacatcacttgg

SEQ ID NO: 371098 - DNA, 20 bp, Artificial Sequence
  chemically synthesized
tggtgtcagttgacatcact

SEQ ID NO: 371099 - DNA, 20 bp, Artificial Sequence
  chemically synthesized
ttttctactctgtgtggtgt

SEQ ID NO: 371100 - DNA, 20 bp, Artificial Sequence
  chemically synthesized
tgatgtcaactgacaccaca

SEQ ID NO: 371101 - DNA, 20 bp, Artificial Sequence
  chemically synthesized
atgtcaactgacaccacaca

SEQ ID NO: 371102 - DNA, 20 bp, Artificial Sequence
  chemically synthesized
tcaactgacaccacacagag

SEQ ID NO: 371103 - DNA, 20 bp, Artificial Sequence
  chemically synthesized
attgatttttctactctgtg

SEQ ID NO: 371104 - DNA, 20 bp, Artificial Sequence
  chemically synthesized
cacagagtagaaaaatcaat

SEQ ID NO: 371105 - DNA, 20 bp, Artificial Sequence
  chemically synthesized
aaaaatcaataagctgaaca

SEQ ID NO: 371106 - DNA, 20 bp, Artificial Sequence
  chemically synthesized
atcaggaattcagccgtgtt

SEQ ID NO: 371107 - DNA, 20 bp, Artificial Sequence
  chemically synthesized
gattttgtgaatcaggaatt

SEQ ID NO: 371108 - DNA, 20 bp, Artificial Sequence
  chemically synthesized
tttatctgattttgtgaatc

SEQ ID NO: 371109 - DNA, 20 bp, Artificial Sequence
  chemically synthesized
ttttatctgattttgtgaat

SEQ ID NO: 371110 - DNA, 20 bp, Artificial Sequence
  chemically synthesized
gaattcctgattcacaaaat

SEQ ID NO: 371111 - DNA, 20 bp, Artificial Sequence
  chemically synthesized
gattcacaaaatcagataaa

SEQ ID NO: 371112 - DNA, 20 bp, Artificial Sequence
  chemically synthesized
aaaatcagataaaaagataa

SEQ ID NO: 371113 - DNA, 20 bp, Artificial Sequence
  chemically synthesized
aatcagataaaaagataaaa

SEQ ID NO: 371114 - DNA, 20 bp, Artificial Sequence
  chemically synthesized
gataaaagagatgttatttt

SEQ ID NO: 371115 - DNA, 20 bp, Artificial Sequence
  chemically synthesized
ttattttaagccactgtact

SEQ ID NO: 371116 - DNA, 20 bp, Artificial Sequence
  chemically synthesized
acaaaacaccccaagtacag

SEQ ID NO: 371117 - DNA, 20 bp, Artificial Sequence
  chemically synthesized
tattttaagccactgtactt

SEQ ID NO: 371118 - DNA, 20 bp, Artificial Sequence
  chemically synthesized
attttaagccactgtacttg

SEQ ID NO: 371119 - DNA, 20 bp, Artificial Sequence
  chemically synthesized
gtaacaaaacaccccaagta

SEQ ID NO: 371120 - DNA, 20 bp, Artificial Sequence
  chemically synthesized
actatgtaacaaaacacccc

SEQ ID NO: 371121 - DNA, 20 bp, Artificial Sequence
  chemically synthesized
acttggggtgttttgttaca

SEQ ID NO: 371122 - DNA, 20 bp, Artificial Sequence
  chemically synthesized
ggtgttttgttacatagtaa

SEQ ID NO: 371123 - DNA, 20 bp, Artificial Sequence
  chemically synthesized
gttacatagtaatagaaaac

SEQ ID NO: 371124 - DNA, 20 bp, Artificial Sequence
  chemically synthesized
acatagtaatagaaaaccag

SEQ ID NO: 371125 - DNA, 20 bp, Artificial Sequence
  chemically synthesized
atagtaatagaaaaccagaa

SEQ ID NO: 371126 - DNA, 20 bp, Artificial Sequence
  chemically synthesized
gggagcttaggatactcttc

SEQ ID NO: 371127 - DNA, 20 bp, Artificial Sequence
  chemically synthesized
gaaaaccagaagagtatcct

SEQ ID NO: 371128 - DNA, 20 bp, Artificial Sequence
  chemically synthesized
ctccattccagagggagctt

SEQ ID NO: 371129 - DNA, 20 bp, Artificial Sequence
  chemically synthesized
cctccattccagagggagct

SEQ ID NO: 371130 - DNA, 20 bp, Artificial Sequence
  chemically synthesized
agagtatcctaagctccctc

SEQ ID NO: 371131 - DNA, 20 bp, Artificial Sequence
  chemically synthesized
cagagcctccattccagagg

SEQ ID NO: 371132 - DNA, 20 bp, Artificial Sequence
  chemically synthesized
atcctaagctccctctggaa

SEQ ID NO: 371133 - DNA, 20 bp, Artificial Sequence
  chemically synthesized
ggcagagcctccattccaga

SEQ ID NO: 371134 - DNA, 20 bp, Artificial Sequence
  chemically synthesized
aggcagagcctccattccag

SEQ ID NO: 371135 - DNA, 20 bp, Artificial Sequence
  chemically synthesized
cctaagctccctctggaatg

SEQ ID NO: 371136 - DNA, 20 bp, Artificial Sequence
  chemically synthesized
aaggcagagcctccattcca

SEQ ID NO: 371137 - DNA, 20 bp, Artificial Sequence
  chemically synthesized
ctaagctccctctggaatgg

SEQ ID NO: 371138 - DNA, 20 bp, Artificial Sequence
  chemically synthesized
tcaaggcagagcctccattc

SEQ ID NO: 371139 - DNA, 20 bp, Artificial Sequence
  chemically synthesized
gagggctgtgattcaaggca

SEQ ID NO: 371140 - DNA, 20 bp, Artificial Sequence
  chemically synthesized
gagagggctgtgattcaagg

SEQ ID NO: 371141 - DNA, 20 bp, Artificial Sequence
  chemically synthesized
ggaggctctgccttgaatca

SEQ ID NO: 371142 - DNA, 20 bp, Artificial Sequence
  chemically synthesized
atcgagagggctgtgattca

SEQ ID NO: 371143 - DNA, 20 bp, Artificial Sequence
  chemically synthesized
gatcgagagggctgtgattc

SEQ ID NO: 371144 - DNA, 20 bp, Artificial Sequence
  chemically synthesized
tatcaaggtctcgatcgaga

SEQ ID NO: 371145 - DNA, 20 bp, Artificial Sequence
  chemically synthesized
gaatcacagccctctcgatc

SEQ ID NO: 371146 - DNA, 20 bp, Artificial Sequence
  chemically synthesized
gtatcaaggtctcgatcgag

SEQ ID NO: 371147 - DNA, 20 bp, Artificial Sequence
  chemically synthesized
tgtatcaaggtctcgatcga

SEQ ID NO: 371148 - DNA, 20 bp, Artificial Sequence
  chemically synthesized
catgtatcaaggtctcgatc

SEQ ID NO: 371149 - DNA, 20 bp, Artificial Sequence
  chemically synthesized
atgaagagggacatgtatca

SEQ ID NO: 371150 - DNA, 20 bp, Artificial Sequence
  chemically synthesized
gatgaagagggacatgtatc

SEQ ID NO: 371151 - DNA, 20 bp, Artificial Sequence
  chemically synthesized
agttcaagagtcgatgaaga

SEQ ID NO: 371152 - DNA, 20 bp, Artificial Sequence
  chemically synthesized
gagttcaagagtcgatgaag

SEQ ID NO: 371153 - DNA, 20 bp, Artificial Sequence
  chemically synthesized
agagttcaagagtcgatgaa

SEQ ID NO: 371154 - DNA, 20 bp, Artificial Sequence
  chemically synthesized
aaagagttcaagagtcgatg

SEQ ID NO: 371155 - DNA, 20 bp, Artificial Sequence
  chemically synthesized
gggaaccagaaagagttcaa

SEQ ID NO: 371156 - DNA, 20 bp, Artificial Sequence
  chemically synthesized
cagggaaccagaaagagttc

SEQ ID NO: 371157 - DNA, 20 bp, Artificial Sequence
  chemically synthesized
atcgactcttgaactctttc

SEQ ID NO: 371158 - DNA, 20 bp, Artificial Sequence
  chemically synthesized
gtaaatcagggaaccagaaa

SEQ ID NO: 371159 - DNA, 20 bp, Artificial Sequence
  chemically synthesized
tagtaaatcagggaaccaga

SEQ ID NO: 371160 - DNA, 20 bp, Artificial Sequence
  chemically synthesized
gcaatagtaaatcagggaac

SEQ ID NO: 371161 - DNA, 20 bp, Artificial Sequence
  chemically synthesized
acataggcaatagtaaatca

SEQ ID NO: 371162 - DNA, 20 bp, Artificial Sequence
  chemically synthesized
aacataggcaatagtaaatc

SEQ ID NO: 371163 - DNA, 20 bp, Artificial Sequence
  chemically synthesized
aaacataggcaatagtaaat

SEQ ID NO: 371164 - DNA, 20 bp, Artificial Sequence
  chemically synthesized
ttaaatagaaacataggcaa

SEQ ID NO: 371165 - DNA, 20 bp, Artificial Sequence
  chemically synthesized
aatctgttaaatagaaacat

SEQ ID NO: 371166 - DNA, 20 bp, Artificial Sequence
  chemically synthesized
taatctgttaaatagaaaca

SEQ ID NO: 371167 - DNA, 20 bp, Artificial Sequence
  chemically synthesized
ttgcctatgtttctatttaa

SEQ ID NO: 371168 - DNA, 20 bp, Artificial Sequence
  chemically synthesized
acagggtgtaatctgttaaa

SEQ ID NO: 371169 - DNA, 20 bp, Artificial Sequence
  chemically synthesized
acagattacaccctgtctcc

SEQ ID NO: 371170 - DNA, 20 bp, Artificial Sequence
  chemically synthesized
agactgagtgctgggagaca

SEQ ID NO: 371171 - DNA, 20 bp, Artificial Sequence
  chemically synthesized
gagactgagtgctgggagac

SEQ ID NO: 371172 - DNA, 20 bp, Artificial Sequence
  chemically synthesized
agagactgagtgctgggaga

SEQ ID NO: 371173 - DNA, 20 bp, Artificial Sequence
  chemically synthesized
aagaagagactgagtgctgg

SEQ ID NO: 371174 - DNA, 20 bp, Artificial Sequence
  chemically synthesized
acaccctgtctcccagcact

SEQ ID NO: 371175 - DNA, 20 bp, Artificial Sequence
  chemically synthesized
ctaagaagagactgagtgct

SEQ ID NO: 371176 - DNA, 20 bp, Artificial Sequence
  chemically synthesized
actaagaagagactgagtgc

SEQ ID NO: 371177 - DNA, 20 bp, Artificial Sequence
  chemically synthesized
ggtgtaactaagaagagact

SEQ ID NO: 371178 - DNA, 20 bp, Artificial Sequence
  chemically synthesized
cccagcactcagtctcttct

SEQ ID NO: 371179 - DNA, 20 bp, Artificial Sequence
  chemically synthesized
aattcaggtgtaactaagaa

SEQ ID NO: 371180 - DNA, 20 bp, Artificial Sequence
  chemically synthesized
gaaattcaggtgtaactaag

SEQ ID NO: 371181 - DNA, 20 bp, Artificial Sequence
  chemically synthesized
ggggaaattcaggtgtaact

SEQ ID NO: 371182 - DNA, 20 bp, Artificial Sequence
  chemically synthesized
gacaggcactggggaaattc

SEQ ID NO: 371183 - DNA, 20 bp, Artificial Sequence
  chemically synthesized
ggacaggcactggggaaatt

SEQ ID NO: 371184 - DNA, 20 bp, Artificial Sequence
  chemically synthesized
tagttacacctgaatttccc

SEQ ID NO: 371185 - DNA, 20 bp, Artificial Sequence
  chemically synthesized
actaggcaggacaggcactg

SEQ ID NO: 371186 - DNA, 20 bp, Artificial Sequence
  chemically synthesized
gactaggcaggacaggcact

SEQ ID NO: 371187 - DNA, 20 bp, Artificial Sequence
  chemically synthesized
agactaggcaggacaggcac

SEQ ID NO: 371188 - DNA, 20 bp, Artificial Sequence
  chemically synthesized
aaatacagactaggcaggac

SEQ ID NO: 371189 - DNA, 20 bp, Artificial Sequence
  chemically synthesized
tccccagtgcctgtcctgcc

SEQ ID NO: 371190 - DNA, 20 bp, Artificial Sequence
  chemically synthesized
aaaatacagactaggcagga

SEQ ID NO: 371191 - DNA, 20 bp, Artificial Sequence
  chemically synthesized
ggagaaaatacagactaggc

SEQ ID NO: 371192 - DNA, 20 bp, Artificial Sequence
  chemically synthesized
aggagaaaatacagactagg

SEQ ID NO: 371193 - DNA, 20 bp, Artificial Sequence
  chemically synthesized
aaaaggagaaaatacagact

SEQ ID NO: 371194 - DNA, 20 bp, Artificial Sequence
  chemically synthesized
gaaaaggagaaaatacagac

SEQ ID NO: 371195 - DNA, 20 bp, Artificial Sequence
  chemically synthesized
tggaggaaaaggagaaaata

SEQ ID NO: 371196 - DNA, 20 bp, Artificial Sequence
  chemically synthesized
agtgtaggctggaggaaaag

SEQ ID NO: 371197 - DNA, 20 bp, Artificial Sequence
  chemically synthesized
tgtattttctccttttcctc

SEQ ID NO: 371198 - DNA, 20 bp, Artificial Sequence
  chemically synthesized
gcagtgtaggctggaggaaa

SEQ ID NO: 371199 - DNA, 20 bp, Artificial Sequence
  chemically synthesized
agcagtgtaggctggaggaa

SEQ ID NO: 371200 - DNA, 20 bp, Artificial Sequence
  chemically synthesized
gttatagcagtgtaggctgg

SEQ ID NO: 371201 - DNA, 20 bp, Artificial Sequence
  chemically synthesized
ggttatagcagtgtaggctg

SEQ ID NO: 371202 - DNA, 20 bp, Artificial Sequence
  chemically synthesized
aaggttatagcagtgtaggc

SEQ ID NO: 371203 - DNA, 20 bp, Artificial Sequence
  chemically synthesized
tcctaaggttatagcagtgt

SEQ ID NO: 371204 - DNA, 20 bp, Artificial Sequence
  chemically synthesized
atcctaaggttatagcagtg

SEQ ID NO: 371205 - DNA, 20 bp, Artificial Sequence
  chemically synthesized
aaagtatcctaaggttatag

SEQ ID NO: 371206 - DNA, 20 bp, Artificial Sequence
  chemically synthesized
agcctacactgctataacct

SEQ ID NO: 371207 - DNA, 20 bp, Artificial Sequence
  chemically synthesized
gcctacactgctataacctt

SEQ ID NO: 371208 - DNA, 20 bp, Artificial Sequence
  chemically synthesized
ttgaaagtatcctaaggtta

SEQ ID NO: 371209 - DNA, 20 bp, Artificial Sequence
  chemically synthesized
agcaggttgaaagtatccta

SEQ ID NO: 371210 - DNA, 20 bp, Artificial Sequence
  chemically synthesized
cagcaggttgaaagtatcct

SEQ ID NO: 371211 - DNA, 20 bp, Artificial Sequence
  chemically synthesized
agtttctcacagcaggttga

SEQ ID NO: 371212 - DNA, 20 bp, Artificial Sequence
  chemically synthesized
ggatactttcaacctgctgt

SEQ ID NO: 371213 - DNA, 20 bp, Artificial Sequence
  chemically synthesized
tgcatagagtttctcacagc

SEQ ID NO: 371214 - DNA, 20 bp, Artificial Sequence
  chemically synthesized
ttgcatagagtttctcacag

SEQ ID NO: 371215 - DNA, 20 bp, Artificial Sequence
  chemically synthesized
actttgcatagagtttctca

SEQ ID NO: 371216 - DNA, 20 bp, Artificial Sequence
  chemically synthesized
gctgtgagaaactctatgca

SEQ ID NO: 371217 - DNA, 20 bp, Artificial Sequence
  chemically synthesized
tcatggaaacactttgcata

SEQ ID NO: 371218 - DNA, 20 bp, Artificial Sequence
  chemically synthesized
tatcatggaaacactttgca

SEQ ID NO: 371219 - DNA, 20 bp, Artificial Sequence
  chemically synthesized
aaaagagcagaaaattatca

SEQ ID NO: 371220 - DNA, 20 bp, Artificial Sequence
  chemically synthesized
ccctacagaagggaaaagag

SEQ ID NO: 371221 - DNA, 20 bp, Artificial Sequence
  chemically synthesized
tctccctacagaagggaaaa

SEQ ID NO: 371222 - DNA, 20 bp, Artificial Sequence
  chemically synthesized
tatctccctacagaagggaa

SEQ ID NO: 371223 - DNA, 20 bp, Artificial Sequence
  chemically synthesized
ttctgctcttttcccttctg

SEQ ID NO: 371224 - DNA, 20 bp, Artificial Sequence
  chemically synthesized
tctgctcttttcccttctgt

SEQ ID NO: 371225 - DNA, 20 bp, Artificial Sequence
  chemically synthesized
ctgctcttttcccttctgta

SEQ ID NO: 371226 - DNA, 20 bp, Artificial Sequence
  chemically synthesized
aaacatatctccctacagaa

SEQ ID NO: 371227 - DNA, 20 bp, Artificial Sequence
  chemically synthesized
aaaacatatctccctacaga

SEQ ID NO: 371228 - DNA, 20 bp, Artificial Sequence
  chemically synthesized
gctcttttcccttctgtagg

SEQ ID NO: 371229 - DNA, 20 bp, Artificial Sequence
  chemically synthesized
caaaacatatctccctacag

SEQ ID NO: 371230 - DNA, 20 bp, Artificial Sequence
  chemically synthesized
agccaaaacatatctcccta

SEQ ID NO: 371231 - DNA, 20 bp, Artificial Sequence
  chemically synthesized
ttctgtagggagatatgttt

SEQ ID NO: 371232 - DNA, 20 bp, Artificial Sequence
  chemically synthesized
tatgttttggctatctctac

SEQ ID NO: 371233 - DNA, 20 bp, Artificial Sequence
  chemically synthesized
agtagataaactggtagaga

SEQ ID NO: 371234 - DNA, 20 bp, Artificial Sequence
  chemically synthesized
tagaagtagataaactggta

SEQ ID NO: 371235 - DNA, 20 bp, Artificial Sequence
  chemically synthesized
attagaagtagataaactgg

SEQ ID NO: 371236 - DNA, 20 bp, Artificial Sequence
  chemically synthesized
gaaattagaagtagataaac

SEQ ID NO: 371237 - DNA, 20 bp, Artificial Sequence
  chemically synthesized
gattaaagtgaaattagaag

SEQ ID NO: 371238 - DNA, 20 bp, Artificial Sequence
  chemically synthesized
ctggattaaagtgaaattag

SEQ ID NO: 371239 - DNA, 20 bp, Artificial Sequence
  chemically synthesized
gcactggattaaagtgaaat

SEQ ID NO: 371240 - DNA, 20 bp, Artificial Sequence
  chemically synthesized
cttctaatttcactttaatc

SEQ ID NO: 371241 - DNA, 20 bp, Artificial Sequence
  chemically synthesized
ccgggcctggcactggatta

SEQ ID NO: 371242 - DNA, 20 bp, Artificial Sequence
  chemically synthesized
atttcactttaatccagtgc

SEQ ID NO: 371243 - DNA, 20 bp, Artificial Sequence
  chemically synthesized
tttcactttaatccagtgcc

SEQ ID NO: 371244 - DNA, 20 bp, Artificial Sequence
  chemically synthesized
cttacaaccgggcctggcac

SEQ ID NO: 371245 - DNA, 20 bp, Artificial Sequence
  chemically synthesized
ctttaatccagtgccaggcc

SEQ ID NO: 371246 - DNA, 20 bp, Artificial Sequence
  chemically synthesized
tcggtgcttacaaccgggcc

SEQ ID NO: 371247 - DNA, 20 bp, Artificial Sequence
  chemically synthesized
ccagtgccaggcccggttgt

SEQ ID NO: 371248 - DNA, 20 bp, Artificial Sequence
  chemically synthesized
attcttcggtgcttacaacc

SEQ ID NO: 371249 - DNA, 20 bp, Artificial Sequence
  chemically synthesized
tattcttcggtgcttacaac

SEQ ID NO: 371250 - DNA, 20 bp, Artificial Sequence
  chemically synthesized
aggcccggttgtaagcaccg

SEQ ID NO: 371251 - DNA, 20 bp, Artificial Sequence
  chemically synthesized
atagtcattcatttattctt

SEQ ID NO: 371252 - DNA, 20 bp, Artificial Sequence
  chemically synthesized
aagaataaatgaatgactat

SEQ ID NO: 371253 - DNA, 20 bp, Artificial Sequence
  chemically synthesized
taaatgaatgactattggat

SEQ ID NO: 371254 - DNA, 20 bp, Artificial Sequence
  chemically synthesized
tcactaattcacttatccaa

SEQ ID NO: 371255 - DNA, 20 bp, Artificial Sequence
  chemically synthesized
tgactattggataagtgaat

SEQ ID NO: 371256 - DNA, 20 bp, Artificial Sequence
  chemically synthesized
tattggataagtgaattagt

SEQ ID NO: 371257 - DNA, 20 bp, Artificial Sequence
  chemically synthesized
taaatacatcaatgcattta

SEQ ID NO: 371258 - DNA, 20 bp, Artificial Sequence
  chemically synthesized
aaatacatcaatgcatttat

SEQ ID NO: 371259 - DNA, 20 bp, Artificial Sequence
  chemically synthesized
atcaatgcatttataggtta

SEQ ID NO: 371260 - DNA, 20 bp, Artificial Sequence
  chemically synthesized
taacaatttcagtggagtag

SEQ ID NO: 371261 - DNA, 20 bp, Artificial Sequence
  chemically synthesized
aagtaacaatttcagtggag

SEQ ID NO: 371262 - DNA, 20 bp, Artificial Sequence
  chemically synthesized
ttaaagtaacaatttcagtg

SEQ ID NO: 371263 - DNA, 20 bp, Artificial Sequence
  chemically synthesized
ttttaaagtaacaatttcag

SEQ ID NO: 371264 - DNA, 20 bp, Artificial Sequence
  chemically synthesized
taattttaaagtaacaattt

SEQ ID NO: 371265 - DNA, 20 bp, Artificial Sequence
  chemically synthesized
tgaaattgttactttaaaat

SEQ ID NO: 371266 - DNA, 20 bp, Artificial Sequence
  chemically synthesized
ggttgctttgactaatttta

SEQ ID NO: 371267 - DNA, 20 bp, Artificial Sequence
  chemically synthesized
tgttactttaaaattagtca

SEQ ID NO: 371268 - DNA, 20 bp, Artificial Sequence
  chemically synthesized
ttaaaattagtcaaagcaac

SEQ ID NO: 371269 - DNA, 20 bp, Artificial Sequence
  chemically synthesized
gaaaagaccattcggttttc

SEQ ID NO: 371270 - DNA, 20 bp, Artificial Sequence
  chemically synthesized
aaagcaaccagaaaaccgaa

SEQ ID NO: 371271 - DNA, 20 bp, Artificial Sequence
  chemically synthesized
gggtctgagaaaagaccatt

SEQ ID NO: 371272 - DNA, 20 bp, Artificial Sequence
  chemically synthesized
aaaaccgaatggtcttttct

SEQ ID NO: 371273 - DNA, 20 bp, Artificial Sequence
  chemically synthesized
atttacttggggtctgagaa

SEQ ID NO: 371274 - DNA, 20 bp, Artificial Sequence
  chemically synthesized
atggtcttttctcagacccc

SEQ ID NO: 371275 - DNA, 20 bp, Artificial Sequence
  chemically synthesized
ttgaaatttacttggggtct

SEQ ID NO: 371276 - DNA, 20 bp, Artificial Sequence
  chemically synthesized
attgaattgaaatttacttg

SEQ ID NO: 371277 - DNA, 20 bp, Artificial Sequence
  chemically synthesized
gattgaattgaaatttactt

SEQ ID NO: 371278 - DNA, 20 bp, Artificial Sequence
  chemically synthesized
tgattgaattgaaatttact

SEQ ID NO: 371279 - DNA, 20 bp, Artificial Sequence
  chemically synthesized
ttcaattcaatcactgcctt

SEQ ID NO: 371280 - DNA, 20 bp, Artificial Sequence
  chemically synthesized
gtgactacattgaccaaagg

SEQ ID NO: 371281 - DNA, 20 bp, Artificial Sequence
  chemically synthesized
gaggtgactacattgaccaa

SEQ ID NO: 371282 - DNA, 20 bp, Artificial Sequence
  chemically synthesized
ggaggtgactacattgacca

SEQ ID NO: 371283 - DNA, 20 bp, Artificial Sequence
  chemically synthesized
atcactgcctttggtcaatg

SEQ ID NO: 371284 - DNA, 20 bp, Artificial Sequence
  chemically synthesized
aagaaaaacagtttttaagg

SEQ ID NO: 371285 - DNA, 20 bp, Artificial Sequence
  chemically synthesized
caagaaaaacagtttttaag

SEQ ID NO: 371286 - DNA, 20 bp, Artificial Sequence
  chemically synthesized
agcaagaaaaacagttttta

SEQ ID NO: 371287 - DNA, 20 bp, Artificial Sequence
  chemically synthesized
cagcaagaaaaacagttttt

SEQ ID NO: 371288 - DNA, 20 bp, Artificial Sequence
  chemically synthesized
cacagaagcagcaagaaaaa

SEQ ID NO: 371289 - DNA, 20 bp, Artificial Sequence
  chemically synthesized
tgtctggtcacagaagcagc

SEQ ID NO: 371290 - DNA, 20 bp, Artificial Sequence
  chemically synthesized
aaagtgtctggtcacagaag

SEQ ID NO: 371291 - DNA, 20 bp, Artificial Sequence
  chemically synthesized
tttcttgctgcttctgtgac

SEQ ID NO: 371292 - DNA, 20 bp, Artificial Sequence
  chemically synthesized
tgtaaagtgtctggtcacag

SEQ ID NO: 371293 - DNA, 20 bp, Artificial Sequence
  chemically synthesized
aactgtaaagtgtctggtca

SEQ ID NO: 371294 - DNA, 20 bp, Artificial Sequence
  chemically synthesized
acaggaaactgtaaagtgtc

SEQ ID NO: 371295 - DNA, 20 bp, Artificial Sequence
  chemically synthesized
ttctgtgaccagacacttta

SEQ ID NO: 371296 - DNA, 20 bp, Artificial Sequence
  chemically synthesized
agaagtcacaggaaactgta

SEQ ID NO: 371297 - DNA, 20 bp, Artificial Sequence
  chemically synthesized
gaagtgttaggagaagtcac

SEQ ID NO: 371298 - DNA, 20 bp, Artificial Sequence
  chemically synthesized
agaagtgttaggagaagtca

SEQ ID NO: 371299 - DNA, 20 bp, Artificial Sequence
  chemically synthesized
cagcaaagaagtgttaggag

SEQ ID NO: 371300 - DNA, 20 bp, Artificial Sequence
  chemically synthesized
agccagcaaagaagtgttag

SEQ ID NO: 371301 - DNA, 20 bp, Artificial Sequence
  chemically synthesized
gaagccagcaaagaagtgtt

SEQ ID NO: 371302 - DNA, 20 bp, Artificial Sequence
  chemically synthesized
agaagccagcaaagaagtgt

SEQ ID NO: 371303 - DNA, 20 bp, Artificial Sequence
  chemically synthesized
ttctcctaacacttctttgc

SEQ ID NO: 371304 - DNA, 20 bp, Artificial Sequence
  chemically synthesized
atatagagaagccagcaaag

SEQ ID NO: 371305 - DNA, 20 bp, Artificial Sequence
  chemically synthesized
cagatatagagaagccagca

SEQ ID NO: 371306 - DNA, 20 bp, Artificial Sequence
  chemically synthesized
acgtgcagatatagagaagc

SEQ ID NO: 371307 - DNA, 20 bp, Artificial Sequence
  chemically synthesized
aaatacgtgcagatatagag

SEQ ID NO: 371308 - DNA, 20 bp, Artificial Sequence
  chemically synthesized
tttaaatacgtgcagatata

SEQ ID NO: 371309 - DNA, 20 bp, Artificial Sequence
  chemically synthesized
catttaaatacgtgcagata

SEQ ID NO: 371310 - DNA, 20 bp, Artificial Sequence
  chemically synthesized
aattcacatttaaatacgtg

SEQ ID NO: 371311 - DNA, 20 bp, Artificial Sequence
  chemically synthesized
tatttaaatgtgaattctcc

SEQ ID NO: 371312 - DNA, 20 bp, Artificial Sequence
  chemically synthesized
aatgtgaattctccaagact

SEQ ID NO: 371313 - DNA, 20 bp, Artificial Sequence
  chemically synthesized
gaacccaaaaccaagtcttg

SEQ ID NO: 371314 - DNA, 20 bp, Artificial Sequence
  chemically synthesized
aggaacccaaaaccaagtct

SEQ ID NO: 371315 - DNA, 20 bp, Artificial Sequence
  chemically synthesized
aattctccaagacttggttt

SEQ ID NO: 371316 - DNA, 20 bp, Artificial Sequence
  chemically synthesized
attctccaagacttggtttt

SEQ ID NO: 371317 - DNA, 20 bp, Artificial Sequence
  chemically synthesized
ttaaaaaggaacccaaaacc

SEQ ID NO: 371318 - DNA, 20 bp, Artificial Sequence
  chemically synthesized
gatattatacacagttaaaa

SEQ ID NO: 371319 - DNA, 20 bp, Artificial Sequence
  chemically synthesized
ggatattatacacagttaaa

SEQ ID NO: 371320 - DNA, 20 bp, Artificial Sequence
  chemically synthesized
cggcaaaaggatattataca

SEQ ID NO: 371321 - DNA, 20 bp, Artificial Sequence
  chemically synthesized
ggggcagatgatacggcaaa

SEQ ID NO: 371322 - DNA, 20 bp, Artificial Sequence
  chemically synthesized
gggggcagatgatacggcaa

SEQ ID NO: 371323 - DNA, 20 bp, Artificial Sequence
  chemically synthesized
agccatgggggcagatgata

SEQ ID NO: 371324 - DNA, 20 bp, Artificial Sequence
  chemically synthesized
tgccgtatcatctgccccca

SEQ ID NO: 371325 - DNA, 20 bp, Artificial Sequence
  chemically synthesized
tggagtttaagccatggggg

SEQ ID NO: 371326 - DNA, 20 bp, Artificial Sequence
  chemically synthesized
atatggagtttaagccatgg

SEQ ID NO: 371327 - DNA, 20 bp, Artificial Sequence
  chemically synthesized
aatatggagtttaagccatg

SEQ ID NO: 371328 - DNA, 20 bp, Artificial Sequence
  chemically synthesized
caatatggagtttaagccat

SEQ ID NO: 371329 - DNA, 20 bp, Artificial Sequence
  chemically synthesized
tcaatatggagtttaagcca

SEQ ID NO: 371330 - DNA, 20 bp, Artificial Sequence
  chemically synthesized
gggtaatcaatatggagttt

SEQ ID NO: 371331 - DNA, 20 bp, Artificial Sequence
  chemically synthesized
gtttgggggtaatcaatatg

SEQ ID NO: 371332 - DNA, 20 bp, Artificial Sequence
  chemically synthesized
tggtttgggggtaatcaata

SEQ ID NO: 371333 - DNA, 20 bp, Artificial Sequence
  chemically synthesized
aactaaagaaaatggtttgg

SEQ ID NO: 371334 - DNA, 20 bp, Artificial Sequence
  chemically synthesized
caactaaagaaaatggtttg

SEQ ID NO: 371335 - DNA, 20 bp, Artificial Sequence
  chemically synthesized
acaactaaagaaaatggttt

SEQ ID NO: 371336 - DNA, 20 bp, Artificial Sequence
  chemically synthesized
cacaactaaagaaaatggtt

SEQ ID NO: 371337 - DNA, 20 bp, Artificial Sequence
  chemically synthesized
tacccccaaaccattttctt

SEQ ID NO: 371338 - DNA, 20 bp, Artificial Sequence
  chemically synthesized
gataccacaactaaagaaaa

SEQ ID NO: 371339 - DNA, 20 bp, Artificial Sequence
  chemically synthesized
caaaccattttctttagttg

SEQ ID NO: 371340 - DNA, 20 bp, Artificial Sequence
  chemically synthesized
taggcaagataccacaacta

SEQ ID NO: 371341 - DNA, 20 bp, Artificial Sequence
  chemically synthesized
agtgagaaagtatcataggc

SEQ ID NO: 371342 - DNA, 20 bp, Artificial Sequence
  chemically synthesized
tagcagtgagaaagtatcat

SEQ ID NO: 371343 - DNA, 20 bp, Artificial Sequence
  chemically synthesized
gtagcagtgagaaagtatca

SEQ ID NO: 371344 - DNA, 20 bp, Artificial Sequence
  chemically synthesized
tgataggtgtagcagtgaga

SEQ ID NO: 371345 - DNA, 20 bp, Artificial Sequence
  chemically synthesized
tgtttgataggtgtagcagt

SEQ ID NO: 371346 - DNA, 20 bp, Artificial Sequence
  chemically synthesized
tgtgtgtttgataggtgtag

SEQ ID NO: 371347 - DNA, 20 bp, Artificial Sequence
  chemically synthesized
cagtgtgtgtttgataggtg

SEQ ID NO: 371348 - DNA, 20 bp, Artificial Sequence
  chemically synthesized
gaaatcagtgtgtgtttgat

SEQ ID NO: 371349 - DNA, 20 bp, Artificial Sequence
  chemically synthesized
ggaaatcagtgtgtgtttga

SEQ ID NO: 371350 - DNA, 20 bp, Artificial Sequence
  chemically synthesized
ctggatctgaggagggaaat

SEQ ID NO: 371351 - DNA, 20 bp, Artificial Sequence
  chemically synthesized
cacacactgatttccctcct

SEQ ID NO: 371352 - DNA, 20 bp, Artificial Sequence
  chemically synthesized
aatatgtctggatctgagga

SEQ ID NO: 371353 - DNA, 20 bp, Artificial Sequence
  chemically synthesized
aaatatgtctggatctgagg

SEQ ID NO: 371354 - DNA, 20 bp, Artificial Sequence
  chemically synthesized
aaaatatgtctggatctgag

SEQ ID NO: 371355 - DNA, 20 bp, Artificial Sequence
  chemically synthesized
ctgatttccctcctcagatc

SEQ ID NO: 371356 - DNA, 20 bp, Artificial Sequence
  chemically synthesized
ggaaaatatgtctggatctg

SEQ ID NO: 371357 - DNA, 20 bp, Artificial Sequence
  chemically synthesized
cggaaaatatgtctggatct

SEQ ID NO: 371358 - DNA, 20 bp, Artificial Sequence
  chemically synthesized
taatctccggaaaatatgtc

SEQ ID NO: 371359 - DNA, 20 bp, Artificial Sequence
  chemically synthesized
tcagatccagacatattttc

SEQ ID NO: 371360 - DNA, 20 bp, Artificial Sequence
  chemically synthesized
agatccagacatattttccg

SEQ ID NO: 371361 - DNA, 20 bp, Artificial Sequence
  chemically synthesized
atgggatatccaataatctc

SEQ ID NO: 371362 - DNA, 20 bp, Artificial Sequence
  chemically synthesized
acatattttccggagattat

SEQ ID NO: 371363 - DNA, 20 bp, Artificial Sequence
  chemically synthesized
attgtctttgatgtattgat

SEQ ID NO: 371364 - DNA, 20 bp, Artificial Sequence
  chemically synthesized
tattgtctttgatgtattga

SEQ ID NO: 371365 - DNA, 20 bp, Artificial Sequence
  chemically synthesized
gatatcccatcaatacatca

SEQ ID NO: 371366 - DNA, 20 bp, Artificial Sequence
  chemically synthesized
tggggaagtgatttgtattt

SEQ ID NO: 371367 - DNA, 20 bp, Artificial Sequence
  chemically synthesized
atggggaagtgatttgtatt

SEQ ID NO: 371368 - DNA, 20 bp, Artificial Sequence
  chemically synthesized
taagcaaaactatgatgggg

SEQ ID NO: 371369 - DNA, 20 bp, Artificial Sequence
  chemically synthesized
tacaaatcacttccccatca

SEQ ID NO: 371370 - DNA, 20 bp, Artificial Sequence
  chemically synthesized
aaataagcaaaactatgatg

SEQ ID NO: 371371 - DNA, 20 bp, Artificial Sequence
  chemically synthesized
gaaataagcaaaactatgat

SEQ ID NO: 371372 - DNA, 20 bp, Artificial Sequence
  chemically synthesized
agaaataagcaaaactatga

SEQ ID NO: 371373 - DNA, 20 bp, Artificial Sequence
  chemically synthesized
atatggttagaaatagaaat

SEQ ID NO: 371374 - DNA, 20 bp, Artificial Sequence
  chemically synthesized
tcattggatatggttagaaa

SEQ ID NO: 371375 - DNA, 20 bp, Artificial Sequence
  chemically synthesized
gtggtatcattggatatggt

SEQ ID NO: 371376 - DNA, 20 bp, Artificial Sequence
  chemically synthesized
gatggtggtatcattggata

SEQ ID NO: 371377 - DNA, 20 bp, Artificial Sequence
  chemically synthesized
tgagaggatggtggtatcat

SEQ ID NO: 371378 - DNA, 20 bp, Artificial Sequence
  chemically synthesized
ctgaaaaattgagaggatgg

SEQ ID NO: 371379 - DNA, 20 bp, Artificial Sequence
  chemically synthesized
gggctgaaaaattgagagga

SEQ ID NO: 371380 - DNA, 20 bp, Artificial Sequence
  chemically synthesized
cttagggctgaaaaattgag

SEQ ID NO: 371381 - DNA, 20 bp, Artificial Sequence
  chemically synthesized
tcttagggctgaaaaattga

SEQ ID NO: 371382 - DNA, 20 bp, Artificial Sequence
  chemically synthesized
ccaccatcctctcaattttt

SEQ ID NO: 371383 - DNA, 20 bp, Artificial Sequence
  chemically synthesized
tgtcttagggctgaaaaatt

SEQ ID NO: 371384 - DNA, 20 bp, Artificial Sequence
  chemically synthesized
cctctcaatttttcagccct

SEQ ID NO: 371385 - DNA, 20 bp, Artificial Sequence
  chemically synthesized
tgaaaataacttatgtctta

SEQ ID NO: 371386 - DNA, 20 bp, Artificial Sequence
  chemically synthesized
atttttcagccctaagacat

SEQ ID NO: 371387 - DNA, 20 bp, Artificial Sequence
  chemically synthesized
gtgaaaataacttatgtctt

SEQ ID NO: 371388 - DNA, 20 bp, Artificial Sequence
  chemically synthesized
ggtgaaaataacttatgtct

SEQ ID NO: 371389 - DNA, 20 bp, Artificial Sequence
  chemically synthesized
taaaggatgtggcaagaatg

SEQ ID NO: 371390 - DNA, 20 bp, Artificial Sequence
  chemically synthesized
ttaaaggatgtggcaagaat

SEQ ID NO: 371391 - DNA, 20 bp, Artificial Sequence
  chemically synthesized
atgtaattaaaggatgtggc

SEQ ID NO: 371392 - DNA, 20 bp, Artificial Sequence
  chemically synthesized
attgatgtaattaaaggatg

SEQ ID NO: 371393 - DNA, 20 bp, Artificial Sequence
  chemically synthesized
atcagtattgatgtaattaa

SEQ ID NO: 371394 - DNA, 20 bp, Artificial Sequence
  chemically synthesized
tatcagtattgatgtaatta

SEQ ID NO: 371395 - DNA, 20 bp, Artificial Sequence
  chemically synthesized
tctagagacaacagggatat

SEQ ID NO: 371396 - DNA, 20 bp, Artificial Sequence
  chemically synthesized
ttttgtatctagagacaaca

SEQ ID NO: 371397 - DNA, 20 bp, Artificial Sequence
  chemically synthesized
attttgtatctagagacaac

SEQ ID NO: 371398 - DNA, 20 bp, Artificial Sequence
  chemically synthesized
actgatatccctgttgtctc

SEQ ID NO: 371399 - DNA, 20 bp, Artificial Sequence
  chemically synthesized
cattttgtatctagagacaa

SEQ ID NO: 371400 - DNA, 20 bp, Artificial Sequence
  chemically synthesized
taactgacattttgtatcta

SEQ ID NO: 371401 - DNA, 20 bp, Artificial Sequence
  chemically synthesized
tataactgacattttgtatc

SEQ ID NO: 371402 - DNA, 20 bp, Artificial Sequence
  chemically synthesized
tgtctctagatacaaaatgt

SEQ ID NO: 371403 - DNA, 20 bp, Artificial Sequence
  chemically synthesized
agttataataaactctaaaa

SEQ ID NO: 371404 - DNA, 20 bp, Artificial Sequence
  chemically synthesized
taggtgaagaaaccatttta

SEQ ID NO: 371405 - DNA, 20 bp, Artificial Sequence
  chemically synthesized
tataggtgaagaaaccattt

SEQ ID NO: 371406 - DNA, 20 bp, Artificial Sequence
  chemically synthesized
agatttgaggattataggtg

SEQ ID NO: 371407 - DNA, 20 bp, Artificial Sequence
  chemically synthesized
tgtcaagatttgaggattat

SEQ ID NO: 371408 - DNA, 20 bp, Artificial Sequence
  chemically synthesized
ctgtcaagatttgaggatta

SEQ ID NO: 371409 - DNA, 20 bp, Artificial Sequence
  chemically synthesized
tggataactgtcaagatttg

SEQ ID NO: 371410 - DNA, 20 bp, Artificial Sequence
  chemically synthesized
ttggataactgtcaagattt

SEQ ID NO: 371411 - DNA, 20 bp, Artificial Sequence
  chemically synthesized
ctataatcctcaaatcttga

SEQ ID NO: 371412 - DNA, 20 bp, Artificial Sequence
  chemically synthesized
gactaaattggataactgtc

SEQ ID NO: 371413 - DNA, 20 bp, Artificial Sequence
  chemically synthesized
atcttgacagttatccaatt

SEQ ID NO: 371414 - DNA, 20 bp, Artificial Sequence
  chemically synthesized
ttgtactacatagactaaat

SEQ ID NO: 371415 - DNA, 20 bp, Artificial Sequence
  chemically synthesized
gttatccaatttagtctatg

SEQ ID NO: 371416 - DNA, 20 bp, Artificial Sequence
  chemically synthesized
aaataactagttgtactaca

SEQ ID NO: 371417 - DNA, 20 bp, Artificial Sequence
  chemically synthesized
tttagtctatgtagtacaac

SEQ ID NO: 371418 - DNA, 20 bp, Artificial Sequence
  chemically synthesized
gaacggtttaggaaaataac

SEQ ID NO: 371419 - DNA, 20 bp, Artificial Sequence
  chemically synthesized
agtacttacaagaacggttt

SEQ ID NO: 371420 - DNA, 20 bp, Artificial Sequence
  chemically synthesized
gagtacttacaagaacggtt

SEQ ID NO: 371421 - DNA, 20 bp, Artificial Sequence
  chemically synthesized
ttttcctaaaccgttcttgt

SEQ ID NO: 371422 - DNA, 20 bp, Artificial Sequence
  chemically synthesized
ggttggagtacttacaagaa

SEQ ID NO: 371423 - DNA, 20 bp, Artificial Sequence
  chemically synthesized
actgtggttggagtacttac

SEQ ID NO: 371424 - DNA, 20 bp, Artificial Sequence
  chemically synthesized
tcttgtaagtactccaacca

SEQ ID NO: 371425 - DNA, 20 bp, Artificial Sequence
  chemically synthesized
ctagggggcaactgtggttg

SEQ ID NO: 371426 - DNA, 20 bp, Artificial Sequence
  chemically synthesized
cactagggggcaactgtggt

SEQ ID NO: 371427 - DNA, 20 bp, Artificial Sequence
  chemically synthesized
aaagcactagggggcaactg

SEQ ID NO: 371428 - DNA, 20 bp, Artificial Sequence
  chemically synthesized
ctccaaccacagttgccccc

SEQ ID NO: 371429 - DNA, 20 bp, Artificial Sequence
  chemically synthesized
cagaataagaaagcactagg

SEQ ID NO: 371430 - DNA, 20 bp, Artificial Sequence
  chemically synthesized
acagaataagaaagcactag

SEQ ID NO: 371431 - DNA, 20 bp, Artificial Sequence
  chemically synthesized
tacagaataagaaagcacta

SEQ ID NO: 371432 - DNA, 20 bp, Artificial Sequence
  chemically synthesized
ctacagaataagaaagcact

SEQ ID NO: 371433 - DNA, 20 bp, Artificial Sequence
  chemically synthesized
tctacagaataagaaagcac

SEQ ID NO: 371434 - DNA, 20 bp, Artificial Sequence
  chemically synthesized
atacaatctacagaataaga

SEQ ID NO: 371435 - DNA, 20 bp, Artificial Sequence
  chemically synthesized
cctagtgctttcttattctg

SEQ ID NO: 371436 - DNA, 20 bp, Artificial Sequence
  chemically synthesized
aaaaatacaatctacagaat

SEQ ID NO: 371437 - DNA, 20 bp, Artificial Sequence
  chemically synthesized
gaacacaaaaatacaatcta

SEQ ID NO: 371438 - DNA, 20 bp, Artificial Sequence
  chemically synthesized
tagattgtatttttgtgttc

SEQ ID NO: 371439 - DNA, 20 bp, Artificial Sequence
  chemically synthesized
gtgttggtggagtggaaggc

SEQ ID NO: 371440 - DNA, 20 bp, Artificial Sequence
  chemically synthesized
aaaggtgttggtggagtgga

SEQ ID NO: 371441 - DNA, 20 bp, Artificial Sequence
  chemically synthesized
gaaaggtgttggtggagtgg

SEQ ID NO: 371442 - DNA, 20 bp, Artificial Sequence
  chemically synthesized
gaagaaaggtgttggtggag

SEQ ID NO: 371443 - DNA, 20 bp, Artificial Sequence
  chemically synthesized
cttgaagaaaggtgttggtg

SEQ ID NO: 371444 - DNA, 20 bp, Artificial Sequence
  chemically synthesized
gccttgaagaaaggtgttgg

SEQ ID NO: 371445 - DNA, 20 bp, Artificial Sequence
  chemically synthesized
agagccttgaagaaaggtgt

SEQ ID NO: 371446 - DNA, 20 bp, Artificial Sequence
  chemically synthesized
ctccaccaacacctttcttc

SEQ ID NO: 371447 - DNA, 20 bp, Artificial Sequence
  chemically synthesized
tccaccaacacctttcttca

SEQ ID NO: 371448 - DNA, 20 bp, Artificial Sequence
  chemically synthesized
tcaaacagagccttgaagaa

SEQ ID NO: 371449 - DNA, 20 bp, Artificial Sequence
  chemically synthesized
ttcaaacagagccttgaaga

SEQ ID NO: 371450 - DNA, 20 bp, Artificial Sequence
  chemically synthesized
ttcattcaaacagagccttg

SEQ ID NO: 371451 - DNA, 20 bp, Artificial Sequence
  chemically synthesized
atcaagaattcattcaaaca

SEQ ID NO: 371452 - DNA, 20 bp, Artificial Sequence
  chemically synthesized
gaatcaagaattcattcaaa

SEQ ID NO: 371453 - DNA, 20 bp, Artificial Sequence
  chemically synthesized
tggcaaggcacatgggaatc

SEQ ID NO: 371454 - DNA, 20 bp, Artificial Sequence
  chemically synthesized
aaaggaatggcaaggcacat

SEQ ID NO: 371455 - DNA, 20 bp, Artificial Sequence
  chemically synthesized
taaaggaatggcaaggcaca

SEQ ID NO: 371456 - DNA, 20 bp, Artificial Sequence
  chemically synthesized
ttggttataaaggaatggca

SEQ ID NO: 371457 - DNA, 20 bp, Artificial Sequence
  chemically synthesized
gttggttataaaggaatggc

SEQ ID NO: 371458 - DNA, 20 bp, Artificial Sequence
  chemically synthesized
tggagttggttataaaggaa

SEQ ID NO: 371459 - DNA, 20 bp, Artificial Sequence
  chemically synthesized
ttttttggagttggttataa

SEQ ID NO: 371460 - DNA, 20 bp, Artificial Sequence
  chemically synthesized
tttttttggagttggttata

SEQ ID NO: 371461 - DNA, 20 bp, Artificial Sequence
  chemically synthesized
ggagggactttttttggagt

SEQ ID NO: 371462 - DNA, 20 bp, Artificial Sequence
  chemically synthesized
tttataaccaactccaaaaa

SEQ ID NO: 371463 - DNA, 20 bp, Artificial Sequence
  chemically synthesized
atcaggagggactttttttg

SEQ ID NO: 371464 - DNA, 20 bp, Artificial Sequence
  chemically synthesized
agatcaggagggactttttt

SEQ ID NO: 371465 - DNA, 20 bp, Artificial Sequence
  chemically synthesized
gagagaccgcaagatcagga

SEQ ID NO: 371466 - DNA, 20 bp, Artificial Sequence
  chemically synthesized
cgagagaccgcaagatcagg

SEQ ID NO: 371467 - DNA, 20 bp, Artificial Sequence
  chemically synthesized
ccgagagaccgcaagatcag

SEQ ID NO: 371468 - DNA, 20 bp, Artificial Sequence
  chemically synthesized
aaaagtccctcctgatcttg

SEQ ID NO: 371469 - DNA, 20 bp, Artificial Sequence
  chemically synthesized
gaccgagagaccgcaagatc

SEQ ID NO: 371470 - DNA, 20 bp, Artificial Sequence
  chemically synthesized
tgaccgagagaccgcaagat

SEQ ID NO: 371471 - DNA, 20 bp, Artificial Sequence
  chemically synthesized
acaaatgaccgagagaccgc

SEQ ID NO: 371472 - DNA, 20 bp, Artificial Sequence
  chemically synthesized
ctcctgatcttgcggtctct

SEQ ID NO: 371473 - DNA, 20 bp, Artificial Sequence
  chemically synthesized
ggacatgaacaaatgaccga

SEQ ID NO: 371474 - DNA, 20 bp, Artificial Sequence
  chemically synthesized
agggacatgaacaaatgacc

SEQ ID NO: 371475 - DNA, 20 bp, Artificial Sequence
  chemically synthesized
taatgacaatatgtcattaa

SEQ ID NO: 371476 - DNA, 20 bp, Artificial Sequence
  chemically synthesized
ataatgacaatatgtcatta

SEQ ID NO: 371477 - DNA, 20 bp, Artificial Sequence
  chemically synthesized
gataatgacaatatgtcatt

SEQ ID NO: 371478 - DNA, 20 bp, Artificial Sequence
  chemically synthesized
tattgtcattatctgacttg

SEQ ID NO: 371479 - DNA, 20 bp, Artificial Sequence
  chemically synthesized
aacctacaacaacttcaagt

SEQ ID NO: 371480 - DNA, 20 bp, Artificial Sequence
  chemically synthesized
aggaaacctacaacaacttc

SEQ ID NO: 371481 - DNA, 20 bp, Artificial Sequence
  chemically synthesized
tatctgacttgaagttgttg

SEQ ID NO: 371482 - DNA, 20 bp, Artificial Sequence
  chemically synthesized
atctgacttgaagttgttgt

SEQ ID NO: 371483 - DNA, 20 bp, Artificial Sequence
  chemically synthesized
caggggctcataaagtagtg

SEQ ID NO: 371484 - DNA, 20 bp, Artificial Sequence
  chemically synthesized
ccaggggctcataaagtagt

SEQ ID NO: 371485 - DNA, 20 bp, Artificial Sequence
  chemically synthesized
aggtttcctcactactttat

SEQ ID NO: 371486 - DNA, 20 bp, Artificial Sequence
  chemically synthesized
tcagccaggggctcataaag

SEQ ID NO: 371487 - DNA, 20 bp, Artificial Sequence
  chemically synthesized
ctttcagccaggggctcata

SEQ ID NO: 371488 - DNA, 20 bp, Artificial Sequence
  chemically synthesized
ctcactactttatgagcccc

SEQ ID NO: 371489 - DNA, 20 bp, Artificial Sequence
  chemically synthesized
aaaaaatatctttcagccag

SEQ ID NO: 371490 - DNA, 20 bp, Artificial Sequence
  chemically synthesized
ctttatgagcccctggctga

SEQ ID NO: 371491 - DNA, 20 bp, Artificial Sequence
  chemically synthesized
aaaaaaatatctttcagcca

SEQ ID NO: 371492 - DNA, 20 bp, Artificial Sequence
  chemically synthesized
aaaaaaaatatctttcagcc

SEQ ID NO: 371493 - DNA, 20 bp, Artificial Sequence
  chemically synthesized
aaaaaaaaatatctttcagc

SEQ ID NO: 371494 - DNA, 20 bp, Artificial Sequence
  chemically synthesized
gattaaaaaaaaatatcttt

SEQ ID NO: 371495 - DNA, 20 bp, Artificial Sequence
  chemically synthesized
gacaatgctagttttagtag

SEQ ID NO: 371496 - DNA, 20 bp, Artificial Sequence
  chemically synthesized
agacaatgctagttttagta

SEQ ID NO: 371497 - DNA, 20 bp, Artificial Sequence
  chemically synthesized
tagacaatgctagttttagt

SEQ ID NO: 371498 - DNA, 20 bp, Artificial Sequence
  chemically synthesized
ttttaatcccctactaaaac

SEQ ID NO: 371499 - DNA, 20 bp, Artificial Sequence
  chemically synthesized
atagacaatgctagttttag

SEQ ID NO: 371500 - DNA, 20 bp, Artificial Sequence
  chemically synthesized
gcaatagacaatgctagttt

SEQ ID NO: 371501 - DNA, 20 bp, Artificial Sequence
  chemically synthesized
ctatgtgcaatagacaatgc

SEQ ID NO: 371502 - DNA, 20 bp, Artificial Sequence
  chemically synthesized
ctagcattgtctattgcaca

SEQ ID NO: 371503 - DNA, 20 bp, Artificial Sequence
  chemically synthesized
ggaacattcactatgtgcaa

SEQ ID NO: 371504 - DNA, 20 bp, Artificial Sequence
  chemically synthesized
agctccaaatttaagaaaca

SEQ ID NO: 371505 - DNA, 20 bp, Artificial Sequence
  chemically synthesized
tgttccgtgtttcttaaatt

SEQ ID NO: 371506 - DNA, 20 bp, Artificial Sequence
  chemically synthesized
ttccgtgtttcttaaatttg

SEQ ID NO: 371507 - DNA, 20 bp, Artificial Sequence
  chemically synthesized
tgttcaacagctccaaattt

SEQ ID NO: 371508 - DNA, 20 bp, Artificial Sequence
  chemically synthesized
ttaaatttggagctgttgaa

SEQ ID NO: 371509 - DNA, 20 bp, Artificial Sequence
  chemically synthesized
tgaaaactgaaactgttcaa

SEQ ID NO: 371510 - DNA, 20 bp, Artificial Sequence
  chemically synthesized
ttggagctgttgaacagttt

SEQ ID NO: 371511 - DNA, 20 bp, Artificial Sequence
  chemically synthesized
tgttgaacagtttcagtttt

SEQ ID NO: 371512 - DNA, 20 bp, Artificial Sequence
  chemically synthesized
actcagtcaaaaagtgaatg

SEQ ID NO: 371513 - DNA, 20 bp, Artificial Sequence
  chemically synthesized
gctacattcactttttgact

SEQ ID NO: 371514 - DNA, 20 bp, Artificial Sequence
  chemically synthesized
tatggtacaactcagtcaaa

SEQ ID NO: 371515 - DNA, 20 bp, Artificial Sequence
  chemically synthesized
gtgtcacctatggtacaact

SEQ ID NO: 371516 - DNA, 20 bp, Artificial Sequence
  chemically synthesized
tttttgactgagttgtacca

SEQ ID NO: 371517 - DNA, 20 bp, Artificial Sequence
  chemically synthesized
ttttgactgagttgtaccat

SEQ ID NO: 371518 - DNA, 20 bp, Artificial Sequence
  chemically synthesized
gcacagattagtgtcaccta

SEQ ID NO: 371519 - DNA, 20 bp, Artificial Sequence
  chemically synthesized
gtgccccatttggcacagat

SEQ ID NO: 371520 - DNA, 20 bp, Artificial Sequence
  chemically synthesized
tgacactaatctgtgccaaa

SEQ ID NO: 371521 - DNA, 20 bp, Artificial Sequence
  chemically synthesized
taaatgtgccccatttggca

SEQ ID NO: 371522 - DNA, 20 bp, Artificial Sequence
  chemically synthesized
gacactaatctgtgccaaat

SEQ ID NO: 371523 - DNA, 20 bp, Artificial Sequence
  chemically synthesized
acactaatctgtgccaaatg

SEQ ID NO: 371524 - DNA, 20 bp, Artificial Sequence
  chemically synthesized
tagtttaaatgtgccccatt

SEQ ID NO: 371525 - DNA, 20 bp, Artificial Sequence
  chemically synthesized
cattaaagtaatagtgtaag

SEQ ID NO: 371526 - DNA, 20 bp, Artificial Sequence
  chemically synthesized
aaacattaaagtaatagtgt

SEQ ID NO: 371527 - DNA, 20 bp, Artificial Sequence
  chemically synthesized
caatgaaaacattaaagtaa

SEQ ID NO: 371528 - DNA, 20 bp, Artificial Sequence
  chemically synthesized
tgcgttcaatgaaaacatta

SEQ ID NO: 371529 - DNA, 20 bp, Artificial Sequence
  chemically synthesized
tttaatgttttcattgaacg

SEQ ID NO: 371530 - DNA, 20 bp, Artificial Sequence
  chemically synthesized
ttaatgttttcattgaacgc

SEQ ID NO: 371531 - DNA, 20 bp, Artificial Sequence
  chemically synthesized
attgaacgcaggaatctttg

SEQ ID NO: 371532 - DNA, 20 bp, Artificial Sequence
  chemically synthesized
aaatgtacctagaggctaca

SEQ ID NO: 371533 - DNA, 20 bp, Artificial Sequence
  chemically synthesized
gcaggaatctttgtagcctc

SEQ ID NO: 371534 - DNA, 20 bp, Artificial Sequence
  chemically synthesized
caggaatctttgtagcctct

SEQ ID NO: 371535 - DNA, 20 bp, Artificial Sequence
  chemically synthesized
taaagtttaaatgtacctag

SEQ ID NO: 371536 - DNA, 20 bp, Artificial Sequence
  chemically synthesized
ttaaagtttaaatgtaccta

SEQ ID NO: 371537 - DNA, 20 bp, Artificial Sequence
  chemically synthesized
tcttaaagtttaaatgtacc

SEQ ID NO: 371538 - DNA, 20 bp, Artificial Sequence
  chemically synthesized
tctaggtacatttaaacttt

SEQ ID NO: 371539 - DNA, 20 bp, Artificial Sequence
  chemically synthesized
agaatataatttttatctta

SEQ ID NO: 371540 - DNA, 20 bp, Artificial Sequence
  chemically synthesized
attgattataaatcatttga

SEQ ID NO: 371541 - DNA, 20 bp, Artificial Sequence
  chemically synthesized
tatttgattttaattggcaa

SEQ ID NO: 371542 - DNA, 20 bp, Artificial Sequence
  chemically synthesized
gtctattatttgattttaat

SEQ ID NO: 371543 - DNA, 20 bp, Artificial Sequence
  chemically synthesized
tgccaattaaaatcaaataa

SEQ ID NO: 371544 - DNA, 20 bp, Artificial Sequence
  chemically synthesized
ttaaaatcaaataatagaca

SEQ ID NO: 371545 - DNA, 20 bp, Artificial Sequence
  chemically synthesized
aaatcaaataatagacacag

SEQ ID NO: 371546 - DNA, 20 bp, Artificial Sequence
  chemically synthesized
atagacacagaagtgcctca

SEQ ID NO: 371547 - DNA, 20 bp, Artificial Sequence
  chemically synthesized
ctatcttagttgaagctttg

SEQ ID NO: 371548 - DNA, 20 bp, Artificial Sequence
  chemically synthesized
tctatcttagttgaagcttt

SEQ ID NO: 371549 - DNA, 20 bp, Artificial Sequence
  chemically synthesized
agtgcctcaaagcttcaact

SEQ ID NO: 371550 - DNA, 20 bp, Artificial Sequence
  chemically synthesized
ctttgtgtctatcttagttg

SEQ ID NO: 371551 - DNA, 20 bp, Artificial Sequence
  chemically synthesized
cctcaaagcttcaactaaga

SEQ ID NO: 371552 - DNA, 20 bp, Artificial Sequence
  chemically synthesized
gcacccctttgtgtctatct

SEQ ID NO: 371553 - DNA, 20 bp, Artificial Sequence
  chemically synthesized
cttcaactaagatagacaca

SEQ ID NO: 371554 - DNA, 20 bp, Artificial Sequence
  chemically synthesized
ttcaactaagatagacacaa

SEQ ID NO: 371555 - DNA, 20 bp, Artificial Sequence
  chemically synthesized
tcaactaagatagacacaaa

SEQ ID NO: 371556 - DNA, 20 bp, Artificial Sequence
  chemically synthesized
caactaagatagacacaaag

SEQ ID NO: 371557 - DNA, 20 bp, Artificial Sequence
  chemically synthesized
agatagacacaaaggggtgc

SEQ ID NO: 371558 - DNA, 20 bp, Artificial Sequence
  chemically synthesized
tagacacaaaggggtgccag

SEQ ID NO: 371559 - DNA, 20 bp, Artificial Sequence
  chemically synthesized
gaaataacactgttatccac

SEQ ID NO: 371560 - DNA, 20 bp, Artificial Sequence
  chemically synthesized
aaaggggtgccagtggataa

SEQ ID NO: 371561 - DNA, 20 bp, Artificial Sequence
  chemically synthesized
acagtgttatttcataatca

SEQ ID NO: 371562 - DNA, 20 bp, Artificial Sequence
  chemically synthesized
aattgctagagggaaaaggg

SEQ ID NO: 371563 - DNA, 20 bp, Artificial Sequence
  chemically synthesized
aataattgctagagggaaaa

SEQ ID NO: 371564 - DNA, 20 bp, Artificial Sequence
  chemically synthesized
gaataattgctagagggaaa

SEQ ID NO: 371565 - DNA, 20 bp, Artificial Sequence
  chemically synthesized
cacagcttcccttttccctc

SEQ ID NO: 371566 - DNA, 20 bp, Artificial Sequence
  chemically synthesized
agaataattgctagagggaa

SEQ ID NO: 371567 - DNA, 20 bp, Artificial Sequence
  chemically synthesized
gcatcagaataattgctaga

SEQ ID NO: 371568 - DNA, 20 bp, Artificial Sequence
  chemically synthesized
tgcatcagaataattgctag

SEQ ID NO: 371569 - DNA, 20 bp, Artificial Sequence
  chemically synthesized
ctgcatcagaataattgcta

SEQ ID NO: 371570 - DNA, 20 bp, Artificial Sequence
  chemically synthesized
ttctgcatcagaataattgc

SEQ ID NO: 371571 - DNA, 20 bp, Artificial Sequence
  chemically synthesized
ctctagcaattattctgatg

SEQ ID NO: 371572 - DNA, 20 bp, Artificial Sequence
  chemically synthesized
tcttaagactgattctgcat

SEQ ID NO: 371573 - DNA, 20 bp, Artificial Sequence
  chemically synthesized
caattattctgatgcagaat

SEQ ID NO: 371574 - DNA, 20 bp, Artificial Sequence
  chemically synthesized
tctgatgcagaatcagtctt

SEQ ID NO: 371575 - DNA, 20 bp, Artificial Sequence
  chemically synthesized
tgatgcagaatcagtcttaa

SEQ ID NO: 371576 - DNA, 20 bp, Artificial Sequence
  chemically synthesized
gatgcagaatcagtcttaag

SEQ ID NO: 371577 - DNA, 20 bp, Artificial Sequence
  chemically synthesized
tctagctgcagaaacctctt

SEQ ID NO: 371578 - DNA, 20 bp, Artificial Sequence
  chemically synthesized
tcagtcttaagaggtttctg

SEQ ID NO: 371579 - DNA, 20 bp, Artificial Sequence
  chemically synthesized
tcttaagaggtttctgcagc

SEQ ID NO: 371580 - DNA, 20 bp, Artificial Sequence
  chemically synthesized
tctttgtttacatctagctg

SEQ ID NO: 371581 - DNA, 20 bp, Artificial Sequence
  chemically synthesized
gatacttctttgtttacatc

SEQ ID NO: 371582 - DNA, 20 bp, Artificial Sequence
  chemically synthesized
tctgcagctagatgtaaaca

SEQ ID NO: 371583 - DNA, 20 bp, Artificial Sequence
  chemically synthesized
gcagctagatgtaaacaaag

SEQ ID NO: 371584 - DNA, 20 bp, Artificial Sequence
  chemically synthesized
tgtcagaagtgtagtcaagt

SEQ ID NO: 371585 - DNA, 20 bp, Artificial Sequence
  chemically synthesized
agggtgtcagaagtgtagtc

SEQ ID NO: 371586 - DNA, 20 bp, Artificial Sequence
  chemically synthesized
caaccagggtgtcagaagtg

SEQ ID NO: 371587 - DNA, 20 bp, Artificial Sequence
  chemically synthesized
ttccccaaccagggtgtcag

SEQ ID NO: 371588 - DNA, 20 bp, Artificial Sequence
  chemically synthesized
tgactacacttctgacaccc

SEQ ID NO: 371589 - DNA, 20 bp, Artificial Sequence
  chemically synthesized
catttccccaaccagggtgt

SEQ ID NO: 371590 - DNA, 20 bp, Artificial Sequence
  chemically synthesized
tacacttctgacaccctggt

SEQ ID NO: 371591 - DNA, 20 bp, Artificial Sequence
  chemically synthesized
acacttctgacaccctggtt

SEQ ID NO: 371592 - DNA, 20 bp, Artificial Sequence
  chemically synthesized
cacttctgacaccctggttg

SEQ ID NO: 371593 - DNA, 20 bp, Artificial Sequence
  chemically synthesized
catatacatttccccaacca

SEQ ID NO: 371594 - DNA, 20 bp, Artificial Sequence
  chemically synthesized
ccatatacatttccccaacc

SEQ ID NO: 371595 - DNA, 20 bp, Artificial Sequence
  chemically synthesized
tccatatacatttccccaac

SEQ ID NO: 371596 - DNA, 20 bp, Artificial Sequence
  chemically synthesized
cctggttggggaaatgtata

SEQ ID NO: 371597 - DNA, 20 bp, Artificial Sequence
  chemically synthesized
gattgatatgtctgactgac

SEQ ID NO: 371598 - DNA, 20 bp, Artificial Sequence
  chemically synthesized
aattttgagttcttgtcagt

SEQ ID NO: 371599 - DNA, 20 bp, Artificial Sequence
  chemically synthesized
tttaaattttgagttcttgt

SEQ ID NO: 371600 - DNA, 20 bp, Artificial Sequence
  chemically synthesized
caagggatcatttaaatttt

SEQ ID NO: 371601 - DNA, 20 bp, Artificial Sequence
  chemically synthesized
atttaaatgatcccttgtcc

SEQ ID NO: 371602 - DNA, 20 bp, Artificial Sequence
  chemically synthesized
accacagggctcttggacaa

SEQ ID NO: 371603 - DNA, 20 bp, Artificial Sequence
  chemically synthesized
ttaaatgatcccttgtccaa

SEQ ID NO: 371604 - DNA, 20 bp, Artificial Sequence
  chemically synthesized
aaccacagggctcttggaca

SEQ ID NO: 371605 - DNA, 20 bp, Artificial Sequence
  chemically synthesized
taaccacagggctcttggac

SEQ ID NO: 371606 - DNA, 20 bp, Artificial Sequence
  chemically synthesized
aatgataaccacagggctct

SEQ ID NO: 371607 - DNA, 20 bp, Artificial Sequence
  chemically synthesized
tcccttgtccaagagccctg

SEQ ID NO: 371608 - DNA, 20 bp, Artificial Sequence
  chemically synthesized
aattctaaatgataaccaca

SEQ ID NO: 371609 - DNA, 20 bp, Artificial Sequence
  chemically synthesized
gaattctaaatgataaccac

SEQ ID NO: 371610 - DNA, 20 bp, Artificial Sequence
  chemically synthesized
tgaattctaaatgataacca

SEQ ID NO: 371611 - DNA, 20 bp, Artificial Sequence
  chemically synthesized
agagccctgtggttatcatt

SEQ ID NO: 371612 - DNA, 20 bp, Artificial Sequence
  chemically synthesized
catttagaattcatctgcac

SEQ ID NO: 371613 - DNA, 20 bp, Artificial Sequence
  chemically synthesized
agtatacttaatgacttgtg

SEQ ID NO: 371614 - DNA, 20 bp, Artificial Sequence
  chemically synthesized
attcatctgcacaagtcatt

SEQ ID NO: 371615 - DNA, 20 bp, Artificial Sequence
  chemically synthesized
aagtcattaagtatactctt

SEQ ID NO: 371616 - DNA, 20 bp, Artificial Sequence
  chemically synthesized
gaacaaaatagttttccaaa

SEQ ID NO: 371617 - DNA, 20 bp, Artificial Sequence
  chemically synthesized
cggaacaaaatagttttcca

SEQ ID NO: 371618 - DNA, 20 bp, Artificial Sequence
  chemically synthesized
tacatttttccggaacaaaa

SEQ ID NO: 371619 - DNA, 20 bp, Artificial Sequence
  chemically synthesized
tttggaaaactattttgttc

SEQ ID NO: 371620 - DNA, 20 bp, Artificial Sequence
  chemically synthesized
ttcttgactttacatttttc

SEQ ID NO: 371621 - DNA, 20 bp, Artificial Sequence
  chemically synthesized
ttttgttccggaaaaatgta

SEQ ID NO: 371622 - DNA, 20 bp, Artificial Sequence
  chemically synthesized
ttccggaaaaatgtaaagtc

SEQ ID NO: 371623 - DNA, 20 bp, Artificial Sequence
  chemically synthesized
cggaaaaatgtaaagtcaag

SEQ ID NO: 371624 - DNA, 20 bp, Artificial Sequence
  chemically synthesized
aaaaatgtaaagtcaagaag

SEQ ID NO: 371625 - DNA, 20 bp, Artificial Sequence
  chemically synthesized
aaaatgtaaagtcaagaagc

SEQ ID NO: 371626 - DNA, 20 bp, Artificial Sequence
  chemically synthesized
aagaagcttttttcaaatgt

SEQ ID NO: 371627 - DNA, 20 bp, Artificial Sequence
  chemically synthesized
ggaatgctaacatttgaaaa

SEQ ID NO: 371628 - DNA, 20 bp, Artificial Sequence
  chemically synthesized
gaattatagcattattaaag

SEQ ID NO: 371629 - DNA, 20 bp, Artificial Sequence
  chemically synthesized
tcagaattatagcattatta

SEQ ID NO: 371630 - DNA, 20 bp, Artificial Sequence
  chemically synthesized
aaacaaaaagttcagaatta

SEQ ID NO: 371631 - DNA, 20 bp, Artificial Sequence
  chemically synthesized
tctaatataaacaaaaagtt

SEQ ID NO: 371632 - DNA, 20 bp, Artificial Sequence
  chemically synthesized
tattttctaatataaacaaa

SEQ ID NO: 371633 - DNA, 20 bp, Artificial Sequence
  chemically synthesized
tctgaactttttgtttatat

SEQ ID NO: 371634 - DNA, 20 bp, Artificial Sequence
  chemically synthesized
aatattttttcttttaactc

SEQ ID NO: 371635 - DNA, 20 bp, Artificial Sequence
  chemically synthesized
tgtactatagctagagttaa

SEQ ID NO: 371636 - DNA, 20 bp, Artificial Sequence
  chemically synthesized
ttttcttttaactctagcta

SEQ ID NO: 371637 - DNA, 20 bp, Artificial Sequence
  chemically synthesized
ctctaattgtactatagcta

SEQ ID NO: 371638 - DNA, 20 bp, Artificial Sequence
  chemically synthesized
atctctaattgtactatagc

SEQ ID NO: 371639 - DNA, 20 bp, Artificial Sequence
  chemically synthesized
aaacatctctaattgtacta

SEQ ID NO: 371640 - DNA, 20 bp, Artificial Sequence
  chemically synthesized
aactctagctatagtacaat

SEQ ID NO: 371641 - DNA, 20 bp, Artificial Sequence
  chemically synthesized
ctctagctatagtacaatta

SEQ ID NO: 371642 - DNA, 20 bp, Artificial Sequence
  chemically synthesized
agagatgtttcaaaattatt

SEQ ID NO: 371643 - DNA, 20 bp, Artificial Sequence
  chemically synthesized
gagatgtttcaaaattattc

SEQ ID NO: 371644 - DNA, 20 bp, Artificial Sequence
  chemically synthesized
tgtttcaaaattattcaggt

SEQ ID NO: 371645 - DNA, 20 bp, Artificial Sequence
  chemically synthesized
tattcaggtaagtgcttaat

SEQ ID NO: 371646 - DNA, 20 bp, Artificial Sequence
  chemically synthesized
attcaggtaagtgcttaatt

SEQ ID NO: 371647 - DNA, 20 bp, Artificial Sequence
  chemically synthesized
aagattacgtggacccaatt

SEQ ID NO: 371648 - DNA, 20 bp, Artificial Sequence
  chemically synthesized
ctaactttcagaagattacg

SEQ ID NO: 371649 - DNA, 20 bp, Artificial Sequence
  chemically synthesized
gggtccacgtaatcttctga

SEQ ID NO: 371650 - DNA, 20 bp, Artificial Sequence
  chemically synthesized
tctaaagggctaactttcag

SEQ ID NO: 371651 - DNA, 20 bp, Artificial Sequence
  chemically synthesized
ccacgtaatcttctgaaagt

SEQ ID NO: 371652 - DNA, 20 bp, Artificial Sequence
  chemically synthesized
acctctaaagggctaacttt

SEQ ID NO: 371653 - DNA, 20 bp, Artificial Sequence
  chemically synthesized
tcttctgaaagttagccctt

SEQ ID NO: 371654 - DNA, 20 bp, Artificial Sequence
  chemically synthesized
ttctgaaagttagcccttta

SEQ ID NO: 371655 - DNA, 20 bp, Artificial Sequence
  chemically synthesized
tctgaaagttagccctttag

SEQ ID NO: 371656 - DNA, 20 bp, Artificial Sequence
  chemically synthesized
ttttggctataacctctaaa

SEQ ID NO: 371657 - DNA, 20 bp, Artificial Sequence
  chemically synthesized
tttttggctataacctctaa

SEQ ID NO: 371658 - DNA, 20 bp, Artificial Sequence
  chemically synthesized
ttttttggctataacctcta

SEQ ID NO: 371659 - DNA, 20 bp, Artificial Sequence
  chemically synthesized
agttagccctttagaggtta

SEQ ID NO: 371660 - DNA, 20 bp, Artificial Sequence
  chemically synthesized
ctggataaaacacgattttt

SEQ ID NO: 371661 - DNA, 20 bp, Artificial Sequence
  chemically synthesized
ccaaaaaatcgtgttttatc

SEQ ID NO: 371662 - DNA, 20 bp, Artificial Sequence
  chemically synthesized
taatggaatcttagtggatc

SEQ ID NO: 371663 - DNA, 20 bp, Artificial Sequence
  chemically synthesized
gtgttttatccagatccact

SEQ ID NO: 371664 - DNA, 20 bp, Artificial Sequence
  chemically synthesized
aagtgttaatggaatcttag

SEQ ID NO: 371665 - DNA, 20 bp, Artificial Sequence
  chemically synthesized
cagaagtgttaatggaatct

SEQ ID NO: 371666 - DNA, 20 bp, Artificial Sequence
  chemically synthesized
tgggcacgcagaagtgttaa

SEQ ID NO: 371667 - DNA, 20 bp, Artificial Sequence
  chemically synthesized
ccaaggaggtgggcacgcag

SEQ ID NO: 371668 - DNA, 20 bp, Artificial Sequence
  chemically synthesized
aagccaaggaggtgggcacg

SEQ ID NO: 371669 - DNA, 20 bp, Artificial Sequence
  chemically synthesized
cttctgcgtgcccacctcct

SEQ ID NO: 371670 - DNA, 20 bp, Artificial Sequence
  chemically synthesized
accacaaaagccaaggaggt

SEQ ID NO: 371671 - DNA, 20 bp, Artificial Sequence
  chemically synthesized
gaccacaaaagccaaggagg

SEQ ID NO: 371672 - DNA, 20 bp, Artificial Sequence
  chemically synthesized
aaagaccacaaaagccaagg

SEQ ID NO: 371673 - DNA, 20 bp, Artificial Sequence
  chemically synthesized
caaagaccacaaaagccaag

SEQ ID NO: 371674 - DNA, 20 bp, Artificial Sequence
  chemically synthesized
agcaaagaccacaaaagcca

SEQ ID NO: 371675 - DNA, 20 bp, Artificial Sequence
  chemically synthesized
aagcaaagaccacaaaagcc

SEQ ID NO: 371676 - DNA, 20 bp, Artificial Sequence
  chemically synthesized
gcccacctccttggcttttg

SEQ ID NO: 371677 - DNA, 20 bp, Artificial Sequence
  chemically synthesized
ttgagaagcaaagaccacaa

SEQ ID NO: 371678 - DNA, 20 bp, Artificial Sequence
  chemically synthesized
tacagaagttttgagaagca

SEQ ID NO: 371679 - DNA, 20 bp, Artificial Sequence
  chemically synthesized
gtagatacagaagttttgag

SEQ ID NO: 371680 - DNA, 20 bp, Artificial Sequence
  chemically synthesized
gatgtagatacagaagtttt

SEQ ID NO: 371681 - DNA, 20 bp, Artificial Sequence
  chemically synthesized
ctaaagagatgtagatacag

SEQ ID NO: 371682 - DNA, 20 bp, Artificial Sequence
  chemically synthesized
catctaaagagatgtagata

SEQ ID NO: 371683 - DNA, 20 bp, Artificial Sequence
  chemically synthesized
gacagtcatctaaagagatg

SEQ ID NO: 371684 - DNA, 20 bp, Artificial Sequence
  chemically synthesized
cttctgtatctacatctctt

SEQ ID NO: 371685 - DNA, 20 bp, Artificial Sequence
  chemically synthesized
cctgaagacagtcatctaaa

SEQ ID NO: 371686 - DNA, 20 bp, Artificial Sequence
  chemically synthesized
agcctgaagacagtcatcta

SEQ ID NO: 371687 - DNA, 20 bp, Artificial Sequence
  chemically synthesized
tctctttagatgactgtctt

SEQ ID NO: 371688 - DNA, 20 bp, Artificial Sequence
  chemically synthesized
ctctttagatgactgtcttc

SEQ ID NO: 371689 - DNA, 20 bp, Artificial Sequence
  chemically synthesized
cagctttactagcctgaaga

SEQ ID NO: 371690 - DNA, 20 bp, Artificial Sequence
  chemically synthesized
ttagatgactgtcttcaggc

SEQ ID NO: 371691 - DNA, 20 bp, Artificial Sequence
  chemically synthesized
aaagcagctttactagcctg

SEQ ID NO: 371692 - DNA, 20 bp, Artificial Sequence
  chemically synthesized
tgactgtcttcaggctagta

SEQ ID NO: 371693 - DNA, 20 bp, Artificial Sequence
  chemically synthesized
tgttggcaaagcagctttac

SEQ ID NO: 371694 - DNA, 20 bp, Artificial Sequence
  chemically synthesized
ctctgtttttgttggcaaag

SEQ ID NO: 371695 - DNA, 20 bp, Artificial Sequence
  chemically synthesized
gatctctgtttttgttggca

SEQ ID NO: 371696 - DNA, 20 bp, Artificial Sequence
  chemically synthesized
agctgctttgccaacaaaaa

SEQ ID NO: 371697 - DNA, 20 bp, Artificial Sequence
  chemically synthesized
ttccggatctctgtttttgt

SEQ ID NO: 371698 - DNA, 20 bp, Artificial Sequence
  chemically synthesized
ctgctttgccaacaaaaaca

SEQ ID NO: 371699 - DNA, 20 bp, Artificial Sequence
  chemically synthesized
tgccaacaaaaacagagatc

SEQ ID NO: 371700 - DNA, 20 bp, Artificial Sequence
  chemically synthesized
caacaaaaacagagatccgg

SEQ ID NO: 371701 - DNA, 20 bp, Artificial Sequence
  chemically synthesized
cataaacaccaaggcacttc

SEQ ID NO: 371702 - DNA, 20 bp, Artificial Sequence
  chemically synthesized
acagagatccggaagtgcct

SEQ ID NO: 371703 - DNA, 20 bp, Artificial Sequence
  chemically synthesized
ctaaggtgacataaacacca

SEQ ID NO: 371704 - DNA, 20 bp, Artificial Sequence
  chemically synthesized
cctaaggtgacataaacacc

SEQ ID NO: 371705 - DNA, 20 bp, Artificial Sequence
  chemically synthesized
ccttggtgtttatgtcacct

SEQ ID NO: 371706 - DNA, 20 bp, Artificial Sequence
  chemically synthesized
cttggtgtttatgtcacctt

SEQ ID NO: 371707 - DNA, 20 bp, Artificial Sequence
  chemically synthesized
ttggtgtttatgtcacctta

SEQ ID NO: 371708 - DNA, 20 bp, Artificial Sequence
  chemically synthesized
gtgtttatgtcaccttaggg

SEQ ID NO: 371709 - DNA, 20 bp, Artificial Sequence
  chemically synthesized
attgccttaagactacccta

SEQ ID NO: 371710 - DNA, 20 bp, Artificial Sequence
  chemically synthesized
cattgccttaagactaccct

SEQ ID NO: 371711 - DNA, 20 bp, Artificial Sequence
  chemically synthesized
tgtcaccttagggtagtctt

SEQ ID NO: 371712 - DNA, 20 bp, Artificial Sequence
  chemically synthesized
gtcaccttagggtagtctta

SEQ ID NO: 371713 - DNA, 20 bp, Artificial Sequence
  chemically synthesized
tagtcaccagtcattgcctt

SEQ ID NO: 371714 - DNA, 20 bp, Artificial Sequence
  chemically synthesized
ggtagtcttaaggcaatgac

SEQ ID NO: 371715 - DNA, 20 bp, Artificial Sequence
  chemically synthesized
ttttgtattccagtagtcac

SEQ ID NO: 371716 - DNA, 20 bp, Artificial Sequence
  chemically synthesized
aggcaatgactggtgactac

SEQ ID NO: 371717 - DNA, 20 bp, Artificial Sequence
  chemically synthesized
gctgggcttttgtattccag

SEQ ID NO: 371718 - DNA, 20 bp, Artificial Sequence
  chemically synthesized
ggagctgggcttttgtattc

SEQ ID NO: 371719 - DNA, 20 bp, Artificial Sequence
  chemically synthesized
tggtgactactggaatacaa

SEQ ID NO: 371720 - DNA, 20 bp, Artificial Sequence
  chemically synthesized
actactggaatacaaaagcc

SEQ ID NO: 371721 - DNA, 20 bp, Artificial Sequence
  chemically synthesized
aacttgatacagaaggagct

SEQ ID NO: 371722 - DNA, 20 bp, Artificial Sequence
  chemically synthesized
caacttgatacagaaggagc

SEQ ID NO: 371723 - DNA, 20 bp, Artificial Sequence
  chemically synthesized
gttgcaacttgatacagaag

SEQ ID NO: 371724 - DNA, 20 bp, Artificial Sequence
  chemically synthesized
ttgttgcaacttgatacaga

SEQ ID NO: 371725 - DNA, 20 bp, Artificial Sequence
  chemically synthesized
agcccagctccttctgtatc

SEQ ID NO: 371726 - DNA, 20 bp, Artificial Sequence
  chemically synthesized
cttgttgcaacttgatacag

SEQ ID NO: 371727 - DNA, 20 bp, Artificial Sequence
  chemically synthesized
cagcttgttgcaacttgata

SEQ ID NO: 371728 - DNA, 20 bp, Artificial Sequence
  chemically synthesized
cttctgtatcaagttgcaac

SEQ ID NO: 371729 - DNA, 20 bp, Artificial Sequence
  chemically synthesized
tatcaagttgcaacaagctg

SEQ ID NO: 371730 - DNA, 20 bp, Artificial Sequence
  chemically synthesized
agttgcaacaagctgaagca

SEQ ID NO: 371731 - DNA, 20 bp, Artificial Sequence
  chemically synthesized
cctgggcctaaactatgctt

SEQ ID NO: 371732 - DNA, 20 bp, Artificial Sequence
  chemically synthesized
caacaagctgaagcatagtt

SEQ ID NO: 371733 - DNA, 20 bp, Artificial Sequence
  chemically synthesized
aacaagctgaagcatagttt

SEQ ID NO: 371734 - DNA, 20 bp, Artificial Sequence
  chemically synthesized
gctgaagcatagtttaggcc

SEQ ID NO: 371735 - DNA, 20 bp, Artificial Sequence
  chemically synthesized
ctgaagcatagtttaggccc

SEQ ID NO: 371736 - DNA, 20 bp, Artificial Sequence
  chemically synthesized
ctggttctgcaggaaaacct

SEQ ID NO: 371737 - DNA, 20 bp, Artificial Sequence
  chemically synthesized
tctggttctgcaggaaaacc

SEQ ID NO: 371738 - DNA, 20 bp, Artificial Sequence
  chemically synthesized
tttaggcccaggttttcctg

SEQ ID NO: 371739 - DNA, 20 bp, Artificial Sequence
  chemically synthesized
cccaggttttcctgcagaac

SEQ ID NO: 371740 - DNA, 20 bp, Artificial Sequence
  chemically synthesized
cagcctcagtctggttctgc

SEQ ID NO: 371741 - DNA, 20 bp, Artificial Sequence
  chemically synthesized
ccagcctcagtctggttctg

SEQ ID NO: 371742 - DNA, 20 bp, Artificial Sequence
  chemically synthesized
ttttcctgcagaaccagact

SEQ ID NO: 371743 - DNA, 20 bp, Artificial Sequence
  chemically synthesized
tttcctgcagaaccagactg

SEQ ID NO: 371744 - DNA, 20 bp, Artificial Sequence
  chemically synthesized
gcaaagtgccagcctcagtc

SEQ ID NO: 371745 - DNA, 20 bp, Artificial Sequence
  chemically synthesized
ctgcagaaccagactgaggc

SEQ ID NO: 371746 - DNA, 20 bp, Artificial Sequence
  chemically synthesized
cgcaggcaaagtgccagcct

SEQ ID NO: 371747 - DNA, 20 bp, Artificial Sequence
  chemically synthesized
agcaatcgcaggcaaagtgc

SEQ ID NO: 371748 - DNA, 20 bp, Artificial Sequence
  chemically synthesized
gcaaggagcaatcgcaggca

SEQ ID NO: 371749 - DNA, 20 bp, Artificial Sequence
  chemically synthesized
atcatgcaaggagcaatcgc

SEQ ID NO: 371750 - DNA, 20 bp, Artificial Sequence
  chemically synthesized
aatcatgcaaggagcaatcg

SEQ ID NO: 371751 - DNA, 20 bp, Artificial Sequence
  chemically synthesized
tggggaagaaatcatgcaag

SEQ ID NO: 371752 - DNA, 20 bp, Artificial Sequence
  chemically synthesized
aatggggaagaaatcatgca

SEQ ID NO: 371753 - DNA, 20 bp, Artificial Sequence
  chemically synthesized
gaatggggaagaaatcatgc

SEQ ID NO: 371754 - DNA, 20 bp, Artificial Sequence
  chemically synthesized
gaagtagaataggaatgggg

SEQ ID NO: 371755 - DNA, 20 bp, Artificial Sequence
  chemically synthesized
agagaagtagaataggaatg

SEQ ID NO: 371756 - DNA, 20 bp, Artificial Sequence
  chemically synthesized
aagagaagtagaataggaat

SEQ ID NO: 371757 - DNA, 20 bp, Artificial Sequence
  chemically synthesized
caagagaagtagaataggaa

SEQ ID NO: 371758 - DNA, 20 bp, Artificial Sequence
  chemically synthesized
gtgagcaagagaagtagaat

SEQ ID NO: 371759 - DNA, 20 bp, Artificial Sequence
  chemically synthesized
ggtgagcaagagaagtagaa

SEQ ID NO: 371760 - DNA, 20 bp, Artificial Sequence
  chemically synthesized
aagtaggtgagcaagagaag

SEQ ID NO: 371761 - DNA, 20 bp, Artificial Sequence
  chemically synthesized
ggcaagtaggtgagcaagag

SEQ ID NO: 371762 - DNA, 20 bp, Artificial Sequence
  chemically synthesized
gatggcaagtaggtgagcaa

SEQ ID NO: 371763 - DNA, 20 bp, Artificial Sequence
  chemically synthesized
gggatggcaagtaggtgagc

SEQ ID NO: 371764 - DNA, 20 bp, Artificial Sequence
  chemically synthesized
ctcagggatggcaagtaggt

SEQ ID NO: 371765 - DNA, 20 bp, Artificial Sequence
  chemically synthesized
tgttctcagggatggcaagt

SEQ ID NO: 371766 - DNA, 20 bp, Artificial Sequence
  chemically synthesized
atgttctcagggatggcaag

SEQ ID NO: 371767 - DNA, 20 bp, Artificial Sequence
  chemically synthesized
gaaatgttctcagggatggc

SEQ ID NO: 371768 - DNA, 20 bp, Artificial Sequence
  chemically synthesized
ctcacctacttgccatccct

SEQ ID NO: 371769 - DNA, 20 bp, Artificial Sequence
  chemically synthesized
taaggaaatgttctcaggga

SEQ ID NO: 371770 - DNA, 20 bp, Artificial Sequence
  chemically synthesized
taattaaggaaatgttctca

SEQ ID NO: 371771 - DNA, 20 bp, Artificial Sequence
  chemically synthesized
ttaattaaggaaatgttctc

SEQ ID NO: 371772 - DNA, 20 bp, Artificial Sequence
  chemically synthesized
tttaattaaggaaatgttct

SEQ ID NO: 371773 - DNA, 20 bp, Artificial Sequence
  chemically synthesized
gcatgaaagtagtttaatta

SEQ ID NO: 371774 - DNA, 20 bp, Artificial Sequence
  chemically synthesized
tgcatgaaagtagtttaatt

SEQ ID NO: 371775 - DNA, 20 bp, Artificial Sequence
  chemically synthesized
gaggagaatttgcatgaaag

SEQ ID NO: 371776 - DNA, 20 bp, Artificial Sequence
  chemically synthesized
ggagaggagaatttgcatga

SEQ ID NO: 371777 - DNA, 20 bp, Artificial Sequence
  chemically synthesized
ggtaaagcccatgtggagag

SEQ ID NO: 371778 - DNA, 20 bp, Artificial Sequence
  chemically synthesized
tgcaaattctcctctccaca

SEQ ID NO: 371779 - DNA, 20 bp, Artificial Sequence
  chemically synthesized
ttggtaaagcccatgtggag

SEQ ID NO: 371780 - DNA, 20 bp, Artificial Sequence
  chemically synthesized
gcaaattctcctctccacat

SEQ ID NO: 371781 - DNA, 20 bp, Artificial Sequence
  chemically synthesized
tttggtaaagcccatgtgga

SEQ ID NO: 371782 - DNA, 20 bp, Artificial Sequence
  chemically synthesized
gttttggtaaagcccatgtg

SEQ ID NO: 371783 - DNA, 20 bp, Artificial Sequence
  chemically synthesized
gggttttggtaaagcccatg

SEQ ID NO: 371784 - DNA, 20 bp, Artificial Sequence
  chemically synthesized
tttcaggttgggttttggta

SEQ ID NO: 371785 - DNA, 20 bp, Artificial Sequence
  chemically synthesized
ttatgtttcaggttgggttt

SEQ ID NO: 371786 - DNA, 20 bp, Artificial Sequence
  chemically synthesized
gaatgcttatgtttcaggtt

SEQ ID NO: 371787 - DNA, 20 bp, Artificial Sequence
  chemically synthesized
ggaatgcttatgtttcaggt

SEQ ID NO: 371788 - DNA, 20 bp, Artificial Sequence
  chemically synthesized
caaaacccaacctgaaacat

SEQ ID NO: 371789 - DNA, 20 bp, Artificial Sequence
  chemically synthesized
tagaggaatgcttatgtttc

SEQ ID NO: 371790 - DNA, 20 bp, Artificial Sequence
  chemically synthesized
ttagaggaatgcttatgttt

SEQ ID NO: 371791 - DNA, 20 bp, Artificial Sequence
  chemically synthesized
cataagcattcctctaatta

SEQ ID NO: 371792 - DNA, 20 bp, Artificial Sequence
  chemically synthesized
gcctttattactgtaattag

SEQ ID NO: 371793 - DNA, 20 bp, Artificial Sequence
  chemically synthesized
tgcctttattactgtaatta

SEQ ID NO: 371794 - DNA, 20 bp, Artificial Sequence
  chemically synthesized
gatgcctttattactgtaat

SEQ ID NO: 371795 - DNA, 20 bp, Artificial Sequence
  chemically synthesized
ttcctctaattacagtaata

SEQ ID NO: 371796 - DNA, 20 bp, Artificial Sequence
  chemically synthesized
tcctctaattacagtaataa

SEQ ID NO: 371797 - DNA, 20 bp, Artificial Sequence
  chemically synthesized
aattacagtaataaaggcat

SEQ ID NO: 371798 - DNA, 20 bp, Artificial Sequence
  chemically synthesized
ccattcctagtattttcaaa

SEQ ID NO: 371799 - DNA, 20 bp, Artificial Sequence
  chemically synthesized
agatttctatttgaaaatac

SEQ ID NO: 371800 - DNA, 20 bp, Artificial Sequence
  chemically synthesized
gatttctatttgaaaatact

SEQ ID NO: 371801 - DNA, 20 bp, Artificial Sequence
  chemically synthesized
ctatttgaaaatactaggaa

SEQ ID NO: 371802 - DNA, 20 bp, Artificial Sequence
  chemically synthesized
tatttgaaaatactaggaat

SEQ ID NO: 371803 - DNA, 20 bp, Artificial Sequence
  chemically synthesized
caccgcgcccggcccattcc

SEQ ID NO: 371804 - DNA, 20 bp, Artificial Sequence
  chemically synthesized
tgaaaatactaggaatgggc

SEQ ID NO: 371805 - DNA, 20 bp, Artificial Sequence
  chemically synthesized
gaaaatactaggaatgggcc

SEQ ID NO: 371806 - DNA, 20 bp, Artificial Sequence
  chemically synthesized
tactaggaatgggccgggcg

SEQ ID NO: 371807 - DNA, 20 bp, Artificial Sequence
  chemically synthesized
taggaatgggccgggcgcgg

SEQ ID NO: 371808 - DNA, 20 bp, Artificial Sequence
  chemically synthesized
caggcgtgagccaccgcgcc

SEQ ID NO: 371809 - DNA, 20 bp, Artificial Sequence
  chemically synthesized
agtgctgggattacaggcgt

SEQ ID NO: 371810 - DNA, 20 bp, Artificial Sequence
  chemically synthesized
gtggctcacgcctgtaatcc

SEQ ID NO: 371811 - DNA, 20 bp, Artificial Sequence
  chemically synthesized
tcccaaagtgctgggattac

SEQ ID NO: 371812 - DNA, 20 bp, Artificial Sequence
  chemically synthesized
ctcccaaagtgctgggatta

SEQ ID NO: 371813 - DNA, 20 bp, Artificial Sequence
  chemically synthesized
cgcctgtaatcccagcactt

SEQ ID NO: 371814 - DNA, 20 bp, Artificial Sequence
  chemically synthesized
cctcggcctcccaaagtgct

SEQ ID NO: 371815 - DNA, 20 bp, Artificial Sequence
  chemically synthesized
gcctgtaatcccagcacttt

SEQ ID NO: 371816 - DNA, 20 bp, Artificial Sequence
  chemically synthesized
tcctcggcctcccaaagtgc

SEQ ID NO: 371817 - DNA, 20 bp, Artificial Sequence
  chemically synthesized
ctgtaatcccagcactttgg

SEQ ID NO: 371818 - DNA, 20 bp, Artificial Sequence
  chemically synthesized
tgtaatcccagcactttggg

SEQ ID NO: 371819 - DNA, 20 bp, Artificial Sequence
  chemically synthesized
ccgccctcctcggcctccca

SEQ ID NO: 371820 - DNA, 20 bp, Artificial Sequence
  chemically synthesized
tcccagcactttgggaggcc

SEQ ID NO: 371821 - DNA, 20 bp, Artificial Sequence
  chemically synthesized
cccagcactttgggaggccg

SEQ ID NO: 371822 - DNA, 20 bp, Artificial Sequence
  chemically synthesized
cagcactttgggaggccgag

SEQ ID NO: 371823 - DNA, 20 bp, Artificial Sequence
  chemically synthesized
agcactttgggaggccgagg

SEQ ID NO: 371824 - DNA, 20 bp, Artificial Sequence
  chemically synthesized
gcactttgggaggccgagga

SEQ ID NO: 371825 - DNA, 20 bp, Artificial Sequence
  chemically synthesized
ctttgggaggccgaggaggg

SEQ ID NO: 371826 - DNA, 20 bp, Artificial Sequence
  chemically synthesized
acctcgtgatccgccctcct

SEQ ID NO: 371827 - DNA, 20 bp, Artificial Sequence
  chemically synthesized
ggccgaggagggcggatcac

SEQ ID NO: 371828 - DNA, 20 bp, Artificial Sequence
  chemically synthesized
gccgaggagggcggatcacg

SEQ ID NO: 371829 - DNA, 20 bp, Artificial Sequence
  chemically synthesized
aggagggcggatcacgaggt

SEQ ID NO: 371830 - DNA, 20 bp, Artificial Sequence
  chemically synthesized
ggagggcggatcacgaggtc

SEQ ID NO: 371831 - DNA, 20 bp, Artificial Sequence
  chemically synthesized
agggcggatcacgaggtcag

SEQ ID NO: 371832 - DNA, 20 bp, Artificial Sequence
  chemically synthesized
gatcacgaggtcaggagatc

SEQ ID NO: 371833 - DNA, 20 bp, Artificial Sequence
  chemically synthesized
tcaggagatcaagaccatcc

SEQ ID NO: 371834 - DNA, 20 bp, Artificial Sequence
  chemically synthesized
tttcaccgtgttagccagga

SEQ ID NO: 371835 - DNA, 20 bp, Artificial Sequence
  chemically synthesized
ggggtttcaccgtgttagcc

SEQ ID NO: 371836 - DNA, 20 bp, Artificial Sequence
  chemically synthesized
caagaccatcctggctaaca

SEQ ID NO: 371837 - DNA, 20 bp, Artificial Sequence
  chemically synthesized
tggggtttcaccgtgttagc

SEQ ID NO: 371838 - DNA, 20 bp, Artificial Sequence
  chemically synthesized
gagatggggtttcaccgtgt

SEQ ID NO: 371839 - DNA, 20 bp, Artificial Sequence
  chemically synthesized
ctttttattagagagagatg

SEQ ID NO: 371840 - DNA, 20 bp, Artificial Sequence
  chemically synthesized
tctttttattagagagagat

SEQ ID NO: 371841 - DNA, 20 bp, Artificial Sequence
  chemically synthesized
gtctttttattagagagaga

SEQ ID NO: 371842 - DNA, 20 bp, Artificial Sequence
  chemically synthesized
ttttgtctttttattagaga

SEQ ID NO: 371843 - DNA, 20 bp, Artificial Sequence
  chemically synthesized
atttttgtctttttattaga

SEQ ID NO: 371844 - DNA, 20 bp, Artificial Sequence
  chemically synthesized
ccccatctctctctaataaa

SEQ ID NO: 371845 - DNA, 20 bp, Artificial Sequence
  chemically synthesized
taatttttgtctttttatta

SEQ ID NO: 371846 - DNA, 20 bp, Artificial Sequence
  chemically synthesized
gctaatttttgtctttttat

SEQ ID NO: 371847 - DNA, 20 bp, Artificial Sequence
  chemically synthesized
tctaataaaaagacaaaaat

SEQ ID NO: 371848 - DNA, 20 bp, Artificial Sequence
  chemically synthesized
ataaaaagacaaaaattagc

SEQ ID NO: 371849 - DNA, 20 bp, Artificial Sequence
  chemically synthesized
taaaaagacaaaaattagcc

SEQ ID NO: 371850 - DNA, 20 bp, Artificial Sequence
  chemically synthesized
agacaaaaattagccgggtg

SEQ ID NO: 371851 - DNA, 20 bp, Artificial Sequence
  chemically synthesized
caaaaattagccgggtgtag

SEQ ID NO: 371852 - DNA, 20 bp, Artificial Sequence
  chemically synthesized
caggcgcccgccactacacc

SEQ ID NO: 371853 - DNA, 20 bp, Artificial Sequence
  chemically synthesized
aaattagccgggtgtagtgg

SEQ ID NO: 371854 - DNA, 20 bp, Artificial Sequence
  chemically synthesized
aattagccgggtgtagtggc

SEQ ID NO: 371855 - DNA, 20 bp, Artificial Sequence
  chemically synthesized
ggtgtagtggcgggcgcctg

SEQ ID NO: 371856 - DNA, 20 bp, Artificial Sequence
  chemically synthesized
gtggcgggcgcctgtagtcc

SEQ ID NO: 371857 - DNA, 20 bp, Artificial Sequence
  chemically synthesized
tcccgagtagctgggactac

SEQ ID NO: 371858 - DNA, 20 bp, Artificial Sequence
  chemically synthesized
ctcccgagtagctgggacta

SEQ ID NO: 371859 - DNA, 20 bp, Artificial Sequence
  chemically synthesized
cgcctgtagtcccagctact

SEQ ID NO: 371860 - DNA, 20 bp, Artificial Sequence
  chemically synthesized
ccttagcctcccgagtagct

SEQ ID NO: 371861 - DNA, 20 bp, Artificial Sequence
  chemically synthesized
gcctgtagtcccagctactc

SEQ ID NO: 371862 - DNA, 20 bp, Artificial Sequence
  chemically synthesized
gccttagcctcccgagtagc

SEQ ID NO: 371863 - DNA, 20 bp, Artificial Sequence
  chemically synthesized
ctgtagtcccagctactcgg

SEQ ID NO: 371864 - DNA, 20 bp, Artificial Sequence
  chemically synthesized
tgtagtcccagctactcggg

SEQ ID NO: 371865 - DNA, 20 bp, Artificial Sequence
  chemically synthesized
tcctgccttagcctcccgag

SEQ ID NO: 371866 - DNA, 20 bp, Artificial Sequence
  chemically synthesized
ttctcctgccttagcctccc

SEQ ID NO: 371867 - DNA, 20 bp, Artificial Sequence
  chemically synthesized
tcccagctactcgggaggct

SEQ ID NO: 371868 - DNA, 20 bp, Artificial Sequence
  chemically synthesized
cccagctactcgggaggcta

SEQ ID NO: 371869 - DNA, 20 bp, Artificial Sequence
  chemically synthesized
agctactcgggaggctaagg

SEQ ID NO: 371870 - DNA, 20 bp, Artificial Sequence
  chemically synthesized
gctactcgggaggctaaggc

SEQ ID NO: 371871 - DNA, 20 bp, Artificial Sequence
  chemically synthesized
tactcgggaggctaaggcag

SEQ ID NO: 371872 - DNA, 20 bp, Artificial Sequence
  chemically synthesized
ttcatgccattctcctgcct

SEQ ID NO: 371873 - DNA, 20 bp, Artificial Sequence
  chemically synthesized
gggaggctaaggcaggagaa

SEQ ID NO: 371874 - DNA, 20 bp, Artificial Sequence
  chemically synthesized
gcaggagaatggcatgaacc

SEQ ID NO: 371875 - DNA, 20 bp, Artificial Sequence
  chemically synthesized
caggagaatggcatgaacct

SEQ ID NO: 371876 - DNA, 20 bp, Artificial Sequence
  chemically synthesized
ggagaatggcatgaacctgg

SEQ ID NO: 371877 - DNA, 20 bp, Artificial Sequence
  chemically synthesized
gagaatggcatgaacctggg

SEQ ID NO: 371878 - DNA, 20 bp, Artificial Sequence
  chemically synthesized
aatggcatgaacctgggagg

SEQ ID NO: 371879 - DNA, 20 bp, Artificial Sequence
  chemically synthesized
cactgcaagctccgcctccc

SEQ ID NO: 371880 - DNA, 20 bp, Artificial Sequence
  chemically synthesized
tggcatgaacctgggaggcg

SEQ ID NO: 371881 - DNA, 20 bp, Artificial Sequence
  chemically synthesized
tcactgcaagctccgcctcc

SEQ ID NO: 371882 - DNA, 20 bp, Artificial Sequence
  chemically synthesized
aacctgggaggcggagcttg

SEQ ID NO: 371883 - DNA, 20 bp, Artificial Sequence
  chemically synthesized
tgggaggcggagcttgcagt

SEQ ID NO: 371884 - DNA, 20 bp, Artificial Sequence
  chemically synthesized
gagcaatctcggctcactgc

SEQ ID NO: 371885 - DNA, 20 bp, Artificial Sequence
  chemically synthesized
ggcggagcttgcagtgagcc

SEQ ID NO: 371886 - DNA, 20 bp, Artificial Sequence
  chemically synthesized
ggggtgcagtggagcaatct

SEQ ID NO: 371887 - DNA, 20 bp, Artificial Sequence
  chemically synthesized
gcccaggctggggtgcagtg

SEQ ID NO: 371888 - DNA, 20 bp, Artificial Sequence
  chemically synthesized
tcgcccaggctggggtgcag

SEQ ID NO: 371889 - DNA, 20 bp, Artificial Sequence
  chemically synthesized
gagattgctccactgcaccc

SEQ ID NO: 371890 - DNA, 20 bp, Artificial Sequence
  chemically synthesized
ctgtcgcccaggctggggtg

SEQ ID NO: 371891 - DNA, 20 bp, Artificial Sequence
  chemically synthesized
tgctccactgcaccccagcc

SEQ ID NO: 371892 - DNA, 20 bp, Artificial Sequence
  chemically synthesized
gctccactgcaccccagcct

SEQ ID NO: 371893 - DNA, 20 bp, Artificial Sequence
  chemically synthesized
tcactctgtcgcccaggctg

SEQ ID NO: 371894 - DNA, 20 bp, Artificial Sequence
  chemically synthesized
ctcactctgtcgcccaggct

SEQ ID NO: 371895 - DNA, 20 bp, Artificial Sequence
  chemically synthesized
tctcactctgtcgcccaggc

SEQ ID NO: 371896 - DNA, 20 bp, Artificial Sequence
  chemically synthesized
ctgcaccccagcctgggcga

SEQ ID NO: 371897 - DNA, 20 bp, Artificial Sequence
  chemically synthesized
gtagtctcactctgtcgccc

SEQ ID NO: 371898 - DNA, 20 bp, Artificial Sequence
  chemically synthesized
gcaccccagcctgggcgaca

SEQ ID NO: 371899 - DNA, 20 bp, Artificial Sequence
  chemically synthesized
cgtagtctcactctgtcgcc

SEQ ID NO: 371900 - DNA, 20 bp, Artificial Sequence
  chemically synthesized
cccagcctgggcgacagagt

SEQ ID NO: 371901 - DNA, 20 bp, Artificial Sequence
  chemically synthesized
tttttattatttttgagacg

SEQ ID NO: 371902 - DNA, 20 bp, Artificial Sequence
  chemically synthesized
atattatttttattattttt

SEQ ID NO: 371903 - DNA, 20 bp, Artificial Sequence
  chemically synthesized
caaaaataataaaaataata

SEQ ID NO: 371904 - DNA, 20 bp, Artificial Sequence
  chemically synthesized
tgtcgaagttaaagattaat

SEQ ID NO: 371905 - DNA, 20 bp, Artificial Sequence
  chemically synthesized
ctaacattctgtcgaagtta

SEQ ID NO: 371906 - DNA, 20 bp, Artificial Sequence
  chemically synthesized
tgattaatctttaacttcga

SEQ ID NO: 371907 - DNA, 20 bp, Artificial Sequence
  chemically synthesized
tgaactctaacattctgtcg

SEQ ID NO: 371908 - DNA, 20 bp, Artificial Sequence
  chemically synthesized
ctttaacttcgacagaatgt

SEQ ID NO: 371909 - DNA, 20 bp, Artificial Sequence
  chemically synthesized
ttaacttcgacagaatgtta

SEQ ID NO: 371910 - DNA, 20 bp, Artificial Sequence
  chemically synthesized
aatgttagagttcaaacctg

SEQ ID NO: 371911 - DNA, 20 bp, Artificial Sequence
  chemically synthesized
caaaacctccatagagctac

SEQ ID NO: 371912 - DNA, 20 bp, Artificial Sequence
  chemically synthesized
tcaaaacctccatagagcta

SEQ ID NO: 371913 - DNA, 20 bp, Artificial Sequence
  chemically synthesized
agttcaaacctgtagctcta

SEQ ID NO: 371914 - DNA, 20 bp, Artificial Sequence
  chemically synthesized
ttcaaacctgtagctctatg

SEQ ID NO: 371915 - DNA, 20 bp, Artificial Sequence
  chemically synthesized
tcaaacctgtagctctatgg

SEQ ID NO: 371916 - DNA, 20 bp, Artificial Sequence
  chemically synthesized
tggtaatcaaaacctccata

SEQ ID NO: 371917 - DNA, 20 bp, Artificial Sequence
  chemically synthesized
aatggtaatcaaaacctcca

SEQ ID NO: 371918 - DNA, 20 bp, Artificial Sequence
  chemically synthesized
attgtgttaatggattataa

SEQ ID NO: 371919 - DNA, 20 bp, Artificial Sequence
  chemically synthesized
ttagtaacatattgtgttaa

SEQ ID NO: 371920 - DNA, 20 bp, Artificial Sequence
  chemically synthesized
cattaacacaatatgttact

SEQ ID NO: 371921 - DNA, 20 bp, Artificial Sequence
  chemically synthesized
aacacaatatgttactaaga

SEQ ID NO: 371922 - DNA, 20 bp, Artificial Sequence
  chemically synthesized
tgtgctctgaaatgctatct

SEQ ID NO: 371923 - DNA, 20 bp, Artificial Sequence
  chemically synthesized
atgttactaagatagcattt

SEQ ID NO: 371924 - DNA, 20 bp, Artificial Sequence
  chemically synthesized
gttactaagatagcatttca

SEQ ID NO: 371925 - DNA, 20 bp, Artificial Sequence
  chemically synthesized
taagatagcatttcagagca

SEQ ID NO: 371926 - DNA, 20 bp, Artificial Sequence
  chemically synthesized
agcacagtatgattttcttg

SEQ ID NO: 371927 - DNA, 20 bp, Artificial Sequence
  chemically synthesized
tagttttgtagtatagctac

SEQ ID NO: 371928 - DNA, 20 bp, Artificial Sequence
  chemically synthesized
agtattgtagttttgtagta

SEQ ID NO: 371929 - DNA, 20 bp, Artificial Sequence
  chemically synthesized
actgtagtattgtagttttg

SEQ ID NO: 371930 - DNA, 20 bp, Artificial Sequence
  chemically synthesized
atacagatactgtagtattg

SEQ ID NO: 371931 - DNA, 20 bp, Artificial Sequence
  chemically synthesized
actacaaaactacaatacta

SEQ ID NO: 371932 - DNA, 20 bp, Artificial Sequence
  chemically synthesized
ctaaagtaatacagatactg

SEQ ID NO: 371933 - DNA, 20 bp, Artificial Sequence
  chemically synthesized
agagattttctaaagtaata

SEQ ID NO: 371934 - DNA, 20 bp, Artificial Sequence
  chemically synthesized
ctacagtatctgtattactt

SEQ ID NO: 371935 - DNA, 20 bp, Artificial Sequence
  chemically synthesized
acttttttagagattttcta

SEQ ID NO: 371936 - DNA, 20 bp, Artificial Sequence
  chemically synthesized
actttagaaaatctctaaaa

SEQ ID NO: 371937 - DNA, 20 bp, Artificial Sequence
  chemically synthesized
tataattcacaactttttta

SEQ ID NO: 371938 - DNA, 20 bp, Artificial Sequence
  chemically synthesized
agtataattcacaacttttt

SEQ ID NO: 371939 - DNA, 20 bp, Artificial Sequence
  chemically synthesized
gttgtgaattatactgccaa

SEQ ID NO: 371940 - DNA, 20 bp, Artificial Sequence
  chemically synthesized
ctatctaatcaaaccattgg

SEQ ID NO: 371941 - DNA, 20 bp, Artificial Sequence
  chemically synthesized
attctatctaatcaaaccat

SEQ ID NO: 371942 - DNA, 20 bp, Artificial Sequence
  chemically synthesized
tatactgccaatggtttgat

SEQ ID NO: 371943 - DNA, 20 bp, Artificial Sequence
  chemically synthesized
ctgccaatggtttgattaga

SEQ ID NO: 371944 - DNA, 20 bp, Artificial Sequence
  chemically synthesized
gatattatttaaaaatcagt

SEQ ID NO: 371945 - DNA, 20 bp, Artificial Sequence
  chemically synthesized
atttgatattatttaaaaat

SEQ ID NO: 371946 - DNA, 20 bp, Artificial Sequence
  chemically synthesized
actcttttcatgattagaga

SEQ ID NO: 371947 - DNA, 20 bp, Artificial Sequence
  chemically synthesized
caccactcttttcatgatta

SEQ ID NO: 371948 - DNA, 20 bp, Artificial Sequence
  chemically synthesized
ctcaccactcttttcatgat

SEQ ID NO: 371949 - DNA, 20 bp, Artificial Sequence
  chemically synthesized
tttccatctctaatcatgaa

SEQ ID NO: 371950 - DNA, 20 bp, Artificial Sequence
  chemically synthesized
tccatctctaatcatgaaaa

SEQ ID NO: 371951 - DNA, 20 bp, Artificial Sequence
  chemically synthesized
atctctaatcatgaaaagag

SEQ ID NO: 371952 - DNA, 20 bp, Artificial Sequence
  chemically synthesized
ctaatcatgaaaagagtggt

SEQ ID NO: 371953 - DNA, 20 bp, Artificial Sequence
  chemically synthesized
taatcatgaaaagagtggtg

SEQ ID NO: 371954 - DNA, 20 bp, Artificial Sequence
  chemically synthesized
tcatgaaaagagtggtgagg

SEQ ID NO: 371955 - DNA, 20 bp, Artificial Sequence
  chemically synthesized
catgaaaagagtggtgaggt

SEQ ID NO: 371956 - DNA, 20 bp, Artificial Sequence
  chemically synthesized
atgaaaagagtggtgaggta

SEQ ID NO: 371957 - DNA, 20 bp, Artificial Sequence
  chemically synthesized
aaaagagtggtgaggtaggg

SEQ ID NO: 371958 - DNA, 20 bp, Artificial Sequence
  chemically synthesized
aaagagtggtgaggtagggc

SEQ ID NO: 371959 - DNA, 20 bp, Artificial Sequence
  chemically synthesized
ggcaggataaatcgtaatat

SEQ ID NO: 371960 - DNA, 20 bp, Artificial Sequence
  chemically synthesized
gcaggataaatcgtaatatt

SEQ ID NO: 371961 - DNA, 20 bp, Artificial Sequence
  chemically synthesized
caggataaatcgtaatattg

SEQ ID NO: 371962 - DNA, 20 bp, Artificial Sequence
  chemically synthesized
ataaatcgtaatattggggc

SEQ ID NO: 371963 - DNA, 20 bp, Artificial Sequence
  chemically synthesized
taaatcgtaatattggggcc

SEQ ID NO: 371964 - DNA, 20 bp, Artificial Sequence
  chemically synthesized
aatattggggccaggtgcaa

SEQ ID NO: 371965 - DNA, 20 bp, Artificial Sequence
  chemically synthesized
caggcatgagccattgcacc

SEQ ID NO: 371966 - DNA, 20 bp, Artificial Sequence
  chemically synthesized
agtgttgggcttacaggcat

SEQ ID NO: 371967 - DNA, 20 bp, Artificial Sequence
  chemically synthesized
gtgcaatggctcatgcctgt

SEQ ID NO: 371968 - DNA, 20 bp, Artificial Sequence
  chemically synthesized
tcccaaagtgttgggcttac

SEQ ID NO: 371969 - DNA, 20 bp, Artificial Sequence
  chemically synthesized
ctcccaaagtgttgggctta

SEQ ID NO: 371970 - DNA, 20 bp, Artificial Sequence
  chemically synthesized
tgcctgtaagcccaacactt

SEQ ID NO: 371971 - DNA, 20 bp, Artificial Sequence
  chemically synthesized
cctcagcctcccaaagtgtt

SEQ ID NO: 371972 - DNA, 20 bp, Artificial Sequence
  chemically synthesized
gcctgtaagcccaacacttt

SEQ ID NO: 371973 - DNA, 20 bp, Artificial Sequence
  chemically synthesized
gcctcagcctcccaaagtgt

SEQ ID NO: 371974 - DNA, 20 bp, Artificial Sequence
  chemically synthesized
ctgtaagcccaacactttgg

SEQ ID NO: 371975 - DNA, 20 bp, Artificial Sequence
  chemically synthesized
tgtaagcccaacactttggg

SEQ ID NO: 371976 - DNA, 20 bp, Artificial Sequence
  chemically synthesized
ccacctgcctcagcctccca

SEQ ID NO: 371977 - DNA, 20 bp, Artificial Sequence
  chemically synthesized
gcccaacactttgggaggct

SEQ ID NO: 371978 - DNA, 20 bp, Artificial Sequence
  chemically synthesized
cccaacactttgggaggctg

SEQ ID NO: 371979 - DNA, 20 bp, Artificial Sequence
  chemically synthesized
aacactttgggaggctgagg

SEQ ID NO: 371980 - DNA, 20 bp, Artificial Sequence
  chemically synthesized
acactttgggaggctgaggc

SEQ ID NO: 371981 - DNA, 20 bp, Artificial Sequence
  chemically synthesized
ctttgggaggctgaggcagg

SEQ ID NO: 371982 - DNA, 20 bp, Artificial Sequence
  chemically synthesized
acctcgtgatccacctgcct

SEQ ID NO: 371983 - DNA, 20 bp, Artificial Sequence
  chemically synthesized
ggctgaggcaggtggatcac

SEQ ID NO: 371984 - DNA, 20 bp, Artificial Sequence
  chemically synthesized
gctgaggcaggtggatcacg

SEQ ID NO: 371985 - DNA, 20 bp, Artificial Sequence
  chemically synthesized
aggcaggtggatcacgaggt

SEQ ID NO: 371986 - DNA, 20 bp, Artificial Sequence
  chemically synthesized
ggcaggtggatcacgaggtc

SEQ ID NO: 371987 - DNA, 20 bp, Artificial Sequence
  chemically synthesized
caggtggatcacgaggtcag

SEQ ID NO: 371988 - DNA, 20 bp, Artificial Sequence
  chemically synthesized
gatcacgaggtcaggagttc

SEQ ID NO: 371989 - DNA, 20 bp, Artificial Sequence
  chemically synthesized
cgaggtcaggagttcgagac

SEQ ID NO: 371990 - DNA, 20 bp, Artificial Sequence
  chemically synthesized
tttctccatctcggtcaggc

SEQ ID NO: 371991 - DNA, 20 bp, Artificial Sequence
  chemically synthesized
agttcgagaccagcctgacc

SEQ ID NO: 371992 - DNA, 20 bp, Artificial Sequence
  chemically synthesized
ggggtttctccatctcggtc

SEQ ID NO: 371993 - DNA, 20 bp, Artificial Sequence
  chemically synthesized
cgagaccagcctgaccgaga

SEQ ID NO: 371994 - DNA, 20 bp, Artificial Sequence
  chemically synthesized
tggggtttctccatctcggt

SEQ ID NO: 371995 - DNA, 20 bp, Artificial Sequence
  chemically synthesized
agaccagcctgaccgagatg

SEQ ID NO: 371996 - DNA, 20 bp, Artificial Sequence
  chemically synthesized
gagatggggtttctccatct

SEQ ID NO: 371997 - DNA, 20 bp, Artificial Sequence
  chemically synthesized
ttgtgtttttaatagagatg

SEQ ID NO: 371998 - DNA, 20 bp, Artificial Sequence
  chemically synthesized
tttgtgtttttaatagagat

SEQ ID NO: 371999 - DNA, 20 bp, Artificial Sequence
  chemically synthesized
ttttgtgtttttaatagaga

SEQ ID NO: 372000 - DNA, 20 bp, Artificial Sequence
  chemically synthesized
taatttttgtgtttttaata

SEQ ID NO: 372001 - DNA, 20 bp, Artificial Sequence
  chemically synthesized
gctaatttttgtgtttttaa

SEQ ID NO: 372002 - DNA, 20 bp, Artificial Sequence
  chemically synthesized
tctattaaaaacacaaaaat

SEQ ID NO: 372003 - DNA, 20 bp, Artificial Sequence
  chemically synthesized
ttaaaaacacaaaaattagc

SEQ ID NO: 372004 - DNA, 20 bp, Artificial Sequence
  chemically synthesized
taaaaacacaaaaattagcc

SEQ ID NO: 372005 - DNA, 20 bp, Artificial Sequence
  chemically synthesized
acacaaaaattagccgggca

SEQ ID NO: 372006 - DNA, 20 bp, Artificial Sequence
  chemically synthesized
caaaaattagccgggcacag

SEQ ID NO: 372007 - DNA, 20 bp, Artificial Sequence
  chemically synthesized
caggtacctgccactgtgcc

SEQ ID NO: 372008 - DNA, 20 bp, Artificial Sequence
  chemically synthesized
aaattagccgggcacagtgg

SEQ ID NO: 372009 - DNA, 20 bp, Artificial Sequence
  chemically synthesized
aattagccgggcacagtggc

SEQ ID NO: 372010 - DNA, 20 bp, Artificial Sequence
  chemically synthesized
gtggcaggtacctgtaatcc

SEQ ID NO: 372011 - DNA, 20 bp, Artificial Sequence
  chemically synthesized
tccccagtagctgggattac

SEQ ID NO: 372012 - DNA, 20 bp, Artificial Sequence
  chemically synthesized
ctccccagtagctgggatta

SEQ ID NO: 372013 - DNA, 20 bp, Artificial Sequence
  chemically synthesized
gtacctgtaatcccagctac

SEQ ID NO: 372014 - DNA, 20 bp, Artificial Sequence
  chemically synthesized
tacctgtaatcccagctact

SEQ ID NO: 372015 - DNA, 20 bp, Artificial Sequence
  chemically synthesized
cctcagcctccccagtagct

SEQ ID NO: 372016 - DNA, 20 bp, Artificial Sequence
  chemically synthesized
acctgtaatcccagctactg

SEQ ID NO: 372017 - DNA, 20 bp, Artificial Sequence
  chemically synthesized
gcctcagcctccccagtagc

SEQ ID NO: 372018 - DNA, 20 bp, Artificial Sequence
  chemically synthesized
ctgtaatcccagctactggg

SEQ ID NO: 372019 - DNA, 20 bp, Artificial Sequence
  chemically synthesized
tgtaatcccagctactgggg

SEQ ID NO: 372020 - DNA, 20 bp, Artificial Sequence
  chemically synthesized
tcctgcctcagcctccccag

SEQ ID NO: 372021 - DNA, 20 bp, Artificial Sequence
  chemically synthesized
ctctcctgcctcagcctccc

SEQ ID NO: 372022 - DNA, 20 bp, Artificial Sequence
  chemically synthesized
tcccagctactggggaggct

SEQ ID NO: 372023 - DNA, 20 bp, Artificial Sequence
  chemically synthesized
cccagctactggggaggctg

SEQ ID NO: 372024 - DNA, 20 bp, Artificial Sequence
  chemically synthesized
agctactggggaggctgagg

SEQ ID NO: 372025 - DNA, 20 bp, Artificial Sequence
  chemically synthesized
gctactggggaggctgaggc

SEQ ID NO: 372026 - DNA, 20 bp, Artificial Sequence
  chemically synthesized
tactggggaggctgaggcag

SEQ ID NO: 372027 - DNA, 20 bp, Artificial Sequence
  chemically synthesized
ttcaagcaactctcctgcct

SEQ ID NO: 372028 - DNA, 20 bp, Artificial Sequence
  chemically synthesized
ctggggaggctgaggcagga

SEQ ID NO: 372029 - DNA, 20 bp, Artificial Sequence
  chemically synthesized
gcaggagagttgcttgaacc

SEQ ID NO: 372030 - DNA, 20 bp, Artificial Sequence
  chemically synthesized
caggagagttgcttgaaccc

SEQ ID NO: 372031 - DNA, 20 bp, Artificial Sequence
  chemically synthesized
aacctccgcctcccgggttc

SEQ ID NO: 372032 - DNA, 20 bp, Artificial Sequence
  chemically synthesized
ggagagttgcttgaacccgg

SEQ ID NO: 372033 - DNA, 20 bp, Artificial Sequence
  chemically synthesized
gagagttgcttgaacccggg

SEQ ID NO: 372034 - DNA, 20 bp, Artificial Sequence
  chemically synthesized
agttgcttgaacccgggagg

SEQ ID NO: 372035 - DNA, 20 bp, Artificial Sequence
  chemically synthesized
caatgcaacctccgcctccc

SEQ ID NO: 372036 - DNA, 20 bp, Artificial Sequence
  chemically synthesized
ttgcttgaacccgggaggcg

SEQ ID NO: 372037 - DNA, 20 bp, Artificial Sequence
  chemically synthesized
tcaatgcaacctccgcctcc

SEQ ID NO: 372038 - DNA, 20 bp, Artificial Sequence
  chemically synthesized
tgcttgaacccgggaggcgg

SEQ ID NO: 372039 - DNA, 20 bp, Artificial Sequence
  chemically synthesized
cgggaggcggaggttgcatt

SEQ ID NO: 372040 - DNA, 20 bp, Artificial Sequence
  chemically synthesized
ggcggaggttgcattgagtt

SEQ ID NO: 372041 - DNA, 20 bp, Artificial Sequence
  chemically synthesized
gaggttgcattgagttgaga

SEQ ID NO: 372042 - DNA, 20 bp, Artificial Sequence
  chemically synthesized
tcgcctaggctagagtgcag

SEQ ID NO: 372043 - DNA, 20 bp, Artificial Sequence
  chemically synthesized
gagacagcaccactgcactc

SEQ ID NO: 372044 - DNA, 20 bp, Artificial Sequence
  chemically synthesized
ctgtcgcctaggctagagtg

SEQ ID NO: 372045 - DNA, 20 bp, Artificial Sequence
  chemically synthesized
agcaccactgcactctagcc

SEQ ID NO: 372046 - DNA, 20 bp, Artificial Sequence
  chemically synthesized
gcaccactgcactctagcct

SEQ ID NO: 372047 - DNA, 20 bp, Artificial Sequence
  chemically synthesized
ttggtctgtcgcctaggcta

SEQ ID NO: 372048 - DNA, 20 bp, Artificial Sequence
  chemically synthesized
tcttggtctgtcgcctaggc

SEQ ID NO: 372049 - DNA, 20 bp, Artificial Sequence
  chemically synthesized
ctgcactctagcctaggcga

SEQ ID NO: 372050 - DNA, 20 bp, Artificial Sequence
  chemically synthesized
gtagtcttggtctgtcgcct

SEQ ID NO: 372051 - DNA, 20 bp, Artificial Sequence
  chemically synthesized
cgtagtcttggtctgtcgcc

SEQ ID NO: 372052 - DNA, 20 bp, Artificial Sequence
  chemically synthesized
tctagcctaggcgacagacc

SEQ ID NO: 372053 - DNA, 20 bp, Artificial Sequence
  chemically synthesized
ttttttttgagacgtagtct

SEQ ID NO: 372054 - DNA, 20 bp, Artificial Sequence
  chemically synthesized
tttgttttttttttgagacg

SEQ ID NO: 372055 - DNA, 20 bp, Artificial Sequence
  chemically synthesized
ttgttttttgtttttttttt

SEQ ID NO: 372056 - DNA, 20 bp, Artificial Sequence
  chemically synthesized
ttatattaatatacaaatat

SEQ ID NO: 372057 - DNA, 20 bp, Artificial Sequence
  chemically synthesized
ttatgtcatgagggattcag

SEQ ID NO: 372058 - DNA, 20 bp, Artificial Sequence
  chemically synthesized
tattatgtcatgagggattc

SEQ ID NO: 372059 - DNA, 20 bp, Artificial Sequence
  chemically synthesized
atattatgtcatgagggatt

SEQ ID NO: 372060 - DNA, 20 bp, Artificial Sequence
  chemically synthesized
acatggatattatgtcatga

SEQ ID NO: 372061 - DNA, 20 bp, Artificial Sequence
  chemically synthesized
cacatggatattatgtcatg

SEQ ID NO: 372062 - DNA, 20 bp, Artificial Sequence
  chemically synthesized
acacatggatattatgtcat

SEQ ID NO: 372063 - DNA, 20 bp, Artificial Sequence
  chemically synthesized
ataaaaaggcttgatacaca

SEQ ID NO: 372064 - DNA, 20 bp, Artificial Sequence
  chemically synthesized
acataatatccatgtgtatc

SEQ ID NO: 372065 - DNA, 20 bp, Artificial Sequence
  chemically synthesized
taacagatgcaggaataaaa

SEQ ID NO: 372066 - DNA, 20 bp, Artificial Sequence
  chemically synthesized
gtaacagatgcaggaataaa

SEQ ID NO: 372067 - DNA, 20 bp, Artificial Sequence
  chemically synthesized
agaataacggtaacagatgc

SEQ ID NO: 372068 - DNA, 20 bp, Artificial Sequence
  chemically synthesized
gagaataacggtaacagatg

SEQ ID NO: 372069 - DNA, 20 bp, Artificial Sequence
  chemically synthesized
catagggagaataacggtaa

SEQ ID NO: 372070 - DNA, 20 bp, Artificial Sequence
  chemically synthesized
gagaggcatagggagaataa

SEQ ID NO: 372071 - DNA, 20 bp, Artificial Sequence
  chemically synthesized
ctggctgtgagaggcatagg

SEQ ID NO: 372072 - DNA, 20 bp, Artificial Sequence
  chemically synthesized
ttctggctgtgagaggcata

SEQ ID NO: 372073 - DNA, 20 bp, Artificial Sequence
  chemically synthesized
cttctggctgtgagaggcat

SEQ ID NO: 372074 - DNA, 20 bp, Artificial Sequence
  chemically synthesized
ccttctggctgtgagaggca

SEQ ID NO: 372075 - DNA, 20 bp, Artificial Sequence
  chemically synthesized
tattctccctatgcctctca

SEQ ID NO: 372076 - DNA, 20 bp, Artificial Sequence
  chemically synthesized
gttttccttctggctgtgag

SEQ ID NO: 372077 - DNA, 20 bp, Artificial Sequence
  chemically synthesized
ctccctatgcctctcacagc

SEQ ID NO: 372078 - DNA, 20 bp, Artificial Sequence
  chemically synthesized
agttttccttctggctgtga

SEQ ID NO: 372079 - DNA, 20 bp, Artificial Sequence
  chemically synthesized
tcagttttccttctggctgt

SEQ ID NO: 372080 - DNA, 20 bp, Artificial Sequence
  chemically synthesized
cctatgcctctcacagccag

SEQ ID NO: 372081 - DNA, 20 bp, Artificial Sequence
  chemically synthesized
ctatgcctctcacagccaga

SEQ ID NO: 372082 - DNA, 20 bp, Artificial Sequence
  chemically synthesized
tagactttcagttttccttc

SEQ ID NO: 372083 - DNA, 20 bp, Artificial Sequence
  chemically synthesized
acagccagaaggaaaactga

SEQ ID NO: 372084 - DNA, 20 bp, Artificial Sequence
  chemically synthesized
aaaggaagatagtagacttt

SEQ ID NO: 372085 - DNA, 20 bp, Artificial Sequence
  chemically synthesized
ttttaccaaaaggaagatag

SEQ ID NO: 372086 - DNA, 20 bp, Artificial Sequence
  chemically synthesized
aatttttaccaaaaggaaga

SEQ ID NO: 372087 - DNA, 20 bp, Artificial Sequence
  chemically synthesized
aaagtctactatcttccttt

SEQ ID NO: 372088 - DNA, 20 bp, Artificial Sequence
  chemically synthesized
ttcaaatttttaccaaaagg

SEQ ID NO: 372089 - DNA, 20 bp, Artificial Sequence
  chemically synthesized
cttttcaaatttttaccaaa

SEQ ID NO: 372090 - DNA, 20 bp, Artificial Sequence
  chemically synthesized
tcttttcaaatttttaccaa

SEQ ID NO: 372091 - DNA, 20 bp, Artificial Sequence
  chemically synthesized
ccttttggtaaaaatttgaa

SEQ ID NO: 372092 - DNA, 20 bp, Artificial Sequence
  chemically synthesized
tttggtaaaaatttgaaaag

SEQ ID NO: 372093 - DNA, 20 bp, Artificial Sequence
  chemically synthesized
ttggtaaaaatttgaaaaga

SEQ ID NO: 372094 - DNA, 20 bp, Artificial Sequence
  chemically synthesized
tggtaaaaatttgaaaagaa

SEQ ID NO: 372095 - DNA, 20 bp, Artificial Sequence
  chemically synthesized
aatttgaaaagaagggcatt

SEQ ID NO: 372096 - DNA, 20 bp, Artificial Sequence
  chemically synthesized
atttgaaaagaagggcattc

SEQ ID NO: 372097 - DNA, 20 bp, Artificial Sequence
  chemically synthesized
tgaaaagaagggcattcagg

SEQ ID NO: 372098 - DNA, 20 bp, Artificial Sequence
  chemically synthesized
aaaagaagggcattcaggta

SEQ ID NO: 372099 - DNA, 20 bp, Artificial Sequence
  chemically synthesized
gaagggcattcaggtagaga

SEQ ID NO: 372100 - DNA, 20 bp, Artificial Sequence
  chemically synthesized
gagatggcatttattaatgc

SEQ ID NO: 372101 - DNA, 20 bp, Artificial Sequence
  chemically synthesized
tttattaatgccagtgactg

SEQ ID NO: 372102 - DNA, 20 bp, Artificial Sequence
  chemically synthesized
gaacagtctgccgcagtcac

SEQ ID NO: 372103 - DNA, 20 bp, Artificial Sequence
  chemically synthesized
attaatgccagtgactgcgg

SEQ ID NO: 372104 - DNA, 20 bp, Artificial Sequence
  chemically synthesized
ggcccaagaacagtctgccg

SEQ ID NO: 372105 - DNA, 20 bp, Artificial Sequence
  chemically synthesized
tgactgcggcagactgttct

SEQ ID NO: 372106 - DNA, 20 bp, Artificial Sequence
  chemically synthesized
gactgcggcagactgttctt

SEQ ID NO: 372107 - DNA, 20 bp, Artificial Sequence
  chemically synthesized
gcttcccagcggcccaagaa

SEQ ID NO: 372108 - DNA, 20 bp, Artificial Sequence
  chemically synthesized
gcagactgttcttgggccgc

SEQ ID NO: 372109 - DNA, 20 bp, Artificial Sequence
  chemically synthesized
cacaggcttcccagcggccc

SEQ ID NO: 372110 - DNA, 20 bp, Artificial Sequence
  chemically synthesized
cagactgttcttgggccgct

SEQ ID NO: 372111 - DNA, 20 bp, Artificial Sequence
  chemically synthesized
actgttcttgggccgctggg

SEQ ID NO: 372112 - DNA, 20 bp, Artificial Sequence
  chemically synthesized
tatcaccacaggcttcccag

SEQ ID NO: 372113 - DNA, 20 bp, Artificial Sequence
  chemically synthesized
gtttatcaccacaggcttcc

SEQ ID NO: 372114 - DNA, 20 bp, Artificial Sequence
  chemically synthesized
ttgggccgctgggaagcctg

SEQ ID NO: 372115 - DNA, 20 bp, Artificial Sequence
  chemically synthesized
ccaatgctgtttatcaccac

SEQ ID NO: 372116 - DNA, 20 bp, Artificial Sequence
  chemically synthesized
tccaatgctgtttatcacca

SEQ ID NO: 372117 - DNA, 20 bp, Artificial Sequence
  chemically synthesized
gggaagcctgtggtgataaa

SEQ ID NO: 372118 - DNA, 20 bp, Artificial Sequence
  chemically synthesized
cctgtggtgataaacagcat

SEQ ID NO: 372119 - DNA, 20 bp, Artificial Sequence
  chemically synthesized
tgtggtgataaacagcattg

SEQ ID NO: 372120 - DNA, 20 bp, Artificial Sequence
  chemically synthesized
gtggtgataaacagcattgg

SEQ ID NO: 372121 - DNA, 20 bp, Artificial Sequence
  chemically synthesized
gtgataaacagcattggagg

SEQ ID NO: 372122 - DNA, 20 bp, Artificial Sequence
  chemically synthesized
taaacagcattggaggaaga

SEQ ID NO: 372123 - DNA, 20 bp, Artificial Sequence
  chemically synthesized
aacagcattggaggaagaaa

SEQ ID NO: 372124 - DNA, 20 bp, Artificial Sequence
  chemically synthesized
agtcatgtgccatatgtaaa

SEQ ID NO: 372125 - DNA, 20 bp, Artificial Sequence
  chemically synthesized
aaagagtcaccatttacata

SEQ ID NO: 372126 - DNA, 20 bp, Artificial Sequence
  chemically synthesized
atggcacatgactctcatca

SEQ ID NO: 372127 - DNA, 20 bp, Artificial Sequence
  chemically synthesized
agcaacacaagctgtgatga

SEQ ID NO: 372128 - DNA, 20 bp, Artificial Sequence
  chemically synthesized
taagcaacacaagctgtgat

SEQ ID NO: 372129 - DNA, 20 bp, Artificial Sequence
  chemically synthesized
aactggtgaataagcaacac

SEQ ID NO: 372130 - DNA, 20 bp, Artificial Sequence
  chemically synthesized
agcttgtgttgcttattcac

SEQ ID NO: 372131 - DNA, 20 bp, Artificial Sequence
  chemically synthesized
gcaaagtcaaactggtgaat

SEQ ID NO: 372132 - DNA, 20 bp, Artificial Sequence
  chemically synthesized
tggcaagggcaaagtcaaac

SEQ ID NO: 372133 - DNA, 20 bp, Artificial Sequence
  chemically synthesized
ctaaccttttggcaagggca

SEQ ID NO: 372134 - DNA, 20 bp, Artificial Sequence
  chemically synthesized
tttgactttgcccttgccaa

SEQ ID NO: 372135 - DNA, 20 bp, Artificial Sequence
  chemically synthesized
gttgtctaaccttttggcaa

SEQ ID NO: 372136 - DNA, 20 bp, Artificial Sequence
  chemically synthesized
ttgactttgcccttgccaaa

SEQ ID NO: 372137 - DNA, 20 bp, Artificial Sequence
  chemically synthesized
ggttgtctaaccttttggca

SEQ ID NO: 372138 - DNA, 20 bp, Artificial Sequence
  chemically synthesized
aggttgtctaaccttttggc

SEQ ID NO: 372139 - DNA, 20 bp, Artificial Sequence
  chemically synthesized
ctttgcccttgccaaaaggt

SEQ ID NO: 372140 - DNA, 20 bp, Artificial Sequence
  chemically synthesized
gcagaggttgtctaaccttt

SEQ ID NO: 372141 - DNA, 20 bp, Artificial Sequence
  chemically synthesized
ggatgaggagggcatagcag

SEQ ID NO: 372142 - DNA, 20 bp, Artificial Sequence
  chemically synthesized
aggatgaggagggcatagca

SEQ ID NO: 372143 - DNA, 20 bp, Artificial Sequence
  chemically synthesized
gtaggatgaggagggcatag

SEQ ID NO: 372144 - DNA, 20 bp, Artificial Sequence
  chemically synthesized
ccagtaggatgaggagggca

SEQ ID NO: 372145 - DNA, 20 bp, Artificial Sequence
  chemically synthesized
atttgccagtaggatgagga

SEQ ID NO: 372146 - DNA, 20 bp, Artificial Sequence
  chemically synthesized
aatttgccagtaggatgagg

SEQ ID NO: 372147 - DNA, 20 bp, Artificial Sequence
  chemically synthesized
taatttgccagtaggatgag

SEQ ID NO: 372148 - DNA, 20 bp, Artificial Sequence
  chemically synthesized
ggtaatttgccagtaggatg

SEQ ID NO: 372149 - DNA, 20 bp, Artificial Sequence
  chemically synthesized
ctatgccctcctcatcctac

SEQ ID NO: 372150 - DNA, 20 bp, Artificial Sequence
  chemically synthesized
tggtaatttgccagtaggat

SEQ ID NO: 372151 - DNA, 20 bp, Artificial Sequence
  chemically synthesized
caaagtggtaatttgccagt

SEQ ID NO: 372152 - DNA, 20 bp, Artificial Sequence
  chemically synthesized
acaaagtggtaatttgccag

SEQ ID NO: 372153 - DNA, 20 bp, Artificial Sequence
  chemically synthesized
ggaacaaagtggtaatttgc

SEQ ID NO: 372154 - DNA, 20 bp, Artificial Sequence
  chemically synthesized
ttcataaaatgggaacaaag

SEQ ID NO: 372155 - DNA, 20 bp, Artificial Sequence
  chemically synthesized
aatttcataaaatgggaaca

SEQ ID NO: 372156 - DNA, 20 bp, Artificial Sequence
  chemically synthesized
attcaataatttcataaaat

SEQ ID NO: 372157 - DNA, 20 bp, Artificial Sequence
  chemically synthesized
tattcaataatttcataaaa

SEQ ID NO: 372158 - DNA, 20 bp, Artificial Sequence
  chemically synthesized
ttttatgaaattattgaata

SEQ ID NO: 372159 - DNA, 20 bp, Artificial Sequence
  chemically synthesized
ttaaaaaagacaaatattaa

SEQ ID NO: 372160 - DNA, 20 bp, Artificial Sequence
  chemically synthesized
gtcaataactggtattaaaa

SEQ ID NO: 372161 - DNA, 20 bp, Artificial Sequence
  chemically synthesized
atatttgtcttttttaatac

SEQ ID NO: 372162 - DNA, 20 bp, Artificial Sequence
  chemically synthesized
gacgatcacttgtcaataac

SEQ ID NO: 372163 - DNA, 20 bp, Artificial Sequence
  chemically synthesized
ttttaataccagttattgac

SEQ ID NO: 372164 - DNA, 20 bp, Artificial Sequence
  chemically synthesized
aaaaaatatttattgaatga

SEQ ID NO: 372165 - DNA, 20 bp, Artificial Sequence
  chemically synthesized
tatttattgaatgacagtta

SEQ ID NO: 372166 - DNA, 20 bp, Artificial Sequence
  chemically synthesized
tttattgaatgacagttaaa

SEQ ID NO: 372167 - DNA, 20 bp, Artificial Sequence
  chemically synthesized
tggaaattaaaatacagtaa

SEQ ID NO: 372168 - DNA, 20 bp, Artificial Sequence
  chemically synthesized
ttggaaattaaaatacagta

SEQ ID NO: 372169 - DNA, 20 bp, Artificial Sequence
  chemically synthesized
gtttattggaaattaaaata

SEQ ID NO: 372170 - DNA, 20 bp, Artificial Sequence
  chemically synthesized
tgtgacacatatatgtttat

SEQ ID NO: 372171 - DNA, 20 bp, Artificial Sequence
  chemically synthesized
gtcacatatttttaaaaata

SEQ ID NO: 372172 - DNA, 20 bp, Artificial Sequence
  chemically synthesized
cacatatttttaaaaatatg

SEQ ID NO: 372173 - DNA, 20 bp, Artificial Sequence
  chemically synthesized
atatttttaaaaatatggag

SEQ ID NO: 372174 - DNA, 20 bp, Artificial Sequence
  chemically synthesized
tttaaaaatatggagaagtt

SEQ ID NO: 372175 - DNA, 20 bp, Artificial Sequence
  chemically synthesized
gtttttgttttgctttactt

SEQ ID NO: 372176 - DNA, 20 bp, Artificial Sequence
  chemically synthesized
ggcattaacctaccaaagta

SEQ ID NO: 372177 - DNA, 20 bp, Artificial Sequence
  chemically synthesized
tttgttttgctttactttgg

SEQ ID NO: 372178 - DNA, 20 bp, Artificial Sequence
  chemically synthesized
ttgttttgctttactttggt

SEQ ID NO: 372179 - DNA, 20 bp, Artificial Sequence
  chemically synthesized
catcaggcattaacctacca

SEQ ID NO: 372180 - DNA, 20 bp, Artificial Sequence
  chemically synthesized
tggaaaagattatgaacatc

SEQ ID NO: 372181 - DNA, 20 bp, Artificial Sequence
  chemically synthesized
ctggaaaagattatgaacat

SEQ ID NO: 372182 - DNA, 20 bp, Artificial Sequence
  chemically synthesized
ctgatgttcataatcttttc

SEQ ID NO: 372183 - DNA, 20 bp, Artificial Sequence
  chemically synthesized
cccagcctgttgaactggaa

SEQ ID NO: 372184 - DNA, 20 bp, Artificial Sequence
  chemically synthesized
cataatcttttccagttcaa

SEQ ID NO: 372185 - DNA, 20 bp, Artificial Sequence
  chemically synthesized
ataatcttttccagttcaac

SEQ ID NO: 372186 - DNA, 20 bp, Artificial Sequence
  chemically synthesized
actcacccagcctgttgaac

SEQ ID NO: 372187 - DNA, 20 bp, Artificial Sequence
  chemically synthesized
tcttttccagttcaacaggc

SEQ ID NO: 372188 - DNA, 20 bp, Artificial Sequence
  chemically synthesized
cttttccagttcaacaggct

SEQ ID NO: 372189 - DNA, 20 bp, Artificial Sequence
  chemically synthesized
tccagttcaacaggctgggt

SEQ ID NO: 372190 - DNA, 20 bp, Artificial Sequence
  chemically synthesized
agttcaacaggctgggtgag

SEQ ID NO: 372191 - DNA, 20 bp, Artificial Sequence
  chemically synthesized
atggtaccataccactcacc

SEQ ID NO: 372192 - DNA, 20 bp, Artificial Sequence
  chemically synthesized
aacaggctgggtgagtggta

SEQ ID NO: 372193 - DNA, 20 bp, Artificial Sequence
  chemically synthesized
gagtggtatggtaccataaa

SEQ ID NO: 372194 - DNA, 20 bp, Artificial Sequence
  chemically synthesized
agtggtatggtaccataaaa

SEQ ID NO: 372195 - DNA, 20 bp, Artificial Sequence
  chemically synthesized
ccagctgatcatccttttta

SEQ ID NO: 372196 - DNA, 20 bp, Artificial Sequence
  chemically synthesized
ggtaccataaaaaggatgat

SEQ ID NO: 372197 - DNA, 20 bp, Artificial Sequence
  chemically synthesized
ccataaaaaggatgatcagc

SEQ ID NO: 372198 - DNA, 20 bp, Artificial Sequence
  chemically synthesized
aggatgatcagctggaaatc

SEQ ID NO: 372199 - DNA, 20 bp, Artificial Sequence
  chemically synthesized
agattgaaggtcttgatttc

SEQ ID NO: 372200 - DNA, 20 bp, Artificial Sequence
  chemically synthesized
ggaatggaagtagagattga

SEQ ID NO: 372201 - DNA, 20 bp, Artificial Sequence
  chemically synthesized
gggaatggaagtagagattg

SEQ ID NO: 372202 - DNA, 20 bp, Artificial Sequence
  chemically synthesized
tgttagagggaatggaagta

SEQ ID NO: 372203 - DNA, 20 bp, Artificial Sequence
  chemically synthesized
tttgttagagggaatggaag

SEQ ID NO: 372204 - DNA, 20 bp, Artificial Sequence
  chemically synthesized
ctgtttgttagagggaatgg

SEQ ID NO: 372205 - DNA, 20 bp, Artificial Sequence
  chemically synthesized
tggctgtttgttagagggaa

SEQ ID NO: 372206 - DNA, 20 bp, Artificial Sequence
  chemically synthesized
tgccatggctgtttgttaga

SEQ ID NO: 372207 - DNA, 20 bp, Artificial Sequence
  chemically synthesized
atgccatggctgtttgttag

SEQ ID NO: 372208 - DNA, 20 bp, Artificial Sequence
  chemically synthesized
cttccattccctctaacaaa

SEQ ID NO: 372209 - DNA, 20 bp, Artificial Sequence
  chemically synthesized
catgccatggctgtttgtta

SEQ ID NO: 372210 - DNA, 20 bp, Artificial Sequence
  chemically synthesized
aacatgccatggctgtttgt

SEQ ID NO: 372211 - DNA, 20 bp, Artificial Sequence
  chemically synthesized
ttccctctaacaaacagcca

SEQ ID NO: 372212 - DNA, 20 bp, Artificial Sequence
  chemically synthesized
aattaaatgacaacatgcca

SEQ ID NO: 372213 - DNA, 20 bp, Artificial Sequence
  chemically synthesized
gcatgttgtcatttaattct

SEQ ID NO: 372214 - DNA, 20 bp, Artificial Sequence
  chemically synthesized
atgttgtcatttaattctga

SEQ ID NO: 372215 - DNA, 20 bp, Artificial Sequence
  chemically synthesized
gttgtcatttaattctgaga

SEQ ID NO: 372216 - DNA, 20 bp, Artificial Sequence
  chemically synthesized
atgtggaaatgaagctctct

SEQ ID NO: 372217 - DNA, 20 bp, Artificial Sequence
  chemically synthesized
tttctgaagatgtggaaatg

SEQ ID NO: 372218 - DNA, 20 bp, Artificial Sequence
  chemically synthesized
gagcttcatttccacatctt

SEQ ID NO: 372219 - DNA, 20 bp, Artificial Sequence
  chemically synthesized
gttctgtctttctgaagatg

SEQ ID NO: 372220 - DNA, 20 bp, Artificial Sequence
  chemically synthesized
ttcatttccacatcttcaga

SEQ ID NO: 372221 - DNA, 20 bp, Artificial Sequence
  chemically synthesized
agcattgttctgtctttctg

SEQ ID NO: 372222 - DNA, 20 bp, Artificial Sequence
  chemically synthesized
tttccacatcttcagaaaga

SEQ ID NO: 372223 - DNA, 20 bp, Artificial Sequence
  chemically synthesized
tcagaaagacagaacaatgc

SEQ ID NO: 372224 - DNA, 20 bp, Artificial Sequence
  chemically synthesized
ggaatacatgcaagtacatc

SEQ ID NO: 372225 - DNA, 20 bp, Artificial Sequence
  chemically synthesized
atcactattggaatacatgc

SEQ ID NO: 372226 - DNA, 20 bp, Artificial Sequence
  chemically synthesized
tgtacttgcatgtattccaa

SEQ ID NO: 372227 - DNA, 20 bp, Artificial Sequence
  chemically synthesized
gtctgaaaggcaatcactat

SEQ ID NO: 372228 - DNA, 20 bp, Artificial Sequence
  chemically synthesized
ttccaatagtgattgccttt

SEQ ID NO: 372229 - DNA, 20 bp, Artificial Sequence
  chemically synthesized
ggagaagaggaaggtctgaa

SEQ ID NO: 372230 - DNA, 20 bp, Artificial Sequence
  chemically synthesized
gggagaagaggaaggtctga

SEQ ID NO: 372231 - DNA, 20 bp, Artificial Sequence
  chemically synthesized
attcaaatgggagaagagga

SEQ ID NO: 372232 - DNA, 20 bp, Artificial Sequence
  chemically synthesized
tattcaaatgggagaagagg

SEQ ID NO: 372233 - DNA, 20 bp, Artificial Sequence
  chemically synthesized
gtctattcaaatgggagaag

SEQ ID NO: 372234 - DNA, 20 bp, Artificial Sequence
  chemically synthesized
tgtctattcaaatgggagaa

SEQ ID NO: 372235 - DNA, 20 bp, Artificial Sequence
  chemically synthesized
aatgtctattcaaatgggag

SEQ ID NO: 372236 - DNA, 20 bp, Artificial Sequence
  chemically synthesized
gctaatgtctattcaaatgg

SEQ ID NO: 372237 - DNA, 20 bp, Artificial Sequence
  chemically synthesized
ttcctcttctcccatttgaa

SEQ ID NO: 372238 - DNA, 20 bp, Artificial Sequence
  chemically synthesized
aggctaatgtctattcaaat

SEQ ID NO: 372239 - DNA, 20 bp, Artificial Sequence
  chemically synthesized
gaggctaatgtctattcaaa

SEQ ID NO: 372240 - DNA, 20 bp, Artificial Sequence
  chemically synthesized
tctcccatttgaatagacat

SEQ ID NO: 372241 - DNA, 20 bp, Artificial Sequence
  chemically synthesized
tgaatagacattagcctcat

SEQ ID NO: 372242 - DNA, 20 bp, Artificial Sequence
  chemically synthesized
aggtgtggaggtcactcatg

SEQ ID NO: 372243 - DNA, 20 bp, Artificial Sequence
  chemically synthesized
caggtgtggaggtcactcat

SEQ ID NO: 372244 - DNA, 20 bp, Artificial Sequence
  chemically synthesized
tggggagagtacaggtgtgg

SEQ ID NO: 372245 - DNA, 20 bp, Artificial Sequence
  chemically synthesized
atggggagagtacaggtgtg

SEQ ID NO: 372246 - DNA, 20 bp, Artificial Sequence
  chemically synthesized
gtatggggagagtacaggtg

SEQ ID NO: 372247 - DNA, 20 bp, Artificial Sequence
  chemically synthesized
atcgtgtatggggagagtac

SEQ ID NO: 372248 - DNA, 20 bp, Artificial Sequence
  chemically synthesized
aatcgtgtatggggagagta

SEQ ID NO: 372249 - DNA, 20 bp, Artificial Sequence
  chemically synthesized
tgcagaatcgtgtatgggga

SEQ ID NO: 372250 - DNA, 20 bp, Artificial Sequence
  chemically synthesized
tatgcagaatcgtgtatggg

SEQ ID NO: 372251 - DNA, 20 bp, Artificial Sequence
  chemically synthesized
tatatgcagaatcgtgtatg

SEQ ID NO: 372252 - DNA, 20 bp, Artificial Sequence
  chemically synthesized
ctatatgcagaatcgtgtat

SEQ ID NO: 372253 - DNA, 20 bp, Artificial Sequence
  chemically synthesized
gctatatgcagaatcgtgta

SEQ ID NO: 372254 - DNA, 20 bp, Artificial Sequence
  chemically synthesized
cccatacacgattctgcata

SEQ ID NO: 372255 - DNA, 20 bp, Artificial Sequence
  chemically synthesized
ttacatttggtggctatatg

SEQ ID NO: 372256 - DNA, 20 bp, Artificial Sequence
  chemically synthesized
tattagaaagttacatttgg

SEQ ID NO: 372257 - DNA, 20 bp, Artificial Sequence
  chemically synthesized
gcatattagaaagttacatt

SEQ ID NO: 372258 - DNA, 20 bp, Artificial Sequence
  chemically synthesized
tttatgttttgcatattaga

SEQ ID NO: 372259 - DNA, 20 bp, Artificial Sequence
  chemically synthesized
tttttttatgttttgcatat

SEQ ID NO: 372260 - DNA, 20 bp, Artificial Sequence
  chemically synthesized
aaacataaaaaaaaacttcc

SEQ ID NO: 372261 - DNA, 20 bp, Artificial Sequence
  chemically synthesized
atgtgttcaaaaaaaccagg

SEQ ID NO: 372262 - DNA, 20 bp, Artificial Sequence
  chemically synthesized
tgaatgtgttcaaaaaaacc

SEQ ID NO: 372263 - DNA, 20 bp, Artificial Sequence
  chemically synthesized
atgaatgtgttcaaaaaaac

SEQ ID NO: 372264 - DNA, 20 bp, Artificial Sequence
  chemically synthesized
tgaacacattcatctcaatt

SEQ ID NO: 372265 - DNA, 20 bp, Artificial Sequence
  chemically synthesized
ggatgattccttgctcaatt

SEQ ID NO: 372266 - DNA, 20 bp, Artificial Sequence
  chemically synthesized
cacattcatctcaattgagc

SEQ ID NO: 372267 - DNA, 20 bp, Artificial Sequence
  chemically synthesized
acattcatctcaattgagca

SEQ ID NO: 372268 - DNA, 20 bp, Artificial Sequence
  chemically synthesized
gactggggatacaatgtgga

SEQ ID NO: 372269 - DNA, 20 bp, Artificial Sequence
  chemically synthesized
ggtggactggggatacaatg

SEQ ID NO: 372270 - DNA, 20 bp, Artificial Sequence
  chemically synthesized
atccatccacattgtatccc

SEQ ID NO: 372271 - DNA, 20 bp, Artificial Sequence
  chemically synthesized
gatgcgggaaaggtggactg

SEQ ID NO: 372272 - DNA, 20 bp, Artificial Sequence
  chemically synthesized
ggatgcgggaaaggtggact

SEQ ID NO: 372273 - DNA, 20 bp, Artificial Sequence
  chemically synthesized
aggatgcgggaaaggtggac

SEQ ID NO: 372274 - DNA, 20 bp, Artificial Sequence
  chemically synthesized
tgaaaaggatgcgggaaagg

SEQ ID NO: 372275 - DNA, 20 bp, Artificial Sequence
  chemically synthesized
aattgaaaaggatgcgggaa

SEQ ID NO: 372276 - DNA, 20 bp, Artificial Sequence
  chemically synthesized
aaattgaaaaggatgcggga

SEQ ID NO: 372277 - DNA, 20 bp, Artificial Sequence
  chemically synthesized
caaaaaattgaaaaggatgc

SEQ ID NO: 372278 - DNA, 20 bp, Artificial Sequence
  chemically synthesized
gcaaaaaattgaaaaggatg

SEQ ID NO: 372279 - DNA, 20 bp, Artificial Sequence
  chemically synthesized
caattggcaaaaaattgaaa

SEQ ID NO: 372280 - DNA, 20 bp, Artificial Sequence
  chemically synthesized
gcaattggcaaaaaattgaa

SEQ ID NO: 372281 - DNA, 20 bp, Artificial Sequence
  chemically synthesized
ggttttgggatatgggcaat

SEQ ID NO: 372282 - DNA, 20 bp, Artificial Sequence
  chemically synthesized
taatggaggttttgggatat

SEQ ID NO: 372283 - DNA, 20 bp, Artificial Sequence
  chemically synthesized
gtaatggaggttttgggata

SEQ ID NO: 372284 - DNA, 20 bp, Artificial Sequence
  chemically synthesized
atgaccgtaatggaggtttt

SEQ ID NO: 372285 - DNA, 20 bp, Artificial Sequence
  chemically synthesized
catgaccgtaatggaggttt

SEQ ID NO: 372286 - DNA, 20 bp, Artificial Sequence
  chemically synthesized
atatcccaaaacctccatta

SEQ ID NO: 372287 - DNA, 20 bp, Artificial Sequence
  chemically synthesized
gtttgacatgaccgtaatgg

SEQ ID NO: 372288 - DNA, 20 bp, Artificial Sequence
  chemically synthesized
agtttgacatgaccgtaatg

SEQ ID NO: 372289 - DNA, 20 bp, Artificial Sequence
  chemically synthesized
gtagtttgacatgaccgtaa

SEQ ID NO: 372290 - DNA, 20 bp, Artificial Sequence
  chemically synthesized
ggtcatgtcaaactacttac

SEQ ID NO: 372291 - DNA, 20 bp, Artificial Sequence
  chemically synthesized
tgagttcaggaaccagtaag

SEQ ID NO: 372292 - DNA, 20 bp, Artificial Sequence
  chemically synthesized
aattgagttcaggaaccagt

SEQ ID NO: 372293 - DNA, 20 bp, Artificial Sequence
  chemically synthesized
aaccaattgagttcaggaac

SEQ ID NO: 372294 - DNA, 20 bp, Artificial Sequence
  chemically synthesized
gtcacaaaccaattgagttc

SEQ ID NO: 372295 - DNA, 20 bp, Artificial Sequence
  chemically synthesized
agtcacaaaccaattgagtt

SEQ ID NO: 372296 - DNA, 20 bp, Artificial Sequence
  chemically synthesized
tactggttcctgaactcaat

SEQ ID NO: 372297 - DNA, 20 bp, Artificial Sequence
  chemically synthesized
tatgaagtcacaaaccaatt

SEQ ID NO: 372298 - DNA, 20 bp, Artificial Sequence
  chemically synthesized
aaaaaatgctgaggagtatg

SEQ ID NO: 372299 - DNA, 20 bp, Artificial Sequence
  chemically synthesized
gtttgtgacttcatactcct

SEQ ID NO: 372300 - DNA, 20 bp, Artificial Sequence
  chemically synthesized
aaaaaaaaaaaaatgctgag

SEQ ID NO: 372301 - DNA, 20 bp, Artificial Sequence
  chemically synthesized
aaaaaaaaaaaaaaatgctg

SEQ ID NO: 372302 - DNA, 20 bp, Artificial Sequence
  chemically synthesized
taaaaaaaaaaaaaaatgct

SEQ ID NO: 372303 - DNA, 20 bp, Artificial Sequence
  chemically synthesized
catttttttttttttttaat

SEQ ID NO: 372304 - DNA, 20 bp, Artificial Sequence
  chemically synthesized
ttttttttttaatcagccaa

SEQ ID NO: 372305 - DNA, 20 bp, Artificial Sequence
  chemically synthesized
tttttttttaatcagccaat

SEQ ID NO: 372306 - DNA, 20 bp, Artificial Sequence
  chemically synthesized
tgttggagctttcagcctat

SEQ ID NO: 372307 - DNA, 20 bp, Artificial Sequence
  chemically synthesized
ttaatcagccaataggctga

SEQ ID NO: 372308 - DNA, 20 bp, Artificial Sequence
  chemically synthesized
tttggccctgttggagcttt

SEQ ID NO: 372309 - DNA, 20 bp, Artificial Sequence
  chemically synthesized
caataggctgaaagctccaa

SEQ ID NO: 372310 - DNA, 20 bp, Artificial Sequence
  chemically synthesized
aataggctgaaagctccaac

SEQ ID NO: 372311 - DNA, 20 bp, Artificial Sequence
  chemically synthesized
ataggctgaaagctccaaca

SEQ ID NO: 372312 - DNA, 20 bp, Artificial Sequence
  chemically synthesized
ttttttttttggccctgttg

SEQ ID NO: 372313 - DNA, 20 bp, Artificial Sequence
  chemically synthesized
ttttttttttttggccctgt

SEQ ID NO: 372314 - DNA, 20 bp, Artificial Sequence
  chemically synthesized
gaaaaaggcttttttttttt

SEQ ID NO: 372315 - DNA, 20 bp, Artificial Sequence
  chemically synthesized
caacagggccaaaaaaaaaa

SEQ ID NO: 372316 - DNA, 20 bp, Artificial Sequence
  chemically synthesized
aaaaaaaaaaaagccttttt

SEQ ID NO: 372317 - DNA, 20 bp, Artificial Sequence
  chemically synthesized
taagaagactaagctgaaaa

SEQ ID NO: 372318 - DNA, 20 bp, Artificial Sequence
  chemically synthesized
ctaagaagactaagctgaaa

SEQ ID NO: 372319 - DNA, 20 bp, Artificial Sequence
  chemically synthesized
aaaaaaagcctttttcagct

SEQ ID NO: 372320 - DNA, 20 bp, Artificial Sequence
  chemically synthesized
agttagttgctaagaagact

SEQ ID NO: 372321 - DNA, 20 bp, Artificial Sequence
  chemically synthesized
ctttttcagcttagtcttct

SEQ ID NO: 372322 - DNA, 20 bp, Artificial Sequence
  chemically synthesized
acaatcagttagttgctaag

SEQ ID NO: 372323 - DNA, 20 bp, Artificial Sequence
  chemically synthesized
cagacaatcagttagttgct

SEQ ID NO: 372324 - DNA, 20 bp, Artificial Sequence
  chemically synthesized
tttataggcagacaatcagt

SEQ ID NO: 372325 - DNA, 20 bp, Artificial Sequence
  chemically synthesized
atcttttataggcagacaat

SEQ ID NO: 372326 - DNA, 20 bp, Artificial Sequence
  chemically synthesized
aactgattgtctgcctataa

SEQ ID NO: 372327 - DNA, 20 bp, Artificial Sequence
  chemically synthesized
gattaaacatcttttatagg

SEQ ID NO: 372328 - DNA, 20 bp, Artificial Sequence
  chemically synthesized
attgattaaacatcttttat

SEQ ID NO: 372329 - DNA, 20 bp, Artificial Sequence
  chemically synthesized
cattgattaaacatctttta

SEQ ID NO: 372330 - DNA, 20 bp, Artificial Sequence
  chemically synthesized
aaagatgtttaatcaatgtt

SEQ ID NO: 372331 - DNA, 20 bp, Artificial Sequence
  chemically synthesized
gatgtttaatcaatgtttgg

SEQ ID NO: 372332 - DNA, 20 bp, Artificial Sequence
  chemically synthesized
tgtttaatcaatgtttggaa

SEQ ID NO: 372333 - DNA, 20 bp, Artificial Sequence
  chemically synthesized
taatcaatgtttggaagaga

SEQ ID NO: 372334 - DNA, 20 bp, Artificial Sequence
  chemically synthesized
ttggaagagatggacttgaa

SEQ ID NO: 372335 - DNA, 20 bp, Artificial Sequence
  chemically synthesized
aagagtacaacaggccattc

SEQ ID NO: 372336 - DNA, 20 bp, Artificial Sequence
  chemically synthesized
catgccaacaagagtacaac

SEQ ID NO: 372337 - DNA, 20 bp, Artificial Sequence
  chemically synthesized
tcatgccaacaagagtacaa

SEQ ID NO: 372338 - DNA, 20 bp, Artificial Sequence
  chemically synthesized
atggcctgttgtactcttgt

SEQ ID NO: 372339 - DNA, 20 bp, Artificial Sequence
  chemically synthesized
agggattttcatgccaacaa

SEQ ID NO: 372340 - DNA, 20 bp, Artificial Sequence
  chemically synthesized
aaagggattttcatgccaac

SEQ ID NO: 372341 - DNA, 20 bp, Artificial Sequence
  chemically synthesized
gttggcatgaaaatcccttt

SEQ ID NO: 372342 - DNA, 20 bp, Artificial Sequence
  chemically synthesized
ctatagactagaaacttaaa

SEQ ID NO: 372343 - DNA, 20 bp, Artificial Sequence
  chemically synthesized
actatagactagaaacttaa

SEQ ID NO: 372344 - DNA, 20 bp, Artificial Sequence
  chemically synthesized
aactatagactagaaactta

SEQ ID NO: 372345 - DNA, 20 bp, Artificial Sequence
  chemically synthesized
tgaaaatccctttaagtttc

SEQ ID NO: 372346 - DNA, 20 bp, Artificial Sequence
  chemically synthesized
ccctttaagtttctagtcta

SEQ ID NO: 372347 - DNA, 20 bp, Artificial Sequence
  chemically synthesized
aattgatatcaactatagac

SEQ ID NO: 372348 - DNA, 20 bp, Artificial Sequence
  chemically synthesized
gttgaaattgatatcaacta

SEQ ID NO: 372349 - DNA, 20 bp, Artificial Sequence
  chemically synthesized
gcttggctagggttgtattg

SEQ ID NO: 372350 - DNA, 20 bp, Artificial Sequence
  chemically synthesized
tgcttggctagggttgtatt

SEQ ID NO: 372351 - DNA, 20 bp, Artificial Sequence
  chemically synthesized
ttgcttggctagggttgtat

SEQ ID NO: 372352 - DNA, 20 bp, Artificial Sequence
  chemically synthesized
tttcaaccccaatacaaccc

SEQ ID NO: 372353 - DNA, 20 bp, Artificial Sequence
  chemically synthesized
accccaatacaaccctagcc

SEQ ID NO: 372354 - DNA, 20 bp, Artificial Sequence
  chemically synthesized
agacgaattttgcttggcta

SEQ ID NO: 372355 - DNA, 20 bp, Artificial Sequence
  chemically synthesized
gagacgaattttgcttggct

SEQ ID NO: 372356 - DNA, 20 bp, Artificial Sequence
  chemically synthesized
agagacgaattttgcttggc

SEQ ID NO: 372357 - DNA, 20 bp, Artificial Sequence
  chemically synthesized
aagaagagacgaattttgct

SEQ ID NO: 372358 - DNA, 20 bp, Artificial Sequence
  chemically synthesized
catgggagcagaaggaagaa

SEQ ID NO: 372359 - DNA, 20 bp, Artificial Sequence
  chemically synthesized
tgcatgggagcagaaggaag

SEQ ID NO: 372360 - DNA, 20 bp, Artificial Sequence
  chemically synthesized
gtatgcatgggagcagaagg

SEQ ID NO: 372361 - DNA, 20 bp, Artificial Sequence
  chemically synthesized
ggggtatgcatgggagcaga

SEQ ID NO: 372362 - DNA, 20 bp, Artificial Sequence
  chemically synthesized
gggggtatgcatgggagcag

SEQ ID NO: 372363 - DNA, 20 bp, Artificial Sequence
  chemically synthesized
cacgggggtatgcatgggag

SEQ ID NO: 372364 - DNA, 20 bp, Artificial Sequence
  chemically synthesized
taccacgggggtatgcatgg

SEQ ID NO: 372365 - DNA, 20 bp, Artificial Sequence
  chemically synthesized
cctaccacgggggtatgcat

SEQ ID NO: 372366 - DNA, 20 bp, Artificial Sequence
  chemically synthesized
tcctaccacgggggtatgca

SEQ ID NO: 372367 - DNA, 20 bp, Artificial Sequence
  chemically synthesized
tgctcccatgcatacccccg

SEQ ID NO: 372368 - DNA, 20 bp, Artificial Sequence
  chemically synthesized
tcccatgcatacccccgtgg

SEQ ID NO: 372369 - DNA, 20 bp, Artificial Sequence
  chemically synthesized
cccatgcatacccccgtggt

SEQ ID NO: 372370 - DNA, 20 bp, Artificial Sequence
  chemically synthesized
tatagtatgtcctaccacgg

SEQ ID NO: 372371 - DNA, 20 bp, Artificial Sequence
  chemically synthesized
atatagtatgtcctaccacg

SEQ ID NO: 372372 - DNA, 20 bp, Artificial Sequence
  chemically synthesized
tatatagtatgtcctaccac

SEQ ID NO: 372373 - DNA, 20 bp, Artificial Sequence
  chemically synthesized
ctatatagtatgtcctacca

SEQ ID NO: 372374 - DNA, 20 bp, Artificial Sequence
  chemically synthesized
ccgtggtaggacatactata

SEQ ID NO: 372375 - DNA, 20 bp, Artificial Sequence
  chemically synthesized
aaagcaattacaagactata

SEQ ID NO: 372376 - DNA, 20 bp, Artificial Sequence
  chemically synthesized
aagcaatcaaaagcaattac

SEQ ID NO: 372377 - DNA, 20 bp, Artificial Sequence
  chemically synthesized
ggtatttcaaaagcaatcaa

SEQ ID NO: 372378 - DNA, 20 bp, Artificial Sequence
  chemically synthesized
gggaaaaataggtatttcaa

SEQ ID NO: 372379 - DNA, 20 bp, Artificial Sequence
  chemically synthesized
ggcatataaatgggaaaaat

SEQ ID NO: 372380 - DNA, 20 bp, Artificial Sequence
  chemically synthesized
tggcatataaatgggaaaaa

SEQ ID NO: 372381 - DNA, 20 bp, Artificial Sequence
  chemically synthesized
ttaagagatggcatataaat

SEQ ID NO: 372382 - DNA, 20 bp, Artificial Sequence
  chemically synthesized
gttaagagatggcatataaa

SEQ ID NO: 372383 - DNA, 20 bp, Artificial Sequence
  chemically synthesized
ctggcactgtagttaagaga

SEQ ID NO: 372384 - DNA, 20 bp, Artificial Sequence
  chemically synthesized
tatatgccatctcttaacta

SEQ ID NO: 372385 - DNA, 20 bp, Artificial Sequence
  chemically synthesized
atacctggcactgtagttaa

SEQ ID NO: 372386 - DNA, 20 bp, Artificial Sequence
  chemically synthesized
atatacctggcactgtagtt

SEQ ID NO: 372387 - DNA, 20 bp, Artificial Sequence
  chemically synthesized
ccatctcttaactacagtgc

SEQ ID NO: 372388 - DNA, 20 bp, Artificial Sequence
  chemically synthesized
catctcttaactacagtgcc

SEQ ID NO: 372389 - DNA, 20 bp, Artificial Sequence
  chemically synthesized
ctgccatatacctggcactg

SEQ ID NO: 372390 - DNA, 20 bp, Artificial Sequence
  chemically synthesized
taactacagtgccaggtata

SEQ ID NO: 372391 - DNA, 20 bp, Artificial Sequence
  chemically synthesized
ttgagattctgccatatacc

SEQ ID NO: 372392 - DNA, 20 bp, Artificial Sequence
  chemically synthesized
ctacagtgccaggtatatgg

SEQ ID NO: 372393 - DNA, 20 bp, Artificial Sequence
  chemically synthesized
tatggcagaatctcaaaact

SEQ ID NO: 372394 - DNA, 20 bp, Artificial Sequence
  chemically synthesized
agtctttttaactcagtttt

SEQ ID NO: 372395 - DNA, 20 bp, Artificial Sequence
  chemically synthesized
aatctcaaaactgagttaaa

SEQ ID NO: 372396 - DNA, 20 bp, Artificial Sequence
  chemically synthesized
aaatcttagtctttttaact

SEQ ID NO: 372397 - DNA, 20 bp, Artificial Sequence
  chemically synthesized
aaaactgagttaaaaagact

SEQ ID NO: 372398 - DNA, 20 bp, Artificial Sequence
  chemically synthesized
gttaaaaagactaagatttc

SEQ ID NO: 372399 - DNA, 20 bp, Artificial Sequence
  chemically synthesized
tgcgcctagcccagaaatct

SEQ ID NO: 372400 - DNA, 20 bp, Artificial Sequence
  chemically synthesized
ttaaaaagactaagatttct

SEQ ID NO: 372401 - DNA, 20 bp, Artificial Sequence
  chemically synthesized
aaagactaagatttctgggc

SEQ ID NO: 372402 - DNA, 20 bp, Artificial Sequence
  chemically synthesized
aagactaagatttctgggct

SEQ ID NO: 372403 - DNA, 20 bp, Artificial Sequence
  chemically synthesized
gtgagccactgcgcctagcc

SEQ ID NO: 372404 - DNA, 20 bp, Artificial Sequence
  chemically synthesized
taagatttctgggctaggcg

SEQ ID NO: 372405 - DNA, 20 bp, Artificial Sequence
  chemically synthesized
gatttctgggctaggcgcag

SEQ ID NO: 372406 - DNA, 20 bp, Artificial Sequence
  chemically synthesized
caggcgtgagccactgcgcc

SEQ ID NO: 372407 - DNA, 20 bp, Artificial Sequence
  chemically synthesized
agtgctgggattacaggcgt

SEQ ID NO: 372408 - DNA, 20 bp, Artificial Sequence
  chemically synthesized
gtggctcacgcctgtaatcc

SEQ ID NO: 372409 - DNA, 20 bp, Artificial Sequence
  chemically synthesized
gtctaaagtgctgggattac

SEQ ID NO: 372410 - DNA, 20 bp, Artificial Sequence
  chemically synthesized
cgtctaaagtgctgggatta

SEQ ID NO: 372411 - DNA, 20 bp, Artificial Sequence
  chemically synthesized
cgcctgtaatcccagcactt

SEQ ID NO: 372412 - DNA, 20 bp, Artificial Sequence
  chemically synthesized
cctcggccgtctaaagtgct

SEQ ID NO: 372413 - DNA, 20 bp, Artificial Sequence
  chemically synthesized
acctcggccgtctaaagtgc

SEQ ID NO: 372414 - DNA, 20 bp, Artificial Sequence
  chemically synthesized
tgtaatcccagcactttaga

SEQ ID NO: 372415 - DNA, 20 bp, Artificial Sequence
  chemically synthesized
cttcccacctcggccgtcta

SEQ ID NO: 372416 - DNA, 20 bp, Artificial Sequence
  chemically synthesized
tcccagcactttagacggcc

SEQ ID NO: 372417 - DNA, 20 bp, Artificial Sequence
  chemically synthesized
cccagcactttagacggccg

SEQ ID NO: 372418 - DNA, 20 bp, Artificial Sequence
  chemically synthesized
agcactttagacggccgagg

SEQ ID NO: 372419 - DNA, 20 bp, Artificial Sequence
  chemically synthesized
gcactttagacggccgaggt

SEQ ID NO: 372420 - DNA, 20 bp, Artificial Sequence
  chemically synthesized
ctttagacggccgaggtggg

SEQ ID NO: 372421 - DNA, 20 bp, Artificial Sequence
  chemically synthesized
ctcaggtggtcttcccacct

SEQ ID NO: 372422 - DNA, 20 bp, Artificial Sequence
  chemically synthesized
ccgaggtgggaagaccacct

SEQ ID NO: 372423 - DNA, 20 bp, Artificial Sequence
  chemically synthesized
cgaggtgggaagaccacctg

SEQ ID NO: 372424 - DNA, 20 bp, Artificial Sequence
  chemically synthesized
ctcgaactcccgacctcagg

SEQ ID NO: 372425 - DNA, 20 bp, Artificial Sequence
  chemically synthesized
gtgggaagaccacctgaggt

SEQ ID NO: 372426 - DNA, 20 bp, Artificial Sequence
  chemically synthesized
tgggaagaccacctgaggtc

SEQ ID NO: 372427 - DNA, 20 bp, Artificial Sequence
  chemically synthesized
ggtctcgaactcccgacctc

SEQ ID NO: 372428 - DNA, 20 bp, Artificial Sequence
  chemically synthesized
ggaagaccacctgaggtcgg

SEQ ID NO: 372429 - DNA, 20 bp, Artificial Sequence
  chemically synthesized
tggtctcgaactcccgacct

SEQ ID NO: 372430 - DNA, 20 bp, Artificial Sequence
  chemically synthesized
ccacctgaggtcgggagttc

SEQ ID NO: 372431 - DNA, 20 bp, Artificial Sequence
  chemically synthesized
tgaggtcgggagttcgagac

SEQ ID NO: 372432 - DNA, 20 bp, Artificial Sequence
  chemically synthesized
tttctccatgttggtcaggc

SEQ ID NO: 372433 - DNA, 20 bp, Artificial Sequence
  chemically synthesized
gaggtttctccatgttggtc

SEQ ID NO: 372434 - DNA, 20 bp, Artificial Sequence
  chemically synthesized
cgagaccagcctgaccaaca

SEQ ID NO: 372435 - DNA, 20 bp, Artificial Sequence
  chemically synthesized
tgaggtttctccatgttggt

SEQ ID NO: 372436 - DNA, 20 bp, Artificial Sequence
  chemically synthesized
agaccagcctgaccaacatg

SEQ ID NO: 372437 - DNA, 20 bp, Artificial Sequence
  chemically synthesized
gagatgaggtttctccatgt

SEQ ID NO: 372438 - DNA, 20 bp, Artificial Sequence
  chemically synthesized
ttgtatttgtagtagagatg

SEQ ID NO: 372439 - DNA, 20 bp, Artificial Sequence
  chemically synthesized
tttgtatttgtagtagagat

SEQ ID NO: 372440 - DNA, 20 bp, Artificial Sequence
  chemically synthesized
ctaattttgtatttgtagta

SEQ ID NO: 372441 - DNA, 20 bp, Artificial Sequence
  chemically synthesized
ggctaattttgtatttgtag

SEQ ID NO: 372442 - DNA, 20 bp, Artificial Sequence
  chemically synthesized
cctggctaattttgtatttg

SEQ ID NO: 372443 - DNA, 20 bp, Artificial Sequence
  chemically synthesized
ctctactacaaatacaaaat

SEQ ID NO: 372444 - DNA, 20 bp, Artificial Sequence
  chemically synthesized
actacaaatacaaaattagc

SEQ ID NO: 372445 - DNA, 20 bp, Artificial Sequence
  chemically synthesized
ctacaaatacaaaattagcc

SEQ ID NO: 372446 - DNA, 20 bp, Artificial Sequence
  chemically synthesized
aatacaaaattagccaggtg

SEQ ID NO: 372447 - DNA, 20 bp, Artificial Sequence
  chemically synthesized
caggcatgcgtcaccacacc

SEQ ID NO: 372448 - DNA, 20 bp, Artificial Sequence
  chemically synthesized
gtgacgcatgcctgtaatcc

SEQ ID NO: 372449 - DNA, 20 bp, Artificial Sequence
  chemically synthesized
tcctgagtagctgggattac

SEQ ID NO: 372450 - DNA, 20 bp, Artificial Sequence
  chemically synthesized
ctcctgagtagctgggatta

SEQ ID NO: 372451 - DNA, 20 bp, Artificial Sequence
  chemically synthesized
tgcctgtaatcccagctact

SEQ ID NO: 372452 - DNA, 20 bp, Artificial Sequence
  chemically synthesized
cctcagcctcctgagtagct

SEQ ID NO: 372453 - DNA, 20 bp, Artificial Sequence
  chemically synthesized
gcctgtaatcccagctactc

SEQ ID NO: 372454 - DNA, 20 bp, Artificial Sequence
  chemically synthesized
gcctcagcctcctgagtagc

SEQ ID NO: 372455 - DNA, 20 bp, Artificial Sequence
  chemically synthesized
ctgtaatcccagctactcag

SEQ ID NO: 372456 - DNA, 20 bp, Artificial Sequence
  chemically synthesized
tgtaatcccagctactcagg

SEQ ID NO: 372457 - DNA, 20 bp, Artificial Sequence
  chemically synthesized
tcctgcctcagcctcctgag

SEQ ID NO: 372458 - DNA, 20 bp, Artificial Sequence
  chemically synthesized
ttctcctgcctcagcctcct

SEQ ID NO: 372459 - DNA, 20 bp, Artificial Sequence
  chemically synthesized
tcccagctactcaggaggct

SEQ ID NO: 372460 - DNA, 20 bp, Artificial Sequence
  chemically synthesized
cccagctactcaggaggctg

SEQ ID NO: 372461 - DNA, 20 bp, Artificial Sequence
  chemically synthesized
agctactcaggaggctgagg

SEQ ID NO: 372462 - DNA, 20 bp, Artificial Sequence
  chemically synthesized
gctactcaggaggctgaggc

SEQ ID NO: 372463 - DNA, 20 bp, Artificial Sequence
  chemically synthesized
tactcaggaggctgaggcag

SEQ ID NO: 372464 - DNA, 20 bp, Artificial Sequence
  chemically synthesized
ttcaagcgattctcctgcct

SEQ ID NO: 372465 - DNA, 20 bp, Artificial Sequence
  chemically synthesized
gcaggagaatcgcttgaacc

SEQ ID NO: 372466 - DNA, 20 bp, Artificial Sequence
  chemically synthesized
aacctccgccttctgggttc

SEQ ID NO: 372467 - DNA, 20 bp, Artificial Sequence
  chemically synthesized
ggagaatcgcttgaacccag

SEQ ID NO: 372468 - DNA, 20 bp, Artificial Sequence
  chemically synthesized
gagaatcgcttgaacccaga

SEQ ID NO: 372469 - DNA, 20 bp, Artificial Sequence
  chemically synthesized
aatcgcttgaacccagaagg

SEQ ID NO: 372470 - DNA, 20 bp, Artificial Sequence
  chemically synthesized
caccgcaacctccgccttct

SEQ ID NO: 372471 - DNA, 20 bp, Artificial Sequence
  chemically synthesized
tcgcttgaacccagaaggcg

SEQ ID NO: 372472 - DNA, 20 bp, Artificial Sequence
  chemically synthesized
tcaccgcaacctccgccttc

SEQ ID NO: 372473 - DNA, 20 bp, Artificial Sequence
  chemically synthesized
cgcttgaacccagaaggcgg

SEQ ID NO: 372474 - DNA, 20 bp, Artificial Sequence
  chemically synthesized
aacccagaaggcggaggttg

SEQ ID NO: 372475 - DNA, 20 bp, Artificial Sequence
  chemically synthesized
cagaaggcggaggttgcggt

SEQ ID NO: 372476 - DNA, 20 bp, Artificial Sequence
  chemically synthesized
ggagtgcgatggcgcaatat

SEQ ID NO: 372477 - DNA, 20 bp, Artificial Sequence
  chemically synthesized
ttgcccaggctggagtgcga

SEQ ID NO: 372478 - DNA, 20 bp, Artificial Sequence
  chemically synthesized
gatattgcgccatcgcactc

SEQ ID NO: 372479 - DNA, 20 bp, Artificial Sequence
  chemically synthesized
tgcgccatcgcactccagcc

SEQ ID NO: 372480 - DNA, 20 bp, Artificial Sequence
  chemically synthesized
gcgccatcgcactccagcct

SEQ ID NO: 372481 - DNA, 20 bp, Artificial Sequence
  chemically synthesized
tgctgtcgttgcccaggctg

SEQ ID NO: 372482 - DNA, 20 bp, Artificial Sequence
  chemically synthesized
tttgctgtcgttgcccaggc

SEQ ID NO: 372483 - DNA, 20 bp, Artificial Sequence
  chemically synthesized
gagttttgctgtcgttgccc

SEQ ID NO: 372484 - DNA, 20 bp, Artificial Sequence
  chemically synthesized
ggagttttgctgtcgttgcc

SEQ ID NO: 372485 - DNA, 20 bp, Artificial Sequence
  chemically synthesized
cactccagcctgggcaacga

SEQ ID NO: 372486 - DNA, 20 bp, Artificial Sequence
  chemically synthesized
tttttcttttttttgagatg

SEQ ID NO: 372487 - DNA, 20 bp, Artificial Sequence
  chemically synthesized
tctttttcttttttttgaga

SEQ ID NO: 372488 - DNA, 20 bp, Artificial Sequence
  chemically synthesized
caaaactccatctcaaaaaa

SEQ ID NO: 372489 - DNA, 20 bp, Artificial Sequence
  chemically synthesized
tttttctttttctttttttt

SEQ ID NO: 372490 - DNA, 20 bp, Artificial Sequence
  chemically synthesized
tccatctcaaaaaaaagaaa

SEQ ID NO: 372491 - DNA, 20 bp, Artificial Sequence
  chemically synthesized
aaaagaaaaagaaaaaaact

SEQ ID NO: 372492 - DNA, 20 bp, Artificial Sequence
  chemically synthesized
tacaggtttgaaagaaatct

SEQ ID NO: 372493 - DNA, 20 bp, Artificial Sequence
  chemically synthesized
tcatcagattacaggtttga

SEQ ID NO: 372494 - DNA, 20 bp, Artificial Sequence
  chemically synthesized
tacaatcatcatcagattac

SEQ ID NO: 372495 - DNA, 20 bp, Artificial Sequence
  chemically synthesized
atacaatcatcatcagatta

SEQ ID NO: 372496 - DNA, 20 bp, Artificial Sequence
  chemically synthesized
gaattgcatacaatcatcat

SEQ ID NO: 372497 - DNA, 20 bp, Artificial Sequence
  chemically synthesized
tgtatgcaattctttttaaa

SEQ ID NO: 372498 - DNA, 20 bp, Artificial Sequence
  chemically synthesized
aagatttttagctttttaaa

SEQ ID NO: 372499 - DNA, 20 bp, Artificial Sequence
  chemically synthesized
ttttaaaaagctaaaaatct

SEQ ID NO: 372500 - DNA, 20 bp, Artificial Sequence
  chemically synthesized
ataactcaatctaagatttt

SEQ ID NO: 372501 - DNA, 20 bp, Artificial Sequence
  chemically synthesized
aaagctaaaaatcttagatt

SEQ ID NO: 372502 - DNA, 20 bp, Artificial Sequence
  chemically synthesized
attcataaataactcaatct

SEQ ID NO: 372503 - DNA, 20 bp, Artificial Sequence
  chemically synthesized
gagttatttatgaatacaaa

SEQ ID NO: 372504 - DNA, 20 bp, Artificial Sequence
  chemically synthesized
agttatttatgaatacaaac

SEQ ID NO: 372505 - DNA, 20 bp, Artificial Sequence
  chemically synthesized
tatgaatacaaacaggtatg

SEQ ID NO: 372506 - DNA, 20 bp, Artificial Sequence
  chemically synthesized
gaatacaaacaggtatgaag

SEQ ID NO: 372507 - DNA, 20 bp, Artificial Sequence
  chemically synthesized
ggtatgaagcagaaaccacg

SEQ ID NO: 372508 - DNA, 20 bp, Artificial Sequence
  chemically synthesized
gtatgaagcagaaaccacga

SEQ ID NO: 372509 - DNA, 20 bp, Artificial Sequence
  chemically synthesized
tgaagcagaaaccacgaagg

SEQ ID NO: 372510 - DNA, 20 bp, Artificial Sequence
  chemically synthesized
ttttttgccagctgccttcg

SEQ ID NO: 372511 - DNA, 20 bp, Artificial Sequence
  chemically synthesized
gcagaaaccacgaaggcagc

SEQ ID NO: 372512 - DNA, 20 bp, Artificial Sequence
  chemically synthesized
cttactctggtattttttgc

SEQ ID NO: 372513 - DNA, 20 bp, Artificial Sequence
  chemically synthesized
aggcagctggcaaaaaatac

SEQ ID NO: 372514 - DNA, 20 bp, Artificial Sequence
  chemically synthesized
gcagctggcaaaaaatacca

SEQ ID NO: 372515 - DNA, 20 bp, Artificial Sequence
  chemically synthesized
ctggcaaaaaataccagagt

SEQ ID NO: 372516 - DNA, 20 bp, Artificial Sequence
  chemically synthesized
gttcctagctgtacttactc

SEQ ID NO: 372517 - DNA, 20 bp, Artificial Sequence
  chemically synthesized
aaaaaataccagagtaagta

SEQ ID NO: 372518 - DNA, 20 bp, Artificial Sequence
  chemically synthesized
aataccagagtaagtacagc

SEQ ID NO: 372519 - DNA, 20 bp, Artificial Sequence
  chemically synthesized
ataccagagtaagtacagct

SEQ ID NO: 372520 - DNA, 20 bp, Artificial Sequence
  chemically synthesized
gtaagtacagctaggaactg

SEQ ID NO: 372521 - DNA, 20 bp, Artificial Sequence
  chemically synthesized
acactggcatctacagttcc

SEQ ID NO: 372522 - DNA, 20 bp, Artificial Sequence
  chemically synthesized
cagctaggaactgtagatgc

SEQ ID NO: 372523 - DNA, 20 bp, Artificial Sequence
  chemically synthesized
tagactgacactggcatcta

SEQ ID NO: 372524 - DNA, 20 bp, Artificial Sequence
  chemically synthesized
ggaactgtagatgccagtgt

SEQ ID NO: 372525 - DNA, 20 bp, Artificial Sequence
  chemically synthesized
tcaaagatgtagactgacac

SEQ ID NO: 372526 - DNA, 20 bp, Artificial Sequence
  chemically synthesized
tttcatacagttcaaagatg

SEQ ID NO: 372527 - DNA, 20 bp, Artificial Sequence
  chemically synthesized
aggctctttcatacagttca

SEQ ID NO: 372528 - DNA, 20 bp, Artificial Sequence
  chemically synthesized
tacatctttgaactgtatga

SEQ ID NO: 372529 - DNA, 20 bp, Artificial Sequence
  chemically synthesized
catctttgaactgtatgaaa

SEQ ID NO: 372530 - DNA, 20 bp, Artificial Sequence
  chemically synthesized
gtccaataggctctttcata

SEQ ID NO: 372531 - DNA, 20 bp, Artificial Sequence
  chemically synthesized
aactgtatgaaagagcctat

SEQ ID NO: 372532 - DNA, 20 bp, Artificial Sequence
  chemically synthesized
ataaatacttagtgtccaat

SEQ ID NO: 372533 - DNA, 20 bp, Artificial Sequence
  chemically synthesized
gataaatacttagtgtccaa

SEQ ID NO: 372534 - DNA, 20 bp, Artificial Sequence
  chemically synthesized
gaaagagcctattggacact

SEQ ID NO: 372535 - DNA, 20 bp, Artificial Sequence
  chemically synthesized
gaaagaatttgataaatact

SEQ ID NO: 372536 - DNA, 20 bp, Artificial Sequence
  chemically synthesized
tagaactagcttcaaagaga

SEQ ID NO: 372537 - DNA, 20 bp, Artificial Sequence
  chemically synthesized
tatcaaattctttctctttg

SEQ ID NO: 372538 - DNA, 20 bp, Artificial Sequence
  chemically synthesized
tttttagaactagcttcaaa

SEQ ID NO: 372539 - DNA, 20 bp, Artificial Sequence
  chemically synthesized
aaattctttctctttgaagc

SEQ ID NO: 372540 - DNA, 20 bp, Artificial Sequence
  chemically synthesized
tgtttttagaactagcttca

SEQ ID NO: 372541 - DNA, 20 bp, Artificial Sequence
  chemically synthesized
gtttctattgtttttagaac

SEQ ID NO: 372542 - DNA, 20 bp, Artificial Sequence
  chemically synthesized
gaagctagttctaaaaacaa

SEQ ID NO: 372543 - DNA, 20 bp, Artificial Sequence
  chemically synthesized
ccttttgtttctattgtttt

SEQ ID NO: 372544 - DNA, 20 bp, Artificial Sequence
  chemically synthesized
tctaaaaacaatagaaacaa

SEQ ID NO: 372545 - DNA, 20 bp, Artificial Sequence
  chemically synthesized
ctaaaaacaatagaaacaaa

SEQ ID NO: 372546 - DNA, 20 bp, Artificial Sequence
  chemically synthesized
aatagaaacaaaaggaattt

SEQ ID NO: 372547 - DNA, 20 bp, Artificial Sequence
  chemically synthesized
gtagccaaggtaaagcaagt

SEQ ID NO: 372548 - DNA, 20 bp, Artificial Sequence
  chemically synthesized
ttctgtagccaaggtaaagc

SEQ ID NO: 372549 - DNA, 20 bp, Artificial Sequence
  chemically synthesized
ttagctaacttgctttacct

SEQ ID NO: 372550 - DNA, 20 bp, Artificial Sequence
  chemically synthesized
aatattctgtagccaaggta

SEQ ID NO: 372551 - DNA, 20 bp, Artificial Sequence
  chemically synthesized
aacttgctttaccttggcta

SEQ ID NO: 372552 - DNA, 20 bp, Artificial Sequence
  chemically synthesized
tttaaaatattctgtagcca

SEQ ID NO: 372553 - DNA, 20 bp, Artificial Sequence
  chemically synthesized
atttaaaatattctgtagcc

SEQ ID NO: 372554 - DNA, 20 bp, Artificial Sequence
  chemically synthesized
gttagatttaaaatattctg

SEQ ID NO: 372555 - DNA, 20 bp, Artificial Sequence
  chemically synthesized
ttaagaactatttggaatgt

SEQ ID NO: 372556 - DNA, 20 bp, Artificial Sequence
  chemically synthesized
tttaaatctaacattccaaa

SEQ ID NO: 372557 - DNA, 20 bp, Artificial Sequence
  chemically synthesized
agaatactttaagaactatt

SEQ ID NO: 372558 - DNA, 20 bp, Artificial Sequence
  chemically synthesized
aacattccaaatagttctta

SEQ ID NO: 372559 - DNA, 20 bp, Artificial Sequence
  chemically synthesized
aaaccagttcagaatacttt

SEQ ID NO: 372560 - DNA, 20 bp, Artificial Sequence
  chemically synthesized
gttcttaaagtattctgaac

SEQ ID NO: 372561 - DNA, 20 bp, Artificial Sequence
  chemically synthesized
ttcacagaaagaaaccagtt

SEQ ID NO: 372562 - DNA, 20 bp, Artificial Sequence
  chemically synthesized
ttgtcttcacagaaagaaac

SEQ ID NO: 372563 - DNA, 20 bp, Artificial Sequence
  chemically synthesized
tgaactggtttctttctgtg

SEQ ID NO: 372564 - DNA, 20 bp, Artificial Sequence
  chemically synthesized
atcataattgtcttcacaga

SEQ ID NO: 372565 - DNA, 20 bp, Artificial Sequence
  chemically synthesized
agaaatcataattgtcttca

SEQ ID NO: 372566 - DNA, 20 bp, Artificial Sequence
  chemically synthesized
tgaagacaattatgatttct

SEQ ID NO: 372567 - DNA, 20 bp, Artificial Sequence
  chemically synthesized
tatacaattattcatagact

SEQ ID NO: 372568 - DNA, 20 bp, Artificial Sequence
  chemically synthesized
cgtaagtatacaattattca

SEQ ID NO: 372569 - DNA, 20 bp, Artificial Sequence
  chemically synthesized
atactgtcctaacattgcgt

SEQ ID NO: 372570 - DNA, 20 bp, Artificial Sequence
  chemically synthesized
attgtatacttacgcaatgt

SEQ ID NO: 372571 - DNA, 20 bp, Artificial Sequence
  chemically synthesized
ttgtatacttacgcaatgtt

SEQ ID NO: 372572 - DNA, 20 bp, Artificial Sequence
  chemically synthesized
atacttacgcaatgttagga

SEQ ID NO: 372573 - DNA, 20 bp, Artificial Sequence
  chemically synthesized
ttgaacatcaaatcatttta

SEQ ID NO: 372574 - DNA, 20 bp, Artificial Sequence
  chemically synthesized
tacttttccaagattaatag

SEQ ID NO: 372575 - DNA, 20 bp, Artificial Sequence
  chemically synthesized
aatatttctactattaatct

SEQ ID NO: 372576 - DNA, 20 bp, Artificial Sequence
  chemically synthesized
ttttacttttccaagattaa

SEQ ID NO: 372577 - DNA, 20 bp, Artificial Sequence
  chemically synthesized
ttctactattaatcttggaa

SEQ ID NO: 372578 - DNA, 20 bp, Artificial Sequence
  chemically synthesized
aagatattttttacttttcc

SEQ ID NO: 372579 - DNA, 20 bp, Artificial Sequence
  chemically synthesized
aagtaaaaaatatcttctat

SEQ ID NO: 372580 - DNA, 20 bp, Artificial Sequence
  chemically synthesized
gtaaaaaatatcttctatca

SEQ ID NO: 372581 - DNA, 20 bp, Artificial Sequence
  chemically synthesized
taaaaaatatcttctatcag

SEQ ID NO: 372582 - DNA, 20 bp, Artificial Sequence
  chemically synthesized
tgttagatttcctctgatag

SEQ ID NO: 372583 - DNA, 20 bp, Artificial Sequence
  chemically synthesized
gagtgttagatttcctctga

SEQ ID NO: 372584 - DNA, 20 bp, Artificial Sequence
  chemically synthesized
taacttatttttgagagtgt

SEQ ID NO: 372585 - DNA, 20 bp, Artificial Sequence
  chemically synthesized
catatttaacttatttttga

SEQ ID NO: 372586 - DNA, 20 bp, Artificial Sequence
  chemically synthesized
aatctaacactctcaaaaat

SEQ ID NO: 372587 - DNA, 20 bp, Artificial Sequence
  chemically synthesized
atcatatttaacttattttt

SEQ ID NO: 372588 - DNA, 20 bp, Artificial Sequence
  chemically synthesized
ataagttaaatatgatacaa

SEQ ID NO: 372589 - DNA, 20 bp, Artificial Sequence
  chemically synthesized
agttaaatatgatacaatgg

SEQ ID NO: 372590 - DNA, 20 bp, Artificial Sequence
  chemically synthesized
aatggcagttctacaacatc

SEQ ID NO: 372591 - DNA, 20 bp, Artificial Sequence
  chemically synthesized
tattgaatatctggatgttg

SEQ ID NO: 372592 - DNA, 20 bp, Artificial Sequence
  chemically synthesized
gctgcctactattgaatatc

SEQ ID NO: 372593 - DNA, 20 bp, Artificial Sequence
  chemically synthesized
tacaacatccagatattcaa

SEQ ID NO: 372594 - DNA, 20 bp, Artificial Sequence
  chemically synthesized
aacatccagatattcaatag

SEQ ID NO: 372595 - DNA, 20 bp, Artificial Sequence
  chemically synthesized
acatccagatattcaatagt

SEQ ID NO: 372596 - DNA, 20 bp, Artificial Sequence
  chemically synthesized
tccagatattcaatagtagg

SEQ ID NO: 372597 - DNA, 20 bp, Artificial Sequence
  chemically synthesized
tcaaagatgtgaattatggc

SEQ ID NO: 372598 - DNA, 20 bp, Artificial Sequence
  chemically synthesized
tttttcaaagatgtgaatta

SEQ ID NO: 372599 - DNA, 20 bp, Artificial Sequence
  chemically synthesized
ttgccctcttgaatttttca

SEQ ID NO: 372600 - DNA, 20 bp, Artificial Sequence
  chemically synthesized
ttcacatctttgaaaaattc

SEQ ID NO: 372601 - DNA, 20 bp, Artificial Sequence
  chemically synthesized
cacatctttgaaaaattcaa

SEQ ID NO: 372602 - DNA, 20 bp, Artificial Sequence
  chemically synthesized
acatctttgaaaaattcaag

SEQ ID NO: 372603 - DNA, 20 bp, Artificial Sequence
  chemically synthesized
catctttgaaaaattcaaga

SEQ ID NO: 372604 - DNA, 20 bp, Artificial Sequence
  chemically synthesized
ctccttcacattggcaaaat

SEQ ID NO: 372605 - DNA, 20 bp, Artificial Sequence
  chemically synthesized
aaactaattttgccaatgtg

SEQ ID NO: 372606 - DNA, 20 bp, Artificial Sequence
  chemically synthesized
aactaattttgccaatgtga

SEQ ID NO: 372607 - DNA, 20 bp, Artificial Sequence
  chemically synthesized
ttcttacagctccttcacat

SEQ ID NO: 372608 - DNA, 20 bp, Artificial Sequence
  chemically synthesized
ctaattttgccaatgtgaag

SEQ ID NO: 372609 - DNA, 20 bp, Artificial Sequence
  chemically synthesized
tgccaatgtgaaggagctgt

SEQ ID NO: 372610 - DNA, 20 bp, Artificial Sequence
  chemically synthesized
ttaaagcataatttttctta

SEQ ID NO: 372611 - DNA, 20 bp, Artificial Sequence
  chemically synthesized
taagaaaaattatgctttaa

SEQ ID NO: 372612 - DNA, 20 bp, Artificial Sequence
  chemically synthesized
aacatcttatatttccatta

SEQ ID NO: 372613 - DNA, 20 bp, Artificial Sequence
  chemically synthesized
ttatgctttaatggaaatat

SEQ ID NO: 372614 - DNA, 20 bp, Artificial Sequence
  chemically synthesized
taagatgtttttgttgcctt

SEQ ID NO: 372615 - DNA, 20 bp, Artificial Sequence
  chemically synthesized
ggattaaaaagcaatactta

SEQ ID NO: 372616 - DNA, 20 bp, Artificial Sequence
  chemically synthesized
aggattaaaaagcaatactt

SEQ ID NO: 372617 - DNA, 20 bp, Artificial Sequence
  chemically synthesized
actgaatttcaaggattaaa

SEQ ID NO: 372618 - DNA, 20 bp, Artificial Sequence
  chemically synthesized
gctttttaatccttgaaatt

SEQ ID NO: 372619 - DNA, 20 bp, Artificial Sequence
  chemically synthesized
aagtatttgactgaatttca

SEQ ID NO: 372620 - DNA, 20 bp, Artificial Sequence
  chemically synthesized
taagtatttgactgaatttc

SEQ ID NO: 372621 - DNA, 20 bp, Artificial Sequence
  chemically synthesized
atatatggaaaataattatt

SEQ ID NO: 372622 - DNA, 20 bp, Artificial Sequence
  chemically synthesized
aatatgtctaataagatata

SEQ ID NO: 372623 - DNA, 20 bp, Artificial Sequence
  chemically synthesized
ttattttccatatatcttat

SEQ ID NO: 372624 - DNA, 20 bp, Artificial Sequence
  chemically synthesized
tgagtgctaatatgtctaat

SEQ ID NO: 372625 - DNA, 20 bp, Artificial Sequence
  chemically synthesized
atatatcttattagacatat

SEQ ID NO: 372626 - DNA, 20 bp, Artificial Sequence
  chemically synthesized
agacatattagcactcatgc

SEQ ID NO: 372627 - DNA, 20 bp, Artificial Sequence
  chemically synthesized
ataaaatctctaaccagcat

SEQ ID NO: 372628 - DNA, 20 bp, Artificial Sequence
  chemically synthesized
atattagcactcatgctggt

SEQ ID NO: 372629 - DNA, 20 bp, Artificial Sequence
  chemically synthesized
attagcactcatgctggtta

SEQ ID NO: 372630 - DNA, 20 bp, Artificial Sequence
  chemically synthesized
aggaagataaaatctctaac

SEQ ID NO: 372631 - DNA, 20 bp, Artificial Sequence
  chemically synthesized
gttagagattttatcttcct

SEQ ID NO: 372632 - DNA, 20 bp, Artificial Sequence
  chemically synthesized
tagagattttatcttcctca

SEQ ID NO: 372633 - DNA, 20 bp, Artificial Sequence
  chemically synthesized
gtgttggtatggctctgagg

SEQ ID NO: 372634 - DNA, 20 bp, Artificial Sequence
  chemically synthesized
ggtgtgttggtatggctctg

SEQ ID NO: 372635 - DNA, 20 bp, Artificial Sequence
  chemically synthesized
gggtgtgttggtatggctct

SEQ ID NO: 372636 - DNA, 20 bp, Artificial Sequence
  chemically synthesized
tttagaagggtgtgttggta

SEQ ID NO: 372637 - DNA, 20 bp, Artificial Sequence
  chemically synthesized
tagggtttagaagggtgtgt

SEQ ID NO: 372638 - DNA, 20 bp, Artificial Sequence
  chemically synthesized
ttgcaaagtagggtttagaa

SEQ ID NO: 372639 - DNA, 20 bp, Artificial Sequence
  chemically synthesized
gttgcaaagtagggtttaga

SEQ ID NO: 372640 - DNA, 20 bp, Artificial Sequence
  chemically synthesized
cgttgcaaagtagggtttag

SEQ ID NO: 372641 - DNA, 20 bp, Artificial Sequence
  chemically synthesized
cagcgttgcaaagtagggtt

SEQ ID NO: 372642 - DNA, 20 bp, Artificial Sequence
  chemically synthesized
tgcctcagcgttgcaaagta

SEQ ID NO: 372643 - DNA, 20 bp, Artificial Sequence
  chemically synthesized
ttgcctcagcgttgcaaagt

SEQ ID NO: 372644 - DNA, 20 bp, Artificial Sequence
  chemically synthesized
tttgcctcagcgttgcaaag

SEQ ID NO: 372645 - DNA, 20 bp, Artificial Sequence
  chemically synthesized
gtctttgcctcagcgttgca

SEQ ID NO: 372646 - DNA, 20 bp, Artificial Sequence
  chemically synthesized
aaaccctactttgcaacgct

SEQ ID NO: 372647 - DNA, 20 bp, Artificial Sequence
  chemically synthesized
aaccctactttgcaacgctg

SEQ ID NO: 372648 - DNA, 20 bp, Artificial Sequence
  chemically synthesized
tactttgcaacgctgaggca

SEQ ID NO: 372649 - DNA, 20 bp, Artificial Sequence
  chemically synthesized
ggtttgcagagtctttgcct

SEQ ID NO: 372650 - DNA, 20 bp, Artificial Sequence
  chemically synthesized
agccagaagtacggtttgca

SEQ ID NO: 372651 - DNA, 20 bp, Artificial Sequence
  chemically synthesized
aaagccagaagtacggtttg

SEQ ID NO: 372652 - DNA, 20 bp, Artificial Sequence
  chemically synthesized
gactctgcaaaccgtacttc

SEQ ID NO: 372653 - DNA, 20 bp, Artificial Sequence
  chemically synthesized
agtcagtaaagccagaagta

SEQ ID NO: 372654 - DNA, 20 bp, Artificial Sequence
  chemically synthesized
gagtcagtcagtaaagccag

SEQ ID NO: 372655 - DNA, 20 bp, Artificial Sequence
  chemically synthesized
tgagagtcagtcagtaaagc

SEQ ID NO: 372656 - DNA, 20 bp, Artificial Sequence
  chemically synthesized
attctgagagtcagtcagta

SEQ ID NO: 372657 - DNA, 20 bp, Artificial Sequence
  chemically synthesized
tttagattctgagagtcagt

SEQ ID NO: 372658 - DNA, 20 bp, Artificial Sequence
  chemically synthesized
tggctttactgactgactct

SEQ ID NO: 372659 - DNA, 20 bp, Artificial Sequence
  chemically synthesized
tacctttagattctgagagt

SEQ ID NO: 372660 - DNA, 20 bp, Artificial Sequence
  chemically synthesized
tccctacctttagattctga

SEQ ID NO: 372661 - DNA, 20 bp, Artificial Sequence
  chemically synthesized
gctccctacctttagattct

SEQ ID NO: 372662 - DNA, 20 bp, Artificial Sequence
  chemically synthesized
tgactgactctcagaatcta

SEQ ID NO: 372663 - DNA, 20 bp, Artificial Sequence
  chemically synthesized
gactgactctcagaatctaa

SEQ ID NO: 372664 - DNA, 20 bp, Artificial Sequence
  chemically synthesized
tgactctcagaatctaaagg

SEQ ID NO: 372665 - DNA, 20 bp, Artificial Sequence
  chemically synthesized
gactctcagaatctaaaggt

SEQ ID NO: 372666 - DNA, 20 bp, Artificial Sequence
  chemically synthesized
actctcagaatctaaaggta

SEQ ID NO: 372667 - DNA, 20 bp, Artificial Sequence
  chemically synthesized
cctctattgctccctacctt

SEQ ID NO: 372668 - DNA, 20 bp, Artificial Sequence
  chemically synthesized
tctcagaatctaaaggtagg

SEQ ID NO: 372669 - DNA, 20 bp, Artificial Sequence
  chemically synthesized
aatctaaaggtagggagcaa

SEQ ID NO: 372670 - DNA, 20 bp, Artificial Sequence
  chemically synthesized
tctaaaggtagggagcaata

SEQ ID NO: 372671 - DNA, 20 bp, Artificial Sequence
  chemically synthesized
ctaaaggtagggagcaatag

SEQ ID NO: 372672 - DNA, 20 bp, Artificial Sequence
  chemically synthesized
taaaggtagggagcaataga

SEQ ID NO: 372673 - DNA, 20 bp, Artificial Sequence
  chemically synthesized
aaggtagggagcaatagagg

SEQ ID NO: 372674 - DNA, 20 bp, Artificial Sequence
  chemically synthesized
gagcaatagagggagactgc

SEQ ID NO: 372675 - DNA, 20 bp, Artificial Sequence
  chemically synthesized
atagagggagactgcaagcc

SEQ ID NO: 372676 - DNA, 20 bp, Artificial Sequence
  chemically synthesized
ttgtccctcctccaggcttg

SEQ ID NO: 372677 - DNA, 20 bp, Artificial Sequence
  chemically synthesized
agagggagactgcaagcctg

SEQ ID NO: 372678 - DNA, 20 bp, Artificial Sequence
  chemically synthesized
gagggagactgcaagcctgg

SEQ ID NO: 372679 - DNA, 20 bp, Artificial Sequence
  chemically synthesized
gggagactgcaagcctggag

SEQ ID NO: 372680 - DNA, 20 bp, Artificial Sequence
  chemically synthesized
ggagactgcaagcctggagg

SEQ ID NO: 372681 - DNA, 20 bp, Artificial Sequence
  chemically synthesized
gagactgcaagcctggagga

SEQ ID NO: 372682 - DNA, 20 bp, Artificial Sequence
  chemically synthesized
aaatcctttgtccctcctcc

SEQ ID NO: 372683 - DNA, 20 bp, Artificial Sequence
  chemically synthesized
taaatcctttgtccctcctc

SEQ ID NO: 372684 - DNA, 20 bp, Artificial Sequence
  chemically synthesized
gcaagcctggaggagggaca

SEQ ID NO: 372685 - DNA, 20 bp, Artificial Sequence
  chemically synthesized
caagcctggaggagggacaa

SEQ ID NO: 372686 - DNA, 20 bp, Artificial Sequence
  chemically synthesized
catgggaagctagtgtgaat

SEQ ID NO: 372687 - DNA, 20 bp, Artificial Sequence
  chemically synthesized
aaggatttactcattcacac

SEQ ID NO: 372688 - DNA, 20 bp, Artificial Sequence
  chemically synthesized
acagtaagtgcatgggaagc

SEQ ID NO: 372689 - DNA, 20 bp, Artificial Sequence
  chemically synthesized
aaggacagtaagtgcatggg

SEQ ID NO: 372690 - DNA, 20 bp, Artificial Sequence
  chemically synthesized
aataaggacagtaagtgcat

SEQ ID NO: 372691 - DNA, 20 bp, Artificial Sequence
  chemically synthesized
taataaggacagtaagtgca

SEQ ID NO: 372692 - DNA, 20 bp, Artificial Sequence
  chemically synthesized
gaactgctaataaggacagt

SEQ ID NO: 372693 - DNA, 20 bp, Artificial Sequence
  chemically synthesized
catgcacttactgtccttat

SEQ ID NO: 372694 - DNA, 20 bp, Artificial Sequence
  chemically synthesized
tagggaactgctaataagga

SEQ ID NO: 372695 - DNA, 20 bp, Artificial Sequence
  chemically synthesized
gcacttactgtccttattag

SEQ ID NO: 372696 - DNA, 20 bp, Artificial Sequence
  chemically synthesized
cgtctagggaactgctaata

SEQ ID NO: 372697 - DNA, 20 bp, Artificial Sequence
  chemically synthesized
acgtctagggaactgctaat

SEQ ID NO: 372698 - DNA, 20 bp, Artificial Sequence
  chemically synthesized
tgtccttattagcagttccc

SEQ ID NO: 372699 - DNA, 20 bp, Artificial Sequence
  chemically synthesized
ggcatgaagaagcacgtcta

SEQ ID NO: 372700 - DNA, 20 bp, Artificial Sequence
  chemically synthesized
aggcatgaagaagcacgtct

SEQ ID NO: 372701 - DNA, 20 bp, Artificial Sequence
  chemically synthesized
caggcatgaagaagcacgtc

SEQ ID NO: 372702 - DNA, 20 bp, Artificial Sequence
  chemically synthesized
gtgctgctgcaggcatgaag

SEQ ID NO: 372703 - DNA, 20 bp, Artificial Sequence
  chemically synthesized
aaagtgctgctgcaggcatg

SEQ ID NO: 372704 - DNA, 20 bp, Artificial Sequence
  chemically synthesized
gacgtgcttcttcatgcctg

SEQ ID NO: 372705 - DNA, 20 bp, Artificial Sequence
  chemically synthesized
gtgcttcttcatgcctgcag

SEQ ID NO: 372706 - DNA, 20 bp, Artificial Sequence
  chemically synthesized
ttactaaaaagtgctgctgc

SEQ ID NO: 372707 - DNA, 20 bp, Artificial Sequence
  chemically synthesized
gttactaaaaagtgctgctg

SEQ ID NO: 372708 - DNA, 20 bp, Artificial Sequence
  chemically synthesized
atgcctgcagcagcactttt

SEQ ID NO: 372709 - DNA, 20 bp, Artificial Sequence
  chemically synthesized
ttgaatagcttgttactaaa

SEQ ID NO: 372710 - DNA, 20 bp, Artificial Sequence
  chemically synthesized
cagcagcactttttagtaac

SEQ ID NO: 372711 - DNA, 20 bp, Artificial Sequence
  chemically synthesized
tagtaacaagctattcaatt

SEQ ID NO: 372712 - DNA, 20 bp, Artificial Sequence
  chemically synthesized
aaaacacaagctaaattgaa

SEQ ID NO: 372713 - DNA, 20 bp, Artificial Sequence
  chemically synthesized
gcttttgaaaaacaaaacac

SEQ ID NO: 372714 - DNA, 20 bp, Artificial Sequence
  chemically synthesized
gcttgtgttttgtttttcaa

SEQ ID NO: 372715 - DNA, 20 bp, Artificial Sequence
  chemically synthesized
tgttttgtttttcaaaagct

SEQ ID NO: 372716 - DNA, 20 bp, Artificial Sequence
  chemically synthesized
ttttgtttttcaaaagctta

SEQ ID NO: 372717 - DNA, 20 bp, Artificial Sequence
  chemically synthesized
ttttcaaaagcttagagaat

SEQ ID NO: 372718 - DNA, 20 bp, Artificial Sequence
  chemically synthesized
ggcgatgaagctgattctct

SEQ ID NO: 372719 - DNA, 20 bp, Artificial Sequence
  chemically synthesized
tttctgcagcaggggcgatg

SEQ ID NO: 372720 - DNA, 20 bp, Artificial Sequence
  chemically synthesized
cagcttcatcgcccctgctg

SEQ ID NO: 372721 - DNA, 20 bp, Artificial Sequence
  chemically synthesized
tgctggtatttctgcagcag

SEQ ID NO: 372722 - DNA, 20 bp, Artificial Sequence
  chemically synthesized
gtgctggtatttctgcagca

SEQ ID NO: 372723 - DNA, 20 bp, Artificial Sequence
  chemically synthesized
ggtgctggtatttctgcagc

SEQ ID NO: 372724 - DNA, 20 bp, Artificial Sequence
  chemically synthesized
tggtgctggtatttctgcag

SEQ ID NO: 372725 - DNA, 20 bp, Artificial Sequence
  chemically synthesized
aggtggtgctggtatttctg

SEQ ID NO: 372726 - DNA, 20 bp, Artificial Sequence
  chemically synthesized
cgcccctgctgcagaaatac

SEQ ID NO: 372727 - DNA, 20 bp, Artificial Sequence
  chemically synthesized
ctctgccagccaggtggtgc

SEQ ID NO: 372728 - DNA, 20 bp, Artificial Sequence
  chemically synthesized
gcagaaataccagcaccacc

SEQ ID NO: 372729 - DNA, 20 bp, Artificial Sequence
  chemically synthesized
aaataccagcaccacctggc

SEQ ID NO: 372730 - DNA, 20 bp, Artificial Sequence
  chemically synthesized
ccggacctctgccagccagg

SEQ ID NO: 372731 - DNA, 20 bp, Artificial Sequence
  chemically synthesized
taccagcaccacctggctgg

SEQ ID NO: 372732 - DNA, 20 bp, Artificial Sequence
  chemically synthesized
ggcccggacctctgccagcc

SEQ ID NO: 372733 - DNA, 20 bp, Artificial Sequence
  chemically synthesized
ccagcaccacctggctggca

SEQ ID NO: 372734 - DNA, 20 bp, Artificial Sequence
  chemically synthesized
aggcccggacctctgccagc

SEQ ID NO: 372735 - DNA, 20 bp, Artificial Sequence
  chemically synthesized
cagcaccacctggctggcag

SEQ ID NO: 372736 - DNA, 20 bp, Artificial Sequence
  chemically synthesized
actgaggcccggacctctgc

SEQ ID NO: 372737 - DNA, 20 bp, Artificial Sequence
  chemically synthesized
ccacctggctggcagaggtc

SEQ ID NO: 372738 - DNA, 20 bp, Artificial Sequence
  chemically synthesized
cacctggctggcagaggtcc

SEQ ID NO: 372739 - DNA, 20 bp, Artificial Sequence
  chemically synthesized
gctggcagaggtccgggcct

SEQ ID NO: 372740 - DNA, 20 bp, Artificial Sequence
  chemically synthesized
ggcccaatgggactgaggcc

SEQ ID NO: 372741 - DNA, 20 bp, Artificial Sequence
  chemically synthesized
ggaagggcccaatgggactg

SEQ ID NO: 372742 - DNA, 20 bp, Artificial Sequence
  chemically synthesized
aggaagggcccaatgggact

SEQ ID NO: 372743 - DNA, 20 bp, Artificial Sequence
  chemically synthesized
ggtccgggcctcagtcccat

SEQ ID NO: 372744 - DNA, 20 bp, Artificial Sequence
  chemically synthesized
gtccgggcctcagtcccatt

SEQ ID NO: 372745 - DNA, 20 bp, Artificial Sequence
  chemically synthesized
gatagcaggaagggcccaat

SEQ ID NO: 372746 - DNA, 20 bp, Artificial Sequence
  chemically synthesized
ggatagcaggaagggcccaa

SEQ ID NO: 372747 - DNA, 20 bp, Artificial Sequence
  chemically synthesized
cctctctgggatagcaggaa

SEQ ID NO: 372748 - DNA, 20 bp, Artificial Sequence
  chemically synthesized
ccctctctgggatagcagga

SEQ ID NO: 372749 - DNA, 20 bp, Artificial Sequence
  chemically synthesized
accctctctgggatagcagg

SEQ ID NO: 372750 - DNA, 20 bp, Artificial Sequence
  chemically synthesized
ttgggcccttcctgctatcc

SEQ ID NO: 372751 - DNA, 20 bp, Artificial Sequence
  chemically synthesized
gctaccctctctgggatagc

SEQ ID NO: 372752 - DNA, 20 bp, Artificial Sequence
  chemically synthesized
tgctaccctctctgggatag

SEQ ID NO: 372753 - DNA, 20 bp, Artificial Sequence
  chemically synthesized
gggcccttcctgctatccca

SEQ ID NO: 372754 - DNA, 20 bp, Artificial Sequence
  chemically synthesized
gcccttcctgctatcccaga

SEQ ID NO: 372755 - DNA, 20 bp, Artificial Sequence
  chemically synthesized
tggtgctaccctctctggga

SEQ ID NO: 372756 - DNA, 20 bp, Artificial Sequence
  chemically synthesized
cccttcctgctatcccagag

SEQ ID NO: 372757 - DNA, 20 bp, Artificial Sequence
  chemically synthesized
ccttcctgctatcccagaga

SEQ ID NO: 372758 - DNA, 20 bp, Artificial Sequence
  chemically synthesized
tggctggtgctaccctctct

SEQ ID NO: 372759 - DNA, 20 bp, Artificial Sequence
  chemically synthesized
tcctgctatcccagagaggg

SEQ ID NO: 372760 - DNA, 20 bp, Artificial Sequence
  chemically synthesized
gtggctggtgctaccctctc

SEQ ID NO: 372761 - DNA, 20 bp, Artificial Sequence
  chemically synthesized
tatcccagagagggtagcac

SEQ ID NO: 372762 - DNA, 20 bp, Artificial Sequence
  chemically synthesized
agagggtagcaccagccacg

SEQ ID NO: 372763 - DNA, 20 bp, Artificial Sequence
  chemically synthesized
gtagggggctgctacgtggc

SEQ ID NO: 372764 - DNA, 20 bp, Artificial Sequence
  chemically synthesized
gggtagcaccagccacgtag

SEQ ID NO: 372765 - DNA, 20 bp, Artificial Sequence
  chemically synthesized
ctgagtagggggctgctacg

SEQ ID NO: 372766 - DNA, 20 bp, Artificial Sequence
  chemically synthesized
ccacgtagcagccccctact

SEQ ID NO: 372767 - DNA, 20 bp, Artificial Sequence
  chemically synthesized
tgagctcaggtctgagtagg

SEQ ID NO: 372768 - DNA, 20 bp, Artificial Sequence
  chemically synthesized
ctgagctcaggtctgagtag

SEQ ID NO: 372769 - DNA, 20 bp, Artificial Sequence
  chemically synthesized
gctgagctcaggtctgagta

SEQ ID NO: 372770 - DNA, 20 bp, Artificial Sequence
  chemically synthesized
agctgagctcaggtctgagt

SEQ ID NO: 372771 - DNA, 20 bp, Artificial Sequence
  chemically synthesized
aagctgagctcaggtctgag

SEQ ID NO: 372772 - DNA, 20 bp, Artificial Sequence
  chemically synthesized
gcagccccctactcagacct

SEQ ID NO: 372773 - DNA, 20 bp, Artificial Sequence
  chemically synthesized
acaaagctgagctcaggtct

SEQ ID NO: 372774 - DNA, 20 bp, Artificial Sequence
  chemically synthesized
cccctactcagacctgagct

SEQ ID NO: 372775 - DNA, 20 bp, Artificial Sequence
  chemically synthesized
gactctacaaagctgagctc

SEQ ID NO: 372776 - DNA, 20 bp, Artificial Sequence
  chemically synthesized
ggactctacaaagctgagct

SEQ ID NO: 372777 - DNA, 20 bp, Artificial Sequence
  chemically synthesized
cagacctgagctcagctttg

SEQ ID NO: 372778 - DNA, 20 bp, Artificial Sequence
  chemically synthesized
aggaaggactctacaaagct

SEQ ID NO: 372779 - DNA, 20 bp, Artificial Sequence
  chemically synthesized
gacctgagctcagctttgta

SEQ ID NO: 372780 - DNA, 20 bp, Artificial Sequence
  chemically synthesized
ccttgaggaaggactctaca

SEQ ID NO: 372781 - DNA, 20 bp, Artificial Sequence
  chemically synthesized
gctttgtagagtccttcctc

SEQ ID NO: 372782 - DNA, 20 bp, Artificial Sequence
  chemically synthesized
ctttgtagagtccttcctca

SEQ ID NO: 372783 - DNA, 20 bp, Artificial Sequence
  chemically synthesized
tttgtagagtccttcctcaa

SEQ ID NO: 372784 - DNA, 20 bp, Artificial Sequence
  chemically synthesized
acacttagaacccttgagga

SEQ ID NO: 372785 - DNA, 20 bp, Artificial Sequence
  chemically synthesized
aacacttagaacccttgagg

SEQ ID NO: 372786 - DNA, 20 bp, Artificial Sequence
  chemically synthesized
actaacacttagaacccttg

SEQ ID NO: 372787 - DNA, 20 bp, Artificial Sequence
  chemically synthesized
tactaacacttagaaccctt

SEQ ID NO: 372788 - DNA, 20 bp, Artificial Sequence
  chemically synthesized
agtccttcctcaagggttct

SEQ ID NO: 372789 - DNA, 20 bp, Artificial Sequence
  chemically synthesized
tcctcaagggttctaagtgt

SEQ ID NO: 372790 - DNA, 20 bp, Artificial Sequence
  chemically synthesized
aggttagaattactaacact

SEQ ID NO: 372791 - DNA, 20 bp, Artificial Sequence
  chemically synthesized
gggctgggaagacaaaaggt

SEQ ID NO: 372792 - DNA, 20 bp, Artificial Sequence
  chemically synthesized
cctagggctgggaagacaaa

SEQ ID NO: 372793 - DNA, 20 bp, Artificial Sequence
  chemically synthesized
tcctagggctgggaagacaa

SEQ ID NO: 372794 - DNA, 20 bp, Artificial Sequence
  chemically synthesized
attctaaccttttgtcttcc

SEQ ID NO: 372795 - DNA, 20 bp, Artificial Sequence
  chemically synthesized
ctaccgctcctagggctggg

SEQ ID NO: 372796 - DNA, 20 bp, Artificial Sequence
  chemically synthesized
accttttgtcttcccagccc

SEQ ID NO: 372797 - DNA, 20 bp, Artificial Sequence
  chemically synthesized
ccttttgtcttcccagccct

SEQ ID NO: 372798 - DNA, 20 bp, Artificial Sequence
  chemically synthesized
tagctaccgctcctagggct

SEQ ID NO: 372799 - DNA, 20 bp, Artificial Sequence
  chemically synthesized
ttttgtcttcccagccctag

SEQ ID NO: 372800 - DNA, 20 bp, Artificial Sequence
  chemically synthesized
gtagctaccgctcctagggc

SEQ ID NO: 372801 - DNA, 20 bp, Artificial Sequence
  chemically synthesized
tgtcttcccagccctaggag

SEQ ID NO: 372802 - DNA, 20 bp, Artificial Sequence
  chemically synthesized
caaagtagctaccgctccta

SEQ ID NO: 372803 - DNA, 20 bp, Artificial Sequence
  chemically synthesized
acaaagtagctaccgctcct

SEQ ID NO: 372804 - DNA, 20 bp, Artificial Sequence
  chemically synthesized
cttcccagccctaggagcgg

SEQ ID NO: 372805 - DNA, 20 bp, Artificial Sequence
  chemically synthesized
cacaaagtagctaccgctcc

SEQ ID NO: 372806 - DNA, 20 bp, Artificial Sequence
  chemically synthesized
gaggtagcaagtgcacaaag

SEQ ID NO: 372807 - DNA, 20 bp, Artificial Sequence
  chemically synthesized
gaagaggtagcaagtgcaca

SEQ ID NO: 372808 - DNA, 20 bp, Artificial Sequence
  chemically synthesized
tgacaaagagaagaggtagc

SEQ ID NO: 372809 - DNA, 20 bp, Artificial Sequence
  chemically synthesized
aaattgacaaagagaagagg

SEQ ID NO: 372810 - DNA, 20 bp, Artificial Sequence
  chemically synthesized
gaaaaattgacaaagagaag

SEQ ID NO: 372811 - DNA, 20 bp, Artificial Sequence
  chemically synthesized
tgaaaaattgacaaagagaa

SEQ ID NO: 372812 - DNA, 20 bp, Artificial Sequence
  chemically synthesized
attgaaaaattgacaaagag

SEQ ID NO: 372813 - DNA, 20 bp, Artificial Sequence
  chemically synthesized
ggtattgaaaaattgacaaa

SEQ ID NO: 372814 - DNA, 20 bp, Artificial Sequence
  chemically synthesized
taggtattgaaaaattgaca

SEQ ID NO: 372815 - DNA, 20 bp, Artificial Sequence
  chemically synthesized
tttgtcaatttttcaatacc

SEQ ID NO: 372816 - DNA, 20 bp, Artificial Sequence
  chemically synthesized
aacaagaggaattgggatct

SEQ ID NO: 372817 - DNA, 20 bp, Artificial Sequence
  chemically synthesized
taacaagaggaattgggatc

SEQ ID NO: 372818 - DNA, 20 bp, Artificial Sequence
  chemically synthesized
ataatgtaacaagaggaatt

SEQ ID NO: 372819 - DNA, 20 bp, Artificial Sequence
  chemically synthesized
aataatgtaacaagaggaat

SEQ ID NO: 372820 - DNA, 20 bp, Artificial Sequence
  chemically synthesized
gcagaaaataatgtaacaag

SEQ ID NO: 372821 - DNA, 20 bp, Artificial Sequence
  chemically synthesized
agcagaaaataatgtaacaa

SEQ ID NO: 372822 - DNA, 20 bp, Artificial Sequence
  chemically synthesized
gtagcagaaaataatgtaac

SEQ ID NO: 372823 - DNA, 20 bp, Artificial Sequence
  chemically synthesized
tgttacattattttctgcta

SEQ ID NO: 372824 - DNA, 20 bp, Artificial Sequence
  chemically synthesized
aaccacttgagtgactgtag

SEQ ID NO: 372825 - DNA, 20 bp, Artificial Sequence
  chemically synthesized
agaaaccacttgagtgactg

SEQ ID NO: 372826 - DNA, 20 bp, Artificial Sequence
  chemically synthesized
attttctgctacagtcactc

SEQ ID NO: 372827 - DNA, 20 bp, Artificial Sequence
  chemically synthesized
ttctgctacagtcactcaag

SEQ ID NO: 372828 - DNA, 20 bp, Artificial Sequence
  chemically synthesized
ttaacagacagaaaccactt

SEQ ID NO: 372829 - DNA, 20 bp, Artificial Sequence
  chemically synthesized
agccagggtcagttaacaga

SEQ ID NO: 372830 - DNA, 20 bp, Artificial Sequence
  chemically synthesized
tgtcagccagggtcagttaa

SEQ ID NO: 372831 - DNA, 20 bp, Artificial Sequence
  chemically synthesized
ttctgtctgttaactgaccc

SEQ ID NO: 372832 - DNA, 20 bp, Artificial Sequence
  chemically synthesized
gatgatgtgtcagccagggt

SEQ ID NO: 372833 - DNA, 20 bp, Artificial Sequence
  chemically synthesized
ttgggatgatgtgtcagcca

SEQ ID NO: 372834 - DNA, 20 bp, Artificial Sequence
  chemically synthesized
tttgggatgatgtgtcagcc

SEQ ID NO: 372835 - DNA, 20 bp, Artificial Sequence
  chemically synthesized
gtttgggatgatgtgtcagc

SEQ ID NO: 372836 - DNA, 20 bp, Artificial Sequence
  chemically synthesized
ttgggtttgggatgatgtgt

SEQ ID NO: 372837 - DNA, 20 bp, Artificial Sequence
  chemically synthesized
tagtgacaagttttgggttt

SEQ ID NO: 372838 - DNA, 20 bp, Artificial Sequence
  chemically synthesized
atagtgacaagttttgggtt

SEQ ID NO: 372839 - DNA, 20 bp, Artificial Sequence
  chemically synthesized
ttttgatagtgacaagtttt

SEQ ID NO: 372840 - DNA, 20 bp, Artificial Sequence
  chemically synthesized
attttgatagtgacaagttt

SEQ ID NO: 372841 - DNA, 20 bp, Artificial Sequence
  chemically synthesized
atttccattttgatagtgac

SEQ ID NO: 372842 - DNA, 20 bp, Artificial Sequence
  chemically synthesized
aaaacttgtcactatcaaaa

SEQ ID NO: 372843 - DNA, 20 bp, Artificial Sequence
  chemically synthesized
ttaatgtatttccattttga

SEQ ID NO: 372844 - DNA, 20 bp, Artificial Sequence
  chemically synthesized
tatcaaaatggaaatacatt

SEQ ID NO: 372845 - DNA, 20 bp, Artificial Sequence
  chemically synthesized
aatggaaatacattaagtgt

SEQ ID NO: 372846 - DNA, 20 bp, Artificial Sequence
  chemically synthesized
atggaaatacattaagtgtt

SEQ ID NO: 372847 - DNA, 20 bp, Artificial Sequence
  chemically synthesized
agtgttgggtctgtgtttaa

SEQ ID NO: 372848 - DNA, 20 bp, Artificial Sequence
  chemically synthesized
tcatccttacccattaaaca

SEQ ID NO: 372849 - DNA, 20 bp, Artificial Sequence
  chemically synthesized
gtgttgggtctgtgtttaat

SEQ ID NO: 372850 - DNA, 20 bp, Artificial Sequence
  chemically synthesized
tgggtctgtgtttaatgggt

SEQ ID NO: 372851 - DNA, 20 bp, Artificial Sequence
  chemically synthesized
gggtctgtgtttaatgggta

SEQ ID NO: 372852 - DNA, 20 bp, Artificial Sequence
  chemically synthesized
tatgtggtctttggaagaat

SEQ ID NO: 372853 - DNA, 20 bp, Artificial Sequence
  chemically synthesized
gatgatttctcattcttcca

SEQ ID NO: 372854 - DNA, 20 bp, Artificial Sequence
  chemically synthesized
atataatatgtggtctttgg

SEQ ID NO: 372855 - DNA, 20 bp, Artificial Sequence
  chemically synthesized
ggaatataatatgtggtctt

SEQ ID NO: 372856 - DNA, 20 bp, Artificial Sequence
  chemically synthesized
caatagtggaatataatatg

SEQ ID NO: 372857 - DNA, 20 bp, Artificial Sequence
  chemically synthesized
aaagtagtagaaaacaatag

SEQ ID NO: 372858 - DNA, 20 bp, Artificial Sequence
  chemically synthesized
ataaaagtagtagaaaacaa

SEQ ID NO: 372859 - DNA, 20 bp, Artificial Sequence
  chemically synthesized
tcattattttataaaagtag

SEQ ID NO: 372860 - DNA, 20 bp, Artificial Sequence
  chemically synthesized
tagtcattattttataaaag

SEQ ID NO: 372861 - DNA, 20 bp, Artificial Sequence
  chemically synthesized
atttagtcattattttataa

SEQ ID NO: 372862 - DNA, 20 bp, Artificial Sequence
  chemically synthesized
tataaaataatgactaaata

SEQ ID NO: 372863 - DNA, 20 bp, Artificial Sequence
  chemically synthesized
tactgaagtatatctatatt

SEQ ID NO: 372864 - DNA, 20 bp, Artificial Sequence
  chemically synthesized
gactaaatatagatatactt

SEQ ID NO: 372865 - DNA, 20 bp, Artificial Sequence
  chemically synthesized
atatagatatacttcagtac

SEQ ID NO: 372866 - DNA, 20 bp, Artificial Sequence
  chemically synthesized
tatagatatacttcagtaca

SEQ ID NO: 372867 - DNA, 20 bp, Artificial Sequence
  chemically synthesized
gatcaaatatccttgtactg

SEQ ID NO: 372868 - DNA, 20 bp, Artificial Sequence
  chemically synthesized
tacaaggatatttgatcttc

SEQ ID NO: 372869 - DNA, 20 bp, Artificial Sequence
  chemically synthesized
aggatatttgatcttctgga

SEQ ID NO: 372870 - DNA, 20 bp, Artificial Sequence
  chemically synthesized
atatggatacggctgtccag

SEQ ID NO: 372871 - DNA, 20 bp, Artificial Sequence
  chemically synthesized
cacatatggatacggctgtc

SEQ ID NO: 372872 - DNA, 20 bp, Artificial Sequence
  chemically synthesized
aaagaatgcacatatggata

SEQ ID NO: 372873 - DNA, 20 bp, Artificial Sequence
  chemically synthesized
ctacagaaagaatgcacata

SEQ ID NO: 372874 - DNA, 20 bp, Artificial Sequence
  chemically synthesized
ccatatgtgcattctttctg

SEQ ID NO: 372875 - DNA, 20 bp, Artificial Sequence
  chemically synthesized
aactgagttccatctacaga

SEQ ID NO: 372876 - DNA, 20 bp, Artificial Sequence
  chemically synthesized
atgtgcattctttctgtaga

SEQ ID NO: 372877 - DNA, 20 bp, Artificial Sequence
  chemically synthesized
atacaactgagttccatcta

SEQ ID NO: 372878 - DNA, 20 bp, Artificial Sequence
  chemically synthesized
ttctttctgtagatggaact

SEQ ID NO: 372879 - DNA, 20 bp, Artificial Sequence
  chemically synthesized
tttttgactctaatacaact

SEQ ID NO: 372880 - DNA, 20 bp, Artificial Sequence
  chemically synthesized
tagatggaactcagttgtat

SEQ ID NO: 372881 - DNA, 20 bp, Artificial Sequence
  chemically synthesized
gatggaactcagttgtatta

SEQ ID NO: 372882 - DNA, 20 bp, Artificial Sequence
  chemically synthesized
catggttagaatttttaaaa

SEQ ID NO: 372883 - DNA, 20 bp, Artificial Sequence
  chemically synthesized
ttttttaaaaattctaacca

SEQ ID NO: 372884 - DNA, 20 bp, Artificial Sequence
  chemically synthesized
ttgattcaactgtccatggt

SEQ ID NO: 372885 - DNA, 20 bp, Artificial Sequence
  chemically synthesized
ttaaaaattctaaccatgga

SEQ ID NO: 372886 - DNA, 20 bp, Artificial Sequence
  chemically synthesized
agatttgattcaactgtcca

SEQ ID NO: 372887 - DNA, 20 bp, Artificial Sequence
  chemically synthesized
atggacagttgaatcaaatc

SEQ ID NO: 372888 - DNA, 20 bp, Artificial Sequence
  chemically synthesized
ttgaatcaaatctagccctg

SEQ ID NO: 372889 - DNA, 20 bp, Artificial Sequence
  chemically synthesized
ttgaaaaataactacagggc

SEQ ID NO: 372890 - DNA, 20 bp, Artificial Sequence
  chemically synthesized
gactttgaaaaataactaca

SEQ ID NO: 372891 - DNA, 20 bp, Artificial Sequence
  chemically synthesized
tgactttgaaaaataactac

SEQ ID NO: 372892 - DNA, 20 bp, Artificial Sequence
  chemically synthesized
ttgactttgaaaaataacta

SEQ ID NO: 372893 - DNA, 20 bp, Artificial Sequence
  chemically synthesized
agccctgtagttatttttca

SEQ ID NO: 372894 - DNA, 20 bp, Artificial Sequence
  chemically synthesized
tttttcaaagtcaacatgaa

SEQ ID NO: 372895 - DNA, 20 bp, Artificial Sequence
  chemically synthesized
aatattgtcaaaaatccacc

SEQ ID NO: 372896 - DNA, 20 bp, Artificial Sequence
  chemically synthesized
tggtatagcaattttccagg

SEQ ID NO: 372897 - DNA, 20 bp, Artificial Sequence
  chemically synthesized
ggatggtatagcaattttcc

SEQ ID NO: 372898 - DNA, 20 bp, Artificial Sequence
  chemically synthesized
tggatggtatagcaattttc

SEQ ID NO: 372899 - DNA, 20 bp, Artificial Sequence
  chemically synthesized
tgtgtatagtatggatggta

SEQ ID NO: 372900 - DNA, 20 bp, Artificial Sequence
  chemically synthesized
tattatgtgtatagtatgga

SEQ ID NO: 372901 - DNA, 20 bp, Artificial Sequence
  chemically synthesized
tccatattatgtgtatagta

SEQ ID NO: 372902 - DNA, 20 bp, Artificial Sequence
  chemically synthesized
tctaatccatattatgtgta

SEQ ID NO: 372903 - DNA, 20 bp, Artificial Sequence
  chemically synthesized
tccatactatacacataata

SEQ ID NO: 372904 - DNA, 20 bp, Artificial Sequence
  chemically synthesized
actatacacataatatggat

SEQ ID NO: 372905 - DNA, 20 bp, Artificial Sequence
  chemically synthesized
attagattttaaatactgcg

SEQ ID NO: 372906 - DNA, 20 bp, Artificial Sequence
  chemically synthesized
gtgtgcaggaggtgactacg

SEQ ID NO: 372907 - DNA, 20 bp, Artificial Sequence
  chemically synthesized
cctaaactttggtgtgcagg

SEQ ID NO: 372908 - DNA, 20 bp, Artificial Sequence
  chemically synthesized
tcctaaactttggtgtgcag

SEQ ID NO: 372909 - DNA, 20 bp, Artificial Sequence
  chemically synthesized
cttcctaaactttggtgtgc

SEQ ID NO: 372910 - DNA, 20 bp, Artificial Sequence
  chemically synthesized
tagtcacctcctgcacacca

SEQ ID NO: 372911 - DNA, 20 bp, Artificial Sequence
  chemically synthesized
tcttcctaaactttggtgtg

SEQ ID NO: 372912 - DNA, 20 bp, Artificial Sequence
  chemically synthesized
acctcctgcacaccaaagtt

SEQ ID NO: 372913 - DNA, 20 bp, Artificial Sequence
  chemically synthesized
cctcctgcacaccaaagttt

SEQ ID NO: 372914 - DNA, 20 bp, Artificial Sequence
  chemically synthesized
ctcaatgtcttcctaaactt

SEQ ID NO: 372915 - DNA, 20 bp, Artificial Sequence
  chemically synthesized
cctgcacaccaaagtttagg

SEQ ID NO: 372916 - DNA, 20 bp, Artificial Sequence
  chemically synthesized
ccaaagtttaggaagacatt

SEQ ID NO: 372917 - DNA, 20 bp, Artificial Sequence
  chemically synthesized
aagacattgagctaaactca

SEQ ID NO: 372918 - DNA, 20 bp, Artificial Sequence
  chemically synthesized
ggctttttgctctttgagtt

SEQ ID NO: 372919 - DNA, 20 bp, Artificial Sequence
  chemically synthesized
gacattgagctaaactcaaa

SEQ ID NO: 372920 - DNA, 20 bp, Artificial Sequence
  chemically synthesized
actctggctttttgctcttt

SEQ ID NO: 372921 - DNA, 20 bp, Artificial Sequence
  chemically synthesized
agctaaactcaaagagcaaa

SEQ ID NO: 372922 - DNA, 20 bp, Artificial Sequence
  chemically synthesized
aaactcaaagagcaaaaagc

SEQ ID NO: 372923 - DNA, 20 bp, Artificial Sequence
  chemically synthesized
actcaaagagcaaaaagcca

SEQ ID NO: 372924 - DNA, 20 bp, Artificial Sequence
  chemically synthesized
taagaaagctgcatacactc

SEQ ID NO: 372925 - DNA, 20 bp, Artificial Sequence
  chemically synthesized
gcaaaaagccagagtgtatg

SEQ ID NO: 372926 - DNA, 20 bp, Artificial Sequence
  chemically synthesized
ggaagaattgcatgttaaga

SEQ ID NO: 372927 - DNA, 20 bp, Artificial Sequence
  chemically synthesized
ggcaggaagaattgcatgtt

SEQ ID NO: 372928 - DNA, 20 bp, Artificial Sequence
  chemically synthesized
gggcttaccttagaggcagg

SEQ ID NO: 372929 - DNA, 20 bp, Artificial Sequence
  chemically synthesized
atgcaattcttcctgcctct

SEQ ID NO: 372930 - DNA, 20 bp, Artificial Sequence
  chemically synthesized
tgcaattcttcctgcctcta

SEQ ID NO: 372931 - DNA, 20 bp, Artificial Sequence
  chemically synthesized
ctagggcttaccttagaggc

SEQ ID NO: 372932 - DNA, 20 bp, Artificial Sequence
  chemically synthesized
tctagggcttaccttagagg

SEQ ID NO: 372933 - DNA, 20 bp, Artificial Sequence
  chemically synthesized
attcttcctgcctctaaggt

SEQ ID NO: 372934 - DNA, 20 bp, Artificial Sequence
  chemically synthesized
caatctagggcttaccttag

SEQ ID NO: 372935 - DNA, 20 bp, Artificial Sequence
  chemically synthesized
acaatctagggcttacctta

SEQ ID NO: 372936 - DNA, 20 bp, Artificial Sequence
  chemically synthesized
aaacaatctagggcttacct

SEQ ID NO: 372937 - DNA, 20 bp, Artificial Sequence
  chemically synthesized
cctgcctctaaggtaagccc

SEQ ID NO: 372938 - DNA, 20 bp, Artificial Sequence
  chemically synthesized
caggtaaagaaaacaatcta

SEQ ID NO: 372939 - DNA, 20 bp, Artificial Sequence
  chemically synthesized
gcaggtaaagaaaacaatct

SEQ ID NO: 372940 - DNA, 20 bp, Artificial Sequence
  chemically synthesized
tgcaggtaaagaaaacaatc

SEQ ID NO: 372941 - DNA, 20 bp, Artificial Sequence
  chemically synthesized
tagattgttttctttacctg

SEQ ID NO: 372942 - DNA, 20 bp, Artificial Sequence
  chemically synthesized
agattgttttctttacctgc

SEQ ID NO: 372943 - DNA, 20 bp, Artificial Sequence
  chemically synthesized
tgcagaaagccctgcaggta

SEQ ID NO: 372944 - DNA, 20 bp, Artificial Sequence
  chemically synthesized
gattgttttctttacctgca

SEQ ID NO: 372945 - DNA, 20 bp, Artificial Sequence
  chemically synthesized
catactgcagaaagccctgc

SEQ ID NO: 372946 - DNA, 20 bp, Artificial Sequence
  chemically synthesized
acatactgcagaaagccctg

SEQ ID NO: 372947 - DNA, 20 bp, Artificial Sequence
  chemically synthesized
tttacctgcagggctttctg

SEQ ID NO: 372948 - DNA, 20 bp, Artificial Sequence
  chemically synthesized
ctattaagacatactgcaga

SEQ ID NO: 372949 - DNA, 20 bp, Artificial Sequence
  chemically synthesized
tttactattaagacatactg

SEQ ID NO: 372950 - DNA, 20 bp, Artificial Sequence
  chemically synthesized
ctttctgcagtatgtcttaa

SEQ ID NO: 372951 - DNA, 20 bp, Artificial Sequence
  chemically synthesized
tgcagtatgtcttaatagta

SEQ ID NO: 372952 - DNA, 20 bp, Artificial Sequence
  chemically synthesized
gctggattatctttactatt

SEQ ID NO: 372953 - DNA, 20 bp, Artificial Sequence
  chemically synthesized
tcttaatagtaaagataatc

SEQ ID NO: 372954 - DNA, 20 bp, Artificial Sequence
  chemically synthesized
atagtaaagataatccagca

SEQ ID NO: 372955 - DNA, 20 bp, Artificial Sequence
  chemically synthesized
gcatattacaaatgctgtgc

SEQ ID NO: 372956 - DNA, 20 bp, Artificial Sequence
  chemically synthesized
tttgtaatatgcttgtgatc

SEQ ID NO: 372957 - DNA, 20 bp, Artificial Sequence
  chemically synthesized
ttccatccattcttgatcac

SEQ ID NO: 372958 - DNA, 20 bp, Artificial Sequence
  chemically synthesized
aatatgcttgtgatcaagaa

SEQ ID NO: 372959 - DNA, 20 bp, Artificial Sequence
  chemically synthesized
tgcttgtgatcaagaatgga

SEQ ID NO: 372960 - DNA, 20 bp, Artificial Sequence
  chemically synthesized
tgatcaagaatggatggaaa

SEQ ID NO: 372961 - DNA, 20 bp, Artificial Sequence
  chemically synthesized
gatcaagaatggatggaaac

SEQ ID NO: 372962 - DNA, 20 bp, Artificial Sequence
  chemically synthesized
aagaatggatggaaacagga

SEQ ID NO: 372963 - DNA, 20 bp, Artificial Sequence
  chemically synthesized
tggatggaaacaggatggta

SEQ ID NO: 372964 - DNA, 20 bp, Artificial Sequence
  chemically synthesized
ggatggtatagtcctaactt

SEQ ID NO: 372965 - DNA, 20 bp, Artificial Sequence
  chemically synthesized
ttaatttacatgcttaagtt

SEQ ID NO: 372966 - DNA, 20 bp, Artificial Sequence
  chemically synthesized
attaatttacatgcttaagt

SEQ ID NO: 372967 - DNA, 20 bp, Artificial Sequence
  chemically synthesized
tgcaattaatttacatgctt

SEQ ID NO: 372968 - DNA, 20 bp, Artificial Sequence
  chemically synthesized
ttaattgcatctcataatgt

SEQ ID NO: 372969 - DNA, 20 bp, Artificial Sequence
  chemically synthesized
tgtggattggctgacattat

SEQ ID NO: 372970 - DNA, 20 bp, Artificial Sequence
  chemically synthesized
gtatgactaagagtgtggat

SEQ ID NO: 372971 - DNA, 20 bp, Artificial Sequence
  chemically synthesized
tgtcagccaatccacactct

SEQ ID NO: 372972 - DNA, 20 bp, Artificial Sequence
  chemically synthesized
aatctgtatgactaagagtg

SEQ ID NO: 372973 - DNA, 20 bp, Artificial Sequence
  chemically synthesized
tctttaatctgtatgactaa

SEQ ID NO: 372974 - DNA, 20 bp, Artificial Sequence
  chemically synthesized
aatccacactcttagtcata

SEQ ID NO: 372975 - DNA, 20 bp, Artificial Sequence
  chemically synthesized
gttctttaatctgtatgact

SEQ ID NO: 372976 - DNA, 20 bp, Artificial Sequence
  chemically synthesized
actcttagtcatacagatta

SEQ ID NO: 372977 - DNA, 20 bp, Artificial Sequence
  chemically synthesized
catacagattaaagaaccaa

SEQ ID NO: 372978 - DNA, 20 bp, Artificial Sequence
  chemically synthesized
atacagattaaagaaccaaa

SEQ ID NO: 372979 - DNA, 20 bp, Artificial Sequence
  chemically synthesized
tgatttccttgggttccttt

SEQ ID NO: 372980 - DNA, 20 bp, Artificial Sequence
  chemically synthesized
taaagaaccaaaaggaaccc

SEQ ID NO: 372981 - DNA, 20 bp, Artificial Sequence
  chemically synthesized
aaagaaccaaaaggaaccca

SEQ ID NO: 372982 - DNA, 20 bp, Artificial Sequence
  chemically synthesized
ttaccctttctgatttcctt

SEQ ID NO: 372983 - DNA, 20 bp, Artificial Sequence
  chemically synthesized
caaaaggaacccaaggaaat

SEQ ID NO: 372984 - DNA, 20 bp, Artificial Sequence
  chemically synthesized
attaccctttctgatttcct

SEQ ID NO: 372985 - DNA, 20 bp, Artificial Sequence
  chemically synthesized
aggaacccaaggaaatcaga

SEQ ID NO: 372986 - DNA, 20 bp, Artificial Sequence
  chemically synthesized
ggaacccaaggaaatcagaa

SEQ ID NO: 372987 - DNA, 20 bp, Artificial Sequence
  chemically synthesized
gaacccaaggaaatcagaaa

SEQ ID NO: 372988 - DNA, 20 bp, Artificial Sequence
  chemically synthesized
tcagaaagggtaattctgct

SEQ ID NO: 372989 - DNA, 20 bp, Artificial Sequence
  chemically synthesized
aaagggtaattctgcttaga

SEQ ID NO: 372990 - DNA, 20 bp, Artificial Sequence
  chemically synthesized
tgtaagagcaactttctaag

SEQ ID NO: 372991 - DNA, 20 bp, Artificial Sequence
  chemically synthesized
aaatgtaagagcaactttct

SEQ ID NO: 372992 - DNA, 20 bp, Artificial Sequence
  chemically synthesized
accatgtatatgaaatgtaa

SEQ ID NO: 372993 - DNA, 20 bp, Artificial Sequence
  chemically synthesized
caaccatgtatatgaaatgt

SEQ ID NO: 372994 - DNA, 20 bp, Artificial Sequence
  chemically synthesized
gctcttacatttcatataca

SEQ ID NO: 372995 - DNA, 20 bp, Artificial Sequence
  chemically synthesized
acatttcatatacatggttg

SEQ ID NO: 372996 - DNA, 20 bp, Artificial Sequence
  chemically synthesized
ttgaagtttgacctcaaaaa

SEQ ID NO: 372997 - DNA, 20 bp, Artificial Sequence
  chemically synthesized
aattgatttttctttttttg

SEQ ID NO: 372998 - DNA, 20 bp, Artificial Sequence
  chemically synthesized
aaattgatttttcttttttt

SEQ ID NO: 372999 - DNA, 20 bp, Artificial Sequence
  chemically synthesized
aaaaaaagaaaaatcaattt

SEQ ID NO: 373000 - DNA, 20 bp, Artificial Sequence
  chemically synthesized
aaaaaagaaaaatcaatttc

SEQ ID NO: 373001 - DNA, 20 bp, Artificial Sequence
  chemically synthesized
aatcaatttcaggcactgaa

SEQ ID NO: 373002 - DNA, 20 bp, Artificial Sequence
  chemically synthesized
taagttacacaattgccgtt

SEQ ID NO: 373003 - DNA, 20 bp, Artificial Sequence
  chemically synthesized
gtattataaatttaataaat

SEQ ID NO: 373004 - DNA, 20 bp, Artificial Sequence
  chemically synthesized
tttataatacaatgaaatct

SEQ ID NO: 373005 - DNA, 20 bp, Artificial Sequence
  chemically synthesized
aatgagagtaatagaaaact

SEQ ID NO: 373006 - DNA, 20 bp, Artificial Sequence
  chemically synthesized
caaataagaaatgagagtaa

SEQ ID NO: 373007 - DNA, 20 bp, Artificial Sequence
  chemically synthesized
agtgtccaaataagaaatga

SEQ ID NO: 373008 - DNA, 20 bp, Artificial Sequence
  chemically synthesized
ccagtgtccaaataagaaat

SEQ ID NO: 373009 - DNA, 20 bp, Artificial Sequence
  chemically synthesized
tattactctcatttcttatt

SEQ ID NO: 373010 - DNA, 20 bp, Artificial Sequence
  chemically synthesized
gcaattaccagtgtccaaat

SEQ ID NO: 373011 - DNA, 20 bp, Artificial Sequence
  chemically synthesized
ctcatttcttatttggacac

SEQ ID NO: 373012 - DNA, 20 bp, Artificial Sequence
  chemically synthesized
cataagaaagaagcaattac

SEQ ID NO: 373013 - DNA, 20 bp, Artificial Sequence
  chemically synthesized
tttaaaaatgcataagaaag

SEQ ID NO: 373014 - DNA, 20 bp, Artificial Sequence
  chemically synthesized
tactttaaaaatgcataaga

SEQ ID NO: 373015 - DNA, 20 bp, Artificial Sequence
  chemically synthesized
tttatactttaaaaatgcat

SEQ ID NO: 373016 - DNA, 20 bp, Artificial Sequence
  chemically synthesized
ttctttcttatgcattttta

SEQ ID NO: 373017 - DNA, 20 bp, Artificial Sequence
  chemically synthesized
taaagtataaatcctgatac

SEQ ID NO: 373018 - DNA, 20 bp, Artificial Sequence
  chemically synthesized
gggtagtgccagctagtatc

SEQ ID NO: 373019 - DNA, 20 bp, Artificial Sequence
  chemically synthesized
ggggtagtgccagctagtat

SEQ ID NO: 373020 - DNA, 20 bp, Artificial Sequence
  chemically synthesized
gtataaatcctgatactagc

SEQ ID NO: 373021 - DNA, 20 bp, Artificial Sequence
  chemically synthesized
aatattggggtagtgccagc

SEQ ID NO: 373022 - DNA, 20 bp, Artificial Sequence
  chemically synthesized
aaaaaatattggggtagtgc

SEQ ID NO: 373023 - DNA, 20 bp, Artificial Sequence
  chemically synthesized
aaagggaaaaaatattgggg

SEQ ID NO: 373024 - DNA, 20 bp, Artificial Sequence
  chemically synthesized
gttaaagggaaaaaatattg

SEQ ID NO: 373025 - DNA, 20 bp, Artificial Sequence
  chemically synthesized
agttaaagggaaaaaatatt

SEQ ID NO: 373026 - DNA, 20 bp, Artificial Sequence
  chemically synthesized
aagttaaagggaaaaaatat

SEQ ID NO: 373027 - DNA, 20 bp, Artificial Sequence
  chemically synthesized
aggaaaattccaaagttaaa

SEQ ID NO: 373028 - DNA, 20 bp, Artificial Sequence
  chemically synthesized
atattttttccctttaactt

SEQ ID NO: 373029 - DNA, 20 bp, Artificial Sequence
  chemically synthesized
aaggaaaattccaaagttaa

SEQ ID NO: 373030 - DNA, 20 bp, Artificial Sequence
  chemically synthesized
aaaggaaaattccaaagtta

SEQ ID NO: 373031 - DNA, 20 bp, Artificial Sequence
  chemically synthesized
tttttaaaaggaaaattcca

SEQ ID NO: 373032 - DNA, 20 bp, Artificial Sequence
  chemically synthesized
tagaatgacaattttttaaa

SEQ ID NO: 373033 - DNA, 20 bp, Artificial Sequence
  chemically synthesized
ctagaatgacaattttttaa

SEQ ID NO: 373034 - DNA, 20 bp, Artificial Sequence
  chemically synthesized
cttttaaaaaattgtcattc

SEQ ID NO: 373035 - DNA, 20 bp, Artificial Sequence
  chemically synthesized
tttaaaaaattgtcattcta

SEQ ID NO: 373036 - DNA, 20 bp, Artificial Sequence
  chemically synthesized
agctggtagcatgttaactc

SEQ ID NO: 373037 - DNA, 20 bp, Artificial Sequence
  chemically synthesized
ttctagagttaacatgctac

SEQ ID NO: 373038 - DNA, 20 bp, Artificial Sequence
  chemically synthesized
tttaatttgtgaaaagctgg

SEQ ID NO: 373039 - DNA, 20 bp, Artificial Sequence
  chemically synthesized
aaatttaatttgtgaaaagc

SEQ ID NO: 373040 - DNA, 20 bp, Artificial Sequence
  chemically synthesized
caacaaatttaatttgtgaa

SEQ ID NO: 373041 - DNA, 20 bp, Artificial Sequence
  chemically synthesized
tcacaaattaaatttgttgt

SEQ ID NO: 373042 - DNA, 20 bp, Artificial Sequence
  chemically synthesized
ttaaatttgttgttagaaaa

SEQ ID NO: 373043 - DNA, 20 bp, Artificial Sequence
  chemically synthesized
ttgttagaaaatggcttcca

SEQ ID NO: 373044 - DNA, 20 bp, Artificial Sequence
  chemically synthesized
tagaaaatggcttccatggc

SEQ ID NO: 373045 - DNA, 20 bp, Artificial Sequence
  chemically synthesized
gccaccgcgcctggccatgg

SEQ ID NO: 373046 - DNA, 20 bp, Artificial Sequence
  chemically synthesized
agaaaatggcttccatggcc

SEQ ID NO: 373047 - DNA, 20 bp, Artificial Sequence
  chemically synthesized
tgagccaccgcgcctggcca

SEQ ID NO: 373048 - DNA, 20 bp, Artificial Sequence
  chemically synthesized
atggcttccatggccaggcg

SEQ ID NO: 373049 - DNA, 20 bp, Artificial Sequence
  chemically synthesized
gcttccatggccaggcgcgg

SEQ ID NO: 373050 - DNA, 20 bp, Artificial Sequence
  chemically synthesized
caggcgtgagccaccgcgcc

SEQ ID NO: 373051 - DNA, 20 bp, Artificial Sequence
  chemically synthesized
agtgcggggattacaggcgt

SEQ ID NO: 373052 - DNA, 20 bp, Artificial Sequence
  chemically synthesized
tcccaaagtgcggggattac

SEQ ID NO: 373053 - DNA, 20 bp, Artificial Sequence
  chemically synthesized
ctcccaaagtgcggggatta

SEQ ID NO: 373054 - DNA, 20 bp, Artificial Sequence
  chemically synthesized
cgcctgtaatccccgcactt

SEQ ID NO: 373055 - DNA, 20 bp, Artificial Sequence
  chemically synthesized
gctcggcctcccaaagtgcg

SEQ ID NO: 373056 - DNA, 20 bp, Artificial Sequence
  chemically synthesized
gcctgtaatccccgcacttt

SEQ ID NO: 373057 - DNA, 20 bp, Artificial Sequence
  chemically synthesized
ggctcggcctcccaaagtgc

SEQ ID NO: 373058 - DNA, 20 bp, Artificial Sequence
  chemically synthesized
tggctcggcctcccaaagtg

SEQ ID NO: 373059 - DNA, 20 bp, Artificial Sequence
  chemically synthesized
ctgtaatccccgcactttgg

SEQ ID NO: 373060 - DNA, 20 bp, Artificial Sequence
  chemically synthesized
tgtaatccccgcactttggg

SEQ ID NO: 373061 - DNA, 20 bp, Artificial Sequence
  chemically synthesized
ccacctggctcggcctccca

SEQ ID NO: 373062 - DNA, 20 bp, Artificial Sequence
  chemically synthesized
tccccgcactttgggaggcc

SEQ ID NO: 373063 - DNA, 20 bp, Artificial Sequence
  chemically synthesized
cgcactttgggaggccgagc

SEQ ID NO: 373064 - DNA, 20 bp, Artificial Sequence
  chemically synthesized
gcactttgggaggccgagcc

SEQ ID NO: 373065 - DNA, 20 bp, Artificial Sequence
  chemically synthesized
ctttgggaggccgagccagg

SEQ ID NO: 373066 - DNA, 20 bp, Artificial Sequence
  chemically synthesized
acctcgtgatccacctggct

SEQ ID NO: 373067 - DNA, 20 bp, Artificial Sequence
  chemically synthesized
tcctgacctcgtgatccacc

SEQ ID NO: 373068 - DNA, 20 bp, Artificial Sequence
  chemically synthesized
ggccgagccaggtggatcac

SEQ ID NO: 373069 - DNA, 20 bp, Artificial Sequence
  chemically synthesized
gccgagccaggtggatcacg

SEQ ID NO: 373070 - DNA, 20 bp, Artificial Sequence
  chemically synthesized
agccaggtggatcacgaggt

SEQ ID NO: 373071 - DNA, 20 bp, Artificial Sequence
  chemically synthesized
gccaggtggatcacgaggtc

SEQ ID NO: 373072 - DNA, 20 bp, Artificial Sequence
  chemically synthesized
caggtggatcacgaggtcag

SEQ ID NO: 373073 - DNA, 20 bp, Artificial Sequence
  chemically synthesized
gatcacgaggtcaggagttc

SEQ ID NO: 373074 - DNA, 20 bp, Artificial Sequence
  chemically synthesized
tcaggagttcgagaccaccc

SEQ ID NO: 373075 - DNA, 20 bp, Artificial Sequence
  chemically synthesized
tttcaccgtgttagccaggg

SEQ ID NO: 373076 - DNA, 20 bp, Artificial Sequence
  chemically synthesized
gggtttcaccgtgttagcca

SEQ ID NO: 373077 - DNA, 20 bp, Artificial Sequence
  chemically synthesized
ggggtttcaccgtgttagcc

SEQ ID NO: 373078 - DNA, 20 bp, Artificial Sequence
  chemically synthesized
cgagaccaccctggctaaca

SEQ ID NO: 373079 - DNA, 20 bp, Artificial Sequence
  chemically synthesized
cggggtttcaccgtgttagc

SEQ ID NO: 373080 - DNA, 20 bp, Artificial Sequence
  chemically synthesized
gagacggggtttcaccgtgt

SEQ ID NO: 373081 - DNA, 20 bp, Artificial Sequence
  chemically synthesized
ttgtatttttagtagagacg

SEQ ID NO: 373082 - DNA, 20 bp, Artificial Sequence
  chemically synthesized
tttgtatttttagtagagac

SEQ ID NO: 373083 - DNA, 20 bp, Artificial Sequence
  chemically synthesized
ttttgtatttttagtagaga

SEQ ID NO: 373084 - DNA, 20 bp, Artificial Sequence
  chemically synthesized
aattttttgtatttttagta

SEQ ID NO: 373085 - DNA, 20 bp, Artificial Sequence
  chemically synthesized
ctaattttttgtatttttag

SEQ ID NO: 373086 - DNA, 20 bp, Artificial Sequence
  chemically synthesized
cggctaattttttgtatttt

SEQ ID NO: 373087 - DNA, 20 bp, Artificial Sequence
  chemically synthesized
ctactaaaaatacaaaaaat

SEQ ID NO: 373088 - DNA, 20 bp, Artificial Sequence
  chemically synthesized
taaaaatacaaaaaattagc

SEQ ID NO: 373089 - DNA, 20 bp, Artificial Sequence
  chemically synthesized
aaaaatacaaaaaattagcc

SEQ ID NO: 373090 - DNA, 20 bp, Artificial Sequence
  chemically synthesized
tacaaaaaattagccgggca

SEQ ID NO: 373091 - DNA, 20 bp, Artificial Sequence
  chemically synthesized
aaaaaattagccgggcatgg

SEQ ID NO: 373092 - DNA, 20 bp, Artificial Sequence
  chemically synthesized
caggtgcccgccaccatgcc

SEQ ID NO: 373093 - DNA, 20 bp, Artificial Sequence
  chemically synthesized
aaattagccgggcatggtgg

SEQ ID NO: 373094 - DNA, 20 bp, Artificial Sequence
  chemically synthesized
aattagccgggcatggtggc

SEQ ID NO: 373095 - DNA, 20 bp, Artificial Sequence
  chemically synthesized
ggcatggtggcgggcacctg

SEQ ID NO: 373096 - DNA, 20 bp, Artificial Sequence
  chemically synthesized
gtggcgggcacctgtagtcc

SEQ ID NO: 373097 - DNA, 20 bp, Artificial Sequence
  chemically synthesized
tcccaagtagctgggactac

SEQ ID NO: 373098 - DNA, 20 bp, Artificial Sequence
  chemically synthesized
ctcccaagtagctgggacta

SEQ ID NO: 373099 - DNA, 20 bp, Artificial Sequence
  chemically synthesized
cacctgtagtcccagctact

SEQ ID NO: 373100 - DNA, 20 bp, Artificial Sequence
  chemically synthesized
cctcagcctcccaagtagct

SEQ ID NO: 373101 - DNA, 20 bp, Artificial Sequence
  chemically synthesized
acctgtagtcccagctactt

SEQ ID NO: 373102 - DNA, 20 bp, Artificial Sequence
  chemically synthesized
gcctcagcctcccaagtagc

SEQ ID NO: 373103 - DNA, 20 bp, Artificial Sequence
  chemically synthesized
ctgtagtcccagctacttgg

SEQ ID NO: 373104 - DNA, 20 bp, Artificial Sequence
  chemically synthesized
tgtagtcccagctacttggg

SEQ ID NO: 373105 - DNA, 20 bp, Artificial Sequence
  chemically synthesized
tcctgcctcagcctcccaag

SEQ ID NO: 373106 - DNA, 20 bp, Artificial Sequence
  chemically synthesized
ttctcctgcctcagcctccc

SEQ ID NO: 373107 - DNA, 20 bp, Artificial Sequence
  chemically synthesized
tcccagctacttgggaggct

SEQ ID NO: 373108 - DNA, 20 bp, Artificial Sequence
  chemically synthesized
cccagctacttgggaggctg

SEQ ID NO: 373109 - DNA, 20 bp, Artificial Sequence
  chemically synthesized
agctacttgggaggctgagg

SEQ ID NO: 373110 - DNA, 20 bp, Artificial Sequence
  chemically synthesized
gctacttgggaggctgaggc

SEQ ID NO: 373111 - DNA, 20 bp, Artificial Sequence
  chemically synthesized
tacttgggaggctgaggcag

SEQ ID NO: 373112 - DNA, 20 bp, Artificial Sequence
  chemically synthesized
ttcacgccattctcctgcct

SEQ ID NO: 373113 - DNA, 20 bp, Artificial Sequence
  chemically synthesized
gggaggctgaggcaggagaa

SEQ ID NO: 373114 - DNA, 20 bp, Artificial Sequence
  chemically synthesized
gcaggagaatggcgtgaacc

SEQ ID NO: 373115 - DNA, 20 bp, Artificial Sequence
  chemically synthesized
caggagaatggcgtgaaccc

SEQ ID NO: 373116 - DNA, 20 bp, Artificial Sequence
  chemically synthesized
ggagaatggcgtgaacccgg

SEQ ID NO: 373117 - DNA, 20 bp, Artificial Sequence
  chemically synthesized
gagaatggcgtgaacccggg

SEQ ID NO: 373118 - DNA, 20 bp, Artificial Sequence
  chemically synthesized
aatggcgtgaacccgggagg

SEQ ID NO: 373119 - DNA, 20 bp, Artificial Sequence
  chemically synthesized
cactgcaacctctgcctccc

SEQ ID NO: 373120 - DNA, 20 bp, Artificial Sequence
  chemically synthesized
tggcgtgaacccgggaggca

SEQ ID NO: 373121 - DNA, 20 bp, Artificial Sequence
  chemically synthesized
tcactgcaacctctgcctcc

SEQ ID NO: 373122 - DNA, 20 bp, Artificial Sequence
  chemically synthesized
ggcgtgaacccgggaggcag

SEQ ID NO: 373123 - DNA, 20 bp, Artificial Sequence
  chemically synthesized
aacccgggaggcagaggttg

SEQ ID NO: 373124 - DNA, 20 bp, Artificial Sequence
  chemically synthesized
cgggaggcagaggttgcagt

SEQ ID NO: 373125 - DNA, 20 bp, Artificial Sequence
  chemically synthesized
ggcagaggttgcagtgagcc

SEQ ID NO: 373126 - DNA, 20 bp, Artificial Sequence
  chemically synthesized
ggagtgcagtggcatgatct

SEQ ID NO: 373127 - DNA, 20 bp, Artificial Sequence
  chemically synthesized
tcacccaggctggagtgcag

SEQ ID NO: 373128 - DNA, 20 bp, Artificial Sequence
  chemically synthesized
gagatcatgccactgcactc

SEQ ID NO: 373129 - DNA, 20 bp, Artificial Sequence
  chemically synthesized
ctgtcacccaggctggagtg

SEQ ID NO: 373130 - DNA, 20 bp, Artificial Sequence
  chemically synthesized
catgccactgcactccagcc

SEQ ID NO: 373131 - DNA, 20 bp, Artificial Sequence
  chemically synthesized
atgccactgcactccagcct

SEQ ID NO: 373132 - DNA, 20 bp, Artificial Sequence
  chemically synthesized
ttgctctgtcacccaggctg

SEQ ID NO: 373133 - DNA, 20 bp, Artificial Sequence
  chemically synthesized
tcttgctctgtcacccaggc

SEQ ID NO: 373134 - DNA, 20 bp, Artificial Sequence
  chemically synthesized
ctgcactccagcctgggtga

SEQ ID NO: 373135 - DNA, 20 bp, Artificial Sequence
  chemically synthesized
agagtcttgctctgtcaccc

SEQ ID NO: 373136 - DNA, 20 bp, Artificial Sequence
  chemically synthesized
gcactccagcctgggtgaca

SEQ ID NO: 373137 - DNA, 20 bp, Artificial Sequence
  chemically synthesized
cagagtcttgctctgtcacc

SEQ ID NO: 373138 - DNA, 20 bp, Artificial Sequence
  chemically synthesized
tccagcctgggtgacagagc

SEQ ID NO: 373139 - DNA, 20 bp, Artificial Sequence
  chemically synthesized
ttttttttttttttgaaaca

SEQ ID NO: 373140 - DNA, 20 bp, Artificial Sequence
  chemically synthesized
ttttttttttttttttgaaa

SEQ ID NO: 373141 - DNA, 20 bp, Artificial Sequence
  chemically synthesized
aaaaaaaaaaaaaaaaaaaa

SEQ ID NO: 373142 - DNA, 20 bp, Artificial Sequence
  chemically synthesized
ctaaattttggataaaatgg

SEQ ID NO: 373143 - DNA, 20 bp, Artificial Sequence
  chemically synthesized
agcctaaattttggataaaa

SEQ ID NO: 373144 - DNA, 20 bp, Artificial Sequence
  chemically synthesized
cttccattttatccaaaatt

SEQ ID NO: 373145 - DNA, 20 bp, Artificial Sequence
  chemically synthesized
ttccattttatccaaaattt

SEQ ID NO: 373146 - DNA, 20 bp, Artificial Sequence
  chemically synthesized
atttttaagagcctaaattt

SEQ ID NO: 373147 - DNA, 20 bp, Artificial Sequence
  chemically synthesized
gaaaagggatacatttttaa

SEQ ID NO: 373148 - DNA, 20 bp, Artificial Sequence
  chemically synthesized
atgaaaagggatacattttt

SEQ ID NO: 373149 - DNA, 20 bp, Artificial Sequence
  chemically synthesized
tattaagaatatcatgaaaa

SEQ ID NO: 373150 - DNA, 20 bp, Artificial Sequence
  chemically synthesized
atattaagaatatcatgaaa

SEQ ID NO: 373151 - DNA, 20 bp, Artificial Sequence
  chemically synthesized
aatattaagaatatcatgaa

SEQ ID NO: 373152 - DNA, 20 bp, Artificial Sequence
  chemically synthesized
atctacagaacattaatatt

SEQ ID NO: 373153 - DNA, 20 bp, Artificial Sequence
  chemically synthesized
ttcttaatattaatgttctg

SEQ ID NO: 373154 - DNA, 20 bp, Artificial Sequence
  chemically synthesized
gtgcctctatagaacatcta

SEQ ID NO: 373155 - DNA, 20 bp, Artificial Sequence
  chemically synthesized
aatgttctgtagatgttcta

SEQ ID NO: 373156 - DNA, 20 bp, Artificial Sequence
  chemically synthesized
tgttctgtagatgttctata

SEQ ID NO: 373157 - DNA, 20 bp, Artificial Sequence
  chemically synthesized
gttctgtagatgttctatag

SEQ ID NO: 373158 - DNA, 20 bp, Artificial Sequence
  chemically synthesized
gtttatttcaagtgcctcta

SEQ ID NO: 373159 - DNA, 20 bp, Artificial Sequence
  chemically synthesized
agatatgttgagtttatttc

SEQ ID NO: 373160 - DNA, 20 bp, Artificial Sequence
  chemically synthesized
ctgtctttattagatatgtt

SEQ ID NO: 373161 - DNA, 20 bp, Artificial Sequence
  chemically synthesized
taaactcaacatatctaata

SEQ ID NO: 373162 - DNA, 20 bp, Artificial Sequence
  chemically synthesized
ctcaacatatctaataaaga

SEQ ID NO: 373163 - DNA, 20 bp, Artificial Sequence
  chemically synthesized
ctttccatttctgtctttat

SEQ ID NO: 373164 - DNA, 20 bp, Artificial Sequence
  chemically synthesized
atatctaataaagacagaaa

SEQ ID NO: 373165 - DNA, 20 bp, Artificial Sequence
  chemically synthesized
ctaataaagacagaaatgga

SEQ ID NO: 373166 - DNA, 20 bp, Artificial Sequence
  chemically synthesized
taataaagacagaaatggaa

SEQ ID NO: 373167 - DNA, 20 bp, Artificial Sequence
  chemically synthesized
aaagacagaaatggaaaggt

SEQ ID NO: 373168 - DNA, 20 bp, Artificial Sequence
  chemically synthesized
gaaatggaaaggtaagtaca

SEQ ID NO: 373169 - DNA, 20 bp, Artificial Sequence
  chemically synthesized
aaatggaaaggtaagtacat

SEQ ID NO: 373170 - DNA, 20 bp, Artificial Sequence
  chemically synthesized
aggtaagtacataggttttc

SEQ ID NO: 373171 - DNA, 20 bp, Artificial Sequence
  chemically synthesized
gggatagagtacatcaaaac

SEQ ID NO: 373172 - DNA, 20 bp, Artificial Sequence
  chemically synthesized
gaaaaaacaggcaagggata

SEQ ID NO: 373173 - DNA, 20 bp, Artificial Sequence
  chemically synthesized
aagaaaaaacaggcaaggga

SEQ ID NO: 373174 - DNA, 20 bp, Artificial Sequence
  chemically synthesized
ggtcaagaaaaaacaggcaa

SEQ ID NO: 373175 - DNA, 20 bp, Artificial Sequence
  chemically synthesized
tggtcaagaaaaaacaggca

SEQ ID NO: 373176 - DNA, 20 bp, Artificial Sequence
  chemically synthesized
ttggtcaagaaaaaacaggc

SEQ ID NO: 373177 - DNA, 20 bp, Artificial Sequence
  chemically synthesized
tgtattggtcaagaaaaaac

SEQ ID NO: 373178 - DNA, 20 bp, Artificial Sequence
  chemically synthesized
atgtattggtcaagaaaaaa

SEQ ID NO: 373179 - DNA, 20 bp, Artificial Sequence
  chemically synthesized
taacattgtatgtattggtc

SEQ ID NO: 373180 - DNA, 20 bp, Artificial Sequence
  chemically synthesized
ttaagtaacattgtatgtat

SEQ ID NO: 373181 - DNA, 20 bp, Artificial Sequence
  chemically synthesized
atattgaggatggcatgttt

SEQ ID NO: 373182 - DNA, 20 bp, Artificial Sequence
  chemically synthesized
gacattgggaatattgagga

SEQ ID NO: 373183 - DNA, 20 bp, Artificial Sequence
  chemically synthesized
aggggacattgggaatattg

SEQ ID NO: 373184 - DNA, 20 bp, Artificial Sequence
  chemically synthesized
taggggacattgggaatatt

SEQ ID NO: 373185 - DNA, 20 bp, Artificial Sequence
  chemically synthesized
gtcttagtataggggacatt

SEQ ID NO: 373186 - DNA, 20 bp, Artificial Sequence
  chemically synthesized
agtcttagtataggggacat

SEQ ID NO: 373187 - DNA, 20 bp, Artificial Sequence
  chemically synthesized
ttcccaatgtcccctatact

SEQ ID NO: 373188 - DNA, 20 bp, Artificial Sequence
  chemically synthesized
caagactagtcttagtatag

SEQ ID NO: 373189 - DNA, 20 bp, Artificial Sequence
  chemically synthesized
tcaagactagtcttagtata

SEQ ID NO: 373190 - DNA, 20 bp, Artificial Sequence
  chemically synthesized
gtcaagactagtcttagtat

SEQ ID NO: 373191 - DNA, 20 bp, Artificial Sequence
  chemically synthesized
ggtcaagactagtcttagta

SEQ ID NO: 373192 - DNA, 20 bp, Artificial Sequence
  chemically synthesized
aatgtcccctatactaagac

SEQ ID NO: 373193 - DNA, 20 bp, Artificial Sequence
  chemically synthesized
tctggggtcaagactagtct

SEQ ID NO: 373194 - DNA, 20 bp, Artificial Sequence
  chemically synthesized
cttcagtctggggtcaagac

SEQ ID NO: 373195 - DNA, 20 bp, Artificial Sequence
  chemically synthesized
actaagactagtcttgaccc

SEQ ID NO: 373196 - DNA, 20 bp, Artificial Sequence
  chemically synthesized
agttccttcagtctggggtc

SEQ ID NO: 373197 - DNA, 20 bp, Artificial Sequence
  chemically synthesized
ctagtcttgaccccagactg

SEQ ID NO: 373198 - DNA, 20 bp, Artificial Sequence
  chemically synthesized
ctttaagttccttcagtctg

SEQ ID NO: 373199 - DNA, 20 bp, Artificial Sequence
  chemically synthesized
tagtcttgaccccagactga

SEQ ID NO: 373200 - DNA, 20 bp, Artificial Sequence
  chemically synthesized
actttaagttccttcagtct

SEQ ID NO: 373201 - DNA, 20 bp, Artificial Sequence
  chemically synthesized
aactttaagttccttcagtc

SEQ ID NO: 373202 - DNA, 20 bp, Artificial Sequence
  chemically synthesized
gtgggaactttaagttcctt

SEQ ID NO: 373203 - DNA, 20 bp, Artificial Sequence
  chemically synthesized
ccccagactgaaggaactta

SEQ ID NO: 373204 - DNA, 20 bp, Artificial Sequence
  chemically synthesized
tatttcctagtgggaacttt

SEQ ID NO: 373205 - DNA, 20 bp, Artificial Sequence
  chemically synthesized
aaggaacttaaagttcccac

SEQ ID NO: 373206 - DNA, 20 bp, Artificial Sequence
  chemically synthesized
aggaacttaaagttcccact

SEQ ID NO: 373207 - DNA, 20 bp, Artificial Sequence
  chemically synthesized
tcaccctactatttcctagt

SEQ ID NO: 373208 - DNA, 20 bp, Artificial Sequence
  chemically synthesized
gtcaccctactatttcctag

SEQ ID NO: 373209 - DNA, 20 bp, Artificial Sequence
  chemically synthesized
ttaaagttcccactaggaaa

SEQ ID NO: 373210 - DNA, 20 bp, Artificial Sequence
  chemically synthesized
tatgtcaccctactatttcc

SEQ ID NO: 373211 - DNA, 20 bp, Artificial Sequence
  chemically synthesized
aagttcccactaggaaatag

SEQ ID NO: 373212 - DNA, 20 bp, Artificial Sequence
  chemically synthesized
agttcccactaggaaatagt

SEQ ID NO: 373213 - DNA, 20 bp, Artificial Sequence
  chemically synthesized
gttcccactaggaaatagta

SEQ ID NO: 373214 - DNA, 20 bp, Artificial Sequence
  chemically synthesized
taggaaatagtagggtgaca

SEQ ID NO: 373215 - DNA, 20 bp, Artificial Sequence
  chemically synthesized
aggaaatagtagggtgacat

SEQ ID NO: 373216 - DNA, 20 bp, Artificial Sequence
  chemically synthesized
aatagtagggtgacatagga

SEQ ID NO: 373217 - DNA, 20 bp, Artificial Sequence
  chemically synthesized
aggaaagtaactcatccgaa

SEQ ID NO: 373218 - DNA, 20 bp, Artificial Sequence
  chemically synthesized
taaagaaaatcttttcggat

SEQ ID NO: 373219 - DNA, 20 bp, Artificial Sequence
  chemically synthesized
accactaaagaaaatctttt

SEQ ID NO: 373220 - DNA, 20 bp, Artificial Sequence
  chemically synthesized
tcatccgaaaagattttctt

SEQ ID NO: 373221 - DNA, 20 bp, Artificial Sequence
  chemically synthesized
tccgaaaagattttctttag

SEQ ID NO: 373222 - DNA, 20 bp, Artificial Sequence
  chemically synthesized
ttgtataggttgaaccacta

SEQ ID NO: 373223 - DNA, 20 bp, Artificial Sequence
  chemically synthesized
cctgggtggtatgtttgtat

SEQ ID NO: 373224 - DNA, 20 bp, Artificial Sequence
  chemically synthesized
ccctgggtggtatgtttgta

SEQ ID NO: 373225 - DNA, 20 bp, Artificial Sequence
  chemically synthesized
acctatacaaacataccacc

SEQ ID NO: 373226 - DNA, 20 bp, Artificial Sequence
  chemically synthesized
cctatacaaacataccaccc

SEQ ID NO: 373227 - DNA, 20 bp, Artificial Sequence
  chemically synthesized
ctatacaaacataccaccca

SEQ ID NO: 373228 - DNA, 20 bp, Artificial Sequence
  chemically synthesized
ggcctgctgtattccctggg

SEQ ID NO: 373229 - DNA, 20 bp, Artificial Sequence
  chemically synthesized
ctgggcctgctgtattccct

SEQ ID NO: 373230 - DNA, 20 bp, Artificial Sequence
  chemically synthesized
aacataccacccagggaata

SEQ ID NO: 373231 - DNA, 20 bp, Artificial Sequence
  chemically synthesized
actgggcctgctgtattccc

SEQ ID NO: 373232 - DNA, 20 bp, Artificial Sequence
  chemically synthesized
ataccacccagggaatacag

SEQ ID NO: 373233 - DNA, 20 bp, Artificial Sequence
  chemically synthesized
taccacccagggaatacagc

SEQ ID NO: 373234 - DNA, 20 bp, Artificial Sequence
  chemically synthesized
cccagggaatacagcaggcc

SEQ ID NO: 373235 - DNA, 20 bp, Artificial Sequence
  chemically synthesized
atatgtctagaattatcact

SEQ ID NO: 373236 - DNA, 20 bp, Artificial Sequence
  chemically synthesized
aatatgtctagaattatcac

SEQ ID NO: 373237 - DNA, 20 bp, Artificial Sequence
  chemically synthesized
agcaggcccagtgataattc

SEQ ID NO: 373238 - DNA, 20 bp, Artificial Sequence
  chemically synthesized
atcattatgttgaatatgtc

SEQ ID NO: 373239 - DNA, 20 bp, Artificial Sequence
  chemically synthesized
tcaacataatgatttccaat

SEQ ID NO: 373240 - DNA, 20 bp, Artificial Sequence
  chemically synthesized
caacataatgatttccaatc

SEQ ID NO: 373241 - DNA, 20 bp, Artificial Sequence
  chemically synthesized
cataatgatttccaatcagg

SEQ ID NO: 373242 - DNA, 20 bp, Artificial Sequence
  chemically synthesized
ataatgatttccaatcaggt

SEQ ID NO: 373243 - DNA, 20 bp, Artificial Sequence
  chemically synthesized
tcatttcctgcctacctgat

SEQ ID NO: 373244 - DNA, 20 bp, Artificial Sequence
  chemically synthesized
atgatttccaatcaggtagg

SEQ ID NO: 373245 - DNA, 20 bp, Artificial Sequence
  chemically synthesized
tgatttccaatcaggtaggc

SEQ ID NO: 373246 - DNA, 20 bp, Artificial Sequence
  chemically synthesized
caatcaggtaggcaggaaat

SEQ ID NO: 373247 - DNA, 20 bp, Artificial Sequence
  chemically synthesized
aatcaggtaggcaggaaatg

SEQ ID NO: 373248 - DNA, 20 bp, Artificial Sequence
  chemically synthesized
ggtaggcaggaaatgaggaa

SEQ ID NO: 373249 - DNA, 20 bp, Artificial Sequence
  chemically synthesized
ggaaatgaggaaaagctgtt

SEQ ID NO: 373250 - DNA, 20 bp, Artificial Sequence
  chemically synthesized
gccacttaactgtcactcaa

SEQ ID NO: 373251 - DNA, 20 bp, Artificial Sequence
  chemically synthesized
gaggaaaagctgttgagtga

SEQ ID NO: 373252 - DNA, 20 bp, Artificial Sequence
  chemically synthesized
aaagctgttgagtgacagtt

SEQ ID NO: 373253 - DNA, 20 bp, Artificial Sequence
  chemically synthesized
gctgttgagtgacagttaag

SEQ ID NO: 373254 - DNA, 20 bp, Artificial Sequence
  chemically synthesized
gttgagtgacagttaagtgg

SEQ ID NO: 373255 - DNA, 20 bp, Artificial Sequence
  chemically synthesized
ttgagtgacagttaagtggc

SEQ ID NO: 373256 - DNA, 20 bp, Artificial Sequence
  chemically synthesized
tgagtgacagttaagtggca

SEQ ID NO: 373257 - DNA, 20 bp, Artificial Sequence
  chemically synthesized
ctaattgttgttaaattgat

SEQ ID NO: 373258 - DNA, 20 bp, Artificial Sequence
  chemically synthesized
ccaatcaatttaacaacaat

SEQ ID NO: 373259 - DNA, 20 bp, Artificial Sequence
  chemically synthesized
atttaacaacaattagttaa

SEQ ID NO: 373260 - DNA, 20 bp, Artificial Sequence
  chemically synthesized
taacaacaattagttaaaag

SEQ ID NO: 373261 - DNA, 20 bp, Artificial Sequence
  chemically synthesized
ttagttaaaagcggtaccaa

SEQ ID NO: 373262 - DNA, 20 bp, Artificial Sequence
  chemically synthesized
ggctcaataaaagtagctgt

SEQ ID NO: 373263 - DNA, 20 bp, Artificial Sequence
  chemically synthesized
tagtaagggctcaataaaag

SEQ ID NO: 373264 - DNA, 20 bp, Artificial Sequence
  chemically synthesized
taccaacagctacttttatt

SEQ ID NO: 373265 - DNA, 20 bp, Artificial Sequence
  chemically synthesized
ccatagtaagggctcaataa

SEQ ID NO: 373266 - DNA, 20 bp, Artificial Sequence
  chemically synthesized
cttttattgagcccttacta

SEQ ID NO: 373267 - DNA, 20 bp, Artificial Sequence
  chemically synthesized
ttttattgagcccttactat

SEQ ID NO: 373268 - DNA, 20 bp, Artificial Sequence
  chemically synthesized
aagtgcctggcccatagtaa

SEQ ID NO: 373269 - DNA, 20 bp, Artificial Sequence
  chemically synthesized
aaagtgcctggcccatagta

SEQ ID NO: 373270 - DNA, 20 bp, Artificial Sequence
  chemically synthesized
taaagtgcctggcccatagt

SEQ ID NO: 373271 - DNA, 20 bp, Artificial Sequence
  chemically synthesized
attgagcccttactatgggc

SEQ ID NO: 373272 - DNA, 20 bp, Artificial Sequence
  chemically synthesized
ttgagcccttactatgggcc

SEQ ID NO: 373273 - DNA, 20 bp, Artificial Sequence
  chemically synthesized
tatataaagtgcctggccca

SEQ ID NO: 373274 - DNA, 20 bp, Artificial Sequence
  chemically synthesized
gatgatgtatataaagtgcc

SEQ ID NO: 373275 - DNA, 20 bp, Artificial Sequence
  chemically synthesized
taagttagatgatgtatata

SEQ ID NO: 373276 - DNA, 20 bp, Artificial Sequence
  chemically synthesized
ttttttggtgaatattaagt

SEQ ID NO: 373277 - DNA, 20 bp, Artificial Sequence
  chemically synthesized
tgaattttttggtgaatatt

SEQ ID NO: 373278 - DNA, 20 bp, Artificial Sequence
  chemically synthesized
ttaatattcaccaaaaaatt

SEQ ID NO: 373279 - DNA, 20 bp, Artificial Sequence
  chemically synthesized
tattgccttcctgaattttt

SEQ ID NO: 373280 - DNA, 20 bp, Artificial Sequence
  chemically synthesized
taatattcaccaaaaaattc

SEQ ID NO: 373281 - DNA, 20 bp, Artificial Sequence
  chemically synthesized
tattcaccaaaaaattcagg

SEQ ID NO: 373282 - DNA, 20 bp, Artificial Sequence
  chemically synthesized
attcaccaaaaaattcagga

SEQ ID NO: 373283 - DNA, 20 bp, Artificial Sequence
  chemically synthesized
aattttattttttaaaccaa

SEQ ID NO: 373284 - DNA, 20 bp, Artificial Sequence
  chemically synthesized
ttttattttttaaaccaatg

SEQ ID NO: 373285 - DNA, 20 bp, Artificial Sequence
  chemically synthesized
ttattttttaaaccaatgga

SEQ ID NO: 373286 - DNA, 20 bp, Artificial Sequence
  chemically synthesized
ttttctgtcagactctccat

SEQ ID NO: 373287 - DNA, 20 bp, Artificial Sequence
  chemically synthesized
taaaccaatggagagtctga

SEQ ID NO: 373288 - DNA, 20 bp, Artificial Sequence
  chemically synthesized
aacttgttcaaattttctgt

SEQ ID NO: 373289 - DNA, 20 bp, Artificial Sequence
  chemically synthesized
gtctgacagaaaatttgaac

SEQ ID NO: 373290 - DNA, 20 bp, Artificial Sequence
  chemically synthesized
aaatttgaacaagttgcacc

SEQ ID NO: 373291 - DNA, 20 bp, Artificial Sequence
  chemically synthesized
catctgttagttttaggact

SEQ ID NO: 373292 - DNA, 20 bp, Artificial Sequence
  chemically synthesized
cagcaacatctgttagtttt

SEQ ID NO: 373293 - DNA, 20 bp, Artificial Sequence
  chemically synthesized
gcaccaagtcctaaaactaa

SEQ ID NO: 373294 - DNA, 20 bp, Artificial Sequence
  chemically synthesized
ccagcaacatctgttagttt

SEQ ID NO: 373295 - DNA, 20 bp, Artificial Sequence
  chemically synthesized
ccaattccagcaacatctgt

SEQ ID NO: 373296 - DNA, 20 bp, Artificial Sequence
  chemically synthesized
ctaaaactaacagatgttgc

SEQ ID NO: 373297 - DNA, 20 bp, Artificial Sequence
  chemically synthesized
ctaacagatgttgctggaat

SEQ ID NO: 373298 - DNA, 20 bp, Artificial Sequence
  chemically synthesized
catggtcctggttccaattc

SEQ ID NO: 373299 - DNA, 20 bp, Artificial Sequence
  chemically synthesized
gatgttgctggaattggaac

SEQ ID NO: 373300 - DNA, 20 bp, Artificial Sequence
  chemically synthesized
atgttgctggaattggaacc

SEQ ID NO: 373301 - DNA, 20 bp, Artificial Sequence
  chemically synthesized
gttactgtagcacatggtcc

SEQ ID NO: 373302 - DNA, 20 bp, Artificial Sequence
  chemically synthesized
ggaaccaggaccatgtgcta

SEQ ID NO: 373303 - DNA, 20 bp, Artificial Sequence
  chemically synthesized
gagcaagttactgtagcaca

SEQ ID NO: 373304 - DNA, 20 bp, Artificial Sequence
  chemically synthesized
gaaacttgagcaagttactg

SEQ ID NO: 373305 - DNA, 20 bp, Artificial Sequence
  chemically synthesized
tgtgctacagtaacttgctc

SEQ ID NO: 373306 - DNA, 20 bp, Artificial Sequence
  chemically synthesized
agcttagtagaaacttgagc

SEQ ID NO: 373307 - DNA, 20 bp, Artificial Sequence
  chemically synthesized
gcatagcttagtagaaactt

SEQ ID NO: 373308 - DNA, 20 bp, Artificial Sequence
  chemically synthesized
aacttgctcaagtttctact

SEQ ID NO: 373309 - DNA, 20 bp, Artificial Sequence
  chemically synthesized
tagagtggagcatagcttag

SEQ ID NO: 373310 - DNA, 20 bp, Artificial Sequence
  chemically synthesized
gcgtagagtggagcatagct

SEQ ID NO: 373311 - DNA, 20 bp, Artificial Sequence
  chemically synthesized
gagttgcgtagagtggagca

SEQ ID NO: 373312 - DNA, 20 bp, Artificial Sequence
  chemically synthesized
acttagagttgcgtagagtg

SEQ ID NO: 373313 - DNA, 20 bp, Artificial Sequence
  chemically synthesized
aaacttagagttgcgtagag

SEQ ID NO: 373314 - DNA, 20 bp, Artificial Sequence
  chemically synthesized
atgaaacttagagttgcgta

SEQ ID NO: 373315 - DNA, 20 bp, Artificial Sequence
  chemically synthesized
tgatgaaacttagagttgcg

SEQ ID NO: 373316 - DNA, 20 bp, Artificial Sequence
  chemically synthesized
gctccactctacgcaactct

SEQ ID NO: 373317 - DNA, 20 bp, Artificial Sequence
  chemically synthesized
cagtgtattgatgaaactta

SEQ ID NO: 373318 - DNA, 20 bp, Artificial Sequence
  chemically synthesized
tccagtgtattgatgaaact

SEQ ID NO: 373319 - DNA, 20 bp, Artificial Sequence
  chemically synthesized
tctaagtttcatcaatacac

SEQ ID NO: 373320 - DNA, 20 bp, Artificial Sequence
  chemically synthesized
tgagtatatgaaatgagttc

SEQ ID NO: 373321 - DNA, 20 bp, Artificial Sequence
  chemically synthesized
ggggaatgagtatatgaaat

SEQ ID NO: 373322 - DNA, 20 bp, Artificial Sequence
  chemically synthesized
ggtaatagactaaggggaat

SEQ ID NO: 373323 - DNA, 20 bp, Artificial Sequence
  chemically synthesized
tttcatatactcattcccct

SEQ ID NO: 373324 - DNA, 20 bp, Artificial Sequence
  chemically synthesized
tttcatggtaatagactaag

SEQ ID NO: 373325 - DNA, 20 bp, Artificial Sequence
  chemically synthesized
atttcatggtaatagactaa

SEQ ID NO: 373326 - DNA, 20 bp, Artificial Sequence
  chemically synthesized
tatttcatggtaatagacta

SEQ ID NO: 373327 - DNA, 20 bp, Artificial Sequence
  chemically synthesized
gtatttcatggtaatagact

SEQ ID NO: 373328 - DNA, 20 bp, Artificial Sequence
  chemically synthesized
cctagtgtatttcatggtaa

SEQ ID NO: 373329 - DNA, 20 bp, Artificial Sequence
  chemically synthesized
tttgaacctagtgtatttca

SEQ ID NO: 373330 - DNA, 20 bp, Artificial Sequence
  chemically synthesized
tctattaccatgaaatacac

SEQ ID NO: 373331 - DNA, 20 bp, Artificial Sequence
  chemically synthesized
ctattaccatgaaatacact

SEQ ID NO: 373332 - DNA, 20 bp, Artificial Sequence
  chemically synthesized
tcttattgcaagtttgaacc

SEQ ID NO: 373333 - DNA, 20 bp, Artificial Sequence
  chemically synthesized
actaggttcaaacttgcaat

SEQ ID NO: 373334 - DNA, 20 bp, Artificial Sequence
  chemically synthesized
ccttaatgatttcttattgc

SEQ ID NO: 373335 - DNA, 20 bp, Artificial Sequence
  chemically synthesized
acttgcaataagaaatcatt

SEQ ID NO: 373336 - DNA, 20 bp, Artificial Sequence
  chemically synthesized
cttgcaataagaaatcatta

SEQ ID NO: 373337 - DNA, 20 bp, Artificial Sequence
  chemically synthesized
ttgcaataagaaatcattaa

SEQ ID NO: 373338 - DNA, 20 bp, Artificial Sequence
  chemically synthesized
acttggaattgtaaggtgat

SEQ ID NO: 373339 - DNA, 20 bp, Artificial Sequence
  chemically synthesized
tgtctgtacttggaattgta

SEQ ID NO: 373340 - DNA, 20 bp, Artificial Sequence
  chemically synthesized
ttgtctgtacttggaattgt

SEQ ID NO: 373341 - DNA, 20 bp, Artificial Sequence
  chemically synthesized
actcatcaccttacaattcc

SEQ ID NO: 373342 - DNA, 20 bp, Artificial Sequence
  chemically synthesized
tcaccttacaattccaagta

SEQ ID NO: 373343 - DNA, 20 bp, Artificial Sequence
  chemically synthesized
tttccacacttgtctgtact

SEQ ID NO: 373344 - DNA, 20 bp, Artificial Sequence
  chemically synthesized
ttacaattccaagtacagac

SEQ ID NO: 373345 - DNA, 20 bp, Artificial Sequence
  chemically synthesized
attccaagtacagacaagtg

SEQ ID NO: 373346 - DNA, 20 bp, Artificial Sequence
  chemically synthesized
tggaaatgatcctaccaaac

SEQ ID NO: 373347 - DNA, 20 bp, Artificial Sequence
  chemically synthesized
tacacttctccttgtttggt

SEQ ID NO: 373348 - DNA, 20 bp, Artificial Sequence
  chemically synthesized
ggaaatgatcctaccaaaca

SEQ ID NO: 373349 - DNA, 20 bp, Artificial Sequence
  chemically synthesized
atacacttctccttgtttgg

SEQ ID NO: 373350 - DNA, 20 bp, Artificial Sequence
  chemically synthesized
aaatgatcctaccaaacaag

SEQ ID NO: 373351 - DNA, 20 bp, Artificial Sequence
  chemically synthesized
gtgatacacttctccttgtt

SEQ ID NO: 373352 - DNA, 20 bp, Artificial Sequence
  chemically synthesized
tgatcctaccaaacaaggag

SEQ ID NO: 373353 - DNA, 20 bp, Artificial Sequence
  chemically synthesized
ctgagaagatgtaaaggcga

SEQ ID NO: 373354 - DNA, 20 bp, Artificial Sequence
  chemically synthesized
aacatcctgagaagatgtaa

SEQ ID NO: 373355 - DNA, 20 bp, Artificial Sequence
  chemically synthesized
taacatcctgagaagatgta

SEQ ID NO: 373356 - DNA, 20 bp, Artificial Sequence
  chemically synthesized
ctgtcgcctttacatcttct

SEQ ID NO: 373357 - DNA, 20 bp, Artificial Sequence
  chemically synthesized
tgtcgcctttacatcttctc

SEQ ID NO: 373358 - DNA, 20 bp, Artificial Sequence
  chemically synthesized
gataaagttaacatcctgag

SEQ ID NO: 373359 - DNA, 20 bp, Artificial Sequence
  chemically synthesized
ggagataaagttaacatcct

SEQ ID NO: 373360 - DNA, 20 bp, Artificial Sequence
  chemically synthesized
caggatgttaactttatctc

SEQ ID NO: 373361 - DNA, 20 bp, Artificial Sequence
  chemically synthesized
ttgtcattaagctggagata

SEQ ID NO: 373362 - DNA, 20 bp, Artificial Sequence
  chemically synthesized
ttgtgcttgtcattaagctg

SEQ ID NO: 373363 - DNA, 20 bp, Artificial Sequence
  chemically synthesized
atttgtgcttgtcattaagc

SEQ ID NO: 373364 - DNA, 20 bp, Artificial Sequence
  chemically synthesized
tttatctccagcttaatgac

SEQ ID NO: 373365 - DNA, 20 bp, Artificial Sequence
  chemically synthesized
aagaatttgtgcttgtcatt

SEQ ID NO: 373366 - DNA, 20 bp, Artificial Sequence
  chemically synthesized
atgacaagcacaaattcttg

SEQ ID NO: 373367 - DNA, 20 bp, Artificial Sequence
  chemically synthesized
gcctgaaatttaagaactac

SEQ ID NO: 373368 - DNA, 20 bp, Artificial Sequence
  chemically synthesized
ttcttgtagttcttaaattt

SEQ ID NO: 373369 - DNA, 20 bp, Artificial Sequence
  chemically synthesized
tcttgtagttcttaaatttc

SEQ ID NO: 373370 - DNA, 20 bp, Artificial Sequence
  chemically synthesized
taaagaacagcctgaaattt

SEQ ID NO: 373371 - DNA, 20 bp, Artificial Sequence
  chemically synthesized
ttaaatttcaggctgttctt

SEQ ID NO: 373372 - DNA, 20 bp, Artificial Sequence
  chemically synthesized
tgtactataaaactaaagaa

SEQ ID NO: 373373 - DNA, 20 bp, Artificial Sequence
  chemically synthesized
aaatatgtactataaaacta

SEQ ID NO: 373374 - DNA, 20 bp, Artificial Sequence
  chemically synthesized
caggctgttctttagtttta

SEQ ID NO: 373375 - DNA, 20 bp, Artificial Sequence
  chemically synthesized
ctcaggcatgggtataaata

SEQ ID NO: 373376 - DNA, 20 bp, Artificial Sequence
  chemically synthesized
ctgtatttatacccatgcct

SEQ ID NO: 373377 - DNA, 20 bp, Artificial Sequence
  chemically synthesized
cacagcattttctcaggcat

SEQ ID NO: 373378 - DNA, 20 bp, Artificial Sequence
  chemically synthesized
acacagcattttctcaggca

SEQ ID NO: 373379 - DNA, 20 bp, Artificial Sequence
  chemically synthesized
ataagacacagcattttctc

SEQ ID NO: 373380 - DNA, 20 bp, Artificial Sequence
  chemically synthesized
tataagacacagcattttct

SEQ ID NO: 373381 - DNA, 20 bp, Artificial Sequence
  chemically synthesized
ttatatgactttataagaca

SEQ ID NO: 373382 - DNA, 20 bp, Artificial Sequence
  chemically synthesized
agaaaatgctgtgtcttata

SEQ ID NO: 373383 - DNA, 20 bp, Artificial Sequence
  chemically synthesized
tcagcattatatgactttat

SEQ ID NO: 373384 - DNA, 20 bp, Artificial Sequence
  chemically synthesized
tataaagtcatataatgctg

SEQ ID NO: 373385 - DNA, 20 bp, Artificial Sequence
  chemically synthesized
ataaagtcatataatgctga

SEQ ID NO: 373386 - DNA, 20 bp, Artificial Sequence
  chemically synthesized
gtcatataatgctgaaggtc

SEQ ID NO: 373387 - DNA, 20 bp, Artificial Sequence
  chemically synthesized
tcatataatgctgaaggtca

SEQ ID NO: 373388 - DNA, 20 bp, Artificial Sequence
  chemically synthesized
agagcatattccttgacctt

SEQ ID NO: 373389 - DNA, 20 bp, Artificial Sequence
  chemically synthesized
gtcaaggaatatgctcttgc

SEQ ID NO: 373390 - DNA, 20 bp, Artificial Sequence
  chemically synthesized
gatccctacaaatctggcaa

SEQ ID NO: 373391 - DNA, 20 bp, Artificial Sequence
  chemically synthesized
aggatccctacaaatctggc

SEQ ID NO: 373392 - DNA, 20 bp, Artificial Sequence
  chemically synthesized
atatgctcttgccagatttg

SEQ ID NO: 373393 - DNA, 20 bp, Artificial Sequence
  chemically synthesized
tatgctcttgccagatttgt

SEQ ID NO: 373394 - DNA, 20 bp, Artificial Sequence
  chemically synthesized
ggctaggatccctacaaatc

SEQ ID NO: 373395 - DNA, 20 bp, Artificial Sequence
  chemically synthesized
atgctcttgccagatttgta

SEQ ID NO: 373396 - DNA, 20 bp, Artificial Sequence
  chemically synthesized
tgccagatttgtagggatcc

SEQ ID NO: 373397 - DNA, 20 bp, Artificial Sequence
  chemically synthesized
gatttgtagggatcctagcc

SEQ ID NO: 373398 - DNA, 20 bp, Artificial Sequence
  chemically synthesized
cgtgtgagtggtgctaggct

SEQ ID NO: 373399 - DNA, 20 bp, Artificial Sequence
  chemically synthesized
acgtgtgagtggtgctaggc

SEQ ID NO: 373400 - DNA, 20 bp, Artificial Sequence
  chemically synthesized
gattacgtgtgagtggtgct

SEQ ID NO: 373401 - DNA, 20 bp, Artificial Sequence
  chemically synthesized
tgattacgtgtgagtggtgc

SEQ ID NO: 373402 - DNA, 20 bp, Artificial Sequence
  chemically synthesized
aataaatgattacgtgtgag

SEQ ID NO: 373403 - DNA, 20 bp, Artificial Sequence
  chemically synthesized
tttaataaatgattacgtgt

SEQ ID NO: 373404 - DNA, 20 bp, Artificial Sequence
  chemically synthesized
gaacagattagcatcatgat

SEQ ID NO: 373405 - DNA, 20 bp, Artificial Sequence
  chemically synthesized
gatcatgatgctaatctgtt

SEQ ID NO: 373406 - DNA, 20 bp, Artificial Sequence
  chemically synthesized
gcctatgactctgaacagat

SEQ ID NO: 373407 - DNA, 20 bp, Artificial Sequence
  chemically synthesized
tcatgatgctaatctgttca

SEQ ID NO: 373408 - DNA, 20 bp, Artificial Sequence
  chemically synthesized
tatgggcctatgactctgaa

SEQ ID NO: 373409 - DNA, 20 bp, Artificial Sequence
  chemically synthesized
tgctaatctgttcagagtca

SEQ ID NO: 373410 - DNA, 20 bp, Artificial Sequence
  chemically synthesized
gctaatctgttcagagtcat

SEQ ID NO: 373411 - DNA, 20 bp, Artificial Sequence
  chemically synthesized
ttcagagtcataggcccata

SEQ ID NO: 373412 - DNA, 20 bp, Artificial Sequence
  chemically synthesized
ataggaaatattgtctttat

SEQ ID NO: 373413 - DNA, 20 bp, Artificial Sequence
  chemically synthesized
cataggaaatattgtcttta

SEQ ID NO: 373414 - DNA, 20 bp, Artificial Sequence
  chemically synthesized
cataaagacaatatttccta

SEQ ID NO: 373415 - DNA, 20 bp, Artificial Sequence
  chemically synthesized
ataaagacaatatttcctat

SEQ ID NO: 373416 - DNA, 20 bp, Artificial Sequence
  chemically synthesized
gacaatatttcctatgggtt

SEQ ID NO: 373417 - DNA, 20 bp, Artificial Sequence
  chemically synthesized
attagcacatcttaacccat

SEQ ID NO: 373418 - DNA, 20 bp, Artificial Sequence
  chemically synthesized
gattagcacatcttaaccca

SEQ ID NO: 373419 - DNA, 20 bp, Artificial Sequence
  chemically synthesized
gtttgttcagttaatgagat

SEQ ID NO: 373420 - DNA, 20 bp, Artificial Sequence
  chemically synthesized
ttctggtttgttcagttaat

SEQ ID NO: 373421 - DNA, 20 bp, Artificial Sequence
  chemically synthesized
atctcattaactgaacaaac

SEQ ID NO: 373422 - DNA, 20 bp, Artificial Sequence
  chemically synthesized
taaattcattctggtttgtt

SEQ ID NO: 373423 - DNA, 20 bp, Artificial Sequence
  chemically synthesized
tgctgtgattaaattcattc

SEQ ID NO: 373424 - DNA, 20 bp, Artificial Sequence
  chemically synthesized
aaccagaatgaatttaatca

SEQ ID NO: 373425 - DNA, 20 bp, Artificial Sequence
  chemically synthesized
cagaatgaatttaatcacag

SEQ ID NO: 373426 - DNA, 20 bp, Artificial Sequence
  chemically synthesized
tgaatttaatcacagcagtc

SEQ ID NO: 373427 - DNA, 20 bp, Artificial Sequence
  chemically synthesized
gaatttaatcacagcagtca

SEQ ID NO: 373428 - DNA, 20 bp, Artificial Sequence
  chemically synthesized
aatttaatcacagcagtcaa

SEQ ID NO: 373429 - DNA, 20 bp, Artificial Sequence
  chemically synthesized
ttaatcacagcagtcaaggg

SEQ ID NO: 373430 - DNA, 20 bp, Artificial Sequence
  chemically synthesized
tttgtcttggaatgatgcgg

SEQ ID NO: 373431 - DNA, 20 bp, Artificial Sequence
  chemically synthesized
taatttgtcttggaatgatg

SEQ ID NO: 373432 - DNA, 20 bp, Artificial Sequence
  chemically synthesized
ggaagctaccgcatcattcc

SEQ ID NO: 373433 - DNA, 20 bp, Artificial Sequence
  chemically synthesized
acaatatctctaatttgtct

SEQ ID NO: 373434 - DNA, 20 bp, Artificial Sequence
  chemically synthesized
cgcatcattccaagacaaat

SEQ ID NO: 373435 - DNA, 20 bp, Artificial Sequence
  chemically synthesized
catcattccaagacaaatta

SEQ ID NO: 373436 - DNA, 20 bp, Artificial Sequence
  chemically synthesized
ttagagatattgtacccctg

SEQ ID NO: 373437 - DNA, 20 bp, Artificial Sequence
  chemically synthesized
aatcaaagataacaccacag

SEQ ID NO: 373438 - DNA, 20 bp, Artificial Sequence
  chemically synthesized
aaatcaaagataacaccaca

SEQ ID NO: 373439 - DNA, 20 bp, Artificial Sequence
  chemically synthesized
gaaatcaaagataacaccac

SEQ ID NO: 373440 - DNA, 20 bp, Artificial Sequence
  chemically synthesized
cgaaatcaaagataacacca

SEQ ID NO: 373441 - DNA, 20 bp, Artificial Sequence
  chemically synthesized
gaaacctctaatcgaaatca

SEQ ID NO: 373442 - DNA, 20 bp, Artificial Sequence
  chemically synthesized
gtgttatctttgatttcgat

SEQ ID NO: 373443 - DNA, 20 bp, Artificial Sequence
  chemically synthesized
gttatctttgatttcgatta

SEQ ID NO: 373444 - DNA, 20 bp, Artificial Sequence
  chemically synthesized
ttatctttgatttcgattag

SEQ ID NO: 373445 - DNA, 20 bp, Artificial Sequence
  chemically synthesized
ttgatttcgattagaggttt

SEQ ID NO: 373446 - DNA, 20 bp, Artificial Sequence
  chemically synthesized
tgatttcgattagaggtttc

SEQ ID NO: 373447 - DNA, 20 bp, Artificial Sequence
  chemically synthesized
aggtttcaggctgcttccta

SEQ ID NO: 373448 - DNA, 20 bp, Artificial Sequence
  chemically synthesized
ttgaatctagccataggaag

SEQ ID NO: 373449 - DNA, 20 bp, Artificial Sequence
  chemically synthesized
attttgaatctagccatagg

SEQ ID NO: 373450 - DNA, 20 bp, Artificial Sequence
  chemically synthesized
ttcaggctgcttcctatggc

SEQ ID NO: 373451 - DNA, 20 bp, Artificial Sequence
  chemically synthesized
aatattttgaatctagccat

SEQ ID NO: 373452 - DNA, 20 bp, Artificial Sequence
  chemically synthesized
taatattttgaatctagcca

SEQ ID NO: 373453 - DNA, 20 bp, Artificial Sequence
  chemically synthesized
taggcttaatattttgaatc

SEQ ID NO: 373454 - DNA, 20 bp, Artificial Sequence
  chemically synthesized
atggctagattcaaaatatt

SEQ ID NO: 373455 - DNA, 20 bp, Artificial Sequence
  chemically synthesized
tcaaaatattaagcctacta

SEQ ID NO: 373456 - DNA, 20 bp, Artificial Sequence
  chemically synthesized
aaaatattaagcctactaaa

SEQ ID NO: 373457 - DNA, 20 bp, Artificial Sequence
  chemically synthesized
tacctttcattctctttagt

SEQ ID NO: 373458 - DNA, 20 bp, Artificial Sequence
  chemically synthesized
ttacctttcattctctttag

SEQ ID NO: 373459 - DNA, 20 bp, Artificial Sequence
  chemically synthesized
aacttacctttcattctctt

SEQ ID NO: 373460 - DNA, 20 bp, Artificial Sequence
  chemically synthesized
aagcctactaaagagaatga

SEQ ID NO: 373461 - DNA, 20 bp, Artificial Sequence
  chemically synthesized
agcctactaaagagaatgaa

SEQ ID NO: 373462 - DNA, 20 bp, Artificial Sequence
  chemically synthesized
tactaaagagaatgaaaggt

SEQ ID NO: 373463 - DNA, 20 bp, Artificial Sequence
  chemically synthesized
aagtttatgactttgcatct

SEQ ID NO: 373464 - DNA, 20 bp, Artificial Sequence
  chemically synthesized
tagtgcagttccaagatgca

SEQ ID NO: 373465 - DNA, 20 bp, Artificial Sequence
  chemically synthesized
gttatcagtagtgcagttcc

SEQ ID NO: 373466 - DNA, 20 bp, Artificial Sequence
  chemically synthesized
ctttgcagttatcagtagtg

SEQ ID NO: 373467 - DNA, 20 bp, Artificial Sequence
  chemically synthesized
ttaggctttgcagttatcag

SEQ ID NO: 373468 - DNA, 20 bp, Artificial Sequence
  chemically synthesized
gccttaggctttgcagttat

SEQ ID NO: 373469 - DNA, 20 bp, Artificial Sequence
  chemically synthesized
ctgcactactgataactgca

SEQ ID NO: 373470 - DNA, 20 bp, Artificial Sequence
  chemically synthesized
cttcaaagccttaggctttg

SEQ ID NO: 373471 - DNA, 20 bp, Artificial Sequence
  chemically synthesized
tactgataactgcaaagcct

SEQ ID NO: 373472 - DNA, 20 bp, Artificial Sequence
  chemically synthesized
actgataactgcaaagccta

SEQ ID NO: 373473 - DNA, 20 bp, Artificial Sequence
  chemically synthesized
tcatttctcttcaaagcctt

SEQ ID NO: 373474 - DNA, 20 bp, Artificial Sequence
  chemically synthesized
gtcatttctcttcaaagcct

SEQ ID NO: 373475 - DNA, 20 bp, Artificial Sequence
  chemically synthesized
ctgcaaagcctaaggctttg

SEQ ID NO: 373476 - DNA, 20 bp, Artificial Sequence
  chemically synthesized
gcaaagcctaaggctttgaa

SEQ ID NO: 373477 - DNA, 20 bp, Artificial Sequence
  chemically synthesized
ttttttgtcatttctcttca

SEQ ID NO: 373478 - DNA, 20 bp, Artificial Sequence
  chemically synthesized
tgaagagaaatgacaaaaaa

SEQ ID NO: 373479 - DNA, 20 bp, Artificial Sequence
  chemically synthesized
atcatattttcataaatatt

SEQ ID NO: 373480 - DNA, 20 bp, Artificial Sequence
  chemically synthesized
tatatttatatacaattggg

SEQ ID NO: 373481 - DNA, 20 bp, Artificial Sequence
  chemically synthesized
ctttatatttatatacaatt

SEQ ID NO: 373482 - DNA, 20 bp, Artificial Sequence
  chemically synthesized
tctttatatttatatacaat

SEQ ID NO: 373483 - DNA, 20 bp, Artificial Sequence
  chemically synthesized
cccaattgtatataaatata

SEQ ID NO: 373484 - DNA, 20 bp, Artificial Sequence
  chemically synthesized
atctcctgaatcattttaaa

SEQ ID NO: 373485 - DNA, 20 bp, Artificial Sequence
  chemically synthesized
cattactttttaaaatgatt

SEQ ID NO: 373486 - DNA, 20 bp, Artificial Sequence
  chemically synthesized
attactttttaaaatgattc

SEQ ID NO: 373487 - DNA, 20 bp, Artificial Sequence
  chemically synthesized
tactttttaaaatgattcag

SEQ ID NO: 373488 - DNA, 20 bp, Artificial Sequence
  chemically synthesized
tgattcaggagataaactac

SEQ ID NO: 373489 - DNA, 20 bp, Artificial Sequence
  chemically synthesized
aggagataaactactggtat

SEQ ID NO: 373490 - DNA, 20 bp, Artificial Sequence
  chemically synthesized
aacatgatcacttataccag

SEQ ID NO: 373491 - DNA, 20 bp, Artificial Sequence
  chemically synthesized
gataacatgatcacttatac

SEQ ID NO: 373492 - DNA, 20 bp, Artificial Sequence
  chemically synthesized
aatatatttttcatgagatt

SEQ ID NO: 373493 - DNA, 20 bp, Artificial Sequence
  chemically synthesized
tagcttaatatatttttcat

SEQ ID NO: 373494 - DNA, 20 bp, Artificial Sequence
  chemically synthesized
aatctcatgaaaaatatatt

SEQ ID NO: 373495 - DNA, 20 bp, Artificial Sequence
  chemically synthesized
atatattaagctataacgat

SEQ ID NO: 373496 - DNA, 20 bp, Artificial Sequence
  chemically synthesized
taaaagcaggctaatcgtta

SEQ ID NO: 373497 - DNA, 20 bp, Artificial Sequence
  chemically synthesized
tcatacacatttttaaaagc

SEQ ID NO: 373498 - DNA, 20 bp, Artificial Sequence
  chemically synthesized
ttcatacacatttttaaaag

SEQ ID NO: 373499 - DNA, 20 bp, Artificial Sequence
  chemically synthesized
actttcatacacatttttaa

SEQ ID NO: 373500 - DNA, 20 bp, Artificial Sequence
  chemically synthesized
gcttttaaaaatgtgtatga

SEQ ID NO: 373501 - DNA, 20 bp, Artificial Sequence
  chemically synthesized
ttaaaaatgtgtatgaaagt

SEQ ID NO: 373502 - DNA, 20 bp, Artificial Sequence
  chemically synthesized
gtatgaaagtcagttattaa

SEQ ID NO: 373503 - DNA, 20 bp, Artificial Sequence
  chemically synthesized
gaaagtcagttattaaaagc

SEQ ID NO: 373504 - DNA, 20 bp, Artificial Sequence
  chemically synthesized
ctttatttaacaacatcatc

SEQ ID NO: 373505 - DNA, 20 bp, Artificial Sequence
  chemically synthesized
ctagatgatgttgttaaata

SEQ ID NO: 373506 - DNA, 20 bp, Artificial Sequence
  chemically synthesized
gggaaatttcaacacattgt

SEQ ID NO: 373507 - DNA, 20 bp, Artificial Sequence
  chemically synthesized
atgtgttgaaatttccctat

SEQ ID NO: 373508 - DNA, 20 bp, Artificial Sequence
  chemically synthesized
gtgttgaaatttccctattg

SEQ ID NO: 373509 - DNA, 20 bp, Artificial Sequence
  chemically synthesized
tgttttataattctccaata

SEQ ID NO: 373510 - DNA, 20 bp, Artificial Sequence
  chemically synthesized
ttgttttataattctccaat

SEQ ID NO: 373511 - DNA, 20 bp, Artificial Sequence
  chemically synthesized
tttgttttataattctccaa

SEQ ID NO: 373512 - DNA, 20 bp, Artificial Sequence
  chemically synthesized
gaattataaaacaaataaaa

SEQ ID NO: 373513 - DNA, 20 bp, Artificial Sequence
  chemically synthesized
ctacattttatgtgatgcat

SEQ ID NO: 373514 - DNA, 20 bp, Artificial Sequence
  chemically synthesized
ctgatgcatcacataaaatg

SEQ ID NO: 373515 - DNA, 20 bp, Artificial Sequence
  chemically synthesized
atgcatcacataaaatgtag

SEQ ID NO: 373516 - DNA, 20 bp, Artificial Sequence
  chemically synthesized
aaaatgtagaagcgaaattt

SEQ ID NO: 373517 - DNA, 20 bp, Artificial Sequence
  chemically synthesized
aaatgtagaagcgaaatttg

SEQ ID NO: 373518 - DNA, 20 bp, Artificial Sequence
  chemically synthesized
aatgtagaagcgaaatttga

SEQ ID NO: 373519 - DNA, 20 bp, Artificial Sequence
  chemically synthesized
agaagcgaaatttgagggtt

SEQ ID NO: 373520 - DNA, 20 bp, Artificial Sequence
  chemically synthesized
tcaataaaatattaaatgcc

SEQ ID NO: 373521 - DNA, 20 bp, Artificial Sequence
  chemically synthesized
caataaaatattaaatgcct

SEQ ID NO: 373522 - DNA, 20 bp, Artificial Sequence
  chemically synthesized
taaaatattaaatgcctggg

SEQ ID NO: 373523 - DNA, 20 bp, Artificial Sequence
  chemically synthesized
aacaattacggagactgccc

SEQ ID NO: 373524 - DNA, 20 bp, Artificial Sequence
  chemically synthesized
aaacaattacggagactgcc

SEQ ID NO: 373525 - DNA, 20 bp, Artificial Sequence
  chemically synthesized
cctcaagggaaacaattacg

SEQ ID NO: 373526 - DNA, 20 bp, Artificial Sequence
  chemically synthesized
cccctcaagggaaacaatta

SEQ ID NO: 373527 - DNA, 20 bp, Artificial Sequence
  chemically synthesized
tctccgtaattgtttccctt

SEQ ID NO: 373528 - DNA, 20 bp, Artificial Sequence
  chemically synthesized
ctccgtaattgtttcccttg

SEQ ID NO: 373529 - DNA, 20 bp, Artificial Sequence
  chemically synthesized
tccgtaattgtttcccttga

SEQ ID NO: 373530 - DNA, 20 bp, Artificial Sequence
  chemically synthesized
ccgtaattgtttcccttgag

SEQ ID NO: 373531 - DNA, 20 bp, Artificial Sequence
  chemically synthesized
cgtaattgtttcccttgagg

SEQ ID NO: 373532 - DNA, 20 bp, Artificial Sequence
  chemically synthesized
tttttttttttccccctcaa

SEQ ID NO: 373533 - DNA, 20 bp, Artificial Sequence
  chemically synthesized
ttttttttttttccccctca

SEQ ID NO: 373534 - DNA, 20 bp, Artificial Sequence
  chemically synthesized
tttttttttttttccccctc

SEQ ID NO: 373535 - DNA, 20 bp, Artificial Sequence
  chemically synthesized
aaaaaaaaaacctttccttt

SEQ ID NO: 373536 - DNA, 20 bp, Artificial Sequence
  chemically synthesized
tgcctactacctgaaaggaa

SEQ ID NO: 373537 - DNA, 20 bp, Artificial Sequence
  chemically synthesized
aaaaaaaaacctttcctttc

SEQ ID NO: 373538 - DNA, 20 bp, Artificial Sequence
  chemically synthesized
gtgcctactacctgaaagga

SEQ ID NO: 373539 - DNA, 20 bp, Artificial Sequence
  chemically synthesized
aaaaaacctttcctttcagg

SEQ ID NO: 373540 - DNA, 20 bp, Artificial Sequence
  chemically synthesized
ctgtgtgcctactacctgaa

SEQ ID NO: 373541 - DNA, 20 bp, Artificial Sequence
  chemically synthesized
actgtgtgcctactacctga

SEQ ID NO: 373542 - DNA, 20 bp, Artificial Sequence
  chemically synthesized
aaacctttcctttcaggtag

SEQ ID NO: 373543 - DNA, 20 bp, Artificial Sequence
  chemically synthesized
aacctttcctttcaggtagt

SEQ ID NO: 373544 - DNA, 20 bp, Artificial Sequence
  chemically synthesized
cctttcaggtagtaggcaca

SEQ ID NO: 373545 - DNA, 20 bp, Artificial Sequence
  chemically synthesized
gatttggagagacaaggggt

SEQ ID NO: 373546 - DNA, 20 bp, Artificial Sequence
  chemically synthesized
tctagatttggagagacaag

SEQ ID NO: 373547 - DNA, 20 bp, Artificial Sequence
  chemically synthesized
gtctagatttggagagacaa

SEQ ID NO: 373548 - DNA, 20 bp, Artificial Sequence
  chemically synthesized
agtctagatttggagagaca

SEQ ID NO: 373549 - DNA, 20 bp, Artificial Sequence
  chemically synthesized
gagtctagatttggagagac

SEQ ID NO: 373550 - DNA, 20 bp, Artificial Sequence
  chemically synthesized
atttggagtctagatttgga

SEQ ID NO: 373551 - DNA, 20 bp, Artificial Sequence
  chemically synthesized
accccttgtctctccaaatc

SEQ ID NO: 373552 - DNA, 20 bp, Artificial Sequence
  chemically synthesized
atatttggagtctagatttg

SEQ ID NO: 373553 - DNA, 20 bp, Artificial Sequence
  chemically synthesized
atatatttggagtctagatt

SEQ ID NO: 373554 - DNA, 20 bp, Artificial Sequence
  chemically synthesized
actaatatatatttggagtc

SEQ ID NO: 373555 - DNA, 20 bp, Artificial Sequence
  chemically synthesized
ttgtgactaatatatatttg

SEQ ID NO: 373556 - DNA, 20 bp, Artificial Sequence
  chemically synthesized
tattgtgactaatatatatt

SEQ ID NO: 373557 - DNA, 20 bp, Artificial Sequence
  chemically synthesized
tctagactccaaatatatat

SEQ ID NO: 373558 - DNA, 20 bp, Artificial Sequence
  chemically synthesized
gtcaagcagaataagaatgt

SEQ ID NO: 373559 - DNA, 20 bp, Artificial Sequence
  chemically synthesized
acaaattagtcaagcagaat

SEQ ID NO: 373560 - DNA, 20 bp, Artificial Sequence
  chemically synthesized
ttgactacaaattagtcaag

SEQ ID NO: 373561 - DNA, 20 bp, Artificial Sequence
  chemically synthesized
agcttgactacaaattagtc

SEQ ID NO: 373562 - DNA, 20 bp, Artificial Sequence
  chemically synthesized
tattctgcttgactaatttg

SEQ ID NO: 373563 - DNA, 20 bp, Artificial Sequence
  chemically synthesized
tattcagcttgactacaaat

SEQ ID NO: 373564 - DNA, 20 bp, Artificial Sequence
  chemically synthesized
tgcttgactaatttgtagtc

SEQ ID NO: 373565 - DNA, 20 bp, Artificial Sequence
  chemically synthesized
agtttccactgaattgtatt

SEQ ID NO: 373566 - DNA, 20 bp, Artificial Sequence
  chemically synthesized
tagtcaagctgaatacaatt

SEQ ID NO: 373567 - DNA, 20 bp, Artificial Sequence
  chemically synthesized
tcaagctgaatacaattcag

SEQ ID NO: 373568 - DNA, 20 bp, Artificial Sequence
  chemically synthesized
agatgaatttatttcatatt

SEQ ID NO: 373569 - DNA, 20 bp, Artificial Sequence
  chemically synthesized
aaataaattcatctaataaa

SEQ ID NO: 373570 - DNA, 20 bp, Artificial Sequence
  chemically synthesized
aataaattcatctaataaaa

SEQ ID NO: 373571 - DNA, 20 bp, Artificial Sequence
  chemically synthesized
agtcattggtacctttttat

SEQ ID NO: 373572 - DNA, 20 bp, Artificial Sequence
  chemically synthesized
atatgttgttatacagtcat

SEQ ID NO: 373573 - DNA, 20 bp, Artificial Sequence
  chemically synthesized
tatctacatatgttgttata

SEQ ID NO: 373574 - DNA, 20 bp, Artificial Sequence
  chemically synthesized
tgactgtataacaacatatg

SEQ ID NO: 373575 - DNA, 20 bp, Artificial Sequence
  chemically synthesized
ataacaacatatgtagataa

SEQ ID NO: 373576 - DNA, 20 bp, Artificial Sequence
  chemically synthesized
ataaaacattcaatcccaca

SEQ ID NO: 373577 - DNA, 20 bp, Artificial Sequence
  chemically synthesized
aaacattcaatcccacatgg

SEQ ID NO: 373578 - DNA, 20 bp, Artificial Sequence
  chemically synthesized
ttccaggaaagctgccatgt

SEQ ID NO: 373579 - DNA, 20 bp, Artificial Sequence
  chemically synthesized
attccaggaaagctgccatg

SEQ ID NO: 373580 - DNA, 20 bp, Artificial Sequence
  chemically synthesized
atcccacatggcagctttcc

SEQ ID NO: 373581 - DNA, 20 bp, Artificial Sequence
  chemically synthesized
aatgattttatattccagga

SEQ ID NO: 373582 - DNA, 20 bp, Artificial Sequence
  chemically synthesized
ataaaatgattttatattcc

SEQ ID NO: 373583 - DNA, 20 bp, Artificial Sequence
  chemically synthesized
gataaaatgattttatattc

SEQ ID NO: 373584 - DNA, 20 bp, Artificial Sequence
  chemically synthesized
ataaaatcattttatcatta

SEQ ID NO: 373585 - DNA, 20 bp, Artificial Sequence
  chemically synthesized
taaaatcattttatcattat

SEQ ID NO: 373586 - DNA, 20 bp, Artificial Sequence
  chemically synthesized
cattttatcattatgggtat

SEQ ID NO: 373587 - DNA, 20 bp, Artificial Sequence
  chemically synthesized
attatgggtattagctcatg

SEQ ID NO: 373588 - DNA, 20 bp, Artificial Sequence
  chemically synthesized
tgggtattagctcatgaagt

SEQ ID NO: 373589 - DNA, 20 bp, Artificial Sequence
  chemically synthesized
taaaataatactgacttcat

SEQ ID NO: 373590 - DNA, 20 bp, Artificial Sequence
  chemically synthesized
tattattttaaaaacatgct

SEQ ID NO: 373591 - DNA, 20 bp, Artificial Sequence
  chemically synthesized
taaaaacatgctaagaatgt

SEQ ID NO: 373592 - DNA, 20 bp, Artificial Sequence
  chemically synthesized
aattttgaagctaacattct

SEQ ID NO: 373593 - DNA, 20 bp, Artificial Sequence
  chemically synthesized
ttttgagatattaaattttg

SEQ ID NO: 373594 - DNA, 20 bp, Artificial Sequence
  chemically synthesized
ttcaaaatttaatatctcaa

SEQ ID NO: 373595 - DNA, 20 bp, Artificial Sequence
  chemically synthesized
aaaatttaatatctcaaaag

SEQ ID NO: 373596 - DNA, 20 bp, Artificial Sequence
  chemically synthesized
aaatttaatatctcaaaagc

SEQ ID NO: 373597 - DNA, 20 bp, Artificial Sequence
  chemically synthesized
ataaccaaaatcctgctttt

SEQ ID NO: 373598 - DNA, 20 bp, Artificial Sequence
  chemically synthesized
atatctcaaaagcaggattt

SEQ ID NO: 373599 - DNA, 20 bp, Artificial Sequence
  chemically synthesized
agcaggattttggttatacc

SEQ ID NO: 373600 - DNA, 20 bp, Artificial Sequence
  chemically synthesized
aggattttggttataccaag

SEQ ID NO: 373601 - DNA, 20 bp, Artificial Sequence
  chemically synthesized
tctctattttataaaccact

SEQ ID NO: 373602 - DNA, 20 bp, Artificial Sequence
  chemically synthesized
ataccaagtggtttataaaa

SEQ ID NO: 373603 - DNA, 20 bp, Artificial Sequence
  chemically synthesized
accaagtggtttataaaata

SEQ ID NO: 373604 - DNA, 20 bp, Artificial Sequence
  chemically synthesized
tagagatatttatccataca

SEQ ID NO: 373605 - DNA, 20 bp, Artificial Sequence
  chemically synthesized
ttgtcacataaaactgtgta

SEQ ID NO: 373606 - DNA, 20 bp, Artificial Sequence
  chemically synthesized
cacagttttatgtgacaatt

SEQ ID NO: 373607 - DNA, 20 bp, Artificial Sequence
  chemically synthesized
acagttttatgtgacaattt

SEQ ID NO: 373608 - DNA, 20 bp, Artificial Sequence
  chemically synthesized
tgacaatttaggtgtcctta

SEQ ID NO: 373609 - DNA, 20 bp, Artificial Sequence
  chemically synthesized
ctgcccaccaagaagctata

SEQ ID NO: 373610 - DNA, 20 bp, Artificial Sequence
  chemically synthesized
actgcccaccaagaagctat

SEQ ID NO: 373611 - DNA, 20 bp, Artificial Sequence
  chemically synthesized
taggtgtccttatagcttct

SEQ ID NO: 373612 - DNA, 20 bp, Artificial Sequence
  chemically synthesized
gtgtccttatagcttcttgg

SEQ ID NO: 373613 - DNA, 20 bp, Artificial Sequence
  chemically synthesized
tgtccttatagcttcttggt

SEQ ID NO: 373614 - DNA, 20 bp, Artificial Sequence
  chemically synthesized
agtttacactgcccaccaag

SEQ ID NO: 373615 - DNA, 20 bp, Artificial Sequence
  chemically synthesized
ccttatagcttcttggtggg

SEQ ID NO: 373616 - DNA, 20 bp, Artificial Sequence
  chemically synthesized
accagtttacactgcccacc

SEQ ID NO: 373617 - DNA, 20 bp, Artificial Sequence
  chemically synthesized
tcttggtgggcagtgtaaac

SEQ ID NO: 373618 - DNA, 20 bp, Artificial Sequence
  chemically synthesized
ttattattattattttttac

SEQ ID NO: 373619 - DNA, 20 bp, Artificial Sequence
  chemically synthesized
ataataataataattttgct

SEQ ID NO: 373620 - DNA, 20 bp, Artificial Sequence
  chemically synthesized
atatgtatcgcaaaaatact

SEQ ID NO: 373621 - DNA, 20 bp, Artificial Sequence
  chemically synthesized
gtatttttgcgatacatata

SEQ ID NO: 373622 - DNA, 20 bp, Artificial Sequence
  chemically synthesized
ggatattaacattttttaaa

SEQ ID NO: 373623 - DNA, 20 bp, Artificial Sequence
  chemically synthesized
aggatattaacattttttaa

SEQ ID NO: 373624 - DNA, 20 bp, Artificial Sequence
  chemically synthesized
caggatattaacatttttta

SEQ ID NO: 373625 - DNA, 20 bp, Artificial Sequence
  chemically synthesized
tttaaaaaatgttaatatcc

SEQ ID NO: 373626 - DNA, 20 bp, Artificial Sequence
  chemically synthesized
aaaaatgttaatatcctggc

SEQ ID NO: 373627 - DNA, 20 bp, Artificial Sequence
  chemically synthesized
aaaatgttaatatcctggct

SEQ ID NO: 373628 - DNA, 20 bp, Artificial Sequence
  chemically synthesized
ttgagccaccgtgcccagcc

SEQ ID NO: 373629 - DNA, 20 bp, Artificial Sequence
  chemically synthesized
cttgagccaccgtgcccagc

SEQ ID NO: 373630 - DNA, 20 bp, Artificial Sequence
  chemically synthesized
gttaatatcctggctgggca

SEQ ID NO: 373631 - DNA, 20 bp, Artificial Sequence
  chemically synthesized
aatatcctggctgggcacgg

SEQ ID NO: 373632 - DNA, 20 bp, Artificial Sequence
  chemically synthesized
caggcttgagccaccgtgcc

SEQ ID NO: 373633 - DNA, 20 bp, Artificial Sequence
  chemically synthesized
ctggctgggcacggtggctc

SEQ ID NO: 373634 - DNA, 20 bp, Artificial Sequence
  chemically synthesized
agtgctgggattacaggctt

SEQ ID NO: 373635 - DNA, 20 bp, Artificial Sequence
  chemically synthesized
gtggctcaagcctgtaatcc

SEQ ID NO: 373636 - DNA, 20 bp, Artificial Sequence
  chemically synthesized
tcccaaagtgctgggattac

SEQ ID NO: 373637 - DNA, 20 bp, Artificial Sequence
  chemically synthesized
ctcccaaagtgctgggatta

SEQ ID NO: 373638 - DNA, 20 bp, Artificial Sequence
  chemically synthesized
agcctgtaatcccagcactt

SEQ ID NO: 373639 - DNA, 20 bp, Artificial Sequence
  chemically synthesized
cctcggcctcccaaagtgct

SEQ ID NO: 373640 - DNA, 20 bp, Artificial Sequence
  chemically synthesized
gcctgtaatcccagcacttt

SEQ ID NO: 373641 - DNA, 20 bp, Artificial Sequence
  chemically synthesized
acctcggcctcccaaagtgc

SEQ ID NO: 373642 - DNA, 20 bp, Artificial Sequence
  chemically synthesized
ctgtaatcccagcactttgg

SEQ ID NO: 373643 - DNA, 20 bp, Artificial Sequence
  chemically synthesized
tgtaatcccagcactttggg

SEQ ID NO: 373644 - DNA, 20 bp, Artificial Sequence
  chemically synthesized
cttcccacctcggcctccca

SEQ ID NO: 373645 - DNA, 20 bp, Artificial Sequence
  chemically synthesized
tcccagcactttgggaggcc

SEQ ID NO: 373646 - DNA, 20 bp, Artificial Sequence
  chemically synthesized
cccagcactttgggaggccg

SEQ ID NO: 373647 - DNA, 20 bp, Artificial Sequence
  chemically synthesized
agcactttgggaggccgagg

SEQ ID NO: 373648 - DNA, 20 bp, Artificial Sequence
  chemically synthesized
gcactttgggaggccgaggt

SEQ ID NO: 373649 - DNA, 20 bp, Artificial Sequence
  chemically synthesized
ctttgggaggccgaggtggg

SEQ ID NO: 373650 - DNA, 20 bp, Artificial Sequence
  chemically synthesized
accttgtaatcttcccacct

SEQ ID NO: 373651 - DNA, 20 bp, Artificial Sequence
  chemically synthesized
ggccgaggtgggaagattac

SEQ ID NO: 373652 - DNA, 20 bp, Artificial Sequence
  chemically synthesized
gccgaggtgggaagattaca

SEQ ID NO: 373653 - DNA, 20 bp, Artificial Sequence
  chemically synthesized
aggtgggaagattacaaggt

SEQ ID NO: 373654 - DNA, 20 bp, Artificial Sequence
  chemically synthesized
ggtgggaagattacaaggtc

SEQ ID NO: 373655 - DNA, 20 bp, Artificial Sequence
  chemically synthesized
tgggaagattacaaggtcag

SEQ ID NO: 373656 - DNA, 20 bp, Artificial Sequence
  chemically synthesized
gattacaaggtcaggagatc

SEQ ID NO: 373657 - DNA, 20 bp, Artificial Sequence
  chemically synthesized
tcaggagatcgagaccatcc

SEQ ID NO: 373658 - DNA, 20 bp, Artificial Sequence
  chemically synthesized
tttcaccgtgttcgccagga

SEQ ID NO: 373659 - DNA, 20 bp, Artificial Sequence
  chemically synthesized
ggggtttcaccgtgttcgcc

SEQ ID NO: 373660 - DNA, 20 bp, Artificial Sequence
  chemically synthesized
cgagaccatcctggcgaaca

SEQ ID NO: 373661 - DNA, 20 bp, Artificial Sequence
  chemically synthesized
cggggtttcaccgtgttcgc

SEQ ID NO: 373662 - DNA, 20 bp, Artificial Sequence
  chemically synthesized
ttgtatttttagtagagacg

SEQ ID NO: 373663 - DNA, 20 bp, Artificial Sequence
  chemically synthesized
tttgtatttttagtagagac

SEQ ID NO: 373664 - DNA, 20 bp, Artificial Sequence
  chemically synthesized
ttttgtatttttagtagaga

SEQ ID NO: 373665 - DNA, 20 bp, Artificial Sequence
  chemically synthesized
aactttttgtatttttagta

SEQ ID NO: 373666 - DNA, 20 bp, Artificial Sequence
  chemically synthesized
ctaactttttgtatttttag

SEQ ID NO: 373667 - DNA, 20 bp, Artificial Sequence
  chemically synthesized
tggctaactttttgtatttt

SEQ ID NO: 373668 - DNA, 20 bp, Artificial Sequence
  chemically synthesized
gtctctactaaaaatacaaa

SEQ ID NO: 373669 - DNA, 20 bp, Artificial Sequence
  chemically synthesized
ctactaaaaatacaaaaagt

SEQ ID NO: 373670 - DNA, 20 bp, Artificial Sequence
  chemically synthesized
taaaaatacaaaaagttagc

SEQ ID NO: 373671 - DNA, 20 bp, Artificial Sequence
  chemically synthesized
aaaaatacaaaaagttagcc

SEQ ID NO: 373672 - DNA, 20 bp, Artificial Sequence
  chemically synthesized
tacaaaaagttagccaggcg

SEQ ID NO: 373673 - DNA, 20 bp, Artificial Sequence
  chemically synthesized
aaaaagttagccaggcgtgg

SEQ ID NO: 373674 - DNA, 20 bp, Artificial Sequence
  chemically synthesized
caggcgcctgccaccacgcc

SEQ ID NO: 373675 - DNA, 20 bp, Artificial Sequence
  chemically synthesized
aagttagccaggcgtggtgg

SEQ ID NO: 373676 - DNA, 20 bp, Artificial Sequence
  chemically synthesized
agttagccaggcgtggtggc

SEQ ID NO: 373677 - DNA, 20 bp, Artificial Sequence
  chemically synthesized
ggcgtggtggcaggcgcctg

SEQ ID NO: 373678 - DNA, 20 bp, Artificial Sequence
  chemically synthesized
gtggcaggcgcctgtggtcc

SEQ ID NO: 373679 - DNA, 20 bp, Artificial Sequence
  chemically synthesized
tcccgagtagctgggaccac

SEQ ID NO: 373680 - DNA, 20 bp, Artificial Sequence
  chemically synthesized
ctcccgagtagctgggacca

SEQ ID NO: 373681 - DNA, 20 bp, Artificial Sequence
  chemically synthesized
cgcctgtggtcccagctact

SEQ ID NO: 373682 - DNA, 20 bp, Artificial Sequence
  chemically synthesized
cctcagcctcccgagtagct

SEQ ID NO: 373683 - DNA, 20 bp, Artificial Sequence
  chemically synthesized
gcctgtggtcccagctactc

SEQ ID NO: 373684 - DNA, 20 bp, Artificial Sequence
  chemically synthesized
gcctcagcctcccgagtagc

SEQ ID NO: 373685 - DNA, 20 bp, Artificial Sequence
  chemically synthesized
ctgtggtcccagctactcgg

SEQ ID NO: 373686 - DNA, 20 bp, Artificial Sequence
  chemically synthesized
tgtggtcccagctactcggg

SEQ ID NO: 373687 - DNA, 20 bp, Artificial Sequence
  chemically synthesized
tcctgcctcagcctcccgag

SEQ ID NO: 373688 - DNA, 20 bp, Artificial Sequence
  chemically synthesized
ttctcctgcctcagcctccc

SEQ ID NO: 373689 - DNA, 20 bp, Artificial Sequence
  chemically synthesized
tcccagctactcgggaggct

SEQ ID NO: 373690 - DNA, 20 bp, Artificial Sequence
  chemically synthesized
cccagctactcgggaggctg

SEQ ID NO: 373691 - DNA, 20 bp, Artificial Sequence
  chemically synthesized
agctactcgggaggctgagg

SEQ ID NO: 373692 - DNA, 20 bp, Artificial Sequence
  chemically synthesized
gctactcgggaggctgaggc

SEQ ID NO: 373693 - DNA, 20 bp, Artificial Sequence
  chemically synthesized
tactcgggaggctgaggcag

SEQ ID NO: 373694 - DNA, 20 bp, Artificial Sequence
  chemically synthesized
ttcacgccattctcctgcct

SEQ ID NO: 373695 - DNA, 20 bp, Artificial Sequence
  chemically synthesized
gggaggctgaggcaggagaa

SEQ ID NO: 373696 - DNA, 20 bp, Artificial Sequence
  chemically synthesized
gcaggagaatggcgtgaacc

SEQ ID NO: 373697 - DNA, 20 bp, Artificial Sequence
  chemically synthesized
caggagaatggcgtgaaccc

SEQ ID NO: 373698 - DNA, 20 bp, Artificial Sequence
  chemically synthesized
ggagaatggcgtgaacccag

SEQ ID NO: 373699 - DNA, 20 bp, Artificial Sequence
  chemically synthesized
gagaatggcgtgaacccagg

SEQ ID NO: 373700 - DNA, 20 bp, Artificial Sequence
  chemically synthesized
cactgcaagcttcgcctcct

SEQ ID NO: 373701 - DNA, 20 bp, Artificial Sequence
  chemically synthesized
tggcgtgaacccaggaggcg

SEQ ID NO: 373702 - DNA, 20 bp, Artificial Sequence
  chemically synthesized
tcactgcaagcttcgcctcc

SEQ ID NO: 373703 - DNA, 20 bp, Artificial Sequence
  chemically synthesized
aacccaggaggcgaagcttg

SEQ ID NO: 373704 - DNA, 20 bp, Artificial Sequence
  chemically synthesized
caggaggcgaagcttgcagt

SEQ ID NO: 373705 - DNA, 20 bp, Artificial Sequence
  chemically synthesized
gcgcgatctcggctcactgc

SEQ ID NO: 373706 - DNA, 20 bp, Artificial Sequence
  chemically synthesized
ggcgaagcttgcagtgagcc

SEQ ID NO: 373707 - DNA, 20 bp, Artificial Sequence
  chemically synthesized
ggagtgcagtggcgcgatct

SEQ ID NO: 373708 - DNA, 20 bp, Artificial Sequence
  chemically synthesized
tcgcccaggctggagtgcag

SEQ ID NO: 373709 - DNA, 20 bp, Artificial Sequence
  chemically synthesized
gagatcgcgccactgcactc

SEQ ID NO: 373710 - DNA, 20 bp, Artificial Sequence
  chemically synthesized
ctgtcgcccaggctggagtg

SEQ ID NO: 373711 - DNA, 20 bp, Artificial Sequence
  chemically synthesized
cgcgccactgcactccagcc

SEQ ID NO: 373712 - DNA, 20 bp, Artificial Sequence
  chemically synthesized
gcgccactgcactccagcct

SEQ ID NO: 373713 - DNA, 20 bp, Artificial Sequence
  chemically synthesized
ttgctctgtcgcccaggctg

SEQ ID NO: 373714 - DNA, 20 bp, Artificial Sequence
  chemically synthesized
tcttgctctgtcgcccaggc

SEQ ID NO: 373715 - DNA, 20 bp, Artificial Sequence
  chemically synthesized
ctgcactccagcctgggcga

SEQ ID NO: 373716 - DNA, 20 bp, Artificial Sequence
  chemically synthesized
ggagtcttgctctgtcgccc

SEQ ID NO: 373717 - DNA, 20 bp, Artificial Sequence
  chemically synthesized
gcactccagcctgggcgaca

SEQ ID NO: 373718 - DNA, 20 bp, Artificial Sequence
  chemically synthesized
cggagtcttgctctgtcgcc

SEQ ID NO: 373719 - DNA, 20 bp, Artificial Sequence
  chemically synthesized
tccagcctgggcgacagagc

SEQ ID NO: 373720 - DNA, 20 bp, Artificial Sequence
  chemically synthesized
ttacctttttttttgagacg

SEQ ID NO: 373721 - DNA, 20 bp, Artificial Sequence
  chemically synthesized
tattacctttttttttgaga

SEQ ID NO: 373722 - DNA, 20 bp, Artificial Sequence
  chemically synthesized
aagactccgtctcaaaaaaa

SEQ ID NO: 373723 - DNA, 20 bp, Artificial Sequence
  chemically synthesized
aggatattaccttttttttt

SEQ ID NO: 373724 - DNA, 20 bp, Artificial Sequence
  chemically synthesized
agactccgtctcaaaaaaaa

SEQ ID NO: 373725 - DNA, 20 bp, Artificial Sequence
  chemically synthesized
gcatgaaattattaggtcaa

SEQ ID NO: 373726 - DNA, 20 bp, Artificial Sequence
  chemically synthesized
cgcatgaaattattaggtca

SEQ ID NO: 373727 - DNA, 20 bp, Artificial Sequence
  chemically synthesized
ttccagcgcatgaaattatt

SEQ ID NO: 373728 - DNA, 20 bp, Artificial Sequence
  chemically synthesized
cttccagcgcatgaaattat

SEQ ID NO: 373729 - DNA, 20 bp, Artificial Sequence
  chemically synthesized
gacctaataatttcatgcgc

SEQ ID NO: 373730 - DNA, 20 bp, Artificial Sequence
  chemically synthesized
ctaataatttcatgcgctgg

SEQ ID NO: 373731 - DNA, 20 bp, Artificial Sequence
  chemically synthesized
gtttccttttagacagcttc

SEQ ID NO: 373732 - DNA, 20 bp, Artificial Sequence
  chemically synthesized
atgcgctggaagctgtctaa

SEQ ID NO: 373733 - DNA, 20 bp, Artificial Sequence
  chemically synthesized
tgcgctggaagctgtctaaa

SEQ ID NO: 373734 - DNA, 20 bp, Artificial Sequence
  chemically synthesized
ccattttgtttccttttaga

SEQ ID NO: 373735 - DNA, 20 bp, Artificial Sequence
  chemically synthesized
tagaccattttgtttccttt

SEQ ID NO: 373736 - DNA, 20 bp, Artificial Sequence
  chemically synthesized
ctgtctaaaaggaaacaaaa

SEQ ID NO: 373737 - DNA, 20 bp, Artificial Sequence
  chemically synthesized
aaggaaacaaaatggtctac

SEQ ID NO: 373738 - DNA, 20 bp, Artificial Sequence
  chemically synthesized
aggaaacaaaatggtctact

SEQ ID NO: 373739 - DNA, 20 bp, Artificial Sequence
  chemically synthesized
tgttgttctaaataacccag

SEQ ID NO: 373740 - DNA, 20 bp, Artificial Sequence
  chemically synthesized
aaatggtctactgggttatt

SEQ ID NO: 373741 - DNA, 20 bp, Artificial Sequence
  chemically synthesized
ttttgttgttctaaataacc

SEQ ID NO: 373742 - DNA, 20 bp, Artificial Sequence
  chemically synthesized
ttattctaaagttaggcatt

SEQ ID NO: 373743 - DNA, 20 bp, Artificial Sequence
  chemically synthesized
aaaaactaaatgcctaactt

SEQ ID NO: 373744 - DNA, 20 bp, Artificial Sequence
  chemically synthesized
tgaccacttattctaaagtt

SEQ ID NO: 373745 - DNA, 20 bp, Artificial Sequence
  chemically synthesized
atgaccacttattctaaagt

SEQ ID NO: 373746 - DNA, 20 bp, Artificial Sequence
  chemically synthesized
taaatgcctaactttagaat

SEQ ID NO: 373747 - DNA, 20 bp, Artificial Sequence
  chemically synthesized
cataatgaccacttattcta

SEQ ID NO: 373748 - DNA, 20 bp, Artificial Sequence
  chemically synthesized
atgcctaactttagaataag

SEQ ID NO: 373749 - DNA, 20 bp, Artificial Sequence
  chemically synthesized
ggtcattatgtgaacattta

SEQ ID NO: 373750 - DNA, 20 bp, Artificial Sequence
  chemically synthesized
taagtgattttaggttatta

SEQ ID NO: 373751 - DNA, 20 bp, Artificial Sequence
  chemically synthesized
actatcacataagtgatttt

SEQ ID NO: 373752 - DNA, 20 bp, Artificial Sequence
  chemically synthesized
tactatcacataagtgattt

SEQ ID NO: 373753 - DNA, 20 bp, Artificial Sequence
  chemically synthesized
acctaaaatcacttatgtga

SEQ ID NO: 373754 - DNA, 20 bp, Artificial Sequence
  chemically synthesized
acccttttttactatcacat

SEQ ID NO: 373755 - DNA, 20 bp, Artificial Sequence
  chemically synthesized
tcacttatgtgatagtaaaa

SEQ ID NO: 373756 - DNA, 20 bp, Artificial Sequence
  chemically synthesized
cacttatgtgatagtaaaaa

SEQ ID NO: 373757 - DNA, 20 bp, Artificial Sequence
  chemically synthesized
acttatgtgatagtaaaaaa

SEQ ID NO: 373758 - DNA, 20 bp, Artificial Sequence
  chemically synthesized
tgatagtaaaaaagggtgaa

SEQ ID NO: 373759 - DNA, 20 bp, Artificial Sequence
  chemically synthesized
agggtgaaaagtcataaata

SEQ ID NO: 373760 - DNA, 20 bp, Artificial Sequence
  chemically synthesized
cacgatcacatctaaataaa

SEQ ID NO: 373761 - DNA, 20 bp, Artificial Sequence
  chemically synthesized
agggttttctgctatttatt

SEQ ID NO: 373762 - DNA, 20 bp, Artificial Sequence
  chemically synthesized
gatcacatctaaataaatag

SEQ ID NO: 373763 - DNA, 20 bp, Artificial Sequence
  chemically synthesized
atagcagaaaaccctcattt

SEQ ID NO: 373764 - DNA, 20 bp, Artificial Sequence
  chemically synthesized
tagcagaaaaccctcatttc

SEQ ID NO: 373765 - DNA, 20 bp, Artificial Sequence
  chemically synthesized
ttcctttttacccgaaatga

SEQ ID NO: 373766 - DNA, 20 bp, Artificial Sequence
  chemically synthesized
gttcctttttacccgaaatg

SEQ ID NO: 373767 - DNA, 20 bp, Artificial Sequence
  chemically synthesized
ggttcctttttacccgaaat

SEQ ID NO: 373768 - DNA, 20 bp, Artificial Sequence
  chemically synthesized
aaaccctcatttcgggtaaa

SEQ ID NO: 373769 - DNA, 20 bp, Artificial Sequence
  chemically synthesized
aaccctcatttcgggtaaaa

SEQ ID NO: 373770 - DNA, 20 bp, Artificial Sequence
  chemically synthesized
tcattttggcatatttcatt

SEQ ID NO: 373771 - DNA, 20 bp, Artificial Sequence
  chemically synthesized
atcattttggcatatttcat

SEQ ID NO: 373772 - DNA, 20 bp, Artificial Sequence
  chemically synthesized
taaagtcattgttatcattt

SEQ ID NO: 373773 - DNA, 20 bp, Artificial Sequence
  chemically synthesized
aaaatgataacaatgacttt

SEQ ID NO: 373774 - DNA, 20 bp, Artificial Sequence
  chemically synthesized
tgataacaatgactttaagt

SEQ ID NO: 373775 - DNA, 20 bp, Artificial Sequence
  chemically synthesized
attaaccatattctcactta

SEQ ID NO: 373776 - DNA, 20 bp, Artificial Sequence
  chemically synthesized
aatgactttaagtgagaata

SEQ ID NO: 373777 - DNA, 20 bp, Artificial Sequence
  chemically synthesized
aattgaatggaagaagtaaa

SEQ ID NO: 373778 - DNA, 20 bp, Artificial Sequence
  chemically synthesized
caattgaatggaagaagtaa

SEQ ID NO: 373779 - DNA, 20 bp, Artificial Sequence
  chemically synthesized
tattcccaattgaatggaag

SEQ ID NO: 373780 - DNA, 20 bp, Artificial Sequence
  chemically synthesized
taatattcccaattgaatgg

SEQ ID NO: 373781 - DNA, 20 bp, Artificial Sequence
  chemically synthesized
ttttacttcttccattcaat

SEQ ID NO: 373782 - DNA, 20 bp, Artificial Sequence
  chemically synthesized
tttacttcttccattcaatt

SEQ ID NO: 373783 - DNA, 20 bp, Artificial Sequence
  chemically synthesized
tattaatattcccaattgaa

SEQ ID NO: 373784 - DNA, 20 bp, Artificial Sequence
  chemically synthesized
caattgggaatattaataat

SEQ ID NO: 373785 - DNA, 20 bp, Artificial Sequence
  chemically synthesized
tattaataattggaccctta

SEQ ID NO: 373786 - DNA, 20 bp, Artificial Sequence
  chemically synthesized
aataattggacccttacagc

SEQ ID NO: 373787 - DNA, 20 bp, Artificial Sequence
  chemically synthesized
gccaccatgcccagctgtaa

SEQ ID NO: 373788 - DNA, 20 bp, Artificial Sequence
  chemically synthesized
ataattggacccttacagct

SEQ ID NO: 373789 - DNA, 20 bp, Artificial Sequence
  chemically synthesized
agccaccatgcccagctgta

SEQ ID NO: 373790 - DNA, 20 bp, Artificial Sequence
  chemically synthesized
gagccaccatgcccagctgt

SEQ ID NO: 373791 - DNA, 20 bp, Artificial Sequence
  chemically synthesized
tggacccttacagctgggca

SEQ ID NO: 373792 - DNA, 20 bp, Artificial Sequence
  chemically synthesized
acccttacagctgggcatgg

SEQ ID NO: 373793 - DNA, 20 bp, Artificial Sequence
  chemically synthesized
caggtgtgagccaccatgcc

SEQ ID NO: 373794 - DNA, 20 bp, Artificial Sequence
  chemically synthesized
agtgctgggattacaggtgt

SEQ ID NO: 373795 - DNA, 20 bp, Artificial Sequence
  chemically synthesized
gtggctcacacctgtaatcc

SEQ ID NO: 373796 - DNA, 20 bp, Artificial Sequence
  chemically synthesized
tcccaaagtgctgggattac

SEQ ID NO: 373797 - DNA, 20 bp, Artificial Sequence
  chemically synthesized
ctcccaaagtgctgggatta

SEQ ID NO: 373798 - DNA, 20 bp, Artificial Sequence
  chemically synthesized
cacctgtaatcccagcactt

SEQ ID NO: 373799 - DNA, 20 bp, Artificial Sequence
  chemically synthesized
cctcagcctcccaaagtgct

SEQ ID NO: 373800 - DNA, 20 bp, Artificial Sequence
  chemically synthesized
acctgtaatcccagcacttt

SEQ ID NO: 373801 - DNA, 20 bp, Artificial Sequence
  chemically synthesized
gcctcagcctcccaaagtgc

SEQ ID NO: 373802 - DNA, 20 bp, Artificial Sequence
  chemically synthesized
ctgtaatcccagcactttgg

SEQ ID NO: 373803 - DNA, 20 bp, Artificial Sequence
  chemically synthesized
tgtaatcccagcactttggg

SEQ ID NO: 373804 - DNA, 20 bp, Artificial Sequence
  chemically synthesized
ctgcccgcctcagcctccca

SEQ ID NO: 373805 - DNA, 20 bp, Artificial Sequence
  chemically synthesized
tcccagcactttgggaggct

SEQ ID NO: 373806 - DNA, 20 bp, Artificial Sequence
  chemically synthesized
cccagcactttgggaggctg

SEQ ID NO: 373807 - DNA, 20 bp, Artificial Sequence
  chemically synthesized
agcactttgggaggctgagg

SEQ ID NO: 373808 - DNA, 20 bp, Artificial Sequence
  chemically synthesized
gcactttgggaggctgaggc

SEQ ID NO: 373809 - DNA, 20 bp, Artificial Sequence
  chemically synthesized
ctttgggaggctgaggcggg

SEQ ID NO: 373810 - DNA, 20 bp, Artificial Sequence
  chemically synthesized
acctcgtgatctgcccgcct

SEQ ID NO: 373811 - DNA, 20 bp, Artificial Sequence
  chemically synthesized
ggctgaggcgggcagatcac

SEQ ID NO: 373812 - DNA, 20 bp, Artificial Sequence
  chemically synthesized
gctgaggcgggcagatcacg

SEQ ID NO: 373813 - DNA, 20 bp, Artificial Sequence
  chemically synthesized
aggcgggcagatcacgaggt

SEQ ID NO: 373814 - DNA, 20 bp, Artificial Sequence
  chemically synthesized
ggcgggcagatcacgaggtc

SEQ ID NO: 373815 - DNA, 20 bp, Artificial Sequence
  chemically synthesized
cgggcagatcacgaggtcag

SEQ ID NO: 373816 - DNA, 20 bp, Artificial Sequence
  chemically synthesized
gatcacgaggtcaggagatc

SEQ ID NO: 373817 - DNA, 20 bp, Artificial Sequence
  chemically synthesized
tcaggagatcgagaccatcc

SEQ ID NO: 373818 - DNA, 20 bp, Artificial Sequence
  chemically synthesized
tttcaccgtgttagccagga

SEQ ID NO: 373819 - DNA, 20 bp, Artificial Sequence
  chemically synthesized
ggggtttcaccgtgttagcc

SEQ ID NO: 373820 - DNA, 20 bp, Artificial Sequence
  chemically synthesized
cgagaccatcctggctaaca

SEQ ID NO: 373821 - DNA, 20 bp, Artificial Sequence
  chemically synthesized
cggggtttcaccgtgttagc

SEQ ID NO: 373822 - DNA, 20 bp, Artificial Sequence
  chemically synthesized
gagacggggtttcaccgtgt

SEQ ID NO: 373823 - DNA, 20 bp, Artificial Sequence
  chemically synthesized
ttgtatttttagtagagacg

SEQ ID NO: 373824 - DNA, 20 bp, Artificial Sequence
  chemically synthesized
tttgtatttttagtagagac

SEQ ID NO: 373825 - DNA, 20 bp, Artificial Sequence
  chemically synthesized
ttttgtatttttagtagaga

SEQ ID NO: 373826 - DNA, 20 bp, Artificial Sequence
  chemically synthesized
aattttttgtatttttagta

SEQ ID NO: 373827 - DNA, 20 bp, Artificial Sequence
  chemically synthesized
ctaattttttgtatttttag

SEQ ID NO: 373828 - DNA, 20 bp, Artificial Sequence
  chemically synthesized
cggctaattttttgtatttt

SEQ ID NO: 373829 - DNA, 20 bp, Artificial Sequence
  chemically synthesized
ctactaaaaatacaaaaaat

SEQ ID NO: 373830 - DNA, 20 bp, Artificial Sequence
  chemically synthesized
taaaaatacaaaaaattagc

SEQ ID NO: 373831 - DNA, 20 bp, Artificial Sequence
  chemically synthesized
aaaaatacaaaaaattagcc

SEQ ID NO: 373832 - DNA, 20 bp, Artificial Sequence
  chemically synthesized
caggctcctgtcagcacgcc

SEQ ID NO: 373833 - DNA, 20 bp, Artificial Sequence
  chemically synthesized
aaattagccgggcgtgctga

SEQ ID NO: 373834 - DNA, 20 bp, Artificial Sequence
  chemically synthesized
aattagccgggcgtgctgac

SEQ ID NO: 373835 - DNA, 20 bp, Artificial Sequence
  chemically synthesized
ttagccgggcgtgctgacag

SEQ ID NO: 373836 - DNA, 20 bp, Artificial Sequence
  chemically synthesized
ctgggactacaggctcctgt

SEQ ID NO: 373837 - DNA, 20 bp, Artificial Sequence
  chemically synthesized
ggcgtgctgacaggagcctg

SEQ ID NO: 373838 - DNA, 20 bp, Artificial Sequence
  chemically synthesized
ctgacaggagcctgtagtcc

SEQ ID NO: 373839 - DNA, 20 bp, Artificial Sequence
  chemically synthesized
tcccaagtagctgggactac

SEQ ID NO: 373840 - DNA, 20 bp, Artificial Sequence
  chemically synthesized
ctcccaagtagctgggacta

SEQ ID NO: 373841 - DNA, 20 bp, Artificial Sequence
  chemically synthesized
agcctgtagtcccagctact

SEQ ID NO: 373842 - DNA, 20 bp, Artificial Sequence
  chemically synthesized
cctcagcctcccaagtagct

SEQ ID NO: 373843 - DNA, 20 bp, Artificial Sequence
  chemically synthesized
gcctgtagtcccagctactt

SEQ ID NO: 373844 - DNA, 20 bp, Artificial Sequence
  chemically synthesized
gcctcagcctcccaagtagc

SEQ ID NO: 373845 - DNA, 20 bp, Artificial Sequence
  chemically synthesized
ctgtagtcccagctacttgg

SEQ ID NO: 373846 - DNA, 20 bp, Artificial Sequence
  chemically synthesized
tgtagtcccagctacttggg

SEQ ID NO: 373847 - DNA, 20 bp, Artificial Sequence
  chemically synthesized
tcctgcctcagcctcccaag

SEQ ID NO: 373848 - DNA, 20 bp, Artificial Sequence
  chemically synthesized
ttctcctgcctcagcctccc

SEQ ID NO: 373849 - DNA, 20 bp, Artificial Sequence
  chemically synthesized
tcccagctacttgggaggct

SEQ ID NO: 373850 - DNA, 20 bp, Artificial Sequence
  chemically synthesized
cccagctacttgggaggctg

SEQ ID NO: 373851 - DNA, 20 bp, Artificial Sequence
  chemically synthesized
agctacttgggaggctgagg

SEQ ID NO: 373852 - DNA, 20 bp, Artificial Sequence
  chemically synthesized
gctacttgggaggctgaggc

SEQ ID NO: 373853 - DNA, 20 bp, Artificial Sequence
  chemically synthesized
tacttgggaggctgaggcag

SEQ ID NO: 373854 - DNA, 20 bp, Artificial Sequence
  chemically synthesized
ttcacaccattctcctgcct

SEQ ID NO: 373855 - DNA, 20 bp, Artificial Sequence
  chemically synthesized
gggaggctgaggcaggagaa

SEQ ID NO: 373856 - DNA, 20 bp, Artificial Sequence
  chemically synthesized
gcaggagaatggtgtgaacc

SEQ ID NO: 373857 - DNA, 20 bp, Artificial Sequence
  chemically synthesized
caggagaatggtgtgaaccc

SEQ ID NO: 373858 - DNA, 20 bp, Artificial Sequence
  chemically synthesized
ggagaatggtgtgaacccgg

SEQ ID NO: 373859 - DNA, 20 bp, Artificial Sequence
  chemically synthesized
gagaatggtgtgaacccggg

SEQ ID NO: 373860 - DNA, 20 bp, Artificial Sequence
  chemically synthesized
aatggtgtgaacccgggagg

SEQ ID NO: 373861 - DNA, 20 bp, Artificial Sequence
  chemically synthesized
cactgcaagctccgcctccc

SEQ ID NO: 373862 - DNA, 20 bp, Artificial Sequence
  chemically synthesized
tggtgtgaacccgggaggcg

SEQ ID NO: 373863 - DNA, 20 bp, Artificial Sequence
  chemically synthesized
tcactgcaagctccgcctcc

SEQ ID NO: 373864 - DNA, 20 bp, Artificial Sequence
  chemically synthesized
aacccgggaggcggagcttg

SEQ ID NO: 373865 - DNA, 20 bp, Artificial Sequence
  chemically synthesized
cgggaggcggagcttgcagt

SEQ ID NO: 373866 - DNA, 20 bp, Artificial Sequence
  chemically synthesized
atgggatctcggctcactgc

SEQ ID NO: 373867 - DNA, 20 bp, Artificial Sequence
  chemically synthesized
ggcggagcttgcagtgagcc

SEQ ID NO: 373868 - DNA, 20 bp, Artificial Sequence
  chemically synthesized
ggagtgcagtgatgggatct

SEQ ID NO: 373869 - DNA, 20 bp, Artificial Sequence
  chemically synthesized
ccaggctggagtgcagtgat

SEQ ID NO: 373870 - DNA, 20 bp, Artificial Sequence
  chemically synthesized
tccaggctggagtgcagtga

SEQ ID NO: 373871 - DNA, 20 bp, Artificial Sequence
  chemically synthesized
gagatcccatcactgcactc

SEQ ID NO: 373872 - DNA, 20 bp, Artificial Sequence
  chemically synthesized
ctgtcatccaggctggagtg

SEQ ID NO: 373873 - DNA, 20 bp, Artificial Sequence
  chemically synthesized
cccatcactgcactccagcc

SEQ ID NO: 373874 - DNA, 20 bp, Artificial Sequence
  chemically synthesized
ttgctctgtcatccaggctg

SEQ ID NO: 373875 - DNA, 20 bp, Artificial Sequence
  chemically synthesized
tcttgctctgtcatccaggc

SEQ ID NO: 373876 - DNA, 20 bp, Artificial Sequence
  chemically synthesized
ctgcactccagcctggatga

SEQ ID NO: 373877 - DNA, 20 bp, Artificial Sequence
  chemically synthesized
ggattcttgctctgtcatcc

SEQ ID NO: 373878 - DNA, 20 bp, Artificial Sequence
  chemically synthesized
gcactccagcctggatgaca

SEQ ID NO: 373879 - DNA, 20 bp, Artificial Sequence
  chemically synthesized
tggattcttgctctgtcatc

SEQ ID NO: 373880 - DNA, 20 bp, Artificial Sequence
  chemically synthesized
tccagcctggatgacagagc

SEQ ID NO: 373881 - DNA, 20 bp, Artificial Sequence
  chemically synthesized
tttatttattttttttgaga

SEQ ID NO: 373882 - DNA, 20 bp, Artificial Sequence
  chemically synthesized
tttatttatttatttttttt

SEQ ID NO: 373883 - DNA, 20 bp, Artificial Sequence
  chemically synthesized
aaaaaaaataaataaataaa

SEQ ID NO: 373884 - DNA, 20 bp, Artificial Sequence
  chemically synthesized
taaataaataaaaagaaaat

SEQ ID NO: 373885 - DNA, 20 bp, Artificial Sequence
  chemically synthesized
ttcttgtatataacagataa

SEQ ID NO: 373886 - DNA, 20 bp, Artificial Sequence
  chemically synthesized
attcttgtatataacagata

SEQ ID NO: 373887 - DNA, 20 bp, Artificial Sequence
  chemically synthesized
gattcttgtatataacagat

SEQ ID NO: 373888 - DNA, 20 bp, Artificial Sequence
  chemically synthesized
gagtcgattcttgtatataa

SEQ ID NO: 373889 - DNA, 20 bp, Artificial Sequence
  chemically synthesized
gacccttatctgttatatac

SEQ ID NO: 373890 - DNA, 20 bp, Artificial Sequence
  chemically synthesized
atacaagaatcgactcaaaa

SEQ ID NO: 373891 - DNA, 20 bp, Artificial Sequence
  chemically synthesized
gtaagtctttaatccatttt

SEQ ID NO: 373892 - DNA, 20 bp, Artificial Sequence
  chemically synthesized
aatcgactcaaaatggatta

SEQ ID NO: 373893 - DNA, 20 bp, Artificial Sequence
  chemically synthesized
caaaatggattaaagactta

SEQ ID NO: 373894 - DNA, 20 bp, Artificial Sequence
  chemically synthesized
aaaatggattaaagacttac

SEQ ID NO: 373895 - DNA, 20 bp, Artificial Sequence
  chemically synthesized
tagtttcaggttttacctgt

SEQ ID NO: 373896 - DNA, 20 bp, Artificial Sequence
  chemically synthesized
cttctagtagttttagtttc

SEQ ID NO: 373897 - DNA, 20 bp, Artificial Sequence
  chemically synthesized
tcttctagtagttttagttt

SEQ ID NO: 373898 - DNA, 20 bp, Artificial Sequence
  chemically synthesized
aaacctgaaactaaaactac

SEQ ID NO: 373899 - DNA, 20 bp, Artificial Sequence
  chemically synthesized
atgttttcttctagtagttt

SEQ ID NO: 373900 - DNA, 20 bp, Artificial Sequence
  chemically synthesized
cctgaaactaaaactactag

SEQ ID NO: 373901 - DNA, 20 bp, Artificial Sequence
  chemically synthesized
tagtccatgttttcttctag

SEQ ID NO: 373902 - DNA, 20 bp, Artificial Sequence
  chemically synthesized
tcatagtccatgttttcttc

SEQ ID NO: 373903 - DNA, 20 bp, Artificial Sequence
  chemically synthesized
aaaactactagaagaaaaca

SEQ ID NO: 373904 - DNA, 20 bp, Artificial Sequence
  chemically synthesized
tagaagaaaacatggactat

SEQ ID NO: 373905 - DNA, 20 bp, Artificial Sequence
  chemically synthesized
gaagaaaacatggactatga

SEQ ID NO: 373906 - DNA, 20 bp, Artificial Sequence
  chemically synthesized
aagaaaacatggactatgag

SEQ ID NO: 373907 - DNA, 20 bp, Artificial Sequence
  chemically synthesized
aaaacatggactatgagagg

SEQ ID NO: 373908 - DNA, 20 bp, Artificial Sequence
  chemically synthesized
caggcatgagccacctctca

SEQ ID NO: 373909 - DNA, 20 bp, Artificial Sequence
  chemically synthesized
agtactgggattacaggcat

SEQ ID NO: 373910 - DNA, 20 bp, Artificial Sequence
  chemically synthesized
gtggctcatgcctgtaatcc

SEQ ID NO: 373911 - DNA, 20 bp, Artificial Sequence
  chemically synthesized
tcccaaagtactgggattac

SEQ ID NO: 373912 - DNA, 20 bp, Artificial Sequence
  chemically synthesized
ctcccaaagtactgggatta

SEQ ID NO: 373913 - DNA, 20 bp, Artificial Sequence
  chemically synthesized
tgcctgtaatcccagtactt

SEQ ID NO: 373914 - DNA, 20 bp, Artificial Sequence
  chemically synthesized
cctcaacctcccaaagtact

SEQ ID NO: 373915 - DNA, 20 bp, Artificial Sequence
  chemically synthesized
gcctgtaatcccagtacttt

SEQ ID NO: 373916 - DNA, 20 bp, Artificial Sequence
  chemically synthesized
gcctcaacctcccaaagtac

SEQ ID NO: 373917 - DNA, 20 bp, Artificial Sequence
  chemically synthesized
ctgtaatcccagtactttgg

SEQ ID NO: 373918 - DNA, 20 bp, Artificial Sequence
  chemically synthesized
tgtaatcccagtactttggg

SEQ ID NO: 373919 - DNA, 20 bp, Artificial Sequence
  chemically synthesized
ctgcccgcctcaacctccca

SEQ ID NO: 373920 - DNA, 20 bp, Artificial Sequence
  chemically synthesized
tcccagtactttgggaggtt

SEQ ID NO: 373921 - DNA, 20 bp, Artificial Sequence
  chemically synthesized
cccagtactttgggaggttg

SEQ ID NO: 373922 - DNA, 20 bp, Artificial Sequence
  chemically synthesized
agtactttgggaggttgagg

SEQ ID NO: 373923 - DNA, 20 bp, Artificial Sequence
  chemically synthesized
gtactttgggaggttgaggc

SEQ ID NO: 373924 - DNA, 20 bp, Artificial Sequence
  chemically synthesized
ctttgggaggttgaggcggg

SEQ ID NO: 373925 - DNA, 20 bp, Artificial Sequence
  chemically synthesized
ggttgaggcgggcagatcat

SEQ ID NO: 373926 - DNA, 20 bp, Artificial Sequence
  chemically synthesized
gttgaggcgggcagatcatg

SEQ ID NO: 373927 - DNA, 20 bp, Artificial Sequence
  chemically synthesized
aggcgggcagatcatgaggt

SEQ ID NO: 373928 - DNA, 20 bp, Artificial Sequence
  chemically synthesized
ggcgggcagatcatgaggtc

SEQ ID NO: 373929 - DNA, 20 bp, Artificial Sequence
  chemically synthesized
gcgggcagatcatgaggtca

SEQ ID NO: 373930 - DNA, 20 bp, Artificial Sequence
  chemically synthesized
cgggcagatcatgaggtcag

SEQ ID NO: 373931 - DNA, 20 bp, Artificial Sequence
  chemically synthesized
gatcatgaggtcaggggttt

SEQ ID NO: 373932 - DNA, 20 bp, Artificial Sequence
  chemically synthesized
tgaggtcaggggtttgagac

SEQ ID NO: 373933 - DNA, 20 bp, Artificial Sequence
  chemically synthesized
tcaggggtttgagaccagcc

SEQ ID NO: 373934 - DNA, 20 bp, Artificial Sequence
  chemically synthesized
tttcgccatgtttgccaggc

SEQ ID NO: 373935 - DNA, 20 bp, Artificial Sequence
  chemically synthesized
ggggtttcgccatgtttgcc

SEQ ID NO: 373936 - DNA, 20 bp, Artificial Sequence
  chemically synthesized
tgagaccagcctggcaaaca

SEQ ID NO: 373937 - DNA, 20 bp, Artificial Sequence
  chemically synthesized
cggggtttcgccatgtttgc

SEQ ID NO: 373938 - DNA, 20 bp, Artificial Sequence
  chemically synthesized
ttgtatttttagtagagacg

SEQ ID NO: 373939 - DNA, 20 bp, Artificial Sequence
  chemically synthesized
tttgtatttttagtagagac

SEQ ID NO: 373940 - DNA, 20 bp, Artificial Sequence
  chemically synthesized
ttttgtatttttagtagaga

SEQ ID NO: 373941 - DNA, 20 bp, Artificial Sequence
  chemically synthesized
taatttttgtatttttagta

SEQ ID NO: 373942 - DNA, 20 bp, Artificial Sequence
  chemically synthesized
gctaatttttgtatttttag

SEQ ID NO: 373943 - DNA, 20 bp, Artificial Sequence
  chemically synthesized
ccggctaatttttgtatttt

SEQ ID NO: 373944 - DNA, 20 bp, Artificial Sequence
  chemically synthesized
tctactaaaaatacaaaaat

SEQ ID NO: 373945 - DNA, 20 bp, Artificial Sequence
  chemically synthesized
ctaaaaatacaaaaattagc

SEQ ID NO: 373946 - DNA, 20 bp, Artificial Sequence
  chemically synthesized
caaaaattagccggtcgttg

SEQ ID NO: 373947 - DNA, 20 bp, Artificial Sequence
  chemically synthesized
caggcgctcaccacaacgac

SEQ ID NO: 373948 - DNA, 20 bp, Artificial Sequence
  chemically synthesized
aattagccggtcgttgtggt

SEQ ID NO: 373949 - DNA, 20 bp, Artificial Sequence
  chemically synthesized
gtcgttgtggtgagcgcctg

SEQ ID NO: 373950 - DNA, 20 bp, Artificial Sequence
  chemically synthesized
gtggtgagcgcctgtagtcc

SEQ ID NO: 373951 - DNA, 20 bp, Artificial Sequence
  chemically synthesized
tcctgagtagctgggactac

SEQ ID NO: 373952 - DNA, 20 bp, Artificial Sequence
  chemically synthesized
ctcctgagtagctgggacta

SEQ ID NO: 373953 - DNA, 20 bp, Artificial Sequence
  chemically synthesized
cgcctgtagtcccagctact

SEQ ID NO: 373954 - DNA, 20 bp, Artificial Sequence
  chemically synthesized
cctcagcctcctgagtagct

SEQ ID NO: 373955 - DNA, 20 bp, Artificial Sequence
  chemically synthesized
gcctgtagtcccagctactc

SEQ ID NO: 373956 - DNA, 20 bp, Artificial Sequence
  chemically synthesized
gcctcagcctcctgagtagc

SEQ ID NO: 373957 - DNA, 20 bp, Artificial Sequence
  chemically synthesized
ctgtagtcccagctactcag

SEQ ID NO: 373958 - DNA, 20 bp, Artificial Sequence
  chemically synthesized
tgtagtcccagctactcagg

SEQ ID NO: 373959 - DNA, 20 bp, Artificial Sequence
  chemically synthesized
tcctgcctcagcctcctgag

SEQ ID NO: 373960 - DNA, 20 bp, Artificial Sequence
  chemically synthesized
ttctcctgcctcagcctcct

SEQ ID NO: 373961 - DNA, 20 bp, Artificial Sequence
  chemically synthesized
tcccagctactcaggaggct

SEQ ID NO: 373962 - DNA, 20 bp, Artificial Sequence
  chemically synthesized
cccagctactcaggaggctg

SEQ ID NO: 373963 - DNA, 20 bp, Artificial Sequence
  chemically synthesized
agctactcaggaggctgagg

SEQ ID NO: 373964 - DNA, 20 bp, Artificial Sequence
  chemically synthesized
gctactcaggaggctgaggc

SEQ ID NO: 373965 - DNA, 20 bp, Artificial Sequence
  chemically synthesized
tactcaggaggctgaggcag

SEQ ID NO: 373966 - DNA, 20 bp, Artificial Sequence
  chemically synthesized
ctccagtgattctcctgcct

SEQ ID NO: 373967 - DNA, 20 bp, Artificial Sequence
  chemically synthesized
ggctgaggcaggagaatcac

SEQ ID NO: 373968 - DNA, 20 bp, Artificial Sequence
  chemically synthesized
ctgaggcaggagaatcactg

SEQ ID NO: 373969 - DNA, 20 bp, Artificial Sequence
  chemically synthesized
gcaggagaatcactggagcc

SEQ ID NO: 373970 - DNA, 20 bp, Artificial Sequence
  chemically synthesized
aacctccaccttccgggctc

SEQ ID NO: 373971 - DNA, 20 bp, Artificial Sequence
  chemically synthesized
ggagaatcactggagcccgg

SEQ ID NO: 373972 - DNA, 20 bp, Artificial Sequence
  chemically synthesized
gagaatcactggagcccgga

SEQ ID NO: 373973 - DNA, 20 bp, Artificial Sequence
  chemically synthesized
aatcactggagcccggaagg

SEQ ID NO: 373974 - DNA, 20 bp, Artificial Sequence
  chemically synthesized
cacagcaacctccaccttcc

SEQ ID NO: 373975 - DNA, 20 bp, Artificial Sequence
  chemically synthesized
tcactggagcccggaaggtg

SEQ ID NO: 373976 - DNA, 20 bp, Artificial Sequence
  chemically synthesized
tcacagcaacctccaccttc

SEQ ID NO: 373977 - DNA, 20 bp, Artificial Sequence
  chemically synthesized
cactggagcccggaaggtgg

SEQ ID NO: 373978 - DNA, 20 bp, Artificial Sequence
  chemically synthesized
cggaaggtggaggttgctgt

SEQ ID NO: 373979 - DNA, 20 bp, Artificial Sequence
  chemically synthesized
ggtggaggttgctgtgagcc

SEQ ID NO: 373980 - DNA, 20 bp, Artificial Sequence
  chemically synthesized
aatggtgcggtctaggctca

SEQ ID NO: 373981 - DNA, 20 bp, Artificial Sequence
  chemically synthesized
ggaatgcaatggtgcggtct

SEQ ID NO: 373982 - DNA, 20 bp, Artificial Sequence
  chemically synthesized
tggaatgcaatggtgcggtc

SEQ ID NO: 373983 - DNA, 20 bp, Artificial Sequence
  chemically synthesized
caggctggaatgcaatggtg

SEQ ID NO: 373984 - DNA, 20 bp, Artificial Sequence
  chemically synthesized
tcacccaggctggaatgcaa

SEQ ID NO: 373985 - DNA, 20 bp, Artificial Sequence
  chemically synthesized
tagaccgcaccattgcattc

SEQ ID NO: 373986 - DNA, 20 bp, Artificial Sequence
  chemically synthesized
cgcaccattgcattccagcc

SEQ ID NO: 373987 - DNA, 20 bp, Artificial Sequence
  chemically synthesized
gcaccattgcattccagcct

SEQ ID NO: 373988 - DNA, 20 bp, Artificial Sequence
  chemically synthesized
tcttgctttgtcacccaggc

SEQ ID NO: 373989 - DNA, 20 bp, Artificial Sequence
  chemically synthesized
acagtcttgctttgtcaccc

SEQ ID NO: 373990 - DNA, 20 bp, Artificial Sequence
  chemically synthesized
gcattccagcctgggtgaca

SEQ ID NO: 373991 - DNA, 20 bp, Artificial Sequence
  chemically synthesized
gacagtcttgctttgtcacc

SEQ ID NO: 373992 - DNA, 20 bp, Artificial Sequence
  chemically synthesized
tccagcctgggtgacaaagc

SEQ ID NO: 373993 - DNA, 20 bp, Artificial Sequence
  chemically synthesized
ttttttttttttttttgaga

SEQ ID NO: 373994 - DNA, 20 bp, Artificial Sequence
  chemically synthesized
tttttttttttttttttttt

SEQ ID NO: 373995 - DNA, 20 bp, Artificial Sequence
  chemically synthesized
aaaaaaaaaacatcaactaa

SEQ ID NO: 373996 - DNA, 20 bp, Artificial Sequence
  chemically synthesized
agaccaatgtcataagcttt

SEQ ID NO: 373997 - DNA, 20 bp, Artificial Sequence
  chemically synthesized
caactaaaagcttatgacat

SEQ ID NO: 373998 - DNA, 20 bp, Artificial Sequence
  chemically synthesized
cttgcccagaccaatgtcat

SEQ ID NO: 373999 - DNA, 20 bp, Artificial Sequence
  chemically synthesized
aaaagcttatgacattggtc

SEQ ID NO: 374000 - DNA, 20 bp, Artificial Sequence
  chemically synthesized
aaagcttatgacattggtct

SEQ ID NO: 374001 - DNA, 20 bp, Artificial Sequence
  chemically synthesized
cttatgacattggtctgggc

SEQ ID NO: 374002 - DNA, 20 bp, Artificial Sequence
  chemically synthesized
ttatgacattggtctgggca

SEQ ID NO: 374003 - DNA, 20 bp, Artificial Sequence
  chemically synthesized
atatccaaaaaatccttgcc

SEQ ID NO: 374004 - DNA, 20 bp, Artificial Sequence
  chemically synthesized
tggtctgggcaaggattttt

SEQ ID NO: 374005 - DNA, 20 bp, Artificial Sequence
  chemically synthesized
gattttttggatatgaaccc

SEQ ID NO: 374006 - DNA, 20 bp, Artificial Sequence
  chemically synthesized
ttttttggatatgaacccaa

SEQ ID NO: 374007 - DNA, 20 bp, Artificial Sequence
  chemically synthesized
tggatatgaacccaagagca

SEQ ID NO: 374008 - DNA, 20 bp, Artificial Sequence
  chemically synthesized
tttttgttgcctatgctctt

SEQ ID NO: 374009 - DNA, 20 bp, Artificial Sequence
  chemically synthesized
ggatatgaacccaagagcat

SEQ ID NO: 374010 - DNA, 20 bp, Artificial Sequence
  chemically synthesized
atttttgttgcctatgctct

SEQ ID NO: 374011 - DNA, 20 bp, Artificial Sequence
  chemically synthesized
ataggcaacaaaaataaaaa

SEQ ID NO: 374012 - DNA, 20 bp, Artificial Sequence
  chemically synthesized
aaaataaaaatagacaaatg

SEQ ID NO: 374013 - DNA, 20 bp, Artificial Sequence
  chemically synthesized
tgaagttgcatcaacctaaa

SEQ ID NO: 374014 - DNA, 20 bp, Artificial Sequence
  chemically synthesized
tggctgtgcagaagctgttt

SEQ ID NO: 374015 - DNA, 20 bp, Artificial Sequence
  chemically synthesized
ttggctgtgcagaagctgtt

SEQ ID NO: 374016 - DNA, 20 bp, Artificial Sequence
  chemically synthesized
caacctaaacagcttctgca

SEQ ID NO: 374017 - DNA, 20 bp, Artificial Sequence
  chemically synthesized
ttatttccttggctgtgcag

SEQ ID NO: 374018 - DNA, 20 bp, Artificial Sequence
  chemically synthesized
taaacagcttctgcacagcc

SEQ ID NO: 374019 - DNA, 20 bp, Artificial Sequence
  chemically synthesized
ggattatttccttggctgtg

SEQ ID NO: 374020 - DNA, 20 bp, Artificial Sequence
  chemically synthesized
aaacagcttctgcacagcca

SEQ ID NO: 374021 - DNA, 20 bp, Artificial Sequence
  chemically synthesized
ctgaaaagggattatttcct

SEQ ID NO: 374022 - DNA, 20 bp, Artificial Sequence
  chemically synthesized
ccaaggaaataatccctttt

SEQ ID NO: 374023 - DNA, 20 bp, Artificial Sequence
  chemically synthesized
caaggaaataatcccttttc

SEQ ID NO: 374024 - DNA, 20 bp, Artificial Sequence
  chemically synthesized
gtataccatatacctgaaaa

SEQ ID NO: 374025 - DNA, 20 bp, Artificial Sequence
  chemically synthesized
tgtataccatatacctgaaa

SEQ ID NO: 374026 - DNA, 20 bp, Artificial Sequence
  chemically synthesized
ttgtataccatatacctgaa

SEQ ID NO: 374027 - DNA, 20 bp, Artificial Sequence
  chemically synthesized
ataatcccttttcaggtata

SEQ ID NO: 374028 - DNA, 20 bp, Artificial Sequence
  chemically synthesized
agggacaactcatggagcag

SEQ ID NO: 374029 - DNA, 20 bp, Artificial Sequence
  chemically synthesized
aatattttctcctgctccat

SEQ ID NO: 374030 - DNA, 20 bp, Artificial Sequence
  chemically synthesized
gaagggacaactcatggagc

SEQ ID NO: 374031 - DNA, 20 bp, Artificial Sequence
  chemically synthesized
tgaagggacaactcatggag

SEQ ID NO: 374032 - DNA, 20 bp, Artificial Sequence
  chemically synthesized
gagtgaagggacaactcatg

SEQ ID NO: 374033 - DNA, 20 bp, Artificial Sequence
  chemically synthesized
cagagtgaagggacaactca

SEQ ID NO: 374034 - DNA, 20 bp, Artificial Sequence
  chemically synthesized
tggatattaatcagagtgaa

SEQ ID NO: 374035 - DNA, 20 bp, Artificial Sequence
  chemically synthesized
ttggatattaatcagagtga

SEQ ID NO: 374036 - DNA, 20 bp, Artificial Sequence
  chemically synthesized
tttggatattaatcagagtg

SEQ ID NO: 374037 - DNA, 20 bp, Artificial Sequence
  chemically synthesized
atatttttggatattaatca

SEQ ID NO: 374038 - DNA, 20 bp, Artificial Sequence
  chemically synthesized
atatatttttggatattaat

SEQ ID NO: 374039 - DNA, 20 bp, Artificial Sequence
  chemically synthesized
taaggtttcttatatatttt

SEQ ID NO: 374040 - DNA, 20 bp, Artificial Sequence
  chemically synthesized
attaatatccaaaaatatat

SEQ ID NO: 374041 - DNA, 20 bp, Artificial Sequence
  chemically synthesized
ttgtattgctattgagttta

SEQ ID NO: 374042 - DNA, 20 bp, Artificial Sequence
  chemically synthesized
gttgtattgctattgagttt

SEQ ID NO: 374043 - DNA, 20 bp, Artificial Sequence
  chemically synthesized
ataagaaaccttaaactcaa

SEQ ID NO: 374044 - DNA, 20 bp, Artificial Sequence
  chemically synthesized
tgggttgttgtattgctatt

SEQ ID NO: 374045 - DNA, 20 bp, Artificial Sequence
  chemically synthesized
tcctttgcccatatttaatt

SEQ ID NO: 374046 - DNA, 20 bp, Artificial Sequence
  chemically synthesized
gtcctttgcccatatttaat

SEQ ID NO: 374047 - DNA, 20 bp, Artificial Sequence
  chemically synthesized
tacaacaacccaattaaata

SEQ ID NO: 374048 - DNA, 20 bp, Artificial Sequence
  chemically synthesized
acaacaacccaattaaatat

SEQ ID NO: 374049 - DNA, 20 bp, Artificial Sequence
  chemically synthesized
aacccaattaaatatgggca

SEQ ID NO: 374050 - DNA, 20 bp, Artificial Sequence
  chemically synthesized
acccaattaaatatgggcaa

SEQ ID NO: 374051 - DNA, 20 bp, Artificial Sequence
  chemically synthesized
atatgggcaaaggacctcaa

SEQ ID NO: 374052 - DNA, 20 bp, Artificial Sequence
  chemically synthesized
ttcaaaaaaaaagtctgttg

SEQ ID NO: 374053 - DNA, 20 bp, Artificial Sequence
  chemically synthesized
tttcaaaaaaaaagtctgtt

SEQ ID NO: 374054 - DNA, 20 bp, Artificial Sequence
  chemically synthesized
gcttttttatttcaaaaaaa

SEQ ID NO: 374055 - DNA, 20 bp, Artificial Sequence
  chemically synthesized
actttttttttgaaataaaa

SEQ ID NO: 374056 - DNA, 20 bp, Artificial Sequence
  chemically synthesized
tttactttgtcatattttaa

SEQ ID NO: 374057 - DNA, 20 bp, Artificial Sequence
  chemically synthesized
aaagcttttaaaatatgaca

SEQ ID NO: 374058 - DNA, 20 bp, Artificial Sequence
  chemically synthesized
aatatgacaaagtaaaatca

SEQ ID NO: 374059 - DNA, 20 bp, Artificial Sequence
  chemically synthesized
atgacaaagtaaaatcacag

SEQ ID NO: 374060 - DNA, 20 bp, Artificial Sequence
  chemically synthesized
tcacagtggcaactgtgatt

SEQ ID NO: 374061 - DNA, 20 bp, Artificial Sequence
  chemically synthesized
cacagtggcaactgtgatta

SEQ ID NO: 374062 - DNA, 20 bp, Artificial Sequence
  chemically synthesized
aaaattcagttccttaatca

SEQ ID NO: 374063 - DNA, 20 bp, Artificial Sequence
  chemically synthesized
aaaaataaaaaataaaaatt

SEQ ID NO: 374064 - DNA, 20 bp, Artificial Sequence
  chemically synthesized
ttttattttttatttttttt

SEQ ID NO: 374065 - DNA, 20 bp, Artificial Sequence
  chemically synthesized
tttttattttttttaagttc

SEQ ID NO: 374066 - DNA, 20 bp, Artificial Sequence
  chemically synthesized
ttttattttttttaagttct

SEQ ID NO: 374067 - DNA, 20 bp, Artificial Sequence
  chemically synthesized
cacgttctgcacatgtatcc

SEQ ID NO: 374068 - DNA, 20 bp, Artificial Sequence
  chemically synthesized
taagttctgggatacatgtg

SEQ ID NO: 374069 - DNA, 20 bp, Artificial Sequence
  chemically synthesized
ggatacatgtgcagaacgtg

SEQ ID NO: 374070 - DNA, 20 bp, Artificial Sequence
  chemically synthesized
gatacatgtgcagaacgtgc

SEQ ID NO: 374071 - DNA, 20 bp, Artificial Sequence
  chemically synthesized
gaacgtgcaggcttcttaca

SEQ ID NO: 374072 - DNA, 20 bp, Artificial Sequence
  chemically synthesized
aacgtgcaggcttcttacat

SEQ ID NO: 374073 - DNA, 20 bp, Artificial Sequence
  chemically synthesized
cacatgtatacctatgtaag

SEQ ID NO: 374074 - DNA, 20 bp, Artificial Sequence
  chemically synthesized
tggcacatgtatacctatgt

SEQ ID NO: 374075 - DNA, 20 bp, Artificial Sequence
  chemically synthesized
acataggtatacatgtgcca

SEQ ID NO: 374076 - DNA, 20 bp, Artificial Sequence
  chemically synthesized
taggtatacatgtgccatgg

SEQ ID NO: 374077 - DNA, 20 bp, Artificial Sequence
  chemically synthesized
atagatgcagcaaaccacca

SEQ ID NO: 374078 - DNA, 20 bp, Artificial Sequence
  chemically synthesized
agatgacgggttgatagatg

SEQ ID NO: 374079 - DNA, 20 bp, Artificial Sequence
  chemically synthesized
aaacctagatgacgggttga

SEQ ID NO: 374080 - DNA, 20 bp, Artificial Sequence
  chemically synthesized
gcatctatcaacccgtcatc

SEQ ID NO: 374081 - DNA, 20 bp, Artificial Sequence
  chemically synthesized
catctatcaacccgtcatct

SEQ ID NO: 374082 - DNA, 20 bp, Artificial Sequence
  chemically synthesized
ggacttaaaacctagatgac

SEQ ID NO: 374083 - DNA, 20 bp, Artificial Sequence
  chemically synthesized
aggacttaaaacctagatga

SEQ ID NO: 374084 - DNA, 20 bp, Artificial Sequence
  chemically synthesized
caacccgtcatctaggtttt

SEQ ID NO: 374085 - DNA, 20 bp, Artificial Sequence
  chemically synthesized
tgcacacaggacttaaaacc

SEQ ID NO: 374086 - DNA, 20 bp, Artificial Sequence
  chemically synthesized
gacaaatacctaatgcacac

SEQ ID NO: 374087 - DNA, 20 bp, Artificial Sequence
  chemically synthesized
gttttaagtcctgtgtgcat

SEQ ID NO: 374088 - DNA, 20 bp, Artificial Sequence
  chemically synthesized
ggacaaatacctaatgcaca

SEQ ID NO: 374089 - DNA, 20 bp, Artificial Sequence
  chemically synthesized
ttttaagtcctgtgtgcatt

SEQ ID NO: 374090 - DNA, 20 bp, Artificial Sequence
  chemically synthesized
gcaaggggagggagagcatt

SEQ ID NO: 374091 - DNA, 20 bp, Artificial Sequence
  chemically synthesized
agcaaggggagggagagcat

SEQ ID NO: 374092 - DNA, 20 bp, Artificial Sequence
  chemically synthesized
gtagggagcaaggggaggga

SEQ ID NO: 374093 - DNA, 20 bp, Artificial Sequence
  chemically synthesized
gcgtagggagcaaggggagg

SEQ ID NO: 374094 - DNA, 20 bp, Artificial Sequence
  chemically synthesized
gggcgtagggagcaagggga

SEQ ID NO: 374095 - DNA, 20 bp, Artificial Sequence
  chemically synthesized
ggggcgtagggagcaagggg

SEQ ID NO: 374096 - DNA, 20 bp, Artificial Sequence
  chemically synthesized
gggggcgtagggagcaaggg

SEQ ID NO: 374097 - DNA, 20 bp, Artificial Sequence
  chemically synthesized
gtgggggcgtagggagcaag

SEQ ID NO: 374098 - DNA, 20 bp, Artificial Sequence
  chemically synthesized
ggtgggggcgtagggagcaa

SEQ ID NO: 374099 - DNA, 20 bp, Artificial Sequence
  chemically synthesized
gggtgggggcgtagggagca

SEQ ID NO: 374100 - DNA, 20 bp, Artificial Sequence
  chemically synthesized
ggggtgggggcgtagggagc

SEQ ID NO: 374101 - DNA, 20 bp, Artificial Sequence
  chemically synthesized
tgtgggggtgggggcgtagg

SEQ ID NO: 374102 - DNA, 20 bp, Artificial Sequence
  chemically synthesized
cctgtgggggtgggggcgta

SEQ ID NO: 374103 - DNA, 20 bp, Artificial Sequence
  chemically synthesized
gcctgtgggggtgggggcgt

SEQ ID NO: 374104 - DNA, 20 bp, Artificial Sequence
  chemically synthesized
agcctgtgggggtgggggcg

SEQ ID NO: 374105 - DNA, 20 bp, Artificial Sequence
  chemically synthesized
accggagcctgtgggggtgg

SEQ ID NO: 374106 - DNA, 20 bp, Artificial Sequence
  chemically synthesized
gaccggagcctgtgggggtg

SEQ ID NO: 374107 - DNA, 20 bp, Artificial Sequence
  chemically synthesized
tccctacgcccccaccccca

SEQ ID NO: 374108 - DNA, 20 bp, Artificial Sequence
  chemically synthesized
agaccggagcctgtgggggt

SEQ ID NO: 374109 - DNA, 20 bp, Artificial Sequence
  chemically synthesized
ccctacgcccccacccccac

SEQ ID NO: 374110 - DNA, 20 bp, Artificial Sequence
  chemically synthesized
cagaccggagcctgtggggg

SEQ ID NO: 374111 - DNA, 20 bp, Artificial Sequence
  chemically synthesized
tgacagaccggagcctgtgg

SEQ ID NO: 374112 - DNA, 20 bp, Artificial Sequence
  chemically synthesized
atgacagaccggagcctgtg

SEQ ID NO: 374113 - DNA, 20 bp, Artificial Sequence
  chemically synthesized
catgacagaccggagcctgt

SEQ ID NO: 374114 - DNA, 20 bp, Artificial Sequence
  chemically synthesized
gcccccacccccacaggctc

SEQ ID NO: 374115 - DNA, 20 bp, Artificial Sequence
  chemically synthesized
acatgacagaccggagcctg

SEQ ID NO: 374116 - DNA, 20 bp, Artificial Sequence
  chemically synthesized
gaggggaacatgacagaccg

SEQ ID NO: 374117 - DNA, 20 bp, Artificial Sequence
  chemically synthesized
gggaggggaacatgacagac

SEQ ID NO: 374118 - DNA, 20 bp, Artificial Sequence
  chemically synthesized
acacggggaggggaacatga

SEQ ID NO: 374119 - DNA, 20 bp, Artificial Sequence
  chemically synthesized
tgagacatggacacggggag

SEQ ID NO: 374120 - DNA, 20 bp, Artificial Sequence
  chemically synthesized
ttgagacatggacacgggga

SEQ ID NO: 374121 - DNA, 20 bp, Artificial Sequence
  chemically synthesized
gttgagacatggacacgggg

SEQ ID NO: 374122 - DNA, 20 bp, Artificial Sequence
  chemically synthesized
cgttgagacatggacacggg

SEQ ID NO: 374123 - DNA, 20 bp, Artificial Sequence
  chemically synthesized
ctcgttgagacatggacacg

SEQ ID NO: 374124 - DNA, 20 bp, Artificial Sequence
  chemically synthesized
gctcgttgagacatggacac

SEQ ID NO: 374125 - DNA, 20 bp, Artificial Sequence
  chemically synthesized
tgctcgttgagacatggaca

SEQ ID NO: 374126 - DNA, 20 bp, Artificial Sequence
  chemically synthesized
aagacatgctcgttgagaca

SEQ ID NO: 374127 - DNA, 20 bp, Artificial Sequence
  chemically synthesized
ccccgtgtccatgtctcaac

SEQ ID NO: 374128 - DNA, 20 bp, Artificial Sequence
  chemically synthesized
tcccttaagacatgctcgtt

SEQ ID NO: 374129 - DNA, 20 bp, Artificial Sequence
  chemically synthesized
tgtctcaacgagcatgtctt

SEQ ID NO: 374130 - DNA, 20 bp, Artificial Sequence
  chemically synthesized
gtctcaacgagcatgtctta

SEQ ID NO: 374131 - DNA, 20 bp, Artificial Sequence
  chemically synthesized
tctcaacgagcatgtcttaa

SEQ ID NO: 374132 - DNA, 20 bp, Artificial Sequence
  chemically synthesized
gttgtccatttgtttccctt

SEQ ID NO: 374133 - DNA, 20 bp, Artificial Sequence
  chemically synthesized
catgtcttaagggaaacaaa

SEQ ID NO: 374134 - DNA, 20 bp, Artificial Sequence
  chemically synthesized
taagggaaacaaatggacaa

SEQ ID NO: 374135 - DNA, 20 bp, Artificial Sequence
  chemically synthesized
aagggaaacaaatggacaac

SEQ ID NO: 374136 - DNA, 20 bp, Artificial Sequence
  chemically synthesized
tatgacaaaatgcttatcat

SEQ ID NO: 374137 - DNA, 20 bp, Artificial Sequence
  chemically synthesized
gcagttacctgactaatgat

SEQ ID NO: 374138 - DNA, 20 bp, Artificial Sequence
  chemically synthesized
acaaaatgcttatcattagt

SEQ ID NO: 374139 - DNA, 20 bp, Artificial Sequence
  chemically synthesized
caaaatgcttatcattagtc

SEQ ID NO: 374140 - DNA, 20 bp, Artificial Sequence
  chemically synthesized
tagcatattgttttaatttg

SEQ ID NO: 374141 - DNA, 20 bp, Artificial Sequence
  chemically synthesized
ttctgacaggtgtggggtga

SEQ ID NO: 374142 - DNA, 20 bp, Artificial Sequence
  chemically synthesized
tagccattctgacaggtgtg

SEQ ID NO: 374143 - DNA, 20 bp, Artificial Sequence
  chemically synthesized
atagccattctgacaggtgt

SEQ ID NO: 374144 - DNA, 20 bp, Artificial Sequence
  chemically synthesized
tgctatcaccccacacctgt

SEQ ID NO: 374145 - DNA, 20 bp, Artificial Sequence
  chemically synthesized
aatagccattctgacaggtg

SEQ ID NO: 374146 - DNA, 20 bp, Artificial Sequence
  chemically synthesized
tcaccccacacctgtcagaa

SEQ ID NO: 374147 - DNA, 20 bp, Artificial Sequence
  chemically synthesized
ttgagaatagccattctgac

SEQ ID NO: 374148 - DNA, 20 bp, Artificial Sequence
  chemically synthesized
tttgagaatagccattctga

SEQ ID NO: 374149 - DNA, 20 bp, Artificial Sequence
  chemically synthesized
atcctttgtctttttgagaa

SEQ ID NO: 374150 - DNA, 20 bp, Artificial Sequence
  chemically synthesized
tcagaatggctattctcaaa

SEQ ID NO: 374151 - DNA, 20 bp, Artificial Sequence
  chemically synthesized
tagttatcctttgtcttttt

SEQ ID NO: 374152 - DNA, 20 bp, Artificial Sequence
  chemically synthesized
tggctattctcaaaaagaca

SEQ ID NO: 374153 - DNA, 20 bp, Artificial Sequence
  chemically synthesized
ggctattctcaaaaagacaa

SEQ ID NO: 374154 - DNA, 20 bp, Artificial Sequence
  chemically synthesized
tcaaaaagacaaaggataac

SEQ ID NO: 374155 - DNA, 20 bp, Artificial Sequence
  chemically synthesized
agacaaaggataactagtgt

SEQ ID NO: 374156 - DNA, 20 bp, Artificial Sequence
  chemically synthesized
ttccatattctcaccaacac

SEQ ID NO: 374157 - DNA, 20 bp, Artificial Sequence
  chemically synthesized
aaaggataactagtgttggt

SEQ ID NO: 374158 - DNA, 20 bp, Artificial Sequence
  chemically synthesized
aactagtgttggtgagaata

SEQ ID NO: 374159 - DNA, 20 bp, Artificial Sequence
  chemically synthesized
gtgttggtgagaatatggaa

SEQ ID NO: 374160 - DNA, 20 bp, Artificial Sequence
  chemically synthesized
gttggtgagaatatggaaaa

SEQ ID NO: 374161 - DNA, 20 bp, Artificial Sequence
  chemically synthesized
ttggtgagaatatggaaaag

SEQ ID NO: 374162 - DNA, 20 bp, Artificial Sequence
  chemically synthesized
tggtgagaatatggaaaaga

SEQ ID NO: 374163 - DNA, 20 bp, Artificial Sequence
  chemically synthesized
tatggaaaagagggaaacct

SEQ ID NO: 374164 - DNA, 20 bp, Artificial Sequence
  chemically synthesized
atgttcccattaagggtcca

SEQ ID NO: 374165 - DNA, 20 bp, Artificial Sequence
  chemically synthesized
tatgttcccattaagggtcc

SEQ ID NO: 374166 - DNA, 20 bp, Artificial Sequence
  chemically synthesized
gggaaaccttggacccttaa

SEQ ID NO: 374167 - DNA, 20 bp, Artificial Sequence
  chemically synthesized
ggaaaccttggacccttaat

SEQ ID NO: 374168 - DNA, 20 bp, Artificial Sequence
  chemically synthesized
cctatttatgttcccattaa

SEQ ID NO: 374169 - DNA, 20 bp, Artificial Sequence
  chemically synthesized
acctatttatgttcccatta

SEQ ID NO: 374170 - DNA, 20 bp, Artificial Sequence
  chemically synthesized
tacctatttatgttcccatt

SEQ ID NO: 374171 - DNA, 20 bp, Artificial Sequence
  chemically synthesized
acccttaatgggaacataaa

SEQ ID NO: 374172 - DNA, 20 bp, Artificial Sequence
  chemically synthesized
cccttaatgggaacataaat

SEQ ID NO: 374173 - DNA, 20 bp, Artificial Sequence
  chemically synthesized
aatgggaacataaataggta

SEQ ID NO: 374174 - DNA, 20 bp, Artificial Sequence
  chemically synthesized
ataaataggtacagccatta

SEQ ID NO: 374175 - DNA, 20 bp, Artificial Sequence
  chemically synthesized
cttcctgctgttttccataa

SEQ ID NO: 374176 - DNA, 20 bp, Artificial Sequence
  chemically synthesized
ggtacagccattatggaaaa

SEQ ID NO: 374177 - DNA, 20 bp, Artificial Sequence
  chemically synthesized
acagccattatggaaaacag

SEQ ID NO: 374178 - DNA, 20 bp, Artificial Sequence
  chemically synthesized
cagccattatggaaaacagc

SEQ ID NO: 374179 - DNA, 20 bp, Artificial Sequence
  chemically synthesized
ccattatggaaaacagcagg

SEQ ID NO: 374180 - DNA, 20 bp, Artificial Sequence
  chemically synthesized
tctatttttatttttttttg

SEQ ID NO: 374181 - DNA, 20 bp, Artificial Sequence
  chemically synthesized
tcttcaaaaaaaaataaaaa

SEQ ID NO: 374182 - DNA, 20 bp, Artificial Sequence
  chemically synthesized
gagattgctggattgtatgg

SEQ ID NO: 374183 - DNA, 20 bp, Artificial Sequence
  chemically synthesized
aatagaactaccatacaatc

SEQ ID NO: 374184 - DNA, 20 bp, Artificial Sequence
  chemically synthesized
agtgagattgctggattgta

SEQ ID NO: 374185 - DNA, 20 bp, Artificial Sequence
  chemically synthesized
gtacccagtagtgagattgc

SEQ ID NO: 374186 - DNA, 20 bp, Artificial Sequence
  chemically synthesized
caatccagcaatctcactac

SEQ ID NO: 374187 - DNA, 20 bp, Artificial Sequence
  chemically synthesized
aatccagcaatctcactact

SEQ ID NO: 374188 - DNA, 20 bp, Artificial Sequence
  chemically synthesized
ttaggtatgtacccagtagt

SEQ ID NO: 374189 - DNA, 20 bp, Artificial Sequence
  chemically synthesized
ttccttaggtatgtacccag

SEQ ID NO: 374190 - DNA, 20 bp, Artificial Sequence
  chemically synthesized
catttccttaggtatgtacc

SEQ ID NO: 374191 - DNA, 20 bp, Artificial Sequence
  chemically synthesized
tcactactgggtacatacct

SEQ ID NO: 374192 - DNA, 20 bp, Artificial Sequence
  chemically synthesized
cactactgggtacataccta

SEQ ID NO: 374193 - DNA, 20 bp, Artificial Sequence
  chemically synthesized
tatactgatgtcatttcctt

SEQ ID NO: 374194 - DNA, 20 bp, Artificial Sequence
  chemically synthesized
atatactgatgtcatttcct

SEQ ID NO: 374195 - DNA, 20 bp, Artificial Sequence
  chemically synthesized
catacctaaggaaatgacat

SEQ ID NO: 374196 - DNA, 20 bp, Artificial Sequence
  chemically synthesized
ggaaatgacatcagtatatc

SEQ ID NO: 374197 - DNA, 20 bp, Artificial Sequence
  chemically synthesized
aatgacatcagtatatcaag

SEQ ID NO: 374198 - DNA, 20 bp, Artificial Sequence
  chemically synthesized
ccacaataaacacgggtgtg

SEQ ID NO: 374199 - DNA, 20 bp, Artificial Sequence
  chemically synthesized
aatactgccacaataaacac

SEQ ID NO: 374200 - DNA, 20 bp, Artificial Sequence
  chemically synthesized
gaatactgccacaataaaca

SEQ ID NO: 374201 - DNA, 20 bp, Artificial Sequence
  chemically synthesized
ctgcacacccgtgtttattg

SEQ ID NO: 374202 - DNA, 20 bp, Artificial Sequence
  chemically synthesized
cacacccgtgtttattgtgg

SEQ ID NO: 374203 - DNA, 20 bp, Artificial Sequence
  chemically synthesized
tattgtggcagtattcacat

SEQ ID NO: 374204 - DNA, 20 bp, Artificial Sequence
  chemically synthesized
tggcagtattcacattagac

SEQ ID NO: 374205 - DNA, 20 bp, Artificial Sequence
  chemically synthesized
tattcacattagacaagata

SEQ ID NO: 374206 - DNA, 20 bp, Artificial Sequence
  chemically synthesized
acaagatatggaatcaacct

SEQ ID NO: 374207 - DNA, 20 bp, Artificial Sequence
  chemically synthesized
tcatctgttgatggttactt

SEQ ID NO: 374208 - DNA, 20 bp, Artificial Sequence
  chemically synthesized
ttcatctgttgatggttact

SEQ ID NO: 374209 - DNA, 20 bp, Artificial Sequence
  chemically synthesized
tcaacctaagtaaccatcaa

SEQ ID NO: 374210 - DNA, 20 bp, Artificial Sequence
  chemically synthesized
tgaatccgttcatctgttga

SEQ ID NO: 374211 - DNA, 20 bp, Artificial Sequence
  chemically synthesized
agtaaccatcaacagatgaa

SEQ ID NO: 374212 - DNA, 20 bp, Artificial Sequence
  chemically synthesized
gatgaacggattcaaaaatg

SEQ ID NO: 374213 - DNA, 20 bp, Artificial Sequence
  chemically synthesized
aatgtggaatatacacacaa

SEQ ID NO: 374214 - DNA, 20 bp, Artificial Sequence
  chemically synthesized
attttcttattaaagttgaa

SEQ ID NO: 374215 - DNA, 20 bp, Artificial Sequence
  chemically synthesized
gaacactattcaactttaat

SEQ ID NO: 374216 - DNA, 20 bp, Artificial Sequence
  chemically synthesized
attacaggattttcttatta

SEQ ID NO: 374217 - DNA, 20 bp, Artificial Sequence
  chemically synthesized
taataagaaaatcctgtaat

SEQ ID NO: 374218 - DNA, 20 bp, Artificial Sequence
  chemically synthesized
aataagaaaatcctgtaatt

SEQ ID NO: 374219 - DNA, 20 bp, Artificial Sequence
  chemically synthesized
accacattgttcccaattac

SEQ ID NO: 374220 - DNA, 20 bp, Artificial Sequence
  chemically synthesized
aaccacattgttcccaatta

SEQ ID NO: 374221 - DNA, 20 bp, Artificial Sequence
  chemically synthesized
tcctgtaattgggaacaatg

SEQ ID NO: 374222 - DNA, 20 bp, Artificial Sequence
  chemically synthesized
gggaacaatgtggttgaacc

SEQ ID NO: 374223 - DNA, 20 bp, Artificial Sequence
  chemically synthesized
gaacaatgtggttgaacctg

SEQ ID NO: 374224 - DNA, 20 bp, Artificial Sequence
  chemically synthesized
aacaatgtggttgaacctgg

SEQ ID NO: 374225 - DNA, 20 bp, Artificial Sequence
  chemically synthesized
tgaaaactccaaaatcctcc

SEQ ID NO: 374226 - DNA, 20 bp, Artificial Sequence
  chemically synthesized
ttgaaaactccaaaatcctc

SEQ ID NO: 374227 - DNA, 20 bp, Artificial Sequence
  chemically synthesized
tggttgaacctggaggattt

SEQ ID NO: 374228 - DNA, 20 bp, Artificial Sequence
  chemically synthesized
gttgaacctggaggattttg

SEQ ID NO: 374229 - DNA, 20 bp, Artificial Sequence
  chemically synthesized
tttggagttttcaaattctc

SEQ ID NO: 374230 - DNA, 20 bp, Artificial Sequence
  chemically synthesized
agttttcaaattctcaagtc

SEQ ID NO: 374231 - DNA, 20 bp, Artificial Sequence
  chemically synthesized
gttttcaaattctcaagtcc

SEQ ID NO: 374232 - DNA, 20 bp, Artificial Sequence
  chemically synthesized
aattttccgtgcctggactt

SEQ ID NO: 374233 - DNA, 20 bp, Artificial Sequence
  chemically synthesized
caaattctcaagtccaggca

SEQ ID NO: 374234 - DNA, 20 bp, Artificial Sequence
  chemically synthesized
aaattataattttccgtgcc

SEQ ID NO: 374235 - DNA, 20 bp, Artificial Sequence
  chemically synthesized
aaaattataatttttttttt

SEQ ID NO: 374236 - DNA, 20 bp, Artificial Sequence
  chemically synthesized
ttggaaaaaaatgtgaaata

SEQ ID NO: 374237 - DNA, 20 bp, Artificial Sequence
  chemically synthesized
aggctcagagacggagaaaa

SEQ ID NO: 374238 - DNA, 20 bp, Artificial Sequence
  chemically synthesized
acactattttctccgtctct

SEQ ID NO: 374239 - DNA, 20 bp, Artificial Sequence
  chemically synthesized
agtatctaggctcagagacg

SEQ ID NO: 374240 - DNA, 20 bp, Artificial Sequence
  chemically synthesized
atagtatctaggctcagaga

SEQ ID NO: 374241 - DNA, 20 bp, Artificial Sequence
  chemically synthesized
attttctccgtctctgagcc

SEQ ID NO: 374242 - DNA, 20 bp, Artificial Sequence
  chemically synthesized
gaaaatagtatctaggctca

SEQ ID NO: 374243 - DNA, 20 bp, Artificial Sequence
  chemically synthesized
aggaaaatagtatctaggct

SEQ ID NO: 374244 - DNA, 20 bp, Artificial Sequence
  chemically synthesized
agtccaggaaaatagtatct

SEQ ID NO: 374245 - DNA, 20 bp, Artificial Sequence
  chemically synthesized
cagtccaggaaaatagtatc

SEQ ID NO: 374246 - DNA, 20 bp, Artificial Sequence
  chemically synthesized
gagcctagatactattttcc

SEQ ID NO: 374247 - DNA, 20 bp, Artificial Sequence
  chemically synthesized
ctccatccagtccaggaaaa

SEQ ID NO: 374248 - DNA, 20 bp, Artificial Sequence
  chemically synthesized
tagatactattttcctggac

SEQ ID NO: 374249 - DNA, 20 bp, Artificial Sequence
  chemically synthesized
ttacattctccatccagtcc

SEQ ID NO: 374250 - DNA, 20 bp, Artificial Sequence
  chemically synthesized
tactattttcctggactgga

SEQ ID NO: 374251 - DNA, 20 bp, Artificial Sequence
  chemically synthesized
tttacattctccatccagtc

SEQ ID NO: 374252 - DNA, 20 bp, Artificial Sequence
  chemically synthesized
ctattttcctggactggatg

SEQ ID NO: 374253 - DNA, 20 bp, Artificial Sequence
  chemically synthesized
tctactttacattctccatc

SEQ ID NO: 374254 - DNA, 20 bp, Artificial Sequence
  chemically synthesized
tggactggatggagaatgta

SEQ ID NO: 374255 - DNA, 20 bp, Artificial Sequence
  chemically synthesized
actggatggagaatgtaaag

SEQ ID NO: 374256 - DNA, 20 bp, Artificial Sequence
  chemically synthesized
ggagaatgtaaagtagaaac

SEQ ID NO: 374257 - DNA, 20 bp, Artificial Sequence
  chemically synthesized
agaatgtaaagtagaaacaa

SEQ ID NO: 374258 - DNA, 20 bp, Artificial Sequence
  chemically synthesized
agaaacaagagtgtgttcct

SEQ ID NO: 374259 - DNA, 20 bp, Artificial Sequence
  chemically synthesized
aaacaagagtgtgttcctga

SEQ ID NO: 374260 - DNA, 20 bp, Artificial Sequence
  chemically synthesized
aacaagagtgtgttcctgag

SEQ ID NO: 374261 - DNA, 20 bp, Artificial Sequence
  chemically synthesized
caagagtgtgttcctgagag

SEQ ID NO: 374262 - DNA, 20 bp, Artificial Sequence
  chemically synthesized
aagagtgtgttcctgagagg

SEQ ID NO: 374263 - DNA, 20 bp, Artificial Sequence
  chemically synthesized
agagtgtgttcctgagagga

SEQ ID NO: 374264 - DNA, 20 bp, Artificial Sequence
  chemically synthesized
tttcaccatcccctcctctc

SEQ ID NO: 374265 - DNA, 20 bp, Artificial Sequence
  chemically synthesized
gagtgtgttcctgagaggag

SEQ ID NO: 374266 - DNA, 20 bp, Artificial Sequence
  chemically synthesized
ctttcaccatcccctcctct

SEQ ID NO: 374267 - DNA, 20 bp, Artificial Sequence
  chemically synthesized
gtgttcctgagaggagggga

SEQ ID NO: 374268 - DNA, 20 bp, Artificial Sequence
  chemically synthesized
ctgagaggaggggatggtga

SEQ ID NO: 374269 - DNA, 20 bp, Artificial Sequence
  chemically synthesized
aaccttctctgttgtggtgg

SEQ ID NO: 374270 - DNA, 20 bp, Artificial Sequence
  chemically synthesized
tgaaagaaccgccaccacaa

SEQ ID NO: 374271 - DNA, 20 bp, Artificial Sequence
  chemically synthesized
cccaaccttctctgttgtgg

SEQ ID NO: 374272 - DNA, 20 bp, Artificial Sequence
  chemically synthesized
aaagaaccgccaccacaaca

SEQ ID NO: 374273 - DNA, 20 bp, Artificial Sequence
  chemically synthesized
acccccaaccttctctgttg

SEQ ID NO: 374274 - DNA, 20 bp, Artificial Sequence
  chemically synthesized
gaaccgccaccacaacagag

SEQ ID NO: 374275 - DNA, 20 bp, Artificial Sequence
  chemically synthesized
aaccgccaccacaacagaga

SEQ ID NO: 374276 - DNA, 20 bp, Artificial Sequence
  chemically synthesized
gccaccacaacagagaaggt

SEQ ID NO: 374277 - DNA, 20 bp, Artificial Sequence
  chemically synthesized
ccaccacaacagagaaggtt

SEQ ID NO: 374278 - DNA, 20 bp, Artificial Sequence
  chemically synthesized
caccacaacagagaaggttg

SEQ ID NO: 374279 - DNA, 20 bp, Artificial Sequence
  chemically synthesized
accacaacagagaaggttgg

SEQ ID NO: 374280 - DNA, 20 bp, Artificial Sequence
  chemically synthesized
cagagaaggttgggggtatc

SEQ ID NO: 374281 - DNA, 20 bp, Artificial Sequence
  chemically synthesized
agagaaggttgggggtatcc

SEQ ID NO: 374282 - DNA, 20 bp, Artificial Sequence
  chemically synthesized
aggttgggggtatccaggtg

SEQ ID NO: 374283 - DNA, 20 bp, Artificial Sequence
  chemically synthesized
ttgggggtatccaggtgcag

SEQ ID NO: 374284 - DNA, 20 bp, Artificial Sequence
  chemically synthesized
gacccaattacttctgcacc

SEQ ID NO: 374285 - DNA, 20 bp, Artificial Sequence
  chemically synthesized
tatccaggtgcagaagtaat

SEQ ID NO: 374286 - DNA, 20 bp, Artificial Sequence
  chemically synthesized
atccaggtgcagaagtaatt

SEQ ID NO: 374287 - DNA, 20 bp, Artificial Sequence
  chemically synthesized
gaagtaattgggtcccattc

SEQ ID NO: 374288 - DNA, 20 bp, Artificial Sequence
  chemically synthesized
agtaattgggtcccattcca

SEQ ID NO: 374289 - DNA, 20 bp, Artificial Sequence
  chemically synthesized
cctgggctggactctggaat

SEQ ID NO: 374290 - DNA, 20 bp, Artificial Sequence
  chemically synthesized
tcctgggctggactctggaa

SEQ ID NO: 374291 - DNA, 20 bp, Artificial Sequence
  chemically synthesized
ttgggtcccattccagagtc

SEQ ID NO: 374292 - DNA, 20 bp, Artificial Sequence
  chemically synthesized
tgcattcctgggctggactc

SEQ ID NO: 374293 - DNA, 20 bp, Artificial Sequence
  chemically synthesized
tcccattccagagtccagcc

SEQ ID NO: 374294 - DNA, 20 bp, Artificial Sequence
  chemically synthesized
cccattccagagtccagccc

SEQ ID NO: 374295 - DNA, 20 bp, Artificial Sequence
  chemically synthesized
gtcttgttgcattcctgggc

SEQ ID NO: 374296 - DNA, 20 bp, Artificial Sequence
  chemically synthesized
tggagtcttgttgcattcct

SEQ ID NO: 374297 - DNA, 20 bp, Artificial Sequence
  chemically synthesized
ttggagtcttgttgcattcc

SEQ ID NO: 374298 - DNA, 20 bp, Artificial Sequence
  chemically synthesized
gtccagcccaggaatgcaac

SEQ ID NO: 374299 - DNA, 20 bp, Artificial Sequence
  chemically synthesized
aggaatgcaacaagactcca

SEQ ID NO: 374300 - DNA, 20 bp, Artificial Sequence
  chemically synthesized
ctgggtctgacataactttg

SEQ ID NO: 374301 - DNA, 20 bp, Artificial Sequence
  chemically synthesized
gcctgggtctgacataactt

SEQ ID NO: 374302 - DNA, 20 bp, Artificial Sequence
  chemically synthesized
acaagactccaaagttatgt

SEQ ID NO: 374303 - DNA, 20 bp, Artificial Sequence
  chemically synthesized
ctccaaagttatgtcagacc

SEQ ID NO: 374304 - DNA, 20 bp, Artificial Sequence
  chemically synthesized
tccaaagttatgtcagaccc

SEQ ID NO: 374305 - DNA, 20 bp, Artificial Sequence
  chemically synthesized
aagttatgtcagacccaggc

SEQ ID NO: 374306 - DNA, 20 bp, Artificial Sequence
  chemically synthesized
catgctcacgattcttgcct

SEQ ID NO: 374307 - DNA, 20 bp, Artificial Sequence
  chemically synthesized
acatgctcacgattcttgcc

SEQ ID NO: 374308 - DNA, 20 bp, Artificial Sequence
  chemically synthesized
cagacccaggcaagaatcgt

SEQ ID NO: 374309 - DNA, 20 bp, Artificial Sequence
  chemically synthesized
agaatcgtgagcatgtgtct

SEQ ID NO: 374310 - DNA, 20 bp, Artificial Sequence
  chemically synthesized
tgagcatgtgtcttagcaaa

SEQ ID NO: 374311 - DNA, 20 bp, Artificial Sequence
  chemically synthesized
ctagctcatgtccatttgct

SEQ ID NO: 374312 - DNA, 20 bp, Artificial Sequence
  chemically synthesized
gtgtcttagcaaatggacat

SEQ ID NO: 374313 - DNA, 20 bp, Artificial Sequence
  chemically synthesized
cttagcaaatggacatgagc

SEQ ID NO: 374314 - DNA, 20 bp, Artificial Sequence
  chemically synthesized
atggacatgagctagccacc

SEQ ID NO: 374315 - DNA, 20 bp, Artificial Sequence
  chemically synthesized
gtgcctgggtactgggtggc

SEQ ID NO: 374316 - DNA, 20 bp, Artificial Sequence
  chemically synthesized
tgaagtgcctgggtactggg

SEQ ID NO: 374317 - DNA, 20 bp, Artificial Sequence
  chemically synthesized
tgagctagccacccagtacc

SEQ ID NO: 374318 - DNA, 20 bp, Artificial Sequence
  chemically synthesized
gagctagccacccagtaccc

SEQ ID NO: 374319 - DNA, 20 bp, Artificial Sequence
  chemically synthesized
tgctgaagtgcctgggtact

SEQ ID NO: 374320 - DNA, 20 bp, Artificial Sequence
  chemically synthesized
ctgctgaagtgcctgggtac

SEQ ID NO: 374321 - DNA, 20 bp, Artificial Sequence
  chemically synthesized
tatatcctgctgaagtgcct

SEQ ID NO: 374322 - DNA, 20 bp, Artificial Sequence
  chemically synthesized
cacccagtacccaggcactt

SEQ ID NO: 374323 - DNA, 20 bp, Artificial Sequence
  chemically synthesized
ctatatcctgctgaagtgcc

SEQ ID NO: 374324 - DNA, 20 bp, Artificial Sequence
  chemically synthesized
ccagtacccaggcacttcag

SEQ ID NO: 374325 - DNA, 20 bp, Artificial Sequence
  chemically synthesized
cagtacccaggcacttcagc

SEQ ID NO: 374326 - DNA, 20 bp, Artificial Sequence
  chemically synthesized
ctgtaccctatatcctgctg

SEQ ID NO: 374327 - DNA, 20 bp, Artificial Sequence
  chemically synthesized
ccaggcacttcagcaggata

SEQ ID NO: 374328 - DNA, 20 bp, Artificial Sequence
  chemically synthesized
caggcacttcagcaggatat

SEQ ID NO: 374329 - DNA, 20 bp, Artificial Sequence
  chemically synthesized
aggcacttcagcaggatata

SEQ ID NO: 374330 - DNA, 20 bp, Artificial Sequence
  chemically synthesized
cttcagcaggatatagggta

SEQ ID NO: 374331 - DNA, 20 bp, Artificial Sequence
  chemically synthesized
cagcaggatatagggtacag

SEQ ID NO: 374332 - DNA, 20 bp, Artificial Sequence
  chemically synthesized
tgtgtttgctggaggcatgt

SEQ ID NO: 374333 - DNA, 20 bp, Artificial Sequence
  chemically synthesized
ctgtgtttgctggaggcatg

SEQ ID NO: 374334 - DNA, 20 bp, Artificial Sequence
  chemically synthesized
aataatttcccacatgcctc

SEQ ID NO: 374335 - DNA, 20 bp, Artificial Sequence
  chemically synthesized
ttgagcactgtgtttgctgg

SEQ ID NO: 374336 - DNA, 20 bp, Artificial Sequence
  chemically synthesized
attgagcactgtgtttgctg

SEQ ID NO: 374337 - DNA, 20 bp, Artificial Sequence
  chemically synthesized
ccacatgcctccagcaaaca

SEQ ID NO: 374338 - DNA, 20 bp, Artificial Sequence
  chemically synthesized
ccattgagcactgtgtttgc

SEQ ID NO: 374339 - DNA, 20 bp, Artificial Sequence
  chemically synthesized
ccagcaaacacagtgctcaa

SEQ ID NO: 374340 - DNA, 20 bp, Artificial Sequence
  chemically synthesized
cagcaaacacagtgctcaat

SEQ ID NO: 374341 - DNA, 20 bp, Artificial Sequence
  chemically synthesized
tcatcctccaaaaacccatt

SEQ ID NO: 374342 - DNA, 20 bp, Artificial Sequence
  chemically synthesized
cacagtgctcaatgggtttt

SEQ ID NO: 374343 - DNA, 20 bp, Artificial Sequence
  chemically synthesized
cagtgctcaatgggtttttg

SEQ ID NO: 374344 - DNA, 20 bp, Artificial Sequence
  chemically synthesized
agtgctcaatgggtttttgg

SEQ ID NO: 374345 - DNA, 20 bp, Artificial Sequence
  chemically synthesized
caatgggtttttggaggatg

SEQ ID NO: 374346 - DNA, 20 bp, Artificial Sequence
  chemically synthesized
tttggaggatgaagaatgac

SEQ ID NO: 374347 - DNA, 20 bp, Artificial Sequence
  chemically synthesized
ttggaggatgaagaatgaca

SEQ ID NO: 374348 - DNA, 20 bp, Artificial Sequence
  chemically synthesized
tggaggatgaagaatgacaa

SEQ ID NO: 374349 - DNA, 20 bp, Artificial Sequence
  chemically synthesized
tgtacggtcaagaaacatgg

SEQ ID NO: 374350 - DNA, 20 bp, Artificial Sequence
  chemically synthesized
ctctgtacggtcaagaaaca

SEQ ID NO: 374351 - DNA, 20 bp, Artificial Sequence
  chemically synthesized
caccatgtttcttgaccgta

SEQ ID NO: 374352 - DNA, 20 bp, Artificial Sequence
  chemically synthesized
tttcatatctctgtacggtc

SEQ ID NO: 374353 - DNA, 20 bp, Artificial Sequence
  chemically synthesized
ccatgtttcttgaccgtaca

SEQ ID NO: 374354 - DNA, 20 bp, Artificial Sequence
  chemically synthesized
ggccctttcatatctctgta

SEQ ID NO: 374355 - DNA, 20 bp, Artificial Sequence
  chemically synthesized
ttgaccgtacagagatatga

SEQ ID NO: 374356 - DNA, 20 bp, Artificial Sequence
  chemically synthesized
tgaccgtacagagatatgaa

SEQ ID NO: 374357 - DNA, 20 bp, Artificial Sequence
  chemically synthesized
gaccgtacagagatatgaaa

SEQ ID NO: 374358 - DNA, 20 bp, Artificial Sequence
  chemically synthesized
tatgaaagggcctacaactt

SEQ ID NO: 374359 - DNA, 20 bp, Artificial Sequence
  chemically synthesized
gttccttggcctcaagttgt

SEQ ID NO: 374360 - DNA, 20 bp, Artificial Sequence
  chemically synthesized
atgaaagggcctacaacttg

SEQ ID NO: 374361 - DNA, 20 bp, Artificial Sequence
  chemically synthesized
tgttccttggcctcaagttg

SEQ ID NO: 374362 - DNA, 20 bp, Artificial Sequence
  chemically synthesized
agggcctacaacttgaggcc

SEQ ID NO: 374363 - DNA, 20 bp, Artificial Sequence
  chemically synthesized
gggcctacaacttgaggcca

SEQ ID NO: 374364 - DNA, 20 bp, Artificial Sequence
  chemically synthesized
ggaccttgttccttggcctc

SEQ ID NO: 374365 - DNA, 20 bp, Artificial Sequence
  chemically synthesized
acaacttgaggccaaggaac

SEQ ID NO: 374366 - DNA, 20 bp, Artificial Sequence
  chemically synthesized
caacttgaggccaaggaaca

SEQ ID NO: 374367 - DNA, 20 bp, Artificial Sequence
  chemically synthesized
cccatagggaccttgttcct

SEQ ID NO: 374368 - DNA, 20 bp, Artificial Sequence
  chemically synthesized
gccaaggaacaaggtcccta

SEQ ID NO: 374369 - DNA, 20 bp, Artificial Sequence
  chemically synthesized
ccaaggaacaaggtccctat

SEQ ID NO: 374370 - DNA, 20 bp, Artificial Sequence
  chemically synthesized
catgtacaattcatcccata

SEQ ID NO: 374371 - DNA, 20 bp, Artificial Sequence
  chemically synthesized
tcatgtacaattcatcccat

SEQ ID NO: 374372 - DNA, 20 bp, Artificial Sequence
  chemically synthesized
ttcatgtacaattcatccca

SEQ ID NO: 374373 - DNA, 20 bp, Artificial Sequence
  chemically synthesized
ggatgaattgtacatgaaat

SEQ ID NO: 374374 - DNA, 20 bp, Artificial Sequence
  chemically synthesized
gatgaattgtacatgaaatc

SEQ ID NO: 374375 - DNA, 20 bp, Artificial Sequence
  chemically synthesized
aattgtacatgaaatcaggt

SEQ ID NO: 374376 - DNA, 20 bp, Artificial Sequence
  chemically synthesized
ccaggatttgaaggcgggtg

SEQ ID NO: 374377 - DNA, 20 bp, Artificial Sequence
  chemically synthesized
cagtgccaggatttgaaggc

SEQ ID NO: 374378 - DNA, 20 bp, Artificial Sequence
  chemically synthesized
acagtgccaggatttgaagg

SEQ ID NO: 374379 - DNA, 20 bp, Artificial Sequence
  chemically synthesized
gatacagtgccaggatttga

SEQ ID NO: 374380 - DNA, 20 bp, Artificial Sequence
  chemically synthesized
ccacacccgccttcaaatcc

SEQ ID NO: 374381 - DNA, 20 bp, Artificial Sequence
  chemically synthesized
tgatacagtgccaggatttg

SEQ ID NO: 374382 - DNA, 20 bp, Artificial Sequence
  chemically synthesized
cctgacactgatacagtgcc

SEQ ID NO: 374383 - DNA, 20 bp, Artificial Sequence
  chemically synthesized
tcctgacactgatacagtgc

SEQ ID NO: 374384 - DNA, 20 bp, Artificial Sequence
  chemically synthesized
ttcaaatcctggcactgtat

SEQ ID NO: 374385 - DNA, 20 bp, Artificial Sequence
  chemically synthesized
tcagagtcctgacactgata

SEQ ID NO: 374386 - DNA, 20 bp, Artificial Sequence
  chemically synthesized
tcctggcactgtatcagtgt

SEQ ID NO: 374387 - DNA, 20 bp, Artificial Sequence
  chemically synthesized
cctggcactgtatcagtgtc

SEQ ID NO: 374388 - DNA, 20 bp, Artificial Sequence
  chemically synthesized
tgtatcagtgtcaggactct

SEQ ID NO: 374389 - DNA, 20 bp, Artificial Sequence
  chemically synthesized
cagtgtcaggactctgagct

SEQ ID NO: 374390 - DNA, 20 bp, Artificial Sequence
  chemically synthesized
ggatatgatggcttagctca

SEQ ID NO: 374391 - DNA, 20 bp, Artificial Sequence
  chemically synthesized
ggggatatgatggcttagct

SEQ ID NO: 374392 - DNA, 20 bp, Artificial Sequence
  chemically synthesized
tcacaggggatatgatggct

SEQ ID NO: 374393 - DNA, 20 bp, Artificial Sequence
  chemically synthesized
gcaggtcacaggggatatga

SEQ ID NO: 374394 - DNA, 20 bp, Artificial Sequence
  chemically synthesized
tgtataagggcaggtcacag

SEQ ID NO: 374395 - DNA, 20 bp, Artificial Sequence
  chemically synthesized
atgtataagggcaggtcaca

SEQ ID NO: 374396 - DNA, 20 bp, Artificial Sequence
  chemically synthesized
gatgtataagggcaggtcac

SEQ ID NO: 374397 - DNA, 20 bp, Artificial Sequence
  chemically synthesized
ggatgtataagggcaggtca

SEQ ID NO: 374398 - DNA, 20 bp, Artificial Sequence
  chemically synthesized
ccatctggatgtataagggc

SEQ ID NO: 374399 - DNA, 20 bp, Artificial Sequence
  chemically synthesized
gccatctggatgtataaggg

SEQ ID NO: 374400 - DNA, 20 bp, Artificial Sequence
  chemically synthesized
caggccatctggatgtataa

SEQ ID NO: 374401 - DNA, 20 bp, Artificial Sequence
  chemically synthesized
tcaggccatctggatgtata

SEQ ID NO: 374402 - DNA, 20 bp, Artificial Sequence
  chemically synthesized
gtgacctgcccttatacatc

SEQ ID NO: 374403 - DNA, 20 bp, Artificial Sequence
  chemically synthesized
ttcaggccatctggatgtat

SEQ ID NO: 374404 - DNA, 20 bp, Artificial Sequence
  chemically synthesized
cctgcccttatacatccaga

SEQ ID NO: 374405 - DNA, 20 bp, Artificial Sequence
  chemically synthesized
ttcagttgcttcaggccatc

SEQ ID NO: 374406 - DNA, 20 bp, Artificial Sequence
  chemically synthesized
ttatacatccagatggcctg

SEQ ID NO: 374407 - DNA, 20 bp, Artificial Sequence
  chemically synthesized
tgtggatcttcagttgcttc

SEQ ID NO: 374408 - DNA, 20 bp, Artificial Sequence
  chemically synthesized
ttgtggatcttcagttgctt

SEQ ID NO: 374409 - DNA, 20 bp, Artificial Sequence
  chemically synthesized
cagatggcctgaagcaactg

SEQ ID NO: 374410 - DNA, 20 bp, Artificial Sequence
  chemically synthesized
ttcactcttttgtggatctt

SEQ ID NO: 374411 - DNA, 20 bp, Artificial Sequence
  chemically synthesized
aagcaactgaagatccacaa

SEQ ID NO: 374412 - DNA, 20 bp, Artificial Sequence
  chemically synthesized
gcaactgaagatccacaaaa

SEQ ID NO: 374413 - DNA, 20 bp, Artificial Sequence
  chemically synthesized
aggctattttcactcttttg

SEQ ID NO: 374414 - DNA, 20 bp, Artificial Sequence
  chemically synthesized
gatccacaaaagagtgaaaa

SEQ ID NO: 374415 - DNA, 20 bp, Artificial Sequence
  chemically synthesized
tggtggaatgtcatcagtta

SEQ ID NO: 374416 - DNA, 20 bp, Artificial Sequence
  chemically synthesized
atggtggaatgtcatcagtt

SEQ ID NO: 374417 - DNA, 20 bp, Artificial Sequence
  chemically synthesized
tcacaatggtggaatgtcat

SEQ ID NO: 374418 - DNA, 20 bp, Artificial Sequence
  chemically synthesized
gcagaaacaaatcacaatgg

SEQ ID NO: 374419 - DNA, 20 bp, Artificial Sequence
  chemically synthesized
ggggcagaaacaaatcacaa

SEQ ID NO: 374420 - DNA, 20 bp, Artificial Sequence
  chemically synthesized
attgatcagttagggtgggg

SEQ ID NO: 374421 - DNA, 20 bp, Artificial Sequence
  chemically synthesized
tacattgatcagttagggtg

SEQ ID NO: 374422 - DNA, 20 bp, Artificial Sequence
  chemically synthesized
gtacattgatcagttagggt

SEQ ID NO: 374423 - DNA, 20 bp, Artificial Sequence
  chemically synthesized
agtacattgatcagttaggg

SEQ ID NO: 374424 - DNA, 20 bp, Artificial Sequence
  chemically synthesized
caaagtacattgatcagtta

SEQ ID NO: 374425 - DNA, 20 bp, Artificial Sequence
  chemically synthesized
acaaagtacattgatcagtt

SEQ ID NO: 374426 - DNA, 20 bp, Artificial Sequence
  chemically synthesized
tacaaagtacattgatcagt

SEQ ID NO: 374427 - DNA, 20 bp, Artificial Sequence
  chemically synthesized
agattacaaagtacattgat

SEQ ID NO: 374428 - DNA, 20 bp, Artificial Sequence
  chemically synthesized
taagggtgggggagattaca

SEQ ID NO: 374429 - DNA, 20 bp, Artificial Sequence
  chemically synthesized
gaaccttcttaagggtgggg

SEQ ID NO: 374430 - DNA, 20 bp, Artificial Sequence
  chemically synthesized
aagaaccttcttaagggtgg

SEQ ID NO: 374431 - DNA, 20 bp, Artificial Sequence
  chemically synthesized
ttgtaatctcccccaccctt

SEQ ID NO: 374432 - DNA, 20 bp, Artificial Sequence
  chemically synthesized
aaagaaccttcttaagggtg

SEQ ID NO: 374433 - DNA, 20 bp, Artificial Sequence
  chemically synthesized
caaagaaccttcttaagggt

SEQ ID NO: 374434 - DNA, 20 bp, Artificial Sequence
  chemically synthesized
acaaagaaccttcttaaggg

SEQ ID NO: 374435 - DNA, 20 bp, Artificial Sequence
  chemically synthesized
taatctcccccacccttaag

SEQ ID NO: 374436 - DNA, 20 bp, Artificial Sequence
  chemically synthesized
aatctcccccacccttaaga

SEQ ID NO: 374437 - DNA, 20 bp, Artificial Sequence
  chemically synthesized
atgacaaagaaccttcttaa

SEQ ID NO: 374438 - DNA, 20 bp, Artificial Sequence
  chemically synthesized
aatgacaaagaaccttctta

SEQ ID NO: 374439 - DNA, 20 bp, Artificial Sequence
  chemically synthesized
gaatgacaaagaaccttctt

SEQ ID NO: 374440 - DNA, 20 bp, Artificial Sequence
  chemically synthesized
caagggtggggagaatgaca

SEQ ID NO: 374441 - DNA, 20 bp, Artificial Sequence
  chemically synthesized
agtacattctcaagggtggg

SEQ ID NO: 374442 - DNA, 20 bp, Artificial Sequence
  chemically synthesized
ttgtcattctccccaccctt

SEQ ID NO: 374443 - DNA, 20 bp, Artificial Sequence
  chemically synthesized
aaagtacattctcaagggtg

SEQ ID NO: 374444 - DNA, 20 bp, Artificial Sequence
  chemically synthesized
caaagtacattctcaagggt

SEQ ID NO: 374445 - DNA, 20 bp, Artificial Sequence
  chemically synthesized
acaaagtacattctcaaggg

SEQ ID NO: 374446 - DNA, 20 bp, Artificial Sequence
  chemically synthesized
ctcacaaagtacattctcaa

SEQ ID NO: 374447 - DNA, 20 bp, Artificial Sequence
  chemically synthesized
tctcacaaagtacattctca

SEQ ID NO: 374448 - DNA, 20 bp, Artificial Sequence
  chemically synthesized
atctcacaaagtacattctc

SEQ ID NO: 374449 - DNA, 20 bp, Artificial Sequence
  chemically synthesized
cccttgagaatgtactttgt

SEQ ID NO: 374450 - DNA, 20 bp, Artificial Sequence
  chemically synthesized
agcagggggtggatctcaca

SEQ ID NO: 374451 - DNA, 20 bp, Artificial Sequence
  chemically synthesized
gatgttttgcgagcaggggg

SEQ ID NO: 374452 - DNA, 20 bp, Artificial Sequence
  chemically synthesized
agcgatgttttgcgagcagg

SEQ ID NO: 374453 - DNA, 20 bp, Artificial Sequence
  chemically synthesized
gagcgatgttttgcgagcag

SEQ ID NO: 374454 - DNA, 20 bp, Artificial Sequence
  chemically synthesized
ggagcgatgttttgcgagca

SEQ ID NO: 374455 - DNA, 20 bp, Artificial Sequence
  chemically synthesized
aggagcgatgttttgcgagc

SEQ ID NO: 374456 - DNA, 20 bp, Artificial Sequence
  chemically synthesized
taggagcgatgttttgcgag

SEQ ID NO: 374457 - DNA, 20 bp, Artificial Sequence
  chemically synthesized
agttaggagcgatgttttgc

SEQ ID NO: 374458 - DNA, 20 bp, Artificial Sequence
  chemically synthesized
gggataggcggtggagttag

SEQ ID NO: 374459 - DNA, 20 bp, Artificial Sequence
  chemically synthesized
ttgggataggcggtggagtt

SEQ ID NO: 374460 - DNA, 20 bp, Artificial Sequence
  chemically synthesized
tttgggataggcggtggagt

SEQ ID NO: 374461 - DNA, 20 bp, Artificial Sequence
  chemically synthesized
aggttttgggataggcggtg

SEQ ID NO: 374462 - DNA, 20 bp, Artificial Sequence
  chemically synthesized
acaggttttgggataggcgg

SEQ ID NO: 374463 - DNA, 20 bp, Artificial Sequence
  chemically synthesized
cttacaggttttgggatagg

SEQ ID NO: 374464 - DNA, 20 bp, Artificial Sequence
  chemically synthesized
gttcttacaggttttgggat

SEQ ID NO: 374465 - DNA, 20 bp, Artificial Sequence
  chemically synthesized
agttcttacaggttttggga

SEQ ID NO: 374466 - DNA, 20 bp, Artificial Sequence
  chemically synthesized
cattagttcttacaggtttt

SEQ ID NO: 374467 - DNA, 20 bp, Artificial Sequence
  chemically synthesized
tcattagttcttacaggttt

SEQ ID NO: 374468 - DNA, 20 bp, Artificial Sequence
  chemically synthesized
ccgcctatcccaaaacctgt

SEQ ID NO: 374469 - DNA, 20 bp, Artificial Sequence
  chemically synthesized
ggattatcattagttcttac

SEQ ID NO: 374470 - DNA, 20 bp, Artificial Sequence
  chemically synthesized
gggattatcattagttctta

SEQ ID NO: 374471 - DNA, 20 bp, Artificial Sequence
  chemically synthesized
aagggtggtgggattatcat

SEQ ID NO: 374472 - DNA, 20 bp, Artificial Sequence
  chemically synthesized
aggagtcagccaagggtggt

SEQ ID NO: 374473 - DNA, 20 bp, Artificial Sequence
  chemically synthesized
aatgataatcccaccaccct

SEQ ID NO: 374474 - DNA, 20 bp, Artificial Sequence
  chemically synthesized
aaggagtcagccaagggtgg

SEQ ID NO: 374475 - DNA, 20 bp, Artificial Sequence
  chemically synthesized
aaaaaggagtcagccaaggg

SEQ ID NO: 374476 - DNA, 20 bp, Artificial Sequence
  chemically synthesized
ctgaaaaaggagtcagccaa

SEQ ID NO: 374477 - DNA, 20 bp, Artificial Sequence
  chemically synthesized
tctgaaaaaggagtcagcca

SEQ ID NO: 374478 - DNA, 20 bp, Artificial Sequence
  chemically synthesized
gtctgaaaaaggagtcagcc

SEQ ID NO: 374479 - DNA, 20 bp, Artificial Sequence
  chemically synthesized
gctgagtctgaaaaaggagt

SEQ ID NO: 374480 - DNA, 20 bp, Artificial Sequence
  chemically synthesized
cccttggctgactccttttt

SEQ ID NO: 374481 - DNA, 20 bp, Artificial Sequence
  chemically synthesized
gtgggctgagtctgaaaaag

SEQ ID NO: 374482 - DNA, 20 bp, Artificial Sequence
  chemically synthesized
aggtgggctgagtctgaaaa

SEQ ID NO: 374483 - DNA, 20 bp, Artificial Sequence
  chemically synthesized
caggtgggctgagtctgaaa

SEQ ID NO: 374484 - DNA, 20 bp, Artificial Sequence
  chemically synthesized
gctgactcctttttcagact

SEQ ID NO: 374485 - DNA, 20 bp, Artificial Sequence
  chemically synthesized
cacctgggtgcaggtgggct

SEQ ID NO: 374486 - DNA, 20 bp, Artificial Sequence
  chemically synthesized
tatttcacctgggtgcaggt

SEQ ID NO: 374487 - DNA, 20 bp, Artificial Sequence
  chemically synthesized
ttatttcacctgggtgcagg

SEQ ID NO: 374488 - DNA, 20 bp, Artificial Sequence
  chemically synthesized
agactcagcccacctgcacc

SEQ ID NO: 374489 - DNA, 20 bp, Artificial Sequence
  chemically synthesized
gactcagcccacctgcaccc

SEQ ID NO: 374490 - DNA, 20 bp, Artificial Sequence
  chemically synthesized
tgtttatttcacctgggtgc

SEQ ID NO: 374491 - DNA, 20 bp, Artificial Sequence
  chemically synthesized
ctgtttatttcacctgggtg

SEQ ID NO: 374492 - DNA, 20 bp, Artificial Sequence
  chemically synthesized
caaggctgtttatttcacct

SEQ ID NO: 374493 - DNA, 20 bp, Artificial Sequence
  chemically synthesized
acaaggctgtttatttcacc

SEQ ID NO: 374494 - DNA, 20 bp, Artificial Sequence
  chemically synthesized
ctgcacccaggtgaaataaa

SEQ ID NO: 374495 - DNA, 20 bp, Artificial Sequence
  chemically synthesized
caggctttgtgtgagcaaca

SEQ ID NO: 374496 - DNA, 20 bp, Artificial Sequence
  chemically synthesized
acaggctttgtgtgagcaac

SEQ ID NO: 374497 - DNA, 20 bp, Artificial Sequence
  chemically synthesized
acagccttgttgctcacaca

SEQ ID NO: 374498 - DNA, 20 bp, Artificial Sequence
  chemically synthesized
ccaccaaacaggctttgtgt

SEQ ID NO: 374499 - DNA, 20 bp, Artificial Sequence
  chemically synthesized
ttgctcacacaaagcctgtt

SEQ ID NO: 374500 - DNA, 20 bp, Artificial Sequence
  chemically synthesized
ctcacacaaagcctgtttgg

SEQ ID NO: 374501 - DNA, 20 bp, Artificial Sequence
  chemically synthesized
gagtgaagagaccaccaaac

SEQ ID NO: 374502 - DNA, 20 bp, Artificial Sequence
  chemically synthesized
cgagtgaagagaccaccaaa

SEQ ID NO: 374503 - DNA, 20 bp, Artificial Sequence
  chemically synthesized
tgtttggtggtctcttcact

SEQ ID NO: 374504 - DNA, 20 bp, Artificial Sequence
  chemically synthesized
gtcacgcccctccgagtgaa

SEQ ID NO: 374505 - DNA, 20 bp, Artificial Sequence
  chemically synthesized
tttggtggtctcttcactcg

SEQ ID NO: 374506 - DNA, 20 bp, Artificial Sequence
  chemically synthesized
ttggtggtctcttcactcgg

SEQ ID NO: 374507 - DNA, 20 bp, Artificial Sequence
  chemically synthesized
ttgtcacgcccctccgagtg

SEQ ID NO: 374508 - DNA, 20 bp, Artificial Sequence
  chemically synthesized
tggtggtctcttcactcgga

SEQ ID NO: 374509 - DNA, 20 bp, Artificial Sequence
  chemically synthesized
ggtggtctcttcactcggag

SEQ ID NO: 374510 - DNA, 20 bp, Artificial Sequence
  chemically synthesized
cctgattgtcacgcccctcc

SEQ ID NO: 374511 - DNA, 20 bp, Artificial Sequence
  chemically synthesized
actcggaggggcgtgacaat

SEQ ID NO: 374512 - DNA, 20 bp, Artificial Sequence
  chemically synthesized
ctcggaggggcgtgacaatc

SEQ ID NO: 374513 - DNA, 20 bp, Artificial Sequence
  chemically synthesized
cgtgacaatcaggtcccctc

SEQ ID NO: 374514 - DNA, 20 bp, Artificial Sequence
  chemically synthesized
tttgtcttaaatttctggag

SEQ ID NO: 374515 - DNA, 20 bp, Artificial Sequence
  chemically synthesized
ttttgtcttaaatttctgga

SEQ ID NO: 374516 - DNA, 20 bp, Artificial Sequence
  chemically synthesized
gttttgtcttaaatttctgg

SEQ ID NO: 374517 - DNA, 20 bp, Artificial Sequence
  chemically synthesized
ggttttgtcttaaatttctg

SEQ ID NO: 374518 - DNA, 20 bp, Artificial Sequence
  chemically synthesized
caggtcccctccagaaattt

SEQ ID NO: 374519 - DNA, 20 bp, Artificial Sequence
  chemically synthesized
ggggttttgtcttaaatttc

SEQ ID NO: 374520 - DNA, 20 bp, Artificial Sequence
  chemically synthesized
agaaatttaagacaaaaccc

SEQ ID NO: 374521 - DNA, 20 bp, Artificial Sequence
  chemically synthesized
aaatttaagacaaaacccca

SEQ ID NO: 374522 - DNA, 20 bp, Artificial Sequence
  chemically synthesized
ttaagacaaaaccccagaga

SEQ ID NO: 374523 - DNA, 20 bp, Artificial Sequence
  chemically synthesized
taagacaaaaccccagagaa

SEQ ID NO: 374524 - DNA, 20 bp, Artificial Sequence
  chemically synthesized
agatgccccccctttctctg

SEQ ID NO: 374525 - DNA, 20 bp, Artificial Sequence
  chemically synthesized
aagacaaaaccccagagaaa

SEQ ID NO: 374526 - DNA, 20 bp, Artificial Sequence
  chemically synthesized
gagatgccccccctttctct

SEQ ID NO: 374527 - DNA, 20 bp, Artificial Sequence
  chemically synthesized
agacaaaaccccagagaaag

SEQ ID NO: 374528 - DNA, 20 bp, Artificial Sequence
  chemically synthesized
tgagatgccccccctttctc

SEQ ID NO: 374529 - DNA, 20 bp, Artificial Sequence
  chemically synthesized
gacaaaaccccagagaaagg

SEQ ID NO: 374530 - DNA, 20 bp, Artificial Sequence
  chemically synthesized
acaaaaccccagagaaaggg

SEQ ID NO: 374531 - DNA, 20 bp, Artificial Sequence
  chemically synthesized
caaaaccccagagaaagggg

SEQ ID NO: 374532 - DNA, 20 bp, Artificial Sequence
  chemically synthesized
cagagaaagggggggcatct

SEQ ID NO: 374533 - DNA, 20 bp, Artificial Sequence
  chemically synthesized
atctcagccaatttaggact

SEQ ID NO: 374534 - DNA, 20 bp, Artificial Sequence
  chemically synthesized
ggggcatctcagtcctaaat

SEQ ID NO: 374535 - DNA, 20 bp, Artificial Sequence
  chemically synthesized
tatttcatctcagccaattt

SEQ ID NO: 374536 - DNA, 20 bp, Artificial Sequence
  chemically synthesized
atatttcatctcagccaatt

SEQ ID NO: 374537 - DNA, 20 bp, Artificial Sequence
  chemically synthesized
atctcagtcctaaattggct

SEQ ID NO: 374538 - DNA, 20 bp, Artificial Sequence
  chemically synthesized
agatcctgcatatttcatct

SEQ ID NO: 374539 - DNA, 20 bp, Artificial Sequence
  chemically synthesized
attggctgagatgaaatatg

SEQ ID NO: 374540 - DNA, 20 bp, Artificial Sequence
  chemically synthesized
ttggctgagatgaaatatgc

SEQ ID NO: 374541 - DNA, 20 bp, Artificial Sequence
  chemically synthesized
atgaaatatgcaggatctac

SEQ ID NO: 374542 - DNA, 20 bp, Artificial Sequence
  chemically synthesized
aatatgcaggatctaccgga

SEQ ID NO: 374543 - DNA, 20 bp, Artificial Sequence
  chemically synthesized
atataaagcctactttccgg

SEQ ID NO: 374544 - DNA, 20 bp, Artificial Sequence
  chemically synthesized
atgcaggatctaccggaaag

SEQ ID NO: 374545 - DNA, 20 bp, Artificial Sequence
  chemically synthesized
tgcaggatctaccggaaagt

SEQ ID NO: 374546 - DNA, 20 bp, Artificial Sequence
  chemically synthesized
tatatataaagcctactttc

SEQ ID NO: 374547 - DNA, 20 bp, Artificial Sequence
  chemically synthesized
ctgaacttaatttatatata

SEQ ID NO: 374548 - DNA, 20 bp, Artificial Sequence
  chemically synthesized
gtaggctttatatataaatt

SEQ ID NO: 374549 - DNA, 20 bp, Artificial Sequence
  chemically synthesized
ctttatatataaattaagtt

SEQ ID NO: 374550 - DNA, 20 bp, Artificial Sequence
  chemically synthesized
tataaattaagttcagattc

SEQ ID NO: 374551 - DNA, 20 bp, Artificial Sequence
  chemically synthesized
attaagttcagattcaagaa

SEQ ID NO: 374552 - DNA, 20 bp, Artificial Sequence
  chemically synthesized
ttaagttcagattcaagaaa

SEQ ID NO: 374553 - DNA, 20 bp, Artificial Sequence
  chemically synthesized
agttcagattcaagaaaagg

SEQ ID NO: 374554 - DNA, 20 bp, Artificial Sequence
  chemically synthesized
ttcaagaaaaggcagttatt

SEQ ID NO: 374555 - DNA, 20 bp, Artificial Sequence
  chemically synthesized
taaggatctacatgcagtgg

SEQ ID NO: 374556 - DNA, 20 bp, Artificial Sequence
  chemically synthesized
agattcactgccactgcatg

SEQ ID NO: 374557 - DNA, 20 bp, Artificial Sequence
  chemically synthesized
acataaggatctacatgcag

SEQ ID NO: 374558 - DNA, 20 bp, Artificial Sequence
  chemically synthesized
cccacataaggatctacatg

SEQ ID NO: 374559 - DNA, 20 bp, Artificial Sequence
  chemically synthesized
actgcatgtagatccttatg

SEQ ID NO: 374560 - DNA, 20 bp, Artificial Sequence
  chemically synthesized
ctgcatgtagatccttatgt

SEQ ID NO: 374561 - DNA, 20 bp, Artificial Sequence
  chemically synthesized
tgcatgtagatccttatgtg

SEQ ID NO: 374562 - DNA, 20 bp, Artificial Sequence
  chemically synthesized
ttcttagaaatccccacata

SEQ ID NO: 374563 - DNA, 20 bp, Artificial Sequence
  chemically synthesized
attcttagaaatccccacat

SEQ ID NO: 374564 - DNA, 20 bp, Artificial Sequence
  chemically synthesized
atccttatgtggggatttct

SEQ ID NO: 374565 - DNA, 20 bp, Artificial Sequence
  chemically synthesized
aggtgctggacaatgattct

SEQ ID NO: 374566 - DNA, 20 bp, Artificial Sequence
  chemically synthesized
gatttctaagaatcattgtc

SEQ ID NO: 374567 - DNA, 20 bp, Artificial Sequence
  chemically synthesized
ttgctttgcagtttaggtgc

SEQ ID NO: 374568 - DNA, 20 bp, Artificial Sequence
  chemically synthesized
accggtttgctttgcagttt

SEQ ID NO: 374569 - DNA, 20 bp, Artificial Sequence
  chemically synthesized
tgtccagcacctaaactgca

SEQ ID NO: 374570 - DNA, 20 bp, Artificial Sequence
  chemically synthesized
taccggtttgctttgcagtt

SEQ ID NO: 374571 - DNA, 20 bp, Artificial Sequence
  chemically synthesized
tttattaccggtttgctttg

SEQ ID NO: 374572 - DNA, 20 bp, Artificial Sequence
  chemically synthesized
acctaaactgcaaagcaaac

SEQ ID NO: 374573 - DNA, 20 bp, Artificial Sequence
  chemically synthesized
attgttgtctgatttattac

SEQ ID NO: 374574 - DNA, 20 bp, Artificial Sequence
  chemically synthesized
aaagcaaaccggtaataaat

SEQ ID NO: 374575 - DNA, 20 bp, Artificial Sequence
  chemically synthesized
taataaatcagacaacaatt

SEQ ID NO: 374576 - DNA, 20 bp, Artificial Sequence
  chemically synthesized
ataaatcagacaacaattaa

SEQ ID NO: 374577 - DNA, 20 bp, Artificial Sequence
  chemically synthesized
tcagacaacaattaagagcc

SEQ ID NO: 374578 - DNA, 20 bp, Artificial Sequence
  chemically synthesized
gctcttgtctcaagatgact

SEQ ID NO: 374579 - DNA, 20 bp, Artificial Sequence
  chemically synthesized
attaagagccaagtcatctt

SEQ ID NO: 374580 - DNA, 20 bp, Artificial Sequence
  chemically synthesized
gagccaagtcatcttgagac

SEQ ID NO: 374581 - DNA, 20 bp, Artificial Sequence
  chemically synthesized
gccaagtcatcttgagacaa

SEQ ID NO: 374582 - DNA, 20 bp, Artificial Sequence
  chemically synthesized
gagtcctgagctcttgtctc

SEQ ID NO: 374583 - DNA, 20 bp, Artificial Sequence
  chemically synthesized
gtcatcttgagacaagagct

SEQ ID NO: 374584 - DNA, 20 bp, Artificial Sequence
  chemically synthesized
tcatcttgagacaagagctc

SEQ ID NO: 374585 - DNA, 20 bp, Artificial Sequence
  chemically synthesized
tgagacaagagctcaggact

SEQ ID NO: 374586 - DNA, 20 bp, Artificial Sequence
  chemically synthesized
aggctgcttctctgagtcct

SEQ ID NO: 374587 - DNA, 20 bp, Artificial Sequence
  chemically synthesized
agacaagagctcaggactca

SEQ ID NO: 374588 - DNA, 20 bp, Artificial Sequence
  chemically synthesized
caagagctcaggactcagag

SEQ ID NO: 374589 - DNA, 20 bp, Artificial Sequence
  chemically synthesized
gagctcaggactcagagaag

SEQ ID NO: 374590 - DNA, 20 bp, Artificial Sequence
  chemically synthesized
catttgcaggctgcttctct

SEQ ID NO: 374591 - DNA, 20 bp, Artificial Sequence
  chemically synthesized
aatgtccatttcacatttgc

SEQ ID NO: 374592 - DNA, 20 bp, Artificial Sequence
  chemically synthesized
gaatgtccatttcacatttg

SEQ ID NO: 374593 - DNA, 20 bp, Artificial Sequence
  chemically synthesized
agcagcctgcaaatgtgaaa

SEQ ID NO: 374594 - DNA, 20 bp, Artificial Sequence
  chemically synthesized
gcaaatgtgaaatggacatt

SEQ ID NO: 374595 - DNA, 20 bp, Artificial Sequence
  chemically synthesized
aatgtgaaatggacattcag

SEQ ID NO: 374596 - DNA, 20 bp, Artificial Sequence
  chemically synthesized
tgaaatggacattcagaagt

SEQ ID NO: 374597 - DNA, 20 bp, Artificial Sequence
  chemically synthesized
atggacattcagaagtcagt

SEQ ID NO: 374598 - DNA, 20 bp, Artificial Sequence
  chemically synthesized
aagtcagtgagtttctgaac

SEQ ID NO: 374599 - DNA, 20 bp, Artificial Sequence
  chemically synthesized
tcagtgagtttctgaactag

SEQ ID NO: 374600 - DNA, 20 bp, Artificial Sequence
  chemically synthesized
gtaaccgggcactgctagtt

SEQ ID NO: 374601 - DNA, 20 bp, Artificial Sequence
  chemically synthesized
gcttcgtaaccgggcactgc

SEQ ID NO: 374602 - DNA, 20 bp, Artificial Sequence
  chemically synthesized
gtttctgaactagcagtgcc

SEQ ID NO: 374603 - DNA, 20 bp, Artificial Sequence
  chemically synthesized
actagcagtgcccggttacg

SEQ ID NO: 374604 - DNA, 20 bp, Artificial Sequence
  chemically synthesized
tcttcaacagcttcgtaacc

SEQ ID NO: 374605 - DNA, 20 bp, Artificial Sequence
  chemically synthesized
ctcttcaacagcttcgtaac

SEQ ID NO: 374606 - DNA, 20 bp, Artificial Sequence
  chemically synthesized
gcccggttacgaagctgttg

SEQ ID NO: 374607 - DNA, 20 bp, Artificial Sequence
  chemically synthesized
ccggttacgaagctgttgaa

SEQ ID NO: 374608 - DNA, 20 bp, Artificial Sequence
  chemically synthesized
cagtccacaaggctcttcaa

SEQ ID NO: 374609 - DNA, 20 bp, Artificial Sequence
  chemically synthesized
gaagctgttgaagagccttg

SEQ ID NO: 374610 - DNA, 20 bp, Artificial Sequence
  chemically synthesized
aacatataaagcagtccaca

SEQ ID NO: 374611 - DNA, 20 bp, Artificial Sequence
  chemically synthesized
gaacatataaagcagtccac

SEQ ID NO: 374612 - DNA, 20 bp, Artificial Sequence
  chemically synthesized
actacccagaacatataaag

SEQ ID NO: 374613 - DNA, 20 bp, Artificial Sequence
  chemically synthesized
ggaactacccagaacatata

SEQ ID NO: 374614 - DNA, 20 bp, Artificial Sequence
  chemically synthesized
gtggactgctttatatgttc

SEQ ID NO: 374615 - DNA, 20 bp, Artificial Sequence
  chemically synthesized
tggactgctttatatgttct

SEQ ID NO: 374616 - DNA, 20 bp, Artificial Sequence
  chemically synthesized
actgctttatatgttctggg

SEQ ID NO: 374617 - DNA, 20 bp, Artificial Sequence
  chemically synthesized
cgaggacctatggaactacc

SEQ ID NO: 374618 - DNA, 20 bp, Artificial Sequence
  chemically synthesized
atatgttctgggtagttcca

SEQ ID NO: 374619 - DNA, 20 bp, Artificial Sequence
  chemically synthesized
tatgttctgggtagttccat

SEQ ID NO: 374620 - DNA, 20 bp, Artificial Sequence
  chemically synthesized
tctctttctgcgaggaccta

SEQ ID NO: 374621 - DNA, 20 bp, Artificial Sequence
  chemically synthesized
ggtagttccataggtcctcg

SEQ ID NO: 374622 - DNA, 20 bp, Artificial Sequence
  chemically synthesized
gttccataggtcctcgcaga

SEQ ID NO: 374623 - DNA, 20 bp, Artificial Sequence
  chemically synthesized
gtttattttctctttctgcg

SEQ ID NO: 374624 - DNA, 20 bp, Artificial Sequence
  chemically synthesized
tccataggtcctcgcagaaa

SEQ ID NO: 374625 - DNA, 20 bp, Artificial Sequence
  chemically synthesized
ggtttattttctctttctgc

SEQ ID NO: 374626 - DNA, 20 bp, Artificial Sequence
  chemically synthesized
ctaaggttaatttcaacgaa

SEQ ID NO: 374627 - DNA, 20 bp, Artificial Sequence
  chemically synthesized
tctaaggttaatttcaacga

SEQ ID NO: 374628 - DNA, 20 bp, Artificial Sequence
  chemically synthesized
cctttcgttgaaattaacct

SEQ ID NO: 374629 - DNA, 20 bp, Artificial Sequence
  chemically synthesized
gttgaaattaaccttagacc

SEQ ID NO: 374630 - DNA, 20 bp, Artificial Sequence
  chemically synthesized
cctttaagaatctaggtcta

SEQ ID NO: 374631 - DNA, 20 bp, Artificial Sequence
  chemically synthesized
tcctttaagaatctaggtct

SEQ ID NO: 374632 - DNA, 20 bp, Artificial Sequence
  chemically synthesized
tttgagtcctttaagaatct

SEQ ID NO: 374633 - DNA, 20 bp, Artificial Sequence
  chemically synthesized
gtttgagtcctttaagaatc

SEQ ID NO: 374634 - DNA, 20 bp, Artificial Sequence
  chemically synthesized
accttagacctagattctta

SEQ ID NO: 374635 - DNA, 20 bp, Artificial Sequence
  chemically synthesized
ccttagacctagattcttaa

SEQ ID NO: 374636 - DNA, 20 bp, Artificial Sequence
  chemically synthesized
gcgaaaagtttgagtccttt

SEQ ID NO: 374637 - DNA, 20 bp, Artificial Sequence
  chemically synthesized
tccttccccgcgaaaagttt

SEQ ID NO: 374638 - DNA, 20 bp, Artificial Sequence
  chemically synthesized
taaaggactcaaacttttcg

SEQ ID NO: 374639 - DNA, 20 bp, Artificial Sequence
  chemically synthesized
aaaggactcaaacttttcgc

SEQ ID NO: 374640 - DNA, 20 bp, Artificial Sequence
  chemically synthesized
aaggactcaaacttttcgcg

SEQ ID NO: 374641 - DNA, 20 bp, Artificial Sequence
  chemically synthesized
ggcctttccttccccgcgaa

SEQ ID NO: 374642 - DNA, 20 bp, Artificial Sequence
  chemically synthesized
gactcaaacttttcgcgggg

SEQ ID NO: 374643 - DNA, 20 bp, Artificial Sequence
  chemically synthesized
actcaaacttttcgcgggga

SEQ ID NO: 374644 - DNA, 20 bp, Artificial Sequence
  chemically synthesized
aaacttttcgcggggaagga

SEQ ID NO: 374645 - DNA, 20 bp, Artificial Sequence
  chemically synthesized
aacttttcgcggggaaggaa

SEQ ID NO: 374646 - DNA, 20 bp, Artificial Sequence
  chemically synthesized
tttcgcggggaaggaaaggc

SEQ ID NO: 374647 - DNA, 20 bp, Artificial Sequence
  chemically synthesized
tacagctcctgtcaatagac

SEQ ID NO: 374648 - DNA, 20 bp, Artificial Sequence
  chemically synthesized
aggaaaggccagtctattga

SEQ ID NO: 374649 - DNA, 20 bp, Artificial Sequence
  chemically synthesized
ggaaaggccagtctattgac

SEQ ID NO: 374650 - DNA, 20 bp, Artificial Sequence
  chemically synthesized
aaaggccagtctattgacag

SEQ ID NO: 374651 - DNA, 20 bp, Artificial Sequence
  chemically synthesized
atatctacagctcctgtcaa

SEQ ID NO: 374652 - DNA, 20 bp, Artificial Sequence
  chemically synthesized
cagtctattgacaggagctg

SEQ ID NO: 374653 - DNA, 20 bp, Artificial Sequence
  chemically synthesized
cccacaggccttaatatcta

SEQ ID NO: 374654 - DNA, 20 bp, Artificial Sequence
  chemically synthesized
tgacaggagctgtagatatt

SEQ ID NO: 374655 - DNA, 20 bp, Artificial Sequence
  chemically synthesized
gacaggagctgtagatatta

SEQ ID NO: 374656 - DNA, 20 bp, Artificial Sequence
  chemically synthesized
gctgtagatattaaggcctg

SEQ ID NO: 374657 - DNA, 20 bp, Artificial Sequence
  chemically synthesized
ctgtagatattaaggcctgt

SEQ ID NO: 374658 - DNA, 20 bp, Artificial Sequence
  chemically synthesized
tgtagatattaaggcctgtg

SEQ ID NO: 374659 - DNA, 20 bp, Artificial Sequence
  chemically synthesized
gtagatattaaggcctgtgg

SEQ ID NO: 374660 - DNA, 20 bp, Artificial Sequence
  chemically synthesized
tagatattaaggcctgtggg

SEQ ID NO: 374661 - DNA, 20 bp, Artificial Sequence
  chemically synthesized
ccccctcccccaccccccac

SEQ ID NO: 374662 - DNA, 20 bp, Artificial Sequence
  chemically synthesized
atattaaggcctgtgggggg

SEQ ID NO: 374663 - DNA, 20 bp, Artificial Sequence
  chemically synthesized
tccccctcccccacccccca

SEQ ID NO: 374664 - DNA, 20 bp, Artificial Sequence
  chemically synthesized
tattaaggcctgtggggggt

SEQ ID NO: 374665 - DNA, 20 bp, Artificial Sequence
  chemically synthesized
attaaggcctgtggggggtg

SEQ ID NO: 374666 - DNA, 20 bp, Artificial Sequence
  chemically synthesized
ttaaggcctgtggggggtgg

SEQ ID NO: 374667 - DNA, 20 bp, Artificial Sequence
  chemically synthesized
aaggcctgtggggggtgggg

SEQ ID NO: 374668 - DNA, 20 bp, Artificial Sequence
  chemically synthesized
aggcctgtggggggtggggg

SEQ ID NO: 374669 - DNA, 20 bp, Artificial Sequence
  chemically synthesized
ggcctgtggggggtggggga

SEQ ID NO: 374670 - DNA, 20 bp, Artificial Sequence
  chemically synthesized
gcctgtggggggtgggggag

SEQ ID NO: 374671 - DNA, 20 bp, Artificial Sequence
  chemically synthesized
cctgtggggggtgggggagg

SEQ ID NO: 374672 - DNA, 20 bp, Artificial Sequence
  chemically synthesized
ggggagggggactcattatc

SEQ ID NO: 374673 - DNA, 20 bp, Artificial Sequence
  chemically synthesized
gggagggggactcattatct

SEQ ID NO: 374674 - DNA, 20 bp, Artificial Sequence
  chemically synthesized
tgtggcttttcccagataat

SEQ ID NO: 374675 - DNA, 20 bp, Artificial Sequence
  chemically synthesized
ggggactcattatctgggaa

SEQ ID NO: 374676 - DNA, 20 bp, Artificial Sequence
  chemically synthesized
attaagggtgtggcttttcc

SEQ ID NO: 374677 - DNA, 20 bp, Artificial Sequence
  chemically synthesized
tttatgatggattaagggtg

SEQ ID NO: 374678 - DNA, 20 bp, Artificial Sequence
  chemically synthesized
cactgtttatgatggattaa

SEQ ID NO: 374679 - DNA, 20 bp, Artificial Sequence
  chemically synthesized
tcactgtttatgatggatta

SEQ ID NO: 374680 - DNA, 20 bp, Artificial Sequence
  chemically synthesized
atcactgtttatgatggatt

SEQ ID NO: 374681 - DNA, 20 bp, Artificial Sequence
  chemically synthesized
cacccttaatccatcataaa

SEQ ID NO: 374682 - DNA, 20 bp, Artificial Sequence
  chemically synthesized
ccaggcatcactgtttatga

SEQ ID NO: 374683 - DNA, 20 bp, Artificial Sequence
  chemically synthesized
ccatcataaacagtgatgcc

SEQ ID NO: 374684 - DNA, 20 bp, Artificial Sequence
  chemically synthesized
catcataaacagtgatgcct

SEQ ID NO: 374685 - DNA, 20 bp, Artificial Sequence
  chemically synthesized
atcataaacagtgatgcctg

SEQ ID NO: 374686 - DNA, 20 bp, Artificial Sequence
  chemically synthesized
aaacagtgatgcctggggca

SEQ ID NO: 374687 - DNA, 20 bp, Artificial Sequence
  chemically synthesized
tgtagtctcaactgtgcccc

SEQ ID NO: 374688 - DNA, 20 bp, Artificial Sequence
  chemically synthesized
gtgtagtctcaactgtgccc

SEQ ID NO: 374689 - DNA, 20 bp, Artificial Sequence
  chemically synthesized
gtgatgcctggggcacagtt

SEQ ID NO: 374690 - DNA, 20 bp, Artificial Sequence
  chemically synthesized
gcacagttgagactacacct

SEQ ID NO: 374691 - DNA, 20 bp, Artificial Sequence
  chemically synthesized
acagttgagactacaccttg

SEQ ID NO: 374692 - DNA, 20 bp, Artificial Sequence
  chemically synthesized
tagattcttcctccaaggtg

SEQ ID NO: 374693 - DNA, 20 bp, Artificial Sequence
  chemically synthesized
cagttgagactacaccttgg

SEQ ID NO: 374694 - DNA, 20 bp, Artificial Sequence
  chemically synthesized
ttgagactacaccttggagg

SEQ ID NO: 374695 - DNA, 20 bp, Artificial Sequence
  chemically synthesized
aaacctagattcttcctcca

SEQ ID NO: 374696 - DNA, 20 bp, Artificial Sequence
  chemically synthesized
aaaacctagattcttcctcc

SEQ ID NO: 374697 - DNA, 20 bp, Artificial Sequence
  chemically synthesized
tacaccttggaggaagaatc

SEQ ID NO: 374698 - DNA, 20 bp, Artificial Sequence
  chemically synthesized
acaccttggaggaagaatct

SEQ ID NO: 374699 - DNA, 20 bp, Artificial Sequence
  chemically synthesized
ggagttggataggaaaaacc

SEQ ID NO: 374700 - DNA, 20 bp, Artificial Sequence
  chemically synthesized
tgtttcttttggagttggat

SEQ ID NO: 374701 - DNA, 20 bp, Artificial Sequence
  chemically synthesized
gtgtttcttttggagttgga

SEQ ID NO: 374702 - DNA, 20 bp, Artificial Sequence
  chemically synthesized
tttttcctatccaactccaa

SEQ ID NO: 374703 - DNA, 20 bp, Artificial Sequence
  chemically synthesized
aaatgtgtttcttttggagt

SEQ ID NO: 374704 - DNA, 20 bp, Artificial Sequence
  chemically synthesized
attgaaatgtgtttcttttg

SEQ ID NO: 374705 - DNA, 20 bp, Artificial Sequence
  chemically synthesized
ccattgaaatgtgtttcttt

SEQ ID NO: 374706 - DNA, 20 bp, Artificial Sequence
  chemically synthesized
ccaaaagaaacacatttcaa

SEQ ID NO: 374707 - DNA, 20 bp, Artificial Sequence
  chemically synthesized
tttgtttgcttgtttttcag

SEQ ID NO: 374708 - DNA, 20 bp, Artificial Sequence
  chemically synthesized
aatggcaactgctgaaaaac

SEQ ID NO: 374709 - DNA, 20 bp, Artificial Sequence
  chemically synthesized
ctttttgtttgcttgttttt

SEQ ID NO: 374710 - DNA, 20 bp, Artificial Sequence
  chemically synthesized
ctgaaaaacaagcaaacaaa

SEQ ID NO: 374711 - DNA, 20 bp, Artificial Sequence
  chemically synthesized
aacaagcaaacaaaaagtac

SEQ ID NO: 374712 - DNA, 20 bp, Artificial Sequence
  chemically synthesized
ccaaagaaacaaaaaggtgc

SEQ ID NO: 374713 - DNA, 20 bp, Artificial Sequence
  chemically synthesized
ttcttaccaaagaaacaaaa

SEQ ID NO: 374714 - DNA, 20 bp, Artificial Sequence
  chemically synthesized
cttcttaccaaagaaacaaa

SEQ ID NO: 374715 - DNA, 20 bp, Artificial Sequence
  chemically synthesized
ccagcacctttttgtttctt

SEQ ID NO: 374716 - DNA, 20 bp, Artificial Sequence
  chemically synthesized
cacctttttgtttctttggt

SEQ ID NO: 374717 - DNA, 20 bp, Artificial Sequence
  chemically synthesized
ctttttgtttctttggtaag

SEQ ID NO: 374718 - DNA, 20 bp, Artificial Sequence
  chemically synthesized
gatgtttcgccttcttacca

SEQ ID NO: 374719 - DNA, 20 bp, Artificial Sequence
  chemically synthesized
tttttgtttctttggtaaga

SEQ ID NO: 374720 - DNA, 20 bp, Artificial Sequence
  chemically synthesized
ggtaagaaggcgaaacatcc

SEQ ID NO: 374721 - DNA, 20 bp, Artificial Sequence
  chemically synthesized
ttcttttttttagacaatct

SEQ ID NO: 374722 - DNA, 20 bp, Artificial Sequence
  chemically synthesized
tttcttttttttagacaatc

SEQ ID NO: 374723 - DNA, 20 bp, Artificial Sequence
  chemically synthesized
atcccagattgtctaaaaaa

SEQ ID NO: 374724 - DNA, 20 bp, Artificial Sequence
  chemically synthesized
tttcccgaatttcttttttt

SEQ ID NO: 374725 - DNA, 20 bp, Artificial Sequence
  chemically synthesized
ttgtctaaaaaaaagaaatt

SEQ ID NO: 374726 - DNA, 20 bp, Artificial Sequence
  chemically synthesized
tgtctaaaaaaaagaaattc

SEQ ID NO: 374727 - DNA, 20 bp, Artificial Sequence
  chemically synthesized
aaaaaagaaattcgggaaat

SEQ ID NO: 374728 - DNA, 20 bp, Artificial Sequence
  chemically synthesized
cagaacgttttatcatgatc

SEQ ID NO: 374729 - DNA, 20 bp, Artificial Sequence
  chemically synthesized
agaacgttttatcatgatct

SEQ ID NO: 374730 - DNA, 20 bp, Artificial Sequence
  chemically synthesized
gaacgttttatcatgatctg

SEQ ID NO: 374731 - DNA, 20 bp, Artificial Sequence
  chemically synthesized
cttactggacaacataaccc

SEQ ID NO: 374732 - DNA, 20 bp, Artificial Sequence
  chemically synthesized
tgatctggggttatgttgtc

SEQ ID NO: 374733 - DNA, 20 bp, Artificial Sequence
  chemically synthesized
ctggggttatgttgtccagt

SEQ ID NO: 374734 - DNA, 20 bp, Artificial Sequence
  chemically synthesized
ggttatgttgtccagtaaga

SEQ ID NO: 374735 - DNA, 20 bp, Artificial Sequence
  chemically synthesized
ataactagtggctatcttac

SEQ ID NO: 374736 - DNA, 20 bp, Artificial Sequence
  chemically synthesized
ttgtccagtaagatagccac

SEQ ID NO: 374737 - DNA, 20 bp, Artificial Sequence
  chemically synthesized
cagtagccacatataactag

SEQ ID NO: 374738 - DNA, 20 bp, Artificial Sequence
  chemically synthesized
gttcagtagccacatataac

SEQ ID NO: 374739 - DNA, 20 bp, Artificial Sequence
  chemically synthesized
agatagccactagttatatg

SEQ ID NO: 374740 - DNA, 20 bp, Artificial Sequence
  chemically synthesized
gtcccatttcaaatgttcag

SEQ ID NO: 374741 - DNA, 20 bp, Artificial Sequence
  chemically synthesized
ctagtcccatttcaaatgtt

SEQ ID NO: 374742 - DNA, 20 bp, Artificial Sequence
  chemically synthesized
tggctactgaacatttgaaa

SEQ ID NO: 374743 - DNA, 20 bp, Artificial Sequence
  chemically synthesized
ggctactgaacatttgaaat

SEQ ID NO: 374744 - DNA, 20 bp, Artificial Sequence
  chemically synthesized
ctgaacatttgaaatgggac

SEQ ID NO: 374745 - DNA, 20 bp, Artificial Sequence
  chemically synthesized
tttggcttcctcagttatgc

SEQ ID NO: 374746 - DNA, 20 bp, Artificial Sequence
  chemically synthesized
gaaatgggactagcataact

SEQ ID NO: 374747 - DNA, 20 bp, Artificial Sequence
  chemically synthesized
aaatgggactagcataactg

SEQ ID NO: 374748 - DNA, 20 bp, Artificial Sequence
  chemically synthesized
tgggactagcataactgagg

SEQ ID NO: 374749 - DNA, 20 bp, Artificial Sequence
  chemically synthesized
aaatgaaaatttggcttcct

SEQ ID NO: 374750 - DNA, 20 bp, Artificial Sequence
  chemically synthesized
aataaagcaaaatgaaaatt

SEQ ID NO: 374751 - DNA, 20 bp, Artificial Sequence
  chemically synthesized
ataaaattgaagcaaaaata

SEQ ID NO: 374752 - DNA, 20 bp, Artificial Sequence
  chemically synthesized
tttcaatataaataaaattg

SEQ ID NO: 374753 - DNA, 20 bp, Artificial Sequence
  chemically synthesized
ttatttatattgaaaacaaa

SEQ ID NO: 374754 - DNA, 20 bp, Artificial Sequence
  chemically synthesized
aatgaagttatggttaatgg

SEQ ID NO: 374755 - DNA, 20 bp, Artificial Sequence
  chemically synthesized
accaatgaagttatggttaa

SEQ ID NO: 374756 - DNA, 20 bp, Artificial Sequence
  chemically synthesized
ctcccaaaccaatgaagtta

SEQ ID NO: 374757 - DNA, 20 bp, Artificial Sequence
  chemically synthesized
tccattaaccataacttcat

SEQ ID NO: 374758 - DNA, 20 bp, Artificial Sequence
  chemically synthesized
cttgttctcccaaaccaatg

SEQ ID NO: 374759 - DNA, 20 bp, Artificial Sequence
  chemically synthesized
taaccataacttcattggtt

SEQ ID NO: 374760 - DNA, 20 bp, Artificial Sequence
  chemically synthesized
aaccataacttcattggttt

SEQ ID NO: 374761 - DNA, 20 bp, Artificial Sequence
  chemically synthesized
ccataacttcattggtttgg

SEQ ID NO: 374762 - DNA, 20 bp, Artificial Sequence
  chemically synthesized
cttcattggtttgggagaac

SEQ ID NO: 374763 - DNA, 20 bp, Artificial Sequence
  chemically synthesized
tgccatattttcatgggtta

SEQ ID NO: 374764 - DNA, 20 bp, Artificial Sequence
  chemically synthesized
ttcagttgccatattttcat

SEQ ID NO: 374765 - DNA, 20 bp, Artificial Sequence
  chemically synthesized
attcagttgccatattttca

SEQ ID NO: 374766 - DNA, 20 bp, Artificial Sequence
  chemically synthesized
tactttaacccatgaaaata

SEQ ID NO: 374767 - DNA, 20 bp, Artificial Sequence
  chemically synthesized
gaaaatatggcaactgaatt

SEQ ID NO: 374768 - DNA, 20 bp, Artificial Sequence
  chemically synthesized
atttacagcacatctgaatt

SEQ ID NO: 374769 - DNA, 20 bp, Artificial Sequence
  chemically synthesized
tggaggatattttacattta

SEQ ID NO: 374770 - DNA, 20 bp, Artificial Sequence
  chemically synthesized
tactaaatcattaaggttgg

SEQ ID NO: 374771 - DNA, 20 bp, Artificial Sequence
  chemically synthesized
gtactaaatcattaaggttg

SEQ ID NO: 374772 - DNA, 20 bp, Artificial Sequence
  chemically synthesized
atgtactaaatcattaaggt

SEQ ID NO: 374773 - DNA, 20 bp, Artificial Sequence
  chemically synthesized
aagaatgtactaaatcatta

SEQ ID NO: 374774 - DNA, 20 bp, Artificial Sequence
  chemically synthesized
atcctccaaccttaatgatt

SEQ ID NO: 374775 - DNA, 20 bp, Artificial Sequence
  chemically synthesized
aaagaatgtactaaatcatt

SEQ ID NO: 374776 - DNA, 20 bp, Artificial Sequence
  chemically synthesized
agacattttacgttagtgaa

SEQ ID NO: 374777 - DNA, 20 bp, Artificial Sequence
  chemically synthesized
cttaatgagacattttacgt

SEQ ID NO: 374778 - DNA, 20 bp, Artificial Sequence
  chemically synthesized
ctaacgtaaaatgtctcatt

SEQ ID NO: 374779 - DNA, 20 bp, Artificial Sequence
  chemically synthesized
gtaatcaaaaaagacttaat

SEQ ID NO: 374780 - DNA, 20 bp, Artificial Sequence
  chemically synthesized
atttcaacatgtaatcaaaa

SEQ ID NO: 374781 - DNA, 20 bp, Artificial Sequence
  chemically synthesized
gattacatgttgaaatattt

SEQ ID NO: 374782 - DNA, 20 bp, Artificial Sequence
  chemically synthesized
ggtgacattaatgttttatt

SEQ ID NO: 374783 - DNA, 20 bp, Artificial Sequence
  chemically synthesized
tttaaaaagtgaaaataaac

SEQ ID NO: 374784 - DNA, 20 bp, Artificial Sequence
  chemically synthesized
ctttaaaaagtgaaaataaa

SEQ ID NO: 374785 - DNA, 20 bp, Artificial Sequence
  chemically synthesized
ctgtttattttcacttttta

SEQ ID NO: 374786 - DNA, 20 bp, Artificial Sequence
  chemically synthesized
tttattttcactttttaaag

SEQ ID NO: 374787 - DNA, 20 bp, Artificial Sequence
  chemically synthesized
ttttgagtagccactttaaa

SEQ ID NO: 374788 - DNA, 20 bp, Artificial Sequence
  chemically synthesized
ttttaaagtggctactcaaa

SEQ ID NO: 374789 - DNA, 20 bp, Artificial Sequence
  chemically synthesized
tgtaatttaaactttttgag

SEQ ID NO: 374790 - DNA, 20 bp, Artificial Sequence
  chemically synthesized
atatgtaatttaaacttttt

SEQ ID NO: 374791 - DNA, 20 bp, Artificial Sequence
  chemically synthesized
aaaagtttaaattacatata

SEQ ID NO: 374792 - DNA, 20 bp, Artificial Sequence
  chemically synthesized
gtgctgtccaaaagaaatat

SEQ ID NO: 374793 - DNA, 20 bp, Artificial Sequence
  chemically synthesized
tatatagcttatatttcttt

SEQ ID NO: 374794 - DNA, 20 bp, Artificial Sequence
  chemically synthesized
tagcttatatttcttttgga

SEQ ID NO: 374795 - DNA, 20 bp, Artificial Sequence
  chemically synthesized
tccaggccagtgctgtccaa

SEQ ID NO: 374796 - DNA, 20 bp, Artificial Sequence
  chemically synthesized
atatttcttttggacagcac

SEQ ID NO: 374797 - DNA, 20 bp, Artificial Sequence
  chemically synthesized
tcttttggacagcactggcc

SEQ ID NO: 374798 - DNA, 20 bp, Artificial Sequence
  chemically synthesized
ttttggacagcactggcctg

SEQ ID NO: 374799 - DNA, 20 bp, Artificial Sequence
  chemically synthesized
ttttgaactgtactccaggc

SEQ ID NO: 374800 - DNA, 20 bp, Artificial Sequence
  chemically synthesized
gacagcactggcctggagta

SEQ ID NO: 374801 - DNA, 20 bp, Artificial Sequence
  chemically synthesized
ctatttttgaactgtactcc

SEQ ID NO: 374802 - DNA, 20 bp, Artificial Sequence
  chemically synthesized
cctatttttgaactgtactc

SEQ ID NO: 374803 - DNA, 20 bp, Artificial Sequence
  chemically synthesized
cctggagtacagttcaaaaa

SEQ ID NO: 374804 - DNA, 20 bp, Artificial Sequence
  chemically synthesized
ctggagtacagttcaaaaat

SEQ ID NO: 374805 - DNA, 20 bp, Artificial Sequence
  chemically synthesized
tggagtacagttcaaaaata

SEQ ID NO: 374806 - DNA, 20 bp, Artificial Sequence
  chemically synthesized
tcaaaaatagggcaaaaatt

SEQ ID NO: 374807 - DNA, 20 bp, Artificial Sequence
  chemically synthesized
aaaaatagggcaaaaattca

SEQ ID NO: 374808 - DNA, 20 bp, Artificial Sequence
  chemically synthesized
gcaaaactcagatgtggaag

SEQ ID NO: 374809 - DNA, 20 bp, Artificial Sequence
  chemically synthesized
ttcgcaaaactcagatgtgg

SEQ ID NO: 374810 - DNA, 20 bp, Artificial Sequence
  chemically synthesized
gagttacttcttccacatct

SEQ ID NO: 374811 - DNA, 20 bp, Artificial Sequence
  chemically synthesized
atgttcgcaaaactcagatg

SEQ ID NO: 374812 - DNA, 20 bp, Artificial Sequence
  chemically synthesized
gaataaatgttcgcaaaact

SEQ ID NO: 374813 - DNA, 20 bp, Artificial Sequence
  chemically synthesized
cagactggtgtgtatgtagc

SEQ ID NO: 374814 - DNA, 20 bp, Artificial Sequence
  chemically synthesized
acagactggtgtgtatgtag

SEQ ID NO: 374815 - DNA, 20 bp, Artificial Sequence
  chemically synthesized
tacacagactggtgtgtatg

SEQ ID NO: 374816 - DNA, 20 bp, Artificial Sequence
  chemically synthesized
tattcctgctacatacacac

SEQ ID NO: 374817 - DNA, 20 bp, Artificial Sequence
  chemically synthesized
ttatgtgtagatacacagac

SEQ ID NO: 374818 - DNA, 20 bp, Artificial Sequence
  chemically synthesized
tttcattatgtgtagataca

SEQ ID NO: 374819 - DNA, 20 bp, Artificial Sequence
  chemically synthesized
agtctgtttttcattatgtg

SEQ ID NO: 374820 - DNA, 20 bp, Artificial Sequence
  chemically synthesized
tatctacacataatgaaaaa

SEQ ID NO: 374821 - DNA, 20 bp, Artificial Sequence
  chemically synthesized
gtatatgaggggattgagaa

SEQ ID NO: 374822 - DNA, 20 bp, Artificial Sequence
  chemically synthesized
cctctgtatatgaggggatt

SEQ ID NO: 374823 - DNA, 20 bp, Artificial Sequence
  chemically synthesized
acctgccctctgtatatgag

SEQ ID NO: 374824 - DNA, 20 bp, Artificial Sequence
  chemically synthesized
tttctcaatcccctcatata

SEQ ID NO: 374825 - DNA, 20 bp, Artificial Sequence
  chemically synthesized
cacctgccctctgtatatga

SEQ ID NO: 374826 - DNA, 20 bp, Artificial Sequence
  chemically synthesized
tcacctgccctctgtatatg

SEQ ID NO: 374827 - DNA, 20 bp, Artificial Sequence
  chemically synthesized
tctcaatcccctcatataca

SEQ ID NO: 374828 - DNA, 20 bp, Artificial Sequence
  chemically synthesized
ctcacctgccctctgtatat

SEQ ID NO: 374829 - DNA, 20 bp, Artificial Sequence
  chemically synthesized
ctcaatcccctcatatacag

SEQ ID NO: 374830 - DNA, 20 bp, Artificial Sequence
  chemically synthesized
tcaatcccctcatatacaga

SEQ ID NO: 374831 - DNA, 20 bp, Artificial Sequence
  chemically synthesized
atcccctcatatacagaggg

SEQ ID NO: 374832 - DNA, 20 bp, Artificial Sequence
  chemically synthesized
tcccctcatatacagagggc

SEQ ID NO: 374833 - DNA, 20 bp, Artificial Sequence
  chemically synthesized
ctcatatacagagggcaggt

SEQ ID NO: 374834 - DNA, 20 bp, Artificial Sequence
  chemically synthesized
tatacagagggcaggtgagt

SEQ ID NO: 374835 - DNA, 20 bp, Artificial Sequence
  chemically synthesized
cagagggcaggtgagtgagc

SEQ ID NO: 374836 - DNA, 20 bp, Artificial Sequence
  chemically synthesized
gggcaggtgagtgagccagt

SEQ ID NO: 374837 - DNA, 20 bp, Artificial Sequence
  chemically synthesized
gcaggtgagtgagccagtga

SEQ ID NO: 374838 - DNA, 20 bp, Artificial Sequence
  chemically synthesized
ggtgagtgagccagtgagag

SEQ ID NO: 374839 - DNA, 20 bp, Artificial Sequence
  chemically synthesized
acctctcagtcttctctcac

SEQ ID NO: 374840 - DNA, 20 bp, Artificial Sequence
  chemically synthesized
tgagccagtgagagaagact

SEQ ID NO: 374841 - DNA, 20 bp, Artificial Sequence
  chemically synthesized
agccagtgagagaagactga

SEQ ID NO: 374842 - DNA, 20 bp, Artificial Sequence
  chemically synthesized
gccagtgagagaagactgag

SEQ ID NO: 374843 - DNA, 20 bp, Artificial Sequence
  chemically synthesized
gtgagagaagactgagaggt

SEQ ID NO: 374844 - DNA, 20 bp, Artificial Sequence
  chemically synthesized
tatatgatccacttacctct

SEQ ID NO: 374845 - DNA, 20 bp, Artificial Sequence
  chemically synthesized
agagaagactgagaggtaag

SEQ ID NO: 374846 - DNA, 20 bp, Artificial Sequence
  chemically synthesized
gtaagtggatcatataaatt

SEQ ID NO: 374847 - DNA, 20 bp, Artificial Sequence
  chemically synthesized
gtggatcatataaattaaga

SEQ ID NO: 374848 - DNA, 20 bp, Artificial Sequence
  chemically synthesized
ctaatgattctaatgttgtt

SEQ ID NO: 374849 - DNA, 20 bp, Artificial Sequence
  chemically synthesized
ttaagatggcctaacaacat

SEQ ID NO: 374850 - DNA, 20 bp, Artificial Sequence
  chemically synthesized
cctaatgattctaatgttgt

SEQ ID NO: 374851 - DNA, 20 bp, Artificial Sequence
  chemically synthesized
cctaacaacattagaatcat

SEQ ID NO: 374852 - DNA, 20 bp, Artificial Sequence
  chemically synthesized
ctaacaacattagaatcatt

SEQ ID NO: 374853 - DNA, 20 bp, Artificial Sequence
  chemically synthesized
ggactgttgtcataagttat

SEQ ID NO: 374854 - DNA, 20 bp, Artificial Sequence
  chemically synthesized
tggactgttgtcataagtta

SEQ ID NO: 374855 - DNA, 20 bp, Artificial Sequence
  chemically synthesized
aatcctataacttatgacaa

SEQ ID NO: 374856 - DNA, 20 bp, Artificial Sequence
  chemically synthesized
gcatcttggactgttgtcat

SEQ ID NO: 374857 - DNA, 20 bp, Artificial Sequence
  chemically synthesized
ataacttatgacaacagtcc

SEQ ID NO: 374858 - DNA, 20 bp, Artificial Sequence
  chemically synthesized
tgacaacagtccaagatgca

SEQ ID NO: 374859 - DNA, 20 bp, Artificial Sequence
  chemically synthesized
ttaaaaatcactttgcatct

SEQ ID NO: 374860 - DNA, 20 bp, Artificial Sequence
  chemically synthesized
agatgcaaagtgatttttaa

SEQ ID NO: 374861 - DNA, 20 bp, Artificial Sequence
  chemically synthesized
gaaaactagaaaatttaatt

SEQ ID NO: 374862 - DNA, 20 bp, Artificial Sequence
  chemically synthesized
gtgatctaaattaaattttc

SEQ ID NO: 374863 - DNA, 20 bp, Artificial Sequence
  chemically synthesized
aagggaaagaaaaggaaaac

SEQ ID NO: 374864 - DNA, 20 bp, Artificial Sequence
  chemically synthesized
acctattaaagggaaagaaa

SEQ ID NO: 374865 - DNA, 20 bp, Artificial Sequence
  chemically synthesized
aacctattaaagggaaagaa

SEQ ID NO: 374866 - DNA, 20 bp, Artificial Sequence
  chemically synthesized
catgaaacctattaaaggga

SEQ ID NO: 374867 - DNA, 20 bp, Artificial Sequence
  chemically synthesized
ttccttttctttccctttaa

SEQ ID NO: 374868 - DNA, 20 bp, Artificial Sequence
  chemically synthesized
tccttttctttccctttaat

SEQ ID NO: 374869 - DNA, 20 bp, Artificial Sequence
  chemically synthesized
ttttcatgaaacctattaaa

SEQ ID NO: 374870 - DNA, 20 bp, Artificial Sequence
  chemically synthesized
attttcatgaaacctattaa

SEQ ID NO: 374871 - DNA, 20 bp, Artificial Sequence
  chemically synthesized
gattttcatgaaacctatta

SEQ ID NO: 374872 - DNA, 20 bp, Artificial Sequence
  chemically synthesized
taataggtttcatgaaaatc

SEQ ID NO: 374873 - DNA, 20 bp, Artificial Sequence
  chemically synthesized
tcatgaaaatcaagaattat

SEQ ID NO: 374874 - DNA, 20 bp, Artificial Sequence
  chemically synthesized
catgaaaatcaagaattata

SEQ ID NO: 374875 - DNA, 20 bp, Artificial Sequence
  chemically synthesized
gaaaatcaagaattataagg

SEQ ID NO: 374876 - DNA, 20 bp, Artificial Sequence
  chemically synthesized
aaaatcaagaattataaggc

SEQ ID NO: 374877 - DNA, 20 bp, Artificial Sequence
  chemically synthesized
aaatcaagaattataaggcg

SEQ ID NO: 374878 - DNA, 20 bp, Artificial Sequence
  chemically synthesized
atcaagaattataaggcggg

SEQ ID NO: 374879 - DNA, 20 bp, Artificial Sequence
  chemically synthesized
tcaagaattataaggcgggg

SEQ ID NO: 374880 - DNA, 20 bp, Artificial Sequence
  chemically synthesized
gaattataaggcggggaggt

SEQ ID NO: 374881 - DNA, 20 bp, Artificial Sequence
  chemically synthesized
aattataaggcggggaggta

SEQ ID NO: 374882 - DNA, 20 bp, Artificial Sequence
  chemically synthesized
ataaggcggggaggtaaggc

SEQ ID NO: 374883 - DNA, 20 bp, Artificial Sequence
  chemically synthesized
aaggcggggaggtaaggctg

SEQ ID NO: 374884 - DNA, 20 bp, Artificial Sequence
  chemically synthesized
gcggggaggtaaggctggag

SEQ ID NO: 374885 - DNA, 20 bp, Artificial Sequence
  chemically synthesized
ctttattagattgtcttctc

SEQ ID NO: 374886 - DNA, 20 bp, Artificial Sequence
  chemically synthesized
ctggagaagacaatctaata

SEQ ID NO: 374887 - DNA, 20 bp, Artificial Sequence
  chemically synthesized
tttgtcctacatcgctttat

SEQ ID NO: 374888 - DNA, 20 bp, Artificial Sequence
  chemically synthesized
gacaatctaataaagcgatg

SEQ ID NO: 374889 - DNA, 20 bp, Artificial Sequence
  chemically synthesized
acaatctaataaagcgatgt

SEQ ID NO: 374890 - DNA, 20 bp, Artificial Sequence
  chemically synthesized
taaagcgatgtaggacaaat

SEQ ID NO: 374891 - DNA, 20 bp, Artificial Sequence
  chemically synthesized
gtaggacaaatgagaaaaat

SEQ ID NO: 374892 - DNA, 20 bp, Artificial Sequence
  chemically synthesized
taggacaaatgagaaaaatc

SEQ ID NO: 374893 - DNA, 20 bp, Artificial Sequence
  chemically synthesized
agtgttggagtagaataagg

SEQ ID NO: 374894 - DNA, 20 bp, Artificial Sequence
  chemically synthesized
gaaagtgttggagtagaata

SEQ ID NO: 374895 - DNA, 20 bp, Artificial Sequence
  chemically synthesized
ggaaagtgttggagtagaat

SEQ ID NO: 374896 - DNA, 20 bp, Artificial Sequence
  chemically synthesized
acagttggaaagtgttggag

SEQ ID NO: 374897 - DNA, 20 bp, Artificial Sequence
  chemically synthesized
atgacagttggaaagtgttg

SEQ ID NO: 374898 - DNA, 20 bp, Artificial Sequence
  chemically synthesized
tcatgacagttggaaagtgt

SEQ ID NO: 374899 - DNA, 20 bp, Artificial Sequence
  chemically synthesized
tgaaggtcatgacagttgga

SEQ ID NO: 374900 - DNA, 20 bp, Artificial Sequence
  chemically synthesized
accatgaaggtcatgacagt

SEQ ID NO: 374901 - DNA, 20 bp, Artificial Sequence
  chemically synthesized
acagaccatgaaggtcatga

SEQ ID NO: 374902 - DNA, 20 bp, Artificial Sequence
  chemically synthesized
tccaactgtcatgaccttca

SEQ ID NO: 374903 - DNA, 20 bp, Artificial Sequence
  chemically synthesized
gaggtacagacagaccatga

SEQ ID NO: 374904 - DNA, 20 bp, Artificial Sequence
  chemically synthesized
tgaggtacagacagaccatg

SEQ ID NO: 374905 - DNA, 20 bp, Artificial Sequence
  chemically synthesized
tcagagaattgaggtacaga

SEQ ID NO: 374906 - DNA, 20 bp, Artificial Sequence
  chemically synthesized
ctgatcagagaattgaggta

SEQ ID NO: 374907 - DNA, 20 bp, Artificial Sequence
  chemically synthesized
ttttactgatcagagaattg

SEQ ID NO: 374908 - DNA, 20 bp, Artificial Sequence
  chemically synthesized
attttactgatcagagaatt

SEQ ID NO: 374909 - DNA, 20 bp, Artificial Sequence
  chemically synthesized
ctgtacctcaattctctgat

SEQ ID NO: 374910 - DNA, 20 bp, Artificial Sequence
  chemically synthesized
catccaaattttactgatca

SEQ ID NO: 374911 - DNA, 20 bp, Artificial Sequence
  chemically synthesized
ttcatccaaattttactgat

SEQ ID NO: 374912 - DNA, 20 bp, Artificial Sequence
  chemically synthesized
attctctgatcagtaaaatt

SEQ ID NO: 374913 - DNA, 20 bp, Artificial Sequence
  chemically synthesized
aaaatttggatgaaatatgc

SEQ ID NO: 374914 - DNA, 20 bp, Artificial Sequence
  chemically synthesized
cattttgtctcaacagagtc

SEQ ID NO: 374915 - DNA, 20 bp, Artificial Sequence
  chemically synthesized
gaaatatgctggactctgtt

SEQ ID NO: 374916 - DNA, 20 bp, Artificial Sequence
  chemically synthesized
gttttcattttgtctcaaca

SEQ ID NO: 374917 - DNA, 20 bp, Artificial Sequence
  chemically synthesized
atgttttcattttgtctcaa

SEQ ID NO: 374918 - DNA, 20 bp, Artificial Sequence
  chemically synthesized
ttgagacaaaatgaaaacat

SEQ ID NO: 374919 - DNA, 20 bp, Artificial Sequence
  chemically synthesized
tgagacaaaatgaaaacata

SEQ ID NO: 374920 - DNA, 20 bp, Artificial Sequence
  chemically synthesized
agacaaaatgaaaacataag

SEQ ID NO: 374921 - DNA, 20 bp, Artificial Sequence
  chemically synthesized
acaaaatgaaaacataagga

SEQ ID NO: 374922 - DNA, 20 bp, Artificial Sequence
  chemically synthesized
atgtagtgatttacagatga

SEQ ID NO: 374923 - DNA, 20 bp, Artificial Sequence
  chemically synthesized
gtacataatgtagtgattta

SEQ ID NO: 374924 - DNA, 20 bp, Artificial Sequence
  chemically synthesized
atactaatgggtacataatg

SEQ ID NO: 374925 - DNA, 20 bp, Artificial Sequence
  chemically synthesized
tcactacattatgtacccat

SEQ ID NO: 374926 - DNA, 20 bp, Artificial Sequence
  chemically synthesized
gctaacaataaaatactaat

SEQ ID NO: 374927 - DNA, 20 bp, Artificial Sequence
  chemically synthesized
tgctaacaataaaatactaa

SEQ ID NO: 374928 - DNA, 20 bp, Artificial Sequence
  chemically synthesized
acccattagtattttattgt

SEQ ID NO: 374929 - DNA, 20 bp, Artificial Sequence
  chemically synthesized
ttagtattttattgttagca

SEQ ID NO: 374930 - DNA, 20 bp, Artificial Sequence
  chemically synthesized
ttattgttagcaaagattaa

SEQ ID NO: 374931 - DNA, 20 bp, Artificial Sequence
  chemically synthesized
ccatccagccttggagttgt

SEQ ID NO: 374932 - DNA, 20 bp, Artificial Sequence
  chemically synthesized
aatagaaaactgacaactcc

SEQ ID NO: 374933 - DNA, 20 bp, Artificial Sequence
  chemically synthesized
atagaaaactgacaactcca

SEQ ID NO: 374934 - DNA, 20 bp, Artificial Sequence
  chemically synthesized
aaaactgacaactccaaggc

SEQ ID NO: 374935 - DNA, 20 bp, Artificial Sequence
  chemically synthesized
cttcatgccatccagccttg

SEQ ID NO: 374936 - DNA, 20 bp, Artificial Sequence
  chemically synthesized
ggcttcatgccatccagcct

SEQ ID NO: 374937 - DNA, 20 bp, Artificial Sequence
  chemically synthesized
ctgacaactccaaggctgga

SEQ ID NO: 374938 - DNA, 20 bp, Artificial Sequence
  chemically synthesized
gtgtagggcttcatgccatc

SEQ ID NO: 374939 - DNA, 20 bp, Artificial Sequence
  chemically synthesized
ctccaaggctggatggcatg

SEQ ID NO: 374940 - DNA, 20 bp, Artificial Sequence
  chemically synthesized
atggcatgaagccctacacc

SEQ ID NO: 374941 - DNA, 20 bp, Artificial Sequence
  chemically synthesized
ggcagcaactactaggtgta

SEQ ID NO: 374942 - DNA, 20 bp, Artificial Sequence
  chemically synthesized
tggcagcaactactaggtgt

SEQ ID NO: 374943 - DNA, 20 bp, Artificial Sequence
  chemically synthesized
gcatgaagccctacacctag

SEQ ID NO: 374944 - DNA, 20 bp, Artificial Sequence
  chemically synthesized
atggcagcaactactaggtg

SEQ ID NO: 374945 - DNA, 20 bp, Artificial Sequence
  chemically synthesized
agactatggcagcaactact

SEQ ID NO: 374946 - DNA, 20 bp, Artificial Sequence
  chemically synthesized
cagactatggcagcaactac

SEQ ID NO: 374947 - DNA, 20 bp, Artificial Sequence
  chemically synthesized
acacctagtagttgctgcca

SEQ ID NO: 374948 - DNA, 20 bp, Artificial Sequence
  chemically synthesized
aacctcaaatcagactatgg

SEQ ID NO: 374949 - DNA, 20 bp, Artificial Sequence
  chemically synthesized
aggaacctcaaatcagacta

SEQ ID NO: 374950 - DNA, 20 bp, Artificial Sequence
  chemically synthesized
ttgctgccatagtctgattt

SEQ ID NO: 374951 - DNA, 20 bp, Artificial Sequence
  chemically synthesized
tgctgccatagtctgatttg

SEQ ID NO: 374952 - DNA, 20 bp, Artificial Sequence
  chemically synthesized
tgatttgaggaacctcaaat

SEQ ID NO: 374953 - DNA, 20 bp, Artificial Sequence
  chemically synthesized
ggctggggaagaatgatttg

SEQ ID NO: 374954 - DNA, 20 bp, Artificial Sequence
  chemically synthesized
aggctggggaagaatgattt

SEQ ID NO: 374955 - DNA, 20 bp, Artificial Sequence
  chemically synthesized
ttcctcaaatcattcttccc

SEQ ID NO: 374956 - DNA, 20 bp, Artificial Sequence
  chemically synthesized
aaaaaatgattaggctgggg

SEQ ID NO: 374957 - DNA, 20 bp, Artificial Sequence
  chemically synthesized
gagaaaaaatgattaggctg

SEQ ID NO: 374958 - DNA, 20 bp, Artificial Sequence
  chemically synthesized
agagaaaaaatgattaggct

SEQ ID NO: 374959 - DNA, 20 bp, Artificial Sequence
  chemically synthesized
aagagaaaaaatgattaggc

SEQ ID NO: 374960 - DNA, 20 bp, Artificial Sequence
  chemically synthesized
tctgaagagaaaaaatgatt

SEQ ID NO: 374961 - DNA, 20 bp, Artificial Sequence
  chemically synthesized
gtctgaagagaaaaaatgat

SEQ ID NO: 374962 - DNA, 20 bp, Artificial Sequence
  chemically synthesized
gcctaatcattttttctctt

SEQ ID NO: 374963 - DNA, 20 bp, Artificial Sequence
  chemically synthesized
ggcaggattccaggtctgaa

SEQ ID NO: 374964 - DNA, 20 bp, Artificial Sequence
  chemically synthesized
tcattttttctcttcagacc

SEQ ID NO: 374965 - DNA, 20 bp, Artificial Sequence
  chemically synthesized
atggcaggattccaggtctg

SEQ ID NO: 374966 - DNA, 20 bp, Artificial Sequence
  chemically synthesized
cgagaggatggcaggattcc

SEQ ID NO: 374967 - DNA, 20 bp, Artificial Sequence
  chemically synthesized
gcgagaggatggcaggattc

SEQ ID NO: 374968 - DNA, 20 bp, Artificial Sequence
  chemically synthesized
ctatgacgcgagaggatggc

SEQ ID NO: 374969 - DNA, 20 bp, Artificial Sequence
  chemically synthesized
actatgacgcgagaggatgg

SEQ ID NO: 374970 - DNA, 20 bp, Artificial Sequence
  chemically synthesized
caaactatgacgcgagagga

SEQ ID NO: 374971 - DNA, 20 bp, Artificial Sequence
  chemically synthesized
cccccaaactatgacgcgag

SEQ ID NO: 374972 - DNA, 20 bp, Artificial Sequence
  chemically synthesized
acccccaaactatgacgcga

SEQ ID NO: 374973 - DNA, 20 bp, Artificial Sequence
  chemically synthesized
cctgccatcctctcgcgtca

SEQ ID NO: 374974 - DNA, 20 bp, Artificial Sequence
  chemically synthesized
taacccccaaactatgacgc

SEQ ID NO: 374975 - DNA, 20 bp, Artificial Sequence
  chemically synthesized
catcctctcgcgtcatagtt

SEQ ID NO: 374976 - DNA, 20 bp, Artificial Sequence
  chemically synthesized
atcctctcgcgtcatagttt

SEQ ID NO: 374977 - DNA, 20 bp, Artificial Sequence
  chemically synthesized
tcctctcgcgtcatagtttg

SEQ ID NO: 374978 - DNA, 20 bp, Artificial Sequence
  chemically synthesized
cctctcgcgtcatagtttgg

SEQ ID NO: 374979 - DNA, 20 bp, Artificial Sequence
  chemically synthesized
tgttcattggcatatgcagg

SEQ ID NO: 374980 - DNA, 20 bp, Artificial Sequence
  chemically synthesized
tactgttcattggcatatgc

SEQ ID NO: 374981 - DNA, 20 bp, Artificial Sequence
  chemically synthesized
atactgttcattggcatatg

SEQ ID NO: 374982 - DNA, 20 bp, Artificial Sequence
  chemically synthesized
tgcctgcatatgccaatgaa

SEQ ID NO: 374983 - DNA, 20 bp, Artificial Sequence
  chemically synthesized
cacgtggctatactgttcat

SEQ ID NO: 374984 - DNA, 20 bp, Artificial Sequence
  chemically synthesized
gcatatgccaatgaacagta

SEQ ID NO: 374985 - DNA, 20 bp, Artificial Sequence
  chemically synthesized
aacagtatagccacgtgaca

SEQ ID NO: 374986 - DNA, 20 bp, Artificial Sequence
  chemically synthesized
gccttcatttctgtgtcacg

SEQ ID NO: 374987 - DNA, 20 bp, Artificial Sequence
  chemically synthesized
agccacgtgacacagaaatg

SEQ ID NO: 374988 - DNA, 20 bp, Artificial Sequence
  chemically synthesized
gccacgtgacacagaaatga

SEQ ID NO: 374989 - DNA, 20 bp, Artificial Sequence
  chemically synthesized
tgacacagaaatgaaggcca

SEQ ID NO: 374990 - DNA, 20 bp, Artificial Sequence
  chemically synthesized
actgatgaattatggttctg

SEQ ID NO: 374991 - DNA, 20 bp, Artificial Sequence
  chemically synthesized
attgaataactgatgaatta

SEQ ID NO: 374992 - DNA, 20 bp, Artificial Sequence
  chemically synthesized
gccacagaaccataattcat

SEQ ID NO: 374993 - DNA, 20 bp, Artificial Sequence
  chemically synthesized
tcatcagttattcaatgtgt

SEQ ID NO: 374994 - DNA, 20 bp, Artificial Sequence
  chemically synthesized
caatgtgttagctgacaact

SEQ ID NO: 374995 - DNA, 20 bp, Artificial Sequence
  chemically synthesized
ctctatgatttccaagttgt

SEQ ID NO: 374996 - DNA, 20 bp, Artificial Sequence
  chemically synthesized
ttgagtgctctatgatttcc

SEQ ID NO: 374997 - DNA, 20 bp, Artificial Sequence
  chemically synthesized
agctgacaacttggaaatca

SEQ ID NO: 374998 - DNA, 20 bp, Artificial Sequence
  chemically synthesized
ctgacaacttggaaatcata

SEQ ID NO: 374999 - DNA, 20 bp, Artificial Sequence
  chemically synthesized
atcatagagcactcaactcc

SEQ ID NO: 375000 - DNA, 20 bp, Artificial Sequence
  chemically synthesized
tcaggaagtaacttggagtt

SEQ ID NO: 375001 - DNA, 20 bp, Artificial Sequence
  chemically synthesized
gcttttcaggaagtaacttg

SEQ ID NO: 375002 - DNA, 20 bp, Artificial Sequence
  chemically synthesized
ctgcttttcaggaagtaact

SEQ ID NO: 375003 - DNA, 20 bp, Artificial Sequence
  chemically synthesized
actccaagttacttcctgaa

SEQ ID NO: 375004 - DNA, 20 bp, Artificial Sequence
  chemically synthesized
gcatttctctgcttttcagg

SEQ ID NO: 375005 - DNA, 20 bp, Artificial Sequence
  chemically synthesized
ccaagttacttcctgaaaag

SEQ ID NO: 375006 - DNA, 20 bp, Artificial Sequence
  chemically synthesized
gaagcatttctctgcttttc

SEQ ID NO: 375007 - DNA, 20 bp, Artificial Sequence
  chemically synthesized
aagttacttcctgaaaagca

SEQ ID NO: 375008 - DNA, 20 bp, Artificial Sequence
  chemically synthesized
ggaagcatttctctgctttt

SEQ ID NO: 375009 - DNA, 20 bp, Artificial Sequence
  chemically synthesized
aaagcagagaaatgcttcct

SEQ ID NO: 375010 - DNA, 20 bp, Artificial Sequence
  chemically synthesized
cagagaaatgcttcctcagt

SEQ ID NO: 375011 - DNA, 20 bp, Artificial Sequence
  chemically synthesized
gttctgtggcctcactgagg

SEQ ID NO: 375012 - DNA, 20 bp, Artificial Sequence
  chemically synthesized
agagaaatgcttcctcagtg

SEQ ID NO: 375013 - DNA, 20 bp, Artificial Sequence
  chemically synthesized
tgagttctgtggcctcactg

SEQ ID NO: 375014 - DNA, 20 bp, Artificial Sequence
  chemically synthesized
gtgagttctgtggcctcact

SEQ ID NO: 375015 - DNA, 20 bp, Artificial Sequence
  chemically synthesized
atgcttcctcagtgaggcca

SEQ ID NO: 375016 - DNA, 20 bp, Artificial Sequence
  chemically synthesized
atgtaaagctgtgagttctg

SEQ ID NO: 375017 - DNA, 20 bp, Artificial Sequence
  chemically synthesized
cagtgaggccacagaactca

SEQ ID NO: 375018 - DNA, 20 bp, Artificial Sequence
  chemically synthesized
taggtaaaatgtaaagctgt

SEQ ID NO: 375019 - DNA, 20 bp, Artificial Sequence
  chemically synthesized
caaattgtaggtaaaatgta

SEQ ID NO: 375020 - DNA, 20 bp, Artificial Sequence
  chemically synthesized
gtggatcatgtgcaaattgt

SEQ ID NO: 375021 - DNA, 20 bp, Artificial Sequence
  chemically synthesized
tgtggatcatgtgcaaattg

SEQ ID NO: 375022 - DNA, 20 bp, Artificial Sequence
  chemically synthesized
tgcacatgatccacatgatc

SEQ ID NO: 375023 - DNA, 20 bp, Artificial Sequence
  chemically synthesized
aaagccgaggccagatcatg

SEQ ID NO: 375024 - DNA, 20 bp, Artificial Sequence
  chemically synthesized
tgatccacatgatctggcct

SEQ ID NO: 375025 - DNA, 20 bp, Artificial Sequence
  chemically synthesized
ggttgagggaaagccgaggc

SEQ ID NO: 375026 - DNA, 20 bp, Artificial Sequence
  chemically synthesized
aaggggttgagggaaagccg

SEQ ID NO: 375027 - DNA, 20 bp, Artificial Sequence
  chemically synthesized
taaggggttgagggaaagcc

SEQ ID NO: 375028 - DNA, 20 bp, Artificial Sequence
  chemically synthesized
agttgtaaggggttgaggga

SEQ ID NO: 375029 - DNA, 20 bp, Artificial Sequence
  chemically synthesized
taacagttgtaaggggttga

SEQ ID NO: 375030 - DNA, 20 bp, Artificial Sequence
  chemically synthesized
gtaacagttgtaaggggttg

SEQ ID NO: 375031 - DNA, 20 bp, Artificial Sequence
  chemically synthesized
tgtaacagttgtaaggggtt

SEQ ID NO: 375032 - DNA, 20 bp, Artificial Sequence
  chemically synthesized
gaaactgtaacagttgtaag

SEQ ID NO: 375033 - DNA, 20 bp, Artificial Sequence
  chemically synthesized
tgaaactgtaacagttgtaa

SEQ ID NO: 375034 - DNA, 20 bp, Artificial Sequence
  chemically synthesized
atgaaactgtaacagttgta

SEQ ID NO: 375035 - DNA, 20 bp, Artificial Sequence
  chemically synthesized
tatgaaactgtaacagttgt

SEQ ID NO: 375036 - DNA, 20 bp, Artificial Sequence
  chemically synthesized
tcaaccccttacaactgtta

SEQ ID NO: 375037 - DNA, 20 bp, Artificial Sequence
  chemically synthesized
agaaggctatgaaactgtaa

SEQ ID NO: 375038 - DNA, 20 bp, Artificial Sequence
  chemically synthesized
ttacaactgttacagtttca

SEQ ID NO: 375039 - DNA, 20 bp, Artificial Sequence
  chemically synthesized
acagtttcatagccttctgt

SEQ ID NO: 375040 - DNA, 20 bp, Artificial Sequence
  chemically synthesized
tttgtctagtgactgacaga

SEQ ID NO: 375041 - DNA, 20 bp, Artificial Sequence
  chemically synthesized
ttttgtctagtgactgacag

SEQ ID NO: 375042 - DNA, 20 bp, Artificial Sequence
  chemically synthesized
gagttttgtctagtgactga

SEQ ID NO: 375043 - DNA, 20 bp, Artificial Sequence
  chemically synthesized
catagccttctgtcagtcac

SEQ ID NO: 375044 - DNA, 20 bp, Artificial Sequence
  chemically synthesized
ggaagtgtctgagttttgtc

SEQ ID NO: 375045 - DNA, 20 bp, Artificial Sequence
  chemically synthesized
gtcagtcactagacaaaact

SEQ ID NO: 375046 - DNA, 20 bp, Artificial Sequence
  chemically synthesized
agtactggaaggaagtgtct

SEQ ID NO: 375047 - DNA, 20 bp, Artificial Sequence
  chemically synthesized
aaaactcagacacttccttc

SEQ ID NO: 375048 - DNA, 20 bp, Artificial Sequence
  chemically synthesized
atgttgccagtactggaagg

SEQ ID NO: 375049 - DNA, 20 bp, Artificial Sequence
  chemically synthesized
gtaatgttgccagtactgga

SEQ ID NO: 375050 - DNA, 20 bp, Artificial Sequence
  chemically synthesized
cagacacttccttccagtac

SEQ ID NO: 375051 - DNA, 20 bp, Artificial Sequence
  chemically synthesized
agtaatgttgccagtactgg

SEQ ID NO: 375052 - DNA, 20 bp, Artificial Sequence
  chemically synthesized
tgcagtaatgttgccagtac

SEQ ID NO: 375053 - DNA, 20 bp, Artificial Sequence
  chemically synthesized
agaatgtgcagtaatgttgc

SEQ ID NO: 375054 - DNA, 20 bp, Artificial Sequence
  chemically synthesized
aaacctaaaagaagaatgtg

SEQ ID NO: 375055 - DNA, 20 bp, Artificial Sequence
  chemically synthesized
attactgcacattcttcttt

SEQ ID NO: 375056 - DNA, 20 bp, Artificial Sequence
  chemically synthesized
ttactgcacattcttctttt

SEQ ID NO: 375057 - DNA, 20 bp, Artificial Sequence
  chemically synthesized
cagggctgaaaacctaaaag

SEQ ID NO: 375058 - DNA, 20 bp, Artificial Sequence
  chemically synthesized
agccagggctgaaaacctaa

SEQ ID NO: 375059 - DNA, 20 bp, Artificial Sequence
  chemically synthesized
acattcttcttttaggtttt

SEQ ID NO: 375060 - DNA, 20 bp, Artificial Sequence
  chemically synthesized
ttcttttaggttttcagccc

SEQ ID NO: 375061 - DNA, 20 bp, Artificial Sequence
  chemically synthesized
gtgatgctaatgtgtagcca

SEQ ID NO: 375062 - DNA, 20 bp, Artificial Sequence
  chemically synthesized
ggtgatgctaatgtgtagcc

SEQ ID NO: 375063 - DNA, 20 bp, Artificial Sequence
  chemically synthesized
gggtgatgctaatgtgtagc

SEQ ID NO: 375064 - DNA, 20 bp, Artificial Sequence
  chemically synthesized
tttcagccctggctacacat

SEQ ID NO: 375065 - DNA, 20 bp, Artificial Sequence
  chemically synthesized
cctcgggtgatgctaatgtg

SEQ ID NO: 375066 - DNA, 20 bp, Artificial Sequence
  chemically synthesized
gctacacattagcatcaccc

SEQ ID NO: 375067 - DNA, 20 bp, Artificial Sequence
  chemically synthesized
ctacacattagcatcacccg

SEQ ID NO: 375068 - DNA, 20 bp, Artificial Sequence
  chemically synthesized
acacattagcatcacccgag

SEQ ID NO: 375069 - DNA, 20 bp, Artificial Sequence
  chemically synthesized
tacagatttaaaagctcctc

SEQ ID NO: 375070 - DNA, 20 bp, Artificial Sequence
  chemically synthesized
gtacagatttaaaagctcct

SEQ ID NO: 375071 - DNA, 20 bp, Artificial Sequence
  chemically synthesized
acacaatggtacagatttaa

SEQ ID NO: 375072 - DNA, 20 bp, Artificial Sequence
  chemically synthesized
atcagaaacacacaatggta

SEQ ID NO: 375073 - DNA, 20 bp, Artificial Sequence
  chemically synthesized
ggggcatcagaaacacacaa

SEQ ID NO: 375074 - DNA, 20 bp, Artificial Sequence
  chemically synthesized
caacatggcgtggggggcat

SEQ ID NO: 375075 - DNA, 20 bp, Artificial Sequence
  chemically synthesized
acaaaacaacatggcgtggg

SEQ ID NO: 375076 - DNA, 20 bp, Artificial Sequence
  chemically synthesized
aacaaaacaacatggcgtgg

SEQ ID NO: 375077 - DNA, 20 bp, Artificial Sequence
  chemically synthesized
aaacaaaacaacatggcgtg

SEQ ID NO: 375078 - DNA, 20 bp, Artificial Sequence
  chemically synthesized
caaacaaaacaacatggcgt

SEQ ID NO: 375079 - DNA, 20 bp, Artificial Sequence
  chemically synthesized
acaaacaaaacaacatggcg

SEQ ID NO: 375080 - DNA, 20 bp, Artificial Sequence
  chemically synthesized
cgaaaacaaacaaaacaaca

SEQ ID NO: 375081 - DNA, 20 bp, Artificial Sequence
  chemically synthesized
tttttgttttttgtttcttt

SEQ ID NO: 375082 - DNA, 20 bp, Artificial Sequence
  chemically synthesized
tgttttttgtttctttgaga

SEQ ID NO: 375083 - DNA, 20 bp, Artificial Sequence
  chemically synthesized
ttttttgtttctttgagaca

SEQ ID NO: 375084 - DNA, 20 bp, Artificial Sequence
  chemically synthesized
aagagtagaactctgtctca

SEQ ID NO: 375085 - DNA, 20 bp, Artificial Sequence
  chemically synthesized
tccagcctgggcaaaaagag

SEQ ID NO: 375086 - DNA, 20 bp, Artificial Sequence
  chemically synthesized
cgctccagcctgggcaaaaa

SEQ ID NO: 375087 - DNA, 20 bp, Artificial Sequence
  chemically synthesized
agagttctactctttttgcc

SEQ ID NO: 375088 - DNA, 20 bp, Artificial Sequence
  chemically synthesized
gagttctactctttttgccc

SEQ ID NO: 375089 - DNA, 20 bp, Artificial Sequence
  chemically synthesized
tgcgctccagcctgggcaaa

SEQ ID NO: 375090 - DNA, 20 bp, Artificial Sequence
  chemically synthesized
tctactctttttgcccaggc

SEQ ID NO: 375091 - DNA, 20 bp, Artificial Sequence
  chemically synthesized
tactctttttgcccaggctg

SEQ ID NO: 375092 - DNA, 20 bp, Artificial Sequence
  chemically synthesized
gcaccgttgcgctccagcct

SEQ ID NO: 375093 - DNA, 20 bp, Artificial Sequence
  chemically synthesized
cgcaccgttgcgctccagcc

SEQ ID NO: 375094 - DNA, 20 bp, Artificial Sequence
  chemically synthesized
gagatcgcaccgttgcgctc

SEQ ID NO: 375095 - DNA, 20 bp, Artificial Sequence
  chemically synthesized
ttgcccaggctggagcgcaa

SEQ ID NO: 375096 - DNA, 20 bp, Artificial Sequence
  chemically synthesized
ggagcgcaacggtgcgatct

SEQ ID NO: 375097 - DNA, 20 bp, Artificial Sequence
  chemically synthesized
ggcagaggttgcagtgagcc

SEQ ID NO: 375098 - DNA, 20 bp, Artificial Sequence
  chemically synthesized
caggaggcagaggttgcagt

SEQ ID NO: 375099 - DNA, 20 bp, Artificial Sequence
  chemically synthesized
aacccaggaggcagaggttg

SEQ ID NO: 375100 - DNA, 20 bp, Artificial Sequence
  chemically synthesized
cgcttgaacccaggaggcag

SEQ ID NO: 375101 - DNA, 20 bp, Artificial Sequence
  chemically synthesized
tcactgcaacctctgcctcc

SEQ ID NO: 375102 - DNA, 20 bp, Artificial Sequence
  chemically synthesized
tcgcttgaacccaggaggca

SEQ ID NO: 375103 - DNA, 20 bp, Artificial Sequence
  chemically synthesized
cactgcaacctctgcctcct

SEQ ID NO: 375104 - DNA, 20 bp, Artificial Sequence
  chemically synthesized
aatcgcttgaacccaggagg

SEQ ID NO: 375105 - DNA, 20 bp, Artificial Sequence
  chemically synthesized
gacaatcgcttgaacccagg

SEQ ID NO: 375106 - DNA, 20 bp, Artificial Sequence
  chemically synthesized
tgacaatcgcttgaacccag

SEQ ID NO: 375107 - DNA, 20 bp, Artificial Sequence
  chemically synthesized
aacctctgcctcctgggttc

SEQ ID NO: 375108 - DNA, 20 bp, Artificial Sequence
  chemically synthesized
catgacaatcgcttgaaccc

SEQ ID NO: 375109 - DNA, 20 bp, Artificial Sequence
  chemically synthesized
gcatgacaatcgcttgaacc

SEQ ID NO: 375110 - DNA, 20 bp, Artificial Sequence
  chemically synthesized
ttcaagcgattgtcatgcct

SEQ ID NO: 375111 - DNA, 20 bp, Artificial Sequence
  chemically synthesized
cccagctatttgggaggccg

SEQ ID NO: 375112 - DNA, 20 bp, Artificial Sequence
  chemically synthesized
tcccagctatttgggaggcc

SEQ ID NO: 375113 - DNA, 20 bp, Artificial Sequence
  chemically synthesized
tcatgcctcggcctcccaaa

SEQ ID NO: 375114 - DNA, 20 bp, Artificial Sequence
  chemically synthesized
tgtaatcccagctatttggg

SEQ ID NO: 375115 - DNA, 20 bp, Artificial Sequence
  chemically synthesized
ctgtaatcccagctatttgg

SEQ ID NO: 375116 - DNA, 20 bp, Artificial Sequence
  chemically synthesized
gcctcggcctcccaaatagc

SEQ ID NO: 375117 - DNA, 20 bp, Artificial Sequence
  chemically synthesized
gcctgtaatcccagctattt

SEQ ID NO: 375118 - DNA, 20 bp, Artificial Sequence
  chemically synthesized
cctcggcctcccaaatagct

SEQ ID NO: 375119 - DNA, 20 bp, Artificial Sequence
  chemically synthesized
tgcctgtaatcccagctatt

SEQ ID NO: 375120 - DNA, 20 bp, Artificial Sequence
  chemically synthesized
ctcccaaatagctgggatta

SEQ ID NO: 375121 - DNA, 20 bp, Artificial Sequence
  chemically synthesized
tcccaaatagctgggattac

SEQ ID NO: 375122 - DNA, 20 bp, Artificial Sequence
  chemically synthesized
gtggcaggtgcctgtaatcc

SEQ ID NO: 375123 - DNA, 20 bp, Artificial Sequence
  chemically synthesized
aattagccgggtgtggtggc

SEQ ID NO: 375124 - DNA, 20 bp, Artificial Sequence
  chemically synthesized
aaattagccgggtgtggtgg

SEQ ID NO: 375125 - DNA, 20 bp, Artificial Sequence
  chemically synthesized
caggcacctgccaccacacc

SEQ ID NO: 375126 - DNA, 20 bp, Artificial Sequence
  chemically synthesized
aaaaaattagccgggtgtgg

SEQ ID NO: 375127 - DNA, 20 bp, Artificial Sequence
  chemically synthesized
aaaaaaaaattagccgggtg

SEQ ID NO: 375128 - DNA, 20 bp, Artificial Sequence
  chemically synthesized
aatacaaaaaaaaattagcc

SEQ ID NO: 375129 - DNA, 20 bp, Artificial Sequence
  chemically synthesized
aaatacaaaaaaaaattagc

SEQ ID NO: 375130 - DNA, 20 bp, Artificial Sequence
  chemically synthesized
ctacaaatacaaaaaaaaat

SEQ ID NO: 375131 - DNA, 20 bp, Artificial Sequence
  chemically synthesized
ctaatttttttttgtatttg

SEQ ID NO: 375132 - DNA, 20 bp, Artificial Sequence
  chemically synthesized
atttttttttgtatttgtag

SEQ ID NO: 375133 - DNA, 20 bp, Artificial Sequence
  chemically synthesized
ttttttttgtatttgtagta

SEQ ID NO: 375134 - DNA, 20 bp, Artificial Sequence
  chemically synthesized
ttttgtatttgtagtagaga

SEQ ID NO: 375135 - DNA, 20 bp, Artificial Sequence
  chemically synthesized
tttgtatttgtagtagagac

SEQ ID NO: 375136 - DNA, 20 bp, Artificial Sequence
  chemically synthesized
ttgtatttgtagtagagacg

SEQ ID NO: 375137 - DNA, 20 bp, Artificial Sequence
  chemically synthesized
gagacggggtttcaccatgt

SEQ ID NO: 375138 - DNA, 20 bp, Artificial Sequence
  chemically synthesized
cggggtttcaccatgttggc

SEQ ID NO: 375139 - DNA, 20 bp, Artificial Sequence
  chemically synthesized
caagaccatcctggccaaca

SEQ ID NO: 375140 - DNA, 20 bp, Artificial Sequence
  chemically synthesized
ggggtttcaccatgttggcc

SEQ ID NO: 375141 - DNA, 20 bp, Artificial Sequence
  chemically synthesized
tttcaccatgttggccagga

SEQ ID NO: 375142 - DNA, 20 bp, Artificial Sequence
  chemically synthesized
ctaagagatcaagaccatcc

SEQ ID NO: 375143 - DNA, 20 bp, Artificial Sequence
  chemically synthesized
ccaggatggtcttgatctct

SEQ ID NO: 375144 - DNA, 20 bp, Artificial Sequence
  chemically synthesized
atcacgaggtctaagagatc

SEQ ID NO: 375145 - DNA, 20 bp, Artificial Sequence
  chemically synthesized
gggtggatcacgaggtctaa

SEQ ID NO: 375146 - DNA, 20 bp, Artificial Sequence
  chemically synthesized
gcgggtggatcacgaggtct

SEQ ID NO: 375147 - DNA, 20 bp, Artificial Sequence
  chemically synthesized
gctgaggcgggtggatcacg

SEQ ID NO: 375148 - DNA, 20 bp, Artificial Sequence
  chemically synthesized
ggctgaggcgggtggatcac

SEQ ID NO: 375149 - DNA, 20 bp, Artificial Sequence
  chemically synthesized
acctcgtgatccacccgcct

SEQ ID NO: 375150 - DNA, 20 bp, Artificial Sequence
  chemically synthesized
cttcgggaggctgaggcggg

SEQ ID NO: 375151 - DNA, 20 bp, Artificial Sequence
  chemically synthesized
gcacttcgggaggctgaggc

SEQ ID NO: 375152 - DNA, 20 bp, Artificial Sequence
  chemically synthesized
agcacttcgggaggctgagg

SEQ ID NO: 375153 - DNA, 20 bp, Artificial Sequence
  chemically synthesized
cccagcacttcgggaggctg

SEQ ID NO: 375154 - DNA, 20 bp, Artificial Sequence
  chemically synthesized
tcccagcacttcgggaggct

SEQ ID NO: 375155 - DNA, 20 bp, Artificial Sequence
  chemically synthesized
ccacccgcctcagcctcccg

SEQ ID NO: 375156 - DNA, 20 bp, Artificial Sequence
  chemically synthesized
tgtaatcccagcacttcggg

SEQ ID NO: 375157 - DNA, 20 bp, Artificial Sequence
  chemically synthesized
ctgtaatcccagcacttcgg

SEQ ID NO: 375158 - DNA, 20 bp, Artificial Sequence
  chemically synthesized
gcctcagcctcccgaagtgc

SEQ ID NO: 375159 - DNA, 20 bp, Artificial Sequence
  chemically synthesized
gcctgtaatcccagcacttc

SEQ ID NO: 375160 - DNA, 20 bp, Artificial Sequence
  chemically synthesized
cctcagcctcccgaagtgct

SEQ ID NO: 375161 - DNA, 20 bp, Artificial Sequence
  chemically synthesized
cgcctgtaatcccagcactt

SEQ ID NO: 375162 - DNA, 20 bp, Artificial Sequence
  chemically synthesized
ctcccgaagtgctgggatta

SEQ ID NO: 375163 - DNA, 20 bp, Artificial Sequence
  chemically synthesized
tcccgaagtgctgggattac

SEQ ID NO: 375164 - DNA, 20 bp, Artificial Sequence
  chemically synthesized
gtggctcacgcctgtaatcc

SEQ ID NO: 375165 - DNA, 20 bp, Artificial Sequence
  chemically synthesized
agtgctgggattacaggcgt

SEQ ID NO: 375166 - DNA, 20 bp, Artificial Sequence
  chemically synthesized
gattacaggcgtgagccacc

SEQ ID NO: 375167 - DNA, 20 bp, Artificial Sequence
  chemically synthesized
agggggcattagaggccggg

SEQ ID NO: 375168 - DNA, 20 bp, Artificial Sequence
  chemically synthesized
gaaagggggcattagaggcc

SEQ ID NO: 375169 - DNA, 20 bp, Artificial Sequence
  chemically synthesized
agaaagggggcattagaggc

SEQ ID NO: 375170 - DNA, 20 bp, Artificial Sequence
  chemically synthesized
tgaaagaaagggggcattag

SEQ ID NO: 375171 - DNA, 20 bp, Artificial Sequence
  chemically synthesized
atgaaagaaagggggcatta

SEQ ID NO: 375172 - DNA, 20 bp, Artificial Sequence
  chemically synthesized
ttatgaaagaaagggggcat

SEQ ID NO: 375173 - DNA, 20 bp, Artificial Sequence
  chemically synthesized
gtaatgttatgaaagaaagg

SEQ ID NO: 375174 - DNA, 20 bp, Artificial Sequence
  chemically synthesized
tgtaatgttatgaaagaaag

SEQ ID NO: 375175 - DNA, 20 bp, Artificial Sequence
  chemically synthesized
gtgtaatgttatgaaagaaa

SEQ ID NO: 375176 - DNA, 20 bp, Artificial Sequence
  chemically synthesized
tgtgtaatgttatgaaagaa

SEQ ID NO: 375177 - DNA, 20 bp, Artificial Sequence
  chemically synthesized
gtgtgtaatgttatgaaaga

SEQ ID NO: 375178 - DNA, 20 bp, Artificial Sequence
  chemically synthesized
cttggtgtgtaatgttatga

SEQ ID NO: 375179 - DNA, 20 bp, Artificial Sequence
  chemically synthesized
ctttcataacattacacacc

SEQ ID NO: 375180 - DNA, 20 bp, Artificial Sequence
  chemically synthesized
gaagtttgccaaataatact

SEQ ID NO: 375181 - DNA, 20 bp, Artificial Sequence
  chemically synthesized
attacacaccaagtattatt

SEQ ID NO: 375182 - DNA, 20 bp, Artificial Sequence
  chemically synthesized
aatacagtataggggatgag

SEQ ID NO: 375183 - DNA, 20 bp, Artificial Sequence
  chemically synthesized
agtaatacagtataggggat

SEQ ID NO: 375184 - DNA, 20 bp, Artificial Sequence
  chemically synthesized
caataagtaatacagtatag

SEQ ID NO: 375185 - DNA, 20 bp, Artificial Sequence
  chemically synthesized
tcaataagtaatacagtata

SEQ ID NO: 375186 - DNA, 20 bp, Artificial Sequence
  chemically synthesized
gtcaataagtaatacagtat

SEQ ID NO: 375187 - DNA, 20 bp, Artificial Sequence
  chemically synthesized
tgtcaataagtaatacagta

SEQ ID NO: 375188 - DNA, 20 bp, Artificial Sequence
  chemically synthesized
aacaatgtcaataagtaata

SEQ ID NO: 375189 - DNA, 20 bp, Artificial Sequence
  chemically synthesized
agctgggaaacaatgtcaat

SEQ ID NO: 375190 - DNA, 20 bp, Artificial Sequence
  chemically synthesized
tacttattgacattgtttcc

SEQ ID NO: 375191 - DNA, 20 bp, Artificial Sequence
  chemically synthesized
attgacattgtttcccagct

SEQ ID NO: 375192 - DNA, 20 bp, Artificial Sequence
  chemically synthesized
ttgacattgtttcccagctc

SEQ ID NO: 375193 - DNA, 20 bp, Artificial Sequence
  chemically synthesized
caagcgtgtaggcctgagct

SEQ ID NO: 375194 - DNA, 20 bp, Artificial Sequence
  chemically synthesized
ccaagcgtgtaggcctgagc

SEQ ID NO: 375195 - DNA, 20 bp, Artificial Sequence
  chemically synthesized
tgtgccaagcgtgtaggcct

SEQ ID NO: 375196 - DNA, 20 bp, Artificial Sequence
  chemically synthesized
ccagctcaggcctacacgct

SEQ ID NO: 375197 - DNA, 20 bp, Artificial Sequence
  chemically synthesized
acagaatgtgccaagcgtgt

SEQ ID NO: 375198 - DNA, 20 bp, Artificial Sequence
  chemically synthesized
gacagaatgtgccaagcgtg

SEQ ID NO: 375199 - DNA, 20 bp, Artificial Sequence
  chemically synthesized
ccagagagacagaatgtgcc

SEQ ID NO: 375200 - DNA, 20 bp, Artificial Sequence
  chemically synthesized
cttggcacattctgtctctc

SEQ ID NO: 375201 - DNA, 20 bp, Artificial Sequence
  chemically synthesized
gatcattgtggccagagaga

SEQ ID NO: 375202 - DNA, 20 bp, Artificial Sequence
  chemically synthesized
acacgatcattgtggccaga

SEQ ID NO: 375203 - DNA, 20 bp, Artificial Sequence
  chemically synthesized
ttacacgatcattgtggcca

SEQ ID NO: 375204 - DNA, 20 bp, Artificial Sequence
  chemically synthesized
gcttacacgatcattgtggc

SEQ ID NO: 375205 - DNA, 20 bp, Artificial Sequence
  chemically synthesized
ccttgcttacacgatcattg

SEQ ID NO: 375206 - DNA, 20 bp, Artificial Sequence
  chemically synthesized
tctggccacaatgatcgtgt

SEQ ID NO: 375207 - DNA, 20 bp, Artificial Sequence
  chemically synthesized
gccacaatgatcgtgtaagc

SEQ ID NO: 375208 - DNA, 20 bp, Artificial Sequence
  chemically synthesized
ccacaatgatcgtgtaagca

SEQ ID NO: 375209 - DNA, 20 bp, Artificial Sequence
  chemically synthesized
cattcctttaagttggtttt

SEQ ID NO: 375210 - DNA, 20 bp, Artificial Sequence
  chemically synthesized
caaggctgaaaaccaactta

SEQ ID NO: 375211 - DNA, 20 bp, Artificial Sequence
  chemically synthesized
aaggctgaaaaccaacttaa

SEQ ID NO: 375212 - DNA, 20 bp, Artificial Sequence
  chemically synthesized
ctcttcccattcctttaagt

SEQ ID NO: 375213 - DNA, 20 bp, Artificial Sequence
  chemically synthesized
tgaaaaccaacttaaaggaa

SEQ ID NO: 375214 - DNA, 20 bp, Artificial Sequence
  chemically synthesized
gtaactcttcccattccttt

SEQ ID NO: 375215 - DNA, 20 bp, Artificial Sequence
  chemically synthesized
gaaaaccaacttaaaggaat

SEQ ID NO: 375216 - DNA, 20 bp, Artificial Sequence
  chemically synthesized
aaccaacttaaaggaatggg

SEQ ID NO: 375217 - DNA, 20 bp, Artificial Sequence
  chemically synthesized
ccaacttaaaggaatgggaa

SEQ ID NO: 375218 - DNA, 20 bp, Artificial Sequence
  chemically synthesized
atgggaagagttacaaactt

SEQ ID NO: 375219 - DNA, 20 bp, Artificial Sequence
  chemically synthesized
gcatcatgtgtgggagactt

SEQ ID NO: 375220 - DNA, 20 bp, Artificial Sequence
  chemically synthesized
tcatcctgcatcatgtgtgg

SEQ ID NO: 375221 - DNA, 20 bp, Artificial Sequence
  chemically synthesized
catcatcctgcatcatgtgt

SEQ ID NO: 375222 - DNA, 20 bp, Artificial Sequence
  chemically synthesized
tcatcatcctgcatcatgtg

SEQ ID NO: 375223 - DNA, 20 bp, Artificial Sequence
  chemically synthesized
taagtctcccacacatgatg

SEQ ID NO: 375224 - DNA, 20 bp, Artificial Sequence
  chemically synthesized
aagtctcccacacatgatgc

SEQ ID NO: 375225 - DNA, 20 bp, Artificial Sequence
  chemically synthesized
atgcaggatgatgactttat

SEQ ID NO: 375226 - DNA, 20 bp, Artificial Sequence
  chemically synthesized
aatcatgaaaatatctgata

SEQ ID NO: 375227 - DNA, 20 bp, Artificial Sequence
  chemically synthesized
catgattttatgatatttat

SEQ ID NO: 375228 - DNA, 20 bp, Artificial Sequence
  chemically synthesized
atttatcagacattttctcc

SEQ ID NO: 375229 - DNA, 20 bp, Artificial Sequence
  chemically synthesized
tttatcagacattttctcct

SEQ ID NO: 375230 - DNA, 20 bp, Artificial Sequence
  chemically synthesized
atcagacattttctcctggg

SEQ ID NO: 375231 - DNA, 20 bp, Artificial Sequence
  chemically synthesized
ctctaacataaacttcccag

SEQ ID NO: 375232 - DNA, 20 bp, Artificial Sequence
  chemically synthesized
tactctaacataaacttccc

SEQ ID NO: 375233 - DNA, 20 bp, Artificial Sequence
  chemically synthesized
ttactctaacataaacttcc

SEQ ID NO: 375234 - DNA, 20 bp, Artificial Sequence
  chemically synthesized
ttctcctgggaagtttatgt

SEQ ID NO: 375235 - DNA, 20 bp, Artificial Sequence
  chemically synthesized
ctcctgggaagtttatgtta

SEQ ID NO: 375236 - DNA, 20 bp, Artificial Sequence
  chemically synthesized
gagtaaaaatcatgtatcat

SEQ ID NO: 375237 - DNA, 20 bp, Artificial Sequence
  chemically synthesized
agtaaaaatcatgtatcatt

SEQ ID NO: 375238 - DNA, 20 bp, Artificial Sequence
  chemically synthesized
gtaaaaatcatgtatcatta

SEQ ID NO: 375239 - DNA, 20 bp, Artificial Sequence
  chemically synthesized
aaaaatcatgtatcattagg

SEQ ID NO: 375240 - DNA, 20 bp, Artificial Sequence
  chemically synthesized
aatcatgtatcattagggag

SEQ ID NO: 375241 - DNA, 20 bp, Artificial Sequence
  chemically synthesized
tcatgtatcattagggagta

SEQ ID NO: 375242 - DNA, 20 bp, Artificial Sequence
  chemically synthesized
catgtatcattagggagtag

SEQ ID NO: 375243 - DNA, 20 bp, Artificial Sequence
  chemically synthesized
gggagtagaggtaatgctaa

SEQ ID NO: 375244 - DNA, 20 bp, Artificial Sequence
  chemically synthesized
gtagaggtaatgctaaaagc

SEQ ID NO: 375245 - DNA, 20 bp, Artificial Sequence
  chemically synthesized
tagaggtaatgctaaaagca

SEQ ID NO: 375246 - DNA, 20 bp, Artificial Sequence
  chemically synthesized
ctactctcagtccttgcttt

SEQ ID NO: 375247 - DNA, 20 bp, Artificial Sequence
  chemically synthesized
taatgctaaaagcaaggact

SEQ ID NO: 375248 - DNA, 20 bp, Artificial Sequence
  chemically synthesized
atgctaaaagcaaggactga

SEQ ID NO: 375249 - DNA, 20 bp, Artificial Sequence
  chemically synthesized
ctaaaagcaaggactgagag

SEQ ID NO: 375250 - DNA, 20 bp, Artificial Sequence
  chemically synthesized
tctcatgaattaactactct

SEQ ID NO: 375251 - DNA, 20 bp, Artificial Sequence
  chemically synthesized
actgagagtagttaattcat

SEQ ID NO: 375252 - DNA, 20 bp, Artificial Sequence
  chemically synthesized
taattcatgagaatgaatga

SEQ ID NO: 375253 - DNA, 20 bp, Artificial Sequence
  chemically synthesized
cagctgatctatcacgtcat

SEQ ID NO: 375254 - DNA, 20 bp, Artificial Sequence
  chemically synthesized
gcagctgatctatcacgtca

SEQ ID NO: 375255 - DNA, 20 bp, Artificial Sequence
  chemically synthesized
gatggaatcccatgacgtga

SEQ ID NO: 375256 - DNA, 20 bp, Artificial Sequence
  chemically synthesized
aatcccatgacgtgatagat

SEQ ID NO: 375257 - DNA, 20 bp, Artificial Sequence
  chemically synthesized
ctattgagaccatagtgtag

SEQ ID NO: 375258 - DNA, 20 bp, Artificial Sequence
  chemically synthesized
atagatcagctgctacacta

SEQ ID NO: 375259 - DNA, 20 bp, Artificial Sequence
  chemically synthesized
gaactattgagaccatagtg

SEQ ID NO: 375260 - DNA, 20 bp, Artificial Sequence
  chemically synthesized
taattgaactattgagacca

SEQ ID NO: 375261 - DNA, 20 bp, Artificial Sequence
  chemically synthesized
ctgctacactatggtctcaa

SEQ ID NO: 375262 - DNA, 20 bp, Artificial Sequence
  chemically synthesized
ttatgaataattgaactatt

SEQ ID NO: 375263 - DNA, 20 bp, Artificial Sequence
  chemically synthesized
tcataaaattacactgatcg

SEQ ID NO: 375264 - DNA, 20 bp, Artificial Sequence
  chemically synthesized
tcacattagaaaactacgat

SEQ ID NO: 375265 - DNA, 20 bp, Artificial Sequence
  chemically synthesized
tcaaaacaaaaatgtcacat

SEQ ID NO: 375266 - DNA, 20 bp, Artificial Sequence
  chemically synthesized
acatttttgttttgattatt

SEQ ID NO: 375267 - DNA, 20 bp, Artificial Sequence
  chemically synthesized
ttttgttttgattattcggt

SEQ ID NO: 375268 - DNA, 20 bp, Artificial Sequence
  chemically synthesized
gttttgattattcggttggt

SEQ ID NO: 375269 - DNA, 20 bp, Artificial Sequence
  chemically synthesized
attcggttggtcagacaact

SEQ ID NO: 375270 - DNA, 20 bp, Artificial Sequence
  chemically synthesized
ggcgaaaccatttggttact

SEQ ID NO: 375271 - DNA, 20 bp, Artificial Sequence
  chemically synthesized
cagacaactgagtaaccaaa

SEQ ID NO: 375272 - DNA, 20 bp, Artificial Sequence
  chemically synthesized
aataagtaggcgaaaccatt

SEQ ID NO: 375273 - DNA, 20 bp, Artificial Sequence
  chemically synthesized
aatggtttcgcctacttatt

SEQ ID NO: 375274 - DNA, 20 bp, Artificial Sequence
  chemically synthesized
aactgaataaccaaataagt

SEQ ID NO: 375275 - DNA, 20 bp, Artificial Sequence
  chemically synthesized
caactgaataaccaaataag

SEQ ID NO: 375276 - DNA, 20 bp, Artificial Sequence
  chemically synthesized
gaacaactgaataaccaaat

SEQ ID NO: 375277 - DNA, 20 bp, Artificial Sequence
  chemically synthesized
cgcctacttatttggttatt

SEQ ID NO: 375278 - DNA, 20 bp, Artificial Sequence
  chemically synthesized
tatttggttattcagttgtt

SEQ ID NO: 375279 - DNA, 20 bp, Artificial Sequence
  chemically synthesized
aagcatggggtaaaaaggtc

SEQ ID NO: 375280 - DNA, 20 bp, Artificial Sequence
  chemically synthesized
taaggaagcatggggtaaaa

SEQ ID NO: 375281 - DNA, 20 bp, Artificial Sequence
  chemically synthesized
ttaaggaagcatggggtaaa

SEQ ID NO: 375282 - DNA, 20 bp, Artificial Sequence
  chemically synthesized
gcttatgttaaggaagcatg

SEQ ID NO: 375283 - DNA, 20 bp, Artificial Sequence
  chemically synthesized
agcttatgttaaggaagcat

SEQ ID NO: 375284 - DNA, 20 bp, Artificial Sequence
  chemically synthesized
cagcttatgttaaggaagca

SEQ ID NO: 375285 - DNA, 20 bp, Artificial Sequence
  chemically synthesized
aaattcagcttatgttaagg

SEQ ID NO: 375286 - DNA, 20 bp, Artificial Sequence
  chemically synthesized
accccatgcttccttaacat

SEQ ID NO: 375287 - DNA, 20 bp, Artificial Sequence
  chemically synthesized
gataaattcagcttatgtta

SEQ ID NO: 375288 - DNA, 20 bp, Artificial Sequence
  chemically synthesized
agataaattcagcttatgtt

SEQ ID NO: 375289 - DNA, 20 bp, Artificial Sequence
  chemically synthesized
acattgaacagagataaatt

SEQ ID NO: 375290 - DNA, 20 bp, Artificial Sequence
  chemically synthesized
cttttgtgttacattgaaca

SEQ ID NO: 375291 - DNA, 20 bp, Artificial Sequence
  chemically synthesized
ggcttttgtgttacattgaa

SEQ ID NO: 375292 - DNA, 20 bp, Artificial Sequence
  chemically synthesized
ctctgttcaatgtaacacaa

SEQ ID NO: 375293 - DNA, 20 bp, Artificial Sequence
  chemically synthesized
gtaacacaaaagcccgtatt

SEQ ID NO: 375294 - DNA, 20 bp, Artificial Sequence
  chemically synthesized
aacacaaaagcccgtattta

SEQ ID NO: 375295 - DNA, 20 bp, Artificial Sequence
  chemically synthesized
tataatctggctctaaatac

SEQ ID NO: 375296 - DNA, 20 bp, Artificial Sequence
  chemically synthesized
gtataatctggctctaaata

SEQ ID NO: 375297 - DNA, 20 bp, Artificial Sequence
  chemically synthesized
caaaagcccgtatttagagc

SEQ ID NO: 375298 - DNA, 20 bp, Artificial Sequence
  chemically synthesized
agctggaaactggtataatc

SEQ ID NO: 375299 - DNA, 20 bp, Artificial Sequence
  chemically synthesized
tatttagagccagattatac

SEQ ID NO: 375300 - DNA, 20 bp, Artificial Sequence
  chemically synthesized
agccagattataccagtttc

SEQ ID NO: 375301 - DNA, 20 bp, Artificial Sequence
  chemically synthesized
aagaggacacagctggaaac

SEQ ID NO: 375302 - DNA, 20 bp, Artificial Sequence
  chemically synthesized
tatgtttaagaggacacagc

SEQ ID NO: 375303 - DNA, 20 bp, Artificial Sequence
  chemically synthesized
gtaatatgtttaagaggaca

SEQ ID NO: 375304 - DNA, 20 bp, Artificial Sequence
  chemically synthesized
gaatgagtaatatgtttaag

SEQ ID NO: 375305 - DNA, 20 bp, Artificial Sequence
  chemically synthesized
agaatgagtaatatgtttaa

SEQ ID NO: 375306 - DNA, 20 bp, Artificial Sequence
  chemically synthesized
agagaatgagtaatatgttt

SEQ ID NO: 375307 - DNA, 20 bp, Artificial Sequence
  chemically synthesized
aatggaagacatgagagaat

SEQ ID NO: 375308 - DNA, 20 bp, Artificial Sequence
  chemically synthesized
gaaagaaatggaagacatga

SEQ ID NO: 375309 - DNA, 20 bp, Artificial Sequence
  chemically synthesized
aggaaagaaatggaagacat

SEQ ID NO: 375310 - DNA, 20 bp, Artificial Sequence
  chemically synthesized
ttttttaaggaaagaaatgg

SEQ ID NO: 375311 - DNA, 20 bp, Artificial Sequence
  chemically synthesized
tcattttttaaggaaagaaa

SEQ ID NO: 375312 - DNA, 20 bp, Artificial Sequence
  chemically synthesized
gtattctcattttttaagga

SEQ ID NO: 375313 - DNA, 20 bp, Artificial Sequence
  chemically synthesized
ggtggtattctcatttttta

SEQ ID NO: 375314 - DNA, 20 bp, Artificial Sequence
  chemically synthesized
catttctttccttaaaaaat

SEQ ID NO: 375315 - DNA, 20 bp, Artificial Sequence
  chemically synthesized
aggtggtattctcatttttt

SEQ ID NO: 375316 - DNA, 20 bp, Artificial Sequence
  chemically synthesized
aaacatatataggagatagg

SEQ ID NO: 375317 - DNA, 20 bp, Artificial Sequence
  chemically synthesized
tgcaaacatatataggagat

SEQ ID NO: 375318 - DNA, 20 bp, Artificial Sequence
  chemically synthesized
ttgcaaacatatataggaga

SEQ ID NO: 375319 - DNA, 20 bp, Artificial Sequence
  chemically synthesized
atgtttgcaaacatatatag

SEQ ID NO: 375320 - DNA, 20 bp, Artificial Sequence
  chemically synthesized
acatgtttgcaaacatatat

SEQ ID NO: 375321 - DNA, 20 bp, Artificial Sequence
  chemically synthesized
aacatgtttgcaaacatata

SEQ ID NO: 375322 - DNA, 20 bp, Artificial Sequence
  chemically synthesized
atgtttgcaaacatgtttac

SEQ ID NO: 375323 - DNA, 20 bp, Artificial Sequence
  chemically synthesized
tatatgtgaattaccttgca

SEQ ID NO: 375324 - DNA, 20 bp, Artificial Sequence
  chemically synthesized
tgagagatgctaactgtgca

SEQ ID NO: 375325 - DNA, 20 bp, Artificial Sequence
  chemically synthesized
tgtgaattaccttgcacagt

SEQ ID NO: 375326 - DNA, 20 bp, Artificial Sequence
  chemically synthesized
ctgagagatgctaactgtgc

SEQ ID NO: 375327 - DNA, 20 bp, Artificial Sequence
  chemically synthesized
cttgcacagttagcatctct

SEQ ID NO: 375328 - DNA, 20 bp, Artificial Sequence
  chemically synthesized
ttgcacagttagcatctctc

SEQ ID NO: 375329 - DNA, 20 bp, Artificial Sequence
  chemically synthesized
cggtcactttcacatcctga

SEQ ID NO: 375330 - DNA, 20 bp, Artificial Sequence
  chemically synthesized
gacggtcactttcacatcct

SEQ ID NO: 375331 - DNA, 20 bp, Artificial Sequence
  chemically synthesized
tagcatctctcaggatgtga

SEQ ID NO: 375332 - DNA, 20 bp, Artificial Sequence
  chemically synthesized
taaattactgaggaggaaga

SEQ ID NO: 375333 - DNA, 20 bp, Artificial Sequence
  chemically synthesized
aaagtgaccgtcttcctcct

SEQ ID NO: 375334 - DNA, 20 bp, Artificial Sequence
  chemically synthesized
agagtaaattactgaggagg

SEQ ID NO: 375335 - DNA, 20 bp, Artificial Sequence
  chemically synthesized
caaagagtaaattactgagg

SEQ ID NO: 375336 - DNA, 20 bp, Artificial Sequence
  chemically synthesized
acaaagagtaaattactgag

SEQ ID NO: 375337 - DNA, 20 bp, Artificial Sequence
  chemically synthesized
agacaaagagtaaattactg

SEQ ID NO: 375338 - DNA, 20 bp, Artificial Sequence
  chemically synthesized
aagacaaagagtaaattact

SEQ ID NO: 375339 - DNA, 20 bp, Artificial Sequence
  chemically synthesized
aatggctttgataagacaaa

SEQ ID NO: 375340 - DNA, 20 bp, Artificial Sequence
  chemically synthesized
ttaatggctttgataagaca

SEQ ID NO: 375341 - DNA, 20 bp, Artificial Sequence
  chemically synthesized
atttactctttgtcttatca

SEQ ID NO: 375342 - DNA, 20 bp, Artificial Sequence
  chemically synthesized
ggggttttaatggctttgat

SEQ ID NO: 375343 - DNA, 20 bp, Artificial Sequence
  chemically synthesized
tcacctctgaggggttttaa

SEQ ID NO: 375344 - DNA, 20 bp, Artificial Sequence
  chemically synthesized
tcaaagccattaaaacccct

SEQ ID NO: 375345 - DNA, 20 bp, Artificial Sequence
  chemically synthesized
aaagccattaaaacccctca

SEQ ID NO: 375346 - DNA, 20 bp, Artificial Sequence
  chemically synthesized
aagccattaaaacccctcag

SEQ ID NO: 375347 - DNA, 20 bp, Artificial Sequence
  chemically synthesized
caaatttaatcacctctgag

SEQ ID NO: 375348 - DNA, 20 bp, Artificial Sequence
  chemically synthesized
gcaaatttaatcacctctga

SEQ ID NO: 375349 - DNA, 20 bp, Artificial Sequence
  chemically synthesized
agcaaatttaatcacctctg

SEQ ID NO: 375350 - DNA, 20 bp, Artificial Sequence
  chemically synthesized
cagcaaatttaatcacctct

SEQ ID NO: 375351 - DNA, 20 bp, Artificial Sequence
  chemically synthesized
attaaatttgctgtgataaa

SEQ ID NO: 375352 - DNA, 20 bp, Artificial Sequence
  chemically synthesized
aataaccccactgtttatca

SEQ ID NO: 375353 - DNA, 20 bp, Artificial Sequence
  chemically synthesized
aaatttgctgtgataaacag

SEQ ID NO: 375354 - DNA, 20 bp, Artificial Sequence
  chemically synthesized
aatttgctgtgataaacagt

SEQ ID NO: 375355 - DNA, 20 bp, Artificial Sequence
  chemically synthesized
atttgctgtgataaacagtg

SEQ ID NO: 375356 - DNA, 20 bp, Artificial Sequence
  chemically synthesized
tgataaacagtggggttatt

SEQ ID NO: 375357 - DNA, 20 bp, Artificial Sequence
  chemically synthesized
aacagtggggttattaagca

SEQ ID NO: 375358 - DNA, 20 bp, Artificial Sequence
  chemically synthesized
agtggggttattaagcaaag

SEQ ID NO: 375359 - DNA, 20 bp, Artificial Sequence
  chemically synthesized
aaaaaacttaggtgtgttca

SEQ ID NO: 375360 - DNA, 20 bp, Artificial Sequence
  chemically synthesized
agtaaactatgaacacacct

SEQ ID NO: 375361 - DNA, 20 bp, Artificial Sequence
  chemically synthesized
caatatttaagaaaaaactt

SEQ ID NO: 375362 - DNA, 20 bp, Artificial Sequence
  chemically synthesized
acaatatttaagaaaaaact

SEQ ID NO: 375363 - DNA, 20 bp, Artificial Sequence
  chemically synthesized
ccagctccactacaatattt

SEQ ID NO: 375364 - DNA, 20 bp, Artificial Sequence
  chemically synthesized
aagttttttcttaaatattg

SEQ ID NO: 375365 - DNA, 20 bp, Artificial Sequence
  chemically synthesized
ttttttcttaaatattgtag

SEQ ID NO: 375366 - DNA, 20 bp, Artificial Sequence
  chemically synthesized
ttttcttaaatattgtagtg

SEQ ID NO: 375367 - DNA, 20 bp, Artificial Sequence
  chemically synthesized
cttaaatattgtagtggagc

SEQ ID NO: 375368 - DNA, 20 bp, Artificial Sequence
  chemically synthesized
tacctaaaaaaaaaaatttc

SEQ ID NO: 375369 - DNA, 20 bp, Artificial Sequence
  chemically synthesized
gagctggaaatttttttttt

SEQ ID NO: 375370 - DNA, 20 bp, Artificial Sequence
  chemically synthesized
agctggaaattttttttttt

SEQ ID NO: 375371 - DNA, 20 bp, Artificial Sequence
  chemically synthesized
ctgcttttttgtggatatgg

SEQ ID NO: 375372 - DNA, 20 bp, Artificial Sequence
  chemically synthesized
ttgctgcttttttgtggata

SEQ ID NO: 375373 - DNA, 20 bp, Artificial Sequence
  chemically synthesized
tttcttccatatccacaaaa

SEQ ID NO: 375374 - DNA, 20 bp, Artificial Sequence
  chemically synthesized
gtgggcttgctgcttttttg

SEQ ID NO: 375375 - DNA, 20 bp, Artificial Sequence
  chemically synthesized
cttccatatccacaaaaaag

SEQ ID NO: 375376 - DNA, 20 bp, Artificial Sequence
  chemically synthesized
catatccacaaaaaagcagc

SEQ ID NO: 375377 - DNA, 20 bp, Artificial Sequence
  chemically synthesized
acaaacagatgagtttcagt

SEQ ID NO: 375378 - DNA, 20 bp, Artificial Sequence
  chemically synthesized
cacaaacagatgagtttcag

SEQ ID NO: 375379 - DNA, 20 bp, Artificial Sequence
  chemically synthesized
tagcacaaacagatgagttt

SEQ ID NO: 375380 - DNA, 20 bp, Artificial Sequence
  chemically synthesized
atttagtagcacaaacagat

SEQ ID NO: 375381 - DNA, 20 bp, Artificial Sequence
  chemically synthesized
ggattatttagtagcacaaa

SEQ ID NO: 375382 - DNA, 20 bp, Artificial Sequence
  chemically synthesized
aaaagtaggggattatttag

SEQ ID NO: 375383 - DNA, 20 bp, Artificial Sequence
  chemically synthesized
aggaaaagtaggggattatt

SEQ ID NO: 375384 - DNA, 20 bp, Artificial Sequence
  chemically synthesized
acctacagtaggaaaagtag

SEQ ID NO: 375385 - DNA, 20 bp, Artificial Sequence
  chemically synthesized
aacctacagtaggaaaagta

SEQ ID NO: 375386 - DNA, 20 bp, Artificial Sequence
  chemically synthesized
caacctacagtaggaaaagt

SEQ ID NO: 375387 - DNA, 20 bp, Artificial Sequence
  chemically synthesized
tcaacctacagtaggaaaag

SEQ ID NO: 375388 - DNA, 20 bp, Artificial Sequence
  chemically synthesized
aaatcaacctacagtaggaa

SEQ ID NO: 375389 - DNA, 20 bp, Artificial Sequence
  chemically synthesized
atcccctacttttcctactg

SEQ ID NO: 375390 - DNA, 20 bp, Artificial Sequence
  chemically synthesized
tcccctacttttcctactgt

SEQ ID NO: 375391 - DNA, 20 bp, Artificial Sequence
  chemically synthesized
ccaataaatcaacctacagt

SEQ ID NO: 375392 - DNA, 20 bp, Artificial Sequence
  chemically synthesized
accaataaatcaacctacag

SEQ ID NO: 375393 - DNA, 20 bp, Artificial Sequence
  chemically synthesized
gggaccaataaatcaaccta

SEQ ID NO: 375394 - DNA, 20 bp, Artificial Sequence
  chemically synthesized
cctactgtaggttgatttat

SEQ ID NO: 375395 - DNA, 20 bp, Artificial Sequence
  chemically synthesized
taagtaggaatgagaaagtg

SEQ ID NO: 375396 - DNA, 20 bp, Artificial Sequence
  chemically synthesized
ttaagtaggaatgagaaagt

SEQ ID NO: 375397 - DNA, 20 bp, Artificial Sequence
  chemically synthesized
attaagtaggaatgagaaag

SEQ ID NO: 375398 - DNA, 20 bp, Artificial Sequence
  chemically synthesized
cctattaagtaggaatgaga

SEQ ID NO: 375399 - DNA, 20 bp, Artificial Sequence
  chemically synthesized
ccatcctattaagtaggaat

SEQ ID NO: 375400 - DNA, 20 bp, Artificial Sequence
  chemically synthesized
actttctcattcctacttaa

SEQ ID NO: 375401 - DNA, 20 bp, Artificial Sequence
  chemically synthesized
ctttctcattcctacttaat

SEQ ID NO: 375402 - DNA, 20 bp, Artificial Sequence
  chemically synthesized
gatatgccatcctattaagt

SEQ ID NO: 375403 - DNA, 20 bp, Artificial Sequence
  chemically synthesized
agatatgccatcctattaag

SEQ ID NO: 375404 - DNA, 20 bp, Artificial Sequence
  chemically synthesized
ctcattcctacttaatagga

SEQ ID NO: 375405 - DNA, 20 bp, Artificial Sequence
  chemically synthesized
gctagatatgccatcctatt

SEQ ID NO: 375406 - DNA, 20 bp, Artificial Sequence
  chemically synthesized
acttaataggatggcatatc

SEQ ID NO: 375407 - DNA, 20 bp, Artificial Sequence
  chemically synthesized
aggatggcatatctagccta

SEQ ID NO: 375408 - DNA, 20 bp, Artificial Sequence
  chemically synthesized
tcacatttcccaccataggc

SEQ ID NO: 375409 - DNA, 20 bp, Artificial Sequence
  chemically synthesized
atggcatatctagcctatgg

SEQ ID NO: 375410 - DNA, 20 bp, Artificial Sequence
  chemically synthesized
tggcatatctagcctatggt

SEQ ID NO: 375411 - DNA, 20 bp, Artificial Sequence
  chemically synthesized
gctatcacatttcccaccat

SEQ ID NO: 375412 - DNA, 20 bp, Artificial Sequence
  chemically synthesized
ggctatcacatttcccacca

SEQ ID NO: 375413 - DNA, 20 bp, Artificial Sequence
  chemically synthesized
gcctatggtgggaaatgtga

SEQ ID NO: 375414 - DNA, 20 bp, Artificial Sequence
  chemically synthesized
gtgggaaatgtgatagcctt

SEQ ID NO: 375415 - DNA, 20 bp, Artificial Sequence
  chemically synthesized
cttaacaccccgttgaccaa

SEQ ID NO: 375416 - DNA, 20 bp, Artificial Sequence
  chemically synthesized
atgtgatagcctttggtcaa

SEQ ID NO: 375417 - DNA, 20 bp, Artificial Sequence
  chemically synthesized
tcttaacaccccgttgacca

SEQ ID NO: 375418 - DNA, 20 bp, Artificial Sequence
  chemically synthesized
tgtgatagcctttggtcaac

SEQ ID NO: 375419 - DNA, 20 bp, Artificial Sequence
  chemically synthesized
gtgatagcctttggtcaacg

SEQ ID NO: 375420 - DNA, 20 bp, Artificial Sequence
  chemically synthesized
cctttggtcaacggggtgtt

SEQ ID NO: 375421 - DNA, 20 bp, Artificial Sequence
  chemically synthesized
ggggtgttaagaaaacatga

SEQ ID NO: 375422 - DNA, 20 bp, Artificial Sequence
  chemically synthesized
gggtgttaagaaaacatgac

SEQ ID NO: 375423 - DNA, 20 bp, Artificial Sequence
  chemically synthesized
gtgttaagaaaacatgacag

SEQ ID NO: 375424 - DNA, 20 bp, Artificial Sequence
  chemically synthesized
ttaagaaaacatgacaggag

SEQ ID NO: 375425 - DNA, 20 bp, Artificial Sequence
  chemically synthesized
aagaaaacatgacaggagca

SEQ ID NO: 375426 - DNA, 20 bp, Artificial Sequence
  chemically synthesized
catgacaggagcagagcctt

SEQ ID NO: 375427 - DNA, 20 bp, Artificial Sequence
  chemically synthesized
acaggagcagagccttgaga

SEQ ID NO: 375428 - DNA, 20 bp, Artificial Sequence
  chemically synthesized
caggagcagagccttgagat

SEQ ID NO: 375429 - DNA, 20 bp, Artificial Sequence
  chemically synthesized
aaacatgccagcccatctca

SEQ ID NO: 375430 - DNA, 20 bp, Artificial Sequence
  chemically synthesized
caaacatgccagcccatctc

SEQ ID NO: 375431 - DNA, 20 bp, Artificial Sequence
  chemically synthesized
agcagagccttgagatgggc

SEQ ID NO: 375432 - DNA, 20 bp, Artificial Sequence
  chemically synthesized
ttgagatgggctggcatgtt

SEQ ID NO: 375433 - DNA, 20 bp, Artificial Sequence
  chemically synthesized
gatagcaagcccaaacatgc

SEQ ID NO: 375434 - DNA, 20 bp, Artificial Sequence
  chemically synthesized
tgagatgggctggcatgttt

SEQ ID NO: 375435 - DNA, 20 bp, Artificial Sequence
  chemically synthesized
gcatgtttgggcttgctatc

SEQ ID NO: 375436 - DNA, 20 bp, Artificial Sequence
  chemically synthesized
ataggttgtcactagatagc

SEQ ID NO: 375437 - DNA, 20 bp, Artificial Sequence
  chemically synthesized
tttcataggttgtcactaga

SEQ ID NO: 375438 - DNA, 20 bp, Artificial Sequence
  chemically synthesized
atgttttcataggttgtcac

SEQ ID NO: 375439 - DNA, 20 bp, Artificial Sequence
  chemically synthesized
cacccagtgcatgttttcat

SEQ ID NO: 375440 - DNA, 20 bp, Artificial Sequence
  chemically synthesized
ccacccagtgcatgttttca

SEQ ID NO: 375441 - DNA, 20 bp, Artificial Sequence
  chemically synthesized
caacctatgaaaacatgcac

SEQ ID NO: 375442 - DNA, 20 bp, Artificial Sequence
  chemically synthesized
aacctatgaaaacatgcact

SEQ ID NO: 375443 - DNA, 20 bp, Artificial Sequence
  chemically synthesized
ctatgaaaacatgcactggg

SEQ ID NO: 375444 - DNA, 20 bp, Artificial Sequence
  chemically synthesized
gaaaacatgcactgggtggc

SEQ ID NO: 375445 - DNA, 20 bp, Artificial Sequence
  chemically synthesized
ctggaatggcaccggccacc

SEQ ID NO: 375446 - DNA, 20 bp, Artificial Sequence
  chemically synthesized
ggcacacactggaatggcac

SEQ ID NO: 375447 - DNA, 20 bp, Artificial Sequence
  chemically synthesized
ctgggtggccggtgccattc

SEQ ID NO: 375448 - DNA, 20 bp, Artificial Sequence
  chemically synthesized
tccagaggcacacactggaa

SEQ ID NO: 375449 - DNA, 20 bp, Artificial Sequence
  chemically synthesized
tcacgtccagaggcacacac

SEQ ID NO: 375450 - DNA, 20 bp, Artificial Sequence
  chemically synthesized
gccattccagtgtgtgcctc

SEQ ID NO: 375451 - DNA, 20 bp, Artificial Sequence
  chemically synthesized
ctttgatgtgtcacgtccag

SEQ ID NO: 375452 - DNA, 20 bp, Artificial Sequence
  chemically synthesized
tctttgatgtgtcacgtcca

SEQ ID NO: 375453 - DNA, 20 bp, Artificial Sequence
  chemically synthesized
tttctttgatgtgtcacgtc

SEQ ID NO: 375454 - DNA, 20 bp, Artificial Sequence
  chemically synthesized
cctctggacgtgacacatca

SEQ ID NO: 375455 - DNA, 20 bp, Artificial Sequence
  chemically synthesized
tttcagcggcaggtttggtt

SEQ ID NO: 375456 - DNA, 20 bp, Artificial Sequence
  chemically synthesized
ttggctttcagcggcaggtt

SEQ ID NO: 375457 - DNA, 20 bp, Artificial Sequence
  chemically synthesized
taggcttggctttcagcggc

SEQ ID NO: 375458 - DNA, 20 bp, Artificial Sequence
  chemically synthesized
caaaccaaacctgccgctga

SEQ ID NO: 375459 - DNA, 20 bp, Artificial Sequence
  chemically synthesized
ctaggcttggctttcagcgg

SEQ ID NO: 375460 - DNA, 20 bp, Artificial Sequence
  chemically synthesized
ttgctaggcttggctttcag

SEQ ID NO: 375461 - DNA, 20 bp, Artificial Sequence
  chemically synthesized
caaacctgccgctgaaagcc

SEQ ID NO: 375462 - DNA, 20 bp, Artificial Sequence
  chemically synthesized
tagttgctaggcttggcttt

SEQ ID NO: 375463 - DNA, 20 bp, Artificial Sequence
  chemically synthesized
ctgccgctgaaagccaagcc

SEQ ID NO: 375464 - DNA, 20 bp, Artificial Sequence
  chemically synthesized
aggctggtagttgctaggct

SEQ ID NO: 375465 - DNA, 20 bp, Artificial Sequence
  chemically synthesized
gcatcaggctggtagttgct

SEQ ID NO: 375466 - DNA, 20 bp, Artificial Sequence
  chemically synthesized
tgcatcaggctggtagttgc

SEQ ID NO: 375467 - DNA, 20 bp, Artificial Sequence
  chemically synthesized
aagccaagcctagcaactac

SEQ ID NO: 375468 - DNA, 20 bp, Artificial Sequence
  chemically synthesized
ttggttctgcatcaggctgg

SEQ ID NO: 375469 - DNA, 20 bp, Artificial Sequence
  chemically synthesized
gatttggttctgcatcaggc

SEQ ID NO: 375470 - DNA, 20 bp, Artificial Sequence
  chemically synthesized
tagcaactaccagcctgatg

SEQ ID NO: 375471 - DNA, 20 bp, Artificial Sequence
  chemically synthesized
tctagatttggttctgcatc

SEQ ID NO: 375472 - DNA, 20 bp, Artificial Sequence
  chemically synthesized
atctagatttggttctgcat

SEQ ID NO: 375473 - DNA, 20 bp, Artificial Sequence
  chemically synthesized
gcctgatgcagaaccaaatc

SEQ ID NO: 375474 - DNA, 20 bp, Artificial Sequence
  chemically synthesized
gacctaagttgatctagatt

SEQ ID NO: 375475 - DNA, 20 bp, Artificial Sequence
  chemically synthesized
ttggctgacctaagttgatc

SEQ ID NO: 375476 - DNA, 20 bp, Artificial Sequence
  chemically synthesized
gaaccaaatctagatcaact

SEQ ID NO: 375477 - DNA, 20 bp, Artificial Sequence
  chemically synthesized
aaccaaatctagatcaactt

SEQ ID NO: 375478 - DNA, 20 bp, Artificial Sequence
  chemically synthesized
aaatctagatcaacttaggt

SEQ ID NO: 375479 - DNA, 20 bp, Artificial Sequence
  chemically synthesized
atgcggggtttggctgacct

SEQ ID NO: 375480 - DNA, 20 bp, Artificial Sequence
  chemically synthesized
tctcatggtcatgcggggtt

SEQ ID NO: 375481 - DNA, 20 bp, Artificial Sequence
  chemically synthesized
ttaattctcatggtcatgcg

SEQ ID NO: 375482 - DNA, 20 bp, Artificial Sequence
  chemically synthesized
attaattctcatggtcatgc

SEQ ID NO: 375483 - DNA, 20 bp, Artificial Sequence
  chemically synthesized
cattaattctcatggtcatg

SEQ ID NO: 375484 - DNA, 20 bp, Artificial Sequence
  chemically synthesized
gccaaaccccgcatgaccat

SEQ ID NO: 375485 - DNA, 20 bp, Artificial Sequence
  chemically synthesized
ttaaatagcattaattctca

SEQ ID NO: 375486 - DNA, 20 bp, Artificial Sequence
  chemically synthesized
tccaacttaatggttttaaa

SEQ ID NO: 375487 - DNA, 20 bp, Artificial Sequence
  chemically synthesized
taatgctatttaaaaccatt

SEQ ID NO: 375488 - DNA, 20 bp, Artificial Sequence
  chemically synthesized
gctatttaaaaccattaagt

SEQ ID NO: 375489 - DNA, 20 bp, Artificial Sequence
  chemically synthesized
aatcattacctccaacttaa

SEQ ID NO: 375490 - DNA, 20 bp, Artificial Sequence
  chemically synthesized
tatttaaaaccattaagttg

SEQ ID NO: 375491 - DNA, 20 bp, Artificial Sequence
  chemically synthesized
atttaaaaccattaagttgg

SEQ ID NO: 375492 - DNA, 20 bp, Artificial Sequence
  chemically synthesized
gctctcaaaacaataatatc

SEQ ID NO: 375493 - DNA, 20 bp, Artificial Sequence
  chemically synthesized
ttacttgatattattgtttt

SEQ ID NO: 375494 - DNA, 20 bp, Artificial Sequence
  chemically synthesized
acttgatattattgttttga

SEQ ID NO: 375495 - DNA, 20 bp, Artificial Sequence
  chemically synthesized
atttgggcagatgtattggt

SEQ ID NO: 375496 - DNA, 20 bp, Artificial Sequence
  chemically synthesized
gtttatttgggcagatgtat

SEQ ID NO: 375497 - DNA, 20 bp, Artificial Sequence
  chemically synthesized
aacaaacgcgtttatttggg

SEQ ID NO: 375498 - DNA, 20 bp, Artificial Sequence
  chemically synthesized
gtgaacaaacgcgtttattt

SEQ ID NO: 375499 - DNA, 20 bp, Artificial Sequence
  chemically synthesized
tgtgaacaaacgcgtttatt

SEQ ID NO: 375500 - DNA, 20 bp, Artificial Sequence
  chemically synthesized
tattgagggttataggggtt

SEQ ID NO: 375501 - DNA, 20 bp, Artificial Sequence
  chemically synthesized
ttcgctattgagggttatag

SEQ ID NO: 375502 - DNA, 20 bp, Artificial Sequence
  chemically synthesized
cttcgctattgagggttata

SEQ ID NO: 375503 - DNA, 20 bp, Artificial Sequence
  chemically synthesized
ccttcgctattgagggttat

SEQ ID NO: 375504 - DNA, 20 bp, Artificial Sequence
  chemically synthesized
gccttcgctattgagggtta

SEQ ID NO: 375505 - DNA, 20 bp, Artificial Sequence
  chemically synthesized
tgaacccctataaccctcaa

SEQ ID NO: 375506 - DNA, 20 bp, Artificial Sequence
  chemically synthesized
cctgatgccttcgctattga

SEQ ID NO: 375507 - DNA, 20 bp, Artificial Sequence
  chemically synthesized
acctgatgccttcgctattg

SEQ ID NO: 375508 - DNA, 20 bp, Artificial Sequence
  chemically synthesized
ccctataaccctcaatagcg

SEQ ID NO: 375509 - DNA, 20 bp, Artificial Sequence
  chemically synthesized
aacctgatgccttcgctatt

SEQ ID NO: 375510 - DNA, 20 bp, Artificial Sequence
  chemically synthesized
cctataaccctcaatagcga

SEQ ID NO: 375511 - DNA, 20 bp, Artificial Sequence
  chemically synthesized
accctcaatagcgaaggcat

SEQ ID NO: 375512 - DNA, 20 bp, Artificial Sequence
  chemically synthesized
ccctcaatagcgaaggcatc

SEQ ID NO: 375513 - DNA, 20 bp, Artificial Sequence
  chemically synthesized
atagcgaaggcatcaggttc

SEQ ID NO: 375514 - DNA, 20 bp, Artificial Sequence
  chemically synthesized
agcgaaggcatcaggttcaa

SEQ ID NO: 375515 - DNA, 20 bp, Artificial Sequence
  chemically synthesized
ggcatcaggttcaagagact

SEQ ID NO: 375516 - DNA, 20 bp, Artificial Sequence
  chemically synthesized
gcatcaggttcaagagactg

SEQ ID NO: 375517 - DNA, 20 bp, Artificial Sequence
  chemically synthesized
tcaggttcaagagactgagg

SEQ ID NO: 375518 - DNA, 20 bp, Artificial Sequence
  chemically synthesized
ctggctatgggtttcttcct

SEQ ID NO: 375519 - DNA, 20 bp, Artificial Sequence
  chemically synthesized
gagactgaggaagaaaccca

SEQ ID NO: 375520 - DNA, 20 bp, Artificial Sequence
  chemically synthesized
ctgaggaagaaacccatagc

SEQ ID NO: 375521 - DNA, 20 bp, Artificial Sequence
  chemically synthesized
atgcctcgtttgctggctat

SEQ ID NO: 375522 - DNA, 20 bp, Artificial Sequence
  chemically synthesized
aatgcctcgtttgctggcta

SEQ ID NO: 375523 - DNA, 20 bp, Artificial Sequence
  chemically synthesized
gaaacccatagccagcaaac

SEQ ID NO: 375524 - DNA, 20 bp, Artificial Sequence
  chemically synthesized
aaacccatagccagcaaacg

SEQ ID NO: 375525 - DNA, 20 bp, Artificial Sequence
  chemically synthesized
aaacccaatgcctcgtttgc

SEQ ID NO: 375526 - DNA, 20 bp, Artificial Sequence
  chemically synthesized
atagccagcaaacgaggcat

SEQ ID NO: 375527 - DNA, 20 bp, Artificial Sequence
  chemically synthesized
tagccagcaaacgaggcatt

SEQ ID NO: 375528 - DNA, 20 bp, Artificial Sequence
  chemically synthesized
aacgaggcattgggttttat

SEQ ID NO: 375529 - DNA, 20 bp, Artificial Sequence
  chemically synthesized
cgaggcattgggttttatta

SEQ ID NO: 375530 - DNA, 20 bp, Artificial Sequence
  chemically synthesized
gaggcattgggttttattag

SEQ ID NO: 375531 - DNA, 20 bp, Artificial Sequence
  chemically synthesized
ttttattagaggtttacata

SEQ ID NO: 375532 - DNA, 20 bp, Artificial Sequence
  chemically synthesized
tttattagaggtttacatac

SEQ ID NO: 375533 - DNA, 20 bp, Artificial Sequence
  chemically synthesized
ttattagaggtttacataca

SEQ ID NO: 375534 - DNA, 20 bp, Artificial Sequence
  chemically synthesized
tattagaggtttacatacag

SEQ ID NO: 375535 - DNA, 20 bp, Artificial Sequence
  chemically synthesized
ttagaggtttacatacaggg

SEQ ID NO: 375536 - DNA, 20 bp, Artificial Sequence
  chemically synthesized
tagaggtttacatacagggg

SEQ ID NO: 375537 - DNA, 20 bp, Artificial Sequence
  chemically synthesized
agaggtttacatacagggga

SEQ ID NO: 375538 - DNA, 20 bp, Artificial Sequence
  chemically synthesized
tacatacaggggagggaatt

SEQ ID NO: 375539 - DNA, 20 bp, Artificial Sequence
  chemically synthesized
atacaggggagggaattcag

SEQ ID NO: 375540 - DNA, 20 bp, Artificial Sequence
  chemically synthesized
caggggagggaattcagtag

SEQ ID NO: 375541 - DNA, 20 bp, Artificial Sequence
  chemically synthesized
gggagggaattcagtagtgg

SEQ ID NO: 375542 - DNA, 20 bp, Artificial Sequence
  chemically synthesized
ggagggaattcagtagtggt

SEQ ID NO: 375543 - DNA, 20 bp, Artificial Sequence
  chemically synthesized
ggaattcagtagtggtgggc

SEQ ID NO: 375544 - DNA, 20 bp, Artificial Sequence
  chemically synthesized
ttcagtagtggtgggctgga

SEQ ID NO: 375545 - DNA, 20 bp, Artificial Sequence
  chemically synthesized
tcagtagtggtgggctggac

SEQ ID NO: 375546 - DNA, 20 bp, Artificial Sequence
  chemically synthesized
agtagtggtgggctggacag

SEQ ID NO: 375547 - DNA, 20 bp, Artificial Sequence
  chemically synthesized
ggtaaggcacttctcctgtc

SEQ ID NO: 375548 - DNA, 20 bp, Artificial Sequence
  chemically synthesized
agtggtgggctggacaggag

SEQ ID NO: 375549 - DNA, 20 bp, Artificial Sequence
  chemically synthesized
caggagaagtgccttacctg

SEQ ID NO: 375550 - DNA, 20 bp, Artificial Sequence
  chemically synthesized
ctggatcgtttctacaggta

SEQ ID NO: 375551 - DNA, 20 bp, Artificial Sequence
  chemically synthesized
actggatcgtttctacaggt

SEQ ID NO: 375552 - DNA, 20 bp, Artificial Sequence
  chemically synthesized
caccactggatcgtttctac

SEQ ID NO: 375553 - DNA, 20 bp, Artificial Sequence
  chemically synthesized
ccaccactggatcgtttcta

SEQ ID NO: 375554 - DNA, 20 bp, Artificial Sequence
  chemically synthesized
ccttacctgtagaaacgatc

SEQ ID NO: 375555 - DNA, 20 bp, Artificial Sequence
  chemically synthesized
tacctgtagaaacgatccag

SEQ ID NO: 375556 - DNA, 20 bp, Artificial Sequence
  chemically synthesized
ctgtagaaacgatccagtgg

SEQ ID NO: 375557 - DNA, 20 bp, Artificial Sequence
  chemically synthesized
tagaaacgatccagtggtgg

SEQ ID NO: 375558 - DNA, 20 bp, Artificial Sequence
  chemically synthesized
cttgtccagtctgccaccac

SEQ ID NO: 375559 - DNA, 20 bp, Artificial Sequence
  chemically synthesized
acgatccagtggtggcagac

SEQ ID NO: 375560 - DNA, 20 bp, Artificial Sequence
  chemically synthesized
ccagtggtggcagactggac

SEQ ID NO: 375561 - DNA, 20 bp, Artificial Sequence
  chemically synthesized
tggtggcagactggacaaga

SEQ ID NO: 375562 - DNA, 20 bp, Artificial Sequence
  chemically synthesized
tgctgcgaggctatcttgtc

SEQ ID NO: 375563 - DNA, 20 bp, Artificial Sequence
  chemically synthesized
gactggacaagatagcctcg

SEQ ID NO: 375564 - DNA, 20 bp, Artificial Sequence
  chemically synthesized
gacaagatagcctcgcagca

SEQ ID NO: 375565 - DNA, 20 bp, Artificial Sequence
  chemically synthesized
atcactaccactgtgctgcg

SEQ ID NO: 375566 - DNA, 20 bp, Artificial Sequence
  chemically synthesized
catcactaccactgtgctgc

SEQ ID NO: 375567 - DNA, 20 bp, Artificial Sequence
  chemically synthesized
aagatagcctcgcagcacag

SEQ ID NO: 375568 - DNA, 20 bp, Artificial Sequence
  chemically synthesized
atagcctcgcagcacagtgg

SEQ ID NO: 375569 - DNA, 20 bp, Artificial Sequence
  chemically synthesized
tcgcagcacagtggtagtga

SEQ ID NO: 375570 - DNA, 20 bp, Artificial Sequence
  chemically synthesized
cagcacagtggtagtgatgg

SEQ ID NO: 375571 - DNA, 20 bp, Artificial Sequence
  chemically synthesized
cacagtggtagtgatggcgg

SEQ ID NO: 375572 - DNA, 20 bp, Artificial Sequence
  chemically synthesized
agtggtagtgatggcggcgg

SEQ ID NO: 375573 - DNA, 20 bp, Artificial Sequence
  chemically synthesized
gtggtagtgatggcggcggt

SEQ ID NO: 375574 - DNA, 20 bp, Artificial Sequence
  chemically synthesized
agtgatggcggcggtgggat

SEQ ID NO: 375575 - DNA, 20 bp, Artificial Sequence
  chemically synthesized
gatggcggcggtgggatgag

SEQ ID NO: 375576 - DNA, 20 bp, Artificial Sequence
  chemically synthesized
atggcggcggtgggatgagc

SEQ ID NO: 375577 - DNA, 20 bp, Artificial Sequence
  chemically synthesized
atgctgcccgcaagcagcgt

SEQ ID NO: 375578 - DNA, 20 bp, Artificial Sequence
  chemically synthesized
gggcaaaccaacgctgcttg

SEQ ID NO: 375579 - DNA, 20 bp, Artificial Sequence
  chemically synthesized
ggcaaaccaacgctgcttgc

SEQ ID NO: 375580 - DNA, 20 bp, Artificial Sequence
  chemically synthesized
aactgcatgctgcccgcaag

SEQ ID NO: 375581 - DNA, 20 bp, Artificial Sequence
  chemically synthesized
aaaccaacgctgcttgcggg

SEQ ID NO: 375582 - DNA, 20 bp, Artificial Sequence
  chemically synthesized
ataaactgcatgctgcccgc

SEQ ID NO: 375583 - DNA, 20 bp, Artificial Sequence
  chemically synthesized
cgctgcttgcgggcagcatg

SEQ ID NO: 375584 - DNA, 20 bp, Artificial Sequence
  chemically synthesized
cgggcagcatgcagtttata

SEQ ID NO: 375585 - DNA, 20 bp, Artificial Sequence
  chemically synthesized
gtcattaagggcagagggtt

SEQ ID NO: 375586 - DNA, 20 bp, Artificial Sequence
  chemically synthesized
tgaacgtcattaagggcaga

SEQ ID NO: 375587 - DNA, 20 bp, Artificial Sequence
  chemically synthesized
gtgaacgtcattaagggcag

SEQ ID NO: 375588 - DNA, 20 bp, Artificial Sequence
  chemically synthesized
ggtgaacgtcattaagggca

SEQ ID NO: 375589 - DNA, 20 bp, Artificial Sequence
  chemically synthesized
caggtgaacgtcattaaggg

SEQ ID NO: 375590 - DNA, 20 bp, Artificial Sequence
  chemically synthesized
tgccaggtgaacgtcattaa

SEQ ID NO: 375591 - DNA, 20 bp, Artificial Sequence
  chemically synthesized
ttgccaggtgaacgtcatta

SEQ ID NO: 375592 - DNA, 20 bp, Artificial Sequence
  chemically synthesized
gttgccaggtgaacgtcatt

SEQ ID NO: 375593 - DNA, 20 bp, Artificial Sequence
  chemically synthesized
tgcccttaatgacgttcacc

SEQ ID NO: 375594 - DNA, 20 bp, Artificial Sequence
  chemically synthesized
tgggttggatgaaggttgcc

SEQ ID NO: 375595 - DNA, 20 bp, Artificial Sequence
  chemically synthesized
ttgggttggatgaaggttgc

SEQ ID NO: 375596 - DNA, 20 bp, Artificial Sequence
  chemically synthesized
ccgagttttgggttggatga

SEQ ID NO: 375597 - DNA, 20 bp, Artificial Sequence
  chemically synthesized
cccgagttttgggttggatg

SEQ ID NO: 375598 - DNA, 20 bp, Artificial Sequence
  chemically synthesized
tgaggccccgagttttgggt

SEQ ID NO: 375599 - DNA, 20 bp, Artificial Sequence
  chemically synthesized
ccttcatccaacccaaaact

SEQ ID NO: 375600 - DNA, 20 bp, Artificial Sequence
  chemically synthesized
cttcatccaacccaaaactc

SEQ ID NO: 375601 - DNA, 20 bp, Artificial Sequence
  chemically synthesized
ggattgaggccccgagtttt

SEQ ID NO: 375602 - DNA, 20 bp, Artificial Sequence
  chemically synthesized
ttcatccaacccaaaactcg

SEQ ID NO: 375603 - DNA, 20 bp, Artificial Sequence
  chemically synthesized
cggattgaggccccgagttt

SEQ ID NO: 375604 - DNA, 20 bp, Artificial Sequence
  chemically synthesized
atacagcggattgaggcccc

SEQ ID NO: 375605 - DNA, 20 bp, Artificial Sequence
  chemically synthesized
gccatacatacagcggattg

SEQ ID NO: 375606 - DNA, 20 bp, Artificial Sequence
  chemically synthesized
ggccatacatacagcggatt

SEQ ID NO: 375607 - DNA, 20 bp, Artificial Sequence
  chemically synthesized
aacacgggccatacatacag

SEQ ID NO: 375608 - DNA, 20 bp, Artificial Sequence
  chemically synthesized
gcctcaatccgctgtatgta

SEQ ID NO: 375609 - DNA, 20 bp, Artificial Sequence
  chemically synthesized
tggaacacgggccatacata

SEQ ID NO: 375610 - DNA, 20 bp, Artificial Sequence
  chemically synthesized
aagtgcatcccgtggaacac

SEQ ID NO: 375611 - DNA, 20 bp, Artificial Sequence
  chemically synthesized
tatgtatggcccgtgttcca

SEQ ID NO: 375612 - DNA, 20 bp, Artificial Sequence
  chemically synthesized
caagtgcatcccgtggaaca

SEQ ID NO: 375613 - DNA, 20 bp, Artificial Sequence
  chemically synthesized
atgtatggcccgtgttccac

SEQ ID NO: 375614 - DNA, 20 bp, Artificial Sequence
  chemically synthesized
tgagccccaagtgcatcccg

SEQ ID NO: 375615 - DNA, 20 bp, Artificial Sequence
  chemically synthesized
cgtgttccacgggatgcact

SEQ ID NO: 375616 - DNA, 20 bp, Artificial Sequence
  chemically synthesized
gtgttccacgggatgcactt

SEQ ID NO: 375617 - DNA, 20 bp, Artificial Sequence
  chemically synthesized
tgttccacgggatgcacttg

SEQ ID NO: 375618 - DNA, 20 bp, Artificial Sequence
  chemically synthesized
cacgggatgcacttggggct

SEQ ID NO: 375619 - DNA, 20 bp, Artificial Sequence
  chemically synthesized
atgaggaacatctgagcccc

SEQ ID NO: 375620 - DNA, 20 bp, Artificial Sequence
  chemically synthesized
cttgtctatgaggaacatct

SEQ ID NO: 375621 - DNA, 20 bp, Artificial Sequence
  chemically synthesized
tggggctcagatgttcctca

SEQ ID NO: 375622 - DNA, 20 bp, Artificial Sequence
  chemically synthesized
ctcagatgttcctcatagac

SEQ ID NO: 375623 - DNA, 20 bp, Artificial Sequence
  chemically synthesized
agagcccttccttgtctatg

SEQ ID NO: 375624 - DNA, 20 bp, Artificial Sequence
  chemically synthesized
tcagatgttcctcatagaca

SEQ ID NO: 375625 - DNA, 20 bp, Artificial Sequence
  chemically synthesized
gagagcccttccttgtctat

SEQ ID NO: 375626 - DNA, 20 bp, Artificial Sequence
  chemically synthesized
gatgttcctcatagacaagg

SEQ ID NO: 375627 - DNA, 20 bp, Artificial Sequence
  chemically synthesized
atgttcctcatagacaagga

SEQ ID NO: 375628 - DNA, 20 bp, Artificial Sequence
  chemically synthesized
tgttcctcatagacaaggaa

SEQ ID NO: 375629 - DNA, 20 bp, Artificial Sequence
  chemically synthesized
acaaggaagggctctcttgc

SEQ ID NO: 375630 - DNA, 20 bp, Artificial Sequence
  chemically synthesized
caaggaagggctctcttgct

SEQ ID NO: 375631 - DNA, 20 bp, Artificial Sequence
  chemically synthesized
ctgggagtagcccagcaaga

SEQ ID NO: 375632 - DNA, 20 bp, Artificial Sequence
  chemically synthesized
atctgggagtagcccagcaa

SEQ ID NO: 375633 - DNA, 20 bp, Artificial Sequence
  chemically synthesized
gaatctgggagtagcccagc

SEQ ID NO: 375634 - DNA, 20 bp, Artificial Sequence
  chemically synthesized
tacggaatctgggagtagcc

SEQ ID NO: 375635 - DNA, 20 bp, Artificial Sequence
  chemically synthesized
ctctcttgctgggctactcc

SEQ ID NO: 375636 - DNA, 20 bp, Artificial Sequence
  chemically synthesized
cgagctacggaatctgggag

SEQ ID NO: 375637 - DNA, 20 bp, Artificial Sequence
  chemically synthesized
ttccgagctacggaatctgg

SEQ ID NO: 375638 - DNA, 20 bp, Artificial Sequence
  chemically synthesized
ttttccgagctacggaatct

SEQ ID NO: 375639 - DNA, 20 bp, Artificial Sequence
  chemically synthesized
tgggctactcccagattccg

SEQ ID NO: 375640 - DNA, 20 bp, Artificial Sequence
  chemically synthesized
gttttccgagctacggaatc

SEQ ID NO: 375641 - DNA, 20 bp, Artificial Sequence
  chemically synthesized
tactcccagattccgtagct

SEQ ID NO: 375642 - DNA, 20 bp, Artificial Sequence
  chemically synthesized
tgaatgtgttttccgagcta

SEQ ID NO: 375643 - DNA, 20 bp, Artificial Sequence
  chemically synthesized
cacacctgaatgtgttttcc

SEQ ID NO: 375644 - DNA, 20 bp, Artificial Sequence
  chemically synthesized
cgtagctcggaaaacacatt

SEQ ID NO: 375645 - DNA, 20 bp, Artificial Sequence
  chemically synthesized
gtagctcggaaaacacattc

SEQ ID NO: 375646 - DNA, 20 bp, Artificial Sequence
  chemically synthesized
aacacattcaggtgtgtctg

SEQ ID NO: 375647 - DNA, 20 bp, Artificial Sequence
  chemically synthesized
attcaggtgtgtctgcagta

SEQ ID NO: 375648 - DNA, 20 bp, Artificial Sequence
  chemically synthesized
ttcaggtgtgtctgcagtac

SEQ ID NO: 375649 - DNA, 20 bp, Artificial Sequence
  chemically synthesized
tcaggtgtgtctgcagtaca

SEQ ID NO: 375650 - DNA, 20 bp, Artificial Sequence
  chemically synthesized
cttagaatgaccctgtactg

SEQ ID NO: 375651 - DNA, 20 bp, Artificial Sequence
  chemically synthesized
ctgcagtacagggtcattct

SEQ ID NO: 375652 - DNA, 20 bp, Artificial Sequence
  chemically synthesized
tgcagtacagggtcattcta

SEQ ID NO: 375653 - DNA, 20 bp, Artificial Sequence
  chemically synthesized
gcagtacagggtcattctaa

SEQ ID NO: 375654 - DNA, 20 bp, Artificial Sequence
  chemically synthesized
caataatgtgcgcataccct

SEQ ID NO: 375655 - DNA, 20 bp, Artificial Sequence
  chemically synthesized
tatgcgcacattattgcaat

SEQ ID NO: 375656 - DNA, 20 bp, Artificial Sequence
  chemically synthesized
atgcgcacattattgcaatc

SEQ ID NO: 375657 - DNA, 20 bp, Artificial Sequence
  chemically synthesized
aagataggtaatcaagtata

SEQ ID NO: 375658 - DNA, 20 bp, Artificial Sequence
  chemically synthesized
aaccagtaagataggtaatc

SEQ ID NO: 375659 - DNA, 20 bp, Artificial Sequence
  chemically synthesized
tacttgattacctatcttac

SEQ ID NO: 375660 - DNA, 20 bp, Artificial Sequence
  chemically synthesized
aacaacataaccagtaagat

SEQ ID NO: 375661 - DNA, 20 bp, Artificial Sequence
  chemically synthesized
caacaacataaccagtaaga

SEQ ID NO: 375662 - DNA, 20 bp, Artificial Sequence
  chemically synthesized
aaaacaacaacataaccagt

SEQ ID NO: 375663 - DNA, 20 bp, Artificial Sequence
  chemically synthesized
acacaaaacaacaacataac

SEQ ID NO: 375664 - DNA, 20 bp, Artificial Sequence
  chemically synthesized
tgtgtacgtgtgtgtatgca

SEQ ID NO: 375665 - DNA, 20 bp, Artificial Sequence
  chemically synthesized
gtgtacgtgtgtgtatgcat

SEQ ID NO: 375666 - DNA, 20 bp, Artificial Sequence
  chemically synthesized
tgtatgcatgggtgttttta

SEQ ID NO: 375667 - DNA, 20 bp, Artificial Sequence
  chemically synthesized
tatgcatgggtgtttttaca

SEQ ID NO: 375668 - DNA, 20 bp, Artificial Sequence
  chemically synthesized
catgggtgtttttacagagt

SEQ ID NO: 375669 - DNA, 20 bp, Artificial Sequence
  chemically synthesized
acagagtcagatgtcaaccg

SEQ ID NO: 375670 - DNA, 20 bp, Artificial Sequence
  chemically synthesized
cagagtcagatgtcaaccgc

SEQ ID NO: 375671 - DNA, 20 bp, Artificial Sequence
  chemically synthesized
agagtcagatgtcaaccgca

SEQ ID NO: 375672 - DNA, 20 bp, Artificial Sequence
  chemically synthesized
agacacttgtattgtccctg

SEQ ID NO: 375673 - DNA, 20 bp, Artificial Sequence
  chemically synthesized
gtcaaccgcagggacaatac

SEQ ID NO: 375674 - DNA, 20 bp, Artificial Sequence
  chemically synthesized
tacagcaggctgaaatgagt

SEQ ID NO: 375675 - DNA, 20 bp, Artificial Sequence
  chemically synthesized
tacaagtgtcttactcattt

SEQ ID NO: 375676 - DNA, 20 bp, Artificial Sequence
  chemically synthesized
ttgttacagcaggctgaaat

SEQ ID NO: 375677 - DNA, 20 bp, Artificial Sequence
  chemically synthesized
ctatggtatcttgttacagc

SEQ ID NO: 375678 - DNA, 20 bp, Artificial Sequence
  chemically synthesized
tcatttcagcctgctgtaac

SEQ ID NO: 375679 - DNA, 20 bp, Artificial Sequence
  chemically synthesized
tctatggtatcttgttacag

SEQ ID NO: 375680 - DNA, 20 bp, Artificial Sequence
  chemically synthesized
cagtctatggtatcttgtta

SEQ ID NO: 375681 - DNA, 20 bp, Artificial Sequence
  chemically synthesized
cctgctgtaacaagatacca

SEQ ID NO: 375682 - DNA, 20 bp, Artificial Sequence
  chemically synthesized
tgtaacaagataccatagac

SEQ ID NO: 375683 - DNA, 20 bp, Artificial Sequence
  chemically synthesized
gtaacaagataccatagact

SEQ ID NO: 375684 - DNA, 20 bp, Artificial Sequence
  chemically synthesized
tgtttaagctgcccagtcta

SEQ ID NO: 375685 - DNA, 20 bp, Artificial Sequence
  chemically synthesized
acaagataccatagactggg

SEQ ID NO: 375686 - DNA, 20 bp, Artificial Sequence
  chemically synthesized
tttctgttgtttaagctgcc

SEQ ID NO: 375687 - DNA, 20 bp, Artificial Sequence
  chemically synthesized
agactgggcagcttaaacaa

SEQ ID NO: 375688 - DNA, 20 bp, Artificial Sequence
  chemically synthesized
aaaataaatttctgttgttt

SEQ ID NO: 375689 - DNA, 20 bp, Artificial Sequence
  chemically synthesized
aacagaaatttattttctca

SEQ ID NO: 375690 - DNA, 20 bp, Artificial Sequence
  chemically synthesized
aatttattttctcacagttc

SEQ ID NO: 375691 - DNA, 20 bp, Artificial Sequence
  chemically synthesized
cttaaagcctccagaactgt

SEQ ID NO: 375692 - DNA, 20 bp, Artificial Sequence
  chemically synthesized
tttattttctcacagttctg

SEQ ID NO: 375693 - DNA, 20 bp, Artificial Sequence
  chemically synthesized
ttattttctcacagttctgg

SEQ ID NO: 375694 - DNA, 20 bp, Artificial Sequence
  chemically synthesized
gacctcggacttaaagcctc

SEQ ID NO: 375695 - DNA, 20 bp, Artificial Sequence
  chemically synthesized
ctcacagttctggaggcttt

SEQ ID NO: 375696 - DNA, 20 bp, Artificial Sequence
  chemically synthesized
gttctggaggctttaagtcc

SEQ ID NO: 375697 - DNA, 20 bp, Artificial Sequence
  chemically synthesized
gaacactgacctcggactta

SEQ ID NO: 375698 - DNA, 20 bp, Artificial Sequence
  chemically synthesized
ttctggaggctttaagtccg

SEQ ID NO: 375699 - DNA, 20 bp, Artificial Sequence
  chemically synthesized
ggaggctttaagtccgaggt

SEQ ID NO: 375700 - DNA, 20 bp, Artificial Sequence
  chemically synthesized
acacgctggaacactgacct

SEQ ID NO: 375701 - DNA, 20 bp, Artificial Sequence
  chemically synthesized
taagtccgaggtcagtgttc

SEQ ID NO: 375702 - DNA, 20 bp, Artificial Sequence
  chemically synthesized
tctccagaacttgaacacgc

SEQ ID NO: 375703 - DNA, 20 bp, Artificial Sequence
  chemically synthesized
gtcagtgttccagcgtgttc

SEQ ID NO: 375704 - DNA, 20 bp, Artificial Sequence
  chemically synthesized
gttccagcgtgttcaagttc

SEQ ID NO: 375705 - DNA, 20 bp, Artificial Sequence
  chemically synthesized
tccagcgtgttcaagttctg

SEQ ID NO: 375706 - DNA, 20 bp, Artificial Sequence
  chemically synthesized
cagcgtgttcaagttctgga

SEQ ID NO: 375707 - DNA, 20 bp, Artificial Sequence
  chemically synthesized
agcgtgttcaagttctggag

SEQ ID NO: 375708 - DNA, 20 bp, Artificial Sequence
  chemically synthesized
gcgtgttcaagttctggaga

SEQ ID NO: 375709 - DNA, 20 bp, Artificial Sequence
  chemically synthesized
atcaggaggagagccctctc

SEQ ID NO: 375710 - DNA, 20 bp, Artificial Sequence
  chemically synthesized
ttgtttacatatcaggagga

SEQ ID NO: 375711 - DNA, 20 bp, Artificial Sequence
  chemically synthesized
tgttgtttacatatcaggag

SEQ ID NO: 375712 - DNA, 20 bp, Artificial Sequence
  chemically synthesized
gttgttgtttacatatcagg

SEQ ID NO: 375713 - DNA, 20 bp, Artificial Sequence
  chemically synthesized
ggttgttgtttacatatcag

SEQ ID NO: 375714 - DNA, 20 bp, Artificial Sequence
  chemically synthesized
aaggttgttgtttacatatc

SEQ ID NO: 375715 - DNA, 20 bp, Artificial Sequence
  chemically synthesized
gaaggttgttgtttacatat

SEQ ID NO: 375716 - DNA, 20 bp, Artificial Sequence
  chemically synthesized
ccatgtgaggacacaggaga

SEQ ID NO: 375717 - DNA, 20 bp, Artificial Sequence
  chemically synthesized
gccatgtgaggacacaggag

SEQ ID NO: 375718 - DNA, 20 bp, Artificial Sequence
  chemically synthesized
tttgccatgtgaggacacag

SEQ ID NO: 375719 - DNA, 20 bp, Artificial Sequence
  chemically synthesized
gctttgccatgtgaggacac

SEQ ID NO: 375720 - DNA, 20 bp, Artificial Sequence
  chemically synthesized
tgctttgccatgtgaggaca

SEQ ID NO: 375721 - DNA, 20 bp, Artificial Sequence
  chemically synthesized
ccttctcctgtgtcctcaca

SEQ ID NO: 375722 - DNA, 20 bp, Artificial Sequence
  chemically synthesized
tgctcttgctttgccatgtg

SEQ ID NO: 375723 - DNA, 20 bp, Artificial Sequence
  chemically synthesized
ttgctcttgctttgccatgt

SEQ ID NO: 375724 - DNA, 20 bp, Artificial Sequence
  chemically synthesized
tcctgtgtcctcacatggca

SEQ ID NO: 375725 - DNA, 20 bp, Artificial Sequence
  chemically synthesized
gtgtcctcacatggcaaagc

SEQ ID NO: 375726 - DNA, 20 bp, Artificial Sequence
  chemically synthesized
gtcctcacatggcaaagcaa

SEQ ID NO: 375727 - DNA, 20 bp, Artificial Sequence
  chemically synthesized
tcacatggcaaagcaagagc

SEQ ID NO: 375728 - DNA, 20 bp, Artificial Sequence
  chemically synthesized
caaagcaagagcaagctctc

SEQ ID NO: 375729 - DNA, 20 bp, Artificial Sequence
  chemically synthesized
cgtgtaaagaaaacaccaga

SEQ ID NO: 375730 - DNA, 20 bp, Artificial Sequence
  chemically synthesized
cccgtgtaaagaaaacacca

SEQ ID NO: 375731 - DNA, 20 bp, Artificial Sequence
  chemically synthesized
ggcccgtgtaaagaaaacac

SEQ ID NO: 375732 - DNA, 20 bp, Artificial Sequence
  chemically synthesized
tctctggtgttttctttaca

SEQ ID NO: 375733 - DNA, 20 bp, Artificial Sequence
  chemically synthesized
ctctggtgttttctttacac

SEQ ID NO: 375734 - DNA, 20 bp, Artificial Sequence
  chemically synthesized
ctgatccggtggcccgtgta

SEQ ID NO: 375735 - DNA, 20 bp, Artificial Sequence
  chemically synthesized
gttttctttacacgggccac

SEQ ID NO: 375736 - DNA, 20 bp, Artificial Sequence
  chemically synthesized
ctttacacgggccaccggat

SEQ ID NO: 375737 - DNA, 20 bp, Artificial Sequence
  chemically synthesized
caggtggggctctgatccgg

SEQ ID NO: 375738 - DNA, 20 bp, Artificial Sequence
  chemically synthesized
ttacacgggccaccggatca

SEQ ID NO: 375739 - DNA, 20 bp, Artificial Sequence
  chemically synthesized
atgcaggtggggctctgatc

SEQ ID NO: 375740 - DNA, 20 bp, Artificial Sequence
  chemically synthesized
aagataagcacatgcaggtg

SEQ ID NO: 375741 - DNA, 20 bp, Artificial Sequence
  chemically synthesized
taagataagcacatgcaggt

SEQ ID NO: 375742 - DNA, 20 bp, Artificial Sequence
  chemically synthesized
gtaagataagcacatgcagg

SEQ ID NO: 375743 - DNA, 20 bp, Artificial Sequence
  chemically synthesized
agggtaagataagcacatgc

SEQ ID NO: 375744 - DNA, 20 bp, Artificial Sequence
  chemically synthesized
tagggtaagataagcacatg

SEQ ID NO: 375745 - DNA, 20 bp, Artificial Sequence
  chemically synthesized
ggaattaattagggtaagat

SEQ ID NO: 375746 - DNA, 20 bp, Artificial Sequence
  chemically synthesized
ctttgggaattaattagggt

SEQ ID NO: 375747 - DNA, 20 bp, Artificial Sequence
  chemically synthesized
gaacctttgggaattaatta

SEQ ID NO: 375748 - DNA, 20 bp, Artificial Sequence
  chemically synthesized
ggaacctttgggaattaatt

SEQ ID NO: 375749 - DNA, 20 bp, Artificial Sequence
  chemically synthesized
tggaacctttgggaattaat

SEQ ID NO: 375750 - DNA, 20 bp, Artificial Sequence
  chemically synthesized
cttaccctaattaattccca

SEQ ID NO: 375751 - DNA, 20 bp, Artificial Sequence
  chemically synthesized
ttaccctaattaattcccaa

SEQ ID NO: 375752 - DNA, 20 bp, Artificial Sequence
  chemically synthesized
tatttggagatggaaccttt

SEQ ID NO: 375753 - DNA, 20 bp, Artificial Sequence
  chemically synthesized
atatttggagatggaacctt

SEQ ID NO: 375754 - DNA, 20 bp, Artificial Sequence
  chemically synthesized
aatgggacgatatttggaga

SEQ ID NO: 375755 - DNA, 20 bp, Artificial Sequence
  chemically synthesized
ccccaatgggacgatatttg

SEQ ID NO: 375756 - DNA, 20 bp, Artificial Sequence
  chemically synthesized
acccccaatgggacgatatt

SEQ ID NO: 375757 - DNA, 20 bp, Artificial Sequence
  chemically synthesized
atctccaaatatcgtcccat

SEQ ID NO: 375758 - DNA, 20 bp, Artificial Sequence
  chemically synthesized
tctccaaatatcgtcccatt

SEQ ID NO: 375759 - DNA, 20 bp, Artificial Sequence
  chemically synthesized
ctccaaatatcgtcccattg

SEQ ID NO: 375760 - DNA, 20 bp, Artificial Sequence
  chemically synthesized
tccaaatatcgtcccattgg

SEQ ID NO: 375761 - DNA, 20 bp, Artificial Sequence
  chemically synthesized
ctgaagccctaacccccaat

SEQ ID NO: 375762 - DNA, 20 bp, Artificial Sequence
  chemically synthesized
gctgaagccctaacccccaa

SEQ ID NO: 375763 - DNA, 20 bp, Artificial Sequence
  chemically synthesized
aatatcgtcccattgggggt

SEQ ID NO: 375764 - DNA, 20 bp, Artificial Sequence
  chemically synthesized
atatcgtcccattgggggtt

SEQ ID NO: 375765 - DNA, 20 bp, Artificial Sequence
  chemically synthesized
tatcgtcccattgggggtta

SEQ ID NO: 375766 - DNA, 20 bp, Artificial Sequence
  chemically synthesized
cccattgggggttagggctt

SEQ ID NO: 375767 - DNA, 20 bp, Artificial Sequence
  chemically synthesized
tgccccaaattcatatgctg

SEQ ID NO: 375768 - DNA, 20 bp, Artificial Sequence
  chemically synthesized
agggcttcagcatatgaatt

SEQ ID NO: 375769 - DNA, 20 bp, Artificial Sequence
  chemically synthesized
gggcttcagcatatgaattt

SEQ ID NO: 375770 - DNA, 20 bp, Artificial Sequence
  chemically synthesized
ggcttcagcatatgaatttg

SEQ ID NO: 375771 - DNA, 20 bp, Artificial Sequence
  chemically synthesized
gaatttggggcaaacacgaa

SEQ ID NO: 375772 - DNA, 20 bp, Artificial Sequence
  chemically synthesized
ttggggcaaacacgaatagt

SEQ ID NO: 375773 - DNA, 20 bp, Artificial Sequence
  chemically synthesized
aatagtcagtccataacaac

SEQ ID NO: 375774 - DNA, 20 bp, Artificial Sequence
  chemically synthesized
tagtccttcacttgttgtta

SEQ ID NO: 375775 - DNA, 20 bp, Artificial Sequence
  chemically synthesized
tcagtccataacaacaagtg

SEQ ID NO: 375776 - DNA, 20 bp, Artificial Sequence
  chemically synthesized
cagtccataacaacaagtga

SEQ ID NO: 375777 - DNA, 20 bp, Artificial Sequence
  chemically synthesized
taacaacaagtgaaggacta

SEQ ID NO: 375778 - DNA, 20 bp, Artificial Sequence
  chemically synthesized
actgtataaaatagattctg

SEQ ID NO: 375779 - DNA, 20 bp, Artificial Sequence
  chemically synthesized
actacagaatctattttata

SEQ ID NO: 375780 - DNA, 20 bp, Artificial Sequence
  chemically synthesized
gaaaatattactgtataaaa

SEQ ID NO: 375781 - DNA, 20 bp, Artificial Sequence
  chemically synthesized
acagtaatattttcttttat

SEQ ID NO: 375782 - DNA, 20 bp, Artificial Sequence
  chemically synthesized
cactttcatatagctcataa

SEQ ID NO: 375783 - DNA, 20 bp, Artificial Sequence
  chemically synthesized
ttcttttatgagctatatga

SEQ ID NO: 375784 - DNA, 20 bp, Artificial Sequence
  chemically synthesized
cttgctttgtcactttcata

SEQ ID NO: 375785 - DNA, 20 bp, Artificial Sequence
  chemically synthesized
tgagctatatgaaagtgaca

SEQ ID NO: 375786 - DNA, 20 bp, Artificial Sequence
  chemically synthesized
ctatatgaaagtgacaaagc

SEQ ID NO: 375787 - DNA, 20 bp, Artificial Sequence
  chemically synthesized
tatgaaagtgacaaagcaag

SEQ ID NO: 375788 - DNA, 20 bp, Artificial Sequence
  chemically synthesized
aagtgacaaagcaagtggtt

SEQ ID NO: 375789 - DNA, 20 bp, Artificial Sequence
  chemically synthesized
agtattgtaataccatgaca

SEQ ID NO: 375790 - DNA, 20 bp, Artificial Sequence
  chemically synthesized
tcagttcttaatctttgtca

SEQ ID NO: 375791 - DNA, 20 bp, Artificial Sequence
  chemically synthesized
gtaataccatgacaaagatt

SEQ ID NO: 375792 - DNA, 20 bp, Artificial Sequence
  chemically synthesized
caaagattaagaactgaact

SEQ ID NO: 375793 - DNA, 20 bp, Artificial Sequence
  chemically synthesized
tataaagtatttgctcagtt

SEQ ID NO: 375794 - DNA, 20 bp, Artificial Sequence
  chemically synthesized
agaagtataaagtatttgct

SEQ ID NO: 375795 - DNA, 20 bp, Artificial Sequence
  chemically synthesized
tgaactgaaccagaagtata

SEQ ID NO: 375796 - DNA, 20 bp, Artificial Sequence
  chemically synthesized
gagcaaatactttatacttc

SEQ ID NO: 375797 - DNA, 20 bp, Artificial Sequence
  chemically synthesized
aatactttatacttctggtt

SEQ ID NO: 375798 - DNA, 20 bp, Artificial Sequence
  chemically synthesized
gttatgatgaactgaaccag

SEQ ID NO: 375799 - DNA, 20 bp, Artificial Sequence
  chemically synthesized
tcagttatgatgaactgaac

SEQ ID NO: 375800 - DNA, 20 bp, Artificial Sequence
  chemically synthesized
ttttatatttttgggtaatt

SEQ ID NO: 375801 - DNA, 20 bp, Artificial Sequence
  chemically synthesized
agctctccttttatattttt

SEQ ID NO: 375802 - DNA, 20 bp, Artificial Sequence
  chemically synthesized
cagctctccttttatatttt

SEQ ID NO: 375803 - DNA, 20 bp, Artificial Sequence
  chemically synthesized
tgaattacccaaaaatataa

SEQ ID NO: 375804 - DNA, 20 bp, Artificial Sequence
  chemically synthesized
gaattacccaaaaatataaa

SEQ ID NO: 375805 - DNA, 20 bp, Artificial Sequence
  chemically synthesized
attacccaaaaatataaaag

SEQ ID NO: 375806 - DNA, 20 bp, Artificial Sequence
  chemically synthesized
tacccaaaaatataaaagga

SEQ ID NO: 375807 - DNA, 20 bp, Artificial Sequence
  chemically synthesized
aaaatataaaaggagagctg

SEQ ID NO: 375808 - DNA, 20 bp, Artificial Sequence
  chemically synthesized
agatttttctagaacaacta

SEQ ID NO: 375809 - DNA, 20 bp, Artificial Sequence
  chemically synthesized
aaggagagctgtagttgttc

SEQ ID NO: 375810 - DNA, 20 bp, Artificial Sequence
  chemically synthesized
tacacgaaggaagatttttc

SEQ ID NO: 375811 - DNA, 20 bp, Artificial Sequence
  chemically synthesized
aacccactcctacacgaagg

SEQ ID NO: 375812 - DNA, 20 bp, Artificial Sequence
  chemically synthesized
tagaaaaatcttccttcgtg

SEQ ID NO: 375813 - DNA, 20 bp, Artificial Sequence
  chemically synthesized
agaaaaatcttccttcgtgt

SEQ ID NO: 375814 - DNA, 20 bp, Artificial Sequence
  chemically synthesized
gcaaacccactcctacacga

SEQ ID NO: 375815 - DNA, 20 bp, Artificial Sequence
  chemically synthesized
aaaaatcttccttcgtgtag

SEQ ID NO: 375816 - DNA, 20 bp, Artificial Sequence
  chemically synthesized
cgcaaacccactcctacacg

SEQ ID NO: 375817 - DNA, 20 bp, Artificial Sequence
  chemically synthesized
aatcttccttcgtgtaggag

SEQ ID NO: 375818 - DNA, 20 bp, Artificial Sequence
  chemically synthesized
atcttccttcgtgtaggagt

SEQ ID NO: 375819 - DNA, 20 bp, Artificial Sequence
  chemically synthesized
ttcgtgtaggagtgggtttg

SEQ ID NO: 375820 - DNA, 20 bp, Artificial Sequence
  chemically synthesized
tcgtgtaggagtgggtttgc

SEQ ID NO: 375821 - DNA, 20 bp, Artificial Sequence
  chemically synthesized
actccaggtgtggattagca

SEQ ID NO: 375822 - DNA, 20 bp, Artificial Sequence
  chemically synthesized
ccaaaactccaggtgtggat

SEQ ID NO: 375823 - DNA, 20 bp, Artificial Sequence
  chemically synthesized
ttactgtgctaatccacacc

SEQ ID NO: 375824 - DNA, 20 bp, Artificial Sequence
  chemically synthesized
actgtgctaatccacacctg

SEQ ID NO: 375825 - DNA, 20 bp, Artificial Sequence
  chemically synthesized
gacgcccaaaactccaggtg

SEQ ID NO: 375826 - DNA, 20 bp, Artificial Sequence
  chemically synthesized
ctaatccacacctggagttt

SEQ ID NO: 375827 - DNA, 20 bp, Artificial Sequence
  chemically synthesized
accttgacgcccaaaactcc

SEQ ID NO: 375828 - DNA, 20 bp, Artificial Sequence
  chemically synthesized
taatccacacctggagtttt

SEQ ID NO: 375829 - DNA, 20 bp, Artificial Sequence
  chemically synthesized
aaccttgacgcccaaaactc

SEQ ID NO: 375830 - DNA, 20 bp, Artificial Sequence
  chemically synthesized
cacctggagttttgggcgtc

SEQ ID NO: 375831 - DNA, 20 bp, Artificial Sequence
  chemically synthesized
acctggagttttgggcgtca

SEQ ID NO: 375832 - DNA, 20 bp, Artificial Sequence
  chemically synthesized
ttttgggcgtcaaggttgat

SEQ ID NO: 375833 - DNA, 20 bp, Artificial Sequence
  chemically synthesized
tttgggcgtcaaggttgata

SEQ ID NO: 375834 - DNA, 20 bp, Artificial Sequence
  chemically synthesized
ttgggcgtcaaggttgataa

SEQ ID NO: 375835 - DNA, 20 bp, Artificial Sequence
  chemically synthesized
cgtcaaggttgataagggtc

SEQ ID NO: 375836 - DNA, 20 bp, Artificial Sequence
  chemically synthesized
gtcaaggttgataagggtca

SEQ ID NO: 375837 - DNA, 20 bp, Artificial Sequence
  chemically synthesized
tcaaggttgataagggtcaa

SEQ ID NO: 375838 - DNA, 20 bp, Artificial Sequence
  chemically synthesized
gttgataagggtcaagggtt

SEQ ID NO: 375839 - DNA, 20 bp, Artificial Sequence
  chemically synthesized
ttgataagggtcaagggttt

SEQ ID NO: 375840 - DNA, 20 bp, Artificial Sequence
  chemically synthesized
agggtcaagggtttgggttt

SEQ ID NO: 375841 - DNA, 20 bp, Artificial Sequence
  chemically synthesized
aagggtttgggttttggctc

SEQ ID NO: 375842 - DNA, 20 bp, Artificial Sequence
  chemically synthesized
tgggttttggctctggcttg

SEQ ID NO: 375843 - DNA, 20 bp, Artificial Sequence
  chemically synthesized
aaacgatcttccacaagcca

SEQ ID NO: 375844 - DNA, 20 bp, Artificial Sequence
  chemically synthesized
gaaaacgatcttccacaagc

SEQ ID NO: 375845 - DNA, 20 bp, Artificial Sequence
  chemically synthesized
gttttggctctggcttgtgg

SEQ ID NO: 375846 - DNA, 20 bp, Artificial Sequence
  chemically synthesized
ctcagaaaacgatcttccac

SEQ ID NO: 375847 - DNA, 20 bp, Artificial Sequence
  chemically synthesized
cttgtggaagatcgttttct

SEQ ID NO: 375848 - DNA, 20 bp, Artificial Sequence
  chemically synthesized
tgtggaagatcgttttctga

SEQ ID NO: 375849 - DNA, 20 bp, Artificial Sequence
  chemically synthesized
ctggtgcccaagaatgctct

SEQ ID NO: 375850 - DNA, 20 bp, Artificial Sequence
  chemically synthesized
tcgttttctgagagcattct

SEQ ID NO: 375851 - DNA, 20 bp, Artificial Sequence
  chemically synthesized
cgttttctgagagcattctt

SEQ ID NO: 375852 - DNA, 20 bp, Artificial Sequence
  chemically synthesized
ctgagagcattcttgggcac

SEQ ID NO: 375853 - DNA, 20 bp, Artificial Sequence
  chemically synthesized
tgtctgaccagctggtgccc

SEQ ID NO: 375854 - DNA, 20 bp, Artificial Sequence
  chemically synthesized
gagcattcttgggcaccagc

SEQ ID NO: 375855 - DNA, 20 bp, Artificial Sequence
  chemically synthesized
attcttgggcaccagctggt

SEQ ID NO: 375856 - DNA, 20 bp, Artificial Sequence
  chemically synthesized
aatgggagtgtctgaccagc

SEQ ID NO: 375857 - DNA, 20 bp, Artificial Sequence
  chemically synthesized
ttggaatgggagtgtctgac

SEQ ID NO: 375858 - DNA, 20 bp, Artificial Sequence
  chemically synthesized
actatgtcccattggaatgg

SEQ ID NO: 375859 - DNA, 20 bp, Artificial Sequence
  chemically synthesized
gtcagacactcccattccaa

SEQ ID NO: 375860 - DNA, 20 bp, Artificial Sequence
  chemically synthesized
aaactatgtcccattggaat

SEQ ID NO: 375861 - DNA, 20 bp, Artificial Sequence
  chemically synthesized
tcagacactcccattccaat

SEQ ID NO: 375862 - DNA, 20 bp, Artificial Sequence
  chemically synthesized
aaaactatgtcccattggaa

SEQ ID NO: 375863 - DNA, 20 bp, Artificial Sequence
  chemically synthesized
tgttgaaaactatgtcccat

SEQ ID NO: 375864 - DNA, 20 bp, Artificial Sequence
  chemically synthesized
actcccattccaatgggaca

SEQ ID NO: 375865 - DNA, 20 bp, Artificial Sequence
  chemically synthesized
caatgggacatagttttcaa

SEQ ID NO: 375866 - DNA, 20 bp, Artificial Sequence
  chemically synthesized
atgggacatagttttcaaca

SEQ ID NO: 375867 - DNA, 20 bp, Artificial Sequence
  chemically synthesized
gggacatagttttcaacaga

SEQ ID NO: 375868 - DNA, 20 bp, Artificial Sequence
  chemically synthesized
ggacatagttttcaacagag

SEQ ID NO: 375869 - DNA, 20 bp, Artificial Sequence
  chemically synthesized
ttcaacagagaggaataatc

SEQ ID NO: 375870 - DNA, 20 bp, Artificial Sequence
  chemically synthesized
tcaacagagaggaataatcc

SEQ ID NO: 375871 - DNA, 20 bp, Artificial Sequence
  chemically synthesized
tgtattgccttatatacacc

SEQ ID NO: 375872 - DNA, 20 bp, Artificial Sequence
  chemically synthesized
ggaataatccaggtgtatat

SEQ ID NO: 375873 - DNA, 20 bp, Artificial Sequence
  chemically synthesized
gaataatccaggtgtatata

SEQ ID NO: 375874 - DNA, 20 bp, Artificial Sequence
  chemically synthesized
aggtgtatataaggcaatac

SEQ ID NO: 375875 - DNA, 20 bp, Artificial Sequence
  chemically synthesized
aaggcaatacaagaaacctt

SEQ ID NO: 375876 - DNA, 20 bp, Artificial Sequence
  chemically synthesized
aggcaatacaagaaaccttg

SEQ ID NO: 375877 - DNA, 20 bp, Artificial Sequence
  chemically synthesized
gctaaggcctggaagcctca

SEQ ID NO: 375878 - DNA, 20 bp, Artificial Sequence
  chemically synthesized
tgctaaggcctggaagcctc

SEQ ID NO: 375879 - DNA, 20 bp, Artificial Sequence
  chemically synthesized
acaagaaaccttgaggcttc

SEQ ID NO: 375880 - DNA, 20 bp, Artificial Sequence
  chemically synthesized
caagaaaccttgaggcttcc

SEQ ID NO: 375881 - DNA, 20 bp, Artificial Sequence
  chemically synthesized
ttcttcttgctaaggcctgg

SEQ ID NO: 375882 - DNA, 20 bp, Artificial Sequence
  chemically synthesized
accttgaggcttccaggcct

SEQ ID NO: 375883 - DNA, 20 bp, Artificial Sequence
  chemically synthesized
caattcttcttgctaaggcc

SEQ ID NO: 375884 - DNA, 20 bp, Artificial Sequence
  chemically synthesized
tgaggcttccaggccttagc

SEQ ID NO: 375885 - DNA, 20 bp, Artificial Sequence
  chemically synthesized
ggcttccaggccttagcaag

SEQ ID NO: 375886 - DNA, 20 bp, Artificial Sequence
  chemically synthesized
cactccaattcttcttgcta

SEQ ID NO: 375887 - DNA, 20 bp, Artificial Sequence
  chemically synthesized
ccactccaattcttcttgct

SEQ ID NO: 375888 - DNA, 20 bp, Artificial Sequence
  chemically synthesized
caggccttagcaagaagaat

SEQ ID NO: 375889 - DNA, 20 bp, Artificial Sequence
  chemically synthesized
ggccttagcaagaagaattg

SEQ ID NO: 375890 - DNA, 20 bp, Artificial Sequence
  chemically synthesized
cttagcaagaagaattggag

SEQ ID NO: 375891 - DNA, 20 bp, Artificial Sequence
  chemically synthesized
agcaagaagaattggagtgg

SEQ ID NO: 375892 - DNA, 20 bp, Artificial Sequence
  chemically synthesized
gaattggagtggaagtttaa

SEQ ID NO: 375893 - DNA, 20 bp, Artificial Sequence
  chemically synthesized
ttggagtggaagtttaaaag

SEQ ID NO: 375894 - DNA, 20 bp, Artificial Sequence
  chemically synthesized
tggaagtttaaaagcagaac

SEQ ID NO: 375895 - DNA, 20 bp, Artificial Sequence
  chemically synthesized
ccctcaattagaaaatgttc

SEQ ID NO: 375896 - DNA, 20 bp, Artificial Sequence
  chemically synthesized
aactggaacattttctaatt

SEQ ID NO: 375897 - DNA, 20 bp, Artificial Sequence
  chemically synthesized
actggaacattttctaattg

SEQ ID NO: 375898 - DNA, 20 bp, Artificial Sequence
  chemically synthesized
ctggaacattttctaattga

SEQ ID NO: 375899 - DNA, 20 bp, Artificial Sequence
  chemically synthesized
ttctctctaccaccctcaat

SEQ ID NO: 375900 - DNA, 20 bp, Artificial Sequence
  chemically synthesized
gaacattttctaattgaggg

SEQ ID NO: 375901 - DNA, 20 bp, Artificial Sequence
  chemically synthesized
cattttctaattgagggtgg

SEQ ID NO: 375902 - DNA, 20 bp, Artificial Sequence
  chemically synthesized
ttttctaattgagggtggta

SEQ ID NO: 375903 - DNA, 20 bp, Artificial Sequence
  chemically synthesized
ttctaattgagggtggtaga

SEQ ID NO: 375904 - DNA, 20 bp, Artificial Sequence
  chemically synthesized
tcagccgaatatataaatat

SEQ ID NO: 375905 - DNA, 20 bp, Artificial Sequence
  chemically synthesized
aattctgatatttatatatt

SEQ ID NO: 375906 - DNA, 20 bp, Artificial Sequence
  chemically synthesized
tgatatttatatattcggct

SEQ ID NO: 375907 - DNA, 20 bp, Artificial Sequence
  chemically synthesized
gatatttatatattcggctg

SEQ ID NO: 375908 - DNA, 20 bp, Artificial Sequence
  chemically synthesized
ttatatattcggctgaggtt

SEQ ID NO: 375909 - DNA, 20 bp, Artificial Sequence
  chemically synthesized
atatattcggctgaggttga

SEQ ID NO: 375910 - DNA, 20 bp, Artificial Sequence
  chemically synthesized
tccttgaaagctctcaacct

SEQ ID NO: 375911 - DNA, 20 bp, Artificial Sequence
  chemically synthesized
ggctgaggttgagagctttc

SEQ ID NO: 375912 - DNA, 20 bp, Artificial Sequence
  chemically synthesized
gctgaggttgagagctttca

SEQ ID NO: 375913 - DNA, 20 bp, Artificial Sequence
  chemically synthesized
agccagctcagcatccttga

SEQ ID NO: 375914 - DNA, 20 bp, Artificial Sequence
  chemically synthesized
tgagagctttcaaggatgct

SEQ ID NO: 375915 - DNA, 20 bp, Artificial Sequence
  chemically synthesized
agctttcaaggatgctgagc

SEQ ID NO: 375916 - DNA, 20 bp, Artificial Sequence
  chemically synthesized
ttccaagccagcagccagct

SEQ ID NO: 375917 - DNA, 20 bp, Artificial Sequence
  chemically synthesized
aaggatgctgagctggctgc

SEQ ID NO: 375918 - DNA, 20 bp, Artificial Sequence
  chemically synthesized
gttcattccaagccagcagc

SEQ ID NO: 375919 - DNA, 20 bp, Artificial Sequence
  chemically synthesized
tgctgagctggctgctggct

SEQ ID NO: 375920 - DNA, 20 bp, Artificial Sequence
  chemically synthesized
acacgttcattccaagccag

SEQ ID NO: 375921 - DNA, 20 bp, Artificial Sequence
  chemically synthesized
cacacacgttcattccaagc

SEQ ID NO: 375922 - DNA, 20 bp, Artificial Sequence
  chemically synthesized
cacacacacacgttcattcc

SEQ ID NO: 375923 - DNA, 20 bp, Artificial Sequence
  chemically synthesized
tgtgtgtgtgtgtgtgtgtg

SEQ ID NO: 375924 - DNA, 20 bp, Artificial Sequence
  chemically synthesized
gtgtgtgtgtgtgtgtagtg

SEQ ID NO: 375925 - DNA, 20 bp, Artificial Sequence
  chemically synthesized
gtgtgtagtgtagtgtaaat

SEQ ID NO: 375926 - DNA, 20 bp, Artificial Sequence
  chemically synthesized
gtgtaaataagcaacattgc

SEQ ID NO: 375927 - DNA, 20 bp, Artificial Sequence
  chemically synthesized
caattataagattacaagac

SEQ ID NO: 375928 - DNA, 20 bp, Artificial Sequence
  chemically synthesized
atgaacaattataagattac

SEQ ID NO: 375929 - DNA, 20 bp, Artificial Sequence
  chemically synthesized
tttctcttatgaacaattat

SEQ ID NO: 375930 - DNA, 20 bp, Artificial Sequence
  chemically synthesized
gtaatcttataattgttcat

SEQ ID NO: 375931 - DNA, 20 bp, Artificial Sequence
  chemically synthesized
aatcttataattgttcataa

SEQ ID NO: 375932 - DNA, 20 bp, Artificial Sequence
  chemically synthesized
attgttcataagagaaaata

SEQ ID NO: 375933 - DNA, 20 bp, Artificial Sequence
  chemically synthesized
tcataagagaaaatacagtc

SEQ ID NO: 375934 - DNA, 20 bp, Artificial Sequence
  chemically synthesized
ataagagaaaatacagtcta

SEQ ID NO: 375935 - DNA, 20 bp, Artificial Sequence
  chemically synthesized
taagagaaaatacagtctag

SEQ ID NO: 375936 - DNA, 20 bp, Artificial Sequence
  chemically synthesized
gagaaaatacagtctagagg

SEQ ID NO: 375937 - DNA, 20 bp, Artificial Sequence
  chemically synthesized
gaaaatacagtctagaggaa

SEQ ID NO: 375938 - DNA, 20 bp, Artificial Sequence
  chemically synthesized
aactagatgatctcttcctc

SEQ ID NO: 375939 - DNA, 20 bp, Artificial Sequence
  chemically synthesized
gtctagaggaagagatcatc

SEQ ID NO: 375940 - DNA, 20 bp, Artificial Sequence
  chemically synthesized
gaagagatcatctagtttac

SEQ ID NO: 375941 - DNA, 20 bp, Artificial Sequence
  chemically synthesized
aagagatcatctagtttact

SEQ ID NO: 375942 - DNA, 20 bp, Artificial Sequence
  chemically synthesized
attactagttcccagtaaac

SEQ ID NO: 375943 - DNA, 20 bp, Artificial Sequence
  chemically synthesized
tcatctagtttactgggaac

SEQ ID NO: 375944 - DNA, 20 bp, Artificial Sequence
  chemically synthesized
agataagcattactagttcc

SEQ ID NO: 375945 - DNA, 20 bp, Artificial Sequence
  chemically synthesized
ctcggcaagataagcattac

SEQ ID NO: 375946 - DNA, 20 bp, Artificial Sequence
  chemically synthesized
catttaaacctcggcaagat

SEQ ID NO: 375947 - DNA, 20 bp, Artificial Sequence
  chemically synthesized
ctagtaatgcttatcttgcc

SEQ ID NO: 375948 - DNA, 20 bp, Artificial Sequence
  chemically synthesized
tagtaatgcttatcttgccg

SEQ ID NO: 375949 - DNA, 20 bp, Artificial Sequence
  chemically synthesized
tcattcatttaaacctcggc

SEQ ID NO: 375950 - DNA, 20 bp, Artificial Sequence
  chemically synthesized
gtgatcattcatttaaacct

SEQ ID NO: 375951 - DNA, 20 bp, Artificial Sequence
  chemically synthesized
gaggtttaaatgaatgatca

SEQ ID NO: 375952 - DNA, 20 bp, Artificial Sequence
  chemically synthesized
atttttcttataagtcatta

SEQ ID NO: 375953 - DNA, 20 bp, Artificial Sequence
  chemically synthesized
tcacggctgtaatgacttat

SEQ ID NO: 375954 - DNA, 20 bp, Artificial Sequence
  chemically synthesized
ttagatttaatttttcttat

SEQ ID NO: 375955 - DNA, 20 bp, Artificial Sequence
  chemically synthesized
ttataagaaaaattaaatct

SEQ ID NO: 375956 - DNA, 20 bp, Artificial Sequence
  chemically synthesized
ataagaaaaattaaatctaa

SEQ ID NO: 375957 - DNA, 20 bp, Artificial Sequence
  chemically synthesized
aaaaattaaatctaagagca

SEQ ID NO: 375958 - DNA, 20 bp, Artificial Sequence
  chemically synthesized
ctgctcagaggctgtgctct

SEQ ID NO: 375959 - DNA, 20 bp, Artificial Sequence
  chemically synthesized
aatctaagagcacagcctct

SEQ ID NO: 375960 - DNA, 20 bp, Artificial Sequence
  chemically synthesized
ctaagagcacagcctctgag

SEQ ID NO: 375961 - DNA, 20 bp, Artificial Sequence
  chemically synthesized
tgtatacagtttctgctcag

SEQ ID NO: 375962 - DNA, 20 bp, Artificial Sequence
  chemically synthesized
ctgtatacagtttctgctca

SEQ ID NO: 375963 - DNA, 20 bp, Artificial Sequence
  chemically synthesized
ctctgtatacagtttctgct

SEQ ID NO: 375964 - DNA, 20 bp, Artificial Sequence
  chemically synthesized
ctctgagcagaaactgtata

SEQ ID NO: 375965 - DNA, 20 bp, Artificial Sequence
  chemically synthesized
ctgagcagaaactgtataca

SEQ ID NO: 375966 - DNA, 20 bp, Artificial Sequence
  chemically synthesized
tgagcagaaactgtatacag

SEQ ID NO: 375967 - DNA, 20 bp, Artificial Sequence
  chemically synthesized
tgtacataaacctctgtata

SEQ ID NO: 375968 - DNA, 20 bp, Artificial Sequence
  chemically synthesized
tatacagaggtttatgtaca

SEQ ID NO: 375969 - DNA, 20 bp, Artificial Sequence
  chemically synthesized
atctaattcttttcatcgca

SEQ ID NO: 375970 - DNA, 20 bp, Artificial Sequence
  chemically synthesized
gtacacagctgtgcgatgaa

SEQ ID NO: 375971 - DNA, 20 bp, Artificial Sequence
  chemically synthesized
agctgtgcgatgaaaagaat

SEQ ID NO: 375972 - DNA, 20 bp, Artificial Sequence
  chemically synthesized
attgcaaaagcatcagggca

SEQ ID NO: 375973 - DNA, 20 bp, Artificial Sequence
  chemically synthesized
cctttattgcaaaagcatca

SEQ ID NO: 375974 - DNA, 20 bp, Artificial Sequence
  chemically synthesized
ccctttattgcaaaagcatc

SEQ ID NO: 375975 - DNA, 20 bp, Artificial Sequence
  chemically synthesized
accctttattgcaaaagcat

SEQ ID NO: 375976 - DNA, 20 bp, Artificial Sequence
  chemically synthesized
ttttgaaccctttattgcaa

SEQ ID NO: 375977 - DNA, 20 bp, Artificial Sequence
  chemically synthesized
gccctgatgcttttgcaata

SEQ ID NO: 375978 - DNA, 20 bp, Artificial Sequence
  chemically synthesized
ccctgatgcttttgcaataa

SEQ ID NO: 375979 - DNA, 20 bp, Artificial Sequence
  chemically synthesized
cctgatgcttttgcaataaa

SEQ ID NO: 375980 - DNA, 20 bp, Artificial Sequence
  chemically synthesized
ataaagggttcaaaaatctg

SEQ ID NO: 375981 - DNA, 20 bp, Artificial Sequence
  chemically synthesized
aaagggttcaaaaatctgtg

SEQ ID NO: 375982 - DNA, 20 bp, Artificial Sequence
  chemically synthesized
aaggagtagggtgttctcca

SEQ ID NO: 375983 - DNA, 20 bp, Artificial Sequence
  chemically synthesized
gtggagaacaccctactcct

SEQ ID NO: 375984 - DNA, 20 bp, Artificial Sequence
  chemically synthesized
ctgggttgtactaaggagta

SEQ ID NO: 375985 - DNA, 20 bp, Artificial Sequence
  chemically synthesized
tctgggttgtactaaggagt

SEQ ID NO: 375986 - DNA, 20 bp, Artificial Sequence
  chemically synthesized
ctctgggttgtactaaggag

SEQ ID NO: 375987 - DNA, 20 bp, Artificial Sequence
  chemically synthesized
ctgctctgggttgtactaag

SEQ ID NO: 375988 - DNA, 20 bp, Artificial Sequence
  chemically synthesized
gactgctctgggttgtacta

SEQ ID NO: 375989 - DNA, 20 bp, Artificial Sequence
  chemically synthesized
agactgctctgggttgtact

SEQ ID NO: 375990 - DNA, 20 bp, Artificial Sequence
  chemically synthesized
ccctactccttagtacaacc

SEQ ID NO: 375991 - DNA, 20 bp, Artificial Sequence
  chemically synthesized
ctactccttagtacaaccca

SEQ ID NO: 375992 - DNA, 20 bp, Artificial Sequence
  chemically synthesized
ctccttagtacaacccagag

SEQ ID NO: 375993 - DNA, 20 bp, Artificial Sequence
  chemically synthesized
aggctacagcagactgctct

SEQ ID NO: 375994 - DNA, 20 bp, Artificial Sequence
  chemically synthesized
caggctacagcagactgctc

SEQ ID NO: 375995 - DNA, 20 bp, Artificial Sequence
  chemically synthesized
caacccagagcagtctgctg

SEQ ID NO: 375996 - DNA, 20 bp, Artificial Sequence
  chemically synthesized
accaattaagcaggctacag

SEQ ID NO: 375997 - DNA, 20 bp, Artificial Sequence
  chemically synthesized
cataccaattaagcaggcta

SEQ ID NO: 375998 - DNA, 20 bp, Artificial Sequence
  chemically synthesized
tctgctgtagcctgcttaat

SEQ ID NO: 375999 - DNA, 20 bp, Artificial Sequence
  chemically synthesized
tcatagcataccaattaagc

SEQ ID NO: 376000 - DNA, 20 bp, Artificial Sequence
  chemically synthesized
atcatagcataccaattaag

SEQ ID NO: 376001 - DNA, 20 bp, Artificial Sequence
  chemically synthesized
ttgatcatagcataccaatt

SEQ ID NO: 376002 - DNA, 20 bp, Artificial Sequence
  chemically synthesized
aatcaagagggatttgatca

SEQ ID NO: 376003 - DNA, 20 bp, Artificial Sequence
  chemically synthesized
ccctaggggtgtaatcaaga

SEQ ID NO: 376004 - DNA, 20 bp, Artificial Sequence
  chemically synthesized
accctaggggtgtaatcaag

SEQ ID NO: 376005 - DNA, 20 bp, Artificial Sequence
  chemically synthesized
taccctaggggtgtaatcaa

SEQ ID NO: 376006 - DNA, 20 bp, Artificial Sequence
  chemically synthesized
tataccctaggggtgtaatc

SEQ ID NO: 376007 - DNA, 20 bp, Artificial Sequence
  chemically synthesized
atccctcttgattacacccc

SEQ ID NO: 376008 - DNA, 20 bp, Artificial Sequence
  chemically synthesized
tccctcttgattacacccct

SEQ ID NO: 376009 - DNA, 20 bp, Artificial Sequence
  chemically synthesized
ccctcttgattacaccccta

SEQ ID NO: 376010 - DNA, 20 bp, Artificial Sequence
  chemically synthesized
tgcctcctattataccctag

SEQ ID NO: 376011 - DNA, 20 bp, Artificial Sequence
  chemically synthesized
ctgcctcctattatacccta

SEQ ID NO: 376012 - DNA, 20 bp, Artificial Sequence
  chemically synthesized
cctgcctcctattataccct

SEQ ID NO: 376013 - DNA, 20 bp, Artificial Sequence
  chemically synthesized
acctgcctcctattataccc

SEQ ID NO: 376014 - DNA, 20 bp, Artificial Sequence
  chemically synthesized
attacacccctagggtataa

SEQ ID NO: 376015 - DNA, 20 bp, Artificial Sequence
  chemically synthesized
ttacacccctagggtataat

SEQ ID NO: 376016 - DNA, 20 bp, Artificial Sequence
  chemically synthesized
acacccctagggtataatag

SEQ ID NO: 376017 - DNA, 20 bp, Artificial Sequence
  chemically synthesized
cacccctagggtataatagg

SEQ ID NO: 376018 - DNA, 20 bp, Artificial Sequence
  chemically synthesized
ccctagggtataataggagg

SEQ ID NO: 376019 - DNA, 20 bp, Artificial Sequence
  chemically synthesized
cctagggtataataggaggc

SEQ ID NO: 376020 - DNA, 20 bp, Artificial Sequence
  chemically synthesized
ctgtatgatgaaaggcgtta

SEQ ID NO: 376021 - DNA, 20 bp, Artificial Sequence
  chemically synthesized
tttactttctgtatgatgaa

SEQ ID NO: 376022 - DNA, 20 bp, Artificial Sequence
  chemically synthesized
gtttactttctgtatgatga

SEQ ID NO: 376023 - DNA, 20 bp, Artificial Sequence
  chemically synthesized
ctttaacgcctttcatcata

SEQ ID NO: 376024 - DNA, 20 bp, Artificial Sequence
  chemically synthesized
aacgcctttcatcatacaga

SEQ ID NO: 376025 - DNA, 20 bp, Artificial Sequence
  chemically synthesized
acagaaagtaaactgcttta

SEQ ID NO: 376026 - DNA, 20 bp, Artificial Sequence
  chemically synthesized
ggctatttttatccataaag

SEQ ID NO: 376027 - DNA, 20 bp, Artificial Sequence
  chemically synthesized
catggctatttttatccata

SEQ ID NO: 376028 - DNA, 20 bp, Artificial Sequence
  chemically synthesized
aactgctttatggataaaaa

SEQ ID NO: 376029 - DNA, 20 bp, Artificial Sequence
  chemically synthesized
tggataaaaatagccatgta

SEQ ID NO: 376030 - DNA, 20 bp, Artificial Sequence
  chemically synthesized
gtcaatagtgagtctgtaca

SEQ ID NO: 376031 - DNA, 20 bp, Artificial Sequence
  chemically synthesized
gggtggctggtgtcaatagt

SEQ ID NO: 376032 - DNA, 20 bp, Artificial Sequence
  chemically synthesized
tacagactcactattgacac

SEQ ID NO: 376033 - DNA, 20 bp, Artificial Sequence
  chemically synthesized
ccaggggtggctggtgtcaa

SEQ ID NO: 376034 - DNA, 20 bp, Artificial Sequence
  chemically synthesized
ttgaagtcaccaggggtggc

SEQ ID NO: 376035 - DNA, 20 bp, Artificial Sequence
  chemically synthesized
ctattgacaccagccacccc

SEQ ID NO: 376036 - DNA, 20 bp, Artificial Sequence
  chemically synthesized
agccttgaagtcaccagggg

SEQ ID NO: 376037 - DNA, 20 bp, Artificial Sequence
  chemically synthesized
atgagccttgaagtcaccag

SEQ ID NO: 376038 - DNA, 20 bp, Artificial Sequence
  chemically synthesized
gatgagccttgaagtcacca

SEQ ID NO: 376039 - DNA, 20 bp, Artificial Sequence
  chemically synthesized
tgatgagccttgaagtcacc

SEQ ID NO: 376040 - DNA, 20 bp, Artificial Sequence
  chemically synthesized
ctgatgagccttgaagtcac

SEQ ID NO: 376041 - DNA, 20 bp, Artificial Sequence
  chemically synthesized
cagccacccctggtgacttc

SEQ ID NO: 376042 - DNA, 20 bp, Artificial Sequence
  chemically synthesized
agccacccctggtgacttca

SEQ ID NO: 376043 - DNA, 20 bp, Artificial Sequence
  chemically synthesized
tgcattgctgatgagccttg

SEQ ID NO: 376044 - DNA, 20 bp, Artificial Sequence
  chemically synthesized
ctggtgacttcaaggctcat

SEQ ID NO: 376045 - DNA, 20 bp, Artificial Sequence
  chemically synthesized
aacagttgtgcattgctgat

SEQ ID NO: 376046 - DNA, 20 bp, Artificial Sequence
  chemically synthesized
ctctttgctttattttaaaa

SEQ ID NO: 376047 - DNA, 20 bp, Artificial Sequence
  chemically synthesized
tgcacaactgttttaaaata

SEQ ID NO: 376048 - DNA, 20 bp, Artificial Sequence
  chemically synthesized
aactgttttaaaataaagca

SEQ ID NO: 376049 - DNA, 20 bp, Artificial Sequence
  chemically synthesized
ctgttttaaaataaagcaaa

SEQ ID NO: 376050 - DNA, 20 bp, Artificial Sequence
  chemically synthesized
ataaagcaaagagtcacatg

SEQ ID NO: 376051 - DNA, 20 bp, Artificial Sequence
  chemically synthesized
caaagagtcacatgtagaat

SEQ ID NO: 376052 - DNA, 20 bp, Artificial Sequence
  chemically synthesized
cacatgtagaattggaatta

SEQ ID NO: 376053 - DNA, 20 bp, Artificial Sequence
  chemically synthesized
acatgtagaattggaattac

SEQ ID NO: 376054 - DNA, 20 bp, Artificial Sequence
  chemically synthesized
attggaattacaggaataat

SEQ ID NO: 376055 - DNA, 20 bp, Artificial Sequence
  chemically synthesized
ggaattacaggaataatgag

SEQ ID NO: 376056 - DNA, 20 bp, Artificial Sequence
  chemically synthesized
caggaataatgagaagtaaa

SEQ ID NO: 376057 - DNA, 20 bp, Artificial Sequence
  chemically synthesized
aataatgagaagtaaacaga

SEQ ID NO: 376058 - DNA, 20 bp, Artificial Sequence
  chemically synthesized
taatgagaagtaaacagaaa

SEQ ID NO: 376059 - DNA, 20 bp, Artificial Sequence
  chemically synthesized
aatgagaagtaaacagaaag

SEQ ID NO: 376060 - DNA, 20 bp, Artificial Sequence
  chemically synthesized
ggttagccctcaaggcaacg

SEQ ID NO: 376061 - DNA, 20 bp, Artificial Sequence
  chemically synthesized
gaaagaggccacgttgcctt

SEQ ID NO: 376062 - DNA, 20 bp, Artificial Sequence
  chemically synthesized
aaagaggccacgttgccttg

SEQ ID NO: 376063 - DNA, 20 bp, Artificial Sequence
  chemically synthesized
aagaggccacgttgccttga

SEQ ID NO: 376064 - DNA, 20 bp, Artificial Sequence
  chemically synthesized
aatctataggttagccctca

SEQ ID NO: 376065 - DNA, 20 bp, Artificial Sequence
  chemically synthesized
taatctataggttagccctc

SEQ ID NO: 376066 - DNA, 20 bp, Artificial Sequence
  chemically synthesized
ttgccttgagggctaaccta

SEQ ID NO: 376067 - DNA, 20 bp, Artificial Sequence
  chemically synthesized
tttttttctaatctataggt

SEQ ID NO: 376068 - DNA, 20 bp, Artificial Sequence
  chemically synthesized
ttgagggctaacctatagat

SEQ ID NO: 376069 - DNA, 20 bp, Artificial Sequence
  chemically synthesized
ccgatttttttctaatctat

SEQ ID NO: 376070 - DNA, 20 bp, Artificial Sequence
  chemically synthesized
cccgatttttttctaatcta

SEQ ID NO: 376071 - DNA, 20 bp, Artificial Sequence
  chemically synthesized
cctatagattagaaaaaaat

SEQ ID NO: 376072 - DNA, 20 bp, Artificial Sequence
  chemically synthesized
ctatagattagaaaaaaatc

SEQ ID NO: 376073 - DNA, 20 bp, Artificial Sequence
  chemically synthesized
tatagattagaaaaaaatcg

SEQ ID NO: 376074 - DNA, 20 bp, Artificial Sequence
  chemically synthesized
gaaaaaaatcggggccctaa

SEQ ID NO: 376075 - DNA, 20 bp, Artificial Sequence
  chemically synthesized
catcagtagtgtgtctttta

SEQ ID NO: 376076 - DNA, 20 bp, Artificial Sequence
  chemically synthesized
ccatcagtagtgtgtctttt

SEQ ID NO: 376077 - DNA, 20 bp, Artificial Sequence
  chemically synthesized
cccatcagtagtgtgtcttt

SEQ ID NO: 376078 - DNA, 20 bp, Artificial Sequence
  chemically synthesized
cctaaaagacacactactga

SEQ ID NO: 376079 - DNA, 20 bp, Artificial Sequence
  chemically synthesized
ctaaaagacacactactgat

SEQ ID NO: 376080 - DNA, 20 bp, Artificial Sequence
  chemically synthesized
taaaagacacactactgatg

SEQ ID NO: 376081 - DNA, 20 bp, Artificial Sequence
  chemically synthesized
ctatccctagaccccatcag

SEQ ID NO: 376082 - DNA, 20 bp, Artificial Sequence
  chemically synthesized
gctctatccctagaccccat

SEQ ID NO: 376083 - DNA, 20 bp, Artificial Sequence
  chemically synthesized
gacacactactgatggggtc

SEQ ID NO: 376084 - DNA, 20 bp, Artificial Sequence
  chemically synthesized
acacactactgatggggtct

SEQ ID NO: 376085 - DNA, 20 bp, Artificial Sequence
  chemically synthesized
cacactactgatggggtcta

SEQ ID NO: 376086 - DNA, 20 bp, Artificial Sequence
  chemically synthesized
ctactgatggggtctaggga

SEQ ID NO: 376087 - DNA, 20 bp, Artificial Sequence
  chemically synthesized
actgatggggtctagggata

SEQ ID NO: 376088 - DNA, 20 bp, Artificial Sequence
  chemically synthesized
tttaaaaatagctctatccc

SEQ ID NO: 376089 - DNA, 20 bp, Artificial Sequence
  chemically synthesized
tagggatagagctattttta

SEQ ID NO: 376090 - DNA, 20 bp, Artificial Sequence
  chemically synthesized
tgttaccactgctttaaaaa

SEQ ID NO: 376091 - DNA, 20 bp, Artificial Sequence
  chemically synthesized
ggatagagctatttttaaag

SEQ ID NO: 376092 - DNA, 20 bp, Artificial Sequence
  chemically synthesized
tagagctatttttaaagcag

SEQ ID NO: 376093 - DNA, 20 bp, Artificial Sequence
  chemically synthesized
agcagtggtaacaaaacaat

SEQ ID NO: 376094 - DNA, 20 bp, Artificial Sequence
  chemically synthesized
attggtgtcacgtaacactc

SEQ ID NO: 376095 - DNA, 20 bp, Artificial Sequence
  chemically synthesized
gtgaattatcttagttactg

SEQ ID NO: 376096 - DNA, 20 bp, Artificial Sequence
  chemically synthesized
cacgtaacactccagtaact

SEQ ID NO: 376097 - DNA, 20 bp, Artificial Sequence
  chemically synthesized
aagtgaattatcttagttac

SEQ ID NO: 376098 - DNA, 20 bp, Artificial Sequence
  chemically synthesized
tgcagtcaagtgaattatct

SEQ ID NO: 376099 - DNA, 20 bp, Artificial Sequence
  chemically synthesized
aagataattcacttgactgc

SEQ ID NO: 376100 - DNA, 20 bp, Artificial Sequence
  chemically synthesized
attttgcttgtcttgcagtc

SEQ ID NO: 376101 - DNA, 20 bp, Artificial Sequence
  chemically synthesized
aattcacttgactgcaagac

SEQ ID NO: 376102 - DNA, 20 bp, Artificial Sequence
  chemically synthesized
cctatattttgcttgtcttg

SEQ ID NO: 376103 - DNA, 20 bp, Artificial Sequence
  chemically synthesized
actgcaagacaagcaaaata

SEQ ID NO: 376104 - DNA, 20 bp, Artificial Sequence
  chemically synthesized
ctgcaagacaagcaaaatat

SEQ ID NO: 376105 - DNA, 20 bp, Artificial Sequence
  chemically synthesized
taaatgtgcaactatgtctc

SEQ ID NO: 376106 - DNA, 20 bp, Artificial Sequence
  chemically synthesized
aaatgtgcaactatgtctca

SEQ ID NO: 376107 - DNA, 20 bp, Artificial Sequence
  chemically synthesized
acttgggtaaccttgagaca

SEQ ID NO: 376108 - DNA, 20 bp, Artificial Sequence
  chemically synthesized
attttaacttgggtaacctt

SEQ ID NO: 376109 - DNA, 20 bp, Artificial Sequence
  chemically synthesized
actatgtctcaaggttaccc

SEQ ID NO: 376110 - DNA, 20 bp, Artificial Sequence
  chemically synthesized
gttgctccaaattttaactt

SEQ ID NO: 376111 - DNA, 20 bp, Artificial Sequence
  chemically synthesized
agttgctccaaattttaact

SEQ ID NO: 376112 - DNA, 20 bp, Artificial Sequence
  chemically synthesized
aggttacccaagttaaaatt

SEQ ID NO: 376113 - DNA, 20 bp, Artificial Sequence
  chemically synthesized
gttacccaagttaaaatttg

SEQ ID NO: 376114 - DNA, 20 bp, Artificial Sequence
  chemically synthesized
attgtaaaatgagacatgtt

SEQ ID NO: 376115 - DNA, 20 bp, Artificial Sequence
  chemically synthesized
tcattttgtcattgtaaaat

SEQ ID NO: 376116 - DNA, 20 bp, Artificial Sequence
  chemically synthesized
acaatgacaaaatgaacact

SEQ ID NO: 376117 - DNA, 20 bp, Artificial Sequence
  chemically synthesized
tcttaaacacagtgaaaact

SEQ ID NO: 376118 - DNA, 20 bp, Artificial Sequence
  chemically synthesized
acttagttttcactgtgttt

SEQ ID NO: 376119 - DNA, 20 bp, Artificial Sequence
  chemically synthesized
aaagacacttttcttaaaca

SEQ ID NO: 376120 - DNA, 20 bp, Artificial Sequence
  chemically synthesized
gttttcactgtgtttaagaa

SEQ ID NO: 376121 - DNA, 20 bp, Artificial Sequence
  chemically synthesized
ataatgcatttaatgtggca

SEQ ID NO: 376122 - DNA, 20 bp, Artificial Sequence
  chemically synthesized
tcctgataatgcatttaatg

SEQ ID NO: 376123 - DNA, 20 bp, Artificial Sequence
  chemically synthesized
tgccacattaaatgcattat

SEQ ID NO: 376124 - DNA, 20 bp, Artificial Sequence
  chemically synthesized
gccacattaaatgcattatc

SEQ ID NO: 376125 - DNA, 20 bp, Artificial Sequence
  chemically synthesized
cacattaaatgcattatcag

SEQ ID NO: 376126 - DNA, 20 bp, Artificial Sequence
  chemically synthesized
caggagatacattattatca

SEQ ID NO: 376127 - DNA, 20 bp, Artificial Sequence
  chemically synthesized
tacattattatcacagctgc

SEQ ID NO: 376128 - DNA, 20 bp, Artificial Sequence
  chemically synthesized
acattattatcacagctgca

SEQ ID NO: 376129 - DNA, 20 bp, Artificial Sequence
  chemically synthesized
tctgaaaaatattttccttg

SEQ ID NO: 376130 - DNA, 20 bp, Artificial Sequence
  chemically synthesized
gctgcaaggaaaatattttt

SEQ ID NO: 376131 - DNA, 20 bp, Artificial Sequence
  chemically synthesized
gaaaatatttttcagattca

SEQ ID NO: 376132 - DNA, 20 bp, Artificial Sequence
  chemically synthesized
tcaaagattcaacaacactg

SEQ ID NO: 376133 - DNA, 20 bp, Artificial Sequence
  chemically synthesized
ttcaacaacactgtggtacg

SEQ ID NO: 376134 - DNA, 20 bp, Artificial Sequence
  chemically synthesized
aattcaagttctgcgtacca

SEQ ID NO: 376135 - DNA, 20 bp, Artificial Sequence
  chemically synthesized
ttttcatctgacagcaattc

SEQ ID NO: 376136 - DNA, 20 bp, Artificial Sequence
  chemically synthesized
cgcagaacttgaattgctgt

SEQ ID NO: 376137 - DNA, 20 bp, Artificial Sequence
  chemically synthesized
acgtttaacttttcatctga

SEQ ID NO: 376138 - DNA, 20 bp, Artificial Sequence
  chemically synthesized
ttgaattgctgtcagatgaa

SEQ ID NO: 376139 - DNA, 20 bp, Artificial Sequence
  chemically synthesized
tcagatgaaaagttaaacgt

SEQ ID NO: 376140 - DNA, 20 bp, Artificial Sequence
  chemically synthesized
caattgaaacaacaaatatt

SEQ ID NO: 376141 - DNA, 20 bp, Artificial Sequence
  chemically synthesized
aattgaaacaacaaatattc

SEQ ID NO: 376142 - DNA, 20 bp, Artificial Sequence
  chemically synthesized
aacaacaaatattcaggaca

SEQ ID NO: 376143 - DNA, 20 bp, Artificial Sequence
  chemically synthesized
tattcaggacaaagtgttta

SEQ ID NO: 376144 - DNA, 20 bp, Artificial Sequence
  chemically synthesized
gtgaaaaccctcaaaagaaa

SEQ ID NO: 376145 - DNA, 20 bp, Artificial Sequence
  chemically synthesized
tgtttatagccctttctttt

SEQ ID NO: 376146 - DNA, 20 bp, Artificial Sequence
  chemically synthesized
tgtgaaaaccctcaaaagaa

SEQ ID NO: 376147 - DNA, 20 bp, Artificial Sequence
  chemically synthesized
gtttatagccctttcttttg

SEQ ID NO: 376148 - DNA, 20 bp, Artificial Sequence
  chemically synthesized
atgtgaaaaccctcaaaaga

SEQ ID NO: 376149 - DNA, 20 bp, Artificial Sequence
  chemically synthesized
tttatagccctttcttttga

SEQ ID NO: 376150 - DNA, 20 bp, Artificial Sequence
  chemically synthesized
ctcaatgtgaaaaccctcaa

SEQ ID NO: 376151 - DNA, 20 bp, Artificial Sequence
  chemically synthesized
cttttgagggttttcacatt

SEQ ID NO: 376152 - DNA, 20 bp, Artificial Sequence
  chemically synthesized
ttttgagggttttcacattg

SEQ ID NO: 376153 - DNA, 20 bp, Artificial Sequence
  chemically synthesized
tgagggttttcacattgagg

SEQ ID NO: 376154 - DNA, 20 bp, Artificial Sequence
  chemically synthesized
gtatcactggagaagataaa

SEQ ID NO: 376155 - DNA, 20 bp, Artificial Sequence
  chemically synthesized
agtatgctttttatcttctc

SEQ ID NO: 376156 - DNA, 20 bp, Artificial Sequence
  chemically synthesized
atgttaaagtatcactggag

SEQ ID NO: 376157 - DNA, 20 bp, Artificial Sequence
  chemically synthesized
cccatgttaaagtatcactg

SEQ ID NO: 376158 - DNA, 20 bp, Artificial Sequence
  chemically synthesized
ggcccatgttaaagtatcac

SEQ ID NO: 376159 - DNA, 20 bp, Artificial Sequence
  chemically synthesized
tctccagtgatactttaaca

SEQ ID NO: 376160 - DNA, 20 bp, Artificial Sequence
  chemically synthesized
ctccagtgatactttaacat

SEQ ID NO: 376161 - DNA, 20 bp, Artificial Sequence
  chemically synthesized
gtgcttgaaggcccatgtta

SEQ ID NO: 376162 - DNA, 20 bp, Artificial Sequence
  chemically synthesized
atactttaacatgggccttc

SEQ ID NO: 376163 - DNA, 20 bp, Artificial Sequence
  chemically synthesized
gctgttattcaggtgcttga

SEQ ID NO: 376164 - DNA, 20 bp, Artificial Sequence
  chemically synthesized
tgctgttattcaggtgcttg

SEQ ID NO: 376165 - DNA, 20 bp, Artificial Sequence
  chemically synthesized
gccttcaagcacctgaataa

SEQ ID NO: 376166 - DNA, 20 bp, Artificial Sequence
  chemically synthesized
ttttgtaattgctgttattc

SEQ ID NO: 376167 - DNA, 20 bp, Artificial Sequence
  chemically synthesized
tttttgtaattgctgttatt

SEQ ID NO: 376168 - DNA, 20 bp, Artificial Sequence
  chemically synthesized
atatttttttcatcaacgac

SEQ ID NO: 376169 - DNA, 20 bp, Artificial Sequence
  chemically synthesized
tatttttttcatcaacgact

SEQ ID NO: 376170 - DNA, 20 bp, Artificial Sequence
  chemically synthesized
aaaaaaacgcataaaatgcc

SEQ ID NO: 376171 - DNA, 20 bp, Artificial Sequence
  chemically synthesized
attttaagggcatatttaat

SEQ ID NO: 376172 - DNA, 20 bp, Artificial Sequence
  chemically synthesized
gattttaagggcatatttaa

SEQ ID NO: 376173 - DNA, 20 bp, Artificial Sequence
  chemically synthesized
aggaacaagcacgattttaa

SEQ ID NO: 376174 - DNA, 20 bp, Artificial Sequence
  chemically synthesized
gaggaacaagcacgatttta

SEQ ID NO: 376175 - DNA, 20 bp, Artificial Sequence
  chemically synthesized
tgaggaacaagcacgatttt

SEQ ID NO: 376176 - DNA, 20 bp, Artificial Sequence
  chemically synthesized
ttaaaatcgtgcttgttcct

SEQ ID NO: 376177 - DNA, 20 bp, Artificial Sequence
  chemically synthesized
taataagtagactgaggaac

SEQ ID NO: 376178 - DNA, 20 bp, Artificial Sequence
  chemically synthesized
aacttctaataagtagactg

SEQ ID NO: 376179 - DNA, 20 bp, Artificial Sequence
  chemically synthesized
gaacttctaataagtagact

SEQ ID NO: 376180 - DNA, 20 bp, Artificial Sequence
  chemically synthesized
ttgttcctcagtctacttat

SEQ ID NO: 376181 - DNA, 20 bp, Artificial Sequence
  chemically synthesized
tgttttgaacttctaataag

SEQ ID NO: 376182 - DNA, 20 bp, Artificial Sequence
  chemically synthesized
ttcctcagtctacttattag

SEQ ID NO: 376183 - DNA, 20 bp, Artificial Sequence
  chemically synthesized
ccttgttttgaacttctaat

SEQ ID NO: 376184 - DNA, 20 bp, Artificial Sequence
  chemically synthesized
acttattagaagttcaaaac

SEQ ID NO: 376185 - DNA, 20 bp, Artificial Sequence
  chemically synthesized
cttattagaagttcaaaaca

SEQ ID NO: 376186 - DNA, 20 bp, Artificial Sequence
  chemically synthesized
agaagttcaaaacaaggctt

SEQ ID NO: 376187 - DNA, 20 bp, Artificial Sequence
  chemically synthesized
cagaaactggatttgaacca

SEQ ID NO: 376188 - DNA, 20 bp, Artificial Sequence
  chemically synthesized
acaaggctttggttcaaatc

SEQ ID NO: 376189 - DNA, 20 bp, Artificial Sequence
  chemically synthesized
ttggttcaaatccagtttct

SEQ ID NO: 376190 - DNA, 20 bp, Artificial Sequence
  chemically synthesized
aagaaatttatctcagaaac

SEQ ID NO: 376191 - DNA, 20 bp, Artificial Sequence
  chemically synthesized
atgaattaagaaatttatct

SEQ ID NO: 376192 - DNA, 20 bp, Artificial Sequence
  chemically synthesized
aatattttttacaatgaatt

SEQ ID NO: 376193 - DNA, 20 bp, Artificial Sequence
  chemically synthesized
ttcattgtaaaaaatattaa

SEQ ID NO: 376194 - DNA, 20 bp, Artificial Sequence
  chemically synthesized
ttctaaaaacattaaaattt

SEQ ID NO: 376195 - DNA, 20 bp, Artificial Sequence
  chemically synthesized
gaccaaaattttaatgtttt

SEQ ID NO: 376196 - DNA, 20 bp, Artificial Sequence
  chemically synthesized
aatgtttttagaaaacatca

SEQ ID NO: 376197 - DNA, 20 bp, Artificial Sequence
  chemically synthesized
atgtttttagaaaacatcac

SEQ ID NO: 376198 - DNA, 20 bp, Artificial Sequence
  chemically synthesized
tagaaaacatcacaggtaat

SEQ ID NO: 376199 - DNA, 20 bp, Artificial Sequence
  chemically synthesized
tcacaggtaatcagaacaaa

SEQ ID NO: 376200 - DNA, 20 bp, Artificial Sequence
  chemically synthesized
cacaggtaatcagaacaaac

SEQ ID NO: 376201 - DNA, 20 bp, Artificial Sequence
  chemically synthesized
tcagaacaaacaggaataaa

SEQ ID NO: 376202 - DNA, 20 bp, Artificial Sequence
  chemically synthesized
aaacaggaataaaaagaaca

SEQ ID NO: 376203 - DNA, 20 bp, Artificial Sequence
  chemically synthesized
acaggaataaaaagaacaaa

SEQ ID NO: 376204 - DNA, 20 bp, Artificial Sequence
  chemically synthesized
aataaaaagaacaaagagta

SEQ ID NO: 376205 - DNA, 20 bp, Artificial Sequence
  chemically synthesized
ataaaaagaacaaagagtaa

SEQ ID NO: 376206 - DNA, 20 bp, Artificial Sequence
  chemically synthesized
aaaagaacaaagagtaaagg

SEQ ID NO: 376207 - DNA, 20 bp, Artificial Sequence
  chemically synthesized
aaagaacaaagagtaaagga

SEQ ID NO: 376208 - DNA, 20 bp, Artificial Sequence
  chemically synthesized
agaacaaagagtaaaggaag

SEQ ID NO: 376209 - DNA, 20 bp, Artificial Sequence
  chemically synthesized
acaaagagtaaaggaaggag

SEQ ID NO: 376210 - DNA, 20 bp, Artificial Sequence
  chemically synthesized
caaagagtaaaggaaggaga

SEQ ID NO: 376211 - DNA, 20 bp, Artificial Sequence
  chemically synthesized
agagtaaaggaaggagaagg

SEQ ID NO: 376212 - DNA, 20 bp, Artificial Sequence
  chemically synthesized
gagtaaaggaaggagaagga

SEQ ID NO: 376213 - DNA, 20 bp, Artificial Sequence
  chemically synthesized
taaaggaaggagaaggaagg

SEQ ID NO: 376214 - DNA, 20 bp, Artificial Sequence
  chemically synthesized
aggaaggagaaggaaggaag

SEQ ID NO: 376215 - DNA, 20 bp, Artificial Sequence
  chemically synthesized
ggaaggagaaggaaggaaga

SEQ ID NO: 376216 - DNA, 20 bp, Artificial Sequence
  chemically synthesized
ggagaaggaaggaagaagga

SEQ ID NO: 376217 - DNA, 20 bp, Artificial Sequence
  chemically synthesized
gagaaggaaggaagaaggaa

SEQ ID NO: 376218 - DNA, 20 bp, Artificial Sequence
  chemically synthesized
agaaggaaggaagaaggaaa

SEQ ID NO: 376219 - DNA, 20 bp, Artificial Sequence
  chemically synthesized
gaaggaaggaagaaggaaag

SEQ ID NO: 376220 - DNA, 20 bp, Artificial Sequence
  chemically synthesized
aagaaggaaaggggaaatat

SEQ ID NO: 376221 - DNA, 20 bp, Artificial Sequence
  chemically synthesized
agaaggaaaggggaaatata

SEQ ID NO: 376222 - DNA, 20 bp, Artificial Sequence
  chemically synthesized
aaggaaaggggaaatataag

SEQ ID NO: 376223 - DNA, 20 bp, Artificial Sequence
  chemically synthesized
aggaaaggggaaatataagg

SEQ ID NO: 376224 - DNA, 20 bp, Artificial Sequence
  chemically synthesized
gaaaggggaaatataaggag

SEQ ID NO: 376225 - DNA, 20 bp, Artificial Sequence
  chemically synthesized
aggggaaatataaggaggag

SEQ ID NO: 376226 - DNA, 20 bp, Artificial Sequence
  chemically synthesized
gggaaatataaggaggagta

SEQ ID NO: 376227 - DNA, 20 bp, Artificial Sequence
  chemically synthesized
ataaggaggagtagagaatg

SEQ ID NO: 376228 - DNA, 20 bp, Artificial Sequence
  chemically synthesized
aaggaggagtagagaatgaa

SEQ ID NO: 376229 - DNA, 20 bp, Artificial Sequence
  chemically synthesized
aggaggagtagagaatgaag

SEQ ID NO: 376230 - DNA, 20 bp, Artificial Sequence
  chemically synthesized
gagtagagaatgaagaggtg

SEQ ID NO: 376231 - DNA, 20 bp, Artificial Sequence
  chemically synthesized
agtagagaatgaagaggtga

SEQ ID NO: 376232 - DNA, 20 bp, Artificial Sequence
  chemically synthesized
gtagagaatgaagaggtgaa

SEQ ID NO: 376233 - DNA, 20 bp, Artificial Sequence
  chemically synthesized
gaatgaagaggtgaagggaa

SEQ ID NO: 376234 - DNA, 20 bp, Artificial Sequence
  chemically synthesized
ttatctgaaaataaaaatca

SEQ ID NO: 376235 - DNA, 20 bp, Artificial Sequence
  chemically synthesized
aaagctgtgatttttatttt

SEQ ID NO: 376236 - DNA, 20 bp, Artificial Sequence
  chemically synthesized
gtgatttttattttcagata

SEQ ID NO: 376237 - DNA, 20 bp, Artificial Sequence
  chemically synthesized
ttttattttcagataaagca

SEQ ID NO: 376238 - DNA, 20 bp, Artificial Sequence
  chemically synthesized
tttattttcagataaagcac

SEQ ID NO: 376239 - DNA, 20 bp, Artificial Sequence
  chemically synthesized
attttcagataaagcacagg

SEQ ID NO: 376240 - DNA, 20 bp, Artificial Sequence
  chemically synthesized
tttcagataaagcacaggta

SEQ ID NO: 376241 - DNA, 20 bp, Artificial Sequence
  chemically synthesized
gtagagaaaatctatgacat

SEQ ID NO: 376242 - DNA, 20 bp, Artificial Sequence
  chemically synthesized
tagagaaaatctatgacatt

SEQ ID NO: 376243 - DNA, 20 bp, Artificial Sequence
  chemically synthesized
gaaagactctcctaatgtca

SEQ ID NO: 376244 - DNA, 20 bp, Artificial Sequence
  chemically synthesized
gagaaaatctatgacattag

SEQ ID NO: 376245 - DNA, 20 bp, Artificial Sequence
  chemically synthesized
gaaaatctatgacattagga

SEQ ID NO: 376246 - DNA, 20 bp, Artificial Sequence
  chemically synthesized
actatgaggtttttaaatga

SEQ ID NO: 376247 - DNA, 20 bp, Artificial Sequence
  chemically synthesized
tctttcatttaaaaacctca

SEQ ID NO: 376248 - DNA, 20 bp, Artificial Sequence
  chemically synthesized
ccctcctacctaaaactatg

SEQ ID NO: 376249 - DNA, 20 bp, Artificial Sequence
  chemically synthesized
atttaaaaacctcatagttt

SEQ ID NO: 376250 - DNA, 20 bp, Artificial Sequence
  chemically synthesized
accctcctacctaaaactat

SEQ ID NO: 376251 - DNA, 20 bp, Artificial Sequence
  chemically synthesized
tttaaaaacctcatagtttt

SEQ ID NO: 376252 - DNA, 20 bp, Artificial Sequence
  chemically synthesized
aaaaacctcatagttttagg

SEQ ID NO: 376253 - DNA, 20 bp, Artificial Sequence
  chemically synthesized
aaaacctcatagttttaggt

SEQ ID NO: 376254 - DNA, 20 bp, Artificial Sequence
  chemically synthesized
aacctcatagttttaggtag

SEQ ID NO: 376255 - DNA, 20 bp, Artificial Sequence
  chemically synthesized
acctcatagttttaggtagg

SEQ ID NO: 376256 - DNA, 20 bp, Artificial Sequence
  chemically synthesized
cctcatagttttaggtagga

SEQ ID NO: 376257 - DNA, 20 bp, Artificial Sequence
  chemically synthesized
ttaggtaggagggttcttat

SEQ ID NO: 376258 - DNA, 20 bp, Artificial Sequence
  chemically synthesized
ggtaggagggttcttattgg

SEQ ID NO: 376259 - DNA, 20 bp, Artificial Sequence
  chemically synthesized
gtatgaaagattccaccaat

SEQ ID NO: 376260 - DNA, 20 bp, Artificial Sequence
  chemically synthesized
tttggattgaacaagtatga

SEQ ID NO: 376261 - DNA, 20 bp, Artificial Sequence
  chemically synthesized
atggataatttggattgaac

SEQ ID NO: 376262 - DNA, 20 bp, Artificial Sequence
  chemically synthesized
agaacaattaatggataatt

SEQ ID NO: 376263 - DNA, 20 bp, Artificial Sequence
  chemically synthesized
aaatcagacagaacaattaa

SEQ ID NO: 376264 - DNA, 20 bp, Artificial Sequence
  chemically synthesized
atgaaagctaataaatcaga

SEQ ID NO: 376265 - DNA, 20 bp, Artificial Sequence
  chemically synthesized
aattgttctgtctgatttat

SEQ ID NO: 376266 - DNA, 20 bp, Artificial Sequence
  chemically synthesized
tttgatgaaagctaataaat

SEQ ID NO: 376267 - DNA, 20 bp, Artificial Sequence
  chemically synthesized
aaatgatatttatttgatga

SEQ ID NO: 376268 - DNA, 20 bp, Artificial Sequence
  chemically synthesized
aaatatcattttctatgctt

SEQ ID NO: 376269 - DNA, 20 bp, Artificial Sequence
  chemically synthesized
gatttcaagttgctaaagca

SEQ ID NO: 376270 - DNA, 20 bp, Artificial Sequence
  chemically synthesized
caaatgatttcaagttgcta

SEQ ID NO: 376271 - DNA, 20 bp, Artificial Sequence
  chemically synthesized
aacagttggcaaatgatttc

SEQ ID NO: 376272 - DNA, 20 bp, Artificial Sequence
  chemically synthesized
ttgtattatataacaacagt

SEQ ID NO: 376273 - DNA, 20 bp, Artificial Sequence
  chemically synthesized
cgacttgtattatataacaa

SEQ ID NO: 376274 - DNA, 20 bp, Artificial Sequence
  chemically synthesized
caactgttgttatataatac

SEQ ID NO: 376275 - DNA, 20 bp, Artificial Sequence
  chemically synthesized
ttatataatacaagtcgaaa
